United States Patent 6,821,724 (METHODS OF GENETIC ANALYSIS USING NUCLEIC ACID ARRAYS) - sequence listing, part 2

SEQ ID NO: 24998 - DNA, 25 bp, Mus musculus
cagcacctttctgccggagcagagc

SEQ ID NO: 24999 - DNA, 25 bp, Mus musculus
tggcaccagccggacactgtcgtca

SEQ ID NO: 25000 - DNA, 25 bp, Mus musculus
caccgtggccatcgtctttctcaac

SEQ ID NO: 25001 - DNA, 25 bp, Mus musculus
ctacaaccacatgcttcgcaagaag

SEQ ID NO: 25002 - DNA, 25 bp, Mus musculus
gtgtgccatgctaccacgctatcta

SEQ ID NO: 25003 - DNA, 25 bp, Mus musculus
tgccatgctaccacgctatctaaga

SEQ ID NO: 25004 - DNA, 25 bp, Mus musculus
catgctaccacgctatctaagaacc

SEQ ID NO: 25005 - DNA, 25 bp, Mus musculus
cccttcctccctattaatgcatgat

SEQ ID NO: 25006 - DNA, 25 bp, Mus musculus
ctccctattaatgcatgataatgaa

SEQ ID NO: 25007 - DNA, 25 bp, Mus musculus
agaatttcatctctaaatgagttaa

SEQ ID NO: 25008 - DNA, 25 bp, Mus musculus
atttcatctctaaatgagttaaaga

SEQ ID NO: 25009 - DNA, 25 bp, Mus musculus
tgttattctaaactcttatcaagta

SEQ ID NO: 25010 - DNA, 25 bp, Mus musculus
tattctaaactcttatcaagtatca

SEQ ID NO: 25011 - DNA, 25 bp, Mus musculus
tctaaactcttatcaagtatcaaat

SEQ ID NO: 25012 - DNA, 25 bp, Mus musculus
ggttccttagagctctctacgcagt

SEQ ID NO: 25013 - DNA, 25 bp, Mus musculus
gagctctctacgcagtctgcgcttt

SEQ ID NO: 25014 - DNA, 25 bp, Mus musculus
ctctctacgcagtctgcgctttttg

SEQ ID NO: 25015 - DNA, 25 bp, Mus musculus
tttgctctattgtgtggaatcgagt

SEQ ID NO: 25016 - DNA, 25 bp, Mus musculus
tgaacgctatgcttacatatattgt

SEQ ID NO: 25017 - DNA, 25 bp, Mus musculus
atattgtcttgtgttgctgtgtgcc

SEQ ID NO: 25018 - DNA, 25 bp, Mus musculus
tcttgtgttgctgtgtgccatgcta

SEQ ID NO: 25019 - DNA, 25 bp, Mus musculus
gttgctgtgtgccatgctaccacgc

SEQ ID NO: 25020 - DNA, 25 bp, Mus musculus
aacacatcagtgagctatcttctac

SEQ ID NO: 25021 - DNA, 25 bp, Mus musculus
atgatgtattctcgctttaacactt

SEQ ID NO: 25022 - DNA, 25 bp, Mus musculus
ttgaagccagccatctttctgaaaa

SEQ ID NO: 25023 - DNA, 25 bp, Mus musculus
ccagccatctttctgaaaatactag

SEQ ID NO: 25024 - DNA, 25 bp, Mus musculus
ggcacatcagaagactcccagatct

SEQ ID NO: 25025 - DNA, 25 bp, Mus musculus
tcagaagactcccagatctttaatg

SEQ ID NO: 25026 - DNA, 25 bp, Mus musculus
gactcccagatctttaatgcagaaa

SEQ ID NO: 25027 - DNA, 25 bp, Mus musculus
taatatttgtcccataaacatgtaa

SEQ ID NO: 25028 - DNA, 25 bp, Mus musculus
tatttgtcccataaacatgtaactc

SEQ ID NO: 25029 - DNA, 25 bp, Mus musculus
ttgtcccataaacatgtaactctac

SEQ ID NO: 25030 - DNA, 25 bp, Mus musculus
tcccataaacatgtaactctactaa

SEQ ID NO: 25031 - DNA, 25 bp, Mus musculus
cataaacatgtaactctactaacaa

SEQ ID NO: 25032 - DNA, 25 bp, Mus musculus
tattctcgctttaacacttacaatc

SEQ ID NO: 25033 - DNA, 25 bp, Mus musculus
cgctttaacacttacaatcaagctc

SEQ ID NO: 25034 - DNA, 25 bp, Mus musculus
agagacttcctcattcgtttccagt

SEQ ID NO: 25035 - DNA, 25 bp, Mus musculus
acctgcccagccaagagggctaatt

SEQ ID NO: 25036 - DNA, 25 bp, Mus musculus
gctaattgcacaacctctccatcga

SEQ ID NO: 25037 - DNA, 25 bp, Mus musculus
ccatcgaacctgcctcttgagcgtt

SEQ ID NO: 25038 - DNA, 25 bp, Mus musculus
gtgctttgtgggtttgggctatatt

SEQ ID NO: 25039 - DNA, 25 bp, Mus musculus
gtttcattgaagccagccatctttc

SEQ ID NO: 25040 - DNA, 25 bp, Mus musculus
agagtaccaagacttggcgtcagcc

SEQ ID NO: 25041 - DNA, 25 bp, Mus musculus
cttggcgtcagccctaggactagtg

SEQ ID NO: 25042 - DNA, 25 bp, Mus musculus
cacgtctctggacaagccctcagtg

SEQ ID NO: 25043 - DNA, 25 bp, Mus musculus
tctggacaagccctcagtggtgtcc

SEQ ID NO: 25044 - DNA, 25 bp, Mus musculus
caagccctcagtggtgtccttgcag

SEQ ID NO: 25045 - DNA, 25 bp, Mus musculus
ggtgtccttgcagaacctcatcgta

SEQ ID NO: 25046 - DNA, 25 bp, Mus musculus
catagccaaccaggcgaaagggatg

SEQ ID NO: 25047 - DNA, 25 bp, Mus musculus
ttctggaccgcctgagatgtatgag

SEQ ID NO: 25048 - DNA, 25 bp, Mus musculus
accgcctgagatgtatgaggtgcat

SEQ ID NO: 25049 - DNA, 25 bp, Mus musculus
tacctggatccgtgtcatccagcag

SEQ ID NO: 25050 - DNA, 25 bp, Mus musculus
gatccgtgtcatccagcagagtgtg

SEQ ID NO: 25051 - DNA, 25 bp, Mus musculus
tgtcatccagcagagtgtgcgcctg

SEQ ID NO: 25052 - DNA, 25 bp, Mus musculus
gtcagccctaggactagtgaaggag

SEQ ID NO: 25053 - DNA, 25 bp, Mus musculus
tacatatggcttcaggtcctagtcg

SEQ ID NO: 25054 - DNA, 25 bp, Mus musculus
ccaggatgtgcacgagctggagaaa

SEQ ID NO: 25055 - DNA, 25 bp, Mus musculus
tgtgcacgagctggagaaagaggcc

SEQ ID NO: 25056 - DNA, 25 bp, Mus musculus
acttatccatgaaggctgcctgctc

SEQ ID NO: 25057 - DNA, 25 bp, Mus musculus
cacaggccgcttcaaagatgtcctg

SEQ ID NO: 25058 - DNA, 25 bp, Mus musculus
ccgcttcaaagatgtcctgttgctg

SEQ ID NO: 25059 - DNA, 25 bp, Mus musculus
tgtcctgttgctgctgatgacagat

SEQ ID NO: 25060 - DNA, 25 bp, Mus musculus
gttgctgctgatgacagatgtgctc

SEQ ID NO: 25061 - DNA, 25 bp, Mus musculus
accatgatggctgacccgcttcagg

SEQ ID NO: 25062 - DNA, 25 bp, Mus musculus
catgatggctgacccgcttcaggag

SEQ ID NO: 25063 - DNA, 25 bp, Mus musculus
atgctggcagcggtgatatccctat

SEQ ID NO: 25064 - DNA, 25 bp, Mus musculus
gcggtgatatccctatctaggatgt

SEQ ID NO: 25065 - DNA, 25 bp, Mus musculus
cggtgatatccctatctaggatgtc

SEQ ID NO: 25066 - DNA, 25 bp, Mus musculus
gtgatatccctatctaggatgtcga

SEQ ID NO: 25067 - DNA, 25 bp, Mus musculus
tgatatccctatctaggatgtcgaa

SEQ ID NO: 25068 - DNA, 25 bp, Mus musculus
atatccctatctaggatgtcgaagc

SEQ ID NO: 25069 - DNA, 25 bp, Mus musculus
tatccctatctaggatgtcgaagcc

SEQ ID NO: 25070 - DNA, 25 bp, Mus musculus
tccctatctaggatgtcgaagccgc

SEQ ID NO: 25071 - DNA, 25 bp, Mus musculus
ccctatctaggatgtcgaagccgct

SEQ ID NO: 25072 - DNA, 25 bp, Mus musculus
aggatgtcgaagccgctgggcttgt

SEQ ID NO: 25073 - DNA, 25 bp, Mus musculus
atgatggctgacccgcttcaggaga

SEQ ID NO: 25074 - DNA, 25 bp, Mus musculus
atgtcgaagccgctgggcttgtgac

SEQ ID NO: 25075 - DNA, 25 bp, Mus musculus
gctgacccgcttcaggagattgaca

SEQ ID NO: 25076 - DNA, 25 bp, Mus musculus
tgacccgcttcaggagattgacaca

SEQ ID NO: 25077 - DNA, 25 bp, Mus musculus
gacccgcttcaggagattgacacaa

SEQ ID NO: 25078 - DNA, 25 bp, Mus musculus
ctgatgatgctggcagcggtgatat

SEQ ID NO: 25079 - DNA, 25 bp, Mus musculus
tgatgatgctggcagcggtgatatc

SEQ ID NO: 25080 - DNA, 25 bp, Mus musculus
atgatgctggcagcggtgatatccc

SEQ ID NO: 25081 - DNA, 25 bp, Mus musculus
tgatgctggcagcggtgatatccct

SEQ ID NO: 25082 - DNA, 25 bp, Mus musculus
agaatgaccccatcaggcttccaac

SEQ ID NO: 25083 - DNA, 25 bp, Mus musculus
cctgtggacagtctgagcagctcca

SEQ ID NO: 25084 - DNA, 25 bp, Mus musculus
gaactgccctacatatcttaaattg

SEQ ID NO: 25085 - DNA, 25 bp, Mus musculus
ccctacatatcttaaattggattgt

SEQ ID NO: 25086 - DNA, 25 bp, Mus musculus
tcatcaggacaactactgttttcta

SEQ ID NO: 25087 - DNA, 25 bp, Mus musculus
atattacacgaggctcggagtttgt

SEQ ID NO: 25088 - DNA, 25 bp, Mus musculus
aattacactgaccaagtcacaatgt

SEQ ID NO: 25089 - DNA, 25 bp, Mus musculus
actgaccaagtcacaatgtattccg

SEQ ID NO: 25090 - DNA, 25 bp, Mus musculus
acaatgtattccggttgcaggaact

SEQ ID NO: 25091 - DNA, 25 bp, Mus musculus
cccagtatgcccagtgtgatcttgg

SEQ ID NO: 25092 - DNA, 25 bp, Mus musculus
agtgtgatcttggagcgttgggtct

SEQ ID NO: 25093 - DNA, 25 bp, Mus musculus
atcttggagcgttgggtcttgacat

SEQ ID NO: 25094 - DNA, 25 bp, Mus musculus
agctccagcagctcctatgatggca

SEQ ID NO: 25095 - DNA, 25 bp, Mus musculus
agcagctcctatgatggcagtgacc

SEQ ID NO: 25096 - DNA, 25 bp, Mus musculus
tcctatgatggcagtgaccgggagg

SEQ ID NO: 25097 - DNA, 25 bp, Mus musculus
gatccacggggtgacttccattctc

SEQ ID NO: 25098 - DNA, 25 bp, Mus musculus
ccaattgtgcttggccgacctgcta

SEQ ID NO: 25099 - DNA, 25 bp, Mus musculus
agcccttctgtaaaacgcatgagga

SEQ ID NO: 25100 - DNA, 25 bp, Mus musculus
taaggcttcctggtacatgtttgtt

SEQ ID NO: 25101 - DNA, 25 bp, Mus musculus
tgttactgcagtgaactgccctaca

SEQ ID NO: 25102 - DNA, 25 bp, Mus musculus
tcctgccacgacattcaggtcgcag

SEQ ID NO: 25103 - DNA, 25 bp, Mus musculus
ctgccacgacattcaggtcgcagac

SEQ ID NO: 25104 - DNA, 25 bp, Mus musculus
caggtcgcagacagcatggggtctc

SEQ ID NO: 25105 - DNA, 25 bp, Mus musculus
gcagacagcatggggtctcggttct

SEQ ID NO: 25106 - DNA, 25 bp, Mus musculus
agacagcatggggtctcggttcttc

SEQ ID NO: 25107 - DNA, 25 bp, Mus musculus
gcaaggctcccgctgaagttacttg

SEQ ID NO: 25108 - DNA, 25 bp, Mus musculus
caaggctcccgctgaagttacttga

SEQ ID NO: 25109 - DNA, 25 bp, Mus musculus
ctcccgctgaagttacttgacctct

SEQ ID NO: 25110 - DNA, 25 bp, Mus musculus
agttgccaaagacctggtacagaag

SEQ ID NO: 25111 - DNA, 25 bp, Mus musculus
aagctcggcggccatggacaatgac

SEQ ID NO: 25112 - DNA, 25 bp, Mus musculus
agctcggcggccatggacaatgacc

SEQ ID NO: 25113 - DNA, 25 bp, Mus musculus
ctcggcggccatggacaatgaccca

SEQ ID NO: 25114 - DNA, 25 bp, Mus musculus
tgccacgacattcaggtcgcagaca

SEQ ID NO: 25115 - DNA, 25 bp, Mus musculus
ccacgacattcaggtcgcagacagc

SEQ ID NO: 25116 - DNA, 25 bp, Mus musculus
cacgacattcaggtcgcagacagca

SEQ ID NO: 25117 - DNA, 25 bp, Mus musculus
cgacattcaggtcgcagacagcatg

SEQ ID NO: 25118 - DNA, 25 bp, Mus musculus
gacattcaggtcgcagacagcatgg

SEQ ID NO: 25119 - DNA, 25 bp, Mus musculus
cattcaggtcgcagacagcatgggg

SEQ ID NO: 25120 - DNA, 25 bp, Mus musculus
attcaggtcgcagacagcatggggt

SEQ ID NO: 25121 - DNA, 25 bp, Mus musculus
tcaggtcgcagacagcatggggtct

SEQ ID NO: 25122 - DNA, 25 bp, Mus musculus
gctaagtctgaccctatggtgcagt

SEQ ID NO: 25123 - DNA, 25 bp, Mus musculus
aagtctgaccctatggtgcagtgca

SEQ ID NO: 25124 - DNA, 25 bp, Mus musculus
gagatctgccttaaggacctggagg

SEQ ID NO: 25125 - DNA, 25 bp, Mus musculus
gaccatgcctgcatccccatcaaga

SEQ ID NO: 25126 - DNA, 25 bp, Mus musculus
tgcatccccatcaagaaatctgacc

SEQ ID NO: 25127 - DNA, 25 bp, Mus musculus
atccccatcaagaaatctgaccctg

SEQ ID NO: 25128 - DNA, 25 bp, Mus musculus
cccatcaagaaatctgaccctgttg

SEQ ID NO: 25129 - DNA, 25 bp, Mus musculus
atcaagaaatctgaccctgttgtgt

SEQ ID NO: 25130 - DNA, 25 bp, Mus musculus
aaatctgaccctgttgtgtcatatc

SEQ ID NO: 25131 - DNA, 25 bp, Mus musculus
tctgaccctgttgtgtcatatcggg

SEQ ID NO: 25132 - DNA, 25 bp, Mus musculus
gaccctgttgtgtcatatcgggaga

SEQ ID NO: 25133 - DNA, 25 bp, Mus musculus
accctgttgtgtcatatcgggagac

SEQ ID NO: 25134 - DNA, 25 bp, Mus musculus
tctgaccctatggtgcagtgcatca

SEQ ID NO: 25135 - DNA, 25 bp, Mus musculus
gaggaatccaacgtgctgtgtctgt

SEQ ID NO: 25136 - DNA, 25 bp, Mus musculus
gaccctatggtgcagtgcatcattg

SEQ ID NO: 25137 - DNA, 25 bp, Mus musculus
tgcatcattgaggagtctggagaac

SEQ ID NO: 25138 - DNA, 25 bp, Mus musculus
catattattgctggcgccggtgagc

SEQ ID NO: 25139 - DNA, 25 bp, Mus musculus
attattgctggcgccggtgagctgc

SEQ ID NO: 25140 - DNA, 25 bp, Mus musculus
ctgcacctggagatctgccttaagg

SEQ ID NO: 25141 - DNA, 25 bp, Mus musculus
cacctggagatctgccttaaggacc

SEQ ID NO: 25142 - DNA, 25 bp, Mus musculus
ctggagatctgccttaaggacctgg

SEQ ID NO: 25143 - DNA, 25 bp, Mus musculus
tgccccaaagcctcacagaactgtg

SEQ ID NO: 25144 - DNA, 25 bp, Mus musculus
cccaaagcctcacagaactgtgcac

SEQ ID NO: 25145 - DNA, 25 bp, Mus musculus
cacatgacaacacagtttgtactga

SEQ ID NO: 25146 - DNA, 25 bp, Mus musculus
atgacaacacagtttgtactgaagg

SEQ ID NO: 25147 - DNA, 25 bp, Mus musculus
acaacacagtttgtactgaaggtat

SEQ ID NO: 25148 - DNA, 25 bp, Mus musculus
catctacactagacactgtgtcaaa

SEQ ID NO: 25149 - DNA, 25 bp, Mus musculus
ctacactagacactgtgtcaaagtc

SEQ ID NO: 25150 - DNA, 25 bp, Mus musculus
acactgtgtcaaagtctgagtgact

SEQ ID NO: 25151 - DNA, 25 bp, Mus musculus
agtctgagtgactgggtagttgaca

SEQ ID NO: 25152 - DNA, 25 bp, Mus musculus
gacatagagctgcttctgtgtaaat

SEQ ID NO: 25153 - DNA, 25 bp, Mus musculus
atagagctgcttctgtgtaaatgct

SEQ ID NO: 25154 - DNA, 25 bp, Mus musculus
tgtaaatgctgcttctgtgtaaatg

SEQ ID NO: 25155 - DNA, 25 bp, Mus musculus
cacaggctgactgtcgctaagttca

SEQ ID NO: 25156 - DNA, 25 bp, Mus musculus
aggctgactgtcgctaagttcatgg

SEQ ID NO: 25157 - DNA, 25 bp, Mus musculus
caaacctctctggctgcccaggtgg

SEQ ID NO: 25158 - DNA, 25 bp, Mus musculus
tattgctagcctgcctgctctaagg

SEQ ID NO: 25159 - DNA, 25 bp, Mus musculus
tgctagcctgcctgctctaagggtg

SEQ ID NO: 25160 - DNA, 25 bp, Mus musculus
cctgctacttggcacatgacaacac

SEQ ID NO: 25161 - DNA, 25 bp, Mus musculus
gctacttggcacatgacaacacagt

SEQ ID NO: 25162 - DNA, 25 bp, Mus musculus
acttggcacatgacaacacagtttg

SEQ ID NO: 25163 - DNA, 25 bp, Mus musculus
gccttctattcttaaagaggataat

SEQ ID NO: 25164 - DNA, 25 bp, Mus musculus
tttgaccaactggaccaggaaaatg

SEQ ID NO: 25165 - DNA, 25 bp, Mus musculus
aggattcccagtcagctgctgctga

SEQ ID NO: 25166 - DNA, 25 bp, Mus musculus
gattcccagtcagctgctgctgagg

SEQ ID NO: 25167 - DNA, 25 bp, Mus musculus
cagtcagctgctgctgaggaacctg

SEQ ID NO: 25168 - DNA, 25 bp, Mus musculus
agtcagctgctgctgaggaacctga

SEQ ID NO: 25169 - DNA, 25 bp, Mus musculus
cagctgctgctgaggaacctgagac

SEQ ID NO: 25170 - DNA, 25 bp, Mus musculus
ctgctgctgaggaacctgagacaga

SEQ ID NO: 25171 - DNA, 25 bp, Mus musculus
ctcccaagacagcctggacagagaa

SEQ ID NO: 25172 - DNA, 25 bp, Mus musculus
cccaagacagcctggacagagaatg

SEQ ID NO: 25173 - DNA, 25 bp, Mus musculus
ccaagacagcctggacagagaatgc

SEQ ID NO: 25174 - DNA, 25 bp, Mus musculus
aagacagcctggacagagaatgctc

SEQ ID NO: 25175 - DNA, 25 bp, Mus musculus
tgaccaactggaccaggaaaatgat

SEQ ID NO: 25176 - DNA, 25 bp, Mus musculus
ccaactggaccaggaaaatgatgat

SEQ ID NO: 25177 - DNA, 25 bp, Mus musculus
agctcaaattcagcgatgaggaaga

SEQ ID NO: 25178 - DNA, 25 bp, Mus musculus
ctcaaattcagcgatgaggaagatg

SEQ ID NO: 25179 - DNA, 25 bp, Mus musculus
ggccacaaggattcccagtcagctg

SEQ ID NO: 25180 - DNA, 25 bp, Mus musculus
gccacaaggattcccagtcagctgc

SEQ ID NO: 25181 - DNA, 25 bp, Mus musculus
acaaggattcccagtcagctgctgc

SEQ ID NO: 25182 - DNA, 25 bp, Mus musculus
aaggattcccagtcagctgctgctg

SEQ ID NO: 25183 - DNA, 25 bp, Mus musculus
ggacggacgatcacaccctcatcag

SEQ ID NO: 25184 - DNA, 25 bp, Mus musculus
ccctcatcagagtcgtggtgtcgag

SEQ ID NO: 25185 - DNA, 25 bp, Mus musculus
ccatatctctcagtccaatgtctga

SEQ ID NO: 25186 - DNA, 25 bp, Mus musculus
tatctctcagtccaatgtctgagtt

SEQ ID NO: 25187 - DNA, 25 bp, Mus musculus
gttaataaccctattatcttgattg

SEQ ID NO: 25188 - DNA, 25 bp, Mus musculus
aatgctgtcaatcaagcttactgct

SEQ ID NO: 25189 - DNA, 25 bp, Mus musculus
gctgtcaatcaagcttactgctcta

SEQ ID NO: 25190 - DNA, 25 bp, Mus musculus
gtcaatcaagcttactgctctagca

SEQ ID NO: 25191 - DNA, 25 bp, Mus musculus
tactgctctagcagacctgcaaaat

SEQ ID NO: 25192 - DNA, 25 bp, Mus musculus
tctagcagacctgcaaaattatgat

SEQ ID NO: 25193 - DNA, 25 bp, Mus musculus
tagtatccaaaacattggcgacaaa

SEQ ID NO: 25194 - DNA, 25 bp, Mus musculus
tatccaaaacattggcgacaaataa

SEQ ID NO: 25195 - DNA, 25 bp, Mus musculus
atgactgagagccgcctggagcgcc

SEQ ID NO: 25196 - DNA, 25 bp, Mus musculus
ccacacttgcttgcattctgtgcct

SEQ ID NO: 25197 - DNA, 25 bp, Mus musculus
gctgccttacactagtatgctaatg

SEQ ID NO: 25198 - DNA, 25 bp, Mus musculus
tatgctaatgaccaaaggtgtctta

SEQ ID NO: 25199 - DNA, 25 bp, Mus musculus
cttctgatgttctgtctacagtagg

SEQ ID NO: 25200 - DNA, 25 bp, Mus musculus
ctgatgttctgtctacagtaggtag

SEQ ID NO: 25201 - DNA, 25 bp, Mus musculus
gtagtgaccttcccatatctctcag

SEQ ID NO: 25202 - DNA, 25 bp, Mus musculus
accttcccatatctctcagtccaat

SEQ ID NO: 25203 - DNA, 25 bp, Mus musculus
agatatcctccatcgtggaagagct

SEQ ID NO: 25204 - DNA, 25 bp, Mus musculus
tatcctccatcgtggaagagctcag

SEQ ID NO: 25205 - DNA, 25 bp, Mus musculus
acagcctgatttggggcatggcagc

SEQ ID NO: 25206 - DNA, 25 bp, Mus musculus
tgatttggggcatggcagcagtagc

SEQ ID NO: 25207 - DNA, 25 bp, Mus musculus
tagcgctgagcacagctcagagtgg

SEQ ID NO: 25208 - DNA, 25 bp, Mus musculus
aaggcgctgcacacaactgcatcct

SEQ ID NO: 25209 - DNA, 25 bp, Mus musculus
ctgcacacaactgcatccttacgat

SEQ ID NO: 25210 - DNA, 25 bp, Mus musculus
cacacaactgcatccttacgatgtt

SEQ ID NO: 25211 - DNA, 25 bp, Mus musculus
acaactgcatccttacgatgttctc

SEQ ID NO: 25212 - DNA, 25 bp, Mus musculus
actgcatccttacgatgttctctaa

SEQ ID NO: 25213 - DNA, 25 bp, Mus musculus
gcatccttacgatgttctctaaaaa

SEQ ID NO: 25214 - DNA, 25 bp, Mus musculus
tccttacgatgttctctaaaaacat

SEQ ID NO: 25215 - DNA, 25 bp, Mus musculus
cctccatcgtggaagagctcagacc

SEQ ID NO: 25216 - DNA, 25 bp, Mus musculus
tggaagagctcagaccccgagaagc

SEQ ID NO: 25217 - DNA, 25 bp, Mus musculus
aagctggtgtctagctgcggcccag

SEQ ID NO: 25218 - DNA, 25 bp, Mus musculus
tctagctgcggcccagagcaaggat

SEQ ID NO: 25219 - DNA, 25 bp, Mus musculus
tattcaggagacctttctgccatct

SEQ ID NO: 25220 - DNA, 25 bp, Mus musculus
tctccacctacagcctgatttgggg

SEQ ID NO: 25221 - DNA, 25 bp, Mus musculus
ccacctacagcctgatttggggcat

SEQ ID NO: 25222 - DNA, 25 bp, Mus musculus
cctacagcctgatttggggcatggc

SEQ ID NO: 25223 - DNA, 25 bp, Mus musculus
aagttaacactcaagccaagacagc

SEQ ID NO: 25224 - DNA, 25 bp, Mus musculus
acactcaagccaagacagctatccc

SEQ ID NO: 25225 - DNA, 25 bp, Mus musculus
atctccacacttagcaagcaagcaa

SEQ ID NO: 25226 - DNA, 25 bp, Mus musculus
acacttagcaagcaagcaagagatg

SEQ ID NO: 25227 - DNA, 25 bp, Mus musculus
gacagtctctctaaatgctcccaca

SEQ ID NO: 25228 - DNA, 25 bp, Mus musculus
ctctctaaatgctcccacagagcac

SEQ ID NO: 25229 - DNA, 25 bp, Mus musculus
ctgaggtccaggccacaccatgacg

SEQ ID NO: 25230 - DNA, 25 bp, Mus musculus
tagttgggtctctatgatgggaata

SEQ ID NO: 25231 - DNA, 25 bp, Mus musculus
gtgaccctgctggctgacagaggcc

SEQ ID NO: 25232 - DNA, 25 bp, Mus musculus
cagcaagctacttctttgttctctg

SEQ ID NO: 25233 - DNA, 25 bp, Mus musculus
cagccactgatacctttcctcatgt

SEQ ID NO: 25234 - DNA, 25 bp, Mus musculus
ctgatacctttcctcatgttctgct

SEQ ID NO: 25235 - DNA, 25 bp, Mus musculus
agacagctatccccaaaacgacagc

SEQ ID NO: 25236 - DNA, 25 bp, Mus musculus
gggccagtgaacaccctggttgagt

SEQ ID NO: 25237 - DNA, 25 bp, Mus musculus
gtgaacaccctggttgagtagtctt

SEQ ID NO: 25238 - DNA, 25 bp, Mus musculus
tagtcttcggaggcctctgaatgaa

SEQ ID NO: 25239 - DNA, 25 bp, Mus musculus
gcctctgaatgaacctgcttctagc

SEQ ID NO: 25240 - DNA, 25 bp, Mus musculus
gaatgaacctgcttctagcttagag

SEQ ID NO: 25241 - DNA, 25 bp, Mus musculus
gagatgtcccggagattcaagacag

SEQ ID NO: 25242 - DNA, 25 bp, Mus musculus
aagacagagcttatctccacactta

SEQ ID NO: 25243 - DNA, 25 bp, Mus musculus
gaggacttccatgcacgacgggagg

SEQ ID NO: 25244 - DNA, 25 bp, Mus musculus
gagggcatccgccaacaaatccgct

SEQ ID NO: 25245 - DNA, 25 bp, Mus musculus
accgttgatctgactctgcagcctg

SEQ ID NO: 25246 - DNA, 25 bp, Mus musculus
gttgatctgactctgcagcctgccc

SEQ ID NO: 25247 - DNA, 25 bp, Mus musculus
gagcttgctccaccaaaaagagagg

SEQ ID NO: 25248 - DNA, 25 bp, Mus musculus
cttgctccaccaaaaagagagggtg

SEQ ID NO: 25249 - DNA, 25 bp, Mus musculus
gctccaccaaaaagagagggtgcca

SEQ ID NO: 25250 - DNA, 25 bp, Mus musculus
ggtgccatctccgacaataccaaag

SEQ ID NO: 25251 - DNA, 25 bp, Mus musculus
atctccgacaataccaaagcagccc

SEQ ID NO: 25252 - DNA, 25 bp, Mus musculus
tccgacaataccaaagcagccctca

SEQ ID NO: 25253 - DNA, 25 bp, Mus musculus
gacaataccaaagcagccctcaaag

SEQ ID NO: 25254 - DNA, 25 bp, Mus musculus
aataccaaagcagccctcaaagctg

SEQ ID NO: 25255 - DNA, 25 bp, Mus musculus
ttccagccttctctgcagcctgtgg

SEQ ID NO: 25256 - DNA, 25 bp, Mus musculus
gagcctgtgtgtccagatgttgaga

SEQ ID NO: 25257 - DNA, 25 bp, Mus musculus
gcactgccaccatgctctgatcctg

SEQ ID NO: 25258 - DNA, 25 bp, Mus musculus
tgctctgatcctgcacctgacaccg

SEQ ID NO: 25259 - DNA, 25 bp, Mus musculus
tctgatcctgcacctgacaccgttg

SEQ ID NO: 25260 - DNA, 25 bp, Mus musculus
cctgcacctgacaccgttgatctga

SEQ ID NO: 25261 - DNA, 25 bp, Mus musculus
cctgacaccgttgatctgactctgc

SEQ ID NO: 25262 - DNA, 25 bp, Mus musculus
gacaccgttgatctgactctgcagc

SEQ ID NO: 25263 - DNA, 25 bp, Mus musculus
acatgaactacagctgtgctgtgaa

SEQ ID NO: 25264 - DNA, 25 bp, Mus musculus
actacagctgtgctgtgaagagaat

SEQ ID NO: 25265 - DNA, 25 bp, Mus musculus
ccccagaaatgcagcgctcatacag

SEQ ID NO: 25266 - DNA, 25 bp, Mus musculus
agcgctcatacagctgagagaaggc

SEQ ID NO: 25267 - DNA, 25 bp, Mus musculus
tactttttatactacactgatgctg

SEQ ID NO: 25268 - DNA, 25 bp, Mus musculus
actgatgctgcttgatagaagtctg

SEQ ID NO: 25269 - DNA, 25 bp, Mus musculus
tctgtgggctttgtcagatatgtca

SEQ ID NO: 25270 - DNA, 25 bp, Mus musculus
gtcagatatgtcacccaagtaaatg

SEQ ID NO: 25271 - DNA, 25 bp, Mus musculus
tatgtcacccaagtaaatgctttgt

SEQ ID NO: 25272 - DNA, 25 bp, Mus musculus
aaagctcacttgagaaacactgcag

SEQ ID NO: 25273 - DNA, 25 bp, Mus musculus
tttattacatttgcaacataaaagt

SEQ ID NO: 25274 - DNA, 25 bp, Mus musculus
attacatttgcaacataaaagtact

SEQ ID NO: 25275 - DNA, 25 bp, Mus musculus
gcattaatccacatttcccttcttc

SEQ ID NO: 25276 - DNA, 25 bp, Mus musculus
ttaatccacatttcccttcttcaga

SEQ ID NO: 25277 - DNA, 25 bp, Mus musculus
atccacatttcccttcttcagaggt

SEQ ID NO: 25278 - DNA, 25 bp, Mus musculus
atttcccttcttcagaggtgtagtg

SEQ ID NO: 25279 - DNA, 25 bp, Mus musculus
tgtatttaggtcagtccccagaaat

SEQ ID NO: 25280 - DNA, 25 bp, Mus musculus
atttaggtcagtccccagaaatgca

SEQ ID NO: 25281 - DNA, 25 bp, Mus musculus
taggtcagtccccagaaatgcagcg

SEQ ID NO: 25282 - DNA, 25 bp, Mus musculus
agtccccagaaatgcagcgctcata

SEQ ID NO: 25283 - DNA, 25 bp, Mus musculus
tgctcatgtcaacagactgtcggac

SEQ ID NO: 25284 - DNA, 25 bp, Mus musculus
gctcatgtcaacagactgtcggaca

SEQ ID NO: 25285 - DNA, 25 bp, Mus musculus
ttcaggcacacgcacagtcatattg

SEQ ID NO: 25286 - DNA, 25 bp, Mus musculus
aggcacacgcacagtcatattgtcc

SEQ ID NO: 25287 - DNA, 25 bp, Mus musculus
ggcacacgcacagtcatattgtcca

SEQ ID NO: 25288 - DNA, 25 bp, Mus musculus
cacacgcacagtcatattgtccata

SEQ ID NO: 25289 - DNA, 25 bp, Mus musculus
acacgcacagtcatattgtccatag

SEQ ID NO: 25290 - DNA, 25 bp, Mus musculus
cacgcacagtcatattgtccatagc

SEQ ID NO: 25291 - DNA, 25 bp, Mus musculus
cgcacagtcatattgtccatagcct

SEQ ID NO: 25292 - DNA, 25 bp, Mus musculus
taacttctcatagatgtgatcctca

SEQ ID NO: 25293 - DNA, 25 bp, Mus musculus
aacttctcatagatgtgatcctcaa

SEQ ID NO: 25294 - DNA, 25 bp, Mus musculus
acttctcatagatgtgatcctcaaa

SEQ ID NO: 25295 - DNA, 25 bp, Mus musculus
tcatgtcaacagactgtcggacatc

SEQ ID NO: 25296 - DNA, 25 bp, Mus musculus
atgtcaacagactgtcggacatccg

SEQ ID NO: 25297 - DNA, 25 bp, Mus musculus
gtcaacagactgtcggacatccgcc

SEQ ID NO: 25298 - DNA, 25 bp, Mus musculus
tcaacagactgtcggacatccgcca

SEQ ID NO: 25299 - DNA, 25 bp, Mus musculus
caacagactgtcggacatccgccac

SEQ ID NO: 25300 - DNA, 25 bp, Mus musculus
cactgcttcaggcacacgcacagtc

SEQ ID NO: 25301 - DNA, 25 bp, Mus musculus
ctgcttcaggcacacgcacagtcat

SEQ ID NO: 25302 - DNA, 25 bp, Mus musculus
cttcaggcacacgcacagtcatatt

SEQ ID NO: 25303 - DNA, 25 bp, Mus musculus
cttattacccgggcagtgccgccat

SEQ ID NO: 25304 - DNA, 25 bp, Mus musculus
tattacccgggcagtgccgccatgc

SEQ ID NO: 25305 - DNA, 25 bp, Mus musculus
atgtttgccgcctggcgtgacgccc

SEQ ID NO: 25306 - DNA, 25 bp, Mus musculus
tgtttgccgcctggcgtgacgccct

SEQ ID NO: 25307 - DNA, 25 bp, Mus musculus
gacgccctctagcctcgctgtagag

SEQ ID NO: 25308 - DNA, 25 bp, Mus musculus
acgccctctagcctcgctgtagaga

SEQ ID NO: 25309 - DNA, 25 bp, Mus musculus
gccctctagcctcgctgtagagact

SEQ ID NO: 25310 - DNA, 25 bp, Mus musculus
tatttttctgatggctaagcctgtt

SEQ ID NO: 25311 - DNA, 25 bp, Mus musculus
atttttctgatggctaagcctgttg

SEQ ID NO: 25312 - DNA, 25 bp, Mus musculus
tttttctgatggctaagcctgttgc

SEQ ID NO: 25313 - DNA, 25 bp, Mus musculus
ttttctgatggctaagcctgttgca

SEQ ID NO: 25314 - DNA, 25 bp, Mus musculus
tttctgatggctaagcctgttgcag

SEQ ID NO: 25315 - DNA, 25 bp, Mus musculus
attacccgggcagtgccgccatgca

SEQ ID NO: 25316 - DNA, 25 bp, Mus musculus
ttctgatggctaagcctgttgcaga

SEQ ID NO: 25317 - DNA, 25 bp, Mus musculus
ttacccgggcagtgccgccatgcat

SEQ ID NO: 25318 - DNA, 25 bp, Mus musculus
tacccgggcagtgccgccatgcatc

SEQ ID NO: 25319 - DNA, 25 bp, Mus musculus
gcagtgccgccatgcatccttgatg

SEQ ID NO: 25320 - DNA, 25 bp, Mus musculus
cttgatgtttgccgcctggcgtgac

SEQ ID NO: 25321 - DNA, 25 bp, Mus musculus
ttgatgtttgccgcctggcgtgacg

SEQ ID NO: 25322 - DNA, 25 bp, Mus musculus
tgatgtttgccgcctggcgtgacgc

SEQ ID NO: 25323 - DNA, 25 bp, Mus musculus
gatgtttgccgcctggcgtgacgcc

SEQ ID NO: 25324 - DNA, 25 bp, Mus musculus
gaactatagccatctaccgaaagca

SEQ ID NO: 25325 - DNA, 25 bp, Mus musculus
agatatttttgctcttgctctcaca

SEQ ID NO: 25326 - DNA, 25 bp, Mus musculus
gttgttgtctgcatctagaaagagc

SEQ ID NO: 25327 - DNA, 25 bp, Mus musculus
agaactcaagaaagcccaaatggca

SEQ ID NO: 25328 - DNA, 25 bp, Mus musculus
agcccaaatggcagccaaagttgca

SEQ ID NO: 25329 - DNA, 25 bp, Mus musculus
agccaaagttgcagctgaggaacgg

SEQ ID NO: 25330 - DNA, 25 bp, Mus musculus
agttgcagctgaggaacgggcactc

SEQ ID NO: 25331 - DNA, 25 bp, Mus musculus
cttcacagatcggatggccactaga

SEQ ID NO: 25332 - DNA, 25 bp, Mus musculus
agatcggatggccactagatccacc

SEQ ID NO: 25333 - DNA, 25 bp, Mus musculus
tagaacttctcgacttattggaaag

SEQ ID NO: 25334 - DNA, 25 bp, Mus musculus
gaaccgctctgtcagccttactata

SEQ ID NO: 25335 - DNA, 25 bp, Mus musculus
tactatatactgaacgctcacattc

SEQ ID NO: 25336 - DNA, 25 bp, Mus musculus
tctcacagtcgtatgtgctgctggt

SEQ ID NO: 25337 - DNA, 25 bp, Mus musculus
atgtgctgctggtgctgaacccctt

SEQ ID NO: 25338 - DNA, 25 bp, Mus musculus
gttacctcggatcccacaagtgctt

SEQ ID NO: 25339 - DNA, 25 bp, Mus musculus
cccacaagtgctttcccaggaggtg

SEQ ID NO: 25340 - DNA, 25 bp, Mus musculus
catgattcatcctgacccagagaga

SEQ ID NO: 25341 - DNA, 25 bp, Mus musculus
tcatcctgacccagagagaaggcct

SEQ ID NO: 25342 - DNA, 25 bp, Mus musculus
ttcagcaatggagctggtgaagcat

SEQ ID NO: 25343 - DNA, 25 bp, Mus musculus
ttcagtgttgttgtctgcatctaga

SEQ ID NO: 25344 - DNA, 25 bp, Mus musculus
tctgacgtcgggaggccagagatca

SEQ ID NO: 25345 - DNA, 25 bp, Mus musculus
tgacgtcgggaggccagagatcaga

SEQ ID NO: 25346 - DNA, 25 bp, Mus musculus
gaccctggttcctctgcatgaggat

SEQ ID NO: 25347 - DNA, 25 bp, Mus musculus
accctggttcctctgcatgaggatg

SEQ ID NO: 25348 - DNA, 25 bp, Mus musculus
ccctggttcctctgcatgaggatga

SEQ ID NO: 25349 - DNA, 25 bp, Mus musculus
cctggttcctctgcatgaggatgaa

SEQ ID NO: 25350 - DNA, 25 bp, Mus musculus
tggttcctctgcatgaggatgaaga

SEQ ID NO: 25351 - DNA, 25 bp, Mus musculus
ggttcctctgcatgaggatgaagaa

SEQ ID NO: 25352 - DNA, 25 bp, Mus musculus
gttcctctgcatgaggatgaagaaa

SEQ ID NO: 25353 - DNA, 25 bp, Mus musculus
ttcctctgcatgaggatgaagaaat

SEQ ID NO: 25354 - DNA, 25 bp, Mus musculus
tcctctgcatgaggatgaagaaatg

SEQ ID NO: 25355 - DNA, 25 bp, Mus musculus
aaatgaaccggatgcacgaaagcat

SEQ ID NO: 25356 - DNA, 25 bp, Mus musculus
ttcactgctttgaaggcgtgactgc

SEQ ID NO: 25357 - DNA, 25 bp, Mus musculus
tcactgctttgaaggcgtgactgcc

SEQ ID NO: 25358 - DNA, 25 bp, Mus musculus
tgactatgaccctggttcctctgca

SEQ ID NO: 25359 - DNA, 25 bp, Mus musculus
gactatgaccctggttcctctgcat

SEQ ID NO: 25360 - DNA, 25 bp, Mus musculus
actatgaccctggttcctctgcatg

SEQ ID NO: 25361 - DNA, 25 bp, Mus musculus
tatgaccctggttcctctgcatgag

SEQ ID NO: 25362 - DNA, 25 bp, Mus musculus
atgaccctggttcctctgcatgagg

SEQ ID NO: 25363 - DNA, 25 bp, Mus musculus
tgaccctggttcctctgcatgagga

SEQ ID NO: 25364 - DNA, 25 bp, Mus musculus
ctgcctgcatacactactctacact

SEQ ID NO: 25365 - DNA, 25 bp, Mus musculus
gcctgcatacactactctacactgt

SEQ ID NO: 25366 - DNA, 25 bp, Mus musculus
acactgtgcactcaggcacgcgcga

SEQ ID NO: 25367 - DNA, 25 bp, Mus musculus
tgtgcactcaggcacgcgcgaccta

SEQ ID NO: 25368 - DNA, 25 bp, Mus musculus
cacgcgcgacctacaccaacgatga

SEQ ID NO: 25369 - DNA, 25 bp, Mus musculus
tgacctcaaggtgcactcgcttgct

SEQ ID NO: 25370 - DNA, 25 bp, Mus musculus
aggtgcactcgcttgctgagctcca

SEQ ID NO: 25371 - DNA, 25 bp, Mus musculus
gtgcactcgcttgctgagctccacc

SEQ ID NO: 25372 - DNA, 25 bp, Mus musculus
gcactcgcttgctgagctccaccat

SEQ ID NO: 25373 - DNA, 25 bp, Mus musculus
actcgcttgctgagctccaccatca

SEQ ID NO: 25374 - DNA, 25 bp, Mus musculus
tcgcttgctgagctccaccatcact

SEQ ID NO: 25375 - DNA, 25 bp, Mus musculus
gcttgctgagctccaccatcactgg

SEQ ID NO: 25376 - DNA, 25 bp, Mus musculus
ctgcatacactactctacactgtgc

SEQ ID NO: 25377 - DNA, 25 bp, Mus musculus
ggttcatgacacagaacacgccgac

SEQ ID NO: 25378 - DNA, 25 bp, Mus musculus
gcatacactactctacactgtgcac

SEQ ID NO: 25379 - DNA, 25 bp, Mus musculus
atacactactctacactgtgcactc

SEQ ID NO: 25380 - DNA, 25 bp, Mus musculus
acactactctacactgtgcactcag

SEQ ID NO: 25381 - DNA, 25 bp, Mus musculus
actactctacactgtgcactcaggc

SEQ ID NO: 25382 - DNA, 25 bp, Mus musculus
tactctacactgtgcactcaggcac

SEQ ID NO: 25383 - DNA, 25 bp, Mus musculus
ctctacactgtgcactcaggcacgc

SEQ ID NO: 25384 - DNA, 25 bp, Mus musculus
ctacactgtgcactcaggcacgcgc

SEQ ID NO: 25385 - DNA, 25 bp, Mus musculus
gcacggctggaggttttggctcgcc

SEQ ID NO: 25386 - DNA, 25 bp, Mus musculus
gaggttttggctcgcccatggatat

SEQ ID NO: 25387 - DNA, 25 bp, Mus musculus
atctttgatatgttctttggaggag

SEQ ID NO: 25388 - DNA, 25 bp, Mus musculus
gctctcagtgaccttagaagactta

SEQ ID NO: 25389 - DNA, 25 bp, Mus musculus
ctctcagtgaccttagaagacttat

SEQ ID NO: 25390 - DNA, 25 bp, Mus musculus
cttatatactggtgcaacaaggaaa

SEQ ID NO: 25391 - DNA, 25 bp, Mus musculus
ttatatactggtgcaacaaggaaac

SEQ ID NO: 25392 - DNA, 25 bp, Mus musculus
tatatactggtgcaacaaggaaact

SEQ ID NO: 25393 - DNA, 25 bp, Mus musculus
atatactggtgcaacaaggaaactg

SEQ ID NO: 25394 - DNA, 25 bp, Mus musculus
aggttttggctcgcccatggatatc

SEQ ID NO: 25395 - DNA, 25 bp, Mus musculus
ggttttggctcgcccatggatatct

SEQ ID NO: 25396 - DNA, 25 bp, Mus musculus
gttttggctcgcccatggatatctt

SEQ ID NO: 25397 - DNA, 25 bp, Mus musculus
ttttggctcgcccatggatatcttt

SEQ ID NO: 25398 - DNA, 25 bp, Mus musculus
tttggctcgcccatggatatctttg

SEQ ID NO: 25399 - DNA, 25 bp, Mus musculus
ttggctcgcccatggatatctttga

SEQ ID NO: 25400 - DNA, 25 bp, Mus musculus
cgcccatggatatctttgatatgtt

SEQ ID NO: 25401 - DNA, 25 bp, Mus musculus
tatctttgatatgttctttggagga

SEQ ID NO: 25402 - DNA, 25 bp, Mus musculus
taggcgccacttgcgaatctttcta

SEQ ID NO: 25403 - DNA, 25 bp, Mus musculus
ccacttgcgaatctttctacttcag

SEQ ID NO: 25404 - DNA, 25 bp, Mus musculus
attactgaagctccagcagcaagtg

SEQ ID NO: 25405 - DNA, 25 bp, Mus musculus
gaagctccagcagcaagtgccttac

SEQ ID NO: 25406 - DNA, 25 bp, Mus musculus
gctccagcagcaagtgccttacaat

SEQ ID NO: 25407 - DNA, 25 bp, Mus musculus
ccagcagcaagtgccttacaattaa

SEQ ID NO: 25408 - DNA, 25 bp, Mus musculus
ttaattaacttctgtgtgaagcgaa

SEQ ID NO: 25409 - DNA, 25 bp, Mus musculus
attaacttctgtgtgaagcgaaaga

SEQ ID NO: 25410 - DNA, 25 bp, Mus musculus
aacccctgtttgaatacagctgact

SEQ ID NO: 25411 - DNA, 25 bp, Mus musculus
aatacagctgactacaaccgagtat

SEQ ID NO: 25412 - DNA, 25 bp, Mus musculus
acagctgactacaaccgagtatcgc

SEQ ID NO: 25413 - DNA, 25 bp, Mus musculus
gctgactacaaccgagtatcgcata

SEQ ID NO: 25414 - DNA, 25 bp, Mus musculus
cttgcgaatctttctacttcagcgc

SEQ ID NO: 25415 - DNA, 25 bp, Mus musculus
ctacaaccgagtatcgcatagcttc

SEQ ID NO: 25416 - DNA, 25 bp, Mus musculus
gcgaatctttctacttcagcgcagc

SEQ ID NO: 25417 - DNA, 25 bp, Mus musculus
ctttctacttcagcgcagcagttat

SEQ ID NO: 25418 - DNA, 25 bp, Mus musculus
tctacttcagcgcagcagttatcgc

SEQ ID NO: 25419 - DNA, 25 bp, Mus musculus
acttcagcgcagcagttatcgcttc

SEQ ID NO: 25420 - DNA, 25 bp, Mus musculus
cagcagttatcgcttctgttttcca

SEQ ID NO: 25421 - DNA, 25 bp, Mus musculus
cagttatcgcttctgttttccactt

SEQ ID NO: 25422 - DNA, 25 bp, Mus musculus
ttaattactgaagctccagcagcaa

SEQ ID NO: 25423 - DNA, 25 bp, Mus musculus
gccttcttcttgatcttaaagatcg

SEQ ID NO: 25424 - DNA, 25 bp, Mus musculus
cttcttcttgatcttaaagatcgtg

SEQ ID NO: 25425 - DNA, 25 bp, Mus musculus
tgtgcagagtccattcccacatctt

SEQ ID NO: 25426 - DNA, 25 bp, Mus musculus
cagagtccattcccacatctttcct

SEQ ID NO: 25427 - DNA, 25 bp, Mus musculus
gagtccattcccacatctttcctca

SEQ ID NO: 25428 - DNA, 25 bp, Mus musculus
ccattcccacatctttcctcaagta

SEQ ID NO: 25429 - DNA, 25 bp, Mus musculus
tcccacatctttcctcaagtatctt

SEQ ID NO: 25430 - DNA, 25 bp, Mus musculus
ccacatctttcctcaagtatcttct

SEQ ID NO: 25431 - DNA, 25 bp, Mus musculus
acatctttcctcaagtatcttctat

SEQ ID NO: 25432 - DNA, 25 bp, Mus musculus
tttatcatgaattcccttttaatca

SEQ ID NO: 25433 - DNA, 25 bp, Mus musculus
tatcatgaattcccttttaatcaac

SEQ ID NO: 25434 - DNA, 25 bp, Mus musculus
tcatgaattcccttttaatcaactg

SEQ ID NO: 25435 - DNA, 25 bp, Mus musculus
tcttcttgatcttaaagatcgtgta

SEQ ID NO: 25436 - DNA, 25 bp, Mus musculus
tgactgaaaccattttcccatcatc

SEQ ID NO: 25437 - DNA, 25 bp, Mus musculus
tgaaaccattttcccatcatccttt

SEQ ID NO: 25438 - DNA, 25 bp, Mus musculus
ttcccatcatcctttgttctgacca

SEQ ID NO: 25439 - DNA, 25 bp, Mus musculus
cccatcatcctttgttctgaccatt

SEQ ID NO: 25440 - DNA, 25 bp, Mus musculus
catcatcctttgttctgaccattct

SEQ ID NO: 25441 - DNA, 25 bp, Mus musculus
tctttgtaccctttaagagatccat

SEQ ID NO: 25442 - DNA, 25 bp, Mus musculus
tgtaccctttaagagatccatcttt

SEQ ID NO: 25443 - DNA, 25 bp, Mus musculus
gtatttaccaatggtgattggctac

SEQ ID NO: 25444 - DNA, 25 bp, Mus musculus
attggctacatgatgtcctaagagc

SEQ ID NO: 25445 - DNA, 25 bp, Mus musculus
acacaaagccagtatgatggtgttc

SEQ ID NO: 25446 - DNA, 25 bp, Mus musculus
gcctccaaccagcacttggtgagga

SEQ ID NO: 25447 - DNA, 25 bp, Mus musculus
ctccaaccagcacttggtgaggata

SEQ ID NO: 25448 - DNA, 25 bp, Mus musculus
aaccagcacttggtgaggataaggc

SEQ ID NO: 25449 - DNA, 25 bp, Mus musculus
ggacacttcaattcaatctaaaaca

SEQ ID NO: 25450 - DNA, 25 bp, Mus musculus
ttcaattcaatctaaaacaagggat

SEQ ID NO: 25451 - DNA, 25 bp, Mus musculus
caattcaatctaaaacaagggatgt

SEQ ID NO: 25452 - DNA, 25 bp, Mus musculus
tattgaagcatgctccccagactcc

SEQ ID NO: 25453 - DNA, 25 bp, Mus musculus
ttgaagcatgctccccagactccct

SEQ ID NO: 25454 - DNA, 25 bp, Mus musculus
ccccagactcccttaatgcctgaag

SEQ ID NO: 25455 - DNA, 25 bp, Mus musculus
tggctacatgatgtcctaagagcaa

SEQ ID NO: 25456 - DNA, 25 bp, Mus musculus
gctacatgatgtcctaagagcaatt

SEQ ID NO: 25457 - DNA, 25 bp, Mus musculus
caattgatgaactgtcctggtgaca

SEQ ID NO: 25458 - DNA, 25 bp, Mus musculus
attgatgaactgtcctggtgacaaa

SEQ ID NO: 25459 - DNA, 25 bp, Mus musculus
atgaactgtcctggtgacaaactgg

SEQ ID NO: 25460 - DNA, 25 bp, Mus musculus
gttattttacacaaagccagtatga

SEQ ID NO: 25461 - DNA, 25 bp, Mus musculus
tattttacacaaagccagtatgatg

SEQ ID NO: 25462 - DNA, 25 bp, Mus musculus
ttacacaaagccagtatgatggtgt

SEQ ID NO: 25463 - DNA, 25 bp, Mus musculus
ctggcccagccatttctcgcatcaa

SEQ ID NO: 25464 - DNA, 25 bp, Mus musculus
cagccatttctcgcatcaacaatgc

SEQ ID NO: 25465 - DNA, 25 bp, Mus musculus
tgctcctatatccacgagatcgaca

SEQ ID NO: 25466 - DNA, 25 bp, Mus musculus
tatatccacgagatcgacatctcta

SEQ ID NO: 25467 - DNA, 25 bp, Mus musculus
cacgagatcgacatctctatgatcc

SEQ ID NO: 25468 - DNA, 25 bp, Mus musculus
atgatccttgcagaagccatcagga

SEQ ID NO: 25469 - DNA, 25 bp, Mus musculus
cttgcagaagccatcaggagtacct

SEQ ID NO: 25470 - DNA, 25 bp, Mus musculus
gaagccatcaggagtacctcacaat

SEQ ID NO: 25471 - DNA, 25 bp, Mus musculus
atcaggagtacctcacaatgcgaga

SEQ ID NO: 25472 - DNA, 25 bp, Mus musculus
agtacctcacaatgcgagaatatgt

SEQ ID NO: 25473 - DNA, 25 bp, Mus musculus
tctcctacatgttcagccatgagcc

SEQ ID NO: 25474 - DNA, 25 bp, Mus musculus
acatgttcagccatgagcctctata

SEQ ID NO: 25475 - DNA, 25 bp, Mus musculus
tttctcgcatcaacaatgcatgcta

SEQ ID NO: 25476 - DNA, 25 bp, Mus musculus
tgttcagccatgagcctctataata

SEQ ID NO: 25477 - DNA, 25 bp, Mus musculus
gcatcaacaatgcatgctaccgaag

SEQ ID NO: 25478 - DNA, 25 bp, Mus musculus
acaatgcatgctaccgaagcagtag

SEQ ID NO: 25479 - DNA, 25 bp, Mus musculus
catgctaccgaagcagtagtagtta

SEQ ID NO: 25480 - DNA, 25 bp, Mus musculus
gtagttaccaataccatacctcagg

SEQ ID NO: 25481 - DNA, 25 bp, Mus musculus
accaataccatacctcaggaggaca

SEQ ID NO: 25482 - DNA, 25 bp, Mus musculus
accatacctcaggaggacaagatga

SEQ ID NO: 25483 - DNA, 25 bp, Mus musculus
aagatgaaacactgctcctatatcc

SEQ ID NO: 25484 - DNA, 25 bp, Mus musculus
tctaggctgctgtttccacctcttg

SEQ ID NO: 25485 - DNA, 25 bp, Mus musculus
ctgtttccacctcttgacacctctg

SEQ ID NO: 25486 - DNA, 25 bp, Mus musculus
atccataaatccttgttgatttttg

SEQ ID NO: 25487 - DNA, 25 bp, Mus musculus
taacatctagactttggagtttcca

SEQ ID NO: 25488 - DNA, 25 bp, Mus musculus
aatgtctctttagatctcagggcag

SEQ ID NO: 25489 - DNA, 25 bp, Mus musculus
ttagatctcagggcagaaatgataa

SEQ ID NO: 25490 - DNA, 25 bp, Mus musculus
ataacctggggagacctgctgcctt

SEQ ID NO: 25491 - DNA, 25 bp, Mus musculus
tcatctacttcccaatgcttgaggc

SEQ ID NO: 25492 - DNA, 25 bp, Mus musculus
acttcccaatgcttgaggccagcct

SEQ ID NO: 25493 - DNA, 25 bp, Mus musculus
tgcttgaggccagcctgtagtcaga

SEQ ID NO: 25494 - DNA, 25 bp, Mus musculus
ttgaggccagcctgtagtcagatat

SEQ ID NO: 25495 - DNA, 25 bp, Mus musculus
cagatatttcacccagacataaagg

SEQ ID NO: 25496 - DNA, 25 bp, Mus musculus
acctctgccctgctgcaggcattct

SEQ ID NO: 25497 - DNA, 25 bp, Mus musculus
gccctgctgcaggcattctagacct

SEQ ID NO: 25498 - DNA, 25 bp, Mus musculus
ctgcaggcattctagacctttgggg

SEQ ID NO: 25499 - DNA, 25 bp, Mus musculus
atcgtctacctgagctcctgtctcc

SEQ ID NO: 25500 - DNA, 25 bp, Mus musculus
ccacacttattttcccatctgccta

SEQ ID NO: 25501 - DNA, 25 bp, Mus musculus
ttattttcccatctgcctacattca

SEQ ID NO: 25502 - DNA, 25 bp, Mus musculus
tcccatctgcctacattcaagaaac

SEQ ID NO: 25503 - DNA, 25 bp, Mus musculus
catctgcctacattcaagaaacagg

SEQ ID NO: 25504 - DNA, 25 bp, Mus musculus
ggcacattctctattggtcagaagt

SEQ ID NO: 25505 - DNA, 25 bp, Mus musculus
ttctctattggtcagaagtgtgtca

SEQ ID NO: 25506 - DNA, 25 bp, Mus musculus
cttctagaatgtccgatctaggact

SEQ ID NO: 25507 - DNA, 25 bp, Mus musculus
taggactagctcccaaatgatactg

SEQ ID NO: 25508 - DNA, 25 bp, Mus musculus
ccaaatgatactgtcctgccatcat

SEQ ID NO: 25509 - DNA, 25 bp, Mus musculus
gatactgtcctgccatcattctgat

SEQ ID NO: 25510 - DNA, 25 bp, Mus musculus
tttgactgtttgtggtgagcatcgc

SEQ ID NO: 25511 - DNA, 25 bp, Mus musculus
ctagtttccatctcaagcctgtgac

SEQ ID NO: 25512 - DNA, 25 bp, Mus musculus
tccatctcaagcctgtgacggacag

SEQ ID NO: 25513 - DNA, 25 bp, Mus musculus
ttgtcaagtttgccccaatggtacg

SEQ ID NO: 25514 - DNA, 25 bp, Mus musculus
ccccaatggtacgctgtttgaagag

SEQ ID NO: 25515 - DNA, 25 bp, Mus musculus
cctgtcacctgagcatttggaaatt

SEQ ID NO: 25516 - DNA, 25 bp, Mus musculus
gaaagtgttcttggcccaggctcag

SEQ ID NO: 25517 - DNA, 25 bp, Mus musculus
gtctcctttgggagatgtggaggac

SEQ ID NO: 25518 - DNA, 25 bp, Mus musculus
caagctggcaggcttaactgaggtg

SEQ ID NO: 25519 - DNA, 25 bp, Mus musculus
cttaactgaggtgtgtcatgttcat

SEQ ID NO: 25520 - DNA, 25 bp, Mus musculus
tgtgtgtccgtgcccccgaatccta

SEQ ID NO: 25521 - DNA, 25 bp, Mus musculus
aatcctaggctgccgcttcacagtg

SEQ ID NO: 25522 - DNA, 25 bp, Mus musculus
aggctgccgcttcacagtgtagacc

SEQ ID NO: 25523 - DNA, 25 bp, Mus musculus
ccgcttcacagtgtagaccttctag

SEQ ID NO: 25524 - DNA, 25 bp, Mus musculus
tctgagcctgggctggcatataact

SEQ ID NO: 25525 - DNA, 25 bp, Mus musculus
tgagcctgggctggcatataacttt

SEQ ID NO: 25526 - DNA, 25 bp, Mus musculus
acttactcaacaaactgtatactat

SEQ ID NO: 25527 - DNA, 25 bp, Mus musculus
actcaacaaactgtatactatttat

SEQ ID NO: 25528 - DNA, 25 bp, Mus musculus
tactatttgggccactacgtatata

SEQ ID NO: 25529 - DNA, 25 bp, Mus musculus
ctatttgggccactacgtatatatt

SEQ ID NO: 25530 - DNA, 25 bp, Mus musculus
aacatacttaacatgtttgaatatg

SEQ ID NO: 25531 - DNA, 25 bp, Mus musculus
taatgaattcatcacatccattatt

SEQ ID NO: 25532 - DNA, 25 bp, Mus musculus
atgaattcatcacatccattatttt

SEQ ID NO: 25533 - DNA, 25 bp, Mus musculus
attttaagcctgtacatcttatagt

SEQ ID NO: 25534 - DNA, 25 bp, Mus musculus
taagcctgtacatcttatagtgtct

SEQ ID NO: 25535 - DNA, 25 bp, Mus musculus
agcctgtacatcttatagtgtctca

SEQ ID NO: 25536 - DNA, 25 bp, Mus musculus
agctgctgtgtcatgcagaaacctg

SEQ ID NO: 25537 - DNA, 25 bp, Mus musculus
tcatgcagaaacctgtgtagaatac

SEQ ID NO: 25538 - DNA, 25 bp, Mus musculus
acatttgatgtcttcgtagtatggc

SEQ ID NO: 25539 - DNA, 25 bp, Mus musculus
gatgtcttcgtagtatggcataatg

SEQ ID NO: 25540 - DNA, 25 bp, Mus musculus
taatgtcatgacttactcaacaaac

SEQ ID NO: 25541 - DNA, 25 bp, Mus musculus
gtcatgacttactcaacaaactgta

SEQ ID NO: 25542 - DNA, 25 bp, Mus musculus
catgacttactcaacaaactgtata

SEQ ID NO: 25543 - DNA, 25 bp, Mus musculus
tgacttactcaacaaactgtatact

SEQ ID NO: 25544 - DNA, 25 bp, Mus musculus
taccctcgaaatgtcatcaacaacc

SEQ ID NO: 25545 - DNA, 25 bp, Mus musculus
cctcgaaatgtcatcaacaaccaga

SEQ ID NO: 25546 - DNA, 25 bp, Mus musculus
ttcaacttctacttcctgcttctcg

SEQ ID NO: 25547 - DNA, 25 bp, Mus musculus
aacttctacttcctgcttctcgcct

SEQ ID NO: 25548 - DNA, 25 bp, Mus musculus
tgctcccagttcgtccccgagatga

SEQ ID NO: 25549 - DNA, 25 bp, Mus musculus
ttcgtccccgagatgagacttggcg

SEQ ID NO: 25550 - DNA, 25 bp, Mus musculus
ctctacacctactgggttcctctgg

SEQ ID NO: 25551 - DNA, 25 bp, Mus musculus
tactgggttcctctgggctttgtgc

SEQ ID NO: 25552 - DNA, 25 bp, Mus musculus
tgggttcctctgggctttgtgctgg

SEQ ID NO: 25553 - DNA, 25 bp, Mus musculus
cctctgggctttgtgctggctgtca

SEQ ID NO: 25554 - DNA, 25 bp, Mus musculus
ctgggctttgtgctggctgtcacca

SEQ ID NO: 25555 - DNA, 25 bp, Mus musculus
ggctttgtgctggctgtcaccatca

SEQ ID NO: 25556 - DNA, 25 bp, Mus musculus
aatgtcatcaacaaccagaagtaca

SEQ ID NO: 25557 - DNA, 25 bp, Mus musculus
gtgctggctgtcaccatcatccgtg

SEQ ID NO: 25558 - DNA, 25 bp, Mus musculus
gtcatcaacaaccagaagtacaatt

SEQ ID NO: 25559 - DNA, 25 bp, Mus musculus
atcaacaaccagaagtacaatttct

SEQ ID NO: 25560 - DNA, 25 bp, Mus musculus
gtgttgttcagtcagttcagatact

SEQ ID NO: 25561 - DNA, 25 bp, Mus musculus
ttgttcagtcagttcagatacttct

SEQ ID NO: 25562 - DNA, 25 bp, Mus musculus
cagttcagatacttcttcaacttct

SEQ ID NO: 25563 - DNA, 25 bp, Mus musculus
ttcagatacttcttcaacttctact

SEQ ID NO: 25564 - DNA, 25 bp, Mus musculus
ttcttcaacttctacttcctgcttc

SEQ ID NO: 25565 - DNA, 25 bp, Mus musculus
ctaaacgagctttggcactggaaga

SEQ ID NO: 25566 - DNA, 25 bp, Mus musculus
ttggtttcctgctccaccttcccag

SEQ ID NO: 25567 - DNA, 25 bp, Mus musculus
tggtctgcccacatgacttatccag

SEQ ID NO: 25568 - DNA, 25 bp, Mus musculus
gcccacatgacttatccagacaggg

SEQ ID NO: 25569 - DNA, 25 bp, Mus musculus
atgacttatccagacagggtgccca

SEQ ID NO: 25570 - DNA, 25 bp, Mus musculus
tatccagacagggtgcccaaccaac

SEQ ID NO: 25571 - DNA, 25 bp, Mus musculus
tagccaagaatccttctgctcagct

SEQ ID NO: 25572 - DNA, 25 bp, Mus musculus
agaatccttctgctcagcttctcta

SEQ ID NO: 25573 - DNA, 25 bp, Mus musculus
ctcagcttctctactgcagatcaga

SEQ ID NO: 25574 - DNA, 25 bp, Mus musculus
gcataagacccaaggtttcattctc

SEQ ID NO: 25575 - DNA, 25 bp, Mus musculus
aggtttcattctctatattagatag

SEQ ID NO: 25576 - DNA, 25 bp, Mus musculus
tctctatattagatagcctgttagc

SEQ ID NO: 25577 - DNA, 25 bp, Mus musculus
ttcccagcaatgagctcagcaaagt

SEQ ID NO: 25578 - DNA, 25 bp, Mus musculus
gtcctactaccttcaagatatcaaa

SEQ ID NO: 25579 - DNA, 25 bp, Mus musculus
ctaccttcaagatatcaaagaaaca

SEQ ID NO: 25580 - DNA, 25 bp, Mus musculus
acagtctaagtcacctgttgtctgc

SEQ ID NO: 25581 - DNA, 25 bp, Mus musculus
taagtcacctgttgtctgcttgtaa

SEQ ID NO: 25582 - DNA, 25 bp, Mus musculus
tttattaactctgggaacttcacag

SEQ ID NO: 25583 - DNA, 25 bp, Mus musculus
aactctgggaacttcacagatgtag

SEQ ID NO: 25584 - DNA, 25 bp, Mus musculus
caagcttggtctgcccacatgactt

SEQ ID NO: 25585 - DNA, 25 bp, Mus musculus
cgacagccctgtgtgccgactggat

SEQ ID NO: 25586 - DNA, 25 bp, Mus musculus
ccctgtgtgccgactggatattgag

SEQ ID NO: 25587 - DNA, 25 bp, Mus musculus
cctgtctagtccctgtgcatctctt

SEQ ID NO: 25588 - DNA, 25 bp, Mus musculus
gtctagtccctgtgcatctcttggc

SEQ ID NO: 25589 - DNA, 25 bp, Mus musculus
tagtccctgtgcatctcttggcagt

SEQ ID NO: 25590 - DNA, 25 bp, Mus musculus
ctgtgcatctcttggcagtgaccta

SEQ ID NO: 25591 - DNA, 25 bp, Mus musculus
tgcatctcttggcagtgacctacta

SEQ ID NO: 25592 - DNA, 25 bp, Mus musculus
atctcttggcagtgacctactattt

SEQ ID NO: 25593 - DNA, 25 bp, Mus musculus
tgacctactatttatgaggcctctg

SEQ ID NO: 25594 - DNA, 25 bp, Mus musculus
actatttatgaggcctctgtgagct

SEQ ID NO: 25595 - DNA, 25 bp, Mus musculus
tatgaggcctctgtgagctagctca

SEQ ID NO: 25596 - DNA, 25 bp, Mus musculus
ggagttcttatgctggcttttagtg

SEQ ID NO: 25597 - DNA, 25 bp, Mus musculus
tattgagcccaggtcctcaaagaca

SEQ ID NO: 25598 - DNA, 25 bp, Mus musculus
tgagcccaggtcctcaaagacacag

SEQ ID NO: 25599 - DNA, 25 bp, Mus musculus
gcccaggtcctcaaagacacaggag

SEQ ID NO: 25600 - DNA, 25 bp, Mus musculus
gtcctcaaagacacaggaggctgca

SEQ ID NO: 25601 - DNA, 25 bp, Mus musculus
ctcaaagacacaggaggctgcatga

SEQ ID NO: 25602 - DNA, 25 bp, Mus musculus
atgatataggctgttccagagatcc

SEQ ID NO: 25603 - DNA, 25 bp, Mus musculus
gttccagagatccctgtctagtccc

SEQ ID NO: 25604 - DNA, 25 bp, Mus musculus
ccagagatccctgtctagtccctgt

SEQ ID NO: 25605 - DNA, 25 bp, Mus musculus
aatgacggccatttcttctcaggtg

SEQ ID NO: 25606 - DNA, 25 bp, Mus musculus
gacggccatttcttctcaggtggct

SEQ ID NO: 25607 - DNA, 25 bp, Mus musculus
atctcgggtcttcctcttagcacat

SEQ ID NO: 25608 - DNA, 25 bp, Mus musculus
ggtcttcctcttagcacatttccct

SEQ ID NO: 25609 - DNA, 25 bp, Mus musculus
tcaccaagtgttgggcggccttatt

SEQ ID NO: 25610 - DNA, 25 bp, Mus musculus
cggccttattgttggtgctgccctt

SEQ ID NO: 25611 - DNA, 25 bp, Mus musculus
ccttattgttggtgctgcccttggc

SEQ ID NO: 25612 - DNA, 25 bp, Mus musculus
tgctgcccttggctggctaatgagc

SEQ ID NO: 25613 - DNA, 25 bp, Mus musculus
actgctctggccctcatgctgggtg

SEQ ID NO: 25614 - DNA, 25 bp, Mus musculus
gctctggccctcatgctgggtgcca

SEQ ID NO: 25615 - DNA, 25 bp, Mus musculus
atgctgggtgccagcctcatgtatt

SEQ ID NO: 25616 - DNA, 25 bp, Mus musculus
ctgggtgccagcctcatgtattgga

SEQ ID NO: 25617 - DNA, 25 bp, Mus musculus
ggccatttcttctcaggtggcttct

SEQ ID NO: 25618 - DNA, 25 bp, Mus musculus
gccagcctcatgtattggactctct

SEQ ID NO: 25619 - DNA, 25 bp, Mus musculus
tggcctggcttattgtaccttccta

SEQ ID NO: 25620 - DNA, 25 bp, Mus musculus
cctggcttattgtaccttcctattg

SEQ ID NO: 25621 - DNA, 25 bp, Mus musculus
ttattgtaccttcctattggcagtc

SEQ ID NO: 25622 - DNA, 25 bp, Mus musculus
ttgtaccttcctattggcagtcggc

SEQ ID NO: 25623 - DNA, 25 bp, Mus musculus
taccttcctattggcagtcggccta

SEQ ID NO: 25624 - DNA, 25 bp, Mus musculus
cctattggcagtcggcctatctcgg

SEQ ID NO: 25625 - DNA, 25 bp, Mus musculus
attggcagtcggcctatctcgggtc

SEQ ID NO: 25626 - DNA, 25 bp, Mus musculus
tgcaaaggtcaccgatggagaaaca

SEQ ID NO: 25627 - DNA, 25 bp, Mus musculus
ctctttcctgatagttgatgacaag

SEQ ID NO: 25628 - DNA, 25 bp, Mus musculus
gcccttggtgtattcctggtctcgg

SEQ ID NO: 25629 - DNA, 25 bp, Mus musculus
ggtgtattcctggtctcggagcaaa

SEQ ID NO: 25630 - DNA, 25 bp, Mus musculus
ataatgagccagcaccctgaagggt

SEQ ID NO: 25631 - DNA, 25 bp, Mus musculus
cctttgctgcagagattcctaagca

SEQ ID NO: 25632 - DNA, 25 bp, Mus musculus
tggagctttggcaaccctagcccca

SEQ ID NO: 25633 - DNA, 25 bp, Mus musculus
agccccagctaactttggacagtca

SEQ ID NO: 25634 - DNA, 25 bp, Mus musculus
ctttggacagtcagcatatgtccct

SEQ ID NO: 25635 - DNA, 25 bp, Mus musculus
acagtcagcatatgtccctgccatc

SEQ ID NO: 25636 - DNA, 25 bp, Mus musculus
agctggtatcacagccagtggttca

SEQ ID NO: 25637 - DNA, 25 bp, Mus musculus
tatcacagccagtggttcagacagg

SEQ ID NO: 25638 - DNA, 25 bp, Mus musculus
tgacaagccctgagaatgccatctg

SEQ ID NO: 25639 - DNA, 25 bp, Mus musculus
agaatgccatctgctggctccactc

SEQ ID NO: 25640 - DNA, 25 bp, Mus musculus
cacacgggctcaactgtcctgggtg

SEQ ID NO: 25641 - DNA, 25 bp, Mus musculus
actgtcctgggtgatagtgacttgc

SEQ ID NO: 25642 - DNA, 25 bp, Mus musculus
ccaggccacaggctgcaggtcacag

SEQ ID NO: 25643 - DNA, 25 bp, Mus musculus
aagcagccttgcaactgcagattac

SEQ ID NO: 25644 - DNA, 25 bp, Mus musculus
ccgtagccagtgccctgctttactc

SEQ ID NO: 25645 - DNA, 25 bp, Mus musculus
tcgaaagcccttggtgtattcctgg

SEQ ID NO: 25646 - DNA, 25 bp, Mus musculus
ggacacctaacacaatcatagacca

SEQ ID NO: 25647 - DNA, 25 bp, Mus musculus
acctaacacaatcatagaccaaagc

SEQ ID NO: 25648 - DNA, 25 bp, Mus musculus
atccagatcacatatactgaaccgt

SEQ ID NO: 25649 - DNA, 25 bp, Mus musculus
ccagatcacatatactgaaccgtgt

SEQ ID NO: 25650 - DNA, 25 bp, Mus musculus
agatcacatatactgaaccgtgtac

SEQ ID NO: 25651 - DNA, 25 bp, Mus musculus
gaaccgtgtacctcgcgatagtaga

SEQ ID NO: 25652 - DNA, 25 bp, Mus musculus
accgtgtacctcgcgatagtagaga

SEQ ID NO: 25653 - DNA, 25 bp, Mus musculus
cgtgtacctcgcgatagtagagaag

SEQ ID NO: 25654 - DNA, 25 bp, Mus musculus
tgtacctcgcgatagtagagaagaa

SEQ ID NO: 25655 - DNA, 25 bp, Mus musculus
aacattctcgacgcattcaaagtga

SEQ ID NO: 25656 - DNA, 25 bp, Mus musculus
ttctcgacgcattcaaagtgattaa

SEQ ID NO: 25657 - DNA, 25 bp, Mus musculus
ctcgacgcattcaaagtgattaata

SEQ ID NO: 25658 - DNA, 25 bp, Mus musculus
caatcatagaccaaagcaaagacgg

SEQ ID NO: 25659 - DNA, 25 bp, Mus musculus
atcatagaccaaagcaaagacggct

SEQ ID NO: 25660 - DNA, 25 bp, Mus musculus
caaagacggcttcatcaacataaat

SEQ ID NO: 25661 - DNA, 25 bp, Mus musculus
aagacggcttcatcaacataaatga

SEQ ID NO: 25662 - DNA, 25 bp, Mus musculus
gacggcttcatcaacataaatgaca

SEQ ID NO: 25663 - DNA, 25 bp, Mus musculus
cggcttcatcaacataaatgacata

SEQ ID NO: 25664 - DNA, 25 bp, Mus musculus
gaagaacattaactgccctagaacg

SEQ ID NO: 25665 - DNA, 25 bp, Mus musculus
gaatccagatcacatatactgaacc

SEQ ID NO: 25666 - DNA, 25 bp, Mus musculus
atctcttgcagcaacaatgaccttg

SEQ ID NO: 25667 - DNA, 25 bp, Mus musculus
tgcagcaacaatgaccttggagcct

SEQ ID NO: 25668 - DNA, 25 bp, Mus musculus
acctgcccagctgatcctgaagaga

SEQ ID NO: 25669 - DNA, 25 bp, Mus musculus
ccagctgatcctgaagagaagatac

SEQ ID NO: 25670 - DNA, 25 bp, Mus musculus
cagttagtccagctgcgcctggaca

SEQ ID NO: 25671 - DNA, 25 bp, Mus musculus
tctgttttactgagcctgggtgcct

SEQ ID NO: 25672 - DNA, 25 bp, Mus musculus
agcctgggtgcctcccatattcagg

SEQ ID NO: 25673 - DNA, 25 bp, Mus musculus
ggtgcctcccatattcaggcctgga

SEQ ID NO: 25674 - DNA, 25 bp, Mus musculus
tcccatattcaggcctggatccccg

SEQ ID NO: 25675 - DNA, 25 bp, Mus musculus
cttcctggttcatcacagaggccaa

SEQ ID NO: 25676 - DNA, 25 bp, Mus musculus
ggttcatcacagaggccaacttccc

SEQ ID NO: 25677 - DNA, 25 bp, Mus musculus
tcacagaggccaacttcccagagta

SEQ ID NO: 25678 - DNA, 25 bp, Mus musculus
agtggccatctctacatcggtcctc

SEQ ID NO: 25679 - DNA, 25 bp, Mus musculus
cttcccagagtacaagcagcctgag

SEQ ID NO: 25680 - DNA, 25 bp, Mus musculus
catctctacatcggtcctcttggtt

SEQ ID NO: 25681 - DNA, 25 bp, Mus musculus
ggctttcctggcctggtacatcaaa

SEQ ID NO: 25682 - DNA, 25 bp, Mus musculus
cctggcctggtacatcaaatcaagg

SEQ ID NO: 25683 - DNA, 25 bp, Mus musculus
gcagccttctcagccgtgccgtgtt

SEQ ID NO: 25684 - DNA, 25 bp, Mus musculus
ttctcagccgtgccgtgttgaggtg

SEQ ID NO: 25685 - DNA, 25 bp, Mus musculus
aacagtaccaatgactgtgagggcc

SEQ ID NO: 25686 - DNA, 25 bp, Mus musculus
ctaaccacacgatttcagaaactca

SEQ ID NO: 25687 - DNA, 25 bp, Mus musculus
acatccttttcgccttcaccaagcg

SEQ ID NO: 25688 - DNA, 25 bp, Mus musculus
ttttcgccttcaccaagcgagtcct

SEQ ID NO: 25689 - DNA, 25 bp, Mus musculus
ctctgcggcgcaagcaggaagaggt

SEQ ID NO: 25690 - DNA, 25 bp, Mus musculus
ggggcttcatctgcagaaagatcac

SEQ ID NO: 25691 - DNA, 25 bp, Mus musculus
gcttcatctgcagaaagatcacttc

SEQ ID NO: 25692 - DNA, 25 bp, Mus musculus
gaaagatcacttccaacaagctgga

SEQ ID NO: 25693 - DNA, 25 bp, Mus musculus
cttccaacaagctggagaatggagg

SEQ ID NO: 25694 - DNA, 25 bp, Mus musculus
tcccctcttacgacagcgtgacaaa

SEQ ID NO: 25695 - DNA, 25 bp, Mus musculus
cttacgacagcgtgacaaagcccga

SEQ ID NO: 25696 - DNA, 25 bp, Mus musculus
gcgtgacaaagcccgacaaggagaa

SEQ ID NO: 25697 - DNA, 25 bp, Mus musculus
aaacttccgaatctcacggacacag

SEQ ID NO: 25698 - DNA, 25 bp, Mus musculus
cttccgaatctcacggacacagagc

SEQ ID NO: 25699 - DNA, 25 bp, Mus musculus
agttggacatcctgcggcagcagat

SEQ ID NO: 25700 - DNA, 25 bp, Mus musculus
tggacatcctgcggcagcagatgga

SEQ ID NO: 25701 - DNA, 25 bp, Mus musculus
tggcgtccaatccttccaaagtgtc

SEQ ID NO: 25702 - DNA, 25 bp, Mus musculus
cttccaaagtgtcttacgagcctat

SEQ ID NO: 25703 - DNA, 25 bp, Mus musculus
tgtcttacgagcctatcacgaccac

SEQ ID NO: 25704 - DNA, 25 bp, Mus musculus
cttacgagcctatcacgaccactct

SEQ ID NO: 25705 - DNA, 25 bp, Mus musculus
agcctatcacgaccactctgcggcg

SEQ ID NO: 25706 - DNA, 25 bp, Mus musculus
tcacgaccactctgcggcgcaagca

SEQ ID NO: 25707 - DNA, 25 bp, Mus musculus
gaaggcctcccatggcatgaggaaa

SEQ ID NO: 25708 - DNA, 25 bp, Mus musculus
agtaatgtctgtctgactgtcatct

SEQ ID NO: 25709 - DNA, 25 bp, Mus musculus
aacattaacagcttctcctgaccag

SEQ ID NO: 25710 - DNA, 25 bp, Mus musculus
aacagcttctcctgaccagagagac

SEQ ID NO: 25711 - DNA, 25 bp, Mus musculus
ttctcctgaccagagagaccatgca

SEQ ID NO: 25712 - DNA, 25 bp, Mus musculus
aagcttggtcttagacccatcaagc

SEQ ID NO: 25713 - DNA, 25 bp, Mus musculus
ggtcttagacccatcaagcttgagg

SEQ ID NO: 25714 - DNA, 25 bp, Mus musculus
agacccatcaagcttgaggtttcta

SEQ ID NO: 25715 - DNA, 25 bp, Mus musculus
ttttgacaaaccatttgagttgatg

SEQ ID NO: 25716 - DNA, 25 bp, Mus musculus
gggagttctccttcagtaaggagag

SEQ ID NO: 25717 - DNA, 25 bp, Mus musculus
tctccttcagtaaggagagcaagcc

SEQ ID NO: 25718 - DNA, 25 bp, Mus musculus
agtgctgtgtcagaggatggagtaa

SEQ ID NO: 25719 - DNA, 25 bp, Mus musculus
ctgactgtcatctcagcaagtccta

SEQ ID NO: 25720 - DNA, 25 bp, Mus musculus
gtcatctcagcaagtcctaaggact

SEQ ID NO: 25721 - DNA, 25 bp, Mus musculus
ttccatgctgccttgttgaaagata

SEQ ID NO: 25722 - DNA, 25 bp, Mus musculus
agtgatcctgtctctcactgagggg

SEQ ID NO: 25723 - DNA, 25 bp, Mus musculus
acattttctgcccaaattccattct

SEQ ID NO: 25724 - DNA, 25 bp, Mus musculus
caaattccattctgtgtgcagtttt

SEQ ID NO: 25725 - DNA, 25 bp, Mus musculus
ccattctgtgtgcagtttttaagta

SEQ ID NO: 25726 - DNA, 25 bp, Mus musculus
aagagcttctggacagcaaacatta

SEQ ID NO: 25727 - DNA, 25 bp, Mus musculus
aggagaactggccatcgcagagcgt

SEQ ID NO: 25728 - DNA, 25 bp, Mus musculus
agaactggccatcgcagagcgtacc

SEQ ID NO: 25729 - DNA, 25 bp, Mus musculus
cactgctcatcaagcaatactgcag

SEQ ID NO: 25730 - DNA, 25 bp, Mus musculus
tgctcatcaagcaatactgcaggga

SEQ ID NO: 25731 - DNA, 25 bp, Mus musculus
tcaagcaatactgcagggagagtgg

SEQ ID NO: 25732 - DNA, 25 bp, Mus musculus
tgcgcaacctacagaagcaggtgga

SEQ ID NO: 25733 - DNA, 25 bp, Mus musculus
aggtgctgcgcaaggctgcatacaa

SEQ ID NO: 25734 - DNA, 25 bp, Mus musculus
tgcgcaaggctgcatacaagatcgt

SEQ ID NO: 25735 - DNA, 25 bp, Mus musculus
cagtacaggtgacacctgagaacct

SEQ ID NO: 25736 - DNA, 25 bp, Mus musculus
aggtgacacctgagaacctacaaga

SEQ ID NO: 25737 - DNA, 25 bp, Mus musculus
tgacacctgagaacctacaagactt

SEQ ID NO: 25738 - DNA, 25 bp, Mus musculus
cacctgagaacctacaagactttgt

SEQ ID NO: 25739 - DNA, 25 bp, Mus musculus
ccctgtgtggcctagatgagagcaa

SEQ ID NO: 25740 - DNA, 25 bp, Mus musculus
atgagagcaaggcccagctgtcagc

SEQ ID NO: 25741 - DNA, 25 bp, Mus musculus
agagcaaggcccagctgtcagcagc

SEQ ID NO: 25742 - DNA, 25 bp, Mus musculus
aggcccagctgtcagcagcagtgct

SEQ ID NO: 25743 - DNA, 25 bp, Mus musculus
cccagctgtcagcagcagtgctcac

SEQ ID NO: 25744 - DNA, 25 bp, Mus musculus
cagcagtgctcacactgctcatcaa

SEQ ID NO: 25745 - DNA, 25 bp, Mus musculus
cagtgctcacactgctcatcaagca

SEQ ID NO: 25746 - DNA, 25 bp, Mus musculus
tcacactgctcatcaagcaatactg

SEQ ID NO: 25747 - DNA, 25 bp, Mus musculus
gcgcccacagagagcctcagtccag

SEQ ID NO: 25748 - DNA, 25 bp, Mus musculus
ctcagtccagttcaagctcggcatg

SEQ ID NO: 25749 - DNA, 25 bp, Mus musculus
agaactatgtagccactctggcgcg

SEQ ID NO: 25750 - DNA, 25 bp, Mus musculus
actatgtagccactctggcgcgtgg

SEQ ID NO: 25751 - DNA, 25 bp, Mus musculus
atgtagccactctggcgcgtggagg

SEQ ID NO: 25752 - DNA, 25 bp, Mus musculus
ccactctggcgcgtggaggtgcatt

SEQ ID NO: 25753 - DNA, 25 bp, Mus musculus
gacacggctcggcgagagaatttcg

SEQ ID NO: 25754 - DNA, 25 bp, Mus musculus
gagaatttcggcgtgctgctcgatg

SEQ ID NO: 25755 - DNA, 25 bp, Mus musculus
aatttcggcgtgctgctcgatggct

SEQ ID NO: 25756 - DNA, 25 bp, Mus musculus
gtgctgctcgatggctactagatct

SEQ ID NO: 25757 - DNA, 25 bp, Mus musculus
ggctactagatctaagctcagtgtg

SEQ ID NO: 25758 - DNA, 25 bp, Mus musculus
tactagatctaagctcagtgtgccg

SEQ ID NO: 25759 - DNA, 25 bp, Mus musculus
gttcaagctcggcatgctgggctac

SEQ ID NO: 25760 - DNA, 25 bp, Mus musculus
atctttgactgtacctcaagagtga

SEQ ID NO: 25761 - DNA, 25 bp, Mus musculus
caagctcggcatgctgggctacggc

SEQ ID NO: 25762 - DNA, 25 bp, Mus musculus
gacaaccttcgtgaatcgctactat

SEQ ID NO: 25763 - DNA, 25 bp, Mus musculus
cttcgtgaatcgctactatgacggg

SEQ ID NO: 25764 - DNA, 25 bp, Mus musculus
cgtgaatcgctactatgacgggcga

SEQ ID NO: 25765 - DNA, 25 bp, Mus musculus
gaatcgctactatgacgggcgagtt

SEQ ID NO: 25766 - DNA, 25 bp, Mus musculus
ctactatgacgggcgagtttgataa

SEQ ID NO: 25767 - DNA, 25 bp, Mus musculus
ctatgacgggcgagtttgataagaa

SEQ ID NO: 25768 - DNA, 25 bp, Mus musculus
tgaaatcaccttccattggtttggg

SEQ ID NO: 25769 - DNA, 25 bp, Mus musculus
aatcaccttccattggtttgggctg

SEQ ID NO: 25770 - DNA, 25 bp, Mus musculus
ctctagcttcactcccaagttctac

SEQ ID NO: 25771 - DNA, 25 bp, Mus musculus
cttcactcccaagttctactggatg

SEQ ID NO: 25772 - DNA, 25 bp, Mus musculus
tcccaagttctactggatgtctgat

SEQ ID NO: 25773 - DNA, 25 bp, Mus musculus
tacatgagaccctaagaggcctggg

SEQ ID NO: 25774 - DNA, 25 bp, Mus musculus
atgagaccctaagaggcctgggata

SEQ ID NO: 25775 - DNA, 25 bp, Mus musculus
cacggtgccaaagcccctgtattgt

SEQ ID NO: 25776 - DNA, 25 bp, Mus musculus
ggtgccaaagcccctgtattgtgtt

SEQ ID NO: 25777 - DNA, 25 bp, Mus musculus
gcccctgtattgtgtttgtgaacca

SEQ ID NO: 25778 - DNA, 25 bp, Mus musculus
tgtttgtgaaccatcctacatgtaa

SEQ ID NO: 25779 - DNA, 25 bp, Mus musculus
ttgtgaaccatcctacatgtaaggg

SEQ ID NO: 25780 - DNA, 25 bp, Mus musculus
ccattggtttgggctggaaactcat

SEQ ID NO: 25781 - DNA, 25 bp, Mus musculus
aactcatggttggagcacaggaagt

SEQ ID NO: 25782 - DNA, 25 bp, Mus musculus
tgggcttcgtgtcactttggcctgt

SEQ ID NO: 25783 - DNA, 25 bp, Mus musculus
tcgtgtcactttggcctgtcactta

SEQ ID NO: 25784 - DNA, 25 bp, Mus musculus
tgtcactttggcctgtcacttagat

SEQ ID NO: 25785 - DNA, 25 bp, Mus musculus
cactttggcctgtcacttagatggc

SEQ ID NO: 25786 - DNA, 25 bp, Mus musculus
ggcctgtcacttagatggccttggc

SEQ ID NO: 25787 - DNA, 25 bp, Mus musculus
agatggccttggctctagcttcact

SEQ ID NO: 25788 - DNA, 25 bp, Mus musculus
aatccctctgggtgttgctcttgcc

SEQ ID NO: 25789 - DNA, 25 bp, Mus musculus
tgttgctcttgccagctggtgactc

SEQ ID NO: 25790 - DNA, 25 bp, Mus musculus
tagtgccacctttactgtgcttttt

SEQ ID NO: 25791 - DNA, 25 bp, Mus musculus
tgccacctttactgtgctttttgct

SEQ ID NO: 25792 - DNA, 25 bp, Mus musculus
tgtttatcacccattcgacctataa

SEQ ID NO: 25793 - DNA, 25 bp, Mus musculus
ttatcacccattcgacctataagaa

SEQ ID NO: 25794 - DNA, 25 bp, Mus musculus
tattacagacaccgtgaaacgcggt

SEQ ID NO: 25795 - DNA, 25 bp, Mus musculus
cccagtccactggctgtggattctt

SEQ ID NO: 25796 - DNA, 25 bp, Mus musculus
ttcagtgacttgtcacattatagag

SEQ ID NO: 25797 - DNA, 25 bp, Mus musculus
ttggtttatgcctgattttgctagc

SEQ ID NO: 25798 - DNA, 25 bp, Mus musculus
gtttatgcctgattttgctagctta

SEQ ID NO: 25799 - DNA, 25 bp, Mus musculus
tttttaatcaacttgactgtaatat

SEQ ID NO: 25800 - DNA, 25 bp, Mus musculus
tgctcttgccagctggtgactccca

SEQ ID NO: 25801 - DNA, 25 bp, Mus musculus
tgccagctggtgactcccagcagct

SEQ ID NO: 25802 - DNA, 25 bp, Mus musculus
cagctggtgactcccagcagctcac

SEQ ID NO: 25803 - DNA, 25 bp, Mus musculus
agctgcgcttcaggtttgagctgta

SEQ ID NO: 25804 - DNA, 25 bp, Mus musculus
ctcttcagggtctcatagtgccacc

SEQ ID NO: 25805 - DNA, 25 bp, Mus musculus
ttcagggtctcatagtgccaccttt

SEQ ID NO: 25806 - DNA, 25 bp, Mus musculus
agggtctcatagtgccacctttact

SEQ ID NO: 25807 - DNA, 25 bp, Mus musculus
tcatagtgccacctttactgtgctt

SEQ ID NO: 25808 - DNA, 25 bp, Mus musculus
agcttggagcctacgccaggttcac

SEQ ID NO: 25809 - DNA, 25 bp, Mus musculus
gagcctacgccaggttcactggcca

SEQ ID NO: 25810 - DNA, 25 bp, Mus musculus
tgtgagctgccatccaggtactggg

SEQ ID NO: 25811 - DNA, 25 bp, Mus musculus
gaataagtactctcaaccactgagc

SEQ ID NO: 25812 - DNA, 25 bp, Mus musculus
tcaaccactgagccataactccagc

SEQ ID NO: 25813 - DNA, 25 bp, Mus musculus
ccataactccagcctactattatca

SEQ ID NO: 25814 - DNA, 25 bp, Mus musculus
ctccagcctactattatcatctgtg

SEQ ID NO: 25815 - DNA, 25 bp, Mus musculus
cctactattatcatctgtggttctc

SEQ ID NO: 25816 - DNA, 25 bp, Mus musculus
attatcatctgtggttctcagtgca

SEQ ID NO: 25817 - DNA, 25 bp, Mus musculus
ggttctcagtgcaaagtggtgttct

SEQ ID NO: 25818 - DNA, 25 bp, Mus musculus
taggctctctgatgctgacctgata

SEQ ID NO: 25819 - DNA, 25 bp, Mus musculus
ctctgatgctgacctgataagaatg

SEQ ID NO: 25820 - DNA, 25 bp, Mus musculus
attaggtcactgccattcgacacag

SEQ ID NO: 25821 - DNA, 25 bp, Mus musculus
actgaaatcgaccatgtggtgactt

SEQ ID NO: 25822 - DNA, 25 bp, Mus musculus
tttatcggtgtcttgtctgcatgta

SEQ ID NO: 25823 - DNA, 25 bp, Mus musculus
ggtgtcttgtctgcatgtacatctg

SEQ ID NO: 25824 - DNA, 25 bp, Mus musculus
gcatgtacatctgtgtgccctgtgc

SEQ ID NO: 25825 - DNA, 25 bp, Mus musculus
gtgtgccctgtgcatagccagtgcc

SEQ ID NO: 25826 - DNA, 25 bp, Mus musculus
catagccagtgcctggagaagcaaa

SEQ ID NO: 25827 - DNA, 25 bp, Mus musculus
gacatctgtgagctgccatccaggt

SEQ ID NO: 25828 - DNA, 25 bp, Mus musculus
tacgagaggaccttcgtctgcctga

SEQ ID NO: 25829 - DNA, 25 bp, Mus musculus
aggaccttcgtctgcctgaaggagg

SEQ ID NO: 25830 - DNA, 25 bp, Mus musculus
atcacagtgctgtctgccatgacag

SEQ ID NO: 25831 - DNA, 25 bp, Mus musculus
tcacagtgctgtctgccatgacaga

SEQ ID NO: 25832 - DNA, 25 bp, Mus musculus
acagtgctgtctgccatgacagagg

SEQ ID NO: 25833 - DNA, 25 bp, Mus musculus
cagtgctgtctgccatgacagagga

SEQ ID NO: 25834 - DNA, 25 bp, Mus musculus
tgtctgccatgacagaggaggcagc

SEQ ID NO: 25835 - DNA, 25 bp, Mus musculus
aggcagctgttgcgatcaaggccat

SEQ ID NO: 25836 - DNA, 25 bp, Mus musculus
ctgttgcgatcaaggccattgcgga

SEQ ID NO: 25837 - DNA, 25 bp, Mus musculus
ttgcgatcaaggccattgcggaata

SEQ ID NO: 25838 - DNA, 25 bp, Mus musculus
gcgatcaaggccattgcggaataac

SEQ ID NO: 25839 - DNA, 25 bp, Mus musculus
cgatcaaggccattgcggaataacc

SEQ ID NO: 25840 - DNA, 25 bp, Mus musculus
cttcgtctgcctgaaggaggactgg

SEQ ID NO: 25841 - DNA, 25 bp, Mus musculus
ttcgtctgcctgaaggaggactggg

SEQ ID NO: 25842 - DNA, 25 bp, Mus musculus
ctgcctgaaggaggactgggcaatg

SEQ ID NO: 25843 - DNA, 25 bp, Mus musculus
gagatcctgatcacagtgctgtctg

SEQ ID NO: 25844 - DNA, 25 bp, Mus musculus
agatcctgatcacagtgctgtctgc

SEQ ID NO: 25845 - DNA, 25 bp, Mus musculus
tcctgatcacagtgctgtctgccat

SEQ ID NO: 25846 - DNA, 25 bp, Mus musculus
ctgatcacagtgctgtctgccatga

SEQ ID NO: 25847 - DNA, 25 bp, Mus musculus
tgatcacagtgctgtctgccatgac

SEQ ID NO: 25848 - DNA, 25 bp, Mus musculus
ttcctaaggagctgcaggagaggca

SEQ ID NO: 25849 - DNA, 25 bp, Mus musculus
agaggcaaatctcctcagtgtcact

SEQ ID NO: 25850 - DNA, 25 bp, Mus musculus
atctcttccagaagacagactactt

SEQ ID NO: 25851 - DNA, 25 bp, Mus musculus
agacagactacttcaatgggtaaag

SEQ ID NO: 25852 - DNA, 25 bp, Mus musculus
ggctttaacagcttgttttattcat

SEQ ID NO: 25853 - DNA, 25 bp, Mus musculus
aactgtctcgataattttcctcttg

SEQ ID NO: 25854 - DNA, 25 bp, Mus musculus
ccctttgctttgtgtgaccacatgc

SEQ ID NO: 25855 - DNA, 25 bp, Mus musculus
gctttgtgtgaccacatgctttctg

SEQ ID NO: 25856 - DNA, 25 bp, Mus musculus
tgtgaccacatgctttctgtaccat

SEQ ID NO: 25857 - DNA, 25 bp, Mus musculus
cacatgctttctgtaccattcactt

SEQ ID NO: 25858 - DNA, 25 bp, Mus musculus
ctttctgtaccattcacttacttgg

SEQ ID NO: 25859 - DNA, 25 bp, Mus musculus
tttttggatctcatgatttatggaa

SEQ ID NO: 25860 - DNA, 25 bp, Mus musculus
aaatctcctcagtgtcactgccaca

SEQ ID NO: 25861 - DNA, 25 bp, Mus musculus
acctctcgtgaggcctgtggcatat

SEQ ID NO: 25862 - DNA, 25 bp, Mus musculus
aattctgtagcatctttgcccattt

SEQ ID NO: 25863 - DNA, 25 bp, Mus musculus
gtagcatctttgcccatttgcttag

SEQ ID NO: 25864 - DNA, 25 bp, Mus musculus
tctttgcccatttgcttagctgctg

SEQ ID NO: 25865 - DNA, 25 bp, Mus musculus
cccatttgcttagctgctggctgtg

SEQ ID NO: 25866 - DNA, 25 bp, Mus musculus
tgcttagctgctggctgtgaatgcg

SEQ ID NO: 25867 - DNA, 25 bp, Mus musculus
aatgaaatctcttccagaagacaga

SEQ ID NO: 25868 - DNA, 25 bp, Mus musculus
tagccaggtttccattgattcattc

SEQ ID NO: 25869 - DNA, 25 bp, Mus musculus
ggtttccattgattcattccaaggt

SEQ ID NO: 25870 - DNA, 25 bp, Mus musculus
ctccctcatagtctctcatagaaat

SEQ ID NO: 25871 - DNA, 25 bp, Mus musculus
tagtcacggcactctgctccctgtc

SEQ ID NO: 25872 - DNA, 25 bp, Mus musculus
ccctgtcactagtggcaggttctgt

SEQ ID NO: 25873 - DNA, 25 bp, Mus musculus
cactagtggcaggttctgttgatgt

SEQ ID NO: 25874 - DNA, 25 bp, Mus musculus
tggcaggttctgttgatgtgtgaca

SEQ ID NO: 25875 - DNA, 25 bp, Mus musculus
ttgcaaacagttcacggacatgttg

SEQ ID NO: 25876 - DNA, 25 bp, Mus musculus
ggagacaaagcccctggcggttgtg

SEQ ID NO: 25877 - DNA, 25 bp, Mus musculus
tcttctgagatttctggcagtgtgg

SEQ ID NO: 25878 - DNA, 25 bp, Mus musculus
tccatgttcatctgtctacctctta

SEQ ID NO: 25879 - DNA, 25 bp, Mus musculus
ttcatctgtctacctcttaactgaa

SEQ ID NO: 25880 - DNA, 25 bp, Mus musculus
tcccttttctcctgggctatgaatt

SEQ ID NO: 25881 - DNA, 25 bp, Mus musculus
ttctcctgggctatgaattcctgta

SEQ ID NO: 25882 - DNA, 25 bp, Mus musculus
acatatttctctacttttgtatcag

SEQ ID NO: 25883 - DNA, 25 bp, Mus musculus
ggcctcaattccagtatgttttaat

SEQ ID NO: 25884 - DNA, 25 bp, Mus musculus
gcatgtactgctttgtcggcctcac

SEQ ID NO: 25885 - DNA, 25 bp, Mus musculus
actgctttgtcggcctcaccagctt

SEQ ID NO: 25886 - DNA, 25 bp, Mus musculus
tcttccccaacatgcacagggattt

SEQ ID NO: 25887 - DNA, 25 bp, Mus musculus
ccaacatgcacagggatttaacaac

SEQ ID NO: 25888 - DNA, 25 bp, Mus musculus
cgcagaagctgcaggccctgcagcg

SEQ ID NO: 25889 - DNA, 25 bp, Mus musculus
ctgcagagtcgcttctgctccgcca

SEQ ID NO: 25890 - DNA, 25 bp, Mus musculus
tgacacgctggacatcactggcagc

SEQ ID NO: 25891 - DNA, 25 bp, Mus musculus
catcactggcagcgccgaggtgcgg

SEQ ID NO: 25892 - DNA, 25 bp, Mus musculus
catgccacagctaaggccacagtgg

SEQ ID NO: 25893 - DNA, 25 bp, Mus musculus
tgccacagctaaggccacagtggct

SEQ ID NO: 25894 - DNA, 25 bp, Mus musculus
agtggctgctttcacggccagtgag

SEQ ID NO: 25895 - DNA, 25 bp, Mus musculus
tggctgctttcacggccagtgaggg

SEQ ID NO: 25896 - DNA, 25 bp, Mus musculus
gctgctttcacggccagtgagggcc

SEQ ID NO: 25897 - DNA, 25 bp, Mus musculus
tgctttcacggccagtgagggccac

SEQ ID NO: 25898 - DNA, 25 bp, Mus musculus
cacggccagtgagggccacgcacat

SEQ ID NO: 25899 - DNA, 25 bp, Mus musculus
cgcacatcccagggtcgtggaacta

SEQ ID NO: 25900 - DNA, 25 bp, Mus musculus
gctccgccatccgcgaggtgtatga

SEQ ID NO: 25901 - DNA, 25 bp, Mus musculus
cgccatccgcgaggtgtatgaacag

SEQ ID NO: 25902 - DNA, 25 bp, Mus musculus
ccatccgcgaggtgtatgaacagct

SEQ ID NO: 25903 - DNA, 25 bp, Mus musculus
tatgaacagctctatgacacgctgg

SEQ ID NO: 25904 - DNA, 25 bp, Mus musculus
aacagctctatgacacgctggacat

SEQ ID NO: 25905 - DNA, 25 bp, Mus musculus
cagctctatgacacgctggacatca

SEQ ID NO: 25906 - DNA, 25 bp, Mus musculus
gctctatgacacgctggacatcact

SEQ ID NO: 25907 - DNA, 25 bp, Mus musculus
tctatgacacgctggacatcactgg

SEQ ID NO: 25908 - DNA, 25 bp, Mus musculus
catgaagttcaacctctccggcctt

SEQ ID NO: 25909 - DNA, 25 bp, Mus musculus
ccgttatgtcatctcgcaagggaac

SEQ ID NO: 25910 - DNA, 25 bp, Mus musculus
agacttgggccttgggccagctcag

SEQ ID NO: 25911 - DNA, 25 bp, Mus musculus
gatcccagcacagccggccttcaga

SEQ ID NO: 25912 - DNA, 25 bp, Mus musculus
agcacagccggccttcagaagtgtt

SEQ ID NO: 25913 - DNA, 25 bp, Mus musculus
catcactgactgattttgaagagga

SEQ ID NO: 25914 - DNA, 25 bp, Mus musculus
ttcctttccttcttcctgattcaga

SEQ ID NO: 25915 - DNA, 25 bp, Mus musculus
tccttcttcctgattcagacttcgg

SEQ ID NO: 25916 - DNA, 25 bp, Mus musculus
attcagacttcggaatgttgaccct

SEQ ID NO: 25917 - DNA, 25 bp, Mus musculus
gaatgttgaccctcgcagggaagga

SEQ ID NO: 25918 - DNA, 25 bp, Mus musculus
ataatttagactctggtatggccaa

SEQ ID NO: 25919 - DNA, 25 bp, Mus musculus
tagactctggtatggccaaagattt

SEQ ID NO: 25920 - DNA, 25 bp, Mus musculus
tgtcatctcgcaagggaacgaggat

SEQ ID NO: 25921 - DNA, 25 bp, Mus musculus
tggcgtcttccgaatccaccaaagg

SEQ ID NO: 25922 - DNA, 25 bp, Mus musculus
gctcagctacctgcacacggccaag

SEQ ID NO: 25923 - DNA, 25 bp, Mus musculus
ctacctgcacacggccaagaagaag

SEQ ID NO: 25924 - DNA, 25 bp, Mus musculus
cacatacacactggaaatcaccagc

SEQ ID NO: 25925 - DNA, 25 bp, Mus musculus
gttgtattagccctctgcagacttg

SEQ ID NO: 25926 - DNA, 25 bp, Mus musculus
ttagccctctgcagacttgggcctt

SEQ ID NO: 25927 - DNA, 25 bp, Mus musculus
ctctgcagacttgggccttgggcca

SEQ ID NO: 25928 - DNA, 25 bp, Mus musculus
gaactcacatctcatccagcatatg

SEQ ID NO: 25929 - DNA, 25 bp, Mus musculus
ctcacatctcatccagcatatgaga

SEQ ID NO: 25930 - DNA, 25 bp, Mus musculus
cattcagagctcacatctgattcac

SEQ ID NO: 25931 - DNA, 25 bp, Mus musculus
tcagagctcacatctgattcaccat

SEQ ID NO: 25932 - DNA, 25 bp, Mus musculus
gagctcacatctgattcaccatcac

SEQ ID NO: 25933 - DNA, 25 bp, Mus musculus
ctcacatctgattcaccatcacaga

SEQ ID NO: 25934 - DNA, 25 bp, Mus musculus
acatctgattcaccatcacagaatc

SEQ ID NO: 25935 - DNA, 25 bp, Mus musculus
tctgattcaccatcacagaatccat

SEQ ID NO: 25936 - DNA, 25 bp, Mus musculus
gattcaccatcacagaatccatact

SEQ ID NO: 25937 - DNA, 25 bp, Mus musculus
taaagccttcagtcagaactcagcc

SEQ ID NO: 25938 - DNA, 25 bp, Mus musculus
agccttcagtcagaactcagccctt

SEQ ID NO: 25939 - DNA, 25 bp, Mus musculus
cttcagtcagaactcagcccttatt

SEQ ID NO: 25940 - DNA, 25 bp, Mus musculus
tctcatccagcatatgagagtccat

SEQ ID NO: 25941 - DNA, 25 bp, Mus musculus
cagtcagaactcagcccttattctg

SEQ ID NO: 25942 - DNA, 25 bp, Mus musculus
acccttcgaatgcaaagagtgtgga

SEQ ID NO: 25943 - DNA, 25 bp, Mus musculus
gactaactccagccttcgaaggcac

SEQ ID NO: 25944 - DNA, 25 bp, Mus musculus
cagccttcgaaggcaccagagaatt

SEQ ID NO: 25945 - DNA, 25 bp, Mus musculus
ccttcgaaggcaccagagaattcac

SEQ ID NO: 25946 - DNA, 25 bp, Mus musculus
accctttgcttgcactgagtgtggc

SEQ ID NO: 25947 - DNA, 25 bp, Mus musculus
tgcttgcactgagtgtggcaaggcc

SEQ ID NO: 25948 - DNA, 25 bp, Mus musculus
cttcattcagagctcacatctgatt

SEQ ID NO: 25949 - DNA, 25 bp, Mus musculus
cggccctacattgcaagtgcttacc

SEQ ID NO: 25950 - DNA, 25 bp, Mus musculus
tacattgcaagtgcttaccgctcca

SEQ ID NO: 25951 - DNA, 25 bp, Mus musculus
aagcctatgcattatcttgcctgaa

SEQ ID NO: 25952 - DNA, 25 bp, Mus musculus
tatcttgcctgaaagtcaagcctgc

SEQ ID NO: 25953 - DNA, 25 bp, Mus musculus
aagtcaagcctgcatatcgtggtct

SEQ ID NO: 25954 - DNA, 25 bp, Mus musculus
catatcgtggtctccatcaggccag

SEQ ID NO: 25955 - DNA, 25 bp, Mus musculus
gtggtctccatcaggccagaaatca

SEQ ID NO: 25956 - DNA, 25 bp, Mus musculus
tccatcaggccagaaatcatatctc

SEQ ID NO: 25957 - DNA, 25 bp, Mus musculus
gaaatcatatctctccattacacat

SEQ ID NO: 25958 - DNA, 25 bp, Mus musculus
atatctctccattacacatgtatga

SEQ ID NO: 25959 - DNA, 25 bp, Mus musculus
ctccattacacatgtatgatacata

SEQ ID NO: 25960 - DNA, 25 bp, Mus musculus
tcatcaattgtattttctagtaggt

SEQ ID NO: 25961 - DNA, 25 bp, Mus musculus
gcaagtgcttaccgctccaagtctc

SEQ ID NO: 25962 - DNA, 25 bp, Mus musculus
atccctttctacgttgtgatccttg

SEQ ID NO: 25963 - DNA, 25 bp, Mus musculus
atccttgtcctgattgggatgctgg

SEQ ID NO: 25964 - DNA, 25 bp, Mus musculus
gtctattccccaaggatgaaatgga

SEQ ID NO: 25965 - DNA, 25 bp, Mus musculus
gatgacttctcaagcgaagagcaat

SEQ ID NO: 25966 - DNA, 25 bp, Mus musculus
cagattccacaatgtcacaagtaat

SEQ ID NO: 25967 - DNA, 25 bp, Mus musculus
tgtcacaagtaattctcttcagtgg

SEQ ID NO: 25968 - DNA, 25 bp, Mus musculus
aagtaattctcttcagtggacagaa

SEQ ID NO: 25969 - DNA, 25 bp, Mus musculus
tatgatgcacaccatgggacagaac

SEQ ID NO: 25970 - DNA, 25 bp, Mus musculus
gcacaccatgggacagaacttccag

SEQ ID NO: 25971 - DNA, 25 bp, Mus musculus
atcttggcttcgattcttttgggtg

SEQ ID NO: 25972 - DNA, 25 bp, Mus musculus
gcttcgattcttttgggtgcagttt

SEQ ID NO: 25973 - DNA, 25 bp, Mus musculus
tcgattcttttgggtgcagttttga

SEQ ID NO: 25974 - DNA, 25 bp, Mus musculus
gagcaacattctgctgttaacagac

SEQ ID NO: 25975 - DNA, 25 bp, Mus musculus
caacattctgctgttaacagacagt

SEQ ID NO: 25976 - DNA, 25 bp, Mus musculus
cattctgctgttaacagacagttga

SEQ ID NO: 25977 - DNA, 25 bp, Mus musculus
tgaagccacacaatggacaaaatcc

SEQ ID NO: 25978 - DNA, 25 bp, Mus musculus
agccacacaatggacaaaatccatg

SEQ ID NO: 25979 - DNA, 25 bp, Mus musculus
gacaaaatccatgtcaattaccaca

SEQ ID NO: 25980 - DNA, 25 bp, Mus musculus
aattaccacaagaaattgtcgatga

SEQ ID NO: 25981 - DNA, 25 bp, Mus musculus
acagaacttccagaaatggggcttg

SEQ ID NO: 25982 - DNA, 25 bp, Mus musculus
tgtgttgctcatccaactttgaatt

SEQ ID NO: 25983 - DNA, 25 bp, Mus musculus
gttgctcatccaactttgaatttta

SEQ ID NO: 25984 - DNA, 25 bp, Mus musculus
tgcaacaacaaaggcaactgtcact

SEQ ID NO: 25985 - DNA, 25 bp, Mus musculus
aaaggcaactgtcactgtgttcgag

SEQ ID NO: 25986 - DNA, 25 bp, Mus musculus
ggcaactgtcactgtgttcgaggat

SEQ ID NO: 25987 - DNA, 25 bp, Mus musculus
cactgtgttcgaggatggcagccac

SEQ ID NO: 25988 - DNA, 25 bp, Mus musculus
tggcagccaccacattgtttacaaa

SEQ ID NO: 25989 - DNA, 25 bp, Mus musculus
cacatggattcttccaagtgtgatt

SEQ ID NO: 25990 - DNA, 25 bp, Mus musculus
gattcttccaagtgtgattcaacta

SEQ ID NO: 25991 - DNA, 25 bp, Mus musculus
attctctacatatctctgcccttac

SEQ ID NO: 25992 - DNA, 25 bp, Mus musculus
ctctacatatctctgcccttacttg

SEQ ID NO: 25993 - DNA, 25 bp, Mus musculus
aaactgagtcgtgtatgtgacagag

SEQ ID NO: 25994 - DNA, 25 bp, Mus musculus
agcgacagctctacaacagaagata

SEQ ID NO: 25995 - DNA, 25 bp, Mus musculus
gacagctctacaacagaagatagcg

SEQ ID NO: 25996 - DNA, 25 bp, Mus musculus
taatcaagtattgctaccccaaaag

SEQ ID NO: 25997 - DNA, 25 bp, Mus musculus
tcaagtattgctaccccaaaagaag

SEQ ID NO: 25998 - DNA, 25 bp, Mus musculus
gctaccccaaaagaagataatctgg

SEQ ID NO: 25999 - DNA, 25 bp, Mus musculus
cactctaaaccatgaactaataaat

SEQ ID NO: 26000 - DNA, 25 bp, Mus musculus
tctaaaccatgaactaataaatcag

SEQ ID NO: 26001 - DNA, 25 bp, Mus musculus
tcttccaagtgtgattcaactagag

SEQ ID NO: 26002 - DNA, 25 bp, Mus musculus
agagattgcaacgaccatggggttt

SEQ ID NO: 26003 - DNA, 25 bp, Mus musculus
gattgcaacgaccatggggtttgca

SEQ ID NO: 26004 - DNA, 25 bp, Mus musculus
tgcaacaatttacagcattgccact

SEQ ID NO: 26005 - DNA, 25 bp, Mus musculus
aatttacagcattgccactgtgata

SEQ ID NO: 26006 - DNA, 25 bp, Mus musculus
cattgccactgtgatataggatata

SEQ ID NO: 26007 - DNA, 25 bp, Mus musculus
aatcagcttcagctcattctctaca

SEQ ID NO: 26008 - DNA, 25 bp, Mus musculus
cttcagctcattctctacatatctc

SEQ ID NO: 26009 - DNA, 25 bp, Mus musculus
gctcagttgcaacctaaagaggtgg

SEQ ID NO: 26010 - DNA, 25 bp, Mus musculus
cataagacttattccatggctacca

SEQ ID NO: 26011 - DNA, 25 bp, Mus musculus
gctgccccagaccagatagcaggtg

SEQ ID NO: 26012 - DNA, 25 bp, Mus musculus
gtgcagcttcctgtccaggtaccaa

SEQ ID NO: 26013 - DNA, 25 bp, Mus musculus
cagcttcctgtccaggtaccaaaca

SEQ ID NO: 26014 - DNA, 25 bp, Mus musculus
caggtaccaaacaccgatattcagg

SEQ ID NO: 26015 - DNA, 25 bp, Mus musculus
gtaccaaacaccgatattcaggcca

SEQ ID NO: 26016 - DNA, 25 bp, Mus musculus
aacaccgatattcaggccagccagc

SEQ ID NO: 26017 - DNA, 25 bp, Mus musculus
gatattcaggccagccagcgacgtc

SEQ ID NO: 26018 - DNA, 25 bp, Mus musculus
attcaggccagccagcgacgtcatg

SEQ ID NO: 26019 - DNA, 25 bp, Mus musculus
caggccagccagcgacgtcatgtgt

SEQ ID NO: 26020 - DNA, 25 bp, Mus musculus
cagcgacgtcatgtgtgtgtggact

SEQ ID NO: 26021 - DNA, 25 bp, Mus musculus
acttattccatggctaccaagtcct

SEQ ID NO: 26022 - DNA, 25 bp, Mus musculus
tattccatggctaccaagtcctctg

SEQ ID NO: 26023 - DNA, 25 bp, Mus musculus
tccatggctaccaagtcctctgcag

SEQ ID NO: 26024 - DNA, 25 bp, Mus musculus
accaagtcctctgcaggggcacagc

SEQ ID NO: 26025 - DNA, 25 bp, Mus musculus
aagtcctctgcaggggcacagccac

SEQ ID NO: 26026 - DNA, 25 bp, Mus musculus
tcctctgcaggggcacagccaccta

SEQ ID NO: 26027 - DNA, 25 bp, Mus musculus
ggggcacagccacctaccaaagctg

SEQ ID NO: 26028 - DNA, 25 bp, Mus musculus
aaagctgccccagaccagatagcag

SEQ ID NO: 26029 - DNA, 25 bp, Mus musculus
tcttttctccaccgagctttcagac

SEQ ID NO: 26030 - DNA, 25 bp, Mus musculus
caccgagctttcagacgcccagggt

SEQ ID NO: 26031 - DNA, 25 bp, Mus musculus
cctatcgtctggaagcgaaggcagg

SEQ ID NO: 26032 - DNA, 25 bp, Mus musculus
catcgtcagcatctccctgggcaag

SEQ ID NO: 26033 - DNA, 25 bp, Mus musculus
cgtcagcatctccctgggcaagatc

SEQ ID NO: 26034 - DNA, 25 bp, Mus musculus
catctccctgggcaagatctacaac

SEQ ID NO: 26035 - DNA, 25 bp, Mus musculus
ctccctgggcaagatctacaactcg

SEQ ID NO: 26036 - DNA, 25 bp, Mus musculus
caagatctacaactcgcgggtccag

SEQ ID NO: 26037 - DNA, 25 bp, Mus musculus
cggcatcaagctgcacaagaacctc

SEQ ID NO: 26038 - DNA, 25 bp, Mus musculus
catcaagctgcacaagaacctcttg

SEQ ID NO: 26039 - DNA, 25 bp, Mus musculus
caagctgcacaagaacctcttggtg

SEQ ID NO: 26040 - DNA, 25 bp, Mus musculus
ggtgtcgttggtgctgcgcacgccc

SEQ ID NO: 26041 - DNA, 25 bp, Mus musculus
ttcagacgcccagggtacaaccaca

SEQ ID NO: 26042 - DNA, 25 bp, Mus musculus
gggtacaaccacagaggaagacctg

SEQ ID NO: 26043 - DNA, 25 bp, Mus musculus
tcctctcgcagcttcagaaggcaag

SEQ ID NO: 26044 - DNA, 25 bp, Mus musculus
tctcgcagcttcagaaggcaagcag

SEQ ID NO: 26045 - DNA, 25 bp, Mus musculus
agcttcagaaggcaagcaggcgttc

SEQ ID NO: 26046 - DNA, 25 bp, Mus musculus
caagcaggcgttcaccctatcgtct

SEQ ID NO: 26047 - DNA, 25 bp, Mus musculus
gcaggcgttcaccctatcgtctgga

SEQ ID NO: 26048 - DNA, 25 bp, Mus musculus
caccctatcgtctggaagcgaaggc

SEQ ID NO: 26049 - DNA, 25 bp, Mus musculus
aggatcacagttccttattgtgaca

SEQ ID NO: 26050 - DNA, 25 bp, Mus musculus
acagttccttattgtgacatccttc

SEQ ID NO: 26051 - DNA, 25 bp, Mus musculus
agccttgagcccagcagggttttct

SEQ ID NO: 26052 - DNA, 25 bp, Mus musculus
gagcccagcagggttttctagaggt

SEQ ID NO: 26053 - DNA, 25 bp, Mus musculus
gagcacttccacctggactcaagtt

SEQ ID NO: 26054 - DNA, 25 bp, Mus musculus
tcctggtaaaacaccttggagacag

SEQ ID NO: 26055 - DNA, 25 bp, Mus musculus
aatttcctgtccagacaccaactgg

SEQ ID NO: 26056 - DNA, 25 bp, Mus musculus
agacaccaactggcctttgcttctg

SEQ ID NO: 26057 - DNA, 25 bp, Mus musculus
caactggcctttgcttctgtgcctt

SEQ ID NO: 26058 - DNA, 25 bp, Mus musculus
gcctttgcttctgtgccttgtgaat

SEQ ID NO: 26059 - DNA, 25 bp, Mus musculus
gcttctgtgccttgtgaattagtaa

SEQ ID NO: 26060 - DNA, 25 bp, Mus musculus
ccccttcagctgtgtacaataaagt

SEQ ID NO: 26061 - DNA, 25 bp, Mus musculus
ccttattgtgacatccttcccttgg

SEQ ID NO: 26062 - DNA, 25 bp, Mus musculus
tgtgacatccttcccttggcctgga

SEQ ID NO: 26063 - DNA, 25 bp, Mus musculus
cttgactcagctggaggagcctgga

SEQ ID NO: 26064 - DNA, 25 bp, Mus musculus
ggttccctgtcacagtagtactgtt

SEQ ID NO: 26065 - DNA, 25 bp, Mus musculus
tactgttgacacctgccctgagctg

SEQ ID NO: 26066 - DNA, 25 bp, Mus musculus
tgagctgttcactgccaggcccacg

SEQ ID NO: 26067 - DNA, 25 bp, Mus musculus
gttcactgccaggcccacgtggagc

SEQ ID NO: 26068 - DNA, 25 bp, Mus musculus
cccatgacagacactctgtccctaa

SEQ ID NO: 26069 - DNA, 25 bp, Mus musculus
tgcccagaatacctgagctctgagc

SEQ ID NO: 26070 - DNA, 25 bp, Mus musculus
ccagaatacctgagctctgagcgta

SEQ ID NO: 26071 - DNA, 25 bp, Mus musculus
cccagaccctgaggcagcaacttta

SEQ ID NO: 26072 - DNA, 25 bp, Mus musculus
ccctgaggcagcaactttacccaga

SEQ ID NO: 26073 - DNA, 25 bp, Mus musculus
ggcagcaactttacccagagggctc

SEQ ID NO: 26074 - DNA, 25 bp, Mus musculus
agcaactttacccagagggctctgt

SEQ ID NO: 26075 - DNA, 25 bp, Mus musculus
aactttacccagagggctctgtgtg

SEQ ID NO: 26076 - DNA, 25 bp, Mus musculus
acccagagggctctgtgtgcagtct

SEQ ID NO: 26077 - DNA, 25 bp, Mus musculus
cagagggctctgtgtgcagtctgtg

SEQ ID NO: 26078 - DNA, 25 bp, Mus musculus
agggctctgtgtgcagtctgtgaag

SEQ ID NO: 26079 - DNA, 25 bp, Mus musculus
gaagaccagcaagctttccggacct

SEQ ID NO: 26080 - DNA, 25 bp, Mus musculus
gaccagcaagctttccggaccttgg

SEQ ID NO: 26081 - DNA, 25 bp, Mus musculus
gaatacctgagctctgagcgtagtg

SEQ ID NO: 26082 - DNA, 25 bp, Mus musculus
ctgagctctgagcgtagtgcggccc

SEQ ID NO: 26083 - DNA, 25 bp, Mus musculus
agctctgagcgtagtgcggcccagc

SEQ ID NO: 26084 - DNA, 25 bp, Mus musculus
cagcagcgtgcgtcggtttgaaagc

SEQ ID NO: 26085 - DNA, 25 bp, Mus musculus
gtttgaaagctcggctccaacccag

SEQ ID NO: 26086 - DNA, 25 bp, Mus musculus
ggctccaacccagcggacttcagaa

SEQ ID NO: 26087 - DNA, 25 bp, Mus musculus
tccaacccagcggacttcagaagca

SEQ ID NO: 26088 - DNA, 25 bp, Mus musculus
ccagcggacttcagaagcagcgggt

SEQ ID NO: 26089 - DNA, 25 bp, Mus musculus
aatcgacagctgagcagaagagtgt

SEQ ID NO: 26090 - DNA, 25 bp, Mus musculus
atatgaaatacctctgatcgctggt

SEQ ID NO: 26091 - DNA, 25 bp, Mus musculus
tgagcaacttctctgggctgatcta

SEQ ID NO: 26092 - DNA, 25 bp, Mus musculus
agcaacttctctgggctgatctagc

SEQ ID NO: 26093 - DNA, 25 bp, Mus musculus
acttctctgggctgatctagcatgt

SEQ ID NO: 26094 - DNA, 25 bp, Mus musculus
ttctctgggctgatctagcatgtga

SEQ ID NO: 26095 - DNA, 25 bp, Mus musculus
ctctgggctgatctagcatgtgaat

SEQ ID NO: 26096 - DNA, 25 bp, Mus musculus
tgaatactactgagagcgtagtgga

SEQ ID NO: 26097 - DNA, 25 bp, Mus musculus
aatactactgagagcgtagtggata

SEQ ID NO: 26098 - DNA, 25 bp, Mus musculus
gatattcagggcgatcttgggtaca

SEQ ID NO: 26099 - DNA, 25 bp, Mus musculus
tattcagggcgatcttgggtacatc

SEQ ID NO: 26100 - DNA, 25 bp, Mus musculus
tcttgggtacatctatctgtgcttt

SEQ ID NO: 26101 - DNA, 25 bp, Mus musculus
atgaaatacctctgatcgctggtgc

SEQ ID NO: 26102 - DNA, 25 bp, Mus musculus
aatacctctgatcgctggtgcgtgt

SEQ ID NO: 26103 - DNA, 25 bp, Mus musculus
tacctctgatcgctggtgcgtgtcc

SEQ ID NO: 26104 - DNA, 25 bp, Mus musculus
cgtgtccctgaacgtgagcaacttc

SEQ ID NO: 26105 - DNA, 25 bp, Mus musculus
tgtccctgaacgtgagcaacttctc

SEQ ID NO: 26106 - DNA, 25 bp, Mus musculus
tccctgaacgtgagcaacttctctg

SEQ ID NO: 26107 - DNA, 25 bp, Mus musculus
aacgtgagcaacttctctgggctga

SEQ ID NO: 26108 - DNA, 25 bp, Mus musculus
cgtgagcaacttctctgggctgatc

SEQ ID NO: 26109 - DNA, 25 bp, Mus musculus
gaaattgtctcaaagcctgtgcatc

SEQ ID NO: 26110 - DNA, 25 bp, Mus musculus
aaattgtctcaaagcctgtgcatct

SEQ ID NO: 26111 - DNA, 25 bp, Mus musculus
ctgcgcgtgtgcttggattggaaga

SEQ ID NO: 26112 - DNA, 25 bp, Mus musculus
gaagagtctgttcgctggagctcca

SEQ ID NO: 26113 - DNA, 25 bp, Mus musculus
gagtctgttcgctggagctccacgc

SEQ ID NO: 26114 - DNA, 25 bp, Mus musculus
agtctgttcgctggagctccacgca

SEQ ID NO: 26115 - DNA, 25 bp, Mus musculus
tggagctccacgcagccagaagtcg

SEQ ID NO: 26116 - DNA, 25 bp, Mus musculus
agctccacgcagccagaagtcggaa

SEQ ID NO: 26117 - DNA, 25 bp, Mus musculus
gctccacgcagccagaagtcggaaa

SEQ ID NO: 26118 - DNA, 25 bp, Mus musculus
tccacgcagccagaagtcggaaagt

SEQ ID NO: 26119 - DNA, 25 bp, Mus musculus
ccacgcagccagaagtcggaaagtg

SEQ ID NO: 26120 - DNA, 25 bp, Mus musculus
tcctctatgtaggttccaaactaag

SEQ ID NO: 26121 - DNA, 25 bp, Mus musculus
attgtctcaaagcctgtgcatctat

SEQ ID NO: 26122 - DNA, 25 bp, Mus musculus
ttgtctcaaagcctgtgcatctatc

SEQ ID NO: 26123 - DNA, 25 bp, Mus musculus
gtctcaaagcctgtgcatctatctg

SEQ ID NO: 26124 - DNA, 25 bp, Mus musculus
tcaaagcctgtgcatctatctgcgc

SEQ ID NO: 26125 - DNA, 25 bp, Mus musculus
caaagcctgtgcatctatctgcgcg

SEQ ID NO: 26126 - DNA, 25 bp, Mus musculus
catctatctgcgcgtgtgcttggat

SEQ ID NO: 26127 - DNA, 25 bp, Mus musculus
ctatctgcgcgtgtgcttggattgg

SEQ ID NO: 26128 - DNA, 25 bp, Mus musculus
tatctgcgcgtgtgcttggattgga

SEQ ID NO: 26129 - DNA, 25 bp, Mus musculus
tgctaagtgcctagagccaatcccc

SEQ ID NO: 26130 - DNA, 25 bp, Mus musculus
taagtgcctagagccaatccccaat

SEQ ID NO: 26131 - DNA, 25 bp, Mus musculus
ttccgatgctcactaccgaaccacg

SEQ ID NO: 26132 - DNA, 25 bp, Mus musculus
tccgatgctcactaccgaaccacgt

SEQ ID NO: 26133 - DNA, 25 bp, Mus musculus
cgatgctcactaccgaaccacgtac

SEQ ID NO: 26134 - DNA, 25 bp, Mus musculus
ggtgctgctacgactctacggggcc

SEQ ID NO: 26135 - DNA, 25 bp, Mus musculus
gctgctacgactctacggggccatc

SEQ ID NO: 26136 - DNA, 25 bp, Mus musculus
tgctacgactctacggggccatcct

SEQ ID NO: 26137 - DNA, 25 bp, Mus musculus
gctacgactctacggggccatcctg

SEQ ID NO: 26138 - DNA, 25 bp, Mus musculus
tacgactctacggggccatcctgca

SEQ ID NO: 26139 - DNA, 25 bp, Mus musculus
acgactctacggggccatcctgcag

SEQ ID NO: 26140 - DNA, 25 bp, Mus musculus
gactctacggggccatcctgcaggg

SEQ ID NO: 26141 - DNA, 25 bp, Mus musculus
aagtgcctagagccaatccccaatc

SEQ ID NO: 26142 - DNA, 25 bp, Mus musculus
actctacggggccatcctgcagggt

SEQ ID NO: 26143 - DNA, 25 bp, Mus musculus
gtgcctagagccaatccccaatcgg

SEQ ID NO: 26144 - DNA, 25 bp, Mus musculus
cctagagccaatccccaatcggcgg

SEQ ID NO: 26145 - DNA, 25 bp, Mus musculus
ccgagcctatcagtggtgccgggag

SEQ ID NO: 26146 - DNA, 25 bp, Mus musculus
gagcctatcagtggtgccgggagta

SEQ ID NO: 26147 - DNA, 25 bp, Mus musculus
cctatcagtggtgccgggagtacct

SEQ ID NO: 26148 - DNA, 25 bp, Mus musculus
gtcccgtgagcggaggcctcagcaa

SEQ ID NO: 26149 - DNA, 25 bp, Mus musculus
tcttccgatgctcactaccgaacca

SEQ ID NO: 26150 - DNA, 25 bp, Mus musculus
gctcgctaacttcccgaggcacgtg

SEQ ID NO: 26151 - DNA, 25 bp, Mus musculus
taacttcccgaggcacgtgatagcg

SEQ ID NO: 26152 - DNA, 25 bp, Mus musculus
ctccgcgaagctgaagcaactgaaa

SEQ ID NO: 26153 - DNA, 25 bp, Mus musculus
gagctcacctttactgtgtgctgtt

SEQ ID NO: 26154 - DNA, 25 bp, Mus musculus
actgtgtgctgttctgggtagtgct

SEQ ID NO: 26155 - DNA, 25 bp, Mus musculus
cctggcctagcagcatccggaaagt

SEQ ID NO: 26156 - DNA, 25 bp, Mus musculus
ctagcagcatccggaaagtgtttag

SEQ ID NO: 26157 - DNA, 25 bp, Mus musculus
cttgaaaacattaccgtctgtagct

SEQ ID NO: 26158 - DNA, 25 bp, Mus musculus
aacattaccgtctgtagctgagtgc

SEQ ID NO: 26159 - DNA, 25 bp, Mus musculus
attaccgtctgtagctgagtgctgt

SEQ ID NO: 26160 - DNA, 25 bp, Mus musculus
accgtctgtagctgagtgctgttta

SEQ ID NO: 26161 - DNA, 25 bp, Mus musculus
gtctgtagctgagtgctgtttaaat

SEQ ID NO: 26162 - DNA, 25 bp, Mus musculus
gatagcgtgcgccaagcagaaggct

SEQ ID NO: 26163 - DNA, 25 bp, Mus musculus
cattggaacctcgctgggatgtgac

SEQ ID NO: 26164 - DNA, 25 bp, Mus musculus
atgtgacgaagccgagccggctgca

SEQ ID NO: 26165 - DNA, 25 bp, Mus musculus
cgaagccgagccggctgcaaagaga

SEQ ID NO: 26166 - DNA, 25 bp, Mus musculus
aattattctggagttcctgtcgaag

SEQ ID NO: 26167 - DNA, 25 bp, Mus musculus
tctggagttcctgtcgaaggtcaag

SEQ ID NO: 26168 - DNA, 25 bp, Mus musculus
gccctttactgccatgtcggaggag

SEQ ID NO: 26169 - DNA, 25 bp, Mus musculus
tactgccatgtcggaggagagcatc

SEQ ID NO: 26170 - DNA, 25 bp, Mus musculus
cgatgacgagtccttgggctgcatc

SEQ ID NO: 26171 - DNA, 25 bp, Mus musculus
gatgacgagtccttgggctgcatct

SEQ ID NO: 26172 - DNA, 25 bp, Mus musculus
ggaactgccggcagttcaatctacg

SEQ ID NO: 26173 - DNA, 25 bp, Mus musculus
aactgccggcagttcaatctacgga

SEQ ID NO: 26174 - DNA, 25 bp, Mus musculus
tgccggcagttcaatctacggagaa

SEQ ID NO: 26175 - DNA, 25 bp, Mus musculus
gccggcagttcaatctacggagaaa

SEQ ID NO: 26176 - DNA, 25 bp, Mus musculus
tcatcttaaagcttacgggtcctgg

SEQ ID NO: 26177 - DNA, 25 bp, Mus musculus
ttacgggtcctggcaccttgtcgat

SEQ ID NO: 26178 - DNA, 25 bp, Mus musculus
ggcaccttgtcgatggcaattgcgg

SEQ ID NO: 26179 - DNA, 25 bp, Mus musculus
gcaccttgtcgatggcaattgcggg

SEQ ID NO: 26180 - DNA, 25 bp, Mus musculus
caccttgtcgatggcaattgcggga

SEQ ID NO: 26181 - DNA, 25 bp, Mus musculus
accttgtcgatggcaattgcgggac

SEQ ID NO: 26182 - DNA, 25 bp, Mus musculus
atgacgagtccttgggctgcatctc

SEQ ID NO: 26183 - DNA, 25 bp, Mus musculus
tgacgagtccttgggctgcatctcc

SEQ ID NO: 26184 - DNA, 25 bp, Mus musculus
acgagtccttgggctgcatctcctt

SEQ ID NO: 26185 - DNA, 25 bp, Mus musculus
cgagtccttgggctgcatctccttc

SEQ ID NO: 26186 - DNA, 25 bp, Mus musculus
gagtccttgggctgcatctccttcg

SEQ ID NO: 26187 - DNA, 25 bp, Mus musculus
agtccttgggctgcatctccttcga

SEQ ID NO: 26188 - DNA, 25 bp, Mus musculus
gtccttgggctgcatctccttcgag

SEQ ID NO: 26189 - DNA, 25 bp, Mus musculus
tccttgggctgcatctccttcgagc

SEQ ID NO: 26190 - DNA, 25 bp, Mus musculus
cagccgtctgtgctgcgccggacct

SEQ ID NO: 26191 - DNA, 25 bp, Mus musculus
tctgtgctgcgccggacctacacgc

SEQ ID NO: 26192 - DNA, 25 bp, Mus musculus
atgtccaagtaccagctgggcatgc

SEQ ID NO: 26193 - DNA, 25 bp, Mus musculus
cagctgggcatgctgcacttcagca

SEQ ID NO: 26194 - DNA, 25 bp, Mus musculus
ggcatgctgcacttcagcacacagt

SEQ ID NO: 26195 - DNA, 25 bp, Mus musculus
atgctgcacttcagcacacagtatg

SEQ ID NO: 26196 - DNA, 25 bp, Mus musculus
ctgcacttcagcacacagtatgacc

SEQ ID NO: 26197 - DNA, 25 bp, Mus musculus
ttcagcacacagtatgacctgctac

SEQ ID NO: 26198 - DNA, 25 bp, Mus musculus
agcacacagtatgacctgctacaca

SEQ ID NO: 26199 - DNA, 25 bp, Mus musculus
acacagtatgacctgctacacaacc

SEQ ID NO: 26200 - DNA, 25 bp, Mus musculus
tatgacctgctacacaaccacctca

SEQ ID NO: 26201 - DNA, 25 bp, Mus musculus
atctcccatgatggctcgcgccagg

SEQ ID NO: 26202 - DNA, 25 bp, Mus musculus
tacacgcccgatgactacttccgga

SEQ ID NO: 26203 - DNA, 25 bp, Mus musculus
gatgactacttccggaagtttgagc

SEQ ID NO: 26204 - DNA, 25 bp, Mus musculus
tccctcgactccaatcttgatgacg

SEQ ID NO: 26205 - DNA, 25 bp, Mus musculus
tccaatcttgatgacgtagactctc

SEQ ID NO: 26206 - DNA, 25 bp, Mus musculus
gacgtagactctctgactgacgagg

SEQ ID NO: 26207 - DNA, 25 bp, Mus musculus
gtagactctctgactgacgaggaga

SEQ ID NO: 26208 - DNA, 25 bp, Mus musculus
gactctctgactgacgaggagatca

SEQ ID NO: 26209 - DNA, 25 bp, Mus musculus
atcatgtccaagtaccagctgggca

SEQ ID NO: 26210 - DNA, 25 bp, Mus musculus
gcaccatgtctggttgtgcagccga

SEQ ID NO: 26211 - DNA, 25 bp, Mus musculus
cagccgactgccagtactgggagag

SEQ ID NO: 26212 - DNA, 25 bp, Mus musculus
cctatgcctacggggtgatggacag

SEQ ID NO: 26213 - DNA, 25 bp, Mus musculus
ctgaagaggcctacgaccttggccg

SEQ ID NO: 26214 - DNA, 25 bp, Mus musculus
ttggccgcagagctattgcttatgc

SEQ ID NO: 26215 - DNA, 25 bp, Mus musculus
ctattgcttatgctacccacagaga

SEQ ID NO: 26216 - DNA, 25 bp, Mus musculus
cttatgctacccacagagacaacta

SEQ ID NO: 26217 - DNA, 25 bp, Mus musculus
ctacccacagagacaactattctgg

SEQ ID NO: 26218 - DNA, 25 bp, Mus musculus
acatgtaccacatgaaggaagacgg

SEQ ID NO: 26219 - DNA, 25 bp, Mus musculus
gttccgatgtcagtgacctgctgta

SEQ ID NO: 26220 - DNA, 25 bp, Mus musculus
atgtcagtgacctgctgtacaagta

SEQ ID NO: 26221 - DNA, 25 bp, Mus musculus
gtgacctgctgtacaagtacggaga

SEQ ID NO: 26222 - DNA, 25 bp, Mus musculus
gggaacgcatctccgtgtctgcagc

SEQ ID NO: 26223 - DNA, 25 bp, Mus musculus
ccgtgtctgcagcatccaagctgct

SEQ ID NO: 26224 - DNA, 25 bp, Mus musculus
catccaagctgctttccaacatgat

SEQ ID NO: 26225 - DNA, 25 bp, Mus musculus
agctgctttccaacatgatgctgca

SEQ ID NO: 26226 - DNA, 25 bp, Mus musculus
tttccaacatgatgctgcagtaccg

SEQ ID NO: 26227 - DNA, 25 bp, Mus musculus
acatgatgctgcagtaccgggggat

SEQ ID NO: 26228 - DNA, 25 bp, Mus musculus
tgttttccactggcagcgggaacac

SEQ ID NO: 26229 - DNA, 25 bp, Mus musculus
ggaacacctatgcctacggggtgat

SEQ ID NO: 26230 - DNA, 25 bp, Mus musculus
cggccatagtctgcaaggttggcaa

SEQ ID NO: 26231 - DNA, 25 bp, Mus musculus
ccatagtctgcaaggttggcaacga

SEQ ID NO: 26232 - DNA, 25 bp, Mus musculus
cagcctccataattgtcaataatga

SEQ ID NO: 26233 - DNA, 25 bp, Mus musculus
agaatatcatcgtcatagtggctgg

SEQ ID NO: 26234 - DNA, 25 bp, Mus musculus
atatcatcgtcatagtggctggagc

SEQ ID NO: 26235 - DNA, 25 bp, Mus musculus
tcatcgtcatagtggctggagcaaa

SEQ ID NO: 26236 - DNA, 25 bp, Mus musculus
agaaggcagccagtgtcattagccg

SEQ ID NO: 26237 - DNA, 25 bp, Mus musculus
cagccagtgtcattagccgagccaa

SEQ ID NO: 26238 - DNA, 25 bp, Mus musculus
gtgtcattagccgagccaaagtgat

SEQ ID NO: 26239 - DNA, 25 bp, Mus musculus
tcattagccgagccaaagtgatgat

SEQ ID NO: 26240 - DNA, 25 bp, Mus musculus
attagccgagccaaagtgatgatat

SEQ ID NO: 26241 - DNA, 25 bp, Mus musculus
tagccgagccaaagtgatgatatgc

SEQ ID NO: 26242 - DNA, 25 bp, Mus musculus
atcatatttctacagagtttacata

SEQ ID NO: 26243 - DNA, 25 bp, Mus musculus
tagaaataagcccggcagcttctct

SEQ ID NO: 26244 - DNA, 25 bp, Mus musculus
atatttctacagagtttacatatca

SEQ ID NO: 26245 - DNA, 25 bp, Mus musculus
agtttacatatcagaccagagatgc

SEQ ID NO: 26246 - DNA, 25 bp, Mus musculus
ttacatatcagaccagagatgcagc

SEQ ID NO: 26247 - DNA, 25 bp, Mus musculus
catatcagaccagagatgcagctac

SEQ ID NO: 26248 - DNA, 25 bp, Mus musculus
ctacaggaacagcctccataattgt

SEQ ID NO: 26249 - DNA, 25 bp, Mus musculus
caggaacagcctccataattgtcaa

SEQ ID NO: 26250 - DNA, 25 bp, Mus musculus
gaacagcctccataattgtcaataa

SEQ ID NO: 26251 - DNA, 25 bp, Mus musculus
agtggctcttctggctaccgtcacc

SEQ ID NO: 26252 - DNA, 25 bp, Mus musculus
tctgttgcaagcctacttctcccta

SEQ ID NO: 26253 - DNA, 25 bp, Mus musculus
ctatttccagggatacgcgcgctca

SEQ ID NO: 26254 - DNA, 25 bp, Mus musculus
atacgcgcgctcagcgcaactcagg

SEQ ID NO: 26255 - DNA, 25 bp, Mus musculus
gcgctcagcgcaactcaggctgact

SEQ ID NO: 26256 - DNA, 25 bp, Mus musculus
tgcactgggcttgctagtccacttc

SEQ ID NO: 26257 - DNA, 25 bp, Mus musculus
cggcacgctacggactgcgctcttc

SEQ ID NO: 26258 - DNA, 25 bp, Mus musculus
gctacggactgcgctcttcagatgg

SEQ ID NO: 26259 - DNA, 25 bp, Mus musculus
gactgcgctcttcagatggctccag

SEQ ID NO: 26260 - DNA, 25 bp, Mus musculus
gctcttcagatggctccagatgctc

SEQ ID NO: 26261 - DNA, 25 bp, Mus musculus
gctccagatgctcctgccgatggcc

SEQ ID NO: 26262 - DNA, 25 bp, Mus musculus
cctgccgatggcctgaggcgaaggc

SEQ ID NO: 26263 - DNA, 25 bp, Mus musculus
gcaagcctacttctccctacaggtg

SEQ ID NO: 26264 - DNA, 25 bp, Mus musculus
ctccctacaggtgatctctgcacga

SEQ ID NO: 26265 - DNA, 25 bp, Mus musculus
acaggtgatctctgcacgaagggct

SEQ ID NO: 26266 - DNA, 25 bp, Mus musculus
gatctctgcacgaagggctttccac

SEQ ID NO: 26267 - DNA, 25 bp, Mus musculus
tgcacgaagggctttccacgtgtcg

SEQ ID NO: 26268 - DNA, 25 bp, Mus musculus
aaactgcagcgagtactttccgctg

SEQ ID NO: 26269 - DNA, 25 bp, Mus musculus
cgcagccctgtgcggactgttctac

SEQ ID NO: 26270 - DNA, 25 bp, Mus musculus
cggactgttctacctgttcgcgcgc

SEQ ID NO: 26271 - DNA, 25 bp, Mus musculus
ggccggtacaaccttaagcagtgca

SEQ ID NO: 26272 - DNA, 25 bp, Mus musculus
cggtacaaccttaagcagtgcaaga

SEQ ID NO: 26273 - DNA, 25 bp, Mus musculus
gagttcccagttttgacacatgtat

SEQ ID NO: 26274 - DNA, 25 bp, Mus musculus
ttcccagttttgacacatgtattta

SEQ ID NO: 26275 - DNA, 25 bp, Mus musculus
aagagaccaacactgagctcagaag

SEQ ID NO: 26276 - DNA, 25 bp, Mus musculus
agaccaacactgagctcagaagccc

SEQ ID NO: 26277 - DNA, 25 bp, Mus musculus
gctgttaactgaacctccttgcttc

SEQ ID NO: 26278 - DNA, 25 bp, Mus musculus
acctccttgcttctgttagagaggg

SEQ ID NO: 26279 - DNA, 25 bp, Mus musculus
gaatccctgtgtctcttttgcttaa

SEQ ID NO: 26280 - DNA, 25 bp, Mus musculus
tccctgtgtctcttttgcttaagat

SEQ ID NO: 26281 - DNA, 25 bp, Mus musculus
tgtctcttttgcttaagattaaagg

SEQ ID NO: 26282 - DNA, 25 bp, Mus musculus
ctgctgctgtcttacttgagtcttt

SEQ ID NO: 26283 - DNA, 25 bp, Mus musculus
aagatgtctctgaacggacagcgcg

SEQ ID NO: 26284 - DNA, 25 bp, Mus musculus
gagtgccatctcttctacaacgagc

SEQ ID NO: 26285 - DNA, 25 bp, Mus musculus
tgccatctcttctacaacgagcagc

SEQ ID NO: 26286 - DNA, 25 bp, Mus musculus
ctcttctacaacgagcagcaggaga

SEQ ID NO: 26287 - DNA, 25 bp, Mus musculus
ttctacaacgagcagcaggagactg

SEQ ID NO: 26288 - DNA, 25 bp, Mus musculus
ggggcccatgcccaaagtgtgcagt

SEQ ID NO: 26289 - DNA, 25 bp, Mus musculus
gcccatgcccaaagtgtgcagtaaa

SEQ ID NO: 26290 - DNA, 25 bp, Mus musculus
ccatcccgaacaccagcagaaatgg

SEQ ID NO: 26291 - DNA, 25 bp, Mus musculus
ctgaagctgtttgttccccactgct

SEQ ID NO: 26292 - DNA, 25 bp, Mus musculus
tttgttccccactgctatggtgtta

SEQ ID NO: 26293 - DNA, 25 bp, Mus musculus
ggctgaaccctgatggaaagagcat

SEQ ID NO: 26294 - DNA, 25 bp, Mus musculus
ataagatcctgaccatcgaagtgaa

SEQ ID NO: 26295 - DNA, 25 bp, Mus musculus
agatcctgaccatcgaagtgaagat

SEQ ID NO: 26296 - DNA, 25 bp, Mus musculus
accagacctcgaacaacattccagc

SEQ ID NO: 26297 - DNA, 25 bp, Mus musculus
agacctcgaacaacattccagcaga

SEQ ID NO: 26298 - DNA, 25 bp, Mus musculus
cctcgaacaacattccagcagacat

SEQ ID NO: 26299 - DNA, 25 bp, Mus musculus
acaacattccagcagacatcgtctt

SEQ ID NO: 26300 - DNA, 25 bp, Mus musculus
acattccagcagacatcgtctttgt

SEQ ID NO: 26301 - DNA, 25 bp, Mus musculus
taaaggacaagccacacaatatctt

SEQ ID NO: 26302 - DNA, 25 bp, Mus musculus
cacacaatatcttcaagagagatgg

SEQ ID NO: 26303 - DNA, 25 bp, Mus musculus
gttccccactgctatggtgttataa

SEQ ID NO: 26304 - DNA, 25 bp, Mus musculus
gttataactcagcttacaataccaa

SEQ ID NO: 26305 - DNA, 25 bp, Mus musculus
ataactcagcttacaataccaagaa

SEQ ID NO: 26306 - DNA, 25 bp, Mus musculus
actcagcttacaataccaagaagat

SEQ ID NO: 26307 - DNA, 25 bp, Mus musculus
agatgaaaatctcccacaagcggct

SEQ ID NO: 26308 - DNA, 25 bp, Mus musculus
tgaaaatctcccacaagcggctgaa

SEQ ID NO: 26309 - DNA, 25 bp, Mus musculus
tctcccacaagcggctgaaccctga

SEQ ID NO: 26310 - DNA, 25 bp, Mus musculus
acaagcggctgaaccctgatggaaa

SEQ ID NO: 26311 - DNA, 25 bp, Mus musculus
tgaaccagcggggactgctgtgtaa

SEQ ID NO: 26312 - DNA, 25 bp, Mus musculus
tctgcaaagctggcttcacgcgcag

SEQ ID NO: 26313 - DNA, 25 bp, Mus musculus
acttcgacatcagatctgccccttt

SEQ ID NO: 26314 - DNA, 25 bp, Mus musculus
taatttactcttggctttcaaggca

SEQ ID NO: 26315 - DNA, 25 bp, Mus musculus
actcttggctttcaaggcaaattga

SEQ ID NO: 26316 - DNA, 25 bp, Mus musculus
aaattgatattcacatccaaagcgg

SEQ ID NO: 26317 - DNA, 25 bp, Mus musculus
aaagcgggcagcatcaactgcttgg

SEQ ID NO: 26318 - DNA, 25 bp, Mus musculus
ggcagcatcaactgcttggcgggtt

SEQ ID NO: 26319 - DNA, 25 bp, Mus musculus
tggactgagctgggacccaggatgt

SEQ ID NO: 26320 - DNA, 25 bp, Mus musculus
gagctgggacccaggatgtgaaata

SEQ ID NO: 26321 - DNA, 25 bp, Mus musculus
tattgtggctctgattatgtacact

SEQ ID NO: 26322 - DNA, 25 bp, Mus musculus
tgcctgacctgctgaccaggctcac

SEQ ID NO: 26323 - DNA, 25 bp, Mus musculus
ccgccgctgatgatgcagccatagc

SEQ ID NO: 26324 - DNA, 25 bp, Mus musculus
tgatcgatcatcgagggtattttca

SEQ ID NO: 26325 - DNA, 25 bp, Mus musculus
gacagacaagtacatcctttgctcc

SEQ ID NO: 26326 - DNA, 25 bp, Mus musculus
caagtacatcctttgctcctgacca

SEQ ID NO: 26327 - DNA, 25 bp, Mus musculus
ttgctcctgaccaaacgagagcatg

SEQ ID NO: 26328 - DNA, 25 bp, Mus musculus
ctgaccaaacgagagcatggaccca

SEQ ID NO: 26329 - DNA, 25 bp, Mus musculus
acccaaggtgctcctgtctgcagag

SEQ ID NO: 26330 - DNA, 25 bp, Mus musculus
tgattcctagaaacttcgacatcag

SEQ ID NO: 26331 - DNA, 25 bp, Mus musculus
cagcctgcccagagcagccaggagg

SEQ ID NO: 26332 - DNA, 25 bp, Mus musculus
cctgcccagagcagccaggaggatg

SEQ ID NO: 26333 - DNA, 25 bp, Mus musculus
gtcccatatttaggcagactgcctg

SEQ ID NO: 26334 - DNA, 25 bp, Mus musculus
tcccatatttaggcagactgcctgg

SEQ ID NO: 26335 - DNA, 25 bp, Mus musculus
atatttaggcagactgcctggctac

SEQ ID NO: 26336 - DNA, 25 bp, Mus musculus
tatttaggcagactgcctggctaca

SEQ ID NO: 26337 - DNA, 25 bp, Mus musculus
tttaggcagactgcctggctacagg

SEQ ID NO: 26338 - DNA, 25 bp, Mus musculus
ttaggcagactgcctggctacaggg

SEQ ID NO: 26339 - DNA, 25 bp, Mus musculus
taggcagactgcctggctacagggc

SEQ ID NO: 26340 - DNA, 25 bp, Mus musculus
aggcagactgcctggctacagggct

SEQ ID NO: 26341 - DNA, 25 bp, Mus musculus
cagactgcctggctacagggctgct

SEQ ID NO: 26342 - DNA, 25 bp, Mus musculus
tacagggctgctgcggcctggagaa

SEQ ID NO: 26343 - DNA, 25 bp, Mus musculus
tgcccagagcagccaggaggatgtc

SEQ ID NO: 26344 - DNA, 25 bp, Mus musculus
gcccagagcagccaggaggatgtcc

SEQ ID NO: 26345 - DNA, 25 bp, Mus musculus
cccagagcagccaggaggatgtccc

SEQ ID NO: 26346 - DNA, 25 bp, Mus musculus
ccagagcagccaggaggatgtccca

SEQ ID NO: 26347 - DNA, 25 bp, Mus musculus
aggatgtcccatatttaggcagact

SEQ ID NO: 26348 - DNA, 25 bp, Mus musculus
ggatgtcccatatttaggcagactg

SEQ ID NO: 26349 - DNA, 25 bp, Mus musculus
atgtcccatatttaggcagactgcc

SEQ ID NO: 26350 - DNA, 25 bp, Mus musculus
tgtcccatatttaggcagactgcct

SEQ ID NO: 26351 - DNA, 25 bp, Mus musculus
cagcctgcactgaagttcaatggtg

SEQ ID NO: 26352 - DNA, 25 bp, Mus musculus
catattaatcacaccattttctgga

SEQ ID NO: 26353 - DNA, 25 bp, Mus musculus
agacctgactatctgaaagctattt

SEQ ID NO: 26354 - DNA, 25 bp, Mus musculus
tacacagcttgcaagaagtgaaacc

SEQ ID NO: 26355 - DNA, 25 bp, Mus musculus
ctcactcacggccacattgagtgcc

SEQ ID NO: 26356 - DNA, 25 bp, Mus musculus
caggctccgggctggtttatagtag

SEQ ID NO: 26357 - DNA, 25 bp, Mus musculus
agcattgcagcactatgactggggt

SEQ ID NO: 26358 - DNA, 25 bp, Mus musculus
gcagcactatgactggggtgctgta

SEQ ID NO: 26359 - DNA, 25 bp, Mus musculus
ctatgactggggtgctgtagtcttt

SEQ ID NO: 26360 - DNA, 25 bp, Mus musculus
tattgatgtctttccacatacctga

SEQ ID NO: 26361 - DNA, 25 bp, Mus musculus
tgtctttccacatacctgataattc

SEQ ID NO: 26362 - DNA, 25 bp, Mus musculus
tccacatacctgataattctatgat

SEQ ID NO: 26363 - DNA, 25 bp, Mus musculus
ttctggacaaacctgagccctaagg

SEQ ID NO: 26364 - DNA, 25 bp, Mus musculus
atcaagcgtgactttgggtcttttg

SEQ ID NO: 26365 - DNA, 25 bp, Mus musculus
ctgacagccatgtctgtgggagtcc

SEQ ID NO: 26366 - DNA, 25 bp, Mus musculus
ttacagattgctgcctgctctaatc

SEQ ID NO: 26367 - DNA, 25 bp, Mus musculus
attgctgcctgctctaatcaggacc

SEQ ID NO: 26368 - DNA, 25 bp, Mus musculus
acaacaggccttattccgctgctgg

SEQ ID NO: 26369 - DNA, 25 bp, Mus musculus
ggccttattccgctgctggggattg

SEQ ID NO: 26370 - DNA, 25 bp, Mus musculus
attccgctgctggggattgacgtgt

SEQ ID NO: 26371 - DNA, 25 bp, Mus musculus
aaaggcacatctgtcagtgccaaag

SEQ ID NO: 26372 - DNA, 25 bp, Mus musculus
aggcacatctgtcagtgccaaagca

SEQ ID NO: 26373 - DNA, 25 bp, Mus musculus
cagtgccaaagcacaaatgaccaag

SEQ ID NO: 26374 - DNA, 25 bp, Mus musculus
gccaaagcacaaatgaccaaggacc

SEQ ID NO: 26375 - DNA, 25 bp, Mus musculus
ccaaagcacaaatgaccaaggaccg

SEQ ID NO: 26376 - DNA, 25 bp, Mus musculus
tgaagtggctttccaggacgaagtg

SEQ ID NO: 26377 - DNA, 25 bp, Mus musculus
cttgttctatgggccacctggaact

SEQ ID NO: 26378 - DNA, 25 bp, Mus musculus
ttgttctatgggccacctggaactg

SEQ ID NO: 26379 - DNA, 25 bp, Mus musculus
tgttctatgggccacctggaactgg

SEQ ID NO: 26380 - DNA, 25 bp, Mus musculus
ttctatgggccacctggaactggca

SEQ ID NO: 26381 - DNA, 25 bp, Mus musculus
tctatgggccacctggaactggcaa

SEQ ID NO: 26382 - DNA, 25 bp, Mus musculus
ctatgggccacctggaactggcaaa

SEQ ID NO: 26383 - DNA, 25 bp, Mus musculus
ggcacatctgtcagtgccaaagcac

SEQ ID NO: 26384 - DNA, 25 bp, Mus musculus
gcacatctgtcagtgccaaagcaca

SEQ ID NO: 26385 - DNA, 25 bp, Mus musculus
acatctgtcagtgccaaagcacaaa

SEQ ID NO: 26386 - DNA, 25 bp, Mus musculus
catctgtcagtgccaaagcacaaat

SEQ ID NO: 26387 - DNA, 25 bp, Mus musculus
atctgtcagtgccaaagcacaaatg

SEQ ID NO: 26388 - DNA, 25 bp, Mus musculus
ctgtcagtgccaaagcacaaatgac

SEQ ID NO: 26389 - DNA, 25 bp, Mus musculus
tgtcagtgccaaagcacaaatgacc

SEQ ID NO: 26390 - DNA, 25 bp, Mus musculus
gtcagtgccaaagcacaaatgacca

SEQ ID NO: 26391 - DNA, 25 bp, Mus musculus
ggatttagcccacaggagccctaga

SEQ ID NO: 26392 - DNA, 25 bp, Mus musculus
agcccacaggagccctagatgcaaa

SEQ ID NO: 26393 - DNA, 25 bp, Mus musculus
gagcccaaggtcccaaggcacagca

SEQ ID NO: 26394 - DNA, 25 bp, Mus musculus
aaggtcccaaggcacagcagcgcac

SEQ ID NO: 26395 - DNA, 25 bp, Mus musculus
ccaaggcacagcagcgcacctgtgt

SEQ ID NO: 26396 - DNA, 25 bp, Mus musculus
cacagcagcgcacctgtgtgcctgc

SEQ ID NO: 26397 - DNA, 25 bp, Mus musculus
agcgcacctgtgtgcctgctctcct

SEQ ID NO: 26398 - DNA, 25 bp, Mus musculus
tgcctgctctcctcatgtacataca

SEQ ID NO: 26399 - DNA, 25 bp, Mus musculus
tcatgtacatacataacgtgctttc

SEQ ID NO: 26400 - DNA, 25 bp, Mus musculus
acatacataacgtgctttctctccc

SEQ ID NO: 26401 - DNA, 25 bp, Mus musculus
cccgacagactcagaccaaggtgcg

SEQ ID NO: 26402 - DNA, 25 bp, Mus musculus
agactcagaccaaggtgcggccccg

SEQ ID NO: 26403 - DNA, 25 bp, Mus musculus
acagacagcctgttagtgggagctt

SEQ ID NO: 26404 - DNA, 25 bp, Mus musculus
ttcctttagcccagctgcctgcagg

SEQ ID NO: 26405 - DNA, 25 bp, Mus musculus
ccaagccagcttctcttcaccttga

SEQ ID NO: 26406 - DNA, 25 bp, Mus musculus
cagcttctcttcaccttgaagtagt

SEQ ID NO: 26407 - DNA, 25 bp, Mus musculus
ctcttcaccttgaagtagtctgcca

SEQ ID NO: 26408 - DNA, 25 bp, Mus musculus
accttgaagtagtctgccaggcctg

SEQ ID NO: 26409 - DNA, 25 bp, Mus musculus
aagtagtctgccaggcctggtgcag

SEQ ID NO: 26410 - DNA, 25 bp, Mus musculus
atctggcactcggagcccaaggtcc

SEQ ID NO: 26411 - DNA, 25 bp, Mus musculus
cacgcactccacgggacatgggtct

SEQ ID NO: 26412 - DNA, 25 bp, Mus musculus
ctccacgggacatgggtctgggact

SEQ ID NO: 26413 - DNA, 25 bp, Mus musculus
ctcacacacttcgaggtacagagag

SEQ ID NO: 26414 - DNA, 25 bp, Mus musculus
cacacacttcgaggtacagagagtc

SEQ ID NO: 26415 - DNA, 25 bp, Mus musculus
cacacttcgaggtacagagagtctg

SEQ ID NO: 26416 - DNA, 25 bp, Mus musculus
agcaggcactgtagcaacagagaat

SEQ ID NO: 26417 - DNA, 25 bp, Mus musculus
cttatggagctcaaacctcagatgc

SEQ ID NO: 26418 - DNA, 25 bp, Mus musculus
tatggagctcaaacctcagatgcag

SEQ ID NO: 26419 - DNA, 25 bp, Mus musculus
tggagctcaaacctcagatgcagga

SEQ ID NO: 26420 - DNA, 25 bp, Mus musculus
tcaaacctcagatgcaggaggagaa

SEQ ID NO: 26421 - DNA, 25 bp, Mus musculus
acctcagatgcaggaggagaagaga

SEQ ID NO: 26422 - DNA, 25 bp, Mus musculus
agaactgccagagacaatggaccct

SEQ ID NO: 26423 - DNA, 25 bp, Mus musculus
actgtaacgtacagcactgctgccc

SEQ ID NO: 26424 - DNA, 25 bp, Mus musculus
tgtaacgtacagcactgctgcccag

SEQ ID NO: 26425 - DNA, 25 bp, Mus musculus
taacgtacagcactgctgcccagtc

SEQ ID NO: 26426 - DNA, 25 bp, Mus musculus
gtacagcactgctgcccagtctcac

SEQ ID NO: 26427 - DNA, 25 bp, Mus musculus
gctgcccagtctcacacacttcgag

SEQ ID NO: 26428 - DNA, 25 bp, Mus musculus
tgcccagtctcacacacttcgaggt

SEQ ID NO: 26429 - DNA, 25 bp, Mus musculus
cccagtctcacacacttcgaggtac

SEQ ID NO: 26430 - DNA, 25 bp, Mus musculus
cagtctcacacacttcgaggtacag

SEQ ID NO: 26431 - DNA, 25 bp, Mus musculus
atcccatacgacatgctgcaggaca

SEQ ID NO: 26432 - DNA, 25 bp, Mus musculus
cccatacgacatgctgcaggacatc

SEQ ID NO: 26433 - DNA, 25 bp, Mus musculus
atgacggacatgcgtactcgagaca

SEQ ID NO: 26434 - DNA, 25 bp, Mus musculus
gacggacatgcgtactcgagacaaa

SEQ ID NO: 26435 - DNA, 25 bp, Mus musculus
cggacatgcgtactcgagacaaagt

SEQ ID NO: 26436 - DNA, 25 bp, Mus musculus
gacatgcgtactcgagacaaagtcc

SEQ ID NO: 26437 - DNA, 25 bp, Mus musculus
catgcgtactcgagacaaagtcctg

SEQ ID NO: 26438 - DNA, 25 bp, Mus musculus
cgtactcgagacaaagtcctgataa

SEQ ID NO: 26439 - DNA, 25 bp, Mus musculus
ccatcaagacaccgagtgtgactat

SEQ ID NO: 26440 - DNA, 25 bp, Mus musculus
catcaagacaccgagtgtgactatc

SEQ ID NO: 26441 - DNA, 25 bp, Mus musculus
atcaagacaccgagtgtgactatca

SEQ ID NO: 26442 - DNA, 25 bp, Mus musculus
tcaagacaccgagtgtgactatcag

SEQ ID NO: 26443 - DNA, 25 bp, Mus musculus
catacgacatgctgcaggacatcaa

SEQ ID NO: 26444 - DNA, 25 bp, Mus musculus
acatgctgcaggacatcaagattga

SEQ ID NO: 26445 - DNA, 25 bp, Mus musculus
atcttgagcacgccgtcctggagct

SEQ ID NO: 26446 - DNA, 25 bp, Mus musculus
cttgagcacgccgtcctggagctgg

SEQ ID NO: 26447 - DNA, 25 bp, Mus musculus
cgccgtcctggagctggctcagtgc

SEQ ID NO: 26448 - DNA, 25 bp, Mus musculus
gtacgactccatgacggacatgcgt

SEQ ID NO: 26449 - DNA, 25 bp, Mus musculus
acgactccatgacggacatgcgtac

SEQ ID NO: 26450 - DNA, 25 bp, Mus musculus
ctccatgacggacatgcgtactcga

SEQ ID NO: 26451 - DNA, 25 bp, Mus musculus
atgccacagaccggtgctgtgttac

SEQ ID NO: 26452 - DNA, 25 bp, Mus musculus
cagaccggtgctgtgttactcatga

SEQ ID NO: 26453 - DNA, 25 bp, Mus musculus
agccatctcctgaaacacccggaca

SEQ ID NO: 26454 - DNA, 25 bp, Mus musculus
tctgtcttcacccagaatgagacac

SEQ ID NO: 26455 - DNA, 25 bp, Mus musculus
ttcacccagaatgagacacagaagt

SEQ ID NO: 26456 - DNA, 25 bp, Mus musculus
actccactgccttgaatctgtctac

SEQ ID NO: 26457 - DNA, 25 bp, Mus musculus
tgaatctgtctacttccacctttct

SEQ ID NO: 26458 - DNA, 25 bp, Mus musculus
tgtctacttccacctttctcttggc

SEQ ID NO: 26459 - DNA, 25 bp, Mus musculus
cctttctcttggcatccaacttcct

SEQ ID NO: 26460 - DNA, 25 bp, Mus musculus
tcttggcatccaacttcctgcttcg

SEQ ID NO: 26461 - DNA, 25 bp, Mus musculus
catccaacttcctgcttcgtaccta

SEQ ID NO: 26462 - DNA, 25 bp, Mus musculus
ggaggccctcacaagtaaagcaatt

SEQ ID NO: 26463 - DNA, 25 bp, Mus musculus
gtgttactcatgactgttgctacaa

SEQ ID NO: 26464 - DNA, 25 bp, Mus musculus
actgttgctacaagagcctggagaa

SEQ ID NO: 26465 - DNA, 25 bp, Mus musculus
ggggccaaatcacctgttctgcaaa

SEQ ID NO: 26466 - DNA, 25 bp, Mus musculus
aaatcacctgttctgcaaaccagaa

SEQ ID NO: 26467 - DNA, 25 bp, Mus musculus
accagaactcctgtcagaaacggct

SEQ ID NO: 26468 - DNA, 25 bp, Mus musculus
actcctgtcagaaacggctgtgtca

SEQ ID NO: 26469 - DNA, 25 bp, Mus musculus
gtcagaaacggctgtgtcagtgcga

SEQ ID NO: 26470 - DNA, 25 bp, Mus musculus
tctaccccaacatgttttgcaaagg

SEQ ID NO: 26471 - DNA, 25 bp, Mus musculus
gacaccatgctgaggagtccacagc

SEQ ID NO: 26472 - DNA, 25 bp, Mus musculus
accatgctgaggagtccacagccat

SEQ ID NO: 26473 - DNA, 25 bp, Mus musculus
tcctcatcgtggactgggatattca

SEQ ID NO: 26474 - DNA, 25 bp, Mus musculus
gcaacggcacccagcaagcattcta

SEQ ID NO: 26475 - DNA, 25 bp, Mus musculus
gcacccagcaagcattctacaacga

SEQ ID NO: 26476 - DNA, 25 bp, Mus musculus
agcaagcattctacaacgatccctc

SEQ ID NO: 26477 - DNA, 25 bp, Mus musculus
acaacgatccctctgtgctctacat

SEQ ID NO: 26478 - DNA, 25 bp, Mus musculus
acgatccctctgtgctctacatctc

SEQ ID NO: 26479 - DNA, 25 bp, Mus musculus
tgctctacatctccctgcatcgcta

SEQ ID NO: 26480 - DNA, 25 bp, Mus musculus
ccctgcatcgctacgacaacgggaa

SEQ ID NO: 26481 - DNA, 25 bp, Mus musculus
tgcatcgctacgacaacgggaactt

SEQ ID NO: 26482 - DNA, 25 bp, Mus musculus
caggctctggggctcctgaagaggt

SEQ ID NO: 26483 - DNA, 25 bp, Mus musculus
ccatgggattctgcttcttcaactc

SEQ ID NO: 26484 - DNA, 25 bp, Mus musculus
gcttcttcaactccgtagccatcac

SEQ ID NO: 26485 - DNA, 25 bp, Mus musculus
actccgtagccatcacagctaaact

SEQ ID NO: 26486 - DNA, 25 bp, Mus musculus
ccgtagccatcacagctaaactcct

SEQ ID NO: 26487 - DNA, 25 bp, Mus musculus
tagccatcacagctaaactcctgca

SEQ ID NO: 26488 - DNA, 25 bp, Mus musculus
ctaaactcctgcagcagaagctgag

SEQ ID NO: 26489 - DNA, 25 bp, Mus musculus
gcaaggtcctcatcgtggactggga

SEQ ID NO: 26490 - DNA, 25 bp, Mus musculus
aggtcctcatcgtggactgggatat

SEQ ID NO: 26491 - DNA, 25 bp, Mus musculus
gaacgactgtcttcataacccgaga

SEQ ID NO: 26492 - DNA, 25 bp, Mus musculus
acatcttactgactgttgaagacat

SEQ ID NO: 26493 - DNA, 25 bp, Mus musculus
tcatcgctgtttcttccacggtcac

SEQ ID NO: 26494 - DNA, 25 bp, Mus musculus
tgatgctaatcatcactctcgtcag

SEQ ID NO: 26495 - DNA, 25 bp, Mus musculus
tcactctcgtcagtgtctactgcac

SEQ ID NO: 26496 - DNA, 25 bp, Mus musculus
cggcagccatgactctagaaaacca

SEQ ID NO: 26497 - DNA, 25 bp, Mus musculus
ctctagaaaaccaacatgcgttttg

SEQ ID NO: 26498 - DNA, 25 bp, Mus musculus
taactcacgccagcaggtgaaatga

SEQ ID NO: 26499 - DNA, 25 bp, Mus musculus
gaccttccatcatagaagaatattt

SEQ ID NO: 26500 - DNA, 25 bp, Mus musculus
aagccatgtgacatttccaaccaga

SEQ ID NO: 26501 - DNA, 25 bp, Mus musculus
tgtgacatttccaaccagatcatct

SEQ ID NO: 26502 - DNA, 25 bp, Mus musculus
atttccaaccagatcatctttgtaa

SEQ ID NO: 26503 - DNA, 25 bp, Mus musculus
aagacatatctcacctcaattctac

SEQ ID NO: 26504 - DNA, 25 bp, Mus musculus
tatctcacctcaattctacatcagc

SEQ ID NO: 26505 - DNA, 25 bp, Mus musculus
acctcaattctacatcagctgtccc

SEQ ID NO: 26506 - DNA, 25 bp, Mus musculus
ccaccttggctgtccataatgcctg

SEQ ID NO: 26507 - DNA, 25 bp, Mus musculus
atgcctgctctgaggttgtatgtca

SEQ ID NO: 26508 - DNA, 25 bp, Mus musculus
agaacggtggcatctgtgttgtcca

SEQ ID NO: 26509 - DNA, 25 bp, Mus musculus
gcaagtgtcctgcaggagaagactg

SEQ ID NO: 26510 - DNA, 25 bp, Mus musculus
ccacccgagacactgttatcatcgc

SEQ ID NO: 26511 - DNA, 25 bp, Mus musculus
cacaacctaattgaacgcgcaggcg

SEQ ID NO: 26512 - DNA, 25 bp, Mus musculus
caacctaattgaacgcgcaggcgat

SEQ ID NO: 26513 - DNA, 25 bp, Mus musculus
ccaagtccaatgatcggagatggct

SEQ ID NO: 26514 - DNA, 25 bp, Mus musculus
aagtccaatgatcggagatggctgg

SEQ ID NO: 26515 - DNA, 25 bp, Mus musculus
tggaacaagggcccatcctgaaggc

SEQ ID NO: 26516 - DNA, 25 bp, Mus musculus
gaacaagggcccatcctgaaggcat

SEQ ID NO: 26517 - DNA, 25 bp, Mus musculus
acaagggcccatcctgaaggcatct

SEQ ID NO: 26518 - DNA, 25 bp, Mus musculus
aagggcccatcctgaaggcatctgt

SEQ ID NO: 26519 - DNA, 25 bp, Mus musculus
tggattacatccgcaaattacagaa

SEQ ID NO: 26520 - DNA, 25 bp, Mus musculus
gattacatccgcaaattacagaagg

SEQ ID NO: 26521 - DNA, 25 bp, Mus musculus
ttacatccgcaaattacagaaggaa

SEQ ID NO: 26522 - DNA, 25 bp, Mus musculus
acatccgcaaattacagaaggaaca

SEQ ID NO: 26523 - DNA, 25 bp, Mus musculus
acctaattgaacgcgcaggcgattc

SEQ ID NO: 26524 - DNA, 25 bp, Mus musculus
ctaattgaacgcgcaggcgattcaa

SEQ ID NO: 26525 - DNA, 25 bp, Mus musculus
aattgaacgcgcaggcgattcaaca

SEQ ID NO: 26526 - DNA, 25 bp, Mus musculus
ttgaacgcgcaggcgattcaacatt

SEQ ID NO: 26527 - DNA, 25 bp, Mus musculus
tgggcacctcatccccaagtccaat

SEQ ID NO: 26528 - DNA, 25 bp, Mus musculus
cctcatccccaagtccaatgatcgg

SEQ ID NO: 26529 - DNA, 25 bp, Mus musculus
tcatccccaagtccaatgatcggag

SEQ ID NO: 26530 - DNA, 25 bp, Mus musculus
atccccaagtccaatgatcggagat

SEQ ID NO: 26531 - DNA, 25 bp, Mus musculus
ctgtggggcctgcaaggagaactac

SEQ ID NO: 26532 - DNA, 25 bp, Mus musculus
gaactactgtctcatgattacattt

SEQ ID NO: 26533 - DNA, 25 bp, Mus musculus
cgattcttgctgcatcaacataact

SEQ ID NO: 26534 - DNA, 25 bp, Mus musculus
ttgctgcatcaacataactgtgggc

SEQ ID NO: 26535 - DNA, 25 bp, Mus musculus
ggaatccactatccatacccagggc

SEQ ID NO: 26536 - DNA, 25 bp, Mus musculus
cactatccatacccagggctgcgtg

SEQ ID NO: 26537 - DNA, 25 bp, Mus musculus
ccagggctgcgtggagactatagca

SEQ ID NO: 26538 - DNA, 25 bp, Mus musculus
catactgctggtggctgcagcggcc

SEQ ID NO: 26539 - DNA, 25 bp, Mus musculus
cattgcttttgtggaggtcttggga

SEQ ID NO: 26540 - DNA, 25 bp, Mus musculus
ctgctgtctggtgaagagtattcga

SEQ ID NO: 26541 - DNA, 25 bp, Mus musculus
ggcgtttggtcttttcatggagtgg

SEQ ID NO: 26542 - DNA, 25 bp, Mus musculus
tggtcttttcatggagtggattctc

SEQ ID NO: 26543 - DNA, 25 bp, Mus musculus
catgattacatttgccatcttcttg

SEQ ID NO: 26544 - DNA, 25 bp, Mus musculus
tgccatcttcttgtctcttatcatg

SEQ ID NO: 26545 - DNA, 25 bp, Mus musculus
tgctggctatgtgtttagagaccag

SEQ ID NO: 26546 - DNA, 25 bp, Mus musculus
cttccagcagcagatgcagaattac

SEQ ID NO: 26547 - DNA, 25 bp, Mus musculus
agacaacaaaacagccactattttg

SEQ ID NO: 26548 - DNA, 25 bp, Mus musculus
tggagcttctaactacacagactgg

SEQ ID NO: 26549 - DNA, 25 bp, Mus musculus
ggacagagtccccgattcttgctgc

SEQ ID NO: 26550 - DNA, 25 bp, Mus musculus
agtccccgattcttgctgcatcaac

SEQ ID NO: 26551 - DNA, 25 bp, Mus musculus
gtttagccttctgaagaatcaggtc

SEQ ID NO: 26552 - DNA, 25 bp, Mus musculus
tcaccttttcttctgtgtgcctagc

SEQ ID NO: 26553 - DNA, 25 bp, Mus musculus
atagtctgtcttgagtccttgtaca

SEQ ID NO: 26554 - DNA, 25 bp, Mus musculus
tgtcttgagtccttgtacatatttc

SEQ ID NO: 26555 - DNA, 25 bp, Mus musculus
gagtccttgtacatatttctgtgta

SEQ ID NO: 26556 - DNA, 25 bp, Mus musculus
tccttgtacatatttctgtgtagct

SEQ ID NO: 26557 - DNA, 25 bp, Mus musculus
atatttctgtgtagctataactact

SEQ ID NO: 26558 - DNA, 25 bp, Mus musculus
agctataactactgtatcactttca

SEQ ID NO: 26559 - DNA, 25 bp, Mus musculus
tataactactgtatcactttcatta

SEQ ID NO: 26560 - DNA, 25 bp, Mus musculus
aactactgtatcactttcattatta

SEQ ID NO: 26561 - DNA, 25 bp, Mus musculus
gatttatccagtggctatgttaaaa

SEQ ID NO: 26562 - DNA, 25 bp, Mus musculus
caattttcaggactttgtattaatg

SEQ ID NO: 26563 - DNA, 25 bp, Mus musculus
ccttttcttctgtgtgcctagcatc

SEQ ID NO: 26564 - DNA, 25 bp, Mus musculus
cttctgtgtgcctagcatcgggaag

SEQ ID NO: 26565 - DNA, 25 bp, Mus musculus
ttggcagtctagctcagcatgtcta

SEQ ID NO: 26566 - DNA, 25 bp, Mus musculus
gcagtctagctcagcatgtctaaca

SEQ ID NO: 26567 - DNA, 25 bp, Mus musculus
gtctagctcagcatgtctaacatat

SEQ ID NO: 26568 - DNA, 25 bp, Mus musculus
agcatgtctaacatatccagtgctg

SEQ ID NO: 26569 - DNA, 25 bp, Mus musculus
tccagtgctggctaatttgaacgat

SEQ ID NO: 26570 - DNA, 25 bp, Mus musculus
atttggctgccaattaatgatgaat

SEQ ID NO: 26571 - DNA, 25 bp, Mus musculus
atctccctaaatcacatggctgctg

SEQ ID NO: 26572 - DNA, 25 bp, Mus musculus
gctgctgcatacattgcaatgttgc

SEQ ID NO: 26573 - DNA, 25 bp, Mus musculus
tttggcaagccagttcttattagac

SEQ ID NO: 26574 - DNA, 25 bp, Mus musculus
attagacactgctacaggcttcaca

SEQ ID NO: 26575 - DNA, 25 bp, Mus musculus
cactgctacaggcttcacaatcttc

SEQ ID NO: 26576 - DNA, 25 bp, Mus musculus
tacaggcttcacaatcttcaaggtg

SEQ ID NO: 26577 - DNA, 25 bp, Mus musculus
cttcacaatcttcaaggtggaccca

SEQ ID NO: 26578 - DNA, 25 bp, Mus musculus
agatctctggcttcgagctcatatc

SEQ ID NO: 26579 - DNA, 25 bp, Mus musculus
ctggcttcgagctcatatcttggct

SEQ ID NO: 26580 - DNA, 25 bp, Mus musculus
tcatatcttggcttcctgtcatgtc

SEQ ID NO: 26581 - DNA, 25 bp, Mus musculus
ttcctgtcatgtctaagcccgacag

SEQ ID NO: 26582 - DNA, 25 bp, Mus musculus
tgtggcaccatcctgcctgcggcgt

SEQ ID NO: 26583 - DNA, 25 bp, Mus musculus
tttgcaagttgcttcttcactcatt

SEQ ID NO: 26584 - DNA, 25 bp, Mus musculus
tgaagaagcctgcaccgtaagtgaa

SEQ ID NO: 26585 - DNA, 25 bp, Mus musculus
aactcacttagtccttgctaattgc

SEQ ID NO: 26586 - DNA, 25 bp, Mus musculus
actgtcacgtgaacgcagagaaggc

SEQ ID NO: 26587 - DNA, 25 bp, Mus musculus
ctgattttcctggacccattttcag

SEQ ID NO: 26588 - DNA, 25 bp, Mus musculus
ttcctggacccattttcagtgcttt

SEQ ID NO: 26589 - DNA, 25 bp, Mus musculus
gacccattttcagtgctttgaggaa

SEQ ID NO: 26590 - DNA, 25 bp, Mus musculus
ttttcagtgctttgaggaacatgag

SEQ ID NO: 26591 - DNA, 25 bp, Mus musculus
ggaaccacgtgtccatgtgcattgt

SEQ ID NO: 26592 - DNA, 25 bp, Mus musculus
acgtgtccatgtgcattgtaaacgg

SEQ ID NO: 26593 - DNA, 25 bp, Mus musculus
gaaagccctggaacagagtggtcca

SEQ ID NO: 26594 - DNA, 25 bp, Mus musculus
aagttctctgcaccaagtgtcgagt

SEQ ID NO: 26595 - DNA, 25 bp, Mus musculus
tctgcaccaagtgtcgagtgcccat

SEQ ID NO: 26596 - DNA, 25 bp, Mus musculus
gtcgagtgcccatctatgagcctct

SEQ ID NO: 26597 - DNA, 25 bp, Mus musculus
tgcccatctatgagcctcttgaaat

SEQ ID NO: 26598 - DNA, 25 bp, Mus musculus
tactaaagcatgactctggtgatca

SEQ ID NO: 26599 - DNA, 25 bp, Mus musculus
ctgaatacatctcaaaaatgaaagt

SEQ ID NO: 26600 - DNA, 25 bp, Mus musculus
ggatcaagttctctgcagcaagtca

SEQ ID NO: 26601 - DNA, 25 bp, Mus musculus
ctgcagcaagtcattaccagggaag

SEQ ID NO: 26602 - DNA, 25 bp, Mus musculus
tttcactttcggcagtgatctttgt

SEQ ID NO: 26603 - DNA, 25 bp, Mus musculus
ggtcccccattgatgagaagaacaa

SEQ ID NO: 26604 - DNA, 25 bp, Mus musculus
agaacctggctgctgtgctgccctt

SEQ ID NO: 26605 - DNA, 25 bp, Mus musculus
tggctgctgtgctgccctttggagg

SEQ ID NO: 26606 - DNA, 25 bp, Mus musculus
ctgtgctgccctttggagggacatt

SEQ ID NO: 26607 - DNA, 25 bp, Mus musculus
aggcttttgagcacagcgtgcatcg

SEQ ID NO: 26608 - DNA, 25 bp, Mus musculus
tgcatcgctatggccagtccaccgg

SEQ ID NO: 26609 - DNA, 25 bp, Mus musculus
gctatggccagtccaccggagagtt

SEQ ID NO: 26610 - DNA, 25 bp, Mus musculus
ccaccggagagttcctgcaagtggg

SEQ ID NO: 26611 - DNA, 25 bp, Mus musculus
cttggcagccccatcttcttactac

SEQ ID NO: 26612 - DNA, 25 bp, Mus musculus
ttactacaaactgcttcgggagaat

SEQ ID NO: 26613 - DNA, 25 bp, Mus musculus
tctgttcaaggcgttcgaggaggag

SEQ ID NO: 26614 - DNA, 25 bp, Mus musculus
cctacggggcaacctcactgacctg

SEQ ID NO: 26615 - DNA, 25 bp, Mus musculus
cctcactgacctggagcccaatggt

SEQ ID NO: 26616 - DNA, 25 bp, Mus musculus
tatccacacatggccacgcaaagtg

SEQ ID NO: 26617 - DNA, 25 bp, Mus musculus
gccacgcaaagtgcgtggacacatc

SEQ ID NO: 26618 - DNA, 25 bp, Mus musculus
acacatcagtcatctccaactggct

SEQ ID NO: 26619 - DNA, 25 bp, Mus musculus
cagtcatctccaactggctgaaagg

SEQ ID NO: 26620 - DNA, 25 bp, Mus musculus
tctccaactggctgaaaggctgaac

SEQ ID NO: 26621 - DNA, 25 bp, Mus musculus
ttgcctgagtcctccctgctgagta

SEQ ID NO: 26622 - DNA, 25 bp, Mus musculus
gagtcctccctgctgagtaaagcta

SEQ ID NO: 26623 - DNA, 25 bp, Mus musculus
caaactgcttcgggagaatctcaag

SEQ ID NO: 26624 - DNA, 25 bp, Mus musculus
gcatatcctagtcgactatgacgag

SEQ ID NO: 26625 - DNA, 25 bp, Mus musculus
gaaaggctacctcctacagatcttc

SEQ ID NO: 26626 - DNA, 25 bp, Mus musculus
ctacctcctacagatcttcaccaag

SEQ ID NO: 26627 - DNA, 25 bp, Mus musculus
cacactcttcctggaagtcattcaa

SEQ ID NO: 26628 - DNA, 25 bp, Mus musculus
ggaagtcattcaacgtcacaaccac

SEQ ID NO: 26629 - DNA, 25 bp, Mus musculus
cattcaacgtcacaaccaccagggc

SEQ ID NO: 26630 - DNA, 25 bp, Mus musculus
caactctctgttcaaggcgttcgag

SEQ ID NO: 26631 - DNA, 25 bp, Mus musculus
ggcacagccggggatgctctcacct

SEQ ID NO: 26632 - DNA, 25 bp, Mus musculus
ggggatgctctcacctaccacaatg

SEQ ID NO: 26633 - DNA, 25 bp, Mus musculus
agcaactgtgcactgacgcatcatg

SEQ ID NO: 26634 - DNA, 25 bp, Mus musculus
aactgtgcactgacgcatcatggtg

SEQ ID NO: 26635 - DNA, 25 bp, Mus musculus
tgtgcactgacgcatcatggtggct

SEQ ID NO: 26636 - DNA, 25 bp, Mus musculus
ctgacgcatcatggtggctggtggt

SEQ ID NO: 26637 - DNA, 25 bp, Mus musculus
acgcatcatggtggctggtggtata

SEQ ID NO: 26638 - DNA, 25 bp, Mus musculus
catcatggtggctggtggtataaga

SEQ ID NO: 26639 - DNA, 25 bp, Mus musculus
tataagaactgccatttggccaacc

SEQ ID NO: 26640 - DNA, 25 bp, Mus musculus
aactgccatttggccaacccgaatg

SEQ ID NO: 26641 - DNA, 25 bp, Mus musculus
aactgggagccatggaagggacatg

SEQ ID NO: 26642 - DNA, 25 bp, Mus musculus
attccttatgtggagctgagaatcc

SEQ ID NO: 26643 - DNA, 25 bp, Mus musculus
gctctcacctaccacaatggatgga

SEQ ID NO: 26644 - DNA, 25 bp, Mus musculus
ctcacctaccacaatggatggaagt

SEQ ID NO: 26645 - DNA, 25 bp, Mus musculus
acctaccacaatggatggaagttca

SEQ ID NO: 26646 - DNA, 25 bp, Mus musculus
aagttcacgacttttgacagagaca

SEQ ID NO: 26647 - DNA, 25 bp, Mus musculus
gacaatgatattgccctcagcaact

SEQ ID NO: 26648 - DNA, 25 bp, Mus musculus
gatattgccctcagcaactgtgcac

SEQ ID NO: 26649 - DNA, 25 bp, Mus musculus
attgccctcagcaactgtgcactga

SEQ ID NO: 26650 - DNA, 25 bp, Mus musculus
ctcagcaactgtgcactgacgcatc

SEQ ID NO: 26651 - DNA, 25 bp, Mus musculus
gggccaccagcacgatgagtgaagg

SEQ ID NO: 26652 - DNA, 25 bp, Mus musculus
aacataacagcaccatgttagagtc

SEQ ID NO: 26653 - DNA, 25 bp, Mus musculus
agccaggccctatgtccaacagtgt

SEQ ID NO: 26654 - DNA, 25 bp, Mus musculus
gccctatgtccaacagtgttttcct

SEQ ID NO: 26655 - DNA, 25 bp, Mus musculus
tgtccaacagtgttttcctgacaac

SEQ ID NO: 26656 - DNA, 25 bp, Mus musculus
acagtgttttcctgacaactggaga

SEQ ID NO: 26657 - DNA, 25 bp, Mus musculus
agttcctcaagatggagactttgat

SEQ ID NO: 26658 - DNA, 25 bp, Mus musculus
agaactacagatgcggctaaaagca

SEQ ID NO: 26659 - DNA, 25 bp, Mus musculus
actagaccccatgatggaacgagaa

SEQ ID NO: 26660 - DNA, 25 bp, Mus musculus
acaacctatcctggatgccatggat

SEQ ID NO: 26661 - DNA, 25 bp, Mus musculus
tatcctggatgccatggatgcgaag

SEQ ID NO: 26662 - DNA, 25 bp, Mus musculus
ttccctctgtctcaggatgaccaga

SEQ ID NO: 26663 - DNA, 25 bp, Mus musculus
acagcaccatgttagagtcggacct

SEQ ID NO: 26664 - DNA, 25 bp, Mus musculus
tagagtcggacctggggaccatggt

SEQ ID NO: 26665 - DNA, 25 bp, Mus musculus
atgcaacgtcacctcaagtacaaag

SEQ ID NO: 26666 - DNA, 25 bp, Mus musculus
ctcaagtacaaagaccttctttcat

SEQ ID NO: 26667 - DNA, 25 bp, Mus musculus
tacaaagaccttctttcatggacta

SEQ ID NO: 26668 - DNA, 25 bp, Mus musculus
gaccttctttcatggactactttga

SEQ ID NO: 26669 - DNA, 25 bp, Mus musculus
ctttcatggactactttgataagca

SEQ ID NO: 26670 - DNA, 25 bp, Mus musculus
tgcgtgagccaggccctatgtccaa

SEQ ID NO: 26671 - DNA, 25 bp, Mus musculus
acactgggtacctgtcatgctgccg

SEQ ID NO: 26672 - DNA, 25 bp, Mus musculus
acctgtcatgctgccgcttcctgga

SEQ ID NO: 26673 - DNA, 25 bp, Mus musculus
atgtgatgtccctgtcactggcccc

SEQ ID NO: 26674 - DNA, 25 bp, Mus musculus
tgatgtccctgtcactggcccccga

SEQ ID NO: 26675 - DNA, 25 bp, Mus musculus
ccgatggccgaacctttgtgtcagg

SEQ ID NO: 26676 - DNA, 25 bp, Mus musculus
gaacctttgtgtcaggtgcctgtga

SEQ ID NO: 26677 - DNA, 25 bp, Mus musculus
ttgtgtcaggtgcctgtgacgcctc

SEQ ID NO: 26678 - DNA, 25 bp, Mus musculus
gtgcctgtgacgcctccatcaagct

SEQ ID NO: 26679 - DNA, 25 bp, Mus musculus
cctccatcaagctgtgggatgttcg

SEQ ID NO: 26680 - DNA, 25 bp, Mus musculus
ccatcaagctgtgggatgttcggga

SEQ ID NO: 26681 - DNA, 25 bp, Mus musculus
agtcggacatcaatgccgtggcttt

SEQ ID NO: 26682 - DNA, 25 bp, Mus musculus
cggacatcaatgccgtggctttctt

SEQ ID NO: 26683 - DNA, 25 bp, Mus musculus
tgtcatgctgccgcttcctggacga

SEQ ID NO: 26684 - DNA, 25 bp, Mus musculus
catgctgccgcttcctggacgacaa

SEQ ID NO: 26685 - DNA, 25 bp, Mus musculus
gccgcttcctggacgacaaccaaat

SEQ ID NO: 26686 - DNA, 25 bp, Mus musculus
gcttcctggacgacaaccaaatcat

SEQ ID NO: 26687 - DNA, 25 bp, Mus musculus
tcctggacgacaaccaaatcatcac

SEQ ID NO: 26688 - DNA, 25 bp, Mus musculus
acaaccaaatcatcaccagctctgg

SEQ ID NO: 26689 - DNA, 25 bp, Mus musculus
accaaatcatcaccagctctgggga

SEQ ID NO: 26690 - DNA, 25 bp, Mus musculus
acattgagacaggccagcagacggt

SEQ ID NO: 26691 - DNA, 25 bp, Mus musculus
aatccctgccaagcagcctgggcca

SEQ ID NO: 26692 - DNA, 25 bp, Mus musculus
tgccaagcagcctgggccagagaca

SEQ ID NO: 26693 - DNA, 25 bp, Mus musculus
tgctcattggctgcatcgctggctt

SEQ ID NO: 26694 - DNA, 25 bp, Mus musculus
ttggctgcatcgctggcttgatctt

SEQ ID NO: 26695 - DNA, 25 bp, Mus musculus
tgatcttcttgaccttcgtcacatt

SEQ ID NO: 26696 - DNA, 25 bp, Mus musculus
tcttgaccttcgtcacattctctac

SEQ ID NO: 26697 - DNA, 25 bp, Mus musculus
tctctaccaccaacggaaagctgcg

SEQ ID NO: 26698 - DNA, 25 bp, Mus musculus
agctgcggcagtgagcagctacccg

SEQ ID NO: 26699 - DNA, 25 bp, Mus musculus
gagcagctacccgcggatgtccacc

SEQ ID NO: 26700 - DNA, 25 bp, Mus musculus
tttccttcctgtggtcagaacactc

SEQ ID NO: 26701 - DNA, 25 bp, Mus musculus
tccatccctgtacagttctgctatg

SEQ ID NO: 26702 - DNA, 25 bp, Mus musculus
cctgtacagttctgctatgcttctg

SEQ ID NO: 26703 - DNA, 25 bp, Mus musculus
atcccagcagacagaagcgctcggt

SEQ ID NO: 26704 - DNA, 25 bp, Mus musculus
agttctgctatgcttctgcgaattc

SEQ ID NO: 26705 - DNA, 25 bp, Mus musculus
tggaggaccacaactggccacagta

SEQ ID NO: 26706 - DNA, 25 bp, Mus musculus
accacaactggccacagtacttcag

SEQ ID NO: 26707 - DNA, 25 bp, Mus musculus
cacagtacttcagagacccctgtga

SEQ ID NO: 26708 - DNA, 25 bp, Mus musculus
tctctgggcacgcctttttctacgc

SEQ ID NO: 26709 - DNA, 25 bp, Mus musculus
agcgctgtcaggccatgcacgtgca

SEQ ID NO: 26710 - DNA, 25 bp, Mus musculus
ccatgcacgtgcacggcagcttgct

SEQ ID NO: 26711 - DNA, 25 bp, Mus musculus
tgggcctgctcattggctgcatcgc

SEQ ID NO: 26712 - DNA, 25 bp, Mus musculus
cactgggtcctacatcgccaatcga

SEQ ID NO: 26713 - DNA, 25 bp, Mus musculus
ctacatcgccaatcgagtgactgac

SEQ ID NO: 26714 - DNA, 25 bp, Mus musculus
ttaccagcttggtttccacagtatt

SEQ ID NO: 26715 - DNA, 25 bp, Mus musculus
ccagcttggtttccacagtattgaa

SEQ ID NO: 26716 - DNA, 25 bp, Mus musculus
tttccacagtattgaactgaacgag

SEQ ID NO: 26717 - DNA, 25 bp, Mus musculus
tgaactgaacgagcctccactagtc

SEQ ID NO: 26718 - DNA, 25 bp, Mus musculus
actgaacgagcctccactagtccac

SEQ ID NO: 26719 - DNA, 25 bp, Mus musculus
ccacacagccgccagtctctttaag

SEQ ID NO: 26720 - DNA, 25 bp, Mus musculus
gatgtgttaccggtacagagaagat

SEQ ID NO: 26721 - DNA, 25 bp, Mus musculus
catcattgcaggctgggaccctcaa

SEQ ID NO: 26722 - DNA, 25 bp, Mus musculus
aatccccaagttcaccattgccacg

SEQ ID NO: 26723 - DNA, 25 bp, Mus musculus
ccccaagttcaccattgccacgttg

SEQ ID NO: 26724 - DNA, 25 bp, Mus musculus
catcgccaatcgagtgactgacaag

SEQ ID NO: 26725 - DNA, 25 bp, Mus musculus
catcttctgctgccgctcaggctca

SEQ ID NO: 26726 - DNA, 25 bp, Mus musculus
ctcaggctcagccgctgatacccaa

SEQ ID NO: 26727 - DNA, 25 bp, Mus musculus
aggctcagccgctgatacccaagct

SEQ ID NO: 26728 - DNA, 25 bp, Mus musculus
agccgctgatacccaagctgtggca

SEQ ID NO: 26729 - DNA, 25 bp, Mus musculus
cgctgatacccaagctgtggcagac

SEQ ID NO: 26730 - DNA, 25 bp, Mus musculus
tgatacccaagctgtggcagacgct

SEQ ID NO: 26731 - DNA, 25 bp, Mus musculus
tgtggcagacgctgtcacttaccag

SEQ ID NO: 26732 - DNA, 25 bp, Mus musculus
actttatacactgacagtgactttc

SEQ ID NO: 26733 - DNA, 25 bp, Mus musculus
gacagtgactttcatcccagttgca

SEQ ID NO: 26734 - DNA, 25 bp, Mus musculus
gaatctggctgcaaggaatgtgagg

SEQ ID NO: 26735 - DNA, 25 bp, Mus musculus
agctttatacgcattgtccaaatgt

SEQ ID NO: 26736 - DNA, 25 bp, Mus musculus
caaatgttcatcaacacgtcctgac

SEQ ID NO: 26737 - DNA, 25 bp, Mus musculus
aacacgtcctgactgcatgcgagcc

SEQ ID NO: 26738 - DNA, 25 bp, Mus musculus
tcctgactgcatgcgagcctcttcc

SEQ ID NO: 26739 - DNA, 25 bp, Mus musculus
gcgagcctcttccgtgtttctgtta

SEQ ID NO: 26740 - DNA, 25 bp, Mus musculus
ccacctgctgctcagaggcagcaca

SEQ ID NO: 26741 - DNA, 25 bp, Mus musculus
gctgctcagaggcagcacagctcca

SEQ ID NO: 26742 - DNA, 25 bp, Mus musculus
cagaggcagcacagctccatgcatt

SEQ ID NO: 26743 - DNA, 25 bp, Mus musculus
agctccatgcatttgaaatctgctg

SEQ ID NO: 26744 - DNA, 25 bp, Mus musculus
gactttcatcccagttgcaaagtta

SEQ ID NO: 26745 - DNA, 25 bp, Mus musculus
catcccagttgcaaagttactgcaa

SEQ ID NO: 26746 - DNA, 25 bp, Mus musculus
atgaactgctttctcctggaattgc

SEQ ID NO: 26747 - DNA, 25 bp, Mus musculus
tgctttctcctggaattgcaggtta

SEQ ID NO: 26748 - DNA, 25 bp, Mus musculus
tacagtaacatgactcttaatgaaa

SEQ ID NO: 26749 - DNA, 25 bp, Mus musculus
taccttgcaaacagcactctgtctt

SEQ ID NO: 26750 - DNA, 25 bp, Mus musculus
gcaaacagcactctgtcttctaaca

SEQ ID NO: 26751 - DNA, 25 bp, Mus musculus
agcactctgtcttctaacaagaatg

SEQ ID NO: 26752 - DNA, 25 bp, Mus musculus
gggtaaccttggcaggccatcagaa

SEQ ID NO: 26753 - DNA, 25 bp, Mus musculus
aaccttggcaggccatcagaagaag

SEQ ID NO: 26754 - DNA, 25 bp, Mus musculus
gtcaccatcggtaatggcgtgagaa

SEQ ID NO: 26755 - DNA, 25 bp, Mus musculus
ccatcggtaatggcgtgagaactcg

SEQ ID NO: 26756 - DNA, 25 bp, Mus musculus
aggttgaccactgtggaatgtgcca

SEQ ID NO: 26757 - DNA, 25 bp, Mus musculus
gttgaccactgtggaatgtgccaga

SEQ ID NO: 26758 - DNA, 25 bp, Mus musculus
accactgtggaatgtgccagaaaga

SEQ ID NO: 26759 - DNA, 25 bp, Mus musculus
agatcagcttcttggctgagaaaca

SEQ ID NO: 26760 - DNA, 25 bp, Mus musculus
atcagcttcttggctgagaaacaac

SEQ ID NO: 26761 - DNA, 25 bp, Mus musculus
acaacttcccatctgtgaagaatga

SEQ ID NO: 26762 - DNA, 25 bp, Mus musculus
aacttcccatctgtgaagaatgaac

SEQ ID NO: 26763 - DNA, 25 bp, Mus musculus
tgaactggacttgttgcccacggga

SEQ ID NO: 26764 - DNA, 25 bp, Mus musculus
ctgagtagcattcactcaatgaggg

SEQ ID NO: 26765 - DNA, 25 bp, Mus musculus
gagtagcattcactcaatgagggtc

SEQ ID NO: 26766 - DNA, 25 bp, Mus musculus
agcattcactcaatgagggtccaga

SEQ ID NO: 26767 - DNA, 25 bp, Mus musculus
cattcactcaatgagggtccagatg

SEQ ID NO: 26768 - DNA, 25 bp, Mus musculus
agatgaaccagtcaccatcggtaat

SEQ ID NO: 26769 - DNA, 25 bp, Mus musculus
atgaaccagtcaccatcggtaatgg

SEQ ID NO: 26770 - DNA, 25 bp, Mus musculus
gaaccagtcaccatcggtaatggcg

SEQ ID NO: 26771 - DNA, 25 bp, Mus musculus
cagtcaccatcggtaatggcgtgag

SEQ ID NO: 26772 - DNA, 25 bp, Mus musculus
aacgctaagctactggtgaaagagg

SEQ ID NO: 26773 - DNA, 25 bp, Mus musculus
ctcctgactgtggccctagcaggtg

SEQ ID NO: 26774 - DNA, 25 bp, Mus musculus
ctcctggcagaagcgggtgtacagc

SEQ ID NO: 26775 - DNA, 25 bp, Mus musculus
ctgctgtcctaccaaacctccatgg

SEQ ID NO: 26776 - DNA, 25 bp, Mus musculus
tcctaccaaacctccatggtgtctg

SEQ ID NO: 26777 - DNA, 25 bp, Mus musculus
caaacctccatggtgtctgacggag

SEQ ID NO: 26778 - DNA, 25 bp, Mus musculus
tccatggtgtctgacggagagccct

SEQ ID NO: 26779 - DNA, 25 bp, Mus musculus
tggcatgtcatgggcctgtcctccc

SEQ ID NO: 26780 - DNA, 25 bp, Mus musculus
tgaccctggggttcagcactctcag

SEQ ID NO: 26781 - DNA, 25 bp, Mus musculus
gccccacaggctcttctgaagaaac

SEQ ID NO: 26782 - DNA, 25 bp, Mus musculus
aaccagggcatctgcctgaactaat

SEQ ID NO: 26783 - DNA, 25 bp, Mus musculus
ggcatctgcctgaactaatacctag

SEQ ID NO: 26784 - DNA, 25 bp, Mus musculus
gtccagggcaccacaccaatgctgc

SEQ ID NO: 26785 - DNA, 25 bp, Mus musculus
acaccaatgctgcagatgctcaacg

SEQ ID NO: 26786 - DNA, 25 bp, Mus musculus
atgctgcagatgctcaacggagctg

SEQ ID NO: 26787 - DNA, 25 bp, Mus musculus
ctcaacggagctgtcttcagaccag

SEQ ID NO: 26788 - DNA, 25 bp, Mus musculus
gtcttcagaccagaggtgccactac

SEQ ID NO: 26789 - DNA, 25 bp, Mus musculus
agaccagaggtgccactacgcaggg

SEQ ID NO: 26790 - DNA, 25 bp, Mus musculus
gggatgctgcccactatgattggcc

SEQ ID NO: 26791 - DNA, 25 bp, Mus musculus
ctgcccactatgattggcctcctgg

SEQ ID NO: 26792 - DNA, 25 bp, Mus musculus
ctcctgctgggcttcttgtgctgtc

SEQ ID NO: 26793 - DNA, 25 bp, Mus musculus
cctgctgggcttcttgtgctgtcga

SEQ ID NO: 26794 - DNA, 25 bp, Mus musculus
cattacccatcgagactactgctgg

SEQ ID NO: 26795 - DNA, 25 bp, Mus musculus
gtagtcaacattgcagtgggtagct

SEQ ID NO: 26796 - DNA, 25 bp, Mus musculus
agtcaacattgcagtgggtagctgt

SEQ ID NO: 26797 - DNA, 25 bp, Mus musculus
tcaacattgcagtgggtagctgtcg

SEQ ID NO: 26798 - DNA, 25 bp, Mus musculus
gcctcctggtccgcctgtatcggct

SEQ ID NO: 26799 - DNA, 25 bp, Mus musculus
ctcctggtccgcctgtatcggctgc

SEQ ID NO: 26800 - DNA, 25 bp, Mus musculus
gtccgcctgtatcggctgctgtggg

SEQ ID NO: 26801 - DNA, 25 bp, Mus musculus
ccgcctgtatcggctgctgtgggtc

SEQ ID NO: 26802 - DNA, 25 bp, Mus musculus
gggtcctgcaacgacaacctctgtc

SEQ ID NO: 26803 - DNA, 25 bp, Mus musculus
gtcctgcaacgacaacctctgtctc

SEQ ID NO: 26804 - DNA, 25 bp, Mus musculus
tgtgctgtcgagctgggattgattg

SEQ ID NO: 26805 - DNA, 25 bp, Mus musculus
tgcaacgacaacctctgtctcaaga

SEQ ID NO: 26806 - DNA, 25 bp, Mus musculus
tgctgtcgagctgggattgattgcc

SEQ ID NO: 26807 - DNA, 25 bp, Mus musculus
tagcggtctaggatgtcttgtagca

SEQ ID NO: 26808 - DNA, 25 bp, Mus musculus
tgtagcacgccattacccatcgaga

SEQ ID NO: 26809 - DNA, 25 bp, Mus musculus
tagcacgccattacccatcgagact

SEQ ID NO: 26810 - DNA, 25 bp, Mus musculus
gcacgccattacccatcgagactac

SEQ ID NO: 26811 - DNA, 25 bp, Mus musculus
acgccattacccatcgagactactg

SEQ ID NO: 26812 - DNA, 25 bp, Mus musculus
gccattacccatcgagactactgct

SEQ ID NO: 26813 - DNA, 25 bp, Mus musculus
ttaagtcctccatgcctggttccat

SEQ ID NO: 26814 - DNA, 25 bp, Mus musculus
gttccatctgtctgccaacaaccct

SEQ ID NO: 26815 - DNA, 25 bp, Mus musculus
tatcagcaagcaatcaacttacctt

SEQ ID NO: 26816 - DNA, 25 bp, Mus musculus
caagcaatcaacttaccttgcatct

SEQ ID NO: 26817 - DNA, 25 bp, Mus musculus
ttaccttgcatctctgtgggtaatt

SEQ ID NO: 26818 - DNA, 25 bp, Mus musculus
tgcatctctgtgggtaatttcccca

SEQ ID NO: 26819 - DNA, 25 bp, Mus musculus
gttctccctttcagtctccctgtga

SEQ ID NO: 26820 - DNA, 25 bp, Mus musculus
tcctacttccctgaagcttcaactc

SEQ ID NO: 26821 - DNA, 25 bp, Mus musculus
catctgttaggcttcttactatatc

SEQ ID NO: 26822 - DNA, 25 bp, Mus musculus
ttaggcttcttactatatctatcat

SEQ ID NO: 26823 - DNA, 25 bp, Mus musculus
ctatatctatcatttactatggccc

SEQ ID NO: 26824 - DNA, 25 bp, Mus musculus
ctatcatttactatggccctacggt

SEQ ID NO: 26825 - DNA, 25 bp, Mus musculus
tctgtctgccaacaacccttggaaa

SEQ ID NO: 26826 - DNA, 25 bp, Mus musculus
ccagggttccagcactaccaagtgg

SEQ ID NO: 26827 - DNA, 25 bp, Mus musculus
ttccagcactaccaagtgggaattt

SEQ ID NO: 26828 - DNA, 25 bp, Mus musculus
agccaagacaggcaagcagggcaga

SEQ ID NO: 26829 - DNA, 25 bp, Mus musculus
agaagcacattcaacacttaatggc

SEQ ID NO: 26830 - DNA, 25 bp, Mus musculus
acattcaacacttaatggcttggct

SEQ ID NO: 26831 - DNA, 25 bp, Mus musculus
aacacttaatggcttggctatcagc

SEQ ID NO: 26832 - DNA, 25 bp, Mus musculus
cttggctatcagcaagcaatcaact

SEQ ID NO: 26833 - DNA, 25 bp, Mus musculus
cattaagcccttgtgtagagcagaa

SEQ ID NO: 26834 - DNA, 25 bp, Mus musculus
agcagaaccagcccaaacttctgcc

SEQ ID NO: 26835 - DNA, 25 bp, Mus musculus
gaaactaaatccatcctgagactca

SEQ ID NO: 26836 - DNA, 25 bp, Mus musculus
aaatccatcctgagactcaagatgt

SEQ ID NO: 26837 - DNA, 25 bp, Mus musculus
aaattgttccaccttggctcatgct

SEQ ID NO: 26838 - DNA, 25 bp, Mus musculus
cttggctcatgctgaactctttaga

SEQ ID NO: 26839 - DNA, 25 bp, Mus musculus
ttactcactcctaagctgattctag

SEQ ID NO: 26840 - DNA, 25 bp, Mus musculus
aagctgattctaggaccttgcaggc

SEQ ID NO: 26841 - DNA, 25 bp, Mus musculus
tgcaggctgcctttcatttaacgat

SEQ ID NO: 26842 - DNA, 25 bp, Mus musculus
ctgcctttcatttaacgatgttgcc

SEQ ID NO: 26843 - DNA, 25 bp, Mus musculus
agccccagcatgactgttacctaca

SEQ ID NO: 26844 - DNA, 25 bp, Mus musculus
agcatgactgttacctacattaaat

SEQ ID NO: 26845 - DNA, 25 bp, Mus musculus
ttctgccactcgaaccttcaacaac

SEQ ID NO: 26846 - DNA, 25 bp, Mus musculus
caacaaccaggacagcgtcccacat

SEQ ID NO: 26847 - DNA, 25 bp, Mus musculus
ccaggacagcgtcccacatatccat

SEQ ID NO: 26848 - DNA, 25 bp, Mus musculus
cagcgtcccacatatccattgccat

SEQ ID NO: 26849 - DNA, 25 bp, Mus musculus
tatccattgccatcagaaaccacaa

SEQ ID NO: 26850 - DNA, 25 bp, Mus musculus
ttgccatcagaaaccacaagaaaag

SEQ ID NO: 26851 - DNA, 25 bp, Mus musculus
acctgggcacctgcagacctgcaac

SEQ ID NO: 26852 - DNA, 25 bp, Mus musculus
gcagacctgcaacaccaaccagcat

SEQ ID NO: 26853 - DNA, 25 bp, Mus musculus
tatgtttatgcctgacagcatgttt

SEQ ID NO: 26854 - DNA, 25 bp, Mus musculus
gcctgacagcatgtttgtgatcgaa

SEQ ID NO: 26855 - DNA, 25 bp, Mus musculus
gcgttgtccctgcatagtgaagata

SEQ ID NO: 26856 - DNA, 25 bp, Mus musculus
ttgtccctgcatagtgaagataccc

SEQ ID NO: 26857 - DNA, 25 bp, Mus musculus
agtgaagatacccacgtgcgttctc

SEQ ID NO: 26858 - DNA, 25 bp, Mus musculus
gatacccacgtgcgttctcagtgcc

SEQ ID NO: 26859 - DNA, 25 bp, Mus musculus
acccacgtgcgttctcagtgccaga

SEQ ID NO: 26860 - DNA, 25 bp, Mus musculus
cacgtgcgttctcagtgccagaccc

SEQ ID NO: 26861 - DNA, 25 bp, Mus musculus
gtgcgttctcagtgccagaccctca

SEQ ID NO: 26862 - DNA, 25 bp, Mus musculus
cgttctcagtgccagaccctcagtg

SEQ ID NO: 26863 - DNA, 25 bp, Mus musculus
tctcagtgccagaccctcagtggga

SEQ ID NO: 26864 - DNA, 25 bp, Mus musculus
tgccagaccctcagtgggacttgtt

SEQ ID NO: 26865 - DNA, 25 bp, Mus musculus
gtattcagtatgcctttctttaaag

SEQ ID NO: 26866 - DNA, 25 bp, Mus musculus
ttcagtatgcctttctttaaagata

SEQ ID NO: 26867 - DNA, 25 bp, Mus musculus
atgtgagcttgtcacccaaagagtg

SEQ ID NO: 26868 - DNA, 25 bp, Mus musculus
gcttgtcacccaaagagtgtgtgct

SEQ ID NO: 26869 - DNA, 25 bp, Mus musculus
tgtcacccaaagagtgtgtgctctc

SEQ ID NO: 26870 - DNA, 25 bp, Mus musculus
gtgtgctctccaaacgctggaggag

SEQ ID NO: 26871 - DNA, 25 bp, Mus musculus
tgctctccaaacgctggaggagatg

SEQ ID NO: 26872 - DNA, 25 bp, Mus musculus
tctccaaacgctggaggagatgaag

SEQ ID NO: 26873 - DNA, 25 bp, Mus musculus
cctcagcaacggcaccgtgcagatt

SEQ ID NO: 26874 - DNA, 25 bp, Mus musculus
cagcaacggcaccgtgcagattaac

SEQ ID NO: 26875 - DNA, 25 bp, Mus musculus
ggtgacctacatcaacgagaagagg

SEQ ID NO: 26876 - DNA, 25 bp, Mus musculus
ctacatcaacgagaagagggacttc

SEQ ID NO: 26877 - DNA, 25 bp, Mus musculus
gtatggctgctgcaaggagctggcc

SEQ ID NO: 26878 - DNA, 25 bp, Mus musculus
ctgctgcaaggagctggccagccgc

SEQ ID NO: 26879 - DNA, 25 bp, Mus musculus
ccgcaccatggtagacaagctgctg

SEQ ID NO: 26880 - DNA, 25 bp, Mus musculus
ctgctagctctgagcctgcactgta

SEQ ID NO: 26881 - DNA, 25 bp, Mus musculus
ctagctctgagcctgcactgtaggc

SEQ ID NO: 26882 - DNA, 25 bp, Mus musculus
cgctcagcccactgtatgaattgta

SEQ ID NO: 26883 - DNA, 25 bp, Mus musculus
tcagcccactgtatgaattgtataa

SEQ ID NO: 26884 - DNA, 25 bp, Mus musculus
ggactgctctttccttagctttata

SEQ ID NO: 26885 - DNA, 25 bp, Mus musculus
ccaggaccacaccaaacttatcctg

SEQ ID NO: 26886 - DNA, 25 bp, Mus musculus
ggaccacaccaaacttatcctgtgc

SEQ ID NO: 26887 - DNA, 25 bp, Mus musculus
caaacttatcctgtgccccctgatg

SEQ ID NO: 26888 - DNA, 25 bp, Mus musculus
acttatcctgtgccccctgatggca

SEQ ID NO: 26889 - DNA, 25 bp, Mus musculus
gtgccccctgatggcagcggtgacc

SEQ ID NO: 26890 - DNA, 25 bp, Mus musculus
ccccctgatggcagcggtgacctac

SEQ ID NO: 26891 - DNA, 25 bp, Mus musculus
cctgatggcagcggtgacctacatc

SEQ ID NO: 26892 - DNA, 25 bp, Mus musculus
agcggtgacctacatcaacgagaag

SEQ ID NO: 26893 - DNA, 25 bp, Mus musculus
gaaagccatgctggccaagtttgcc

SEQ ID NO: 26894 - DNA, 25 bp, Mus musculus
gtttgccgaagatgaccgcattgag

SEQ ID NO: 26895 - DNA, 25 bp, Mus musculus
actcctcaaagaacatgctgcaaag

SEQ ID NO: 26896 - DNA, 25 bp, Mus musculus
cgatgttgacatgcttggtgaagag

SEQ ID NO: 26897 - DNA, 25 bp, Mus musculus
catagcaagaccgggcgagacctgg

SEQ ID NO: 26898 - DNA, 25 bp, Mus musculus
aagaccgggcgagacctggagtgct

SEQ ID NO: 26899 - DNA, 25 bp, Mus musculus
tcagatgctgccactagatgtcagc

SEQ ID NO: 26900 - DNA, 25 bp, Mus musculus
gctgccactagatgtcagcgtaact

SEQ ID NO: 26901 - DNA, 25 bp, Mus musculus
tgtcagcgtaactgctgttttacag

SEQ ID NO: 26902 - DNA, 25 bp, Mus musculus
tgctgttttacagttggtgacagta

SEQ ID NO: 26903 - DNA, 25 bp, Mus musculus
tggtctatctgcatgttctaaaaca

SEQ ID NO: 26904 - DNA, 25 bp, Mus musculus
ctatttcatcatgtatacagtttga

SEQ ID NO: 26905 - DNA, 25 bp, Mus musculus
tgaccgcattgagctcatgaatgcc

SEQ ID NO: 26906 - DNA, 25 bp, Mus musculus
actcattgaagaacgccggagccag

SEQ ID NO: 26907 - DNA, 25 bp, Mus musculus
tgaagaacgccggagccagttcctc

SEQ ID NO: 26908 - DNA, 25 bp, Mus musculus
gagccagttcctcgcagacaaacaa

SEQ ID NO: 26909 - DNA, 25 bp, Mus musculus
gttcctcgcagacaaacaacgtgag

SEQ ID NO: 26910 - DNA, 25 bp, Mus musculus
caaacaacgtgagctggaggaattg

SEQ ID NO: 26911 - DNA, 25 bp, Mus musculus
gcaactacagcaaaggcggcagggc

SEQ ID NO: 26912 - DNA, 25 bp, Mus musculus
acagcaaaggcggcagggctgcatc

SEQ ID NO: 26913 - DNA, 25 bp, Mus musculus
gaaagaagcgccgactcatgactct

SEQ ID NO: 26914 - DNA, 25 bp, Mus musculus
agaagcgccgactcatgactctgtc

SEQ ID NO: 26915 - DNA, 25 bp, Mus musculus
cgctggccttgcgactccaccggag

SEQ ID NO: 26916 - DNA, 25 bp, Mus musculus
gactccaccggagtctgcagcctgt

SEQ ID NO: 26917 - DNA, 25 bp, Mus musculus
actccaccggagtctgcagcctgtc

SEQ ID NO: 26918 - DNA, 25 bp, Mus musculus
accggagtctgcagcctgtccctcg

SEQ ID NO: 26919 - DNA, 25 bp, Mus musculus
gagtctgcagcctgtccctcgttat

SEQ ID NO: 26920 - DNA, 25 bp, Mus musculus
agtctgcagcctgtccctcgttatg

SEQ ID NO: 26921 - DNA, 25 bp, Mus musculus
tctgcagcctgtccctcgttatgcg

SEQ ID NO: 26922 - DNA, 25 bp, Mus musculus
ctgcagcctgtccctcgttatgcgc

SEQ ID NO: 26923 - DNA, 25 bp, Mus musculus
tgcagcctgtccctcgttatgcgca

SEQ ID NO: 26924 - DNA, 25 bp, Mus musculus
gcagcctgtccctcgttatgcgcac

SEQ ID NO: 26925 - DNA, 25 bp, Mus musculus
gaagcgccgactcatgactctgtcg

SEQ ID NO: 26926 - DNA, 25 bp, Mus musculus
aagcgccgactcatgactctgtcgg

SEQ ID NO: 26927 - DNA, 25 bp, Mus musculus
agcgccgactcatgactctgtcggt

SEQ ID NO: 26928 - DNA, 25 bp, Mus musculus
gcgccgactcatgactctgtcggta

SEQ ID NO: 26929 - DNA, 25 bp, Mus musculus
cgccgactcatgactctgtcggtat

SEQ ID NO: 26930 - DNA, 25 bp, Mus musculus
gccgactcatgactctgtcggtatg

SEQ ID NO: 26931 - DNA, 25 bp, Mus musculus
ctctcgcatgcagcacgctggcctt

SEQ ID NO: 26932 - DNA, 25 bp, Mus musculus
catgcagcacgctggccttgcgact

SEQ ID NO: 26933 - DNA, 25 bp, Mus musculus
atgaattgttcttcacattttcagt

SEQ ID NO: 26934 - DNA, 25 bp, Mus musculus
tgttcttcacattttcagttgcatc

SEQ ID NO: 26935 - DNA, 25 bp, Mus musculus
agcatcccaagtgcccagagtgctg

SEQ ID NO: 26936 - DNA, 25 bp, Mus musculus
gcccagagtgctgtgtggtctgcag

SEQ ID NO: 26937 - DNA, 25 bp, Mus musculus
tctgcagccctggatccttcaatcc

SEQ ID NO: 26938 - DNA, 25 bp, Mus musculus
tcaatccccgggatggaactcattg

SEQ ID NO: 26939 - DNA, 25 bp, Mus musculus
atggaactcattgcctccagtgcaa

SEQ ID NO: 26940 - DNA, 25 bp, Mus musculus
acaacagcctggtgtatggagcgaa

SEQ ID NO: 26941 - DNA, 25 bp, Mus musculus
agacatgcatgtaggccagggcctt

SEQ ID NO: 26942 - DNA, 25 bp, Mus musculus
tgtgggacccagcagctcattcaac

SEQ ID NO: 26943 - DNA, 25 bp, Mus musculus
acccagcagctcattcaacataaaa

SEQ ID NO: 26944 - DNA, 25 bp, Mus musculus
cagctcattcaacataaaagtatat

SEQ ID NO: 26945 - DNA, 25 bp, Mus musculus
tcacattttcagttgcatctataga

SEQ ID NO: 26946 - DNA, 25 bp, Mus musculus
taataactcactattatgccaaaat

SEQ ID NO: 26947 - DNA, 25 bp, Mus musculus
agccatgtacagaccatagttgtga

SEQ ID NO: 26948 - DNA, 25 bp, Mus musculus
gattcttcattcagcaagtagaagt

SEQ ID NO: 26949 - DNA, 25 bp, Mus musculus
agccactgcctgagatatactacat

SEQ ID NO: 26950 - DNA, 25 bp, Mus musculus
accgctgctttccagggtatggcat

SEQ ID NO: 26951 - DNA, 25 bp, Mus musculus
gctttccagggtatggcataaatgt

SEQ ID NO: 26952 - DNA, 25 bp, Mus musculus
taaatgtcctgaagcatcccaagtg

SEQ ID NO: 26953 - DNA, 25 bp, Mus musculus
tcctgaagcatcccaagtgcccaga

SEQ ID NO: 26954 - DNA, 25 bp, Mus musculus
attttaatcaatctcacagctatta

SEQ ID NO: 26955 - DNA, 25 bp, Mus musculus
tgcttaaatgcatctccaggtatat

SEQ ID NO: 26956 - DNA, 25 bp, Mus musculus
aataggactgacttctccatgtgtt

SEQ ID NO: 26957 - DNA, 25 bp, Mus musculus
actgacttctccatgtgttcccctt

SEQ ID NO: 26958 - DNA, 25 bp, Mus musculus
ttctccatgtgttccccttggactt

SEQ ID NO: 26959 - DNA, 25 bp, Mus musculus
tccccttggactttctaggatctgc

SEQ ID NO: 26960 - DNA, 25 bp, Mus musculus
ttctaggatctgccctttcttcagc

SEQ ID NO: 26961 - DNA, 25 bp, Mus musculus
ccctttcttcagcaatcagtgcaat

SEQ ID NO: 26962 - DNA, 25 bp, Mus musculus
cttcagcaatcagtgcaatcacatt

SEQ ID NO: 26963 - DNA, 25 bp, Mus musculus
caatcagtgcaatcacattggacat

SEQ ID NO: 26964 - DNA, 25 bp, Mus musculus
tggacataccaaattcaacacagta

SEQ ID NO: 26965 - DNA, 25 bp, Mus musculus
taccaaattcaacacagtaaactgt

SEQ ID NO: 26966 - DNA, 25 bp, Mus musculus
aatgcatctccaggtatatcgtttc

SEQ ID NO: 26967 - DNA, 25 bp, Mus musculus
attttcagcatttaatcagaatttc

SEQ ID NO: 26968 - DNA, 25 bp, Mus musculus
gttatattctattccactgaaaact

SEQ ID NO: 26969 - DNA, 25 bp, Mus musculus
ttctattccactgaaaactagacat

SEQ ID NO: 26970 - DNA, 25 bp, Mus musculus
tagacattaatttcaccaaaatgtt

SEQ ID NO: 26971 - DNA, 25 bp, Mus musculus
ttgcaattctgttcctgcaatagga

SEQ ID NO: 26972 - DNA, 25 bp, Mus musculus
ttctgttcctgcaataggactgact

SEQ ID NO: 26973 - DNA, 25 bp, Mus musculus
tcctgcaataggactgacttctcca

SEQ ID NO: 26974 - DNA, 25 bp, Mus musculus
tctgccaccaatatggggccctggc

SEQ ID NO: 26975 - DNA, 25 bp, Mus musculus
accaatatggggccctggctatcct

SEQ ID NO: 26976 - DNA, 25 bp, Mus musculus
ttttccatgtttctgtgggagacag

SEQ ID NO: 26977 - DNA, 25 bp, Mus musculus
gcaattcttccacacacttggagca

SEQ ID NO: 26978 - DNA, 25 bp, Mus musculus
ccaagctcagttcagcagggaactg

SEQ ID NO: 26979 - DNA, 25 bp, Mus musculus
gtgcgctcctcttggttgagggacc

SEQ ID NO: 26980 - DNA, 25 bp, Mus musculus
tcctcttggttgagggacctgacaa

SEQ ID NO: 26981 - DNA, 25 bp, Mus musculus
acaagaccctggatgagaggaggat

SEQ ID NO: 26982 - DNA, 25 bp, Mus musculus
tctggactggtgtttcttggcagct

SEQ ID NO: 26983 - DNA, 25 bp, Mus musculus
ctggtgtttcttggcagctgtcccc

SEQ ID NO: 26984 - DNA, 25 bp, Mus musculus
tttcttggcagctgtcccctgtcct

SEQ ID NO: 26985 - DNA, 25 bp, Mus musculus
ttccatacactcatctctggaatca

SEQ ID NO: 26986 - DNA, 25 bp, Mus musculus
ctttcttcctactgcctgggatatt

SEQ ID NO: 26987 - DNA, 25 bp, Mus musculus
tttaacagctcgaaatggctcccag

SEQ ID NO: 26988 - DNA, 25 bp, Mus musculus
agctcgaaatggctcccagtattac

SEQ ID NO: 26989 - DNA, 25 bp, Mus musculus
aaatggctcccagtattactgtaca

SEQ ID NO: 26990 - DNA, 25 bp, Mus musculus
ctcccagtattactgtacacaggat

SEQ ID NO: 26991 - DNA, 25 bp, Mus musculus
caccctgaagtcatattgtattgta

SEQ ID NO: 26992 - DNA, 25 bp, Mus musculus
tagcacccgtagctgcccagggaaa

SEQ ID NO: 26993 - DNA, 25 bp, Mus musculus
tcacactttcttcataggttttcca

SEQ ID NO: 26994 - DNA, 25 bp, Mus musculus
aatgttacagcatcacacttatatt

SEQ ID NO: 26995 - DNA, 25 bp, Mus musculus
ttctaatgatccattatatcctaat

SEQ ID NO: 26996 - DNA, 25 bp, Mus musculus
tattatgcatttaacctgtgaactc

SEQ ID NO: 26997 - DNA, 25 bp, Mus musculus
aacctgtgaactcatagttatgaga

SEQ ID NO: 26998 - DNA, 25 bp, Mus musculus
gaggactgccagacctctcgatgtt

SEQ ID NO: 26999 - DNA, 25 bp, Mus musculus
gactgccagacctctcgatgttcta

SEQ ID NO: 27000 - DNA, 25 bp, Mus musculus
tgccagacctctcgatgttctagat

SEQ ID NO: 27001 - DNA, 25 bp, Mus musculus
acctctcgatgttctagatatagac

SEQ ID NO: 27002 - DNA, 25 bp, Mus musculus
tatagacttgatgccctgccttgag

SEQ ID NO: 27003 - DNA, 25 bp, Mus musculus
cttgatgccctgccttgagcattgt

SEQ ID NO: 27004 - DNA, 25 bp, Mus musculus
gatgccctgccttgagcattgtgga

SEQ ID NO: 27005 - DNA, 25 bp, Mus musculus
gccctgccttgagcattgtggagtt

SEQ ID NO: 27006 - DNA, 25 bp, Mus musculus
tgatccattatatcctaattaatgt

SEQ ID NO: 27007 - DNA, 25 bp, Mus musculus
tgatcttaataaccctatttatgat

SEQ ID NO: 27008 - DNA, 25 bp, Mus musculus
ttatgatctgttgtagtctgctgct

SEQ ID NO: 27009 - DNA, 25 bp, Mus musculus
gtatgttctggcttttcctggagta

SEQ ID NO: 27010 - DNA, 25 bp, Mus musculus
tgttctggcttttcctggagtatat

SEQ ID NO: 27011 - DNA, 25 bp, Mus musculus
tctggcttttcctggagtatatctt

SEQ ID NO: 27012 - DNA, 25 bp, Mus musculus
ttttcctggagtatatcttctaaag

SEQ ID NO: 27013 - DNA, 25 bp, Mus musculus
tctagactagcctatgattagccta

SEQ ID NO: 27014 - DNA, 25 bp, Mus musculus
gaaatccagtcagtccgacgccaca

SEQ ID NO: 27015 - DNA, 25 bp, Mus musculus
cgccacaccaacagcgtgctggaag

SEQ ID NO: 27016 - DNA, 25 bp, Mus musculus
ttcctcagggagcagaggatgttca

SEQ ID NO: 27017 - DNA, 25 bp, Mus musculus
atgttcatgatccagaccattgcgc

SEQ ID NO: 27018 - DNA, 25 bp, Mus musculus
atgatccagaccattgcgcagtaca

SEQ ID NO: 27019 - DNA, 25 bp, Mus musculus
cagaccattgcgcagtacaagttcg

SEQ ID NO: 27020 - DNA, 25 bp, Mus musculus
caagtcctcgtccagttcctgcaga

SEQ ID NO: 27021 - DNA, 25 bp, Mus musculus
ctcgtccagttcctgcagaattcca

SEQ ID NO: 27022 - DNA, 25 bp, Mus musculus
aggctcatttgatctcctccgggat

SEQ ID NO: 27023 - DNA, 25 bp, Mus musculus
atttgatctcctccgggatgcagct

SEQ ID NO: 27024 - DNA, 25 bp, Mus musculus
tctcctccgggatgcagcttctgga

SEQ ID NO: 27025 - DNA, 25 bp, Mus musculus
agttactcacaaacatcatgtatta

SEQ ID NO: 27026 - DNA, 25 bp, Mus musculus
accaacagcgtgctggaaggcatca

SEQ ID NO: 27027 - DNA, 25 bp, Mus musculus
ctctctgagctcatgatctactgcc

SEQ ID NO: 27028 - DNA, 25 bp, Mus musculus
gagctcatgatctactgcctggaac

SEQ ID NO: 27029 - DNA, 25 bp, Mus musculus
atgatctactgcctggaacacaacg

SEQ ID NO: 27030 - DNA, 25 bp, Mus musculus
tactgcctggaacacaacgaaaagg

SEQ ID NO: 27031 - DNA, 25 bp, Mus musculus
gtgcccacgatgctgcgattcctca

SEQ ID NO: 27032 - DNA, 25 bp, Mus musculus
acgatgctgcgattcctcagggagc

SEQ ID NO: 27033 - DNA, 25 bp, Mus musculus
ctgcgattcctcagggagcagagga

SEQ ID NO: 27034 - DNA, 25 bp, Mus musculus
agctacatctacgtcaggaggccaa

SEQ ID NO: 27035 - DNA, 25 bp, Mus musculus
gctacatctacgtcaggaggccaac

SEQ ID NO: 27036 - DNA, 25 bp, Mus musculus
ccacttctatacctgactcatgagg

SEQ ID NO: 27037 - DNA, 25 bp, Mus musculus
tatacctgactcatgaggccagcat

SEQ ID NO: 27038 - DNA, 25 bp, Mus musculus
atacctgactcatgaggccagcatt

SEQ ID NO: 27039 - DNA, 25 bp, Mus musculus
acctgactcatgaggccagcattac

SEQ ID NO: 27040 - DNA, 25 bp, Mus musculus
ctgactcatgaggccagcattaccg

SEQ ID NO: 27041 - DNA, 25 bp, Mus musculus
tgactcatgaggccagcattaccgt

SEQ ID NO: 27042 - DNA, 25 bp, Mus musculus
gactcatgaggccagcattaccgtg

SEQ ID NO: 27043 - DNA, 25 bp, Mus musculus
actcatgaggccagcattaccgtgt

SEQ ID NO: 27044 - DNA, 25 bp, Mus musculus
agcattaccgtgtggttgataccga

SEQ ID NO: 27045 - DNA, 25 bp, Mus musculus
cattaccgtgtggttgataccgagt

SEQ ID NO: 27046 - DNA, 25 bp, Mus musculus
ctacatctacgtcaggaggccaaca

SEQ ID NO: 27047 - DNA, 25 bp, Mus musculus
tacatctacgtcaggaggccaacat

SEQ ID NO: 27048 - DNA, 25 bp, Mus musculus
catctacgtcaggaggccaacattc

SEQ ID NO: 27049 - DNA, 25 bp, Mus musculus
atctacgtcaggaggccaacattcg

SEQ ID NO: 27050 - DNA, 25 bp, Mus musculus
tctacgtcaggaggccaacattcgg

SEQ ID NO: 27051 - DNA, 25 bp, Mus musculus
ctacgtcaggaggccaacattcggc

SEQ ID NO: 27052 - DNA, 25 bp, Mus musculus
gcccacttctatacctgactcatga

SEQ ID NO: 27053 - DNA, 25 bp, Mus musculus
cccacttctatacctgactcatgag

SEQ ID NO: 27054 - DNA, 25 bp, Mus musculus
taagacgtgctctgagggaatatca

SEQ ID NO: 27055 - DNA, 25 bp, Mus musculus
gggaatatcagcaccagtcgcccaa

SEQ ID NO: 27056 - DNA, 25 bp, Mus musculus
cttcatgtagttccagatgggactg

SEQ ID NO: 27057 - DNA, 25 bp, Mus musculus
gtagttccagatgggactggaagtc

SEQ ID NO: 27058 - DNA, 25 bp, Mus musculus
gttccagatgggactggaagtcatt

SEQ ID NO: 27059 - DNA, 25 bp, Mus musculus
gtaatttcttgcatatgcaacatct

SEQ ID NO: 27060 - DNA, 25 bp, Mus musculus
atttcttgcatatgcaacatcttaa

SEQ ID NO: 27061 - DNA, 25 bp, Mus musculus
tcttgcatatgcaacatcttaaaag

SEQ ID NO: 27062 - DNA, 25 bp, Mus musculus
tgcatatgcaacatcttaaaagggg

SEQ ID NO: 27063 - DNA, 25 bp, Mus musculus
atagcagcttatacacatatatgaa

SEQ ID NO: 27064 - DNA, 25 bp, Mus musculus
gcagcttatacacatatatgaaaat

SEQ ID NO: 27065 - DNA, 25 bp, Mus musculus
tgtctattgttttgcacgaattaat

SEQ ID NO: 27066 - DNA, 25 bp, Mus musculus
atcagcaccagtcgcccaaggactt

SEQ ID NO: 27067 - DNA, 25 bp, Mus musculus
agcaccagtcgcccaaggacttggc

SEQ ID NO: 27068 - DNA, 25 bp, Mus musculus
agtcgcccaaggacttggcttcatg

SEQ ID NO: 27069 - DNA, 25 bp, Mus musculus
cgcccaaggacttggcttcatgtag

SEQ ID NO: 27070 - DNA, 25 bp, Mus musculus
ccaaggacttggcttcatgtagttc

SEQ ID NO: 27071 - DNA, 25 bp, Mus musculus
aggacttggcttcatgtagttccag

SEQ ID NO: 27072 - DNA, 25 bp, Mus musculus
acttggcttcatgtagttccagatg

SEQ ID NO: 27073 - DNA, 25 bp, Mus musculus
tggcttcatgtagttccagatggga

SEQ ID NO: 27074 - DNA, 25 bp, Mus musculus
gaaccatgtcaagcggatagcagct

SEQ ID NO: 27075 - DNA, 25 bp, Mus musculus
cagatacaactccgtgaggcaaagg

SEQ ID NO: 27076 - DNA, 25 bp, Mus musculus
ttacttcaacatgtaccttatactc

SEQ ID NO: 27077 - DNA, 25 bp, Mus musculus
caacatgtaccttatactcatcatg

SEQ ID NO: 27078 - DNA, 25 bp, Mus musculus
gtaccttatactcatcatgtgcaac

SEQ ID NO: 27079 - DNA, 25 bp, Mus musculus
cgtctgttgtcacggattccggcga

SEQ ID NO: 27080 - DNA, 25 bp, Mus musculus
ctctcgtctctcagtcaattaggtt

SEQ ID NO: 27081 - DNA, 25 bp, Mus musculus
tctctcagtcaattaggttcagcca

SEQ ID NO: 27082 - DNA, 25 bp, Mus musculus
aggctgctaaggctctcagatgtat

SEQ ID NO: 27083 - DNA, 25 bp, Mus musculus
ctaaggctctcagatgtattgttcc

SEQ ID NO: 27084 - DNA, 25 bp, Mus musculus
acatgtgaattgtctccgtggtgga

SEQ ID NO: 27085 - DNA, 25 bp, Mus musculus
gaattgtctccgtggtggaaatggt

SEQ ID NO: 27086 - DNA, 25 bp, Mus musculus
caactccgtgaggcaaaggaccagc

SEQ ID NO: 27087 - DNA, 25 bp, Mus musculus
gattttcattgtctgctggtctccc

SEQ ID NO: 27088 - DNA, 25 bp, Mus musculus
cattgtctgctggtctcccttcttt

SEQ ID NO: 27089 - DNA, 25 bp, Mus musculus
tcttcaccttatcttaatgatctcc

SEQ ID NO: 27090 - DNA, 25 bp, Mus musculus
ccttatcttaatgatctcctgccct

SEQ ID NO: 27091 - DNA, 25 bp, Mus musculus
cttaatgatctcctgccctcagaac

SEQ ID NO: 27092 - DNA, 25 bp, Mus musculus
tcagaacgtctactgctcttgcttt

SEQ ID NO: 27093 - DNA, 25 bp, Mus musculus
tatgtcttacttcaacatgtacctt

SEQ ID NO: 27094 - DNA, 25 bp, Mus musculus
tatatcttcacttgaacccaagtca

SEQ ID NO: 27095 - DNA, 25 bp, Mus musculus
acttgaacccaagtcattttgatat

SEQ ID NO: 27096 - DNA, 25 bp, Mus musculus
ttggtcatgtgctgtaccatctgcc

SEQ ID NO: 27097 - DNA, 25 bp, Mus musculus
atgtgctgtaccatctgccacaaga

SEQ ID NO: 27098 - DNA, 25 bp, Mus musculus
tgtaccatctgccacaagatatttt

SEQ ID NO: 27099 - DNA, 25 bp, Mus musculus
ttccacggaagacactagtcagtac

SEQ ID NO: 27100 - DNA, 25 bp, Mus musculus
tagtcagtactccttagttttctct

SEQ ID NO: 27101 - DNA, 25 bp, Mus musculus
ctctacccacagcgtttgatgtatt

SEQ ID NO: 27102 - DNA, 25 bp, Mus musculus
tacccacagcgtttgatgtattatt

SEQ ID NO: 27103 - DNA, 25 bp, Mus musculus
tgcaggcctcagtaatttgggatta

SEQ ID NO: 27104 - DNA, 25 bp, Mus musculus
attcttctaccaaagattgattaca

SEQ ID NO: 27105 - DNA, 25 bp, Mus musculus
cttctaccaaagattgattacaagc

SEQ ID NO: 27106 - DNA, 25 bp, Mus musculus
tgaacccaagtcattttgatattat

SEQ ID NO: 27107 - DNA, 25 bp, Mus musculus
ctggcaaaagccttctatttatgac

SEQ ID NO: 27108 - DNA, 25 bp, Mus musculus
gcaaaagccttctatttatgacaac

SEQ ID NO: 27109 - DNA, 25 bp, Mus musculus
aaagccttctatttatgacaacact

SEQ ID NO: 27110 - DNA, 25 bp, Mus musculus
ttctatttatgacaacacttggtca

SEQ ID NO: 27111 - DNA, 25 bp, Mus musculus
tatttatgacaacacttggtcatgt

SEQ ID NO: 27112 - DNA, 25 bp, Mus musculus
ttatgacaacacttggtcatgtgct

SEQ ID NO: 27113 - DNA, 25 bp, Mus musculus
cacttggtcatgtgctgtaccatct

SEQ ID NO: 27114 - DNA, 25 bp, Mus musculus
gccttcactcttctgcacgctatgg

SEQ ID NO: 27115 - DNA, 25 bp, Mus musculus
actcttctgcacgctatggcagcca

SEQ ID NO: 27116 - DNA, 25 bp, Mus musculus
agtcttgccgtgggctgaagctgat

SEQ ID NO: 27117 - DNA, 25 bp, Mus musculus
agctgatgtaccgctacgatgagga

SEQ ID NO: 27118 - DNA, 25 bp, Mus musculus
tcatcagtttggtcaaccagatatg

SEQ ID NO: 27119 - DNA, 25 bp, Mus musculus
aagtgtctggcaaacacggtggcat

SEQ ID NO: 27120 - DNA, 25 bp, Mus musculus
tcgagaactgtctcaacaaacccac

SEQ ID NO: 27121 - DNA, 25 bp, Mus musculus
tcccatcctcatgaagatgccgaac

SEQ ID NO: 27122 - DNA, 25 bp, Mus musculus
gaagatgccgaacccatggtcactt

SEQ ID NO: 27123 - DNA, 25 bp, Mus musculus
gccgaacccatggtcacttatatat

SEQ ID NO: 27124 - DNA, 25 bp, Mus musculus
aagctgtctttgcactagctctaaa

SEQ ID NO: 27125 - DNA, 25 bp, Mus musculus
tctttgcactagctctaaagaagaa

SEQ ID NO: 27126 - DNA, 25 bp, Mus musculus
acgacggcaacagcacagtggcgga

SEQ ID NO: 27127 - DNA, 25 bp, Mus musculus
gcaacagcacagtggcggatgggaa

SEQ ID NO: 27128 - DNA, 25 bp, Mus musculus
agcctcgaaagtggctacagctgga

SEQ ID NO: 27129 - DNA, 25 bp, Mus musculus
gccagatctgccagcacttgtgcta

SEQ ID NO: 27130 - DNA, 25 bp, Mus musculus
agcacttgtgctacctgtccatggt

SEQ ID NO: 27131 - DNA, 25 bp, Mus musculus
tgttctgcctggagtgtgcactgcg

SEQ ID NO: 27132 - DNA, 25 bp, Mus musculus
agtgtgcactgcgccatgtggagaa

SEQ ID NO: 27133 - DNA, 25 bp, Mus musculus
cactgcgccatgtggagaagcagaa

SEQ ID NO: 27134 - DNA, 25 bp, Mus musculus
aaactcgagcttccgccgctcggat

SEQ ID NO: 27135 - DNA, 25 bp, Mus musculus
ccgctcggatcatccaagtgtttga

SEQ ID NO: 27136 - DNA, 25 bp, Mus musculus
ccgcaagtacactcaggctgagggt

SEQ ID NO: 27137 - DNA, 25 bp, Mus musculus
gtacactcaggctgagggtaaaaag

SEQ ID NO: 27138 - DNA, 25 bp, Mus musculus
caccgtgcaagggcaactgcagggc

SEQ ID NO: 27139 - DNA, 25 bp, Mus musculus
ggtgcgcttcatgcagcagtggctg

SEQ ID NO: 27140 - DNA, 25 bp, Mus musculus
gcgcttcatgcagcagtggctggag

SEQ ID NO: 27141 - DNA, 25 bp, Mus musculus
cttcatgcagcagtggctggagacc

SEQ ID NO: 27142 - DNA, 25 bp, Mus musculus
catgcagcagtggctggagaccaga

SEQ ID NO: 27143 - DNA, 25 bp, Mus musculus
aggaagtcccaagtcgcacattgac

SEQ ID NO: 27144 - DNA, 25 bp, Mus musculus
aagtcccaagtcgcacattgacaga

SEQ ID NO: 27145 - DNA, 25 bp, Mus musculus
tcccaagtcgcacattgacagagca

SEQ ID NO: 27146 - DNA, 25 bp, Mus musculus
ggatcatccaagtgtttgagcatgg

SEQ ID NO: 27147 - DNA, 25 bp, Mus musculus
tcatccaagtgtttgagcatggcat

SEQ ID NO: 27148 - DNA, 25 bp, Mus musculus
aggggacaccttggtctcagtggat

SEQ ID NO: 27149 - DNA, 25 bp, Mus musculus
ggacaccttggtctcagtggattac

SEQ ID NO: 27150 - DNA, 25 bp, Mus musculus
caccttggtctcagtggattacgaa

SEQ ID NO: 27151 - DNA, 25 bp, Mus musculus
cttggtctcagtggattacgaaatt

SEQ ID NO: 27152 - DNA, 25 bp, Mus musculus
ggtgtttttccgcaagtacactcag

SEQ ID NO: 27153 - DNA, 25 bp, Mus musculus
gtttttccgcaagtacactcaggct

SEQ ID NO: 27154 - DNA, 25 bp, Mus musculus
tgatcaaatccagccgtcctttgcg

SEQ ID NO: 27155 - DNA, 25 bp, Mus musculus
tggctgcctttttcctctgctggtg

SEQ ID NO: 27156 - DNA, 25 bp, Mus musculus
tccactctttacctgccagcctaga

SEQ ID NO: 27157 - DNA, 25 bp, Mus musculus
ctttacctgccagcctagagagggc

SEQ ID NO: 27158 - DNA, 25 bp, Mus musculus
ctgccagcctagagagggccctgac

SEQ ID NO: 27159 - DNA, 25 bp, Mus musculus
actcagctcagaccagtgatacagg

SEQ ID NO: 27160 - DNA, 25 bp, Mus musculus
gctctaacttccagcttcatctgct

SEQ ID NO: 27161 - DNA, 25 bp, Mus musculus
agcttcatctgctttgagttccact

SEQ ID NO: 27162 - DNA, 25 bp, Mus musculus
atctgctttgagttccactgtgcta

SEQ ID NO: 27163 - DNA, 25 bp, Mus musculus
tttgagttccactgtgctataggca

SEQ ID NO: 27164 - DNA, 25 bp, Mus musculus
tgttgaccttcaggctacatgctca

SEQ ID NO: 27165 - DNA, 25 bp, Mus musculus
ccttcaggctacatgctcattagga

SEQ ID NO: 27166 - DNA, 25 bp, Mus musculus
tcctctgctggtgcccatttcaagt

SEQ ID NO: 27167 - DNA, 25 bp, Mus musculus
gctacatgctcattaggaaaacttg

SEQ ID NO: 27168 - DNA, 25 bp, Mus musculus
gctggtgcccatttcaagtagtggc

SEQ ID NO: 27169 - DNA, 25 bp, Mus musculus
ttcaagtagtggccctcatatccac

SEQ ID NO: 27170 - DNA, 25 bp, Mus musculus
tatccacaatccaagtccgtgaacg

SEQ ID NO: 27171 - DNA, 25 bp, Mus musculus
agaacatgactccaggcattgtaac

SEQ ID NO: 27172 - DNA, 25 bp, Mus musculus
tgactccaggcattgtaactgcttt

SEQ ID NO: 27173 - DNA, 25 bp, Mus musculus
gcctcaatccaatgctttatgtctt

SEQ ID NO: 27174 - DNA, 25 bp, Mus musculus
ttatgggccaggacttcagagaaag

SEQ ID NO: 27175 - DNA, 25 bp, Mus musculus
atgcatcaccctcgtgtaactaagc

SEQ ID NO: 27176 - DNA, 25 bp, Mus musculus
caccctcgtgtaactaagctccaag

SEQ ID NO: 27177 - DNA, 25 bp, Mus musculus
gaggaacctgtcttcagctctatgg

SEQ ID NO: 27178 - DNA, 25 bp, Mus musculus
cctgtcttcagctctatggtgaccc

SEQ ID NO: 27179 - DNA, 25 bp, Mus musculus
gtcttcagctctatggtgacccttt

SEQ ID NO: 27180 - DNA, 25 bp, Mus musculus
gattggtccttagccccgaattgtg

SEQ ID NO: 27181 - DNA, 25 bp, Mus musculus
gttagtttgctctttgatcacttaa

SEQ ID NO: 27182 - DNA, 25 bp, Mus musculus
ttgctctttgatcacttaaaatgga

SEQ ID NO: 27183 - DNA, 25 bp, Mus musculus
ttttaatgttcattcaagtgacagg

SEQ ID NO: 27184 - DNA, 25 bp, Mus musculus
agattggacacgtcagactgtgaca

SEQ ID NO: 27185 - DNA, 25 bp, Mus musculus
gacatagcagcatttctgtgctgaa

SEQ ID NO: 27186 - DNA, 25 bp, Mus musculus
gcagcatttctgtgctgaactgtta

SEQ ID NO: 27187 - DNA, 25 bp, Mus musculus
cgtgtaactaagctccaagcactgt

SEQ ID NO: 27188 - DNA, 25 bp, Mus musculus
gtaactaagctccaagcactgttgc

SEQ ID NO: 27189 - DNA, 25 bp, Mus musculus
ctccaagcactgttgctgcttcagg

SEQ ID NO: 27190 - DNA, 25 bp, Mus musculus
caagcactgttgctgcttcagggga

SEQ ID NO: 27191 - DNA, 25 bp, Mus musculus
gcactgttgctgcttcaggggaaaa

SEQ ID NO: 27192 - DNA, 25 bp, Mus musculus
ttgctgcttcaggggaaaagggctt

SEQ ID NO: 27193 - DNA, 25 bp, Mus musculus
tttggatctgtgcagcggattccca

SEQ ID NO: 27194 - DNA, 25 bp, Mus musculus
tctgtgcagcggattcccatggcgg

SEQ ID NO: 27195 - DNA, 25 bp, Mus musculus
tcattgagaacgccccagtgcacag

SEQ ID NO: 27196 - DNA, 25 bp, Mus musculus
ttgagaacgccccagtgcacagatg

SEQ ID NO: 27197 - DNA, 25 bp, Mus musculus
aagcaggctcattcatgatatcagt

SEQ ID NO: 27198 - DNA, 25 bp, Mus musculus
caggctcattcatgatatcagttgt

SEQ ID NO: 27199 - DNA, 25 bp, Mus musculus
gctcattcatgatatcagttgtgtc

SEQ ID NO: 27200 - DNA, 25 bp, Mus musculus
cagatatatacccaatcgtgatcct

SEQ ID NO: 27201 - DNA, 25 bp, Mus musculus
atatatacccaatcgtgatcctctg

SEQ ID NO: 27202 - DNA, 25 bp, Mus musculus
tatacccaatcgtgatcctctggac

SEQ ID NO: 27203 - DNA, 25 bp, Mus musculus
acccaatcgtgatcctctggacaag

SEQ ID NO: 27204 - DNA, 25 bp, Mus musculus
caatcgtgatcctctggacaagtgt

SEQ ID NO: 27205 - DNA, 25 bp, Mus musculus
tgatcctctggacaagtgtagaacc

SEQ ID NO: 27206 - DNA, 25 bp, Mus musculus
atcctctggacaagtgtagaaccct

SEQ ID NO: 27207 - DNA, 25 bp, Mus musculus
agaacgccccagtgcacagatggca

SEQ ID NO: 27208 - DNA, 25 bp, Mus musculus
acgccccagtgcacagatggcagag

SEQ ID NO: 27209 - DNA, 25 bp, Mus musculus
ccccagtgcacagatggcagagctc

SEQ ID NO: 27210 - DNA, 25 bp, Mus musculus
caggtcatcatttcgatccaaacta

SEQ ID NO: 27211 - DNA, 25 bp, Mus musculus
gtcatcatttcgatccaaactaaat

SEQ ID NO: 27212 - DNA, 25 bp, Mus musculus
atcatttcgatccaaactaaattgc

SEQ ID NO: 27213 - DNA, 25 bp, Mus musculus
atttcgatccaaactaaattgcaga

SEQ ID NO: 27214 - DNA, 25 bp, Mus musculus
gcacagttcaagttgcctcgccgcc

SEQ ID NO: 27215 - DNA, 25 bp, Mus musculus
gcgctgtacgcttaccactggaaac

SEQ ID NO: 27216 - DNA, 25 bp, Mus musculus
gctgtacgcttaccactggaaacct

SEQ ID NO: 27217 - DNA, 25 bp, Mus musculus
cctgcaatccagacaggttgacacg

SEQ ID NO: 27218 - DNA, 25 bp, Mus musculus
tgcaatccagacaggttgacacgtt

SEQ ID NO: 27219 - DNA, 25 bp, Mus musculus
atccagacaggttgacacgttttcg

SEQ ID NO: 27220 - DNA, 25 bp, Mus musculus
gttgacacgttttcggtagcaggat

SEQ ID NO: 27221 - DNA, 25 bp, Mus musculus
tgacacgttttcggtagcaggattt

SEQ ID NO: 27222 - DNA, 25 bp, Mus musculus
agacatgggttccttgctagtgctc

SEQ ID NO: 27223 - DNA, 25 bp, Mus musculus
acatgggttccttgctagtgctctg

SEQ ID NO: 27224 - DNA, 25 bp, Mus musculus
cttgctagtgctctgagttcgatga

SEQ ID NO: 27225 - DNA, 25 bp, Mus musculus
tgctagtgctctgagttcgatgaag

SEQ ID NO: 27226 - DNA, 25 bp, Mus musculus
ctagtgctctgagttcgatgaagag

SEQ ID NO: 27227 - DNA, 25 bp, Mus musculus
tgtacgcttaccactggaaacctgc

SEQ ID NO: 27228 - DNA, 25 bp, Mus musculus
tacgcttaccactggaaacctgcaa

SEQ ID NO: 27229 - DNA, 25 bp, Mus musculus
cttaccactggaaacctgcaatcca

SEQ ID NO: 27230 - DNA, 25 bp, Mus musculus
taccactggaaacctgcaatccaga

SEQ ID NO: 27231 - DNA, 25 bp, Mus musculus
ccactggaaacctgcaatccagaca

SEQ ID NO: 27232 - DNA, 25 bp, Mus musculus
actggaaacctgcaatccagacagg

SEQ ID NO: 27233 - DNA, 25 bp, Mus musculus
gaaacctgcaatccagacaggttga

SEQ ID NO: 27234 - DNA, 25 bp, Mus musculus
aacctgcaatccagacaggttgaca

SEQ ID NO: 27235 - DNA, 25 bp, Mus musculus
taccaagcccatcagtgaggtgcta

SEQ ID NO: 27236 - DNA, 25 bp, Mus musculus
atccgacatgacaggcaacaccgta

SEQ ID NO: 27237 - DNA, 25 bp, Mus musculus
tgatgtacctaaactggtgactgag

SEQ ID NO: 27238 - DNA, 25 bp, Mus musculus
acctaaactggtgactgagttcctg

SEQ ID NO: 27239 - DNA, 25 bp, Mus musculus
gaagtttgacctggaccagttgata

SEQ ID NO: 27240 - DNA, 25 bp, Mus musculus
aagcattcggactgtcctgacattt

SEQ ID NO: 27241 - DNA, 25 bp, Mus musculus
tcggactgtcctgacattttgagtt

SEQ ID NO: 27242 - DNA, 25 bp, Mus musculus
ttgagttccagagacctgggtgttc

SEQ ID NO: 27243 - DNA, 25 bp, Mus musculus
tccagagacctgggtgttctgagct

SEQ ID NO: 27244 - DNA, 25 bp, Mus musculus
ctgagctgggctaccgtgacctgaa

SEQ ID NO: 27245 - DNA, 25 bp, Mus musculus
accgtgacctgaagccttgctcctg

SEQ ID NO: 27246 - DNA, 25 bp, Mus musculus
acctgaagccttgctcctgacagtg

SEQ ID NO: 27247 - DNA, 25 bp, Mus musculus
catgacaggcaacaccgtacagtat

SEQ ID NO: 27248 - DNA, 25 bp, Mus musculus
gccttgctcctgacagtgttctctg

SEQ ID NO: 27249 - DNA, 25 bp, Mus musculus
tattgggcgtcttgagaccatggtt

SEQ ID NO: 27250 - DNA, 25 bp, Mus musculus
catggttgatgccctctcatcttgc

SEQ ID NO: 27251 - DNA, 25 bp, Mus musculus
cctctcatcttgccatatgaactat

SEQ ID NO: 27252 - DNA, 25 bp, Mus musculus
gaactatgggaccagtgtggtggtt

SEQ ID NO: 27253 - DNA, 25 bp, Mus musculus
gtcagccaagatgctcacctatgac

SEQ ID NO: 27254 - DNA, 25 bp, Mus musculus
caagatgctcacctatgacccaatg

SEQ ID NO: 27255 - DNA, 25 bp, Mus musculus
ctatgacccaatgctgctcttcact

SEQ ID NO: 27256 - DNA, 25 bp, Mus musculus
gctactcgcgctgtgacattccaag

SEQ ID NO: 27257 - DNA, 25 bp, Mus musculus
actcgcgctgtgacattccaagcta

SEQ ID NO: 27258 - DNA, 25 bp, Mus musculus
atgggcccttaagaactgtgtggat

SEQ ID NO: 27259 - DNA, 25 bp, Mus musculus
ggcccttaagaactgtgtggattgc

SEQ ID NO: 27260 - DNA, 25 bp, Mus musculus
ttgccagaaatcctccaggattcgc

SEQ ID NO: 27261 - DNA, 25 bp, Mus musculus
ccagaaatcctccaggattcgcctt

SEQ ID NO: 27262 - DNA, 25 bp, Mus musculus
gaaatcctccaggattcgcctttgt

SEQ ID NO: 27263 - DNA, 25 bp, Mus musculus
atcctccaggattcgcctttgtgga

SEQ ID NO: 27264 - DNA, 25 bp, Mus musculus
ctccaggattcgcctttgtggaatt

SEQ ID NO: 27265 - DNA, 25 bp, Mus musculus
caggattcgcctttgtggaatttga

SEQ ID NO: 27266 - DNA, 25 bp, Mus musculus
gattcgcctttgtggaatttgaaga

SEQ ID NO: 27267 - DNA, 25 bp, Mus musculus
aagaccctagagatgcagaggatgc

SEQ ID NO: 27268 - DNA, 25 bp, Mus musculus
gctgtgacattccaagctagagccg

SEQ ID NO: 27269 - DNA, 25 bp, Mus musculus
gtgacattccaagctagagccgagt

SEQ ID NO: 27270 - DNA, 25 bp, Mus musculus
acattccaagctagagccgagtaca

SEQ ID NO: 27271 - DNA, 25 bp, Mus musculus
ttccaagctagagccgagtacacgg

SEQ ID NO: 27272 - DNA, 25 bp, Mus musculus
agagccgagtacacgggccggccat

SEQ ID NO: 27273 - DNA, 25 bp, Mus musculus
cggccatcatgtcacgctacgggcg

SEQ ID NO: 27274 - DNA, 25 bp, Mus musculus
ccatcatgtcacgctacgggcggta

SEQ ID NO: 27275 - DNA, 25 bp, Mus musculus
actatgggcccttaagaactgtgtg

SEQ ID NO: 27276 - DNA, 25 bp, Mus musculus
tcaactgatgacttgtgatgtcttt

SEQ ID NO: 27277 - DNA, 25 bp, Mus musculus
ttttccaacaggattcaatcacttc

SEQ ID NO: 27278 - DNA, 25 bp, Mus musculus
ctcattgtgaagtcccttaagagta

SEQ ID NO: 27279 - DNA, 25 bp, Mus musculus
aatggaccttacaggaccttgcagc

SEQ ID NO: 27280 - DNA, 25 bp, Mus musculus
ggaccttacaggaccttgcagctgc

SEQ ID NO: 27281 - DNA, 25 bp, Mus musculus
ccttacaggaccttgcagctgctgt

SEQ ID NO: 27282 - DNA, 25 bp, Mus musculus
tacaggaccttgcagctgctgtctg

SEQ ID NO: 27283 - DNA, 25 bp, Mus musculus
ctctttcaagtgcacttgttaactt

SEQ ID NO: 27284 - DNA, 25 bp, Mus musculus
caagtgcacttgttaacttgtggtt

SEQ ID NO: 27285 - DNA, 25 bp, Mus musculus
gtgcacttgttaacttgtggttact

SEQ ID NO: 27286 - DNA, 25 bp, Mus musculus
tgaaagcccagtgttaaagtccaag

SEQ ID NO: 27287 - DNA, 25 bp, Mus musculus
gtggataatctgcccctgcactgat

SEQ ID NO: 27288 - DNA, 25 bp, Mus musculus
aggattcaatcacttctagtctagt

SEQ ID NO: 27289 - DNA, 25 bp, Mus musculus
attcaatcacttctagtctagtgtt

SEQ ID NO: 27290 - DNA, 25 bp, Mus musculus
caatcacttctagtctagtgtttac

SEQ ID NO: 27291 - DNA, 25 bp, Mus musculus
tcacttctagtctagtgtttacagt

SEQ ID NO: 27292 - DNA, 25 bp, Mus musculus
tgtttacagtttctcattgtgaagt

SEQ ID NO: 27293 - DNA, 25 bp, Mus musculus
ttacagtttctcattgtgaagtccc

SEQ ID NO: 27294 - DNA, 25 bp, Mus musculus
cagtttctcattgtgaagtccctta

SEQ ID NO: 27295 - DNA, 25 bp, Mus musculus
tttctcattgtgaagtcccttaaga

SEQ ID NO: 27296 - DNA, 25 bp, Mus musculus
gcgcggcacacatattcatccttac

SEQ ID NO: 27297 - DNA, 25 bp, Mus musculus
cgcggcacacatattcatccttacg

SEQ ID NO: 27298 - DNA, 25 bp, Mus musculus
atattcatccttacgaggtgcgcga

SEQ ID NO: 27299 - DNA, 25 bp, Mus musculus
tattcatccttacgaggtgcgcgaa

SEQ ID NO: 27300 - DNA, 25 bp, Mus musculus
attcatccttacgaggtgcgcgaaa

SEQ ID NO: 27301 - DNA, 25 bp, Mus musculus
ttcatccttacgaggtgcgcgaaaa

SEQ ID NO: 27302 - DNA, 25 bp, Mus musculus
tcatccttacgaggtgcgcgaaaaa

SEQ ID NO: 27303 - DNA, 25 bp, Mus musculus
tccttacgaggtgcgcgaaaaacag

SEQ ID NO: 27304 - DNA, 25 bp, Mus musculus
gaaagccgtgagcccagaagacagg

SEQ ID NO: 27305 - DNA, 25 bp, Mus musculus
gcggcacacatattcatccttacga

SEQ ID NO: 27306 - DNA, 25 bp, Mus musculus
cggcacacatattcatccttacgag

SEQ ID NO: 27307 - DNA, 25 bp, Mus musculus
ggcacacatattcatccttacgagg

SEQ ID NO: 27308 - DNA, 25 bp, Mus musculus
gcacacatattcatccttacgaggt

SEQ ID NO: 27309 - DNA, 25 bp, Mus musculus
cacacatattcatccttacgaggtg

SEQ ID NO: 27310 - DNA, 25 bp, Mus musculus
acacatattcatccttacgaggtgc

SEQ ID NO: 27311 - DNA, 25 bp, Mus musculus
cacatattcatccttacgaggtgcg

SEQ ID NO: 27312 - DNA, 25 bp, Mus musculus
acatattcatccttacgaggtgcgc

SEQ ID NO: 27313 - DNA, 25 bp, Mus musculus
tatcacccggtggaaatttagctct

SEQ ID NO: 27314 - DNA, 25 bp, Mus musculus
atcacccggtggaaatttagctctg

SEQ ID NO: 27315 - DNA, 25 bp, Mus musculus
tctgtctttcaattttgaaactcat

SEQ ID NO: 27316 - DNA, 25 bp, Mus musculus
ctgtctttcaattttgaaactcata

SEQ ID NO: 27317 - DNA, 25 bp, Mus musculus
tgtctttcaattttgaaactcatag

SEQ ID NO: 27318 - DNA, 25 bp, Mus musculus
aattttgaaactcataggagatata

SEQ ID NO: 27319 - DNA, 25 bp, Mus musculus
attttgaaactcataggagatatag

SEQ ID NO: 27320 - DNA, 25 bp, Mus musculus
ttttgaaactcataggagatataga

SEQ ID NO: 27321 - DNA, 25 bp, Mus musculus
taatagttgcagtgttgacgataaa

SEQ ID NO: 27322 - DNA, 25 bp, Mus musculus
aatagttgcagtgttgacgataaag

SEQ ID NO: 27323 - DNA, 25 bp, Mus musculus
atagttgcagtgttgacgataaaga

SEQ ID NO: 27324 - DNA, 25 bp, Mus musculus
tagttgcagtgttgacgataaagat

SEQ ID NO: 27325 - DNA, 25 bp, Mus musculus
tcacccggtggaaatttagctctgt

SEQ ID NO: 27326 - DNA, 25 bp, Mus musculus
ggaaatttagctctgtctttcaatt

SEQ ID NO: 27327 - DNA, 25 bp, Mus musculus
gaaatttagctctgtctttcaattt

SEQ ID NO: 27328 - DNA, 25 bp, Mus musculus
ttagctctgtctttcaattttgaaa

SEQ ID NO: 27329 - DNA, 25 bp, Mus musculus
tagctctgtctttcaattttgaaac

SEQ ID NO: 27330 - DNA, 25 bp, Mus musculus
agctctgtctttcaattttgaaact

SEQ ID NO: 27331 - DNA, 25 bp, Mus musculus
gctctgtctttcaattttgaaactc

SEQ ID NO: 27332 - DNA, 25 bp, Mus musculus
ctctgtctttcaattttgaaactca

SEQ ID NO: 27333 - DNA, 25 bp, Mus musculus
ttcgcacacatccttgggcttgtaa

SEQ ID NO: 27334 - DNA, 25 bp, Mus musculus
agcaggcttcaggacagcagggttg

SEQ ID NO: 27335 - DNA, 25 bp, Mus musculus
gtggctctcagggctgtgatcaaac

SEQ ID NO: 27336 - DNA, 25 bp, Mus musculus
atcaaacttgaggcccttcaggagc

SEQ ID NO: 27337 - DNA, 25 bp, Mus musculus
ttgccttgctcttccactgcaggtg

SEQ ID NO: 27338 - DNA, 25 bp, Mus musculus
tgctcttccactgcaggtgacaact

SEQ ID NO: 27339 - DNA, 25 bp, Mus musculus
tccactgcaggtgacaactaaagta

SEQ ID NO: 27340 - DNA, 25 bp, Mus musculus
taaagtaccttgtttgcacccactg

SEQ ID NO: 27341 - DNA, 25 bp, Mus musculus
ggccctctgcagctctgctctatgg

SEQ ID NO: 27342 - DNA, 25 bp, Mus musculus
ctgcagctctgctctatggcatgtg

SEQ ID NO: 27343 - DNA, 25 bp, Mus musculus
ctctgctctatggcatgtgcagctg

SEQ ID NO: 27344 - DNA, 25 bp, Mus musculus
tctatggcatgtgcagctgtggggc

SEQ ID NO: 27345 - DNA, 25 bp, Mus musculus
cttcaggacagcagggttgaagagc

SEQ ID NO: 27346 - DNA, 25 bp, Mus musculus
gccattgtggcaccatcccaggcca

SEQ ID NO: 27347 - DNA, 25 bp, Mus musculus
caggcagccacatcctttgaggcac

SEQ ID NO: 27348 - DNA, 25 bp, Mus musculus
tcctttgaggcacttgtgcgctttg

SEQ ID NO: 27349 - DNA, 25 bp, Mus musculus
cttgtgcgctttgcagagcggcagc

SEQ ID NO: 27350 - DNA, 25 bp, Mus musculus
cggcagccgtgtttcagcgtgcaag

SEQ ID NO: 27351 - DNA, 25 bp, Mus musculus
ttcagcgtgcaagagatggggcagc

SEQ ID NO: 27352 - DNA, 25 bp, Mus musculus
gcactgcacacggtgttcaggagac

SEQ ID NO: 27353 - DNA, 25 bp, Mus musculus
gttggtctctgttgtgcttactgca

SEQ ID NO: 27354 - DNA, 25 bp, Mus musculus
tgtgcttactgcaggctgtaatggc

SEQ ID NO: 27355 - DNA, 25 bp, Mus musculus
ctacatatcacgtgtgagacaactt

SEQ ID NO: 27356 - DNA, 25 bp, Mus musculus
acaacttctttcacatctccatagt

SEQ ID NO: 27357 - DNA, 25 bp, Mus musculus
tctttcacatctccatagtgcccag

SEQ ID NO: 27358 - DNA, 25 bp, Mus musculus
acatctccatagtgcccagcaaatt

SEQ ID NO: 27359 - DNA, 25 bp, Mus musculus
aagacttgctgccaaattctgcctt

SEQ ID NO: 27360 - DNA, 25 bp, Mus musculus
tgctgccaaattctgccttttgggt

SEQ ID NO: 27361 - DNA, 25 bp, Mus musculus
ctgccttttgggtcagtataggatg

SEQ ID NO: 27362 - DNA, 25 bp, Mus musculus
gaatcttcacacttcccactgccaa

SEQ ID NO: 27363 - DNA, 25 bp, Mus musculus
agattttgtattgccatcaggtgcc

SEQ ID NO: 27364 - DNA, 25 bp, Mus musculus
tgtattgccatcaggtgccaaataa

SEQ ID NO: 27365 - DNA, 25 bp, Mus musculus
ttgttccctctgaggctgaatgctc

SEQ ID NO: 27366 - DNA, 25 bp, Mus musculus
aggctgaatgctccaagagagtggg

SEQ ID NO: 27367 - DNA, 25 bp, Mus musculus
gaactgtgcttcttacttactgata

SEQ ID NO: 27368 - DNA, 25 bp, Mus musculus
tgcttcttacttactgatatccagt

SEQ ID NO: 27369 - DNA, 25 bp, Mus musculus
ttacttactgatatccagtaactgg

SEQ ID NO: 27370 - DNA, 25 bp, Mus musculus
taactggcacttactaggtcttcat

SEQ ID NO: 27371 - DNA, 25 bp, Mus musculus
gcacttactaggtcttcatgaatgt

SEQ ID NO: 27372 - DNA, 25 bp, Mus musculus
tattttctacatatcacgtgtgaga

SEQ ID NO: 27373 - DNA, 25 bp, Mus musculus
atgtttatccttgaagacataaaag

SEQ ID NO: 27374 - DNA, 25 bp, Mus musculus
cttctactttcactgtactcagccc

SEQ ID NO: 27375 - DNA, 25 bp, Mus musculus
gtcatgttcctcatgatatatatct

SEQ ID NO: 27376 - DNA, 25 bp, Mus musculus
aaccactgaaggtgcttattaatgg

SEQ ID NO: 27377 - DNA, 25 bp, Mus musculus
cttattaatggttctccagatgtat

SEQ ID NO: 27378 - DNA, 25 bp, Mus musculus
ttaatggttctccagatgtatacaa

SEQ ID NO: 27379 - DNA, 25 bp, Mus musculus
aatggttctccagatgtatacaagt

SEQ ID NO: 27380 - DNA, 25 bp, Mus musculus
tggttctccagatgtatacaagtat

SEQ ID NO: 27381 - DNA, 25 bp, Mus musculus
gttctccagatgtatacaagtattg

SEQ ID NO: 27382 - DNA, 25 bp, Mus musculus
atgattcctcaagtttacagctgta

SEQ ID NO: 27383 - DNA, 25 bp, Mus musculus
gattcctcaagtttacagctgtaca

SEQ ID NO: 27384 - DNA, 25 bp, Mus musculus
ttcctcaagtttacagctgtacaaa

SEQ ID NO: 27385 - DNA, 25 bp, Mus musculus
acctcgacctgcttacattggactg

SEQ ID NO: 27386 - DNA, 25 bp, Mus musculus
ctcgacctgcttacattggactggg

SEQ ID NO: 27387 - DNA, 25 bp, Mus musculus
cgacctgcttacattggactgggaa

SEQ ID NO: 27388 - DNA, 25 bp, Mus musculus
acctgcttacattggactgggaatc

SEQ ID NO: 27389 - DNA, 25 bp, Mus musculus
cgtgtgactctttcacgcaccctca

SEQ ID NO: 27390 - DNA, 25 bp, Mus musculus
tgtgactctttcacgcaccctcata

SEQ ID NO: 27391 - DNA, 25 bp, Mus musculus
tgactctttcacgcaccctcataaa

SEQ ID NO: 27392 - DNA, 25 bp, Mus musculus
ttgtcatgttcctcatgatatatat

SEQ ID NO: 27393 - DNA, 25 bp, Mus musculus
tccagagtggatccctcgtgtgctt

SEQ ID NO: 27394 - DNA, 25 bp, Mus musculus
cagagtggatccctcgtgtgcttca

SEQ ID NO: 27395 - DNA, 25 bp, Mus musculus
gaaggcaagcacctcgtacacttta

SEQ ID NO: 27396 - DNA, 25 bp, Mus musculus
aaggcaagcacctcgtacactttag

SEQ ID NO: 27397 - DNA, 25 bp, Mus musculus
aggcaagcacctcgtacactttagg

SEQ ID NO: 27398 - DNA, 25 bp, Mus musculus
ggcaagcacctcgtacactttagga

SEQ ID NO: 27399 - DNA, 25 bp, Mus musculus
caagcacctcgtacactttaggatg

SEQ ID NO: 27400 - DNA, 25 bp, Mus musculus
aagcacctcgtacactttaggatgg

SEQ ID NO: 27401 - DNA, 25 bp, Mus musculus
agcacctcgtacactttaggatggt

SEQ ID NO: 27402 - DNA, 25 bp, Mus musculus
gctgccactggccccagcagtcaag

SEQ ID NO: 27403 - DNA, 25 bp, Mus musculus
ccactggccccagcagtcaagatct

SEQ ID NO: 27404 - DNA, 25 bp, Mus musculus
cactggccccagcagtcaagatctg

SEQ ID NO: 27405 - DNA, 25 bp, Mus musculus
gagtggatccctcgtgtgcttcatg

SEQ ID NO: 27406 - DNA, 25 bp, Mus musculus
ggatccctcgtgtgcttcatggagg

SEQ ID NO: 27407 - DNA, 25 bp, Mus musculus
gatccctcgtgtgcttcatggaggc

SEQ ID NO: 27408 - DNA, 25 bp, Mus musculus
cctcgtgtgcttcatggaggcaagg

SEQ ID NO: 27409 - DNA, 25 bp, Mus musculus
ctcgtgtgcttcatggaggcaaggc

SEQ ID NO: 27410 - DNA, 25 bp, Mus musculus
ttcatggaggcaaggcatggccaag

SEQ ID NO: 27411 - DNA, 25 bp, Mus musculus
atgaaggcaagcacctcgtacactt

SEQ ID NO: 27412 - DNA, 25 bp, Mus musculus
tgaaggcaagcacctcgtacacttt

SEQ ID NO: 27413 - DNA, 25 bp, Mus musculus
gctgcatcttatcacccggaacctg

SEQ ID NO: 27414 - DNA, 25 bp, Mus musculus
gcatcttatcacccggaacctgcag

SEQ ID NO: 27415 - DNA, 25 bp, Mus musculus
aaccatcctgtttgcagacctccat

SEQ ID NO: 27416 - DNA, 25 bp, Mus musculus
catcctgtttgcagacctccatgca

SEQ ID NO: 27417 - DNA, 25 bp, Mus musculus
agacctccatgcatacctggacaac

SEQ ID NO: 27418 - DNA, 25 bp, Mus musculus
cctccatgcatacctggacaacatg

SEQ ID NO: 27419 - DNA, 25 bp, Mus musculus
tgcatacctggacaacatgaaagcc

SEQ ID NO: 27420 - DNA, 25 bp, Mus musculus
caacatgaaagccccctgggagctt

SEQ ID NO: 27421 - DNA, 25 bp, Mus musculus
ggagcttctagaacttcgaaccagt

SEQ ID NO: 27422 - DNA, 25 bp, Mus musculus
tctagaacttcgaaccagttactat

SEQ ID NO: 27423 - DNA, 25 bp, Mus musculus
agaacttcgaaccagttactatgag

SEQ ID NO: 27424 - DNA, 25 bp, Mus musculus
acttcgaaccagttactatgagaat

SEQ ID NO: 27425 - DNA, 25 bp, Mus musculus
ggccaccacgggcaagccacacgtg

SEQ ID NO: 27426 - DNA, 25 bp, Mus musculus
gggcaagccacacgtggcttacttt

SEQ ID NO: 27427 - DNA, 25 bp, Mus musculus
ggcttactttgtacccatgtccaag

SEQ ID NO: 27428 - DNA, 25 bp, Mus musculus
ttactttgtacccatgtccaagatc

SEQ ID NO: 27429 - DNA, 25 bp, Mus musculus
acccatgtccaagatcgctgacttt

SEQ ID NO: 27430 - DNA, 25 bp, Mus musculus
catgtccaagatcgctgactttttg

SEQ ID NO: 27431 - DNA, 25 bp, Mus musculus
caagatcgctgactttttgaaggca

SEQ ID NO: 27432 - DNA, 25 bp, Mus musculus
tgaggtaaccatcctgtttgcagac

SEQ ID NO: 27433 - DNA, 25 bp, Mus musculus
atcagtgtgtctatgccgcacacaa

SEQ ID NO: 27434 - DNA, 25 bp, Mus musculus
atgccgcacacaactctgtcgtaat

SEQ ID NO: 27435 - DNA, 25 bp, Mus musculus
tgataggcaccgtgctgtgtctttg

SEQ ID NO: 27436 - DNA, 25 bp, Mus musculus
gcaccgtgctgtgtctttgccaaat

SEQ ID NO: 27437 - DNA, 25 bp, Mus musculus
gtctttgccaaataatgctttataa

SEQ ID NO: 27438 - DNA, 25 bp, Mus musculus
tcagtgcaacactgtggatgctatt

SEQ ID NO: 27439 - DNA, 25 bp, Mus musculus
cttaagacaacgagcacacatgtgc

SEQ ID NO: 27440 - DNA, 25 bp, Mus musculus
aagtgttcatggctcaccttgttct

SEQ ID NO: 27441 - DNA, 25 bp, Mus musculus
tcatggctcaccttgttctacacaa

SEQ ID NO: 27442 - DNA, 25 bp, Mus musculus
ctcaccttgttctacacaaaagatt

SEQ ID NO: 27443 - DNA, 25 bp, Mus musculus
ttgttctacacaaaagattctgctt

SEQ ID NO: 27444 - DNA, 25 bp, Mus musculus
tacacaaaagattctgcttgaagct

SEQ ID NO: 27445 - DNA, 25 bp, Mus musculus
cacacaactctgtcgtaatagatga

SEQ ID NO: 27446 - DNA, 25 bp, Mus musculus
agtcagctgactgcagtgttgagga

SEQ ID NO: 27447 - DNA, 25 bp, Mus musculus
aatgacccgattctcagccaattct

SEQ ID NO: 27448 - DNA, 25 bp, Mus musculus
ccgattctcagccaattcttgaata

SEQ ID NO: 27449 - DNA, 25 bp, Mus musculus
ctcagccaattcttgaataaactcc

SEQ ID NO: 27450 - DNA, 25 bp, Mus musculus
cccagcgtatcttatggtaaaagat

SEQ ID NO: 27451 - DNA, 25 bp, Mus musculus
tgctctctaaacaggcttcctttac

SEQ ID NO: 27452 - DNA, 25 bp, Mus musculus
aatctgttagctgaggcatagagga

SEQ ID NO: 27453 - DNA, 25 bp, Mus musculus
cattccatctttccacataacacta

SEQ ID NO: 27454 - DNA, 25 bp, Mus musculus
tccatctttccacataacactatta

SEQ ID NO: 27455 - DNA, 25 bp, Mus musculus
ttcacttctataggagcagatgcat

SEQ ID NO: 27456 - DNA, 25 bp, Mus musculus
catagcatatcaaacacattggatc

SEQ ID NO: 27457 - DNA, 25 bp, Mus musculus
agcatatcaaacacattggatccca

SEQ ID NO: 27458 - DNA, 25 bp, Mus musculus
atatcaaacacattggatcccacga

SEQ ID NO: 27459 - DNA, 25 bp, Mus musculus
aacacattggatcccacgatgttag

SEQ ID NO: 27460 - DNA, 25 bp, Mus musculus
acattggatcccacgatgttagata

SEQ ID NO: 27461 - DNA, 25 bp, Mus musculus
gccatgtctcctttacctgcagaag

SEQ ID NO: 27462 - DNA, 25 bp, Mus musculus
atgtctcctttacctgcagaagaat

SEQ ID NO: 27463 - DNA, 25 bp, Mus musculus
tctcctttacctgcagaagaatagc

SEQ ID NO: 27464 - DNA, 25 bp, Mus musculus
cctttacctgcagaagaatagcatg

SEQ ID NO: 27465 - DNA, 25 bp, Mus musculus
ttatttccaataattccaatttcat

SEQ ID NO: 27466 - DNA, 25 bp, Mus musculus
tttccaataattccaatttcatata

SEQ ID NO: 27467 - DNA, 25 bp, Mus musculus
ccaataattccaatttcatatagaa

SEQ ID NO: 27468 - DNA, 25 bp, Mus musculus
tctagtttccagccattaaaatgaa

SEQ ID NO: 27469 - DNA, 25 bp, Mus musculus
agtttccagccattaaaatgaactg

SEQ ID NO: 27470 - DNA, 25 bp, Mus musculus
atatatgtgagtcccttgctattca

SEQ ID NO: 27471 - DNA, 25 bp, Mus musculus
cccttgctattcacttctataggag

SEQ ID NO: 27472 - DNA, 25 bp, Mus musculus
ttgctattcacttctataggagcag

SEQ ID NO: 27473 - DNA, 25 bp, Mus musculus
tctggccccagctcagcttctcagg

SEQ ID NO: 27474 - DNA, 25 bp, Mus musculus
ggccccagctcagcttctcaggaca

SEQ ID NO: 27475 - DNA, 25 bp, Mus musculus
gatagcatctcctgtcttttcccat

SEQ ID NO: 27476 - DNA, 25 bp, Mus musculus
ccatcaccacagcagaatccttttt

SEQ ID NO: 27477 - DNA, 25 bp, Mus musculus
tctgtttcgtccgtcctctttctag

SEQ ID NO: 27478 - DNA, 25 bp, Mus musculus
tccgtcctctttctagaacatactg

SEQ ID NO: 27479 - DNA, 25 bp, Mus musculus
gtcctctttctagaacatactggta

SEQ ID NO: 27480 - DNA, 25 bp, Mus musculus
ctagaacatactggtacttgtagga

SEQ ID NO: 27481 - DNA, 25 bp, Mus musculus
gaacatactggtacttgtaggatgt

SEQ ID NO: 27482 - DNA, 25 bp, Mus musculus
ttcctgtggtcctagctggcactgg

SEQ ID NO: 27483 - DNA, 25 bp, Mus musculus
ctggcactggctcattacctacaaa

SEQ ID NO: 27484 - DNA, 25 bp, Mus musculus
gcactggctcattacctacaaaacc

SEQ ID NO: 27485 - DNA, 25 bp, Mus musculus
agctcagcttctcaggacaggaaaa

SEQ ID NO: 27486 - DNA, 25 bp, Mus musculus
gccagctacagattccaaccctgaa

SEQ ID NO: 27487 - DNA, 25 bp, Mus musculus
agctacagattccaaccctgaacag

SEQ ID NO: 27488 - DNA, 25 bp, Mus musculus
agattccaaccctgaacagatagca

SEQ ID NO: 27489 - DNA, 25 bp, Mus musculus
ttccaaccctgaacagatagcatct

SEQ ID NO: 27490 - DNA, 25 bp, Mus musculus
caaccctgaacagatagcatctcct

SEQ ID NO: 27491 - DNA, 25 bp, Mus musculus
tgaacagatagcatctcctgtcttt

SEQ ID NO: 27492 - DNA, 25 bp, Mus musculus
acagatagcatctcctgtcttttcc

SEQ ID NO: 27493 - DNA, 25 bp, Mus musculus
gtgatctgtatccttagccacccta

SEQ ID NO: 27494 - DNA, 25 bp, Mus musculus
accctatcaagaacaccaacgatgc

SEQ ID NO: 27495 - DNA, 25 bp, Mus musculus
tttggagcttctggaaccaattgaa

SEQ ID NO: 27496 - DNA, 25 bp, Mus musculus
cttcatttcccgtgcctatgatgct

SEQ ID NO: 27497 - DNA, 25 bp, Mus musculus
tcatttcccgtgcctatgatgctac

SEQ ID NO: 27498 - DNA, 25 bp, Mus musculus
tttcccgtgcctatgatgctaccac

SEQ ID NO: 27499 - DNA, 25 bp, Mus musculus
ttcccgtgcctatgatgctaccacg

SEQ ID NO: 27500 - DNA, 25 bp, Mus musculus
tcccgtgcctatgatgctaccacgc

SEQ ID NO: 27501 - DNA, 25 bp, Mus musculus
cccgtgcctatgatgctaccacgca

SEQ ID NO: 27502 - DNA, 25 bp, Mus musculus
ccgtgcctatgatgctaccacgcac

SEQ ID NO: 27503 - DNA, 25 bp, Mus musculus
cgtgcctatgatgctaccacgcact

SEQ ID NO: 27504 - DNA, 25 bp, Mus musculus
actaacagcagtacatattatgtaa

SEQ ID NO: 27505 - DNA, 25 bp, Mus musculus
ctcctttgcacataatgtggcagca

SEQ ID NO: 27506 - DNA, 25 bp, Mus musculus
taatgtggcagcacagggcaagtat

SEQ ID NO: 27507 - DNA, 25 bp, Mus musculus
tgtggcagcacagggcaagtatatt

SEQ ID NO: 27508 - DNA, 25 bp, Mus musculus
gaaatcagaccggctttggagcttc

SEQ ID NO: 27509 - DNA, 25 bp, Mus musculus
aaatcagaccggctttggagcttct

SEQ ID NO: 27510 - DNA, 25 bp, Mus musculus
aatcagaccggctttggagcttctg

SEQ ID NO: 27511 - DNA, 25 bp, Mus musculus
atcagaccggctttggagcttctgg

SEQ ID NO: 27512 - DNA, 25 bp, Mus musculus
cggctttggagcttctggaaccaat

SEQ ID NO: 27513 - DNA, 25 bp, Mus musculus
cgcctggcctgtggtggtcttcctg

SEQ ID NO: 27514 - DNA, 25 bp, Mus musculus
aggctccatattcttggcctccagg

SEQ ID NO: 27515 - DNA, 25 bp, Mus musculus
atgctgaccacgcagagacctggca

SEQ ID NO: 27516 - DNA, 25 bp, Mus musculus
ccacttggcaatttcatttcaatat

SEQ ID NO: 27517 - DNA, 25 bp, Mus musculus
agatcacagactgttggccccctgt

SEQ ID NO: 27518 - DNA, 25 bp, Mus musculus
tcacagactgttggccccctgtctg

SEQ ID NO: 27519 - DNA, 25 bp, Mus musculus
tttattgctgtacatgttgccgtga

SEQ ID NO: 27520 - DNA, 25 bp, Mus musculus
gctgtacatgttgccgtgactgctt

SEQ ID NO: 27521 - DNA, 25 bp, Mus musculus
gtacatgttgccgtgactgcttttg

SEQ ID NO: 27522 - DNA, 25 bp, Mus musculus
gccgtgactgcttttgtatctttgc

SEQ ID NO: 27523 - DNA, 25 bp, Mus musculus
gtgactgcttttgtatctttgcaat

SEQ ID NO: 27524 - DNA, 25 bp, Mus musculus
actgcttttgtatctttgcaataaa

SEQ ID NO: 27525 - DNA, 25 bp, Mus musculus
catattcttggcctccagggtagac

SEQ ID NO: 27526 - DNA, 25 bp, Mus musculus
attcttggcctccagggtagacagg

SEQ ID NO: 27527 - DNA, 25 bp, Mus musculus
ggctgtcagtgctacccggagcacc

SEQ ID NO: 27528 - DNA, 25 bp, Mus musculus
cacccgtgcagggcacctgcctgga

SEQ ID NO: 27529 - DNA, 25 bp, Mus musculus
ccatggcactgtgtcactgaaattt

SEQ ID NO: 27530 - DNA, 25 bp, Mus musculus
tggcactgtgtcactgaaatttcat

SEQ ID NO: 27531 - DNA, 25 bp, Mus musculus
gtcttgttcctttgacttctgaaag

SEQ ID NO: 27532 - DNA, 25 bp, Mus musculus
ggacacatgctgaccacgcagagac

SEQ ID NO: 27533 - DNA, 25 bp, Mus musculus
gcgccccagaaggaccagcagaagg

SEQ ID NO: 27534 - DNA, 25 bp, Mus musculus
gctgcccaagctgattccatccggc

SEQ ID NO: 27535 - DNA, 25 bp, Mus musculus
atcaaagcaactacgtgttcgtgtt

SEQ ID NO: 27536 - DNA, 25 bp, Mus musculus
gcaactacgtgttcgtgtttctcgg

SEQ ID NO: 27537 - DNA, 25 bp, Mus musculus
gtgttcgtgtttctcggcctcatcc

SEQ ID NO: 27538 - DNA, 25 bp, Mus musculus
gtgtttctcggcctcatcctgtact

SEQ ID NO: 27539 - DNA, 25 bp, Mus musculus
gtttctcggcctcatcctgtactgc

SEQ ID NO: 27540 - DNA, 25 bp, Mus musculus
ttctcggcctcatcctgtactgcgt

SEQ ID NO: 27541 - DNA, 25 bp, Mus musculus
ctcggcctcatcctgtactgcgtgg

SEQ ID NO: 27542 - DNA, 25 bp, Mus musculus
gcctcatcctgtactgcgtggtgac

SEQ ID NO: 27543 - DNA, 25 bp, Mus musculus
ctcatcctgtactgcgtggtgacat

SEQ ID NO: 27544 - DNA, 25 bp, Mus musculus
catcctgtactgcgtggtgacatct

SEQ ID NO: 27545 - DNA, 25 bp, Mus musculus
ctgattccatccggcgcaggcgaga

SEQ ID NO: 27546 - DNA, 25 bp, Mus musculus
tggtgacatctcccatgctgctggt

SEQ ID NO: 27547 - DNA, 25 bp, Mus musculus
gattccatccggcgcaggcgagagt

SEQ ID NO: 27548 - DNA, 25 bp, Mus musculus
cttcgtggaccagcaacgtttctcg

SEQ ID NO: 27549 - DNA, 25 bp, Mus musculus
tctcgcgaccccgcaatgtgggaga

SEQ ID NO: 27550 - DNA, 25 bp, Mus musculus
tcgcgaccccgcaatgtgggagagc

SEQ ID NO: 27551 - DNA, 25 bp, Mus musculus
cagcgcctggtacgcaacgtggagt

SEQ ID NO: 27552 - DNA, 25 bp, Mus musculus
gcgcctggtacgcaacgtggagtat

SEQ ID NO: 27553 - DNA, 25 bp, Mus musculus
gcctggtacgcaacgtggagtatta

SEQ ID NO: 27554 - DNA, 25 bp, Mus musculus
tggggcctcagcacatctggcagaa

SEQ ID NO: 27555 - DNA, 25 bp, Mus musculus
ggggcctcagcacatctggcagaaa

SEQ ID NO: 27556 - DNA, 25 bp, Mus musculus
gcccgatctcagagctcagacaaga

SEQ ID NO: 27557 - DNA, 25 bp, Mus musculus
cccgatctcagagctcagacaagag

SEQ ID NO: 27558 - DNA, 25 bp, Mus musculus
ccgatctcagagctcagacaagaga

SEQ ID NO: 27559 - DNA, 25 bp, Mus musculus
gatctcagagctcagacaagagagc

SEQ ID NO: 27560 - DNA, 25 bp, Mus musculus
agacaagagagcgtcccctacaagt

SEQ ID NO: 27561 - DNA, 25 bp, Mus musculus
gacaagagagcgtcccctacaagtg

SEQ ID NO: 27562 - DNA, 25 bp, Mus musculus
caagagagcgtcccctacaagtggt

SEQ ID NO: 27563 - DNA, 25 bp, Mus musculus
aagagagcgtcccctacaagtggtg

SEQ ID NO: 27564 - DNA, 25 bp, Mus musculus
agagagcgtcccctacaagtggtgg

SEQ ID NO: 27565 - DNA, 25 bp, Mus musculus
agagcgtcccctacaagtggtggag

SEQ ID NO: 27566 - DNA, 25 bp, Mus musculus
gggcctcagcacatctggcagaaat

SEQ ID NO: 27567 - DNA, 25 bp, Mus musculus
gcctcagcacatctggcagaaatac

SEQ ID NO: 27568 - DNA, 25 bp, Mus musculus
cctcagcacatctggcagaaataca

SEQ ID NO: 27569 - DNA, 25 bp, Mus musculus
ctcagcacatctggcagaaatacac

SEQ ID NO: 27570 - DNA, 25 bp, Mus musculus
ctctagaaatgaaccctcaataaag

SEQ ID NO: 27571 - DNA, 25 bp, Mus musculus
tctagaaatgaaccctcaataaaga

SEQ ID NO: 27572 - DNA, 25 bp, Mus musculus
tcctgcccgatctcagagctcagac

SEQ ID NO: 27573 - DNA, 25 bp, Mus musculus
ctgcccgatctcagagctcagacaa

SEQ ID NO: 27574 - DNA, 25 bp, Mus musculus
atcaacaaggaccgagcaaaagacg

SEQ ID NO: 27575 - DNA, 25 bp, Mus musculus
ggctctaaatcccaggcctcatctc

SEQ ID NO: 27576 - DNA, 25 bp, Mus musculus
tgctcttcgtgtggcagatcattct

SEQ ID NO: 27577 - DNA, 25 bp, Mus musculus
tcttcgtgtggcagatcattctgcc

SEQ ID NO: 27578 - DNA, 25 bp, Mus musculus
ggcagatcattctgccaaatacttg

SEQ ID NO: 27579 - DNA, 25 bp, Mus musculus
agatcattctgccaaatacttgaac

SEQ ID NO: 27580 - DNA, 25 bp, Mus musculus
tgccaaatacttgaacactgtgttt

SEQ ID NO: 27581 - DNA, 25 bp, Mus musculus
atacttgaacactgtgttttattgt

SEQ ID NO: 27582 - DNA, 25 bp, Mus musculus
tttgtgactcaaacttctgtgctgg

SEQ ID NO: 27583 - DNA, 25 bp, Mus musculus
actcaaacttctgtgctgggtgaag

SEQ ID NO: 27584 - DNA, 25 bp, Mus musculus
caaacttctgtgctgggtgaagtac

SEQ ID NO: 27585 - DNA, 25 bp, Mus musculus
gtacccattgtgattgtggaagcta

SEQ ID NO: 27586 - DNA, 25 bp, Mus musculus
gctcttaggcctgcggctttgatgg

SEQ ID NO: 27587 - DNA, 25 bp, Mus musculus
tacccattgtgattgtggaagctag

SEQ ID NO: 27588 - DNA, 25 bp, Mus musculus
ttgtaagctttccattttatagaag

SEQ ID NO: 27589 - DNA, 25 bp, Mus musculus
gctttccattttatagaaggcacac

SEQ ID NO: 27590 - DNA, 25 bp, Mus musculus
atagaaggcacacacacacacaagg

SEQ ID NO: 27591 - DNA, 25 bp, Mus musculus
cattagcgctattggctgtatgtgc

SEQ ID NO: 27592 - DNA, 25 bp, Mus musculus
ataatgcacaactgttgatgactgg

SEQ ID NO: 27593 - DNA, 25 bp, Mus musculus
atgcacaactgttgatgactggctg

SEQ ID NO: 27594 - DNA, 25 bp, Mus musculus
ttaatttgctcttcgtgtggcagat

SEQ ID NO: 27595 - DNA, 25 bp, Mus musculus
cgaagccatctatgagtgcacagcc

SEQ ID NO: 27596 - DNA, 25 bp, Mus musculus
agccatctatgagtgcacagccacg

SEQ ID NO: 27597 - DNA, 25 bp, Mus musculus
gttcccgactatcgacatgggacct

SEQ ID NO: 27598 - DNA, 25 bp, Mus musculus
tatcgacatgggacctcagctgaag

SEQ ID NO: 27599 - DNA, 25 bp, Mus musculus
cgacatgggacctcagctgaaggtg

SEQ ID NO: 27600 - DNA, 25 bp, Mus musculus
catgggacctcagctgaaggtggtg

SEQ ID NO: 27601 - DNA, 25 bp, Mus musculus
cccagaccctgagatctcttggttc

SEQ ID NO: 27602 - DNA, 25 bp, Mus musculus
agaccctgagatctcttggttcaaa

SEQ ID NO: 27603 - DNA, 25 bp, Mus musculus
tcctgtggaccctgctgcaagcaac

SEQ ID NO: 27604 - DNA, 25 bp, Mus musculus
ccctgctgcaagcaacggtcgtatc

SEQ ID NO: 27605 - DNA, 25 bp, Mus musculus
tgcaagcaacggtcgtatcaaacag

SEQ ID NO: 27606 - DNA, 25 bp, Mus musculus
tcgtatcaaacagctgcgatcaggt

SEQ ID NO: 27607 - DNA, 25 bp, Mus musculus
tgagtgcacagccacgaacagtctc

SEQ ID NO: 27608 - DNA, 25 bp, Mus musculus
caaacagctgcgatcaggtgcattg

SEQ ID NO: 27609 - DNA, 25 bp, Mus musculus
gtgcacagccacgaacagtctcggg

SEQ ID NO: 27610 - DNA, 25 bp, Mus musculus
agccacgaacagtctcggggagatc

SEQ ID NO: 27611 - DNA, 25 bp, Mus musculus
caacacaagtgccaagctgtcagtg

SEQ ID NO: 27612 - DNA, 25 bp, Mus musculus
cacaagtgccaagctgtcagtgctt

SEQ ID NO: 27613 - DNA, 25 bp, Mus musculus
caagctgtcagtgcttgaagaggac

SEQ ID NO: 27614 - DNA, 25 bp, Mus musculus
gctgtcagtgcttgaagaggaccag

SEQ ID NO: 27615 - DNA, 25 bp, Mus musculus
ccagctgccgtctgggttcccgact

SEQ ID NO: 27616 - DNA, 25 bp, Mus musculus
tctactcctttactcttgagccccg

SEQ ID NO: 27617 - DNA, 25 bp, Mus musculus
ctcttgagccccgagttatcgagga

SEQ ID NO: 27618 - DNA, 25 bp, Mus musculus
tgaaaaccgcatttggcatttcttt

SEQ ID NO: 27619 - DNA, 25 bp, Mus musculus
ccgcatttggcatttctttggagag

SEQ ID NO: 27620 - DNA, 25 bp, Mus musculus
ttggcatttctttggagagaaagtt

SEQ ID NO: 27621 - DNA, 25 bp, Mus musculus
ttaaaccttctaaacatatgcaaat

SEQ ID NO: 27622 - DNA, 25 bp, Mus musculus
tgtatccataacagaaatcacccag

SEQ ID NO: 27623 - DNA, 25 bp, Mus musculus
cataacagaaatcacccagtccaat

SEQ ID NO: 27624 - DNA, 25 bp, Mus musculus
cacccagtccaatgctgaccaacta

SEQ ID NO: 27625 - DNA, 25 bp, Mus musculus
gtccaatgctgaccaactaatgact

SEQ ID NO: 27626 - DNA, 25 bp, Mus musculus
tgctgaccaactaatgacttgttgt

SEQ ID NO: 27627 - DNA, 25 bp, Mus musculus
tactcctcctgtcatttcaccaata

SEQ ID NO: 27628 - DNA, 25 bp, Mus musculus
tgaatagctatcttcagacatcgcc

SEQ ID NO: 27629 - DNA, 25 bp, Mus musculus
gctatcttcagacatcgccagcatc

SEQ ID NO: 27630 - DNA, 25 bp, Mus musculus
catcgccagcatctgtgtttgtaag

SEQ ID NO: 27631 - DNA, 25 bp, Mus musculus
ttgtaagcacatcgttctgttcctt

SEQ ID NO: 27632 - DNA, 25 bp, Mus musculus
gcacatcgttctgttccttgcagac

SEQ ID NO: 27633 - DNA, 25 bp, Mus musculus
cgttctgttccttgcagacctcgga

SEQ ID NO: 27634 - DNA, 25 bp, Mus musculus
ttcactgtttagtgggctccacctt

SEQ ID NO: 27635 - DNA, 25 bp, Mus musculus
ccacctttacaagtaggagattcag

SEQ ID NO: 27636 - DNA, 25 bp, Mus musculus
actcagatctccttgaaaagaacaa

SEQ ID NO: 27637 - DNA, 25 bp, Mus musculus
tgaatacctaccttcagacatcacc

SEQ ID NO: 27638 - DNA, 25 bp, Mus musculus
tgacatgatcatactactggtggtc

SEQ ID NO: 27639 - DNA, 25 bp, Mus musculus
gatcatactactggtggtcatgttg

SEQ ID NO: 27640 - DNA, 25 bp, Mus musculus
catactactggtggtcatgttgatg

SEQ ID NO: 27641 - DNA, 25 bp, Mus musculus
actactggtggtcatgttgatgtgt

SEQ ID NO: 27642 - DNA, 25 bp, Mus musculus
gaaatacccagcattggcttacagc

SEQ ID NO: 27643 - DNA, 25 bp, Mus musculus
atacccagcattggcttacagctaa

SEQ ID NO: 27644 - DNA, 25 bp, Mus musculus
gtattcccattaaattcaaccagca

SEQ ID NO: 27645 - DNA, 25 bp, Mus musculus
ccattaaattcaaccagcattatcc

SEQ ID NO: 27646 - DNA, 25 bp, Mus musculus
ttaaattcaaccagcattatccata

SEQ ID NO: 27647 - DNA, 25 bp, Mus musculus
aattcaaccagcattatccatatca

SEQ ID NO: 27648 - DNA, 25 bp, Mus musculus
accttcagacatcaccagcgtctgt

SEQ ID NO: 27649 - DNA, 25 bp, Mus musculus
ccagcattatccatatcaaattttt

SEQ ID NO: 27650 - DNA, 25 bp, Mus musculus
catcaccagcgtctgtgtttactag

SEQ ID NO: 27651 - DNA, 25 bp, Mus musculus
caccagcgtctgtgtttactagcaa

SEQ ID NO: 27652 - DNA, 25 bp, Mus musculus
tgcagaccccagaaggagttcattg

SEQ ID NO: 27653 - DNA, 25 bp, Mus musculus
aggacaacgtcgatcttgtagagtt

SEQ ID NO: 27654 - DNA, 25 bp, Mus musculus
gttttggtgtccttccatgtacttg

SEQ ID NO: 27655 - DNA, 25 bp, Mus musculus
ttggtgtccttccatgtacttggaa

SEQ ID NO: 27656 - DNA, 25 bp, Mus musculus
gtgtccttccatgtacttggaattt

SEQ ID NO: 27657 - DNA, 25 bp, Mus musculus
tggtcagcagtgcccacaaccccaa

SEQ ID NO: 27658 - DNA, 25 bp, Mus musculus
gtcagcagtgcccacaaccccaata

SEQ ID NO: 27659 - DNA, 25 bp, Mus musculus
cacagagcgaccaggatctgaacgc

SEQ ID NO: 27660 - DNA, 25 bp, Mus musculus
cagagcgaccaggatctgaacgccc

SEQ ID NO: 27661 - DNA, 25 bp, Mus musculus
gaccaggatctgaacgcccgtcctt

SEQ ID NO: 27662 - DNA, 25 bp, Mus musculus
ccaggatctgaacgcccgtccttgt

SEQ ID NO: 27663 - DNA, 25 bp, Mus musculus
aggatctgaacgcccgtccttgttg

SEQ ID NO: 27664 - DNA, 25 bp, Mus musculus
tgaacgcccgtccttgttgccaaat

SEQ ID NO: 27665 - DNA, 25 bp, Mus musculus
cgtccttgttgccaaatggcaaaga

SEQ ID NO: 27666 - DNA, 25 bp, Mus musculus
tccttgttgccaaatggcaaagaaa

SEQ ID NO: 27667 - DNA, 25 bp, Mus musculus
gcctcgccttccagtcatagcctgg

SEQ ID NO: 27668 - DNA, 25 bp, Mus musculus
ctcgccttccagtcatagcctggct

SEQ ID NO: 27669 - DNA, 25 bp, Mus musculus
caaccccaataaggcagagatccct

SEQ ID NO: 27670 - DNA, 25 bp, Mus musculus
atgacccgaagaaacacctatgtgt

SEQ ID NO: 27671 - DNA, 25 bp, Mus musculus
cgaagaaacacctatgtgtgcacag

SEQ ID NO: 27672 - DNA, 25 bp, Mus musculus
gaaacacctatgtgtgcacagagcg

SEQ ID NO: 27673 - DNA, 25 bp, Mus musculus
cacctatgtgtgcacagagcgacca

SEQ ID NO: 27674 - DNA, 25 bp, Mus musculus
cctatgtgtgcacagagcgaccagg

SEQ ID NO: 27675 - DNA, 25 bp, Mus musculus
tgtgtgcacagagcgaccaggatct

SEQ ID NO: 27676 - DNA, 25 bp, Mus musculus
tgcacagagcgaccaggatctgaac

SEQ ID NO: 27677 - DNA, 25 bp, Mus musculus
gacaaggtctctccatatatcccag

SEQ ID NO: 27678 - DNA, 25 bp, Mus musculus
gtctctccatatatcccagactatc

SEQ ID NO: 27679 - DNA, 25 bp, Mus musculus
agcacacaaaacctgtacacactgt

SEQ ID NO: 27680 - DNA, 25 bp, Mus musculus
ctgtacacactgtctgaaggaaggg

SEQ ID NO: 27681 - DNA, 25 bp, Mus musculus
ctgctccactctgctgggcggcaag

SEQ ID NO: 27682 - DNA, 25 bp, Mus musculus
cactctgctgggcggcaagacctag

SEQ ID NO: 27683 - DNA, 25 bp, Mus musculus
gacctagaacgggccctgcactgtc

SEQ ID NO: 27684 - DNA, 25 bp, Mus musculus
cccaccatgggttgtggtctcagaa

SEQ ID NO: 27685 - DNA, 25 bp, Mus musculus
ctcagaaatcgcttcagcagctctt

SEQ ID NO: 27686 - DNA, 25 bp, Mus musculus
ttcagcagctcttccctggaggctg

SEQ ID NO: 27687 - DNA, 25 bp, Mus musculus
agctcttccctggaggctgtgacag

SEQ ID NO: 27688 - DNA, 25 bp, Mus musculus
tggcttccaacctctctgaaggaag

SEQ ID NO: 27689 - DNA, 25 bp, Mus musculus
ccatatatcccagactatccatgaa

SEQ ID NO: 27690 - DNA, 25 bp, Mus musculus
ccatgaatgatcctcctacctgttt

SEQ ID NO: 27691 - DNA, 25 bp, Mus musculus
atgatcctcctacctgtttctagag

SEQ ID NO: 27692 - DNA, 25 bp, Mus musculus
ctcctacctgtttctagagtgctag

SEQ ID NO: 27693 - DNA, 25 bp, Mus musculus
cctgtttctagagtgctaggattac

SEQ ID NO: 27694 - DNA, 25 bp, Mus musculus
caggcatgcatgaccacacgtggcc

SEQ ID NO: 27695 - DNA, 25 bp, Mus musculus
tcctttcctgtttgcaaccttgctt

SEQ ID NO: 27696 - DNA, 25 bp, Mus musculus
acctgtagcacacaaaacctgtaca

SEQ ID NO: 27697 - DNA, 25 bp, Mus musculus
gccattatgagctcttggcacacaa

SEQ ID NO: 27698 - DNA, 25 bp, Mus musculus
cattatgagctcttggcacacaagt

SEQ ID NO: 27699 - DNA, 25 bp, Mus musculus
caaattcattcaacatagaaccaat

SEQ ID NO: 27700 - DNA, 25 bp, Mus musculus
aattcattcaacatagaaccaatga

SEQ ID NO: 27701 - DNA, 25 bp, Mus musculus
ttcattcaacatagaaccaatgaga

SEQ ID NO: 27702 - DNA, 25 bp, Mus musculus
cattcaacatagaaccaatgagagc

SEQ ID NO: 27703 - DNA, 25 bp, Mus musculus
ttcaacatagaaccaatgagagcaa

SEQ ID NO: 27704 - DNA, 25 bp, Mus musculus
tttgtttgccatggattctacctgg

SEQ ID NO: 27705 - DNA, 25 bp, Mus musculus
tgtttgccatggattctacctggcc

SEQ ID NO: 27706 - DNA, 25 bp, Mus musculus
tgccatggattctacctggccaaga

SEQ ID NO: 27707 - DNA, 25 bp, Mus musculus
ccatggattctacctggccaagaaa

SEQ ID NO: 27708 - DNA, 25 bp, Mus musculus
atggattctacctggccaagaaaag

SEQ ID NO: 27709 - DNA, 25 bp, Mus musculus
ttatgagctcttggcacacaagtga

SEQ ID NO: 27710 - DNA, 25 bp, Mus musculus
atgagctcttggcacacaagtgagc

SEQ ID NO: 27711 - DNA, 25 bp, Mus musculus
gctcttggcacacaagtgagcattt

SEQ ID NO: 27712 - DNA, 25 bp, Mus musculus
agcattttcagtgcagtgagactca

SEQ ID NO: 27713 - DNA, 25 bp, Mus musculus
cattttcagtgcagtgagactcaag

SEQ ID NO: 27714 - DNA, 25 bp, Mus musculus
gtatacctcaatctttactactgta

SEQ ID NO: 27715 - DNA, 25 bp, Mus musculus
atacctcaatctttactactgtatt

SEQ ID NO: 27716 - DNA, 25 bp, Mus musculus
gccaaattcattcaacatagaacca

SEQ ID NO: 27717 - DNA, 25 bp, Mus musculus
gcaggcatcagccgttcagtgacag

SEQ ID NO: 27718 - DNA, 25 bp, Mus musculus
gcatcagccgttcagtgacagttac

SEQ ID NO: 27719 - DNA, 25 bp, Mus musculus
tccctcaacgacgcctatgacttcg

SEQ ID NO: 27720 - DNA, 25 bp, Mus musculus
aacgacgcctatgacttcgtcaaga

SEQ ID NO: 27721 - DNA, 25 bp, Mus musculus
cgacgcctatgacttcgtcaagagg

SEQ ID NO: 27722 - DNA, 25 bp, Mus musculus
acgcctatgacttcgtcaagaggaa

SEQ ID NO: 27723 - DNA, 25 bp, Mus musculus
actttgagcggacgctggggctcag

SEQ ID NO: 27724 - DNA, 25 bp, Mus musculus
tttgagcggacgctggggctcagca

SEQ ID NO: 27725 - DNA, 25 bp, Mus musculus
cggacgctggggctcagcagcccat

SEQ ID NO: 27726 - DNA, 25 bp, Mus musculus
ggctcagcagcccatgcgacaacca

SEQ ID NO: 27727 - DNA, 25 bp, Mus musculus
catgcgacaaccacgcacccagtga

SEQ ID NO: 27728 - DNA, 25 bp, Mus musculus
aaccacgcacccagtgagcagctct

SEQ ID NO: 27729 - DNA, 25 bp, Mus musculus
atcagccgttcagtgacagttactg

SEQ ID NO: 27730 - DNA, 25 bp, Mus musculus
cagccgttcagtgacagttactgta

SEQ ID NO: 27731 - DNA, 25 bp, Mus musculus
gttactgtagcctacctgatgcaga

SEQ ID NO: 27732 - DNA, 25 bp, Mus musculus
tactgtagcctacctgatgcagaag

SEQ ID NO: 27733 - DNA, 25 bp, Mus musculus
ctgtagcctacctgatgcagaagat

SEQ ID NO: 27734 - DNA, 25 bp, Mus musculus
gtagcctacctgatgcagaagatga

SEQ ID NO: 27735 - DNA, 25 bp, Mus musculus
cctacctgatgcagaagatgaacct

SEQ ID NO: 27736 - DNA, 25 bp, Mus musculus
agaagatgaacctgtccctcaacga

SEQ ID NO: 27737 - DNA, 25 bp, Mus musculus
atctacttctcaatggtccaggctg

SEQ ID NO: 27738 - DNA, 25 bp, Mus musculus
tctacttctcaatggtccaggctgg

SEQ ID NO: 27739 - DNA, 25 bp, Mus musculus
tcatgagctgtgactatctgaggtg

SEQ ID NO: 27740 - DNA, 25 bp, Mus musculus
agctgtgactatctgaggtgctaag

SEQ ID NO: 27741 - DNA, 25 bp, Mus musculus
actatctgaggtgctaagtattttt

SEQ ID NO: 27742 - DNA, 25 bp, Mus musculus
ttaaaggtaactccatcaagatgag

SEQ ID NO: 27743 - DNA, 25 bp, Mus musculus
taaaggtaactccatcaagatgaga

SEQ ID NO: 27744 - DNA, 25 bp, Mus musculus
aaaggtaactccatcaagatgagaa

SEQ ID NO: 27745 - DNA, 25 bp, Mus musculus
aggtaactccatcaagatgagaagc

SEQ ID NO: 27746 - DNA, 25 bp, Mus musculus
gtaactccatcaagatgagaagcct

SEQ ID NO: 27747 - DNA, 25 bp, Mus musculus
atgagaagccttccgagactttgta

SEQ ID NO: 27748 - DNA, 25 bp, Mus musculus
tgagaagccttccgagactttgtaa

SEQ ID NO: 27749 - DNA, 25 bp, Mus musculus
acttctcaatggtccaggctggagc

SEQ ID NO: 27750 - DNA, 25 bp, Mus musculus
cttctcaatggtccaggctggagca

SEQ ID NO: 27751 - DNA, 25 bp, Mus musculus
ttctcaatggtccaggctggagcaa

SEQ ID NO: 27752 - DNA, 25 bp, Mus musculus
ctcaatggtccaggctggagcaaag

SEQ ID NO: 27753 - DNA, 25 bp, Mus musculus
tcaatggtccaggctggagcaaagc

SEQ ID NO: 27754 - DNA, 25 bp, Mus musculus
caatggtccaggctggagcaaagcg

SEQ ID NO: 27755 - DNA, 25 bp, Mus musculus
gcgctcatgagctgtgactatctga

SEQ ID NO: 27756 - DNA, 25 bp, Mus musculus
cgctcatgagctgtgactatctgag

SEQ ID NO: 27757 - DNA, 25 bp, Mus musculus
ttagtcccaagtcgtcggactccat

SEQ ID NO: 27758 - DNA, 25 bp, Mus musculus
gtcccaagtcgtcggactccatttg

SEQ ID NO: 27759 - DNA, 25 bp, Mus musculus
tgcgtctcttttcattcatctccag

SEQ ID NO: 27760 - DNA, 25 bp, Mus musculus
cgtctcttttcattcatctccagac

SEQ ID NO: 27761 - DNA, 25 bp, Mus musculus
gtctcttttcattcatctccagacc

SEQ ID NO: 27762 - DNA, 25 bp, Mus musculus
ctcttttcattcatctccagacctt

SEQ ID NO: 27763 - DNA, 25 bp, Mus musculus
tcttttcattcatctccagaccttt

SEQ ID NO: 27764 - DNA, 25 bp, Mus musculus
ttttcattcatctccagacctttag

SEQ ID NO: 27765 - DNA, 25 bp, Mus musculus
tttcattcatctccagacctttaga

SEQ ID NO: 27766 - DNA, 25 bp, Mus musculus
cattcatctccagacctttagaggt

SEQ ID NO: 27767 - DNA, 25 bp, Mus musculus
ttcatctccagacctttagaggttt

SEQ ID NO: 27768 - DNA, 25 bp, Mus musculus
tcatctccagacctttagaggtttt

SEQ ID NO: 27769 - DNA, 25 bp, Mus musculus
ccaagtcgtcggactccatttgcta

SEQ ID NO: 27770 - DNA, 25 bp, Mus musculus
aagtcgtcggactccatttgctatt

SEQ ID NO: 27771 - DNA, 25 bp, Mus musculus
agtcgtcggactccatttgctattc

SEQ ID NO: 27772 - DNA, 25 bp, Mus musculus
tcgtcggactccatttgctattctt

SEQ ID NO: 27773 - DNA, 25 bp, Mus musculus
tcggactccatttgctattcttttc

SEQ ID NO: 27774 - DNA, 25 bp, Mus musculus
cggactccatttgctattcttttct

SEQ ID NO: 27775 - DNA, 25 bp, Mus musculus
gtagtgggcgttcgtctttgcgtct

SEQ ID NO: 27776 - DNA, 25 bp, Mus musculus
ttgcgtctcttttcattcatctcca

SEQ ID NO: 27777 - DNA, 25 bp, Mus musculus
ccctcctgaaaccatctccttatgg

SEQ ID NO: 27778 - DNA, 25 bp, Mus musculus
tgaaaccatctccttatgggcaatc

SEQ ID NO: 27779 - DNA, 25 bp, Mus musculus
tatggaactgctgtgctctgtccta

SEQ ID NO: 27780 - DNA, 25 bp, Mus musculus
actgctgtgctctgtcctacctgcc

SEQ ID NO: 27781 - DNA, 25 bp, Mus musculus
gtgctctgtcctacctgccatatca

SEQ ID NO: 27782 - DNA, 25 bp, Mus musculus
tgatacaactgtatcacaacacaca

SEQ ID NO: 27783 - DNA, 25 bp, Mus musculus
aactgtatcacaacacacacgcaca

SEQ ID NO: 27784 - DNA, 25 bp, Mus musculus
acacatacacacacaccagaactgt

SEQ ID NO: 27785 - DNA, 25 bp, Mus musculus
acacacacaccagaactgtgttgag

SEQ ID NO: 27786 - DNA, 25 bp, Mus musculus
gcctgggactcaacatacagaaaca

SEQ ID NO: 27787 - DNA, 25 bp, Mus musculus
atatagccctagggcattgaagctg

SEQ ID NO: 27788 - DNA, 25 bp, Mus musculus
ccctagggcattgaagctgggctca

SEQ ID NO: 27789 - DNA, 25 bp, Mus musculus
gatcccagctggagaagcccagaaa

SEQ ID NO: 27790 - DNA, 25 bp, Mus musculus
ccagaaacaaagcctcttctgtctc

SEQ ID NO: 27791 - DNA, 25 bp, Mus musculus
cctcttctgtctctatggaccagct

SEQ ID NO: 27792 - DNA, 25 bp, Mus musculus
ctatggaccagctctggacacctgc

SEQ ID NO: 27793 - DNA, 25 bp, Mus musculus
accagctctggacacctgctcatgc

SEQ ID NO: 27794 - DNA, 25 bp, Mus musculus
tctggacacctgctcatgcaggtgc

SEQ ID NO: 27795 - DNA, 25 bp, Mus musculus
cacctgctcatgcaggtgccttccg

SEQ ID NO: 27796 - DNA, 25 bp, Mus musculus
aactggctgggagaccatgtggtgt

SEQ ID NO: 27797 - DNA, 25 bp, Mus musculus
cagagtcactcacaggcaattattt

SEQ ID NO: 27798 - DNA, 25 bp, Mus musculus
gcaattatttcccattccactcagt

SEQ ID NO: 27799 - DNA, 25 bp, Mus musculus
ggtccaaatcacaccctttgtgatc

SEQ ID NO: 27800 - DNA, 25 bp, Mus musculus
ccaaatcacaccctttgtgatctta

SEQ ID NO: 27801 - DNA, 25 bp, Mus musculus
cacaccctttgtgatcttaagataa

SEQ ID NO: 27802 - DNA, 25 bp, Mus musculus
accctttgtgatcttaagataatca

SEQ ID NO: 27803 - DNA, 25 bp, Mus musculus
gatgtaacttgggctgcagtctgta

SEQ ID NO: 27804 - DNA, 25 bp, Mus musculus
gtaacttgggctgcagtctgtaatc

SEQ ID NO: 27805 - DNA, 25 bp, Mus musculus
acttgggctgcagtctgtaatccac

SEQ ID NO: 27806 - DNA, 25 bp, Mus musculus
gcagtctgtaatccacctcttcagc

SEQ ID NO: 27807 - DNA, 25 bp, Mus musculus
gtctgtaatccacctcttcagctat

SEQ ID NO: 27808 - DNA, 25 bp, Mus musculus
tgtaatccacctcttcagctataag

SEQ ID NO: 27809 - DNA, 25 bp, Mus musculus
tccactcagttctggctaccagaag

SEQ ID NO: 27810 - DNA, 25 bp, Mus musculus
cacctcttcagctataagtaggccg

SEQ ID NO: 27811 - DNA, 25 bp, Mus musculus
cagttctggctaccagaagatgctc

SEQ ID NO: 27812 - DNA, 25 bp, Mus musculus
ttctggctaccagaagatgctcccc

SEQ ID NO: 27813 - DNA, 25 bp, Mus musculus
tgctgatatctgtcggatgggtatc

SEQ ID NO: 27814 - DNA, 25 bp, Mus musculus
tgatatctgtcggatgggtatcaca

SEQ ID NO: 27815 - DNA, 25 bp, Mus musculus
tatctgtcggatgggtatcacagcg

SEQ ID NO: 27816 - DNA, 25 bp, Mus musculus
tatcacagcgtaatttcatcatagg

SEQ ID NO: 27817 - DNA, 25 bp, Mus musculus
ttgggtccaaatcacaccctttgtg

SEQ ID NO: 27818 - DNA, 25 bp, Mus musculus
cacaacatcacggtgaaccaggtca

SEQ ID NO: 27819 - DNA, 25 bp, Mus musculus
gtgaaccaggtcaacgcatgtcatg

SEQ ID NO: 27820 - DNA, 25 bp, Mus musculus
ccagagtacttcacctacagcgtgc

SEQ ID NO: 27821 - DNA, 25 bp, Mus musculus
gagtacttcacctacagcgtgctgc

SEQ ID NO: 27822 - DNA, 25 bp, Mus musculus
tacttcacctacagcgtgctgctca

SEQ ID NO: 27823 - DNA, 25 bp, Mus musculus
agcgtgctgctcagcctgctggcct

SEQ ID NO: 27824 - DNA, 25 bp, Mus musculus
gtgttcctgcagatcagctgcattg

SEQ ID NO: 27825 - DNA, 25 bp, Mus musculus
ctgcagatcagctgcattggaaagc

SEQ ID NO: 27826 - DNA, 25 bp, Mus musculus
ctcatgctggccattgagttcatct

SEQ ID NO: 27827 - DNA, 25 bp, Mus musculus
ctggccattgagttcatctatgtgc

SEQ ID NO: 27828 - DNA, 25 bp, Mus musculus
gagttcatctatgtgctcatcgtgg

SEQ ID NO: 27829 - DNA, 25 bp, Mus musculus
gtgcccggcgtcacactcttcgaca

SEQ ID NO: 27830 - DNA, 25 bp, Mus musculus
caggtcaacgcatgtcatgtgatgg

SEQ ID NO: 27831 - DNA, 25 bp, Mus musculus
ggcgtcacactcttcgacaacgctg

SEQ ID NO: 27832 - DNA, 25 bp, Mus musculus
aacgcatgtcatgtgatggagtcgg

SEQ ID NO: 27833 - DNA, 25 bp, Mus musculus
gagtcggccttcaactacagcctgg

SEQ ID NO: 27834 - DNA, 25 bp, Mus musculus
tcggccttcaactacagcctgggcg

SEQ ID NO: 27835 - DNA, 25 bp, Mus musculus
gccttcaactacagcctgggcgacg

SEQ ID NO: 27836 - DNA, 25 bp, Mus musculus
agcctgggcgacgagcagggcttct

SEQ ID NO: 27837 - DNA, 25 bp, Mus musculus
aactgcaacttcccagagtacttca

SEQ ID NO: 27838 - DNA, 25 bp, Mus musculus
tgcaacttcccagagtacttcacct

SEQ ID NO: 27839 - DNA, 25 bp, Mus musculus
atcaagtccaacttcaagccctcac

SEQ ID NO: 27840 - DNA, 25 bp, Mus musculus
ttcaagccctcacttctggcccaga

SEQ ID NO: 27841 - DNA, 25 bp, Mus musculus
atcaagcgcatggcaggcatgaagg

SEQ ID NO: 27842 - DNA, 25 bp, Mus musculus
cccatttccatgaactttgaggtgc

SEQ ID NO: 27843 - DNA, 25 bp, Mus musculus
atttccatgaactttgaggtgccat

SEQ ID NO: 27844 - DNA, 25 bp, Mus musculus
ggcctcaaggtgcgctacttgaagg

SEQ ID NO: 27845 - DNA, 25 bp, Mus musculus
gtattcgaaccgaagctgaactaca

SEQ ID NO: 27846 - DNA, 25 bp, Mus musculus
ttcgaaccgaagctgaactacagcg

SEQ ID NO: 27847 - DNA, 25 bp, Mus musculus
aagctgaactacagcgaccatgatg

SEQ ID NO: 27848 - DNA, 25 bp, Mus musculus
ctgaactacagcgaccatgatgtca

SEQ ID NO: 27849 - DNA, 25 bp, Mus musculus
tacagcgaccatgatgtcatcaaat

SEQ ID NO: 27850 - DNA, 25 bp, Mus musculus
acccctagtgaccactcaccagtgt

SEQ ID NO: 27851 - DNA, 25 bp, Mus musculus
ccctcacttctggcccagaagattg

SEQ ID NO: 27852 - DNA, 25 bp, Mus musculus
tgctgcctttcctttccaatagccc

SEQ ID NO: 27853 - DNA, 25 bp, Mus musculus
gtgaggatcccgactccattgaaca

SEQ ID NO: 27854 - DNA, 25 bp, Mus musculus
aggatcccgactccattgaacacaa

SEQ ID NO: 27855 - DNA, 25 bp, Mus musculus
ccgactccattgaacacaagcgggg

SEQ ID NO: 27856 - DNA, 25 bp, Mus musculus
ccattgaacacaagcggggtacagg

SEQ ID NO: 27857 - DNA, 25 bp, Mus musculus
gccaagtacaaggccagcgagaacg

SEQ ID NO: 27858 - DNA, 25 bp, Mus musculus
aagtacaaggccagcgagaacgcca

SEQ ID NO: 27859 - DNA, 25 bp, Mus musculus
agcgagaacgccattgtatggaaga

SEQ ID NO: 27860 - DNA, 25 bp, Mus musculus
atttgatgcactgctcgaactccat

SEQ ID NO: 27861 - DNA, 25 bp, Mus musculus
tgcactgctcgaactccatgttatc

SEQ ID NO: 27862 - DNA, 25 bp, Mus musculus
gaactataaggccctccatgtgaag

SEQ ID NO: 27863 - DNA, 25 bp, Mus musculus
ctctgtcttgccgaatagcctccaa

SEQ ID NO: 27864 - DNA, 25 bp, Mus musculus
tgtcttgccgaatagcctccaattc

SEQ ID NO: 27865 - DNA, 25 bp, Mus musculus
gaatagcctccaattcctgtgggtt

SEQ ID NO: 27866 - DNA, 25 bp, Mus musculus
tagcctccaattcctgtgggttcct

SEQ ID NO: 27867 - DNA, 25 bp, Mus musculus
attcctgtgggttcctacactcagt

SEQ ID NO: 27868 - DNA, 25 bp, Mus musculus
gtgggttcctacactcagttctgtt

SEQ ID NO: 27869 - DNA, 25 bp, Mus musculus
tacactcagttctgttcccataagc

SEQ ID NO: 27870 - DNA, 25 bp, Mus musculus
actcagttctgttcccataagcatg

SEQ ID NO: 27871 - DNA, 25 bp, Mus musculus
ttctgttcccataagcatggatggg

SEQ ID NO: 27872 - DNA, 25 bp, Mus musculus
gctcgaactccatgttatcagcata

SEQ ID NO: 27873 - DNA, 25 bp, Mus musculus
tgttgtcaccatcctgaaatctctc

SEQ ID NO: 27874 - DNA, 25 bp, Mus musculus
cgaactccatgttatcagcatagac

SEQ ID NO: 27875 - DNA, 25 bp, Mus musculus
tatcagcatagacagcccctctgta

SEQ ID NO: 27876 - DNA, 25 bp, Mus musculus
cagcatagacagcccctctgtaaat

SEQ ID NO: 27877 - DNA, 25 bp, Mus musculus
agacagcccctctgtaaatgatggg

SEQ ID NO: 27878 - DNA, 25 bp, Mus musculus
caatgttgtcagcacctaaaatccg

SEQ ID NO: 27879 - DNA, 25 bp, Mus musculus
tgttgtcagcacctaaaatccgttc

SEQ ID NO: 27880 - DNA, 25 bp, Mus musculus
cccgaactataaggccctccatgtg

SEQ ID NO: 27881 - DNA, 25 bp, Mus musculus
tgcctcacaaatgcctatgtaggtt

SEQ ID NO: 27882 - DNA, 25 bp, Mus musculus
ctcacaaatgcctatgtaggttctt

SEQ ID NO: 27883 - DNA, 25 bp, Mus musculus
ctgttcctctcatcctggagtaagc

SEQ ID NO: 27884 - DNA, 25 bp, Mus musculus
tggctgtaggccagcccactgtcct

SEQ ID NO: 27885 - DNA, 25 bp, Mus musculus
ctgtaggccagcccactgtccttga

SEQ ID NO: 27886 - DNA, 25 bp, Mus musculus
gccagcccactgtccttgatatcga

SEQ ID NO: 27887 - DNA, 25 bp, Mus musculus
agcccactgtccttgatatcgaatg

SEQ ID NO: 27888 - DNA, 25 bp, Mus musculus
ccactgtccttgatatcgaatgtcc

SEQ ID NO: 27889 - DNA, 25 bp, Mus musculus
atatcgaatgtcctttgaaggagac

SEQ ID NO: 27890 - DNA, 25 bp, Mus musculus
ccagcctctacatcttttcctggaa

SEQ ID NO: 27891 - DNA, 25 bp, Mus musculus
gcctctacatcttttcctggaatat

SEQ ID NO: 27892 - DNA, 25 bp, Mus musculus
tctacatcttttcctggaatatgtt

SEQ ID NO: 27893 - DNA, 25 bp, Mus musculus
aatgcctatgtaggttcttagccct

SEQ ID NO: 27894 - DNA, 25 bp, Mus musculus
tatgtaggttcttagccctgacagc

SEQ ID NO: 27895 - DNA, 25 bp, Mus musculus
ggttcttagccctgacagctctgag

SEQ ID NO: 27896 - DNA, 25 bp, Mus musculus
tcttagccctgacagctctgaggtg

SEQ ID NO: 27897 - DNA, 25 bp, Mus musculus
cagctctgaggtgtcactgggcaaa

SEQ ID NO: 27898 - DNA, 25 bp, Mus musculus
ctctgaggtgtcactgggcaaagat

SEQ ID NO: 27899 - DNA, 25 bp, Mus musculus
agatgactgcacatgggcagctccc

SEQ ID NO: 27900 - DNA, 25 bp, Mus musculus
ctactgttcctctcatcctggagta

SEQ ID NO: 27901 - DNA, 25 bp, Mus musculus
tgcagcccctaagcaaggatgctga

SEQ ID NO: 27902 - DNA, 25 bp, Mus musculus
cctgagcccagagtttctctgaagc

SEQ ID NO: 27903 - DNA, 25 bp, Mus musculus
cacgtttcctcgtggagcctcagtt

SEQ ID NO: 27904 - DNA, 25 bp, Mus musculus
tggagcctcagttttcctgtctgta

SEQ ID NO: 27905 - DNA, 25 bp, Mus musculus
ctcagttttcctgtctgtatgcaaa

SEQ ID NO: 27906 - DNA, 25 bp, Mus musculus
tttcctgtctgtatgcaaagcttgg

SEQ ID NO: 27907 - DNA, 25 bp, Mus musculus
gaaatgtacctgacgtgctccatcc

SEQ ID NO: 27908 - DNA, 25 bp, Mus musculus
tacctgacgtgctccatccctagga

SEQ ID NO: 27909 - DNA, 25 bp, Mus musculus
tccatccctaggagtgctgagtccc

SEQ ID NO: 27910 - DNA, 25 bp, Mus musculus
gagtcccactgagaaagcgggcaca

SEQ ID NO: 27911 - DNA, 25 bp, Mus musculus
gggcacagacgcctcaaatggaacc

SEQ ID NO: 27912 - DNA, 25 bp, Mus musculus
agacgcctcaaatggaaccacaagt

SEQ ID NO: 27913 - DNA, 25 bp, Mus musculus
cccagagtttctctgaagctttcca

SEQ ID NO: 27914 - DNA, 25 bp, Mus musculus
ggcatcctgccgagaaggtcatgac

SEQ ID NO: 27915 - DNA, 25 bp, Mus musculus
tcatgaccctaatctggtacgagag

SEQ ID NO: 27916 - DNA, 25 bp, Mus musculus
ccctaatctggtacgagagctcctt

SEQ ID NO: 27917 - DNA, 25 bp, Mus musculus
gctccttctggaactgggcaagctc

SEQ ID NO: 27918 - DNA, 25 bp, Mus musculus
cgcaaggctctgggtctctcaggag

SEQ ID NO: 27919 - DNA, 25 bp, Mus musculus
ggtctctcaggaggtctagatttgc

SEQ ID NO: 27920 - DNA, 25 bp, Mus musculus
gatttgcctgccctgtttctagctg

SEQ ID NO: 27921 - DNA, 25 bp, Mus musculus
gctatcatcaccataccctggatcc

SEQ ID NO: 27922 - DNA, 25 bp, Mus musculus
tggacaactacagacacacttactc

SEQ ID NO: 27923 - DNA, 25 bp, Mus musculus
ctcacatacaactatgagggaaaag

SEQ ID NO: 27924 - DNA, 25 bp, Mus musculus
ggaaaaggctcggctgctggctctg

SEQ ID NO: 27925 - DNA, 25 bp, Mus musculus
tgctgtagtgacctacaggaagaag

SEQ ID NO: 27926 - DNA, 25 bp, Mus musculus
tttttggaccatctggagcccaaat

SEQ ID NO: 27927 - DNA, 25 bp, Mus musculus
gaccatctggagcccaaatttagga

SEQ ID NO: 27928 - DNA, 25 bp, Mus musculus
tccctgcttttcactgtaaaccagg

SEQ ID NO: 27929 - DNA, 25 bp, Mus musculus
tcccatctcggtctgcagaatctcc

SEQ ID NO: 27930 - DNA, 25 bp, Mus musculus
ctcggtctgcagaatctccatgcaa

SEQ ID NO: 27931 - DNA, 25 bp, Mus musculus
ctgcagaatctccatgcaaatgcac

SEQ ID NO: 27932 - DNA, 25 bp, Mus musculus
catgcaaatgcacatttacagagaa

SEQ ID NO: 27933 - DNA, 25 bp, Mus musculus
actacagacacacttactcagagtg

SEQ ID NO: 27934 - DNA, 25 bp, Mus musculus
gacacacttactcagagtggtacaa

SEQ ID NO: 27935 - DNA, 25 bp, Mus musculus
ggtacaatttcattcagccccgact

SEQ ID NO: 27936 - DNA, 25 bp, Mus musculus
atttcattcagccccgacttggtga

SEQ ID NO: 27937 - DNA, 25 bp, Mus musculus
ttcagccccgacttggtgatgaaac

SEQ ID NO: 27938 - DNA, 25 bp, Mus musculus
cttgctcaagactacgtcctcacat

SEQ ID NO: 27939 - DNA, 25 bp, Mus musculus
caagactacgtcctcacatacaact

SEQ ID NO: 27940 - DNA, 25 bp, Mus musculus
tacgtcctcacatacaactatgagg

SEQ ID NO: 27941 - DNA, 25 bp, Mus musculus
attatcaaatagaaccacagtatcc

SEQ ID NO: 27942 - DNA, 25 bp, Mus musculus
ttatcaaatagaaccacagtatcca

SEQ ID NO: 27943 - DNA, 25 bp, Mus musculus
actaaatggccctgcatcgcgcctg

SEQ ID NO: 27944 - DNA, 25 bp, Mus musculus
ctaaatggccctgcatcgcgcctgc

SEQ ID NO: 27945 - DNA, 25 bp, Mus musculus
taaatggccctgcatcgcgcctgcg

SEQ ID NO: 27946 - DNA, 25 bp, Mus musculus
aatggccctgcatcgcgcctgcgag

SEQ ID NO: 27947 - DNA, 25 bp, Mus musculus
atggccctgcatcgcgcctgcgagt

SEQ ID NO: 27948 - DNA, 25 bp, Mus musculus
atcgcgcctgcgagtggctggcagc

SEQ ID NO: 27949 - DNA, 25 bp, Mus musculus
tggctggcagccaaatcactgcccc

SEQ ID NO: 27950 - DNA, 25 bp, Mus musculus
tgcccccgtgcagattgttttcatc

SEQ ID NO: 27951 - DNA, 25 bp, Mus musculus
cccccgtgcagattgttttcatcca

SEQ ID NO: 27952 - DNA, 25 bp, Mus musculus
ccccgtgcagattgttttcatccat

SEQ ID NO: 27953 - DNA, 25 bp, Mus musculus
ctatccccgactaaatggccctgca

SEQ ID NO: 27954 - DNA, 25 bp, Mus musculus
tatccccgactaaatggccctgcat

SEQ ID NO: 27955 - DNA, 25 bp, Mus musculus
atccccgactaaatggccctgcatc

SEQ ID NO: 27956 - DNA, 25 bp, Mus musculus
tccccgactaaatggccctgcatcg

SEQ ID NO: 27957 - DNA, 25 bp, Mus musculus
cccgactaaatggccctgcatcgcg

SEQ ID NO: 27958 - DNA, 25 bp, Mus musculus
ccgactaaatggccctgcatcgcgc

SEQ ID NO: 27959 - DNA, 25 bp, Mus musculus
cgactaaatggccctgcatcgcgcc

SEQ ID NO: 27960 - DNA, 25 bp, Mus musculus
gactaaatggccctgcatcgcgcct

SEQ ID NO: 27961 - DNA, 25 bp, Mus musculus
gccagctcgcaggtgaccttaagtg

SEQ ID NO: 27962 - DNA, 25 bp, Mus musculus
tcgcaggtgaccttaagtggaactc

SEQ ID NO: 27963 - DNA, 25 bp, Mus musculus
cttctgaactacacttctgagctcc

SEQ ID NO: 27964 - DNA, 25 bp, Mus musculus
cctccaaatggctgatgaccctcag

SEQ ID NO: 27965 - DNA, 25 bp, Mus musculus
tgatgaccctcaggtcccttaagtg

SEQ ID NO: 27966 - DNA, 25 bp, Mus musculus
agaccccttattcttcataaggctg

SEQ ID NO: 27967 - DNA, 25 bp, Mus musculus
cttattcttcataaggctgaggcaa

SEQ ID NO: 27968 - DNA, 25 bp, Mus musculus
agcgctgacatttctctttcgagtg

SEQ ID NO: 27969 - DNA, 25 bp, Mus musculus
attagattctgccaactcatgaaat

SEQ ID NO: 27970 - DNA, 25 bp, Mus musculus
ttctgccaactcatgaaatgaagaa

SEQ ID NO: 27971 - DNA, 25 bp, Mus musculus
aatcttttcaacagtttcatgtttg

SEQ ID NO: 27972 - DNA, 25 bp, Mus musculus
ttcaacagtttcatgtttggggctg

SEQ ID NO: 27973 - DNA, 25 bp, Mus musculus
ggaactccagcccacagggtcatct

SEQ ID NO: 27974 - DNA, 25 bp, Mus musculus
ccagcccacagggtcatcttgcaaa

SEQ ID NO: 27975 - DNA, 25 bp, Mus musculus
tgggcatctcggatagggagtatct

SEQ ID NO: 27976 - DNA, 25 bp, Mus musculus
gttgactcttggcgacgaagcaaag

SEQ ID NO: 27977 - DNA, 25 bp, Mus musculus
tcttggcgacgaagcaaaggtcaca

SEQ ID NO: 27978 - DNA, 25 bp, Mus musculus
aggcttgtcacactgatttcaatgc

SEQ ID NO: 27979 - DNA, 25 bp, Mus musculus
gtcacactgatttcaatgcaaaata

SEQ ID NO: 27980 - DNA, 25 bp, Mus musculus
agtctgacccgtagtcttgtacaag

SEQ ID NO: 27981 - DNA, 25 bp, Mus musculus
tctctcgaatagtcatgtcaaattt

SEQ ID NO: 27982 - DNA, 25 bp, Mus musculus
ctcctcctgctcaaaattgtgacaa

SEQ ID NO: 27983 - DNA, 25 bp, Mus musculus
cctctagctcttgggggaatccctg

SEQ ID NO: 27984 - DNA, 25 bp, Mus musculus
atccctggagaactcagcatctcga

SEQ ID NO: 27985 - DNA, 25 bp, Mus musculus
ggagaactcagcatctcgagcaggt

SEQ ID NO: 27986 - DNA, 25 bp, Mus musculus
ctcagcatctcgagcaggttcgaat

SEQ ID NO: 27987 - DNA, 25 bp, Mus musculus
ggttctttactgttgtgatcagcat

SEQ ID NO: 27988 - DNA, 25 bp, Mus musculus
ttgtgatcagcatctgccccagtaa

SEQ ID NO: 27989 - DNA, 25 bp, Mus musculus
tcagcatctgccccagtaaagagca

SEQ ID NO: 27990 - DNA, 25 bp, Mus musculus
aagagcacacttctttggaagttct

SEQ ID NO: 27991 - DNA, 25 bp, Mus musculus
tgacctctctgatgtctcggtcgtt

SEQ ID NO: 27992 - DNA, 25 bp, Mus musculus
tgtctcggtcgtttgtgttatacaa

SEQ ID NO: 27993 - DNA, 25 bp, Mus musculus
gctgcccagcacatttcagatgtcg

SEQ ID NO: 27994 - DNA, 25 bp, Mus musculus
gatgtcgttccagaccctctgttca

SEQ ID NO: 27995 - DNA, 25 bp, Mus musculus
gttccagaccctctgttcactccag

SEQ ID NO: 27996 - DNA, 25 bp, Mus musculus
gaccctctgttcactccagagaatc

SEQ ID NO: 27997 - DNA, 25 bp, Mus musculus
ctgttcactccagagaatcctgaaa

SEQ ID NO: 27998 - DNA, 25 bp, Mus musculus
tcccaggtccagacacagcctctag

SEQ ID NO: 27999 - DNA, 25 bp, Mus musculus
gtccagacacagcctctagctcttg

SEQ ID NO: 28000 - DNA, 25 bp, Mus musculus
acacagcctctagctcttgggggaa

SEQ ID NO: 28001 - DNA, 25 bp, Mus musculus
gttgaccattctcaaacaacaccca

SEQ ID NO: 28002 - DNA, 25 bp, Mus musculus
ctcttttcagactgtgagctggagg

SEQ ID NO: 28003 - DNA, 25 bp, Mus musculus
ttttaacagaagacatcctgcccat

SEQ ID NO: 28004 - DNA, 25 bp, Mus musculus
cagaagacatcctgcccattgcaaa

SEQ ID NO: 28005 - DNA, 25 bp, Mus musculus
tgcccattgcaaaagcaatgtgtct

SEQ ID NO: 28006 - DNA, 25 bp, Mus musculus
tcttccaccagtcaagacacgtggc

SEQ ID NO: 28007 - DNA, 25 bp, Mus musculus
accagtcaagacacgtggcagggtc

SEQ ID NO: 28008 - DNA, 25 bp, Mus musculus
cagggtcttgctgttgtttagttct

SEQ ID NO: 28009 - DNA, 25 bp, Mus musculus
gttgtttagttcttccttgcacaga

SEQ ID NO: 28010 - DNA, 25 bp, Mus musculus
tagttcttccttgcacagaatatgt

SEQ ID NO: 28011 - DNA, 25 bp, Mus musculus
ttccttgcacagaatatgtaacgtt

SEQ ID NO: 28012 - DNA, 25 bp, Mus musculus
atttgcattctggaattgagtatct

SEQ ID NO: 28013 - DNA, 25 bp, Mus musculus
tcagactgtgagctggaggaaccct

SEQ ID NO: 28014 - DNA, 25 bp, Mus musculus
taccgcagaggccgtgtaagatcag

SEQ ID NO: 28015 - DNA, 25 bp, Mus musculus
ttaactcagacatcacgtgccagtt

SEQ ID NO: 28016 - DNA, 25 bp, Mus musculus
tcacgtgccagttgattgtttgcca

SEQ ID NO: 28017 - DNA, 25 bp, Mus musculus
tggtgaatatcccacagggttaaag

SEQ ID NO: 28018 - DNA, 25 bp, Mus musculus
cgttcctacataatccctcagagcg

SEQ ID NO: 28019 - DNA, 25 bp, Mus musculus
tacataatccctcagagcgagattg

SEQ ID NO: 28020 - DNA, 25 bp, Mus musculus
atccctcagagcgagattgcagtgc

SEQ ID NO: 28021 - DNA, 25 bp, Mus musculus
atgtgaggaccccgcttcctacatg

SEQ ID NO: 28022 - DNA, 25 bp, Mus musculus
cgcttcctacatgcaggtggccaag

SEQ ID NO: 28023 - DNA, 25 bp, Mus musculus
cgcctgcagaactcagtgtgccctg

SEQ ID NO: 28024 - DNA, 25 bp, Mus musculus
cagaactcagtgtgccctgaagcag

SEQ ID NO: 28025 - DNA, 25 bp, Mus musculus
acggccacaggtgcattctgggaag

SEQ ID NO: 28026 - DNA, 25 bp, Mus musculus
tgaaggcagtctccctgctgtggtg

SEQ ID NO: 28027 - DNA, 25 bp, Mus musculus
cagtctccctgctgtggtgatagag

SEQ ID NO: 28028 - DNA, 25 bp, Mus musculus
ccctgctgtggtgatagagattaaa

SEQ ID NO: 28029 - DNA, 25 bp, Mus musculus
gccaaacaaacagcccgaatcatct

SEQ ID NO: 28030 - DNA, 25 bp, Mus musculus
gcccgaatcatctttgtgagtcttg

SEQ ID NO: 28031 - DNA, 25 bp, Mus musculus
atcatctttgtgagtcttgaaaaag

SEQ ID NO: 28032 - DNA, 25 bp, Mus musculus
gacttttgcttttaaactgcaagag

SEQ ID NO: 28033 - DNA, 25 bp, Mus musculus
ctacatgcaggtggccaagaccatt

SEQ ID NO: 28034 - DNA, 25 bp, Mus musculus
tgtctttcataatcatggaatccac

SEQ ID NO: 28035 - DNA, 25 bp, Mus musculus
tcataatcatggaatccacgctacc

SEQ ID NO: 28036 - DNA, 25 bp, Mus musculus
tcatggaatccacgctaccaccatc

SEQ ID NO: 28037 - DNA, 25 bp, Mus musculus
caccatccagcctgaattcgctagc

SEQ ID NO: 28038 - DNA, 25 bp, Mus musculus
cgtcggctctaagtcaagtgtgctc

SEQ ID NO: 28039 - DNA, 25 bp, Mus musculus
gtcaagtgtgctcccgtgtgagctc

SEQ ID NO: 28040 - DNA, 25 bp, Mus musculus
tgagctcgcctgcagaactcagtgt

SEQ ID NO: 28041 - DNA, 25 bp, Mus musculus
catcttccatgctgggacacaagcc

SEQ ID NO: 28042 - DNA, 25 bp, Mus musculus
tcttccatgctgggacacaagccac

SEQ ID NO: 28043 - DNA, 25 bp, Mus musculus
atcagctcttggtgcccaccaagac

SEQ ID NO: 28044 - DNA, 25 bp, Mus musculus
cttagcgcctggtgcctccatcatg

SEQ ID NO: 28045 - DNA, 25 bp, Mus musculus
tagcgcctggtgcctccatcatggc

SEQ ID NO: 28046 - DNA, 25 bp, Mus musculus
gcgcctggtgcctccatcatggcta

SEQ ID NO: 28047 - DNA, 25 bp, Mus musculus
ggtgcctccatcatggctaaagcat

SEQ ID NO: 28048 - DNA, 25 bp, Mus musculus
tgcctccatcatggctaaagcatgg

SEQ ID NO: 28049 - DNA, 25 bp, Mus musculus
cctccatcatggctaaagcatgggc

SEQ ID NO: 28050 - DNA, 25 bp, Mus musculus
tccatcatggctaaagcatgggccg

SEQ ID NO: 28051 - DNA, 25 bp, Mus musculus
ctaaagcatgggccgtggggacact

SEQ ID NO: 28052 - DNA, 25 bp, Mus musculus
catgggccgtggggacactgacgac

SEQ ID NO: 28053 - DNA, 25 bp, Mus musculus
ttccatgctgggacacaagccacat

SEQ ID NO: 28054 - DNA, 25 bp, Mus musculus
tgggacacaagccacatcttcctgt

SEQ ID NO: 28055 - DNA, 25 bp, Mus musculus
acacaagccacatcttcctgtcctg

SEQ ID NO: 28056 - DNA, 25 bp, Mus musculus
acaagccacatcttcctgtcctggg

SEQ ID NO: 28057 - DNA, 25 bp, Mus musculus
tatatatgtcatcagctcttggtgc

SEQ ID NO: 28058 - DNA, 25 bp, Mus musculus
tatatgtcatcagctcttggtgccc

SEQ ID NO: 28059 - DNA, 25 bp, Mus musculus
tatgtcatcagctcttggtgcccac

SEQ ID NO: 28060 - DNA, 25 bp, Mus musculus
tcatcagctcttggtgcccaccaag

SEQ ID NO: 28061 - DNA, 25 bp, Mus musculus
atgttgtgcagctttgcttctttgc

SEQ ID NO: 28062 - DNA, 25 bp, Mus musculus
tgcagctttgcttctttgcctctct

SEQ ID NO: 28063 - DNA, 25 bp, Mus musculus
cgctccttcgttgtaaatatcgcta

SEQ ID NO: 28064 - DNA, 25 bp, Mus musculus
aatatcgctagtgatcgttgccaaa

SEQ ID NO: 28065 - DNA, 25 bp, Mus musculus
cgttgccaaatgacgttctggatgg

SEQ ID NO: 28066 - DNA, 25 bp, Mus musculus
caaatgacgttctggatgggcctgt

SEQ ID NO: 28067 - DNA, 25 bp, Mus musculus
caccgggcctgcctctctttgtcgt

SEQ ID NO: 28068 - DNA, 25 bp, Mus musculus
ttttcgtctcctgagcatcggagct

SEQ ID NO: 28069 - DNA, 25 bp, Mus musculus
tcgtctcctgagcatcggagcttgg

SEQ ID NO: 28070 - DNA, 25 bp, Mus musculus
tctcctgagcatcggagcttggaac

SEQ ID NO: 28071 - DNA, 25 bp, Mus musculus
cctgagcatcggagcttggaactca

SEQ ID NO: 28072 - DNA, 25 bp, Mus musculus
agcttggaactcagcagtttcacgt

SEQ ID NO: 28073 - DNA, 25 bp, Mus musculus
agctttgcttctttgcctctctctc

SEQ ID NO: 28074 - DNA, 25 bp, Mus musculus
ccgcactgctttcgtgaattttgta

SEQ ID NO: 28075 - DNA, 25 bp, Mus musculus
cgatattgtcagccttctaaaagca

SEQ ID NO: 28076 - DNA, 25 bp, Mus musculus
tattgtcagccttctaaaagcaagt

SEQ ID NO: 28077 - DNA, 25 bp, Mus musculus
cagccttctaaaagcaagtggagaa

SEQ ID NO: 28078 - DNA, 25 bp, Mus musculus
tatggccatgtacacgttctgacaa

SEQ ID NO: 28079 - DNA, 25 bp, Mus musculus
gttctgacaactggtggcaaatttc

SEQ ID NO: 28080 - DNA, 25 bp, Mus musculus
tttcgctccttcgttgtaaatatcg

SEQ ID NO: 28081 - DNA, 25 bp, Mus musculus
tttgggatcaaccgccctgctgtat

SEQ ID NO: 28082 - DNA, 25 bp, Mus musculus
gctgtattagctccagaggatgggc

SEQ ID NO: 28083 - DNA, 25 bp, Mus musculus
acctgtgtccatcacatcaagcgcc

SEQ ID NO: 28084 - DNA, 25 bp, Mus musculus
gtccatcacatcaagcgccaggaca

SEQ ID NO: 28085 - DNA, 25 bp, Mus musculus
cacatcaagcgccaggacatcattc

SEQ ID NO: 28086 - DNA, 25 bp, Mus musculus
aagcgccaggacatcattctcaagt

SEQ ID NO: 28087 - DNA, 25 bp, Mus musculus
caggacatcattctcaagtgggagc

SEQ ID NO: 28088 - DNA, 25 bp, Mus musculus
atcattctcaagtgggagctagggg

SEQ ID NO: 28089 - DNA, 25 bp, Mus musculus
gtctttctcgctgagtgctacaacc

SEQ ID NO: 28090 - DNA, 25 bp, Mus musculus
ctcgctgagtgctacaaccttctga

SEQ ID NO: 28091 - DNA, 25 bp, Mus musculus
gagtgctacaaccttctgaatgatc

SEQ ID NO: 28092 - DNA, 25 bp, Mus musculus
tacaaccttctgaatgatcaggaca

SEQ ID NO: 28093 - DNA, 25 bp, Mus musculus
ttagctccagaggatgggctggcca

SEQ ID NO: 28094 - DNA, 25 bp, Mus musculus
aagatgctcgtggctgtcaaggcac

SEQ ID NO: 28095 - DNA, 25 bp, Mus musculus
ctggccatgtccctacacttcatga

SEQ ID NO: 28096 - DNA, 25 bp, Mus musculus
atgtccctacacttcatgacactgg

SEQ ID NO: 28097 - DNA, 25 bp, Mus musculus
ctacacttcatgacactgggtggca

SEQ ID NO: 28098 - DNA, 25 bp, Mus musculus
tccggactccagggccacatcatgg

SEQ ID NO: 28099 - DNA, 25 bp, Mus musculus
ctccagggccacatcatggagaacc

SEQ ID NO: 28100 - DNA, 25 bp, Mus musculus
tacttcagtgatacctgtgtccatc

SEQ ID NO: 28101 - DNA, 25 bp, Mus musculus
agtgatacctgtgtccatcacatca

SEQ ID NO: 28102 - DNA, 25 bp, Mus musculus
ctatttccagattggtgccattcag

SEQ ID NO: 28103 - DNA, 25 bp, Mus musculus
tggtgccattcagtcatttgccggc

SEQ ID NO: 28104 - DNA, 25 bp, Mus musculus
caccgtgttcttcatcagcatcgag

SEQ ID NO: 28105 - DNA, 25 bp, Mus musculus
catcagcatcgagatgtgccagatc

SEQ ID NO: 28106 - DNA, 25 bp, Mus musculus
gatgtgccagatcgcagatgtcctc

SEQ ID NO: 28107 - DNA, 25 bp, Mus musculus
cgtgttccaggtctgcattggctgc

SEQ ID NO: 28108 - DNA, 25 bp, Mus musculus
ctgcattggctgcttcctgtgctac

SEQ ID NO: 28109 - DNA, 25 bp, Mus musculus
tggctgcttcctgtgctactgccca

SEQ ID NO: 28110 - DNA, 25 bp, Mus musculus
cttcctgtgctactgcccagggatg

SEQ ID NO: 28111 - DNA, 25 bp, Mus musculus
gtgctactgcccagggatgcctaac

SEQ ID NO: 28112 - DNA, 25 bp, Mus musculus
gcctaacatcttcaacttcatgccc

SEQ ID NO: 28113 - DNA, 25 bp, Mus musculus
catcttcaacttcatgcccatccgg

SEQ ID NO: 28114 - DNA, 25 bp, Mus musculus
ctttgctgactacttcacggccatg

SEQ ID NO: 28115 - DNA, 25 bp, Mus musculus
tctcatctttgtctatgatgagatc

SEQ ID NO: 28116 - DNA, 25 bp, Mus musculus
tgactacttcacggccatggcgcag

SEQ ID NO: 28117 - DNA, 25 bp, Mus musculus
ccatctacaagatcttcaagacagc

SEQ ID NO: 28118 - DNA, 25 bp, Mus musculus
acaagatcttcaagacagctacggc

SEQ ID NO: 28119 - DNA, 25 bp, Mus musculus
agacagctacggccaggaatggaca

SEQ ID NO: 28120 - DNA, 25 bp, Mus musculus
atttggtcagcgcctgtaccagcag

SEQ ID NO: 28121 - DNA, 25 bp, Mus musculus
tcagcgcctgtaccagcagtacacc

SEQ ID NO: 28122 - DNA, 25 bp, Mus musculus
ctgttacaccgtgttcttcatcagc

SEQ ID NO: 28123 - DNA, 25 bp, Mus musculus
gctctttgactgccttaccacgtca

SEQ ID NO: 28124 - DNA, 25 bp, Mus musculus
tctttgactgccttaccacgtcatt

SEQ ID NO: 28125 - DNA, 25 bp, Mus musculus
taccacgtcattgacacacaggctg

SEQ ID NO: 28126 - DNA, 25 bp, Mus musculus
gaatgttatgtccatcagtgacgga

SEQ ID NO: 28127 - DNA, 25 bp, Mus musculus
gtcacgtgtcagatgtgctgcacag

SEQ ID NO: 28128 - DNA, 25 bp, Mus musculus
tgtcagatgtgctgcacaggccaga

SEQ ID NO: 28129 - DNA, 25 bp, Mus musculus
taccatgaaactcggacttggctca

SEQ ID NO: 28130 - DNA, 25 bp, Mus musculus
accatgaaactcggacttggctcag

SEQ ID NO: 28131 - DNA, 25 bp, Mus musculus
catgaaactcggacttggctcagta

SEQ ID NO: 28132 - DNA, 25 bp, Mus musculus
atgaaactcggacttggctcagtac

SEQ ID NO: 28133 - DNA, 25 bp, Mus musculus
gaaactcggacttggctcagtacca

SEQ ID NO: 28134 - DNA, 25 bp, Mus musculus
aaactcggacttggctcagtaccag

SEQ ID NO: 28135 - DNA, 25 bp, Mus musculus
ctttgactgccttaccacgtcattg

SEQ ID NO: 28136 - DNA, 25 bp, Mus musculus
ttgactgccttaccacgtcattgac

SEQ ID NO: 28137 - DNA, 25 bp, Mus musculus
tgactgccttaccacgtcattgaca

SEQ ID NO: 28138 - DNA, 25 bp, Mus musculus
actgccttaccacgtcattgacaca

SEQ ID NO: 28139 - DNA, 25 bp, Mus musculus
ctgccttaccacgtcattgacacac

SEQ ID NO: 28140 - DNA, 25 bp, Mus musculus
gccttaccacgtcattgacacacag

SEQ ID NO: 28141 - DNA, 25 bp, Mus musculus
ccttaccacgtcattgacacacagg

SEQ ID NO: 28142 - DNA, 25 bp, Mus musculus
ttaccacgtcattgacacacaggct

SEQ ID NO: 28143 - DNA, 25 bp, Mus musculus
ctgttgcttccctatgtcagcagtg

SEQ ID NO: 28144 - DNA, 25 bp, Mus musculus
cttccctatgtcagcagtgagctga

SEQ ID NO: 28145 - DNA, 25 bp, Mus musculus
gcagctgctacagctggcatgatga

SEQ ID NO: 28146 - DNA, 25 bp, Mus musculus
attcaccatgttaagaccaatggaa

SEQ ID NO: 28147 - DNA, 25 bp, Mus musculus
aatggaattctgttctgtggccggt

SEQ ID NO: 28148 - DNA, 25 bp, Mus musculus
tctccctgagcaaagggtattcctg

SEQ ID NO: 28149 - DNA, 25 bp, Mus musculus
attcctgtcagtctttgaccctctc

SEQ ID NO: 28150 - DNA, 25 bp, Mus musculus
tctctccatggtttgctgtaaccca

SEQ ID NO: 28151 - DNA, 25 bp, Mus musculus
ctccatggtttgctgtaacccaagt

SEQ ID NO: 28152 - DNA, 25 bp, Mus musculus
ctgtaacccaagtgaccttatccat

SEQ ID NO: 28153 - DNA, 25 bp, Mus musculus
cccaagtgaccttatccataagtgc

SEQ ID NO: 28154 - DNA, 25 bp, Mus musculus
tatccataagtgcaatggcaattat

SEQ ID NO: 28155 - DNA, 25 bp, Mus musculus
tacaacatgaacgatgccctctaca

SEQ ID NO: 28156 - DNA, 25 bp, Mus musculus
gatgccctctacaagttgggcatga

SEQ ID NO: 28157 - DNA, 25 bp, Mus musculus
gccctctacaagttgggcatgactg

SEQ ID NO: 28158 - DNA, 25 bp, Mus musculus
tttggcggcagggcagacttttctg

SEQ ID NO: 28159 - DNA, 25 bp, Mus musculus
ttttctggaatgtcttccaagcaag

SEQ ID NO: 28160 - DNA, 25 bp, Mus musculus
ggaatgtcttccaagcaaggcttgt

SEQ ID NO: 28161 - DNA, 25 bp, Mus musculus
ggcttgtttctgtctaaggttgtgc

SEQ ID NO: 28162 - DNA, 25 bp, Mus musculus
gtgcataaggcctttgtggaggtta

SEQ ID NO: 28163 - DNA, 25 bp, Mus musculus
tggttgtcacgtgatggtactgtta

SEQ ID NO: 28164 - DNA, 25 bp, Mus musculus
agtatgacaagtctcctggagtctg

SEQ ID NO: 28165 - DNA, 25 bp, Mus musculus
gtcgcagttacgctttatggcgtgc

SEQ ID NO: 28166 - DNA, 25 bp, Mus musculus
gttacgctttatggcgtgccataga

SEQ ID NO: 28167 - DNA, 25 bp, Mus musculus
ctttatggcgtgccatagactgttg

SEQ ID NO: 28168 - DNA, 25 bp, Mus musculus
tatggcgtgccatagactgttggag

SEQ ID NO: 28169 - DNA, 25 bp, Mus musculus
gaggtactcgacagactacgaccgc

SEQ ID NO: 28170 - DNA, 25 bp, Mus musculus
ctcgacagactacgaccgctgagtt

SEQ ID NO: 28171 - DNA, 25 bp, Mus musculus
acagatggcttgctagtacgttgct

SEQ ID NO: 28172 - DNA, 25 bp, Mus musculus
gatggcttgctagtacgttgctcag

SEQ ID NO: 28173 - DNA, 25 bp, Mus musculus
ctagtacgttgctcagtggtgtcta

SEQ ID NO: 28174 - DNA, 25 bp, Mus musculus
gtacgttgctcagtggtgtctacgt

SEQ ID NO: 28175 - DNA, 25 bp, Mus musculus
atgacaagtctcctggagtctgata

SEQ ID NO: 28176 - DNA, 25 bp, Mus musculus
ctcctggagtctgatacagcaatca

SEQ ID NO: 28177 - DNA, 25 bp, Mus musculus
atcagattcccatcggtatatggta

SEQ ID NO: 28178 - DNA, 25 bp, Mus musculus
agattcccatcggtatatggtagaa

SEQ ID NO: 28179 - DNA, 25 bp, Mus musculus
aatgtgtttgtcctgtacgtagtcg

SEQ ID NO: 28180 - DNA, 25 bp, Mus musculus
gtgtttgtcctgtacgtagtcgcag

SEQ ID NO: 28181 - DNA, 25 bp, Mus musculus
ctgtacgtagtcgcagttacgcttt

SEQ ID NO: 28182 - DNA, 25 bp, Mus musculus
tacgtagtcgcagttacgctttatg

SEQ ID NO: 28183 - DNA, 25 bp, Mus musculus
atattacaccaatgatggagctgaa

SEQ ID NO: 28184 - DNA, 25 bp, Mus musculus
ttacaccaatgatggagctgaagcc

SEQ ID NO: 28185 - DNA, 25 bp, Mus musculus
atgccgaaaaggtggccgagaagct

SEQ ID NO: 28186 - DNA, 25 bp, Mus musculus
aatgaatcactctgtctttttcctt

SEQ ID NO: 28187 - DNA, 25 bp, Mus musculus
tacctccaagttttgacaccattga

SEQ ID NO: 28188 - DNA, 25 bp, Mus musculus
caagttttgacaccattgaacatga

SEQ ID NO: 28189 - DNA, 25 bp, Mus musculus
ttgacaccattgaacatgacttcag

SEQ ID NO: 28190 - DNA, 25 bp, Mus musculus
acaccattgaacatgacttcagaaa

SEQ ID NO: 28191 - DNA, 25 bp, Mus musculus
aacatgacttcagaaatccattccc

SEQ ID NO: 28192 - DNA, 25 bp, Mus musculus
atgacttcagaaatccattccccag

SEQ ID NO: 28193 - DNA, 25 bp, Mus musculus
acttcagaaatccattccccagctc

SEQ ID NO: 28194 - DNA, 25 bp, Mus musculus
cattccccagctcatgaaaatgtac

SEQ ID NO: 28195 - DNA, 25 bp, Mus musculus
cgaatgctggcagtgaccgagcctg

SEQ ID NO: 28196 - DNA, 25 bp, Mus musculus
atgctggcagtgaccgagcctgggt

SEQ ID NO: 28197 - DNA, 25 bp, Mus musculus
acaccgactttgctgacgagtgccc

SEQ ID NO: 28198 - DNA, 25 bp, Mus musculus
actttgctgacgagtgccccaagcc

SEQ ID NO: 28199 - DNA, 25 bp, Mus musculus
ttgctgacgagtgccccaagcctga

SEQ ID NO: 28200 - DNA, 25 bp, Mus musculus
ctgacgagtgccccaagcctgagct

SEQ ID NO: 28201 - DNA, 25 bp, Mus musculus
tgctcgccatccgcttcctaaatgc

SEQ ID NO: 28202 - DNA, 25 bp, Mus musculus
ccatccgcttcctaaatgctgagaa

SEQ ID NO: 28203 - DNA, 25 bp, Mus musculus
gagctccgagactttcgaggaaata

SEQ ID NO: 28204 - DNA, 25 bp, Mus musculus
acccctctacatcttgcctgtgagc

SEQ ID NO: 28205 - DNA, 25 bp, Mus musculus
gagcacttggtgactttgggtgctg

SEQ ID NO: 28206 - DNA, 25 bp, Mus musculus
ttggtgactttgggtgctgatgtca

SEQ ID NO: 28207 - DNA, 25 bp, Mus musculus
actttgggtgctgatgtcaacgctc

SEQ ID NO: 28208 - DNA, 25 bp, Mus musculus
caggagccctgcaatggccggacag

SEQ ID NO: 28209 - DNA, 25 bp, Mus musculus
cagaatcctgacctggtttcgctct

SEQ ID NO: 28210 - DNA, 25 bp, Mus musculus
cctgacctggtttcgctcttgttga

SEQ ID NO: 28211 - DNA, 25 bp, Mus musculus
ctggtttcgctcttgttgaaatgtg

SEQ ID NO: 28212 - DNA, 25 bp, Mus musculus
agtacccggatacagcagcagctgg

SEQ ID NO: 28213 - DNA, 25 bp, Mus musculus
cagatgctacccgagagcgaggatg

SEQ ID NO: 28214 - DNA, 25 bp, Mus musculus
tatgatgactgtgtgtttggaggcc

SEQ ID NO: 28215 - DNA, 25 bp, Mus musculus
ctacatcttgcctgtgagcagggct

SEQ ID NO: 28216 - DNA, 25 bp, Mus musculus
ctgcaggccaccaactacaatggcc

SEQ ID NO: 28217 - DNA, 25 bp, Mus musculus
gccaccaactacaatggccacacgt

SEQ ID NO: 28218 - DNA, 25 bp, Mus musculus
aactacaatggccacacgtgtctgc

SEQ ID NO: 28219 - DNA, 25 bp, Mus musculus
aatggccacacgtgtctgcacctag

SEQ ID NO: 28220 - DNA, 25 bp, Mus musculus
tgtctgcacctagcctctactcacg

SEQ ID NO: 28221 - DNA, 25 bp, Mus musculus
ggctacctggccatcgtggagcact

SEQ ID NO: 28222 - DNA, 25 bp, Mus musculus
ctggccatcgtggagcacttggtga

SEQ ID NO: 28223 - DNA, 25 bp, Mus musculus
tcttctccagatcctccagggcctg

SEQ ID NO: 28224 - DNA, 25 bp, Mus musculus
ttctccagatcctccagggcctgct

SEQ ID NO: 28225 - DNA, 25 bp, Mus musculus
cgcccctgtgaagcatactggatca

SEQ ID NO: 28226 - DNA, 25 bp, Mus musculus
cccctgtgaagcatactggatcacc

SEQ ID NO: 28227 - DNA, 25 bp, Mus musculus
aagcatactggatcaccaagttgtg

SEQ ID NO: 28228 - DNA, 25 bp, Mus musculus
gcatactggatcaccaagttgtgga

SEQ ID NO: 28229 - DNA, 25 bp, Mus musculus
actggatcaccaagttgtggagcgt

SEQ ID NO: 28230 - DNA, 25 bp, Mus musculus
tggatcaccaagttgtggagcgtgc

SEQ ID NO: 28231 - DNA, 25 bp, Mus musculus
cgtgcgcagcttgcagggatctcgt

SEQ ID NO: 28232 - DNA, 25 bp, Mus musculus
tgcgcagcttgcagggatctcgtag

SEQ ID NO: 28233 - DNA, 25 bp, Mus musculus
cgcagcttgcagggatctcgtagcc

SEQ ID NO: 28234 - DNA, 25 bp, Mus musculus
ttgcagggatctcgtagccgccctg

SEQ ID NO: 28235 - DNA, 25 bp, Mus musculus
ctccagatcctccagggcctgcttg

SEQ ID NO: 28236 - DNA, 25 bp, Mus musculus
atcctccagggcctgcttgcagaga

SEQ ID NO: 28237 - DNA, 25 bp, Mus musculus
cctccagggcctgcttgcagagatg

SEQ ID NO: 28238 - DNA, 25 bp, Mus musculus
tccagggcctgcttgcagagatggc

SEQ ID NO: 28239 - DNA, 25 bp, Mus musculus
cagggcctgcttgcagagatggcac

SEQ ID NO: 28240 - DNA, 25 bp, Mus musculus
cctcgtaacgcccctgtgaagcata

SEQ ID NO: 28241 - DNA, 25 bp, Mus musculus
gtaacgcccctgtgaagcatactgg

SEQ ID NO: 28242 - DNA, 25 bp, Mus musculus
aacgcccctgtgaagcatactggat

SEQ ID NO: 28243 - DNA, 25 bp, Mus musculus
aagctgaagccaggaaccagagttg

SEQ ID NO: 28244 - DNA, 25 bp, Mus musculus
gatatgaccacactaaccatcatga

SEQ ID NO: 28245 - DNA, 25 bp, Mus musculus
cttacaaatccagaattattccagc

SEQ ID NO: 28246 - DNA, 25 bp, Mus musculus
aatccagaattattccagcgtgtag

SEQ ID NO: 28247 - DNA, 25 bp, Mus musculus
atacctccaaaaggctgtttgctct

SEQ ID NO: 28248 - DNA, 25 bp, Mus musculus
cctccaaaaggctgtttgctctatg

SEQ ID NO: 28249 - DNA, 25 bp, Mus musculus
aaaggctgtttgctctatggaccgc

SEQ ID NO: 28250 - DNA, 25 bp, Mus musculus
tgtttgctctatggaccgccagcac

SEQ ID NO: 28251 - DNA, 25 bp, Mus musculus
ttgctctatggaccgccagcactgg

SEQ ID NO: 28252 - DNA, 25 bp, Mus musculus
ctctatggaccgccagcactgggaa

SEQ ID NO: 28253 - DNA, 25 bp, Mus musculus
tatggaccgccagcactgggaaaac

SEQ ID NO: 28254 - DNA, 25 bp, Mus musculus
ggaccgccagcactgggaaaacact

SEQ ID NO: 28255 - DNA, 25 bp, Mus musculus
atgaccacactaaccatcatgagat

SEQ ID NO: 28256 - DNA, 25 bp, Mus musculus
ccgccagcactgggaaaacactctt

SEQ ID NO: 28257 - DNA, 25 bp, Mus musculus
accacactaaccatcatgagatatc

SEQ ID NO: 28258 - DNA, 25 bp, Mus musculus
acactaaccatcatgagatatctgc

SEQ ID NO: 28259 - DNA, 25 bp, Mus musculus
gtttataacatgtctcacgaggatc

SEQ ID NO: 28260 - DNA, 25 bp, Mus musculus
atgtctcacgaggatcctggaaatg

SEQ ID NO: 28261 - DNA, 25 bp, Mus musculus
tcttattctgagattggaggcctgt

SEQ ID NO: 28262 - DNA, 25 bp, Mus musculus
atagaattgcctcttacaaatccag

SEQ ID NO: 28263 - DNA, 25 bp, Mus musculus
ttgcctcttacaaatccagaattat

SEQ ID NO: 28264 - DNA, 25 bp, Mus musculus
aatatggccgagctggcccagcagg

SEQ ID NO: 28265 - DNA, 25 bp, Mus musculus
gagttgcccagtgaggatggcccag

SEQ ID NO: 28266 - DNA, 25 bp, Mus musculus
ttcagccatggcctgagctttgggg

SEQ ID NO: 28267 - DNA, 25 bp, Mus musculus
cccgataccctggggacagagcacg

SEQ ID NO: 28268 - DNA, 25 bp, Mus musculus
gataccctggggacagagcacggct

SEQ ID NO: 28269 - DNA, 25 bp, Mus musculus
aacctgtccaagaaggatctggact

SEQ ID NO: 28270 - DNA, 25 bp, Mus musculus
ttaatgctcctagatgactccctgc

SEQ ID NO: 28271 - DNA, 25 bp, Mus musculus
atgctcctagatgactccctgctcc

SEQ ID NO: 28272 - DNA, 25 bp, Mus musculus
tctaccatgtctcctgaggcctcca

SEQ ID NO: 28273 - DNA, 25 bp, Mus musculus
atgtctcctgaggcctccaaggcca

SEQ ID NO: 28274 - DNA, 25 bp, Mus musculus
ctcccatccttcaggctgcacttgg

SEQ ID NO: 28275 - DNA, 25 bp, Mus musculus
ttcaggctgcacttggtggtgaagt

SEQ ID NO: 28276 - DNA, 25 bp, Mus musculus
atgctggggcctgaggtccctgagc

SEQ ID NO: 28277 - DNA, 25 bp, Mus musculus
cctgaggtccctgagcctgagcaaa

SEQ ID NO: 28278 - DNA, 25 bp, Mus musculus
cctgagcaaatgccggctcttcctc

SEQ ID NO: 28279 - DNA, 25 bp, Mus musculus
tctccgttccatcacctggacttca

SEQ ID NO: 28280 - DNA, 25 bp, Mus musculus
ttccatcacctggacttcagccatg

SEQ ID NO: 28281 - DNA, 25 bp, Mus musculus
catcacctggacttcagccatggcc

SEQ ID NO: 28282 - DNA, 25 bp, Mus musculus
ctggacttcagccatggcctgagct

SEQ ID NO: 28283 - DNA, 25 bp, Mus musculus
gacttcagccatggcctgagctttg

SEQ ID NO: 28284 - DNA, 25 bp, Mus musculus
tatctccaacagcctctctctttca

SEQ ID NO: 28285 - DNA, 25 bp, Mus musculus
gaccgttgtgtgtgttctggaaacg

SEQ ID NO: 28286 - DNA, 25 bp, Mus musculus
gaatcagcctagcaggcccagcaac

SEQ ID NO: 28287 - DNA, 25 bp, Mus musculus
caggcccagcaacacagcctctaag

SEQ ID NO: 28288 - DNA, 25 bp, Mus musculus
cagcaacacagcctctaagttagag

SEQ ID NO: 28289 - DNA, 25 bp, Mus musculus
cacagcctctaagttagagcgggat

SEQ ID NO: 28290 - DNA, 25 bp, Mus musculus
acttgaaccccaaattgcttcagca

SEQ ID NO: 28291 - DNA, 25 bp, Mus musculus
aaattgctttgcctgaaataagaag

SEQ ID NO: 28292 - DNA, 25 bp, Mus musculus
ttcaaaaatgttctcagctgattgg

SEQ ID NO: 28293 - DNA, 25 bp, Mus musculus
aatgttctcagctgattggaattct

SEQ ID NO: 28294 - DNA, 25 bp, Mus musculus
gaacaaaatacacaacagtgtccat

SEQ ID NO: 28295 - DNA, 25 bp, Mus musculus
aatacacaacagtgtccatatttta

SEQ ID NO: 28296 - DNA, 25 bp, Mus musculus
acctctcaatttcactcaagagttt

SEQ ID NO: 28297 - DNA, 25 bp, Mus musculus
cactcaagagtttccatctcctcaa

SEQ ID NO: 28298 - DNA, 25 bp, Mus musculus
tccatctcctcaaacgtattggaag

SEQ ID NO: 28299 - DNA, 25 bp, Mus musculus
tcctcaaacgtattggaaggagatt

SEQ ID NO: 28300 - DNA, 25 bp, Mus musculus
tacagcttcagttactgtggccctc

SEQ ID NO: 28301 - DNA, 25 bp, Mus musculus
tgtgatgctgctcatcattgtatgt

SEQ ID NO: 28302 - DNA, 25 bp, Mus musculus
gctgctcatcattgtatgtcacaag

SEQ ID NO: 28303 - DNA, 25 bp, Mus musculus
gaagccgaatcagcctagcaggccc

SEQ ID NO: 28304 - DNA, 25 bp, Mus musculus
attcgtttcttgcagtttgacccag

SEQ ID NO: 28305 - DNA, 25 bp, Mus musculus
ttttaaacttgaccattattgccat

SEQ ID NO: 28306 - DNA, 25 bp, Mus musculus
ttattgccatgaaccgtatatggac

SEQ ID NO: 28307 - DNA, 25 bp, Mus musculus
aaagctcctggtaatcacaagccgt

SEQ ID NO: 28308 - DNA, 25 bp, Mus musculus
agctcctggtaatcacaagccgtga

SEQ ID NO: 28309 - DNA, 25 bp, Mus musculus
tcctggtaatcacaagccgtgacaa

SEQ ID NO: 28310 - DNA, 25 bp, Mus musculus
cctggtaatcacaagccgtgacaac

SEQ ID NO: 28311 - DNA, 25 bp, Mus musculus
tggtaatcacaagccgtgacaactt

SEQ ID NO: 28312 - DNA, 25 bp, Mus musculus
ggtaatcacaagccgtgacaactta

SEQ ID NO: 28313 - DNA, 25 bp, Mus musculus
taatcacaagccgtgacaacttagg

SEQ ID NO: 28314 - DNA, 25 bp, Mus musculus
aatcacaagccgtgacaacttaggg

SEQ ID NO: 28315 - DNA, 25 bp, Mus musculus
tcacaagccgtgacaacttagggat

SEQ ID NO: 28316 - DNA, 25 bp, Mus musculus
ttaaacttgaccattattgccatga

SEQ ID NO: 28317 - DNA, 25 bp, Mus musculus
cacaagccgtgacaacttagggatt

SEQ ID NO: 28318 - DNA, 25 bp, Mus musculus
taaacttgaccattattgccatgaa

SEQ ID NO: 28319 - DNA, 25 bp, Mus musculus
aacttgaccattattgccatgaacc

SEQ ID NO: 28320 - DNA, 25 bp, Mus musculus
ttgaccattattgccatgaaccgta

SEQ ID NO: 28321 - DNA, 25 bp, Mus musculus
tgaccattattgccatgaaccgtat

SEQ ID NO: 28322 - DNA, 25 bp, Mus musculus
accattattgccatgaaccgtatat

SEQ ID NO: 28323 - DNA, 25 bp, Mus musculus
ccattattgccatgaaccgtatatg

SEQ ID NO: 28324 - DNA, 25 bp, Mus musculus
attattgccatgaaccgtatatgga

SEQ ID NO: 28325 - DNA, 25 bp, Mus musculus
ttctccggcctggactgtgataccg

SEQ ID NO: 28326 - DNA, 25 bp, Mus musculus
gagagactttcagtgccctttctac

SEQ ID NO: 28327 - DNA, 25 bp, Mus musculus
atggcctttttgacacgagcctact

SEQ ID NO: 28328 - DNA, 25 bp, Mus musculus
gcctttttgacacgagcctactgaa

SEQ ID NO: 28329 - DNA, 25 bp, Mus musculus
acacgagcctactgaatgctgtgta

SEQ ID NO: 28330 - DNA, 25 bp, Mus musculus
atattgagtgaaccttgtggactct

SEQ ID NO: 28331 - DNA, 25 bp, Mus musculus
cctatttctgcattaaaatgtaatg

SEQ ID NO: 28332 - DNA, 25 bp, Mus musculus
tgattgcttgctttatttcagacaa

SEQ ID NO: 28333 - DNA, 25 bp, Mus musculus
ttgcttgctttatttcagacaacca

SEQ ID NO: 28334 - DNA, 25 bp, Mus musculus
gctttatttcagacaaccagtgctt

SEQ ID NO: 28335 - DNA, 25 bp, Mus musculus
ttatttcagacaaccagtgctttga

SEQ ID NO: 28336 - DNA, 25 bp, Mus musculus
tttcagacaaccagtgctttgattt

SEQ ID NO: 28337 - DNA, 25 bp, Mus musculus
agactttcagtgccctttctacagt

SEQ ID NO: 28338 - DNA, 25 bp, Mus musculus
tcagtgccctttctacagttggaag

SEQ ID NO: 28339 - DNA, 25 bp, Mus musculus
tttctttatatactattcccaccat

SEQ ID NO: 28340 - DNA, 25 bp, Mus musculus
cagactttgccttttcacaaaggtg

SEQ ID NO: 28341 - DNA, 25 bp, Mus musculus
tttcacaaaggtggagcgtgaattc

SEQ ID NO: 28342 - DNA, 25 bp, Mus musculus
tgaattccagaaggacccagtattc

SEQ ID NO: 28343 - DNA, 25 bp, Mus musculus
aaatgaagtcttcggtcagaaatgg

SEQ ID NO: 28344 - DNA, 25 bp, Mus musculus
tgaagtcttcggtcagaaatggcct

SEQ ID NO: 28345 - DNA, 25 bp, Mus musculus
ggtccttccagaactgtaataacat

SEQ ID NO: 28346 - DNA, 25 bp, Mus musculus
gtaataacatgctgtaccccaagca

SEQ ID NO: 28347 - DNA, 25 bp, Mus musculus
gccaacacgaatccgacaacagctg

SEQ ID NO: 28348 - DNA, 25 bp, Mus musculus
aacacgaatccgacaacagctgcat

SEQ ID NO: 28349 - DNA, 25 bp, Mus musculus
aatccgacaacagctgcatatatgt

SEQ ID NO: 28350 - DNA, 25 bp, Mus musculus
ccgacaacagctgcatatatgtcaa

SEQ ID NO: 28351 - DNA, 25 bp, Mus musculus
acaacagctgcatatatgtcaacac

SEQ ID NO: 28352 - DNA, 25 bp, Mus musculus
tatatgtcaacacgatcactcacaa

SEQ ID NO: 28353 - DNA, 25 bp, Mus musculus
atgtcaacacgatcactcacaaatg

SEQ ID NO: 28354 - DNA, 25 bp, Mus musculus
tcaacacgatcactcacaaatgtac

SEQ ID NO: 28355 - DNA, 25 bp, Mus musculus
cgagatcgaccacatcatcgcagac

SEQ ID NO: 28356 - DNA, 25 bp, Mus musculus
gatcgaccacatcatcgcagacatg

SEQ ID NO: 28357 - DNA, 25 bp, Mus musculus
acatgctgtaccccaagcactacaa

SEQ ID NO: 28358 - DNA, 25 bp, Mus musculus
tcgaccacatcatcgcagacatgtc

SEQ ID NO: 28359 - DNA, 25 bp, Mus musculus
tgctgtaccccaagcactacaaata

SEQ ID NO: 28360 - DNA, 25 bp, Mus musculus
atcacattctgccgtacgcttgccg

SEQ ID NO: 28361 - DNA, 25 bp, Mus musculus
acattctgccgtacgcttgccggaa

SEQ ID NO: 28362 - DNA, 25 bp, Mus musculus
cttgccggaattcctattgccaaca

SEQ ID NO: 28363 - DNA, 25 bp, Mus musculus
gccggaattcctattgccaacacga

SEQ ID NO: 28364 - DNA, 25 bp, Mus musculus
cctattgccaacacgaatccgacaa

SEQ ID NO: 28365 - DNA, 25 bp, Mus musculus
attgccaacacgaatccgacaacag

SEQ ID NO: 28366 - DNA, 25 bp, Mus musculus
ccaacacttccagagctcaagatct

SEQ ID NO: 28367 - DNA, 25 bp, Mus musculus
aacacttccagagctcaagatctgc

SEQ ID NO: 28368 - DNA, 25 bp, Mus musculus
gtactccgaggccatcctcgagggc

SEQ ID NO: 28369 - DNA, 25 bp, Mus musculus
tactccgaggccatcctcgagggct

SEQ ID NO: 28370 - DNA, 25 bp, Mus musculus
tcgagggctcctagttcggagtctc

SEQ ID NO: 28371 - DNA, 25 bp, Mus musculus
gagggctcctagttcggagtctcca

SEQ ID NO: 28372 - DNA, 25 bp, Mus musculus
gctcctagttcggagtctccatgca

SEQ ID NO: 28373 - DNA, 25 bp, Mus musculus
ctcctagttcggagtctccatgcag

SEQ ID NO: 28374 - DNA, 25 bp, Mus musculus
tcctagttcggagtctccatgcagc

SEQ ID NO: 28375 - DNA, 25 bp, Mus musculus
ctagttcggagtctccatgcagcta

SEQ ID NO: 28376 - DNA, 25 bp, Mus musculus
tagttcggagtctccatgcagctac

SEQ ID NO: 28377 - DNA, 25 bp, Mus musculus
agttcggagtctccatgcagctacg

SEQ ID NO: 28378 - DNA, 25 bp, Mus musculus
acacttccagagctcaagatctgcc

SEQ ID NO: 28379 - DNA, 25 bp, Mus musculus
cacttccagagctcaagatctgccg

SEQ ID NO: 28380 - DNA, 25 bp, Mus musculus
gatgtgcatcggcaagtgtgcatgt

SEQ ID NO: 28381 - DNA, 25 bp, Mus musculus
atgtgcatcggcaagtgtgcatgtg

SEQ ID NO: 28382 - DNA, 25 bp, Mus musculus
atgtgtgatccggacgtcctccggt

SEQ ID NO: 28383 - DNA, 25 bp, Mus musculus
tccggtactccgaggccatcctcga

SEQ ID NO: 28384 - DNA, 25 bp, Mus musculus
ccggtactccgaggccatcctcgag

SEQ ID NO: 28385 - DNA, 25 bp, Mus musculus
ggtactccgaggccatcctcgaggg

SEQ ID NO: 28386 - DNA, 25 bp, Mus musculus
atggagctatctggtggacgcaggc

SEQ ID NO: 28387 - DNA, 25 bp, Mus musculus
gagctatctggtggacgcaggcctt

SEQ ID NO: 28388 - DNA, 25 bp, Mus musculus
gtatatttcgatgtatgtggtcact

SEQ ID NO: 28389 - DNA, 25 bp, Mus musculus
tatgtaacctgtgttgcgcaaatgc

SEQ ID NO: 28390 - DNA, 25 bp, Mus musculus
gtaacctgtgttgcgcaaatgccgc

SEQ ID NO: 28391 - DNA, 25 bp, Mus musculus
acctgtgttgcgcaaatgccgcatc

SEQ ID NO: 28392 - DNA, 25 bp, Mus musculus
gcgcaaatgccgcatcaatttgagt

SEQ ID NO: 28393 - DNA, 25 bp, Mus musculus
caaatgccgcatcaatttgagtgat

SEQ ID NO: 28394 - DNA, 25 bp, Mus musculus
atgccgcatcaatttgagtgattgt

SEQ ID NO: 28395 - DNA, 25 bp, Mus musculus
atactgtggtcatatgcccgtgttt

SEQ ID NO: 28396 - DNA, 25 bp, Mus musculus
tcatatgcccgtgtttgtcacttac

SEQ ID NO: 28397 - DNA, 25 bp, Mus musculus
tgtttactatgaacacacagaaata

SEQ ID NO: 28398 - DNA, 25 bp, Mus musculus
ctatctggtggacgcaggccttgag

SEQ ID NO: 28399 - DNA, 25 bp, Mus musculus
tctggtggacgcaggccttgagaac

SEQ ID NO: 28400 - DNA, 25 bp, Mus musculus
ttctagcaaatgcacttggtatact

SEQ ID NO: 28401 - DNA, 25 bp, Mus musculus
ttagttggcaacactgcccattcaa

SEQ ID NO: 28402 - DNA, 25 bp, Mus musculus
ggcaacactgcccattcaattgaat

SEQ ID NO: 28403 - DNA, 25 bp, Mus musculus
aacactgcccattcaattgaatccg

SEQ ID NO: 28404 - DNA, 25 bp, Mus musculus
gcccattcaattgaatccgaaagga

SEQ ID NO: 28405 - DNA, 25 bp, Mus musculus
ttaaggattgccttcagtttgtgtt

SEQ ID NO: 28406 - DNA, 25 bp, Mus musculus
taaggtcattgctactgtcagcaca

SEQ ID NO: 28407 - DNA, 25 bp, Mus musculus
tgctactgtcagcacaacagtcagt

SEQ ID NO: 28408 - DNA, 25 bp, Mus musculus
aactgtccggatcatcatcactatc

SEQ ID NO: 28409 - DNA, 25 bp, Mus musculus
gatcatcatcactatccaccacagg

SEQ ID NO: 28410 - DNA, 25 bp, Mus musculus
cactatccaccacagggacgaggaa

SEQ ID NO: 28411 - DNA, 25 bp, Mus musculus
tatccaccacagggacgaggaagtg

SEQ ID NO: 28412 - DNA, 25 bp, Mus musculus
agtggttctcctgaaccagcgtgga

SEQ ID NO: 28413 - DNA, 25 bp, Mus musculus
ggttctcctgaaccagcgtggacaa

SEQ ID NO: 28414 - DNA, 25 bp, Mus musculus
tctcctgaaccagcgtggacaatgg

SEQ ID NO: 28415 - DNA, 25 bp, Mus musculus
cctgaaccagcgtggacaatggtga

SEQ ID NO: 28416 - DNA, 25 bp, Mus musculus
gaaccagcgtggacaatggtgagat

SEQ ID NO: 28417 - DNA, 25 bp, Mus musculus
gtaagcctcttgtcagcaagagagt

SEQ ID NO: 28418 - DNA, 25 bp, Mus musculus
cacaacagtcagtggggacgagaag

SEQ ID NO: 28419 - DNA, 25 bp, Mus musculus
agcctcttgtcagcaagagagtatc

SEQ ID NO: 28420 - DNA, 25 bp, Mus musculus
ctaatatcgttctagcaacttgctg

SEQ ID NO: 28421 - DNA, 25 bp, Mus musculus
atatcgttctagcaacttgctgagg

SEQ ID NO: 28422 - DNA, 25 bp, Mus musculus
ttctagcaacttgctgaggcacggc

SEQ ID NO: 28423 - DNA, 25 bp, Mus musculus
tagcaacttgctgaggcacggcatg

SEQ ID NO: 28424 - DNA, 25 bp, Mus musculus
caacttgctgaggcacggcatgaag

SEQ ID NO: 28425 - DNA, 25 bp, Mus musculus
catgaagctcttcgtggagcacgtg

SEQ ID NO: 28426 - DNA, 25 bp, Mus musculus
gaagctcttcgtggagcacgtgtgg

SEQ ID NO: 28427 - DNA, 25 bp, Mus musculus
ttacccgtggatgaccaaactgcac

SEQ ID NO: 28428 - DNA, 25 bp, Mus musculus
gatgaccaaactgcacatgagccac

SEQ ID NO: 28429 - DNA, 25 bp, Mus musculus
gggcctcccagacaaaagcgcattt

SEQ ID NO: 28430 - DNA, 25 bp, Mus musculus
cccagacaaaagcgcatttctttgg

SEQ ID NO: 28431 - DNA, 25 bp, Mus musculus
cgcatttctttggcattccgaatcc

SEQ ID NO: 28432 - DNA, 25 bp, Mus musculus
tctttggcattccgaatccccatcg

SEQ ID NO: 28433 - DNA, 25 bp, Mus musculus
tgcactgcctgtcttgctccagctc

SEQ ID NO: 28434 - DNA, 25 bp, Mus musculus
gcctgtcttgctccagctcagctga

SEQ ID NO: 28435 - DNA, 25 bp, Mus musculus
tgtcttgctccagctcagctgagac

SEQ ID NO: 28436 - DNA, 25 bp, Mus musculus
gctcagctgagaccccaggcccggg

SEQ ID NO: 28437 - DNA, 25 bp, Mus musculus
cagctgagaccccaggcccggggca

SEQ ID NO: 28438 - DNA, 25 bp, Mus musculus
caggcccggggcacattcttgtagc

SEQ ID NO: 28439 - DNA, 25 bp, Mus musculus
gaccaaactgcacatgagccacgag

SEQ ID NO: 28440 - DNA, 25 bp, Mus musculus
gcacatgagccacgagacggatggc

SEQ ID NO: 28441 - DNA, 25 bp, Mus musculus
catgagccacgagacggatggcaag

SEQ ID NO: 28442 - DNA, 25 bp, Mus musculus
cactcgccgcaggcgcatagagatt

SEQ ID NO: 28443 - DNA, 25 bp, Mus musculus
agagattgccaacaacttgtgtctc

SEQ ID NO: 28444 - DNA, 25 bp, Mus musculus
cctcagagagcaccccggtctgctg

SEQ ID NO: 28445 - DNA, 25 bp, Mus musculus
cctccttctagattttgaggcggag

SEQ ID NO: 28446 - DNA, 25 bp, Mus musculus
ggctagagcactggctccgggcctc

SEQ ID NO: 28447 - DNA, 25 bp, Mus musculus
tcatcggcagcctcaatgtgcagac

SEQ ID NO: 28448 - DNA, 25 bp, Mus musculus
tcggcagcctcaatgtgcagacgag

SEQ ID NO: 28449 - DNA, 25 bp, Mus musculus
tacgctgcttcggcttcgtgatgta

SEQ ID NO: 28450 - DNA, 25 bp, Mus musculus
tcggcttcgtgatgtactcgagctt

SEQ ID NO: 28451 - DNA, 25 bp, Mus musculus
tcgtgatgtactcgagcttggagtg

SEQ ID NO: 28452 - DNA, 25 bp, Mus musculus
actcgagcttggagtggtcgcgata

SEQ ID NO: 28453 - DNA, 25 bp, Mus musculus
agtggtcgcgataccctatggctgc

SEQ ID NO: 28454 - DNA, 25 bp, Mus musculus
ggtcgcgataccctatggctgcttc

SEQ ID NO: 28455 - DNA, 25 bp, Mus musculus
gataccctatggctgcttcgtcgta

SEQ ID NO: 28456 - DNA, 25 bp, Mus musculus
ctatggctgcttcgtcgtacgcgta

SEQ ID NO: 28457 - DNA, 25 bp, Mus musculus
ctgcttcgtcgtacgcgtatgacgg

SEQ ID NO: 28458 - DNA, 25 bp, Mus musculus
cttcgtcgtacgcgtatgacggcga

SEQ ID NO: 28459 - DNA, 25 bp, Mus musculus
gcagcctcaatgtgcagacgagtga

SEQ ID NO: 28460 - DNA, 25 bp, Mus musculus
tcaatgtgcagacgagtgagtcggg

SEQ ID NO: 28461 - DNA, 25 bp, Mus musculus
acttcgatgccttctgtactctagc

SEQ ID NO: 28462 - DNA, 25 bp, Mus musculus
tctgtactctagcggactgcgtggt

SEQ ID NO: 28463 - DNA, 25 bp, Mus musculus
tgaaccccagacgaagcgctctacg

SEQ ID NO: 28464 - DNA, 25 bp, Mus musculus
ccagacgaagcgctctacgctgctt

SEQ ID NO: 28465 - DNA, 25 bp, Mus musculus
gaagcgctctacgctgcttcggctt

SEQ ID NO: 28466 - DNA, 25 bp, Mus musculus
ctctacgctgcttcggcttcgtgat

SEQ ID NO: 28467 - DNA, 25 bp, Mus musculus
tgccaactatgagcgcttcgtgcct

SEQ ID NO: 28468 - DNA, 25 bp, Mus musculus
cgtggacgatttccctaatgctgct

SEQ ID NO: 28469 - DNA, 25 bp, Mus musculus
catccacaacttggcagactggttc

SEQ ID NO: 28470 - DNA, 25 bp, Mus musculus
caacttggcagactggttccagcga

SEQ ID NO: 28471 - DNA, 25 bp, Mus musculus
atgaggccattctgctgtgaactga

SEQ ID NO: 28472 - DNA, 25 bp, Mus musculus
ccattctgctgtgaactgactacat

SEQ ID NO: 28473 - DNA, 25 bp, Mus musculus
tggccttggctgcgttttctaaata

SEQ ID NO: 28474 - DNA, 25 bp, Mus musculus
gccctcgtggcttttttacagagag

SEQ ID NO: 28475 - DNA, 25 bp, Mus musculus
ttctggtaaggggctgcggtgtcct

SEQ ID NO: 28476 - DNA, 25 bp, Mus musculus
ccttccttacctgtcacccatgtga

SEQ ID NO: 28477 - DNA, 25 bp, Mus musculus
ttacctgtcacccatgtgaagaagt

SEQ ID NO: 28478 - DNA, 25 bp, Mus musculus
gtcacccatgtgaagaagtgggcta

SEQ ID NO: 28479 - DNA, 25 bp, Mus musculus
cgatttccctaatgctgcttccctg

SEQ ID NO: 28480 - DNA, 25 bp, Mus musculus
tctcgaccgaaacgtggctgtctat

SEQ ID NO: 28481 - DNA, 25 bp, Mus musculus
ctacttccgctggcgccggagcttt

SEQ ID NO: 28482 - DNA, 25 bp, Mus musculus
gagctttgcagtgcacatcacctct

SEQ ID NO: 28483 - DNA, 25 bp, Mus musculus
tgcagtgcacatcacctctttctgg

SEQ ID NO: 28484 - DNA, 25 bp, Mus musculus
gtgccggacatgccaagctgtgcag

SEQ ID NO: 28485 - DNA, 25 bp, Mus musculus
ccaagctgtgcagacctctggggac

SEQ ID NO: 28486 - DNA, 25 bp, Mus musculus
caagagcatccacaacttggcagac

SEQ ID NO: 28487 - DNA, 25 bp, Mus musculus
ctgaggctcagcgcacaactgcagg

SEQ ID NO: 28488 - DNA, 25 bp, Mus musculus
gcgcacaactgcaggtagctcttta

SEQ ID NO: 28489 - DNA, 25 bp, Mus musculus
ggaccgtcatgcggtcactgtggtc

SEQ ID NO: 28490 - DNA, 25 bp, Mus musculus
gaccgtcatgcggtcactgtggtca

SEQ ID NO: 28491 - DNA, 25 bp, Mus musculus
accgtcatgcggtcactgtggtcag

SEQ ID NO: 28492 - DNA, 25 bp, Mus musculus
ccgtcatgcggtcactgtggtcaga

SEQ ID NO: 28493 - DNA, 25 bp, Mus musculus
cgtcatgcggtcactgtggtcagaa

SEQ ID NO: 28494 - DNA, 25 bp, Mus musculus
gtcatgcggtcactgtggtcagaac

SEQ ID NO: 28495 - DNA, 25 bp, Mus musculus
tcatgcggtcactgtggtcagaacc

SEQ ID NO: 28496 - DNA, 25 bp, Mus musculus
catgcggtcactgtggtcagaaccc

SEQ ID NO: 28497 - DNA, 25 bp, Mus musculus
cgcacaactgcaggtagctctttac

SEQ ID NO: 28498 - DNA, 25 bp, Mus musculus
cacaactgcaggtagctctttacag

SEQ ID NO: 28499 - DNA, 25 bp, Mus musculus
ctgcaggtagctctttacagcagtg

SEQ ID NO: 28500 - DNA, 25 bp, Mus musculus
caggtagctctttacagcagtgaga

SEQ ID NO: 28501 - DNA, 25 bp, Mus musculus
aggtagctctttacagcagtgagaa

SEQ ID NO: 28502 - DNA, 25 bp, Mus musculus
ctctttacagcagtgagaagctgag

SEQ ID NO: 28503 - DNA, 25 bp, Mus musculus
tcaagtgaagctttctccctattcg

SEQ ID NO: 28504 - DNA, 25 bp, Mus musculus
caagtgaagctttctccctattcga

SEQ ID NO: 28505 - DNA, 25 bp, Mus musculus
atcttcgcacctcaaggcgcacctg

SEQ ID NO: 28506 - DNA, 25 bp, Mus musculus
gaggcctttcacactgcagctggca

SEQ ID NO: 28507 - DNA, 25 bp, Mus musculus
tcagctgccccatctgtgagaagcg

SEQ ID NO: 28508 - DNA, 25 bp, Mus musculus
gctgccccatctgtgagaagcgctt

SEQ ID NO: 28509 - DNA, 25 bp, Mus musculus
gccccatctgtgagaagcgcttcat

SEQ ID NO: 28510 - DNA, 25 bp, Mus musculus
agaagcgcttcatgcggacgaccac

SEQ ID NO: 28511 - DNA, 25 bp, Mus musculus
agcgcttcatgcggacgaccacctg

SEQ ID NO: 28512 - DNA, 25 bp, Mus musculus
gcttcatgcggacgaccacctgacg

SEQ ID NO: 28513 - DNA, 25 bp, Mus musculus
tcatgcggacgaccacctgacgaag

SEQ ID NO: 28514 - DNA, 25 bp, Mus musculus
tgcggacgaccacctgacgaagcac

SEQ ID NO: 28515 - DNA, 25 bp, Mus musculus
ggacgaccacctgacgaagcacgca

SEQ ID NO: 28516 - DNA, 25 bp, Mus musculus
agcgactacagccgctccgatgcca

SEQ ID NO: 28517 - DNA, 25 bp, Mus musculus
gcctttcacactgcagctggcagga

SEQ ID NO: 28518 - DNA, 25 bp, Mus musculus
tttcacactgcagctggcaggagtg

SEQ ID NO: 28519 - DNA, 25 bp, Mus musculus
agttcgcacgctcggacgagctggc

SEQ ID NO: 28520 - DNA, 25 bp, Mus musculus
cacgctcggacgagctggcacggca

SEQ ID NO: 28521 - DNA, 25 bp, Mus musculus
gctcggacgagctggcacggcacta

SEQ ID NO: 28522 - DNA, 25 bp, Mus musculus
agctggcacggcactatcgcacgca

SEQ ID NO: 28523 - DNA, 25 bp, Mus musculus
cgcacacgggcgagaagaagttcag

SEQ ID NO: 28524 - DNA, 25 bp, Mus musculus
agaagttcagctgccccatctgtga

SEQ ID NO: 28525 - DNA, 25 bp, Mus musculus
tgaccaagggtggcccagtgtaaat

SEQ ID NO: 28526 - DNA, 25 bp, Mus musculus
tcacagggcaccttagacggtctgg

SEQ ID NO: 28527 - DNA, 25 bp, Mus musculus
tcatttctaatcgtcgcagtgtttc

SEQ ID NO: 28528 - DNA, 25 bp, Mus musculus
gtcgcagtgtttcctgctttgggcc

SEQ ID NO: 28529 - DNA, 25 bp, Mus musculus
gtgtttcctgctttgggccagcaaa

SEQ ID NO: 28530 - DNA, 25 bp, Mus musculus
cctgctttgggccagcaaagaagcc

SEQ ID NO: 28531 - DNA, 25 bp, Mus musculus
agaagcctgatgactgcatagggtt

SEQ ID NO: 28532 - DNA, 25 bp, Mus musculus
tacttagacgcaccgtgtttgtgac

SEQ ID NO: 28533 - DNA, 25 bp, Mus musculus
gacgcaccgtgtttgtgactactac

SEQ ID NO: 28534 - DNA, 25 bp, Mus musculus
ctactacagcaatcaccatagctac

SEQ ID NO: 28535 - DNA, 25 bp, Mus musculus
cagcaatcaccatagctacgagatg

SEQ ID NO: 28536 - DNA, 25 bp, Mus musculus
tcaccatagctacgagatgagattt

SEQ ID NO: 28537 - DNA, 25 bp, Mus musculus
ggcaccttagacggtctggagaagg

SEQ ID NO: 28538 - DNA, 25 bp, Mus musculus
gaaggtaccagaaacctcttctgag

SEQ ID NO: 28539 - DNA, 25 bp, Mus musculus
acacagtacccaggaagttgattgc

SEQ ID NO: 28540 - DNA, 25 bp, Mus musculus
acgcatggctacagttactaatgga

SEQ ID NO: 28541 - DNA, 25 bp, Mus musculus
agttactaatggactctgctgcaga

SEQ ID NO: 28542 - DNA, 25 bp, Mus musculus
acatgcttccctgttattccagctt

SEQ ID NO: 28543 - DNA, 25 bp, Mus musculus
gcaaattcaccatcgggctcatttc

SEQ ID NO: 28544 - DNA, 25 bp, Mus musculus
tcaccatcgggctcatttctaatcg

SEQ ID NO: 28545 - DNA, 25 bp, Mus musculus
acgcctgcgccggctatgtcaccat

SEQ ID NO: 28546 - DNA, 25 bp, Mus musculus
ctgcgccggctatgtcaccatcaca

SEQ ID NO: 28547 - DNA, 25 bp, Mus musculus
tctagctgcgcgttgtagtatcggc

SEQ ID NO: 28548 - DNA, 25 bp, Mus musculus
agctgcgcgttgtagtatcggctct

SEQ ID NO: 28549 - DNA, 25 bp, Mus musculus
gttgtagtatcggctctggtggcta

SEQ ID NO: 28550 - DNA, 25 bp, Mus musculus
gtagtatcggctctggtggctacac

SEQ ID NO: 28551 - DNA, 25 bp, Mus musculus
tagtatcggctctggtggctacaca

SEQ ID NO: 28552 - DNA, 25 bp, Mus musculus
gtatcggctctggtggctacacatc

SEQ ID NO: 28553 - DNA, 25 bp, Mus musculus
tatcggctctggtggctacacatcg

SEQ ID NO: 28554 - DNA, 25 bp, Mus musculus
gtggctacacatcggcggtgccgcg

SEQ ID NO: 28555 - DNA, 25 bp, Mus musculus
tggctacacatcggcggtgccgcgt

SEQ ID NO: 28556 - DNA, 25 bp, Mus musculus
gctacacatcggcggtgccgcgtgc

SEQ ID NO: 28557 - DNA, 25 bp, Mus musculus
tgcgacgctctcatggtcgctgaca

SEQ ID NO: 28558 - DNA, 25 bp, Mus musculus
gacgctctcatggtcgctgacatct

SEQ ID NO: 28559 - DNA, 25 bp, Mus musculus
gctgacatctagcccggctccactt

SEQ ID NO: 28560 - DNA, 25 bp, Mus musculus
tgacatctagcccggctccacttct

SEQ ID NO: 28561 - DNA, 25 bp, Mus musculus
ggctccacttctagctgcgcgttgt

SEQ ID NO: 28562 - DNA, 25 bp, Mus musculus
ctccacttctagctgcgcgttgtag

SEQ ID NO: 28563 - DNA, 25 bp, Mus musculus
tccacttctagctgcgcgttgtagt

SEQ ID NO: 28564 - DNA, 25 bp, Mus musculus
ttctagctgcgcgttgtagtatcgg

SEQ ID NO: 28565 - DNA, 25 bp, Mus musculus
tgccgaaagctacaccttcttcctt

SEQ ID NO: 28566 - DNA, 25 bp, Mus musculus
gaaagctacaccttcttccttgaca

SEQ ID NO: 28567 - DNA, 25 bp, Mus musculus
cttcttccttgacatcctgctgagt

SEQ ID NO: 28568 - DNA, 25 bp, Mus musculus
cttgacatcctgctgagttccatca

SEQ ID NO: 28569 - DNA, 25 bp, Mus musculus
tgacatcctgctgagttccatcagg

SEQ ID NO: 28570 - DNA, 25 bp, Mus musculus
gacatcctgctgagttccatcaggg

SEQ ID NO: 28571 - DNA, 25 bp, Mus musculus
acatcctgctgagttccatcaggga

SEQ ID NO: 28572 - DNA, 25 bp, Mus musculus
tcctgctgagttccatcagggatgg

SEQ ID NO: 28573 - DNA, 25 bp, Mus musculus
cctgctgagttccatcagggatgga

SEQ ID NO: 28574 - DNA, 25 bp, Mus musculus
ctgctgagttccatcagggatggaa

SEQ ID NO: 28575 - DNA, 25 bp, Mus musculus
agttccatcagggatggaatcagcg

SEQ ID NO: 28576 - DNA, 25 bp, Mus musculus
aaagctacaccttcttccttgacat

SEQ ID NO: 28577 - DNA, 25 bp, Mus musculus
aagctacaccttcttccttgacatc

SEQ ID NO: 28578 - DNA, 25 bp, Mus musculus
agctacaccttcttccttgacatcc

SEQ ID NO: 28579 - DNA, 25 bp, Mus musculus
gctacaccttcttccttgacatcct

SEQ ID NO: 28580 - DNA, 25 bp, Mus musculus
ctacaccttcttccttgacatcctg

SEQ ID NO: 28581 - DNA, 25 bp, Mus musculus
tacaccttcttccttgacatcctgc

SEQ ID NO: 28582 - DNA, 25 bp, Mus musculus
accttcttccttgacatcctgctga

SEQ ID NO: 28583 - DNA, 25 bp, Mus musculus
ccttcttccttgacatcctgctgag

SEQ ID NO: 28584 - DNA, 25 bp, Mus musculus
ttactctctctgaccctggagtcac

SEQ ID NO: 28585 - DNA, 25 bp, Mus musculus
tctctgaccctggagtcacaccact

SEQ ID NO: 28586 - DNA, 25 bp, Mus musculus
acacctccaacattaccaatgtgac

SEQ ID NO: 28587 - DNA, 25 bp, Mus musculus
ccaacattaccaatgtgaccgtgaa

SEQ ID NO: 28588 - DNA, 25 bp, Mus musculus
gcaccttcattgaggactacaaaga

SEQ ID NO: 28589 - DNA, 25 bp, Mus musculus
tagatggctgggctaccctgttcct

SEQ ID NO: 28590 - DNA, 25 bp, Mus musculus
gctgggctaccctgttcctgagaac

SEQ ID NO: 28591 - DNA, 25 bp, Mus musculus
tgttcctgagaaccagcatccctac

SEQ ID NO: 28592 - DNA, 25 bp, Mus musculus
tgagaaccagcatccctaccatcaa

SEQ ID NO: 28593 - DNA, 25 bp, Mus musculus
tccctaccatcaacatggagaacaa

SEQ ID NO: 28594 - DNA, 25 bp, Mus musculus
catggttctctgtggacattgactc

SEQ ID NO: 28595 - DNA, 25 bp, Mus musculus
agagccagccgtcagagacagaaag

SEQ ID NO: 28596 - DNA, 25 bp, Mus musculus
cgcctgtcacactagctgctgccaa

SEQ ID NO: 28597 - DNA, 25 bp, Mus musculus
tcacactagctgctgccaaaaaagc

SEQ ID NO: 28598 - DNA, 25 bp, Mus musculus
tagctgctgccaaaaaagccaagtc

SEQ ID NO: 28599 - DNA, 25 bp, Mus musculus
ctgccaaaaaagccaagtctgagac

SEQ ID NO: 28600 - DNA, 25 bp, Mus musculus
ccaagtctgagactgtgttgacctg

SEQ ID NO: 28601 - DNA, 25 bp, Mus musculus
ctgtgttgacctgctccaatggccg

SEQ ID NO: 28602 - DNA, 25 bp, Mus musculus
tgacctgctccaatggccgtgcccg

SEQ ID NO: 28603 - DNA, 25 bp, Mus musculus
ttccagacacctccaacattaccaa

SEQ ID NO: 28604 - DNA, 25 bp, Mus musculus
ttccagcagcttttagcaggtgaat

SEQ ID NO: 28605 - DNA, 25 bp, Mus musculus
tccagcagcttttagcaggtgaata

SEQ ID NO: 28606 - DNA, 25 bp, Mus musculus
tctcccagaacaagccttctacatg

SEQ ID NO: 28607 - DNA, 25 bp, Mus musculus
ctcccagaacaagccttctacatgg

SEQ ID NO: 28608 - DNA, 25 bp, Mus musculus
caagccttctacatggtgggaccca

SEQ ID NO: 28609 - DNA, 25 bp, Mus musculus
agccttctacatggtgggacccatt

SEQ ID NO: 28610 - DNA, 25 bp, Mus musculus
gccttctacatggtgggacccattc

SEQ ID NO: 28611 - DNA, 25 bp, Mus musculus
ccttctacatggtgggacccattcg

SEQ ID NO: 28612 - DNA, 25 bp, Mus musculus
tctacatggtgggacccattcgaag

SEQ ID NO: 28613 - DNA, 25 bp, Mus musculus
gtgggacccattcgaagaagccgtg

SEQ ID NO: 28614 - DNA, 25 bp, Mus musculus
attcgaagaagccgtgctaaaggct

SEQ ID NO: 28615 - DNA, 25 bp, Mus musculus
agaagccgtgctaaaggctgattaa

SEQ ID NO: 28616 - DNA, 25 bp, Mus musculus
ccagcagcttttagcaggtgaatat

SEQ ID NO: 28617 - DNA, 25 bp, Mus musculus
tgaatatgaccatctcccagaacaa

SEQ ID NO: 28618 - DNA, 25 bp, Mus musculus
gaatatgaccatctcccagaacaag

SEQ ID NO: 28619 - DNA, 25 bp, Mus musculus
aatatgaccatctcccagaacaagc

SEQ ID NO: 28620 - DNA, 25 bp, Mus musculus
tatgaccatctcccagaacaagcct

SEQ ID NO: 28621 - DNA, 25 bp, Mus musculus
tgaccatctcccagaacaagccttc

SEQ ID NO: 28622 - DNA, 25 bp, Mus musculus
accatctcccagaacaagccttcta

SEQ ID NO: 28623 - DNA, 25 bp, Mus musculus
catctcccagaacaagccttctaca

SEQ ID NO: 28624 - DNA, 25 bp, Mus musculus
caccctcatcagcgtggtccagaat

SEQ ID NO: 28625 - DNA, 25 bp, Mus musculus
catcagcgtggtccagaatgcgttc

SEQ ID NO: 28626 - DNA, 25 bp, Mus musculus
gccaaccagaactgcgtagatgcgt

SEQ ID NO: 28627 - DNA, 25 bp, Mus musculus
gtagatgcgtaccccactttccttg

SEQ ID NO: 28628 - DNA, 25 bp, Mus musculus
cccactttccttgtgatactctgga

SEQ ID NO: 28629 - DNA, 25 bp, Mus musculus
actttccttgtgatactctggactg

SEQ ID NO: 28630 - DNA, 25 bp, Mus musculus
gtgatactctggactgcaggactac

SEQ ID NO: 28631 - DNA, 25 bp, Mus musculus
ctactttgcagccaagtccctgccg

SEQ ID NO: 28632 - DNA, 25 bp, Mus musculus
gccttcgccggactgatgtacctgt

SEQ ID NO: 28633 - DNA, 25 bp, Mus musculus
ttcgccggactgatgtacctgtttg

SEQ ID NO: 28634 - DNA, 25 bp, Mus musculus
ctgatgtacctgtttgtgaggcaaa

SEQ ID NO: 28635 - DNA, 25 bp, Mus musculus
atgtacctgtttgtgaggcaaaaat

SEQ ID NO: 28636 - DNA, 25 bp, Mus musculus
ggtccagaatgcgttctttgcccac

SEQ ID NO: 28637 - DNA, 25 bp, Mus musculus
tgcgttctttgcccacaaggtggag

SEQ ID NO: 28638 - DNA, 25 bp, Mus musculus
gttctttgcccacaaggtggagcat

SEQ ID NO: 28639 - DNA, 25 bp, Mus musculus
agcttccagaggaccgggactcttg

SEQ ID NO: 28640 - DNA, 25 bp, Mus musculus
cttgcctttgagcgggtctacactg

SEQ ID NO: 28641 - DNA, 25 bp, Mus musculus
gcctttgagcgggtctacactgcca

SEQ ID NO: 28642 - DNA, 25 bp, Mus musculus
gtctacactgccaaccagaactgcg

SEQ ID NO: 28643 - DNA, 25 bp, Mus musculus
tacactgccaaccagaactgcgtag

SEQ ID NO: 28644 - DNA, 25 bp, Mus musculus
aatatccaaagactgtactggccag

SEQ ID NO: 28645 - DNA, 25 bp, Mus musculus
tatccaaagactgtactggccagtg

SEQ ID NO: 28646 - DNA, 25 bp, Mus musculus
cgttgcatcttttccactcgggcac

SEQ ID NO: 28647 - DNA, 25 bp, Mus musculus
ttgcatcttttccactcgggcacaa

SEQ ID NO: 28648 - DNA, 25 bp, Mus musculus
atcttttccactcgggcacaatcgg

SEQ ID NO: 28649 - DNA, 25 bp, Mus musculus
cttttccactcgggcacaatcggtg

SEQ ID NO: 28650 - DNA, 25 bp, Mus musculus
tttccactcgggcacaatcggtgtg

SEQ ID NO: 28651 - DNA, 25 bp, Mus musculus
tccactcgggcacaatcggtgtgct

SEQ ID NO: 28652 - DNA, 25 bp, Mus musculus
ctcgggcacaatcggtgtgctgggt

SEQ ID NO: 28653 - DNA, 25 bp, Mus musculus
ggcacaatcggtgtgctgggttaat

SEQ ID NO: 28654 - DNA, 25 bp, Mus musculus
cacaatcggtgtgctgggttaatgg

SEQ ID NO: 28655 - DNA, 25 bp, Mus musculus
atcggtgtgctgggttaatggctag

SEQ ID NO: 28656 - DNA, 25 bp, Mus musculus
gactgtactggccagtgtcctttac

SEQ ID NO: 28657 - DNA, 25 bp, Mus musculus
ctgtactggccagtgtcctttactt

SEQ ID NO: 28658 - DNA, 25 bp, Mus musculus
taggtagatccagaccgtgagatgt

SEQ ID NO: 28659 - DNA, 25 bp, Mus musculus
ggtagatccagaccgtgagatgttt

SEQ ID NO: 28660 - DNA, 25 bp, Mus musculus
tagatccagaccgtgagatgtttta

SEQ ID NO: 28661 - DNA, 25 bp, Mus musculus
gatccagaccgtgagatgttttagg

SEQ ID NO: 28662 - DNA, 25 bp, Mus musculus
taatgtagctatttttctcgttgca

SEQ ID NO: 28663 - DNA, 25 bp, Mus musculus
ctcgttgcatcttttccactcgggc

SEQ ID NO: 28664 - DNA, 25 bp, Mus musculus
attccaaggcccagaagaagaatcg

SEQ ID NO: 28665 - DNA, 25 bp, Mus musculus
aactgcgccggcagcactcctacga

SEQ ID NO: 28666 - DNA, 25 bp, Mus musculus
gtgcttgcttcacggcagcaaatcc

SEQ ID NO: 28667 - DNA, 25 bp, Mus musculus
cggcagcaaatcctacttcttcagg

SEQ ID NO: 28668 - DNA, 25 bp, Mus musculus
caaatcctacttcttcaggcagccc

SEQ ID NO: 28669 - DNA, 25 bp, Mus musculus
cttcaggcagcccacggtggcaggg

SEQ ID NO: 28670 - DNA, 25 bp, Mus musculus
ccttgtcaccaataagccagtggtg

SEQ ID NO: 28671 - DNA, 25 bp, Mus musculus
caccaataagccagtggtgtcggcc

SEQ ID NO: 28672 - DNA, 25 bp, Mus musculus
ctgtgccaggtcgtttccagaagga

SEQ ID NO: 28673 - DNA, 25 bp, Mus musculus
accccagggctttcaatggctccag

SEQ ID NO: 28674 - DNA, 25 bp, Mus musculus
tcaatggctccagcaatggacatgt

SEQ ID NO: 28675 - DNA, 25 bp, Mus musculus
gctccagcaatggacatgtttatga

SEQ ID NO: 28676 - DNA, 25 bp, Mus musculus
cctacgacaccttcgtggacctgca

SEQ ID NO: 28677 - DNA, 25 bp, Mus musculus
tgtttgagatgccagctggtgagag

SEQ ID NO: 28678 - DNA, 25 bp, Mus musculus
gctcctttgccaacaagtcctcagt

SEQ ID NO: 28679 - DNA, 25 bp, Mus musculus
ttgccaacaagtcctcagtgaccac

SEQ ID NO: 28680 - DNA, 25 bp, Mus musculus
acaagtcctcagtgaccactgccgg

SEQ ID NO: 28681 - DNA, 25 bp, Mus musculus
gcggctacatgctcagcaagtcgct

SEQ ID NO: 28682 - DNA, 25 bp, Mus musculus
acatgctcagcaagtcgctctaccc

SEQ ID NO: 28683 - DNA, 25 bp, Mus musculus
tgatcagtgcttgcttcacggcagc

SEQ ID NO: 28684 - DNA, 25 bp, Mus musculus
gatccagtcccgaacagtgaggcag

SEQ ID NO: 28685 - DNA, 25 bp, Mus musculus
gtcccgaacagtgaggcagttccag

SEQ ID NO: 28686 - DNA, 25 bp, Mus musculus
gttctgctatcgagccgcactagaa

SEQ ID NO: 28687 - DNA, 25 bp, Mus musculus
ctatcgagccgcactagaatacctg

SEQ ID NO: 28688 - DNA, 25 bp, Mus musculus
agccgcactagaatacctgggcagc

SEQ ID NO: 28689 - DNA, 25 bp, Mus musculus
ctttgatcactatgcaacctagaaa

SEQ ID NO: 28690 - DNA, 25 bp, Mus musculus
tcactatgcaacctagaaacccctt

SEQ ID NO: 28691 - DNA, 25 bp, Mus musculus
tgcaacctagaaaccccttctggat

SEQ ID NO: 28692 - DNA, 25 bp, Mus musculus
ctacaggcccttcgctatccatgga

SEQ ID NO: 28693 - DNA, 25 bp, Mus musculus
cgctatccatggagtctcttctgag

SEQ ID NO: 28694 - DNA, 25 bp, Mus musculus
agtctcttctgagccatacagggca

SEQ ID NO: 28695 - DNA, 25 bp, Mus musculus
ttctgagccatacagggcacttgag

SEQ ID NO: 28696 - DNA, 25 bp, Mus musculus
gttcactgactggccagaacaagga

SEQ ID NO: 28697 - DNA, 25 bp, Mus musculus
tgactggccagaacaaggagtgcca

SEQ ID NO: 28698 - DNA, 25 bp, Mus musculus
tggccaagatgggcccatttccgtg

SEQ ID NO: 28699 - DNA, 25 bp, Mus musculus
gcccatttccgtgcattgcagtgcc

SEQ ID NO: 28700 - DNA, 25 bp, Mus musculus
ttccgtgcattgcagtgccggcgtt

SEQ ID NO: 28701 - DNA, 25 bp, Mus musculus
agatatcttccagactgtcaaaatg

SEQ ID NO: 28702 - DNA, 25 bp, Mus musculus
gttaagaacacaacgaccagccatg

SEQ ID NO: 28703 - DNA, 25 bp, Mus musculus
aacacaacgaccagccatggtacaa

SEQ ID NO: 28704 - DNA, 25 bp, Mus musculus
caagcccttagtgaggaccagagat

SEQ ID NO: 28705 - DNA, 25 bp, Mus musculus
atgtatccggtgaacgaagagctgt

SEQ ID NO: 28706 - DNA, 25 bp, Mus musculus
tccagagtagccatcgacctcacca

SEQ ID NO: 28707 - DNA, 25 bp, Mus musculus
atcgacctcaccaacaaagcttcga

SEQ ID NO: 28708 - DNA, 25 bp, Mus musculus
ctcaccaacaaagcttcgatggctt

SEQ ID NO: 28709 - DNA, 25 bp, Mus musculus
atggctttcttacaaaagcatttag

SEQ ID NO: 28710 - DNA, 25 bp, Mus musculus
gatgagaacctgattcctgggtcac

SEQ ID NO: 28711 - DNA, 25 bp, Mus musculus
attcctgggtcaccctttgacgcag

SEQ ID NO: 28712 - DNA, 25 bp, Mus musculus
cagcaacactctccaggatcacaga

SEQ ID NO: 28713 - DNA, 25 bp, Mus musculus
cactctccaggatcacagacccaga

SEQ ID NO: 28714 - DNA, 25 bp, Mus musculus
ccaggatcacagacccagaattaga

SEQ ID NO: 28715 - DNA, 25 bp, Mus musculus
tcacagacccagaattagaagaact

SEQ ID NO: 28716 - DNA, 25 bp, Mus musculus
ctctttatcaactctgccaaattcc

SEQ ID NO: 28717 - DNA, 25 bp, Mus musculus
atcaactctgccaaattccagactc

SEQ ID NO: 28718 - DNA, 25 bp, Mus musculus
tctgccaaattccagactccaaagg

SEQ ID NO: 28719 - DNA, 25 bp, Mus musculus
cagactccaaaggacatcgcaaaaa

SEQ ID NO: 28720 - DNA, 25 bp, Mus musculus
tacaatcaagggctcaggcaccaga

SEQ ID NO: 28721 - DNA, 25 bp, Mus musculus
caagggctcaggcaccagaactttg

SEQ ID NO: 28722 - DNA, 25 bp, Mus musculus
ctcaggcaccagaactttgacgact

SEQ ID NO: 28723 - DNA, 25 bp, Mus musculus
atcgattccagagtagccatcgacc

SEQ ID NO: 28724 - DNA, 25 bp, Mus musculus
acgtatgcggctcgctgtgactgcc

SEQ ID NO: 28725 - DNA, 25 bp, Mus musculus
tatgcggctcgctgtgactgcctgc

SEQ ID NO: 28726 - DNA, 25 bp, Mus musculus
accttcagtagtcggtgccctcgtg

SEQ ID NO: 28727 - DNA, 25 bp, Mus musculus
ttcagtagtcggtgccctcgtgcga

SEQ ID NO: 28728 - DNA, 25 bp, Mus musculus
atagtcgaggcgatctctaagatgg

SEQ ID NO: 28729 - DNA, 25 bp, Mus musculus
gcgatctctaagatggcaggctgtc

SEQ ID NO: 28730 - DNA, 25 bp, Mus musculus
atctctaagatggcaggctgtctgt

SEQ ID NO: 28731 - DNA, 25 bp, Mus musculus
ttgatgacacggatgcgacgtcctg

SEQ ID NO: 28732 - DNA, 25 bp, Mus musculus
atgacacggatgcgacgtcctgcat

SEQ ID NO: 28733 - DNA, 25 bp, Mus musculus
acacggatgcgacgtcctgcatcgc

SEQ ID NO: 28734 - DNA, 25 bp, Mus musculus
cgacgtcctgcatcgccatcgtggc

SEQ ID NO: 28735 - DNA, 25 bp, Mus musculus
cgtcctgcatcgccatcgtggcgct

SEQ ID NO: 28736 - DNA, 25 bp, Mus musculus
cgttatcagttgacccactcaccgt

SEQ ID NO: 28737 - DNA, 25 bp, Mus musculus
cactcaccgtgtgaaggcactgact

SEQ ID NO: 28738 - DNA, 25 bp, Mus musculus
tcaccgtgtgaaggcactgactctg

SEQ ID NO: 28739 - DNA, 25 bp, Mus musculus
gacagcctgctcatctgcaagatgg

SEQ ID NO: 28740 - DNA, 25 bp, Mus musculus
gaagactatcctgcacgtatcgtga

SEQ ID NO: 28741 - DNA, 25 bp, Mus musculus
gactatcctgcacgtatcgtgaata

SEQ ID NO: 28742 - DNA, 25 bp, Mus musculus
atcgtgaataccttcagtagtcggt

SEQ ID NO: 28743 - DNA, 25 bp, Mus musculus
gtgaataccttcagtagtcggtgcc

SEQ ID NO: 28744 - DNA, 25 bp, Mus musculus
ttcctagaggcttctcgctttgctc

SEQ ID NO: 28745 - DNA, 25 bp, Mus musculus
tcctagaggcttctcgctttgctca

SEQ ID NO: 28746 - DNA, 25 bp, Mus musculus
gctttgctcaggagaatgagctgat

SEQ ID NO: 28747 - DNA, 25 bp, Mus musculus
gatgttcctggagaccagcgctctc

SEQ ID NO: 28748 - DNA, 25 bp, Mus musculus
tgttcctggagaccagcgctctcac

SEQ ID NO: 28749 - DNA, 25 bp, Mus musculus
gttcctggagaccagcgctctcacg

SEQ ID NO: 28750 - DNA, 25 bp, Mus musculus
gaccagcgctctcacgggtgagaat

SEQ ID NO: 28751 - DNA, 25 bp, Mus musculus
accagcgctctcacgggtgagaatg

SEQ ID NO: 28752 - DNA, 25 bp, Mus musculus
ccagcgctctcacgggtgagaatgt

SEQ ID NO: 28753 - DNA, 25 bp, Mus musculus
cgctctcacgggtgagaatgtggaa

SEQ ID NO: 28754 - DNA, 25 bp, Mus musculus
ctctcacgggtgagaatgtggaaga

SEQ ID NO: 28755 - DNA, 25 bp, Mus musculus
gaagaagctttcctcaagtgcgcgc

SEQ ID NO: 28756 - DNA, 25 bp, Mus musculus
cctagaggcttctcgctttgctcag

SEQ ID NO: 28757 - DNA, 25 bp, Mus musculus
agaagctttcctcaagtgcgcgcga

SEQ ID NO: 28758 - DNA, 25 bp, Mus musculus
ctagaggcttctcgctttgctcagg

SEQ ID NO: 28759 - DNA, 25 bp, Mus musculus
agaggcttctcgctttgctcaggag

SEQ ID NO: 28760 - DNA, 25 bp, Mus musculus
gaggcttctcgctttgctcaggaga

SEQ ID NO: 28761 - DNA, 25 bp, Mus musculus
aggcttctcgctttgctcaggagaa

SEQ ID NO: 28762 - DNA, 25 bp, Mus musculus
ggcttctcgctttgctcaggagaat

SEQ ID NO: 28763 - DNA, 25 bp, Mus musculus
ttctcgctttgctcaggagaatgag

SEQ ID NO: 28764 - DNA, 25 bp, Mus musculus
ctcgctttgctcaggagaatgagct

SEQ ID NO: 28765 - DNA, 25 bp, Mus musculus
gtctacctgtcggatataaatccat

SEQ ID NO: 28766 - DNA, 25 bp, Mus musculus
gatataaatccatgacctctggaag

SEQ ID NO: 28767 - DNA, 25 bp, Mus musculus
acctggcaactgctgcacgagaccg

SEQ ID NO: 28768 - DNA, 25 bp, Mus musculus
tggcaactgctgcacgagaccgagt

SEQ ID NO: 28769 - DNA, 25 bp, Mus musculus
caactgctgcacgagaccgagtccg

SEQ ID NO: 28770 - DNA, 25 bp, Mus musculus
ctgctgcacgagaccgagtccggac

SEQ ID NO: 28771 - DNA, 25 bp, Mus musculus
accactgctaagccgagccactatg

SEQ ID NO: 28772 - DNA, 25 bp, Mus musculus
actgctaagccgagccactatggtg

SEQ ID NO: 28773 - DNA, 25 bp, Mus musculus
gctaagccgagccactatggtggat

SEQ ID NO: 28774 - DNA, 25 bp, Mus musculus
aagccgagccactatggtggatgca

SEQ ID NO: 28775 - DNA, 25 bp, Mus musculus
ccgagccactatggtggatgcacac

SEQ ID NO: 28776 - DNA, 25 bp, Mus musculus
agccactatggtggatgcacacacc

SEQ ID NO: 28777 - DNA, 25 bp, Mus musculus
aatccatgacctctggaaggcaaaa

SEQ ID NO: 28778 - DNA, 25 bp, Mus musculus
ccatgacctctggaaggcaaaattg

SEQ ID NO: 28779 - DNA, 25 bp, Mus musculus
gctaatgctatctttactgcgcact

SEQ ID NO: 28780 - DNA, 25 bp, Mus musculus
aatgctatctttactgcgcactcag

SEQ ID NO: 28781 - DNA, 25 bp, Mus musculus
tttactgcgcactcagctgtagtac

SEQ ID NO: 28782 - DNA, 25 bp, Mus musculus
actgcgcactcagctgtagtacgac

SEQ ID NO: 28783 - DNA, 25 bp, Mus musculus
gcgcactcagctgtagtacgacgag

SEQ ID NO: 28784 - DNA, 25 bp, Mus musculus
cactcagctgtagtacgacgagtga

SEQ ID NO: 28785 - DNA, 25 bp, Mus musculus
gacgtgtctgcacctgtgatcctag

SEQ ID NO: 28786 - DNA, 25 bp, Mus musculus
tctgcacctgtgatcctagactctc

SEQ ID NO: 28787 - DNA, 25 bp, Mus musculus
ttttacctggcagttgttccactgg

SEQ ID NO: 28788 - DNA, 25 bp, Mus musculus
ctggcagttgttccactggtgaact

SEQ ID NO: 28789 - DNA, 25 bp, Mus musculus
gttagtctttgaccactatagtttg

SEQ ID NO: 28790 - DNA, 25 bp, Mus musculus
ctttgaccactatagtttgatgcca

SEQ ID NO: 28791 - DNA, 25 bp, Mus musculus
gatgccatctccattttggttgacc

SEQ ID NO: 28792 - DNA, 25 bp, Mus musculus
attttggttgacctgtctcaccatc

SEQ ID NO: 28793 - DNA, 25 bp, Mus musculus
gttgacctgtctcaccatcaggcct

SEQ ID NO: 28794 - DNA, 25 bp, Mus musculus
caccatcaggcctgttactctccat

SEQ ID NO: 28795 - DNA, 25 bp, Mus musculus
caggcctgttactctccatgactaa

SEQ ID NO: 28796 - DNA, 25 bp, Mus musculus
tgttactctccatgactaactgtgt

SEQ ID NO: 28797 - DNA, 25 bp, Mus musculus
cagctacccagctacaataggtgcc

SEQ ID NO: 28798 - DNA, 25 bp, Mus musculus
cccagctacaataggtgccaccaac

SEQ ID NO: 28799 - DNA, 25 bp, Mus musculus
aggtgccaccaacaatgctataagc

SEQ ID NO: 28800 - DNA, 25 bp, Mus musculus
caccaacaatgctataagcccaaac

SEQ ID NO: 28801 - DNA, 25 bp, Mus musculus
caatgctataagcccaaaccaccgg

SEQ ID NO: 28802 - DNA, 25 bp, Mus musculus
tcagcaaagcctcgttggtggctcc

SEQ ID NO: 28803 - DNA, 25 bp, Mus musculus
tggctccaattgtggctgggtagct

SEQ ID NO: 28804 - DNA, 25 bp, Mus musculus
ttgggaccaccaagttgtaaagatg

SEQ ID NO: 28805 - DNA, 25 bp, Mus musculus
ttggtcctgctttaccgtggcttcg

SEQ ID NO: 28806 - DNA, 25 bp, Mus musculus
tggtcctgctttaccgtggcttcgt

SEQ ID NO: 28807 - DNA, 25 bp, Mus musculus
gtctcgtcagtttgcttggtttcgg

SEQ ID NO: 28808 - DNA, 25 bp, Mus musculus
tctcgtcagtttgcttggtttcggg

SEQ ID NO: 28809 - DNA, 25 bp, Mus musculus
cgtgttgctggtggtgccttcggta

SEQ ID NO: 28810 - DNA, 25 bp, Mus musculus
gtgttgctggtggtgccttcggtaa

SEQ ID NO: 28811 - DNA, 25 bp, Mus musculus
ctggtggtgccttcggtaatcgtgt

SEQ ID NO: 28812 - DNA, 25 bp, Mus musculus
gtggtgccttcggtaatcgtgtatt

SEQ ID NO: 28813 - DNA, 25 bp, Mus musculus
ggtgccttcggtaatcgtgtatttg

SEQ ID NO: 28814 - DNA, 25 bp, Mus musculus
gtgccttcggtaatcgtgtatttgc

SEQ ID NO: 28815 - DNA, 25 bp, Mus musculus
gccttcggtaatcgtgtatttgctg

SEQ ID NO: 28816 - DNA, 25 bp, Mus musculus
tatttgctgaagtggatcggtactt

SEQ ID NO: 28817 - DNA, 25 bp, Mus musculus
taccgtggcttcgtctcggtctcgt

SEQ ID NO: 28818 - DNA, 25 bp, Mus musculus
gtggcttcgtctcggtctcgtcagt

SEQ ID NO: 28819 - DNA, 25 bp, Mus musculus
ggcttcgtctcggtctcgtcagttt

SEQ ID NO: 28820 - DNA, 25 bp, Mus musculus
gcttcgtctcggtctcgtcagtttg

SEQ ID NO: 28821 - DNA, 25 bp, Mus musculus
ttcgtctcggtctcgtcagtttgct

SEQ ID NO: 28822 - DNA, 25 bp, Mus musculus
tcgtctcggtctcgtcagtttgctt

SEQ ID NO: 28823 - DNA, 25 bp, Mus musculus
tctcggtctcgtcagtttgcttggt

SEQ ID NO: 28824 - DNA, 25 bp, Mus musculus
tcggtctcgtcagtttgcttggttt

SEQ ID NO: 28825 - DNA, 25 bp, Mus musculus
ttcctgctctatgtctctgccgctt

SEQ ID NO: 28826 - DNA, 25 bp, Mus musculus
tcctgctctatgtctctgccgcttt

SEQ ID NO: 28827 - DNA, 25 bp, Mus musculus
tctgccgctttcttcctgtatgatc

SEQ ID NO: 28828 - DNA, 25 bp, Mus musculus
ctgccgctttcttcctgtatgatct

SEQ ID NO: 28829 - DNA, 25 bp, Mus musculus
tgccgctttcttcctgtatgatctg

SEQ ID NO: 28830 - DNA, 25 bp, Mus musculus
ccgctttcttcctgtatgatctggt

SEQ ID NO: 28831 - DNA, 25 bp, Mus musculus
cgctttcttcctgtatgatctggtg

SEQ ID NO: 28832 - DNA, 25 bp, Mus musculus
gctttcttcctgtatgatctggtgc

SEQ ID NO: 28833 - DNA, 25 bp, Mus musculus
ctttcttcctgtatgatctggtgcg

SEQ ID NO: 28834 - DNA, 25 bp, Mus musculus
ttcgggaaactcacttcacctgcaa

SEQ ID NO: 28835 - DNA, 25 bp, Mus musculus
tcgggaaactcacttcacctgcaag

SEQ ID NO: 28836 - DNA, 25 bp, Mus musculus
cgggaaactcacttcacctgcaagg

SEQ ID NO: 28837 - DNA, 25 bp, Mus musculus
cctgctctatgtctctgccgctttc

SEQ ID NO: 28838 - DNA, 25 bp, Mus musculus
gctctatgtctctgccgctttcttc

SEQ ID NO: 28839 - DNA, 25 bp, Mus musculus
ctctatgtctctgccgctttcttcc

SEQ ID NO: 28840 - DNA, 25 bp, Mus musculus
tctatgtctctgccgctttcttcct

SEQ ID NO: 28841 - DNA, 25 bp, Mus musculus
atgtctctgccgctttcttcctgta

SEQ ID NO: 28842 - DNA, 25 bp, Mus musculus
tgtctctgccgctttcttcctgtat

SEQ ID NO: 28843 - DNA, 25 bp, Mus musculus
gtctctgccgctttcttcctgtatg

SEQ ID NO: 28844 - DNA, 25 bp, Mus musculus
ctctgccgctttcttcctgtatgat

SEQ ID NO: 28845 - DNA, 25 bp, Mus musculus
agctttatgggacctgcgtaatctg

SEQ ID NO: 28846 - DNA, 25 bp, Mus musculus
tgaaattttccaggtccactggtct

SEQ ID NO: 28847 - DNA, 25 bp, Mus musculus
ttgatttgtcaagcgccaaaaaggc

SEQ ID NO: 28848 - DNA, 25 bp, Mus musculus
tgtcaagcgccaaaaaggcattgta

SEQ ID NO: 28849 - DNA, 25 bp, Mus musculus
gcttctggcattctttaccctctga

SEQ ID NO: 28850 - DNA, 25 bp, Mus musculus
tctggcattctttaccctctgattc

SEQ ID NO: 28851 - DNA, 25 bp, Mus musculus
ctttaccctctgattctagcacttt

SEQ ID NO: 28852 - DNA, 25 bp, Mus musculus
taccctctgattctagcactttcaa

SEQ ID NO: 28853 - DNA, 25 bp, Mus musculus
cctctgattctagcactttcaagtg

SEQ ID NO: 28854 - DNA, 25 bp, Mus musculus
ctagcactttcaagtgagctgttgc

SEQ ID NO: 28855 - DNA, 25 bp, Mus musculus
gcactttcaagtgagctgttgcgta

SEQ ID NO: 28856 - DNA, 25 bp, Mus musculus
ttgcgtactgtatcatattgtagct

SEQ ID NO: 28857 - DNA, 25 bp, Mus musculus
ccaggtccactggtctccacataat

SEQ ID NO: 28858 - DNA, 25 bp, Mus musculus
ggtccactggtctccacataatgaa

SEQ ID NO: 28859 - DNA, 25 bp, Mus musculus
gtctccacataatgaaactattctg

SEQ ID NO: 28860 - DNA, 25 bp, Mus musculus
tattctggcctcaagtggtactgat

SEQ ID NO: 28861 - DNA, 25 bp, Mus musculus
tgatcgccgcctgaatgtgtgggat

SEQ ID NO: 28862 - DNA, 25 bp, Mus musculus
tccagagctcctgtttattcatgga

SEQ ID NO: 28863 - DNA, 25 bp, Mus musculus
tgaaccttgggtcatttgctctgtg

SEQ ID NO: 28864 - DNA, 25 bp, Mus musculus
gtcagatgtcacggcatcggaactg

SEQ ID NO: 28865 - DNA, 25 bp, Mus musculus
atgtggtgaccctgttagctgaggg

SEQ ID NO: 28866 - DNA, 25 bp, Mus musculus
ccctgttagctgagggtcttcgtga

SEQ ID NO: 28867 - DNA, 25 bp, Mus musculus
tccgaatgctggctactcaccactt

SEQ ID NO: 28868 - DNA, 25 bp, Mus musculus
tgctggctactcaccacttggcgct

SEQ ID NO: 28869 - DNA, 25 bp, Mus musculus
ctactcaccacttggcgctacatga

SEQ ID NO: 28870 - DNA, 25 bp, Mus musculus
accacttggcgctacatgaagacaa

SEQ ID NO: 28871 - DNA, 25 bp, Mus musculus
acttggcgctacatgaagacaagcc

SEQ ID NO: 28872 - DNA, 25 bp, Mus musculus
aagacaagcctgattttgttggcat

SEQ ID NO: 28873 - DNA, 25 bp, Mus musculus
attttgttggcatcatctgtactcg

SEQ ID NO: 28874 - DNA, 25 bp, Mus musculus
tggattttgccagacgcctgtgtga

SEQ ID NO: 28875 - DNA, 25 bp, Mus musculus
attttgccagacgcctgtgtgagcg

SEQ ID NO: 28876 - DNA, 25 bp, Mus musculus
agtatggcaatgcccctcgagtccg

SEQ ID NO: 28877 - DNA, 25 bp, Mus musculus
agagccgggaacacatccaggatga

SEQ ID NO: 28878 - DNA, 25 bp, Mus musculus
ctcgagtccgcatcagcggacatgt

SEQ ID NO: 28879 - DNA, 25 bp, Mus musculus
gccgggaacacatccaggatgaaaa

SEQ ID NO: 28880 - DNA, 25 bp, Mus musculus
aacacatccaggatgaaaagctagt

SEQ ID NO: 28881 - DNA, 25 bp, Mus musculus
tccggtacttcttggatgggacact

SEQ ID NO: 28882 - DNA, 25 bp, Mus musculus
ggtacttcttggatgggacactgac

SEQ ID NO: 28883 - DNA, 25 bp, Mus musculus
ggacactgacgtcaagacttgggat

SEQ ID NO: 28884 - DNA, 25 bp, Mus musculus
cgtcaagacttgggatccgaatgct

SEQ ID NO: 28885 - DNA, 25 bp, Mus musculus
ggatccgaatgctggctactcacca

SEQ ID NO: 28886 - DNA, 25 bp, Mus musculus
tgaagatccccgacttgactgacgt

SEQ ID NO: 28887 - DNA, 25 bp, Mus musculus
acttgactgacgtgaactccataga

SEQ ID NO: 28888 - DNA, 25 bp, Mus musculus
ttatcacaccatgtttacttcaaca

SEQ ID NO: 28889 - DNA, 25 bp, Mus musculus
tttcctgtcaactgtggtccaaggt

SEQ ID NO: 28890 - DNA, 25 bp, Mus musculus
ctctgtaagagttccaccaattgct

SEQ ID NO: 28891 - DNA, 25 bp, Mus musculus
actgttggcagtctttctcagttac

SEQ ID NO: 28892 - DNA, 25 bp, Mus musculus
ggcagtctttctcagttaccctgga

SEQ ID NO: 28893 - DNA, 25 bp, Mus musculus
tacagtggaccttgctatctacctg

SEQ ID NO: 28894 - DNA, 25 bp, Mus musculus
ggaccttgctatctacctgcactgt

SEQ ID NO: 28895 - DNA, 25 bp, Mus musculus
tgctatctacctgcactgtgctctg

SEQ ID NO: 28896 - DNA, 25 bp, Mus musculus
gcactgtgctctgggtaaactgtaa

SEQ ID NO: 28897 - DNA, 25 bp, Mus musculus
actgtaaccatctcatgatgccaaa

SEQ ID NO: 28898 - DNA, 25 bp, Mus musculus
ctgacgtgaactccatagacaagtg

SEQ ID NO: 28899 - DNA, 25 bp, Mus musculus
ccatagacaagtggtcccgaatgtt

SEQ ID NO: 28900 - DNA, 25 bp, Mus musculus
tcgtttattggctttactatgtaca

SEQ ID NO: 28901 - DNA, 25 bp, Mus musculus
tttactatgtacactaaggtcagtc

SEQ ID NO: 28902 - DNA, 25 bp, Mus musculus
taaccccacagattcccaacagcgg

SEQ ID NO: 28903 - DNA, 25 bp, Mus musculus
cacagattcccaacagcggtaactg

SEQ ID NO: 28904 - DNA, 25 bp, Mus musculus
acagcggtaactgctgtggtttttg

SEQ ID NO: 28905 - DNA, 25 bp, Mus musculus
agagattcagccttccagttggttt

SEQ ID NO: 28906 - DNA, 25 bp, Mus musculus
tgggctgcctaggcatagttttggc

SEQ ID NO: 28907 - DNA, 25 bp, Mus musculus
gcatagttttggccgcaacgctctg

SEQ ID NO: 28908 - DNA, 25 bp, Mus musculus
cagttgtacagcctgatgtaggact

SEQ ID NO: 28909 - DNA, 25 bp, Mus musculus
aacacatcaatccaggacaaaagtg

SEQ ID NO: 28910 - DNA, 25 bp, Mus musculus
gcctatcctgtggtccatttcatac

SEQ ID NO: 28911 - DNA, 25 bp, Mus musculus
cctgtggtccatttcataccatttg

SEQ ID NO: 28912 - DNA, 25 bp, Mus musculus
gtccatttcataccatttgggttgc

SEQ ID NO: 28913 - DNA, 25 bp, Mus musculus
ctcgcggttttccagttacaatgca

SEQ ID NO: 28914 - DNA, 25 bp, Mus musculus
gttttccagttacaatgcaagtgat

SEQ ID NO: 28915 - DNA, 25 bp, Mus musculus
tttctacacatgctggcaagatcaa

SEQ ID NO: 28916 - DNA, 25 bp, Mus musculus
cacatgctggcaagatcaagtgtga

SEQ ID NO: 28917 - DNA, 25 bp, Mus musculus
gttttagtacacagcctacttagag

SEQ ID NO: 28918 - DNA, 25 bp, Mus musculus
ccgcaacgctctggagcgacatgtg

SEQ ID NO: 28919 - DNA, 25 bp, Mus musculus
cgctctggagcgacatgtggcacaa

SEQ ID NO: 28920 - DNA, 25 bp, Mus musculus
aagtcgcctgaggagacgtgcctct

SEQ ID NO: 28921 - DNA, 25 bp, Mus musculus
caacatcgtctattggctttattat

SEQ ID NO: 28922 - DNA, 25 bp, Mus musculus
cgtctattggctttattatgtgaac

SEQ ID NO: 28923 - DNA, 25 bp, Mus musculus
ctaaactacagccttccgtgagaag

SEQ ID NO: 28924 - DNA, 25 bp, Mus musculus
tacagccttccgtgagaagcaagga

SEQ ID NO: 28925 - DNA, 25 bp, Mus musculus
ttcctcttcaaacagttgtacagcc

SEQ ID NO: 28926 - DNA, 25 bp, Mus musculus
accatcaccgcataccatgagcagc

SEQ ID NO: 28927 - DNA, 25 bp, Mus musculus
ccatcaccgcataccatgagcagcg

SEQ ID NO: 28928 - DNA, 25 bp, Mus musculus
cagcgaggccagagacccagcagac

SEQ ID NO: 28929 - DNA, 25 bp, Mus musculus
cgaggccagagacccagcagacgcc

SEQ ID NO: 28930 - DNA, 25 bp, Mus musculus
gcctgcagactcagcgacgccgaca

SEQ ID NO: 28931 - DNA, 25 bp, Mus musculus
gcagactcagcgacgccgacaccaa

SEQ ID NO: 28932 - DNA, 25 bp, Mus musculus
agactcagcgacgccgacaccaagc

SEQ ID NO: 28933 - DNA, 25 bp, Mus musculus
ctactcttcggcggcgccactgcgg

SEQ ID NO: 28934 - DNA, 25 bp, Mus musculus
tactcttcggcggcgccactgcggg

SEQ ID NO: 28935 - DNA, 25 bp, Mus musculus
ggcgccactgcgggagactatgatg

SEQ ID NO: 28936 - DNA, 25 bp, Mus musculus
ttttgggacagtcttatggttctat

SEQ ID NO: 28937 - DNA, 25 bp, Mus musculus
acagtcttatggttctatgtaaggt

SEQ ID NO: 28938 - DNA, 25 bp, Mus musculus
tcaccgcataccatgagcagcgagg

SEQ ID NO: 28939 - DNA, 25 bp, Mus musculus
accgcataccatgagcagcgaggcc

SEQ ID NO: 28940 - DNA, 25 bp, Mus musculus
ccgcataccatgagcagcgaggcca

SEQ ID NO: 28941 - DNA, 25 bp, Mus musculus
gcataccatgagcagcgaggccaga

SEQ ID NO: 28942 - DNA, 25 bp, Mus musculus
cataccatgagcagcgaggccagag

SEQ ID NO: 28943 - DNA, 25 bp, Mus musculus
taccatgagcagcgaggccagagac

SEQ ID NO: 28944 - DNA, 25 bp, Mus musculus
catgagcagcgaggccagagaccca

SEQ ID NO: 28945 - DNA, 25 bp, Mus musculus
atgagcagcgaggccagagacccag

SEQ ID NO: 28946 - DNA, 25 bp, Mus musculus
agatctacacgcacttcacgtcgcg

SEQ ID NO: 28947 - DNA, 25 bp, Mus musculus
gatctacacgcacttcacgtcgcgc

SEQ ID NO: 28948 - DNA, 25 bp, Mus musculus
tcgcgcacagacaccaagaacgtgc

SEQ ID NO: 28949 - DNA, 25 bp, Mus musculus
cgcgcacagacaccaagaacgtgca

SEQ ID NO: 28950 - DNA, 25 bp, Mus musculus
atgccgtcactgacgtgcatcatca

SEQ ID NO: 28951 - DNA, 25 bp, Mus musculus
gccgtcactgacgtgcatcatcaag

SEQ ID NO: 28952 - DNA, 25 bp, Mus musculus
ccgtcactgacgtgcatcatcaaga

SEQ ID NO: 28953 - DNA, 25 bp, Mus musculus
cgtcactgacgtgcatcatcaagaa

SEQ ID NO: 28954 - DNA, 25 bp, Mus musculus
tcactgacgtgcatcatcaagaaca

SEQ ID NO: 28955 - DNA, 25 bp, Mus musculus
cactgacgtgcatcatcaagaacaa

SEQ ID NO: 28956 - DNA, 25 bp, Mus musculus
actgacgtgcatcatcaagaacaac

SEQ ID NO: 28957 - DNA, 25 bp, Mus musculus
acgtgcatcatcaagaacaacctga

SEQ ID NO: 28958 - DNA, 25 bp, Mus musculus
tacacgcacttcacgtcgcgcacag

SEQ ID NO: 28959 - DNA, 25 bp, Mus musculus
acgcacttcacgtcgcgcacagaca

SEQ ID NO: 28960 - DNA, 25 bp, Mus musculus
acttcacgtcgcgcacagacaccaa

SEQ ID NO: 28961 - DNA, 25 bp, Mus musculus
cttcacgtcgcgcacagacaccaag

SEQ ID NO: 28962 - DNA, 25 bp, Mus musculus
tcacgtcgcgcacagacaccaagaa

SEQ ID NO: 28963 - DNA, 25 bp, Mus musculus
cacgtcgcgcacagacaccaagaac

SEQ ID NO: 28964 - DNA, 25 bp, Mus musculus
acgtcgcgcacagacaccaagaacg

SEQ ID NO: 28965 - DNA, 25 bp, Mus musculus
gtcgcgcacagacaccaagaacgtg

SEQ ID NO: 28966 - DNA, 25 bp, Mus musculus
tgattgcatgttgtcttctggtaat

SEQ ID NO: 28967 - DNA, 25 bp, Mus musculus
gattgcatgttgtcttctggtaatg

SEQ ID NO: 28968 - DNA, 25 bp, Mus musculus
cttctatgctactgctgttatgcct

SEQ ID NO: 28969 - DNA, 25 bp, Mus musculus
ttctatgctactgctgttatgcctg

SEQ ID NO: 28970 - DNA, 25 bp, Mus musculus
tctatgctactgctgttatgcctga

SEQ ID NO: 28971 - DNA, 25 bp, Mus musculus
ctatgctactgctgttatgcctgat

SEQ ID NO: 28972 - DNA, 25 bp, Mus musculus
agatatctgcctatgtgtatacaat

SEQ ID NO: 28973 - DNA, 25 bp, Mus musculus
gatatctgcctatgtgtatacaatg

SEQ ID NO: 28974 - DNA, 25 bp, Mus musculus
atatctgcctatgtgtatacaatgg

SEQ ID NO: 28975 - DNA, 25 bp, Mus musculus
tatctgcctatgtgtatacaatgga

SEQ ID NO: 28976 - DNA, 25 bp, Mus musculus
atctgcctatgtgtatacaatggaa

SEQ ID NO: 28977 - DNA, 25 bp, Mus musculus
tctgcctatgtgtatacaatggaaa

SEQ ID NO: 28978 - DNA, 25 bp, Mus musculus
attgcatgttgtcttctggtaatgc

SEQ ID NO: 28979 - DNA, 25 bp, Mus musculus
ttgcatgttgtcttctggtaatgct

SEQ ID NO: 28980 - DNA, 25 bp, Mus musculus
tgcatgttgtcttctggtaatgcta

SEQ ID NO: 28981 - DNA, 25 bp, Mus musculus
gcatgttgtcttctggtaatgctaa

SEQ ID NO: 28982 - DNA, 25 bp, Mus musculus
atgttgtcttctggtaatgctaata

SEQ ID NO: 28983 - DNA, 25 bp, Mus musculus
tgttgtcttctggtaatgctaatat

SEQ ID NO: 28984 - DNA, 25 bp, Mus musculus
gttgtcttctggtaatgctaatatt

SEQ ID NO: 28985 - DNA, 25 bp, Mus musculus
ttgtcttctggtaatgctaatattg

SEQ ID NO: 28986 - DNA, 25 bp, Mus musculus
cctgatgggctgctttgtctttgta

SEQ ID NO: 28987 - DNA, 25 bp, Mus musculus
ctttgtattcctggcacttctggag

SEQ ID NO: 28988 - DNA, 25 bp, Mus musculus
atcctttgacaactcaggaatccag

SEQ ID NO: 28989 - DNA, 25 bp, Mus musculus
tgacaactcaggaatccagtatagg

SEQ ID NO: 28990 - DNA, 25 bp, Mus musculus
agacagaagcatcccgcacaagaag

SEQ ID NO: 28991 - DNA, 25 bp, Mus musculus
aagcatcccgcacaagaagacccac

SEQ ID NO: 28992 - DNA, 25 bp, Mus musculus
gtcttcacagctcaaaatcaaaatc

SEQ ID NO: 28993 - DNA, 25 bp, Mus musculus
ccctgatctaaccgatgtgaatgcc

SEQ ID NO: 28994 - DNA, 25 bp, Mus musculus
tctaaccgatgtgaatgccatagac

SEQ ID NO: 28995 - DNA, 25 bp, Mus musculus
catagacagatggtcccgcatcgtg

SEQ ID NO: 28996 - DNA, 25 bp, Mus musculus
ttcatttaacactgagtgaaatatt

SEQ ID NO: 28997 - DNA, 25 bp, Mus musculus
cctgcctgtcaagtttttataccag

SEQ ID NO: 28998 - DNA, 25 bp, Mus musculus
attcctggcacttctggagtatgcc

SEQ ID NO: 28999 - DNA, 25 bp, Mus musculus
ggcacttctggagtatgcctttgtc

SEQ ID NO: 29000 - DNA, 25 bp, Mus musculus
gaatatcctattagcaccgatggat

SEQ ID NO: 29001 - DNA, 25 bp, Mus musculus
cctattagcaccgatggatgttcac

SEQ ID NO: 29002 - DNA, 25 bp, Mus musculus
agcaccgatggatgttcacaatgaa

SEQ ID NO: 29003 - DNA, 25 bp, Mus musculus
tgcaggcagcgttggtgacaccagg

SEQ ID NO: 29004 - DNA, 25 bp, Mus musculus
gaattcagcaatatcctttgacaac

SEQ ID NO: 29005 - DNA, 25 bp, Mus musculus
agcaatatcctttgacaactcagga

SEQ ID NO: 29006 - DNA, 25 bp, Mus musculus
cgtttgcagttcaggctcgtttctt

SEQ ID NO: 29007 - DNA, 25 bp, Mus musculus
tttgcagttcaggctcgtttctttg

SEQ ID NO: 29008 - DNA, 25 bp, Mus musculus
tctgggtccatccgagaatctgttg

SEQ ID NO: 29009 - DNA, 25 bp, Mus musculus
ctgggtccatccgagaatctgttgt

SEQ ID NO: 29010 - DNA, 25 bp, Mus musculus
gggtccatccgagaatctgttgtag

SEQ ID NO: 29011 - DNA, 25 bp, Mus musculus
aagattctcaagatgttcggtactt

SEQ ID NO: 29012 - DNA, 25 bp, Mus musculus
gattctcaagatgttcggtacttct

SEQ ID NO: 29013 - DNA, 25 bp, Mus musculus
attctcaagatgttcggtacttctg

SEQ ID NO: 29014 - DNA, 25 bp, Mus musculus
aagatgttcggtacttctgaggtga

SEQ ID NO: 29015 - DNA, 25 bp, Mus musculus
atgttcggtacttctgaggtgagac

SEQ ID NO: 29016 - DNA, 25 bp, Mus musculus
gttcggtacttctgaggtgagacta

SEQ ID NO: 29017 - DNA, 25 bp, Mus musculus
ttcggtacttctgaggtgagactat

SEQ ID NO: 29018 - DNA, 25 bp, Mus musculus
ttgcagttcaggctcgtttctttgt

SEQ ID NO: 29019 - DNA, 25 bp, Mus musculus
gcagttcaggctcgtttctttgtct

SEQ ID NO: 29020 - DNA, 25 bp, Mus musculus
gttcaggctcgtttctttgtctggt

SEQ ID NO: 29021 - DNA, 25 bp, Mus musculus
caggctcgtttctttgtctggtgta

SEQ ID NO: 29022 - DNA, 25 bp, Mus musculus
atccgaggttgcgtctcggactctt

SEQ ID NO: 29023 - DNA, 25 bp, Mus musculus
ggttgcgtctcggactcttcgtata

SEQ ID NO: 29024 - DNA, 25 bp, Mus musculus
gttgcgtctcggactcttcgtatag

SEQ ID NO: 29025 - DNA, 25 bp, Mus musculus
atggatactggctctgggtccatcc

SEQ ID NO: 29026 - DNA, 25 bp, Mus musculus
aaattcagcatacaatcattgggat

SEQ ID NO: 29027 - DNA, 25 bp, Mus musculus
aattcagcatacaatcattgggatg

SEQ ID NO: 29028 - DNA, 25 bp, Mus musculus
cccagctcgtcagcaagagcttgac

SEQ ID NO: 29029 - DNA, 25 bp, Mus musculus
ccagctcgtcagcaagagcttgaca

SEQ ID NO: 29030 - DNA, 25 bp, Mus musculus
agctcgtcagcaagagcttgacatg

SEQ ID NO: 29031 - DNA, 25 bp, Mus musculus
gctcgtcagcaagagcttgacatgg

SEQ ID NO: 29032 - DNA, 25 bp, Mus musculus
ctcgtcagcaagagcttgacatggc

SEQ ID NO: 29033 - DNA, 25 bp, Mus musculus
caagagcttgacatggcggaaaaga

SEQ ID NO: 29034 - DNA, 25 bp, Mus musculus
tactcctctcctgttgtccttaagg

SEQ ID NO: 29035 - DNA, 25 bp, Mus musculus
tcctctcctgttgtccttaaggcag

SEQ ID NO: 29036 - DNA, 25 bp, Mus musculus
cctctcctgttgtccttaaggcagc

SEQ ID NO: 29037 - DNA, 25 bp, Mus musculus
ctctcctgttgtccttaaggcagcc

SEQ ID NO: 29038 - DNA, 25 bp, Mus musculus
attcagcatacaatcattgggatga

SEQ ID NO: 29039 - DNA, 25 bp, Mus musculus
tctcctgttgtccttaaggcagcca

SEQ ID NO: 29040 - DNA, 25 bp, Mus musculus
tcagcatacaatcattgggatgaga

SEQ ID NO: 29041 - DNA, 25 bp, Mus musculus
actgctccggaacccagctcgtcag

SEQ ID NO: 29042 - DNA, 25 bp, Mus musculus
gctccggaacccagctcgtcagcaa

SEQ ID NO: 29043 - DNA, 25 bp, Mus musculus
ctccggaacccagctcgtcagcaag

SEQ ID NO: 29044 - DNA, 25 bp, Mus musculus
ggaacccagctcgtcagcaagagct

SEQ ID NO: 29045 - DNA, 25 bp, Mus musculus
gaacccagctcgtcagcaagagctt

SEQ ID NO: 29046 - DNA, 25 bp, Mus musculus
acccagctcgtcagcaagagcttga

SEQ ID NO: 29047 - DNA, 25 bp, Mus musculus
tgaatgcccactaaatttgcaaggt

SEQ ID NO: 29048 - DNA, 25 bp, Mus musculus
actagccaaggtccttctcaggcat

SEQ ID NO: 29049 - DNA, 25 bp, Mus musculus
tttgtgtgccagacagtgactccac

SEQ ID NO: 29050 - DNA, 25 bp, Mus musculus
tgccagacagtgactccacagggat

SEQ ID NO: 29051 - DNA, 25 bp, Mus musculus
acagtgactccacagggatgccagg

SEQ ID NO: 29052 - DNA, 25 bp, Mus musculus
gattgcattgctccttgcagaggga

SEQ ID NO: 29053 - DNA, 25 bp, Mus musculus
attgctccttgcagagggaagccct

SEQ ID NO: 29054 - DNA, 25 bp, Mus musculus
tcggttgtccttctctgggaatgct

SEQ ID NO: 29055 - DNA, 25 bp, Mus musculus
gtccttctctgggaatgctgccacc

SEQ ID NO: 29056 - DNA, 25 bp, Mus musculus
gaatgctgccacccagagcagcaca

SEQ ID NO: 29057 - DNA, 25 bp, Mus musculus
tgccacccagagcagcacacagtga

SEQ ID NO: 29058 - DNA, 25 bp, Mus musculus
ccagagcagcacacagtgattgccc

SEQ ID NO: 29059 - DNA, 25 bp, Mus musculus
caaggtccttctcaggcatctatcc

SEQ ID NO: 29060 - DNA, 25 bp, Mus musculus
ccttctcaggcatctatccttaact

SEQ ID NO: 29061 - DNA, 25 bp, Mus musculus
cttaacttggtctctccacaagctg

SEQ ID NO: 29062 - DNA, 25 bp, Mus musculus
tctccacaagctgcctctgatgctc

SEQ ID NO: 29063 - DNA, 25 bp, Mus musculus
tgcttttacctatgacccttggtca

SEQ ID NO: 29064 - DNA, 25 bp, Mus musculus
accacatacctcatgcggaaccgaa

SEQ ID NO: 29065 - DNA, 25 bp, Mus musculus
tacctcatgcggaaccgaatgtctc

SEQ ID NO: 29066 - DNA, 25 bp, Mus musculus
atgtctctccagtaaacaccccagc

SEQ ID NO: 29067 - DNA, 25 bp, Mus musculus
ataaggattctcgcacctggtgtcc

SEQ ID NO: 29068 - DNA, 25 bp, Mus musculus
aggattctcgcacctggtgtcccat

SEQ ID NO: 29069 - DNA, 25 bp, Mus musculus
taactgtcgtcatcaagttttgaca

SEQ ID NO: 29070 - DNA, 25 bp, Mus musculus
gacactggtatcctgtttattgtta

SEQ ID NO: 29071 - DNA, 25 bp, Mus musculus
gtattcacctacttagagatacatc

SEQ ID NO: 29072 - DNA, 25 bp, Mus musculus
gagatacatctcctggctcttttga

SEQ ID NO: 29073 - DNA, 25 bp, Mus musculus
atacatctcctggctcttttgatgt

SEQ ID NO: 29074 - DNA, 25 bp, Mus musculus
catctcctggctcttttgatgtggt

SEQ ID NO: 29075 - DNA, 25 bp, Mus musculus
ctcctggctcttttgatgtggttca

SEQ ID NO: 29076 - DNA, 25 bp, Mus musculus
gaatagctttgccactctgttgttc

SEQ ID NO: 29077 - DNA, 25 bp, Mus musculus
tagctttgccactctgttgttcatc

SEQ ID NO: 29078 - DNA, 25 bp, Mus musculus
ctttgccactctgttgttcatctat

SEQ ID NO: 29079 - DNA, 25 bp, Mus musculus
ctcgcacctggtgtcccatgatgct

SEQ ID NO: 29080 - DNA, 25 bp, Mus musculus
tgctcgtactattcggtattctgta

SEQ ID NO: 29081 - DNA, 25 bp, Mus musculus
tcgtactattcggtattctgtattc

SEQ ID NO: 29082 - DNA, 25 bp, Mus musculus
tcggtattctgtattcctcatcaag

SEQ ID NO: 29083 - DNA, 25 bp, Mus musculus
gtattctgtattcctcatcaagttg

SEQ ID NO: 29084 - DNA, 25 bp, Mus musculus
ttctgtattcctcatcaagttgaac

SEQ ID NO: 29085 - DNA, 25 bp, Mus musculus
attcctcatcaagttgaacgacatt

SEQ ID NO: 29086 - DNA, 25 bp, Mus musculus
aattaactgtcgtcatcaagttttg

SEQ ID NO: 29087 - DNA, 25 bp, Mus musculus
ggtttctgtcggtgctctccctgct

SEQ ID NO: 29088 - DNA, 25 bp, Mus musculus
gcccgctctgttcatcgctgtgcac

SEQ ID NO: 29089 - DNA, 25 bp, Mus musculus
tgatccgcaactacagtttgctgct

SEQ ID NO: 29090 - DNA, 25 bp, Mus musculus
acatcagcccggtccgggtctacat

SEQ ID NO: 29091 - DNA, 25 bp, Mus musculus
atcagcccggtccgggtctacatca

SEQ ID NO: 29092 - DNA, 25 bp, Mus musculus
ccggtccgggtctacatcaacgatg

SEQ ID NO: 29093 - DNA, 25 bp, Mus musculus
cggtccgggtctacatcaacgatga

SEQ ID NO: 29094 - DNA, 25 bp, Mus musculus
gtccgggtctacatcaacgatgacg

SEQ ID NO: 29095 - DNA, 25 bp, Mus musculus
ccgctctgttcatcgctgtgcacgt

SEQ ID NO: 29096 - DNA, 25 bp, Mus musculus
cgctctgttcatcgctgtgcacgtg

SEQ ID NO: 29097 - DNA, 25 bp, Mus musculus
ctctgttcatcgctgtgcacgtggt

SEQ ID NO: 29098 - DNA, 25 bp, Mus musculus
gtgccctgatccgcaactacagttt

SEQ ID NO: 29099 - DNA, 25 bp, Mus musculus
tgccctgatccgcaactacagtttg

SEQ ID NO: 29100 - DNA, 25 bp, Mus musculus
gccctgatccgcaactacagtttgc

SEQ ID NO: 29101 - DNA, 25 bp, Mus musculus
ccctgatccgcaactacagtttgct

SEQ ID NO: 29102 - DNA, 25 bp, Mus musculus
ctgatccgcaactacagtttgctgc

SEQ ID NO: 29103 - DNA, 25 bp, Mus musculus
gacctctgacagggatgtgcgcgat

SEQ ID NO: 29104 - DNA, 25 bp, Mus musculus
cctctgacagggatgtgcgcgatca

SEQ ID NO: 29105 - DNA, 25 bp, Mus musculus
tcttcagcggcgccattccatactg

SEQ ID NO: 29106 - DNA, 25 bp, Mus musculus
ttcagcggcgccattccatactgtg

SEQ ID NO: 29107 - DNA, 25 bp, Mus musculus
cagcggcgccattccatactgtgac

SEQ ID NO: 29108 - DNA, 25 bp, Mus musculus
gcggcgccattccatactgtgaccg

SEQ ID NO: 29109 - DNA, 25 bp, Mus musculus
cgccattccatactgtgaccgcttc

SEQ ID NO: 29110 - DNA, 25 bp, Mus musculus
attccatactgtgaccgcttcggtg

SEQ ID NO: 29111 - DNA, 25 bp, Mus musculus
tccatactgtgaccgcttcggtgac

SEQ ID NO: 29112 - DNA, 25 bp, Mus musculus
catactgtgaccgcttcggtgactt

SEQ ID NO: 29113 - DNA, 25 bp, Mus musculus
tactgtgaccgcttcggtgacttcc

SEQ ID NO: 29114 - DNA, 25 bp, Mus musculus
ctgtgaccgcttcggtgacttccgc

SEQ ID NO: 29115 - DNA, 25 bp, Mus musculus
gtgcgcgatcatctcaacaacagct

SEQ ID NO: 29116 - DNA, 25 bp, Mus musculus
agatcgtggtgtcacctcggtaggg

SEQ ID NO: 29117 - DNA, 25 bp, Mus musculus
ttcctgccagagcgaggctgcggcc

SEQ ID NO: 29118 - DNA, 25 bp, Mus musculus
agccgtagcctcgaatgccgtcttc

SEQ ID NO: 29119 - DNA, 25 bp, Mus musculus
ccgtagcctcgaatgccgtcttcag

SEQ ID NO: 29120 - DNA, 25 bp, Mus musculus
gtagcctcgaatgccgtcttcagcg

SEQ ID NO: 29121 - DNA, 25 bp, Mus musculus
tcgaatgccgtcttcagcggcgcca

SEQ ID NO: 29122 - DNA, 25 bp, Mus musculus
gaatgccgtcttcagcggcgccatt

SEQ ID NO: 29123 - DNA, 25 bp, Mus musculus
acactctgttcttaaacactcgaat

SEQ ID NO: 29124 - DNA, 25 bp, Mus musculus
ctctgttcttaaacactcgaataga

SEQ ID NO: 29125 - DNA, 25 bp, Mus musculus
aatagcaggcattgtgtggagtcaa

SEQ ID NO: 29126 - DNA, 25 bp, Mus musculus
tcaataagacccgtatatatagcaa

SEQ ID NO: 29127 - DNA, 25 bp, Mus musculus
ataagacccgtatatatagcaagag

SEQ ID NO: 29128 - DNA, 25 bp, Mus musculus
cacctcttcctatttgtggttctca

SEQ ID NO: 29129 - DNA, 25 bp, Mus musculus
tttgtggttctcaaactcctccact

SEQ ID NO: 29130 - DNA, 25 bp, Mus musculus
ggaagcctcagacagctgtcttgtc

SEQ ID NO: 29131 - DNA, 25 bp, Mus musculus
ctcagacagctgtcttgtcaggctc

SEQ ID NO: 29132 - DNA, 25 bp, Mus musculus
tgtcaggctcttgggaggcttctcc

SEQ ID NO: 29133 - DNA, 25 bp, Mus musculus
ttagccataactcttggaggccctt

SEQ ID NO: 29134 - DNA, 25 bp, Mus musculus
gatgtgttcttggttcctgtttgaa

SEQ ID NO: 29135 - DNA, 25 bp, Mus musculus
tgttcttaaacactcgaatagacta

SEQ ID NO: 29136 - DNA, 25 bp, Mus musculus
aaatgcactgtactgttagcgtctt

SEQ ID NO: 29137 - DNA, 25 bp, Mus musculus
tgcactgtactgttagcgtcttctc

SEQ ID NO: 29138 - DNA, 25 bp, Mus musculus
actgtactgttagcgtcttctctac

SEQ ID NO: 29139 - DNA, 25 bp, Mus musculus
ctgttagcgtcttctctacctacag

SEQ ID NO: 29140 - DNA, 25 bp, Mus musculus
ttagcgtcttctctacctacagctc

SEQ ID NO: 29141 - DNA, 25 bp, Mus musculus
tcaggttcctacttcctttggatag

SEQ ID NO: 29142 - DNA, 25 bp, Mus musculus
agtctatcttttggccactcctctt

SEQ ID NO: 29143 - DNA, 25 bp, Mus musculus
tgtctgccccgcagatgctcaaggc

SEQ ID NO: 29144 - DNA, 25 bp, Mus musculus
tgccccgcagatgctcaaggcacgt

SEQ ID NO: 29145 - DNA, 25 bp, Mus musculus
ttttgcccctgatggactggcccaa

SEQ ID NO: 29146 - DNA, 25 bp, Mus musculus
gcccctgatggactggcccaaaatt

SEQ ID NO: 29147 - DNA, 25 bp, Mus musculus
ccctgatggactggcccaaaattct

SEQ ID NO: 29148 - DNA, 25 bp, Mus musculus
gactggcccaaaattctcagcggga

SEQ ID NO: 29149 - DNA, 25 bp, Mus musculus
ctggcccaaaattctcagcgggaat

SEQ ID NO: 29150 - DNA, 25 bp, Mus musculus
ggcccaaaattctcagcgggaatca

SEQ ID NO: 29151 - DNA, 25 bp, Mus musculus
cccaaaattctcagcgggaatcact

SEQ ID NO: 29152 - DNA, 25 bp, Mus musculus
aaattctcagcgggaatcactaagg

SEQ ID NO: 29153 - DNA, 25 bp, Mus musculus
attctcagcgggaatcactaagggt

SEQ ID NO: 29154 - DNA, 25 bp, Mus musculus
tctcagcgggaatcactaagggtgt

SEQ ID NO: 29155 - DNA, 25 bp, Mus musculus
ccccgcagatgctcaaggcacgttg

SEQ ID NO: 29156 - DNA, 25 bp, Mus musculus
ccgcagatgctcaaggcacgttgcc

SEQ ID NO: 29157 - DNA, 25 bp, Mus musculus
atgctcaaggcacgttgccgctacc

SEQ ID NO: 29158 - DNA, 25 bp, Mus musculus
cgttgccgctacctggccgataaag

SEQ ID NO: 29159 - DNA, 25 bp, Mus musculus
ttgccgctacctggccgataaagtt

SEQ ID NO: 29160 - DNA, 25 bp, Mus musculus
gccgctacctggccgataaagtttg

SEQ ID NO: 29161 - DNA, 25 bp, Mus musculus
ctacctggccgataaagtttgaatg

SEQ ID NO: 29162 - DNA, 25 bp, Mus musculus
gggcttttgcccctgatggactggc

SEQ ID NO: 29163 - DNA, 25 bp, Mus musculus
ctaagactccagagatctacctggc

SEQ ID NO: 29164 - DNA, 25 bp, Mus musculus
agactccagagatctacctggcgta

SEQ ID NO: 29165 - DNA, 25 bp, Mus musculus
atccccaggagtatctagcatctac

SEQ ID NO: 29166 - DNA, 25 bp, Mus musculus
atctagcatctactgcctggcggcc

SEQ ID NO: 29167 - DNA, 25 bp, Mus musculus
tagcatctactgcctggcggccgaa

SEQ ID NO: 29168 - DNA, 25 bp, Mus musculus
catctactgcctggcggccgaattt

SEQ ID NO: 29169 - DNA, 25 bp, Mus musculus
gtgatgtctgcgctatcatgagggt

SEQ ID NO: 29170 - DNA, 25 bp, Mus musculus
atgtctgcgctatcatgagggtcca

SEQ ID NO: 29171 - DNA, 25 bp, Mus musculus
ctatcatgagggtccatgccttcct

SEQ ID NO: 29172 - DNA, 25 bp, Mus musculus
tccatgccttcctggaacagtgggg

SEQ ID NO: 29173 - DNA, 25 bp, Mus musculus
atgccttcctggaacagtggggtct

SEQ ID NO: 29174 - DNA, 25 bp, Mus musculus
gtcttattaactaccagggagatgc

SEQ ID NO: 29175 - DNA, 25 bp, Mus musculus
ctccagagatctacctggcgtatcg

SEQ ID NO: 29176 - DNA, 25 bp, Mus musculus
tcttattaactaccagggagatgct

SEQ ID NO: 29177 - DNA, 25 bp, Mus musculus
agatctacctggcgtatcggaactt

SEQ ID NO: 29178 - DNA, 25 bp, Mus musculus
tctacctggcgtatcggaacttcat

SEQ ID NO: 29179 - DNA, 25 bp, Mus musculus
acctggcgtatcggaacttcatgat

SEQ ID NO: 29180 - DNA, 25 bp, Mus musculus
tcatgattgacacttaccgactgaa

SEQ ID NO: 29181 - DNA, 25 bp, Mus musculus
tgattgacacttaccgactgaatcc

SEQ ID NO: 29182 - DNA, 25 bp, Mus musculus
ttgacacttaccgactgaatcccca

SEQ ID NO: 29183 - DNA, 25 bp, Mus musculus
accgactgaatccccaggagtatct

SEQ ID NO: 29184 - DNA, 25 bp, Mus musculus
gccaaagctgctgctaaggctgccc

SEQ ID NO: 29185 - DNA, 25 bp, Mus musculus
gctaaggctgcccagtatggccttg

SEQ ID NO: 29186 - DNA, 25 bp, Mus musculus
ccgaagccctatggaggagcccttg

SEQ ID NO: 29187 - DNA, 25 bp, Mus musculus
aagccctatggaggagcccttggag

SEQ ID NO: 29188 - DNA, 25 bp, Mus musculus
cttggagccctgggataccaaggtg

SEQ ID NO: 29189 - DNA, 25 bp, Mus musculus
tgactcgcgacctcatcaacgttgg

SEQ ID NO: 29190 - DNA, 25 bp, Mus musculus
ctcgcgacctcatcaacgttggtgc

SEQ ID NO: 29191 - DNA, 25 bp, Mus musculus
gcgacctcatcaacgttggtgctac

SEQ ID NO: 29192 - DNA, 25 bp, Mus musculus
acctcatcaacgttggtgctactgc

SEQ ID NO: 29193 - DNA, 25 bp, Mus musculus
tcaacgttggtgctactgcttggtg

SEQ ID NO: 29194 - DNA, 25 bp, Mus musculus
gtgctactgcttggtggagaatgta

SEQ ID NO: 29195 - DNA, 25 bp, Mus musculus
ctactgcttggtggagaatgtaaac

SEQ ID NO: 29196 - DNA, 25 bp, Mus musculus
cctgctgcagctgctaaggcagcca

SEQ ID NO: 29197 - DNA, 25 bp, Mus musculus
gccaaatatggtgctgctggccttg

SEQ ID NO: 29198 - DNA, 25 bp, Mus musculus
gtcctaggagccaggccattcccag

SEQ ID NO: 29199 - DNA, 25 bp, Mus musculus
gcagcaagacctggctttggacttt

SEQ ID NO: 29200 - DNA, 25 bp, Mus musculus
gcaagacctggctttggactttctc

SEQ ID NO: 29201 - DNA, 25 bp, Mus musculus
tttggactttctcccatttatccag

SEQ ID NO: 29202 - DNA, 25 bp, Mus musculus
ggactttctcccatttatccaggtg

SEQ ID NO: 29203 - DNA, 25 bp, Mus musculus
ctttctcccatttatccaggtggtg

SEQ ID NO: 29204 - DNA, 25 bp, Mus musculus
gagttccagaatccatatcagtgtg

SEQ ID NO: 29205 - DNA, 25 bp, Mus musculus
ttccagaatccatatcagtgtgcgg

SEQ ID NO: 29206 - DNA, 25 bp, Mus musculus
tgagactgctgcaggtgactacaca

SEQ ID NO: 29207 - DNA, 25 bp, Mus musculus
gactgctgcaggtgactacacagga

SEQ ID NO: 29208 - DNA, 25 bp, Mus musculus
tgctgcaggtgactacacaggatgc

SEQ ID NO: 29209 - DNA, 25 bp, Mus musculus
cacaggatgctgcgtcgtaaggcaa

SEQ ID NO: 29210 - DNA, 25 bp, Mus musculus
aggatgctgcgtcgtaaggcaatat

SEQ ID NO: 29211 - DNA, 25 bp, Mus musculus
atgctgcgtcgtaaggcaatatgac

SEQ ID NO: 29212 - DNA, 25 bp, Mus musculus
tggagtgcttcactactcaggataa

SEQ ID NO: 29213 - DNA, 25 bp, Mus musculus
agtgcttcactactcaggataatca

SEQ ID NO: 29214 - DNA, 25 bp, Mus musculus
gcttcactactcaggataatcagga

SEQ ID NO: 29215 - DNA, 25 bp, Mus musculus
tcactactcaggataatcaggagaa

SEQ ID NO: 29216 - DNA, 25 bp, Mus musculus
aatccatatcagtgtgcgggacgaa

SEQ ID NO: 29217 - DNA, 25 bp, Mus musculus
ccatatcagtgtgcgggacgaaagg

SEQ ID NO: 29218 - DNA, 25 bp, Mus musculus
tatcagtgtgcgggacgaaaggcta

SEQ ID NO: 29219 - DNA, 25 bp, Mus musculus
gctaatgagcgcattgctgaagaag

SEQ ID NO: 29220 - DNA, 25 bp, Mus musculus
aatgagcgcattgctgaagaagtaa

SEQ ID NO: 29221 - DNA, 25 bp, Mus musculus
ggacattgctactgagcgatgatgt

SEQ ID NO: 29222 - DNA, 25 bp, Mus musculus
cattgctactgagcgatgatgtaaa

SEQ ID NO: 29223 - DNA, 25 bp, Mus musculus
aattgagactgctgcaggtgactac

SEQ ID NO: 29224 - DNA, 25 bp, Mus musculus
tccacgcggactacaagcccttcgt

SEQ ID NO: 29225 - DNA, 25 bp, Mus musculus
cggactacaagcccttcgtctgcga

SEQ ID NO: 29226 - DNA, 25 bp, Mus musculus
tctacaatctgaccttccacatgca

SEQ ID NO: 29227 - DNA, 25 bp, Mus musculus
acaatctgaccttccacatgcacac

SEQ ID NO: 29228 - DNA, 25 bp, Mus musculus
acaacgacaagaagcctttcacgtg

SEQ ID NO: 29229 - DNA, 25 bp, Mus musculus
acgacaagaagcctttcacgtgtgc

SEQ ID NO: 29230 - DNA, 25 bp, Mus musculus
acaagaagcctttcacgtgtgccac

SEQ ID NO: 29231 - DNA, 25 bp, Mus musculus
agaagcctttcacgtgtgccacttg

SEQ ID NO: 29232 - DNA, 25 bp, Mus musculus
tcacgtgtgccacttgcggcaaagg

SEQ ID NO: 29233 - DNA, 25 bp, Mus musculus
cgtgtgccacttgcggcaaaggttt

SEQ ID NO: 29234 - DNA, 25 bp, Mus musculus
gtgccacttgcggcaaaggtttttg

SEQ ID NO: 29235 - DNA, 25 bp, Mus musculus
ccacttgcggcaaaggtttttgcag

SEQ ID NO: 29236 - DNA, 25 bp, Mus musculus
acaagaatcacaagctcacccacag

SEQ ID NO: 29237 - DNA, 25 bp, Mus musculus
agaatcacaagctcacccacagcgg

SEQ ID NO: 29238 - DNA, 25 bp, Mus musculus
tcacccacagcggcgagaagcagta

SEQ ID NO: 29239 - DNA, 25 bp, Mus musculus
agtacaaatgcactatctgtaacaa

SEQ ID NO: 29240 - DNA, 25 bp, Mus musculus
ctatctgtaacaaggccttccatca

SEQ ID NO: 29241 - DNA, 25 bp, Mus musculus
tctgtaacaaggccttccatcaggt

SEQ ID NO: 29242 - DNA, 25 bp, Mus musculus
gtaacaaggccttccatcaggtcta

SEQ ID NO: 29243 - DNA, 25 bp, Mus musculus
aggccttccatcaggtctacaatct

SEQ ID NO: 29244 - DNA, 25 bp, Mus musculus
ctgctccacttctgaactccaacag

SEQ ID NO: 29245 - DNA, 25 bp, Mus musculus
cacttctgaactccaacagcgagaa

SEQ ID NO: 29246 - DNA, 25 bp, Mus musculus
cacgtccctgggaggtcgtccatgt

SEQ ID NO: 29247 - DNA, 25 bp, Mus musculus
aggtcgtccatgtcccgagaagagc

SEQ ID NO: 29248 - DNA, 25 bp, Mus musculus
gaagagcagccgattcctggattgc

SEQ ID NO: 29249 - DNA, 25 bp, Mus musculus
cagccgattcctggattgcgagagt

SEQ ID NO: 29250 - DNA, 25 bp, Mus musculus
cgagagtcctgtgcacgtatttatg

SEQ ID NO: 29251 - DNA, 25 bp, Mus musculus
agcagtaatccttcaggccaagcca

SEQ ID NO: 29252 - DNA, 25 bp, Mus musculus
aatccttcaggccaagccatccaat

SEQ ID NO: 29253 - DNA, 25 bp, Mus musculus
ctgccttgttcatgttgggtataca

SEQ ID NO: 29254 - DNA, 25 bp, Mus musculus
agagactcagaggcgctagttaatg

SEQ ID NO: 29255 - DNA, 25 bp, Mus musculus
gttaatggccagcctgacctatctt

SEQ ID NO: 29256 - DNA, 25 bp, Mus musculus
agatttctgagcctagtgtggaagc

SEQ ID NO: 29257 - DNA, 25 bp, Mus musculus
tggaagccaacagccattacggtta

SEQ ID NO: 29258 - DNA, 25 bp, Mus musculus
ccaacagccattacggttatgatga

SEQ ID NO: 29259 - DNA, 25 bp, Mus musculus
cccttgagcctcaccaagctctggg

SEQ ID NO: 29260 - DNA, 25 bp, Mus musculus
agcctcaccaagctctgggaacgag

SEQ ID NO: 29261 - DNA, 25 bp, Mus musculus
accaagctctgggaacgagagccac

SEQ ID NO: 29262 - DNA, 25 bp, Mus musculus
tcgaccctaatctcatggaaaacag

SEQ ID NO: 29263 - DNA, 25 bp, Mus musculus
gctcccttaatggaacttaagacag

SEQ ID NO: 29264 - DNA, 25 bp, Mus musculus
tttcctttgctccacgaggatggga

SEQ ID NO: 29265 - DNA, 25 bp, Mus musculus
gtagttctgccataacaacaaaatg

SEQ ID NO: 29266 - DNA, 25 bp, Mus musculus
gcaatattcgccattttcttcgggc

SEQ ID NO: 29267 - DNA, 25 bp, Mus musculus
ttcttcgggctagtcccagttagat

SEQ ID NO: 29268 - DNA, 25 bp, Mus musculus
gggctagtcccagttagatggcatc

SEQ ID NO: 29269 - DNA, 25 bp, Mus musculus
ctagtcccagttagatggcatccag

SEQ ID NO: 29270 - DNA, 25 bp, Mus musculus
cattcaagattcgttgtctataatt

SEQ ID NO: 29271 - DNA, 25 bp, Mus musculus
gttgtctataattacctctctgtgg

SEQ ID NO: 29272 - DNA, 25 bp, Mus musculus
gtctataattacctctctgtggttt

SEQ ID NO: 29273 - DNA, 25 bp, Mus musculus
tgactgacatggcgcccagggggtt

SEQ ID NO: 29274 - DNA, 25 bp, Mus musculus
ttttaaaacagatctccgtctcatt

SEQ ID NO: 29275 - DNA, 25 bp, Mus musculus
ttaaaacagatctccgtctcattct

SEQ ID NO: 29276 - DNA, 25 bp, Mus musculus
gttctgccataacaacaaaatgaat

SEQ ID NO: 29277 - DNA, 25 bp, Mus musculus
attaggagcctcagggcaaggtgca

SEQ ID NO: 29278 - DNA, 25 bp, Mus musculus
aggagcctcagggcaaggtgcagaa

SEQ ID NO: 29279 - DNA, 25 bp, Mus musculus
agcctcagggcaaggtgcagaagcg

SEQ ID NO: 29280 - DNA, 25 bp, Mus musculus
gaaatactcttctaggtcatttatg

SEQ ID NO: 29281 - DNA, 25 bp, Mus musculus
ctcttctaggtcatttatgcaatat

SEQ ID NO: 29282 - DNA, 25 bp, Mus musculus
atttatgcaatattcgccattttct

SEQ ID NO: 29283 - DNA, 25 bp, Mus musculus
tatgcaatattcgccattttcttcg

SEQ ID NO: 29284 - DNA, 25 bp, Mus musculus
tgctacttctgtatttgtaaacaat

SEQ ID NO: 29285 - DNA, 25 bp, Mus musculus
tcaccgtccctaagacaatgaaact

SEQ ID NO: 29286 - DNA, 25 bp, Mus musculus
tctcaaataaactcaaatctcaata

SEQ ID NO: 29287 - DNA, 25 bp, Mus musculus
tcaaatctcaatatccatgtgacca

SEQ ID NO: 29288 - DNA, 25 bp, Mus musculus
ctcaatatccatgtgaccacacgat

SEQ ID NO: 29289 - DNA, 25 bp, Mus musculus
atccatgtgaccacacgattagtga

SEQ ID NO: 29290 - DNA, 25 bp, Mus musculus
gtgaccacacgattagtgagtcatt

SEQ ID NO: 29291 - DNA, 25 bp, Mus musculus
tgagctgcttccgtggctgaatcct

SEQ ID NO: 29292 - DNA, 25 bp, Mus musculus
gtgcaaagcatctctcaaattaggt

SEQ ID NO: 29293 - DNA, 25 bp, Mus musculus
agcatctctcaaattaggtttgaat

SEQ ID NO: 29294 - DNA, 25 bp, Mus musculus
ttgtgatcccatgtagtcagtatga

SEQ ID NO: 29295 - DNA, 25 bp, Mus musculus
aggagtccagctattgcgagttaag

SEQ ID NO: 29296 - DNA, 25 bp, Mus musculus
tgaaactcagaactctgtgattcct

SEQ ID NO: 29297 - DNA, 25 bp, Mus musculus
ctctgtgattcctgtggaaatattt

SEQ ID NO: 29298 - DNA, 25 bp, Mus musculus
tgacacactattttgttgatgtaat

SEQ ID NO: 29299 - DNA, 25 bp, Mus musculus
gcaatctacagttttcctaaaatat

SEQ ID NO: 29300 - DNA, 25 bp, Mus musculus
ttgaggcctcttttaactatcacta

SEQ ID NO: 29301 - DNA, 25 bp, Mus musculus
ttaactatcactaggagttgtctct

SEQ ID NO: 29302 - DNA, 25 bp, Mus musculus
aggagttgtctctctcaaataaact

SEQ ID NO: 29303 - DNA, 25 bp, Mus musculus
tgtctctctcaaataaactcaaatc

SEQ ID NO: 29304 - DNA, 25 bp, Mus musculus
ggggagcccatcaccagatgaactt

SEQ ID NO: 29305 - DNA, 25 bp, Mus musculus
ggagcccatcaccagatgaactttt

SEQ ID NO: 29306 - DNA, 25 bp, Mus musculus
tttccttaccaagtagagttcatgg

SEQ ID NO: 29307 - DNA, 25 bp, Mus musculus
cttaccaagtagagttcatggccgg

SEQ ID NO: 29308 - DNA, 25 bp, Mus musculus
agagttcatggccggacagcaccag

SEQ ID NO: 29309 - DNA, 25 bp, Mus musculus
catggccggacagcaccaggtgaaa

SEQ ID NO: 29310 - DNA, 25 bp, Mus musculus
gccggacagcaccaggtgaaagctg

SEQ ID NO: 29311 - DNA, 25 bp, Mus musculus
cggacagcaccaggtgaaagctgtc

SEQ ID NO: 29312 - DNA, 25 bp, Mus musculus
gacagcaccaggtgaaagctgtcaa

SEQ ID NO: 29313 - DNA, 25 bp, Mus musculus
atacataaccaaggtcttgagagct

SEQ ID NO: 29314 - DNA, 25 bp, Mus musculus
acataaccaaggtcttgagagctcg

SEQ ID NO: 29315 - DNA, 25 bp, Mus musculus
ataaccaaggtcttgagagctcgtg

SEQ ID NO: 29316 - DNA, 25 bp, Mus musculus
tatttgtagatgactccttggaaga

SEQ ID NO: 29317 - DNA, 25 bp, Mus musculus
accaaggtcttgagagctcgtgccg

SEQ ID NO: 29318 - DNA, 25 bp, Mus musculus
tttgtagatgactccttggaagact

SEQ ID NO: 29319 - DNA, 25 bp, Mus musculus
tgtagatgactccttggaagactct

SEQ ID NO: 29320 - DNA, 25 bp, Mus musculus
tgactccttggaagactctgaagtt

SEQ ID NO: 29321 - DNA, 25 bp, Mus musculus
actccttggaagactctgaagttct

SEQ ID NO: 29322 - DNA, 25 bp, Mus musculus
agactctgaagttctgatgtgaagc

SEQ ID NO: 29323 - DNA, 25 bp, Mus musculus
actctgaagttctgatgtgaagcca

SEQ ID NO: 29324 - DNA, 25 bp, Mus musculus
caaatacagcttcctgggatctggt

SEQ ID NO: 29325 - DNA, 25 bp, Mus musculus
acgcccacacttatgtacatcaact

SEQ ID NO: 29326 - DNA, 25 bp, Mus musculus
cccacacttatgtacatcaactcaa

SEQ ID NO: 29327 - DNA, 25 bp, Mus musculus
ctctgcccatctcggaaattactag

SEQ ID NO: 29328 - DNA, 25 bp, Mus musculus
ccatctcggaaattactagacatgt

SEQ ID NO: 29329 - DNA, 25 bp, Mus musculus
ggatatcaagcctgccaatatggaa

SEQ ID NO: 29330 - DNA, 25 bp, Mus musculus
caagcctgccaatatggaagagctc

SEQ ID NO: 29331 - DNA, 25 bp, Mus musculus
agagctcacggacgtgatgacggct

SEQ ID NO: 29332 - DNA, 25 bp, Mus musculus
gctcacggacgtgatgacggctgca

SEQ ID NO: 29333 - DNA, 25 bp, Mus musculus
cgtgatgacggctgcaggatttcac

SEQ ID NO: 29334 - DNA, 25 bp, Mus musculus
tcaccccaacagctgtaacacgtgt

SEQ ID NO: 29335 - DNA, 25 bp, Mus musculus
taacacgtgtgtgtacagcagcagt

SEQ ID NO: 29336 - DNA, 25 bp, Mus musculus
tgacatgagggcgtctgcgctctgt

SEQ ID NO: 29337 - DNA, 25 bp, Mus musculus
acacttatgtacatcaactcaattg

SEQ ID NO: 29338 - DNA, 25 bp, Mus musculus
cttatgtacatcaactcaattgcta

SEQ ID NO: 29339 - DNA, 25 bp, Mus musculus
tacatcaactcaattgctatcaata

SEQ ID NO: 29340 - DNA, 25 bp, Mus musculus
atcaactcaattgctatcaatagtg

SEQ ID NO: 29341 - DNA, 25 bp, Mus musculus
acctactgatcagcagatgatttgc

SEQ ID NO: 29342 - DNA, 25 bp, Mus musculus
cgaattaatctctgcccatctcgga

SEQ ID NO: 29343 - DNA, 25 bp, Mus musculus
attaatctctgcccatctcggaaat

SEQ ID NO: 29344 - DNA, 25 bp, Mus musculus
aatctctgcccatctcggaaattac

SEQ ID NO: 29345 - DNA, 25 bp, Mus musculus
cttttcttaaaagactgctgatata

SEQ ID NO: 29346 - DNA, 25 bp, Mus musculus
tgatatagctacatgttctggccac

SEQ ID NO: 29347 - DNA, 25 bp, Mus musculus
gattatctacgcatatctttattaa

SEQ ID NO: 29348 - DNA, 25 bp, Mus musculus
tactaggtaacttcatgctgctcta

SEQ ID NO: 29349 - DNA, 25 bp, Mus musculus
aggtaacttcatgctgctctacagc

SEQ ID NO: 29350 - DNA, 25 bp, Mus musculus
gtaacttcatgctgctctacagcac

SEQ ID NO: 29351 - DNA, 25 bp, Mus musculus
cttcatgctgctctacagcacccag

SEQ ID NO: 29352 - DNA, 25 bp, Mus musculus
atgctgctctacagcacccagctga

SEQ ID NO: 29353 - DNA, 25 bp, Mus musculus
acagcacccagctgaggacctacaa

SEQ ID NO: 29354 - DNA, 25 bp, Mus musculus
agcacccagctgaggacctacaagc

SEQ ID NO: 29355 - DNA, 25 bp, Mus musculus
cacccagctgaggacctacaagcct

SEQ ID NO: 29356 - DNA, 25 bp, Mus musculus
ccaccacagagtagtgctgtgcaga

SEQ ID NO: 29357 - DNA, 25 bp, Mus musculus
atatagctacatgttctggccacat

SEQ ID NO: 29358 - DNA, 25 bp, Mus musculus
atagctacatgttctggccacatgt

SEQ ID NO: 29359 - DNA, 25 bp, Mus musculus
acatgttctggccacatgtaaaaaa

SEQ ID NO: 29360 - DNA, 25 bp, Mus musculus
atgttctggccacatgtaaaaaact

SEQ ID NO: 29361 - DNA, 25 bp, Mus musculus
ttccatttgtggtagtggcattaca

SEQ ID NO: 29362 - DNA, 25 bp, Mus musculus
agtacatagtaccatttatacaaat

SEQ ID NO: 29363 - DNA, 25 bp, Mus musculus
catagtaccatttatacaaattaga

SEQ ID NO: 29364 - DNA, 25 bp, Mus musculus
ttatttaacagctattgattatcta

SEQ ID NO: 29365 - DNA, 25 bp, Mus musculus
aatactgctgagtccaatgtttgct

SEQ ID NO: 29366 - DNA, 25 bp, Mus musculus
atactgctgagtccaatgtttgcta

SEQ ID NO: 29367 - DNA, 25 bp, Mus musculus
tcttgcgcgcaactgatccgtattc

SEQ ID NO: 29368 - DNA, 25 bp, Mus musculus
ttgcgcgcaactgatccgtattcta

SEQ ID NO: 29369 - DNA, 25 bp, Mus musculus
tgcgcgcaactgatccgtattctaa

SEQ ID NO: 29370 - DNA, 25 bp, Mus musculus
gcgcaactgatccgtattctaatat

SEQ ID NO: 29371 - DNA, 25 bp, Mus musculus
gcaactgatccgtattctaatatga

SEQ ID NO: 29372 - DNA, 25 bp, Mus musculus
ttcttaattaccgcgactgtgactg

SEQ ID NO: 29373 - DNA, 25 bp, Mus musculus
tcttaattaccgcgactgtgactgc

SEQ ID NO: 29374 - DNA, 25 bp, Mus musculus
ttaattaccgcgactgtgactgcag

SEQ ID NO: 29375 - DNA, 25 bp, Mus musculus
taattaccgcgactgtgactgcagg

SEQ ID NO: 29376 - DNA, 25 bp, Mus musculus
atgacgctattgctgaactggtctc

SEQ ID NO: 29377 - DNA, 25 bp, Mus musculus
ctgctgagtccaatgtttgctagta

SEQ ID NO: 29378 - DNA, 25 bp, Mus musculus
tgacgctattgctgaactggtctcg

SEQ ID NO: 29379 - DNA, 25 bp, Mus musculus
aatctacaggactaaacaggtatct

SEQ ID NO: 29380 - DNA, 25 bp, Mus musculus
taaacaggtatctggctgagatagc

SEQ ID NO: 29381 - DNA, 25 bp, Mus musculus
acaacctcatggcttataaagctgc

SEQ ID NO: 29382 - DNA, 25 bp, Mus musculus
ttcgtgtaggtcttgcgcgcaactg

SEQ ID NO: 29383 - DNA, 25 bp, Mus musculus
tcgtgtaggtcttgcgcgcaactga

SEQ ID NO: 29384 - DNA, 25 bp, Mus musculus
tgtaggtcttgcgcgcaactgatcc

SEQ ID NO: 29385 - DNA, 25 bp, Mus musculus
gtcttgcgcgcaactgatccgtatt

SEQ ID NO: 29386 - DNA, 25 bp, Mus musculus
gttgataccgccattgtatgaagtg

SEQ ID NO: 29387 - DNA, 25 bp, Mus musculus
accgccattgtatgaagtggtgatg

SEQ ID NO: 29388 - DNA, 25 bp, Mus musculus
gacaacaatgcgggctagggagaag

SEQ ID NO: 29389 - DNA, 25 bp, Mus musculus
ctgtacggcctccaatttagctagc

SEQ ID NO: 29390 - DNA, 25 bp, Mus musculus
acggcctccaatttagctagcagta

SEQ ID NO: 29391 - DNA, 25 bp, Mus musculus
ggcctccaatttagctagcagtatg

SEQ ID NO: 29392 - DNA, 25 bp, Mus musculus
cctccaatttagctagcagtatgag

SEQ ID NO: 29393 - DNA, 25 bp, Mus musculus
atttagctagcagtatgagaactag

SEQ ID NO: 29394 - DNA, 25 bp, Mus musculus
atgagaactagtcctcgaagtggta

SEQ ID NO: 29395 - DNA, 25 bp, Mus musculus
gagaactagtcctcgaagtggtact

SEQ ID NO: 29396 - DNA, 25 bp, Mus musculus
tagtcctcgaagtggtactgtttca

SEQ ID NO: 29397 - DNA, 25 bp, Mus musculus
gtcctcgaagtggtactgtttcagg

SEQ ID NO: 29398 - DNA, 25 bp, Mus musculus
ggtgatgtccatcctgtcggttaac

SEQ ID NO: 29399 - DNA, 25 bp, Mus musculus
atgtccatcctgtcggttaacgaag

SEQ ID NO: 29400 - DNA, 25 bp, Mus musculus
atagtacttcgatgctcttttaaat

SEQ ID NO: 29401 - DNA, 25 bp, Mus musculus
acgagcccaagcactgtgcagtttt

SEQ ID NO: 29402 - DNA, 25 bp, Mus musculus
gcccaagcactgtgcagttttacac

SEQ ID NO: 29403 - DNA, 25 bp, Mus musculus
ccaagcactgtgcagttttacacag

SEQ ID NO: 29404 - DNA, 25 bp, Mus musculus
aagcactgtgcagttttacacagag

SEQ ID NO: 29405 - DNA, 25 bp, Mus musculus
cagttttacacagagcgaggaggac

SEQ ID NO: 29406 - DNA, 25 bp, Mus musculus
gaaccatacataagcaaccgaagta

SEQ ID NO: 29407 - DNA, 25 bp, Mus musculus
ccatacataagcaaccgaagtaaca

SEQ ID NO: 29408 - DNA, 25 bp, Mus musculus
tgtgtaccaaacagcatttctaaga

SEQ ID NO: 29409 - DNA, 25 bp, Mus musculus
gtaccaaacagcatttctaagaaga

SEQ ID NO: 29410 - DNA, 25 bp, Mus musculus
ttattcctatgttctccaaatgtta

SEQ ID NO: 29411 - DNA, 25 bp, Mus musculus
taatgactaacattccacccatgaa

SEQ ID NO: 29412 - DNA, 25 bp, Mus musculus
tgactaacattccacccatgaattc

SEQ ID NO: 29413 - DNA, 25 bp, Mus musculus
ctaacattccacccatgaattcttc

SEQ ID NO: 29414 - DNA, 25 bp, Mus musculus
acattccacccatgaattcttctag

SEQ ID NO: 29415 - DNA, 25 bp, Mus musculus
ttccacccatgaattcttctagaac

SEQ ID NO: 29416 - DNA, 25 bp, Mus musculus
cacccatgaattcttctagaacata

SEQ ID NO: 29417 - DNA, 25 bp, Mus musculus
aatttaccagtgagagtatgaacgt

SEQ ID NO: 29418 - DNA, 25 bp, Mus musculus
tacataagcaaccgaagtaacatat

SEQ ID NO: 29419 - DNA, 25 bp, Mus musculus
aacatatactcaagtgactatgaac

SEQ ID NO: 29420 - DNA, 25 bp, Mus musculus
atatactcaagtgactatgaacgta

SEQ ID NO: 29421 - DNA, 25 bp, Mus musculus
gaatactttgaccgtgaggcagaca

SEQ ID NO: 29422 - DNA, 25 bp, Mus musculus
tactttgaccgtgaggcagacagga

SEQ ID NO: 29423 - DNA, 25 bp, Mus musculus
tttgaccgtgaggcagacaggaaag

SEQ ID NO: 29424 - DNA, 25 bp, Mus musculus
tgtatagtgcatctcgtgaatcata

SEQ ID NO: 29425 - DNA, 25 bp, Mus musculus
atagtgcatctcgtgaatcatacaa

SEQ ID NO: 29426 - DNA, 25 bp, Mus musculus
caaacctgaaaggcacatccgtcag

SEQ ID NO: 29427 - DNA, 25 bp, Mus musculus
gcacatccgtcagttccagatcaca

SEQ ID NO: 29428 - DNA, 25 bp, Mus musculus
cgggacacctgccagttcagagagc

SEQ ID NO: 29429 - DNA, 25 bp, Mus musculus
ggacacctgccagttcagagagcag

SEQ ID NO: 29430 - DNA, 25 bp, Mus musculus
ctgccagttcagagagcagtggaga

SEQ ID NO: 29431 - DNA, 25 bp, Mus musculus
gaagtcaaaccattgccttgggctg

SEQ ID NO: 29432 - DNA, 25 bp, Mus musculus
agtcaaaccattgccttgggctggc

SEQ ID NO: 29433 - DNA, 25 bp, Mus musculus
tcaaaccattgccttgggctggcac

SEQ ID NO: 29434 - DNA, 25 bp, Mus musculus
aaaccattgccttgggctggcacat

SEQ ID NO: 29435 - DNA, 25 bp, Mus musculus
accattgccttgggctggcacatgc

SEQ ID NO: 29436 - DNA, 25 bp, Mus musculus
cattgccttgggctggcacatgccg

SEQ ID NO: 29437 - DNA, 25 bp, Mus musculus
tgccttgggctggcacatgccgtcc

SEQ ID NO: 29438 - DNA, 25 bp, Mus musculus
acatccgtcagttccagatcacagc

SEQ ID NO: 29439 - DNA, 25 bp, Mus musculus
ccgtccaaagtgtctggatgactta

SEQ ID NO: 29440 - DNA, 25 bp, Mus musculus
ccgtcagttccagatcacagcttac

SEQ ID NO: 29441 - DNA, 25 bp, Mus musculus
gtcagttccagatcacagcttacca

SEQ ID NO: 29442 - DNA, 25 bp, Mus musculus
cagttccagatcacagcttaccaag

SEQ ID NO: 29443 - DNA, 25 bp, Mus musculus
gttccagatcacagcttaccaagga

SEQ ID NO: 29444 - DNA, 25 bp, Mus musculus
tccagatcacagcttaccaaggacc

SEQ ID NO: 29445 - DNA, 25 bp, Mus musculus
gatcacagcttaccaaggaccgcgg

SEQ ID NO: 29446 - DNA, 25 bp, Mus musculus
tcacagcttaccaaggaccgcggga

SEQ ID NO: 29447 - DNA, 25 bp, Mus musculus
ttaatggttgcggaccccgaggatg

SEQ ID NO: 29448 - DNA, 25 bp, Mus musculus
tgcggaccccgaggatgttgataac

SEQ ID NO: 29449 - DNA, 25 bp, Mus musculus
ctggagccttcaagatcctgaccca

SEQ ID NO: 29450 - DNA, 25 bp, Mus musculus
tggagccttcaagatcctgacccag

SEQ ID NO: 29451 - DNA, 25 bp, Mus musculus
ggagccttcaagatcctgacccaga

SEQ ID NO: 29452 - DNA, 25 bp, Mus musculus
ccttcaagatcctgacccagaaggg

SEQ ID NO: 29453 - DNA, 25 bp, Mus musculus
cttcaagatcctgacccagaaggga

SEQ ID NO: 29454 - DNA, 25 bp, Mus musculus
ttcaagatcctgacccagaagggaa

SEQ ID NO: 29455 - DNA, 25 bp, Mus musculus
tcaagatcctgacccagaagggaaa

SEQ ID NO: 29456 - DNA, 25 bp, Mus musculus
caagatcctgacccagaagggaaag

SEQ ID NO: 29457 - DNA, 25 bp, Mus musculus
gcggaccccgaggatgttgataact

SEQ ID NO: 29458 - DNA, 25 bp, Mus musculus
ttgataactggagccttcaagatcc

SEQ ID NO: 29459 - DNA, 25 bp, Mus musculus
tgataactggagccttcaagatcct

SEQ ID NO: 29460 - DNA, 25 bp, Mus musculus
gataactggagccttcaagatcctg

SEQ ID NO: 29461 - DNA, 25 bp, Mus musculus
ataactggagccttcaagatcctga

SEQ ID NO: 29462 - DNA, 25 bp, Mus musculus
taactggagccttcaagatcctgac

SEQ ID NO: 29463 - DNA, 25 bp, Mus musculus
aactggagccttcaagatcctgacc

SEQ ID NO: 29464 - DNA, 25 bp, Mus musculus
actggagccttcaagatcctgaccc

SEQ ID NO: 29465 - DNA, 25 bp, Mus musculus
tactgggaacttctctgctaaaaag

SEQ ID NO: 29466 - DNA, 25 bp, Mus musculus
ctctgctaaaaagtccctgacttag

SEQ ID NO: 29467 - DNA, 25 bp, Mus musculus
gctgcttgcaggactacagggcctg

SEQ ID NO: 29468 - DNA, 25 bp, Mus musculus
cagcaacaattcacccacagtgcac

SEQ ID NO: 29469 - DNA, 25 bp, Mus musculus
agtgcacctgcacatgcctttccta

SEQ ID NO: 29470 - DNA, 25 bp, Mus musculus
cctgcacatgcctttcctacatgct

SEQ ID NO: 29471 - DNA, 25 bp, Mus musculus
catgcctttcctacatgcttgctct

SEQ ID NO: 29472 - DNA, 25 bp, Mus musculus
acatgcttgctctgtctcgaactag

SEQ ID NO: 29473 - DNA, 25 bp, Mus musculus
tgtctcgaactagtcacaatcttgt

SEQ ID NO: 29474 - DNA, 25 bp, Mus musculus
gaactagtcacaatcttgttttaag

SEQ ID NO: 29475 - DNA, 25 bp, Mus musculus
gtgccttttcattttgacagtgcta

SEQ ID NO: 29476 - DNA, 25 bp, Mus musculus
tttcattttgacagtgctattaact

SEQ ID NO: 29477 - DNA, 25 bp, Mus musculus
gtccctgacttagcactattcacat

SEQ ID NO: 29478 - DNA, 25 bp, Mus musculus
gacttagcactattcacataaaggc

SEQ ID NO: 29479 - DNA, 25 bp, Mus musculus
tggtgctcctttatcaccttctcta

SEQ ID NO: 29480 - DNA, 25 bp, Mus musculus
atcaccttctctaatcttttaatgt

SEQ ID NO: 29481 - DNA, 25 bp, Mus musculus
ttaatgtgtctgtttgcaatatggg

SEQ ID NO: 29482 - DNA, 25 bp, Mus musculus
ttcacaaatactgtaagctgtcctg

SEQ ID NO: 29483 - DNA, 25 bp, Mus musculus
gtaagctgtcctgctgcttgcagga

SEQ ID NO: 29484 - DNA, 25 bp, Mus musculus
tgtcctgctgcttgcaggactacag

SEQ ID NO: 29485 - DNA, 25 bp, Mus musculus
gacattcagggtgcctctttggggc

SEQ ID NO: 29486 - DNA, 25 bp, Mus musculus
tctttggggccaaggaaggagtgcg

SEQ ID NO: 29487 - DNA, 25 bp, Mus musculus
ggggatctcagccatagtcgttggc

SEQ ID NO: 29488 - DNA, 25 bp, Mus musculus
gatctcagccatagtcgttggcttc

SEQ ID NO: 29489 - DNA, 25 bp, Mus musculus
ctcagccatagtcgttggcttcatg

SEQ ID NO: 29490 - DNA, 25 bp, Mus musculus
agccatagtcgttggcttcatggtt

SEQ ID NO: 29491 - DNA, 25 bp, Mus musculus
agtcgttggcttcatggttccagca

SEQ ID NO: 29492 - DNA, 25 bp, Mus musculus
cgttggcttcatggttccagcagga

SEQ ID NO: 29493 - DNA, 25 bp, Mus musculus
ggttccagcaggatgggtcttagcc

SEQ ID NO: 29494 - DNA, 25 bp, Mus musculus
cttagcccacttggagagctataaa

SEQ ID NO: 29495 - DNA, 25 bp, Mus musculus
ctataaaaagagctccgcagcatga

SEQ ID NO: 29496 - DNA, 25 bp, Mus musculus
taaaaagagctccgcagcatgaagt

SEQ ID NO: 29497 - DNA, 25 bp, Mus musculus
gagtgcgaccccgagaatcatgcca

SEQ ID NO: 29498 - DNA, 25 bp, Mus musculus
gaccccgagaatcatgccaaggctc

SEQ ID NO: 29499 - DNA, 25 bp, Mus musculus
gagaatcatgccaaggctcccccct

SEQ ID NO: 29500 - DNA, 25 bp, Mus musculus
aatcatgccaaggctcccccctatc

SEQ ID NO: 29501 - DNA, 25 bp, Mus musculus
tatcctgcggctgctccaagcgcct

SEQ ID NO: 29502 - DNA, 25 bp, Mus musculus
caaagcccatgtctctgccaagcca

SEQ ID NO: 29503 - DNA, 25 bp, Mus musculus
agcccatgtctctgccaagccagcc

SEQ ID NO: 29504 - DNA, 25 bp, Mus musculus
tgccaagccagccaaaactcccact

SEQ ID NO: 29505 - DNA, 25 bp, Mus musculus
ctacctaagtggtcagaggacgtgc

SEQ ID NO: 29506 - DNA, 25 bp, Mus musculus
tgcagcggacattcagggtgcctct

SEQ ID NO: 29507 - DNA, 25 bp, Mus musculus
agtcgttggcttcatggttccagca

SEQ ID NO: 29508 - DNA, 25 bp, Mus musculus
gtcgttggcttcatggttccagcag

SEQ ID NO: 29509 - DNA, 25 bp, Mus musculus
tcgttggcttcatggttccagcagg

SEQ ID NO: 29510 - DNA, 25 bp, Mus musculus
cgttggcttcatggttccagcagga

SEQ ID NO: 29511 - DNA, 25 bp, Mus musculus
ggacattcagggtgcctctttgggg

SEQ ID NO: 29512 - DNA, 25 bp, Mus musculus
gacattcagggtgcctctttggggc

SEQ ID NO: 29513 - DNA, 25 bp, Mus musculus
cattcagggtgcctctttggggcca

SEQ ID NO: 29514 - DNA, 25 bp, Mus musculus
ttcagggtgcctctttggggccaag

SEQ ID NO: 29515 - DNA, 25 bp, Mus musculus
ccatagtcgttggcttcatggttcc

SEQ ID NO: 29516 - DNA, 25 bp, Mus musculus
catagtcgttggcttcatggttcca

SEQ ID NO: 29517 - DNA, 25 bp, Mus musculus
atagtcgttggcttcatggttccag

SEQ ID NO: 29518 - DNA, 25 bp, Mus musculus
tagtcgttggcttcatggttccagc

SEQ ID NO: 29519 - DNA, 25 bp, Mus musculus
ctacctaagtggtcagaggacgtgc

SEQ ID NO: 29520 - DNA, 25 bp, Mus musculus
tgcagcggacattcagggtgcctct

SEQ ID NO: 29521 - DNA, 25 bp, Mus musculus
tagtcgttggcttcatggttccagc

SEQ ID NO: 29522 - DNA, 25 bp, Mus musculus
agtcgttggcttcatggttccagca

SEQ ID NO: 29523 - DNA, 25 bp, Mus musculus
gtcgttggcttcatggttccagcag

SEQ ID NO: 29524 - DNA, 25 bp, Mus musculus
tcgttggcttcatggttccagcagg

SEQ ID NO: 29525 - DNA, 25 bp, Mus musculus
cgttggcttcatggttccagcagga

SEQ ID NO: 29526 - DNA, 25 bp, Mus musculus
ggacattcagggtgcctctttgggg

SEQ ID NO: 29527 - DNA, 25 bp, Mus musculus
gacattcagggtgcctctttggggc

SEQ ID NO: 29528 - DNA, 25 bp, Mus musculus
cattcagggtgcctctttggggcca

SEQ ID NO: 29529 - DNA, 25 bp, Mus musculus
ttcagggtgcctctttggggccaag

SEQ ID NO: 29530 - DNA, 25 bp, Mus musculus
tctttggggccaaggaaggagtgcg

SEQ ID NO: 29531 - DNA, 25 bp, Mus musculus
ccatagtcgttggcttcatggttcc

SEQ ID NO: 29532 - DNA, 25 bp, Mus musculus
catagtcgttggcttcatggttcca

SEQ ID NO: 29533 - DNA, 25 bp, Mus musculus
atagtcgttggcttcatggttccag

SEQ ID NO: 29534 - DNA, 25 bp, Mus musculus
ttatatcaccaggacatatccagat

SEQ ID NO: 29535 - DNA, 25 bp, Mus musculus
caccaggacatatccagatgacacc

SEQ ID NO: 29536 - DNA, 25 bp, Mus musculus
agattacaactctcaaataattggt

SEQ ID NO: 29537 - DNA, 25 bp, Mus musculus
tcacagcctttgagagctgaggtca

SEQ ID NO: 29538 - DNA, 25 bp, Mus musculus
tttactgttccttctcggacacaag

SEQ ID NO: 29539 - DNA, 25 bp, Mus musculus
acacaagaaaccaaatcgagctgat

SEQ ID NO: 29540 - DNA, 25 bp, Mus musculus
agctgattgcttccagggagtctgc

SEQ ID NO: 29541 - DNA, 25 bp, Mus musculus
gaaatatactaccctgtctgtcctc

SEQ ID NO: 29542 - DNA, 25 bp, Mus musculus
acacctaagactgtctcctcctgac

SEQ ID NO: 29543 - DNA, 25 bp, Mus musculus
tcctgaccatctacactaagctttc

SEQ ID NO: 29544 - DNA, 25 bp, Mus musculus
ccatctacactaagctttctcattc

SEQ ID NO: 29545 - DNA, 25 bp, Mus musculus
acactaagctttctcattctatttt

SEQ ID NO: 29546 - DNA, 25 bp, Mus musculus
tccagatgacacctacaggctgtcg

SEQ ID NO: 29547 - DNA, 25 bp, Mus musculus
tgacacctacaggctgtcgcgatta

SEQ ID NO: 29548 - DNA, 25 bp, Mus musculus
ctacaggctgtcgcgattacttctc

SEQ ID NO: 29549 - DNA, 25 bp, Mus musculus
gctgtcgcgattacttctcagactg

SEQ ID NO: 29550 - DNA, 25 bp, Mus musculus
gaacgccaccattactgaagagttg

SEQ ID NO: 29551 - DNA, 25 bp, Mus musculus
caaaggtctcattggcaacgtacgg

SEQ ID NO: 29552 - DNA, 25 bp, Mus musculus
tctcattggcaacgtacggatcgac

SEQ ID NO: 29553 - DNA, 25 bp, Mus musculus
gcctgcagattacaactctcaaata

SEQ ID NO: 29554 - DNA, 25 bp, Mus musculus
atatttgctctatcagggaagttat

SEQ ID NO: 29555 - DNA, 25 bp, Mus musculus
atttgctctatcagggaagttatct

SEQ ID NO: 29556 - DNA, 25 bp, Mus musculus
aactatagactcgacacagattccc

SEQ ID NO: 29557 - DNA, 25 bp, Mus musculus
actatagactcgacacagattccct

SEQ ID NO: 29558 - DNA, 25 bp, Mus musculus
tatagactcgacacagattccctgg

SEQ ID NO: 29559 - DNA, 25 bp, Mus musculus
tatagcaccttgcttgagtacctga

SEQ ID NO: 29560 - DNA, 25 bp, Mus musculus
atagcaccttgcttgagtacctgag

SEQ ID NO: 29561 - DNA, 25 bp, Mus musculus
agcaccttgcttgagtacctgagaa

SEQ ID NO: 29562 - DNA, 25 bp, Mus musculus
gcaccttgcttgagtacctgagaag

SEQ ID NO: 29563 - DNA, 25 bp, Mus musculus
accttgcttgagtacctgagaagct

SEQ ID NO: 29564 - DNA, 25 bp, Mus musculus
ccttgcttgagtacctgagaagctg

SEQ ID NO: 29565 - DNA, 25 bp, Mus musculus
ttgcttgagtacctgagaagctgtg

SEQ ID NO: 29566 - DNA, 25 bp, Mus musculus
tttgctctatcagggaagttatctt

SEQ ID NO: 29567 - DNA, 25 bp, Mus musculus
gttatctttcaggccactggttact

SEQ ID NO: 29568 - DNA, 25 bp, Mus musculus
tctttcaggccactggttactctga

SEQ ID NO: 29569 - DNA, 25 bp, Mus musculus
caggccactggttactctgagtgga

SEQ ID NO: 29570 - DNA, 25 bp, Mus musculus
aggccactggttactctgagtggag

SEQ ID NO: 29571 - DNA, 25 bp, Mus musculus
gatacaaactatagactcgacacag

SEQ ID NO: 29572 - DNA, 25 bp, Mus musculus
atacaaactatagactcgacacaga

SEQ ID NO: 29573 - DNA, 25 bp, Mus musculus
caaactatagactcgacacagattc

SEQ ID NO: 29574 - DNA, 25 bp, Mus musculus
ccatgccgatcgtcatcgggaacac

SEQ ID NO: 29575 - DNA, 25 bp, Mus musculus
atcgtcatcgggaacacgaatgttg

SEQ ID NO: 29576 - DNA, 25 bp, Mus musculus
gcagcctgcacagcatggcagagat

SEQ ID NO: 29577 - DNA, 25 bp, Mus musculus
cctgcacagcatggcagagatcggt

SEQ ID NO: 29578 - DNA, 25 bp, Mus musculus
ggtgcccagaccgcaactacagtaa

SEQ ID NO: 29579 - DNA, 25 bp, Mus musculus
cagaccgcaactacagtaagctgcc

SEQ ID NO: 29580 - DNA, 25 bp, Mus musculus
gaccgcaactacagtaagctgcctg

SEQ ID NO: 29581 - DNA, 25 bp, Mus musculus
ccgcaactacagtaagctgcctgtt

SEQ ID NO: 29582 - DNA, 25 bp, Mus musculus
aactacagtaagctgcctgtttgcc

SEQ ID NO: 29583 - DNA, 25 bp, Mus musculus
ctacagtaagctgcctgtttgcctg

SEQ ID NO: 29584 - DNA, 25 bp, Mus musculus
acagtaagctgcctgtttgcctgct

SEQ ID NO: 29585 - DNA, 25 bp, Mus musculus
agtaagctgcctgtttgcctgctgt

SEQ ID NO: 29586 - DNA, 25 bp, Mus musculus
caggcaccgtcaagcctgcacgagt

SEQ ID NO: 29587 - DNA, 25 bp, Mus musculus
taagctgcctgtttgcctgctgttc

SEQ ID NO: 29588 - DNA, 25 bp, Mus musculus
ggcaccgtcaagcctgcacgagtag

SEQ ID NO: 29589 - DNA, 25 bp, Mus musculus
caccgtcaagcctgcacgagtagat

SEQ ID NO: 29590 - DNA, 25 bp, Mus musculus
ccgtcaagcctgcacgagtagatcg

SEQ ID NO: 29591 - DNA, 25 bp, Mus musculus
caagcctgcacgagtagatcgcagg

SEQ ID NO: 29592 - DNA, 25 bp, Mus musculus
agcctgcacgagtagatcgcaggtg

SEQ ID NO: 29593 - DNA, 25 bp, Mus musculus
cctgcacgagtagatcgcaggtgca

SEQ ID NO: 29594 - DNA, 25 bp, Mus musculus
agtagatcgcaggtgcacggtggtc

SEQ ID NO: 29595 - DNA, 25 bp, Mus musculus
tcaccttctcctatgggcgtgcctg

SEQ ID NO: 29596 - DNA, 25 bp, Mus musculus
accttctcctatgggcgtgcctgca

SEQ ID NO: 29597 - DNA, 25 bp, Mus musculus
gtcagccgagggcagatgttaaggc

SEQ ID NO: 29598 - DNA, 25 bp, Mus musculus
agatggctgacggcagcacagtcgc

SEQ ID NO: 29599 - DNA, 25 bp, Mus musculus
atggctgacggcagcacagtcgctc

SEQ ID NO: 29600 - DNA, 25 bp, Mus musculus
tggctgacggcagcacagtcgctct

SEQ ID NO: 29601 - DNA, 25 bp, Mus musculus
gcacagtcgctctagatcgccaacg

SEQ ID NO: 29602 - DNA, 25 bp, Mus musculus
acagtcgctctagatcgccaacgat

SEQ ID NO: 29603 - DNA, 25 bp, Mus musculus
cagtcgctctagatcgccaacgatg

SEQ ID NO: 29604 - DNA, 25 bp, Mus musculus
gtcgctctagatcgccaacgatgcc

SEQ ID NO: 29605 - DNA, 25 bp, Mus musculus
tcgctctagatcgccaacgatgcct

SEQ ID NO: 29606 - DNA, 25 bp, Mus musculus
gctctagatcgccaacgatgcctac

SEQ ID NO: 29607 - DNA, 25 bp, Mus musculus
tcctatgggcgtgcctgcaggcatc

SEQ ID NO: 29608 - DNA, 25 bp, Mus musculus
cctatgggcgtgcctgcaggcatct

SEQ ID NO: 29609 - DNA, 25 bp, Mus musculus
gtgcctgcaggcatctgcactcaat

SEQ ID NO: 29610 - DNA, 25 bp, Mus musculus
tgataatgctggtgctgctaatgat

SEQ ID NO: 29611 - DNA, 25 bp, Mus musculus
ataatgctggtgctgctaatgatga

SEQ ID NO: 29612 - DNA, 25 bp, Mus musculus
atgctggtgctgctaatgatgagtt

SEQ ID NO: 29613 - DNA, 25 bp, Mus musculus
ttatcaagcgggcagagatgaacgg

SEQ ID NO: 29614 - DNA, 25 bp, Mus musculus
tatcaagcgggcagagatgaacggg

SEQ ID NO: 29615 - DNA, 25 bp, Mus musculus
gttcttttgcccctgtcagtcattt

SEQ ID NO: 29616 - DNA, 25 bp, Mus musculus
ttgcccctgtcagtcattttcttac

SEQ ID NO: 29617 - DNA, 25 bp, Mus musculus
gccatctcctttcaggtgatgaggt

SEQ ID NO: 29618 - DNA, 25 bp, Mus musculus
tcctttcaggtgatgaggtcacagg

SEQ ID NO: 29619 - DNA, 25 bp, Mus musculus
gagcatacttttaaccaacatgggg

SEQ ID NO: 29620 - DNA, 25 bp, Mus musculus
catgcctatgaggaacctttgaaca

SEQ ID NO: 29621 - DNA, 25 bp, Mus musculus
gaacctttgaacaactggctgaagc

SEQ ID NO: 29622 - DNA, 25 bp, Mus musculus
ttgaacaactggctgaagctttcgc

SEQ ID NO: 29623 - DNA, 25 bp, Mus musculus
ttccccagtcctgatcttgtggatt

SEQ ID NO: 29624 - DNA, 25 bp, Mus musculus
agtcctgatcttgtggattcgttag

SEQ ID NO: 29625 - DNA, 25 bp, Mus musculus
aaccaatgctttcttgtgtctcaac

SEQ ID NO: 29626 - DNA, 25 bp, Mus musculus
cttgtgtctcaactctttgtatatg

SEQ ID NO: 29627 - DNA, 25 bp, Mus musculus
ctgtcagtcattttcttacatgctt

SEQ ID NO: 29628 - DNA, 25 bp, Mus musculus
ttcttacatgcttagcacagattca

SEQ ID NO: 29629 - DNA, 25 bp, Mus musculus
catgcttagcacagattcacaactc

SEQ ID NO: 29630 - DNA, 25 bp, Mus musculus
tagcacagattcacaactcactgtg

SEQ ID NO: 29631 - DNA, 25 bp, Mus musculus
agattcacaactcactgtgtagtgt

SEQ ID NO: 29632 - DNA, 25 bp, Mus musculus
ttcctagattcagctgaagacctgg

SEQ ID NO: 29633 - DNA, 25 bp, Mus musculus
gattcagctgaagacctggtaccta

SEQ ID NO: 29634 - DNA, 25 bp, Mus musculus
ggaaacacatcatggctgatgattg

SEQ ID NO: 29635 - DNA, 25 bp, Mus musculus
ggccatgatcgcctattggaccaac

SEQ ID NO: 29636 - DNA, 25 bp, Mus musculus
gatcgcctattggaccaactttgcc

SEQ ID NO: 29637 - DNA, 25 bp, Mus musculus
ttccatgaaggagcacctgagagaa

SEQ ID NO: 29638 - DNA, 25 bp, Mus musculus
aaagttcctgaagttctgggctgtg

SEQ ID NO: 29639 - DNA, 25 bp, Mus musculus
cctgaagttctgggctgtgacattc

SEQ ID NO: 29640 - DNA, 25 bp, Mus musculus
gacattcgaggtgctgcccacagtg

SEQ ID NO: 29641 - DNA, 25 bp, Mus musculus
gctgcccacagtgactggtgaccag

SEQ ID NO: 29642 - DNA, 25 bp, Mus musculus
tgactcagaggttgcccctgaccca

SEQ ID NO: 29643 - DNA, 25 bp, Mus musculus
cccacctacagatgactctgtggag

SEQ ID NO: 29644 - DNA, 25 bp, Mus musculus
gatgcctgccaccattggcttctaa

SEQ ID NO: 29645 - DNA, 25 bp, Mus musculus
tgccaccattggcttctaaagtctt

SEQ ID NO: 29646 - DNA, 25 bp, Mus musculus
tcatataagccttggtcccagggtt

SEQ ID NO: 29647 - DNA, 25 bp, Mus musculus
ctattggaccaactttgccaggagt

SEQ ID NO: 29648 - DNA, 25 bp, Mus musculus
ctgttcaataaagctctccttcaat

SEQ ID NO: 29649 - DNA, 25 bp, Mus musculus
ccccaacatgggcaactcacctgtg

SEQ ID NO: 29650 - DNA, 25 bp, Mus musculus
catgggcaactcacctgtgcccaca

SEQ ID NO: 29651 - DNA, 25 bp, Mus musculus
gaatggcaactacctggacatcact

SEQ ID NO: 29652 - DNA, 25 bp, Mus musculus
cctggacatcactaagacgataacc

SEQ ID NO: 29653 - DNA, 25 bp, Mus musculus
taagacgataaccagcgcttccatg

SEQ ID NO: 29654 - DNA, 25 bp, Mus musculus
gataaccagcgcttccatgaaggag

SEQ ID NO: 29655 - DNA, 25 bp, Mus musculus
cagcgcttccatgaaggagcacctg

SEQ ID NO: 29656 - DNA, 25 bp, Mus musculus
gccatcgaccgcgcggacaggccga

SEQ ID NO: 29657 - DNA, 25 bp, Mus musculus
gaccgcgcggacaggccgaagccgc

SEQ ID NO: 29658 - DNA, 25 bp, Mus musculus
gaacgatgcccaggagaccactgga

SEQ ID NO: 29659 - DNA, 25 bp, Mus musculus
gatgcccaggagaccactggaacag

SEQ ID NO: 29660 - DNA, 25 bp, Mus musculus
tgcccaggagaccactggaacaggc

SEQ ID NO: 29661 - DNA, 25 bp, Mus musculus
agaccactggaacaggctgagaata

SEQ ID NO: 29662 - DNA, 25 bp, Mus musculus
accactggaacaggctgagaatacg

SEQ ID NO: 29663 - DNA, 25 bp, Mus musculus
gaatacgagcatcgacgctgacgca

SEQ ID NO: 29664 - DNA, 25 bp, Mus musculus
atacgagcatcgacgctgacgcaga

SEQ ID NO: 29665 - DNA, 25 bp, Mus musculus
acgagcatcgacgctgacgcagatg

SEQ ID NO: 29666 - DNA, 25 bp, Mus musculus
gagcatcgacgctgacgcagatgtg

SEQ ID NO: 29667 - DNA, 25 bp, Mus musculus
acgcagatgtggcctctctcaaggg

SEQ ID NO: 29668 - DNA, 25 bp, Mus musculus
aaagcacgctggagaccgatccagg

SEQ ID NO: 29669 - DNA, 25 bp, Mus musculus
agcacgctggagaccgatccaggca

SEQ ID NO: 29670 - DNA, 25 bp, Mus musculus
cacgctggagaccgatccaggcagc

SEQ ID NO: 29671 - DNA, 25 bp, Mus musculus
accgatccaggcagctggccgaaga

SEQ ID NO: 29672 - DNA, 25 bp, Mus musculus
ccaggcagctggccgaagatgagca

SEQ ID NO: 29673 - DNA, 25 bp, Mus musculus
gaatagtgttccgagtccgagaacg

SEQ ID NO: 29674 - DNA, 25 bp, Mus musculus
gtccgagaacgatgcccaggagacc

SEQ ID NO: 29675 - DNA, 25 bp, Mus musculus
ccgagaacgatgcccaggagaccac

SEQ ID NO: 29676 - DNA, 25 bp, Mus musculus
gtcattattctcagtggagaccgcc

SEQ ID NO: 29677 - DNA, 25 bp, Mus musculus
attctcagtggagaccgcccaggct

SEQ ID NO: 29678 - DNA, 25 bp, Mus musculus
ctcaggcagatcgtcacagagcacg

SEQ ID NO: 29679 - DNA, 25 bp, Mus musculus
cagatcgtcacagagcacgtgcagc

SEQ ID NO: 29680 - DNA, 25 bp, Mus musculus
atcgtcacagagcacgtgcagctac

SEQ ID NO: 29681 - DNA, 25 bp, Mus musculus
gagcacgtgcagctactgcatgtga

SEQ ID NO: 29682 - DNA, 25 bp, Mus musculus
cacgtgcagctactgcatgtgatca

SEQ ID NO: 29683 - DNA, 25 bp, Mus musculus
gtgcagctactgcatgtgatcaaga

SEQ ID NO: 29684 - DNA, 25 bp, Mus musculus
cgctgacaacgtgttccttctattg

SEQ ID NO: 29685 - DNA, 25 bp, Mus musculus
tgacaacgtgttccttctattgatt

SEQ ID NO: 29686 - DNA, 25 bp, Mus musculus
gttccttctattgattgcactatta

SEQ ID NO: 29687 - DNA, 25 bp, Mus musculus
ctgacacctaagaaatttactgtga

SEQ ID NO: 29688 - DNA, 25 bp, Mus musculus
aacgtgaagcccatcgaggacatcc

SEQ ID NO: 29689 - DNA, 25 bp, Mus musculus
aagcccatcgaggacatccaagaca

SEQ ID NO: 29690 - DNA, 25 bp, Mus musculus
ctggaactgcagctcaagctgaatc

SEQ ID NO: 29691 - DNA, 25 bp, Mus musculus
gaactgcagctcaagctgaatcacc

SEQ ID NO: 29692 - DNA, 25 bp, Mus musculus
aagctgaatcacccagagtcctctc

SEQ ID NO: 29693 - DNA, 25 bp, Mus musculus
aatcacccagagtcctctcagctgt

SEQ ID NO: 29694 - DNA, 25 bp, Mus musculus
ttcgccaaggtgctccagaagatga

SEQ ID NO: 29695 - DNA, 25 bp, Mus musculus
aagatgacagacctcaggcagatcg

SEQ ID NO: 29696 - DNA, 25 bp, Mus musculus
tcagcatcttctctgtgtacctggc

SEQ ID NO: 29697 - DNA, 25 bp, Mus musculus
tcttctctgtgtacctggcatgtcc

SEQ ID NO: 29698 - DNA, 25 bp, Mus musculus
gaatgcacacctgtgttttccaagg

SEQ ID NO: 29699 - DNA, 25 bp, Mus musculus
aatgagcctgatacctgtgtttcag

SEQ ID NO: 29700 - DNA, 25 bp, Mus musculus
cctgatacctgtgtttcagcatttg

SEQ ID NO: 29701 - DNA, 25 bp, Mus musculus
acctgtgtttcagcatttggccacg

SEQ ID NO: 29702 - DNA, 25 bp, Mus musculus
tattattccttgatcacatttatcg

SEQ ID NO: 29703 - DNA, 25 bp, Mus musculus
tccttgatcacatttatcgtttgat

SEQ ID NO: 29704 - DNA, 25 bp, Mus musculus
atcacatttatcgtttgatcttgct

SEQ ID NO: 29705 - DNA, 25 bp, Mus musculus
gtttgatcttgctctgttatgccag

SEQ ID NO: 29706 - DNA, 25 bp, Mus musculus
tctgttatgccagtgtatgtcgctg

SEQ ID NO: 29707 - DNA, 25 bp, Mus musculus
atgccagtgtatgtcgctgaattct

SEQ ID NO: 29708 - DNA, 25 bp, Mus musculus
ttcttccttcaaagaagctccggtg

SEQ ID NO: 29709 - DNA, 25 bp, Mus musculus
cttcaaagaagctccggtgtttatg

SEQ ID NO: 29710 - DNA, 25 bp, Mus musculus
gttgtgctcaacgccaaacagtcat

SEQ ID NO: 29711 - DNA, 25 bp, Mus musculus
cagtcatcagagctgagcgttctga

SEQ ID NO: 29712 - DNA, 25 bp, Mus musculus
tcagagctgagcgttctgatcaggt

SEQ ID NO: 29713 - DNA, 25 bp, Mus musculus
ctgagcgttctgatcaggtgcgtct

SEQ ID NO: 29714 - DNA, 25 bp, Mus musculus
tcactgtgtgacttgctttactctc

SEQ ID NO: 29715 - DNA, 25 bp, Mus musculus
ctctccatgggctggatgaacgagg

SEQ ID NO: 29716 - DNA, 25 bp, Mus musculus
accagctctggggtcactgagagat

SEQ ID NO: 29717 - DNA, 25 bp, Mus musculus
agctctggggtcactgagagatgcc

SEQ ID NO: 29718 - DNA, 25 bp, Mus musculus
aaatgcaaacccagccatacattgc

SEQ ID NO: 29719 - DNA, 25 bp, Mus musculus
tgcaaacccagccatacattgccat

SEQ ID NO: 29720 - DNA, 25 bp, Mus musculus
aaacccagccatacattgccatgga

SEQ ID NO: 29721 - DNA, 25 bp, Mus musculus
cccagccatacattgccatggattg

SEQ ID NO: 29722 - DNA, 25 bp, Mus musculus
agccatacattgccatggattggga

SEQ ID NO: 29723 - DNA, 25 bp, Mus musculus
catacattgccatggattgggaacc

SEQ ID NO: 29724 - DNA, 25 bp, Mus musculus
acattgccatggattgggaaccaga

SEQ ID NO: 29725 - DNA, 25 bp, Mus musculus
agcatgactgtgtgggctacatgct

SEQ ID NO: 29726 - DNA, 25 bp, Mus musculus
atgactgtgtgggctacatgctgaa

SEQ ID NO: 29727 - DNA, 25 bp, Mus musculus
actgtgtgggctacatgctgaagaa

SEQ ID NO: 29728 - DNA, 25 bp, Mus musculus
tctggggtcactgagagatgcccat

SEQ ID NO: 29729 - DNA, 25 bp, Mus musculus
ccccaaggcgacgacgaaagcagct

SEQ ID NO: 29730 - DNA, 25 bp, Mus musculus
gaaagcagctgtttactctgcagac

SEQ ID NO: 29731 - DNA, 25 bp, Mus musculus
agctgtttactctgcagacggtgaa

SEQ ID NO: 29732 - DNA, 25 bp, Mus musculus
tgtttactctgcagacggtgaactc

SEQ ID NO: 29733 - DNA, 25 bp, Mus musculus
ttactctgcagacggtgaactccaa

SEQ ID NO: 29734 - DNA, 25 bp, Mus musculus
ctctgcagacggtgaactccaatgg

SEQ ID NO: 29735 - DNA, 25 bp, Mus musculus
tgaactccaatggaaccagtgaccg

SEQ ID NO: 29736 - DNA, 25 bp, Mus musculus
gcaaccataccagcaccaaacaaca

SEQ ID NO: 29737 - DNA, 25 bp, Mus musculus
cctactacttcacctaagcctagca

SEQ ID NO: 29738 - DNA, 25 bp, Mus musculus
tctactacaactagtactaccatcc

SEQ ID NO: 29739 - DNA, 25 bp, Mus musculus
agtactaccatccaaactacagctc

SEQ ID NO: 29740 - DNA, 25 bp, Mus musculus
actaccatccaaactacagctccaa

SEQ ID NO: 29741 - DNA, 25 bp, Mus musculus
atccaaactacagctccaacatttg

SEQ ID NO: 29742 - DNA, 25 bp, Mus musculus
actacagctccaacatttgcggaag

SEQ ID NO: 29743 - DNA, 25 bp, Mus musculus
gctccaacatttgcggaagtgtttt

SEQ ID NO: 29744 - DNA, 25 bp, Mus musculus
aagttctttcagcagatctttaggt

SEQ ID NO: 29745 - DNA, 25 bp, Mus musculus
ttctttcagcagatctttaggttaa

SEQ ID NO: 29746 - DNA, 25 bp, Mus musculus
taggatagtctccaaacttttctga

SEQ ID NO: 29747 - DNA, 25 bp, Mus musculus
caaacttttctgatctcttaggata

SEQ ID NO: 29748 - DNA, 25 bp, Mus musculus
actacttcacctaagcctagcacct

SEQ ID NO: 29749 - DNA, 25 bp, Mus musculus
tcacctaagcctagcacctctacag

SEQ ID NO: 29750 - DNA, 25 bp, Mus musculus
tctacagccatacctacaacaacta

SEQ ID NO: 29751 - DNA, 25 bp, Mus musculus
gccatacctacaacaactaagtctg

SEQ ID NO: 29752 - DNA, 25 bp, Mus musculus
cctacaacaactaagtctgcaaata

SEQ ID NO: 29753 - DNA, 25 bp, Mus musculus
acaactaagtctgcaaatagtactt

SEQ ID NO: 29754 - DNA, 25 bp, Mus musculus
gcaaatagtacttcctctactacaa

SEQ ID NO: 29755 - DNA, 25 bp, Mus musculus
tcctctactacaactagtactacca

SEQ ID NO: 29756 - DNA, 25 bp, Mus musculus
ggccgtctcagtgctaagttgacac

SEQ ID NO: 29757 - DNA, 25 bp, Mus musculus
gctaagttgacactccggggcaagg

SEQ ID NO: 29758 - DNA, 25 bp, Mus musculus
actgttggggctgacctccactttg

SEQ ID NO: 29759 - DNA, 25 bp, Mus musculus
cactttgccaaagggcttcgagaag

SEQ ID NO: 29760 - DNA, 25 bp, Mus musculus
tctgctgcagctgcctgagcccatc

SEQ ID NO: 29761 - DNA, 25 bp, Mus musculus
acctgggtggctggcattcaggaac

SEQ ID NO: 29762 - DNA, 25 bp, Mus musculus
ggcattcaggaacctaactgaagtc

SEQ ID NO: 29763 - DNA, 25 bp, Mus musculus
cctaactgaagtcttctctgcaccc

SEQ ID NO: 29764 - DNA, 25 bp, Mus musculus
cttcccatctacagtgttagtggtc

SEQ ID NO: 29765 - DNA, 25 bp, Mus musculus
tttaattccagaattagtcaaccat

SEQ ID NO: 29766 - DNA, 25 bp, Mus musculus
attagtcaaccatcaattagaatcc

SEQ ID NO: 29767 - DNA, 25 bp, Mus musculus
caaccatcaattagaatccatccac

SEQ ID NO: 29768 - DNA, 25 bp, Mus musculus
tttcaaatctactcaaatcagtctg

SEQ ID NO: 29769 - DNA, 25 bp, Mus musculus
atctactcaaatcagtctgcgctgg

SEQ ID NO: 29770 - DNA, 25 bp, Mus musculus
gagtctctggcgctgatcccactgc

SEQ ID NO: 29771 - DNA, 25 bp, Mus musculus
ccactgaagacactgctgcaaatcg

SEQ ID NO: 29772 - DNA, 25 bp, Mus musculus
aagacactgctgcaaatcggagtga

SEQ ID NO: 29773 - DNA, 25 bp, Mus musculus
atgcctttgctgaacgagcgtacct

SEQ ID NO: 29774 - DNA, 25 bp, Mus musculus
ggtatcaacttcgtgcgtgaggtgg

SEQ ID NO: 29775 - DNA, 25 bp, Mus musculus
aaccacgcgggcttcgtcactgttg

SEQ ID NO: 29776 - DNA, 25 bp, Mus musculus
gactctcagagattgctgcaacatc

SEQ ID NO: 29777 - DNA, 25 bp, Mus musculus
agattgctgcaacatctgagcactc

SEQ ID NO: 29778 - DNA, 25 bp, Mus musculus
gtctttacactatattgagtaggct

SEQ ID NO: 29779 - DNA, 25 bp, Mus musculus
tttacactatattgagtaggctaat

SEQ ID NO: 29780 - DNA, 25 bp, Mus musculus
taatctataatgggctcatgaatta

SEQ ID NO: 29781 - DNA, 25 bp, Mus musculus
attactgcaagattacctggacttt

SEQ ID NO: 29782 - DNA, 25 bp, Mus musculus
agattacctggactttgatgattta

SEQ ID NO: 29783 - DNA, 25 bp, Mus musculus
ttacctggactttgatgatttagat

SEQ ID NO: 29784 - DNA, 25 bp, Mus musculus
ttcgctagctttgaattttactgga

SEQ ID NO: 29785 - DNA, 25 bp, Mus musculus
aggtacatgcgacttctatgtggtg

SEQ ID NO: 29786 - DNA, 25 bp, Mus musculus
atgcgacttctatgtggtgtgttgg

SEQ ID NO: 29787 - DNA, 25 bp, Mus musculus
cttctatgtggtgtgttggacttag

SEQ ID NO: 29788 - DNA, 25 bp, Mus musculus
ttgctgcaacatctgagcactctgt

SEQ ID NO: 29789 - DNA, 25 bp, Mus musculus
ctgcaacatctgagcactctgtggg

SEQ ID NO: 29790 - DNA, 25 bp, Mus musculus
caacatctgagcactctgtgggaac

SEQ ID NO: 29791 - DNA, 25 bp, Mus musculus
catctgagcactctgtgggaacagg

SEQ ID NO: 29792 - DNA, 25 bp, Mus musculus
ctgagcactctgtgggaacaggatt

SEQ ID NO: 29793 - DNA, 25 bp, Mus musculus
agcactctgtgggaacaggattcta

SEQ ID NO: 29794 - DNA, 25 bp, Mus musculus
gttttggtctttacactatattgag

SEQ ID NO: 29795 - DNA, 25 bp, Mus musculus
ttggtctttacactatattgagtag

SEQ ID NO: 29796 - DNA, 25 bp, Mus musculus
actctatgcagataacgtcaacgac

SEQ ID NO: 29797 - DNA, 25 bp, Mus musculus
taacgtcaacgactctacatttact

SEQ ID NO: 29798 - DNA, 25 bp, Mus musculus
tttcagcttagtttgagagattgat

SEQ ID NO: 29799 - DNA, 25 bp, Mus musculus
ttatccacacgtgtactcacttgtt

SEQ ID NO: 29800 - DNA, 25 bp, Mus musculus
acacgtgtactcacttgttcattaa

SEQ ID NO: 29801 - DNA, 25 bp, Mus musculus
gtactcacttgttcattaaacgact

SEQ ID NO: 29802 - DNA, 25 bp, Mus musculus
tcgcatgactgtctggaagtagacc

SEQ ID NO: 29803 - DNA, 25 bp, Mus musculus
catgctatttttctgctcactgtac

SEQ ID NO: 29804 - DNA, 25 bp, Mus musculus
tattgttcacataaaccctataatg

SEQ ID NO: 29805 - DNA, 25 bp, Mus musculus
tcacataaaccctataatgtaaata

SEQ ID NO: 29806 - DNA, 25 bp, Mus musculus
tacagtgattactcttctcacaggc

SEQ ID NO: 29807 - DNA, 25 bp, Mus musculus
gattactcttctcacaggctgagtg

SEQ ID NO: 29808 - DNA, 25 bp, Mus musculus
ctctacatttactggctttcttctc

SEQ ID NO: 29809 - DNA, 25 bp, Mus musculus
tggctttcttctctaccatgatacc

SEQ ID NO: 29810 - DNA, 25 bp, Mus musculus
tcttctctaccatgataccaactga

SEQ ID NO: 29811 - DNA, 25 bp, Mus musculus
tgataccaactgactgcaactaccc

SEQ ID NO: 29812 - DNA, 25 bp, Mus musculus
caactgactgcaactacccatagcc

SEQ ID NO: 29813 - DNA, 25 bp, Mus musculus
actgcaactacccatagcccataca

SEQ ID NO: 29814 - DNA, 25 bp, Mus musculus
ccatacaccaggagaatcatggaac

SEQ ID NO: 29815 - DNA, 25 bp, Mus musculus
atggaacagtcgacacactttcagc

SEQ ID NO: 29816 - DNA, 25 bp, Mus musculus
cacggccacagcggtggtgtgatgt

SEQ ID NO: 29817 - DNA, 25 bp, Mus musculus
gccacagcggtggtgtgatgtgcct

SEQ ID NO: 29818 - DNA, 25 bp, Mus musculus
atcgaccaatgcctgagaacttccg

SEQ ID NO: 29819 - DNA, 25 bp, Mus musculus
cgaccaatgcctgagaacttccgaa

SEQ ID NO: 29820 - DNA, 25 bp, Mus musculus
accaatgcctgagaacttccgaaag

SEQ ID NO: 29821 - DNA, 25 bp, Mus musculus
caatgcctgagaacttccgaaagct

SEQ ID NO: 29822 - DNA, 25 bp, Mus musculus
atgcctgagaacttccgaaagctta

SEQ ID NO: 29823 - DNA, 25 bp, Mus musculus
ctgagaacttccgaaagcttaggct

SEQ ID NO: 29824 - DNA, 25 bp, Mus musculus
aagcttaggcttcaaggttgctggg

SEQ ID NO: 29825 - DNA, 25 bp, Mus musculus
ttaggcttcaaggttgctgggaagt

SEQ ID NO: 29826 - DNA, 25 bp, Mus musculus
aggcttcaaggttgctgggaagttg

SEQ ID NO: 29827 - DNA, 25 bp, Mus musculus
gcttcaaggttgctgggaagttgtt

SEQ ID NO: 29828 - DNA, 25 bp, Mus musculus
cacagcggtggtgtgatgtgccttc

SEQ ID NO: 29829 - DNA, 25 bp, Mus musculus
agatcatcgcttttatcgaccaatg

SEQ ID NO: 29830 - DNA, 25 bp, Mus musculus
atcatcgcttttatcgaccaatgcc

SEQ ID NO: 29831 - DNA, 25 bp, Mus musculus
catcgcttttatcgaccaatgcctg

SEQ ID NO: 29832 - DNA, 25 bp, Mus musculus
tcgcttttatcgaccaatgcctgag

SEQ ID NO: 29833 - DNA, 25 bp, Mus musculus
gcttttatcgaccaatgcctgagaa

SEQ ID NO: 29834 - DNA, 25 bp, Mus musculus
ttttatcgaccaatgcctgagaact

SEQ ID NO: 29835 - DNA, 25 bp, Mus musculus
ttatcgaccaatgcctgagaacttc

SEQ ID NO: 29836 - DNA, 25 bp, Mus musculus
ttttgatttgggccctacagactcg

SEQ ID NO: 29837 - DNA, 25 bp, Mus musculus
tgatttgggccctacagactcgtct

SEQ ID NO: 29838 - DNA, 25 bp, Mus musculus
tctaggaccctgtcacccacaggac

SEQ ID NO: 29839 - DNA, 25 bp, Mus musculus
ctgtcacccacaggacgcgcagcgt

SEQ ID NO: 29840 - DNA, 25 bp, Mus musculus
acaggacgcgcagcgtcttgcccat

SEQ ID NO: 29841 - DNA, 25 bp, Mus musculus
tcttgcccatagcgctcgtacgcag

SEQ ID NO: 29842 - DNA, 25 bp, Mus musculus
tcgtacgcaggcgcgttccatcatg

SEQ ID NO: 29843 - DNA, 25 bp, Mus musculus
tacgcaggcgcgttccatcatggaa

SEQ ID NO: 29844 - DNA, 25 bp, Mus musculus
gcgttccatcatggaaccactcatg

SEQ ID NO: 29845 - DNA, 25 bp, Mus musculus
cgttccatcatggaaccactcatgg

SEQ ID NO: 29846 - DNA, 25 bp, Mus musculus
gttccatcatggaaccactcatggt

SEQ ID NO: 29847 - DNA, 25 bp, Mus musculus
ttccatcatggaaccactcatggtt

SEQ ID NO: 29848 - DNA, 25 bp, Mus musculus
tttgggccctacagactcgtctcac

SEQ ID NO: 29849 - DNA, 25 bp, Mus musculus
gtctcaccctcgagcagatccggct

SEQ ID NO: 29850 - DNA, 25 bp, Mus musculus
tcaccctcgagcagatccggctgga

SEQ ID NO: 29851 - DNA, 25 bp, Mus musculus
ccctcgagcagatccggctggagtt

SEQ ID NO: 29852 - DNA, 25 bp, Mus musculus
agatccggctggagttccaggctcc

SEQ ID NO: 29853 - DNA, 25 bp, Mus musculus
tggagttccaggctccattcctcta

SEQ ID NO: 29854 - DNA, 25 bp, Mus musculus
agttccaggctccattcctctagga

SEQ ID NO: 29855 - DNA, 25 bp, Mus musculus
aggctccattcctctaggaccctgt

SEQ ID NO: 29856 - DNA, 25 bp, Mus musculus
ttgactctcaggagagaatgttttg

SEQ ID NO: 29857 - DNA, 25 bp, Mus musculus
tgatgccttttaccactagagactt

SEQ ID NO: 29858 - DNA, 25 bp, Mus musculus
tccttgataccgatggggacttcga

SEQ ID NO: 29859 - DNA, 25 bp, Mus musculus
acttcgatctggaagacacgatgga

SEQ ID NO: 29860 - DNA, 25 bp, Mus musculus
gccggcccatggacagtcagtggat

SEQ ID NO: 29861 - DNA, 25 bp, Mus musculus
acagtcagtggatccctcacgcaca

SEQ ID NO: 29862 - DNA, 25 bp, Mus musculus
agtggatccctcacgcacagtcatg

SEQ ID NO: 29863 - DNA, 25 bp, Mus musculus
acgcacagtcatgaccagacctcac

SEQ ID NO: 29864 - DNA, 25 bp, Mus musculus
gcagcttcatcgccctcgtggagga

SEQ ID NO: 29865 - DNA, 25 bp, Mus musculus
tcatcgccctcgtggaggaacttcc

SEQ ID NO: 29866 - DNA, 25 bp, Mus musculus
taattccatgaatcgcttctctttg

SEQ ID NO: 29867 - DNA, 25 bp, Mus musculus
catgaatcgcttctctttggaaaca

SEQ ID NO: 29868 - DNA, 25 bp, Mus musculus
cttttaccactagagacttctctat

SEQ ID NO: 29869 - DNA, 25 bp, Mus musculus
cgcttctctttggaaacaatactcg

SEQ ID NO: 29870 - DNA, 25 bp, Mus musculus
gagacttctctatccggtccctcgc

SEQ ID NO: 29871 - DNA, 25 bp, Mus musculus
tgaattacctcatatatgtgtttcc

SEQ ID NO: 29872 - DNA, 25 bp, Mus musculus
acctcatatatgtgtttcctgatcg

SEQ ID NO: 29873 - DNA, 25 bp, Mus musculus
tgtttcctgatcggccaaaggatga

SEQ ID NO: 29874 - DNA, 25 bp, Mus musculus
cctgtgagcccgcaactgcgaaagc

SEQ ID NO: 29875 - DNA, 25 bp, Mus musculus
agcccgcaactgcgaaagcagctga

SEQ ID NO: 29876 - DNA, 25 bp, Mus musculus
tggtccccgagtttgcaaatgcatc

SEQ ID NO: 29877 - DNA, 25 bp, Mus musculus
caagctcatcaatgccattgagctc

SEQ ID NO: 29878 - DNA, 25 bp, Mus musculus
catcaatgccattgagctcaagaaa

SEQ ID NO: 29879 - DNA, 25 bp, Mus musculus
tgactggacacccaatgccaggttc

SEQ ID NO: 29880 - DNA, 25 bp, Mus musculus
gacacccaatgccaggttcattata

SEQ ID NO: 29881 - DNA, 25 bp, Mus musculus
gttcattatacgttcctggcttcga

SEQ ID NO: 29882 - DNA, 25 bp, Mus musculus
cattatacgttcctggcttcgagat

SEQ ID NO: 29883 - DNA, 25 bp, Mus musculus
tggcctcaagccacgatgcatcacc

SEQ ID NO: 29884 - DNA, 25 bp, Mus musculus
caagccacgatgcatcaccagagac

SEQ ID NO: 29885 - DNA, 25 bp, Mus musculus
gccacgatgcatcaccagagacctc

SEQ ID NO: 29886 - DNA, 25 bp, Mus musculus
acgatgcatcaccagagacctcaaa

SEQ ID NO: 29887 - DNA, 25 bp, Mus musculus
catcaccagagacctcaaatgggga

SEQ ID NO: 29888 - DNA, 25 bp, Mus musculus
caccagagacctcaaatggggaacg

SEQ ID NO: 29889 - DNA, 25 bp, Mus musculus
caagaaaccacagtgcaaaatctgc

SEQ ID NO: 29890 - DNA, 25 bp, Mus musculus
gaaaccacagtgcaaaatctgccgc

SEQ ID NO: 29891 - DNA, 25 bp, Mus musculus
gaggtcctcacagcacctgtttcta

SEQ ID NO: 29892 - DNA, 25 bp, Mus musculus
ctcacagcacctgtttctagacttg

SEQ ID NO: 29893 - DNA, 25 bp, Mus musculus
acagcacctgtttctagacttgcct

SEQ ID NO: 29894 - DNA, 25 bp, Mus musculus
tctagacttgcctaagttggaaaag

SEQ ID NO: 29895 - DNA, 25 bp, Mus musculus
gacagtgcctggcagtgactggaca

SEQ ID NO: 29896 - DNA, 25 bp, Mus musculus
cagtgactggacacccaatgccagg

SEQ ID NO: 29897 - DNA, 25 bp, Mus musculus
gttaagtccaagctgctgtaccacc

SEQ ID NO: 29898 - DNA, 25 bp, Mus musculus
aagtccaagctgctgtaccacctct

SEQ ID NO: 29899 - DNA, 25 bp, Mus musculus
atctcccaggccaggaaagccgtgg

SEQ ID NO: 29900 - DNA, 25 bp, Mus musculus
atggaagcctgcatggacagggtga

SEQ ID NO: 29901 - DNA, 25 bp, Mus musculus
aaggtctcccaggctgcctcagacc

SEQ ID NO: 29902 - DNA, 25 bp, Mus musculus
tcagacctcctggcctactgtgaag

SEQ ID NO: 29903 - DNA, 25 bp, Mus musculus
gacctcctggcctactgtgaagccc

SEQ ID NO: 29904 - DNA, 25 bp, Mus musculus
atcatcccagtgcctgcctcagaaa

SEQ ID NO: 29905 - DNA, 25 bp, Mus musculus
atcctctaacacccatggcgatgaa

SEQ ID NO: 29906 - DNA, 25 bp, Mus musculus
taacacccatggcgatgaagcgggc

SEQ ID NO: 29907 - DNA, 25 bp, Mus musculus
cacccatggcgatgaagcgggccct

SEQ ID NO: 29908 - DNA, 25 bp, Mus musculus
atgaagcgggccctttcctgctgta

SEQ ID NO: 29909 - DNA, 25 bp, Mus musculus
tccaagctgctgtaccacctctcag

SEQ ID NO: 29910 - DNA, 25 bp, Mus musculus
aagctgctgtaccacctctcagcag

SEQ ID NO: 29911 - DNA, 25 bp, Mus musculus
ctgctgtaccacctctcagcaggga

SEQ ID NO: 29912 - DNA, 25 bp, Mus musculus
cacctctcagcagggagtgcaggaa

SEQ ID NO: 29913 - DNA, 25 bp, Mus musculus
ctctcagcagggagtgcaggaatga

SEQ ID NO: 29914 - DNA, 25 bp, Mus musculus
atgtctaataacagcaccaccagca

SEQ ID NO: 29915 - DNA, 25 bp, Mus musculus
tctaataacagcaccaccagcatct

SEQ ID NO: 29916 - DNA, 25 bp, Mus musculus
agcatctcccaggccaggaaagccg

SEQ ID NO: 29917 - DNA, 25 bp, Mus musculus
gcttggccagaccagacctgggccc

SEQ ID NO: 29918 - DNA, 25 bp, Mus musculus
agggctgcccagacctggctgtttt

SEQ ID NO: 29919 - DNA, 25 bp, Mus musculus
cctcctaggagatgccagaggatag

SEQ ID NO: 29920 - DNA, 25 bp, Mus musculus
gagcgcctcactctgcactgttagc

SEQ ID NO: 29921 - DNA, 25 bp, Mus musculus
ctcactctgcactgttagcaggatg

SEQ ID NO: 29922 - DNA, 25 bp, Mus musculus
ttcaacactcacatccgtgatccgg

SEQ ID NO: 29923 - DNA, 25 bp, Mus musculus
actcacatccgtgatccgggaagag

SEQ ID NO: 29924 - DNA, 25 bp, Mus musculus
atccgtgatccgggaagagaagcaa

SEQ ID NO: 29925 - DNA, 25 bp, Mus musculus
catcatccctgtcaggtttcccaga

SEQ ID NO: 29926 - DNA, 25 bp, Mus musculus
ccctgtcaggtttcccagatgccat

SEQ ID NO: 29927 - DNA, 25 bp, Mus musculus
caggtttcccagatgccatgccgcc

SEQ ID NO: 29928 - DNA, 25 bp, Mus musculus
cacaccagcttggaaccatggggga

SEQ ID NO: 29929 - DNA, 25 bp, Mus musculus
gcccagacctggctgttttcttgcc

SEQ ID NO: 29930 - DNA, 25 bp, Mus musculus
ctgttttcttgcctgtggctgaaga

SEQ ID NO: 29931 - DNA, 25 bp, Mus musculus
tcttgcctgtggctgaagaggctgc

SEQ ID NO: 29932 - DNA, 25 bp, Mus musculus
agaccgactatctagctacatggag

SEQ ID NO: 29933 - DNA, 25 bp, Mus musculus
tttccaggccacaaacattccagag

SEQ ID NO: 29934 - DNA, 25 bp, Mus musculus
ggccacaaacattccagagacatct

SEQ ID NO: 29935 - DNA, 25 bp, Mus musculus
tccagagacatctccttcatatacc

SEQ ID NO: 29936 - DNA, 25 bp, Mus musculus
gtggcttacagttctgggatgaacc

SEQ ID NO: 29937 - DNA, 25 bp, Mus musculus
gtctaatcagtcctgtgtcgtgctc

SEQ ID NO: 29938 - DNA, 25 bp, Mus musculus
tctaatcagtcctgtgtcgtgctcc

SEQ ID NO: 29939 - DNA, 25 bp, Mus musculus
atgagctgcgacttgcacagtgctt

SEQ ID NO: 29940 - DNA, 25 bp, Mus musculus
tgagctgcgacttgcacagtgcttg

SEQ ID NO: 29941 - DNA, 25 bp, Mus musculus
gctgcgacttgcacagtgcttggta

SEQ ID NO: 29942 - DNA, 25 bp, Mus musculus
tgcgacttgcacagtgcttggtagc

SEQ ID NO: 29943 - DNA, 25 bp, Mus musculus
gcgacttgcacagtgcttggtagct

SEQ ID NO: 29944 - DNA, 25 bp, Mus musculus
cgacttgcacagtgcttggtagctt

SEQ ID NO: 29945 - DNA, 25 bp, Mus musculus
gacttgcacagtgcttggtagcttg

SEQ ID NO: 29946 - DNA, 25 bp, Mus musculus
cttgcacagtgcttggtagcttgat

SEQ ID NO: 29947 - DNA, 25 bp, Mus musculus
ttgcacagtgcttggtagcttgatg

SEQ ID NO: 29948 - DNA, 25 bp, Mus musculus
tgcacagtgcttggtagcttgatga

SEQ ID NO: 29949 - DNA, 25 bp, Mus musculus
ctaatcagtcctgtgtcgtgctccc

SEQ ID NO: 29950 - DNA, 25 bp, Mus musculus
taatcagtcctgtgtcgtgctccct

SEQ ID NO: 29951 - DNA, 25 bp, Mus musculus
aatcagtcctgtgtcgtgctccctc

SEQ ID NO: 29952 - DNA, 25 bp, Mus musculus
gacatcgacacaggaggcaagtcta

SEQ ID NO: 29953 - DNA, 25 bp, Mus musculus
acatcgacacaggaggcaagtctac

SEQ ID NO: 29954 - DNA, 25 bp, Mus musculus
catcgacacaggaggcaagtctact

SEQ ID NO: 29955 - DNA, 25 bp, Mus musculus
agcatgagctgcgacttgcacagtg

SEQ ID NO: 29956 - DNA, 25 bp, Mus musculus
catgagctgcgacttgcacagtgct

SEQ ID NO: 29957 - DNA, 25 bp, Mus musculus
tagacggaggccactacacagccta

SEQ ID NO: 29958 - DNA, 25 bp, Mus musculus
acggaggccactacacagcctactg

SEQ ID NO: 29959 - DNA, 25 bp, Mus musculus
ctgtgtcttcggttaggtcatcagc

SEQ ID NO: 29960 - DNA, 25 bp, Mus musculus
tgtcttcggttaggtcatcagcagc

SEQ ID NO: 29961 - DNA, 25 bp, Mus musculus
ggtcatcagcagcttatatcctctt

SEQ ID NO: 29962 - DNA, 25 bp, Mus musculus
cagcagcttatatcctcttgtatac

SEQ ID NO: 29963 - DNA, 25 bp, Mus musculus
cagcttatatcctcttgtatacttc

SEQ ID NO: 29964 - DNA, 25 bp, Mus musculus
tcttgtatacttccctgggaccacg

SEQ ID NO: 29965 - DNA, 25 bp, Mus musculus
tgtatacttccctgggaccacgcat

SEQ ID NO: 29966 - DNA, 25 bp, Mus musculus
cttccctgggaccacgcatagctga

SEQ ID NO: 29967 - DNA, 25 bp, Mus musculus
ccctgggaccacgcatagctgatgt

SEQ ID NO: 29968 - DNA, 25 bp, Mus musculus
tgggaccacgcatagctgatgtagc

SEQ ID NO: 29969 - DNA, 25 bp, Mus musculus
gaggccactacacagcctactgtaa

SEQ ID NO: 29970 - DNA, 25 bp, Mus musculus
accacgcatagctgatgtagccaca

SEQ ID NO: 29971 - DNA, 25 bp, Mus musculus
actacacagcctactgtaagaacgc

SEQ ID NO: 29972 - DNA, 25 bp, Mus musculus
acacagcctactgtaagaacgcgtc

SEQ ID NO: 29973 - DNA, 25 bp, Mus musculus
cagcctactgtaagaacgcgtcaag

SEQ ID NO: 29974 - DNA, 25 bp, Mus musculus
cgtcaaggcagcgctggtttaaatg

SEQ ID NO: 29975 - DNA, 25 bp, Mus musculus
atgaccatttagtttcggatatctc

SEQ ID NO: 29976 - DNA, 25 bp, Mus musculus
tagtttcggatatctctgtgtcttc

SEQ ID NO: 29977 - DNA, 25 bp, Mus musculus
cggatatctctgtgtcttcggttag

SEQ ID NO: 29978 - DNA, 25 bp, Mus musculus
cagtggctccattacaccaaggaca

SEQ ID NO: 29979 - DNA, 25 bp, Mus musculus
cgatttgccttcctctcctgccaat

SEQ ID NO: 29980 - DNA, 25 bp, Mus musculus
caggaccatagcacagagcaacctc

SEQ ID NO: 29981 - DNA, 25 bp, Mus musculus
cacaccttgaatctatcccacagca

SEQ ID NO: 29982 - DNA, 25 bp, Mus musculus
cacagcatatcaacccacagtgacc

SEQ ID NO: 29983 - DNA, 25 bp, Mus musculus
gcaacctgaatttcccaatggcacc

SEQ ID NO: 29984 - DNA, 25 bp, Mus musculus
tcccaatggcacctattgctttgaa

SEQ ID NO: 29985 - DNA, 25 bp, Mus musculus
ctattgctttgaaactctgatgagt

SEQ ID NO: 29986 - DNA, 25 bp, Mus musculus
agccccatgctcagatccactgggc

SEQ ID NO: 29987 - DNA, 25 bp, Mus musculus
ggactccttgcaggagacatgggca

SEQ ID NO: 29988 - DNA, 25 bp, Mus musculus
tttccatgccttttgtggagtacag

SEQ ID NO: 29989 - DNA, 25 bp, Mus musculus
tgccttttgtggagtacagacatat

SEQ ID NO: 29990 - DNA, 25 bp, Mus musculus
ctctcctgccaatcacaagtgcctt

SEQ ID NO: 29991 - DNA, 25 bp, Mus musculus
tgccaatcacaagtgccttactctg

SEQ ID NO: 29992 - DNA, 25 bp, Mus musculus
gaccagacccatgacaaaacctctg

SEQ ID NO: 29993 - DNA, 25 bp, Mus musculus
acctctgtcatccaagagagccaac

SEQ ID NO: 29994 - DNA, 25 bp, Mus musculus
gtcatccaagagagccaactctcta

SEQ ID NO: 29995 - DNA, 25 bp, Mus musculus
acttcaagccaatgtggtaactgct

SEQ ID NO: 29996 - DNA, 25 bp, Mus musculus
tccaaccttcaccaggaccatagca

SEQ ID NO: 29997 - DNA, 25 bp, Mus musculus
cttcaccaggaccatagcacagagc

SEQ ID NO: 29998 - DNA, 25 bp, Mus musculus
ccaaccacacggagcagcaagcact

SEQ ID NO: 29999 - DNA, 25 bp, Mus musculus
caaccacacggagcagcaagcacta

SEQ ID NO: 30000 - DNA, 25 bp, Mus musculus
gagccccgagaatgccagagctcag

SEQ ID NO: 30001 - DNA, 25 bp, Mus musculus
agccccgagaatgccagagctcagc

SEQ ID NO: 30002 - DNA, 25 bp, Mus musculus
agaatgccagagctcagccagcaga

SEQ ID NO: 30003 - DNA, 25 bp, Mus musculus
gaatgccagagctcagccagcagat

SEQ ID NO: 30004 - DNA, 25 bp, Mus musculus
aatgccagagctcagccagcagatg

SEQ ID NO: 30005 - DNA, 25 bp, Mus musculus
tgccagagctcagccagcagatgta

SEQ ID NO: 30006 - DNA, 25 bp, Mus musculus
gccagagctcagccagcagatgtat

SEQ ID NO: 30007 - DNA, 25 bp, Mus musculus
agagctcagccagcagatgtatgct

SEQ ID NO: 30008 - DNA, 25 bp, Mus musculus
agctcagccagcagatgtatgctga

SEQ ID NO: 30009 - DNA, 25 bp, Mus musculus
ctcagccagcagatgtatgctgaca

SEQ ID NO: 30010 - DNA, 25 bp, Mus musculus
aaccacacggagcagcaagcactaa

SEQ ID NO: 30011 - DNA, 25 bp, Mus musculus
ccacacggagcagcaagcactaacg

SEQ ID NO: 30012 - DNA, 25 bp, Mus musculus
cacacggagcagcaagcactaacga

SEQ ID NO: 30013 - DNA, 25 bp, Mus musculus
agcagcaagcactaacgagccccga

SEQ ID NO: 30014 - DNA, 25 bp, Mus musculus
gcagcaagcactaacgagccccgag

SEQ ID NO: 30015 - DNA, 25 bp, Mus musculus
cagcaagcactaacgagccccgaga

SEQ ID NO: 30016 - DNA, 25 bp, Mus musculus
gcaagcactaacgagccccgagaat

SEQ ID NO: 30017 - DNA, 25 bp, Mus musculus
taacgagccccgagaatgccagagc

SEQ ID NO: 30018 - DNA, 25 bp, Mus musculus
gcatatccacgggcaaccaggcgag

SEQ ID NO: 30019 - DNA, 25 bp, Mus musculus
tctggtgcaaccggcttgctatgaa

SEQ ID NO: 30020 - DNA, 25 bp, Mus musculus
cccgcatgaggtgtatgctgaatga

SEQ ID NO: 30021 - DNA, 25 bp, Mus musculus
acaacgtgctaagcctggctaagag

SEQ ID NO: 30022 - DNA, 25 bp, Mus musculus
aggtgatccttcgatggagccaaga

SEQ ID NO: 30023 - DNA, 25 bp, Mus musculus
agtttagcactttggctataggcca

SEQ ID NO: 30024 - DNA, 25 bp, Mus musculus
gcactttggctataggccagtttgg

SEQ ID NO: 30025 - DNA, 25 bp, Mus musculus
accttgctccatcgctctcagacta

SEQ ID NO: 30026 - DNA, 25 bp, Mus musculus
cgctctcagactacatctgtcagtt

SEQ ID NO: 30027 - DNA, 25 bp, Mus musculus
cagactacatctgtcagttggcttc

SEQ ID NO: 30028 - DNA, 25 bp, Mus musculus
acatctgtcagttggcttccaggcc

SEQ ID NO: 30029 - DNA, 25 bp, Mus musculus
acagtcccagagaggtgcatgatgg

SEQ ID NO: 30030 - DNA, 25 bp, Mus musculus
gcaaccggcttgctatgaagggctg

SEQ ID NO: 30031 - DNA, 25 bp, Mus musculus
gagctccgagtgccttgaagattac

SEQ ID NO: 30032 - DNA, 25 bp, Mus musculus
atgaccgagtctccaactggctcaa

SEQ ID NO: 30033 - DNA, 25 bp, Mus musculus
gagtctccaactggctcaaagctga

SEQ ID NO: 30034 - DNA, 25 bp, Mus musculus
ggctcaaagctgagttccttagctt

SEQ ID NO: 30035 - DNA, 25 bp, Mus musculus
ccttcaaaagccagcagtgcctgct

SEQ ID NO: 30036 - DNA, 25 bp, Mus musculus
aaagccagcagtgcctgctgagaaa

SEQ ID NO: 30037 - DNA, 25 bp, Mus musculus
agcagtgcctgctgagaaaccagaa

SEQ ID NO: 30038 - DNA, 25 bp, Mus musculus
agatgtcccgcatgaggtgtatgct

SEQ ID NO: 30039 - DNA, 25 bp, Mus musculus
tcgcgcttcaggccatgcttttcac

SEQ ID NO: 30040 - DNA, 25 bp, Mus musculus
gcgcttcaggccatgcttttcacat

SEQ ID NO: 30041 - DNA, 25 bp, Mus musculus
catgattcgcagccctcggtctaag

SEQ ID NO: 30042 - DNA, 25 bp, Mus musculus
attcgcagccctcggtctaagagaa

SEQ ID NO: 30043 - DNA, 25 bp, Mus musculus
tcgcagccctcggtctaagagaatc

SEQ ID NO: 30044 - DNA, 25 bp, Mus musculus
gcagccctcggtctaagagaatctg

SEQ ID NO: 30045 - DNA, 25 bp, Mus musculus
agccctcggtctaagagaatctgtg

SEQ ID NO: 30046 - DNA, 25 bp, Mus musculus
agacgcattctcatgagtgctgagg

SEQ ID NO: 30047 - DNA, 25 bp, Mus musculus
acgcattctcatgagtgctgaggtc

SEQ ID NO: 30048 - DNA, 25 bp, Mus musculus
gcattctcatgagtgctgaggtctt

SEQ ID NO: 30049 - DNA, 25 bp, Mus musculus
attctcatgagtgctgaggtcttag

SEQ ID NO: 30050 - DNA, 25 bp, Mus musculus
tctcatgagtgctgaggtcttagag

SEQ ID NO: 30051 - DNA, 25 bp, Mus musculus
gcttcaggccatgcttttcacatga

SEQ ID NO: 30052 - DNA, 25 bp, Mus musculus
caggccatgcttttcacatgattcg

SEQ ID NO: 30053 - DNA, 25 bp, Mus musculus
ggccatgcttttcacatgattcgca

SEQ ID NO: 30054 - DNA, 25 bp, Mus musculus
ccatgcttttcacatgattcgcagc

SEQ ID NO: 30055 - DNA, 25 bp, Mus musculus
atgcttttcacatgattcgcagccc

SEQ ID NO: 30056 - DNA, 25 bp, Mus musculus
gcttttcacatgattcgcagccctc

SEQ ID NO: 30057 - DNA, 25 bp, Mus musculus
ttttcacatgattcgcagccctcgg

SEQ ID NO: 30058 - DNA, 25 bp, Mus musculus
cacatgattcgcagccctcggtcta

SEQ ID NO: 30059 - DNA, 25 bp, Mus musculus
ctgcttctgacccaagatggcctcg

SEQ ID NO: 30060 - DNA, 25 bp, Mus musculus
ctgacccaagatggcctcgtgacta

SEQ ID NO: 30061 - DNA, 25 bp, Mus musculus
ggcacatgtctcaagcccatgggga

SEQ ID NO: 30062 - DNA, 25 bp, Mus musculus
aagcccatggggagcatagcagtcc

SEQ ID NO: 30063 - DNA, 25 bp, Mus musculus
ttttaccgaagacatgcatactcca

SEQ ID NO: 30064 - DNA, 25 bp, Mus musculus
catgcatactccatcgatgttgtat

SEQ ID NO: 30065 - DNA, 25 bp, Mus musculus
tactccatcgatgttgtattcacag

SEQ ID NO: 30066 - DNA, 25 bp, Mus musculus
gttgtattcacagtggctgaggaat

SEQ ID NO: 30067 - DNA, 25 bp, Mus musculus
ttcacagtggctgaggaattcttgt

SEQ ID NO: 30068 - DNA, 25 bp, Mus musculus
tacgcagtttctttggcttcacgtt

SEQ ID NO: 30069 - DNA, 25 bp, Mus musculus
ttggcttcacgttgccgattaaaag

SEQ ID NO: 30070 - DNA, 25 bp, Mus musculus
tcacgttgccgattaaaagaccgtg

SEQ ID NO: 30071 - DNA, 25 bp, Mus musculus
caagatggcctcgtgactagacctg

SEQ ID NO: 30072 - DNA, 25 bp, Mus musculus
cacttcagattttactgtttaccat

SEQ ID NO: 30073 - DNA, 25 bp, Mus musculus
agattttactgtttaccatgagcca

SEQ ID NO: 30074 - DNA, 25 bp, Mus musculus
tactgtttaccatgagccatgggtt

SEQ ID NO: 30075 - DNA, 25 bp, Mus musculus
tttgtgtggtcgcccctgaagtctg

SEQ ID NO: 30076 - DNA, 25 bp, Mus musculus
ttgagcaagccatggccctccagct

SEQ ID NO: 30077 - DNA, 25 bp, Mus musculus
agcaggtcctgcccatcgggcacat

SEQ ID NO: 30078 - DNA, 25 bp, Mus musculus
ccatcgggcacatgtctcaagccca

SEQ ID NO: 30079 - DNA, 25 bp, Mus musculus
cagagagcccagagatccccaacgc

SEQ ID NO: 30080 - DNA, 25 bp, Mus musculus
gagagcccagagatccccaacgccg

SEQ ID NO: 30081 - DNA, 25 bp, Mus musculus
taagtggcagcccggatgacctcac

SEQ ID NO: 30082 - DNA, 25 bp, Mus musculus
ggcagcccggatgacctcacatagg

SEQ ID NO: 30083 - DNA, 25 bp, Mus musculus
gcagcccggatgacctcacataggc

SEQ ID NO: 30084 - DNA, 25 bp, Mus musculus
agcccggatgacctcacataggcgg

SEQ ID NO: 30085 - DNA, 25 bp, Mus musculus
gatgacctcacataggcggcgccac

SEQ ID NO: 30086 - DNA, 25 bp, Mus musculus
atgacctcacataggcggcgccacc

SEQ ID NO: 30087 - DNA, 25 bp, Mus musculus
ctcacataggcggcgccaccgctgg

SEQ ID NO: 30088 - DNA, 25 bp, Mus musculus
gcgccaccgctgggaacaagaagga

SEQ ID NO: 30089 - DNA, 25 bp, Mus musculus
cgccaccgctgggaacaagaaggat

SEQ ID NO: 30090 - DNA, 25 bp, Mus musculus
ccaccgctgggaacaagaaggatat

SEQ ID NO: 30091 - DNA, 25 bp, Mus musculus
gccgccgaactagatcacaacacac

SEQ ID NO: 30092 - DNA, 25 bp, Mus musculus
acaacacacccggaaggagccacag

SEQ ID NO: 30093 - DNA, 25 bp, Mus musculus
acgccaggcccggatccacaggcaa

SEQ ID NO: 30094 - DNA, 25 bp, Mus musculus
cgccaggcccggatccacaggcaaa

SEQ ID NO: 30095 - DNA, 25 bp, Mus musculus
caggcccggatccacaggcaaaggc

SEQ ID NO: 30096 - DNA, 25 bp, Mus musculus
ggcccggatccacaggcaaaggcgc

SEQ ID NO: 30097 - DNA, 25 bp, Mus musculus
gatccacaggcaaaggcgcgagtaa

SEQ ID NO: 30098 - DNA, 25 bp, Mus musculus
ccacaggcaaaggcgcgagtaagtg

SEQ ID NO: 30099 - DNA, 25 bp, Mus musculus
tagtttttctggtggactgtgcgga

SEQ ID NO: 30100 - DNA, 25 bp, Mus musculus
tttttctggtggactgtgcggatca

SEQ ID NO: 30101 - DNA, 25 bp, Mus musculus
ccaacgtgccaattcttatcttggg

SEQ ID NO: 30102 - DNA, 25 bp, Mus musculus
tgccaattcttatcttgggaaacaa

SEQ ID NO: 30103 - DNA, 25 bp, Mus musculus
aagtattcatgtgcagtgtgctcaa

SEQ ID NO: 30104 - DNA, 25 bp, Mus musculus
tattcatgtgcagtgtgctcaagag

SEQ ID NO: 30105 - DNA, 25 bp, Mus musculus
tcatgtgcagtgtgctcaagaggca

SEQ ID NO: 30106 - DNA, 25 bp, Mus musculus
tgtgcagtgtgctcaagaggcaagg

SEQ ID NO: 30107 - DNA, 25 bp, Mus musculus
tccgctggctttcccagtatattga

SEQ ID NO: 30108 - DNA, 25 bp, Mus musculus
gctggctttcccagtatattgactg

SEQ ID NO: 30109 - DNA, 25 bp, Mus musculus
ggctttcccagtatattgactgatg

SEQ ID NO: 30110 - DNA, 25 bp, Mus musculus
tttcccagtatattgactgatgttt

SEQ ID NO: 30111 - DNA, 25 bp, Mus musculus
actgtgcggatcattctcgtctcat

SEQ ID NO: 30112 - DNA, 25 bp, Mus musculus
cggatcattctcgtctcatggaatc

SEQ ID NO: 30113 - DNA, 25 bp, Mus musculus
atcattctcgtctcatggaatccaa

SEQ ID NO: 30114 - DNA, 25 bp, Mus musculus
attctcgtctcatggaatccaaagt

SEQ ID NO: 30115 - DNA, 25 bp, Mus musculus
ctcgtctcatggaatccaaagttga

SEQ ID NO: 30116 - DNA, 25 bp, Mus musculus
atgaaacaatatccaacgtgccaat

SEQ ID NO: 30117 - DNA, 25 bp, Mus musculus
caatatccaacgtgccaattcttat

SEQ ID NO: 30118 - DNA, 25 bp, Mus musculus
tatccaacgtgccaattcttatctt

SEQ ID NO: 30119 - DNA, 25 bp, Mus musculus
ctgcaatgcttccaggagcaagaaa

SEQ ID NO: 30120 - DNA, 25 bp, Mus musculus
agccagcaacagttctgaaacctgg

SEQ ID NO: 30121 - DNA, 25 bp, Mus musculus
tcccaaaacttatgtcaaatatgag

SEQ ID NO: 30122 - DNA, 25 bp, Mus musculus
ctcttttccagcagcatagatttga

SEQ ID NO: 30123 - DNA, 25 bp, Mus musculus
aacctctactgccatggaaccgaat

SEQ ID NO: 30124 - DNA, 25 bp, Mus musculus
tgatccaaaaccaaaatgcagcctt

SEQ ID NO: 30125 - DNA, 25 bp, Mus musculus
cagcctttcagccaaatcagtacca

SEQ ID NO: 30126 - DNA, 25 bp, Mus musculus
ttcagccaaatcagtaccagatgct

SEQ ID NO: 30127 - DNA, 25 bp, Mus musculus
caaatcagtaccagatgctaggagg

SEQ ID NO: 30128 - DNA, 25 bp, Mus musculus
agtaccagatgctaggaggacctgg

SEQ ID NO: 30129 - DNA, 25 bp, Mus musculus
gaggctatccacccagacgtgacga

SEQ ID NO: 30130 - DNA, 25 bp, Mus musculus
atccacccagacgtgacgatcaccg

SEQ ID NO: 30131 - DNA, 25 bp, Mus musculus
caacagttctgaaacctggtgactg

SEQ ID NO: 30132 - DNA, 25 bp, Mus musculus
aaagcagcatactgcgcactgttaa

SEQ ID NO: 30133 - DNA, 25 bp, Mus musculus
taggccatgttacaccaagaggctc

SEQ ID NO: 30134 - DNA, 25 bp, Mus musculus
caccaagaggctcggggacgagtgt

SEQ ID NO: 30135 - DNA, 25 bp, Mus musculus
cgaacactgcactactacctgccaa

SEQ ID NO: 30136 - DNA, 25 bp, Mus musculus
ctgcactactacctgccaattacca

SEQ ID NO: 30137 - DNA, 25 bp, Mus musculus
acaggccactgctgagaggtcaagc

SEQ ID NO: 30138 - DNA, 25 bp, Mus musculus
gtcaagctcagatcccaaaacttat

SEQ ID NO: 30139 - DNA, 25 bp, Mus musculus
ctcagatcccaaaacttatgtcaaa

SEQ ID NO: 30140 - DNA, 25 bp, Mus musculus
gagcagcctccaaaggctcctcctt

SEQ ID NO: 30141 - DNA, 25 bp, Mus musculus
aaggctcctccttagctgcatccag

SEQ ID NO: 30142 - DNA, 25 bp, Mus musculus
tttacagccacttcaaccactgatg

SEQ ID NO: 30143 - DNA, 25 bp, Mus musculus
gccacttcaaccactgatggtcatt

SEQ ID NO: 30144 - DNA, 25 bp, Mus musculus
tcaaccactgatggtcattaaaagt

SEQ ID NO: 30145 - DNA, 25 bp, Mus musculus
tcctttttcactaactgaaccagca

SEQ ID NO: 30146 - DNA, 25 bp, Mus musculus
ttcactaactgaaccagcaggtctt

SEQ ID NO: 30147 - DNA, 25 bp, Mus musculus
accagcaggtcttagggctggagac

SEQ ID NO: 30148 - DNA, 25 bp, Mus musculus
gttacaaagacacactgagtctatt

SEQ ID NO: 30149 - DNA, 25 bp, Mus musculus
gtatccatttctaatgtttactata

SEQ ID NO: 30150 - DNA, 25 bp, Mus musculus
ttgtacctgtgtcatctcactttgt

SEQ ID NO: 30151 - DNA, 25 bp, Mus musculus
ctgtgtcatctcactttgtaaataa

SEQ ID NO: 30152 - DNA, 25 bp, Mus musculus
tctccactcttgagagcagcaaggc

SEQ ID NO: 30153 - DNA, 25 bp, Mus musculus
ccaagcaagcagcaccgtgaagctt

SEQ ID NO: 30154 - DNA, 25 bp, Mus musculus
aagcagcaccgtgaagcttagtccc

SEQ ID NO: 30155 - DNA, 25 bp, Mus musculus
gaagcttagtccctcctgcttgaag

SEQ ID NO: 30156 - DNA, 25 bp, Mus musculus
ctcctgcttgaaggacaggcgttcc

SEQ ID NO: 30157 - DNA, 25 bp, Mus musculus
ccgtcagatacggacgtcaagatgc

SEQ ID NO: 30158 - DNA, 25 bp, Mus musculus
gacgtcaagatgctctcttttacag

SEQ ID NO: 30159 - DNA, 25 bp, Mus musculus
ctctcttttacagccacttcaacca

SEQ ID NO: 30160 - DNA, 25 bp, Mus musculus
tgcctatagagtgtgcctggaggtg

SEQ ID NO: 30161 - DNA, 25 bp, Mus musculus
gccagctctgccttctctgatggga

SEQ ID NO: 30162 - DNA, 25 bp, Mus musculus
tagttcttcatgttacggcacctca

SEQ ID NO: 30163 - DNA, 25 bp, Mus musculus
ttcatgttacggcacctcaagcttt

SEQ ID NO: 30164 - DNA, 25 bp, Mus musculus
cacctcaagctttgctttatgttgg

SEQ ID NO: 30165 - DNA, 25 bp, Mus musculus
aagctttgctttatgttggtcatta

SEQ ID NO: 30166 - DNA, 25 bp, Mus musculus
tgcctgtgcacagtagtgcctgtgc

SEQ ID NO: 30167 - DNA, 25 bp, Mus musculus
tgcacagtagtgcctgtgctctggg

SEQ ID NO: 30168 - DNA, 25 bp, Mus musculus
cctgtgctctgggtgtgtctctaag

SEQ ID NO: 30169 - DNA, 25 bp, Mus musculus
ttagaaatactccagcgtccagtgt

SEQ ID NO: 30170 - DNA, 25 bp, Mus musculus
atactccagcgtccagtgtttgcct

SEQ ID NO: 30171 - DNA, 25 bp, Mus musculus
cagcgtccagtgtttgcctttgtct

SEQ ID NO: 30172 - DNA, 25 bp, Mus musculus
tctgccttctctgatgggagcagag

SEQ ID NO: 30173 - DNA, 25 bp, Mus musculus
gaattgcccacaagggtccatactg

SEQ ID NO: 30174 - DNA, 25 bp, Mus musculus
cccacaagggtccatactgtcctgg

SEQ ID NO: 30175 - DNA, 25 bp, Mus musculus
gaatcctgtctgcctggagcagaag

SEQ ID NO: 30176 - DNA, 25 bp, Mus musculus
tgtctgcctggagcagaagccactg

SEQ ID NO: 30177 - DNA, 25 bp, Mus musculus
gacttctgcgagtgtggctcccctg

SEQ ID NO: 30178 - DNA, 25 bp, Mus musculus
ccacacctcctgtttacatagacta

SEQ ID NO: 30179 - DNA, 25 bp, Mus musculus
ctcctgtttacatagactagtttgg

SEQ ID NO: 30180 - DNA, 25 bp, Mus musculus
attaaagctgtcaatctcttccctg

SEQ ID NO: 30181 - DNA, 25 bp, Mus musculus
aaagctgtcaatctcttccctgctg

SEQ ID NO: 30182 - DNA, 25 bp, Mus musculus
gacagtgcagcaccatcagaacggt

SEQ ID NO: 30183 - DNA, 25 bp, Mus musculus
gcagcaccatcagaacggtttgaag

SEQ ID NO: 30184 - DNA, 25 bp, Mus musculus
tttgaaggtccctgcatagattcca

SEQ ID NO: 30185 - DNA, 25 bp, Mus musculus
ccagtaaatactcctgaacgatggg

SEQ ID NO: 30186 - DNA, 25 bp, Mus musculus
atagccgaagctgttcctggcagga

SEQ ID NO: 30187 - DNA, 25 bp, Mus musculus
aaagctgctcaggagcaagtgctga

SEQ ID NO: 30188 - DNA, 25 bp, Mus musculus
taatgcaggcaatcctggttgtgtg

SEQ ID NO: 30189 - DNA, 25 bp, Mus musculus
aggcaatcctggttgtgtgtgcact

SEQ ID NO: 30190 - DNA, 25 bp, Mus musculus
caatcctggttgtgtgtgcactttt

SEQ ID NO: 30191 - DNA, 25 bp, Mus musculus
tcctggttgtgtgtgcacttttata

SEQ ID NO: 30192 - DNA, 25 bp, Mus musculus
atgaacatacattcttcttctggcg

SEQ ID NO: 30193 - DNA, 25 bp, Mus musculus
atacattcttcttctggcgtcaaaa

SEQ ID NO: 30194 - DNA, 25 bp, Mus musculus
cattcttcttctggcgtcaaaagaa

SEQ ID NO: 30195 - DNA, 25 bp, Mus musculus
tcttcttctggcgtcaaaagaactg

SEQ ID NO: 30196 - DNA, 25 bp, Mus musculus
aaacttgaccctcatcaaaaagatg

SEQ ID NO: 30197 - DNA, 25 bp, Mus musculus
gaccctcatcaaaaagatgacatta

SEQ ID NO: 30198 - DNA, 25 bp, Mus musculus
gcctctcaggctgacagtgcagcac

SEQ ID NO: 30199 - DNA, 25 bp, Mus musculus
gctgacagtgcagcaccatcagaac

SEQ ID NO: 30200 - DNA, 25 bp, Mus musculus
tttcgtgtgcatcgtcaccgaacgt

SEQ ID NO: 30201 - DNA, 25 bp, Mus musculus
ttcgtgtgcatcgtcaccgaacgtg

SEQ ID NO: 30202 - DNA, 25 bp, Mus musculus
ggcctcgcaatgaggcgaaaactga

SEQ ID NO: 30203 - DNA, 25 bp, Mus musculus
ctgacgtaaacgtacactcagctag

SEQ ID NO: 30204 - DNA, 25 bp, Mus musculus
gacgtaaacgtacactcagctagtc

SEQ ID NO: 30205 - DNA, 25 bp, Mus musculus
acgtaaacgtacactcagctagtcg

SEQ ID NO: 30206 - DNA, 25 bp, Mus musculus
cgtaaacgtacactcagctagtcga

SEQ ID NO: 30207 - DNA, 25 bp, Mus musculus
gtaaacgtacactcagctagtcgat

SEQ ID NO: 30208 - DNA, 25 bp, Mus musculus
ttcccctgcaagcagtttgggaggc

SEQ ID NO: 30209 - DNA, 25 bp, Mus musculus
tcccctgcaagcagtttgggaggca

SEQ ID NO: 30210 - DNA, 25 bp, Mus musculus
cccctgcaagcagtttgggaggcat

SEQ ID NO: 30211 - DNA, 25 bp, Mus musculus
ccctgcaagcagtttgggaggcatg

SEQ ID NO: 30212 - DNA, 25 bp, Mus musculus
cgtgtgcatcgtcaccgaacgtggc

SEQ ID NO: 30213 - DNA, 25 bp, Mus musculus
gtgtgcatcgtcaccgaacgtggcc

SEQ ID NO: 30214 - DNA, 25 bp, Mus musculus
tgtgcatcgtcaccgaacgtggcct

SEQ ID NO: 30215 - DNA, 25 bp, Mus musculus
gtgcatcgtcaccgaacgtggcctc

SEQ ID NO: 30216 - DNA, 25 bp, Mus musculus
atcgtcaccgaacgtggcctcgcaa

SEQ ID NO: 30217 - DNA, 25 bp, Mus musculus
tcgtcaccgaacgtggcctcgcaat

SEQ ID NO: 30218 - DNA, 25 bp, Mus musculus
tcaccgaacgtggcctcgcaatgag

SEQ ID NO: 30219 - DNA, 25 bp, Mus musculus
tggcctcgcaatgaggcgaaaactg

SEQ ID NO: 30220 - DNA, 25 bp, Mus musculus
cccctgaagccagcaaggctttcat

SEQ ID NO: 30221 - DNA, 25 bp, Mus musculus
tgaagccagcaaggctttcataagg

SEQ ID NO: 30222 - DNA, 25 bp, Mus musculus
aagtgttagatccctcacagggatg

SEQ ID NO: 30223 - DNA, 25 bp, Mus musculus
gttagatccctcacagggatgacca

SEQ ID NO: 30224 - DNA, 25 bp, Mus musculus
tccctcacagggatgaccagtctac

SEQ ID NO: 30225 - DNA, 25 bp, Mus musculus
gaccagtctacgatggtcatccttg

SEQ ID NO: 30226 - DNA, 25 bp, Mus musculus
ccagtctacgatggtcatccttgct

SEQ ID NO: 30227 - DNA, 25 bp, Mus musculus
agtctacgatggtcatccttgcttc

SEQ ID NO: 30228 - DNA, 25 bp, Mus musculus
tctacgatggtcatccttgcttctg

SEQ ID NO: 30229 - DNA, 25 bp, Mus musculus
cgatggtcatccttgcttctgaatt

SEQ ID NO: 30230 - DNA, 25 bp, Mus musculus
atggtcatccttgcttctgaattgg

SEQ ID NO: 30231 - DNA, 25 bp, Mus musculus
atgaaacacagtgtggcctggcttc

SEQ ID NO: 30232 - DNA, 25 bp, Mus musculus
ctttcataaggctgtgctgatcatc

SEQ ID NO: 30233 - DNA, 25 bp, Mus musculus
gaaacacagtgtggcctggcttcgt

SEQ ID NO: 30234 - DNA, 25 bp, Mus musculus
ctttgaagccgttcctgatgtctat

SEQ ID NO: 30235 - DNA, 25 bp, Mus musculus
ttgaagccgttcctgatgtctatgc

SEQ ID NO: 30236 - DNA, 25 bp, Mus musculus
gaagccgttcctgatgtctatgctc

SEQ ID NO: 30237 - DNA, 25 bp, Mus musculus
agccgttcctgatgtctatgctccc

SEQ ID NO: 30238 - DNA, 25 bp, Mus musculus
gttcctgatgtctatgctccctatt

SEQ ID NO: 30239 - DNA, 25 bp, Mus musculus
tcctgatgtctatgctccctattct

SEQ ID NO: 30240 - DNA, 25 bp, Mus musculus
ctgatgtctatgctccctattctgc

SEQ ID NO: 30241 - DNA, 25 bp, Mus musculus
cagacttagaagctcctcagactat

SEQ ID NO: 30242 - DNA, 25 bp, Mus musculus
agacttagaagctcctcagactatg

SEQ ID NO: 30243 - DNA, 25 bp, Mus musculus
attacactgagtatgcgctcctcct

SEQ ID NO: 30244 - DNA, 25 bp, Mus musculus
ttacactgagtatgcgctcctcctc

SEQ ID NO: 30245 - DNA, 25 bp, Mus musculus
tacactgagtatgcgctcctcctct

SEQ ID NO: 30246 - DNA, 25 bp, Mus musculus
acactgagtatgcgctcctcctctt

SEQ ID NO: 30247 - DNA, 25 bp, Mus musculus
cactgagtatgcgctcctcctcttg

SEQ ID NO: 30248 - DNA, 25 bp, Mus musculus
actgagtatgcgctcctcctcttga

SEQ ID NO: 30249 - DNA, 25 bp, Mus musculus
ctgagtatgcgctcctcctcttgag

SEQ ID NO: 30250 - DNA, 25 bp, Mus musculus
tgagtatgcgctcctcctcttgagc

SEQ ID NO: 30251 - DNA, 25 bp, Mus musculus
gagtatgcgctcctcctcttgagct

SEQ ID NO: 30252 - DNA, 25 bp, Mus musculus
agtatgcgctcctcctcttgagctc

SEQ ID NO: 30253 - DNA, 25 bp, Mus musculus
gacttagaagctcctcagactatgc

SEQ ID NO: 30254 - DNA, 25 bp, Mus musculus
cttagaagctcctcagactatgccg

SEQ ID NO: 30255 - DNA, 25 bp, Mus musculus
ttagaagctcctcagactatgccga

SEQ ID NO: 30256 - DNA, 25 bp, Mus musculus
tagaagctcctcagactatgccgat

SEQ ID NO: 30257 - DNA, 25 bp, Mus musculus
actcttgttgttgatgtgtgagctt

SEQ ID NO: 30258 - DNA, 25 bp, Mus musculus
tgtgagcttctagaacgtgggaatt

SEQ ID NO: 30259 - DNA, 25 bp, Mus musculus
tgagcttctagaacgtgggaattac

SEQ ID NO: 30260 - DNA, 25 bp, Mus musculus
aattacactgagtatgcgctcctcc

SEQ ID NO: 30261 - DNA, 25 bp, Mus musculus
ccatgaaactacattcaatgtccat

SEQ ID NO: 30262 - DNA, 25 bp, Mus musculus
catgaaactacattcaatgtccatc

SEQ ID NO: 30263 - DNA, 25 bp, Mus musculus
tcaatgtccatcagggattgtgacg

SEQ ID NO: 30264 - DNA, 25 bp, Mus musculus
aatgtccatcagggattgtgacgtt

SEQ ID NO: 30265 - DNA, 25 bp, Mus musculus
atgtccatcagggattgtgacgttg

SEQ ID NO: 30266 - DNA, 25 bp, Mus musculus
tgtccatcagggattgtgacgttga

SEQ ID NO: 30267 - DNA, 25 bp, Mus musculus
tggtagcacatgtacgcagtcattg

SEQ ID NO: 30268 - DNA, 25 bp, Mus musculus
cacatgtacgcagtcattgctgaca

SEQ ID NO: 30269 - DNA, 25 bp, Mus musculus
actctgtggtgatcggtggctccgt

SEQ ID NO: 30270 - DNA, 25 bp, Mus musculus
tctgtggtgatcggtggctccgtgc

SEQ ID NO: 30271 - DNA, 25 bp, Mus musculus
ttctatcagatgtggatcggcaatg

SEQ ID NO: 30272 - DNA, 25 bp, Mus musculus
tctatcagatgtggatcggcaatga

SEQ ID NO: 30273 - DNA, 25 bp, Mus musculus
gaaactacattcaatgtccatcagg

SEQ ID NO: 30274 - DNA, 25 bp, Mus musculus
aaactacattcaatgtccatcaggg

SEQ ID NO: 30275 - DNA, 25 bp, Mus musculus
aactacattcaatgtccatcaggga

SEQ ID NO: 30276 - DNA, 25 bp, Mus musculus
ctacattcaatgtccatcagggatt

SEQ ID NO: 30277 - DNA, 25 bp, Mus musculus
tacattcaatgtccatcagggattg

SEQ ID NO: 30278 - DNA, 25 bp, Mus musculus
acattcaatgtccatcagggattgt

SEQ ID NO: 30279 - DNA, 25 bp, Mus musculus
attcaatgtccatcagggattgtga

SEQ ID NO: 30280 - DNA, 25 bp, Mus musculus
ttcaatgtccatcagggattgtgac

SEQ ID NO: 30281 - DNA, 25 bp, Mus musculus
actataatcctagtgccagcatgta

SEQ ID NO: 30282 - DNA, 25 bp, Mus musculus
ataatcctagtgccagcatgtacgt

SEQ ID NO: 30283 - DNA, 25 bp, Mus musculus
atgctcactatggggcacaagtcgg

SEQ ID NO: 30284 - DNA, 25 bp, Mus musculus
cacaagtcggctctgccatttgctc

SEQ ID NO: 30285 - DNA, 25 bp, Mus musculus
tcggctctgccatttgctccgagag

SEQ ID NO: 30286 - DNA, 25 bp, Mus musculus
gctctgccatttgctccgagagttc

SEQ ID NO: 30287 - DNA, 25 bp, Mus musculus
ctgccatttgctccgagagttccaa

SEQ ID NO: 30288 - DNA, 25 bp, Mus musculus
gttccaagtacatcctctcaagtgg

SEQ ID NO: 30289 - DNA, 25 bp, Mus musculus
agtacatcctctcaagtggaacata

SEQ ID NO: 30290 - DNA, 25 bp, Mus musculus
tcctctcaagtggaacatactctgt

SEQ ID NO: 30291 - DNA, 25 bp, Mus musculus
gaacatactctgtagcgaaactctg

SEQ ID NO: 30292 - DNA, 25 bp, Mus musculus
actctgtagcgaaactctggtagat

SEQ ID NO: 30293 - DNA, 25 bp, Mus musculus
atcctagtgccagcatgtacgtcac

SEQ ID NO: 30294 - DNA, 25 bp, Mus musculus
ccagcatgtacgtcactggcagcaa

SEQ ID NO: 30295 - DNA, 25 bp, Mus musculus
gcatgtacgtcactggcagcaagga

SEQ ID NO: 30296 - DNA, 25 bp, Mus musculus
acgtcactggcagcaaggacggctg

SEQ ID NO: 30297 - DNA, 25 bp, Mus musculus
atgtcgtctccagccgctggatcac

SEQ ID NO: 30298 - DNA, 25 bp, Mus musculus
gctggatcacagcctttgacaatgc

SEQ ID NO: 30299 - DNA, 25 bp, Mus musculus
tcacagcctttgacaatgctcacta

SEQ ID NO: 30300 - DNA, 25 bp, Mus musculus
cctttgacaatgctcactatggggc

SEQ ID NO: 30301 - DNA, 25 bp, Mus musculus
cgtccgcgggctagtagccaacatg

SEQ ID NO: 30302 - DNA, 25 bp, Mus musculus
ggctagtagccaacatgcagctctt

SEQ ID NO: 30303 - DNA, 25 bp, Mus musculus
ccaacatgcagctctttgtccgcgc

SEQ ID NO: 30304 - DNA, 25 bp, Mus musculus
caacatgcagctctttgtccgcgcc

SEQ ID NO: 30305 - DNA, 25 bp, Mus musculus
acacaccctcgaggtgaccggccag

SEQ ID NO: 30306 - DNA, 25 bp, Mus musculus
cacaccctcgaggtgaccggccagg

SEQ ID NO: 30307 - DNA, 25 bp, Mus musculus
cctcgaggtgaccggccaggagacg

SEQ ID NO: 30308 - DNA, 25 bp, Mus musculus
taggccagtgtggcgtagaggccct

SEQ ID NO: 30309 - DNA, 25 bp, Mus musculus
gctagtagccaacatgcagctcttt

SEQ ID NO: 30310 - DNA, 25 bp, Mus musculus
ctagtagccaacatgcagctctttg

SEQ ID NO: 30311 - DNA, 25 bp, Mus musculus
tagtagccaacatgcagctctttgt

SEQ ID NO: 30312 - DNA, 25 bp, Mus musculus
agtagccaacatgcagctctttgtc

SEQ ID NO: 30313 - DNA, 25 bp, Mus musculus
gtagccaacatgcagctctttgtcc

SEQ ID NO: 30314 - DNA, 25 bp, Mus musculus
tagccaacatgcagctctttgtccg

SEQ ID NO: 30315 - DNA, 25 bp, Mus musculus
agccaacatgcagctctttgtccgc

SEQ ID NO: 30316 - DNA, 25 bp, Mus musculus
gccaacatgcagctctttgtccgcg

SEQ ID NO: 30317 - DNA, 25 bp, Mus musculus
atctcatcaacatactactggcaca

SEQ ID NO: 30318 - DNA, 25 bp, Mus musculus
tcatcaacatactactggcacaagt

SEQ ID NO: 30319 - DNA, 25 bp, Mus musculus
tatgacactgaacataccctgatat

SEQ ID NO: 30320 - DNA, 25 bp, Mus musculus
gacactgaacataccctgatatcaa

SEQ ID NO: 30321 - DNA, 25 bp, Mus musculus
actgaacataccctgatatcaaagt

SEQ ID NO: 30322 - DNA, 25 bp, Mus musculus
gaacataccctgatatcaaagtgca

SEQ ID NO: 30323 - DNA, 25 bp, Mus musculus
cataccctgatatcaaagtgcacca

SEQ ID NO: 30324 - DNA, 25 bp, Mus musculus
atatcaaagtgcaccaaacggtgcc

SEQ ID NO: 30325 - DNA, 25 bp, Mus musculus
tcaaagtgcaccaaacggtgccagt

SEQ ID NO: 30326 - DNA, 25 bp, Mus musculus
aagtgcaccaaacggtgccagtgtc

SEQ ID NO: 30327 - DNA, 25 bp, Mus musculus
tgcaccaaacggtgccagtgtcgaa

SEQ ID NO: 30328 - DNA, 25 bp, Mus musculus
cggtgccagtgtcgaacaagaatgg

SEQ ID NO: 30329 - DNA, 25 bp, Mus musculus
acatactactggcacaagtctcttg

SEQ ID NO: 30330 - DNA, 25 bp, Mus musculus
gatataccacgaaacaaccaagcta

SEQ ID NO: 30331 - DNA, 25 bp, Mus musculus
tactactggcacaagtctcttggag

SEQ ID NO: 30332 - DNA, 25 bp, Mus musculus
tactggcacaagtctcttggagctg

SEQ ID NO: 30333 - DNA, 25 bp, Mus musculus
aagtctcttggagctgggccaattg

SEQ ID NO: 30334 - DNA, 25 bp, Mus musculus
tctcttggagctgggccaattgaac

SEQ ID NO: 30335 - DNA, 25 bp, Mus musculus
ataataccttatgacactgaacata

SEQ ID NO: 30336 - DNA, 25 bp, Mus musculus
ataccttatgacactgaacataccc

SEQ ID NO: 30337 - DNA, 25 bp, Mus musculus
ccttatgacactgaacataccctga

SEQ ID NO: 30338 - DNA, 25 bp, Mus musculus
cgccgcttgctgcagacgtgaacaa

SEQ ID NO: 30339 - DNA, 25 bp, Mus musculus
gttctacgaaatcacggacgatgac

SEQ ID NO: 30340 - DNA, 25 bp, Mus musculus
ttcaagctgtttgcgacaaagttcc

SEQ ID NO: 30341 - DNA, 25 bp, Mus musculus
ggatcatcaaatcacagaataatac

SEQ ID NO: 30342 - DNA, 25 bp, Mus musculus
aataccagaatcatatgccgggatg

SEQ ID NO: 30343 - DNA, 25 bp, Mus musculus
taccagaatcatatgccgggatggt

SEQ ID NO: 30344 - DNA, 25 bp, Mus musculus
agaatcatatgccgggatggtgaat

SEQ ID NO: 30345 - DNA, 25 bp, Mus musculus
aatcatatgccgggatggtgaatta

SEQ ID NO: 30346 - DNA, 25 bp, Mus musculus
tcatatgccgggatggtgaattaac

SEQ ID NO: 30347 - DNA, 25 bp, Mus musculus
atatgccgggatggtgaattaacga

SEQ ID NO: 30348 - DNA, 25 bp, Mus musculus
tgaattaacgagccgtgaaggaact

SEQ ID NO: 30349 - DNA, 25 bp, Mus musculus
ttaacgagccgtgaaggaactagcg

SEQ ID NO: 30350 - DNA, 25 bp, Mus musculus
tacgaaatcacggacgatgacgaac

SEQ ID NO: 30351 - DNA, 25 bp, Mus musculus
gacgatgacgaaccctagggagacg

SEQ ID NO: 30352 - DNA, 25 bp, Mus musculus
ggagacgtctccttcaagctgtttg

SEQ ID NO: 30353 - DNA, 25 bp, Mus musculus
agacgtctccttcaagctgtttgcg

SEQ ID NO: 30354 - DNA, 25 bp, Mus musculus
acgtctccttcaagctgtttgcgac

SEQ ID NO: 30355 - DNA, 25 bp, Mus musculus
gtctccttcaagctgtttgcgacaa

SEQ ID NO: 30356 - DNA, 25 bp, Mus musculus
ctccttcaagctgtttgcgacaaag

SEQ ID NO: 30357 - DNA, 25 bp, Mus musculus
ccttcaagctgtttgcgacaaagtt

SEQ ID NO: 30358 - DNA, 25 bp, Mus musculus
accatcaaggcagtgtctgttgctg

SEQ ID NO: 30359 - DNA, 25 bp, Mus musculus
aaggcagtgtctgttgctgtggtga

SEQ ID NO: 30360 - DNA, 25 bp, Mus musculus
gcagccgccacacagttaggactaa

SEQ ID NO: 30361 - DNA, 25 bp, Mus musculus
agtcactgcctggtccatctacaca

SEQ ID NO: 30362 - DNA, 25 bp, Mus musculus
tgcctggtccatctacacaagaact

SEQ ID NO: 30363 - DNA, 25 bp, Mus musculus
tgtatccctcagtatacaataggcc

SEQ ID NO: 30364 - DNA, 25 bp, Mus musculus
ctagactcagctatgcaattcctga

SEQ ID NO: 30365 - DNA, 25 bp, Mus musculus
atgcaattcctgacggcccagaggt

SEQ ID NO: 30366 - DNA, 25 bp, Mus musculus
cagaggttgcccctgactttggctg

SEQ ID NO: 30367 - DNA, 25 bp, Mus musculus
ctgactttggctggagcctcctatg

SEQ ID NO: 30368 - DNA, 25 bp, Mus musculus
gtcctgggcacagaatctaacagct

SEQ ID NO: 30369 - DNA, 25 bp, Mus musculus
gaatctaacagctgacaagccccct

SEQ ID NO: 30370 - DNA, 25 bp, Mus musculus
cagtaccgaggagcttgtctgcctg

SEQ ID NO: 30371 - DNA, 25 bp, Mus musculus
ctgcctgtccagggatttggacatt

SEQ ID NO: 30372 - DNA, 25 bp, Mus musculus
ccatcgtcagaagacccgactgtcc

SEQ ID NO: 30373 - DNA, 25 bp, Mus musculus
cccccaagcctcagagtgactgtga

SEQ ID NO: 30374 - DNA, 25 bp, Mus musculus
ctgtctccagagctgttccagcaac

SEQ ID NO: 30375 - DNA, 25 bp, Mus musculus
ccagagctgttccagcaacaagccc

SEQ ID NO: 30376 - DNA, 25 bp, Mus musculus
ctgttccagcaacaagcccaggagg

SEQ ID NO: 30377 - DNA, 25 bp, Mus musculus
cagcaacaagcccaggaggcagccg

SEQ ID NO: 30378 - DNA, 25 bp, Mus musculus
ctacttcctgatggagcgtgtgttc

SEQ ID NO: 30379 - DNA, 25 bp, Mus musculus
ttcctgatggagcgtgtgttccaaa

SEQ ID NO: 30380 - DNA, 25 bp, Mus musculus
catggcaacgctgcctgattggcta

SEQ ID NO: 30381 - DNA, 25 bp, Mus musculus
tggcaacgctgcctgattggctacg

SEQ ID NO: 30382 - DNA, 25 bp, Mus musculus
gcaacgctgcctgattggctacggg

SEQ ID NO: 30383 - DNA, 25 bp, Mus musculus
aacgctgcctgattggctacggggt

SEQ ID NO: 30384 - DNA, 25 bp, Mus musculus
ctgcctgattggctacggggtgcca

SEQ ID NO: 30385 - DNA, 25 bp, Mus musculus
gcctgattggctacggggtgccaat

SEQ ID NO: 30386 - DNA, 25 bp, Mus musculus
tgccaatcctcaacgtggacatcaa

SEQ ID NO: 30387 - DNA, 25 bp, Mus musculus
ccaatcctcaacgtggacatcaaca

SEQ ID NO: 30388 - DNA, 25 bp, Mus musculus
aatcctcaacgtggacatcaacatg

SEQ ID NO: 30389 - DNA, 25 bp, Mus musculus
tcctcaacgtggacatcaacatggc

SEQ ID NO: 30390 - DNA, 25 bp, Mus musculus
agcgtgtgttccaaagccaaggcct

SEQ ID NO: 30391 - DNA, 25 bp, Mus musculus
cctcaacgtggacatcaacatggca

SEQ ID NO: 30392 - DNA, 25 bp, Mus musculus
cgtgtgttccaaagccaaggcctga

SEQ ID NO: 30393 - DNA, 25 bp, Mus musculus
tgtgttccaaagccaaggcctgagt

SEQ ID NO: 30394 - DNA, 25 bp, Mus musculus
tgttccaaagccaaggcctgagtac

SEQ ID NO: 30395 - DNA, 25 bp, Mus musculus
ccaaagccaaggcctgagtacatgg

SEQ ID NO: 30396 - DNA, 25 bp, Mus musculus
aaagccaaggcctgagtacatggca

SEQ ID NO: 30397 - DNA, 25 bp, Mus musculus
agccaaggcctgagtacatggcaac

SEQ ID NO: 30398 - DNA, 25 bp, Mus musculus
agtacatggcaacgctgcctgattg

SEQ ID NO: 30399 - DNA, 25 bp, Mus musculus
gtgcaaatacgacggctgtgggaaa

SEQ ID NO: 30400 - DNA, 25 bp, Mus musculus
gaaactctatacaacagctcatcac

SEQ ID NO: 30401 - DNA, 25 bp, Mus musculus
ccggccttaccagtgtgagcattca

SEQ ID NO: 30402 - DNA, 25 bp, Mus musculus
gccttaccagtgtgagcattcaggc

SEQ ID NO: 30403 - DNA, 25 bp, Mus musculus
ttaccagtgtgagcattcaggctgt

SEQ ID NO: 30404 - DNA, 25 bp, Mus musculus
tgagcattcaggctgtgggaaagca

SEQ ID NO: 30405 - DNA, 25 bp, Mus musculus
gcattcaggctgtgggaaagcattt

SEQ ID NO: 30406 - DNA, 25 bp, Mus musculus
aagtcatttcagaactcatactgga

SEQ ID NO: 30407 - DNA, 25 bp, Mus musculus
tcatttcagaactcatactggagaa

SEQ ID NO: 30408 - DNA, 25 bp, Mus musculus
aaagccatatcggtgttcagaagat

SEQ ID NO: 30409 - DNA, 25 bp, Mus musculus
gtctttcaaaacttcaggagatcaa

SEQ ID NO: 30410 - DNA, 25 bp, Mus musculus
tcaacagaaggcacatcagaaccca

SEQ ID NO: 30411 - DNA, 25 bp, Mus musculus
actctatacaacagctcatcacctt

SEQ ID NO: 30412 - DNA, 25 bp, Mus musculus
tacaacagctcatcaccttaaggtc

SEQ ID NO: 30413 - DNA, 25 bp, Mus musculus
aacagctcatcaccttaaggtccat

SEQ ID NO: 30414 - DNA, 25 bp, Mus musculus
agctcatcaccttaaggtccatgag

SEQ ID NO: 30415 - DNA, 25 bp, Mus musculus
ccttaaggtccatgagcgctcacac

SEQ ID NO: 30416 - DNA, 25 bp, Mus musculus
ccatgagcgctcacacacaggagac

SEQ ID NO: 30417 - DNA, 25 bp, Mus musculus
gcgctcacacacaggagaccggcct

SEQ ID NO: 30418 - DNA, 25 bp, Mus musculus
acacacaggagaccggccttaccag

SEQ ID NO: 30419 - DNA, 25 bp, Mus musculus
caggttattcttgacgccatttcaa

SEQ ID NO: 30420 - DNA, 25 bp, Mus musculus
attcttgacgccatttcaaatatct

SEQ ID NO: 30421 - DNA, 25 bp, Mus musculus
gccttccaagttcaggatggagctc

SEQ ID NO: 30422 - DNA, 25 bp, Mus musculus
aacttctaatgtccagctaaggcac

SEQ ID NO: 30423 - DNA, 25 bp, Mus musculus
tgttagctatgtgctgtgctattct

SEQ ID NO: 30424 - DNA, 25 bp, Mus musculus
gctgtgctattctgtgttctcatag

SEQ ID NO: 30425 - DNA, 25 bp, Mus musculus
tcttactgtttctctactaagaact

SEQ ID NO: 30426 - DNA, 25 bp, Mus musculus
actgtacatactctatgaagctgtc

SEQ ID NO: 30427 - DNA, 25 bp, Mus musculus
catactctatgaagctgtcctctga

SEQ ID NO: 30428 - DNA, 25 bp, Mus musculus
ctatgaagctgtcctctgaatttat

SEQ ID NO: 30429 - DNA, 25 bp, Mus musculus
atttcgtaccctgtcatgtcctgta

SEQ ID NO: 30430 - DNA, 25 bp, Mus musculus
taccctgtcatgtcctgtaaataaa

SEQ ID NO: 30431 - DNA, 25 bp, Mus musculus
gacgccatttcaaatatctttcagg

SEQ ID NO: 30432 - DNA, 25 bp, Mus musculus
atttcaaatatctttcaggctgcag

SEQ ID NO: 30433 - DNA, 25 bp, Mus musculus
aatatctttcaggctgcagagaaac

SEQ ID NO: 30434 - DNA, 25 bp, Mus musculus
gtatacaaggcctcattgaacttaa

SEQ ID NO: 30435 - DNA, 25 bp, Mus musculus
aaggcctcattgaacttaattgaga

SEQ ID NO: 30436 - DNA, 25 bp, Mus musculus
ccagaaactacctctgaaggcttcg

SEQ ID NO: 30437 - DNA, 25 bp, Mus musculus
tctgaaggcttcgccttccaagttc

SEQ ID NO: 30438 - DNA, 25 bp, Mus musculus
ggcttcgccttccaagttcaggatg

SEQ ID NO: 30439 - DNA, 25 bp, Mus musculus
gagtcatccaatgaactgcttccag

SEQ ID NO: 30440 - DNA, 25 bp, Mus musculus
gtcatccaatgaactgcttccaggc

SEQ ID NO: 30441 - DNA, 25 bp, Mus musculus
ctatgagctccgtgctgtcgatgtc

SEQ ID NO: 30442 - DNA, 25 bp, Mus musculus
tgagctccgtgctgtcgatgtcgag

SEQ ID NO: 30443 - DNA, 25 bp, Mus musculus
gtgctgtcgatgtcgagtgtctgca

SEQ ID NO: 30444 - DNA, 25 bp, Mus musculus
ctgtcgatgtcgagtgtctgcaacc

SEQ ID NO: 30445 - DNA, 25 bp, Mus musculus
tgtcgatgtcgagtgtctgcaacct

SEQ ID NO: 30446 - DNA, 25 bp, Mus musculus
tgtcgagtgtctgcaacctgtgctg

SEQ ID NO: 30447 - DNA, 25 bp, Mus musculus
tcgagtgtctgcaacctgtgctgga

SEQ ID NO: 30448 - DNA, 25 bp, Mus musculus
cgagtgtctgcaacctgtgctggat

SEQ ID NO: 30449 - DNA, 25 bp, Mus musculus
ggatgctctcgaccttcatgcgctg

SEQ ID NO: 30450 - DNA, 25 bp, Mus musculus
gaccttcatgcgctgtgtcacagac

SEQ ID NO: 30451 - DNA, 25 bp, Mus musculus
tcatccaatgaactgcttccaggct

SEQ ID NO: 30452 - DNA, 25 bp, Mus musculus
atccaatgaactgcttccaggctta

SEQ ID NO: 30453 - DNA, 25 bp, Mus musculus
tccaatgaactgcttccaggcttac

SEQ ID NO: 30454 - DNA, 25 bp, Mus musculus
caatgaactgcttccaggcttacga

SEQ ID NO: 30455 - DNA, 25 bp, Mus musculus
cgagttcccggccatcagcatcgct

SEQ ID NO: 30456 - DNA, 25 bp, Mus musculus
agttcccggccatcagcatcgctca

SEQ ID NO: 30457 - DNA, 25 bp, Mus musculus
gttcccggccatcagcatcgctcag

SEQ ID NO: 30458 - DNA, 25 bp, Mus musculus
tctatgagctccgtgctgtcgatgt

SEQ ID NO: 30459 - DNA, 25 bp, Mus musculus
ctctcgatcacggctctgtgcgaat

SEQ ID NO: 30460 - DNA, 25 bp, Mus musculus
tcgatcacggctctgtgcgaatcac

SEQ ID NO: 30461 - DNA, 25 bp, Mus musculus
agtcttggattcatgccgtacctgg

SEQ ID NO: 30462 - DNA, 25 bp, Mus musculus
cttggattcatgccgtacctggccc

SEQ ID NO: 30463 - DNA, 25 bp, Mus musculus
ggattcatgccgtacctggcccaga

SEQ ID NO: 30464 - DNA, 25 bp, Mus musculus
ttcatgccgtacctggcccagatat

SEQ ID NO: 30465 - DNA, 25 bp, Mus musculus
atgccgtacctggcccagatatggt

SEQ ID NO: 30466 - DNA, 25 bp, Mus musculus
ggcgactgctgcatgaccttggatc

SEQ ID NO: 30467 - DNA, 25 bp, Mus musculus
gactgctgcatgaccttggatcagg

SEQ ID NO: 30468 - DNA, 25 bp, Mus musculus
tgctgcatgaccttggatcaggaaa

SEQ ID NO: 30469 - DNA, 25 bp, Mus musculus
tgcatgaccttggatcaggaaatag

SEQ ID NO: 30470 - DNA, 25 bp, Mus musculus
atagtggaacccattcctgaaactg

SEQ ID NO: 30471 - DNA, 25 bp, Mus musculus
acggctctgtgcgaatcactgttat

SEQ ID NO: 30472 - DNA, 25 bp, Mus musculus
tgcgaatcactgttatcagtagccg

SEQ ID NO: 30473 - DNA, 25 bp, Mus musculus
tcactgttatcagtagccgcacaaa

SEQ ID NO: 30474 - DNA, 25 bp, Mus musculus
gtagccgcacaaacaccagtaatcc

SEQ ID NO: 30475 - DNA, 25 bp, Mus musculus
gccgcacaaacaccagtaatccatc

SEQ ID NO: 30476 - DNA, 25 bp, Mus musculus
tgtctcctggaagtttagtgggtat

SEQ ID NO: 30477 - DNA, 25 bp, Mus musculus
actaccgtcgcaagtcttggattca

SEQ ID NO: 30478 - DNA, 25 bp, Mus musculus
accgtcgcaagtcttggattcatgc

SEQ ID NO: 30479 - DNA, 25 bp, Mus musculus
ccagcttcatgccagcatatgtaga

SEQ ID NO: 30480 - DNA, 25 bp, Mus musculus
tcatgccagcatatgtagatttgag

SEQ ID NO: 30481 - DNA, 25 bp, Mus musculus
gtaagagtgccctccttcataaata

SEQ ID NO: 30482 - DNA, 25 bp, Mus musculus
ctttctaagcagtatggaggaagac

SEQ ID NO: 30483 - DNA, 25 bp, Mus musculus
tgtttccacaatgtcattcccttga

SEQ ID NO: 30484 - DNA, 25 bp, Mus musculus
cacaatgtcattcccttgacacagt

SEQ ID NO: 30485 - DNA, 25 bp, Mus musculus
gtcattcccttgacacagttgggtt

SEQ ID NO: 30486 - DNA, 25 bp, Mus musculus
cccttgacacagttgggttctcata

SEQ ID NO: 30487 - DNA, 25 bp, Mus musculus
aagtatcctagttcatgtacatccg

SEQ ID NO: 30488 - DNA, 25 bp, Mus musculus
cctagttcatgtacatccgaatgct

SEQ ID NO: 30489 - DNA, 25 bp, Mus musculus
tcatgtacatccgaatgctaactaa

SEQ ID NO: 30490 - DNA, 25 bp, Mus musculus
acatccgaatgctaactaatactgt

SEQ ID NO: 30491 - DNA, 25 bp, Mus musculus
catatcccatgtgcacaagctcacc

SEQ ID NO: 30492 - DNA, 25 bp, Mus musculus
ccatgtgcacaagctcacctttcca

SEQ ID NO: 30493 - DNA, 25 bp, Mus musculus
gcacaagctcacctttccagaacca

SEQ ID NO: 30494 - DNA, 25 bp, Mus musculus
agaaccagctgggcgcagaagaaag

SEQ ID NO: 30495 - DNA, 25 bp, Mus musculus
ctaaaacaagtagccttctagtcat

SEQ ID NO: 30496 - DNA, 25 bp, Mus musculus
tttattcacttcagctgagctgctg

SEQ ID NO: 30497 - DNA, 25 bp, Mus musculus
cacttcagctgagctgctgtttcct

SEQ ID NO: 30498 - DNA, 25 bp, Mus musculus
agctgagctgctgtttccttcatgt

SEQ ID NO: 30499 - DNA, 25 bp, Mus musculus
catgctggctgtggtgaaatgcctc

SEQ ID NO: 30500 - DNA, 25 bp, Mus musculus
cttctttgctgaaaggctcaacaag

SEQ ID NO: 30501 - DNA, 25 bp, Mus musculus
gcttgacctgctggatatccgagca

SEQ ID NO: 30502 - DNA, 25 bp, Mus musculus
cggcaagtcactgtaccacgatatc

SEQ ID NO: 30503 - DNA, 25 bp, Mus musculus
caagtcactgtaccacgatatcacg

SEQ ID NO: 30504 - DNA, 25 bp, Mus musculus
gtcactgtaccacgatatcacggga

SEQ ID NO: 30505 - DNA, 25 bp, Mus musculus
actgtaccacgatatcacgggagat

SEQ ID NO: 30506 - DNA, 25 bp, Mus musculus
gtaccacgatatcacgggagatact

SEQ ID NO: 30507 - DNA, 25 bp, Mus musculus
agatacttctggagactatcgaaag

SEQ ID NO: 30508 - DNA, 25 bp, Mus musculus
tacttctggagactatcgaaagatt

SEQ ID NO: 30509 - DNA, 25 bp, Mus musculus
aacgactgagctgtggcagtggctc

SEQ ID NO: 30510 - DNA, 25 bp, Mus musculus
acgactgagctgtggcagtggctca

SEQ ID NO: 30511 - DNA, 25 bp, Mus musculus
aaggctcaacaaggctatgagggga

SEQ ID NO: 30512 - DNA, 25 bp, Mus musculus
ccggaccctgattcgcatcatggtg

SEQ ID NO: 30513 - DNA, 25 bp, Mus musculus
gattcgcatcatggtgtctcgcagc

SEQ ID NO: 30514 - DNA, 25 bp, Mus musculus
tcgcatcatggtgtctcgcagcgag

SEQ ID NO: 30515 - DNA, 25 bp, Mus musculus
ggtgtctcgcagcgagcttgacctg

SEQ ID NO: 30516 - DNA, 25 bp, Mus musculus
gtctcgcagcgagcttgacctgctg

SEQ ID NO: 30517 - DNA, 25 bp, Mus musculus
cagcgagcttgacctgctggatatc

SEQ ID NO: 30518 - DNA, 25 bp, Mus musculus
cgagcttgacctgctggatatccga

SEQ ID NO: 30519 - DNA, 25 bp, Mus musculus
cagcttatcttttcctatttcaaat

SEQ ID NO: 30520 - DNA, 25 bp, Mus musculus
tgggtttcttccttgttgacagttg

SEQ ID NO: 30521 - DNA, 25 bp, Mus musculus
tgtaaaaatgcactttctttctcca

SEQ ID NO: 30522 - DNA, 25 bp, Mus musculus
ttcagaagtcacgacaacaacaaac

SEQ ID NO: 30523 - DNA, 25 bp, Mus musculus
agtcacgacaacaacaaactcagca

SEQ ID NO: 30524 - DNA, 25 bp, Mus musculus
gacaccatcccttaagaacattgtt

SEQ ID NO: 30525 - DNA, 25 bp, Mus musculus
atcccttaagaacattgttgagtgt

SEQ ID NO: 30526 - DNA, 25 bp, Mus musculus
tctctatggattccgacaggagatt

SEQ ID NO: 30527 - DNA, 25 bp, Mus musculus
ggagattctctgggtcttctttgca

SEQ ID NO: 30528 - DNA, 25 bp, Mus musculus
atttctgttgtcagagtcattttaa

SEQ ID NO: 30529 - DNA, 25 bp, Mus musculus
attttaacctgtgtagctagtggca

SEQ ID NO: 30530 - DNA, 25 bp, Mus musculus
acctgtgtagctagtggcattatat

SEQ ID NO: 30531 - DNA, 25 bp, Mus musculus
tcttccttgttgacagttgggagtt

SEQ ID NO: 30532 - DNA, 25 bp, Mus musculus
tttgagtctgactctgaactctgag

SEQ ID NO: 30533 - DNA, 25 bp, Mus musculus
tctgactctgaactctgagatatct

SEQ ID NO: 30534 - DNA, 25 bp, Mus musculus
gatatcttggtgcctagccttcacg

SEQ ID NO: 30535 - DNA, 25 bp, Mus musculus
ttggtgcctagccttcacgtttatt

SEQ ID NO: 30536 - DNA, 25 bp, Mus musculus
ctgtgtccacctgtgtacaccaaaa

SEQ ID NO: 30537 - DNA, 25 bp, Mus musculus
acagtttctccaagagctataggct

SEQ ID NO: 30538 - DNA, 25 bp, Mus musculus
tctccaagagctataggctgtaaaa

SEQ ID NO: 30539 - DNA, 25 bp, Mus musculus
agagtgcatcgagctcgtcgacacg

SEQ ID NO: 30540 - DNA, 25 bp, Mus musculus
gagtgcatcgagctcgtcgacacga

SEQ ID NO: 30541 - DNA, 25 bp, Mus musculus
tggatagcatgtggcctggtactgt

SEQ ID NO: 30542 - DNA, 25 bp, Mus musculus
gtcccacctgttagaagcgtcagcg

SEQ ID NO: 30543 - DNA, 25 bp, Mus musculus
tcccacctgttagaagcgtcagcgg

SEQ ID NO: 30544 - DNA, 25 bp, Mus musculus
cccacctgttagaagcgtcagcggg

SEQ ID NO: 30545 - DNA, 25 bp, Mus musculus
ccacctgttagaagcgtcagcgggc

SEQ ID NO: 30546 - DNA, 25 bp, Mus musculus
cctgttagaagcgtcagcgggcagc

SEQ ID NO: 30547 - DNA, 25 bp, Mus musculus
ctgttagaagcgtcagcgggcagca

SEQ ID NO: 30548 - DNA, 25 bp, Mus musculus
tagaagcgtcagcgggcagcaaagc

SEQ ID NO: 30549 - DNA, 25 bp, Mus musculus
agaagcgtcagcgggcagcaaagct

SEQ ID NO: 30550 - DNA, 25 bp, Mus musculus
agcgtcagcgggcagcaaagctgta

SEQ ID NO: 30551 - DNA, 25 bp, Mus musculus
agtgcatcgagctcgtcgacacgag

SEQ ID NO: 30552 - DNA, 25 bp, Mus musculus
gcatcgagctcgtcgacacgagttg

SEQ ID NO: 30553 - DNA, 25 bp, Mus musculus
catcgagctcgtcgacacgagttga

SEQ ID NO: 30554 - DNA, 25 bp, Mus musculus
atcgagctcgtcgacacgagttgag

SEQ ID NO: 30555 - DNA, 25 bp, Mus musculus
cgagctcgtcgacacgagttgagat

SEQ ID NO: 30556 - DNA, 25 bp, Mus musculus
gagctcgtcgacacgagttgagatc

SEQ ID NO: 30557 - DNA, 25 bp, Mus musculus
gctcgtcgacacgagttgagatcgt

SEQ ID NO: 30558 - DNA, 25 bp, Mus musculus
tcgtcgacacgagttgagatcgtgg

SEQ ID NO: 30559 - DNA, 25 bp, Mus musculus
tgtcatgcagcatcattgactttgg

SEQ ID NO: 30560 - DNA, 25 bp, Mus musculus
catgcagcatcattgactttggaag

SEQ ID NO: 30561 - DNA, 25 bp, Mus musculus
gcttggcatggcctgaatttgctga

SEQ ID NO: 30562 - DNA, 25 bp, Mus musculus
catggcctgaatttgctgagtagcc

SEQ ID NO: 30563 - DNA, 25 bp, Mus musculus
tcacagtcatgtaacactgtgtata

SEQ ID NO: 30564 - DNA, 25 bp, Mus musculus
tcatgtaacactgtgtatagcttgg

SEQ ID NO: 30565 - DNA, 25 bp, Mus musculus
atttctaacagccactgtatgatca

SEQ ID NO: 30566 - DNA, 25 bp, Mus musculus
tctaacagccactgtatgatcaagg

SEQ ID NO: 30567 - DNA, 25 bp, Mus musculus
aacagccactgtatgatcaaggtca

SEQ ID NO: 30568 - DNA, 25 bp, Mus musculus
agccactgtatgatcaaggtcatta

SEQ ID NO: 30569 - DNA, 25 bp, Mus musculus
tatcacccaagcttatagatcagat

SEQ ID NO: 30570 - DNA, 25 bp, Mus musculus
cacccaagcttatagatcagatagg

SEQ ID NO: 30571 - DNA, 25 bp, Mus musculus
gcagcatcattgactttggaaggaa

SEQ ID NO: 30572 - DNA, 25 bp, Mus musculus
gcatcattgactttggaaggaagca

SEQ ID NO: 30573 - DNA, 25 bp, Mus musculus
gatgcttaagtccgtatgtgtccgt

SEQ ID NO: 30574 - DNA, 25 bp, Mus musculus
gcttaagtccgtatgtgtccgtaga

SEQ ID NO: 30575 - DNA, 25 bp, Mus musculus
taagtccgtatgtgtccgtagacca

SEQ ID NO: 30576 - DNA, 25 bp, Mus musculus
tctgacatagcttggcatggcctga

SEQ ID NO: 30577 - DNA, 25 bp, Mus musculus
gacatagcttggcatggcctgaatt

SEQ ID NO: 30578 - DNA, 25 bp, Mus musculus
atagcttggcatggcctgaatttgc

SEQ ID NO: 30579 - DNA, 25 bp, Mus musculus
cgacctgtggccggatgacagctac

SEQ ID NO: 30580 - DNA, 25 bp, Mus musculus
tgggcacttcaagttccaggatcag

SEQ ID NO: 30581 - DNA, 25 bp, Mus musculus
tgtggcacctttaagagccagagcc

SEQ ID NO: 30582 - DNA, 25 bp, Mus musculus
cagagccctgctggtggaactgagt

SEQ ID NO: 30583 - DNA, 25 bp, Mus musculus
atgggccttgctttataggtgagca

SEQ ID NO: 30584 - DNA, 25 bp, Mus musculus
ttataggtgagcaccgcttactgtc

SEQ ID NO: 30585 - DNA, 25 bp, Mus musculus
gtgagcaccgcttactgtctgctca

SEQ ID NO: 30586 - DNA, 25 bp, Mus musculus
tactgtctgctcacactccggctac

SEQ ID NO: 30587 - DNA, 25 bp, Mus musculus
ctgtgtcagattttccacgatggac

SEQ ID NO: 30588 - DNA, 25 bp, Mus musculus
cagattttccacgatggactgtatc

SEQ ID NO: 30589 - DNA, 25 bp, Mus musculus
gatggactgtatccccagatggatg

SEQ ID NO: 30590 - DNA, 25 bp, Mus musculus
ctgtatccccagatggatgagctga

SEQ ID NO: 30591 - DNA, 25 bp, Mus musculus
gttccaggatcaggacacgatcctc

SEQ ID NO: 30592 - DNA, 25 bp, Mus musculus
gatcctcagttactcgctgcgagag

SEQ ID NO: 30593 - DNA, 25 bp, Mus musculus
cagttactcgctgcgagaggtggac

SEQ ID NO: 30594 - DNA, 25 bp, Mus musculus
cagaagtctggctggttctggccac

SEQ ID NO: 30595 - DNA, 25 bp, Mus musculus
tggccactcaggatgctacacagcc

SEQ ID NO: 30596 - DNA, 25 bp, Mus musculus
ctcaggatgctacacagccgcaagc

SEQ ID NO: 30597 - DNA, 25 bp, Mus musculus
atgctacacagccgcaagctgtcgg

SEQ ID NO: 30598 - DNA, 25 bp, Mus musculus
cacagccgcaagctgtcggaccaag

SEQ ID NO: 30599 - DNA, 25 bp, Mus musculus
agcacagaatcgcactgttcctagg

SEQ ID NO: 30600 - DNA, 25 bp, Mus musculus
acagaatcgcactgttcctaggcca

SEQ ID NO: 30601 - DNA, 25 bp, Mus musculus
gctcgcaatggtcgcactgctggtc

SEQ ID NO: 30602 - DNA, 25 bp, Mus musculus
cgcaatggtcgcactgctggtcacc

SEQ ID NO: 30603 - DNA, 25 bp, Mus musculus
gctggtcaccatctgtagcctggaa

SEQ ID NO: 30604 - DNA, 25 bp, Mus musculus
ggtcaccatctgtagcctggaagga

SEQ ID NO: 30605 - DNA, 25 bp, Mus musculus
tatgcggagcctgttcgctcaatac

SEQ ID NO: 30606 - DNA, 25 bp, Mus musculus
gagcctgttcgctcaatactgtcag

SEQ ID NO: 30607 - DNA, 25 bp, Mus musculus
cgctcaatactgtcagagcaggagt

SEQ ID NO: 30608 - DNA, 25 bp, Mus musculus
tcaatactgtcagagcaggagtgat

SEQ ID NO: 30609 - DNA, 25 bp, Mus musculus
atactgtcagagcaggagtgattag

SEQ ID NO: 30610 - DNA, 25 bp, Mus musculus
caaggccgcgagagatgcagaggca

SEQ ID NO: 30611 - DNA, 25 bp, Mus musculus
tcgcactgttcctaggccatagtct

SEQ ID NO: 30612 - DNA, 25 bp, Mus musculus
gccatagtctgccatcatgaagctg

SEQ ID NO: 30613 - DNA, 25 bp, Mus musculus
atagtctgccatcatgaagctgctc

SEQ ID NO: 30614 - DNA, 25 bp, Mus musculus
gtctgccatcatgaagctgctcgca

SEQ ID NO: 30615 - DNA, 25 bp, Mus musculus
catcatgaagctgctcgcaatggtc

SEQ ID NO: 30616 - DNA, 25 bp, Mus musculus
catgaagctgctcgcaatggtcgca

SEQ ID NO: 30617 - DNA, 25 bp, Mus musculus
gaagctgctcgcaatggtcgcactg

SEQ ID NO: 30618 - DNA, 25 bp, Mus musculus
gctgctcgcaatggtcgcactgctg

SEQ ID NO: 30619 - DNA, 25 bp, Mus musculus
gagtggctttgcttttcttgggcac

SEQ ID NO: 30620 - DNA, 25 bp, Mus musculus
catcagataacaccacattcacaag

SEQ ID NO: 30621 - DNA, 25 bp, Mus musculus
cccaaaaacactcagctgttccgat

SEQ ID NO: 30622 - DNA, 25 bp, Mus musculus
atttcctctctctaaaaatgctagg

SEQ ID NO: 30623 - DNA, 25 bp, Mus musculus
tctctctaaaaatgctaggaggctt

SEQ ID NO: 30624 - DNA, 25 bp, Mus musculus
aatgtatctgcatctaacattctgt

SEQ ID NO: 30625 - DNA, 25 bp, Mus musculus
tctgcatctaacattctgtgtaagc

SEQ ID NO: 30626 - DNA, 25 bp, Mus musculus
attctgtgtaagcggtcgtgtcttt

SEQ ID NO: 30627 - DNA, 25 bp, Mus musculus
tgtaagcggtcgtgtctttgcacag

SEQ ID NO: 30628 - DNA, 25 bp, Mus musculus
tgtctttgcacagttaatgcactcc

SEQ ID NO: 30629 - DNA, 25 bp, Mus musculus
gttaatgcactcctgcattggcaaa

SEQ ID NO: 30630 - DNA, 25 bp, Mus musculus
gcactcctgcattggcaaataaaga

SEQ ID NO: 30631 - DNA, 25 bp, Mus musculus
ccacattcacaagtttagcttcttt

SEQ ID NO: 30632 - DNA, 25 bp, Mus musculus
tcacaagtttagcttctttggtagc

SEQ ID NO: 30633 - DNA, 25 bp, Mus musculus
gtttagcttctttggtagccaatgt

SEQ ID NO: 30634 - DNA, 25 bp, Mus musculus
cttctttggtagccaatgtctgtta

SEQ ID NO: 30635 - DNA, 25 bp, Mus musculus
tacaatcagctgctgttaccttaaa

SEQ ID NO: 30636 - DNA, 25 bp, Mus musculus
cagctgctgttaccttaaaactagg

SEQ ID NO: 30637 - DNA, 25 bp, Mus musculus
acttgagacgacgatgatggcaggt

SEQ ID NO: 30638 - DNA, 25 bp, Mus musculus
tggtgtcccaaaaacactcagctgt

SEQ ID NO: 30639 - DNA, 25 bp, Mus musculus
gctccaaattggcagcggcatcctg

SEQ ID NO: 30640 - DNA, 25 bp, Mus musculus
tccaaattggcagcggcatcctggg

SEQ ID NO: 30641 - DNA, 25 bp, Mus musculus
actgtctcacacgtctcatcgatca

SEQ ID NO: 30642 - DNA, 25 bp, Mus musculus
tcgatcatcgacgccgacggcctgg

SEQ ID NO: 30643 - DNA, 25 bp, Mus musculus
gatcatcgacgccgacggcctggtc

SEQ ID NO: 30644 - DNA, 25 bp, Mus musculus
tcatcgacgccgacggcctggtcta

SEQ ID NO: 30645 - DNA, 25 bp, Mus musculus
atcgacgccgacggcctggtctatg

SEQ ID NO: 30646 - DNA, 25 bp, Mus musculus
acgccgacggcctggtctatgcggt

SEQ ID NO: 30647 - DNA, 25 bp, Mus musculus
cgacggcctggtctatgcggtggaa

SEQ ID NO: 30648 - DNA, 25 bp, Mus musculus
acggcctggtctatgcggtggaatg

SEQ ID NO: 30649 - DNA, 25 bp, Mus musculus
cctggtctatgcggtggaatgctcc

SEQ ID NO: 30650 - DNA, 25 bp, Mus musculus
tggtctatgcggtggaatgctccca

SEQ ID NO: 30651 - DNA, 25 bp, Mus musculus
ggaccagatccacatcaagcccaag

SEQ ID NO: 30652 - DNA, 25 bp, Mus musculus
accagatccacatcaagcccaagtc

SEQ ID NO: 30653 - DNA, 25 bp, Mus musculus
gatccacatcaagcccaagtccaaa

SEQ ID NO: 30654 - DNA, 25 bp, Mus musculus
tccacatcaagcccaagtccaaagt

SEQ ID NO: 30655 - DNA, 25 bp, Mus musculus
cacatcaagcccaagtccaaagtgt

SEQ ID NO: 30656 - DNA, 25 bp, Mus musculus
catcaagcccaagtccaaagtgttg

SEQ ID NO: 30657 - DNA, 25 bp, Mus musculus
tcaagcccaagtccaaagtgttgta

SEQ ID NO: 30658 - DNA, 25 bp, Mus musculus
ccactgtctcacacgtctcatcgat

SEQ ID NO: 30659 - DNA, 25 bp, Mus musculus
gaaaccatctaaaacagccagcaag

SEQ ID NO: 30660 - DNA, 25 bp, Mus musculus
aacatcttttgatcaggattcagat

SEQ ID NO: 30661 - DNA, 25 bp, Mus musculus
ttcttacacatacagttttatgctc

SEQ ID NO: 30662 - DNA, 25 bp, Mus musculus
cttttttactcattgaaatgtcatg

SEQ ID NO: 30663 - DNA, 25 bp, Mus musculus
tgtcatgtgttgtctgattggcttg

SEQ ID NO: 30664 - DNA, 25 bp, Mus musculus
gtgttgtctgattggcttgtagaat

SEQ ID NO: 30665 - DNA, 25 bp, Mus musculus
tagattaccgtgcattagcacagat

SEQ ID NO: 30666 - DNA, 25 bp, Mus musculus
attaccgtgcattagcacagatttt

SEQ ID NO: 30667 - DNA, 25 bp, Mus musculus
accgtgcattagcacagattttaat

SEQ ID NO: 30668 - DNA, 25 bp, Mus musculus
ttgcagactacagatctgctttttg

SEQ ID NO: 30669 - DNA, 25 bp, Mus musculus
cagactacagatctgctttttgaaa

SEQ ID NO: 30670 - DNA, 25 bp, Mus musculus
actacagatctgctttttgaaatga

SEQ ID NO: 30671 - DNA, 25 bp, Mus musculus
atcttttgatcaggattcagatgta

SEQ ID NO: 30672 - DNA, 25 bp, Mus musculus
agatgtagacatcttcccctcagac

SEQ ID NO: 30673 - DNA, 25 bp, Mus musculus
cttcccctcagacttcacttctgaa

SEQ ID NO: 30674 - DNA, 25 bp, Mus musculus
ctcagacttcacttctgaaccaccg

SEQ ID NO: 30675 - DNA, 25 bp, Mus musculus
ttttgcagagtctgatgaagaagaa

SEQ ID NO: 30676 - DNA, 25 bp, Mus musculus
ttaagtgcccaaagagcacgaacat

SEQ ID NO: 30677 - DNA, 25 bp, Mus musculus
agtgcccaaagagcacgaacatttt

SEQ ID NO: 30678 - DNA, 25 bp, Mus musculus
ttgttcttacacatacagttttatg

SEQ ID NO: 30679 - DNA, 25 bp, Mus musculus
aatcagatctgagttcaggaggcac

SEQ ID NO: 30680 - DNA, 25 bp, Mus musculus
atcagatctgagttcaggaggcacc

SEQ ID NO: 30681 - DNA, 25 bp, Mus musculus
ctagtacagccagcgagacgccaag

SEQ ID NO: 30682 - DNA, 25 bp, Mus musculus
tagtacagccagcgagacgccaagg

SEQ ID NO: 30683 - DNA, 25 bp, Mus musculus
agtacagccagcgagacgccaaggg

SEQ ID NO: 30684 - DNA, 25 bp, Mus musculus
gtacagccagcgagacgccaagggt

SEQ ID NO: 30685 - DNA, 25 bp, Mus musculus
gtgactaccgtatgggcacttcggt

SEQ ID NO: 30686 - DNA, 25 bp, Mus musculus
tgactaccgtatgggcacttcggta

SEQ ID NO: 30687 - DNA, 25 bp, Mus musculus
taccgtatgggcacttcggtacctg

SEQ ID NO: 30688 - DNA, 25 bp, Mus musculus
ggcacttcggtacctgtttgcgtgg

SEQ ID NO: 30689 - DNA, 25 bp, Mus musculus
tcagatctgagttcaggaggcacct

SEQ ID NO: 30690 - DNA, 25 bp, Mus musculus
agttcaggaggcacctatggcaagt

SEQ ID NO: 30691 - DNA, 25 bp, Mus musculus
ttcaggaggcacctatggcaagtcc

SEQ ID NO: 30692 - DNA, 25 bp, Mus musculus
caggaggcacctatggcaagtccct

SEQ ID NO: 30693 - DNA, 25 bp, Mus musculus
aggcacctatggcaagtccctgtac

SEQ ID NO: 30694 - DNA, 25 bp, Mus musculus
ggcacctatggcaagtccctgtact

SEQ ID NO: 30695 - DNA, 25 bp, Mus musculus
cacctatggcaagtccctgtactag

SEQ ID NO: 30696 - DNA, 25 bp, Mus musculus
actagtacagccagcgagacgccaa

SEQ ID NO: 30697 - DNA, 25 bp, Mus musculus
aagattctgcgcggtctggcagttg

SEQ ID NO: 30698 - DNA, 25 bp, Mus musculus
ctggcagttggcattgcggtagtga

SEQ ID NO: 30699 - DNA, 25 bp, Mus musculus
agtctcgctgtcgtgagaaggacgc

SEQ ID NO: 30700 - DNA, 25 bp, Mus musculus
tctcgctgtcgtgagaaggacgcaa

SEQ ID NO: 30701 - DNA, 25 bp, Mus musculus
ctcgctgtcgtgagaaggacgcaat

SEQ ID NO: 30702 - DNA, 25 bp, Mus musculus
tagactgtagccatggcttatggtg

SEQ ID NO: 30703 - DNA, 25 bp, Mus musculus
agactgtagccatggcttatggtgg

SEQ ID NO: 30704 - DNA, 25 bp, Mus musculus
actgtagccatggcttatggtggct

SEQ ID NO: 30705 - DNA, 25 bp, Mus musculus
ctgtagccatggcttatggtggctc

SEQ ID NO: 30706 - DNA, 25 bp, Mus musculus
gtagccatggcttatggtggctctg

SEQ ID NO: 30707 - DNA, 25 bp, Mus musculus
tggcttatggtggctctggtaacaa

SEQ ID NO: 30708 - DNA, 25 bp, Mus musculus
atggtggctctggtaacaagcaagc

SEQ ID NO: 30709 - DNA, 25 bp, Mus musculus
tggcagttggcattgcggtagtgat

SEQ ID NO: 30710 - DNA, 25 bp, Mus musculus
gcagttggcattgcggtagtgatgt

SEQ ID NO: 30711 - DNA, 25 bp, Mus musculus
cagttggcattgcggtagtgatgta

SEQ ID NO: 30712 - DNA, 25 bp, Mus musculus
gttggcattgcggtagtgatgtacg

SEQ ID NO: 30713 - DNA, 25 bp, Mus musculus
ttggcattgcggtagtgatgtacgg

SEQ ID NO: 30714 - DNA, 25 bp, Mus musculus
aggctgatgctctcattgagtctcg

SEQ ID NO: 30715 - DNA, 25 bp, Mus musculus
gctgatgctctcattgagtctcgct

SEQ ID NO: 30716 - DNA, 25 bp, Mus musculus
gagtctcgctgtcgtgagaaggacg

SEQ ID NO: 30717 - DNA, 25 bp, Mus musculus
catctttgtgctaggaaggagtatg

SEQ ID NO: 30718 - DNA, 25 bp, Mus musculus
tatgggcttcattgggcactacctt

SEQ ID NO: 30719 - DNA, 25 bp, Mus musculus
tcatcacccctgggatgacatttcc

SEQ ID NO: 30720 - DNA, 25 bp, Mus musculus
tcacccctgggatgacatttcctat

SEQ ID NO: 30721 - DNA, 25 bp, Mus musculus
tgacatttcctatgttcttccagaa

SEQ ID NO: 30722 - DNA, 25 bp, Mus musculus
catttcctatgttcttccagaacac

SEQ ID NO: 30723 - DNA, 25 bp, Mus musculus
ttcctatgttcttccagaacacatg

SEQ ID NO: 30724 - DNA, 25 bp, Mus musculus
tgttcttccagaacacatgagcatg

SEQ ID NO: 30725 - DNA, 25 bp, Mus musculus
tcttccagaacacatgagcatgtaa

SEQ ID NO: 30726 - DNA, 25 bp, Mus musculus
tccagtataggctgggcctggagcg

SEQ ID NO: 30727 - DNA, 25 bp, Mus musculus
tataggctgggcctggagcggaaat

SEQ ID NO: 30728 - DNA, 25 bp, Mus musculus
ataggctgggcctggagcggaaata

SEQ ID NO: 30729 - DNA, 25 bp, Mus musculus
cttcattgggcactaccttgaccag

SEQ ID NO: 30730 - DNA, 25 bp, Mus musculus
cattgggcactaccttgaccagaag

SEQ ID NO: 30731 - DNA, 25 bp, Mus musculus
tgggcactaccttgaccagaagagg

SEQ ID NO: 30732 - DNA, 25 bp, Mus musculus
gcactaccttgaccagaagaggctg

SEQ ID NO: 30733 - DNA, 25 bp, Mus musculus
ctaccttgaccagaagaggctgaag

SEQ ID NO: 30734 - DNA, 25 bp, Mus musculus
agggctgtatcatcacccctgggat

SEQ ID NO: 30735 - DNA, 25 bp, Mus musculus
gctgtatcatcacccctgggatgac

SEQ ID NO: 30736 - DNA, 25 bp, Mus musculus
gtatcatcacccctgggatgacatt

SEQ ID NO: 30737 - DNA, 25 bp, Mus musculus
gatcacgagttcgaggccagccggg

SEQ ID NO: 30738 - DNA, 25 bp, Mus musculus
gcagcagctggttgcagttgccgga

SEQ ID NO: 30739 - DNA, 25 bp, Mus musculus
cccagaggtcacccagcagactgtg

SEQ ID NO: 30740 - DNA, 25 bp, Mus musculus
agaggtcacccagcagactgtggag

SEQ ID NO: 30741 - DNA, 25 bp, Mus musculus
ccagcagactgtggagctcaaggag

SEQ ID NO: 30742 - DNA, 25 bp, Mus musculus
gcttgttgatcagcttgccaaagaa

SEQ ID NO: 30743 - DNA, 25 bp, Mus musculus
tgttgatcagcttgccaaagaagca

SEQ ID NO: 30744 - DNA, 25 bp, Mus musculus
tcagcttgccaaagaagcagagaac

SEQ ID NO: 30745 - DNA, 25 bp, Mus musculus
gaacttgctgaagtccatagcgaag

SEQ ID NO: 30746 - DNA, 25 bp, Mus musculus
cttgctgaagtccatagcgaagcag

SEQ ID NO: 30747 - DNA, 25 bp, Mus musculus
gcagctgcaggccctgatagcagaa

SEQ ID NO: 30748 - DNA, 25 bp, Mus musculus
gctgcaggccctgatagcagaaaag

SEQ ID NO: 30749 - DNA, 25 bp, Mus musculus
gaagcttctaccgacagtcgtcagg

SEQ ID NO: 30750 - DNA, 25 bp, Mus musculus
tctaccgacagtcgtcagggccgca

SEQ ID NO: 30751 - DNA, 25 bp, Mus musculus
agagcgctgccgaggcggctcgtca

SEQ ID NO: 30752 - DNA, 25 bp, Mus musculus
ctgccgaggcggctcgtcagctatg

SEQ ID NO: 30753 - DNA, 25 bp, Mus musculus
cggctcgtcagctatggccaaggac

SEQ ID NO: 30754 - DNA, 25 bp, Mus musculus
ctcgtcagctatggccaaggacatc

SEQ ID NO: 30755 - DNA, 25 bp, Mus musculus
gaacaagctccgagtgttggaccca

SEQ ID NO: 30756 - DNA, 25 bp, Mus musculus
caagctccgagtgttggacccagag

SEQ ID NO: 30757 - DNA, 25 bp, Mus musculus
tacctggatcgcatcaatgtggact

SEQ ID NO: 30758 - DNA, 25 bp, Mus musculus
cctggatcgcatcaatgtggactta

SEQ ID NO: 30759 - DNA, 25 bp, Mus musculus
aatcgactcagtgagcatctctagg

SEQ ID NO: 30760 - DNA, 25 bp, Mus musculus
tcgactcagtgagcatctctagggc

SEQ ID NO: 30761 - DNA, 25 bp, Mus musculus
gactcagtgagcatctctagggccc

SEQ ID NO: 30762 - DNA, 25 bp, Mus musculus
gtgagcatctctagggccctggatg

SEQ ID NO: 30763 - DNA, 25 bp, Mus musculus
ctctagggccctggatgcatgatcc

SEQ ID NO: 30764 - DNA, 25 bp, Mus musculus
ctagggccctggatgcatgatccct

SEQ ID NO: 30765 - DNA, 25 bp, Mus musculus
ccctggatgcatgatccctaagcac

SEQ ID NO: 30766 - DNA, 25 bp, Mus musculus
ggatgcatgatccctaagcaccagg

SEQ ID NO: 30767 - DNA, 25 bp, Mus musculus
gcatgatccctaagcaccaggggct

SEQ ID NO: 30768 - DNA, 25 bp, Mus musculus
atgatccctaagcaccaggggctcc

SEQ ID NO: 30769 - DNA, 25 bp, Mus musculus
gaacttgtacaaacgctcagtggac

SEQ ID NO: 30770 - DNA, 25 bp, Mus musculus
gtacaaacgctcagtggacctgaac

SEQ ID NO: 30771 - DNA, 25 bp, Mus musculus
aaacgctcagtggacctgaacactg

SEQ ID NO: 30772 - DNA, 25 bp, Mus musculus
acgctcagtggacctgaacactgac

SEQ ID NO: 30773 - DNA, 25 bp, Mus musculus
tcagtggacctgaacactgacaaga

SEQ ID NO: 30774 - DNA, 25 bp, Mus musculus
tggacctgaacactgacaagaatat

SEQ ID NO: 30775 - DNA, 25 bp, Mus musculus
gacctgaacactgacaagaatatgt

SEQ ID NO: 30776 - DNA, 25 bp, Mus musculus
cctgaacactgacaagaatatgtga

SEQ ID NO: 30777 - DNA, 25 bp, Mus musculus
ctggcatgtcgtgcctgtggatcct

SEQ ID NO: 30778 - DNA, 25 bp, Mus musculus
cgcgcagcgaatgggtcctgacata

SEQ ID NO: 30779 - DNA, 25 bp, Mus musculus
caaactgtacgcagcctgattactg

SEQ ID NO: 30780 - DNA, 25 bp, Mus musculus
aactgtacgcagcctgattactgcc

SEQ ID NO: 30781 - DNA, 25 bp, Mus musculus
ctgtacgcagcctgattactgccac

SEQ ID NO: 30782 - DNA, 25 bp, Mus musculus
gtacgcagcctgattactgccacat

SEQ ID NO: 30783 - DNA, 25 bp, Mus musculus
gcagcctgattactgccacatgctg

SEQ ID NO: 30784 - DNA, 25 bp, Mus musculus
agcctgattactgccacatgctgca

SEQ ID NO: 30785 - DNA, 25 bp, Mus musculus
cctgattactgccacatgctgcaca

SEQ ID NO: 30786 - DNA, 25 bp, Mus musculus
tgattactgccacatgctgcacagt

SEQ ID NO: 30787 - DNA, 25 bp, Mus musculus
cacccagctagaagacaccttggag

SEQ ID NO: 30788 - DNA, 25 bp, Mus musculus
cccagctagaagacaccttggagac

SEQ ID NO: 30789 - DNA, 25 bp, Mus musculus
gtcctgacatagtgcatctcagctg

SEQ ID NO: 30790 - DNA, 25 bp, Mus musculus
tagaagacaccttggagacgtgtcc

SEQ ID NO: 30791 - DNA, 25 bp, Mus musculus
tgacatagtgcatctcagctgcgag

SEQ ID NO: 30792 - DNA, 25 bp, Mus musculus
acatagtgcatctcagctgcgagga

SEQ ID NO: 30793 - DNA, 25 bp, Mus musculus
agtgcatctcagctgcgaggacaac

SEQ ID NO: 30794 - DNA, 25 bp, Mus musculus
catctcagctgcgaggacaacttcc

SEQ ID NO: 30795 - DNA, 25 bp, Mus musculus
tctcagctgcgaggacaacttccta

SEQ ID NO: 30796 - DNA, 25 bp, Mus musculus
gaggacaacttcctaggacaaactg

SEQ ID NO: 30797 - DNA, 25 bp, Mus musculus
cttcctaggacaaactgtacgcagc

SEQ ID NO: 30798 - DNA, 25 bp, Mus musculus
gtatgctgcatcttctaggagtatg

SEQ ID NO: 30799 - DNA, 25 bp, Mus musculus
gctgcatcttctaggagtatggcat

SEQ ID NO: 30800 - DNA, 25 bp, Mus musculus
aagtatctagcctgggctcttctta

SEQ ID NO: 30801 - DNA, 25 bp, Mus musculus
gtatctagcctgggctcttcttagt

SEQ ID NO: 30802 - DNA, 25 bp, Mus musculus
agcctgggctcttcttagtcatgca

SEQ ID NO: 30803 - DNA, 25 bp, Mus musculus
tgggctcttcttagtcatgcacccc

SEQ ID NO: 30804 - DNA, 25 bp, Mus musculus
cgcatatctgatgtcttgctgatgg

SEQ ID NO: 30805 - DNA, 25 bp, Mus musculus
catatctgatgtcttgctgatggat

SEQ ID NO: 30806 - DNA, 25 bp, Mus musculus
tctgatgtcttgctgatggatgcca

SEQ ID NO: 30807 - DNA, 25 bp, Mus musculus
tgatgtcttgctgatggatgccagg

SEQ ID NO: 30808 - DNA, 25 bp, Mus musculus
gtcttgctgatggatgccaggatac

SEQ ID NO: 30809 - DNA, 25 bp, Mus musculus
cttgctgatggatgccaggatacat

SEQ ID NO: 30810 - DNA, 25 bp, Mus musculus
tgcatcttctaggagtatggcattc

SEQ ID NO: 30811 - DNA, 25 bp, Mus musculus
atggcattcgggtccctcttcccag

SEQ ID NO: 30812 - DNA, 25 bp, Mus musculus
ttcccaggctccactagtggaagaa

SEQ ID NO: 30813 - DNA, 25 bp, Mus musculus
cccaggctccactagtggaagaaca

SEQ ID NO: 30814 - DNA, 25 bp, Mus musculus
tttgggagcccaactgaggagatat

SEQ ID NO: 30815 - DNA, 25 bp, Mus musculus
caactaccccaagtatctagcctgg

SEQ ID NO: 30816 - DNA, 25 bp, Mus musculus
taccccaagtatctagcctgggctc

SEQ ID NO: 30817 - DNA, 25 bp, Mus musculus
ccccaagtatctagcctgggctctt

SEQ ID NO: 30818 - DNA, 25 bp, Mus musculus
acatctgttccctttgggtgtcaat

SEQ ID NO: 30819 - DNA, 25 bp, Mus musculus
caatgtacactgctgattctggtct

SEQ ID NO: 30820 - DNA, 25 bp, Mus musculus
tcagcactcaccaaagaaattgaca

SEQ ID NO: 30821 - DNA, 25 bp, Mus musculus
gcactcaccaaagaaattgacaatc

SEQ ID NO: 30822 - DNA, 25 bp, Mus musculus
attgacaatcagactatttggaagg

SEQ ID NO: 30823 - DNA, 25 bp, Mus musculus
aggccttgtggactgcagaaggcgc

SEQ ID NO: 30824 - DNA, 25 bp, Mus musculus
ctcattgagggtgctgagatgcccg

SEQ ID NO: 30825 - DNA, 25 bp, Mus musculus
gagatgcccgggatggctcacctca

SEQ ID NO: 30826 - DNA, 25 bp, Mus musculus
ttcttttctaggagtgagctatgcc

SEQ ID NO: 30827 - DNA, 25 bp, Mus musculus
gagctatgccagagcagctcacctt

SEQ ID NO: 30828 - DNA, 25 bp, Mus musculus
cagagcagctcaccttgagtttgca

SEQ ID NO: 30829 - DNA, 25 bp, Mus musculus
agcagctcaccttgagtttgcagcc

SEQ ID NO: 30830 - DNA, 25 bp, Mus musculus
tgtacactgctgattctggtctcca

SEQ ID NO: 30831 - DNA, 25 bp, Mus musculus
caccttgagtttgcagccttcgggg

SEQ ID NO: 30832 - DNA, 25 bp, Mus musculus
acactgctgattctggtctccatgc

SEQ ID NO: 30833 - DNA, 25 bp, Mus musculus
ctggtctccatgcactcacggctgg

SEQ ID NO: 30834 - DNA, 25 bp, Mus musculus
tgccctggaattgtttgccttgctg

SEQ ID NO: 30835 - DNA, 25 bp, Mus musculus
attgtttgccttgctgaatagcaaa

SEQ ID NO: 30836 - DNA, 25 bp, Mus musculus
gcacagcacccactttctgtatttt

SEQ ID NO: 30837 - DNA, 25 bp, Mus musculus
gccaagaaggcctgcggatgttttc

SEQ ID NO: 30838 - DNA, 25 bp, Mus musculus
ctggtgtcagcactcaccaaagaaa

SEQ ID NO: 30839 - DNA, 25 bp, Mus musculus
aacagcaagctcgcgcctgaagtca

SEQ ID NO: 30840 - DNA, 25 bp, Mus musculus
acagcaagctcgcgcctgaagtcat

SEQ ID NO: 30841 - DNA, 25 bp, Mus musculus
ctcacacacttcgccagcggacatt

SEQ ID NO: 30842 - DNA, 25 bp, Mus musculus
cacacacttcgccagcggacatttc

SEQ ID NO: 30843 - DNA, 25 bp, Mus musculus
cacttcgccagcggacatttcttaa

SEQ ID NO: 30844 - DNA, 25 bp, Mus musculus
acttcgccagcggacatttcttaat

SEQ ID NO: 30845 - DNA, 25 bp, Mus musculus
cttcgccagcggacatttcttaatc

SEQ ID NO: 30846 - DNA, 25 bp, Mus musculus
tcgccagcggacatttcttaatcgc

SEQ ID NO: 30847 - DNA, 25 bp, Mus musculus
cgccagcggacatttcttaatcgca

SEQ ID NO: 30848 - DNA, 25 bp, Mus musculus
cggacatttcttaatcgcagagtct

SEQ ID NO: 30849 - DNA, 25 bp, Mus musculus
ggacatttcttaatcgcagagtcta

SEQ ID NO: 30850 - DNA, 25 bp, Mus musculus
gacatttcttaatcgcagagtctaa

SEQ ID NO: 30851 - DNA, 25 bp, Mus musculus
cagcaagctcgcgcctgaagtcatg

SEQ ID NO: 30852 - DNA, 25 bp, Mus musculus
acatttcttaatcgcagagtctaag

SEQ ID NO: 30853 - DNA, 25 bp, Mus musculus
gcaagctcgcgcctgaagtcatgca

SEQ ID NO: 30854 - DNA, 25 bp, Mus musculus
caagctcgcgcctgaagtcatgcac

SEQ ID NO: 30855 - DNA, 25 bp, Mus musculus
aagctcgcgcctgaagtcatgcacg

SEQ ID NO: 30856 - DNA, 25 bp, Mus musculus
gctcgcgcctgaagtcatgcacgac

SEQ ID NO: 30857 - DNA, 25 bp, Mus musculus
tcgcgcctgaagtcatgcacgactt

SEQ ID NO: 30858 - DNA, 25 bp, Mus musculus
tacaaaggctctctcacacacttcg

SEQ ID NO: 30859 - DNA, 25 bp, Mus musculus
tctcacacacttcgccagcggacat

SEQ ID NO: 30860 - DNA, 25 bp, Mus musculus
tgaactcaatgctagtacaaattca

SEQ ID NO: 30861 - DNA, 25 bp, Mus musculus
aatacagactcactgagctgcccat

SEQ ID NO: 30862 - DNA, 25 bp, Mus musculus
tagtgactttccttgttatagacta

SEQ ID NO: 30863 - DNA, 25 bp, Mus musculus
ctttccttgttatagactagcgagt

SEQ ID NO: 30864 - DNA, 25 bp, Mus musculus
tagactagcgagtccatagtggaag

SEQ ID NO: 30865 - DNA, 25 bp, Mus musculus
gtattaatctttctctactaataat

SEQ ID NO: 30866 - DNA, 25 bp, Mus musculus
taataatcccaaaatggctcctaag

SEQ ID NO: 30867 - DNA, 25 bp, Mus musculus
tcccaaaatggctcctaaggctcca

SEQ ID NO: 30868 - DNA, 25 bp, Mus musculus
aatggctcctaaggctccagaagct

SEQ ID NO: 30869 - DNA, 25 bp, Mus musculus
tcctaaggctccagaagctggcttc

SEQ ID NO: 30870 - DNA, 25 bp, Mus musculus
ctgaaacatctgctcagtcattata

SEQ ID NO: 30871 - DNA, 25 bp, Mus musculus
catctgctcagtcattatactttat

SEQ ID NO: 30872 - DNA, 25 bp, Mus musculus
gactcactgagctgcccatgtgttt

SEQ ID NO: 30873 - DNA, 25 bp, Mus musculus
tttaattgtgctaccatagaagttc

SEQ ID NO: 30874 - DNA, 25 bp, Mus musculus
tggtcttgaacttgctatgtagcct

SEQ ID NO: 30875 - DNA, 25 bp, Mus musculus
tgacctcctgtgtcccaagtgctag

SEQ ID NO: 30876 - DNA, 25 bp, Mus musculus
cctgtgtcccaagtgctaggatcac

SEQ ID NO: 30877 - DNA, 25 bp, Mus musculus
tcccaagtgctaggatcacagaaga

SEQ ID NO: 30878 - DNA, 25 bp, Mus musculus
cagaagacatctccatgcctggcca

SEQ ID NO: 30879 - DNA, 25 bp, Mus musculus
acatctccatgcctggccaagattt

SEQ ID NO: 30880 - DNA, 25 bp, Mus musculus
ggggaactcccagctcagcagcact

SEQ ID NO: 30881 - DNA, 25 bp, Mus musculus
gggaactcccagctcagcagcactg

SEQ ID NO: 30882 - DNA, 25 bp, Mus musculus
gctcagcagcactgaagtcatcatg

SEQ ID NO: 30883 - DNA, 25 bp, Mus musculus
ctcagcagcactgaagtcatcatga

SEQ ID NO: 30884 - DNA, 25 bp, Mus musculus
tcagcagcactgaagtcatcatgat

SEQ ID NO: 30885 - DNA, 25 bp, Mus musculus
gcagcactgaagtcatcatgatcat

SEQ ID NO: 30886 - DNA, 25 bp, Mus musculus
tcatgatcatcttcaccttgaagtt

SEQ ID NO: 30887 - DNA, 25 bp, Mus musculus
catgatcatcttcaccttgaagttc

SEQ ID NO: 30888 - DNA, 25 bp, Mus musculus
tcatcttcaccttgaagttctttgg

SEQ ID NO: 30889 - DNA, 25 bp, Mus musculus
catcttcaccttgaagttctttggg

SEQ ID NO: 30890 - DNA, 25 bp, Mus musculus
atggcccagtaagaaccgggcgctg

SEQ ID NO: 30891 - DNA, 25 bp, Mus musculus
tttgtccctgtggtccgctgtgccc

SEQ ID NO: 30892 - DNA, 25 bp, Mus musculus
aactcccagctcagcagcactgaag

SEQ ID NO: 30893 - DNA, 25 bp, Mus musculus
actcccagctcagcagcactgaagt

SEQ ID NO: 30894 - DNA, 25 bp, Mus musculus
ctcccagctcagcagcactgaagtc

SEQ ID NO: 30895 - DNA, 25 bp, Mus musculus
tcccagctcagcagcactgaagtca

SEQ ID NO: 30896 - DNA, 25 bp, Mus musculus
cccagctcagcagcactgaagtcat

SEQ ID NO: 30897 - DNA, 25 bp, Mus musculus
ccagctcagcagcactgaagtcatc

SEQ ID NO: 30898 - DNA, 25 bp, Mus musculus
cagctcagcagcactgaagtcatca

SEQ ID NO: 30899 - DNA, 25 bp, Mus musculus
agctcagcagcactgaagtcatcat

SEQ ID NO: 30900 - DNA, 25 bp, Mus musculus
ctgccagcctaggtgctgtgagtcc

SEQ ID NO: 30901 - DNA, 25 bp, Mus musculus
ctgccagcccaggtgctgtatctcc

SEQ ID NO: 30902 - DNA, 25 bp, Mus musculus
tttagtctcagacctgctggagttt

SEQ ID NO: 30903 - DNA, 25 bp, Mus musculus
cctgccttttctctgcctctaatac

SEQ ID NO: 30904 - DNA, 25 bp, Mus musculus
ctgcctctaatacacacacaatcat

SEQ ID NO: 30905 - DNA, 25 bp, Mus musculus
ctaatacacacacaatcatcaaatt

SEQ ID NO: 30906 - DNA, 25 bp, Mus musculus
cacacacaatcatcaaattctcagt

SEQ ID NO: 30907 - DNA, 25 bp, Mus musculus
tcctcctttaagagatctgtgaacc

SEQ ID NO: 30908 - DNA, 25 bp, Mus musculus
ctgtcagcttcatctattagaaact

SEQ ID NO: 30909 - DNA, 25 bp, Mus musculus
gcttcatctattagaaactggattc

SEQ ID NO: 30910 - DNA, 25 bp, Mus musculus
tggattcatagtctcagccttggca

SEQ ID NO: 30911 - DNA, 25 bp, Mus musculus
catagtctcagccttggcagacacc

SEQ ID NO: 30912 - DNA, 25 bp, Mus musculus
gtgctgccagccagcctgctctgga

SEQ ID NO: 30913 - DNA, 25 bp, Mus musculus
agcctgctctggacctgtgacctgc

SEQ ID NO: 30914 - DNA, 25 bp, Mus musculus
ctctggacctgtgacctgcaccagg

SEQ ID NO: 30915 - DNA, 25 bp, Mus musculus
gacctgcaccaggacttgctaccag

SEQ ID NO: 30916 - DNA, 25 bp, Mus musculus
caccaggacttgctaccagccaaca

SEQ ID NO: 30917 - DNA, 25 bp, Mus musculus
gacttgctaccagccaacatgtgtt

SEQ ID NO: 30918 - DNA, 25 bp, Mus musculus
gcctggttgcctgtcccaaggctgt

SEQ ID NO: 30919 - DNA, 25 bp, Mus musculus
ttgtgagccctgtggctgttgatga

SEQ ID NO: 30920 - DNA, 25 bp, Mus musculus
agccctgaggcgaatctctttatct

SEQ ID NO: 30921 - DNA, 25 bp, Mus musculus
aatctctttatctcggattgtatgc

SEQ ID NO: 30922 - DNA, 25 bp, Mus musculus
cctgcgaaccactgtttcctggtag

SEQ ID NO: 30923 - DNA, 25 bp, Mus musculus
tgctatggcaacaggcccacttacc

SEQ ID NO: 30924 - DNA, 25 bp, Mus musculus
ttatgaatcagcaccaggtgtaaga

SEQ ID NO: 30925 - DNA, 25 bp, Mus musculus
tgaggctttgaggtccccagcaaga

SEQ ID NO: 30926 - DNA, 25 bp, Mus musculus
tttgaggtccccagcaagacactgc

SEQ ID NO: 30927 - DNA, 25 bp, Mus musculus
agctcacaatcctgcctcttagcca

SEQ ID NO: 30928 - DNA, 25 bp, Mus musculus
atccaccatcttccttgggacctga

SEQ ID NO: 30929 - DNA, 25 bp, Mus musculus
aaggaacagcagcactctctctact

SEQ ID NO: 30930 - DNA, 25 bp, Mus musculus
cactctctctacttctaccaataaa

SEQ ID NO: 30931 - DNA, 25 bp, Mus musculus
ctctacttctaccaataaaacaatg

SEQ ID NO: 30932 - DNA, 25 bp, Mus musculus
tttatctcggattgtatgcgacaat

SEQ ID NO: 30933 - DNA, 25 bp, Mus musculus
tctaccaataaaacaatgcaagagc

SEQ ID NO: 30934 - DNA, 25 bp, Mus musculus
tactggcatcaccacggtttcgaga

SEQ ID NO: 30935 - DNA, 25 bp, Mus musculus
ttcgagagacatcttcagggctaac

SEQ ID NO: 30936 - DNA, 25 bp, Mus musculus
catctacccacagggttttgtgagc

SEQ ID NO: 30937 - DNA, 25 bp, Mus musculus
tcccaagttgaacctatcagcctgg

SEQ ID NO: 30938 - DNA, 25 bp, Mus musculus
agcctggcgaggcaaatgagggttc

SEQ ID NO: 30939 - DNA, 25 bp, Mus musculus
gctgctttctgccctgcgaaccact

SEQ ID NO: 30940 - DNA, 25 bp, Mus musculus
ttctgccctgcgaaccactgtttcc

SEQ ID NO: 30941 - DNA, 25 bp, Mus musculus
ggtctctgtccaagtcagcgtctcc

SEQ ID NO: 30942 - DNA, 25 bp, Mus musculus
agccagtgtgcacctgggcctagcg

SEQ ID NO: 30943 - DNA, 25 bp, Mus musculus
gctcaacgagaccagtttcatcttc

SEQ ID NO: 30944 - DNA, 25 bp, Mus musculus
caacgagaccagtttcatcttcact

SEQ ID NO: 30945 - DNA, 25 bp, Mus musculus
cgagaccagtttcatcttcactcag

SEQ ID NO: 30946 - DNA, 25 bp, Mus musculus
cagtttcatcttcactcagttcttg

SEQ ID NO: 30947 - DNA, 25 bp, Mus musculus
tttcatcttcactcagttcttggag

SEQ ID NO: 30948 - DNA, 25 bp, Mus musculus
catcttcactcagttcttggagtct

SEQ ID NO: 30949 - DNA, 25 bp, Mus musculus
tcagttcttggagtctgcgctgact

SEQ ID NO: 30950 - DNA, 25 bp, Mus musculus
gttcttggagtctgcgctgactaat

SEQ ID NO: 30951 - DNA, 25 bp, Mus musculus
ggagtctgcgctgactaatgagacc

SEQ ID NO: 30952 - DNA, 25 bp, Mus musculus
taatgagaccatgcggcacggctgc

SEQ ID NO: 30953 - DNA, 25 bp, Mus musculus
cagtgtgcacctgggcctagcggtg

SEQ ID NO: 30954 - DNA, 25 bp, Mus musculus
caatcagcccacgcatgtcaacaac

SEQ ID NO: 30955 - DNA, 25 bp, Mus musculus
gggcctagcggtggagcagcatcat

SEQ ID NO: 30956 - DNA, 25 bp, Mus musculus
cttctcggtggacgggcagccagca

SEQ ID NO: 30957 - DNA, 25 bp, Mus musculus
accgtctctgcgctggttgttcaac

SEQ ID NO: 30958 - DNA, 25 bp, Mus musculus
gtctctgcgctggttgttcaacggc

SEQ ID NO: 30959 - DNA, 25 bp, Mus musculus
gttgttcaacggctctgtgctcaac

SEQ ID NO: 30960 - DNA, 25 bp, Mus musculus
caacggctctgtgctcaacgagacc

SEQ ID NO: 30961 - DNA, 25 bp, Mus musculus
cggctctgtgctcaacgagaccagt

SEQ ID NO: 30962 - DNA, 25 bp, Mus musculus
gctgcatgccccaatgaaccagcgt

SEQ ID NO: 30963 - DNA, 25 bp, Mus musculus
ctgcatgccccaatgaaccagcgtc

SEQ ID NO: 30964 - DNA, 25 bp, Mus musculus
cagcgtctgacaggacgttctgtct

SEQ ID NO: 30965 - DNA, 25 bp, Mus musculus
gcgtctgacaggacgttctgtctgt

SEQ ID NO: 30966 - DNA, 25 bp, Mus musculus
cgtctgacaggacgttctgtctgtt

SEQ ID NO: 30967 - DNA, 25 bp, Mus musculus
tctgacaggacgttctgtctgtttg

SEQ ID NO: 30968 - DNA, 25 bp, Mus musculus
ctgacaggacgttctgtctgtttgt

SEQ ID NO: 30969 - DNA, 25 bp, Mus musculus
acaggacgttctgtctgtttgtgct

SEQ ID NO: 30970 - DNA, 25 bp, Mus musculus
tcttgaccgagtctgccgtgggcga

SEQ ID NO: 30971 - DNA, 25 bp, Mus musculus
ttgaccgagtctgccgtgggcgagt

SEQ ID NO: 30972 - DNA, 25 bp, Mus musculus
agtctgccgtgggcgagttctgcct

SEQ ID NO: 30973 - DNA, 25 bp, Mus musculus
tgcctcgtcctacgcgttttcgtgg

SEQ ID NO: 30974 - DNA, 25 bp, Mus musculus
gcatgccccaatgaaccagcgtctg

SEQ ID NO: 30975 - DNA, 25 bp, Mus musculus
catgccccaatgaaccagcgtctga

SEQ ID NO: 30976 - DNA, 25 bp, Mus musculus
gccccaatgaaccagcgtctgacag

SEQ ID NO: 30977 - DNA, 25 bp, Mus musculus
ccaatgaaccagcgtctgacaggac

SEQ ID NO: 30978 - DNA, 25 bp, Mus musculus
aatgaaccagcgtctgacaggacgt

SEQ ID NO: 30979 - DNA, 25 bp, Mus musculus
gaaccagcgtctgacaggacgttct

SEQ ID NO: 30980 - DNA, 25 bp, Mus musculus
aaccagcgtctgacaggacgttctg

SEQ ID NO: 30981 - DNA, 25 bp, Mus musculus
ccagcgtctgacaggacgttctgtc

SEQ ID NO: 30982 - DNA, 25 bp, Mus musculus
tgaccaaaccaactgtgattatcag

SEQ ID NO: 30983 - DNA, 25 bp, Mus musculus
ccaaaccaactgtgattatcagtca

SEQ ID NO: 30984 - DNA, 25 bp, Mus musculus
tgactcttacctttggggatatcgt

SEQ ID NO: 30985 - DNA, 25 bp, Mus musculus
tcgttgctgttcgctgttatgaaaa

SEQ ID NO: 30986 - DNA, 25 bp, Mus musculus
ttgctgttcgctgttatgaaaaggc

SEQ ID NO: 30987 - DNA, 25 bp, Mus musculus
ctgttcgctgttatgaaaaggcata

SEQ ID NO: 30988 - DNA, 25 bp, Mus musculus
tcctggagtcccagagttagccagc

SEQ ID NO: 30989 - DNA, 25 bp, Mus musculus
tggagtcccagagttagccagctaa

SEQ ID NO: 30990 - DNA, 25 bp, Mus musculus
tgtgttactccaagcaattcatggg

SEQ ID NO: 30991 - DNA, 25 bp, Mus musculus
gttactccaagcaattcatgggatt

SEQ ID NO: 30992 - DNA, 25 bp, Mus musculus
actccaagcaattcatgggattttg

SEQ ID NO: 30993 - DNA, 25 bp, Mus musculus
atatacttatgactttctttggaat

SEQ ID NO: 30994 - DNA, 25 bp, Mus musculus
tgatccggacacaatgcacattcaa

SEQ ID NO: 30995 - DNA, 25 bp, Mus musculus
tccggacacaatgcacattcaagaa

SEQ ID NO: 30996 - DNA, 25 bp, Mus musculus
ggacacaatgcacattcaagaacac

SEQ ID NO: 30997 - DNA, 25 bp, Mus musculus
cagagatcaatttccagctgggaga

SEQ ID NO: 30998 - DNA, 25 bp, Mus musculus
tcaatttccagctgggagaagagtt

SEQ ID NO: 30999 - DNA, 25 bp, Mus musculus
atttccagctgggagaagagtttga

SEQ ID NO: 31000 - DNA, 25 bp, Mus musculus
ctgtggttcggttggatggagacaa

SEQ ID NO: 31001 - DNA, 25 bp, Mus musculus
tcgtgactcttacctttggggatat

SEQ ID NO: 31002 - DNA, 25 bp, Mus musculus
tacatactcttacgctccaagtttc

SEQ ID NO: 31003 - DNA, 25 bp, Mus musculus
tcgcctaccagctagaggagttaat

SEQ ID NO: 31004 - DNA, 25 bp, Mus musculus
ctcatcacatgggaatctcagcaca

SEQ ID NO: 31005 - DNA, 25 bp, Mus musculus
gaatctcagcacatgagagccatta

SEQ ID NO: 31006 - DNA, 25 bp, Mus musculus
ctgtctccctctttgatctaatggg

SEQ ID NO: 31007 - DNA, 25 bp, Mus musculus
gatatcagtagttccccaggggcct

SEQ ID NO: 31008 - DNA, 25 bp, Mus musculus
tagttttctcagcatcaattttgga

SEQ ID NO: 31009 - DNA, 25 bp, Mus musculus
tctcagcatcaattttggaaaacct

SEQ ID NO: 31010 - DNA, 25 bp, Mus musculus
ttagaccacaggcatatttcgtcaa

SEQ ID NO: 31011 - DNA, 25 bp, Mus musculus
cacaggcatatttcgtcaagtaggg

SEQ ID NO: 31012 - DNA, 25 bp, Mus musculus
gttgacccacgtatgaacagaagat

SEQ ID NO: 31013 - DNA, 25 bp, Mus musculus
tggttattctggctgtgcatatgtg

SEQ ID NO: 31014 - DNA, 25 bp, Mus musculus
agttaatggcgcttctggaacagaa

SEQ ID NO: 31015 - DNA, 25 bp, Mus musculus
ggatgcctgtcacaattggagatgg

SEQ ID NO: 31016 - DNA, 25 bp, Mus musculus
tgaaggtccttcaagagctttcaca

SEQ ID NO: 31017 - DNA, 25 bp, Mus musculus
tccttcaagagctttcacagtggac

SEQ ID NO: 31018 - DNA, 25 bp, Mus musculus
aagagctttcacagtggactgtgag

SEQ ID NO: 31019 - DNA, 25 bp, Mus musculus
ggtctatccatgacctccgtgtcat

SEQ ID NO: 31020 - DNA, 25 bp, Mus musculus
tccatgacctccgtgtcatttcttc

SEQ ID NO: 31021 - DNA, 25 bp, Mus musculus
tttcttctcatcacatgggaatctc

SEQ ID NO: 31022 - DNA, 25 bp, Mus musculus
gttgtcctctgaccaccacacataa

SEQ ID NO: 31023 - DNA, 25 bp, Mus musculus
aaaccagacgttctagactgttctg

SEQ ID NO: 31024 - DNA, 25 bp, Mus musculus
agctttcagtgactgggatacctgc

SEQ ID NO: 31025 - DNA, 25 bp, Mus musculus
ctgggatacctgctgtccagggagg

SEQ ID NO: 31026 - DNA, 25 bp, Mus musculus
gactaccctctgcttacttgaggtc

SEQ ID NO: 31027 - DNA, 25 bp, Mus musculus
ctgcttacttgaggtctgacatgcc

SEQ ID NO: 31028 - DNA, 25 bp, Mus musculus
cttacttgaggtctgacatgcccaa

SEQ ID NO: 31029 - DNA, 25 bp, Mus musculus
ctgacatgcccaatgagagtgtatt

SEQ ID NO: 31030 - DNA, 25 bp, Mus musculus
acatgcccaatgagagtgtatttag

SEQ ID NO: 31031 - DNA, 25 bp, Mus musculus
acaaggtagccagaccttgaatgta

SEQ ID NO: 31032 - DNA, 25 bp, Mus musculus
gaaactttgttactctcagctctgt

SEQ ID NO: 31033 - DNA, 25 bp, Mus musculus
ttactctcagctctgttgattgcga

SEQ ID NO: 31034 - DNA, 25 bp, Mus musculus
gacgttctagactgttctgggcttg

SEQ ID NO: 31035 - DNA, 25 bp, Mus musculus
gttctagactgttctgggcttggga

SEQ ID NO: 31036 - DNA, 25 bp, Mus musculus
ctagactgttctgggcttgggaaat

SEQ ID NO: 31037 - DNA, 25 bp, Mus musculus
ttattgcagccttgttcgatgatct

SEQ ID NO: 31038 - DNA, 25 bp, Mus musculus
ttgcagccttgttcgatgatctaag

SEQ ID NO: 31039 - DNA, 25 bp, Mus musculus
tttattcattgcaacaaggaaagac

SEQ ID NO: 31040 - DNA, 25 bp, Mus musculus
gaaagtctcagctttcagtgactgg

SEQ ID NO: 31041 - DNA, 25 bp, Mus musculus
ctcagctttcagtgactgggatacc

SEQ ID NO: 31042 - DNA, 25 bp, Mus musculus
tccccatcttcatttggcctcctga

SEQ ID NO: 31043 - DNA, 25 bp, Mus musculus
tcttcatttggcctcctgagaagcc

SEQ ID NO: 31044 - DNA, 25 bp, Mus musculus
tcaggatgcttggctgtgctgaggt

SEQ ID NO: 31045 - DNA, 25 bp, Mus musculus
tgcttggctgtgctgaggtttttat

SEQ ID NO: 31046 - DNA, 25 bp, Mus musculus
cagggacttgccagggctggagaca

SEQ ID NO: 31047 - DNA, 25 bp, Mus musculus
agaggatcccctgcaacaagacatt

SEQ ID NO: 31048 - DNA, 25 bp, Mus musculus
cggacctgcaggagactttccgcca

SEQ ID NO: 31049 - DNA, 25 bp, Mus musculus
cctttggacaaatgtcgctgtcagt

SEQ ID NO: 31050 - DNA, 25 bp, Mus musculus
gacaaatgtcgctgtcagtgttaca

SEQ ID NO: 31051 - DNA, 25 bp, Mus musculus
aaatgtcgctgtcagtgttacagat

SEQ ID NO: 31052 - DNA, 25 bp, Mus musculus
atgacttatttctgctctggaataa

SEQ ID NO: 31053 - DNA, 25 bp, Mus musculus
tatttctgctctggaataaagttgc

SEQ ID NO: 31054 - DNA, 25 bp, Mus musculus
ctcctgagaagccactctggagctg

SEQ ID NO: 31055 - DNA, 25 bp, Mus musculus
agaagccactctggagctgaggcta

SEQ ID NO: 31056 - DNA, 25 bp, Mus musculus
cactctggagctgaggctaagcact

SEQ ID NO: 31057 - DNA, 25 bp, Mus musculus
aagcactaagcccaggaccatatga

SEQ ID NO: 31058 - DNA, 25 bp, Mus musculus
taagcccaggaccatatgactagca

SEQ ID NO: 31059 - DNA, 25 bp, Mus musculus
catatgactagcactgtaccgcccg

SEQ ID NO: 31060 - DNA, 25 bp, Mus musculus
ggacttggctgggttgtggtcacaa

SEQ ID NO: 31061 - DNA, 25 bp, Mus musculus
agcaatctcccagtgccttttacag

SEQ ID NO: 31062 - DNA, 25 bp, Mus musculus
tgtttctggagcctgaattaatcaa

SEQ ID NO: 31063 - DNA, 25 bp, Mus musculus
taatcaaatatcacagcacacattt

SEQ ID NO: 31064 - DNA, 25 bp, Mus musculus
cagagcacaccagcatcaggggcgc

SEQ ID NO: 31065 - DNA, 25 bp, Mus musculus
acaccagcatcaggggcgcatcgcg

SEQ ID NO: 31066 - DNA, 25 bp, Mus musculus
cgccctgacgcttcactatccagga

SEQ ID NO: 31067 - DNA, 25 bp, Mus musculus
gacgcttcactatccaggatcactt

SEQ ID NO: 31068 - DNA, 25 bp, Mus musculus
tcagtctgtgccattccgggcactg

SEQ ID NO: 31069 - DNA, 25 bp, Mus musculus
gtattagcagttccacctcttggcg

SEQ ID NO: 31070 - DNA, 25 bp, Mus musculus
ccacctcttggcgcttattgctctt

SEQ ID NO: 31071 - DNA, 25 bp, Mus musculus
cttggcgcttattgctcttgctcta

SEQ ID NO: 31072 - DNA, 25 bp, Mus musculus
gcttattgctcttgctctaagttgg

SEQ ID NO: 31073 - DNA, 25 bp, Mus musculus
tgctcttgctctaagttggagtgag

SEQ ID NO: 31074 - DNA, 25 bp, Mus musculus
aatatcacagcacacatttttcagg

SEQ ID NO: 31075 - DNA, 25 bp, Mus musculus
acagcacacatttttcaggcaatga

SEQ ID NO: 31076 - DNA, 25 bp, Mus musculus
ttgactctcatagcacaagttttac

SEQ ID NO: 31077 - DNA, 25 bp, Mus musculus
tagacctgtctctgagggacatatg

SEQ ID NO: 31078 - DNA, 25 bp, Mus musculus
tgtctctgagggacatatgcattct

SEQ ID NO: 31079 - DNA, 25 bp, Mus musculus
acatatgcattctctggaagcacat

SEQ ID NO: 31080 - DNA, 25 bp, Mus musculus
tggatcgagcttccttctcagagca

SEQ ID NO: 31081 - DNA, 25 bp, Mus musculus
gagcttccttctcagagcacaccag

SEQ ID NO: 31082 - DNA, 25 bp, Mus musculus
ggagaagacctcctcttctatctgt

SEQ ID NO: 31083 - DNA, 25 bp, Mus musculus
gagaagacctcctcttctatctgta

SEQ ID NO: 31084 - DNA, 25 bp, Mus musculus
aactcttagctgcggtagagctttt

SEQ ID NO: 31085 - DNA, 25 bp, Mus musculus
atggattaccagggcaccaggcatg

SEQ ID NO: 31086 - DNA, 25 bp, Mus musculus
ggattaccagggcaccaggcatgga

SEQ ID NO: 31087 - DNA, 25 bp, Mus musculus
gattaccagggcaccaggcatggag

SEQ ID NO: 31088 - DNA, 25 bp, Mus musculus
attaccagggcaccaggcatggagc

SEQ ID NO: 31089 - DNA, 25 bp, Mus musculus
ttaccagggcaccaggcatggagcc

SEQ ID NO: 31090 - DNA, 25 bp, Mus musculus
accagggcaccaggcatggagccaa

SEQ ID NO: 31091 - DNA, 25 bp, Mus musculus
ccagggcaccaggcatggagccaac

SEQ ID NO: 31092 - DNA, 25 bp, Mus musculus
cagggcaccaggcatggagccaaca

SEQ ID NO: 31093 - DNA, 25 bp, Mus musculus
caccaggcatggagccaacaatgaa

SEQ ID NO: 31094 - DNA, 25 bp, Mus musculus
gaagacctcctcttctatctgtatt

SEQ ID NO: 31095 - DNA, 25 bp, Mus musculus
tcctcttctatctgtattacatgaa

SEQ ID NO: 31096 - DNA, 25 bp, Mus musculus
cctcttctatctgtattacatgaac

SEQ ID NO: 31097 - DNA, 25 bp, Mus musculus
ctcttctatctgtattacatgaacg

SEQ ID NO: 31098 - DNA, 25 bp, Mus musculus
tcttctatctgtattacatgaacgg

SEQ ID NO: 31099 - DNA, 25 bp, Mus musculus
atgtattacaactcttagctgcggt

SEQ ID NO: 31100 - DNA, 25 bp, Mus musculus
gtattacaactcttagctgcggtag

SEQ ID NO: 31101 - DNA, 25 bp, Mus musculus
acaactcttagctgcggtagagctt

SEQ ID NO: 31102 - DNA, 25 bp, Mus musculus
gattctctacaatctatcccggaat

SEQ ID NO: 31103 - DNA, 25 bp, Mus musculus
tctatcccggaatccccaagtgcaa

SEQ ID NO: 31104 - DNA, 25 bp, Mus musculus
aagtgtgccattcacaactcggacc

SEQ ID NO: 31105 - DNA, 25 bp, Mus musculus
cacaactcggacccttgacaagcca

SEQ ID NO: 31106 - DNA, 25 bp, Mus musculus
ccaagtgctgggctctagcgaagac

SEQ ID NO: 31107 - DNA, 25 bp, Mus musculus
ggctgagctacagctccacttggct

SEQ ID NO: 31108 - DNA, 25 bp, Mus musculus
gctccacttggctctttgctggata

SEQ ID NO: 31109 - DNA, 25 bp, Mus musculus
cttggctctttgctggataatccaa

SEQ ID NO: 31110 - DNA, 25 bp, Mus musculus
tcttggcatcctggtacctagccgg

SEQ ID NO: 31111 - DNA, 25 bp, Mus musculus
gcccattgcgttctgtccacggtag

SEQ ID NO: 31112 - DNA, 25 bp, Mus musculus
tgcgttctgtccacggtaggctgct

SEQ ID NO: 31113 - DNA, 25 bp, Mus musculus
ctgtccacggtaggctgctgagatt

SEQ ID NO: 31114 - DNA, 25 bp, Mus musculus
ccggaatccccaagtgcaacagaga

SEQ ID NO: 31115 - DNA, 25 bp, Mus musculus
acagagacttctccgggaaatccag

SEQ ID NO: 31116 - DNA, 25 bp, Mus musculus
acttctccgggaaatccagagcgtg

SEQ ID NO: 31117 - DNA, 25 bp, Mus musculus
tgacaaccagacgccacgggcggaa

SEQ ID NO: 31118 - DNA, 25 bp, Mus musculus
ccagacgccacgggcggaagatgtg

SEQ ID NO: 31119 - DNA, 25 bp, Mus musculus
tatgccctatttaaaggcctgtcta

SEQ ID NO: 31120 - DNA, 25 bp, Mus musculus
gtccatgaggcttaccccaagtgtg

SEQ ID NO: 31121 - DNA, 25 bp, Mus musculus
taccccaagtgtgccattcacaact

SEQ ID NO: 31122 - DNA, 25 bp, Mus musculus
ggacccacaggtgtcatcaccacaa

SEQ ID NO: 31123 - DNA, 25 bp, Mus musculus
acaggtgtcatcaccacaaccatga

SEQ ID NO: 31124 - DNA, 25 bp, Mus musculus
agccggacagtctgggttggactct

SEQ ID NO: 31125 - DNA, 25 bp, Mus musculus
acagtctgggttggactcttctctc

SEQ ID NO: 31126 - DNA, 25 bp, Mus musculus
ttatgttattgacggccctggctta

SEQ ID NO: 31127 - DNA, 25 bp, Mus musculus
tattgacggccctggcttagacgcc

SEQ ID NO: 31128 - DNA, 25 bp, Mus musculus
gtgccctttccaggggcctctgagc

SEQ ID NO: 31129 - DNA, 25 bp, Mus musculus
tctgagctctgccttctgcaagctg

SEQ ID NO: 31130 - DNA, 25 bp, Mus musculus
cttctgcaagctgacctcccagtgt

SEQ ID NO: 31131 - DNA, 25 bp, Mus musculus
gacctcccagtgtggcttgaggcca

SEQ ID NO: 31132 - DNA, 25 bp, Mus musculus
cctgcttcctttctgatggaccttg

SEQ ID NO: 31133 - DNA, 25 bp, Mus musculus
tcctttctgatggaccttggagggc

SEQ ID NO: 31134 - DNA, 25 bp, Mus musculus
cccggctatgtggccattcaagccc

SEQ ID NO: 31135 - DNA, 25 bp, Mus musculus
ctgctcagcaatcgaggagtccggc

SEQ ID NO: 31136 - DNA, 25 bp, Mus musculus
tctttctcagactgggagaagctgg

SEQ ID NO: 31137 - DNA, 25 bp, Mus musculus
gagatgctgcggctgctgggccact

SEQ ID NO: 31138 - DNA, 25 bp, Mus musculus
ctgcggctgctgggccactgaacct

SEQ ID NO: 31139 - DNA, 25 bp, Mus musculus
ctgctgggccactgaacctgggccc

SEQ ID NO: 31140 - DNA, 25 bp, Mus musculus
cctaccgtgcaagacaagagccgga

SEQ ID NO: 31141 - DNA, 25 bp, Mus musculus
gacaagagccggacagtctgggttg

SEQ ID NO: 31142 - DNA, 25 bp, Mus musculus
tggccactgtcttccgtgggcgcat

SEQ ID NO: 31143 - DNA, 25 bp, Mus musculus
cactgtcttccgtgggcgcatgtct

SEQ ID NO: 31144 - DNA, 25 bp, Mus musculus
caaggtagccgtgtgtgacatccca

SEQ ID NO: 31145 - DNA, 25 bp, Mus musculus
cgtcaaaatgtcatccaccttcatt

SEQ ID NO: 31146 - DNA, 25 bp, Mus musculus
gtcaaaatgtcatccaccttcattg

SEQ ID NO: 31147 - DNA, 25 bp, Mus musculus
tcaaaatgtcatccaccttcattgg

SEQ ID NO: 31148 - DNA, 25 bp, Mus musculus
aaatgtcatccaccttcattggcaa

SEQ ID NO: 31149 - DNA, 25 bp, Mus musculus
aatgtcatccaccttcattggcaac

SEQ ID NO: 31150 - DNA, 25 bp, Mus musculus
actgtcttccgtgggcgcatgtcta

SEQ ID NO: 31151 - DNA, 25 bp, Mus musculus
ccaacaacgtcaaggtagccgtgtg

SEQ ID NO: 31152 - DNA, 25 bp, Mus musculus
caacaacgtcaaggtagccgtgtgt

SEQ ID NO: 31153 - DNA, 25 bp, Mus musculus
acaacgtcaaggtagccgtgtgtga

SEQ ID NO: 31154 - DNA, 25 bp, Mus musculus
caacgtcaaggtagccgtgtgtgac

SEQ ID NO: 31155 - DNA, 25 bp, Mus musculus
aacgtcaaggtagccgtgtgtgaca

SEQ ID NO: 31156 - DNA, 25 bp, Mus musculus
acgtcaaggtagccgtgtgtgacat

SEQ ID NO: 31157 - DNA, 25 bp, Mus musculus
cgtcaaggtagccgtgtgtgacatc

SEQ ID NO: 31158 - DNA, 25 bp, Mus musculus
gtcttagatacggagctgcggtaca

SEQ ID NO: 31159 - DNA, 25 bp, Mus musculus
tgcggtacaagcccgacttgaaaga

SEQ ID NO: 31160 - DNA, 25 bp, Mus musculus
ctctgagctatccggtgcaaccttg

SEQ ID NO: 31161 - DNA, 25 bp, Mus musculus
gagctatccggtgcaaccttgttcg

SEQ ID NO: 31162 - DNA, 25 bp, Mus musculus
gctatccggtgcaaccttgttcgtg

SEQ ID NO: 31163 - DNA, 25 bp, Mus musculus
ggaacctcggattgacttcaggcat

SEQ ID NO: 31164 - DNA, 25 bp, Mus musculus
aacctcggattgacttcaggcatta

SEQ ID NO: 31165 - DNA, 25 bp, Mus musculus
tgacttcaggcattaccgggcagat

SEQ ID NO: 31166 - DNA, 25 bp, Mus musculus
ttcaggcattaccgggcagatggcc

SEQ ID NO: 31167 - DNA, 25 bp, Mus musculus
caggcattaccgggcagatggccct

SEQ ID NO: 31168 - DNA, 25 bp, Mus musculus
ggcattaccgggcagatggcccttt

SEQ ID NO: 31169 - DNA, 25 bp, Mus musculus
cattaccgggcagatggccctttgg

SEQ ID NO: 31170 - DNA, 25 bp, Mus musculus
agaggcctccagaaaaagtagatgc

SEQ ID NO: 31171 - DNA, 25 bp, Mus musculus
tgtgcaaacagatcctactgatgaa

SEQ ID NO: 31172 - DNA, 25 bp, Mus musculus
tgcaaacagatcctactgatgaagt

SEQ ID NO: 31173 - DNA, 25 bp, Mus musculus
cagatcctactgatgaagtgcccac

SEQ ID NO: 31174 - DNA, 25 bp, Mus musculus
tcctactgatgaagtgcccaccaaa

SEQ ID NO: 31175 - DNA, 25 bp, Mus musculus
actgatgaagtgcccaccaaaaagt

SEQ ID NO: 31176 - DNA, 25 bp, Mus musculus
tgatgaagtgcccaccaaaaagtca

SEQ ID NO: 31177 - DNA, 25 bp, Mus musculus
tgcccaccaaaaagtcaaagaagca

SEQ ID NO: 31178 - DNA, 25 bp, Mus musculus
tcttctacgaaatcatcgactgctt

SEQ ID NO: 31179 - DNA, 25 bp, Mus musculus
acgaaatcatcgactgcttttccat

SEQ ID NO: 31180 - DNA, 25 bp, Mus musculus
ccatcatcattaccaaagagggcag

SEQ ID NO: 31181 - DNA, 25 bp, Mus musculus
ttaccaaagagggcagcctgccgct

SEQ ID NO: 31182 - DNA, 25 bp, Mus musculus
catccgaaacgttcaggcgtcctct

SEQ ID NO: 31183 - DNA, 25 bp, Mus musculus
ctcacctacactctgcaattctgta

SEQ ID NO: 31184 - DNA, 25 bp, Mus musculus
actctgcaattctgtagccagctaa

SEQ ID NO: 31185 - DNA, 25 bp, Mus musculus
gcttgttcagggccaatttaagtat

SEQ ID NO: 31186 - DNA, 25 bp, Mus musculus
tggatctttccttgatagtacacta

SEQ ID NO: 31187 - DNA, 25 bp, Mus musculus
atctttccttgatagtacactattt

SEQ ID NO: 31188 - DNA, 25 bp, Mus musculus
tagtacactatttgtttgggtactg

SEQ ID NO: 31189 - DNA, 25 bp, Mus musculus
actatttgtttgggtactgatgtct

SEQ ID NO: 31190 - DNA, 25 bp, Mus musculus
aaatcatcgactgcttttccatgct

SEQ ID NO: 31191 - DNA, 25 bp, Mus musculus
tcatcgactgcttttccatgctgca

SEQ ID NO: 31192 - DNA, 25 bp, Mus musculus
gcttttccatgctgcactgtgtggc

SEQ ID NO: 31193 - DNA, 25 bp, Mus musculus
tttccatgctgcactgtgtggccaa

SEQ ID NO: 31194 - DNA, 25 bp, Mus musculus
tcctctacaactttctcagcccgag

SEQ ID NO: 31195 - DNA, 25 bp, Mus musculus
tgctgagccttgtggtccgttacct

SEQ ID NO: 31196 - DNA, 25 bp, Mus musculus
agcactccatcatcattaccaaaga

SEQ ID NO: 31197 - DNA, 25 bp, Mus musculus
actccatcatcattaccaaagaggg

SEQ ID NO: 31198 - DNA, 25 bp, Mus musculus
tcctagggacctttgctgcctgctg

SEQ ID NO: 31199 - DNA, 25 bp, Mus musculus
ggacctttgctgcctgctggatgcc

SEQ ID NO: 31200 - DNA, 25 bp, Mus musculus
ataggacgctgcctctaccaagcgc

SEQ ID NO: 31201 - DNA, 25 bp, Mus musculus
taaattctttgcactggatctcaca

SEQ ID NO: 31202 - DNA, 25 bp, Mus musculus
ctttgcactggatctcacaagcaga

SEQ ID NO: 31203 - DNA, 25 bp, Mus musculus
actggatctcacaagcagaagcaat

SEQ ID NO: 31204 - DNA, 25 bp, Mus musculus
tgacatcttttagacacgtattgac

SEQ ID NO: 31205 - DNA, 25 bp, Mus musculus
cttttagacacgtattgacagtgga

SEQ ID NO: 31206 - DNA, 25 bp, Mus musculus
cgacttctcggctcagcattctgtt

SEQ ID NO: 31207 - DNA, 25 bp, Mus musculus
tcagcattctgttgtttggtttggg

SEQ ID NO: 31208 - DNA, 25 bp, Mus musculus
taatgggacctcatgtggccatgaa

SEQ ID NO: 31209 - DNA, 25 bp, Mus musculus
gacctcatgtggccatgaaattata

SEQ ID NO: 31210 - DNA, 25 bp, Mus musculus
ccctctattccttgatcgccgatta

SEQ ID NO: 31211 - DNA, 25 bp, Mus musculus
attccttgatcgccgattacaccta

SEQ ID NO: 31212 - DNA, 25 bp, Mus musculus
tcaaccctgtcatttacgctttcag

SEQ ID NO: 31213 - DNA, 25 bp, Mus musculus
ctgtcatttacgctttcagaaacca

SEQ ID NO: 31214 - DNA, 25 bp, Mus musculus
tttacgctttcagaaaccaagagat

SEQ ID NO: 31215 - DNA, 25 bp, Mus musculus
aagccctctgcctcatttgctgtgg

SEQ ID NO: 31216 - DNA, 25 bp, Mus musculus
tgtctcagagagctcggtctcccag

SEQ ID NO: 31217 - DNA, 25 bp, Mus musculus
tgtagcagccttctcctcataggac

SEQ ID NO: 31218 - DNA, 25 bp, Mus musculus
cccacctgaattccatgagcaatgc

SEQ ID NO: 31219 - DNA, 25 bp, Mus musculus
ccacctgaattccatgagcaatgca

SEQ ID NO: 31220 - DNA, 25 bp, Mus musculus
tggttgcctgtacgagcggctccat

SEQ ID NO: 31221 - DNA, 25 bp, Mus musculus
ttgcctgtacgagcggctccatgag

SEQ ID NO: 31222 - DNA, 25 bp, Mus musculus
tgcctgtacgagcggctccatgagt

SEQ ID NO: 31223 - DNA, 25 bp, Mus musculus
cctgtacgagcggctccatgagtta

SEQ ID NO: 31224 - DNA, 25 bp, Mus musculus
ctgtacgagcggctccatgagttac

SEQ ID NO: 31225 - DNA, 25 bp, Mus musculus
gtacgagcggctccatgagttacag

SEQ ID NO: 31226 - DNA, 25 bp, Mus musculus
tacgagcggctccatgagttacagc

SEQ ID NO: 31227 - DNA, 25 bp, Mus musculus
cgagcggctccatgagttacagctg

SEQ ID NO: 31228 - DNA, 25 bp, Mus musculus
cggctccatgagttacagctgaatg

SEQ ID NO: 31229 - DNA, 25 bp, Mus musculus
gctccatgagttacagctgaatgac

SEQ ID NO: 31230 - DNA, 25 bp, Mus musculus
acctgaattccatgagcaatgcaaa

SEQ ID NO: 31231 - DNA, 25 bp, Mus musculus
cctgaattccatgagcaatgcaaag

SEQ ID NO: 31232 - DNA, 25 bp, Mus musculus
tgaattccatgagcaatgcaaaggt

SEQ ID NO: 31233 - DNA, 25 bp, Mus musculus
gaattccatgagcaatgcaaaggtc

SEQ ID NO: 31234 - DNA, 25 bp, Mus musculus
attccatgagcaatgcaaaggtctt

SEQ ID NO: 31235 - DNA, 25 bp, Mus musculus
atgcaaaggtcttgtggaggatgag

SEQ ID NO: 31236 - DNA, 25 bp, Mus musculus
aattggttgcctgtacgagcggctc

SEQ ID NO: 31237 - DNA, 25 bp, Mus musculus
attggttgcctgtacgagcggctcc

SEQ ID NO: 31238 - DNA, 25 bp, Mus musculus
cctacacctagaaatctagctcata

SEQ ID NO: 31239 - DNA, 25 bp, Mus musculus
acacctagaaatctagctcatacca

SEQ ID NO: 31240 - DNA, 25 bp, Mus musculus
gagcaaccgagaattcctctgcgct

SEQ ID NO: 31241 - DNA, 25 bp, Mus musculus
caaccgagaattcctctgcgctgag

SEQ ID NO: 31242 - DNA, 25 bp, Mus musculus
ccgagaattcctctgcgctgaggcc

SEQ ID NO: 31243 - DNA, 25 bp, Mus musculus
gcaacccggcaaggcagtcgggatt

SEQ ID NO: 31244 - DNA, 25 bp, Mus musculus
tttcagcgccacagccatggcctgg

SEQ ID NO: 31245 - DNA, 25 bp, Mus musculus
cacagccatggcctgggggccaggc

SEQ ID NO: 31246 - DNA, 25 bp, Mus musculus
taccctgaggtgcccgagaggaggc

SEQ ID NO: 31247 - DNA, 25 bp, Mus musculus
tctgccaatcgggttatggccccca

SEQ ID NO: 31248 - DNA, 25 bp, Mus musculus
gttatggcccccagtgcattcctgt

SEQ ID NO: 31249 - DNA, 25 bp, Mus musculus
agtgcattcctgttcagtccccaac

SEQ ID NO: 31250 - DNA, 25 bp, Mus musculus
aatctagctcataccagggtatcct

SEQ ID NO: 31251 - DNA, 25 bp, Mus musculus
gctcataccagggtatcctcagcct

SEQ ID NO: 31252 - DNA, 25 bp, Mus musculus
tccatgaccccatttctgacctcag

SEQ ID NO: 31253 - DNA, 25 bp, Mus musculus
ctgctcgggtttgcagggagaacac

SEQ ID NO: 31254 - DNA, 25 bp, Mus musculus
tttaagaagccatcacctgagcaac

SEQ ID NO: 31255 - DNA, 25 bp, Mus musculus
aagccatcacctgagcaaccgagaa

SEQ ID NO: 31256 - DNA, 25 bp, Mus musculus
ccatcacctgagcaaccgagaattc

SEQ ID NO: 31257 - DNA, 25 bp, Mus musculus
tcacctgagcaaccgagaattcctc

SEQ ID NO: 31258 - DNA, 25 bp, Mus musculus
tctttacactcttatttgctggaga

SEQ ID NO: 31259 - DNA, 25 bp, Mus musculus
cactcttatttgctggagaaaagtt

SEQ ID NO: 31260 - DNA, 25 bp, Mus musculus
atacctttgtgctgatgcagctctt

SEQ ID NO: 31261 - DNA, 25 bp, Mus musculus
cctttgtgctgatgcagctcttcaa

SEQ ID NO: 31262 - DNA, 25 bp, Mus musculus
tgctgatgcagctcttcaatgaaat

SEQ ID NO: 31263 - DNA, 25 bp, Mus musculus
tgatgcagctcttcaatgaaataaa

SEQ ID NO: 31264 - DNA, 25 bp, Mus musculus
tgcagctcttcaatgaaataaacgc

SEQ ID NO: 31265 - DNA, 25 bp, Mus musculus
gaatcttcaataacgccatcttctg

SEQ ID NO: 31266 - DNA, 25 bp, Mus musculus
tcttcaataacgccatcttctgcac

SEQ ID NO: 31267 - DNA, 25 bp, Mus musculus
ataacgccatcttctgcaccattgt

SEQ ID NO: 31268 - DNA, 25 bp, Mus musculus
acgccatcttctgcaccattgtcct

SEQ ID NO: 31269 - DNA, 25 bp, Mus musculus
ccatcttctgcaccattgtcctggg

SEQ ID NO: 31270 - DNA, 25 bp, Mus musculus
ccccgtcagaacattacaccatcgt

SEQ ID NO: 31271 - DNA, 25 bp, Mus musculus
tctgcaccattgtcctgggcacctt

SEQ ID NO: 31272 - DNA, 25 bp, Mus musculus
cgtcagaacattacaccatcgtgtt

SEQ ID NO: 31273 - DNA, 25 bp, Mus musculus
aacattacaccatcgtgttcaatac

SEQ ID NO: 31274 - DNA, 25 bp, Mus musculus
attacaccatcgtgttcaatacctt

SEQ ID NO: 31275 - DNA, 25 bp, Mus musculus
acaccatcgtgttcaatacctttgt

SEQ ID NO: 31276 - DNA, 25 bp, Mus musculus
ccatcgtgttcaatacctttgtgct

SEQ ID NO: 31277 - DNA, 25 bp, Mus musculus
tgttcaatacctttgtgctgatgca

SEQ ID NO: 31278 - DNA, 25 bp, Mus musculus
tcaatacctttgtgctgatgcagct

SEQ ID NO: 31279 - DNA, 25 bp, Mus musculus
tggcacaacagcagatcccagcatg

SEQ ID NO: 31280 - DNA, 25 bp, Mus musculus
aacagcagatcccagcatggtcagc

SEQ ID NO: 31281 - DNA, 25 bp, Mus musculus
aatgtccatgggctaccagccgtac

SEQ ID NO: 31282 - DNA, 25 bp, Mus musculus
ctaccagccgtacaatatgcagaat

SEQ ID NO: 31283 - DNA, 25 bp, Mus musculus
gcagcccctgtaccagcagatggcc

SEQ ID NO: 31284 - DNA, 25 bp, Mus musculus
acagggaccgccagcacagggcagt

SEQ ID NO: 31285 - DNA, 25 bp, Mus musculus
ctttgactgaccttgagtctggcgc

SEQ ID NO: 31286 - DNA, 25 bp, Mus musculus
ctgaccttgagtctggcgctcacca

SEQ ID NO: 31287 - DNA, 25 bp, Mus musculus
ctcaccatgcagagtaacactacag

SEQ ID NO: 31288 - DNA, 25 bp, Mus musculus
gttcaccagaaaccacttatatgtc

SEQ ID NO: 31289 - DNA, 25 bp, Mus musculus
cagaaaccacttatatgtctaacta

SEQ ID NO: 31290 - DNA, 25 bp, Mus musculus
ccacttatatgtctaactagccatt

SEQ ID NO: 31291 - DNA, 25 bp, Mus musculus
agatcccagcatggtcagcgcctac

SEQ ID NO: 31292 - DNA, 25 bp, Mus musculus
ggtcagcgcctacatgtacccaaca

SEQ ID NO: 31293 - DNA, 25 bp, Mus musculus
catgtacccaacaggtgcccctggg

SEQ ID NO: 31294 - DNA, 25 bp, Mus musculus
cccaacaggtgcccctggggcacag

SEQ ID NO: 31295 - DNA, 25 bp, Mus musculus
aaccccaggctaccagagcgtggct

SEQ ID NO: 31296 - DNA, 25 bp, Mus musculus
gcctccacagaccagcaacataggc

SEQ ID NO: 31297 - DNA, 25 bp, Mus musculus
cagcaacataggctacatggggagc

SEQ ID NO: 31298 - DNA, 25 bp, Mus musculus
ctacatggggagccagccaatgtcc

SEQ ID NO: 31299 - DNA, 25 bp, Mus musculus
gactttcggcacctggacaaccttg

SEQ ID NO: 31300 - DNA, 25 bp, Mus musculus
ctggacaaccttgtggttcctcatg

SEQ ID NO: 31301 - DNA, 25 bp, Mus musculus
ctgttctttacgtctccatggcctg

SEQ ID NO: 31302 - DNA, 25 bp, Mus musculus
tttacgtctccatggcctgctcagc

SEQ ID NO: 31303 - DNA, 25 bp, Mus musculus
tctccatggcctgctcagctagccg

SEQ ID NO: 31304 - DNA, 25 bp, Mus musculus
tggcctgctcagctagccgtgtttt

SEQ ID NO: 31305 - DNA, 25 bp, Mus musculus
gctcagctagccgtgttttctattc

SEQ ID NO: 31306 - DNA, 25 bp, Mus musculus
ccctgtccagtgtatatgttgctta

SEQ ID NO: 31307 - DNA, 25 bp, Mus musculus
atattttaccagctaagtgactgcc

SEQ ID NO: 31308 - DNA, 25 bp, Mus musculus
taccagctaagtgactgccacgcgg

SEQ ID NO: 31309 - DNA, 25 bp, Mus musculus
ctaagtgactgccacgcggttgtgt

SEQ ID NO: 31310 - DNA, 25 bp, Mus musculus
gactgccacgcggttgtgtataacg

SEQ ID NO: 31311 - DNA, 25 bp, Mus musculus
gaccccagtgcccaagtgtttggca

SEQ ID NO: 31312 - DNA, 25 bp, Mus musculus
ggcatcagccttcctgccagtgact

SEQ ID NO: 31313 - DNA, 25 bp, Mus musculus
cctgccagtgacttctgtgccctca

SEQ ID NO: 31314 - DNA, 25 bp, Mus musculus
agtgacttctgtgccctcatctcct

SEQ ID NO: 31315 - DNA, 25 bp, Mus musculus
tggaccaaggctctcagaacaagaa

SEQ ID NO: 31316 - DNA, 25 bp, Mus musculus
ctcagaacaagaacccaagatccct

SEQ ID NO: 31317 - DNA, 25 bp, Mus musculus
gcccgcatactcctgttctttacgt

SEQ ID NO: 31318 - DNA, 25 bp, Mus musculus
atactcctgttctttacgtctccat

SEQ ID NO: 31319 - DNA, 25 bp, Mus musculus
accaggtagacatccccatggagaa

SEQ ID NO: 31320 - DNA, 25 bp, Mus musculus
cactcatcatctaccacgtcatcga

SEQ ID NO: 31321 - DNA, 25 bp, Mus musculus
accgcagtctgctggatgccctgac

SEQ ID NO: 31322 - DNA, 25 bp, Mus musculus
ccaagcccaagtttagcatctctcc

SEQ ID NO: 31323 - DNA, 25 bp, Mus musculus
ccaagtttagcatctctccagattc

SEQ ID NO: 31324 - DNA, 25 bp, Mus musculus
ttagcatctctccagattccttgtc

SEQ ID NO: 31325 - DNA, 25 bp, Mus musculus
tctctccagattccttgtcctgagt

SEQ ID NO: 31326 - DNA, 25 bp, Mus musculus
cagattccttgtcctgagttgcagt

SEQ ID NO: 31327 - DNA, 25 bp, Mus musculus
ccttgtcctgagttgcagttcctca

SEQ ID NO: 31328 - DNA, 25 bp, Mus musculus
cctgagttgcagttcctcaggcccc

SEQ ID NO: 31329 - DNA, 25 bp, Mus musculus
ccactcacttgtgtgggcacgtgga

SEQ ID NO: 31330 - DNA, 25 bp, Mus musculus
acttgtgtgggcacgtggaaagtga

SEQ ID NO: 31331 - DNA, 25 bp, Mus musculus
tcatctaccacgtcatcgactccaa

SEQ ID NO: 31332 - DNA, 25 bp, Mus musculus
acgacctggctcctagtgacctgca

SEQ ID NO: 31333 - DNA, 25 bp, Mus musculus
tggctcctagtgacctgcaccacca

SEQ ID NO: 31334 - DNA, 25 bp, Mus musculus
agatcattgtcatcttggaaggcgt

SEQ ID NO: 31335 - DNA, 25 bp, Mus musculus
ttgtcatcttggaaggcgtggtaga

SEQ ID NO: 31336 - DNA, 25 bp, Mus musculus
aggacggccgctattctgtggacta

SEQ ID NO: 31337 - DNA, 25 bp, Mus musculus
gccgctattctgtggactactccaa

SEQ ID NO: 31338 - DNA, 25 bp, Mus musculus
atgaggaccgcagtctgctggatgc

SEQ ID NO: 31339 - DNA, 25 bp, Mus musculus
tcgtcatgattctgaacaggataat

SEQ ID NO: 31340 - DNA, 25 bp, Mus musculus
ttcagacaacaataccatcttcgtg

SEQ ID NO: 31341 - DNA, 25 bp, Mus musculus
aactggacagcctatgattaatttg

SEQ ID NO: 31342 - DNA, 25 bp, Mus musculus
agtttcatttgatgacccaccttct

SEQ ID NO: 31343 - DNA, 25 bp, Mus musculus
ttcatttgatgacccaccttctgct

SEQ ID NO: 31344 - DNA, 25 bp, Mus musculus
atttgatgacccaccttctgctaaa

SEQ ID NO: 31345 - DNA, 25 bp, Mus musculus
ttctgctaaagcagctatcgactgg

SEQ ID NO: 31346 - DNA, 25 bp, Mus musculus
tgctaaagcagctatcgactggttt

SEQ ID NO: 31347 - DNA, 25 bp, Mus musculus
taaagcagctatcgactggtttgat

SEQ ID NO: 31348 - DNA, 25 bp, Mus musculus
agcagctatcgactggtttgatggt

SEQ ID NO: 31349 - DNA, 25 bp, Mus musculus
agctatcgactggtttgatggtaaa

SEQ ID NO: 31350 - DNA, 25 bp, Mus musculus
tatcgactggtttgatggtaaagaa

SEQ ID NO: 31351 - DNA, 25 bp, Mus musculus
agacaacaataccatcttcgtgcaa

SEQ ID NO: 31352 - DNA, 25 bp, Mus musculus
caataccatcttcgtgcaaggccta

SEQ ID NO: 31353 - DNA, 25 bp, Mus musculus
taccatcttcgtgcaaggcctaggc

SEQ ID NO: 31354 - DNA, 25 bp, Mus musculus
cttcgtgcaaggcctaggcgagaat

SEQ ID NO: 31355 - DNA, 25 bp, Mus musculus
gcaaggcctaggcgagaatgttaca

SEQ ID NO: 31356 - DNA, 25 bp, Mus musculus
atctgtggctgattacttcaagcag

SEQ ID NO: 31357 - DNA, 25 bp, Mus musculus
tgattacttcaagcagattggaatt

SEQ ID NO: 31358 - DNA, 25 bp, Mus musculus
ttacttcaagcagattggaattatt

SEQ ID NO: 31359 - DNA, 25 bp, Mus musculus
acttcaatgagaccgtgcttactgt

SEQ ID NO: 31360 - DNA, 25 bp, Mus musculus
tcaatgagaccgtgcttactgtgtg

SEQ ID NO: 31361 - DNA, 25 bp, Mus musculus
atgagcacctccagaaagatttcat

SEQ ID NO: 31362 - DNA, 25 bp, Mus musculus
acctccagaaagatttcatcatctt

SEQ ID NO: 31363 - DNA, 25 bp, Mus musculus
aagatttcatcatcttcgaggctgc

SEQ ID NO: 31364 - DNA, 25 bp, Mus musculus
tcatcttcgaggctgcaccccaaga

SEQ ID NO: 31365 - DNA, 25 bp, Mus musculus
tcttcgaggctgcaccccaagagac

SEQ ID NO: 31366 - DNA, 25 bp, Mus musculus
tcgaggctgcaccccaagagacacg

SEQ ID NO: 31367 - DNA, 25 bp, Mus musculus
ctgcaccccaagagacacgtggcat

SEQ ID NO: 31368 - DNA, 25 bp, Mus musculus
agccagtggccgactatttcctgtg

SEQ ID NO: 31369 - DNA, 25 bp, Mus musculus
cagtggccgactatttcctgtgact

SEQ ID NO: 31370 - DNA, 25 bp, Mus musculus
atttcctgtgactccttggccccag

SEQ ID NO: 31371 - DNA, 25 bp, Mus musculus
atgagaccgtgcttactgtgtggtc

SEQ ID NO: 31372 - DNA, 25 bp, Mus musculus
tgcttactgtgtggtcagcgcctaa

SEQ ID NO: 31373 - DNA, 25 bp, Mus musculus
ttactgtgtggtcagcgcctaatta

SEQ ID NO: 31374 - DNA, 25 bp, Mus musculus
tgtggtcagcgcctaattactgcta

SEQ ID NO: 31375 - DNA, 25 bp, Mus musculus
cagcgcctaattactgctaccgctg

SEQ ID NO: 31376 - DNA, 25 bp, Mus musculus
attactgctaccgctgtggcaatgt

SEQ ID NO: 31377 - DNA, 25 bp, Mus musculus
accgctgtggcaatgtggcagccat

SEQ ID NO: 31378 - DNA, 25 bp, Mus musculus
aactggatgagcacctccagaaaga

SEQ ID NO: 31379 - DNA, 25 bp, Mus musculus
tttagatgtcaccctggctttatca

SEQ ID NO: 31380 - DNA, 25 bp, Mus musculus
tgtcaccctggctttatcatgaaag

SEQ ID NO: 31381 - DNA, 25 bp, Mus musculus
cctcttctggccaaatgtgtatctc

SEQ ID NO: 31382 - DNA, 25 bp, Mus musculus
aaatgtgtatctcgctcaatcagtg

SEQ ID NO: 31383 - DNA, 25 bp, Mus musculus
gtatctcgctcaatcagtggtctaa

SEQ ID NO: 31384 - DNA, 25 bp, Mus musculus
cgctcaatcagtggtctaattgttg

SEQ ID NO: 31385 - DNA, 25 bp, Mus musculus
gacagctgtgtccgccttcagtctc

SEQ ID NO: 31386 - DNA, 25 bp, Mus musculus
cgccttcagtctctgctcacaagtc

SEQ ID NO: 31387 - DNA, 25 bp, Mus musculus
cagtctctgctcacaagtcaggaga

SEQ ID NO: 31388 - DNA, 25 bp, Mus musculus
ctgctcacaagtcaggagaacagca

SEQ ID NO: 31389 - DNA, 25 bp, Mus musculus
aacagcagtaccactagcccagcac

SEQ ID NO: 31390 - DNA, 25 bp, Mus musculus
agtaccactagcccagcacggaatt

SEQ ID NO: 31391 - DNA, 25 bp, Mus musculus
gtgcattgtcagtccctaaacaaat

SEQ ID NO: 31392 - DNA, 25 bp, Mus musculus
gtaccactagcccagcacggaattc

SEQ ID NO: 31393 - DNA, 25 bp, Mus musculus
tgtcagtccctaaacaaatgggagc

SEQ ID NO: 31394 - DNA, 25 bp, Mus musculus
ccagagttaccaagctgcttcaagg

SEQ ID NO: 31395 - DNA, 25 bp, Mus musculus
agctgcttcaagggagtgatatgtc

SEQ ID NO: 31396 - DNA, 25 bp, Mus musculus
atatgtcgtctccctcaggagatga

SEQ ID NO: 31397 - DNA, 25 bp, Mus musculus
ggcagttctcaaagccagtgccagt

SEQ ID NO: 31398 - DNA, 25 bp, Mus musculus
tctcaaagccagtgccagtctgatg

SEQ ID NO: 31399 - DNA, 25 bp, Mus musculus
tgccagtctgatggcagctggaatc

SEQ ID NO: 31400 - DNA, 25 bp, Mus musculus
tctattcgctgtctgtgagacacag

SEQ ID NO: 31401 - DNA, 25 bp, Mus musculus
ttcccaacaactggtactacatctc

SEQ ID NO: 31402 - DNA, 25 bp, Mus musculus
cacctgtcaccttgcgccagaagac

SEQ ID NO: 31403 - DNA, 25 bp, Mus musculus
tgcgccagaagacctttgactggaa

SEQ ID NO: 31404 - DNA, 25 bp, Mus musculus
cagagaacccactcagagtggacga

SEQ ID NO: 31405 - DNA, 25 bp, Mus musculus
acccactcagagtggacgaatccct

SEQ ID NO: 31406 - DNA, 25 bp, Mus musculus
aatcccttttcagctatggtcttcg

SEQ ID NO: 31407 - DNA, 25 bp, Mus musculus
ttttcagctatggtcttcgggaaag

SEQ ID NO: 31408 - DNA, 25 bp, Mus musculus
gctatggtcttcgggaaagcattgc

SEQ ID NO: 31409 - DNA, 25 bp, Mus musculus
gcagctccttcgaccggaagaagaa

SEQ ID NO: 31410 - DNA, 25 bp, Mus musculus
tctccctaatgtacactggcagcaa

SEQ ID NO: 31411 - DNA, 25 bp, Mus musculus
taatgtacactggcagcaaacgcaa

SEQ ID NO: 31412 - DNA, 25 bp, Mus musculus
acaactggtactacatctcaccaag

SEQ ID NO: 31413 - DNA, 25 bp, Mus musculus
ggctcaccttccaatgcctggagga

SEQ ID NO: 31414 - DNA, 25 bp, Mus musculus
ccttccaatgcctggaggacctggt

SEQ ID NO: 31415 - DNA, 25 bp, Mus musculus
aatgcctggaggacctggtgactca

SEQ ID NO: 31416 - DNA, 25 bp, Mus musculus
tgactcattattctgaagtggctga

SEQ ID NO: 31417 - DNA, 25 bp, Mus musculus
gtctggcacagaacatacctgctcc

SEQ ID NO: 31418 - DNA, 25 bp, Mus musculus
cacagaacatacctgctccaacatc

SEQ ID NO: 31419 - DNA, 25 bp, Mus musculus
cttgcaccagccctggttcacctgt

SEQ ID NO: 31420 - DNA, 25 bp, Mus musculus
cctctgcactcttcatggcgaagaa

SEQ ID NO: 31421 - DNA, 25 bp, Mus musculus
ctgcactcttcatggcgaagaagaa

SEQ ID NO: 31422 - DNA, 25 bp, Mus musculus
cagccagcaagctggagcaggggaa

SEQ ID NO: 31423 - DNA, 25 bp, Mus musculus
gtgagactccagcagccaagcgtct

SEQ ID NO: 31424 - DNA, 25 bp, Mus musculus
agactccagcagccaagcgtcttcg

SEQ ID NO: 31425 - DNA, 25 bp, Mus musculus
ctccagcagccaagcgtcttcggat

SEQ ID NO: 31426 - DNA, 25 bp, Mus musculus
cccagagcctgtctgggaagtccac

SEQ ID NO: 31427 - DNA, 25 bp, Mus musculus
agagcctgtctgggaagtccacacc

SEQ ID NO: 31428 - DNA, 25 bp, Mus musculus
cacccagcagcggtgatgtccaggt

SEQ ID NO: 31429 - DNA, 25 bp, Mus musculus
ccagcagcggtgatgtccaggtgac

SEQ ID NO: 31430 - DNA, 25 bp, Mus musculus
gtgatgtccaggtgacagaggacgc

SEQ ID NO: 31431 - DNA, 25 bp, Mus musculus
tgtccaggtgacagaggacgctgtg

SEQ ID NO: 31432 - DNA, 25 bp, Mus musculus
cactcttcatggcgaagaagaagac

SEQ ID NO: 31433 - DNA, 25 bp, Mus musculus
gttcaaagggcaccagtcggccagg

SEQ ID NO: 31434 - DNA, 25 bp, Mus musculus
gcaccagtcggccagggactcccag

SEQ ID NO: 31435 - DNA, 25 bp, Mus musculus
cagggactcccagtgcagaagcagc

SEQ ID NO: 31436 - DNA, 25 bp, Mus musculus
ggactcccagtgcagaagcagcaag

SEQ ID NO: 31437 - DNA, 25 bp, Mus musculus
cagaagcagcaagcacctcttctac

SEQ ID NO: 31438 - DNA, 25 bp, Mus musculus
aagcagcaagcacctcttctaccct

SEQ ID NO: 31439 - DNA, 25 bp, Mus musculus
ctaccctgcgggctgcagccagcaa

SEQ ID NO: 31440 - DNA, 25 bp, Mus musculus
aagactacgataggcttcggcactc

SEQ ID NO: 31441 - DNA, 25 bp, Mus musculus
gactacgataggcttcggcactctc

SEQ ID NO: 31442 - DNA, 25 bp, Mus musculus
tgatctgcttctccctggtgagccc

SEQ ID NO: 31443 - DNA, 25 bp, Mus musculus
acacccatccttctggtgggcacca

SEQ ID NO: 31444 - DNA, 25 bp, Mus musculus
acccatccttctggtgggcaccaag

SEQ ID NO: 31445 - DNA, 25 bp, Mus musculus
tgggcaccaagctggacctccgtta

SEQ ID NO: 31446 - DNA, 25 bp, Mus musculus
ggcaccaagctggacctccgttatt

SEQ ID NO: 31447 - DNA, 25 bp, Mus musculus
tccgttattacccaagatacgattg

SEQ ID NO: 31448 - DNA, 25 bp, Mus musculus
gattgaaccgcttccggacaaagag

SEQ ID NO: 31449 - DNA, 25 bp, Mus musculus
caaagccctggccatggcccaaaag

SEQ ID NO: 31450 - DNA, 25 bp, Mus musculus
gccctggccatggcccaaaagaatt

SEQ ID NO: 31451 - DNA, 25 bp, Mus musculus
cctggccatggcccaaaagaattgg

SEQ ID NO: 31452 - DNA, 25 bp, Mus musculus
ctacgataggcttcggcactctcct

SEQ ID NO: 31453 - DNA, 25 bp, Mus musculus
tggccatggcccaaaagaattggtt

SEQ ID NO: 31454 - DNA, 25 bp, Mus musculus
taggcttcggcactctcctatcctc

SEQ ID NO: 31455 - DNA, 25 bp, Mus musculus
ggcttcggcactctcctatcctcaa

SEQ ID NO: 31456 - DNA, 25 bp, Mus musculus
ctcctatcctcaaacagatgtcttt

SEQ ID NO: 31457 - DNA, 25 bp, Mus musculus
cctatcctcaaacagatgtctttct

SEQ ID NO: 31458 - DNA, 25 bp, Mus musculus
tatcctcaaacagatgtctttctga

SEQ ID NO: 31459 - DNA, 25 bp, Mus musculus
tcctcaaacagatgtctttctgatc

SEQ ID NO: 31460 - DNA, 25 bp, Mus musculus
tttctgatctgcttctccctggtga

SEQ ID NO: 31461 - DNA, 25 bp, Mus musculus
catcaggctccacagattgcagccc

SEQ ID NO: 31462 - DNA, 25 bp, Mus musculus
gctccacagattgcagcccgggaga

SEQ ID NO: 31463 - DNA, 25 bp, Mus musculus
cagtcactgggacctctggcgactt

SEQ ID NO: 31464 - DNA, 25 bp, Mus musculus
ttgccaggccccttgcagagccact

SEQ ID NO: 31465 - DNA, 25 bp, Mus musculus
acagctggccacggtagcgctccaa

SEQ ID NO: 31466 - DNA, 25 bp, Mus musculus
agcctccacagagttcccaaagtct

SEQ ID NO: 31467 - DNA, 25 bp, Mus musculus
cacagagttcccaaagtctcatgtt

SEQ ID NO: 31468 - DNA, 25 bp, Mus musculus
gttcccaaagtctcatgttccctgt

SEQ ID NO: 31469 - DNA, 25 bp, Mus musculus
tcatgttccctgtaccaccaggagg

SEQ ID NO: 31470 - DNA, 25 bp, Mus musculus
ctgtgcatcactaaggccctgtccc

SEQ ID NO: 31471 - DNA, 25 bp, Mus musculus
cgctgcatcaataaagcccaaggac

SEQ ID NO: 31472 - DNA, 25 bp, Mus musculus
agagctcccgagcctggaatagcca

SEQ ID NO: 31473 - DNA, 25 bp, Mus musculus
cctggccaccaacgagggacgctgt

SEQ ID NO: 31474 - DNA, 25 bp, Mus musculus
gagctcccgagcctggaatagccac

SEQ ID NO: 31475 - DNA, 25 bp, Mus musculus
ggccagttgcccgcagtctgtgcaa

SEQ ID NO: 31476 - DNA, 25 bp, Mus musculus
ttgcccgcagtctgtgcaaggaggg

SEQ ID NO: 31477 - DNA, 25 bp, Mus musculus
cacctccggtcagcatcaagtctga

SEQ ID NO: 31478 - DNA, 25 bp, Mus musculus
cggtcagcatcaagtctgagcgact

SEQ ID NO: 31479 - DNA, 25 bp, Mus musculus
gcatcaagtctgagcgactgtctcc

SEQ ID NO: 31480 - DNA, 25 bp, Mus musculus
agcgactgtctccagtcactgggac

SEQ ID NO: 31481 - DNA, 25 bp, Mus musculus
tgtctccagtcactgggacctctgg

SEQ ID NO: 31482 - DNA, 25 bp, Mus musculus
agcctgagaccatggcccgaatcgc

SEQ ID NO: 31483 - DNA, 25 bp, Mus musculus
gcctgagaccatggcccgaatcgca

SEQ ID NO: 31484 - DNA, 25 bp, Mus musculus
gaatcgcacagggtccatgtaccga

SEQ ID NO: 31485 - DNA, 25 bp, Mus musculus
aatcgcacagggtccatgtaccgag

SEQ ID NO: 31486 - DNA, 25 bp, Mus musculus
atcgcacagggtccatgtaccgagg

SEQ ID NO: 31487 - DNA, 25 bp, Mus musculus
tcgcacagggtccatgtaccgaggc

SEQ ID NO: 31488 - DNA, 25 bp, Mus musculus
cgcacagggtccatgtaccgaggct

SEQ ID NO: 31489 - DNA, 25 bp, Mus musculus
gcacagggtccatgtaccgaggctc

SEQ ID NO: 31490 - DNA, 25 bp, Mus musculus
cacagggtccatgtaccgaggctct

SEQ ID NO: 31491 - DNA, 25 bp, Mus musculus
acagggtccatgtaccgaggctctg

SEQ ID NO: 31492 - DNA, 25 bp, Mus musculus
ttctcagacgtttgacgcaaatcag

SEQ ID NO: 31493 - DNA, 25 bp, Mus musculus
tctcagacgtttgacgcaaatcagg

SEQ ID NO: 31494 - DNA, 25 bp, Mus musculus
accatggcccgaatcgcacagggtc

SEQ ID NO: 31495 - DNA, 25 bp, Mus musculus
ccatggcccgaatcgcacagggtcc

SEQ ID NO: 31496 - DNA, 25 bp, Mus musculus
catggcccgaatcgcacagggtcca

SEQ ID NO: 31497 - DNA, 25 bp, Mus musculus
ggcccgaatcgcacagggtccatgt

SEQ ID NO: 31498 - DNA, 25 bp, Mus musculus
gcccgaatcgcacagggtccatgta

SEQ ID NO: 31499 - DNA, 25 bp, Mus musculus
cccgaatcgcacagggtccatgtac

SEQ ID NO: 31500 - DNA, 25 bp, Mus musculus
ccgaatcgcacagggtccatgtacc

SEQ ID NO: 31501 - DNA, 25 bp, Mus musculus
cgaatcgcacagggtccatgtaccg

SEQ ID NO: 31502 - DNA, 25 bp, Mus musculus
gaatctgtgcctcctaatttaccag

SEQ ID NO: 31503 - DNA, 25 bp, Mus musculus
gtaattcaccttcagtttaacagca

SEQ ID NO: 31504 - DNA, 25 bp, Mus musculus
tcatacttctaaccccatcagtgca

SEQ ID NO: 31505 - DNA, 25 bp, Mus musculus
ttctaaccccatcagtgcagcttat

SEQ ID NO: 31506 - DNA, 25 bp, Mus musculus
ccccatcagtgcagcttataaccta

SEQ ID NO: 31507 - DNA, 25 bp, Mus musculus
catgtgcctaatgtctaaaggaaca

SEQ ID NO: 31508 - DNA, 25 bp, Mus musculus
ttaccgttttatctcactatgatgg

SEQ ID NO: 31509 - DNA, 25 bp, Mus musculus
ttttatctcactatgatggaagttt

SEQ ID NO: 31510 - DNA, 25 bp, Mus musculus
atccagcctgaatctcttagttcaa

SEQ ID NO: 31511 - DNA, 25 bp, Mus musculus
ataccaaaccactatctaaatagca

SEQ ID NO: 31512 - DNA, 25 bp, Mus musculus
aatagcatgcttttacacagacact

SEQ ID NO: 31513 - DNA, 25 bp, Mus musculus
ttacacagacacttgcttgagatac

SEQ ID NO: 31514 - DNA, 25 bp, Mus musculus
caccttcagtttaacagcatatctt

SEQ ID NO: 31515 - DNA, 25 bp, Mus musculus
ttccaagaaacttgcaactgtttgt

SEQ ID NO: 31516 - DNA, 25 bp, Mus musculus
aacagcatatcttcacttacagatg

SEQ ID NO: 31517 - DNA, 25 bp, Mus musculus
atatcttcacttacagatgatacat

SEQ ID NO: 31518 - DNA, 25 bp, Mus musculus
aaggctaatgacactcgttacattc

SEQ ID NO: 31519 - DNA, 25 bp, Mus musculus
aatgacactcgttacattcgggagc

SEQ ID NO: 31520 - DNA, 25 bp, Mus musculus
actcgttacattcgggagcgaattg

SEQ ID NO: 31521 - DNA, 25 bp, Mus musculus
ggcaatccaattgctctgggaaagc

SEQ ID NO: 31522 - DNA, 25 bp, Mus musculus
ggaaagcatccaaacagttttatct

SEQ ID NO: 31523 - DNA, 25 bp, Mus musculus
atctcctacaagctcaacggaaaga

SEQ ID NO: 31524 - DNA, 25 bp, Mus musculus
tacaagctcaacggaaagaggattc

SEQ ID NO: 31525 - DNA, 25 bp, Mus musculus
ttttagatgccaagtggaagccggc

SEQ ID NO: 31526 - DNA, 25 bp, Mus musculus
cagtgtgccaccgtgagtgacagcc

SEQ ID NO: 31527 - DNA, 25 bp, Mus musculus
gacagccgcagcgagaccctcggca

SEQ ID NO: 31528 - DNA, 25 bp, Mus musculus
cgcagcgagaccctcggcagtgcca

SEQ ID NO: 31529 - DNA, 25 bp, Mus musculus
gagaccctcggcagtgccaccaaca

SEQ ID NO: 31530 - DNA, 25 bp, Mus musculus
cctacaacaattttacatgtgtgaa

SEQ ID NO: 31531 - DNA, 25 bp, Mus musculus
ctcataacagaggccttcactgact

SEQ ID NO: 31532 - DNA, 25 bp, Mus musculus
gccttcactgactgattgtcacatg

SEQ ID NO: 31533 - DNA, 25 bp, Mus musculus
actgactgattgtcacatggtatgt

SEQ ID NO: 31534 - DNA, 25 bp, Mus musculus
tgattgtcacatggtatgtgttcag

SEQ ID NO: 31535 - DNA, 25 bp, Mus musculus
tatgaaacactgcctggatggaaag

SEQ ID NO: 31536 - DNA, 25 bp, Mus musculus
acactgcctggatggaaagcagaca

SEQ ID NO: 31537 - DNA, 25 bp, Mus musculus
tggaaagcagacaccacaggcgcca

SEQ ID NO: 31538 - DNA, 25 bp, Mus musculus
caggcccaaagctacgtgcgcttcg

SEQ ID NO: 31539 - DNA, 25 bp, Mus musculus
caaagctacgtgcgcttcgtggaga

SEQ ID NO: 31540 - DNA, 25 bp, Mus musculus
tacgtgcgcttcgtggagaatcaca

SEQ ID NO: 31541 - DNA, 25 bp, Mus musculus
aatcacatgggtgttgcagtcaaat

SEQ ID NO: 31542 - DNA, 25 bp, Mus musculus
atgatccagcttttttagatgccaa

SEQ ID NO: 31543 - DNA, 25 bp, Mus musculus
cattcttcaggcaactttcatcctt

SEQ ID NO: 31544 - DNA, 25 bp, Mus musculus
attcttcaggcaactttcatcctta

SEQ ID NO: 31545 - DNA, 25 bp, Mus musculus
aactttcatccttactatagctatt

SEQ ID NO: 31546 - DNA, 25 bp, Mus musculus
ctttcatccttactatagctatttc

SEQ ID NO: 31547 - DNA, 25 bp, Mus musculus
ttcatccttactatagctatttcta

SEQ ID NO: 31548 - DNA, 25 bp, Mus musculus
tcatccttactatagctatttctag

SEQ ID NO: 31549 - DNA, 25 bp, Mus musculus
atccttactatagctatttctagaa

SEQ ID NO: 31550 - DNA, 25 bp, Mus musculus
tccttactatagctatttctagaag

SEQ ID NO: 31551 - DNA, 25 bp, Mus musculus
ccttactatagctatttctagaagc

SEQ ID NO: 31552 - DNA, 25 bp, Mus musculus
cttactatagctatttctagaagcc

SEQ ID NO: 31553 - DNA, 25 bp, Mus musculus
gctatttctagaagccctttaacat

SEQ ID NO: 31554 - DNA, 25 bp, Mus musculus
tatttctagaagccctttaacattg

SEQ ID NO: 31555 - DNA, 25 bp, Mus musculus
ttcttcaggcaactttcatccttac

SEQ ID NO: 31556 - DNA, 25 bp, Mus musculus
cttcaggcaactttcatccttacta

SEQ ID NO: 31557 - DNA, 25 bp, Mus musculus
ttcaggcaactttcatccttactat

SEQ ID NO: 31558 - DNA, 25 bp, Mus musculus
tcaggcaactttcatccttactata

SEQ ID NO: 31559 - DNA, 25 bp, Mus musculus
caggcaactttcatccttactatag

SEQ ID NO: 31560 - DNA, 25 bp, Mus musculus
ggcaactttcatccttactatagct

SEQ ID NO: 31561 - DNA, 25 bp, Mus musculus
gcaactttcatccttactatagcta

SEQ ID NO: 31562 - DNA, 25 bp, Mus musculus
caactttcatccttactatagctat

SEQ ID NO: 31563 - DNA, 25 bp, Mus musculus
tggcaagaccgttttcgtggtcttg

SEQ ID NO: 31564 - DNA, 25 bp, Mus musculus
aaatgcccatgcaggttgatatcgt

SEQ ID NO: 31565 - DNA, 25 bp, Mus musculus
ccatccttataacagctacattttc

SEQ ID NO: 31566 - DNA, 25 bp, Mus musculus
atccttataacagctacattttcgg

SEQ ID NO: 31567 - DNA, 25 bp, Mus musculus
ccttataacagctacattttcggct

SEQ ID NO: 31568 - DNA, 25 bp, Mus musculus
ttaagtttttactccattatgcaca

SEQ ID NO: 31569 - DNA, 25 bp, Mus musculus
aagtttttactccattatgcacagt

SEQ ID NO: 31570 - DNA, 25 bp, Mus musculus
gtttttactccattatgcacagttt

SEQ ID NO: 31571 - DNA, 25 bp, Mus musculus
ttttactccattatgcacagtttga

SEQ ID NO: 31572 - DNA, 25 bp, Mus musculus
ttactccattatgcacagtttgaga

SEQ ID NO: 31573 - DNA, 25 bp, Mus musculus
actccattatgcacagtttgagata

SEQ ID NO: 31574 - DNA, 25 bp, Mus musculus
tccattatgcacagtttgagataaa

SEQ ID NO: 31575 - DNA, 25 bp, Mus musculus
atgcccatgcaggttgatatcgttg

SEQ ID NO: 31576 - DNA, 25 bp, Mus musculus
ttaaaagattcggctctcttattgg

SEQ ID NO: 31577 - DNA, 25 bp, Mus musculus
aagattcggctctcttattggaatc

SEQ ID NO: 31578 - DNA, 25 bp, Mus musculus
tgaactaataccatccttataacag

SEQ ID NO: 31579 - DNA, 25 bp, Mus musculus
aactaataccatccttataacagct

SEQ ID NO: 31580 - DNA, 25 bp, Mus musculus
ctaataccatccttataacagctac

SEQ ID NO: 31581 - DNA, 25 bp, Mus musculus
aataccatccttataacagctacat

SEQ ID NO: 31582 - DNA, 25 bp, Mus musculus
taccatccttataacagctacattt

SEQ ID NO: 31583 - DNA, 25 bp, Mus musculus
cgcttctaccagcgttttccagaag

SEQ ID NO: 31584 - DNA, 25 bp, Mus musculus
attcaacagcagattgttcgagaga

SEQ ID NO: 31585 - DNA, 25 bp, Mus musculus
aacatctgtaacttcttagaaggtg

SEQ ID NO: 31586 - DNA, 25 bp, Mus musculus
agtttgattggtggctctgactaca

SEQ ID NO: 31587 - DNA, 25 bp, Mus musculus
ttgattggtggctctgactacaaac

SEQ ID NO: 31588 - DNA, 25 bp, Mus musculus
ggtggctctgactacaaactgattt

SEQ ID NO: 31589 - DNA, 25 bp, Mus musculus
ggctctgactacaaactgatttacc

SEQ ID NO: 31590 - DNA, 25 bp, Mus musculus
tctgactacaaactgatttaccggc

SEQ ID NO: 31591 - DNA, 25 bp, Mus musculus
gactacaaactgatttaccggcact

SEQ ID NO: 31592 - DNA, 25 bp, Mus musculus
aaactgatttaccggcactatgcca

SEQ ID NO: 31593 - DNA, 25 bp, Mus musculus
ctgatttaccggcactatgccaccc

SEQ ID NO: 31594 - DNA, 25 bp, Mus musculus
gggatcttggacctcatccaggttt

SEQ ID NO: 31595 - DNA, 25 bp, Mus musculus
cgagagactttccatctggtcctca

SEQ ID NO: 31596 - DNA, 25 bp, Mus musculus
atcttggacctcatccaggtttttg

SEQ ID NO: 31597 - DNA, 25 bp, Mus musculus
gagactttccatctggtcctcaagc

SEQ ID NO: 31598 - DNA, 25 bp, Mus musculus
actttccatctggtcctcaagcgag

SEQ ID NO: 31599 - DNA, 25 bp, Mus musculus
catctggtcctcaagcgagatgaca

SEQ ID NO: 31600 - DNA, 25 bp, Mus musculus
ctggtcctcaagcgagatgacaaca

SEQ ID NO: 31601 - DNA, 25 bp, Mus musculus
gtcctcaagcgagatgacaacatct

SEQ ID NO: 31602 - DNA, 25 bp, Mus musculus
gatgacaacatctgtaacttcttag

SEQ ID NO: 31603 - DNA, 25 bp, Mus musculus
gacaacatctgtaacttcttagaag

SEQ ID NO: 31604 - DNA, 25 bp, Mus musculus
ccaagagtcaagtccttcaaggaga

SEQ ID NO: 31605 - DNA, 25 bp, Mus musculus
gtcaagtccttcaaggagatggctt

SEQ ID NO: 31606 - DNA, 25 bp, Mus musculus
cccatagcttatgagcagtgtatct

SEQ ID NO: 31607 - DNA, 25 bp, Mus musculus
agcagctctaagtaacccattcttc

SEQ ID NO: 31608 - DNA, 25 bp, Mus musculus
atacacggactctgatatgaatatt

SEQ ID NO: 31609 - DNA, 25 bp, Mus musculus
ttcatgtctgtacaatgatggattc

SEQ ID NO: 31610 - DNA, 25 bp, Mus musculus
tggattccaccaggaaaggagttgt

SEQ ID NO: 31611 - DNA, 25 bp, Mus musculus
tgctccctgttgctgaggcatacta

SEQ ID NO: 31612 - DNA, 25 bp, Mus musculus
ctgaggcatactacttcataaataa

SEQ ID NO: 31613 - DNA, 25 bp, Mus musculus
attttgcttgctgaaggaagagaac

SEQ ID NO: 31614 - DNA, 25 bp, Mus musculus
tttcatgaactcataatcttggact

SEQ ID NO: 31615 - DNA, 25 bp, Mus musculus
gaactcataatcttggactgtttat

SEQ ID NO: 31616 - DNA, 25 bp, Mus musculus
tccttcaaggagatggcttgagatc

SEQ ID NO: 31617 - DNA, 25 bp, Mus musculus
ttaaaatcagtgctcctcaaggctc

SEQ ID NO: 31618 - DNA, 25 bp, Mus musculus
ctcctcaaggctccaggtttagtag

SEQ ID NO: 31619 - DNA, 25 bp, Mus musculus
aaggctccaggtttagtagccagca

SEQ ID NO: 31620 - DNA, 25 bp, Mus musculus
ttagtagccagcaccaaacaacacc

SEQ ID NO: 31621 - DNA, 25 bp, Mus musculus
caacacccagaatagggtttgtgca

SEQ ID NO: 31622 - DNA, 25 bp, Mus musculus
aaattcagagccagattatgtattt

SEQ ID NO: 31623 - DNA, 25 bp, Mus musculus
gccttctaattccccatagcttatg

SEQ ID NO: 31624 - DNA, 25 bp, Mus musculus
ttcgcctttgaggtgactgaagatt

SEQ ID NO: 31625 - DNA, 25 bp, Mus musculus
ggcgtctactccagtaaatcctgtc

SEQ ID NO: 31626 - DNA, 25 bp, Mus musculus
atgccaccctggagaaaattgtgtg

SEQ ID NO: 31627 - DNA, 25 bp, Mus musculus
ggaaatccacccagaggccctctca

SEQ ID NO: 31628 - DNA, 25 bp, Mus musculus
actcctgagtctagacgcctaaaga

SEQ ID NO: 31629 - DNA, 25 bp, Mus musculus
gagtctagacgcctaaagacaggaa

SEQ ID NO: 31630 - DNA, 25 bp, Mus musculus
cacgtgacatcatcaccagaatacg

SEQ ID NO: 31631 - DNA, 25 bp, Mus musculus
acatcatcaccagaatacgcttgga

SEQ ID NO: 31632 - DNA, 25 bp, Mus musculus
tcaccagaatacgcttggattgtgg

SEQ ID NO: 31633 - DNA, 25 bp, Mus musculus
cccacgtggacctagaatcgtctct

SEQ ID NO: 31634 - DNA, 25 bp, Mus musculus
tcttcatgtactgggagctgtaatg

SEQ ID NO: 31635 - DNA, 25 bp, Mus musculus
tgtactgggagctgtaatggttacc

SEQ ID NO: 31636 - DNA, 25 bp, Mus musculus
tactccagtaaatcctgtcataaaa

SEQ ID NO: 31637 - DNA, 25 bp, Mus musculus
tcaataaacacacagtaaatacctc

SEQ ID NO: 31638 - DNA, 25 bp, Mus musculus
tcctgtcataaaactccagataaag

SEQ ID NO: 31639 - DNA, 25 bp, Mus musculus
ggattactctactggattgtgaaaa

SEQ ID NO: 31640 - DNA, 25 bp, Mus musculus
ttcctcattgaacgtgggaagaaca

SEQ ID NO: 31641 - DNA, 25 bp, Mus musculus
cccattcctcaggtataagccacgg

SEQ ID NO: 31642 - DNA, 25 bp, Mus musculus
gtataagccacggctgcacgggcaa

SEQ ID NO: 31643 - DNA, 25 bp, Mus musculus
actggtccttcgatgagaatgccac

SEQ ID NO: 31644 - DNA, 25 bp, Mus musculus
atgagaatgccaccctggagaaaat

SEQ ID NO: 31645 - DNA, 25 bp, Mus musculus
tgggtcagctggactggtatgcctg

SEQ ID NO: 31646 - DNA, 25 bp, Mus musculus
actggtatgcctggatcccaaatgg

SEQ ID NO: 31647 - DNA, 25 bp, Mus musculus
gcctggacctgccctatgagtacct

SEQ ID NO: 31648 - DNA, 25 bp, Mus musculus
ctgtctctgtgtgtgtgcacagtct

SEQ ID NO: 31649 - DNA, 25 bp, Mus musculus
caccacacagccctggggaatgcac

SEQ ID NO: 31650 - DNA, 25 bp, Mus musculus
acagccctggggaatgcacagcgat

SEQ ID NO: 31651 - DNA, 25 bp, Mus musculus
aatgcacagcgattatccctgttgt

SEQ ID NO: 31652 - DNA, 25 bp, Mus musculus
cagcgattatccctgttgtgtttta

SEQ ID NO: 31653 - DNA, 25 bp, Mus musculus
tgttttagctgccccaactctatga

SEQ ID NO: 31654 - DNA, 25 bp, Mus musculus
agctgccccaactctatgatatgtg

SEQ ID NO: 31655 - DNA, 25 bp, Mus musculus
cccaactctatgatatgtgcttgtt

SEQ ID NO: 31656 - DNA, 25 bp, Mus musculus
ttgaatccctagtacccacttctct

SEQ ID NO: 31657 - DNA, 25 bp, Mus musculus
atgcctggatcccaaatggcccatg

SEQ ID NO: 31658 - DNA, 25 bp, Mus musculus
caaatggcccatgcaccatgcggaa

SEQ ID NO: 31659 - DNA, 25 bp, Mus musculus
cacccatctccaaggatgtgacaga

SEQ ID NO: 31660 - DNA, 25 bp, Mus musculus
tggactcgttgccttgccttcagca

SEQ ID NO: 31661 - DNA, 25 bp, Mus musculus
cttgccttcagcaggcacggatgca

SEQ ID NO: 31662 - DNA, 25 bp, Mus musculus
agataacagtcaccaagttccttgg

SEQ ID NO: 31663 - DNA, 25 bp, Mus musculus
aattccaggaggagctggctatcat

SEQ ID NO: 31664 - DNA, 25 bp, Mus musculus
atgcaagcctggacctgccctatga

SEQ ID NO: 31665 - DNA, 25 bp, Mus musculus
atactgcagaccctgttcactcagt

SEQ ID NO: 31666 - DNA, 25 bp, Mus musculus
tactttcagagcatgattgacttat

SEQ ID NO: 31667 - DNA, 25 bp, Mus musculus
gaagttcttcagcagtttaatgagc

SEQ ID NO: 31668 - DNA, 25 bp, Mus musculus
gttcttcagcagtttaatgagcctt

SEQ ID NO: 31669 - DNA, 25 bp, Mus musculus
tttaatgagccttgagcacaaacgc

SEQ ID NO: 31670 - DNA, 25 bp, Mus musculus
gagccttgagcacaaacgcggtgct

SEQ ID NO: 31671 - DNA, 25 bp, Mus musculus
ccttgagcacaaacgcggtgctggg

SEQ ID NO: 31672 - DNA, 25 bp, Mus musculus
gcacaaacgcggtgctggggctaag

SEQ ID NO: 31673 - DNA, 25 bp, Mus musculus
caaacgcggtgctggggctaagtga

SEQ ID NO: 31674 - DNA, 25 bp, Mus musculus
gtgacatgtgccagtgcgatgctgc

SEQ ID NO: 31675 - DNA, 25 bp, Mus musculus
acatgtgccagtgcgatgctgccca

SEQ ID NO: 31676 - DNA, 25 bp, Mus musculus
gccagtgcgatgctgcccagccgag

SEQ ID NO: 31677 - DNA, 25 bp, Mus musculus
gaaggccaagacctcatagattcag

SEQ ID NO: 31678 - DNA, 25 bp, Mus musculus
tgacaagacacacgagcatgtgaca

SEQ ID NO: 31679 - DNA, 25 bp, Mus musculus
caagacacacgagcatgtgacaccc

SEQ ID NO: 31680 - DNA, 25 bp, Mus musculus
tgtgacaccccttgtcaggtcatca

SEQ ID NO: 31681 - DNA, 25 bp, Mus musculus
gacaccccttgtcaggtcatcagga

SEQ ID NO: 31682 - DNA, 25 bp, Mus musculus
accccttgtcaggtcatcaggaact

SEQ ID NO: 31683 - DNA, 25 bp, Mus musculus
ccttgtcaggtcatcaggaactagt

SEQ ID NO: 31684 - DNA, 25 bp, Mus musculus
gtcatcaggaactagtctggtgaag

SEQ ID NO: 31685 - DNA, 25 bp, Mus musculus
ttcagttctcagcacagacatctgt

SEQ ID NO: 31686 - DNA, 25 bp, Mus musculus
tctcagcacagacatctgtgttttt

SEQ ID NO: 31687 - DNA, 25 bp, Mus musculus
agctctgcaggggcatgaatctgag

SEQ ID NO: 31688 - DNA, 25 bp, Mus musculus
ctgcctcagctctgctcctcaggaa

SEQ ID NO: 31689 - DNA, 25 bp, Mus musculus
cctcagctctgctcctcaggaaggg

SEQ ID NO: 31690 - DNA, 25 bp, Mus musculus
gtcaggtctctcatcttaagaagtt

SEQ ID NO: 31691 - DNA, 25 bp, Mus musculus
tctctcatcttaagaagttccctct

SEQ ID NO: 31692 - DNA, 25 bp, Mus musculus
gcctgctcaggcccaagggtttcga

SEQ ID NO: 31693 - DNA, 25 bp, Mus musculus
tgctcaggcccaagggtttcgagaa

SEQ ID NO: 31694 - DNA, 25 bp, Mus musculus
tcgagaacctgcacttggtgctaat

SEQ ID NO: 31695 - DNA, 25 bp, Mus musculus
agaacctgcacttggtgctaatctg

SEQ ID NO: 31696 - DNA, 25 bp, Mus musculus
gctaaactgatccagtcctttctcc

SEQ ID NO: 31697 - DNA, 25 bp, Mus musculus
agacatctgtgtttttctcgtccaa

SEQ ID NO: 31698 - DNA, 25 bp, Mus musculus
ctcttccttaaggttcttgtgacag

SEQ ID NO: 31699 - DNA, 25 bp, Mus musculus
ttccttaaggttcttgtgacagatc

SEQ ID NO: 31700 - DNA, 25 bp, Mus musculus
gttcttgtgacagatccagttcagg

SEQ ID NO: 31701 - DNA, 25 bp, Mus musculus
cgtcactaggcacggcaagggtgag

SEQ ID NO: 31702 - DNA, 25 bp, Mus musculus
gtgccctttatttgtactgtcctgt

SEQ ID NO: 31703 - DNA, 25 bp, Mus musculus
tgtactgtcctgtcccatctccctg

SEQ ID NO: 31704 - DNA, 25 bp, Mus musculus
cccctctgtcatggcagctctgcag

SEQ ID NO: 31705 - DNA, 25 bp, Mus musculus
ctctccttgcaggagcggccgagtt

SEQ ID NO: 31706 - DNA, 25 bp, Mus musculus
ctccttgcaggagcggccgagttca

SEQ ID NO: 31707 - DNA, 25 bp, Mus musculus
tgtgctggacacacgttttaggaag

SEQ ID NO: 31708 - DNA, 25 bp, Mus musculus
gtgctggacacacgttttaggaagt

SEQ ID NO: 31709 - DNA, 25 bp, Mus musculus
tgctggacacacgttttaggaagtt

SEQ ID NO: 31710 - DNA, 25 bp, Mus musculus
gttttgcgatcaacggtcggtggct

SEQ ID NO: 31711 - DNA, 25 bp, Mus musculus
ttttgcgatcaacggtcggtggctg

SEQ ID NO: 31712 - DNA, 25 bp, Mus musculus
ttgcgatcaacggtcggtggctgtg

SEQ ID NO: 31713 - DNA, 25 bp, Mus musculus
agagattgaccctgtcaggtgtgaa

SEQ ID NO: 31714 - DNA, 25 bp, Mus musculus
agattgaccctgtcaggtgtgaaag

SEQ ID NO: 31715 - DNA, 25 bp, Mus musculus
gattgaccctgtcaggtgtgaaagt

SEQ ID NO: 31716 - DNA, 25 bp, Mus musculus
attgaccctgtcaggtgtgaaagtt

SEQ ID NO: 31717 - DNA, 25 bp, Mus musculus
tccttgcaggagcggccgagttcag

SEQ ID NO: 31718 - DNA, 25 bp, Mus musculus
ccttgcaggagcggccgagttcaga

SEQ ID NO: 31719 - DNA, 25 bp, Mus musculus
cttgcaggagcggccgagttcagag

SEQ ID NO: 31720 - DNA, 25 bp, Mus musculus
tgcaggagcggccgagttcagagtc

SEQ ID NO: 31721 - DNA, 25 bp, Mus musculus
agtcatgtgctggacacacgtttta

SEQ ID NO: 31722 - DNA, 25 bp, Mus musculus
gtcatgtgctggacacacgttttag

SEQ ID NO: 31723 - DNA, 25 bp, Mus musculus
tcatgtgctggacacacgttttagg

SEQ ID NO: 31724 - DNA, 25 bp, Mus musculus
catgtgctggacacacgttttagga

SEQ ID NO: 31725 - DNA, 25 bp, Mus musculus
ctgcgcttttctcctgagaatatga

SEQ ID NO: 31726 - DNA, 25 bp, Mus musculus
cggcatccctttgccttcatgcctt

SEQ ID NO: 31727 - DNA, 25 bp, Mus musculus
ttgcgctccaaaaatggcatccacc

SEQ ID NO: 31728 - DNA, 25 bp, Mus musculus
tccaaaaatggcatccacctctacc

SEQ ID NO: 31729 - DNA, 25 bp, Mus musculus
aatggcatccacctctacctgaagc

SEQ ID NO: 31730 - DNA, 25 bp, Mus musculus
atccacctctacctgaagccactgg

SEQ ID NO: 31731 - DNA, 25 bp, Mus musculus
attcaatgcctgggctttcaaactc

SEQ ID NO: 31732 - DNA, 25 bp, Mus musculus
ggctttcaaactcattccttcactc

SEQ ID NO: 31733 - DNA, 25 bp, Mus musculus
ttcactccacaaatatttgctgaat

SEQ ID NO: 31734 - DNA, 25 bp, Mus musculus
tgtttccctgtcttgagaaacttca

SEQ ID NO: 31735 - DNA, 25 bp, Mus musculus
aacttcatttatttctcataactgc

SEQ ID NO: 31736 - DNA, 25 bp, Mus musculus
tttagccatctcagtgtgcattttg

SEQ ID NO: 31737 - DNA, 25 bp, Mus musculus
gccttcatgcctttttctgcagggc

SEQ ID NO: 31738 - DNA, 25 bp, Mus musculus
aaggtggtcacagccctctgtttgc

SEQ ID NO: 31739 - DNA, 25 bp, Mus musculus
gtcacagccctctgtttgctgcgct

SEQ ID NO: 31740 - DNA, 25 bp, Mus musculus
gccctctgtttgctgcgctttgaat

SEQ ID NO: 31741 - DNA, 25 bp, Mus musculus
tttgaattctctccagatccctcaa

SEQ ID NO: 31742 - DNA, 25 bp, Mus musculus
ttctctccagatccctcaaagatcc

SEQ ID NO: 31743 - DNA, 25 bp, Mus musculus
ccagatccctcaaagatccccatta

SEQ ID NO: 31744 - DNA, 25 bp, Mus musculus
ccccagctgatcttgcgctccaaaa

SEQ ID NO: 31745 - DNA, 25 bp, Mus musculus
tccaggtggccgagacggtgacaga

SEQ ID NO: 31746 - DNA, 25 bp, Mus musculus
tggccgagacggtgacagagcagta

SEQ ID NO: 31747 - DNA, 25 bp, Mus musculus
tgcagacccctagagaactccacat

SEQ ID NO: 31748 - DNA, 25 bp, Mus musculus
ctagagaactccacatgtctccagg

SEQ ID NO: 31749 - DNA, 25 bp, Mus musculus
gagaactccacatgtctccaggcga

SEQ ID NO: 31750 - DNA, 25 bp, Mus musculus
acatgtctccaggcgagtaggcctc

SEQ ID NO: 31751 - DNA, 25 bp, Mus musculus
tgtctccaggcgagtaggcctcacc

SEQ ID NO: 31752 - DNA, 25 bp, Mus musculus
ctctggattctgtacactaatgcct

SEQ ID NO: 31753 - DNA, 25 bp, Mus musculus
attctgtacactaatgcctgcactt

SEQ ID NO: 31754 - DNA, 25 bp, Mus musculus
tgcacttgctgctctcgggaagaac

SEQ ID NO: 31755 - DNA, 25 bp, Mus musculus
tgctgctctcgggaagaactgattc

SEQ ID NO: 31756 - DNA, 25 bp, Mus musculus
taatccaataaaagccgccttgcga

SEQ ID NO: 31757 - DNA, 25 bp, Mus musculus
agctggctaacctcacacagggcga

SEQ ID NO: 31758 - DNA, 25 bp, Mus musculus
tcacacagggcgaagacaagtacta

SEQ ID NO: 31759 - DNA, 25 bp, Mus musculus
attcctctgactcagaggtcccctc

SEQ ID NO: 31760 - DNA, 25 bp, Mus musculus
agctgtttgactctgaccccatcac

SEQ ID NO: 31761 - DNA, 25 bp, Mus musculus
ctgaccccatcacagtggtgttacc

SEQ ID NO: 31762 - DNA, 25 bp, Mus musculus
acacagtggcggagaaggcgctaca

SEQ ID NO: 31763 - DNA, 25 bp, Mus musculus
gaagcatcaccttcctatatgtagg

SEQ ID NO: 31764 - DNA, 25 bp, Mus musculus
gcatcaccttcctatatgtaggagt

SEQ ID NO: 31765 - DNA, 25 bp, Mus musculus
agatgaccagttcatcatccttgca

SEQ ID NO: 31766 - DNA, 25 bp, Mus musculus
ccagttcatcatccttgcatgcgat

SEQ ID NO: 31767 - DNA, 25 bp, Mus musculus
cttagtccacgtgatgcgcacgtta

SEQ ID NO: 31768 - DNA, 25 bp, Mus musculus
ccacgtgatgcgcacgttagccagt

SEQ ID NO: 31769 - DNA, 25 bp, Mus musculus
aaatgacgacactgattctgcgtca

SEQ ID NO: 31770 - DNA, 25 bp, Mus musculus
cgacactgattctgcgtcaaccgat

SEQ ID NO: 31771 - DNA, 25 bp, Mus musculus
tgattctgcgtcaaccgatgatatg

SEQ ID NO: 31772 - DNA, 25 bp, Mus musculus
gtggtaaagccgctcacccagccgt

SEQ ID NO: 31773 - DNA, 25 bp, Mus musculus
cagctcatccttgccgagcctttac

SEQ ID NO: 31774 - DNA, 25 bp, Mus musculus
atccttgccgagcctttaccatcca

SEQ ID NO: 31775 - DNA, 25 bp, Mus musculus
atcaccgacttcacaggagggtctg

SEQ ID NO: 31776 - DNA, 25 bp, Mus musculus
gacttcacaggagggtctgacacgg

SEQ ID NO: 31777 - DNA, 25 bp, Mus musculus
catcatccttgcatgcgatggcatc

SEQ ID NO: 31778 - DNA, 25 bp, Mus musculus
atgcgatggcatctgggacgtcatg

SEQ ID NO: 31779 - DNA, 25 bp, Mus musculus
tggcatctgggacgtcatggggaac

SEQ ID NO: 31780 - DNA, 25 bp, Mus musculus
cgaagagctctgtgactttgtgaga

SEQ ID NO: 31781 - DNA, 25 bp, Mus musculus
agtcactgatgaccttgagaaagtt

SEQ ID NO: 31782 - DNA, 25 bp, Mus musculus
agtcgacacctgcttgtataaggga

SEQ ID NO: 31783 - DNA, 25 bp, Mus musculus
tgcacccaaagtctcggcagaggcg

SEQ ID NO: 31784 - DNA, 25 bp, Mus musculus
ccctgacttagtccacgtgatgcgc

SEQ ID NO: 31785 - DNA, 25 bp, Mus musculus
caggcagctctgtgttctggattgc

SEQ ID NO: 31786 - DNA, 25 bp, Mus musculus
gcagctctgtgttctggattgcacc

SEQ ID NO: 31787 - DNA, 25 bp, Mus musculus
cagtggacttcacttggcaggaatg

SEQ ID NO: 31788 - DNA, 25 bp, Mus musculus
acttcacttggcaggaatggcagga

SEQ ID NO: 31789 - DNA, 25 bp, Mus musculus
tcacttggcaggaatggcaggagct

SEQ ID NO: 31790 - DNA, 25 bp, Mus musculus
agctggatgctgctcagaggaccct

SEQ ID NO: 31791 - DNA, 25 bp, Mus musculus
tggatgctgctcagaggaccctcta

SEQ ID NO: 31792 - DNA, 25 bp, Mus musculus
actatagcagcctggtacccccttg

SEQ ID NO: 31793 - DNA, 25 bp, Mus musculus
atagcagcctggtacccccttgcag

SEQ ID NO: 31794 - DNA, 25 bp, Mus musculus
gcagcctggtacccccttgcagaag

SEQ ID NO: 31795 - DNA, 25 bp, Mus musculus
catcacaactgggcttattgatggt

SEQ ID NO: 31796 - DNA, 25 bp, Mus musculus
cacaactgggcttattgatggttta

SEQ ID NO: 31797 - DNA, 25 bp, Mus musculus
tgttctggattgcacctagtgtctg

SEQ ID NO: 31798 - DNA, 25 bp, Mus musculus
ggattgcacctagtgtctgtcgccg

SEQ ID NO: 31799 - DNA, 25 bp, Mus musculus
cacctagtgtctgtcgccgtgtgac

SEQ ID NO: 31800 - DNA, 25 bp, Mus musculus
tctgtcgccgtgtgactcgctggta

SEQ ID NO: 31801 - DNA, 25 bp, Mus musculus
gtcgccgtgtgactcgctggtacct

SEQ ID NO: 31802 - DNA, 25 bp, Mus musculus
gtgtgactcgctggtacctggacac

SEQ ID NO: 31803 - DNA, 25 bp, Mus musculus
tgactcgctggtacctggacaccca

SEQ ID NO: 31804 - DNA, 25 bp, Mus musculus
tagcagtggacttcacttggcagga

SEQ ID NO: 31805 - DNA, 25 bp, Mus musculus
gacaagatcatcctcctttccgaga

SEQ ID NO: 31806 - DNA, 25 bp, Mus musculus
caagatcatcctcctttccgagaca

SEQ ID NO: 31807 - DNA, 25 bp, Mus musculus
gatgcgcgtccaccatcacattctt

SEQ ID NO: 31808 - DNA, 25 bp, Mus musculus
atgcgcgtccaccatcacattcttc

SEQ ID NO: 31809 - DNA, 25 bp, Mus musculus
caccatcacattcttccctgactgg

SEQ ID NO: 31810 - DNA, 25 bp, Mus musculus
ccatcacattcttccctgactggtt

SEQ ID NO: 31811 - DNA, 25 bp, Mus musculus
cattcttccctgactggtttcctct

SEQ ID NO: 31812 - DNA, 25 bp, Mus musculus
tcttccctgactggtttcctctctt

SEQ ID NO: 31813 - DNA, 25 bp, Mus musculus
cttccctgactggtttcctctcttg

SEQ ID NO: 31814 - DNA, 25 bp, Mus musculus
cttcggtcatcgccagctccttcgt

SEQ ID NO: 31815 - DNA, 25 bp, Mus musculus
ttcggtcatcgccagctccttcgtt

SEQ ID NO: 31816 - DNA, 25 bp, Mus musculus
cgccagctccttcgttccctggaag

SEQ ID NO: 31817 - DNA, 25 bp, Mus musculus
aagatcatcctcctttccgagacag

SEQ ID NO: 31818 - DNA, 25 bp, Mus musculus
gccagctccttcgttccctggaagc

SEQ ID NO: 31819 - DNA, 25 bp, Mus musculus
catcctcctttccgagacagataaa

SEQ ID NO: 31820 - DNA, 25 bp, Mus musculus
atcctcctttccgagacagataaag

SEQ ID NO: 31821 - DNA, 25 bp, Mus musculus
ctcctttccgagacagataaagaca

SEQ ID NO: 31822 - DNA, 25 bp, Mus musculus
acagataaagacaccttcatgccga

SEQ ID NO: 31823 - DNA, 25 bp, Mus musculus
agataaagacaccttcatgccgatg

SEQ ID NO: 31824 - DNA, 25 bp, Mus musculus
gataaagacaccttcatgccgatgc

SEQ ID NO: 31825 - DNA, 25 bp, Mus musculus
taaagacaccttcatgccgatgcgc

SEQ ID NO: 31826 - DNA, 25 bp, Mus musculus
acttgcctagggatgcagagatatc

SEQ ID NO: 31827 - DNA, 25 bp, Mus musculus
agtgtcctccaggggaagagctaat

SEQ ID NO: 31828 - DNA, 25 bp, Mus musculus
gccgatgcaaacgctttcgatgggt

SEQ ID NO: 31829 - DNA, 25 bp, Mus musculus
gcaaacgctttcgatgggttgatgg

SEQ ID NO: 31830 - DNA, 25 bp, Mus musculus
gctttcgatgggttgatggaagttc

SEQ ID NO: 31831 - DNA, 25 bp, Mus musculus
attttgcatactgggctgctgggca

SEQ ID NO: 31832 - DNA, 25 bp, Mus musculus
gtgtgaccctgtgtactcaaggagg

SEQ ID NO: 31833 - DNA, 25 bp, Mus musculus
aaggaggccactggcgtctatctca

SEQ ID NO: 31834 - DNA, 25 bp, Mus musculus
ggcgtctatctcactgtgtcaagag

SEQ ID NO: 31835 - DNA, 25 bp, Mus musculus
tatctcactgtgtcaagagacgtcc

SEQ ID NO: 31836 - DNA, 25 bp, Mus musculus
tcaagagacgtcccttcatctgttc

SEQ ID NO: 31837 - DNA, 25 bp, Mus musculus
gacgtcccttcatctgttcgtattg

SEQ ID NO: 31838 - DNA, 25 bp, Mus musculus
ttcagtgccccaaggaagaggacac

SEQ ID NO: 31839 - DNA, 25 bp, Mus musculus
acgtcccttcatctgttcgtattga

SEQ ID NO: 31840 - DNA, 25 bp, Mus musculus
aggacacaacaagtcttatgggtga

SEQ ID NO: 31841 - DNA, 25 bp, Mus musculus
gtcttatgggtgactctggatgcaa

SEQ ID NO: 31842 - DNA, 25 bp, Mus musculus
gatgcaagacctgtcgctacctcct

SEQ ID NO: 31843 - DNA, 25 bp, Mus musculus
acctcctagtcaggagggctgaatg

SEQ ID NO: 31844 - DNA, 25 bp, Mus musculus
tcgcctccattcacagtttcagtgt

SEQ ID NO: 31845 - DNA, 25 bp, Mus musculus
ttaacttcggaatccagtccgctgt

SEQ ID NO: 31846 - DNA, 25 bp, Mus musculus
tcggaatccagtccgctgtcagggg

SEQ ID NO: 31847 - DNA, 25 bp, Mus musculus
tatgaacctgtgttctgtcagatta

SEQ ID NO: 31848 - DNA, 25 bp, Mus musculus
atgaacctgtgttctgtcagattat

SEQ ID NO: 31849 - DNA, 25 bp, Mus musculus
ttcccaaaggtggcagctgttcctc

SEQ ID NO: 31850 - DNA, 25 bp, Mus musculus
ctcagctgctcctgctggaccaaag

SEQ ID NO: 31851 - DNA, 25 bp, Mus musculus
ggtgttcgttagtcctcttgcgaag

SEQ ID NO: 31852 - DNA, 25 bp, Mus musculus
gtgttcgttagtcctcttgcgaaga

SEQ ID NO: 31853 - DNA, 25 bp, Mus musculus
gttcgttagtcctcttgcgaagaag

SEQ ID NO: 31854 - DNA, 25 bp, Mus musculus
ttcgttagtcctcttgcgaagaagt

SEQ ID NO: 31855 - DNA, 25 bp, Mus musculus
cgttagtcctcttgcgaagaagttg

SEQ ID NO: 31856 - DNA, 25 bp, Mus musculus
tagtcctcttgcgaagaagttggca

SEQ ID NO: 31857 - DNA, 25 bp, Mus musculus
agtcctcttgcgaagaagttggcag

SEQ ID NO: 31858 - DNA, 25 bp, Mus musculus
tcctcttgcgaagaagttggcagca

SEQ ID NO: 31859 - DNA, 25 bp, Mus musculus
aacctgtgttctgtcagattatctt

SEQ ID NO: 31860 - DNA, 25 bp, Mus musculus
tgttctgtcagattatctttgcagt

SEQ ID NO: 31861 - DNA, 25 bp, Mus musculus
agattatctttgcagtgatgaatgg

SEQ ID NO: 31862 - DNA, 25 bp, Mus musculus
attatctttgcagtgatgaatggat

SEQ ID NO: 31863 - DNA, 25 bp, Mus musculus
ttatctttgcagtgatgaatggata

SEQ ID NO: 31864 - DNA, 25 bp, Mus musculus
atctttgcagtgatgaatggataga

SEQ ID NO: 31865 - DNA, 25 bp, Mus musculus
tagatgctctgtaacttttttccca

SEQ ID NO: 31866 - DNA, 25 bp, Mus musculus
tttcccaaaggtggcagctgttcct

SEQ ID NO: 31867 - DNA, 25 bp, Mus musculus
atccgatgtaactcggtcctcccag

SEQ ID NO: 31868 - DNA, 25 bp, Mus musculus
ttcattgcaacgcccatgacccaga

SEQ ID NO: 31869 - DNA, 25 bp, Mus musculus
atcacaggggcctccgtggaagtca

SEQ ID NO: 31870 - DNA, 25 bp, Mus musculus
gcagcctgcagagcagacatccctt

SEQ ID NO: 31871 - DNA, 25 bp, Mus musculus
tgcagagcagacatcccttctttag

SEQ ID NO: 31872 - DNA, 25 bp, Mus musculus
agagcagacatcccttctttagacc

SEQ ID NO: 31873 - DNA, 25 bp, Mus musculus
gcagacatcccttctttagaccagg

SEQ ID NO: 31874 - DNA, 25 bp, Mus musculus
tctttagaccagggacagaagtggg

SEQ ID NO: 31875 - DNA, 25 bp, Mus musculus
ccctctcaggaggtcttttcatgta

SEQ ID NO: 31876 - DNA, 25 bp, Mus musculus
tctcaggaggtcttttcatgtaact

SEQ ID NO: 31877 - DNA, 25 bp, Mus musculus
tcatgtaactgcctgatggaagccg

SEQ ID NO: 31878 - DNA, 25 bp, Mus musculus
aactgcctgatggaagccggactct

SEQ ID NO: 31879 - DNA, 25 bp, Mus musculus
attgcaacgcccatgacccagaaaa

SEQ ID NO: 31880 - DNA, 25 bp, Mus musculus
gcaacgcccatgacccagaaaatgc

SEQ ID NO: 31881 - DNA, 25 bp, Mus musculus
atgacccagaaaatgccagagaaag

SEQ ID NO: 31882 - DNA, 25 bp, Mus musculus
actgcaatgattccgttgggacaca

SEQ ID NO: 31883 - DNA, 25 bp, Mus musculus
gttgcattcttggcatctgaagaca

SEQ ID NO: 31884 - DNA, 25 bp, Mus musculus
ttcttggcatctgaagacagtggat

SEQ ID NO: 31885 - DNA, 25 bp, Mus musculus
ggatacatcacaggggcctccgtgg

SEQ ID NO: 31886 - DNA, 25 bp, Mus musculus
tacatcacaggggcctccgtggaag

SEQ ID NO: 31887 - DNA, 25 bp, Mus musculus
agtccagcatctatcggagtcttat

SEQ ID NO: 31888 - DNA, 25 bp, Mus musculus
ccagcatctatcggagtcttattgc

SEQ ID NO: 31889 - DNA, 25 bp, Mus musculus
cccaccgtgcagtgtgcatcaacca

SEQ ID NO: 31890 - DNA, 25 bp, Mus musculus
tgtgcatcaaccacaacacccctgg

SEQ ID NO: 31891 - DNA, 25 bp, Mus musculus
cccctgggcttcccaagatctacat

SEQ ID NO: 31892 - DNA, 25 bp, Mus musculus
ctgggcttcccaagatctacatcca

SEQ ID NO: 31893 - DNA, 25 bp, Mus musculus
ggcttcccaagatctacatccatcg

SEQ ID NO: 31894 - DNA, 25 bp, Mus musculus
ttcccaagatctacatccatcgggt

SEQ ID NO: 31895 - DNA, 25 bp, Mus musculus
ccaagatctacatccatcgggttgg

SEQ ID NO: 31896 - DNA, 25 bp, Mus musculus
agatctacatccatcgggttggccg

SEQ ID NO: 31897 - DNA, 25 bp, Mus musculus
tctacatccatcgggttggccgcac

SEQ ID NO: 31898 - DNA, 25 bp, Mus musculus
acatccatcgggttggccgcacagc

SEQ ID NO: 31899 - DNA, 25 bp, Mus musculus
gcatctatcggagtcttattgccac

SEQ ID NO: 31900 - DNA, 25 bp, Mus musculus
tctatcggagtcttattgccactga

SEQ ID NO: 31901 - DNA, 25 bp, Mus musculus
gtcttattgccactgacgtcggctc

SEQ ID NO: 31902 - DNA, 25 bp, Mus musculus
ttattgccactgacgtcggctcaga

SEQ ID NO: 31903 - DNA, 25 bp, Mus musculus
ttgccactgacgtcggctcagaggg

SEQ ID NO: 31904 - DNA, 25 bp, Mus musculus
ccactgacgtcggctcagaggggct

SEQ ID NO: 31905 - DNA, 25 bp, Mus musculus
acgtcggctcagaggggcttggaca

SEQ ID NO: 31906 - DNA, 25 bp, Mus musculus
tcggctcagaggggcttggacatcc

SEQ ID NO: 31907 - DNA, 25 bp, Mus musculus
ggatctagttccctttgcttgctac

SEQ ID NO: 31908 - DNA, 25 bp, Mus musculus
atctagttccctttgcttgctactc

SEQ ID NO: 31909 - DNA, 25 bp, Mus musculus
gatggcccatttgcctgctccctct

SEQ ID NO: 31910 - DNA, 25 bp, Mus musculus
ccatttgcctgctccctctgctgga

SEQ ID NO: 31911 - DNA, 25 bp, Mus musculus
gctccctctgctggaaggtcttcaa

SEQ ID NO: 31912 - DNA, 25 bp, Mus musculus
tccctctgctggaaggtcttcaaga

SEQ ID NO: 31913 - DNA, 25 bp, Mus musculus
cctctgctggaaggtcttcaagaag

SEQ ID NO: 31914 - DNA, 25 bp, Mus musculus
tctgctggaaggtcttcaagaagcc

SEQ ID NO: 31915 - DNA, 25 bp, Mus musculus
accagcaccagatcatccacacggg

SEQ ID NO: 31916 - DNA, 25 bp, Mus musculus
gtgagaaacccttctcctgctccgt

SEQ ID NO: 31917 - DNA, 25 bp, Mus musculus
tcctgctccgtgtgcagcaaaagct

SEQ ID NO: 31918 - DNA, 25 bp, Mus musculus
tgcagcaaaagcttcaaccggagga

SEQ ID NO: 31919 - DNA, 25 bp, Mus musculus
agttccctttgcttgctactcacgg

SEQ ID NO: 31920 - DNA, 25 bp, Mus musculus
ccctttgcttgctactcacgggctc

SEQ ID NO: 31921 - DNA, 25 bp, Mus musculus
cgggctctctttgctcagtccccat

SEQ ID NO: 31922 - DNA, 25 bp, Mus musculus
tcctcttcttcacagggtctccctt

SEQ ID NO: 31923 - DNA, 25 bp, Mus musculus
cacagggtctcccttctttccactg

SEQ ID NO: 31924 - DNA, 25 bp, Mus musculus
cagggtctcccttctttccactgat

SEQ ID NO: 31925 - DNA, 25 bp, Mus musculus
cttctttccactgatgggaacacca

SEQ ID NO: 31926 - DNA, 25 bp, Mus musculus
tctttccactgatgggaacaccacc

SEQ ID NO: 31927 - DNA, 25 bp, Mus musculus
ctaactgctgagctgggcactctgc

SEQ ID NO: 31928 - DNA, 25 bp, Mus musculus
actgctgagctgggcactctgcctg

SEQ ID NO: 31929 - DNA, 25 bp, Mus musculus
tgtcttacaatttttccaagctgat

SEQ ID NO: 31930 - DNA, 25 bp, Mus musculus
tttccaagctgatttattagttata

SEQ ID NO: 31931 - DNA, 25 bp, Mus musculus
aaccagtaatacacacatcatctag

SEQ ID NO: 31932 - DNA, 25 bp, Mus musculus
cagtaatacacacatcatctagctt

SEQ ID NO: 31933 - DNA, 25 bp, Mus musculus
tacacacatcatctagctttttcat

SEQ ID NO: 31934 - DNA, 25 bp, Mus musculus
tctcccttgcagccctacgtgttga

SEQ ID NO: 31935 - DNA, 25 bp, Mus musculus
cccttgcagccctacgtgttgaggt

SEQ ID NO: 31936 - DNA, 25 bp, Mus musculus
tacgtgttgaggttctcttgcaatc

SEQ ID NO: 31937 - DNA, 25 bp, Mus musculus
ttgaggttctcttgcaatctgtgtt

SEQ ID NO: 31938 - DNA, 25 bp, Mus musculus
ttctcttgcaatctgtgttaagtac

SEQ ID NO: 31939 - DNA, 25 bp, Mus musculus
tgtctgactggacacacttcctgaa

SEQ ID NO: 31940 - DNA, 25 bp, Mus musculus
ggacacacttcctgaaatcaggccg

SEQ ID NO: 31941 - DNA, 25 bp, Mus musculus
tctgtctttcagttctgtttcaaac

SEQ ID NO: 31942 - DNA, 25 bp, Mus musculus
tttcagttctgtttcaaactagtgt

SEQ ID NO: 31943 - DNA, 25 bp, Mus musculus
ctagtgtaacaccacgctggctcta

SEQ ID NO: 31944 - DNA, 25 bp, Mus musculus
caccacgctggctctaatgtatctt

SEQ ID NO: 31945 - DNA, 25 bp, Mus musculus
cacgctggctctaatgtatcttttc

SEQ ID NO: 31946 - DNA, 25 bp, Mus musculus
ttctgtcttacaatttttccaagct

SEQ ID NO: 31947 - DNA, 25 bp, Mus musculus
acactcagcggtcatgtctggacat

SEQ ID NO: 31948 - DNA, 25 bp, Mus musculus
gtctggacatgagtgcccagggaat

SEQ ID NO: 31949 - DNA, 25 bp, Mus musculus
gcatttcactgggagcttgcactat

SEQ ID NO: 31950 - DNA, 25 bp, Mus musculus
tttcctgcagtgatcagggtcctgc

SEQ ID NO: 31951 - DNA, 25 bp, Mus musculus
atcagggtcctgcaagcagtgggga

SEQ ID NO: 31952 - DNA, 25 bp, Mus musculus
gcaatcatggttcactgcagtcttg

SEQ ID NO: 31953 - DNA, 25 bp, Mus musculus
atggttcactgcagtcttgaccttt

SEQ ID NO: 31954 - DNA, 25 bp, Mus musculus
gaccttttgggctcaagtgatcctc

SEQ ID NO: 31955 - DNA, 25 bp, Mus musculus
tcctgagtagctgggaccataggct

SEQ ID NO: 31956 - DNA, 25 bp, Mus musculus
gggaccataggctcacaacaccaca

SEQ ID NO: 31957 - DNA, 25 bp, Mus musculus
gggtctcgcaacattgcccagactt

SEQ ID NO: 31958 - DNA, 25 bp, Mus musculus
attgcccagacttcctttgtgttag

SEQ ID NO: 31959 - DNA, 25 bp, Mus musculus
tggacatgagtgcccagggaatatg

SEQ ID NO: 31960 - DNA, 25 bp, Mus musculus
gaatatgcccaagctatgccttgtc

SEQ ID NO: 31961 - DNA, 25 bp, Mus musculus
tatgcccaagctatgccttgtcctc

SEQ ID NO: 31962 - DNA, 25 bp, Mus musculus
gctatgccttgtcctcttgtcctgt

SEQ ID NO: 31963 - DNA, 25 bp, Mus musculus
ccttgtcctcttgtcctgtttgcat

SEQ ID NO: 31964 - DNA, 25 bp, Mus musculus
cctcttgtcctgtttgcatttcact

SEQ ID NO: 31965 - DNA, 25 bp, Mus musculus
cttgtcctgtttgcatttcactggg

SEQ ID NO: 31966 - DNA, 25 bp, Mus musculus
gtcctgtttgcatttcactgggagc

SEQ ID NO: 31967 - DNA, 25 bp, Mus musculus
gtggctgcctgctttcagaatcctg

SEQ ID NO: 31968 - DNA, 25 bp, Mus musculus
gctgcctgctttcagaatcctgtgt

SEQ ID NO: 31969 - DNA, 25 bp, Mus musculus
aagagttgctgaggcccaagcagtt

SEQ ID NO: 31970 - DNA, 25 bp, Mus musculus
tgctgaggcccaagcagtttattta

SEQ ID NO: 31971 - DNA, 25 bp, Mus musculus
agacagactgacagccatggatggg

SEQ ID NO: 31972 - DNA, 25 bp, Mus musculus
actgacagccatggatgggctggag

SEQ ID NO: 31973 - DNA, 25 bp, Mus musculus
agccatggatgggctggagaaacag

SEQ ID NO: 31974 - DNA, 25 bp, Mus musculus
ttgtaccagtactccagccgcatgt

SEQ ID NO: 31975 - DNA, 25 bp, Mus musculus
cagtactccagccgcatgtatccag

SEQ ID NO: 31976 - DNA, 25 bp, Mus musculus
tacgtgagggccttggctgactgcg

SEQ ID NO: 31977 - DNA, 25 bp, Mus musculus
gtatgcgtccttcctatggctggag

SEQ ID NO: 31978 - DNA, 25 bp, Mus musculus
gtctgcactttgatttgtttcctaa

SEQ ID NO: 31979 - DNA, 25 bp, Mus musculus
tttcagaatcctgtgtgtcagccag

SEQ ID NO: 31980 - DNA, 25 bp, Mus musculus
cagaatcctgtgtgtcagccaggcc

SEQ ID NO: 31981 - DNA, 25 bp, Mus musculus
aatcctgtgtgtcagccaggccggg

SEQ ID NO: 31982 - DNA, 25 bp, Mus musculus
tgtcagccaggccgggtggtacagc

SEQ ID NO: 31983 - DNA, 25 bp, Mus musculus
cagcttgcctggctgggtttgcagg

SEQ ID NO: 31984 - DNA, 25 bp, Mus musculus
tccgatcgaagctttaatggagcgt

SEQ ID NO: 31985 - DNA, 25 bp, Mus musculus
ttatcgaggcctctgcgaagcctgg

SEQ ID NO: 31986 - DNA, 25 bp, Mus musculus
ctacccaagagttgctgaggcccaa

SEQ ID NO: 31987 - DNA, 25 bp, Mus musculus
aggcctcgatgtccagccatgacgc

SEQ ID NO: 31988 - DNA, 25 bp, Mus musculus
ccagtcgcaatccctgctgcttatg

SEQ ID NO: 31989 - DNA, 25 bp, Mus musculus
agtacagagctgggcacagtccttt

SEQ ID NO: 31990 - DNA, 25 bp, Mus musculus
gagctgggcacagtcctttgacaag

SEQ ID NO: 31991 - DNA, 25 bp, Mus musculus
ggcacagtcctttgacaagttgatg

SEQ ID NO: 31992 - DNA, 25 bp, Mus musculus
acagtcctttgacaagttgatgcat

SEQ ID NO: 31993 - DNA, 25 bp, Mus musculus
gttgatgcatagccccacggcgcgc

SEQ ID NO: 31994 - DNA, 25 bp, Mus musculus
gatgcatagccccacggcgcgcagt

SEQ ID NO: 31995 - DNA, 25 bp, Mus musculus
tgtattccgggcattcctgcgcaca

SEQ ID NO: 31996 - DNA, 25 bp, Mus musculus
ccgggcattcctgcgcacagaatac

SEQ ID NO: 31997 - DNA, 25 bp, Mus musculus
ggcattcctgcgcacagaatacagc

SEQ ID NO: 31998 - DNA, 25 bp, Mus musculus
cctgcgcacagaatacagcgaagag

SEQ ID NO: 31999 - DNA, 25 bp, Mus musculus
gtcgcaatccctgctgcttatgctg

SEQ ID NO: 32000 - DNA, 25 bp, Mus musculus
gcttatgctggtgctgctgctgtac

SEQ ID NO: 32001 - DNA, 25 bp, Mus musculus
gctgctgctgtactgctcctggaac

SEQ ID NO: 32002 - DNA, 25 bp, Mus musculus
gctgctgtactgctcctggaaccaa

SEQ ID NO: 32003 - DNA, 25 bp, Mus musculus
ccccagctgtgaagtctgcactcca

SEQ ID NO: 32004 - DNA, 25 bp, Mus musculus
ctgtgaagtctgcactccaccaagc

SEQ ID NO: 32005 - DNA, 25 bp, Mus musculus
tgaagtctgcactccaccaagccct

SEQ ID NO: 32006 - DNA, 25 bp, Mus musculus
tccaccaagccctaaggaagtacag

SEQ ID NO: 32007 - DNA, 25 bp, Mus musculus
ctcagacgccctgctggaaaagaag

SEQ ID NO: 32008 - DNA, 25 bp, Mus musculus
catggccgctagggagcgcaaagcc

SEQ ID NO: 32009 - DNA, 25 bp, Mus musculus
agcgttccacaaactgatacgcttt

SEQ ID NO: 32010 - DNA, 25 bp, Mus musculus
ccacaaactgatacgctttaagtgc

SEQ ID NO: 32011 - DNA, 25 bp, Mus musculus
actgatacgctttaagtgcgcaggt

SEQ ID NO: 32012 - DNA, 25 bp, Mus musculus
ttgacttgtcaatggcagtggggtc

SEQ ID NO: 32013 - DNA, 25 bp, Mus musculus
tgtcaatggcagtggggtcgcctaa

SEQ ID NO: 32014 - DNA, 25 bp, Mus musculus
gtcttttcacaggtaggtcaaatct

SEQ ID NO: 32015 - DNA, 25 bp, Mus musculus
cttctgggcaagggcaatggatcct

SEQ ID NO: 32016 - DNA, 25 bp, Mus musculus
aagcctagcttctctgagagagcac

SEQ ID NO: 32017 - DNA, 25 bp, Mus musculus
agcttctctgagagagcactctgga

SEQ ID NO: 32018 - DNA, 25 bp, Mus musculus
tactgtaaagcttccatacccgagg

SEQ ID NO: 32019 - DNA, 25 bp, Mus musculus
ggagcgcaaagccaccaagacccta

SEQ ID NO: 32020 - DNA, 25 bp, Mus musculus
catctccctggtgatgcctatctgt

SEQ ID NO: 32021 - DNA, 25 bp, Mus musculus
cctggtgatgcctatctgtaaggat

SEQ ID NO: 32022 - DNA, 25 bp, Mus musculus
taaggatgcctgctggtttcacatg

SEQ ID NO: 32023 - DNA, 25 bp, Mus musculus
ctggtttcacatggccatttttgac

SEQ ID NO: 32024 - DNA, 25 bp, Mus musculus
ggccatttttgacttcttcaattgg

SEQ ID NO: 32025 - DNA, 25 bp, Mus musculus
cttcttcaattggttaggctatctt

SEQ ID NO: 32026 - DNA, 25 bp, Mus musculus
ctacaccatgtccaatgaggacttc

SEQ ID NO: 32027 - DNA, 25 bp, Mus musculus
gtactgccagaataaacccaagtca

SEQ ID NO: 32028 - DNA, 25 bp, Mus musculus
ccagaataaacccaagtcagagcat

SEQ ID NO: 32029 - DNA, 25 bp, Mus musculus
agctcaatgacctcctcattaaacc

SEQ ID NO: 32030 - DNA, 25 bp, Mus musculus
tcctcattaaaccagtgcagcgaat

SEQ ID NO: 32031 - DNA, 25 bp, Mus musculus
tcatgaaataccagttgctgctgaa

SEQ ID NO: 32032 - DNA, 25 bp, Mus musculus
aataccagttgctgctgaaggattt

SEQ ID NO: 32033 - DNA, 25 bp, Mus musculus
accagttgctgctgaaggattttct

SEQ ID NO: 32034 - DNA, 25 bp, Mus musculus
tcatgtgtttcgtacctaagcgatg

SEQ ID NO: 32035 - DNA, 25 bp, Mus musculus
tgtgtttcgtacctaagcgatgcaa

SEQ ID NO: 32036 - DNA, 25 bp, Mus musculus
gtttcgtacctaagcgatgcaatga

SEQ ID NO: 32037 - DNA, 25 bp, Mus musculus
atgatatgatgtccctggggagact

SEQ ID NO: 32038 - DNA, 25 bp, Mus musculus
atatgatgtccctggggagacttcg

SEQ ID NO: 32039 - DNA, 25 bp, Mus musculus
gaataaacccaagtcagagcatgtg

SEQ ID NO: 32040 - DNA, 25 bp, Mus musculus
taaacccaagtcagagcatgtgctg

SEQ ID NO: 32041 - DNA, 25 bp, Mus musculus
agagcatgtgctgtcagagtttggg

SEQ ID NO: 32042 - DNA, 25 bp, Mus musculus
ctactttgaggagctgaggcagcag

SEQ ID NO: 32043 - DNA, 25 bp, Mus musculus
gctgtggacaccgactgcagctcaa

SEQ ID NO: 32044 - DNA, 25 bp, Mus musculus
gacaccgactgcagctcaatgacct

SEQ ID NO: 32045 - DNA, 25 bp, Mus musculus
gactgcagctcaatgacctcctcat

SEQ ID NO: 32046 - DNA, 25 bp, Mus musculus
tgcagctcaatgacctcctcattaa

SEQ ID NO: 32047 - DNA, 25 bp, Mus musculus
atgtcaaagcggccagggactttat

SEQ ID NO: 32048 - DNA, 25 bp, Mus musculus
actttatcctgaagctgtatcaaga

SEQ ID NO: 32049 - DNA, 25 bp, Mus musculus
gcctactcctccgagacagagggtg

SEQ ID NO: 32050 - DNA, 25 bp, Mus musculus
tcctccgagacagagggtgatctga

SEQ ID NO: 32051 - DNA, 25 bp, Mus musculus
gatctgagcccttcctgcctgatct

SEQ ID NO: 32052 - DNA, 25 bp, Mus musculus
tcctgcctgatctacaagtgcttct

SEQ ID NO: 32053 - DNA, 25 bp, Mus musculus
ctgatctacaagtgcttctggacca

SEQ ID NO: 32054 - DNA, 25 bp, Mus musculus
tgcttctggaccaggacctaaggac

SEQ ID NO: 32055 - DNA, 25 bp, Mus musculus
tggaccaggacctaaggacattatg

SEQ ID NO: 32056 - DNA, 25 bp, Mus musculus
cattatgtagcccacaggacagaga

SEQ ID NO: 32057 - DNA, 25 bp, Mus musculus
gtagcccacaggacagagatgggta

SEQ ID NO: 32058 - DNA, 25 bp, Mus musculus
gtgtctttaattcttcactgtctaa

SEQ ID NO: 32059 - DNA, 25 bp, Mus musculus
atcaagaccagaatcctgacaaaga

SEQ ID NO: 32060 - DNA, 25 bp, Mus musculus
accagaatcctgacaaagagaaggt

SEQ ID NO: 32061 - DNA, 25 bp, Mus musculus
ttatctattctcacttcacttgtgc

SEQ ID NO: 32062 - DNA, 25 bp, Mus musculus
attctcacttcacttgtgctacaga

SEQ ID NO: 32063 - DNA, 25 bp, Mus musculus
cttgtgctacagacaccgagaatat

SEQ ID NO: 32064 - DNA, 25 bp, Mus musculus
ttgtgtttgctgctgtcaaagacac

SEQ ID NO: 32065 - DNA, 25 bp, Mus musculus
ctgtcaaagacacaatcctacagct

SEQ ID NO: 32066 - DNA, 25 bp, Mus musculus
aagacacaatcctacagctaaacct

SEQ ID NO: 32067 - DNA, 25 bp, Mus musculus
ctggttctggtgctacaccagtgct

SEQ ID NO: 32068 - DNA, 25 bp, Mus musculus
agcccctttgagcagccccaatggc

SEQ ID NO: 32069 - DNA, 25 bp, Mus musculus
acgtgtgactctgggatagcaaggc

SEQ ID NO: 32070 - DNA, 25 bp, Mus musculus
cgtcgacgatcctctggtcaccaca

SEQ ID NO: 32071 - DNA, 25 bp, Mus musculus
cgatcctctggtcaccacaacatca

SEQ ID NO: 32072 - DNA, 25 bp, Mus musculus
gctgctaaacttgagccctcaggtt

SEQ ID NO: 32073 - DNA, 25 bp, Mus musculus
tcaggttccagcaggaactccagct

SEQ ID NO: 32074 - DNA, 25 bp, Mus musculus
aggaactccagctcaagaatgctgc

SEQ ID NO: 32075 - DNA, 25 bp, Mus musculus
tccagctcaagaatgctgctcctgc

SEQ ID NO: 32076 - DNA, 25 bp, Mus musculus
tcaagaatgctgctcctgctgctgg

SEQ ID NO: 32077 - DNA, 25 bp, Mus musculus
atgctgctcctgctgctggccatca

SEQ ID NO: 32078 - DNA, 25 bp, Mus musculus
ggtctgatctgggcctgggcccaga

SEQ ID NO: 32079 - DNA, 25 bp, Mus musculus
cagccccaatggcctattctgtcag

SEQ ID NO: 32080 - DNA, 25 bp, Mus musculus
caatggcctattctgtcagatgggt

SEQ ID NO: 32081 - DNA, 25 bp, Mus musculus
tgtcctttcaagggtgacaactaca

SEQ ID NO: 32082 - DNA, 25 bp, Mus musculus
tggtcccactatcagcgcttcacca

SEQ ID NO: 32083 - DNA, 25 bp, Mus musculus
accttcatgctccttgactccagct

SEQ ID NO: 32084 - DNA, 25 bp, Mus musculus
tctgatacatgctctactacgtgtg

SEQ ID NO: 32085 - DNA, 25 bp, Mus musculus
acatgctctactacgtgtgactctg

SEQ ID NO: 32086 - DNA, 25 bp, Mus musculus
tctactacgtgtgactctgggatag

SEQ ID NO: 32087 - DNA, 25 bp, Mus musculus
tccagaaggccaatttcccaacgtg

SEQ ID NO: 32088 - DNA, 25 bp, Mus musculus
ctatgtgccgaatatcgagttggat

SEQ ID NO: 32089 - DNA, 25 bp, Mus musculus
ttatccagacaccgatgttatatag

SEQ ID NO: 32090 - DNA, 25 bp, Mus musculus
ccagacaccgatgttatatagatgt

SEQ ID NO: 32091 - DNA, 25 bp, Mus musculus
tatagatgtgtttcccattgagacc

SEQ ID NO: 32092 - DNA, 25 bp, Mus musculus
tagatgtgtttcccattgagaccct

SEQ ID NO: 32093 - DNA, 25 bp, Mus musculus
gatgtgtttcccattgagaccctga

SEQ ID NO: 32094 - DNA, 25 bp, Mus musculus
tgtgtttcccattgagaccctgaga

SEQ ID NO: 32095 - DNA, 25 bp, Mus musculus
tgtttcccattgagaccctgagagt

SEQ ID NO: 32096 - DNA, 25 bp, Mus musculus
tttcccattgagaccctgagagtta

SEQ ID NO: 32097 - DNA, 25 bp, Mus musculus
tcccattgagaccctgagagttaga

SEQ ID NO: 32098 - DNA, 25 bp, Mus musculus
ccattgagaccctgagagttagaaa

SEQ ID NO: 32099 - DNA, 25 bp, Mus musculus
ttatgggacacatctgcacaggaat

SEQ ID NO: 32100 - DNA, 25 bp, Mus musculus
gggacacatctgcacaggaattttg

SEQ ID NO: 32101 - DNA, 25 bp, Mus musculus
gacacatctgcacaggaattttgtg

SEQ ID NO: 32102 - DNA, 25 bp, Mus musculus
cacatctgcacaggaattttgtgac

SEQ ID NO: 32103 - DNA, 25 bp, Mus musculus
catctgcacaggaattttgtgaccg

SEQ ID NO: 32104 - DNA, 25 bp, Mus musculus
tctctcttatccagacaccgatgtt

SEQ ID NO: 32105 - DNA, 25 bp, Mus musculus
tctcttatccagacaccgatgttat

SEQ ID NO: 32106 - DNA, 25 bp, Mus musculus
tcttatccagacaccgatgttatat

SEQ ID NO: 32107 - DNA, 25 bp, Mus musculus
gtgtattcctgtagactgtggctca

SEQ ID NO: 32108 - DNA, 25 bp, Mus musculus
tattcctgtagactgtggctcaccc

SEQ ID NO: 32109 - DNA, 25 bp, Mus musculus
tatctgtcttaccaatggaagttgg

SEQ ID NO: 32110 - DNA, 25 bp, Mus musculus
ctgtcttaccaatggaagttggagt

SEQ ID NO: 32111 - DNA, 25 bp, Mus musculus
cactcccagctgcatgcctgttaga

SEQ ID NO: 32112 - DNA, 25 bp, Mus musculus
tcccagctgcatgcctgttagatgt

SEQ ID NO: 32113 - DNA, 25 bp, Mus musculus
cagctgcatgcctgttagatgtcct

SEQ ID NO: 32114 - DNA, 25 bp, Mus musculus
ctgcatgcctgttagatgtcctgcc

SEQ ID NO: 32115 - DNA, 25 bp, Mus musculus
agatggcctagactatgggttcaag

SEQ ID NO: 32116 - DNA, 25 bp, Mus musculus
agtagcgttccactgtctagagggc

SEQ ID NO: 32117 - DNA, 25 bp, Mus musculus
agcgttccactgtctagagggctat

SEQ ID NO: 32118 - DNA, 25 bp, Mus musculus
gttccactgtctagagggctatgtg

SEQ ID NO: 32119 - DNA, 25 bp, Mus musculus
caccaatggccgagtgaagggagaa

SEQ ID NO: 32120 - DNA, 25 bp, Mus musculus
agaatacacattccaaaaggagatt

SEQ ID NO: 32121 - DNA, 25 bp, Mus musculus
atacacattccaaaaggagattaca

SEQ ID NO: 32122 - DNA, 25 bp, Mus musculus
gattacatactcttgccgtgaaggg

SEQ ID NO: 32123 - DNA, 25 bp, Mus musculus
tacatactcttgccgtgaagggttc

SEQ ID NO: 32124 - DNA, 25 bp, Mus musculus
atactcttgccgtgaagggttcata

SEQ ID NO: 32125 - DNA, 25 bp, Mus musculus
gagtcgtatctgtcttaccaatgga

SEQ ID NO: 32126 - DNA, 25 bp, Mus musculus
tcgtatctgtcttaccaatggaagt

SEQ ID NO: 32127 - DNA, 25 bp, Mus musculus
acaggctttgctactggagcagcga

SEQ ID NO: 32128 - DNA, 25 bp, Mus musculus
agctgtgcatgcagattctgcagaa

SEQ ID NO: 32129 - DNA, 25 bp, Mus musculus
atatttgactgttaccatcactgtt

SEQ ID NO: 32130 - DNA, 25 bp, Mus musculus
gactgttaccatcactgttaaagcc

SEQ ID NO: 32131 - DNA, 25 bp, Mus musculus
taccatcactgttaaagccttcaca

SEQ ID NO: 32132 - DNA, 25 bp, Mus musculus
cactgttaaagccttcacagtattg

SEQ ID NO: 32133 - DNA, 25 bp, Mus musculus
cttcacagtattgtctcttacttat

SEQ ID NO: 32134 - DNA, 25 bp, Mus musculus
agtattgtctcttacttatgtagac

SEQ ID NO: 32135 - DNA, 25 bp, Mus musculus
gtctcttacttatgtagacatgaaa

SEQ ID NO: 32136 - DNA, 25 bp, Mus musculus
tgtgattcagtcacaaacttctgct

SEQ ID NO: 32137 - DNA, 25 bp, Mus musculus
tcagtcacaaacttctgcttgctac

SEQ ID NO: 32138 - DNA, 25 bp, Mus musculus
ttctgcttgctacaaatcagcttat

SEQ ID NO: 32139 - DNA, 25 bp, Mus musculus
gggcacctctgaaaactgggctgct

SEQ ID NO: 32140 - DNA, 25 bp, Mus musculus
ctctgaaaactgggctgctgttgat

SEQ ID NO: 32141 - DNA, 25 bp, Mus musculus
ttgttaccacgacagagtcttaaat

SEQ ID NO: 32142 - DNA, 25 bp, Mus musculus
cttaaatgacacactgcacacacgt

SEQ ID NO: 32143 - DNA, 25 bp, Mus musculus
tgacacactgcacacacgtacatgc

SEQ ID NO: 32144 - DNA, 25 bp, Mus musculus
actgcacacacgtacatgcacaccg

SEQ ID NO: 32145 - DNA, 25 bp, Mus musculus
cacaccgcacacagacatgatctgg

SEQ ID NO: 32146 - DNA, 25 bp, Mus musculus
gcacacagacatgatctgggacatg

SEQ ID NO: 32147 - DNA, 25 bp, Mus musculus
agcttctctgacttcgagcagcact

SEQ ID NO: 32148 - DNA, 25 bp, Mus musculus
ttctctgacttcgagcagcacttcc

SEQ ID NO: 32149 - DNA, 25 bp, Mus musculus
ttattgatttggctggttcagagga

SEQ ID NO: 32150 - DNA, 25 bp, Mus musculus
ttgatttggctggttcagaggacaa

SEQ ID NO: 32151 - DNA, 25 bp, Mus musculus
atttggctggttcagaggacaaccg

SEQ ID NO: 32152 - DNA, 25 bp, Mus musculus
cagaggacaaccgtcgcacaggcaa

SEQ ID NO: 32153 - DNA, 25 bp, Mus musculus
acaaccgtcgcacaggcaaccaggg

SEQ ID NO: 32154 - DNA, 25 bp, Mus musculus
accgtcgcacaggcaaccagggcat

SEQ ID NO: 32155 - DNA, 25 bp, Mus musculus
gtcgcacaggcaaccagggcattcg

SEQ ID NO: 32156 - DNA, 25 bp, Mus musculus
gcaaccagggcattcggctcaaaga

SEQ ID NO: 32157 - DNA, 25 bp, Mus musculus
accagggcattcggctcaaagagag

SEQ ID NO: 32158 - DNA, 25 bp, Mus musculus
tctttgtactgggcaaagtggtgga

SEQ ID NO: 32159 - DNA, 25 bp, Mus musculus
gacttcgagcagcacttccttccag

SEQ ID NO: 32160 - DNA, 25 bp, Mus musculus
gagcagcacttccttccagccagta

SEQ ID NO: 32161 - DNA, 25 bp, Mus musculus
cacttccttccagccagtagaaatc

SEQ ID NO: 32162 - DNA, 25 bp, Mus musculus
aaccagcgctcttcccgtagtcacg

SEQ ID NO: 32163 - DNA, 25 bp, Mus musculus
cgtagtcacgcaggctcttggtcaa

SEQ ID NO: 32164 - DNA, 25 bp, Mus musculus
gcaggctcttggtcaaggtagatca

SEQ ID NO: 32165 - DNA, 25 bp, Mus musculus
tagatcagcgtgaacgtttgactcc

SEQ ID NO: 32166 - DNA, 25 bp, Mus musculus
aactctaccttattgatttggctgg

SEQ ID NO: 32167 - DNA, 25 bp, Mus musculus
gaaggtcttctccatttatgaggta

SEQ ID NO: 32168 - DNA, 25 bp, Mus musculus
atcttgacactgaatccctagctct

SEQ ID NO: 32169 - DNA, 25 bp, Mus musculus
ccattggccaaggattagagaaagg

SEQ ID NO: 32170 - DNA, 25 bp, Mus musculus
agctccctggaaggatcccacgagc

SEQ ID NO: 32171 - DNA, 25 bp, Mus musculus
ggatcccacgagccagagaacctga

SEQ ID NO: 32172 - DNA, 25 bp, Mus musculus
cacgagccagagaacctgagaaggc

SEQ ID NO: 32173 - DNA, 25 bp, Mus musculus
ctggtctagcagcttgggaccacag

SEQ ID NO: 32174 - DNA, 25 bp, Mus musculus
accacaggccatgtgatgtgcatac

SEQ ID NO: 32175 - DNA, 25 bp, Mus musculus
tatagtttgctcatggcttagccat

SEQ ID NO: 32176 - DNA, 25 bp, Mus musculus
ttgctcatggcttagccattaccca

SEQ ID NO: 32177 - DNA, 25 bp, Mus musculus
atggcttagccattacccatgtctg

SEQ ID NO: 32178 - DNA, 25 bp, Mus musculus
tagccattacccatgtctgtaaatg

SEQ ID NO: 32179 - DNA, 25 bp, Mus musculus
tagctctctaagcacacacaaagaa

SEQ ID NO: 32180 - DNA, 25 bp, Mus musculus
cacacacaaagaattgctgggacct

SEQ ID NO: 32181 - DNA, 25 bp, Mus musculus
actaagcttggagcctgcattgtct

SEQ ID NO: 32182 - DNA, 25 bp, Mus musculus
gcctgcattgtctgtattttgcagc

SEQ ID NO: 32183 - DNA, 25 bp, Mus musculus
attgtctgtattttgcagcaatagg

SEQ ID NO: 32184 - DNA, 25 bp, Mus musculus
aggtacttgctaccctccttgatgt

SEQ ID NO: 32185 - DNA, 25 bp, Mus musculus
ttgctaccctccttgatgttgatct

SEQ ID NO: 32186 - DNA, 25 bp, Mus musculus
ccctccttgatgttgatcttagggc

SEQ ID NO: 32187 - DNA, 25 bp, Mus musculus
ttcctgcggcgccttagggaccatg

SEQ ID NO: 32188 - DNA, 25 bp, Mus musculus
gccttagggaccatggccgatcctc

SEQ ID NO: 32189 - DNA, 25 bp, Mus musculus
actacgccattaagaagcaggcaga

SEQ ID NO: 32190 - DNA, 25 bp, Mus musculus
ctacgccattaagaagcaggcagag

SEQ ID NO: 32191 - DNA, 25 bp, Mus musculus
atactgatcttcagcagatattaga

SEQ ID NO: 32192 - DNA, 25 bp, Mus musculus
tactgatcttcagcagatattagaa

SEQ ID NO: 32193 - DNA, 25 bp, Mus musculus
actgatcttcagcagatattagaaa

SEQ ID NO: 32194 - DNA, 25 bp, Mus musculus
ctgatcttcagcagatattagaaag

SEQ ID NO: 32195 - DNA, 25 bp, Mus musculus
tgatcttcagcagatattagaaagt

SEQ ID NO: 32196 - DNA, 25 bp, Mus musculus
atcttcagcagatattagaaagtga

SEQ ID NO: 32197 - DNA, 25 bp, Mus musculus
ccttagggaccatggccgatcctcg

SEQ ID NO: 32198 - DNA, 25 bp, Mus musculus
cttagggaccatggccgatcctcgc

SEQ ID NO: 32199 - DNA, 25 bp, Mus musculus
gagagaactacgccattaagaagca

SEQ ID NO: 32200 - DNA, 25 bp, Mus musculus
agagaactacgccattaagaagcag

SEQ ID NO: 32201 - DNA, 25 bp, Mus musculus
gagaactacgccattaagaagcagg

SEQ ID NO: 32202 - DNA, 25 bp, Mus musculus
agaactacgccattaagaagcaggc

SEQ ID NO: 32203 - DNA, 25 bp, Mus musculus
gaactacgccattaagaagcaggca

SEQ ID NO: 32204 - DNA, 25 bp, Mus musculus
aactacgccattaagaagcaggcag

SEQ ID NO: 32205 - DNA, 25 bp, Mus musculus
atggagacagcggctgcgcacactc

SEQ ID NO: 32206 - DNA, 25 bp, Mus musculus
gctgcgcacactccagtccatagct

SEQ ID NO: 32207 - DNA, 25 bp, Mus musculus
gcaaacaccatggacgtcttcaaga

SEQ ID NO: 32208 - DNA, 25 bp, Mus musculus
aacaccatggacgtcttcaagaaag

SEQ ID NO: 32209 - DNA, 25 bp, Mus musculus
accatggacgtcttcaagaaaggct

SEQ ID NO: 32210 - DNA, 25 bp, Mus musculus
ttcaagaaaggcttctccattgcca

SEQ ID NO: 32211 - DNA, 25 bp, Mus musculus
ggcttctccattgccaaggaaggtg

SEQ ID NO: 32212 - DNA, 25 bp, Mus musculus
ttctccattgccaaggaaggtgttg

SEQ ID NO: 32213 - DNA, 25 bp, Mus musculus
tatgtgggcaccaaaaccaaggaga

SEQ ID NO: 32214 - DNA, 25 bp, Mus musculus
caaagtgtcacctcagtggctgaga

SEQ ID NO: 32215 - DNA, 25 bp, Mus musculus
agtgtcacctcagtggctgagaaga

SEQ ID NO: 32216 - DNA, 25 bp, Mus musculus
caggccaatgccgtgagtgaagctg

SEQ ID NO: 32217 - DNA, 25 bp, Mus musculus
gcgcacactccagtccatagcttgc

SEQ ID NO: 32218 - DNA, 25 bp, Mus musculus
cacactccagtccatagcttgcagc

SEQ ID NO: 32219 - DNA, 25 bp, Mus musculus
gtccatagcttgcagcagccaggtt

SEQ ID NO: 32220 - DNA, 25 bp, Mus musculus
catagcttgcagcagccaggttcca

SEQ ID NO: 32221 - DNA, 25 bp, Mus musculus
ttgcagcagccaggttccatccttg

SEQ ID NO: 32222 - DNA, 25 bp, Mus musculus
cagccaggttccatccttgcaaaca

SEQ ID NO: 32223 - DNA, 25 bp, Mus musculus
ggttccatccttgcaaacaccatgg

SEQ ID NO: 32224 - DNA, 25 bp, Mus musculus
tccatccttgcaaacaccatggacg

SEQ ID NO: 32225 - DNA, 25 bp, Mus musculus
gcactcgacttattcgattacatgc

SEQ ID NO: 32226 - DNA, 25 bp, Mus musculus
ttattcgattacatgcttgccttgg

SEQ ID NO: 32227 - DNA, 25 bp, Mus musculus
gctgagcaggctcttcagtgtgagt

SEQ ID NO: 32228 - DNA, 25 bp, Mus musculus
gagcaggctcttcagtgtgagttcc

SEQ ID NO: 32229 - DNA, 25 bp, Mus musculus
caggctcttcagtgtgagttcctgc

SEQ ID NO: 32230 - DNA, 25 bp, Mus musculus
cttcagtgtgagttcctgcgagacg

SEQ ID NO: 32231 - DNA, 25 bp, Mus musculus
tgtgagttcctgcgagacgtggaac

SEQ ID NO: 32232 - DNA, 25 bp, Mus musculus
ccagaccttcctttgtggcaagatt

SEQ ID NO: 32233 - DNA, 25 bp, Mus musculus
gaccttcctttgtggcaagattgtc

SEQ ID NO: 32234 - DNA, 25 bp, Mus musculus
cttcctttgtggcaagattgtcatg

SEQ ID NO: 32235 - DNA, 25 bp, Mus musculus
actgatgatctttccacaatccaag

SEQ ID NO: 32236 - DNA, 25 bp, Mus musculus
gatgatctttccacaatccaagccc

SEQ ID NO: 32237 - DNA, 25 bp, Mus musculus
ttcgattacatgcttgccttggatc

SEQ ID NO: 32238 - DNA, 25 bp, Mus musculus
tacatgcttgccttggatcccagta

SEQ ID NO: 32239 - DNA, 25 bp, Mus musculus
atgcttgccttggatcccagtaagc

SEQ ID NO: 32240 - DNA, 25 bp, Mus musculus
cttgccttggatcccagtaagcgct

SEQ ID NO: 32241 - DNA, 25 bp, Mus musculus
ttggatcccagtaagcgctgcactg

SEQ ID NO: 32242 - DNA, 25 bp, Mus musculus
gatcccagtaagcgctgcactgctg

SEQ ID NO: 32243 - DNA, 25 bp, Mus musculus
cccagtaagcgctgcactgctgagc

SEQ ID NO: 32244 - DNA, 25 bp, Mus musculus
tgcactgctgagcaggctcttcagt

SEQ ID NO: 32245 - DNA, 25 bp, Mus musculus
ctcaggcattgcagctctttgagtc

SEQ ID NO: 32246 - DNA, 25 bp, Mus musculus
agctctttgagtcccacgcaggaca

SEQ ID NO: 32247 - DNA, 25 bp, Mus musculus
agctggcccaggctggctatgaggt

SEQ ID NO: 32248 - DNA, 25 bp, Mus musculus
cctgtgccttgtatgcatctgagga

SEQ ID NO: 32249 - DNA, 25 bp, Mus musculus
aagagatcggtcggctggtgcagca

SEQ ID NO: 32250 - DNA, 25 bp, Mus musculus
atgctgtacacaaacattcacgcct

SEQ ID NO: 32251 - DNA, 25 bp, Mus musculus
tacacaaacattcacgcctgcttcg

SEQ ID NO: 32252 - DNA, 25 bp, Mus musculus
aacattcacgcctgcttcgacagaa

SEQ ID NO: 32253 - DNA, 25 bp, Mus musculus
cacgcctgcttcgacagaattgagt

SEQ ID NO: 32254 - DNA, 25 bp, Mus musculus
attgagtacatgcctttctgctcaa

SEQ ID NO: 32255 - DNA, 25 bp, Mus musculus
tacatgcctttctgctcaagtgcca

SEQ ID NO: 32256 - DNA, 25 bp, Mus musculus
cctttctgctcaagtgccaccaaca

SEQ ID NO: 32257 - DNA, 25 bp, Mus musculus
gcaccgagctcttcagcaagtttgc

SEQ ID NO: 32258 - DNA, 25 bp, Mus musculus
agctcttcagcaagtttgcactgcc

SEQ ID NO: 32259 - DNA, 25 bp, Mus musculus
tcagcaagtttgcactgccctacat

SEQ ID NO: 32260 - DNA, 25 bp, Mus musculus
agtttgcactgccctacattcgtga

SEQ ID NO: 32261 - DNA, 25 bp, Mus musculus
cagtgcccatgatcatctttgctaa

SEQ ID NO: 32262 - DNA, 25 bp, Mus musculus
ccatgatcatctttgctaaggatgg

SEQ ID NO: 32263 - DNA, 25 bp, Mus musculus
tcatctttgctaaggatggacattt

SEQ ID NO: 32264 - DNA, 25 bp, Mus musculus
gacattttgccctggaagagctggc

SEQ ID NO: 32265 - DNA, 25 bp, Mus musculus
ttaagtcatgtttgtgctgctggtg

SEQ ID NO: 32266 - DNA, 25 bp, Mus musculus
tgtgctgctggtgccaaacgtttga

SEQ ID NO: 32267 - DNA, 25 bp, Mus musculus
gttctgacgctcaacaccggatata

SEQ ID NO: 32268 - DNA, 25 bp, Mus musculus
acgctcaacaccggatatattcacg

SEQ ID NO: 32269 - DNA, 25 bp, Mus musculus
attcttagtcagcacttcagcagag

SEQ ID NO: 32270 - DNA, 25 bp, Mus musculus
agtcagcacttcagcagagctctta

SEQ ID NO: 32271 - DNA, 25 bp, Mus musculus
cacttcagcagagctcttaaaagcc

SEQ ID NO: 32272 - DNA, 25 bp, Mus musculus
ccctagtgcgttcacatgccactta

SEQ ID NO: 32273 - DNA, 25 bp, Mus musculus
tgcgttcacatgccacttacgttta

SEQ ID NO: 32274 - DNA, 25 bp, Mus musculus
ctgaagttctgttcaggagtttatt

SEQ ID NO: 32275 - DNA, 25 bp, Mus musculus
gtttattatccagtcctatgaatct

SEQ ID NO: 32276 - DNA, 25 bp, Mus musculus
tatccagtcctatgaatctggattc

SEQ ID NO: 32277 - DNA, 25 bp, Mus musculus
agcagtccttggaggagaagcagtc

SEQ ID NO: 32278 - DNA, 25 bp, Mus musculus
cctgcctgaagttcaaagccaacga

SEQ ID NO: 32279 - DNA, 25 bp, Mus musculus
tcaaagccaacgatcacggatatga

SEQ ID NO: 32280 - DNA, 25 bp, Mus musculus
ccaacgatcacggatatgacaactt

SEQ ID NO: 32281 - DNA, 25 bp, Mus musculus
gatatgacaacttccggtccagcaa

SEQ ID NO: 32282 - DNA, 25 bp, Mus musculus
acagctcgtcttgaaggcaagaaca

SEQ ID NO: 32283 - DNA, 25 bp, Mus musculus
cgaatctcactgtcctcattgtgga

SEQ ID NO: 32284 - DNA, 25 bp, Mus musculus
tcactgtcctcattgtggacagata

SEQ ID NO: 32285 - DNA, 25 bp, Mus musculus
cgtgcttgacctcaagctggcagcc

SEQ ID NO: 32286 - DNA, 25 bp, Mus musculus
tgcttgacctcaagctggcagccga

SEQ ID NO: 32287 - DNA, 25 bp, Mus musculus
tgtgcgccagaaacggcggatctac

SEQ ID NO: 32288 - DNA, 25 bp, Mus musculus
tgcgccagaaacggcggatctacga

SEQ ID NO: 32289 - DNA, 25 bp, Mus musculus
aaggcatcggtctgatcgagaagaa

SEQ ID NO: 32290 - DNA, 25 bp, Mus musculus
ggcatcggtctgatcgagaagaaat

SEQ ID NO: 32291 - DNA, 25 bp, Mus musculus
caggttgcaatacccgggagatcgc

SEQ ID NO: 32292 - DNA, 25 bp, Mus musculus
ggttgcaatacccgggagatcgctg

SEQ ID NO: 32293 - DNA, 25 bp, Mus musculus
gcaatacccgggagatcgctgacaa

SEQ ID NO: 32294 - DNA, 25 bp, Mus musculus
gagcatccggaatgtcactgaggac

SEQ ID NO: 32295 - DNA, 25 bp, Mus musculus
atccggaatgtcactgaggacgtcc

SEQ ID NO: 32296 - DNA, 25 bp, Mus musculus
aatgtcactgaggacgtccagaaca

SEQ ID NO: 32297 - DNA, 25 bp, Mus musculus
acctcaagctggcagccgacactct

SEQ ID NO: 32298 - DNA, 25 bp, Mus musculus
tgtcactgaggacgtccagaacagc

SEQ ID NO: 32299 - DNA, 25 bp, Mus musculus
ctcaagctggcagccgacactcttg

SEQ ID NO: 32300 - DNA, 25 bp, Mus musculus
caagctggcagccgacactcttgct

SEQ ID NO: 32301 - DNA, 25 bp, Mus musculus
ctggcagccgacactcttgctgtgc

SEQ ID NO: 32302 - DNA, 25 bp, Mus musculus
cagccgacactcttgctgtgcgcca

SEQ ID NO: 32303 - DNA, 25 bp, Mus musculus
gccgacactcttgctgtgcgccaga

SEQ ID NO: 32304 - DNA, 25 bp, Mus musculus
tcttgctgtgcgccagaaacggcgg

SEQ ID NO: 32305 - DNA, 25 bp, Mus musculus
ttgctgtgcgccagaaacggcggat

SEQ ID NO: 32306 - DNA, 25 bp, Mus musculus
gcaccaggcaggtctgggaaacaag

SEQ ID NO: 32307 - DNA, 25 bp, Mus musculus
cgctgcacgtgcttcacttacaagg

SEQ ID NO: 32308 - DNA, 25 bp, Mus musculus
gacaaggcctgtgcacacttctgtg

SEQ ID NO: 32309 - DNA, 25 bp, Mus musculus
gcctgtgcacacttctgtgcacgca

SEQ ID NO: 32310 - DNA, 25 bp, Mus musculus
gcacacttctgtgcacgcaccagag

SEQ ID NO: 32311 - DNA, 25 bp, Mus musculus
gcacgcaccagagatgtcaccagtt

SEQ ID NO: 32312 - DNA, 25 bp, Mus musculus
accagagatgtcaccagttattccg

SEQ ID NO: 32313 - DNA, 25 bp, Mus musculus
ccttagctggatctaacaggccaca

SEQ ID NO: 32314 - DNA, 25 bp, Mus musculus
ctggatctaacaggccacaactgat

SEQ ID NO: 32315 - DNA, 25 bp, Mus musculus
ctaacaggccacaactgatgcttct

SEQ ID NO: 32316 - DNA, 25 bp, Mus musculus
ttgcttcctgcagtggacttcacct

SEQ ID NO: 32317 - DNA, 25 bp, Mus musculus
cctgcagtggacttcacctgctctc

SEQ ID NO: 32318 - DNA, 25 bp, Mus musculus
ttcacttacaaggacaaggagtgtg

SEQ ID NO: 32319 - DNA, 25 bp, Mus musculus
atctggattaacactcctgaacaga

SEQ ID NO: 32320 - DNA, 25 bp, Mus musculus
attaacactcctgaacagactgtgc

SEQ ID NO: 32321 - DNA, 25 bp, Mus musculus
actcctgaacagactgtgccctatg

SEQ ID NO: 32322 - DNA, 25 bp, Mus musculus
actgtgccctatggactgtccaact

SEQ ID NO: 32323 - DNA, 25 bp, Mus musculus
ccctatggactgtccaactacagag

SEQ ID NO: 32324 - DNA, 25 bp, Mus musculus
ggactgtccaactacagagaaagcc

SEQ ID NO: 32325 - DNA, 25 bp, Mus musculus
tggacacgcttgcgttgtacttgta

SEQ ID NO: 32326 - DNA, 25 bp, Mus musculus
tgagagcccagcctgataccctacg

SEQ ID NO: 32327 - DNA, 25 bp, Mus musculus
gagcccagcctgataccctacggcg

SEQ ID NO: 32328 - DNA, 25 bp, Mus musculus
actgcaacaagacggcgtcaaggag

SEQ ID NO: 32329 - DNA, 25 bp, Mus musculus
gcaacaagacggcgtcaaggaggtg

SEQ ID NO: 32330 - DNA, 25 bp, Mus musculus
gcggtcctgcatcctcttgtgaccc

SEQ ID NO: 32331 - DNA, 25 bp, Mus musculus
ctgcatcctcttgtgaccctggcac

SEQ ID NO: 32332 - DNA, 25 bp, Mus musculus
catcctcttgtgaccctggcactca

SEQ ID NO: 32333 - DNA, 25 bp, Mus musculus
cctcttgtgaccctggcactcagct

SEQ ID NO: 32334 - DNA, 25 bp, Mus musculus
gtgaccctggcactcagcttggagg

SEQ ID NO: 32335 - DNA, 25 bp, Mus musculus
accctggcactcagcttggaggcta

SEQ ID NO: 32336 - DNA, 25 bp, Mus musculus
ctggcactcagcttggaggctatcc

SEQ ID NO: 32337 - DNA, 25 bp, Mus musculus
caccaattgtgccttggcgccttgt

SEQ ID NO: 32338 - DNA, 25 bp, Mus musculus
ctgataccctacggcgcctcaagga

SEQ ID NO: 32339 - DNA, 25 bp, Mus musculus
cacagcagggccaggcactggcaag

SEQ ID NO: 32340 - DNA, 25 bp, Mus musculus
cactggcaagcagatccatgctgtg

SEQ ID NO: 32341 - DNA, 25 bp, Mus musculus
gatccatgctgtgcgctacctcgag

SEQ ID NO: 32342 - DNA, 25 bp, Mus musculus
ctacctcgagtgctcagcactgcaa

SEQ ID NO: 32343 - DNA, 25 bp, Mus musculus
cgagtgctcagcactgcaacaagac

SEQ ID NO: 32344 - DNA, 25 bp, Mus musculus
gtgctcagcactgcaacaagacggc

SEQ ID NO: 32345 - DNA, 25 bp, Mus musculus
ctcagcactgcaacaagacggcgtc

SEQ ID NO: 32346 - DNA, 25 bp, Mus musculus
tttccactggctgatcacctcaact

SEQ ID NO: 32347 - DNA, 25 bp, Mus musculus
ctcaactcaaccaaccatgccattg

SEQ ID NO: 32348 - DNA, 25 bp, Mus musculus
ctgagtgccatttccatgttgtacc

SEQ ID NO: 32349 - DNA, 25 bp, Mus musculus
agtgccatttccatgttgtacctgg

SEQ ID NO: 32350 - DNA, 25 bp, Mus musculus
atttccatgttgtacctggatgagt

SEQ ID NO: 32351 - DNA, 25 bp, Mus musculus
atgttgtacctggatgagtatgaca

SEQ ID NO: 32352 - DNA, 25 bp, Mus musculus
ctacacataccacacaaactgcttc

SEQ ID NO: 32353 - DNA, 25 bp, Mus musculus
ccacacaaactgcttccctatagct

SEQ ID NO: 32354 - DNA, 25 bp, Mus musculus
cacaaactgcttccctatagctgga

SEQ ID NO: 32355 - DNA, 25 bp, Mus musculus
aaactgcttccctatagctggactt

SEQ ID NO: 32356 - DNA, 25 bp, Mus musculus
cttccctatagctggacttttatct

SEQ ID NO: 32357 - DNA, 25 bp, Mus musculus
tgaccttatttatgactttacgtgc

SEQ ID NO: 32358 - DNA, 25 bp, Mus musculus
catgccattgtgcagaccctagtca

SEQ ID NO: 32359 - DNA, 25 bp, Mus musculus
gccattgtgcagaccctagtcaact

SEQ ID NO: 32360 - DNA, 25 bp, Mus musculus
gtgcagaccctagtcaactctgtta

SEQ ID NO: 32361 - DNA, 25 bp, Mus musculus
cagaccctagtcaactctgttaatt

SEQ ID NO: 32362 - DNA, 25 bp, Mus musculus
tctagtatccctaaggcctgttgtg

SEQ ID NO: 32363 - DNA, 25 bp, Mus musculus
gcctgttgtgtccccactgaactga

SEQ ID NO: 32364 - DNA, 25 bp, Mus musculus
cccactgaactgagtgccatttcca

SEQ ID NO: 32365 - DNA, 25 bp, Mus musculus
gaactgagtgccatttccatgttgt

SEQ ID NO: 32366 - DNA, 25 bp, Mus musculus
attcggaacacggcgagctggcaac

SEQ ID NO: 32367 - DNA, 25 bp, Mus musculus
ttcggaacacggcgagctggcaaca

SEQ ID NO: 32368 - DNA, 25 bp, Mus musculus
tgaaaacgctgccagaggagctgat

SEQ ID NO: 32369 - DNA, 25 bp, Mus musculus
aacgctgccagaggagctgatggca

SEQ ID NO: 32370 - DNA, 25 bp, Mus musculus
gctgccagaggagctgatggcaagc

SEQ ID NO: 32371 - DNA, 25 bp, Mus musculus
ctctacccctggacctgaggagaca

SEQ ID NO: 32372 - DNA, 25 bp, Mus musculus
tctacccctggacctgaggagacac

SEQ ID NO: 32373 - DNA, 25 bp, Mus musculus
tacccctggacctgaggagacacta

SEQ ID NO: 32374 - DNA, 25 bp, Mus musculus
ggagacactaacagcagccacagtt

SEQ ID NO: 32375 - DNA, 25 bp, Mus musculus
gagacactaacagcagccacagttc

SEQ ID NO: 32376 - DNA, 25 bp, Mus musculus
gacactaacagcagccacagttccc

SEQ ID NO: 32377 - DNA, 25 bp, Mus musculus
tccccggggcttgtatatagattat

SEQ ID NO: 32378 - DNA, 25 bp, Mus musculus
cggaacacggcgagctggcaacatg

SEQ ID NO: 32379 - DNA, 25 bp, Mus musculus
ggaacacggcgagctggcaacatgg

SEQ ID NO: 32380 - DNA, 25 bp, Mus musculus
acacggcgagctggcaacatgggtg

SEQ ID NO: 32381 - DNA, 25 bp, Mus musculus
acggcgagctggcaacatgggtgta

SEQ ID NO: 32382 - DNA, 25 bp, Mus musculus
agctggcaacatgggtgtaggcatg

SEQ ID NO: 32383 - DNA, 25 bp, Mus musculus
tggcagggctcaacagcaggacaaa

SEQ ID NO: 32384 - DNA, 25 bp, Mus musculus
tcaacagcaggacaaaccacctcgt

SEQ ID NO: 32385 - DNA, 25 bp, Mus musculus
ttccgaagctgaaacgcagaacgtg

SEQ ID NO: 32386 - DNA, 25 bp, Mus musculus
ggcaccccaacatttatgagaatgg

SEQ ID NO: 32387 - DNA, 25 bp, Mus musculus
gcattacaattcttcatccgcctgt

SEQ ID NO: 32388 - DNA, 25 bp, Mus musculus
ggactatcctgttaagtgtgatatc

SEQ ID NO: 32389 - DNA, 25 bp, Mus musculus
ctatcctgttaagtgtgatatcact

SEQ ID NO: 32390 - DNA, 25 bp, Mus musculus
tgatatcactgcttaatgggcacaa

SEQ ID NO: 32391 - DNA, 25 bp, Mus musculus
ttaatgggcacaacaccttatctcc

SEQ ID NO: 32392 - DNA, 25 bp, Mus musculus
ggcacaacaccttatctccagccaa

SEQ ID NO: 32393 - DNA, 25 bp, Mus musculus
acaacaccttatctccagccaaagt

SEQ ID NO: 32394 - DNA, 25 bp, Mus musculus
acaccttatctccagccaaagtgga

SEQ ID NO: 32395 - DNA, 25 bp, Mus musculus
tatctccagccaaagtggatgcttc

SEQ ID NO: 32396 - DNA, 25 bp, Mus musculus
ctccagccaaagtggatgcttcagt

SEQ ID NO: 32397 - DNA, 25 bp, Mus musculus
atgcttcagtcatgatcaggaaatg

SEQ ID NO: 32398 - DNA, 25 bp, Mus musculus
ttacaattcttcatccgcctgtaga

SEQ ID NO: 32399 - DNA, 25 bp, Mus musculus
caattcttcatccgcctgtagaatg

SEQ ID NO: 32400 - DNA, 25 bp, Mus musculus
ttcatccgcctgtagaatgaccgca

SEQ ID NO: 32401 - DNA, 25 bp, Mus musculus
atccgcctgtagaatgaccgcagag

SEQ ID NO: 32402 - DNA, 25 bp, Mus musculus
tagaatgaccgcagagtggagagct

SEQ ID NO: 32403 - DNA, 25 bp, Mus musculus
aatgaccgcagagtggagagctacc

SEQ ID NO: 32404 - DNA, 25 bp, Mus musculus
gagagctaccctctgaaaggtggga

SEQ ID NO: 32405 - DNA, 25 bp, Mus musculus
accctactcagaacgtatggactat

SEQ ID NO: 32406 - DNA, 25 bp, Mus musculus
gaccacaacttcctgtttccagaat

SEQ ID NO: 32407 - DNA, 25 bp, Mus musculus
attttgcctgaggttgtggaaatgg

SEQ ID NO: 32408 - DNA, 25 bp, Mus musculus
atgcctcagctgttgaaccacctga

SEQ ID NO: 32409 - DNA, 25 bp, Mus musculus
cagctgttgaaccacctgaaggcag

SEQ ID NO: 32410 - DNA, 25 bp, Mus musculus
ttgaaccacctgaaggcagacagac

SEQ ID NO: 32411 - DNA, 25 bp, Mus musculus
aaggcagacagactcggcagaagca

SEQ ID NO: 32412 - DNA, 25 bp, Mus musculus
gacagactcggcagaagcatcgact

SEQ ID NO: 32413 - DNA, 25 bp, Mus musculus
ctcggcagaagcatcgactggggtg

SEQ ID NO: 32414 - DNA, 25 bp, Mus musculus
agaagcatcgactggggtgtcttgg

SEQ ID NO: 32415 - DNA, 25 bp, Mus musculus
atcgactggggtgtcttggctgtct

SEQ ID NO: 32416 - DNA, 25 bp, Mus musculus
gtcttggctgtcttcacctgtgctg

SEQ ID NO: 32417 - DNA, 25 bp, Mus musculus
gctgtcttcacctgtgctgagagct

SEQ ID NO: 32418 - DNA, 25 bp, Mus musculus
gaactagattccatggcaaagcacg

SEQ ID NO: 32419 - DNA, 25 bp, Mus musculus
gattccatggcaaagcacgaatcca

SEQ ID NO: 32420 - DNA, 25 bp, Mus musculus
ataccccttgaaccagagcagattc

SEQ ID NO: 32421 - DNA, 25 bp, Mus musculus
cagattctcaggtatggaagaggga

SEQ ID NO: 32422 - DNA, 25 bp, Mus musculus
attaaacccatctggatttctggtg

SEQ ID NO: 32423 - DNA, 25 bp, Mus musculus
cccatctggatttctggtgaaaata

SEQ ID NO: 32424 - DNA, 25 bp, Mus musculus
gaattccaggtcatgcctcagctgt

SEQ ID NO: 32425 - DNA, 25 bp, Mus musculus
caggtcatgcctcagctgttgaacc

SEQ ID NO: 32426 - DNA, 25 bp, Mus musculus
tctatattcttcatcacgctgctcg

SEQ ID NO: 32427 - DNA, 25 bp, Mus musculus
atattcttcatcacgctgctcgttc

SEQ ID NO: 32428 - DNA, 25 bp, Mus musculus
gagaacgtgctacctgcacacgtgg

SEQ ID NO: 32429 - DNA, 25 bp, Mus musculus
gtgctacctgcacacgtggctgaac

SEQ ID NO: 32430 - DNA, 25 bp, Mus musculus
ctacctgcacacgtggctgaacact

SEQ ID NO: 32431 - DNA, 25 bp, Mus musculus
cctgcacacgtggctgaacacttcc

SEQ ID NO: 32432 - DNA, 25 bp, Mus musculus
gcacacgtggctgaacacttcctgg

SEQ ID NO: 32433 - DNA, 25 bp, Mus musculus
gagttgtaccaccagtcctacgatt

SEQ ID NO: 32434 - DNA, 25 bp, Mus musculus
taccaccagtcctacgattgtgtct

SEQ ID NO: 32435 - DNA, 25 bp, Mus musculus
cagtcctacgattgtgtctgtgtca

SEQ ID NO: 32436 - DNA, 25 bp, Mus musculus
gcctccattccggacttcaaggaat

SEQ ID NO: 32437 - DNA, 25 bp, Mus musculus
tccattccggacttcaaggaattct

SEQ ID NO: 32438 - DNA, 25 bp, Mus musculus
ttcatcacgctgctcgttctgggta

SEQ ID NO: 32439 - DNA, 25 bp, Mus musculus
gaattctacacggagtcagatgtga

SEQ ID NO: 32440 - DNA, 25 bp, Mus musculus
acgctgctcgttctgggtagacaga

SEQ ID NO: 32441 - DNA, 25 bp, Mus musculus
ctgctcgttctgggtagacagagtg

SEQ ID NO: 32442 - DNA, 25 bp, Mus musculus
ttagacttcttgtggaagaacaagt

SEQ ID NO: 32443 - DNA, 25 bp, Mus musculus
gagaacctaaaccgagtgctgctgg

SEQ ID NO: 32444 - DNA, 25 bp, Mus musculus
aacctaaaccgagtgctgctggaga

SEQ ID NO: 32445 - DNA, 25 bp, Mus musculus
ctaaaccgagtgctgctggagaacg

SEQ ID NO: 32446 - DNA, 25 bp, Mus musculus
aaccgagtgctgctggagaacgtgc

SEQ ID NO: 32447 - DNA, 25 bp, Mus musculus
ccaggaccacgagcgcctctttgag

SEQ ID NO: 32448 - DNA, 25 bp, Mus musculus
ccacgagcgcctctttgagctcatt

SEQ ID NO: 32449 - DNA, 25 bp, Mus musculus
cccagaccgatatgacagcctggac

SEQ ID NO: 32450 - DNA, 25 bp, Mus musculus
gttctcctactcagccagcatccga

SEQ ID NO: 32451 - DNA, 25 bp, Mus musculus
agccagcatccgagagtgagcagcc

SEQ ID NO: 32452 - DNA, 25 bp, Mus musculus
ccaccacaggacacaagcatggccg

SEQ ID NO: 32453 - DNA, 25 bp, Mus musculus
caggacacaagcatggccgtcatcc

SEQ ID NO: 32454 - DNA, 25 bp, Mus musculus
acaagcatggccgtcatccactgcc

SEQ ID NO: 32455 - DNA, 25 bp, Mus musculus
agcatggccgtcatccactgcctgg

SEQ ID NO: 32456 - DNA, 25 bp, Mus musculus
atggccgtcatccactgcctgggtg

SEQ ID NO: 32457 - DNA, 25 bp, Mus musculus
gccgtcatccactgcctgggtggct

SEQ ID NO: 32458 - DNA, 25 bp, Mus musculus
gtcatccactgcctgggtggctttt

SEQ ID NO: 32459 - DNA, 25 bp, Mus musculus
gcgcctctttgagctcattcttatg

SEQ ID NO: 32460 - DNA, 25 bp, Mus musculus
tcatccactgcctgggtggcttttt

SEQ ID NO: 32461 - DNA, 25 bp, Mus musculus
ctttgagctcattcttatggaggag

SEQ ID NO: 32462 - DNA, 25 bp, Mus musculus
tcccagtgatgcgaaggaggtcatg

SEQ ID NO: 32463 - DNA, 25 bp, Mus musculus
tagattcttcctcagcatcaactgg

SEQ ID NO: 32464 - DNA, 25 bp, Mus musculus
cttcctcagcatcaactggcaggac

SEQ ID NO: 32465 - DNA, 25 bp, Mus musculus
cagcatcaactggcaggacgtggta

SEQ ID NO: 32466 - DNA, 25 bp, Mus musculus
caactggcaggacgtggtacagaaa

SEQ ID NO: 32467 - DNA, 25 bp, Mus musculus
caaacctcaggtcacttcagaagtg

SEQ ID NO: 32468 - DNA, 25 bp, Mus musculus
tccgcaggcgcccttcgtaaaccag

SEQ ID NO: 32469 - DNA, 25 bp, Mus musculus
caggcgcccttcgtaaaccagtatg

SEQ ID NO: 32470 - DNA, 25 bp, Mus musculus
ctggggtcatctatcccttccagcc

SEQ ID NO: 32471 - DNA, 25 bp, Mus musculus
tggggtcatctatcccttccagccc

SEQ ID NO: 32472 - DNA, 25 bp, Mus musculus
ccatcccacagagaggccctatgtg

SEQ ID NO: 32473 - DNA, 25 bp, Mus musculus
catcccacagagaggccctatgtgc

SEQ ID NO: 32474 - DNA, 25 bp, Mus musculus
atcccacagagaggccctatgtgcc

SEQ ID NO: 32475 - DNA, 25 bp, Mus musculus
tcccacagagaggccctatgtgccc

SEQ ID NO: 32476 - DNA, 25 bp, Mus musculus
ccacagagaggccctatgtgcccca

SEQ ID NO: 32477 - DNA, 25 bp, Mus musculus
ggcgcccttcgtaaaccagtatgag

SEQ ID NO: 32478 - DNA, 25 bp, Mus musculus
gcgcccttcgtaaaccagtatgaga

SEQ ID NO: 32479 - DNA, 25 bp, Mus musculus
tatgagaactacgatcccgcgtcac

SEQ ID NO: 32480 - DNA, 25 bp, Mus musculus
atgagaactacgatcccgcgtcacg

SEQ ID NO: 32481 - DNA, 25 bp, Mus musculus
tcccgcgtcacggacctacgaacag

SEQ ID NO: 32482 - DNA, 25 bp, Mus musculus
gcgtcacggacctacgaacagggct

SEQ ID NO: 32483 - DNA, 25 bp, Mus musculus
tcacggacctacgaacagggctacg

SEQ ID NO: 32484 - DNA, 25 bp, Mus musculus
gggctacgtgtactaccgtggtgcg

SEQ ID NO: 32485 - DNA, 25 bp, Mus musculus
agccgaagcctcggtcgcggttgat

SEQ ID NO: 32486 - DNA, 25 bp, Mus musculus
ccgaagcctcggtcgcggttgatga

SEQ ID NO: 32487 - DNA, 25 bp, Mus musculus
tccgtagcgctcaaagaggcgcttg

SEQ ID NO: 32488 - DNA, 25 bp, Mus musculus
ccgtagcgctcaaagaggcgcttga

SEQ ID NO: 32489 - DNA, 25 bp, Mus musculus
agcgctcaaagaggcgcttgaagtc

SEQ ID NO: 32490 - DNA, 25 bp, Mus musculus
tgatgtctgtgggcaggttacccac

SEQ ID NO: 32491 - DNA, 25 bp, Mus musculus
atgtctgtgggcaggttacccacga

SEQ ID NO: 32492 - DNA, 25 bp, Mus musculus
gcaggttacccacgaagaggcggca

SEQ ID NO: 32493 - DNA, 25 bp, Mus musculus
gttacccacgaagaggcggcacgct

SEQ ID NO: 32494 - DNA, 25 bp, Mus musculus
ttacccacgaagaggcggcacgctg

SEQ ID NO: 32495 - DNA, 25 bp, Mus musculus
tacccacgaagaggcggcacgctgg

SEQ ID NO: 32496 - DNA, 25 bp, Mus musculus
acccacgaagaggcggcacgctggc

SEQ ID NO: 32497 - DNA, 25 bp, Mus musculus
cgaagcctcggtcgcggttgatgaa

SEQ ID NO: 32498 - DNA, 25 bp, Mus musculus
gttgatgaagacctcgctgggctct

SEQ ID NO: 32499 - DNA, 25 bp, Mus musculus
ttgatgaagacctcgctgggctctc

SEQ ID NO: 32500 - DNA, 25 bp, Mus musculus
tgatgaagacctcgctgggctctcc

SEQ ID NO: 32501 - DNA, 25 bp, Mus musculus
gggctctccgtagcgctcaaagagg

SEQ ID NO: 32502 - DNA, 25 bp, Mus musculus
ctctccgtagcgctcaaagaggcgc

SEQ ID NO: 32503 - DNA, 25 bp, Mus musculus
tctccgtagcgctcaaagaggcgct

SEQ ID NO: 32504 - DNA, 25 bp, Mus musculus
ctccgtagcgctcaaagaggcgctt

SEQ ID NO: 32505 - DNA, 25 bp, Mus musculus
accaccatgggaacatcgagtcctg

SEQ ID NO: 32506 - DNA, 25 bp, Mus musculus
ggaacatcgagtcctgccacgccga

SEQ ID NO: 32507 - DNA, 25 bp, Mus musculus
acagcaaatcgcgcagggacattgt

SEQ ID NO: 32508 - DNA, 25 bp, Mus musculus
aatcgcgcagggacattgtgcctga

SEQ ID NO: 32509 - DNA, 25 bp, Mus musculus
acattgtgcctgaagctctttttct

SEQ ID NO: 32510 - DNA, 25 bp, Mus musculus
ttgtgcctgaagctctttttctacc

SEQ ID NO: 32511 - DNA, 25 bp, Mus musculus
cccggcggactccaacagctcgtga

SEQ ID NO: 32512 - DNA, 25 bp, Mus musculus
ggcggactccaacagctcgtgacaa

SEQ ID NO: 32513 - DNA, 25 bp, Mus musculus
cctatgcctacgaaggcaccggctc

SEQ ID NO: 32514 - DNA, 25 bp, Mus musculus
ccgactccctgagctcgctggaatc

SEQ ID NO: 32515 - DNA, 25 bp, Mus musculus
ccctgagctcgctggaatccgtgac

SEQ ID NO: 32516 - DNA, 25 bp, Mus musculus
cgctggaatccgtgaccacggatgg

SEQ ID NO: 32517 - DNA, 25 bp, Mus musculus
caggccttagctctggggctctggt

SEQ ID NO: 32518 - DNA, 25 bp, Mus musculus
ctctggtggccatccttctgtgcat

SEQ ID NO: 32519 - DNA, 25 bp, Mus musculus
tcctactagtgacagtggtgctgtt

SEQ ID NO: 32520 - DNA, 25 bp, Mus musculus
tgttcgcagctctgaggcggcagga

SEQ ID NO: 32521 - DNA, 25 bp, Mus musculus
ctttgatcatttccaaagaggacat

SEQ ID NO: 32522 - DNA, 25 bp, Mus musculus
ttgtcagttacaacgacgaaggtgg

SEQ ID NO: 32523 - DNA, 25 bp, Mus musculus
tgaggaaccctgaagccatggagga

SEQ ID NO: 32524 - DNA, 25 bp, Mus musculus
aggacagcaaatcgcgcagggacat

SEQ ID NO: 32525 - DNA, 25 bp, Mus musculus
caaccgctgcatccacgaggagaac

SEQ ID NO: 32526 - DNA, 25 bp, Mus musculus
ctgcatccacgaggagaacccctac

SEQ ID NO: 32527 - DNA, 25 bp, Mus musculus
agctacatcgcctacctcatggatc

SEQ ID NO: 32528 - DNA, 25 bp, Mus musculus
tacatcgcctacctcatggatctgc

SEQ ID NO: 32529 - DNA, 25 bp, Mus musculus
atcgcctacctcatggatctgctgc

SEQ ID NO: 32530 - DNA, 25 bp, Mus musculus
gcctacctcatggatctgctgccca

SEQ ID NO: 32531 - DNA, 25 bp, Mus musculus
tacctcatggatctgctgcccaagg

SEQ ID NO: 32532 - DNA, 25 bp, Mus musculus
ctcatggatctgctgcccaaggacg

SEQ ID NO: 32533 - DNA, 25 bp, Mus musculus
atggatctgctgcccaaggacgacc

SEQ ID NO: 32534 - DNA, 25 bp, Mus musculus
gatctgctgcccaaggacgaccaga

SEQ ID NO: 32535 - DNA, 25 bp, Mus musculus
gccctggagctcaagcagtgaagaa

SEQ ID NO: 32536 - DNA, 25 bp, Mus musculus
ccctggagctcaagcagtgaagaag

SEQ ID NO: 32537 - DNA, 25 bp, Mus musculus
cccctactccacggctggcttattg

SEQ ID NO: 32538 - DNA, 25 bp, Mus musculus
cacggctggcttattggccacccgg

SEQ ID NO: 32539 - DNA, 25 bp, Mus musculus
tggcttattggccacccggagatgt

SEQ ID NO: 32540 - DNA, 25 bp, Mus musculus
gactacagtatggccctgtcctaca

SEQ ID NO: 32541 - DNA, 25 bp, Mus musculus
atggccctgtcctacagccccgagt

SEQ ID NO: 32542 - DNA, 25 bp, Mus musculus
accgccaaccgcaaggagcggcgca

SEQ ID NO: 32543 - DNA, 25 bp, Mus musculus
aggactcagagcatcaacagcgcct

SEQ ID NO: 32544 - DNA, 25 bp, Mus musculus
actcagagcatcaacagcgccttcg

SEQ ID NO: 32545 - DNA, 25 bp, Mus musculus
gtcttccatacctcggtcctcttgt

SEQ ID NO: 32546 - DNA, 25 bp, Mus musculus
catacctcggtcctcttgtagtagc

SEQ ID NO: 32547 - DNA, 25 bp, Mus musculus
gcctgctggtacttcagctgcggcg

SEQ ID NO: 32548 - DNA, 25 bp, Mus musculus
ctgcagacatggactcgtcgcacgt

SEQ ID NO: 32549 - DNA, 25 bp, Mus musculus
cagacatggactcgtcgcacgtcgc

SEQ ID NO: 32550 - DNA, 25 bp, Mus musculus
acatggactcgtcgcacgtcgcctg

SEQ ID NO: 32551 - DNA, 25 bp, Mus musculus
actcgtcgcacgtcgcctgtgtaca

SEQ ID NO: 32552 - DNA, 25 bp, Mus musculus
cgtcgcacgtcgcctgtgtacatgc

SEQ ID NO: 32553 - DNA, 25 bp, Mus musculus
tcgcctgtgtacatgctaggctgcg

SEQ ID NO: 32554 - DNA, 25 bp, Mus musculus
cctgtgtacatgctaggctgcggtc

SEQ ID NO: 32555 - DNA, 25 bp, Mus musculus
gtgtacatgctaggctgcggtccga

SEQ ID NO: 32556 - DNA, 25 bp, Mus musculus
atgctaggctgcggtccgaatgctt

SEQ ID NO: 32557 - DNA, 25 bp, Mus musculus
tctagtcgccagaactccggtaccg

SEQ ID NO: 32558 - DNA, 25 bp, Mus musculus
ggtaccgtgtttgagtcacgccttg

SEQ ID NO: 32559 - DNA, 25 bp, Mus musculus
gaggctctcgatgatctcgtcagtt

SEQ ID NO: 32560 - DNA, 25 bp, Mus musculus
gctctcgatgatctcgtcagttatg

SEQ ID NO: 32561 - DNA, 25 bp, Mus musculus
ctcgatgatctcgtcagttatgcct

SEQ ID NO: 32562 - DNA, 25 bp, Mus musculus
gatctcgtcagttatgcctgctggt

SEQ ID NO: 32563 - DNA, 25 bp, Mus musculus
gtcagttatgcctgctggtacttca

SEQ ID NO: 32564 - DNA, 25 bp, Mus musculus
tatgcctgctggtacttcagctgcg

SEQ ID NO: 32565 - DNA, 25 bp, Mus musculus
ttctgggttcaccttcaggatttct

SEQ ID NO: 32566 - DNA, 25 bp, Mus musculus
tgggttcaccttcaggatttctaca

SEQ ID NO: 32567 - DNA, 25 bp, Mus musculus
ctctaccttcagatgaatgccctga

SEQ ID NO: 32568 - DNA, 25 bp, Mus musculus
taccttcagatgaatgccctgagag

SEQ ID NO: 32569 - DNA, 25 bp, Mus musculus
atgaatgccctgagagctgaggaca

SEQ ID NO: 32570 - DNA, 25 bp, Mus musculus
aatgccctgagagctgaggacactg

SEQ ID NO: 32571 - DNA, 25 bp, Mus musculus
actgccatttattactgtgcaagag

SEQ ID NO: 32572 - DNA, 25 bp, Mus musculus
gccatttattactgtgcaagagatt

SEQ ID NO: 32573 - DNA, 25 bp, Mus musculus
atttattactgtgcaagagattact

SEQ ID NO: 32574 - DNA, 25 bp, Mus musculus
gtagtcactggtacttcgatgtctg

SEQ ID NO: 32575 - DNA, 25 bp, Mus musculus
gtcactggtacttcgatgtctgggg

SEQ ID NO: 32576 - DNA, 25 bp, Mus musculus
actggtacttcgatgtctggggcgc

SEQ ID NO: 32577 - DNA, 25 bp, Mus musculus
caccttcaggatttctacatggagt

SEQ ID NO: 32578 - DNA, 25 bp, Mus musculus
atcgtctccagagacacttcccaaa

SEQ ID NO: 32579 - DNA, 25 bp, Mus musculus
gtctccagagacacttcccaaagca

SEQ ID NO: 32580 - DNA, 25 bp, Mus musculus
tccagagacacttcccaaagcatcc

SEQ ID NO: 32581 - DNA, 25 bp, Mus musculus
agagacacttcccaaagcatcctct

SEQ ID NO: 32582 - DNA, 25 bp, Mus musculus
tcccaaagcatcctctaccttcaga

SEQ ID NO: 32583 - DNA, 25 bp, Mus musculus
agcatcctctaccttcagatgaatg

SEQ ID NO: 32584 - DNA, 25 bp, Mus musculus
atcctctaccttcagatgaatgccc

SEQ ID NO: 32585 - DNA, 25 bp, Mus musculus
ttcactgtacaaccgcagtaatacg

SEQ ID NO: 32586 - DNA, 25 bp, Mus musculus
gtacaaccgcagtaatacggaatat

SEQ ID NO: 32587 - DNA, 25 bp, Mus musculus
atgatgctttcaaactcattctgaa

SEQ ID NO: 32588 - DNA, 25 bp, Mus musculus
aatctgtaatgttcactctcactaa

SEQ ID NO: 32589 - DNA, 25 bp, Mus musculus
taatgttcactctcactaacttaca

SEQ ID NO: 32590 - DNA, 25 bp, Mus musculus
tcactctcactaacttacatcaaag

SEQ ID NO: 32591 - DNA, 25 bp, Mus musculus
tagcacacatgcgccttgtgatgac

SEQ ID NO: 32592 - DNA, 25 bp, Mus musculus
gccttgtgatgacctcgcctgtatt

SEQ ID NO: 32593 - DNA, 25 bp, Mus musculus
tgatgacctcgcctgtatttccata

SEQ ID NO: 32594 - DNA, 25 bp, Mus musculus
cctcgcctgtatttccataacagaa

SEQ ID NO: 32595 - DNA, 25 bp, Mus musculus
aacagaatacccgaggctgcatgat

SEQ ID NO: 32596 - DNA, 25 bp, Mus musculus
atacccgaggctgcatgatttatag

SEQ ID NO: 32597 - DNA, 25 bp, Mus musculus
taaatgaccaagttctcttcgttga

SEQ ID NO: 32598 - DNA, 25 bp, Mus musculus
ttctcttcgttgacaaaagacagcc

SEQ ID NO: 32599 - DNA, 25 bp, Mus musculus
aaagtgccagtgaaccccagaccag

SEQ ID NO: 32600 - DNA, 25 bp, Mus musculus
tggatccacctgaaaatattgatga

SEQ ID NO: 32601 - DNA, 25 bp, Mus musculus
atctcatattctttcagaaacgtgt

SEQ ID NO: 32602 - DNA, 25 bp, Mus musculus
tattctttcagaaacgtgttccagg

SEQ ID NO: 32603 - DNA, 25 bp, Mus musculus
aacgtgttccaggacacaacaagat

SEQ ID NO: 32604 - DNA, 25 bp, Mus musculus
ttccaggacacaacaagatggagtt

SEQ ID NO: 32605 - DNA, 7 bp, Mus musculus
catargt

SEQ ID NO: 32606 - DNA, 25 bp, Mus musculus
tggacccggtttgcaggtcgtgatg

SEQ ID NO: 32607 - DNA, 25 bp, Mus musculus
gacccggtttgcaggtcgtgatgga

SEQ ID NO: 32608 - DNA, 25 bp, Mus musculus
tgaatatcgacgagcgctacatctc

SEQ ID NO: 32609 - DNA, 25 bp, Mus musculus
aatatcgacgagcgctacatctcgc

SEQ ID NO: 32610 - DNA, 25 bp, Mus musculus
atatcgacgagcgctacatctcgca

SEQ ID NO: 32611 - DNA, 25 bp, Mus musculus
atggatatctcttcgtacatgcgca

SEQ ID NO: 32612 - DNA, 25 bp, Mus musculus
tggatatctcttcgtacatgcgcag

SEQ ID NO: 32613 - DNA, 25 bp, Mus musculus
gatatctcttcgtacatgcgcagga

SEQ ID NO: 32614 - DNA, 25 bp, Mus musculus
atatctcttcgtacatgcgcaggat

SEQ ID NO: 32615 - DNA, 25 bp, Mus musculus
atctcttcgtacatgcgcaggatgg

SEQ ID NO: 32616 - DNA, 25 bp, Mus musculus
tctcttcgtacatgcgcaggatggt

SEQ ID NO: 32617 - DNA, 25 bp, Mus musculus
tcttcgtacatgcgcaggatggtgg

SEQ ID NO: 32618 - DNA, 25 bp, Mus musculus
tttgcaggtcgtgatggaccgcaac

SEQ ID NO: 32619 - DNA, 25 bp, Mus musculus
tcgtgatggaccgcaacttgctgga

SEQ ID NO: 32620 - DNA, 25 bp, Mus musculus
agactgcgttctgcagaacactgtt

SEQ ID NO: 32621 - DNA, 25 bp, Mus musculus
actgcgttctgcagaacactgttga

SEQ ID NO: 32622 - DNA, 25 bp, Mus musculus
ctgcgttctgcagaacactgttgaa

SEQ ID NO: 32623 - DNA, 25 bp, Mus musculus
gcgttctgcagaacactgttgaata

SEQ ID NO: 32624 - DNA, 25 bp, Mus musculus
cgttctgcagaacactgttgaatat

SEQ ID NO: 32625 - DNA, 25 bp, Mus musculus
ttctgcagaacactgttgaatatcg

SEQ ID NO: 32626 - DNA, 25 bp, Mus musculus
taactttgcaactataatcctgtat

SEQ ID NO: 32627 - DNA, 25 bp, Mus musculus
ctttgcaactataatcctgtatcag

SEQ ID NO: 32628 - DNA, 25 bp, Mus musculus
ccagatgcaccagaattatgtgact

SEQ ID NO: 32629 - DNA, 25 bp, Mus musculus
agttctagcttaagtgttggcactt

SEQ ID NO: 32630 - DNA, 25 bp, Mus musculus
cttccatgtcgacgtatacccagta

SEQ ID NO: 32631 - DNA, 25 bp, Mus musculus
ctcgtaatactactttaatgattca

SEQ ID NO: 32632 - DNA, 25 bp, Mus musculus
taatgattcagtttctcgagaatgg

SEQ ID NO: 32633 - DNA, 25 bp, Mus musculus
tgattcagtttctcgagaatggtaa

SEQ ID NO: 32634 - DNA, 25 bp, Mus musculus
ttcagtttctcgagaatggtaattg

SEQ ID NO: 32635 - DNA, 25 bp, Mus musculus
ttcaatacgacgtgcctgtaaccat

SEQ ID NO: 32636 - DNA, 25 bp, Mus musculus
aatacgacgtgcctgtaaccatgga

SEQ ID NO: 32637 - DNA, 25 bp, Mus musculus
ctgtaaccatggatgtcccctttgt

SEQ ID NO: 32638 - DNA, 25 bp, Mus musculus
tgcaactataatcctgtatcagttt

SEQ ID NO: 32639 - DNA, 25 bp, Mus musculus
aactataatcctgtatcagtttcct

SEQ ID NO: 32640 - DNA, 25 bp, Mus musculus
tataatcctgtatcagtttcctata

SEQ ID NO: 32641 - DNA, 25 bp, Mus musculus
aatcctgtatcagtttcctataatt

SEQ ID NO: 32642 - DNA, 25 bp, Mus musculus
attattaacagaccagatgcaccag

SEQ ID NO: 32643 - DNA, 25 bp, Mus musculus
attaacagaccagatgcaccagaat

SEQ ID NO: 32644 - DNA, 25 bp, Mus musculus
aacagaccagatgcaccagaattat

SEQ ID NO: 32645 - DNA, 25 bp, Mus musculus
agaccagatgcaccagaattatgtg

SEQ ID NO: 32646 - DNA, 25 bp, Mus musculus
ggagttcagcgagtcggagagcaat

SEQ ID NO: 32647 - DNA, 25 bp, Mus musculus
agttcagcgagtcggagagcaatga

SEQ ID NO: 32648 - DNA, 25 bp, Mus musculus
gcggtaccactatggcacgactggt

SEQ ID NO: 32649 - DNA, 25 bp, Mus musculus
cggtaccactatggcacgactggta

SEQ ID NO: 32650 - DNA, 25 bp, Mus musculus
ggtaccactatggcacgactggtaa

SEQ ID NO: 32651 - DNA, 25 bp, Mus musculus
gtaccactatggcacgactggtaag

SEQ ID NO: 32652 - DNA, 25 bp, Mus musculus
taccactatggcacgactggtaagc

SEQ ID NO: 32653 - DNA, 25 bp, Mus musculus
aggttctatgagcacaggtgggatg

SEQ ID NO: 32654 - DNA, 25 bp, Mus musculus
ggttctatgagcacaggtgggatga

SEQ ID NO: 32655 - DNA, 25 bp, Mus musculus
gttctatgagcacaggtgggatgag

SEQ ID NO: 32656 - DNA, 25 bp, Mus musculus
ttctatgagcacaggtgggatgagg

SEQ ID NO: 32657 - DNA, 25 bp, Mus musculus
tctatgagcacaggtgggatgagga

SEQ ID NO: 32658 - DNA, 25 bp, Mus musculus
gttcagcgagtcggagagcaatgag

SEQ ID NO: 32659 - DNA, 25 bp, Mus musculus
gatctcgtgtctgagtacgagcggt

SEQ ID NO: 32660 - DNA, 25 bp, Mus musculus
atctcgtgtctgagtacgagcggta

SEQ ID NO: 32661 - DNA, 25 bp, Mus musculus
tctcgtgtctgagtacgagcggtac

SEQ ID NO: 32662 - DNA, 25 bp, Mus musculus
gtacgagcggtaccactatggcacg

SEQ ID NO: 32663 - DNA, 25 bp, Mus musculus
tacgagcggtaccactatggcacga

SEQ ID NO: 32664 - DNA, 25 bp, Mus musculus
acgagcggtaccactatggcacgac

SEQ ID NO: 32665 - DNA, 25 bp, Mus musculus
agcggtaccactatggcacgactgg

SEQ ID NO: 32666 - DNA, 25 bp, Mus musculus
tcctcaaagacattatctgtactat

SEQ ID NO: 32667 - DNA, 25 bp, Mus musculus
ttcttgttcagaccaagcctgtgtg

SEQ ID NO: 32668 - DNA, 25 bp, Mus musculus
gtgtaccgctacagtgttgcagttc

SEQ ID NO: 32669 - DNA, 25 bp, Mus musculus
ctgtgacagcaccagtctgaggctg

SEQ ID NO: 32670 - DNA, 25 bp, Mus musculus
ttcagtgacctgtgagatgtgcgga

SEQ ID NO: 32671 - DNA, 25 bp, Mus musculus
cacctcagcagcacagataggggtc

SEQ ID NO: 32672 - DNA, 25 bp, Mus musculus
cacacatcgatagatgtcaggcggg

SEQ ID NO: 32673 - DNA, 25 bp, Mus musculus
gctccgcctcagttaatggaaatat

SEQ ID NO: 32674 - DNA, 25 bp, Mus musculus
catgttaccccaaattagcttctct

SEQ ID NO: 32675 - DNA, 25 bp, Mus musculus
accccaaattagcttctctgcatag

SEQ ID NO: 32676 - DNA, 25 bp, Mus musculus
cttctctgcatagaacataagtatg

SEQ ID NO: 32677 - DNA, 25 bp, Mus musculus
acacgtgtgttctactacagcttat

SEQ ID NO: 32678 - DNA, 25 bp, Mus musculus
ttcagaccaagcctgtgtgcctgat

SEQ ID NO: 32679 - DNA, 25 bp, Mus musculus
ccaagcctgtgtgcctgatatcatt

SEQ ID NO: 32680 - DNA, 25 bp, Mus musculus
tcttcaagttgcccacagtgtctcc

SEQ ID NO: 32681 - DNA, 25 bp, Mus musculus
agttgcccacagtgtctccacttaa

SEQ ID NO: 32682 - DNA, 25 bp, Mus musculus
ccacagtgtctccacttaaataggc

SEQ ID NO: 32683 - DNA, 25 bp, Mus musculus
tagccctgctttaggggccagggtg

SEQ ID NO: 32684 - DNA, 25 bp, Mus musculus
agaggtctgctcctaaggtaacgtg

SEQ ID NO: 32685 - DNA, 25 bp, Mus musculus
agccaatggtctgaggctgtgtacc

SEQ ID NO: 32686 - DNA, 25 bp, Mus musculus
ccctgagggcctgttcgtccagcct

SEQ ID NO: 32687 - DNA, 25 bp, Mus musculus
ttcatctctttcggtcattttagcc

SEQ ID NO: 32688 - DNA, 25 bp, Mus musculus
tccaggcaggcatcaggccatctgg

SEQ ID NO: 32689 - DNA, 25 bp, Mus musculus
actggattctcctcgttaccctgtg

SEQ ID NO: 32690 - DNA, 25 bp, Mus musculus
tgaaacttggtgccacacagagcct

SEQ ID NO: 32691 - DNA, 25 bp, Mus musculus
ttggtgccacacagagcctctgtcc

SEQ ID NO: 32692 - DNA, 25 bp, Mus musculus
tctgtcctgtttcttggctgaagat

SEQ ID NO: 32693 - DNA, 25 bp, Mus musculus
ctgtttcttggctgaagatgacaat

SEQ ID NO: 32694 - DNA, 25 bp, Mus musculus
tcacaagtcaggagagccggccaca

SEQ ID NO: 32695 - DNA, 25 bp, Mus musculus
ggccacagacaggcatggcatgcac

SEQ ID NO: 32696 - DNA, 25 bp, Mus musculus
gcatggcatgcacctcaataaacgc

SEQ ID NO: 32697 - DNA, 25 bp, Mus musculus
catgcacctcaataaacgctgccgt

SEQ ID NO: 32698 - DNA, 25 bp, Mus musculus
ggtcattttagccactcaccgaggt

SEQ ID NO: 32699 - DNA, 25 bp, Mus musculus
ccgaggtctctctttccccatatct

SEQ ID NO: 32700 - DNA, 25 bp, Mus musculus
tttccccatatctactgccttttgt

SEQ ID NO: 32701 - DNA, 25 bp, Mus musculus
catatctactgccttttgtatgagc

SEQ ID NO: 32702 - DNA, 25 bp, Mus musculus
tactgccttttgtatgagccatttt

SEQ ID NO: 32703 - DNA, 25 bp, Mus musculus
cttttgtatgagccattttgtataa

SEQ ID NO: 32704 - DNA, 25 bp, Mus musculus
tttcttgctttgtccaggcaggcat

SEQ ID NO: 32705 - DNA, 25 bp, Mus musculus
gctttgtccaggcaggcatcaggcc

SEQ ID NO: 32706 - DNA, 25 bp, Mus musculus
ttaccactgtcaaagggatcgctga

SEQ ID NO: 32707 - DNA, 25 bp, Mus musculus
actgtcaaagggatcgctgatgatt

SEQ ID NO: 32708 - DNA, 25 bp, Mus musculus
gccagaacatatccaagttcctaat

SEQ ID NO: 32709 - DNA, 25 bp, Mus musculus
ccagaacatatccaagttcctaata

SEQ ID NO: 32710 - DNA, 25 bp, Mus musculus
agaacatatccaagttcctaataag

SEQ ID NO: 32711 - DNA, 25 bp, Mus musculus
gaacatatccaagttcctaataaga

SEQ ID NO: 32712 - DNA, 25 bp, Mus musculus
acatatccaagttcctaataagatt

SEQ ID NO: 32713 - DNA, 25 bp, Mus musculus
catatccaagttcctaataagattt

SEQ ID NO: 32714 - DNA, 25 bp, Mus musculus
tatccaagttcctaataagatttgg

SEQ ID NO: 32715 - DNA, 25 bp, Mus musculus
gatttgggtgcctaggacgatctgc

SEQ ID NO: 32716 - DNA, 25 bp, Mus musculus
atttgggtgcctaggacgatctgct

SEQ ID NO: 32717 - DNA, 25 bp, Mus musculus
gtgcctaggacgatctgcttaaggt

SEQ ID NO: 32718 - DNA, 25 bp, Mus musculus
attcactacagggtgacagcgccag

SEQ ID NO: 32719 - DNA, 25 bp, Mus musculus
tcactacagggtgacagcgccagaa

SEQ ID NO: 32720 - DNA, 25 bp, Mus musculus
cactacagggtgacagcgccagaac

SEQ ID NO: 32721 - DNA, 25 bp, Mus musculus
ggtgacagcgccagaacatatccaa

SEQ ID NO: 32722 - DNA, 25 bp, Mus musculus
gtgacagcgccagaacatatccaag

SEQ ID NO: 32723 - DNA, 25 bp, Mus musculus
gacagcgccagaacatatccaagtt

SEQ ID NO: 32724 - DNA, 25 bp, Mus musculus
acagcgccagaacatatccaagttc

SEQ ID NO: 32725 - DNA, 25 bp, Mus musculus
gcgccagaacatatccaagttccta

SEQ ID NO: 32726 - DNA, 25 bp, Mus musculus
ccaaaattgttctcaactgtgacct

SEQ ID NO: 32727 - DNA, 25 bp, Mus musculus
tcaactgtgacctcttggtagtcct

SEQ ID NO: 32728 - DNA, 25 bp, Mus musculus
ccttcctgccactgtgttatggcat

SEQ ID NO: 32729 - DNA, 25 bp, Mus musculus
gcagctacattctggagaggagcag

SEQ ID NO: 32730 - DNA, 25 bp, Mus musculus
acattctggagaggagcagatgtcc

SEQ ID NO: 32731 - DNA, 25 bp, Mus musculus
gatgtccaaggacccaggaatgtgg

SEQ ID NO: 32732 - DNA, 25 bp, Mus musculus
gtcaagaacccccaggagcaatctc

SEQ ID NO: 32733 - DNA, 25 bp, Mus musculus
aacccccaggagcaatctcagtccg

SEQ ID NO: 32734 - DNA, 25 bp, Mus musculus
caggagcaatctcagtccggaccga

SEQ ID NO: 32735 - DNA, 25 bp, Mus musculus
ggaccgaggccactttgtacatatg

SEQ ID NO: 32736 - DNA, 25 bp, Mus musculus
aggccactttgtacatatgatgtat

SEQ ID NO: 32737 - DNA, 25 bp, Mus musculus
tgggctccagccagagaacaatctt

SEQ ID NO: 32738 - DNA, 25 bp, Mus musculus
gtgacctcttggtagtcctggcgtg

SEQ ID NO: 32739 - DNA, 25 bp, Mus musculus
gtccctctctaaaggctcagaattg

SEQ ID NO: 32740 - DNA, 25 bp, Mus musculus
ctctaaaggctcagaattggacagt

SEQ ID NO: 32741 - DNA, 25 bp, Mus musculus
tgggccccactggatggatactcac

SEQ ID NO: 32742 - DNA, 25 bp, Mus musculus
gatggatactcacgctccacaccaa

SEQ ID NO: 32743 - DNA, 25 bp, Mus musculus
agagcccttccttgaagtttatctg

SEQ ID NO: 32744 - DNA, 25 bp, Mus musculus
cttccttgaagtttatctggctgtt

SEQ ID NO: 32745 - DNA, 25 bp, Mus musculus
ttatctggctgttacaaatgtctcc

SEQ ID NO: 32746 - DNA, 25 bp, Mus musculus
gaactagtatcctgagagtgccaga

SEQ ID NO: 32747 - DNA, 25 bp, Mus musculus
ctagtatcctgagagtgccagagaa

SEQ ID NO: 32748 - DNA, 25 bp, Mus musculus
gctcttcgcattgttcgcttccggc

SEQ ID NO: 32749 - DNA, 25 bp, Mus musculus
tcccttcaactgggatctcccggag

SEQ ID NO: 32750 - DNA, 25 bp, Mus musculus
caagattcgagtgcaccctcggggc

SEQ ID NO: 32751 - DNA, 25 bp, Mus musculus
gattcgagtgcaccctcggggcaac

SEQ ID NO: 32752 - DNA, 25 bp, Mus musculus
gcaccctcggggcaacctctgggcg

SEQ ID NO: 32753 - DNA, 25 bp, Mus musculus
ggggaccccctataagcatgcctca

SEQ ID NO: 32754 - DNA, 25 bp, Mus musculus
taagcatgcctcattctccttggtc

SEQ ID NO: 32755 - DNA, 25 bp, Mus musculus
gcatgcctcattctccttggtcctc

SEQ ID NO: 32756 - DNA, 25 bp, Mus musculus
tgcctcattctccttggtcctcagt

SEQ ID NO: 32757 - DNA, 25 bp, Mus musculus
ctcattctccttggtcctcagtttc

SEQ ID NO: 32758 - DNA, 25 bp, Mus musculus
agagcctgtttggcacagcatgacc

SEQ ID NO: 32759 - DNA, 25 bp, Mus musculus
gcctgtttggcacagcatgacccgg

SEQ ID NO: 32760 - DNA, 25 bp, Mus musculus
tgtttggcacagcatgacccggcaa

SEQ ID NO: 32761 - DNA, 25 bp, Mus musculus
cagcatgacccggcaagcagggagc

SEQ ID NO: 32762 - DNA, 25 bp, Mus musculus
catgacccggcaagcagggagctct

SEQ ID NO: 32763 - DNA, 25 bp, Mus musculus
ccgtggtctcctgctcttcgcattg

SEQ ID NO: 32764 - DNA, 25 bp, Mus musculus
tctcctgctcttcgcattgttcgct

SEQ ID NO: 32765 - DNA, 25 bp, Mus musculus
cctgctcttcgcattgttcgcttcc

SEQ ID NO: 32766 - DNA, 25 bp, Mus musculus
gttcccctggctcctgtaatgcatt

SEQ ID NO: 32767 - DNA, 25 bp, Mus musculus
cccctggctcctgtaatgcattcgc

SEQ ID NO: 32768 - DNA, 25 bp, Mus musculus
ctcatgtgcgcgacagaccaaggac

SEQ ID NO: 32769 - DNA, 25 bp, Mus musculus
aactgtgttttctgcgaatgtgaaa

SEQ ID NO: 32770 - DNA, 25 bp, Mus musculus
tgtgttttctgcgaatgtgaaatgt

SEQ ID NO: 32771 - DNA, 25 bp, Mus musculus
cacacattgtgcactttctcacaga

SEQ ID NO: 32772 - DNA, 25 bp, Mus musculus
acattgtgcactttctcacagactc

SEQ ID NO: 32773 - DNA, 25 bp, Mus musculus
actttctcacagactctagatactc

SEQ ID NO: 32774 - DNA, 25 bp, Mus musculus
ttctcacagactctagatactcgcc

SEQ ID NO: 32775 - DNA, 25 bp, Mus musculus
tcacagactctagatactcgccaga

SEQ ID NO: 32776 - DNA, 25 bp, Mus musculus
actctagatactcgccagatttcaa

SEQ ID NO: 32777 - DNA, 25 bp, Mus musculus
gatactcgccagatttcaagatagt

SEQ ID NO: 32778 - DNA, 25 bp, Mus musculus
ctggctcctgtaatgcattcgcaaa

SEQ ID NO: 32779 - DNA, 25 bp, Mus musculus
tcttttggcaacaacatctcttcgc

SEQ ID NO: 32780 - DNA, 25 bp, Mus musculus
tttggcaacaacatctcttcgctga

SEQ ID NO: 32781 - DNA, 25 bp, Mus musculus
ggcaacaacatctcttcgctgattt

SEQ ID NO: 32782 - DNA, 25 bp, Mus musculus
aacatctcttcgctgatttctctgt

SEQ ID NO: 32783 - DNA, 25 bp, Mus musculus
atctcttcgctgatttctctgtgaa

SEQ ID NO: 32784 - DNA, 25 bp, Mus musculus
tcttcgctgatttctctgtgaacag

SEQ ID NO: 32785 - DNA, 25 bp, Mus musculus
gaaaggctcatgtgcgcgacagacc

SEQ ID NO: 32786 - DNA, 25 bp, Mus musculus
cgatttacctggcctcctcatacca

SEQ ID NO: 32787 - DNA, 25 bp, Mus musculus
tttacctggcctcctcataccagga

SEQ ID NO: 32788 - DNA, 25 bp, Mus musculus
caacatacaacgagcacatcaccaa

SEQ ID NO: 32789 - DNA, 25 bp, Mus musculus
acaacgagcacatcaccaaacgcgt

SEQ ID NO: 32790 - DNA, 25 bp, Mus musculus
acgagcacatcaccaaacgcgtggc

SEQ ID NO: 32791 - DNA, 25 bp, Mus musculus
agcacatcaccaaacgcgtggcctc

SEQ ID NO: 32792 - DNA, 25 bp, Mus musculus
agtccccaggccgaatgctcagcac

SEQ ID NO: 32793 - DNA, 25 bp, Mus musculus
ccccaggccgaatgctcagcactag

SEQ ID NO: 32794 - DNA, 25 bp, Mus musculus
gccgaatgctcagcactaggagaga

SEQ ID NO: 32795 - DNA, 25 bp, Mus musculus
gaatgctcagcactaggagagagcg

SEQ ID NO: 32796 - DNA, 25 bp, Mus musculus
aggtctgggaccagtcttcagtata

SEQ ID NO: 32797 - DNA, 25 bp, Mus musculus
tctgggaccagtcttcagtataagt

SEQ ID NO: 32798 - DNA, 25 bp, Mus musculus
tggcctcctcataccaggacaagtt

SEQ ID NO: 32799 - DNA, 25 bp, Mus musculus
cctcctcataccaggacaagttaag

SEQ ID NO: 32800 - DNA, 25 bp, Mus musculus
gcactgagcagcaccgggtgccctc

SEQ ID NO: 32801 - DNA, 25 bp, Mus musculus
ccaacaagcgaggcccaccaacata

SEQ ID NO: 32802 - DNA, 25 bp, Mus musculus
acaagcgaggcccaccaacatacaa

SEQ ID NO: 32803 - DNA, 25 bp, Mus musculus
agcgaggcccaccaacatacaacga

SEQ ID NO: 32804 - DNA, 25 bp, Mus musculus
gcccaccaacatacaacgagcacat

SEQ ID NO: 32805 - DNA, 25 bp, Mus musculus
caccaacatacaacgagcacatcac

SEQ ID NO: 32806 - DNA, 25 bp, Mus musculus
ctttgtcatcacaaaacccgatgtc

SEQ ID NO: 32807 - DNA, 25 bp, Mus musculus
tgtcatcacaaaacccgatgtctac

SEQ ID NO: 32808 - DNA, 25 bp, Mus musculus
acagttagcagctgctgagaaattc

SEQ ID NO: 32809 - DNA, 25 bp, Mus musculus
tgtttcaaacattcaggaaaacact

SEQ ID NO: 32810 - DNA, 25 bp, Mus musculus
tcagactccaaccgtccaagaggag

SEQ ID NO: 32811 - DNA, 25 bp, Mus musculus
agaactggtcatgtcgcaagcaaac

SEQ ID NO: 32812 - DNA, 25 bp, Mus musculus
ggtcatgtcgcaagcaaacgtatca

SEQ ID NO: 32813 - DNA, 25 bp, Mus musculus
catgtcgcaagcaaacgtatcaaga

SEQ ID NO: 32814 - DNA, 25 bp, Mus musculus
gtactgtttctatcactaataaagt

SEQ ID NO: 32815 - DNA, 25 bp, Mus musculus
ctgtttctatcactaataaagttgt

SEQ ID NO: 32816 - DNA, 25 bp, Mus musculus
tttctatcactaataaagttgtggc

SEQ ID NO: 32817 - DNA, 25 bp, Mus musculus
ttgtggcttcttgttggatggactc

SEQ ID NO: 32818 - DNA, 25 bp, Mus musculus
catcacaaaacccgatgtctacaag

SEQ ID NO: 32819 - DNA, 25 bp, Mus musculus
tgtggcttcttgttggatggactca

SEQ ID NO: 32820 - DNA, 25 bp, Mus musculus
acccgatgtctacaagagccctgct

SEQ ID NO: 32821 - DNA, 25 bp, Mus musculus
gagccctgcttcagacacctacata

SEQ ID NO: 32822 - DNA, 25 bp, Mus musculus
tgcttcagacacctacatagtgttt

SEQ ID NO: 32823 - DNA, 25 bp, Mus musculus
ttcagacacctacatagtgtttggg

SEQ ID NO: 32824 - DNA, 25 bp, Mus musculus
agatttgtctcagcaagcacagtta

SEQ ID NO: 32825 - DNA, 25 bp, Mus musculus
gtctcagcaagcacagttagcagct

SEQ ID NO: 32826 - DNA, 25 bp, Mus musculus
tcagcaagcacagttagcagctgct

SEQ ID NO: 32827 - DNA, 25 bp, Mus musculus
tctccatggagtcacagtcctaaag

SEQ ID NO: 32828 - DNA, 25 bp, Mus musculus
tggagtcacagtcctaaagactatg

SEQ ID NO: 32829 - DNA, 25 bp, Mus musculus
atgatcatattgccctgcatctgtt

SEQ ID NO: 32830 - DNA, 25 bp, Mus musculus
atattgccctgcatctgtttgcttc

SEQ ID NO: 32831 - DNA, 25 bp, Mus musculus
atctgtttgcttctaaagccttcag

SEQ ID NO: 32832 - DNA, 25 bp, Mus musculus
ctaaagccttcagtgttcatgaata

SEQ ID NO: 32833 - DNA, 25 bp, Mus musculus
catagaactctgtagccggaatcta

SEQ ID NO: 32834 - DNA, 25 bp, Mus musculus
actctgtagccggaatctactagaa

SEQ ID NO: 32835 - DNA, 25 bp, Mus musculus
accctgtaacccacgtgctgctgtg

SEQ ID NO: 32836 - DNA, 25 bp, Mus musculus
acgtgctgctgtgaggttaagaaag

SEQ ID NO: 32837 - DNA, 25 bp, Mus musculus
cgtaaagacgctacactgaaaactg

SEQ ID NO: 32838 - DNA, 25 bp, Mus musculus
cattgttgtctgtgtcccctcaatt

SEQ ID NO: 32839 - DNA, 25 bp, Mus musculus
cacagtcctaaagactatggtgccc

SEQ ID NO: 32840 - DNA, 25 bp, Mus musculus
ccatgaactctcttggacttactgc

SEQ ID NO: 32841 - DNA, 25 bp, Mus musculus
actctcttggacttactgccacatt

SEQ ID NO: 32842 - DNA, 25 bp, Mus musculus
ccacattagctggtgacacggctga

SEQ ID NO: 32843 - DNA, 25 bp, Mus musculus
gtgacacggctgagctgacttggat

SEQ ID NO: 32844 - DNA, 25 bp, Mus musculus
cggctgagctgacttggatatgtga

SEQ ID NO: 32845 - DNA, 25 bp, Mus musculus
ccacccagtcatcagctagcttcag

SEQ ID NO: 32846 - DNA, 25 bp, Mus musculus
cagctagcttcaggtttagattagg

SEQ ID NO: 32847 - DNA, 25 bp, Mus musculus
agccagggagctctgggcacactag

SEQ ID NO: 32848 - DNA, 25 bp, Mus musculus
cagggagctctgggcacactagcta

SEQ ID NO: 32849 - DNA, 25 bp, Mus musculus
ttaataccatagatagtgcttgctt

SEQ ID NO: 32850 - DNA, 25 bp, Mus musculus
aataccatagatagtgcttgctttc

SEQ ID NO: 32851 - DNA, 25 bp, Mus musculus
accatagatagtgcttgctttccaa

SEQ ID NO: 32852 - DNA, 25 bp, Mus musculus
ccatagatagtgcttgctttccaag

SEQ ID NO: 32853 - DNA, 25 bp, Mus musculus
atagatagtgcttgctttccaagcc

SEQ ID NO: 32854 - DNA, 25 bp, Mus musculus
tagatagtgcttgctttccaagcct

SEQ ID NO: 32855 - DNA, 25 bp, Mus musculus
gatagtgcttgctttccaagcctgg

SEQ ID NO: 32856 - DNA, 25 bp, Mus musculus
agcatggcgaactgggatatagatg

SEQ ID NO: 32857 - DNA, 25 bp, Mus musculus
gcatggcgaactgggatatagatgg

SEQ ID NO: 32858 - DNA, 25 bp, Mus musculus
atggcgaactgggatatagatggct

SEQ ID NO: 32859 - DNA, 25 bp, Mus musculus
agggagctctgggcacactagctaa

SEQ ID NO: 32860 - DNA, 25 bp, Mus musculus
ggagctctgggcacactagctaatg

SEQ ID NO: 32861 - DNA, 25 bp, Mus musculus
gagctctgggcacactagctaatgt

SEQ ID NO: 32862 - DNA, 25 bp, Mus musculus
gctctgggcacactagctaatgtag

SEQ ID NO: 32863 - DNA, 25 bp, Mus musculus
ctctgggcacactagctaatgtagt

SEQ ID NO: 32864 - DNA, 25 bp, Mus musculus
ctgggcacactagctaatgtagtga

SEQ ID NO: 32865 - DNA, 25 bp, Mus musculus
tgggcacactagctaatgtagtgac

SEQ ID NO: 32866 - DNA, 25 bp, Mus musculus
cttaataccatagatagtgcttgct

SEQ ID NO: 32867 - DNA, 25 bp, Mus musculus
ttatactggagccagcatgaatcca

SEQ ID NO: 32868 - DNA, 25 bp, Mus musculus
agccagcatgaatccagctcgatct

SEQ ID NO: 32869 - DNA, 25 bp, Mus musculus
tttctgccacccattaaggaacaga

SEQ ID NO: 32870 - DNA, 25 bp, Mus musculus
ctgccacccattaaggaacagattt

SEQ ID NO: 32871 - DNA, 25 bp, Mus musculus
gacacttgcgggtttcttcttcaca

SEQ ID NO: 32872 - DNA, 25 bp, Mus musculus
tttcttcttcacacttgttacacag

SEQ ID NO: 32873 - DNA, 25 bp, Mus musculus
cttcttcacacttgttacacagttt

SEQ ID NO: 32874 - DNA, 25 bp, Mus musculus
cacatatttctatatacatggggcc

SEQ ID NO: 32875 - DNA, 25 bp, Mus musculus
atatttctatatacatggggccttt

SEQ ID NO: 32876 - DNA, 25 bp, Mus musculus
ttaactctaattcactataatcctc

SEQ ID NO: 32877 - DNA, 25 bp, Mus musculus
actctaattcactataatcctctcc

SEQ ID NO: 32878 - DNA, 25 bp, Mus musculus
ctcagaatccaagaacccatagggc

SEQ ID NO: 32879 - DNA, 25 bp, Mus musculus
cagcatgaatccagctcgatctttt

SEQ ID NO: 32880 - DNA, 25 bp, Mus musculus
catgaatccagctcgatcttttgga

SEQ ID NO: 32881 - DNA, 25 bp, Mus musculus
aagagactccctagacctggcctca

SEQ ID NO: 32882 - DNA, 25 bp, Mus musculus
agactccctagacctggcctcagat

SEQ ID NO: 32883 - DNA, 25 bp, Mus musculus
ctccctagacctggcctcagatttc

SEQ ID NO: 32884 - DNA, 25 bp, Mus musculus
cctagacctggcctcagatttctgc

SEQ ID NO: 32885 - DNA, 25 bp, Mus musculus
agacctggcctcagatttctgccac

SEQ ID NO: 32886 - DNA, 25 bp, Mus musculus
ctcagatttctgccacccattaagg

SEQ ID NO: 32887 - DNA, 25 bp, Mus musculus
ggcttcagtctgaagtcccatctca

SEQ ID NO: 32888 - DNA, 25 bp, Mus musculus
agtctgaagtcccatctcagtcaac

SEQ ID NO: 32889 - DNA, 25 bp, Mus musculus
ctttagagaagccttccatggctct

SEQ ID NO: 32890 - DNA, 25 bp, Mus musculus
agaagccttccatggctctcatatg

SEQ ID NO: 32891 - DNA, 25 bp, Mus musculus
cttccatggctctcatatgtgtaac

SEQ ID NO: 32892 - DNA, 25 bp, Mus musculus
ccatggctctcatatgtgtaacagc

SEQ ID NO: 32893 - DNA, 25 bp, Mus musculus
cagcatcttagccatcttaaccatc

SEQ ID NO: 32894 - DNA, 25 bp, Mus musculus
catcttagccatcttaaccatcaga

SEQ ID NO: 32895 - DNA, 25 bp, Mus musculus
cttagccatcttaaccatcagacct

SEQ ID NO: 32896 - DNA, 25 bp, Mus musculus
catcttaaccatcagacctacagac

SEQ ID NO: 32897 - DNA, 25 bp, Mus musculus
cttaaccatcagacctacagacgag

SEQ ID NO: 32898 - DNA, 25 bp, Mus musculus
aaccatcagacctacagacgagggg

SEQ ID NO: 32899 - DNA, 25 bp, Mus musculus
ctgaagtcccatctcagtcaacatc

SEQ ID NO: 32900 - DNA, 25 bp, Mus musculus
agtttcagttggagctgtagcctct

SEQ ID NO: 32901 - DNA, 25 bp, Mus musculus
agctgtagcctcttcaaacatctgc

SEQ ID NO: 32902 - DNA, 25 bp, Mus musculus
agcctcttcaaacatctgcgtacca

SEQ ID NO: 32903 - DNA, 25 bp, Mus musculus
ctcttcaaacatctgcgtaccacga

SEQ ID NO: 32904 - DNA, 25 bp, Mus musculus
catctgcgtaccacgagaggacaga

SEQ ID NO: 32905 - DNA, 25 bp, Mus musculus
ctgcgtaccacgagaggacagatcc

SEQ ID NO: 32906 - DNA, 25 bp, Mus musculus
cataagcacctgaagcatacaggag

SEQ ID NO: 32907 - DNA, 25 bp, Mus musculus
tcctgtgcctcacagcccaggggac

SEQ ID NO: 32908 - DNA, 25 bp, Mus musculus
ctcaggctcagagtcaactgctggg

SEQ ID NO: 32909 - DNA, 25 bp, Mus musculus
tcctgactaagctctcagatatcag

SEQ ID NO: 32910 - DNA, 25 bp, Mus musculus
ctaagctctcagatatcagatcctg

SEQ ID NO: 32911 - DNA, 25 bp, Mus musculus
tctcagatatcagatcctgcaaact

SEQ ID NO: 32912 - DNA, 25 bp, Mus musculus
atatcagatcctgcaaacttcctgg

SEQ ID NO: 32913 - DNA, 25 bp, Mus musculus
tagcagctctgccacctagcaacag

SEQ ID NO: 32914 - DNA, 25 bp, Mus musculus
ctctgccacctagcaacagtgactg

SEQ ID NO: 32915 - DNA, 25 bp, Mus musculus
gaaagtcctcaggctgacaggtcac

SEQ ID NO: 32916 - DNA, 25 bp, Mus musculus
cctcaggctgacaggtcaccagtca

SEQ ID NO: 32917 - DNA, 25 bp, Mus musculus
tcctctcactatgcgtgctacggca

SEQ ID NO: 32918 - DNA, 25 bp, Mus musculus
tacggcacatgggttcacacaatga

SEQ ID NO: 32919 - DNA, 25 bp, Mus musculus
ctgtcagatgcaccttcactaatgt

SEQ ID NO: 32920 - DNA, 25 bp, Mus musculus
tttgtctccatccctagagccagag

SEQ ID NO: 32921 - DNA, 25 bp, Mus musculus
gccagagcgcatggctgcatgctaa

SEQ ID NO: 32922 - DNA, 25 bp, Mus musculus
gcgcatggctgcatgctaaggctta

SEQ ID NO: 32923 - DNA, 25 bp, Mus musculus
tatacagcccagtgaaccatctcag

SEQ ID NO: 32924 - DNA, 25 bp, Mus musculus
gagagcccacagctatgttagggag

SEQ ID NO: 32925 - DNA, 25 bp, Mus musculus
gcagatctctagtcaggaggccact

SEQ ID NO: 32926 - DNA, 25 bp, Mus musculus
ctctagtcaggaggccactcctgac

SEQ ID NO: 32927 - DNA, 25 bp, Mus musculus
cacttatgtgccctactcatctctg

SEQ ID NO: 32928 - DNA, 25 bp, Mus musculus
tgtgccctactcatctctgctcctg

SEQ ID NO: 32929 - DNA, 25 bp, Mus musculus
cagacgcacgtgctgacgggacatg

SEQ ID NO: 32930 - DNA, 25 bp, Mus musculus
aagcagcgtcagctcagcttctaac

SEQ ID NO: 32931 - DNA, 25 bp, Mus musculus
ttctaactctctctctcgtagcagc

SEQ ID NO: 32932 - DNA, 25 bp, Mus musculus
ctctcgtagcagctactagctacta

SEQ ID NO: 32933 - DNA, 25 bp, Mus musculus
tagcagctactagctactagtactt

SEQ ID NO: 32934 - DNA, 25 bp, Mus musculus
ctactagctactagtacttggacta

SEQ ID NO: 32935 - DNA, 25 bp, Mus musculus
ttgttgtcttatactggggcacagc

SEQ ID NO: 32936 - DNA, 25 bp, Mus musculus
tcttatactggggcacagcgttggg

SEQ ID NO: 32937 - DNA, 25 bp, Mus musculus
gcattagactcacttacaactgtac

SEQ ID NO: 32938 - DNA, 25 bp, Mus musculus
cttacaactgtacagagagatatgg

SEQ ID NO: 32939 - DNA, 25 bp, Mus musculus
atctctgctcctgtcctcatctgct

SEQ ID NO: 32940 - DNA, 25 bp, Mus musculus
agacattatccctggttggtgtgac

SEQ ID NO: 32941 - DNA, 25 bp, Mus musculus
caacctgctgacctggacaactttg

SEQ ID NO: 32942 - DNA, 25 bp, Mus musculus
ctggacaactttgccaggattggat

SEQ ID NO: 32943 - DNA, 25 bp, Mus musculus
aactttgccaggattggatacctgt

SEQ ID NO: 32944 - DNA, 25 bp, Mus musculus
taagaaagcactggccatcgacatc

SEQ ID NO: 32945 - DNA, 25 bp, Mus musculus
agcactggccatcgacatctttgag

SEQ ID NO: 32946 - DNA, 25 bp, Mus musculus
cgacatctttgagtcagccagacgc

SEQ ID NO: 32947 - DNA, 25 bp, Mus musculus
actgcacaccgtgcctttcacagga

SEQ ID NO: 32948 - DNA, 25 bp, Mus musculus
agcactttttcagctaatcagtatt

SEQ ID NO: 32949 - DNA, 25 bp, Mus musculus
tttctttggatcaaagctggactga

SEQ ID NO: 32950 - DNA, 25 bp, Mus musculus
ctactgctgtttattccagtttcta

SEQ ID NO: 32951 - DNA, 25 bp, Mus musculus
attccagtttctactacctcaggtg

SEQ ID NO: 32952 - DNA, 25 bp, Mus musculus
gtttctactacctcaggtgtcctat

SEQ ID NO: 32953 - DNA, 25 bp, Mus musculus
tttcttctaccaaagttcactctca

SEQ ID NO: 32954 - DNA, 25 bp, Mus musculus
aagttcactctcagaatgaaattct

SEQ ID NO: 32955 - DNA, 25 bp, Mus musculus
aaattctacgtgctgtgtgactatg

SEQ ID NO: 32956 - DNA, 25 bp, Mus musculus
gactatgactcctaagacttccagg

SEQ ID NO: 32957 - DNA, 25 bp, Mus musculus
aactcctattagcaccttactatgt

SEQ ID NO: 32958 - DNA, 25 bp, Mus musculus
tattagcaccttactatgtaagcaa

SEQ ID NO: 32959 - DNA, 25 bp, Mus musculus
ttttcagctaatcagtattaccatg

SEQ ID NO: 32960 - DNA, 25 bp, Mus musculus
taccatgtacatcaacatgcccgcc

SEQ ID NO: 32961 - DNA, 25 bp, Mus musculus
tcaaactcagactgtcccagatgtc

SEQ ID NO: 32962 - DNA, 25 bp, Mus musculus
tcagactgtcccagatgtcaagatc

SEQ ID NO: 32963 - DNA, 25 bp, Mus musculus
tgtcccagatgtcaagatccactgt

SEQ ID NO: 32964 - DNA, 25 bp, Mus musculus
agatgtcaagatccactgtgtttga

SEQ ID NO: 32965 - DNA, 25 bp, Mus musculus
tttgcagttccctcagcttgctggt

SEQ ID NO: 32966 - DNA, 25 bp, Mus musculus
tcagcttgctggtaattgtggtgtt

SEQ ID NO: 32967 - DNA, 25 bp, Mus musculus
agataatggcagacccttggcagga

SEQ ID NO: 32968 - DNA, 25 bp, Mus musculus
tggcagacccttggcaggagtgcat

SEQ ID NO: 32969 - DNA, 25 bp, Mus musculus
tgctcatgtcttctataaaggaaaa

SEQ ID NO: 32970 - DNA, 25 bp, Mus musculus
ctcatgtcttctataaaggaaaagt

SEQ ID NO: 32971 - DNA, 25 bp, Mus musculus
aaagtatccatgtcacagcttcatt

SEQ ID NO: 32972 - DNA, 25 bp, Mus musculus
agtatccatgtcacagcttcattgg

SEQ ID NO: 32973 - DNA, 25 bp, Mus musculus
tatccatgtcacagcttcattggtg

SEQ ID NO: 32974 - DNA, 25 bp, Mus musculus
tgtcacagcttcattggtgaagagt

SEQ ID NO: 32975 - DNA, 25 bp, Mus musculus
tcacagcttcattggtgaagagtct

SEQ ID NO: 32976 - DNA, 25 bp, Mus musculus
agaagacggtcttcacagagcagcc

SEQ ID NO: 32977 - DNA, 25 bp, Mus musculus
aagacggtcttcacagagcagccca

SEQ ID NO: 32978 - DNA, 25 bp, Mus musculus
gacggtcttcacagagcagcccacg

SEQ ID NO: 32979 - DNA, 25 bp, Mus musculus
ctatgcagtaatcctcgcgaggcaa

SEQ ID NO: 32980 - DNA, 25 bp, Mus musculus
gtcttcacagagcagcccacgtggg

SEQ ID NO: 32981 - DNA, 25 bp, Mus musculus
agtaatcctcgcgaggcaagctgga

SEQ ID NO: 32982 - DNA, 25 bp, Mus musculus
gattaaaagttctccagccgacttg

SEQ ID NO: 32983 - DNA, 25 bp, Mus musculus
gttctccagccgacttggtaacagt

SEQ ID NO: 32984 - DNA, 25 bp, Mus musculus
tctccagccgacttggtaacagtta

SEQ ID NO: 32985 - DNA, 25 bp, Mus musculus
tccagccgacttggtaacagttact

SEQ ID NO: 32986 - DNA, 25 bp, Mus musculus
cagccgacttggtaacagttactga

SEQ ID NO: 32987 - DNA, 25 bp, Mus musculus
aatgctcatgtcttctataaaggaa

SEQ ID NO: 32988 - DNA, 25 bp, Mus musculus
gacgaggctgccatggctatcgcca

SEQ ID NO: 32989 - DNA, 25 bp, Mus musculus
gagcgcgtgctgcaggtgtccttca

SEQ ID NO: 32990 - DNA, 25 bp, Mus musculus
agcaggcagacccatacacctgcat

SEQ ID NO: 32991 - DNA, 25 bp, Mus musculus
cagacccatacacctgcataaacac

SEQ ID NO: 32992 - DNA, 25 bp, Mus musculus
cctgcataaacaccacagggtgagc

SEQ ID NO: 32993 - DNA, 25 bp, Mus musculus
gcataaacaccacagggtgagcatc

SEQ ID NO: 32994 - DNA, 25 bp, Mus musculus
taaacaccacagggtgagcatccgg

SEQ ID NO: 32995 - DNA, 25 bp, Mus musculus
ctcgtcttggtttggttcatggtga

SEQ ID NO: 32996 - DNA, 25 bp, Mus musculus
gtcttggtttggttcatggtgatgg

SEQ ID NO: 32997 - DNA, 25 bp, Mus musculus
ctgcatgggatggcttaggggacac

SEQ ID NO: 32998 - DNA, 25 bp, Mus musculus
cttgcccaggcctggcctatactga

SEQ ID NO: 32999 - DNA, 25 bp, Mus musculus
caggcctggcctatactgagagaaa

SEQ ID NO: 33000 - DNA, 25 bp, Mus musculus
cgcgtgctgcaggtgtccttcaaga

SEQ ID NO: 33001 - DNA, 25 bp, Mus musculus
gtgctgcaggtgtccttcaagacca

SEQ ID NO: 33002 - DNA, 25 bp, Mus musculus
caggtgtccttcaagaccagcaagc

SEQ ID NO: 33003 - DNA, 25 bp, Mus musculus
gtgtccttcaagaccagcaagcagc

SEQ ID NO: 33004 - DNA, 25 bp, Mus musculus
tccttcaagaccagcaagcagcaca

SEQ ID NO: 33005 - DNA, 25 bp, Mus musculus
accagcaagcagcacaaggcctgag

SEQ ID NO: 33006 - DNA, 25 bp, Mus musculus
agcaagcagcacaaggcctgagcat

SEQ ID NO: 33007 - DNA, 25 bp, Mus musculus
cgcaatctcgagagcaggcagaccc

SEQ ID NO: 33008 - DNA, 25 bp, Mus musculus
ctcctgactcaggtggccaccaaga

SEQ ID NO: 33009 - DNA, 25 bp, Mus musculus
ctgactcaggtggccaccaagaggc

SEQ ID NO: 33010 - DNA, 25 bp, Mus musculus
cagcaacagcagactgccctcttag

SEQ ID NO: 33011 - DNA, 25 bp, Mus musculus
caacagcagactgccctcttagcac

SEQ ID NO: 33012 - DNA, 25 bp, Mus musculus
cagcagactgccctcttagcacaac

SEQ ID NO: 33013 - DNA, 25 bp, Mus musculus
tccctggccactggggagatctgcc

SEQ ID NO: 33014 - DNA, 25 bp, Mus musculus
atctgccggttcagcaccctgattg

SEQ ID NO: 33015 - DNA, 25 bp, Mus musculus
agcaccctgattgaggagctggagg

SEQ ID NO: 33016 - DNA, 25 bp, Mus musculus
accctgattgaggagctggaggaga

SEQ ID NO: 33017 - DNA, 25 bp, Mus musculus
gggctcctgacggatatcagaagca

SEQ ID NO: 33018 - DNA, 25 bp, Mus musculus
ctcctgacggatatcagaagcactc

SEQ ID NO: 33019 - DNA, 25 bp, Mus musculus
atcagaagcactctaataagatgtg

SEQ ID NO: 33020 - DNA, 25 bp, Mus musculus
gtggccaccaagaggcaacaggtga

SEQ ID NO: 33021 - DNA, 25 bp, Mus musculus
gccaccaagaggcaacaggtgatct

SEQ ID NO: 33022 - DNA, 25 bp, Mus musculus
tcacagtttgcgcatctgagccagt

SEQ ID NO: 33023 - DNA, 25 bp, Mus musculus
tttgcgcatctgagccagttcctgc

SEQ ID NO: 33024 - DNA, 25 bp, Mus musculus
gcgcatctgagccagttcctgcagc

SEQ ID NO: 33025 - DNA, 25 bp, Mus musculus
agccagttcctgcagcaacagcaga

SEQ ID NO: 33026 - DNA, 25 bp, Mus musculus
cagttcctgcagcaacagcagactg

SEQ ID NO: 33027 - DNA, 25 bp, Mus musculus
ttcctgcagcaacagcagactgccc

SEQ ID NO: 33028 - DNA, 25 bp, Mus musculus
cagagccagccgttttcaaagccac

SEQ ID NO: 33029 - DNA, 25 bp, Mus musculus
ttttcaaagccacactgaatctctc

SEQ ID NO: 33030 - DNA, 25 bp, Mus musculus
acatgcccttcatggacttcctgac

SEQ ID NO: 33031 - DNA, 25 bp, Mus musculus
tggacttcctgacgaaagatggctt

SEQ ID NO: 33032 - DNA, 25 bp, Mus musculus
agagcccagaggagctgcgtgccat

SEQ ID NO: 33033 - DNA, 25 bp, Mus musculus
agctgcgtgccatattccaggacaa

SEQ ID NO: 33034 - DNA, 25 bp, Mus musculus
gtgccatattccaggacaagaaggt

SEQ ID NO: 33035 - DNA, 25 bp, Mus musculus
tcactgcctgtcacgttgccctggc

SEQ ID NO: 33036 - DNA, 25 bp, Mus musculus
ctgtttacgatggctcctggtcaga

SEQ ID NO: 33037 - DNA, 25 bp, Mus musculus
acgatggctcctggtcagagtggtt

SEQ ID NO: 33038 - DNA, 25 bp, Mus musculus
gctcctggtcagagtggttccgcag

SEQ ID NO: 33039 - DNA, 25 bp, Mus musculus
gtgtgacctgctgtaggttcacctt

SEQ ID NO: 33040 - DNA, 25 bp, Mus musculus
aagccacactgaatctctccctgct

SEQ ID NO: 33041 - DNA, 25 bp, Mus musculus
cctatgagcaggtcctagagaatct

SEQ ID NO: 33042 - DNA, 25 bp, Mus musculus
tcctagagaatctccagtctaaaag

SEQ ID NO: 33043 - DNA, 25 bp, Mus musculus
gcacacaaccggagccggatatagt

SEQ ID NO: 33044 - DNA, 25 bp, Mus musculus
taggactagactcgggccacatccg

SEQ ID NO: 33045 - DNA, 25 bp, Mus musculus
cgggccacatccgtggctcagtcaa

SEQ ID NO: 33046 - DNA, 25 bp, Mus musculus
acatccgtggctcagtcaacatgcc

SEQ ID NO: 33047 - DNA, 25 bp, Mus musculus
cagtcaacatgcccttcatggactt

SEQ ID NO: 33048 - DNA, 25 bp, Mus musculus
attacctgtctctgccgccagatat

SEQ ID NO: 33049 - DNA, 25 bp, Mus musculus
tgtctctgccgccagatatgagaat

SEQ ID NO: 33050 - DNA, 25 bp, Mus musculus
tgtctgcagcctcccagaagtttcc

SEQ ID NO: 33051 - DNA, 25 bp, Mus musculus
gccattacccaggccgggctgattg

SEQ ID NO: 33052 - DNA, 25 bp, Mus musculus
ctcattattggatgcctaagtggat

SEQ ID NO: 33053 - DNA, 25 bp, Mus musculus
attataagtcagctgccaaagctta

SEQ ID NO: 33054 - DNA, 25 bp, Mus musculus
agtcagctgccaaagcttaggcact

SEQ ID NO: 33055 - DNA, 25 bp, Mus musculus
ctgccaaagcttaggcactctctac

SEQ ID NO: 33056 - DNA, 25 bp, Mus musculus
aagcttaggcactctctacactctt

SEQ ID NO: 33057 - DNA, 25 bp, Mus musculus
aatgagactcagccatcagtcaccc

SEQ ID NO: 33058 - DNA, 25 bp, Mus musculus
actcagccatcagtcacccaggctt

SEQ ID NO: 33059 - DNA, 25 bp, Mus musculus
gtcacccaggcttacttaggcatga

SEQ ID NO: 33060 - DNA, 25 bp, Mus musculus
atctcctgagagagacttttgagga

SEQ ID NO: 33061 - DNA, 25 bp, Mus musculus
actgcaacctgctacccaaagagat

SEQ ID NO: 33062 - DNA, 25 bp, Mus musculus
acctgctacccaaagagattctctg

SEQ ID NO: 33063 - DNA, 25 bp, Mus musculus
tacccaaagagattctctggcgacc

SEQ ID NO: 33064 - DNA, 25 bp, Mus musculus
ccaaagaagccttcagtgatgggat

SEQ ID NO: 33065 - DNA, 25 bp, Mus musculus
aagccttcagtgatgggatcacctc

SEQ ID NO: 33066 - DNA, 25 bp, Mus musculus
cagtcaagaactcctggttcaagat

SEQ ID NO: 33067 - DNA, 25 bp, Mus musculus
aaatgatgtctgcagcctcccagaa

SEQ ID NO: 33068 - DNA, 25 bp, Mus musculus
tacctctttctagtaacaatattgc

SEQ ID NO: 33069 - DNA, 25 bp, Mus musculus
ctctttctagtaacaatattgctca

SEQ ID NO: 33070 - DNA, 25 bp, Mus musculus
gacgctctaactcttgcagcagcat

SEQ ID NO: 33071 - DNA, 25 bp, Mus musculus
gctctaactcttgcagcagcatttc

SEQ ID NO: 33072 - DNA, 25 bp, Mus musculus
gcatttctgtagcttcctgtatctc

SEQ ID NO: 33073 - DNA, 25 bp, Mus musculus
ctgtagcttcctgtatctcggaatg

SEQ ID NO: 33074 - DNA, 25 bp, Mus musculus
cttcctgtatctcggaatgggagca

SEQ ID NO: 33075 - DNA, 25 bp, Mus musculus
cctgtatctcggaatgggagcagaa

SEQ ID NO: 33076 - DNA, 25 bp, Mus musculus
aactatctccattcagcacacctgt

SEQ ID NO: 33077 - DNA, 25 bp, Mus musculus
tatctccattcagcacacctgtcaa

SEQ ID NO: 33078 - DNA, 25 bp, Mus musculus
tcagcacacctgtcaatgtcacctc

SEQ ID NO: 33079 - DNA, 25 bp, Mus musculus
cctcccttgcaaggcataggcagca

SEQ ID NO: 33080 - DNA, 25 bp, Mus musculus
ctcagatttccaacggccagcaact

SEQ ID NO: 33081 - DNA, 25 bp, Mus musculus
agatggtccccacattcagcagtga

SEQ ID NO: 33082 - DNA, 25 bp, Mus musculus
agatttccaacggccagcaactcat

SEQ ID NO: 33083 - DNA, 25 bp, Mus musculus
ccaacggccagcaactcatgagcca

SEQ ID NO: 33084 - DNA, 25 bp, Mus musculus
tcatgagccagccgcagctacacag

SEQ ID NO: 33085 - DNA, 25 bp, Mus musculus
agccgcagctacacagacgctctaa

SEQ ID NO: 33086 - DNA, 25 bp, Mus musculus
cgcagctacacagacgctctaactc

SEQ ID NO: 33087 - DNA, 25 bp, Mus musculus
agctacacagacgctctaactcttg

SEQ ID NO: 33088 - DNA, 25 bp, Mus musculus
acagacgctctaactcttgcagcag

SEQ ID NO: 33089 - DNA, 25 bp, Mus musculus
tccagagatgccgagtacggactgt

SEQ ID NO: 33090 - DNA, 25 bp, Mus musculus
tactccatctatcagggaggattgt

SEQ ID NO: 33091 - DNA, 25 bp, Mus musculus
acagacactttcggtgtttcatcga

SEQ ID NO: 33092 - DNA, 25 bp, Mus musculus
actttcggtgtttcatcgagagact

SEQ ID NO: 33093 - DNA, 25 bp, Mus musculus
tctttccgcaaaatgagatcactgt

SEQ ID NO: 33094 - DNA, 25 bp, Mus musculus
atgagatcactgtagcctttcaatg

SEQ ID NO: 33095 - DNA, 25 bp, Mus musculus
tagcctttcaatgatctacctggta

SEQ ID NO: 33096 - DNA, 25 bp, Mus musculus
ttcaatgatctacctggtatcagtt

SEQ ID NO: 33097 - DNA, 25 bp, Mus musculus
gatctacctggtatcagtttgcaga

SEQ ID NO: 33098 - DNA, 25 bp, Mus musculus
tgacaattttcacctttgttatctg

SEQ ID NO: 33099 - DNA, 25 bp, Mus musculus
caagtgctcacaagctgtgtgcaga

SEQ ID NO: 33100 - DNA, 25 bp, Mus musculus
ctcacaagctgtgtgcagaccagga

SEQ ID NO: 33101 - DNA, 25 bp, Mus musculus
taatcttctaggttgaaggcatgcc

SEQ ID NO: 33102 - DNA, 25 bp, Mus musculus
ttgaaggcatgcctggaaagcgact

SEQ ID NO: 33103 - DNA, 25 bp, Mus musculus
gatatggcctggctgtagaaacctc

SEQ ID NO: 33104 - DNA, 25 bp, Mus musculus
ctgtagaaacctcaggacagatgtg

SEQ ID NO: 33105 - DNA, 25 bp, Mus musculus
actcagcagcgacaggccaacagtc

SEQ ID NO: 33106 - DNA, 25 bp, Mus musculus
cagcgacaggccaacagtccagcca

SEQ ID NO: 33107 - DNA, 25 bp, Mus musculus
caggccaacagtccagccacagaca

SEQ ID NO: 33108 - DNA, 25 bp, Mus musculus
aacagtccagccacagacactttcg

SEQ ID NO: 33109 - DNA, 25 bp, Mus musculus
acgtgcacccagggcagtgcatgca

SEQ ID NO: 33110 - DNA, 25 bp, Mus musculus
gggctgcgcaactcattgtactcat

SEQ ID NO: 33111 - DNA, 25 bp, Mus musculus
agcaacactttggcagtctcatagc

SEQ ID NO: 33112 - DNA, 25 bp, Mus musculus
aacactttggcagtctcatagctgc

SEQ ID NO: 33113 - DNA, 25 bp, Mus musculus
ttggcagtctcatagctgccctcac

SEQ ID NO: 33114 - DNA, 25 bp, Mus musculus
gcagtctcatagctgccctcacggg

SEQ ID NO: 33115 - DNA, 25 bp, Mus musculus
gtctcatagctgccctcacgggcgg

SEQ ID NO: 33116 - DNA, 25 bp, Mus musculus
ggagtctcctccttgttgttctgca

SEQ ID NO: 33117 - DNA, 25 bp, Mus musculus
ttctgcatgtccttgttggctccgt

SEQ ID NO: 33118 - DNA, 25 bp, Mus musculus
tgcatgtccttgttggctccgttct

SEQ ID NO: 33119 - DNA, 25 bp, Mus musculus
atgtccttgttggctccgttcttca

SEQ ID NO: 33120 - DNA, 25 bp, Mus musculus
ttgttggctccgttcttcaggagca

SEQ ID NO: 33121 - DNA, 25 bp, Mus musculus
ctgcgcaactcattgtactcatcca

SEQ ID NO: 33122 - DNA, 25 bp, Mus musculus
ttcttcaggagcacaacagcagcat

SEQ ID NO: 33123 - DNA, 25 bp, Mus musculus
tcattgtactcatccaaaagccgca

SEQ ID NO: 33124 - DNA, 25 bp, Mus musculus
ttgtactcatccaaaagccgcacga

SEQ ID NO: 33125 - DNA, 25 bp, Mus musculus
tccaaaagccgcacgatatcgtggt

SEQ ID NO: 33126 - DNA, 25 bp, Mus musculus
atatcgtggtgcatacgctcctgtg

SEQ ID NO: 33127 - DNA, 25 bp, Mus musculus
tcgtggtgcatacgctcctgtgcga

SEQ ID NO: 33128 - DNA, 25 bp, Mus musculus
cgcggcaatcggtccatgtgatccg

SEQ ID NO: 33129 - DNA, 25 bp, Mus musculus
tccatgtgatccgtgatgtcccggt

SEQ ID NO: 33130 - DNA, 25 bp, Mus musculus
cagttcaggtcatcactggatatca

SEQ ID NO: 33131 - DNA, 25 bp, Mus musculus
tcactggatatcagctgcctgttta

SEQ ID NO: 33132 - DNA, 25 bp, Mus musculus
ctgctccagcttctggaaatggccc

SEQ ID NO: 33133 - DNA, 25 bp, Mus musculus
tgtttaaccctgagaacagactgag

SEQ ID NO: 33134 - DNA, 25 bp, Mus musculus
ctcttgttactcaagatgactactt

SEQ ID NO: 33135 - DNA, 25 bp, Mus musculus
ttactcaagatgactacttcaagga

SEQ ID NO: 33136 - DNA, 25 bp, Mus musculus
gagtacatcacttcagaagaagtcg

SEQ ID NO: 33137 - DNA, 25 bp, Mus musculus
atcacttcagaagaagtcgggcagt

SEQ ID NO: 33138 - DNA, 25 bp, Mus musculus
tgcttaaatctgatcatctctgcta

SEQ ID NO: 33139 - DNA, 25 bp, Mus musculus
aatctgatcatctctgctaactcat

SEQ ID NO: 33140 - DNA, 25 bp, Mus musculus
atcatctctgctaactcatctcagg

SEQ ID NO: 33141 - DNA, 25 bp, Mus musculus
gacaaatcactcagactttctataa

SEQ ID NO: 33142 - DNA, 25 bp, Mus musculus
gatatcagctgcctgtttataacta

SEQ ID NO: 33143 - DNA, 25 bp, Mus musculus
ctgtttataactaccagatgccacc

SEQ ID NO: 33144 - DNA, 25 bp, Mus musculus
accagatgccaccgcagtggcctgc

SEQ ID NO: 33145 - DNA, 25 bp, Mus musculus
ctgttaattaccactgcagtgaagt

SEQ ID NO: 33146 - DNA, 25 bp, Mus musculus
attaccactgcagtgaagttgatcc

SEQ ID NO: 33147 - DNA, 25 bp, Mus musculus
ctgatattttgcccaatgaatgttc

SEQ ID NO: 33148 - DNA, 25 bp, Mus musculus
ttttgcccaatgaatgttcagttca

SEQ ID NO: 33149 - DNA, 25 bp, Mus musculus
cagttcatgatgctgctccagcttc

SEQ ID NO: 33150 - DNA, 25 bp, Mus musculus
cgcactaccagcacgtggccagacg

SEQ ID NO: 33151 - DNA, 25 bp, Mus musculus
accagcacgtggccagacgtggatc

SEQ ID NO: 33152 - DNA, 25 bp, Mus musculus
tgagcacgctcaccgtgcgctcagg

SEQ ID NO: 33153 - DNA, 25 bp, Mus musculus
gcacgctcaccgtgcgctcaggagc

SEQ ID NO: 33154 - DNA, 25 bp, Mus musculus
tcaccgtgcgctcaggagctgcgtc

SEQ ID NO: 33155 - DNA, 25 bp, Mus musculus
ccgtgcgctcaggagctgcgtccac

SEQ ID NO: 33156 - DNA, 25 bp, Mus musculus
tgcgctcaggagctgcgtccacaga

SEQ ID NO: 33157 - DNA, 25 bp, Mus musculus
gagctgcgtccacagatccggtcag

SEQ ID NO: 33158 - DNA, 25 bp, Mus musculus
ccacagatccggtcagcttcgcctt

SEQ ID NO: 33159 - DNA, 25 bp, Mus musculus
atccggtcagcttcgccttggtgaa

SEQ ID NO: 33160 - DNA, 25 bp, Mus musculus
tcagcttcgccttggtgaatacttg

SEQ ID NO: 33161 - DNA, 25 bp, Mus musculus
gcttcgccttggtgaatacttgggt

SEQ ID NO: 33162 - DNA, 25 bp, Mus musculus
tggccagacgtggatccagagaaga

SEQ ID NO: 33163 - DNA, 25 bp, Mus musculus
aagacccagcagatgcgctattccg

SEQ ID NO: 33164 - DNA, 25 bp, Mus musculus
cagcagatgcgctattccggtccga

SEQ ID NO: 33165 - DNA, 25 bp, Mus musculus
atgcgctattccggtccgaggccac

SEQ ID NO: 33166 - DNA, 25 bp, Mus musculus
cgctattccggtccgaggccacctg

SEQ ID NO: 33167 - DNA, 25 bp, Mus musculus
ggtccgaggccacctgtcaggtaga

SEQ ID NO: 33168 - DNA, 25 bp, Mus musculus
ccgaggccacctgtcaggtagatcc

SEQ ID NO: 33169 - DNA, 25 bp, Mus musculus
gactgagcacgctcaccgtgcgctc

SEQ ID NO: 33170 - DNA, 25 bp, Mus musculus
tggcaactacagaaccacatgccac

SEQ ID NO: 33171 - DNA, 25 bp, Mus musculus
ctacagaaccacatgccacaccgtg

SEQ ID NO: 33172 - DNA, 25 bp, Mus musculus
ctttgtctatgacccactgctcaac

SEQ ID NO: 33173 - DNA, 25 bp, Mus musculus
tgtctatgacccactgctcaactgg

SEQ ID NO: 33174 - DNA, 25 bp, Mus musculus
actgctcaactggaggctgatggac

SEQ ID NO: 33175 - DNA, 25 bp, Mus musculus
cacaaataccaaaggcaataagcgg

SEQ ID NO: 33176 - DNA, 25 bp, Mus musculus
aaggacagactcctactctgccggc

SEQ ID NO: 33177 - DNA, 25 bp, Mus musculus
ctcctactctgccggccagtcagta

SEQ ID NO: 33178 - DNA, 25 bp, Mus musculus
tggagaaccagcccataagatagca

SEQ ID NO: 33179 - DNA, 25 bp, Mus musculus
agaaccagcccataagatagcaggg

SEQ ID NO: 33180 - DNA, 25 bp, Mus musculus
agggaccactgtgccagaatccatc

SEQ ID NO: 33181 - DNA, 25 bp, Mus musculus
ccattcattcattggagacggtttg

SEQ ID NO: 33182 - DNA, 25 bp, Mus musculus
aaccacatgccacaccgtgatggaa

SEQ ID NO: 33183 - DNA, 25 bp, Mus musculus
atgccacaccgtgatggaagtgctc

SEQ ID NO: 33184 - DNA, 25 bp, Mus musculus
ccacaccgtgatggaagtgctccgg

SEQ ID NO: 33185 - DNA, 25 bp, Mus musculus
agtgctccgggaacacaaggacagt

SEQ ID NO: 33186 - DNA, 25 bp, Mus musculus
cagtgtcatggctgtgctggaagcc

SEQ ID NO: 33187 - DNA, 25 bp, Mus musculus
tgtcatggctgtgctggaagccttt

SEQ ID NO: 33188 - DNA, 25 bp, Mus musculus
tgtgctggaagcctttgtctatgac

SEQ ID NO: 33189 - DNA, 25 bp, Mus musculus
agcctttgtctatgacccactgctc

SEQ ID NO: 33190 - DNA, 25 bp, Mus musculus
aaccaaataccactgcctgaggcgt

SEQ ID NO: 33191 - DNA, 25 bp, Mus musculus
caaataccactgcctgaggcgtaca

SEQ ID NO: 33192 - DNA, 25 bp, Mus musculus
attgttcaacttgatgctggccatc

SEQ ID NO: 33193 - DNA, 25 bp, Mus musculus
gttcaacttgatgctggccatcttg

SEQ ID NO: 33194 - DNA, 25 bp, Mus musculus
caacttgatgctggccatcttgagc

SEQ ID NO: 33195 - DNA, 25 bp, Mus musculus
gatgctggccatcttgagcattttt

SEQ ID NO: 33196 - DNA, 25 bp, Mus musculus
tttttcagagtctccaaccaaagtg

SEQ ID NO: 33197 - DNA, 25 bp, Mus musculus
agagtctccaaccaaagtgcagcta

SEQ ID NO: 33198 - DNA, 25 bp, Mus musculus
gtctccaaccaaagtgcagctagtg

SEQ ID NO: 33199 - DNA, 25 bp, Mus musculus
tccaaccaaagtgcagctagtggga

SEQ ID NO: 33200 - DNA, 25 bp, Mus musculus
tgtggtgtgccgagagctcaattgt

SEQ ID NO: 33201 - DNA, 25 bp, Mus musculus
gtgccgagagctcaattgtggagca

SEQ ID NO: 33202 - DNA, 25 bp, Mus musculus
ccactgcctgaggcgtacagcctgt

SEQ ID NO: 33203 - DNA, 25 bp, Mus musculus
atcgtcagctgcctgggccatggct

SEQ ID NO: 33204 - DNA, 25 bp, Mus musculus
agctgcctgggccatggctccattg

SEQ ID NO: 33205 - DNA, 25 bp, Mus musculus
ctgggccatggctccattgttcaac

SEQ ID NO: 33206 - DNA, 25 bp, Mus musculus
ggccatggctccattgttcaacttg

SEQ ID NO: 33207 - DNA, 25 bp, Mus musculus
catggctccattgttcaacttgatg

SEQ ID NO: 33208 - DNA, 25 bp, Mus musculus
ggctccattgttcaacttgatgctg

SEQ ID NO: 33209 - DNA, 25 bp, Mus musculus
tccattgttcaacttgatgctggcc

SEQ ID NO: 33210 - DNA, 25 bp, Mus musculus
gaactggccaagcgcatcactgagc

SEQ ID NO: 33211 - DNA, 25 bp, Mus musculus
cgtcttggtgctgaattggggaaat

SEQ ID NO: 33212 - DNA, 25 bp, Mus musculus
ctgatcatggcgtatcactgaagac

SEQ ID NO: 33213 - DNA, 25 bp, Mus musculus
gcgtatcactgaagaccgcctgcgc

SEQ ID NO: 33214 - DNA, 25 bp, Mus musculus
cactgaagaccgcctgcgccaggaa

SEQ ID NO: 33215 - DNA, 25 bp, Mus musculus
agaccgcctgcgccaggaatatcat

SEQ ID NO: 33216 - DNA, 25 bp, Mus musculus
ccgcctgcgccaggaatatcattgg

SEQ ID NO: 33217 - DNA, 25 bp, Mus musculus
cctgcgccaggaatatcattggcgt

SEQ ID NO: 33218 - DNA, 25 bp, Mus musculus
acttcccctacagcaagcaaagcaa

SEQ ID NO: 33219 - DNA, 25 bp, Mus musculus
tcccctacagcaagcaaagcaagat

SEQ ID NO: 33220 - DNA, 25 bp, Mus musculus
cctacagcaagcaaagcaagatgcg

SEQ ID NO: 33221 - DNA, 25 bp, Mus musculus
ggggctccattgtgtgcaagctcct

SEQ ID NO: 33222 - DNA, 25 bp, Mus musculus
atcaaagaatctgttcgtggccaag

SEQ ID NO: 33223 - DNA, 25 bp, Mus musculus
ccattgtgtgcaagctcctggcatc

SEQ ID NO: 33224 - DNA, 25 bp, Mus musculus
gaatctgttcgtggccaagatattt

SEQ ID NO: 33225 - DNA, 25 bp, Mus musculus
tctgttcgtggccaagatattttca

SEQ ID NO: 33226 - DNA, 25 bp, Mus musculus
atacagacaatacccagagatgtga

SEQ ID NO: 33227 - DNA, 25 bp, Mus musculus
cagacaatacccagagatgtgaata

SEQ ID NO: 33228 - DNA, 25 bp, Mus musculus
acaatacccagagatgtgaatacgg

SEQ ID NO: 33229 - DNA, 25 bp, Mus musculus
aatacggctgtgatggagctgctga

SEQ ID NO: 33230 - DNA, 25 bp, Mus musculus
gagctgctgatcatggcgtatcact

SEQ ID NO: 33231 - DNA, 25 bp, Mus musculus
tggcctcctgatgggagaagcagcc

SEQ ID NO: 33232 - DNA, 25 bp, Mus musculus
agaagcagccaaacagctgagacgg

SEQ ID NO: 33233 - DNA, 25 bp, Mus musculus
cagccctcagcatcaggagctcttc

SEQ ID NO: 33234 - DNA, 25 bp, Mus musculus
ccctcagcatcaggagctcttccgg

SEQ ID NO: 33235 - DNA, 25 bp, Mus musculus
ggagctcttccggaacttcagaagc

SEQ ID NO: 33236 - DNA, 25 bp, Mus musculus
cttccggaacttcagaagcatctcc

SEQ ID NO: 33237 - DNA, 25 bp, Mus musculus
cagaagcatctccaaggccatggtg

SEQ ID NO: 33238 - DNA, 25 bp, Mus musculus
ccaatcaggccctggcaaggtcatg

SEQ ID NO: 33239 - DNA, 25 bp, Mus musculus
atcaggccctggcaaggtcatgtgc

SEQ ID NO: 33240 - DNA, 25 bp, Mus musculus
caaggtcatgtgccttctctgatgc

SEQ ID NO: 33241 - DNA, 25 bp, Mus musculus
ggtcatgtgccttctctgatgccca

SEQ ID NO: 33242 - DNA, 25 bp, Mus musculus
tctctgatgcccaaaccctttatgg

SEQ ID NO: 33243 - DNA, 25 bp, Mus musculus
agcagccaaacagctgagacggagg

SEQ ID NO: 33244 - DNA, 25 bp, Mus musculus
tttgagtctgtcagggattgtccac

SEQ ID NO: 33245 - DNA, 25 bp, Mus musculus
tgtccacccagagttaagtcccagt

SEQ ID NO: 33246 - DNA, 25 bp, Mus musculus
cattgaggctccaactcggatccga

SEQ ID NO: 33247 - DNA, 25 bp, Mus musculus
tccaactcggatccgagaaaacatg

SEQ ID NO: 33248 - DNA, 25 bp, Mus musculus
cagtctgcagtccagccctcagcat

SEQ ID NO: 33249 - DNA, 25 bp, Mus musculus
tctgcagtccagccctcagcatcag

SEQ ID NO: 33250 - DNA, 25 bp, Mus musculus
gtccagccctcagcatcaggagctc

SEQ ID NO: 33251 - DNA, 25 bp, Mus musculus
gctgacccaggagtgtcaggaacag

SEQ ID NO: 33252 - DNA, 25 bp, Mus musculus
gttgccccaggagatccgtcggtgc

SEQ ID NO: 33253 - DNA, 25 bp, Mus musculus
taactccctgcatcttcctgggacc

SEQ ID NO: 33254 - DNA, 25 bp, Mus musculus
gcatcttcctgggacctcttggtcc

SEQ ID NO: 33255 - DNA, 25 bp, Mus musculus
tcttcctgggacctcttggtcctca

SEQ ID NO: 33256 - DNA, 25 bp, Mus musculus
tcctgggacctcttggtcctcagcc

SEQ ID NO: 33257 - DNA, 25 bp, Mus musculus
tagggcttgtaccccataacattca

SEQ ID NO: 33258 - DNA, 25 bp, Mus musculus
ggcttgtaccccataacattcacct

SEQ ID NO: 33259 - DNA, 25 bp, Mus musculus
taccccataacattcacctaagata

SEQ ID NO: 33260 - DNA, 25 bp, Mus musculus
cccataacattcacctaagataggt

SEQ ID NO: 33261 - DNA, 25 bp, Mus musculus
ataacattcacctaagataggtact

SEQ ID NO: 33262 - DNA, 25 bp, Mus musculus
attcccaaggagcagctagtggaac

SEQ ID NO: 33263 - DNA, 25 bp, Mus musculus
ccccctggtggcctgtgccagcaat

SEQ ID NO: 33264 - DNA, 25 bp, Mus musculus
ctgtgccagcaatggtcatgcacct

SEQ ID NO: 33265 - DNA, 25 bp, Mus musculus
gaacacccagctttgaactggctga

SEQ ID NO: 33266 - DNA, 25 bp, Mus musculus
cacccagctttgaactggctgagca

SEQ ID NO: 33267 - DNA, 25 bp, Mus musculus
ccagctttgaactggctgagcaaga

SEQ ID NO: 33268 - DNA, 25 bp, Mus musculus
gaggcaaatgcctcacactaactct

SEQ ID NO: 33269 - DNA, 25 bp, Mus musculus
gcaaatgcctcacactaactctaac

SEQ ID NO: 33270 - DNA, 25 bp, Mus musculus
cactaactctaactccctgcatctt

SEQ ID NO: 33271 - DNA, 25 bp, Mus musculus
gtaccacgtcgtccaggaggagctt

SEQ ID NO: 33272 - DNA, 25 bp, Mus musculus
cgtcgtccaggaggagcttattgag

SEQ ID NO: 33273 - DNA, 25 bp, Mus musculus
ctgtgcaccattaacactgtccaag

SEQ ID NO: 33274 - DNA, 25 bp, Mus musculus
aacactgtccaagccttaatcaaga

SEQ ID NO: 33275 - DNA, 25 bp, Mus musculus
gtccaagccttaatcaagagagatg

SEQ ID NO: 33276 - DNA, 25 bp, Mus musculus
cctgcagatccttttgagctcagaa

SEQ ID NO: 33277 - DNA, 25 bp, Mus musculus
gatccttttgagctcagaacttggg

SEQ ID NO: 33278 - DNA, 25 bp, Mus musculus
ccttttgagctcagaacttgggatt

SEQ ID NO: 33279 - DNA, 25 bp, Mus musculus
tttgagctcagaacttgggattgga

SEQ ID NO: 33280 - DNA, 25 bp, Mus musculus
ctttccagtcctggttgttgtagct

SEQ ID NO: 33281 - DNA, 25 bp, Mus musculus
tccagtcctggttgttgtagcttta

SEQ ID NO: 33282 - DNA, 25 bp, Mus musculus
agtcctggttgttgtagctttagat

SEQ ID NO: 33283 - DNA, 25 bp, Mus musculus
gtcctcgcctctcagtgacaaccaa

SEQ ID NO: 33284 - DNA, 25 bp, Mus musculus
caacagcacgttgcgcaaacagaac

SEQ ID NO: 33285 - DNA, 25 bp, Mus musculus
acagaaccttgacctcctggagcag

SEQ ID NO: 33286 - DNA, 25 bp, Mus musculus
ccttgacctcctggagcagttgcag

SEQ ID NO: 33287 - DNA, 25 bp, Mus musculus
taggatccaaagccttgaagccacg

SEQ ID NO: 33288 - DNA, 25 bp, Mus musculus
gaaacttcttaccagcgagagtaag

SEQ ID NO: 33289 - DNA, 25 bp, Mus musculus
cccagctggagcccacaggcgattg

SEQ ID NO: 33290 - DNA, 25 bp, Mus musculus
gcgattgaccgctgccagaagagac

SEQ ID NO: 33291 - DNA, 25 bp, Mus musculus
attcagaggctcaacgagctgtcaa

SEQ ID NO: 33292 - DNA, 25 bp, Mus musculus
ctcaacgagctgtcaagacaagatt

SEQ ID NO: 33293 - DNA, 25 bp, Mus musculus
gagctacaaagccatcaggactgac

SEQ ID NO: 33294 - DNA, 25 bp, Mus musculus
ctacaaagccatcaggactgacatg

SEQ ID NO: 33295 - DNA, 25 bp, Mus musculus
gggcaattggccactgctcttgaga

SEQ ID NO: 33296 - DNA, 25 bp, Mus musculus
ttggccactgctcttgagagagaac

SEQ ID NO: 33297 - DNA, 25 bp, Mus musculus
gccactgctcttgagagagaactcg

SEQ ID NO: 33298 - DNA, 25 bp, Mus musculus
atgagtctacctacctgcacatgcc

SEQ ID NO: 33299 - DNA, 25 bp, Mus musculus
gggactcgcagctgtacagggctta

SEQ ID NO: 33300 - DNA, 25 bp, Mus musculus
agctgtacagggcttatgtaggagt

SEQ ID NO: 33301 - DNA, 25 bp, Mus musculus
tgtaatctcttggatgcagcttcag

SEQ ID NO: 33302 - DNA, 25 bp, Mus musculus
aatctcttggatgcagcttcagaaa

SEQ ID NO: 33303 - DNA, 25 bp, Mus musculus
tgaggcttcagcgtctcctccaagg

SEQ ID NO: 33304 - DNA, 25 bp, Mus musculus
agcgtctcctccaagggttccagag

SEQ ID NO: 33305 - DNA, 25 bp, Mus musculus
gtctcctccaagggttccagagtga

SEQ ID NO: 33306 - DNA, 25 bp, Mus musculus
ggtggtacaccacagtctagactcc

SEQ ID NO: 33307 - DNA, 25 bp, Mus musculus
ccacagtctagactcccatgtgaag

SEQ ID NO: 33308 - DNA, 25 bp, Mus musculus
tctagactcccatgtgaagggaaga

SEQ ID NO: 33309 - DNA, 25 bp, Mus musculus
aagatgctatctgcccacctgtctc

SEQ ID NO: 33310 - DNA, 25 bp, Mus musculus
cccagcctggagctacaaagccatc

SEQ ID NO: 33311 - DNA, 25 bp, Mus musculus
ggagtcagaactgcttcgagggagt

SEQ ID NO: 33312 - DNA, 25 bp, Mus musculus
agaactgcttcgagggagtcaggct

SEQ ID NO: 33313 - DNA, 25 bp, Mus musculus
aatgtctccaccattgatagcatag

SEQ ID NO: 33314 - DNA, 25 bp, Mus musculus
atagactggtcaccctggacgtgct

SEQ ID NO: 33315 - DNA, 25 bp, Mus musculus
tggtcaccctggacgtgcttcaagg

SEQ ID NO: 33316 - DNA, 25 bp, Mus musculus
ttcaaggtactgttcccactgagcc

SEQ ID NO: 33317 - DNA, 25 bp, Mus musculus
ttcccactgagcctgtgcttgcatg

SEQ ID NO: 33318 - DNA, 25 bp, Mus musculus
ccactgagcctgtgcttgcatgact

SEQ ID NO: 33319 - DNA, 25 bp, Mus musculus
tgcttgcatgactacattgaggaga

SEQ ID NO: 33320 - DNA, 25 bp, Mus musculus
gtcacaactgaaaaccctccagctg

SEQ ID NO: 33321 - DNA, 25 bp, Mus musculus
cctccagctggaatggacaatgtgc

SEQ ID NO: 33322 - DNA, 25 bp, Mus musculus
atctttgaataggagcctggaagct

SEQ ID NO: 33323 - DNA, 25 bp, Mus musculus
tatcatgctgcgctctgcagacctg

SEQ ID NO: 33324 - DNA, 25 bp, Mus musculus
gcagatccgcagttacatcaatggg

SEQ ID NO: 33325 - DNA, 25 bp, Mus musculus
ttacatcaatgggcgagtgctctac

SEQ ID NO: 33326 - DNA, 25 bp, Mus musculus
catcaatgggcgagtgctctactat

SEQ ID NO: 33327 - DNA, 25 bp, Mus musculus
agtgctctactatgccacctgcaag

SEQ ID NO: 33328 - DNA, 25 bp, Mus musculus
tgccacctgcaagtgaccttaagtc

SEQ ID NO: 33329 - DNA, 25 bp, Mus musculus
cacctgcaagtgaccttaagtccca

SEQ ID NO: 33330 - DNA, 25 bp, Mus musculus
gggaatgtctccaccattgatagca

SEQ ID NO: 33331 - DNA, 25 bp, Mus musculus
gggtgtcatgtgtcggcttgtccgc

SEQ ID NO: 33332 - DNA, 25 bp, Mus musculus
ggtgtcatgtgtcggcttgtccgcg

SEQ ID NO: 33333 - DNA, 25 bp, Mus musculus
cattatctaatgcgttgtggcttca

SEQ ID NO: 33334 - DNA, 25 bp, Mus musculus
attatctaatgcgttgtggcttcag

SEQ ID NO: 33335 - DNA, 25 bp, Mus musculus
ttatctaatgcgttgtggcttcagc

SEQ ID NO: 33336 - DNA, 25 bp, Mus musculus
tatctaatgcgttgtggcttcagcg

SEQ ID NO: 33337 - DNA, 25 bp, Mus musculus
atctaatgcgttgtggcttcagcgc

SEQ ID NO: 33338 - DNA, 25 bp, Mus musculus
tctaatgcgttgtggcttcagcgcc

SEQ ID NO: 33339 - DNA, 25 bp, Mus musculus
ctaatgcgttgtggcttcagcgccg

SEQ ID NO: 33340 - DNA, 25 bp, Mus musculus
taatgcgttgtggcttcagcgccga

SEQ ID NO: 33341 - DNA, 25 bp, Mus musculus
aatgcgttgtggcttcagcgccgag

SEQ ID NO: 33342 - DNA, 25 bp, Mus musculus
atgcgttgtggcttcagcgccgagg

SEQ ID NO: 33343 - DNA, 25 bp, Mus musculus
gtgtcatgtgtcggcttgtccgcgg

SEQ ID NO: 33344 - DNA, 25 bp, Mus musculus
tgtcatgtgtcggcttgtccgcgga

SEQ ID NO: 33345 - DNA, 25 bp, Mus musculus
cggcttgtccgcggacagcagcaag

SEQ ID NO: 33346 - DNA, 25 bp, Mus musculus
cttgtccgcggacagcagcaagcct

SEQ ID NO: 33347 - DNA, 25 bp, Mus musculus
ttgtccgcggacagcagcaagccta

SEQ ID NO: 33348 - DNA, 25 bp, Mus musculus
tgtccgcggacagcagcaagcctat

SEQ ID NO: 33349 - DNA, 25 bp, Mus musculus
gatgctgtgtgatctccatgaaggc

SEQ ID NO: 33350 - DNA, 25 bp, Mus musculus
acattatctaatgcgttgtggcttc

SEQ ID NO: 33351 - DNA, 25 bp, Mus musculus
tccacccataataagagaatgttcc

SEQ ID NO: 33352 - DNA, 25 bp, Mus musculus
atgttcctactcacacttcagctgg

SEQ ID NO: 33353 - DNA, 25 bp, Mus musculus
gttgtacacatttctctatgttcca

SEQ ID NO: 33354 - DNA, 25 bp, Mus musculus
cacatttctctatgttccagccgtc

SEQ ID NO: 33355 - DNA, 25 bp, Mus musculus
tctctatgttccagccgtctctcca

SEQ ID NO: 33356 - DNA, 25 bp, Mus musculus
tccacacagactgtgcacagactgg

SEQ ID NO: 33357 - DNA, 25 bp, Mus musculus
cagactgtgcacagactggtgcatc

SEQ ID NO: 33358 - DNA, 25 bp, Mus musculus
aataccagtgggaattgctgaagga

SEQ ID NO: 33359 - DNA, 25 bp, Mus musculus
tgggacctcagtttggaagactact

SEQ ID NO: 33360 - DNA, 25 bp, Mus musculus
gactactgtactgtctcacctctgt

SEQ ID NO: 33361 - DNA, 25 bp, Mus musculus
tgtactgtctcacctctgtacttcc

SEQ ID NO: 33362 - DNA, 25 bp, Mus musculus
gtctcacctctgtacttccttgtct

SEQ ID NO: 33363 - DNA, 25 bp, Mus musculus
acacttcagctgggtcacatccatc

SEQ ID NO: 33364 - DNA, 25 bp, Mus musculus
gacagtctctactctcatggagttg

SEQ ID NO: 33365 - DNA, 25 bp, Mus musculus
atggaaactcccatgccttgttcat

SEQ ID NO: 33366 - DNA, 25 bp, Mus musculus
actcccatgccttgttcatctcatg

SEQ ID NO: 33367 - DNA, 25 bp, Mus musculus
atgccttgttcatctcatgtgatat

SEQ ID NO: 33368 - DNA, 25 bp, Mus musculus
cattcccatgagggtacttgagtta

SEQ ID NO: 33369 - DNA, 25 bp, Mus musculus
aagttgagatcgctctgagttgtac

SEQ ID NO: 33370 - DNA, 25 bp, Mus musculus
agatcgctctgagttgtacacattt

SEQ ID NO: 33371 - DNA, 25 bp, Mus musculus
agataactccatggtccatgagctg

SEQ ID NO: 33372 - DNA, 25 bp, Mus musculus
taactccatggtccatgagctgaac

SEQ ID NO: 33373 - DNA, 25 bp, Mus musculus
actagcagacttccttggggccatt

SEQ ID NO: 33374 - DNA, 25 bp, Mus musculus
agcagacttccttggggccattggc

SEQ ID NO: 33375 - DNA, 25 bp, Mus musculus
agacttccttggggccattggctct

SEQ ID NO: 33376 - DNA, 25 bp, Mus musculus
cttccttggggccattggctctggt

SEQ ID NO: 33377 - DNA, 25 bp, Mus musculus
tggggccattggctctggtactgga

SEQ ID NO: 33378 - DNA, 25 bp, Mus musculus
ggccattggctctggtactggaatt

SEQ ID NO: 33379 - DNA, 25 bp, Mus musculus
cattggctctggtactggaattctg

SEQ ID NO: 33380 - DNA, 25 bp, Mus musculus
tactggaattctgcttgcagtcact

SEQ ID NO: 33381 - DNA, 25 bp, Mus musculus
tggaattctgcttgcagtcactatt

SEQ ID NO: 33382 - DNA, 25 bp, Mus musculus
aattctgcttgcagtcactattatt

SEQ ID NO: 33383 - DNA, 25 bp, Mus musculus
ctccatggtccatgagctgaacagg

SEQ ID NO: 33384 - DNA, 25 bp, Mus musculus
gctgaacaggtacatccccacagca

SEQ ID NO: 33385 - DNA, 25 bp, Mus musculus
tctgtgcatcggtgccctgtcagta

SEQ ID NO: 33386 - DNA, 25 bp, Mus musculus
gtgcatcggtgccctgtcagtacta

SEQ ID NO: 33387 - DNA, 25 bp, Mus musculus
catcggtgccctgtcagtactagca

SEQ ID NO: 33388 - DNA, 25 bp, Mus musculus
cggtgccctgtcagtactagcagac

SEQ ID NO: 33389 - DNA, 25 bp, Mus musculus
tgccctgtcagtactagcagacttc

SEQ ID NO: 33390 - DNA, 25 bp, Mus musculus
cctgtcagtactagcagacttcctt

SEQ ID NO: 33391 - DNA, 25 bp, Mus musculus
gctctccaggcccagctgtagcggg

SEQ ID NO: 33392 - DNA, 25 bp, Mus musculus
ctctccaggcccagctgtagcgggg

SEQ ID NO: 33393 - DNA, 25 bp, Mus musculus
tgtaccttgaatgccctctggatgc

SEQ ID NO: 33394 - DNA, 25 bp, Mus musculus
taccttgaatgccctctggatgccc

SEQ ID NO: 33395 - DNA, 25 bp, Mus musculus
accttgaatgccctctggatgccct

SEQ ID NO: 33396 - DNA, 25 bp, Mus musculus
ccttgaatgccctctggatgccctc

SEQ ID NO: 33397 - DNA, 25 bp, Mus musculus
ttgaatgccctctggatgccctctt

SEQ ID NO: 33398 - DNA, 25 bp, Mus musculus
tgaatgccctctggatgccctcttc

SEQ ID NO: 33399 - DNA, 25 bp, Mus musculus
gaatgccctctggatgccctcttct

SEQ ID NO: 33400 - DNA, 25 bp, Mus musculus
aatgccctctggatgccctcttctt

SEQ ID NO: 33401 - DNA, 25 bp, Mus musculus
atgccctctggatgccctcttcttg

SEQ ID NO: 33402 - DNA, 25 bp, Mus musculus
ccatcctttccattaagccagcaga

SEQ ID NO: 33403 - DNA, 25 bp, Mus musculus
tctccaggcccagctgtagcggggc

SEQ ID NO: 33404 - DNA, 25 bp, Mus musculus
catcctttccattaagccagcagag

SEQ ID NO: 33405 - DNA, 25 bp, Mus musculus
tccaggcccagctgtagcggggcat

SEQ ID NO: 33406 - DNA, 25 bp, Mus musculus
ggcatcgccctgtgctgtgtaagga

SEQ ID NO: 33407 - DNA, 25 bp, Mus musculus
catcgccctgtgctgtgtaaggatg

SEQ ID NO: 33408 - DNA, 25 bp, Mus musculus
gatgcttcttcaagaagtgtgagat

SEQ ID NO: 33409 - DNA, 25 bp, Mus musculus
ccttgctcttgattcaacaacacca

SEQ ID NO: 33410 - DNA, 25 bp, Mus musculus
ttgctcttgattcaacaacaccatt

SEQ ID NO: 33411 - DNA, 25 bp, Mus musculus
ctgtaccttgaatgccctctggatg

SEQ ID NO: 33412 - DNA, 25 bp, Mus musculus
ccagcagctgccaacctaggcgctg

SEQ ID NO: 33413 - DNA, 25 bp, Mus musculus
cagcagctgccaacctaggcgctgg

SEQ ID NO: 33414 - DNA, 25 bp, Mus musculus
agcaaatacgcctgcaggcgagatc

SEQ ID NO: 33415 - DNA, 25 bp, Mus musculus
gcaaatacgcctgcaggcgagatct

SEQ ID NO: 33416 - DNA, 25 bp, Mus musculus
aatacgcctgcaggcgagatcttcc

SEQ ID NO: 33417 - DNA, 25 bp, Mus musculus
atacgcctgcaggcgagatcttcca

SEQ ID NO: 33418 - DNA, 25 bp, Mus musculus
acgcctgcaggcgagatcttccagg

SEQ ID NO: 33419 - DNA, 25 bp, Mus musculus
cgcctgcaggcgagatcttccaggc

SEQ ID NO: 33420 - DNA, 25 bp, Mus musculus
cctgcaggcgagatcttccaggccc

SEQ ID NO: 33421 - DNA, 25 bp, Mus musculus
agcagctgccaacctaggcgctggg

SEQ ID NO: 33422 - DNA, 25 bp, Mus musculus
gcagctgccaacctaggcgctgggg

SEQ ID NO: 33423 - DNA, 25 bp, Mus musculus
cgagcctctgcgcgatcgcgtcagg

SEQ ID NO: 33424 - DNA, 25 bp, Mus musculus
gcctctgcgcgatcgcgtcaggctt

SEQ ID NO: 33425 - DNA, 25 bp, Mus musculus
cctctgcgcgatcgcgtcaggcttt

SEQ ID NO: 33426 - DNA, 25 bp, Mus musculus
tcgcgtcaggcttttggtgaccgca

SEQ ID NO: 33427 - DNA, 25 bp, Mus musculus
cgcgtcaggcttttggtgaccgcat

SEQ ID NO: 33428 - DNA, 25 bp, Mus musculus
gttaccatgggcaggaggtgcgctc

SEQ ID NO: 33429 - DNA, 25 bp, Mus musculus
agtttgcagacgccatccaggaggt

SEQ ID NO: 33430 - DNA, 25 bp, Mus musculus
cagacgccatccaggaggtgcagca

SEQ ID NO: 33431 - DNA, 25 bp, Mus musculus
cccacaatgacctgctgcgtacata

SEQ ID NO: 33432 - DNA, 25 bp, Mus musculus
atgacctgctgcgtacatatgaggc

SEQ ID NO: 33433 - DNA, 25 bp, Mus musculus
acatagccatcttctcagccttcaa

SEQ ID NO: 33434 - DNA, 25 bp, Mus musculus
ccatcttctcagccttcaaccttta

SEQ ID NO: 33435 - DNA, 25 bp, Mus musculus
tctcagccttcaacctttacagcct

SEQ ID NO: 33436 - DNA, 25 bp, Mus musculus
tctgtccaagtaatacctctatgcc

SEQ ID NO: 33437 - DNA, 25 bp, Mus musculus
atacctctatgcccaacacaggcaa

SEQ ID NO: 33438 - DNA, 25 bp, Mus musculus
ctatgcccaacacaggcaagggttt

SEQ ID NO: 33439 - DNA, 25 bp, Mus musculus
tgttttctagacttacccgtcagca

SEQ ID NO: 33440 - DNA, 25 bp, Mus musculus
ctagacttacccgtcagcaatgaaa

SEQ ID NO: 33441 - DNA, 25 bp, Mus musculus
cgggcttcaagaacctgctgctgga

SEQ ID NO: 33442 - DNA, 25 bp, Mus musculus
agctgcaggccctgaacgctgctgt

SEQ ID NO: 33443 - DNA, 25 bp, Mus musculus
ccacagcattaacgcttgtgtcccg

SEQ ID NO: 33444 - DNA, 25 bp, Mus musculus
cattaacgcttgtgtcccgcaaact

SEQ ID NO: 33445 - DNA, 25 bp, Mus musculus
cgcttgtgtcccgcaaacttgagga

SEQ ID NO: 33446 - DNA, 25 bp, Mus musculus
tgtcccgcaaacttgaggatgttct

SEQ ID NO: 33447 - DNA, 25 bp, Mus musculus
cgaagaataccaccatcaaggactt

SEQ ID NO: 33448 - DNA, 25 bp, Mus musculus
gggtctgcaaggcccacaatgacct

SEQ ID NO: 33449 - DNA, 25 bp, Mus musculus
agcagattctcatggctgtaggtag

SEQ ID NO: 33450 - DNA, 25 bp, Mus musculus
ctcatctttcccacagatgactctg

SEQ ID NO: 33451 - DNA, 25 bp, Mus musculus
catccacagaaccatctctcatggt

SEQ ID NO: 33452 - DNA, 25 bp, Mus musculus
cagaaccatctctcatggttgttag

SEQ ID NO: 33453 - DNA, 25 bp, Mus musculus
catctctcatggttgttagcaagat

SEQ ID NO: 33454 - DNA, 25 bp, Mus musculus
gcaagatgcctaacacactcaagca

SEQ ID NO: 33455 - DNA, 25 bp, Mus musculus
tgcctaacacactcaagcaaactaa

SEQ ID NO: 33456 - DNA, 25 bp, Mus musculus
acacactcaagcaaactaagcactg

SEQ ID NO: 33457 - DNA, 25 bp, Mus musculus
ttcctttctgaaccatctcagccat

SEQ ID NO: 33458 - DNA, 25 bp, Mus musculus
catctcaccaacctgtgctcagcat

SEQ ID NO: 33459 - DNA, 25 bp, Mus musculus
accaacctgtgctcagcatgaactg

SEQ ID NO: 33460 - DNA, 25 bp, Mus musculus
gtgacaccagcctttgatagtagga

SEQ ID NO: 33461 - DNA, 25 bp, Mus musculus
gactctgtatttgacctgtctatct

SEQ ID NO: 33462 - DNA, 25 bp, Mus musculus
gtatttgacctgtctatcttctcca

SEQ ID NO: 33463 - DNA, 25 bp, Mus musculus
cctctaaatccactcacatctttca

SEQ ID NO: 33464 - DNA, 25 bp, Mus musculus
ctcacatctttcagtctcacaatgc

SEQ ID NO: 33465 - DNA, 25 bp, Mus musculus
tctttcagtctcacaatgcacatca

SEQ ID NO: 33466 - DNA, 25 bp, Mus musculus
agtctcacaatgcacatcacggata

SEQ ID NO: 33467 - DNA, 25 bp, Mus musculus
acaatgcacatcacggatagcttac

SEQ ID NO: 33468 - DNA, 25 bp, Mus musculus
ttggaccttctggcagcccatccac

SEQ ID NO: 33469 - DNA, 25 bp, Mus musculus
tctgccacatctgggccgtggtgcc

SEQ ID NO: 33470 - DNA, 25 bp, Mus musculus
tggtgccctgcattaagagctacct

SEQ ID NO: 33471 - DNA, 25 bp, Mus musculus
tgagcatacctggctctgctccaca

SEQ ID NO: 33472 - DNA, 25 bp, Mus musculus
tacctggctctgctccacatgggct

SEQ ID NO: 33473 - DNA, 25 bp, Mus musculus
gttcctctcaattccacctcaagat

SEQ ID NO: 33474 - DNA, 25 bp, Mus musculus
ctcaattccacctcaagatgggaaa

SEQ ID NO: 33475 - DNA, 25 bp, Mus musculus
tccacctcaagatgggaaaacttgg

SEQ ID NO: 33476 - DNA, 25 bp, Mus musculus
tggaaacacgggcacccctgctccg

SEQ ID NO: 33477 - DNA, 25 bp, Mus musculus
aaggctttgcgttcacatgtactgt

SEQ ID NO: 33478 - DNA, 25 bp, Mus musculus
ttgcgttcacatgtactgtaatagc

SEQ ID NO: 33479 - DNA, 25 bp, Mus musculus
ccagtcttctagaggtgtgactcgt

SEQ ID NO: 33480 - DNA, 25 bp, Mus musculus
cagtgactgccggcattgaggaagg

SEQ ID NO: 33481 - DNA, 25 bp, Mus musculus
ttaagagctacctgatcgagatcca

SEQ ID NO: 33482 - DNA, 25 bp, Mus musculus
tgatcgagatccagtgcatcagcca

SEQ ID NO: 33483 - DNA, 25 bp, Mus musculus
agatccagtgcatcagccacatcta

SEQ ID NO: 33484 - DNA, 25 bp, Mus musculus
tcagccacatctactcactgtgtat

SEQ ID NO: 33485 - DNA, 25 bp, Mus musculus
acatctactcactgtgtatccgcac

SEQ ID NO: 33486 - DNA, 25 bp, Mus musculus
actcactgtgtatccgcaccttctg

SEQ ID NO: 33487 - DNA, 25 bp, Mus musculus
tcgctgcgttgggccaggtctgcag

SEQ ID NO: 33488 - DNA, 25 bp, Mus musculus
tctgcagcaacattaaggtggtgct

SEQ ID NO: 33489 - DNA, 25 bp, Mus musculus
tcctctatccaggttctccactctt

SEQ ID NO: 33490 - DNA, 25 bp, Mus musculus
cctctatccaggttctccactcttt

SEQ ID NO: 33491 - DNA, 25 bp, Mus musculus
tacagtccgttgctgattgtaggaa

SEQ ID NO: 33492 - DNA, 25 bp, Mus musculus
agtccgttgctgattgtaggaaggg

SEQ ID NO: 33493 - DNA, 25 bp, Mus musculus
gatgatgttgttcctggtggcactg

SEQ ID NO: 33494 - DNA, 25 bp, Mus musculus
atgttgttcctggtggcactgagga

SEQ ID NO: 33495 - DNA, 25 bp, Mus musculus
ttgttcctggtggcactgaggatta

SEQ ID NO: 33496 - DNA, 25 bp, Mus musculus
gttcctggtggcactgaggattatg

SEQ ID NO: 33497 - DNA, 25 bp, Mus musculus
ttcctggtggcactgaggattatga

SEQ ID NO: 33498 - DNA, 25 bp, Mus musculus
tcttgaagacccttaccacttgtct

SEQ ID NO: 33499 - DNA, 25 bp, Mus musculus
ttgaagacccttaccacttgtctag

SEQ ID NO: 33500 - DNA, 25 bp, Mus musculus
cttaccacttgtctagttatctctg

SEQ ID NO: 33501 - DNA, 25 bp, Mus musculus
tctatccaggttctccactctttac

SEQ ID NO: 33502 - DNA, 25 bp, Mus musculus
ctatccaggttctccactctttaca

SEQ ID NO: 33503 - DNA, 25 bp, Mus musculus
tccactctttacagtccgttgctga

SEQ ID NO: 33504 - DNA, 25 bp, Mus musculus
cactctttacagtccgttgctgatt

SEQ ID NO: 33505 - DNA, 25 bp, Mus musculus
actctttacagtccgttgctgattg

SEQ ID NO: 33506 - DNA, 25 bp, Mus musculus
tctttacagtccgttgctgattgta

SEQ ID NO: 33507 - DNA, 25 bp, Mus musculus
ctttacagtccgttgctgattgtag

SEQ ID NO: 33508 - DNA, 25 bp, Mus musculus
ttacagtccgttgctgattgtagga

SEQ ID NO: 33509 - DNA, 25 bp, Mus musculus
cacactctgatgctcaggctctagt

SEQ ID NO: 33510 - DNA, 25 bp, Mus musculus
ctgatgctcaggctctagttctctt

SEQ ID NO: 33511 - DNA, 25 bp, Mus musculus
gcatccagaagcttcgtaagaagtg

SEQ ID NO: 33512 - DNA, 25 bp, Mus musculus
tcattgagagccacactgacttcat

SEQ ID NO: 33513 - DNA, 25 bp, Mus musculus
agagccacactgacttcatattttc

SEQ ID NO: 33514 - DNA, 25 bp, Mus musculus
acactgacttcatattttcgacaat

SEQ ID NO: 33515 - DNA, 25 bp, Mus musculus
acttcatattttcgacaatcaaagc

SEQ ID NO: 33516 - DNA, 25 bp, Mus musculus
tattttcgacaatcaaagctccctt

SEQ ID NO: 33517 - DNA, 25 bp, Mus musculus
cgacaatcaaagctcccttgaagcc

SEQ ID NO: 33518 - DNA, 25 bp, Mus musculus
tcaaagctcccttgaagccatatct

SEQ ID NO: 33519 - DNA, 25 bp, Mus musculus
ctcccttgaagccatatctagttcc

SEQ ID NO: 33520 - DNA, 25 bp, Mus musculus
tgaagccatatctagttccaacatc

SEQ ID NO: 33521 - DNA, 25 bp, Mus musculus
ctcaggctctagttctcttaactgt

SEQ ID NO: 33522 - DNA, 25 bp, Mus musculus
tagttccaacatcagataatatcct

SEQ ID NO: 33523 - DNA, 25 bp, Mus musculus
ctctagttctcttaactgtcacacc

SEQ ID NO: 33524 - DNA, 25 bp, Mus musculus
ttctcttaactgtcacacctgacca

SEQ ID NO: 33525 - DNA, 25 bp, Mus musculus
taactgtcacacctgaccagtcaat

SEQ ID NO: 33526 - DNA, 25 bp, Mus musculus
ctgaccagtcaatggtggatgaggg

SEQ ID NO: 33527 - DNA, 25 bp, Mus musculus
atgagggcatggctcgggaagtcat

SEQ ID NO: 33528 - DNA, 25 bp, Mus musculus
aagtcatcaatcgcatccagaagct

SEQ ID NO: 33529 - DNA, 25 bp, Mus musculus
tcaatcgcatccagaagcttcgtaa

SEQ ID NO: 33530 - DNA, 25 bp, Mus musculus
aagtgcatctgcatacgaccaccac

SEQ ID NO: 33531 - DNA, 25 bp, Mus musculus
atctgcatacgaccaccacacctga

SEQ ID NO: 33532 - DNA, 25 bp, Mus musculus
ggctgcgcatatatctcatctgcag

SEQ ID NO: 33533 - DNA, 25 bp, Mus musculus
tatatctcatctgcaggagacgacg

SEQ ID NO: 33534 - DNA, 25 bp, Mus musculus
gactagtcgagaccttctgtactct

SEQ ID NO: 33535 - DNA, 25 bp, Mus musculus
agaccttctgtactcttgatgctgc

SEQ ID NO: 33536 - DNA, 25 bp, Mus musculus
ccttctgtactcttgatgctgcgac

SEQ ID NO: 33537 - DNA, 25 bp, Mus musculus
gtactcttgatgctgcgactctagc

SEQ ID NO: 33538 - DNA, 25 bp, Mus musculus
ttgatgctgcgactctagcatggct

SEQ ID NO: 33539 - DNA, 25 bp, Mus musculus
ctgcgactctagcatggctgactga

SEQ ID NO: 33540 - DNA, 25 bp, Mus musculus
agcatgcgcaacatgtgtcacacgc

SEQ ID NO: 33541 - DNA, 25 bp, Mus musculus
atgcgcaacatgtgtcacacgctca

SEQ ID NO: 33542 - DNA, 25 bp, Mus musculus
cgaccaccacacctgagtgcagaag

SEQ ID NO: 33543 - DNA, 25 bp, Mus musculus
cgcaacatgtgtcacacgctcatcc

SEQ ID NO: 33544 - DNA, 25 bp, Mus musculus
ccaccacacctgagtgcagaagcta

SEQ ID NO: 33545 - DNA, 25 bp, Mus musculus
gagtcgctgactatcaccttggata

SEQ ID NO: 33546 - DNA, 25 bp, Mus musculus
actatcaccttggatacggtgtcga

SEQ ID NO: 33547 - DNA, 25 bp, Mus musculus
ctgtaaacctgactatgaggatctg

SEQ ID NO: 33548 - DNA, 25 bp, Mus musculus
ctatgaggatctgctaggaggtcat

SEQ ID NO: 33549 - DNA, 25 bp, Mus musculus
cctcagatgacattgggctgcgcat

SEQ ID NO: 33550 - DNA, 25 bp, Mus musculus
acattgggctgcgcatatatctcat

SEQ ID NO: 33551 - DNA, 25 bp, Mus musculus
tcccaagtactgcctgaacccggag

SEQ ID NO: 33552 - DNA, 25 bp, Mus musculus
cctgaacccggagtacccagagctg

SEQ ID NO: 33553 - DNA, 25 bp, Mus musculus
cagatgcatgcctggaaacgcagtg

SEQ ID NO: 33554 - DNA, 25 bp, Mus musculus
catgcctggaaacgcagtggacaca

SEQ ID NO: 33555 - DNA, 25 bp, Mus musculus
agtggacacacgcattttggttttg

SEQ ID NO: 33556 - DNA, 25 bp, Mus musculus
acgcattttggttttgcagtgactg

SEQ ID NO: 33557 - DNA, 25 bp, Mus musculus
tgtaactcgaacacattcttttcta

SEQ ID NO: 33558 - DNA, 25 bp, Mus musculus
aacacattcttttctatttcactgg

SEQ ID NO: 33559 - DNA, 25 bp, Mus musculus
acattcttttctatttcactggagc

SEQ ID NO: 33560 - DNA, 25 bp, Mus musculus
ttcttttctatttcactggagcaca

SEQ ID NO: 33561 - DNA, 25 bp, Mus musculus
tctatttcactggagcacaataaat

SEQ ID NO: 33562 - DNA, 25 bp, Mus musculus
atttcactggagcacaataaatggc

SEQ ID NO: 33563 - DNA, 25 bp, Mus musculus
gtacccagagctgagtgagcccacc

SEQ ID NO: 33564 - DNA, 25 bp, Mus musculus
caactactacaactctgcctagggg

SEQ ID NO: 33565 - DNA, 25 bp, Mus musculus
ctggcacctgcctatagggttacgg

SEQ ID NO: 33566 - DNA, 25 bp, Mus musculus
catccctggagctttcgcagggccc

SEQ ID NO: 33567 - DNA, 25 bp, Mus musculus
tggagctttcgcagggcccaacata

SEQ ID NO: 33568 - DNA, 25 bp, Mus musculus
tgtccccaacagtgcccgaaggaag

SEQ ID NO: 33569 - DNA, 25 bp, Mus musculus
tccctcacaagtaagtacctcccag

SEQ ID NO: 33570 - DNA, 25 bp, Mus musculus
ttcctgcgacgggagcagatgcatg

SEQ ID NO: 33571 - DNA, 25 bp, Mus musculus
attgaagcccatggaccttatggta

SEQ ID NO: 33572 - DNA, 25 bp, Mus musculus
agcaagtccacgacgaatttttgcg

SEQ ID NO: 33573 - DNA, 25 bp, Mus musculus
aaattccatttcagtaaatagtgat

SEQ ID NO: 33574 - DNA, 25 bp, Mus musculus
tgaaacatatctctctgcagatgat

SEQ ID NO: 33575 - DNA, 25 bp, Mus musculus
aacatatctctctgcagatgatctg

SEQ ID NO: 33576 - DNA, 25 bp, Mus musculus
atatctctctgcagatgatctgagg

SEQ ID NO: 33577 - DNA, 25 bp, Mus musculus
tctctctgcagatgatctgagggtt

SEQ ID NO: 33578 - DNA, 25 bp, Mus musculus
tgacctatggcgtttagaaatcaca

SEQ ID NO: 33579 - DNA, 25 bp, Mus musculus
aggcttcaacattgtggacatcaag

SEQ ID NO: 33580 - DNA, 25 bp, Mus musculus
cttcaacattgtggacatcaagcca

SEQ ID NO: 33581 - DNA, 25 bp, Mus musculus
tgtggacatcaagccagctaatatg

SEQ ID NO: 33582 - DNA, 25 bp, Mus musculus
ggacatcaagccagctaatatggag

SEQ ID NO: 33583 - DNA, 25 bp, Mus musculus
tccacgacgaatttttgcgagtgct

SEQ ID NO: 33584 - DNA, 25 bp, Mus musculus
aatttttgcgagtgctcatacatat

SEQ ID NO: 33585 - DNA, 25 bp, Mus musculus
ttttgcgagtgctcatacatatcac

SEQ ID NO: 33586 - DNA, 25 bp, Mus musculus
tgctcatacatatcacataaattcc

SEQ ID NO: 33587 - DNA, 25 bp, Mus musculus
tcatacatatcacataaattccatt

SEQ ID NO: 33588 - DNA, 25 bp, Mus musculus
tacatatcacataaattccatttca

SEQ ID NO: 33589 - DNA, 25 bp, Mus musculus
atatcacataaattccatttcagta

SEQ ID NO: 33590 - DNA, 25 bp, Mus musculus
cataaattccatttcagtaaatagt

SEQ ID NO: 33591 - DNA, 25 bp, Mus musculus
ttagccaagcctctgtctagtctca

SEQ ID NO: 33592 - DNA, 25 bp, Mus musculus
cctctgtctagtctcactcctctga

SEQ ID NO: 33593 - DNA, 25 bp, Mus musculus
tttgtaagcctgaactgcagcccac

SEQ ID NO: 33594 - DNA, 25 bp, Mus musculus
agcctgaactgcagcccacacaggg

SEQ ID NO: 33595 - DNA, 25 bp, Mus musculus
ccagtagtgaatcccctcattttgt

SEQ ID NO: 33596 - DNA, 25 bp, Mus musculus
gtagtgaatcccctcattttgtgca

SEQ ID NO: 33597 - DNA, 25 bp, Mus musculus
gtgaatcccctcattttgtgcattt

SEQ ID NO: 33598 - DNA, 25 bp, Mus musculus
ctcattttgtgcatttactttgaag

SEQ ID NO: 33599 - DNA, 25 bp, Mus musculus
ttctcaaagatgcacactccctctt

SEQ ID NO: 33600 - DNA, 25 bp, Mus musculus
actccctcttcatagtgctgtgttt

SEQ ID NO: 33601 - DNA, 25 bp, Mus musculus
ccctcttcatagtgctgtgtttgtt

SEQ ID NO: 33602 - DNA, 25 bp, Mus musculus
cacttgcattgtcattagatgttca

SEQ ID NO: 33603 - DNA, 25 bp, Mus musculus
tctagtctcactcctctgattatcg

SEQ ID NO: 33604 - DNA, 25 bp, Mus musculus
ctcactcctctgattatcgccgcaa

SEQ ID NO: 33605 - DNA, 25 bp, Mus musculus
actcctctgattatcgccgcaaagg

SEQ ID NO: 33606 - DNA, 25 bp, Mus musculus
attatcgccgcaaaggaagcaatta

SEQ ID NO: 33607 - DNA, 25 bp, Mus musculus
aacagtagccgttagaactgcaagc

SEQ ID NO: 33608 - DNA, 25 bp, Mus musculus
cggtctccaggatgagtaagactga

SEQ ID NO: 33609 - DNA, 25 bp, Mus musculus
tctgctgctgcaggatccacagaag

SEQ ID NO: 33610 - DNA, 25 bp, Mus musculus
tactccctcagattatgtaatttat

SEQ ID NO: 33611 - DNA, 25 bp, Mus musculus
ctccactctataaggaactcttcag

SEQ ID NO: 33612 - DNA, 25 bp, Mus musculus
ataaggaactcttcagcactgatgt

SEQ ID NO: 33613 - DNA, 25 bp, Mus musculus
tgatttcccataagttccaccctgg

SEQ ID NO: 33614 - DNA, 25 bp, Mus musculus
tccaccctggcttctggaagctgtg

SEQ ID NO: 33615 - DNA, 25 bp, Mus musculus
agactgacaatcagcagggataaat

SEQ ID NO: 33616 - DNA, 25 bp, Mus musculus
gaactcaaatctaggcttgaaagct

SEQ ID NO: 33617 - DNA, 25 bp, Mus musculus
ctcaaatctaggcttgaaagctaat

SEQ ID NO: 33618 - DNA, 25 bp, Mus musculus
cagtcctttcaatacctcattgtat

SEQ ID NO: 33619 - DNA, 25 bp, Mus musculus
caatacctcattgtatttccccatg

SEQ ID NO: 33620 - DNA, 25 bp, Mus musculus
gatctagctcagagactggtggcaa

SEQ ID NO: 33621 - DNA, 25 bp, Mus musculus
gctcagagactggtggcaagccccc

SEQ ID NO: 33622 - DNA, 25 bp, Mus musculus
agactggtggcaagcccccagaagg

SEQ ID NO: 33623 - DNA, 25 bp, Mus musculus
tcttcagcactgatgttgaatcccc

SEQ ID NO: 33624 - DNA, 25 bp, Mus musculus
aatcccctgaggggctgtcaaagtg

SEQ ID NO: 33625 - DNA, 25 bp, Mus musculus
tctgcactctatgaagggtggtatc

SEQ ID NO: 33626 - DNA, 25 bp, Mus musculus
taagcaaatcctaagactgattttc

SEQ ID NO: 33627 - DNA, 25 bp, Mus musculus
aagactgattttctgcccctaggct

SEQ ID NO: 33628 - DNA, 25 bp, Mus musculus
actgattttctgcccctaggcttgc

SEQ ID NO: 33629 - DNA, 25 bp, Mus musculus
ctgcccctaggcttgccttgtagga

SEQ ID NO: 33630 - DNA, 25 bp, Mus musculus
ctaggcttgccttgtaggacaacag

SEQ ID NO: 33631 - DNA, 25 bp, Mus musculus
aacatgatgcactttggagggtaca

SEQ ID NO: 33632 - DNA, 25 bp, Mus musculus
atgatgcactttggagggtacatcc

SEQ ID NO: 33633 - DNA, 25 bp, Mus musculus
ctgcttgtgtccttgccccgtgcat

SEQ ID NO: 33634 - DNA, 25 bp, Mus musculus
tcccagctctgggtcctccttggca

SEQ ID NO: 33635 - DNA, 25 bp, Mus musculus
gtcctccttggcacccaatgcagac

SEQ ID NO: 33636 - DNA, 25 bp, Mus musculus
cttggcacccaatgcagactcctgt

SEQ ID NO: 33637 - DNA, 25 bp, Mus musculus
ggcacccaatgcagactcctgtttg

SEQ ID NO: 33638 - DNA, 25 bp, Mus musculus
acccaatgcagactcctgtttggat

SEQ ID NO: 33639 - DNA, 25 bp, Mus musculus
caatgcagactcctgtttggatagt

SEQ ID NO: 33640 - DNA, 25 bp, Mus musculus
tgcagactcctgtttggatagtggg

SEQ ID NO: 33641 - DNA, 25 bp, Mus musculus
ctagaagccagtactctgcctgacc

SEQ ID NO: 33642 - DNA, 25 bp, Mus musculus
tatgcccgcactatgccagcaataa

SEQ ID NO: 33643 - DNA, 25 bp, Mus musculus
tacatccagaagcaagctcagacag

SEQ ID NO: 33644 - DNA, 25 bp, Mus musculus
caagctcagacagagcggaagagtg

SEQ ID NO: 33645 - DNA, 25 bp, Mus musculus
aacgttctgcgaaaccggatcaatg

SEQ ID NO: 33646 - DNA, 25 bp, Mus musculus
gttctgcgaaaccggatcaatgaca

SEQ ID NO: 33647 - DNA, 25 bp, Mus musculus
atcaatgacaaccagaaagtctcca

SEQ ID NO: 33648 - DNA, 25 bp, Mus musculus
gtcaccgggcgttggaaatagatga

SEQ ID NO: 33649 - DNA, 25 bp, Mus musculus
atgaaactgttctcgtcaaagctgt

SEQ ID NO: 33650 - DNA, 25 bp, Mus musculus
aaactgttctcgtcaaagctgtgcc

SEQ ID NO: 33651 - DNA, 25 bp, Mus musculus
cgacccatgctccagtttgggctca

SEQ ID NO: 33652 - DNA, 25 bp, Mus musculus
atgctccagtttgggctcattgctt

SEQ ID NO: 33653 - DNA, 25 bp, Mus musculus
tcacggactactaacatcagagcct

SEQ ID NO: 33654 - DNA, 25 bp, Mus musculus
gcccgcttcaaaggcaacagctgga

SEQ ID NO: 33655 - DNA, 25 bp, Mus musculus
ttcaaaggcaacagctggaggctaa

SEQ ID NO: 33656 - DNA, 25 bp, Mus musculus
tgcgtattacttcctgctgtacaga

SEQ ID NO: 33657 - DNA, 25 bp, Mus musculus
ttacttcctgctgtacagaccattc

SEQ ID NO: 33658 - DNA, 25 bp, Mus musculus
aggactgctgctatcctatactctg

SEQ ID NO: 33659 - DNA, 25 bp, Mus musculus
atcctatactctgatgccatttatg

SEQ ID NO: 33660 - DNA, 25 bp, Mus musculus
tactctgatgccatttatgtgtgta

SEQ ID NO: 33661 - DNA, 25 bp, Mus musculus
tgtgtattacatgccttctcagaat

SEQ ID NO: 33662 - DNA, 25 bp, Mus musculus
gccttctcagaatgatgttgactta

SEQ ID NO: 33663 - DNA, 25 bp, Mus musculus
gggctcattgctttttccatatatg

SEQ ID NO: 33664 - DNA, 25 bp, Mus musculus
ctcattcagggagctgctatggcta

SEQ ID NO: 33665 - DNA, 25 bp, Mus musculus
gctgctatggctatactggttgctt

SEQ ID NO: 33666 - DNA, 25 bp, Mus musculus
gtatccgatttcttccaggcacaca

SEQ ID NO: 33667 - DNA, 25 bp, Mus musculus
gatttcttccaggcacacattctta

SEQ ID NO: 33668 - DNA, 25 bp, Mus musculus
ttccaggcacacattcttacaaaga

SEQ ID NO: 33669 - DNA, 25 bp, Mus musculus
gcacacattcttacaaagagagaaa

SEQ ID NO: 33670 - DNA, 25 bp, Mus musculus
aggatccacacgatctccatgaaac

SEQ ID NO: 33671 - DNA, 25 bp, Mus musculus
tgcccacgaggaacttctccgagct

SEQ ID NO: 33672 - DNA, 25 bp, Mus musculus
ccacgaggaacttctccgagctgac

SEQ ID NO: 33673 - DNA, 25 bp, Mus musculus
catcagtgggctgctacctggggag

SEQ ID NO: 33674 - DNA, 25 bp, Mus musculus
ctaagtggggctcctaactgtccag

SEQ ID NO: 33675 - DNA, 25 bp, Mus musculus
tcatccaaggcctcgttgtggggcc

SEQ ID NO: 33676 - DNA, 25 bp, Mus musculus
gtctcctcaggtagctgtgcccctt

SEQ ID NO: 33677 - DNA, 25 bp, Mus musculus
tcctcaggtagctgtgccccttacc

SEQ ID NO: 33678 - DNA, 25 bp, Mus musculus
tgtgccccttacccagctggtctgc

SEQ ID NO: 33679 - DNA, 25 bp, Mus musculus
tacccagctggtctgcttggatttc

SEQ ID NO: 33680 - DNA, 25 bp, Mus musculus
ctgcttggatttcctacgccccagg

SEQ ID NO: 33681 - DNA, 25 bp, Mus musculus
ccccaggcatggaccacctctgttt

SEQ ID NO: 33682 - DNA, 25 bp, Mus musculus
gcatggaccacctctgttttatacc

SEQ ID NO: 33683 - DNA, 25 bp, Mus musculus
ggaacttctccgagctgacctgtgc

SEQ ID NO: 33684 - DNA, 25 bp, Mus musculus
agctgacctgtgccgagacaagttc

SEQ ID NO: 33685 - DNA, 25 bp, Mus musculus
tgacctgtgccgagacaagttctcc

SEQ ID NO: 33686 - DNA, 25 bp, Mus musculus
ctccaagtgtggcgtgatggccgtc

SEQ ID NO: 33687 - DNA, 25 bp, Mus musculus
ccctttcatcccggacatcagtggg

SEQ ID NO: 33688 - DNA, 25 bp, Mus musculus
tttcatcccggacatcagtgggctg

SEQ ID NO: 33689 - DNA, 25 bp, Mus musculus
cccggacatcagtgggctgctacct

SEQ ID NO: 33690 - DNA, 25 bp, Mus musculus
ggacatcagtgggctgctacctggg

SEQ ID NO: 33691 - DNA, 25 bp, Mus musculus
ggattctgggcagtgtcattgtggt

SEQ ID NO: 33692 - DNA, 25 bp, Mus musculus
ttctgggcagtgtcattgtggtatg

SEQ ID NO: 33693 - DNA, 25 bp, Mus musculus
catggtcattccatggagacctctc

SEQ ID NO: 33694 - DNA, 25 bp, Mus musculus
ggtcattccatggagacctctccgt

SEQ ID NO: 33695 - DNA, 25 bp, Mus musculus
gagacctctccgtgaggaagtgaac

SEQ ID NO: 33696 - DNA, 25 bp, Mus musculus
gtcctgattcctgtccatcaaaatt

SEQ ID NO: 33697 - DNA, 25 bp, Mus musculus
ctgattcctgtccatcaaaattggg

SEQ ID NO: 33698 - DNA, 25 bp, Mus musculus
attcctgtccatcaaaattgggtgt

SEQ ID NO: 33699 - DNA, 25 bp, Mus musculus
ccgtgcccctacagtgagagacaga

SEQ ID NO: 33700 - DNA, 25 bp, Mus musculus
cagatgtcccatccatggtctctac

SEQ ID NO: 33701 - DNA, 25 bp, Mus musculus
catccatggtctctactgcattttc

SEQ ID NO: 33702 - DNA, 25 bp, Mus musculus
ccatggtctctactgcattttccct

SEQ ID NO: 33703 - DNA, 25 bp, Mus musculus
tattgggctcttacatccccaatga

SEQ ID NO: 33704 - DNA, 25 bp, Mus musculus
tgggctcttacatccccaatgactg

SEQ ID NO: 33705 - DNA, 25 bp, Mus musculus
cttacatccccaatgactgcactac

SEQ ID NO: 33706 - DNA, 25 bp, Mus musculus
cctctccagagagtagggattttct

SEQ ID NO: 33707 - DNA, 25 bp, Mus musculus
attttcttggactatgatgctggtg

SEQ ID NO: 33708 - DNA, 25 bp, Mus musculus
gaggtttccttctacaatgtgacag

SEQ ID NO: 33709 - DNA, 25 bp, Mus musculus
aagagcgcacgtcctttgatcatct

SEQ ID NO: 33710 - DNA, 25 bp, Mus musculus
ttttctggccatgttgggaatcatg

SEQ ID NO: 33711 - DNA, 25 bp, Mus musculus
tgcgcacatttctctcatgagtgaa

SEQ ID NO: 33712 - DNA, 25 bp, Mus musculus
catttctctcatgagtgaagaatgg

SEQ ID NO: 33713 - DNA, 25 bp, Mus musculus
gcttgctgtatgtccttcaggactt

SEQ ID NO: 33714 - DNA, 25 bp, Mus musculus
tgtatgtccttcaggacttcttgga

SEQ ID NO: 33715 - DNA, 25 bp, Mus musculus
ctttggattcaggtgatgtggagct

SEQ ID NO: 33716 - DNA, 25 bp, Mus musculus
tcagaaatcctgaaaccagtggctc

SEQ ID NO: 33717 - DNA, 25 bp, Mus musculus
atcctgaaaccagtggctctggtac

SEQ ID NO: 33718 - DNA, 25 bp, Mus musculus
aaaccagtggctctggtactcagta

SEQ ID NO: 33719 - DNA, 25 bp, Mus musculus
gtggctctggtactcagtagttagg

SEQ ID NO: 33720 - DNA, 25 bp, Mus musculus
ggtaccctgtgcttcttggtgcttt

SEQ ID NO: 33721 - DNA, 25 bp, Mus musculus
ggatttttctgctactggtaaatat

SEQ ID NO: 33722 - DNA, 25 bp, Mus musculus
gcgtgcatcattgtagtgtgtgcag

SEQ ID NO: 33723 - DNA, 25 bp, Mus musculus
ctactgatttcagctcttcagcagg

SEQ ID NO: 33724 - DNA, 25 bp, Mus musculus
atttcagctcttcagcaggacattc

SEQ ID NO: 33725 - DNA, 25 bp, Mus musculus
gctcttcagcaggacattctactct

SEQ ID NO: 33726 - DNA, 25 bp, Mus musculus
cagcaggacattctactctctttca

SEQ ID NO: 33727 - DNA, 25 bp, Mus musculus
gacattctactctctttcaagatta

SEQ ID NO: 33728 - DNA, 25 bp, Mus musculus
ctactctctttcaagattagtaatc

SEQ ID NO: 33729 - DNA, 25 bp, Mus musculus
taagcttagtctgttgcaagggaag

SEQ ID NO: 33730 - DNA, 25 bp, Mus musculus
tagtctgttgcaagggaaggtctat

SEQ ID NO: 33731 - DNA, 25 bp, Mus musculus
gtctcgagaagccaacccagagaag

SEQ ID NO: 33732 - DNA, 25 bp, Mus musculus
cagccgctttcggaataagatgttc

SEQ ID NO: 33733 - DNA, 25 bp, Mus musculus
accgcagtgcatcgtctttctgaat

SEQ ID NO: 33734 - DNA, 25 bp, Mus musculus
gtgcatcgtctttctgaatatcccc

SEQ ID NO: 33735 - DNA, 25 bp, Mus musculus
tctgaatatccccaggtactgtgca

SEQ ID NO: 33736 - DNA, 25 bp, Mus musculus
tatccccaggtactgtgcaggcacc

SEQ ID NO: 33737 - DNA, 25 bp, Mus musculus
gcaccatgacttcgagccccagagg

SEQ ID NO: 33738 - DNA, 25 bp, Mus musculus
tgacttcgagccccagaggcatgat

SEQ ID NO: 33739 - DNA, 25 bp, Mus musculus
cttcgagccccagaggcatgatgat

SEQ ID NO: 33740 - DNA, 25 bp, Mus musculus
cgagccccagaggcatgatgatggc

SEQ ID NO: 33741 - DNA, 25 bp, Mus musculus
gccccagaggcatgatgatggctac

SEQ ID NO: 33742 - DNA, 25 bp, Mus musculus
tgatgatggctacctggaggtcatc

SEQ ID NO: 33743 - DNA, 25 bp, Mus musculus
ctatgctgggacggccttctctgac

SEQ ID NO: 33744 - DNA, 25 bp, Mus musculus
tgatggctacctggaggtcatcggc

SEQ ID NO: 33745 - DNA, 25 bp, Mus musculus
ctctgacttcctgatgggcagctcc

SEQ ID NO: 33746 - DNA, 25 bp, Mus musculus
cttcctgatgggcagctccaaggac

SEQ ID NO: 33747 - DNA, 25 bp, Mus musculus
cttagccaagcacatccgagtagtg

SEQ ID NO: 33748 - DNA, 25 bp, Mus musculus
caagcacatccgagtagtgtgtgac

SEQ ID NO: 33749 - DNA, 25 bp, Mus musculus
catccgagtagtgtgtgacggaatg

SEQ ID NO: 33750 - DNA, 25 bp, Mus musculus
tcaggacctgaaaccgcagtgcatc

SEQ ID NO: 33751 - DNA, 25 bp, Mus musculus
cctgaaaccgcagtgcatcgtcttt

SEQ ID NO: 33752 - DNA, 25 bp, Mus musculus
aacatctgaatctgacatagtgttg

SEQ ID NO: 33753 - DNA, 25 bp, Mus musculus
ctgaagtcccagcacttgggaactg

SEQ ID NO: 33754 - DNA, 25 bp, Mus musculus
catctggtcatcattgcacaagaat

SEQ ID NO: 33755 - DNA, 25 bp, Mus musculus
gtcatcattgcacaagaatccacag

SEQ ID NO: 33756 - DNA, 25 bp, Mus musculus
caagaatccacagcccgttcccaga

SEQ ID NO: 33757 - DNA, 25 bp, Mus musculus
gcccgttcccagagctcatagccaa

SEQ ID NO: 33758 - DNA, 25 bp, Mus musculus
agtgtgttgctcattccttgaatat

SEQ ID NO: 33759 - DNA, 25 bp, Mus musculus
tttattctgtacctactattcatca

SEQ ID NO: 33760 - DNA, 25 bp, Mus musculus
ctgtacctactattcatcagacatt

SEQ ID NO: 33761 - DNA, 25 bp, Mus musculus
ctactattcatcagacatttggaat

SEQ ID NO: 33762 - DNA, 25 bp, Mus musculus
ttacatgacacagccttagccacta

SEQ ID NO: 33763 - DNA, 25 bp, Mus musculus
gctgccctggctgcagaagagcagg

SEQ ID NO: 33764 - DNA, 25 bp, Mus musculus
tcccagcacttgggaactgagactt

SEQ ID NO: 33765 - DNA, 25 bp, Mus musculus
agcaggtcgtctcgttccagtcgac

SEQ ID NO: 33766 - DNA, 25 bp, Mus musculus
tgatgatctcctgaagccaggtgtt

SEQ ID NO: 33767 - DNA, 25 bp, Mus musculus
catagcaagacctcagagaaatcaa

SEQ ID NO: 33768 - DNA, 25 bp, Mus musculus
aaatcaatgcagacatcttggtact

SEQ ID NO: 33769 - DNA, 25 bp, Mus musculus
atgcagacatcttggtactgatccc

SEQ ID NO: 33770 - DNA, 25 bp, Mus musculus
acatcttggtactgatccctaaaca

SEQ ID NO: 33771 - DNA, 25 bp, Mus musculus
acccgacatgagcatctggtcatca

SEQ ID NO: 33772 - DNA, 25 bp, Mus musculus
catgagcatctggtcatcattgcac

SEQ ID NO: 33773 - DNA, 25 bp, Mus musculus
ctgctgccatggcgctgggtagctc

SEQ ID NO: 33774 - DNA, 25 bp, Mus musculus
gtagctctctgcctgatgagtctgc

SEQ ID NO: 33775 - DNA, 25 bp, Mus musculus
aatatcacatctagcatccctggaa

SEQ ID NO: 33776 - DNA, 25 bp, Mus musculus
acatctagcatccctggaagtacca

SEQ ID NO: 33777 - DNA, 25 bp, Mus musculus
agcatccctggaagtaccagccact

SEQ ID NO: 33778 - DNA, 25 bp, Mus musculus
cctggaagtaccagccactacttga

SEQ ID NO: 33779 - DNA, 25 bp, Mus musculus
agccactacttgatctatcaggaca

SEQ ID NO: 33780 - DNA, 25 bp, Mus musculus
atctatcaggacagcagtaagacca

SEQ ID NO: 33781 - DNA, 25 bp, Mus musculus
agcagtaagaccacaccagccatct

SEQ ID NO: 33782 - DNA, 25 bp, Mus musculus
acaccagccatctcagagactatgg

SEQ ID NO: 33783 - DNA, 25 bp, Mus musculus
gccatctcagagactatggtcaact

SEQ ID NO: 33784 - DNA, 25 bp, Mus musculus
tctgggatcccttcaggctctggaa

SEQ ID NO: 33785 - DNA, 25 bp, Mus musculus
ctctgcctgatgagtctgctgcatc

SEQ ID NO: 33786 - DNA, 25 bp, Mus musculus
atcccttcaggctctggaactccac

SEQ ID NO: 33787 - DNA, 25 bp, Mus musculus
ctaaataacttgacttctgctacca

SEQ ID NO: 33788 - DNA, 25 bp, Mus musculus
aacttgacttctgctaccacggaga

SEQ ID NO: 33789 - DNA, 25 bp, Mus musculus
acttctgctaccacggagacttcta

SEQ ID NO: 33790 - DNA, 25 bp, Mus musculus
acggagacttctacacaaggaatat

SEQ ID NO: 33791 - DNA, 25 bp, Mus musculus
acttctacacaaggaatatccccat

SEQ ID NO: 33792 - DNA, 25 bp, Mus musculus
acacaaggaatatccccatcagttc

SEQ ID NO: 33793 - DNA, 25 bp, Mus musculus
cctaccaatgagtctgttgaggaaa

SEQ ID NO: 33794 - DNA, 25 bp, Mus musculus
gccccctggaagatggcctgttctt

SEQ ID NO: 33795 - DNA, 25 bp, Mus musculus
atggcctgttcttcccaggcagtga

SEQ ID NO: 33796 - DNA, 25 bp, Mus musculus
accccaagctttgtgatggacggtg

SEQ ID NO: 33797 - DNA, 25 bp, Mus musculus
gcagggacacactccggctggaggt

SEQ ID NO: 33798 - DNA, 25 bp, Mus musculus
acacactccggctggaggtagacac

SEQ ID NO: 33799 - DNA, 25 bp, Mus musculus
acaccacaggccgtttgccagagag

SEQ ID NO: 33800 - DNA, 25 bp, Mus musculus
ctggttctccagcacttctgcacct

SEQ ID NO: 33801 - DNA, 25 bp, Mus musculus
gcctgcccaagtcttcaactgctcg

SEQ ID NO: 33802 - DNA, 25 bp, Mus musculus
ggccagagctccctgcctaccgagg

SEQ ID NO: 33803 - DNA, 25 bp, Mus musculus
atgggccccctgtcaacgtgactgc

SEQ ID NO: 33804 - DNA, 25 bp, Mus musculus
cccctgtcaacgtgactgcttctgt

SEQ ID NO: 33805 - DNA, 25 bp, Mus musculus
tgactgcttctgtacaaatccaggg

SEQ ID NO: 33806 - DNA, 25 bp, Mus musculus
tgttcttcccaggcagtgagggagt

SEQ ID NO: 33807 - DNA, 25 bp, Mus musculus
ttgtcacattagagctccccaaggc

SEQ ID NO: 33808 - DNA, 25 bp, Mus musculus
cattagagctccccaaggccaagat

SEQ ID NO: 33809 - DNA, 25 bp, Mus musculus
tgccctatgtgagcctggagctaga

SEQ ID NO: 33810 - DNA, 25 bp, Mus musculus
atgtgagcctggagctagagatgcg

SEQ ID NO: 33811 - DNA, 25 bp, Mus musculus
agctagagatgcggcccttggcagc

SEQ ID NO: 33812 - DNA, 25 bp, Mus musculus
ggcccttggcagctgctggcctcat

SEQ ID NO: 33813 - DNA, 25 bp, Mus musculus
ctgctggcctcatcttccacctggg

SEQ ID NO: 33814 - DNA, 25 bp, Mus musculus
gctcttgcgacgaccagacagaaaa

SEQ ID NO: 33815 - DNA, 25 bp, Mus musculus
cttgcgacgaccagacagaaaactg

SEQ ID NO: 33816 - DNA, 25 bp, Mus musculus
ctgtcaagcaacttaagaggccata

SEQ ID NO: 33817 - DNA, 25 bp, Mus musculus
catatcatctacgatgaccattgca

SEQ ID NO: 33818 - DNA, 25 bp, Mus musculus
atctacgatgaccattgcaggaaaa

SEQ ID NO: 33819 - DNA, 25 bp, Mus musculus
caagtgtactacgcggacgatctgt

SEQ ID NO: 33820 - DNA, 25 bp, Mus musculus
gtgtactacgcggacgatctgtcac

SEQ ID NO: 33821 - DNA, 25 bp, Mus musculus
gacgatctgtcactagtagtaagcc

SEQ ID NO: 33822 - DNA, 25 bp, Mus musculus
agccgcttgggcttaacttacatct

SEQ ID NO: 33823 - DNA, 25 bp, Mus musculus
ttaacttacatctgtagtggaactc

SEQ ID NO: 33824 - DNA, 25 bp, Mus musculus
acttacatctgtagtggaactcctt

SEQ ID NO: 33825 - DNA, 25 bp, Mus musculus
agtggaactccttagtgcttgtagc

SEQ ID NO: 33826 - DNA, 25 bp, Mus musculus
ctaccctgagtccaatcaagagcct

SEQ ID NO: 33827 - DNA, 25 bp, Mus musculus
gtccaatcaagagcctggttaactg

SEQ ID NO: 33828 - DNA, 25 bp, Mus musculus
tcaagagcctggttaactgtcagca

SEQ ID NO: 33829 - DNA, 25 bp, Mus musculus
ttaactgtcagcaggaactgacacg

SEQ ID NO: 33830 - DNA, 25 bp, Mus musculus
ttcatcatgatcagtctgtcaagca

SEQ ID NO: 33831 - DNA, 25 bp, Mus musculus
atcatgatcagtctgtcaagcaact

SEQ ID NO: 33832 - DNA, 25 bp, Mus musculus
atgatcagtctgtcaagcaacttaa

SEQ ID NO: 33833 - DNA, 25 bp, Mus musculus
agtctgtcaagcaacttaagaggcc

SEQ ID NO: 33834 - DNA, 25 bp, Mus musculus
agctccacggcctgaatatcaacta

SEQ ID NO: 33835 - DNA, 25 bp, Mus musculus
tccacggcctgaatatcaactacaa

SEQ ID NO: 33836 - DNA, 25 bp, Mus musculus
tcatggcatgaggtgtttgggcatc

SEQ ID NO: 33837 - DNA, 25 bp, Mus musculus
gggcatcccaaacactgcccacttt

SEQ ID NO: 33838 - DNA, 25 bp, Mus musculus
cactgcccactttgcaaatgtgaca

SEQ ID NO: 33839 - DNA, 25 bp, Mus musculus
tgcccactttgcaaatgtgacacag

SEQ ID NO: 33840 - DNA, 25 bp, Mus musculus
tgaagatgctgtctccttgtgggcc

SEQ ID NO: 33841 - DNA, 25 bp, Mus musculus
ctccttgtgggccaagctgaaactg

SEQ ID NO: 33842 - DNA, 25 bp, Mus musculus
ggcttcagaacggtggcagcctgac

SEQ ID NO: 33843 - DNA, 25 bp, Mus musculus
ttcagaacggtggcagcctgacacc

SEQ ID NO: 33844 - DNA, 25 bp, Mus musculus
gcagcctgacaccgaggaagaatat

SEQ ID NO: 33845 - DNA, 25 bp, Mus musculus
gcctgacaccgaggaagaatatgaa

SEQ ID NO: 33846 - DNA, 25 bp, Mus musculus
tgaatatcaactacaactgtgagat

SEQ ID NO: 33847 - DNA, 25 bp, Mus musculus
atatcaactacaactgtgagatctg

SEQ ID NO: 33848 - DNA, 25 bp, Mus musculus
tcaactacaactgtgagatctgtgg

SEQ ID NO: 33849 - DNA, 25 bp, Mus musculus
ccaaggcttccagcggcactttgcg

SEQ ID NO: 33850 - DNA, 25 bp, Mus musculus
aggcttccagcggcactttgcggag

SEQ ID NO: 33851 - DNA, 25 bp, Mus musculus
gcactttgcggagtggcgtcatgct

SEQ ID NO: 33852 - DNA, 25 bp, Mus musculus
tcatgctcatggcatgaggtgtttg

SEQ ID NO: 33853 - DNA, 25 bp, Mus musculus
tgctcatggcatgaggtgtttgggc

SEQ ID NO: 33854 - DNA, 25 bp, Mus musculus
tgcacgacgcagcgcgggaaggctt

SEQ ID NO: 33855 - DNA, 25 bp, Mus musculus
aaggcttcctggacacgctggtggt

SEQ ID NO: 33856 - DNA, 25 bp, Mus musculus
acgggcatagcttcagctcaagcac

SEQ ID NO: 33857 - DNA, 25 bp, Mus musculus
gcttcagctcaagcacgcccagggc

SEQ ID NO: 33858 - DNA, 25 bp, Mus musculus
gcggccaatcccaagagcagagcta

SEQ ID NO: 33859 - DNA, 25 bp, Mus musculus
gccaatcccaagagcagagctaaat

SEQ ID NO: 33860 - DNA, 25 bp, Mus musculus
tttcttcttagcttcacttctagcg

SEQ ID NO: 33861 - DNA, 25 bp, Mus musculus
cttcttagcttcacttctagcgatg

SEQ ID NO: 33862 - DNA, 25 bp, Mus musculus
acttctagcgatgctagcgtgtcta

SEQ ID NO: 33863 - DNA, 25 bp, Mus musculus
tctagcgatgctagcgtgtctagca

SEQ ID NO: 33864 - DNA, 25 bp, Mus musculus
gctagcgtgtctagcatgtggcttt

SEQ ID NO: 33865 - DNA, 25 bp, Mus musculus
agcgtgtctagcatgtggctttaaa

SEQ ID NO: 33866 - DNA, 25 bp, Mus musculus
acacgctggtggtgctgcacgggtc

SEQ ID NO: 33867 - DNA, 25 bp, Mus musculus
tgccgctcgacttggcccaagagcg

SEQ ID NO: 33868 - DNA, 25 bp, Mus musculus
gacatcaagacatcgtgcgatattt

SEQ ID NO: 33869 - DNA, 25 bp, Mus musculus
aagacatcgtgcgatatttgcgttc

SEQ ID NO: 33870 - DNA, 25 bp, Mus musculus
gatatttgcgttccgctgggtgctc

SEQ ID NO: 33871 - DNA, 25 bp, Mus musculus
acgtcgcccagaccgacgggcatag

SEQ ID NO: 33872 - DNA, 25 bp, Mus musculus
tcgcccagaccgacgggcatagctt

SEQ ID NO: 33873 - DNA, 25 bp, Mus musculus
agaccgacgggcatagcttcagctc

SEQ ID NO: 33874 - DNA, 25 bp, Mus musculus
atcctatgactatcaggcagcctgt

SEQ ID NO: 33875 - DNA, 25 bp, Mus musculus
tgactatcaggcagcctgtgcccct

SEQ ID NO: 33876 - DNA, 25 bp, Mus musculus
ccagcagctactctatggtctcatc

SEQ ID NO: 33877 - DNA, 25 bp, Mus musculus
gctactctatggtctcatctatcac

SEQ ID NO: 33878 - DNA, 25 bp, Mus musculus
ctatggtctcatctatcacagctgg

SEQ ID NO: 33879 - DNA, 25 bp, Mus musculus
tctcatctatcacagctggttccag

SEQ ID NO: 33880 - DNA, 25 bp, Mus musculus
ctatcacagctggttccaggcagac

SEQ ID NO: 33881 - DNA, 25 bp, Mus musculus
cagctggttccaggcagacccggca

SEQ ID NO: 33882 - DNA, 25 bp, Mus musculus
cagccccgagacgcgcgagacagct

SEQ ID NO: 33883 - DNA, 25 bp, Mus musculus
atgaaacagacccagtactacttcg

SEQ ID NO: 33884 - DNA, 25 bp, Mus musculus
cagacccagtactacttcggctcgg

SEQ ID NO: 33885 - DNA, 25 bp, Mus musculus
cagtactacttcggctcggtgaacg

SEQ ID NO: 33886 - DNA, 25 bp, Mus musculus
tgtctttgtgcccaccattgcagat

SEQ ID NO: 33887 - DNA, 25 bp, Mus musculus
tacttcggctcggtgaacgcatcct

SEQ ID NO: 33888 - DNA, 25 bp, Mus musculus
tgtgcccaccattgcagatttcctt

SEQ ID NO: 33889 - DNA, 25 bp, Mus musculus
caccattgcagatttccttaacttg

SEQ ID NO: 33890 - DNA, 25 bp, Mus musculus
tgcagatttccttaacttggcctgg

SEQ ID NO: 33891 - DNA, 25 bp, Mus musculus
taacttggcctggtggacctctgct

SEQ ID NO: 33892 - DNA, 25 bp, Mus musculus
tgccgcctggtccttattccagcag

SEQ ID NO: 33893 - DNA, 25 bp, Mus musculus
ctggtccttattccagcagctactc

SEQ ID NO: 33894 - DNA, 25 bp, Mus musculus
cttattccagcagctactctatggt

SEQ ID NO: 33895 - DNA, 25 bp, Mus musculus
attaatcagctgttgcaggcagtgt

SEQ ID NO: 33896 - DNA, 25 bp, Mus musculus
cagctgttgcaggcagtgtcttaag

SEQ ID NO: 33897 - DNA, 25 bp, Mus musculus
ttcctgttttatgcagctcaaaaaa

SEQ ID NO: 33898 - DNA, 25 bp, Mus musculus
ttgactttgtttctcagcaaagcat

SEQ ID NO: 33899 - DNA, 25 bp, Mus musculus
ttgtttctcagcaaagcattggtca

SEQ ID NO: 33900 - DNA, 25 bp, Mus musculus
ttccatagtcccaccttggagcatt

SEQ ID NO: 33901 - DNA, 25 bp, Mus musculus
agtcccaccttggagcatttatgta

SEQ ID NO: 33902 - DNA, 25 bp, Mus musculus
ttagtgcgaggtggcatgcatataa

SEQ ID NO: 33903 - DNA, 25 bp, Mus musculus
cttgtcaatagcctttttctatcaa

SEQ ID NO: 33904 - DNA, 25 bp, Mus musculus
taacagtcatggcacactgtgtcct

SEQ ID NO: 33905 - DNA, 25 bp, Mus musculus
cacactgtgtcctatcttagcattt

SEQ ID NO: 33906 - DNA, 25 bp, Mus musculus
gtgtcctatcttagcatttaaaagt

SEQ ID NO: 33907 - DNA, 25 bp, Mus musculus
ttgcaggcagtgtcttaaggagact

SEQ ID NO: 33908 - DNA, 25 bp, Mus musculus
gaagcctaactgtcacatcaagcat

SEQ ID NO: 33909 - DNA, 25 bp, Mus musculus
taactgtcacatcaagcatcatcgt

SEQ ID NO: 33910 - DNA, 25 bp, Mus musculus
tcacatcaagcatcatcgtccccat

SEQ ID NO: 33911 - DNA, 25 bp, Mus musculus
caagcatcatcgtccccatgcaaca

SEQ ID NO: 33912 - DNA, 25 bp, Mus musculus
catcaccttatacatcacttcctgt

SEQ ID NO: 33913 - DNA, 25 bp, Mus musculus
cttatacatcacttcctgttttatg

SEQ ID NO: 33914 - DNA, 25 bp, Mus musculus
catcacttcctgttttatgcagctc

SEQ ID NO: 33915 - DNA, 25 bp, Mus musculus
actgaatcctgaacagaaattcttg

SEQ ID NO: 33916 - DNA, 25 bp, Mus musculus
ggttccaattcaaggcgccaggcat

SEQ ID NO: 33917 - DNA, 25 bp, Mus musculus
tgttgttattggcccagggtatcgg

SEQ ID NO: 33918 - DNA, 25 bp, Mus musculus
tattggcccagggtatcggcaggat

SEQ ID NO: 33919 - DNA, 25 bp, Mus musculus
attggcccagggtatcggcaggatc

SEQ ID NO: 33920 - DNA, 25 bp, Mus musculus
ttggcccagggtatcggcaggatct

SEQ ID NO: 33921 - DNA, 25 bp, Mus musculus
ggatctggacagggggctttataag

SEQ ID NO: 33922 - DNA, 25 bp, Mus musculus
tacattccgtaccttaagattggat

SEQ ID NO: 33923 - DNA, 25 bp, Mus musculus
acattccgtaccttaagattggatg

SEQ ID NO: 33924 - DNA, 25 bp, Mus musculus
cattccgtaccttaagattggatga

SEQ ID NO: 33925 - DNA, 25 bp, Mus musculus
attccgtaccttaagattggatgat

SEQ ID NO: 33926 - DNA, 25 bp, Mus musculus
ttccgtaccttaagattggatgatc

SEQ ID NO: 33927 - DNA, 25 bp, Mus musculus
gttccaattcaaggcgccaggcatc

SEQ ID NO: 33928 - DNA, 25 bp, Mus musculus
ttccaattcaaggcgccaggcatct

SEQ ID NO: 33929 - DNA, 25 bp, Mus musculus
tccaattcaaggcgccaggcatctg

SEQ ID NO: 33930 - DNA, 25 bp, Mus musculus
ccaggcatctggggaacctgttgtt

SEQ ID NO: 33931 - DNA, 25 bp, Mus musculus
ggcatctggggaacctgttgttatt

SEQ ID NO: 33932 - DNA, 25 bp, Mus musculus
gcatctggggaacctgttgttattg

SEQ ID NO: 33933 - DNA, 25 bp, Mus musculus
catctggggaacctgttgttattgg

SEQ ID NO: 33934 - DNA, 25 bp, Mus musculus
ctgttgttattggcccagggtatcg

SEQ ID NO: 33935 - DNA, 25 bp, Mus musculus
tataactgtctcctctgggtctgca

SEQ ID NO: 33936 - DNA, 25 bp, Mus musculus
attctgacaaggattccttaatctt

SEQ ID NO: 33937 - DNA, 25 bp, Mus musculus
atgggcctggcatactgtgcctaag

SEQ ID NO: 33938 - DNA, 25 bp, Mus musculus
ggcctggcatactgtgcctaagcac

SEQ ID NO: 33939 - DNA, 25 bp, Mus musculus
tggcatactgtgcctaagcacacag

SEQ ID NO: 33940 - DNA, 25 bp, Mus musculus
gcatactgtgcctaagcacacaggg

SEQ ID NO: 33941 - DNA, 25 bp, Mus musculus
tactgtgcctaagcacacagggggt

SEQ ID NO: 33942 - DNA, 25 bp, Mus musculus
actgtgcctaagcacacagggggtc

SEQ ID NO: 33943 - DNA, 25 bp, Mus musculus
tgtgcctaagcacacagggggtcta

SEQ ID NO: 33944 - DNA, 25 bp, Mus musculus
gtgcctaagcacacagggggtctaa

SEQ ID NO: 33945 - DNA, 25 bp, Mus musculus
cctaagcacacagggggtctaacag

SEQ ID NO: 33946 - DNA, 25 bp, Mus musculus
taagcacacagggggtctaacagta

SEQ ID NO: 33947 - DNA, 25 bp, Mus musculus
atcttcccagtgaacatcttcatgg

SEQ ID NO: 33948 - DNA, 25 bp, Mus musculus
tcccagtgaacatcttcatgggcct

SEQ ID NO: 33949 - DNA, 25 bp, Mus musculus
gtgaacatcttcatgggcctggcat

SEQ ID NO: 33950 - DNA, 25 bp, Mus musculus
tgaacatcttcatgggcctggcata

SEQ ID NO: 33951 - DNA, 25 bp, Mus musculus
aacatcttcatgggcctggcatact

SEQ ID NO: 33952 - DNA, 25 bp, Mus musculus
acatcttcatgggcctggcatactg

SEQ ID NO: 33953 - DNA, 25 bp, Mus musculus
tcttcatgggcctggcatactgtgc

SEQ ID NO: 33954 - DNA, 25 bp, Mus musculus
ttcatgggcctggcatactgtgcct

SEQ ID NO: 33955 - DNA, 25 bp, Mus musculus
ttccgttgcttgttcttcaagcagc

SEQ ID NO: 33956 - DNA, 25 bp, Mus musculus
tccgttgcttgttcttcaagcagca

SEQ ID NO: 33957 - DNA, 25 bp, Mus musculus
tgttcttcaagcagcacaaaatcaa

SEQ ID NO: 33958 - DNA, 25 bp, Mus musculus
gttcttcaagcagcacaaaatcaac

SEQ ID NO: 33959 - DNA, 25 bp, Mus musculus
ttcttcaagcagcacaaaatcaacg

SEQ ID NO: 33960 - DNA, 25 bp, Mus musculus
tcttcaagcagcacaaaatcaacgg

SEQ ID NO: 33961 - DNA, 25 bp, Mus musculus
cttcaagcagcacaaaatcaacggt

SEQ ID NO: 33962 - DNA, 25 bp, Mus musculus
ttcaagcagcacaaaatcaacggtt

SEQ ID NO: 33963 - DNA, 25 bp, Mus musculus
tcaagcagcacaaaatcaacggttc

SEQ ID NO: 33964 - DNA, 25 bp, Mus musculus
caagcagcacaaaatcaacggttct

SEQ ID NO: 33965 - DNA, 25 bp, Mus musculus
aagcagcacaaaatcaacggttctt

SEQ ID NO: 33966 - DNA, 25 bp, Mus musculus
agcagcacaaaatcaacggttcttt

SEQ ID NO: 33967 - DNA, 25 bp, Mus musculus
ccgttgcttgttcttcaagcagcac

SEQ ID NO: 33968 - DNA, 25 bp, Mus musculus
cgttgcttgttcttcaagcagcaca

SEQ ID NO: 33969 - DNA, 25 bp, Mus musculus
gttgcttgttcttcaagcagcacaa

SEQ ID NO: 33970 - DNA, 25 bp, Mus musculus
ttgcttgttcttcaagcagcacaaa

SEQ ID NO: 33971 - DNA, 25 bp, Mus musculus
tgcttgttcttcaagcagcacaaaa

SEQ ID NO: 33972 - DNA, 25 bp, Mus musculus
gcttgttcttcaagcagcacaaaat

SEQ ID NO: 33973 - DNA, 25 bp, Mus musculus
cttgttcttcaagcagcacaaaatc

SEQ ID NO: 33974 - DNA, 25 bp, Mus musculus
ttgttcttcaagcagcacaaaatca

SEQ ID NO: 33975 - DNA, 25 bp, Mus musculus
cctgatgcatgtcatgcagaagagg

SEQ ID NO: 33976 - DNA, 25 bp, Mus musculus
agtcatccattcctcagatgaaggg

SEQ ID NO: 33977 - DNA, 25 bp, Mus musculus
atacccaatctaaagtacacatgac

SEQ ID NO: 33978 - DNA, 25 bp, Mus musculus
aagtacacatgacgtcacctttcac

SEQ ID NO: 33979 - DNA, 25 bp, Mus musculus
acatgacgtcacctttcacctctca

SEQ ID NO: 33980 - DNA, 25 bp, Mus musculus
ctttcacctctcataactcagggat

SEQ ID NO: 33981 - DNA, 25 bp, Mus musculus
cctctcataactcagggatgaaaca

SEQ ID NO: 33982 - DNA, 25 bp, Mus musculus
tgtgttcattcacatcctaaatgag

SEQ ID NO: 33983 - DNA, 25 bp, Mus musculus
cattcacatcctaaatgagtagttt

SEQ ID NO: 33984 - DNA, 25 bp, Mus musculus
agtcccttttggctttgatcttgct

SEQ ID NO: 33985 - DNA, 25 bp, Mus musculus
tattgagcctttcacaagtatgatc

SEQ ID NO: 33986 - DNA, 25 bp, Mus musculus
gcctttcacaagtatgatctattat

SEQ ID NO: 33987 - DNA, 25 bp, Mus musculus
tcagaccggcgaggatgaagaggat

SEQ ID NO: 33988 - DNA, 25 bp, Mus musculus
tgactaaagtcatcttccttccagc

SEQ ID NO: 33989 - DNA, 25 bp, Mus musculus
aagtcatcttccttccagcaagcca

SEQ ID NO: 33990 - DNA, 25 bp, Mus musculus
tcttccttccagcaagccagttcct

SEQ ID NO: 33991 - DNA, 25 bp, Mus musculus
cactcactctgccatctagattctg

SEQ ID NO: 33992 - DNA, 25 bp, Mus musculus
catctagattctgctcccgctggca

SEQ ID NO: 33993 - DNA, 25 bp, Mus musculus
gattctgctcccgctggcagcttcc

SEQ ID NO: 33994 - DNA, 25 bp, Mus musculus
gctggcagcttcccaattcacctgt

SEQ ID NO: 33995 - DNA, 25 bp, Mus musculus
atgattgtctgtaaccaggtgatga

SEQ ID NO: 33996 - DNA, 25 bp, Mus musculus
gattgtctgtaaccaggtgatgaag

SEQ ID NO: 33997 - DNA, 25 bp, Mus musculus
tctgctgttcaaacacaaggagcag

SEQ ID NO: 33998 - DNA, 25 bp, Mus musculus
ctgctgttcaaacacaaggagcagc

SEQ ID NO: 33999 - DNA, 25 bp, Mus musculus
caaacacaaggagcagctcaaagct

SEQ ID NO: 34000 - DNA, 25 bp, Mus musculus
ctcaaagctgagatcctgagaaaga

SEQ ID NO: 34001 - DNA, 25 bp, Mus musculus
aagagagcgctcctggacaaagagt

SEQ ID NO: 34002 - DNA, 25 bp, Mus musculus
gagagcgctcctggacaaagagttg

SEQ ID NO: 34003 - DNA, 25 bp, Mus musculus
agagcgctcctggacaaagagttgc

SEQ ID NO: 34004 - DNA, 25 bp, Mus musculus
agcgctcctggacaaagagttgcag

SEQ ID NO: 34005 - DNA, 25 bp, Mus musculus
gttgcagatccaagtgcaggaagag

SEQ ID NO: 34006 - DNA, 25 bp, Mus musculus
ttgcagatccaagtgcaggaagagc

SEQ ID NO: 34007 - DNA, 25 bp, Mus musculus
attgtctgtaaccaggtgatgaagt

SEQ ID NO: 34008 - DNA, 25 bp, Mus musculus
tgtctgtaaccaggtgatgaagtat

SEQ ID NO: 34009 - DNA, 25 bp, Mus musculus
agcaagctctctgctctgctgttca

SEQ ID NO: 34010 - DNA, 25 bp, Mus musculus
caagctctctgctctgctgttcaaa

SEQ ID NO: 34011 - DNA, 25 bp, Mus musculus
aagctctctgctctgctgttcaaac

SEQ ID NO: 34012 - DNA, 25 bp, Mus musculus
gctctctgctctgctgttcaaacac

SEQ ID NO: 34013 - DNA, 25 bp, Mus musculus
ctctctgctctgctgttcaaacaca

SEQ ID NO: 34014 - DNA, 25 bp, Mus musculus
tctgctctgctgttcaaacacaagg

SEQ ID NO: 34015 - DNA, 25 bp, Mus musculus
ccctatcatcgtctcctgcggatgg

SEQ ID NO: 34016 - DNA, 25 bp, Mus musculus
ctcctgcggatgggacaagctggtc

SEQ ID NO: 34017 - DNA, 25 bp, Mus musculus
caatgccttgtgcttcagccccaac

SEQ ID NO: 34018 - DNA, 25 bp, Mus musculus
tggccccagcatcaagatctgggac

SEQ ID NO: 34019 - DNA, 25 bp, Mus musculus
agaagttatcagcaccagcagcaag

SEQ ID NO: 34020 - DNA, 25 bp, Mus musculus
caccagcagcaaggcagagccaccc

SEQ ID NO: 34021 - DNA, 25 bp, Mus musculus
tttggcatggtctgctgatggccag

SEQ ID NO: 34022 - DNA, 25 bp, Mus musculus
atggtctgctgatggccagactctg

SEQ ID NO: 34023 - DNA, 25 bp, Mus musculus
tgctgatggccagactctgtttgct

SEQ ID NO: 34024 - DNA, 25 bp, Mus musculus
gactctgtttgctggctatacagac

SEQ ID NO: 34025 - DNA, 25 bp, Mus musculus
tggctatacagacaacttggtgcga

SEQ ID NO: 34026 - DNA, 25 bp, Mus musculus
tacagacaacttggtgcgagtatgg

SEQ ID NO: 34027 - DNA, 25 bp, Mus musculus
cattggccacactggctacctgaac

SEQ ID NO: 34028 - DNA, 25 bp, Mus musculus
ccacactggctacctgaacacagtg

SEQ ID NO: 34029 - DNA, 25 bp, Mus musculus
tggctacctgaacacagtgactgtc

SEQ ID NO: 34030 - DNA, 25 bp, Mus musculus
cacagtgactgtctctccagatgga

SEQ ID NO: 34031 - DNA, 25 bp, Mus musculus
gactgtctctccagatggatccctc

SEQ ID NO: 34032 - DNA, 25 bp, Mus musculus
agatggatccctctgtgcttctgga

SEQ ID NO: 34033 - DNA, 25 bp, Mus musculus
tatgctgtgggatctcaatgaaggc

SEQ ID NO: 34034 - DNA, 25 bp, Mus musculus
tgaaggcaagcacctctacacttta

SEQ ID NO: 34035 - DNA, 25 bp, Mus musculus
atactctgggtgtctgcaagtacac

SEQ ID NO: 34036 - DNA, 25 bp, Mus musculus
tactctgggtgtctgcaagtacacg

SEQ ID NO: 34037 - DNA, 25 bp, Mus musculus
gctgccactggccccagcatcaaga

SEQ ID NO: 34038 - DNA, 25 bp, Mus musculus
ccactggccccagcatcaagatctg

SEQ ID NO: 34039 - DNA, 25 bp, Mus musculus
cactggccccagcatcaagatctgg

SEQ ID NO: 34040 - DNA, 25 bp, Mus musculus
atactctgggtgtctgcaagtacac

SEQ ID NO: 34041 - DNA, 25 bp, Mus musculus
tactctgggtgtctgcaagtacacg

SEQ ID NO: 34042 - DNA, 25 bp, Mus musculus
gcagagccaccccagtgtacctctt

SEQ ID NO: 34043 - DNA, 25 bp, Mus musculus
agagccaccccagtgtacctctttg

SEQ ID NO: 34044 - DNA, 25 bp, Mus musculus
ccttgtgcttcagccccaaccgcta

SEQ ID NO: 34045 - DNA, 25 bp, Mus musculus
cttgtgcttcagccccaaccgctac

SEQ ID NO: 34046 - DNA, 25 bp, Mus musculus
gctgccactggccccagcatcaaga

SEQ ID NO: 34047 - DNA, 25 bp, Mus musculus
ccactggccccagcatcaagatctg

SEQ ID NO: 34048 - DNA, 25 bp, Mus musculus
cactggccccagcatcaagatctgg

SEQ ID NO: 34049 - DNA, 25 bp, Mus musculus
ctggccccagcatcaagatctggga

SEQ ID NO: 34050 - DNA, 25 bp, Mus musculus
agcaaggcagagccaccccagtgta

SEQ ID NO: 34051 - DNA, 25 bp, Mus musculus
aaggcagagccaccccagtgtacct

SEQ ID NO: 34052 - DNA, 25 bp, Mus musculus
agcctagaggaccccactgtccaat

SEQ ID NO: 34053 - DNA, 25 bp, Mus musculus
actttattgtcccagatcttgagaa

SEQ ID NO: 34054 - DNA, 25 bp, Mus musculus
catggtccacatatcctcttcctgc

SEQ ID NO: 34055 - DNA, 25 bp, Mus musculus
ttcctgcctatcactggttccttgg

SEQ ID NO: 34056 - DNA, 25 bp, Mus musculus
tccttggtaactatcttcatggcta

SEQ ID NO: 34057 - DNA, 25 bp, Mus musculus
gtaactatcttcatggctaccttaa

SEQ ID NO: 34058 - DNA, 25 bp, Mus musculus
atggcccagcagttaggagcaacgg

SEQ ID NO: 34059 - DNA, 25 bp, Mus musculus
gcaacggctactcctccagagaacc

SEQ ID NO: 34060 - DNA, 25 bp, Mus musculus
cttggttcagcccacagctgtctgt

SEQ ID NO: 34061 - DNA, 25 bp, Mus musculus
cagttccaggacacctgacactttc

SEQ ID NO: 34062 - DNA, 25 bp, Mus musculus
acctgacactttcacacatacagta

SEQ ID NO: 34063 - DNA, 25 bp, Mus musculus
cactttcacacatacagtaggcaaa

SEQ ID NO: 34064 - DNA, 25 bp, Mus musculus
ttgtcccagatcttgagaagtgttc

SEQ ID NO: 34065 - DNA, 25 bp, Mus musculus
ggctctaggctccaggcacttactg

SEQ ID NO: 34066 - DNA, 25 bp, Mus musculus
aggctccaggcacttactgcccatg

SEQ ID NO: 34067 - DNA, 25 bp, Mus musculus
cttactgcccatggtgacaactata

SEQ ID NO: 34068 - DNA, 25 bp, Mus musculus
gctgtctgcccaccttggtgaaaag

SEQ ID NO: 34069 - DNA, 25 bp, Mus musculus
gctttcaggacctcagccagttgat

SEQ ID NO: 34070 - DNA, 25 bp, Mus musculus
aggacctcagccagttgatgagcag

SEQ ID NO: 34071 - DNA, 25 bp, Mus musculus
ggcaagacatcagccacacatggtc

SEQ ID NO: 34072 - DNA, 25 bp, Mus musculus
tggtagcagcctgagcttctctgcc

SEQ ID NO: 34073 - DNA, 25 bp, Mus musculus
ccctttgtcgcagagcagtaagcaa

SEQ ID NO: 34074 - DNA, 25 bp, Mus musculus
tcaggactgtctgccaagctgacaa

SEQ ID NO: 34075 - DNA, 25 bp, Mus musculus
gccaagctgacaagcacagcacaga

SEQ ID NO: 34076 - DNA, 25 bp, Mus musculus
ctgacaagcacagcacagactggag

SEQ ID NO: 34077 - DNA, 25 bp, Mus musculus
agcacagcacagactggagtctgca

SEQ ID NO: 34078 - DNA, 25 bp, Mus musculus
gtctgcaacaccgtgttagctgctc

SEQ ID NO: 34079 - DNA, 25 bp, Mus musculus
gctgctctcactgagcatcccatga

SEQ ID NO: 34080 - DNA, 25 bp, Mus musculus
gaccctggcctgtcacaggagagaa

SEQ ID NO: 34081 - DNA, 25 bp, Mus musculus
tgctgctggccaaataccaaagata

SEQ ID NO: 34082 - DNA, 25 bp, Mus musculus
tggccaaataccaaagataggctgc

SEQ ID NO: 34083 - DNA, 25 bp, Mus musculus
atactgccattctaggtagagtttt

SEQ ID NO: 34084 - DNA, 25 bp, Mus musculus
tccattccttggacctgtctcctac

SEQ ID NO: 34085 - DNA, 25 bp, Mus musculus
cactcccaggttggagcctaggcac

SEQ ID NO: 34086 - DNA, 25 bp, Mus musculus
taggcaccctgccgttacactcttc

SEQ ID NO: 34087 - DNA, 25 bp, Mus musculus
ccctgccgttacactcttctgttct

SEQ ID NO: 34088 - DNA, 25 bp, Mus musculus
actcttctgttctgtaagagtcctt

SEQ ID NO: 34089 - DNA, 25 bp, Mus musculus
tgtaagagtccttccctgtcaggac

SEQ ID NO: 34090 - DNA, 25 bp, Mus musculus
agtccttccctgtcaggactgtctg

SEQ ID NO: 34091 - DNA, 25 bp, Mus musculus
tccctgtcaggactgtctgccaagc

SEQ ID NO: 34092 - DNA, 25 bp, Mus musculus
gggctctgtcagctccctaaactcc

SEQ ID NO: 34093 - DNA, 25 bp, Mus musculus
ctcctccagctccggggatcaagat

SEQ ID NO: 34094 - DNA, 25 bp, Mus musculus
cggcatctcggtagccacagccacg

SEQ ID NO: 34095 - DNA, 25 bp, Mus musculus
ggtagccacagccacgtactgcgaa

SEQ ID NO: 34096 - DNA, 25 bp, Mus musculus
agccacagccacgtactgcgaaggg

SEQ ID NO: 34097 - DNA, 25 bp, Mus musculus
agccacgtactgcgaagggagagcc

SEQ ID NO: 34098 - DNA, 25 bp, Mus musculus
cagaggcacagccctaacttgaatt

SEQ ID NO: 34099 - DNA, 25 bp, Mus musculus
aggcacagccctaacttgaatttct

SEQ ID NO: 34100 - DNA, 25 bp, Mus musculus
ttgaatttcttaccacaaaagcact

SEQ ID NO: 34101 - DNA, 25 bp, Mus musculus
ttttgacatgacagtccctactcag

SEQ ID NO: 34102 - DNA, 25 bp, Mus musculus
tgacatgacagtccctactcagagt

SEQ ID NO: 34103 - DNA, 25 bp, Mus musculus
agtccctactcagagtactgaagag

SEQ ID NO: 34104 - DNA, 25 bp, Mus musculus
ctccagctccggggatcaagattac

SEQ ID NO: 34105 - DNA, 25 bp, Mus musculus
accaccaatgcaagaagggcactgg

SEQ ID NO: 34106 - DNA, 25 bp, Mus musculus
gcactggaggcgagcagcagaactg

SEQ ID NO: 34107 - DNA, 25 bp, Mus musculus
agaactgagccgaggtgccagcgcc

SEQ ID NO: 34108 - DNA, 25 bp, Mus musculus
cccatgtggagctctgcagtatgga

SEQ ID NO: 34109 - DNA, 25 bp, Mus musculus
atgtggagctctgcagtatggacat

SEQ ID NO: 34110 - DNA, 25 bp, Mus musculus
ccatcatcactgcggcatctcggta

SEQ ID NO: 34111 - DNA, 25 bp, Mus musculus
ctgcggcatctcggtagccacagcc

SEQ ID NO: 34112 - DNA, 25 bp, Mus musculus
gtggcttctctgccccagcaggacc

SEQ ID NO: 34113 - DNA, 25 bp, Mus musculus
ctgccccagcaggaccagactctgt

SEQ ID NO: 34114 - DNA, 25 bp, Mus musculus
attcttcatggagtggactccttcg

SEQ ID NO: 34115 - DNA, 25 bp, Mus musculus
tccttcgtgatccgcgaatgcgcct

SEQ ID NO: 34116 - DNA, 25 bp, Mus musculus
gcccgggtgtccatgtatgtggact

SEQ ID NO: 34117 - DNA, 25 bp, Mus musculus
gtgtccatgtatgtggactggattc

SEQ ID NO: 34118 - DNA, 25 bp, Mus musculus
ggtgcccttctgcgctccaggcagc

SEQ ID NO: 34119 - DNA, 25 bp, Mus musculus
cgctccaggcagcctaaagctgggg

SEQ ID NO: 34120 - DNA, 25 bp, Mus musculus
cctaaagctggggcgaccagcaggc

SEQ ID NO: 34121 - DNA, 25 bp, Mus musculus
cagctctgttccctattccatatga

SEQ ID NO: 34122 - DNA, 25 bp, Mus musculus
ctctgttccctattccatatgacct

SEQ ID NO: 34123 - DNA, 25 bp, Mus musculus
tgttccctattccatatgacctcaa

SEQ ID NO: 34124 - DNA, 25 bp, Mus musculus
acgccccgtgtgctgcaggaactga

SEQ ID NO: 34125 - DNA, 25 bp, Mus musculus
gtcaccttcctatgccgggaacaca

SEQ ID NO: 34126 - DNA, 25 bp, Mus musculus
tgccgggaacacaacgtgtgcacgc

SEQ ID NO: 34127 - DNA, 25 bp, Mus musculus
ggcggccccttgatctgcaatggca

SEQ ID NO: 34128 - DNA, 25 bp, Mus musculus
cccttgatctgcaatggcattcttc

SEQ ID NO: 34129 - DNA, 25 bp, Mus musculus
ttgatctgcaatggcattcttcatg

SEQ ID NO: 34130 - DNA, 25 bp, Mus musculus
atctgcaatggcattcttcatggag

SEQ ID NO: 34131 - DNA, 25 bp, Mus musculus
ggcattcttcatggagtggactcct

SEQ ID NO: 34132 - DNA, 25 bp, Mus musculus
ccattcactgtgaagatcagtggcg

SEQ ID NO: 34133 - DNA, 25 bp, Mus musculus
atctgtgacctgaacctgaagatcc

SEQ ID NO: 34134 - DNA, 25 bp, Mus musculus
ccctctggccatgtcactgaggcag

SEQ ID NO: 34135 - DNA, 25 bp, Mus musculus
ggccatgtcactgaggcagagattg

SEQ ID NO: 34136 - DNA, 25 bp, Mus musculus
catgtcactgaggcagagattgtgc

SEQ ID NO: 34137 - DNA, 25 bp, Mus musculus
gagattgtgcccatgggaaagaact

SEQ ID NO: 34138 - DNA, 25 bp, Mus musculus
aactctcactgtgtcagatttgtgc

SEQ ID NO: 34139 - DNA, 25 bp, Mus musculus
tctcactgtgtcagatttgtgcgcc

SEQ ID NO: 34140 - DNA, 25 bp, Mus musculus
gtcagatttgtgcgccaggagatgg

SEQ ID NO: 34141 - DNA, 25 bp, Mus musculus
atgggcgttcacactgtcagcgtaa

SEQ ID NO: 34142 - DNA, 25 bp, Mus musculus
ggcgttcacactgtcagcgtaaagt

SEQ ID NO: 34143 - DNA, 25 bp, Mus musculus
gttcacactgtcagcgtaaagtacc

SEQ ID NO: 34144 - DNA, 25 bp, Mus musculus
tgtgacctgaacctgaagatcccgg

SEQ ID NO: 34145 - DNA, 25 bp, Mus musculus
gacctgaacctgaagatcccggaga

SEQ ID NO: 34146 - DNA, 25 bp, Mus musculus
aacctgaagatcccggagatcaaca

SEQ ID NO: 34147 - DNA, 25 bp, Mus musculus
aagatcccggagatcaacagcagta

SEQ ID NO: 34148 - DNA, 25 bp, Mus musculus
atcaacagcagtagcatgtctgccc

SEQ ID NO: 34149 - DNA, 25 bp, Mus musculus
agcagtagcatgtctgcccatgtca

SEQ ID NO: 34150 - DNA, 25 bp, Mus musculus
agcatgtctgcccatgtcaccagcc

SEQ ID NO: 34151 - DNA, 25 bp, Mus musculus
agcccctctggccatgtcactgagg

SEQ ID NO: 34152 - DNA, 25 bp, Mus musculus
ccatgccctgcaataccatagcatt

SEQ ID NO: 34153 - DNA, 25 bp, Mus musculus
cctgcaataccatagcattgtgacc

SEQ ID NO: 34154 - DNA, 25 bp, Mus musculus
catccacatgttcttacttgcccgc

SEQ ID NO: 34155 - DNA, 25 bp, Mus musculus
ctcccatgctaggaagatctctacc

SEQ ID NO: 34156 - DNA, 25 bp, Mus musculus
aaccatccttcttggagtcttcatc

SEQ ID NO: 34157 - DNA, 25 bp, Mus musculus
ccttcttggagtcttcatcttctgt

SEQ ID NO: 34158 - DNA, 25 bp, Mus musculus
tgtgctccatgttctcttaatgacc

SEQ ID NO: 34159 - DNA, 25 bp, Mus musculus
ccatgttctcttaatgaccttctgc

SEQ ID NO: 34160 - DNA, 25 bp, Mus musculus
taacccttactgtgtttgctacatg

SEQ ID NO: 34161 - DNA, 25 bp, Mus musculus
cttccaggtcaatggcatgttgatc

SEQ ID NO: 34162 - DNA, 25 bp, Mus musculus
atatgcctttcggagcccagagctc

SEQ ID NO: 34163 - DNA, 25 bp, Mus musculus
ctttcggagcccagagctcagagat

SEQ ID NO: 34164 - DNA, 25 bp, Mus musculus
ataccatagcattgtgaccatgcgc

SEQ ID NO: 34165 - DNA, 25 bp, Mus musculus
gaccaaataacacatcagtctgaca

SEQ ID NO: 34166 - DNA, 25 bp, Mus musculus
tgtgaccatgcgccgcaccatcatc

SEQ ID NO: 34167 - DNA, 25 bp, Mus musculus
catcatcaccctaacaattatctgg

SEQ ID NO: 34168 - DNA, 25 bp, Mus musculus
tatctggatgttctgcacagggagc

SEQ ID NO: 34169 - DNA, 25 bp, Mus musculus
cggcatcaccatggtgatcttctcc

SEQ ID NO: 34170 - DNA, 25 bp, Mus musculus
cttcacatcgctgttccctttgatg

SEQ ID NO: 34171 - DNA, 25 bp, Mus musculus
ttttatcctgtgtctctacatccac

SEQ ID NO: 34172 - DNA, 25 bp, Mus musculus
tctctacatccacatgttcttactt

SEQ ID NO: 34173 - DNA, 25 bp, Mus musculus
atttcagagcagaccggcaaagaac

SEQ ID NO: 34174 - DNA, 25 bp, Mus musculus
tttcagagcagaccggcaaagaact

SEQ ID NO: 34175 - DNA, 25 bp, Mus musculus
acaagtacatctgcaccacctcggc

SEQ ID NO: 34176 - DNA, 25 bp, Mus musculus
aagtacatctgcaccacctcggcca

SEQ ID NO: 34177 - DNA, 25 bp, Mus musculus
tcggccatccagaaccggttcaagt

SEQ ID NO: 34178 - DNA, 25 bp, Mus musculus
gccatccagaaccggttcaagtacg

SEQ ID NO: 34179 - DNA, 25 bp, Mus musculus
gtgactcccgacacagactgggccc

SEQ ID NO: 34180 - DNA, 25 bp, Mus musculus
cccgacacagactgggcccatctga

SEQ ID NO: 34181 - DNA, 25 bp, Mus musculus
ccgacacagactgggcccatctgat

SEQ ID NO: 34182 - DNA, 25 bp, Mus musculus
acagactgggcccatctgatgcagg

SEQ ID NO: 34183 - DNA, 25 bp, Mus musculus
gaccacccgtggctgctcagccaga

SEQ ID NO: 34184 - DNA, 25 bp, Mus musculus
accacccgtggctgctcagccagag

SEQ ID NO: 34185 - DNA, 25 bp, Mus musculus
tcagagcagaccggcaaagaactcc

SEQ ID NO: 34186 - DNA, 25 bp, Mus musculus
cagaccggcaaagaactcctgtaca

SEQ ID NO: 34187 - DNA, 25 bp, Mus musculus
gcaaagaactcctgtacaagtacat

SEQ ID NO: 34188 - DNA, 25 bp, Mus musculus
gaactcctgtacaagtacatctgca

SEQ ID NO: 34189 - DNA, 25 bp, Mus musculus
ctcctgtacaagtacatctgcacca

SEQ ID NO: 34190 - DNA, 25 bp, Mus musculus
tcctgtacaagtacatctgcaccac

SEQ ID NO: 34191 - DNA, 25 bp, Mus musculus
tgtacaagtacatctgcaccacctc

SEQ ID NO: 34192 - DNA, 25 bp, Mus musculus
tacaagtacatctgcaccacctcgg

SEQ ID NO: 34193 - DNA, 25 bp, Mus musculus
agaaggtctcggagtaggagtcgca

SEQ ID NO: 34194 - DNA, 25 bp, Mus musculus
agtcgcagaagcagccgcagtagat

SEQ ID NO: 34195 - DNA, 25 bp, Mus musculus
cgctcccgatctaggtctcggagca

SEQ ID NO: 34196 - DNA, 25 bp, Mus musculus
ctcccgatctaggtctcggagcaaa

SEQ ID NO: 34197 - DNA, 25 bp, Mus musculus
ccgatctaggtctcggagcaaaggt

SEQ ID NO: 34198 - DNA, 25 bp, Mus musculus
cgatctaggtctcggagcaaaggtc

SEQ ID NO: 34199 - DNA, 25 bp, Mus musculus
tctaggtctcggagcaaaggtcgat

SEQ ID NO: 34200 - DNA, 25 bp, Mus musculus
cgatcccgctcaaaaggcaggaaat

SEQ ID NO: 34201 - DNA, 25 bp, Mus musculus
tcccgctcaaaaggcaggaaatcca

SEQ ID NO: 34202 - DNA, 25 bp, Mus musculus
agcaaatcgaagcccaagtctgacc

SEQ ID NO: 34203 - DNA, 25 bp, Mus musculus
caaatcgaagcccaagtctgaccgg

SEQ ID NO: 34204 - DNA, 25 bp, Mus musculus
ttcccactcaagaagcaggtctaag

SEQ ID NO: 34205 - DNA, 25 bp, Mus musculus
cagaagcagccgcagtagatctcga

SEQ ID NO: 34206 - DNA, 25 bp, Mus musculus
agatctcgaagtatctcaaaaagtc

SEQ ID NO: 34207 - DNA, 25 bp, Mus musculus
tatctcaaaaagtcgctcccgatct

SEQ ID NO: 34208 - DNA, 25 bp, Mus musculus
ctcaaaaagtcgctcccgatctagg

SEQ ID NO: 34209 - DNA, 25 bp, Mus musculus
tcaaaaagtcgctcccgatctaggt

SEQ ID NO: 34210 - DNA, 25 bp, Mus musculus
aagtcgctcccgatctaggtctcgg

SEQ ID NO: 34211 - DNA, 25 bp, Mus musculus
agtcgctcccgatctaggtctcgga

SEQ ID NO: 34212 - DNA, 25 bp, Mus musculus
tcgctcccgatctaggtctcggagc

SEQ ID NO: 34213 - DNA, 25 bp, Mus musculus
tatatcctcatgtaggatgtcgtcg

SEQ ID NO: 34214 - DNA, 25 bp, Mus musculus
atgtaggatgtcgtcgtggacaatg

SEQ ID NO: 34215 - DNA, 25 bp, Mus musculus
taaagctacgaactggtctgatgtg

SEQ ID NO: 34216 - DNA, 25 bp, Mus musculus
agctacgaactggtctgatgtgtca

SEQ ID NO: 34217 - DNA, 25 bp, Mus musculus
ctggtctgatgtgtcatggaggatg

SEQ ID NO: 34218 - DNA, 25 bp, Mus musculus
ggtgatctcttcttacatctgtctc

SEQ ID NO: 34219 - DNA, 25 bp, Mus musculus
gatctcttcttacatctgtctcgtg

SEQ ID NO: 34220 - DNA, 25 bp, Mus musculus
ttacatctgtctcgtgagcgtgtgt

SEQ ID NO: 34221 - DNA, 25 bp, Mus musculus
cgtgtgtacttcgaggatcgggctc

SEQ ID NO: 34222 - DNA, 25 bp, Mus musculus
cgggctcgcttctatggaggataaa

SEQ ID NO: 34223 - DNA, 25 bp, Mus musculus
tcctgggactacgtggactccgaga

SEQ ID NO: 34224 - DNA, 25 bp, Mus musculus
tgggactacgtggactccgagaaga

SEQ ID NO: 34225 - DNA, 25 bp, Mus musculus
aatgatgacttagcccgcacgctta

SEQ ID NO: 34226 - DNA, 25 bp, Mus musculus
gtcctgcagtactataggcaactct

SEQ ID NO: 34227 - DNA, 25 bp, Mus musculus
cagtactataggcaactcttcctta

SEQ ID NO: 34228 - DNA, 25 bp, Mus musculus
caactcttccttacagcgctcaagg

SEQ ID NO: 34229 - DNA, 25 bp, Mus musculus
ttccttacagcgctcaaggactcgt

SEQ ID NO: 34230 - DNA, 25 bp, Mus musculus
acagcgctcaaggactcgttctaaa

SEQ ID NO: 34231 - DNA, 25 bp, Mus musculus
ctcaaggactcgttctaaagctacg

SEQ ID NO: 34232 - DNA, 25 bp, Mus musculus
ttctaaagctacgaactggtctgat

SEQ ID NO: 34233 - DNA, 25 bp, Mus musculus
ccatctcagagctgactattcctag

SEQ ID NO: 34234 - DNA, 25 bp, Mus musculus
cagagctgactattcctagggtaga

SEQ ID NO: 34235 - DNA, 25 bp, Mus musculus
tgcactctgtgctcatcaactcaga

SEQ ID NO: 34236 - DNA, 25 bp, Mus musculus
ctgtgctcatcaactcagaactgag

SEQ ID NO: 34237 - DNA, 25 bp, Mus musculus
tgctcatcaactcagaactgagctt

SEQ ID NO: 34238 - DNA, 25 bp, Mus musculus
actcagaactgagcttggaagcttc

SEQ ID NO: 34239 - DNA, 25 bp, Mus musculus
aagcttctggcaatcttctaagagc

SEQ ID NO: 34240 - DNA, 25 bp, Mus musculus
gcaatcttctaagagccggagagtg

SEQ ID NO: 34241 - DNA, 25 bp, Mus musculus
atcttctaagagccggagagtgatt

SEQ ID NO: 34242 - DNA, 25 bp, Mus musculus
tttaaaggctctatctgtttacagt

SEQ ID NO: 34243 - DNA, 25 bp, Mus musculus
aaaggctctatctgtttacagtgtt

SEQ ID NO: 34244 - DNA, 25 bp, Mus musculus
atgtatgcttcatacagggatggtg

SEQ ID NO: 34245 - DNA, 25 bp, Mus musculus
tgactattcctagggtagaagacat

SEQ ID NO: 34246 - DNA, 25 bp, Mus musculus
acattgaaaactccagaggctgtgc

SEQ ID NO: 34247 - DNA, 25 bp, Mus musculus
ggcccctcaatctctacaggaaatg

SEQ ID NO: 34248 - DNA, 25 bp, Mus musculus
tcaatctctacaggaaatgcctgcg

SEQ ID NO: 34249 - DNA, 25 bp, Mus musculus
tttggcaaactcttcaccacattaa

SEQ ID NO: 34250 - DNA, 25 bp, Mus musculus
ctcttcaccacattaaggaaacttg

SEQ ID NO: 34251 - DNA, 25 bp, Mus musculus
ttcaccacattaaggaaacttggat

SEQ ID NO: 34252 - DNA, 25 bp, Mus musculus
ccagtgggtccttggcctttggctg

SEQ ID NO: 34253 - DNA, 25 bp, Mus musculus
cacatgtctgggggcaaatacgtag

SEQ ID NO: 34254 - DNA, 25 bp, Mus musculus
gtagactccgagggacatctctaca

SEQ ID NO: 34255 - DNA, 25 bp, Mus musculus
gtgtatgacgcgcacaccaaggaga

SEQ ID NO: 34256 - DNA, 25 bp, Mus musculus
gaccccaagcatctcaacgacgacg

SEQ ID NO: 34257 - DNA, 25 bp, Mus musculus
cccaagcatctcaacgacgacgtgg

SEQ ID NO: 34258 - DNA, 25 bp, Mus musculus
aagcatctcaacgacgacgtggtca

SEQ ID NO: 34259 - DNA, 25 bp, Mus musculus
ctcaacgacgacgtggtcaagattg

SEQ ID NO: 34260 - DNA, 25 bp, Mus musculus
aacgacgacgtggtcaagattgact

SEQ ID NO: 34261 - DNA, 25 bp, Mus musculus
gggacacacagtttcgacggcatct

SEQ ID NO: 34262 - DNA, 25 bp, Mus musculus
cacagtttcgacggcatctggaagg

SEQ ID NO: 34263 - DNA, 25 bp, Mus musculus
agtttcgacggcatctggaaggcca

SEQ ID NO: 34264 - DNA, 25 bp, Mus musculus
ttcgacggcatctggaaggccagct

SEQ ID NO: 34265 - DNA, 25 bp, Mus musculus
gactccgagggacatctctacactg

SEQ ID NO: 34266 - DNA, 25 bp, Mus musculus
ggacatctctacactgttcccatcc

SEQ ID NO: 34267 - DNA, 25 bp, Mus musculus
catctctacactgttcccatccggg

SEQ ID NO: 34268 - DNA, 25 bp, Mus musculus
cagggcaacatctacaagcccaaca

SEQ ID NO: 34269 - DNA, 25 bp, Mus musculus
aacatctacaagcccaacaacaagg

SEQ ID NO: 34270 - DNA, 25 bp, Mus musculus
atctacaagcccaacaacaaggcca

SEQ ID NO: 34271 - DNA, 25 bp, Mus musculus
tacaagcccaacaacaaggccatgg

SEQ ID NO: 34272 - DNA, 25 bp, Mus musculus
cccaacaacaaggccatggcagacg

SEQ ID NO: 34273 - DNA, 25 bp, Mus musculus
gttgctgtggttcgaacagagcgga

SEQ ID NO: 34274 - DNA, 25 bp, Mus musculus
caagcccctgagcacgttctacacg

SEQ ID NO: 34275 - DNA, 25 bp, Mus musculus
cattcaggcctactctgagtccctg

SEQ ID NO: 34276 - DNA, 25 bp, Mus musculus
gtccctgatgtcaccagctgccaag

SEQ ID NO: 34277 - DNA, 25 bp, Mus musculus
agccaagctatagggtcctgaagac

SEQ ID NO: 34278 - DNA, 25 bp, Mus musculus
cccaaacctgatagcttggtcagac

SEQ ID NO: 34279 - DNA, 25 bp, Mus musculus
agcttggtcagaccagccacccagt

SEQ ID NO: 34280 - DNA, 25 bp, Mus musculus
gcttcttgaggactctctcagcgga

SEQ ID NO: 34281 - DNA, 25 bp, Mus musculus
acagcccaccagtgccatggcctga

SEQ ID NO: 34282 - DNA, 25 bp, Mus musculus
tgccatggcctgagcccccagatgt

SEQ ID NO: 34283 - DNA, 25 bp, Mus musculus
cagatgtcacacctgtccgcacgca

SEQ ID NO: 34284 - DNA, 25 bp, Mus musculus
catggatgcccacgcatgtgcaaaa

SEQ ID NO: 34285 - DNA, 25 bp, Mus musculus
cctgagcacgttctacacgcagctg

SEQ ID NO: 34286 - DNA, 25 bp, Mus musculus
gatgccccaggttcttcactacgcg

SEQ ID NO: 34287 - DNA, 25 bp, Mus musculus
ccaggttcttcactacgcgcagtat

SEQ ID NO: 34288 - DNA, 25 bp, Mus musculus
ctacgcgcagtatgtgctgctgggg

SEQ ID NO: 34289 - DNA, 25 bp, Mus musculus
cctgttgctggtgcccatcatctgc

SEQ ID NO: 34290 - DNA, 25 bp, Mus musculus
gctggtgcccatcatctgccaactg

SEQ ID NO: 34291 - DNA, 25 bp, Mus musculus
ccaactgcgcagccaggagaaatgc

SEQ ID NO: 34292 - DNA, 25 bp, Mus musculus
ggaggccattcaggcctactctgag

SEQ ID NO: 34293 - DNA, 25 bp, Mus musculus
gcccatcaatttaacatgttcccca

SEQ ID NO: 34294 - DNA, 25 bp, Mus musculus
atttgattccgaatgccttggcctt

SEQ ID NO: 34295 - DNA, 25 bp, Mus musculus
tggccttctttgattaagaagcctc

SEQ ID NO: 34296 - DNA, 25 bp, Mus musculus
attaagaagcctcaagctttaatca

SEQ ID NO: 34297 - DNA, 25 bp, Mus musculus
agaagcctcaagctttaatcaagag

SEQ ID NO: 34298 - DNA, 25 bp, Mus musculus
aagcctcaagctttaatcaagaggg

SEQ ID NO: 34299 - DNA, 25 bp, Mus musculus
aagtgcctaacaacaatgggcgacg

SEQ ID NO: 34300 - DNA, 25 bp, Mus musculus
agtgcctaacaacaatgggcgacga

SEQ ID NO: 34301 - DNA, 25 bp, Mus musculus
tgcctaacaacaatgggcgacgatt

SEQ ID NO: 34302 - DNA, 25 bp, Mus musculus
ctaacaacaatgggcgacgattcaa

SEQ ID NO: 34303 - DNA, 25 bp, Mus musculus
acaatgggcgacgattcaaggatta

SEQ ID NO: 34304 - DNA, 25 bp, Mus musculus
caatgggcgacgattcaaggattaa

SEQ ID NO: 34305 - DNA, 25 bp, Mus musculus
tttgattccgaatgccttggccttc

SEQ ID NO: 34306 - DNA, 25 bp, Mus musculus
tgattccgaatgccttggccttctt

SEQ ID NO: 34307 - DNA, 25 bp, Mus musculus
ttccgaatgccttggccttctttga

SEQ ID NO: 34308 - DNA, 25 bp, Mus musculus
tccgaatgccttggccttctttgat

SEQ ID NO: 34309 - DNA, 25 bp, Mus musculus
cgaatgccttggccttctttgatta

SEQ ID NO: 34310 - DNA, 25 bp, Mus musculus
gaatgccttggccttctttgattaa

SEQ ID NO: 34311 - DNA, 25 bp, Mus musculus
atgccttggccttctttgattaaga

SEQ ID NO: 34312 - DNA, 25 bp, Mus musculus
tgccttggccttctttgattaagaa

SEQ ID NO: 34313 - DNA, 25 bp, Mus musculus
cggtcactatcactgctgctgctac

SEQ ID NO: 34314 - DNA, 25 bp, Mus musculus
ctatcactgctgctgctactgggaa

SEQ ID NO: 34315 - DNA, 25 bp, Mus musculus
tcttttgacatcagctgtaacgagc

SEQ ID NO: 34316 - DNA, 25 bp, Mus musculus
atcagctgtaacgagcctggtgcac

SEQ ID NO: 34317 - DNA, 25 bp, Mus musculus
agctgtaacgagcctggtgcacagc

SEQ ID NO: 34318 - DNA, 25 bp, Mus musculus
tgtaacgagcctggtgcacagccct

SEQ ID NO: 34319 - DNA, 25 bp, Mus musculus
gagcctggtgcacagccctttcggt

SEQ ID NO: 34320 - DNA, 25 bp, Mus musculus
cctggtgcacagccctttcggttca

SEQ ID NO: 34321 - DNA, 25 bp, Mus musculus
ggtgcacagccctttcggttcaaga

SEQ ID NO: 34322 - DNA, 25 bp, Mus musculus
ttcaagaaaatttcccggctggctg

SEQ ID NO: 34323 - DNA, 25 bp, Mus musculus
aaacttgtacctcagccagagcagt

SEQ ID NO: 34324 - DNA, 25 bp, Mus musculus
cagccagagcagtaggcctgccttg

SEQ ID NO: 34325 - DNA, 25 bp, Mus musculus
tcactgctgctgctactgggaatgg

SEQ ID NO: 34326 - DNA, 25 bp, Mus musculus
gatgctgtgctccgagctgtggatg

SEQ ID NO: 34327 - DNA, 25 bp, Mus musculus
gacctggatcctgagccccaagggg

SEQ ID NO: 34328 - DNA, 25 bp, Mus musculus
cagctacctgagcaatgtgccttca

SEQ ID NO: 34329 - DNA, 25 bp, Mus musculus
ctacctgagcaatgtgccttcaagg

SEQ ID NO: 34330 - DNA, 25 bp, Mus musculus
gagcaatgtgccttcaaggaacagg

SEQ ID NO: 34331 - DNA, 25 bp, Mus musculus
gccgctgattcttttgacatcagct

SEQ ID NO: 34332 - DNA, 25 bp, Mus musculus
gattcttttgacatcagctgtaacg

SEQ ID NO: 34333 - DNA, 25 bp, Mus musculus
caccagctcaaattccgagtgcaga

SEQ ID NO: 34334 - DNA, 25 bp, Mus musculus
ccagctcaaattccgagtgcagaaa

SEQ ID NO: 34335 - DNA, 25 bp, Mus musculus
attactcaggaagctcacctcggac

SEQ ID NO: 34336 - DNA, 25 bp, Mus musculus
tactcaggaagctcacctcggacgg

SEQ ID NO: 34337 - DNA, 25 bp, Mus musculus
ctcaggaagctcacctcggacggag

SEQ ID NO: 34338 - DNA, 25 bp, Mus musculus
caggaagctcacctcggacggagtg

SEQ ID NO: 34339 - DNA, 25 bp, Mus musculus
acagaactggtgctctcctctcctc

SEQ ID NO: 34340 - DNA, 25 bp, Mus musculus
ccattttgatggtgtctgtgacatt

SEQ ID NO: 34341 - DNA, 25 bp, Mus musculus
tgtctgtgacatttcctgttgtgaa

SEQ ID NO: 34342 - DNA, 25 bp, Mus musculus
tctgtgacatttcctgttgtgaagt

SEQ ID NO: 34343 - DNA, 25 bp, Mus musculus
tgtgacatttcctgttgtgaagtaa

SEQ ID NO: 34344 - DNA, 25 bp, Mus musculus
tgacatttcctgttgtgaagtaaaa

SEQ ID NO: 34345 - DNA, 25 bp, Mus musculus
agctcaaattccgagtgcagaaaag

SEQ ID NO: 34346 - DNA, 25 bp, Mus musculus
ctcaaattccgagtgcagaaaagaa

SEQ ID NO: 34347 - DNA, 25 bp, Mus musculus
cccagacccttcattactcaggaag

SEQ ID NO: 34348 - DNA, 25 bp, Mus musculus
cagacccttcattactcaggaagct

SEQ ID NO: 34349 - DNA, 25 bp, Mus musculus
gacccttcattactcaggaagctca

SEQ ID NO: 34350 - DNA, 25 bp, Mus musculus
cccttcattactcaggaagctcacc

SEQ ID NO: 34351 - DNA, 25 bp, Mus musculus
cttcattactcaggaagctcacctc

SEQ ID NO: 34352 - DNA, 25 bp, Mus musculus
tcattactcaggaagctcacctcgg

SEQ ID NO: 34353 - DNA, 25 bp, Mus musculus
ccatttaacgttctctatgagaagg

SEQ ID NO: 34354 - DNA, 25 bp, Mus musculus
tttaacgttctctatgagaaggagg

SEQ ID NO: 34355 - DNA, 25 bp, Mus musculus
cctgacctgtacaagtctgagatgg

SEQ ID NO: 34356 - DNA, 25 bp, Mus musculus
aaggctcttctccagagttctgcaa

SEQ ID NO: 34357 - DNA, 25 bp, Mus musculus
gctcttctccagagttctgcaagta

SEQ ID NO: 34358 - DNA, 25 bp, Mus musculus
aaggcctccaagactgtagagaatg

SEQ ID NO: 34359 - DNA, 25 bp, Mus musculus
aatgccaccagtggagaaaccttag

SEQ ID NO: 34360 - DNA, 25 bp, Mus musculus
gcaccccaggctctgtcaagtcgag

SEQ ID NO: 34361 - DNA, 25 bp, Mus musculus
ccccaggctctgtcaagtcgagttc

SEQ ID NO: 34362 - DNA, 25 bp, Mus musculus
gctctgtcaagtcgagttcgtcttc

SEQ ID NO: 34363 - DNA, 25 bp, Mus musculus
ctgtcaagtcgagttcgtcttctcc

SEQ ID NO: 34364 - DNA, 25 bp, Mus musculus
cacccaagactaccagcagagcggg

SEQ ID NO: 34365 - DNA, 25 bp, Mus musculus
aaatttacagttctactcatgccca

SEQ ID NO: 34366 - DNA, 25 bp, Mus musculus
tttacagttctactcatgcccaacg

SEQ ID NO: 34367 - DNA, 25 bp, Mus musculus
aacggccccatgcggataaccagtg

SEQ ID NO: 34368 - DNA, 25 bp, Mus musculus
ataaccagtggtccctttgagcctg

SEQ ID NO: 34369 - DNA, 25 bp, Mus musculus
agtggtccctttgagcctgacctgt

SEQ ID NO: 34370 - DNA, 25 bp, Mus musculus
ggtccctttgagcctgacctgtaca

SEQ ID NO: 34371 - DNA, 25 bp, Mus musculus
ccctttgagcctgacctgtacaagt

SEQ ID NO: 34372 - DNA, 25 bp, Mus musculus
gagcctgacctgtacaagtctgaga

SEQ ID NO: 34373 - DNA, 25 bp, Mus musculus
tcagaaagcctggtctctcaacctg

SEQ ID NO: 34374 - DNA, 25 bp, Mus musculus
gtctctcaacctgaacggttttgat

SEQ ID NO: 34375 - DNA, 25 bp, Mus musculus
cagatacatcccttctctgccagac

SEQ ID NO: 34376 - DNA, 25 bp, Mus musculus
cccttctctgccagacaggatcctt

SEQ ID NO: 34377 - DNA, 25 bp, Mus musculus
ttctctgccagacaggatccttgat

SEQ ID NO: 34378 - DNA, 25 bp, Mus musculus
gccagacaggatccttgatgccccc

SEQ ID NO: 34379 - DNA, 25 bp, Mus musculus
caggatccttgatgcccccgaaatc

SEQ ID NO: 34380 - DNA, 25 bp, Mus musculus
tgactactacctgaatcttgtagat

SEQ ID NO: 34381 - DNA, 25 bp, Mus musculus
ctactacctgaatcttgtagattgg

SEQ ID NO: 34382 - DNA, 25 bp, Mus musculus
tgtattggctgtggcactggacaac

SEQ ID NO: 34383 - DNA, 25 bp, Mus musculus
attggctgtggcactggacaacagt

SEQ ID NO: 34384 - DNA, 25 bp, Mus musculus
tgtggcactggacaacagtgtgtac

SEQ ID NO: 34385 - DNA, 25 bp, Mus musculus
tctcaacctgaacggttttgatgtg

SEQ ID NO: 34386 - DNA, 25 bp, Mus musculus
agccaagatcctcaggctcagcggc

SEQ ID NO: 34387 - DNA, 25 bp, Mus musculus
gatcctcaggctcagcggcaaacct

SEQ ID NO: 34388 - DNA, 25 bp, Mus musculus
caggctcagcggcaaacctcagaat

SEQ ID NO: 34389 - DNA, 25 bp, Mus musculus
tgccccagaaggctaccagaacaga

SEQ ID NO: 34390 - DNA, 25 bp, Mus musculus
cagtcagaaagccacgcctggctcc

SEQ ID NO: 34391 - DNA, 25 bp, Mus musculus
gacttgcagatacatcccttctctg

SEQ ID NO: 34392 - DNA, 25 bp, Mus musculus
ttgcagatacatcccttctctgcca

SEQ ID NO: 34393 - DNA, 25 bp, Mus musculus
ggaacacagacattttcttatctct

SEQ ID NO: 34394 - DNA, 25 bp, Mus musculus
ttagcatttgcactgaagtagaacc

SEQ ID NO: 34395 - DNA, 25 bp, Mus musculus
gaagtctgacatccatttgatatca

SEQ ID NO: 34396 - DNA, 25 bp, Mus musculus
gtctgacatccatttgatatcaata

SEQ ID NO: 34397 - DNA, 25 bp, Mus musculus
tgacatccatttgatatcaataacg

SEQ ID NO: 34398 - DNA, 25 bp, Mus musculus
acctcctttatgctgacaagttgta

SEQ ID NO: 34399 - DNA, 25 bp, Mus musculus
tcctttatgctgacaagttgtaagg

SEQ ID NO: 34400 - DNA, 25 bp, Mus musculus
cttccagttatatttccttgtcaat

SEQ ID NO: 34401 - DNA, 25 bp, Mus musculus
ccagttatatttccttgtcaatctg

SEQ ID NO: 34402 - DNA, 25 bp, Mus musculus
gttatatttccttgtcaatctgaaa

SEQ ID NO: 34403 - DNA, 25 bp, Mus musculus
atatttccttgtcaatctgaaaatt

SEQ ID NO: 34404 - DNA, 25 bp, Mus musculus
agctatatttgtactttgggcattt

SEQ ID NO: 34405 - DNA, 25 bp, Mus musculus
caaatcatacattcccattccttta

SEQ ID NO: 34406 - DNA, 25 bp, Mus musculus
atcatacattcccattcctttaatc

SEQ ID NO: 34407 - DNA, 25 bp, Mus musculus
tatgtctttcaccatcttttgaatg

SEQ ID NO: 34408 - DNA, 25 bp, Mus musculus
gtctttcaccatcttttgaatgtga

SEQ ID NO: 34409 - DNA, 25 bp, Mus musculus
tgccccaagcgtgctcaatacataa

SEQ ID NO: 34410 - DNA, 25 bp, Mus musculus
tgattttaccttacaactgtgtttg

SEQ ID NO: 34411 - DNA, 25 bp, Mus musculus
taccttacaactgtgtttgaagtct

SEQ ID NO: 34412 - DNA, 25 bp, Mus musculus
tttgaagtctgacatccatttgata

SEQ ID NO: 34413 - DNA, 25 bp, Mus musculus
catggacactcgtcggagcatgtgc

SEQ ID NO: 34414 - DNA, 25 bp, Mus musculus
cactcgtcggagcatgtgcgggtcg

SEQ ID NO: 34415 - DNA, 25 bp, Mus musculus
tccagcggccttggatgcatcaaga

SEQ ID NO: 34416 - DNA, 25 bp, Mus musculus
agcggccttggatgcatcaagagtc

SEQ ID NO: 34417 - DNA, 25 bp, Mus musculus
tgcatcaagagtccaccggcattag

SEQ ID NO: 34418 - DNA, 25 bp, Mus musculus
atcaagagtccaccggcattagcat

SEQ ID NO: 34419 - DNA, 25 bp, Mus musculus
aagagtccaccggcattagcatctc

SEQ ID NO: 34420 - DNA, 25 bp, Mus musculus
agtccaccggcattagcatctctat

SEQ ID NO: 34421 - DNA, 25 bp, Mus musculus
gcattagcatctctatagtatgatt

SEQ ID NO: 34422 - DNA, 25 bp, Mus musculus
ttagcatctctatagtatgattatc

SEQ ID NO: 34423 - DNA, 25 bp, Mus musculus
tatgattatccggtgctacgtgatg

SEQ ID NO: 34424 - DNA, 25 bp, Mus musculus
gattatccggtgctacgtgatgaga

SEQ ID NO: 34425 - DNA, 25 bp, Mus musculus
gctatatacgaaacgctgtgatact

SEQ ID NO: 34426 - DNA, 25 bp, Mus musculus
atatacgaaacgctgtgatactgac

SEQ ID NO: 34427 - DNA, 25 bp, Mus musculus
tacgaaacgctgtgatactgaccga

SEQ ID NO: 34428 - DNA, 25 bp, Mus musculus
agtgactatcggtagccatggactt

SEQ ID NO: 34429 - DNA, 25 bp, Mus musculus
cggtagccatggacttccagcggcc

SEQ ID NO: 34430 - DNA, 25 bp, Mus musculus
tagccatggacttccagcggccttg

SEQ ID NO: 34431 - DNA, 25 bp, Mus musculus
ccatggacttccagcggccttggat

SEQ ID NO: 34432 - DNA, 25 bp, Mus musculus
tggacttccagcggccttggatgca

SEQ ID NO: 34433 - DNA, 25 bp, Mus musculus
gaaaggcaacaccatcaccgagact

SEQ ID NO: 34434 - DNA, 25 bp, Mus musculus
caacaccatcaccgagactgaggtc

SEQ ID NO: 34435 - DNA, 25 bp, Mus musculus
cgaagactttgtgcggcacgctact

SEQ ID NO: 34436 - DNA, 25 bp, Mus musculus
agactttgtgcggcacgctacttgg

SEQ ID NO: 34437 - DNA, 25 bp, Mus musculus
ctttgtgcggcacgctacttggagt

SEQ ID NO: 34438 - DNA, 25 bp, Mus musculus
gcacgctacttggagtaccggagga

SEQ ID NO: 34439 - DNA, 25 bp, Mus musculus
cacaccgatcctgtggactatgaat

SEQ ID NO: 34440 - DNA, 25 bp, Mus musculus
accgatcctgtggactatgaattac

SEQ ID NO: 34441 - DNA, 25 bp, Mus musculus
accaacctggaaaccagcaagatga

SEQ ID NO: 34442 - DNA, 25 bp, Mus musculus
aacctggaaaccagcaagatgaaag

SEQ ID NO: 34443 - DNA, 25 bp, Mus musculus
tttgtggccaaagtccataaccagg

SEQ ID NO: 34444 - DNA, 25 bp, Mus musculus
gaccccaaagactggcccacacaat

SEQ ID NO: 34445 - DNA, 25 bp, Mus musculus
caccatcaccgagactgaggtctgg

SEQ ID NO: 34446 - DNA, 25 bp, Mus musculus
cccaaagactggcccacacaatact

SEQ ID NO: 34447 - DNA, 25 bp, Mus musculus
catcaccgagactgaggtctgggac

SEQ ID NO: 34448 - DNA, 25 bp, Mus musculus
ggacttcctgcgacggctcggagtg

SEQ ID NO: 34449 - DNA, 25 bp, Mus musculus
cttcctgcgacggctcggagtgtac

SEQ ID NO: 34450 - DNA, 25 bp, Mus musculus
gaaactcattaccgaagactttgtg

SEQ ID NO: 34451 - DNA, 25 bp, Mus musculus
actcattaccgaagactttgtgcgg

SEQ ID NO: 34452 - DNA, 25 bp, Mus musculus
cattaccgaagactttgtgcggcac

SEQ ID NO: 34453 - DNA, 25 bp, Mus musculus
taccgaagactttgtgcggcacgct

SEQ ID NO: 34454 - DNA, 25 bp, Mus musculus
tagatttcctcatctgataggctgt

SEQ ID NO: 34455 - DNA, 25 bp, Mus musculus
tcctcatctgataggctgttgcttt

SEQ ID NO: 34456 - DNA, 25 bp, Mus musculus
ctgccacctgtcatagaagggtgct

SEQ ID NO: 34457 - DNA, 25 bp, Mus musculus
agcagctatagattcccccttggcc

SEQ ID NO: 34458 - DNA, 25 bp, Mus musculus
cttggccccaagcctgggacttgag

SEQ ID NO: 34459 - DNA, 25 bp, Mus musculus
cccaagcctgggacttgagccatcg

SEQ ID NO: 34460 - DNA, 25 bp, Mus musculus
agcaatgtgccttgatgaagatttc

SEQ ID NO: 34461 - DNA, 25 bp, Mus musculus
ggcagcaaaacaccaatcacaacgc

SEQ ID NO: 34462 - DNA, 25 bp, Mus musculus
ccaatcacaacgctttgcttctcga

SEQ ID NO: 34463 - DNA, 25 bp, Mus musculus
ctttgcttctcgacatcatgggcca

SEQ ID NO: 34464 - DNA, 25 bp, Mus musculus
ttctcgacatcatgggccaggtcct

SEQ ID NO: 34465 - DNA, 25 bp, Mus musculus
tgggccaggtcctcagtttctaact

SEQ ID NO: 34466 - DNA, 25 bp, Mus musculus
aggctgttgctttaccgtcacacgc

SEQ ID NO: 34467 - DNA, 25 bp, Mus musculus
taccgtcacacgcgatgtgcacagc

SEQ ID NO: 34468 - DNA, 25 bp, Mus musculus
cacacgcgatgtgcacagccaaatt

SEQ ID NO: 34469 - DNA, 25 bp, Mus musculus
cgatgtgcacagccaaattccctac

SEQ ID NO: 34470 - DNA, 25 bp, Mus musculus
gcacagccaaattccctactcaaaa

SEQ ID NO: 34471 - DNA, 25 bp, Mus musculus
tccctactcaaaatatcatgttaaa

SEQ ID NO: 34472 - DNA, 25 bp, Mus musculus
ccatgttgctttcagagaggtcaac

SEQ ID NO: 34473 - DNA, 25 bp, Mus musculus
tcttctctgggaagatacaggagtc

SEQ ID NO: 34474 - DNA, 25 bp, Mus musculus
aaacctagttggcagcccaacatgt

SEQ ID NO: 34475 - DNA, 25 bp, Mus musculus
agttggcagcccaacatgtaactcc

SEQ ID NO: 34476 - DNA, 25 bp, Mus musculus
gcttgcagtatgcctctgaagtcac

SEQ ID NO: 34477 - DNA, 25 bp, Mus musculus
tgcagtatgcctctgaagtcacagc

SEQ ID NO: 34478 - DNA, 25 bp, Mus musculus
atgcctctgaagtcacagcaaaaag

SEQ ID NO: 34479 - DNA, 25 bp, Mus musculus
cctctgaagtcacagcaaaaagtat

SEQ ID NO: 34480 - DNA, 25 bp, Mus musculus
gtattacgtccttcctgggcagaca

SEQ ID NO: 34481 - DNA, 25 bp, Mus musculus
ttacgtccttcctgggcagacaagt

SEQ ID NO: 34482 - DNA, 25 bp, Mus musculus
cgtccttcctgggcagacaagttct

SEQ ID NO: 34483 - DNA, 25 bp, Mus musculus
gcagacaagttcttcacaggacaaa

SEQ ID NO: 34484 - DNA, 25 bp, Mus musculus
ttcttcacaggacaaacagcctgaa

SEQ ID NO: 34485 - DNA, 25 bp, Mus musculus
ttcacaggacaaacagcctgaaatg

SEQ ID NO: 34486 - DNA, 25 bp, Mus musculus
tggcagcccaacatgtaactccaga

SEQ ID NO: 34487 - DNA, 25 bp, Mus musculus
cagcccaacatgtaactccagaact

SEQ ID NO: 34488 - DNA, 25 bp, Mus musculus
aacatgtaactccagaactacaggg

SEQ ID NO: 34489 - DNA, 25 bp, Mus musculus
atcattctgacagatattgaaagcc

SEQ ID NO: 34490 - DNA, 25 bp, Mus musculus
gaaagccccggagagatgtttatgt

SEQ ID NO: 34491 - DNA, 25 bp, Mus musculus
aggtttgcacctgacagtgacagct

SEQ ID NO: 34492 - DNA, 25 bp, Mus musculus
tttgcacctgacagtgacagctaaa

SEQ ID NO: 34493 - DNA, 25 bp, Mus musculus
aaggcttgcagtatgcctctgaagt

SEQ ID NO: 34494 - DNA, 25 bp, Mus musculus
tcttattctactgcaggaaccgtgg

SEQ ID NO: 34495 - DNA, 25 bp, Mus musculus
tattctactgcaggaaccgtggctg

SEQ ID NO: 34496 - DNA, 25 bp, Mus musculus
gtatcttcctgccgcataacacact

SEQ ID NO: 34497 - DNA, 25 bp, Mus musculus
tcctgccgcataacacacttccggt

SEQ ID NO: 34498 - DNA, 25 bp, Mus musculus
cgcataacacacttccggtctcggc

SEQ ID NO: 34499 - DNA, 25 bp, Mus musculus
cctctgttgggctgtagaagttaag

SEQ ID NO: 34500 - DNA, 25 bp, Mus musculus
ttccctcagcaaccatcacttctat

SEQ ID NO: 34501 - DNA, 25 bp, Mus musculus
cagcaaccatcacttctatgaagaa

SEQ ID NO: 34502 - DNA, 25 bp, Mus musculus
ccatcacttctatgaagaatctaaa

SEQ ID NO: 34503 - DNA, 25 bp, Mus musculus
cacctgtttggacggcacagccacc

SEQ ID NO: 34504 - DNA, 25 bp, Mus musculus
ctgtttggacggcacagccaccatc

SEQ ID NO: 34505 - DNA, 25 bp, Mus musculus
tttggacggcacagccaccatccca

SEQ ID NO: 34506 - DNA, 25 bp, Mus musculus
actgcaggaaccgtggctgctgagc

SEQ ID NO: 34507 - DNA, 25 bp, Mus musculus
gcaggaaccgtggctgctgagctaa

SEQ ID NO: 34508 - DNA, 25 bp, Mus musculus
ggaaccgtggctgctgagctaacct

SEQ ID NO: 34509 - DNA, 25 bp, Mus musculus
ggctattgacctttgcctctacctc

SEQ ID NO: 34510 - DNA, 25 bp, Mus musculus
cctttgcctctacctcgcgtagtga

SEQ ID NO: 34511 - DNA, 25 bp, Mus musculus
ttgcctctacctcgcgtagtgagag

SEQ ID NO: 34512 - DNA, 25 bp, Mus musculus
cctctacctcgcgtagtgagaggcc

SEQ ID NO: 34513 - DNA, 25 bp, Mus musculus
catcgcgtatcttcctgccgcataa

SEQ ID NO: 34514 - DNA, 25 bp, Mus musculus
aaggtgtaccactgtgaggagactg

SEQ ID NO: 34515 - DNA, 25 bp, Mus musculus
taccactgtgaggagactgtttttg

SEQ ID NO: 34516 - DNA, 25 bp, Mus musculus
caatatcctctatggaccgctccat

SEQ ID NO: 34517 - DNA, 25 bp, Mus musculus
tatcctctatggaccgctccatagc

SEQ ID NO: 34518 - DNA, 25 bp, Mus musculus
cctctatggaccgctccatagcaaa

SEQ ID NO: 34519 - DNA, 25 bp, Mus musculus
ctatggaccgctccatagcaaacag

SEQ ID NO: 34520 - DNA, 25 bp, Mus musculus
tggaccgctccatagcaaacaggca

SEQ ID NO: 34521 - DNA, 25 bp, Mus musculus
accgctccatagcaaacaggcagtg

SEQ ID NO: 34522 - DNA, 25 bp, Mus musculus
gctccatagcaaacaggcagtgagc

SEQ ID NO: 34523 - DNA, 25 bp, Mus musculus
catttacgtgaaacccaccattgtg

SEQ ID NO: 34524 - DNA, 25 bp, Mus musculus
ccaccattgtgaccggtcttgccca

SEQ ID NO: 34525 - DNA, 25 bp, Mus musculus
caccattgtgaccggtcttgcccag

SEQ ID NO: 34526 - DNA, 25 bp, Mus musculus
actgtttttgcacgaaagcatccat

SEQ ID NO: 34527 - DNA, 25 bp, Mus musculus
cattgtgaccggtcttgcccaggat

SEQ ID NO: 34528 - DNA, 25 bp, Mus musculus
tttgcacgaaagcatccataatgaa

SEQ ID NO: 34529 - DNA, 25 bp, Mus musculus
gagaagtgcctactcacagatccgt

SEQ ID NO: 34530 - DNA, 25 bp, Mus musculus
aagtgcctactcacagatccgtgtt

SEQ ID NO: 34531 - DNA, 25 bp, Mus musculus
tgcctactcacagatccgtgttggg

SEQ ID NO: 34532 - DNA, 25 bp, Mus musculus
ctactcacagatccgtgttgggaac

SEQ ID NO: 34533 - DNA, 25 bp, Mus musculus
ctgggaccccaatatcctctatgga

SEQ ID NO: 34534 - DNA, 25 bp, Mus musculus
ggaccccaatatcctctatggaccg

SEQ ID NO: 34535 - DNA, 25 bp, Mus musculus
ccttgtggcttcgggaagaattgca

SEQ ID NO: 34536 - DNA, 25 bp, Mus musculus
aattgcaacattccagtgtgggctg

SEQ ID NO: 34537 - DNA, 25 bp, Mus musculus
ccttcgctatggcctctttagtcaa

SEQ ID NO: 34538 - DNA, 25 bp, Mus musculus
ctatggcctctttagtcaagacagt

SEQ ID NO: 34539 - DNA, 25 bp, Mus musculus
cctctttagtcaagacagtgggatc

SEQ ID NO: 34540 - DNA, 25 bp, Mus musculus
ctacctgtggcctggcctctctaat

SEQ ID NO: 34541 - DNA, 25 bp, Mus musculus
tggcctctctaatgtcattcacatt

SEQ ID NO: 34542 - DNA, 25 bp, Mus musculus
ctctaatgtcattcacattgaatgg

SEQ ID NO: 34543 - DNA, 25 bp, Mus musculus
tgtcattcacattgaatggggatga

SEQ ID NO: 34544 - DNA, 25 bp, Mus musculus
tgctcatagagccatatatgagccc

SEQ ID NO: 34545 - DNA, 25 bp, Mus musculus
catatatgagccctagctgtgggct

SEQ ID NO: 34546 - DNA, 25 bp, Mus musculus
tgagccctagctgtgggctagaaat

SEQ ID NO: 34547 - DNA, 25 bp, Mus musculus
aacattccagtgtgggctgatggcc

SEQ ID NO: 34548 - DNA, 25 bp, Mus musculus
gatggcccagtctttctttaccagc

SEQ ID NO: 34549 - DNA, 25 bp, Mus musculus
tttctttaccagcaaaaagcctgct

SEQ ID NO: 34550 - DNA, 25 bp, Mus musculus
taccagcaaaaagcctgctaacttc

SEQ ID NO: 34551 - DNA, 25 bp, Mus musculus
cagtggcccccaggattggaatggc

SEQ ID NO: 34552 - DNA, 25 bp, Mus musculus
gggatccatctctttcccatagttt

SEQ ID NO: 34553 - DNA, 25 bp, Mus musculus
ccatattcagtggtttccttcctcg

SEQ ID NO: 34554 - DNA, 25 bp, Mus musculus
tcagtggtttccttcctcgtgccca

SEQ ID NO: 34555 - DNA, 25 bp, Mus musculus
gcacagtccctagtgccttccctaa

SEQ ID NO: 34556 - DNA, 25 bp, Mus musculus
tccctagtgccttccctaatctcta

SEQ ID NO: 34557 - DNA, 25 bp, Mus musculus
accagaaccaacatgcatccattct

SEQ ID NO: 34558 - DNA, 25 bp, Mus musculus
aacatgcatccattcttggcctgtt

SEQ ID NO: 34559 - DNA, 25 bp, Mus musculus
ccattcttggcctgttatacattag

SEQ ID NO: 34560 - DNA, 25 bp, Mus musculus
aactaaacagtgctttttgccatgc

SEQ ID NO: 34561 - DNA, 25 bp, Mus musculus
gccatgcttcttgttaactgcataa

SEQ ID NO: 34562 - DNA, 25 bp, Mus musculus
atgcttcttgttaactgcataaaga

SEQ ID NO: 34563 - DNA, 25 bp, Mus musculus
cttcttgttaactgcataaagaggt

SEQ ID NO: 34564 - DNA, 25 bp, Mus musculus
aggtaactgtcacttgtcagattag

SEQ ID NO: 34565 - DNA, 25 bp, Mus musculus
taactgtcacttgtcagattaggac

SEQ ID NO: 34566 - DNA, 25 bp, Mus musculus
ttatttgcaacaaactggaaaacat

SEQ ID NO: 34567 - DNA, 25 bp, Mus musculus
gtgccttccctaatctctaccagtt

SEQ ID NO: 34568 - DNA, 25 bp, Mus musculus
tccctaatctctaccagttggctct

SEQ ID NO: 34569 - DNA, 25 bp, Mus musculus
tctaccagttggctcttagagatca

SEQ ID NO: 34570 - DNA, 25 bp, Mus musculus
accagttggctcttagagatcaggc

SEQ ID NO: 34571 - DNA, 25 bp, Mus musculus
cagtcaggctcctaatcagtagaga

SEQ ID NO: 34572 - DNA, 25 bp, Mus musculus
ggctcctaatcagtagagagttcat

SEQ ID NO: 34573 - DNA, 25 bp, Mus musculus
agttcatagcctaccagaaccaaca

SEQ ID NO: 34574 - DNA, 25 bp, Mus musculus
cctaccagaaccaacatgcatccat

SEQ ID NO: 34575 - DNA, 25 bp, Mus musculus
tgtatcactgagttcacccaggcca

SEQ ID NO: 34576 - DNA, 25 bp, Mus musculus
atcactgagttcacccaggccaaca

SEQ ID NO: 34577 - DNA, 25 bp, Mus musculus
gatctttctaagcgctctgagacta

SEQ ID NO: 34578 - DNA, 25 bp, Mus musculus
aagcgctctgagactaaagatatat

SEQ ID NO: 34579 - DNA, 25 bp, Mus musculus
atatacacgctcttcacgtggccac

SEQ ID NO: 34580 - DNA, 25 bp, Mus musculus
ttcacgtggccaccgacaccaagaa

SEQ ID NO: 34581 - DNA, 25 bp, Mus musculus
ccgacaccaagaacgtgcattggtg

SEQ ID NO: 34582 - DNA, 25 bp, Mus musculus
acgtgcattggtgttcgatgccgtc

SEQ ID NO: 34583 - DNA, 25 bp, Mus musculus
tgcattggtgttcgatgccgtcact

SEQ ID NO: 34584 - DNA, 25 bp, Mus musculus
cgtcatcatctagtgcaacctgaaa

SEQ ID NO: 34585 - DNA, 25 bp, Mus musculus
catcatctagtgcaacctgaaagac

SEQ ID NO: 34586 - DNA, 25 bp, Mus musculus
catctagtgcaacctgaaagactgt

SEQ ID NO: 34587 - DNA, 25 bp, Mus musculus
actgagttcacccaggccaacaatt

SEQ ID NO: 34588 - DNA, 25 bp, Mus musculus
caggccaacaattacgtcgacgcag

SEQ ID NO: 34589 - DNA, 25 bp, Mus musculus
agctacatccatagccagtttcatg

SEQ ID NO: 34590 - DNA, 25 bp, Mus musculus
tacatccatagccagtttcatgatc

SEQ ID NO: 34591 - DNA, 25 bp, Mus musculus
atccatagccagtttcatgatcttt

SEQ ID NO: 34592 - DNA, 25 bp, Mus musculus
cagtttcatgatctttctaagcgct

SEQ ID NO: 34593 - DNA, 25 bp, Mus musculus
tttcatgatctttctaagcgctctg

SEQ ID NO: 34594 - DNA, 25 bp, Mus musculus
catgatctttctaagcgctctgaga

SEQ ID NO: 34595 - DNA, 25 bp, Mus musculus
agcgacgtttcaagcaacagaagta

SEQ ID NO: 34596 - DNA, 25 bp, Mus musculus
atctggccagcatgattcacctgac

SEQ ID NO: 34597 - DNA, 25 bp, Mus musculus
tgcaaagccacgcgcagcaacaagc

SEQ ID NO: 34598 - DNA, 25 bp, Mus musculus
gccacgcgcagcaacaagctcagca

SEQ ID NO: 34599 - DNA, 25 bp, Mus musculus
ctgccgcggccatctcagtgggcag

SEQ ID NO: 34600 - DNA, 25 bp, Mus musculus
gcctatcccatctgaactcctcggg

SEQ ID NO: 34601 - DNA, 25 bp, Mus musculus
tgaactcctcgggctcggactatgg

SEQ ID NO: 34602 - DNA, 25 bp, Mus musculus
cctcgggctcggactatggcgccat

SEQ ID NO: 34603 - DNA, 25 bp, Mus musculus
gctcggactatggcgccatgtcttg

SEQ ID NO: 34604 - DNA, 25 bp, Mus musculus
actatggcgccatgtcttgttctac

SEQ ID NO: 34605 - DNA, 25 bp, Mus musculus
gcgccatgtcttgttctaccttgct

SEQ ID NO: 34606 - DNA, 25 bp, Mus musculus
ccttgctttatggtcggacctggtg

SEQ ID NO: 34607 - DNA, 25 bp, Mus musculus
tgattcacctgacacccacgcaggt

SEQ ID NO: 34608 - DNA, 25 bp, Mus musculus
cttgctttatggtcggacctggtga

SEQ ID NO: 34609 - DNA, 25 bp, Mus musculus
accaccgctacaagatgaagcgcca

SEQ ID NO: 34610 - DNA, 25 bp, Mus musculus
agcgccaggctaaggacaaggcggc

SEQ ID NO: 34611 - DNA, 25 bp, Mus musculus
aggcggcgcagcaacaactgcagca

SEQ ID NO: 34612 - DNA, 25 bp, Mus musculus
gcccgcagcagcagcaagctcagca

SEQ ID NO: 34613 - DNA, 25 bp, Mus musculus
tcaaagacggcaaaccctgccaggc

SEQ ID NO: 34614 - DNA, 25 bp, Mus musculus
gagccgcaagcctgcaaagccacgc

SEQ ID NO: 34615 - DNA, 25 bp, Mus musculus
caagcctgcaaagccacgcgcagca

SEQ ID NO: 34616 - DNA, 25 bp, Mus musculus
gaggatgccttctacaaatgggaga

SEQ ID NO: 34617 - DNA, 25 bp, Mus musculus
agcagcaaggaccccgctgagcaag

SEQ ID NO: 34618 - DNA, 25 bp, Mus musculus
tcacgtcttcgccaatcacagtgca

SEQ ID NO: 34619 - DNA, 25 bp, Mus musculus
acgtcttcgccaatcacagtgcagc

SEQ ID NO: 34620 - DNA, 25 bp, Mus musculus
tcgccaatcacagtgcagcaaggcc

SEQ ID NO: 34621 - DNA, 25 bp, Mus musculus
gccaatcacagtgcagcaaggccaa

SEQ ID NO: 34622 - DNA, 25 bp, Mus musculus
caatcacagtgcagcaaggccaact

SEQ ID NO: 34623 - DNA, 25 bp, Mus musculus
gtgcagcaaggccaactctcgcaga

SEQ ID NO: 34624 - DNA, 25 bp, Mus musculus
gcagcaaggccaactctcgcagaaa

SEQ ID NO: 34625 - DNA, 25 bp, Mus musculus
agcaaggccaactctcgcagaaacc

SEQ ID NO: 34626 - DNA, 25 bp, Mus musculus
caactctcgcagaaaccccacgtgt

SEQ ID NO: 34627 - DNA, 25 bp, Mus musculus
actctcgcagaaaccccacgtgtgc

SEQ ID NO: 34628 - DNA, 25 bp, Mus musculus
catcaagtctgtcacggcctttttc

SEQ ID NO: 34629 - DNA, 25 bp, Mus musculus
tcaagtctgtcacggcctttttcac

SEQ ID NO: 34630 - DNA, 25 bp, Mus musculus
gcctttttcacgtggcttcgagaag

SEQ ID NO: 34631 - DNA, 25 bp, Mus musculus
ttttcacgtggcttcgagaagcaga

SEQ ID NO: 34632 - DNA, 25 bp, Mus musculus
ttcacgtggcttcgagaagcagaag

SEQ ID NO: 34633 - DNA, 25 bp, Mus musculus
cacgtggcttcgagaagcagaagag

SEQ ID NO: 34634 - DNA, 25 bp, Mus musculus
agtttcacgtcttcgccaatcacag

SEQ ID NO: 34635 - DNA, 25 bp, Mus musculus
tttcacgtcttcgccaatcacagtg

SEQ ID NO: 34636 - DNA, 25 bp, Mus musculus
atctgctactcaggaatcattaaaa

SEQ ID NO: 34637 - DNA, 25 bp, Mus musculus
attaaaactctgctgagatgtccca

SEQ ID NO: 34638 - DNA, 25 bp, Mus musculus
tccccatcaactggggagcaagaaa

SEQ ID NO: 34639 - DNA, 25 bp, Mus musculus
atctctgtggtgttttagttgggca

SEQ ID NO: 34640 - DNA, 25 bp, Mus musculus
aattgtcacttattccatggactga

SEQ ID NO: 34641 - DNA, 25 bp, Mus musculus
aacacattaagtcagtcacaatgac

SEQ ID NO: 34642 - DNA, 25 bp, Mus musculus
cagtcacaatgacctctagctcagt

SEQ ID NO: 34643 - DNA, 25 bp, Mus musculus
tcatttgtactttccatgcaatgct

SEQ ID NO: 34644 - DNA, 25 bp, Mus musculus
gtactttccatgcaatgctgatgct

SEQ ID NO: 34645 - DNA, 25 bp, Mus musculus
ctttccatgcaatgctgatgctctc

SEQ ID NO: 34646 - DNA, 25 bp, Mus musculus
tccatgcaatgctgatgctctcaaa

SEQ ID NO: 34647 - DNA, 25 bp, Mus musculus
atgcaatgctgatgctctcaaagac

SEQ ID NO: 34648 - DNA, 25 bp, Mus musculus
actctgctgagatgtcccaataaaa

SEQ ID NO: 34649 - DNA, 25 bp, Mus musculus
gcttttcacagcacgtttttagaga

SEQ ID NO: 34650 - DNA, 25 bp, Mus musculus
ttagagaccagctgtgagcagagta

SEQ ID NO: 34651 - DNA, 25 bp, Mus musculus
tgtgtcaacccagtaatctacgcct

SEQ ID NO: 34652 - DNA, 25 bp, Mus musculus
cggctctttttccacagaaatgtgg

SEQ ID NO: 34653 - DNA, 25 bp, Mus musculus
tttttccacagaaatgtggcagttt

SEQ ID NO: 34654 - DNA, 25 bp, Mus musculus
tatattccatttcttcctggtgaga

SEQ ID NO: 34655 - DNA, 25 bp, Mus musculus
acaagctctgtctccccatcaactg

SEQ ID NO: 34656 - DNA, 25 bp, Mus musculus
cccctacaatctgagtgtatttgtt

SEQ ID NO: 34657 - DNA, 25 bp, Mus musculus
tttccaagatgttctattcaccaat

SEQ ID NO: 34658 - DNA, 25 bp, Mus musculus
ctgattcagaccgtaggtgtcaacc

SEQ ID NO: 34659 - DNA, 25 bp, Mus musculus
atatagctctccaagacggatactg

SEQ ID NO: 34660 - DNA, 25 bp, Mus musculus
ctctccaagacggatactgacagtt

SEQ ID NO: 34661 - DNA, 25 bp, Mus musculus
gatactgacagttcttacagtcagg

SEQ ID NO: 34662 - DNA, 25 bp, Mus musculus
gacagttcttacagtcaggattccc

SEQ ID NO: 34663 - DNA, 25 bp, Mus musculus
tcttacagtcaggattcccaatctt

SEQ ID NO: 34664 - DNA, 25 bp, Mus musculus
gattcccaatcttgtagggtcaaag

SEQ ID NO: 34665 - DNA, 25 bp, Mus musculus
taggtataagtcacctctttaattg

SEQ ID NO: 34666 - DNA, 25 bp, Mus musculus
gtttccttgaacttctctctgttag

SEQ ID NO: 34667 - DNA, 25 bp, Mus musculus
ttgaacttctctctgttagaaagga

SEQ ID NO: 34668 - DNA, 25 bp, Mus musculus
agatgttctattcaccaatcagtgt

SEQ ID NO: 34669 - DNA, 25 bp, Mus musculus
tctattcaccaatcagtgtgagcag

SEQ ID NO: 34670 - DNA, 25 bp, Mus musculus
caccaatcagtgtgagcagagtaaa

SEQ ID NO: 34671 - DNA, 25 bp, Mus musculus
gaagtaccttcggcagctgtttcaa

SEQ ID NO: 34672 - DNA, 25 bp, Mus musculus
tgtggctataccactggcaaaatgg

SEQ ID NO: 34673 - DNA, 25 bp, Mus musculus
cttcctctctgtggaccaactagaa

SEQ ID NO: 34674 - DNA, 25 bp, Mus musculus
tccatccacaggagaacatgagctc

SEQ ID NO: 34675 - DNA, 25 bp, Mus musculus
tggcttctgattcagaccgtaggtg

SEQ ID NO: 34676 - DNA, 25 bp, Mus musculus
gttgacggcaagctctacatcctgc

SEQ ID NO: 34677 - DNA, 25 bp, Mus musculus
gacggcaagctctacatcctgcagg

SEQ ID NO: 34678 - DNA, 25 bp, Mus musculus
accactacaagctcaaggcccacag

SEQ ID NO: 34679 - DNA, 25 bp, Mus musculus
cactacaagctcaaggcccacagcg

SEQ ID NO: 34680 - DNA, 25 bp, Mus musculus
ctcaaggcccacagcgccgtgctgg

SEQ ID NO: 34681 - DNA, 25 bp, Mus musculus
tcaaggcccacagcgccgtgctggc

SEQ ID NO: 34682 - DNA, 25 bp, Mus musculus
aaggcccacagcgccgtgctggccg

SEQ ID NO: 34683 - DNA, 25 bp, Mus musculus
gcgcgccatctgcagaagtatcggc

SEQ ID NO: 34684 - DNA, 25 bp, Mus musculus
cgcgccatctgcagaagtatcggca

SEQ ID NO: 34685 - DNA, 25 bp, Mus musculus
gcgccatctgcagaagtatcggcac

SEQ ID NO: 34686 - DNA, 25 bp, Mus musculus
gccatctgcagaagtatcggcaccg

SEQ ID NO: 34687 - DNA, 25 bp, Mus musculus
ccatctgcagaagtatcggcaccgg

SEQ ID NO: 34688 - DNA, 25 bp, Mus musculus
acggcaagctctacatcctgcaggc

SEQ ID NO: 34689 - DNA, 25 bp, Mus musculus
ggcaagctctacatcctgcaggccc

SEQ ID NO: 34690 - DNA, 25 bp, Mus musculus
agagccaggccgccgcagagtcgag

SEQ ID NO: 34691 - DNA, 25 bp, Mus musculus
cgcagagtcgagcaccactacaagc

SEQ ID NO: 34692 - DNA, 25 bp, Mus musculus
gagtcgagcaccactacaagctcaa

SEQ ID NO: 34693 - DNA, 25 bp, Mus musculus
agtcgagcaccactacaagctcaag

SEQ ID NO: 34694 - DNA, 25 bp, Mus musculus
tcgagcaccactacaagctcaaggc

SEQ ID NO: 34695 - DNA, 25 bp, Mus musculus
gagcaccactacaagctcaaggccc

SEQ ID NO: 34696 - DNA, 25 bp, Mus musculus
acccattgtctgtcacaccagaagg

SEQ ID NO: 34697 - DNA, 25 bp, Mus musculus
tgtctgtcacaccagaaggttctag

SEQ ID NO: 34698 - DNA, 25 bp, Mus musculus
gtggtccctgagcggaggataagca

SEQ ID NO: 34699 - DNA, 25 bp, Mus musculus
ataagcagcatcagactccacaacc

SEQ ID NO: 34700 - DNA, 25 bp, Mus musculus
agactccacaaccagaggaagaaag

SEQ ID NO: 34701 - DNA, 25 bp, Mus musculus
agacccacgggctgagtcccgctgt

SEQ ID NO: 34702 - DNA, 25 bp, Mus musculus
tgagtcccgctgtggagtggccttg

SEQ ID NO: 34703 - DNA, 25 bp, Mus musculus
ccgctgtggagtggccttgcagctc

SEQ ID NO: 34704 - DNA, 25 bp, Mus musculus
ccagtaaagccacagttctccgagc

SEQ ID NO: 34705 - DNA, 25 bp, Mus musculus
aagccacagttctccgagcacccaa

SEQ ID NO: 34706 - DNA, 25 bp, Mus musculus
agtctgctccagccgtctcttaaaa

SEQ ID NO: 34707 - DNA, 25 bp, Mus musculus
cttaaaacaggccactctctgagaa

SEQ ID NO: 34708 - DNA, 25 bp, Mus musculus
tcacaccagaaggttctagacctac

SEQ ID NO: 34709 - DNA, 25 bp, Mus musculus
caggccactctctgagaaggaattc

SEQ ID NO: 34710 - DNA, 25 bp, Mus musculus
atctcatggaaaccttttagcccat

SEQ ID NO: 34711 - DNA, 25 bp, Mus musculus
agcccattctgacccctgtgtgtgc

SEQ ID NO: 34712 - DNA, 25 bp, Mus musculus
tgtgtgctctgagctcagatcgggt

SEQ ID NO: 34713 - DNA, 25 bp, Mus musculus
ctctgagctcagatcgggttatgag

SEQ ID NO: 34714 - DNA, 25 bp, Mus musculus
ttatgagaccgcccaggcacatcag

SEQ ID NO: 34715 - DNA, 25 bp, Mus musculus
tgagccgcagacctctgtgttcatt

SEQ ID NO: 34716 - DNA, 25 bp, Mus musculus
gcagacctctgtgttcattcctatg

SEQ ID NO: 34717 - DNA, 25 bp, Mus musculus
tgcggcaaggcttcgctgatagctc

SEQ ID NO: 34718 - DNA, 25 bp, Mus musculus
aaggcttcgctgatagctcttacct

SEQ ID NO: 34719 - DNA, 25 bp, Mus musculus
cagtcaccaaagggtgcacactggg

SEQ ID NO: 34720 - DNA, 25 bp, Mus musculus
tcaccaaagggtgcacactgggcaa

SEQ ID NO: 34721 - DNA, 25 bp, Mus musculus
gcacactgggcaacggcctttcagc

SEQ ID NO: 34722 - DNA, 25 bp, Mus musculus
tgggcaacggcctttcagctgtggc

SEQ ID NO: 34723 - DNA, 25 bp, Mus musculus
gcaacggcctttcagctgtggcatc

SEQ ID NO: 34724 - DNA, 25 bp, Mus musculus
acggcctttcagctgtggcatctgt

SEQ ID NO: 34725 - DNA, 25 bp, Mus musculus
tttcagctgtggcatctgtggcaaa

SEQ ID NO: 34726 - DNA, 25 bp, Mus musculus
cagctgtggcatctgtggcaaaagc

SEQ ID NO: 34727 - DNA, 25 bp, Mus musculus
tggcaaaagcttctcccaacggtca

SEQ ID NO: 34728 - DNA, 25 bp, Mus musculus
cttctcccaacggtcagcacttatc

SEQ ID NO: 34729 - DNA, 25 bp, Mus musculus
tcgctgatagctcttacctactccg

SEQ ID NO: 34730 - DNA, 25 bp, Mus musculus
gtacccactctggccagaagcccta

SEQ ID NO: 34731 - DNA, 25 bp, Mus musculus
cctacaaatgtccacactgtgggaa

SEQ ID NO: 34732 - DNA, 25 bp, Mus musculus
gaggccctacagctgccccgagtgt

SEQ ID NO: 34733 - DNA, 25 bp, Mus musculus
gtgctatagccagaactcgtccctg

SEQ ID NO: 34734 - DNA, 25 bp, Mus musculus
tagccagaactcgtccctgcgcagt

SEQ ID NO: 34735 - DNA, 25 bp, Mus musculus
ctcgtccctgcgcagtcaccaaagg

SEQ ID NO: 34736 - DNA, 25 bp, Mus musculus
gtccctgcgcagtcaccaaagggtg

SEQ ID NO: 34737 - DNA, 25 bp, Mus musculus
ttcttggctctgcgtcagtaccctg

SEQ ID NO: 34738 - DNA, 25 bp, Mus musculus
cagtaccctgatgccttctcgagtt

SEQ ID NO: 34739 - DNA, 25 bp, Mus musculus
ttgtcgctacacttcctacctagag

SEQ ID NO: 34740 - DNA, 25 bp, Mus musculus
tgcgcagcacctctgctttccaagg

SEQ ID NO: 34741 - DNA, 25 bp, Mus musculus
gcgttcccattcgttgctgaatttg

SEQ ID NO: 34742 - DNA, 25 bp, Mus musculus
tcatgcctgttgctctcaggtatac

SEQ ID NO: 34743 - DNA, 25 bp, Mus musculus
accctctttctacctcaaatcagtg

SEQ ID NO: 34744 - DNA, 25 bp, Mus musculus
ctctttctacctcaaatcagtgtga

SEQ ID NO: 34745 - DNA, 25 bp, Mus musculus
ctacctcaaatcagtgtgaccactc

SEQ ID NO: 34746 - DNA, 25 bp, Mus musculus
caaatcagtgtgaccactcgcagcc

SEQ ID NO: 34747 - DNA, 25 bp, Mus musculus
ctttgccaaagcagtatctatgctc

SEQ ID NO: 34748 - DNA, 25 bp, Mus musculus
agtatctatgctcttgacttaataa

SEQ ID NO: 34749 - DNA, 25 bp, Mus musculus
cctgatgccttctcgagttaaaatg

SEQ ID NO: 34750 - DNA, 25 bp, Mus musculus
gatgccttctcgagttaaaatgcaa

SEQ ID NO: 34751 - DNA, 25 bp, Mus musculus
ggaagactgacgctgcctgggttga

SEQ ID NO: 34752 - DNA, 25 bp, Mus musculus
ctgacgctgcctgggttgacctctc

SEQ ID NO: 34753 - DNA, 25 bp, Mus musculus
gggttgacctctcctgagcagcgat

SEQ ID NO: 34754 - DNA, 25 bp, Mus musculus
ttgacctctcctgagcagcgatggt

SEQ ID NO: 34755 - DNA, 25 bp, Mus musculus
acctctcctgagcagcgatggtttt

SEQ ID NO: 34756 - DNA, 25 bp, Mus musculus
tccttcttgtcgctacacttcctac

SEQ ID NO: 34757 - DNA, 25 bp, Mus musculus
tgggcagtaaccccagcaacgcaga

SEQ ID NO: 34758 - DNA, 25 bp, Mus musculus
gcagtaaccccagcaacgcagaggt

SEQ ID NO: 34759 - DNA, 25 bp, Mus musculus
cttcgagatgttcctgcccatcctg

SEQ ID NO: 34760 - DNA, 25 bp, Mus musculus
ctcccgcaacaaggagcagtgcacc

SEQ ID NO: 34761 - DNA, 25 bp, Mus musculus
cacctatgacgacttcgtggattgg

SEQ ID NO: 34762 - DNA, 25 bp, Mus musculus
ctatgacgacttcgtggattggctg

SEQ ID NO: 34763 - DNA, 25 bp, Mus musculus
cgtggattggctgcgggtctttgac

SEQ ID NO: 34764 - DNA, 25 bp, Mus musculus
ggattggctgcgggtctttgacaaa

SEQ ID NO: 34765 - DNA, 25 bp, Mus musculus
ctttgacaaatacagcacggcacag

SEQ ID NO: 34766 - DNA, 25 bp, Mus musculus
caaatacagcacggcacagtcatgg

SEQ ID NO: 34767 - DNA, 25 bp, Mus musculus
atacagcacggcacagtcatgggtg

SEQ ID NO: 34768 - DNA, 25 bp, Mus musculus
cagcacggcacagtcatgggtgcag

SEQ ID NO: 34769 - DNA, 25 bp, Mus musculus
ttttgggcaacccaagcctgaagag

SEQ ID NO: 34770 - DNA, 25 bp, Mus musculus
tgggcaacccaagcctgaagagatg

SEQ ID NO: 34771 - DNA, 25 bp, Mus musculus
gcaacccaagcctgaagagatgagt

SEQ ID NO: 34772 - DNA, 25 bp, Mus musculus
acccaagcctgaagagatgagttcc

SEQ ID NO: 34773 - DNA, 25 bp, Mus musculus
gagttccaagacactggacttcgag

SEQ ID NO: 34774 - DNA, 25 bp, Mus musculus
ttccaagacactggacttcgagatg

SEQ ID NO: 34775 - DNA, 25 bp, Mus musculus
gacactggacttcgagatgttcctg

SEQ ID NO: 34776 - DNA, 25 bp, Mus musculus
ggacttcgagatgttcctgcccatc

SEQ ID NO: 34777 - DNA, 25 bp, Mus musculus
ccagaagaccttaatctcttcttca

SEQ ID NO: 34778 - DNA, 25 bp, Mus musculus
actgccacctgccaagatggcatat

SEQ ID NO: 34779 - DNA, 25 bp, Mus musculus
tcctttgaagtgtccgtggaggctc

SEQ ID NO: 34780 - DNA, 25 bp, Mus musculus
agctgccccggcagacaagcagcac

SEQ ID NO: 34781 - DNA, 25 bp, Mus musculus
agacaagcagcacagtctttcacct

SEQ ID NO: 34782 - DNA, 25 bp, Mus musculus
gcagcacagtctttcaccttgaggc

SEQ ID NO: 34783 - DNA, 25 bp, Mus musculus
cagtctttcaccttgaggcccgtgg

SEQ ID NO: 34784 - DNA, 25 bp, Mus musculus
tggaagtcgcctacaattgcacatg

SEQ ID NO: 34785 - DNA, 25 bp, Mus musculus
aagtcgcctacaattgcacatgcgg

SEQ ID NO: 34786 - DNA, 25 bp, Mus musculus
cctacaattgcacatgcggctgtag

SEQ ID NO: 34787 - DNA, 25 bp, Mus musculus
acaattgcacatgcggctgtagcac

SEQ ID NO: 34788 - DNA, 25 bp, Mus musculus
attgcacatgcggctgtagcacggg

SEQ ID NO: 34789 - DNA, 25 bp, Mus musculus
gccacctgccaagatggcatatctt

SEQ ID NO: 34790 - DNA, 25 bp, Mus musculus
agccaacagtgccagatgcagtggg

SEQ ID NO: 34791 - DNA, 25 bp, Mus musculus
acctgccaagatggcatatcttacc

SEQ ID NO: 34792 - DNA, 25 bp, Mus musculus
ggcatatcttaccctggtcagagga

SEQ ID NO: 34793 - DNA, 25 bp, Mus musculus
tcttaccctggtcagaggaagtgtg

SEQ ID NO: 34794 - DNA, 25 bp, Mus musculus
taccctggtcagaggaagtgtgagg

SEQ ID NO: 34795 - DNA, 25 bp, Mus musculus
attggggacacggcatcctttgaag

SEQ ID NO: 34796 - DNA, 25 bp, Mus musculus
gacacggcatcctttgaagtgtccg

SEQ ID NO: 34797 - DNA, 25 bp, Mus musculus
gcatcctttgaagtgtccgtggagg

SEQ ID NO: 34798 - DNA, 25 bp, Mus musculus
acttctgctgcctcagcttcatacg

SEQ ID NO: 34799 - DNA, 25 bp, Mus musculus
ttctgctgcctcagcttcatacgct

SEQ ID NO: 34800 - DNA, 25 bp, Mus musculus
atacgctatgcctactccgctgagt

SEQ ID NO: 34801 - DNA, 25 bp, Mus musculus
gcctactccgctgagtctagggatc

SEQ ID NO: 34802 - DNA, 25 bp, Mus musculus
cctactccgctgagtctagggatcg

SEQ ID NO: 34803 - DNA, 25 bp, Mus musculus
tactccgctgagtctagggatcgga

SEQ ID NO: 34804 - DNA, 25 bp, Mus musculus
actccgctgagtctagggatcggaa

SEQ ID NO: 34805 - DNA, 25 bp, Mus musculus
tccgctgagtctagggatcggaaga

SEQ ID NO: 34806 - DNA, 25 bp, Mus musculus
tacgcctccactgctaagtgcctga

SEQ ID NO: 34807 - DNA, 25 bp, Mus musculus
acgcctccactgctaagtgcctgaa

SEQ ID NO: 34808 - DNA, 25 bp, Mus musculus
gcctccactgctaagtgcctgaaca

SEQ ID NO: 34809 - DNA, 25 bp, Mus musculus
cctccactgctaagtgcctgaacat

SEQ ID NO: 34810 - DNA, 25 bp, Mus musculus
tctgctgcctcagcttcatacgcta

SEQ ID NO: 34811 - DNA, 25 bp, Mus musculus
ctccactgctaagtgcctgaacatc

SEQ ID NO: 34812 - DNA, 25 bp, Mus musculus
tgctgcctcagcttcatacgctatg

SEQ ID NO: 34813 - DNA, 25 bp, Mus musculus
tgcctcagcttcatacgctatgcct

SEQ ID NO: 34814 - DNA, 25 bp, Mus musculus
gcctcagcttcatacgctatgccta

SEQ ID NO: 34815 - DNA, 25 bp, Mus musculus
tcagcttcatacgctatgcctactc

SEQ ID NO: 34816 - DNA, 25 bp, Mus musculus
gcttcatacgctatgcctactccgc

SEQ ID NO: 34817 - DNA, 25 bp, Mus musculus
ttcatacgctatgcctactccgctg

SEQ ID NO: 34818 - DNA, 25 bp, Mus musculus
tcatacgctatgcctactccgctga

SEQ ID NO: 34819 - DNA, 25 bp, Mus musculus
cctcctaagcgtcagccataactga

SEQ ID NO: 34820 - DNA, 25 bp, Mus musculus
aagcgtcagccataactgaaaccca

SEQ ID NO: 34821 - DNA, 25 bp, Mus musculus
tacgatgaaacctaccttcctgtat

SEQ ID NO: 34822 - DNA, 25 bp, Mus musculus
taccttcctgtatctgatgttaata

SEQ ID NO: 34823 - DNA, 25 bp, Mus musculus
attccagaaatattctgcctctcag

SEQ ID NO: 34824 - DNA, 25 bp, Mus musculus
ttctgcctctcagaaaacatattta

SEQ ID NO: 34825 - DNA, 25 bp, Mus musculus
ataacagtgcctcataaatagtaat

SEQ ID NO: 34826 - DNA, 25 bp, Mus musculus
gattcacttcgtgtgtttgcacttc

SEQ ID NO: 34827 - DNA, 25 bp, Mus musculus
cttcgtgtgtttgcacttcaaaagc

SEQ ID NO: 34828 - DNA, 25 bp, Mus musculus
aaagcttgtccgggacctgcaagcg

SEQ ID NO: 34829 - DNA, 25 bp, Mus musculus
tgtccgggacctgcaagcgaaccat

SEQ ID NO: 34830 - DNA, 25 bp, Mus musculus
ggacctgcaagcgaaccattccact

SEQ ID NO: 34831 - DNA, 25 bp, Mus musculus
cagccataactgaaacccagcacaa

SEQ ID NO: 34832 - DNA, 25 bp, Mus musculus
caagcgaaccattccactctttccg

SEQ ID NO: 34833 - DNA, 25 bp, Mus musculus
taactgaaacccagcacaagtgact

SEQ ID NO: 34834 - DNA, 25 bp, Mus musculus
aaacccagcacaagtgactcactca

SEQ ID NO: 34835 - DNA, 25 bp, Mus musculus
agcacaagtgactcactcagactgc

SEQ ID NO: 34836 - DNA, 25 bp, Mus musculus
tcactcagactgcatctttactagt

SEQ ID NO: 34837 - DNA, 25 bp, Mus musculus
agactgcatctttactagtgtagct

SEQ ID NO: 34838 - DNA, 25 bp, Mus musculus
catctttactagtgtagctttttca

SEQ ID NO: 34839 - DNA, 25 bp, Mus musculus
atgccatacgatgaaacctaccttc

SEQ ID NO: 34840 - DNA, 25 bp, Mus musculus
tatccagacccctgagcagtactac

SEQ ID NO: 34841 - DNA, 25 bp, Mus musculus
gacccctgagcagtactacttttgc

SEQ ID NO: 34842 - DNA, 25 bp, Mus musculus
aaactaccctggacactgctgagcc

SEQ ID NO: 34843 - DNA, 25 bp, Mus musculus
ccctggacactgctgagcctatagg

SEQ ID NO: 34844 - DNA, 25 bp, Mus musculus
acactgctgagcctataggttgcca

SEQ ID NO: 34845 - DNA, 25 bp, Mus musculus
ctgagcctataggttgccatcagtt

SEQ ID NO: 34846 - DNA, 25 bp, Mus musculus
gttgccatcagttatgctgaagcca

SEQ ID NO: 34847 - DNA, 25 bp, Mus musculus
tatgctgaagccatggatcaacctc

SEQ ID NO: 34848 - DNA, 25 bp, Mus musculus
gaagccatggatcaacctctttcct

SEQ ID NO: 34849 - DNA, 25 bp, Mus musculus
ctttcctgtgtctcccagcgcacat

SEQ ID NO: 34850 - DNA, 25 bp, Mus musculus
tgtgtctcccagcgcacatgtgcac

SEQ ID NO: 34851 - DNA, 25 bp, Mus musculus
tcccagcgcacatgtgcacgcaagg

SEQ ID NO: 34852 - DNA, 25 bp, Mus musculus
gtactacttttgctacaaggcaatt

SEQ ID NO: 34853 - DNA, 25 bp, Mus musculus
cgcacatgtgcacgcaaggcagcct

SEQ ID NO: 34854 - DNA, 25 bp, Mus musculus
catggttccctctggtcacagcctg

SEQ ID NO: 34855 - DNA, 25 bp, Mus musculus
gttggccatggacggtcaataactg

SEQ ID NO: 34856 - DNA, 25 bp, Mus musculus
cggtcaataactgctccacaagttt

SEQ ID NO: 34857 - DNA, 25 bp, Mus musculus
ataactgctccacaagtttccacct

SEQ ID NO: 34858 - DNA, 25 bp, Mus musculus
caagtttccacctgctggtcagcct

SEQ ID NO: 34859 - DNA, 25 bp, Mus musculus
tccacctgctggtcagccttcctta

SEQ ID NO: 34860 - DNA, 25 bp, Mus musculus
tgctggtcagccttccttaaactac

SEQ ID NO: 34861 - DNA, 25 bp, Mus musculus
aagtctcacgcgacaccctgtacga

SEQ ID NO: 34862 - DNA, 25 bp, Mus musculus
tctcacgcgacaccctgtacgaggc

SEQ ID NO: 34863 - DNA, 25 bp, Mus musculus
tttctcgggcaccgtcaggctcaag

SEQ ID NO: 34864 - DNA, 25 bp, Mus musculus
caagttctcggtgtgcgttctgggg

SEQ ID NO: 34865 - DNA, 25 bp, Mus musculus
cgttctgggggaccagcagcactgt

SEQ ID NO: 34866 - DNA, 25 bp, Mus musculus
ggaccagcagcactgtgatgaagcc

SEQ ID NO: 34867 - DNA, 25 bp, Mus musculus
ccagcagcactgtgatgaagccaag

SEQ ID NO: 34868 - DNA, 25 bp, Mus musculus
tgatgaagccaaggccgtggatatc

SEQ ID NO: 34869 - DNA, 25 bp, Mus musculus
agccaaggccgtggatatccccaca

SEQ ID NO: 34870 - DNA, 25 bp, Mus musculus
ggatatccccacatggacatcgagg

SEQ ID NO: 34871 - DNA, 25 bp, Mus musculus
tatccccacatggacatcgaggcgc

SEQ ID NO: 34872 - DNA, 25 bp, Mus musculus
ccccacatggacatcgaggcgctca

SEQ ID NO: 34873 - DNA, 25 bp, Mus musculus
cacgcgacaccctgtacgaggcggt

SEQ ID NO: 34874 - DNA, 25 bp, Mus musculus
aagtcctgcacgggaaccagcgcaa

SEQ ID NO: 34875 - DNA, 25 bp, Mus musculus
tcctgcacgggaaccagcgcaacgc

SEQ ID NO: 34876 - DNA, 25 bp, Mus musculus
tgcacgggaaccagcgcaacgccgc

SEQ ID NO: 34877 - DNA, 25 bp, Mus musculus
ggaaccagcgcaacgccgcaagttt

SEQ ID NO: 34878 - DNA, 25 bp, Mus musculus
accagcgcaacgccgcaagtttctg

SEQ ID NO: 34879 - DNA, 25 bp, Mus musculus
acgccgcaagtttctggagacggtg

SEQ ID NO: 34880 - DNA, 25 bp, Mus musculus
cctgaagaactacgaccctcagaag

SEQ ID NO: 34881 - DNA, 25 bp, Mus musculus
cagccggagctggagggcagctact

SEQ ID NO: 34882 - DNA, 25 bp, Mus musculus
ggcagctactgtgtgacctcccatg

SEQ ID NO: 34883 - DNA, 25 bp, Mus musculus
agcgcaccaccgggtagttggcctg

SEQ ID NO: 34884 - DNA, 25 bp, Mus musculus
tagttggcctgggactacagaggct

SEQ ID NO: 34885 - DNA, 25 bp, Mus musculus
agttggcctgggactacagaggctc

SEQ ID NO: 34886 - DNA, 25 bp, Mus musculus
gttggcctgggactacagaggctcg

SEQ ID NO: 34887 - DNA, 25 bp, Mus musculus
ttggcctgggactacagaggctcgt

SEQ ID NO: 34888 - DNA, 25 bp, Mus musculus
ggactacagaggctcgttgggaaga

SEQ ID NO: 34889 - DNA, 25 bp, Mus musculus
gactacagaggctcgttgggaagaa

SEQ ID NO: 34890 - DNA, 25 bp, Mus musculus
actacagaggctcgttgggaagaag

SEQ ID NO: 34891 - DNA, 25 bp, Mus musculus
agctactgtgtgacctcccatgatt

SEQ ID NO: 34892 - DNA, 25 bp, Mus musculus
gctactgtgtgacctcccatgattc

SEQ ID NO: 34893 - DNA, 25 bp, Mus musculus
ctactgtgtgacctcccatgattcc

SEQ ID NO: 34894 - DNA, 25 bp, Mus musculus
actagaataggctccagccgcggcc

SEQ ID NO: 34895 - DNA, 25 bp, Mus musculus
ctagaataggctccagccgcggccc

SEQ ID NO: 34896 - DNA, 25 bp, Mus musculus
tagaataggctccagccgcggccct

SEQ ID NO: 34897 - DNA, 25 bp, Mus musculus
agaataggctccagccgcggcccta

SEQ ID NO: 34898 - DNA, 25 bp, Mus musculus
taggctccagccgcggccctactga

SEQ ID NO: 34899 - DNA, 25 bp, Mus musculus
ctcccactgccaggaggctggcgct

SEQ ID NO: 34900 - DNA, 25 bp, Mus musculus
tggcgctactttgggctgctacaac

SEQ ID NO: 34901 - DNA, 25 bp, Mus musculus
aatggaatcctcctgctgtgcaacc

SEQ ID NO: 34902 - DNA, 25 bp, Mus musculus
acttccttcctatgttctcacatca

SEQ ID NO: 34903 - DNA, 25 bp, Mus musculus
ttcctatgttctcacatcacactca

SEQ ID NO: 34904 - DNA, 25 bp, Mus musculus
cacatcacactcaaactggtgacac

SEQ ID NO: 34905 - DNA, 25 bp, Mus musculus
acactcaaactggtgacaccacagg

SEQ ID NO: 34906 - DNA, 25 bp, Mus musculus
tgtttccatggacacaatctccata

SEQ ID NO: 34907 - DNA, 25 bp, Mus musculus
catggacacaatctccatagtgaca

SEQ ID NO: 34908 - DNA, 25 bp, Mus musculus
cacaatctccatagtgacaatgtgg

SEQ ID NO: 34909 - DNA, 25 bp, Mus musculus
gaaaggtgcgctatcccttttgatt

SEQ ID NO: 34910 - DNA, 25 bp, Mus musculus
atttgttccaatgacaatgaaattt

SEQ ID NO: 34911 - DNA, 25 bp, Mus musculus
tactttgggctgctacaacaaggct

SEQ ID NO: 34912 - DNA, 25 bp, Mus musculus
caaggctgctccttccgataccatt

SEQ ID NO: 34913 - DNA, 25 bp, Mus musculus
tgctccttccgataccattacccat

SEQ ID NO: 34914 - DNA, 25 bp, Mus musculus
ttccgataccattacccatgtgcca

SEQ ID NO: 34915 - DNA, 25 bp, Mus musculus
taccattacccatgtgccattgacg

SEQ ID NO: 34916 - DNA, 25 bp, Mus musculus
tgtgccattgacgcagattgtttgc

SEQ ID NO: 34917 - DNA, 25 bp, Mus musculus
tgtttgctgcatgaggagaatttct

SEQ ID NO: 34918 - DNA, 25 bp, Mus musculus
aggtgccccaagcacaaggtgagac

SEQ ID NO: 34919 - DNA, 25 bp, Mus musculus
gatgaccttttggagctgttagcag

SEQ ID NO: 34920 - DNA, 25 bp, Mus musculus
atgaccttttggagctgttagcaga

SEQ ID NO: 34921 - DNA, 25 bp, Mus musculus
agtaaactcaaggatctcggtcatc

SEQ ID NO: 34922 - DNA, 25 bp, Mus musculus
taaactcaaggatctcggtcatcca

SEQ ID NO: 34923 - DNA, 25 bp, Mus musculus
aaactcaaggatctcggtcatccag

SEQ ID NO: 34924 - DNA, 25 bp, Mus musculus
aactcaaggatctcggtcatccagt

SEQ ID NO: 34925 - DNA, 25 bp, Mus musculus
ctcaaggatctcggtcatccagttg

SEQ ID NO: 34926 - DNA, 25 bp, Mus musculus
caaggatctcggtcatccagttgaa

SEQ ID NO: 34927 - DNA, 25 bp, Mus musculus
aggatctcggtcatccagttgaaga

SEQ ID NO: 34928 - DNA, 25 bp, Mus musculus
ggatctcggtcatccagttgaagaa

SEQ ID NO: 34929 - DNA, 25 bp, Mus musculus
ctcggtcatccagttgaagaagaag

SEQ ID NO: 34930 - DNA, 25 bp, Mus musculus
tcggtcatccagttgaagaagaaga

SEQ ID NO: 34931 - DNA, 25 bp, Mus musculus
tgaccttttggagctgttagcagat

SEQ ID NO: 34932 - DNA, 25 bp, Mus musculus
accttttggagctgttagcagatca

SEQ ID NO: 34933 - DNA, 25 bp, Mus musculus
ccttttggagctgttagcagatcaa

SEQ ID NO: 34934 - DNA, 25 bp, Mus musculus
cttttggagctgttagcagatcaag

SEQ ID NO: 34935 - DNA, 25 bp, Mus musculus
tcagaaaatcctgtcactgaagagt

SEQ ID NO: 34936 - DNA, 25 bp, Mus musculus
cagaaaatcctgtcactgaagagta

SEQ ID NO: 34937 - DNA, 25 bp, Mus musculus
aaatcctgtcactgaagagtaaact

SEQ ID NO: 34938 - DNA, 25 bp, Mus musculus
aatcctgtcactgaagagtaaactc

SEQ ID NO: 34939 - DNA, 25 bp, Mus musculus
ggtccagacagtcctctactgcgat

SEQ ID NO: 34940 - DNA, 25 bp, Mus musculus
ccagacagtcctctactgcgatttc

SEQ ID NO: 34941 - DNA, 25 bp, Mus musculus
tatcaccaaagtcctgaaggggaag

SEQ ID NO: 34942 - DNA, 25 bp, Mus musculus
gctgagcttgccaggcataaccctg

SEQ ID NO: 34943 - DNA, 25 bp, Mus musculus
cttgccaggcataaccctggcctca

SEQ ID NO: 34944 - DNA, 25 bp, Mus musculus
ctcaccagccttctctgaggcaggg

SEQ ID NO: 34945 - DNA, 25 bp, Mus musculus
accagccttctctgaggcagggcag

SEQ ID NO: 34946 - DNA, 25 bp, Mus musculus
agccttctctgaggcagggcaggag

SEQ ID NO: 34947 - DNA, 25 bp, Mus musculus
cttctctgaggcagggcaggaggca

SEQ ID NO: 34948 - DNA, 25 bp, Mus musculus
ctgctggagcccgagagccttccat

SEQ ID NO: 34949 - DNA, 25 bp, Mus musculus
gagcccgagagccttccatccagag

SEQ ID NO: 34950 - DNA, 25 bp, Mus musculus
cccgagagccttccatccagagctg

SEQ ID NO: 34951 - DNA, 25 bp, Mus musculus
gacagtcctctactgcgatttcttc

SEQ ID NO: 34952 - DNA, 25 bp, Mus musculus
cgagagccttccatccagagctgac

SEQ ID NO: 34953 - DNA, 25 bp, Mus musculus
agtcctctactgcgatttcttctac

SEQ ID NO: 34954 - DNA, 25 bp, Mus musculus
cctctactgcgatttcttctacctc

SEQ ID NO: 34955 - DNA, 25 bp, Mus musculus
ctgcgatttcttctacctctatatc

SEQ ID NO: 34956 - DNA, 25 bp, Mus musculus
cgatttcttctacctctatatcacc

SEQ ID NO: 34957 - DNA, 25 bp, Mus musculus
tttcttctacctctatatcaccaaa

SEQ ID NO: 34958 - DNA, 25 bp, Mus musculus
cctctatatcaccaaagtcctgaag

SEQ ID NO: 34959 - DNA, 25 bp, Mus musculus
ctatatcaccaaagtcctgaagggg

SEQ ID NO: 34960 - DNA, 25 bp, Mus musculus
cgcgccatcggcagcaagatcggca

SEQ ID NO: 34961 - DNA, 25 bp, Mus musculus
gcgccatcggcagcaagatcggcac

SEQ ID NO: 34962 - DNA, 25 bp, Mus musculus
ccggtcatgaagcgcgccagtgcca

SEQ ID NO: 34963 - DNA, 25 bp, Mus musculus
cggtcatgaagcgcgccagtgccat

SEQ ID NO: 34964 - DNA, 25 bp, Mus musculus
ggtcatgaagcgcgccagtgccatc

SEQ ID NO: 34965 - DNA, 25 bp, Mus musculus
gtcatgaagcgcgccagtgccatcg

SEQ ID NO: 34966 - DNA, 25 bp, Mus musculus
tcatgaagcgcgccagtgccatcgt

SEQ ID NO: 34967 - DNA, 25 bp, Mus musculus
atgaagcgcgccagtgccatcgtca

SEQ ID NO: 34968 - DNA, 25 bp, Mus musculus
cgccatcggcagcaagatcggcacc

SEQ ID NO: 34969 - DNA, 25 bp, Mus musculus
gccatcggcagcaagatcggcaccg

SEQ ID NO: 34970 - DNA, 25 bp, Mus musculus
ccatcggcagcaagatcggcaccgg

SEQ ID NO: 34971 - DNA, 25 bp, Mus musculus
catcggcagcaagatcggcaccggc

SEQ ID NO: 34972 - DNA, 25 bp, Mus musculus
ccccaactgggagccggtcatgaag

SEQ ID NO: 34973 - DNA, 25 bp, Mus musculus
cccaactgggagccggtcatgaagc

SEQ ID NO: 34974 - DNA, 25 bp, Mus musculus
ccaactgggagccggtcatgaagcg

SEQ ID NO: 34975 - DNA, 25 bp, Mus musculus
caactgggagccggtcatgaagcgc

SEQ ID NO: 34976 - DNA, 25 bp, Mus musculus
ctgtaccccagggccttgcatttgc

SEQ ID NO: 34977 - DNA, 25 bp, Mus musculus
cccagggccttgcatttgctaatgg

SEQ ID NO: 34978 - DNA, 25 bp, Mus musculus
atagacacaatactgcataaacagc

SEQ ID NO: 34979 - DNA, 25 bp, Mus musculus
acaatactgcataaacagcagaact

SEQ ID NO: 34980 - DNA, 25 bp, Mus musculus
cagaactttcattgccttgggttct

SEQ ID NO: 34981 - DNA, 25 bp, Mus musculus
tgccttgggttcttattggtgggat

SEQ ID NO: 34982 - DNA, 25 bp, Mus musculus
ctcacacaaagtgctatagcactga

SEQ ID NO: 34983 - DNA, 25 bp, Mus musculus
aactttatacctcagtccatgaggt

SEQ ID NO: 34984 - DNA, 25 bp, Mus musculus
gtgtactcattgattcacagttttt

SEQ ID NO: 34985 - DNA, 25 bp, Mus musculus
attcacagtttttgtgtatagatac

SEQ ID NO: 34986 - DNA, 25 bp, Mus musculus
attatatcgcatagcttccactaac

SEQ ID NO: 34987 - DNA, 25 bp, Mus musculus
tcgcatagcttccactaacctaaga

SEQ ID NO: 34988 - DNA, 25 bp, Mus musculus
catttgctaatgggctccattactg

SEQ ID NO: 34989 - DNA, 25 bp, Mus musculus
ctaatgggctccattactgagcctg

SEQ ID NO: 34990 - DNA, 25 bp, Mus musculus
ggctccattactgagcctgaccact

SEQ ID NO: 34991 - DNA, 25 bp, Mus musculus
gaccactgagctatatcctcaactg

SEQ ID NO: 34992 - DNA, 25 bp, Mus musculus
tgagctatatcctcaactgtagatt

SEQ ID NO: 34993 - DNA, 25 bp, Mus musculus
ggtctcaggtcaatctgtagcctag

SEQ ID NO: 34994 - DNA, 25 bp, Mus musculus
acttagaattctgccttcctcgtct

SEQ ID NO: 34995 - DNA, 25 bp, Mus musculus
ctcgtctggctcaggtatgcacttt

SEQ ID NO: 34996 - DNA, 25 bp, Mus musculus
gaccaatccagctgattcaaaacca

SEQ ID NO: 34997 - DNA, 25 bp, Mus musculus
accaatccagctgattcaaaaccag

SEQ ID NO: 34998 - DNA, 25 bp, Mus musculus
acatcattcatggcagtgattcagt

SEQ ID NO: 34999 - DNA, 25 bp, Mus musculus
tcattcatggcagtgattcagtgga

SEQ ID NO: 35000 - DNA, 25 bp, Mus musculus
cattcatggcagtgattcagtggag

SEQ ID NO: 35001 - DNA, 25 bp, Mus musculus
ttcatggcagtgattcagtggagag

SEQ ID NO: 35002 - DNA, 25 bp, Mus musculus
tcatggcagtgattcagtggagagt

SEQ ID NO: 35003 - DNA, 25 bp, Mus musculus
aagagatccatctggtggtttaagc

SEQ ID NO: 35004 - DNA, 25 bp, Mus musculus
agagatccatctggtggtttaagcc

SEQ ID NO: 35005 - DNA, 25 bp, Mus musculus
agatccatctggtggtttaagcccg

SEQ ID NO: 35006 - DNA, 25 bp, Mus musculus
aaactgatcgacgtacaaagtcttg

SEQ ID NO: 35007 - DNA, 25 bp, Mus musculus
gtacaaagtcttgtgccccatgacc

SEQ ID NO: 35008 - DNA, 25 bp, Mus musculus
aatccagctgattcaaaaccaggca

SEQ ID NO: 35009 - DNA, 25 bp, Mus musculus
aaagtcttgtgccccatgacctggg

SEQ ID NO: 35010 - DNA, 25 bp, Mus musculus
tccagctgattcaaaaccaggcacc

SEQ ID NO: 35011 - DNA, 25 bp, Mus musculus
agctgattcaaaaccaggcaccatc

SEQ ID NO: 35012 - DNA, 25 bp, Mus musculus
tcaaaaccaggcaccatccggtggg

SEQ ID NO: 35013 - DNA, 25 bp, Mus musculus
ggatttctgcattcaagttggcagg

SEQ ID NO: 35014 - DNA, 25 bp, Mus musculus
atttctgcattcaagttggcaggaa

SEQ ID NO: 35015 - DNA, 25 bp, Mus musculus
tctgcattcaagttggcaggaacat

SEQ ID NO: 35016 - DNA, 25 bp, Mus musculus
ctgcattcaagttggcaggaacatc

SEQ ID NO: 35017 - DNA, 25 bp, Mus musculus
gcctcagcggcttatgggctcacct

SEQ ID NO: 35018 - DNA, 25 bp, Mus musculus
ctcagcggcttatgggctcacctac

SEQ ID NO: 35019 - DNA, 25 bp, Mus musculus
gtccatcgaaacgagctcagacacg

SEQ ID NO: 35020 - DNA, 25 bp, Mus musculus
ccatcgaaacgagctcagacacgag

SEQ ID NO: 35021 - DNA, 25 bp, Mus musculus
atcgaaacgagctcagacacgagta

SEQ ID NO: 35022 - DNA, 25 bp, Mus musculus
cgaaacgagctcagacacgagtacc

SEQ ID NO: 35023 - DNA, 25 bp, Mus musculus
acgagctcagacacgagtaccccgt

SEQ ID NO: 35024 - DNA, 25 bp, Mus musculus
tcagacacgagtaccccgtctccgt

SEQ ID NO: 35025 - DNA, 25 bp, Mus musculus
tccgtcacccgaggcgacaaggcca

SEQ ID NO: 35026 - DNA, 25 bp, Mus musculus
tcacccgaggcgacaaggccatctc

SEQ ID NO: 35027 - DNA, 25 bp, Mus musculus
aaggccatctcgcttcggaccatcc

SEQ ID NO: 35028 - DNA, 25 bp, Mus musculus
atctcgcttcggaccatcctcggcg

SEQ ID NO: 35029 - DNA, 25 bp, Mus musculus
gcggcttatgggctcacctacccgc

SEQ ID NO: 35030 - DNA, 25 bp, Mus musculus
cccgagcagacacatcctcgaagcg

SEQ ID NO: 35031 - DNA, 25 bp, Mus musculus
cgagcagacacatcctcgaagcgtg

SEQ ID NO: 35032 - DNA, 25 bp, Mus musculus
cagacacatcctcgaagcgtgtcca

SEQ ID NO: 35033 - DNA, 25 bp, Mus musculus
gacacatcctcgaagcgtgtccatc

SEQ ID NO: 35034 - DNA, 25 bp, Mus musculus
cacatcctcgaagcgtgtccatcga

SEQ ID NO: 35035 - DNA, 25 bp, Mus musculus
aagcgtgtccatcgaaacgagctca

SEQ ID NO: 35036 - DNA, 25 bp, Mus musculus
gcgtgtccatcgaaacgagctcaga

SEQ ID NO: 35037 - DNA, 25 bp, Mus musculus
ctaagccaggttgccatgaagtgtc

SEQ ID NO: 35038 - DNA, 25 bp, Mus musculus
cgctgcagcagtatgcacttcttgg

SEQ ID NO: 35039 - DNA, 25 bp, Mus musculus
tctcagcttcccttgctttctatct

SEQ ID NO: 35040 - DNA, 25 bp, Mus musculus
tctatcttgtgtgtagtgaaataat

SEQ ID NO: 35041 - DNA, 25 bp, Mus musculus
tagagcgagcacccattccaaagct

SEQ ID NO: 35042 - DNA, 25 bp, Mus musculus
gagcacccattccaaagctttatta

SEQ ID NO: 35043 - DNA, 25 bp, Mus musculus
ccattccaaagctttattaccagtg

SEQ ID NO: 35044 - DNA, 25 bp, Mus musculus
caaagctttattaccagtgacgttg

SEQ ID NO: 35045 - DNA, 25 bp, Mus musculus
tttattaccagtgacgttgttgcat

SEQ ID NO: 35046 - DNA, 25 bp, Mus musculus
aattcttgaacatcttttgatgaag

SEQ ID NO: 35047 - DNA, 25 bp, Mus musculus
tcattcttgtgagtcatttaaatgt

SEQ ID NO: 35048 - DNA, 25 bp, Mus musculus
atgtacacactggtacttagagttt

SEQ ID NO: 35049 - DNA, 25 bp, Mus musculus
agcagtatgcacttcttggtagcag

SEQ ID NO: 35050 - DNA, 25 bp, Mus musculus
ccatctatcaacttctacaaaagaa

SEQ ID NO: 35051 - DNA, 25 bp, Mus musculus
atcaacttctacaaaagaagaggtg

SEQ ID NO: 35052 - DNA, 25 bp, Mus musculus
gcttcggatctgtccagtgaagagg

SEQ ID NO: 35053 - DNA, 25 bp, Mus musculus
gatctgtccagtgaagagggatgga

SEQ ID NO: 35054 - DNA, 25 bp, Mus musculus
tagacaatgacaacctccattgtgc

SEQ ID NO: 35055 - DNA, 25 bp, Mus musculus
atgacaacctccattgtgctttaga

SEQ ID NO: 35056 - DNA, 25 bp, Mus musculus
acctccattgtgctttagaataatt

SEQ ID NO: 35057 - DNA, 25 bp, Mus musculus
ttcattatgattttaccaggagctg

SEQ ID NO: 35058 - DNA, 25 bp, Mus musculus
ttcctcggctcactaagtagttagt

SEQ ID NO: 35059 - DNA, 25 bp, Mus musculus
cttcctcggagtctaattctgtgtc

SEQ ID NO: 35060 - DNA, 25 bp, Mus musculus
cctcggagtctaattctgtgtcagt

SEQ ID NO: 35061 - DNA, 25 bp, Mus musculus
agtctaattctgtgtcagttcatta

SEQ ID NO: 35062 - DNA, 25 bp, Mus musculus
ctaattctgtgtcagttcattacct

SEQ ID NO: 35063 - DNA, 25 bp, Mus musculus
attctgtgtcagttcattacctatt

SEQ ID NO: 35064 - DNA, 25 bp, Mus musculus
ctggcgtccataaatcctgtcaaat

SEQ ID NO: 35065 - DNA, 25 bp, Mus musculus
tccataaatcctgtcaaatttcagt

SEQ ID NO: 35066 - DNA, 25 bp, Mus musculus
ggcatatgtatcccagttgtacact

SEQ ID NO: 35067 - DNA, 25 bp, Mus musculus
atatgtatcccagttgtacactaca

SEQ ID NO: 35068 - DNA, 25 bp, Mus musculus
tgtatcccagttgtacactacagat

SEQ ID NO: 35069 - DNA, 25 bp, Mus musculus
ctcggctcactaagtagttagtcta

SEQ ID NO: 35070 - DNA, 25 bp, Mus musculus
ccaggcttctgttattttgatacca

SEQ ID NO: 35071 - DNA, 25 bp, Mus musculus
tattttgataccaaactttttgctg

SEQ ID NO: 35072 - DNA, 25 bp, Mus musculus
tttgataccaaactttttgctgtga

SEQ ID NO: 35073 - DNA, 25 bp, Mus musculus
gataccaaactttttgctgtgattt

SEQ ID NO: 35074 - DNA, 25 bp, Mus musculus
tacacattctagtttaataaccacg

SEQ ID NO: 35075 - DNA, 25 bp, Mus musculus
tgtcagatactgcttcctcggagtc

SEQ ID NO: 35076 - DNA, 25 bp, Mus musculus
cagatactgcttcctcggagtctaa

SEQ ID NO: 35077 - DNA, 25 bp, Mus musculus
ggactttctcatcgtgccccacgaa

SEQ ID NO: 35078 - DNA, 25 bp, Mus musculus
ctttctcatcgtgccccacgaaagt

SEQ ID NO: 35079 - DNA, 25 bp, Mus musculus
gtaccgctatggaggagcctgacag

SEQ ID NO: 35080 - DNA, 25 bp, Mus musculus
aggagcctgacagcctggaggtact

SEQ ID NO: 35081 - DNA, 25 bp, Mus musculus
agcctgacagcctggaggtactggt

SEQ ID NO: 35082 - DNA, 25 bp, Mus musculus
ctgacagcctggaggtactggtgaa

SEQ ID NO: 35083 - DNA, 25 bp, Mus musculus
acagcctggaggtactggtgaagac

SEQ ID NO: 35084 - DNA, 25 bp, Mus musculus
tgaagaccctggactctcagactcg

SEQ ID NO: 35085 - DNA, 25 bp, Mus musculus
agaccctggactctcagactcggac

SEQ ID NO: 35086 - DNA, 25 bp, Mus musculus
ccctggactctcagactcggacttt

SEQ ID NO: 35087 - DNA, 25 bp, Mus musculus
tggactctcagactcggacttttat

SEQ ID NO: 35088 - DNA, 25 bp, Mus musculus
actctcagactcggacttttattgt

SEQ ID NO: 35089 - DNA, 25 bp, Mus musculus
tctcatcgtgccccacgaaagtaaa

SEQ ID NO: 35090 - DNA, 25 bp, Mus musculus
ctcagactcggacttttattgtggg

SEQ ID NO: 35091 - DNA, 25 bp, Mus musculus
catcgtgccccacgaaagtaaatcg

SEQ ID NO: 35092 - DNA, 25 bp, Mus musculus
tgtcggccatggagccgagtgatag

SEQ ID NO: 35093 - DNA, 25 bp, Mus musculus
cggccatggagccgagtgatagtgc

SEQ ID NO: 35094 - DNA, 25 bp, Mus musculus
gtgatagtgccagtaccgctatgga

SEQ ID NO: 35095 - DNA, 25 bp, Mus musculus
atagtgccagtaccgctatggagga

SEQ ID NO: 35096 - DNA, 25 bp, Mus musculus
gtgccagtaccgctatggaggagcc

SEQ ID NO: 35097 - DNA, 25 bp, Mus musculus
ccagtaccgctatggaggagcctga

SEQ ID NO: 35098 - DNA, 25 bp, Mus musculus
tggaagttcgcgcgctctgacgagc

SEQ ID NO: 35099 - DNA, 25 bp, Mus musculus
taccgaaagcacacaggtcacagac

SEQ ID NO: 35100 - DNA, 25 bp, Mus musculus
ccccttgcaaacagactgctattta

SEQ ID NO: 35101 - DNA, 25 bp, Mus musculus
ctatttattggaccttaggacagag

SEQ ID NO: 35102 - DNA, 25 bp, Mus musculus
aatgactctgccaccagttctggcc

SEQ ID NO: 35103 - DNA, 25 bp, Mus musculus
accagttctggccccacagtgactg

SEQ ID NO: 35104 - DNA, 25 bp, Mus musculus
tctggccccacagtgactgaaggcc

SEQ ID NO: 35105 - DNA, 25 bp, Mus musculus
tcgggtccccactagaggatcgagg

SEQ ID NO: 35106 - DNA, 25 bp, Mus musculus
ccccactagaggatcgaggctagat

SEQ ID NO: 35107 - DNA, 25 bp, Mus musculus
agactatgaccgattgtatttctat

SEQ ID NO: 35108 - DNA, 25 bp, Mus musculus
tggcatctctgccgcctgcttcgtt

SEQ ID NO: 35109 - DNA, 25 bp, Mus musculus
ctctgccgcctgcttcgtttttata

SEQ ID NO: 35110 - DNA, 25 bp, Mus musculus
cacagaccctttcagtgccacttgt

SEQ ID NO: 35111 - DNA, 25 bp, Mus musculus
ccctttcagtgccacttgtgcgacc

SEQ ID NO: 35112 - DNA, 25 bp, Mus musculus
cagtgccacttgtgcgaccgggcct

SEQ ID NO: 35113 - DNA, 25 bp, Mus musculus
cgacacatgtagcctgggtcgactc

SEQ ID NO: 35114 - DNA, 25 bp, Mus musculus
atgtagcctgggtcgactcggctag

SEQ ID NO: 35115 - DNA, 25 bp, Mus musculus
tcgactcggctagcccatgcgcgac

SEQ ID NO: 35116 - DNA, 25 bp, Mus musculus
gcccatgcgcgactgtggcaggttc

SEQ ID NO: 35117 - DNA, 25 bp, Mus musculus
cacggtccccttgcaaacagactgc

SEQ ID NO: 35118 - DNA, 25 bp, Mus musculus
tggtcaaccatcgatgacagccaga

SEQ ID NO: 35119 - DNA, 25 bp, Mus musculus
accatcgatgacagccagatctgcc

SEQ ID NO: 35120 - DNA, 25 bp, Mus musculus
gttgccattagcacttactctatgc

SEQ ID NO: 35121 - DNA, 25 bp, Mus musculus
attagcacttactctatgctgggcc

SEQ ID NO: 35122 - DNA, 25 bp, Mus musculus
acttactctatgctgggccacacca

SEQ ID NO: 35123 - DNA, 25 bp, Mus musculus
tctatgctgggccacaccaccaaaa

SEQ ID NO: 35124 - DNA, 25 bp, Mus musculus
aggtcctgggaagctgagagagtca

SEQ ID NO: 35125 - DNA, 25 bp, Mus musculus
ctcatgatccttgacgaggtgcaca

SEQ ID NO: 35126 - DNA, 25 bp, Mus musculus
atccttgacgaggtgcacaccattc

SEQ ID NO: 35127 - DNA, 25 bp, Mus musculus
gtgcacaccattccagccaggatgt

SEQ ID NO: 35128 - DNA, 25 bp, Mus musculus
accattccagccaggatgttccggc

SEQ ID NO: 35129 - DNA, 25 bp, Mus musculus
ttccggcgggttctgactattgtgc

SEQ ID NO: 35130 - DNA, 25 bp, Mus musculus
gatgacagccagatctgccgcttca

SEQ ID NO: 35131 - DNA, 25 bp, Mus musculus
ctgactattgtgcaggcgcactgta

SEQ ID NO: 35132 - DNA, 25 bp, Mus musculus
agccagatctgccgcttcacctcag

SEQ ID NO: 35133 - DNA, 25 bp, Mus musculus
atctgccgcttcacctcagatgcca

SEQ ID NO: 35134 - DNA, 25 bp, Mus musculus
cgcttcacctcagatgccaaggaca

SEQ ID NO: 35135 - DNA, 25 bp, Mus musculus
gatgccaaggacaagcccatcggct

SEQ ID NO: 35136 - DNA, 25 bp, Mus musculus
aagcccatcggctgctccgttgcca

SEQ ID NO: 35137 - DNA, 25 bp, Mus musculus
atcggctgctccgttgccattagca

SEQ ID NO: 35138 - DNA, 25 bp, Mus musculus
tgctccgttgccattagcacttact

SEQ ID NO: 35139 - DNA, 25 bp, Mus musculus
agcatgctgctccgttctctgcctt

SEQ ID NO: 35140 - DNA, 25 bp, Mus musculus
tcctcacggacagctttggccgaca

SEQ ID NO: 35141 - DNA, 25 bp, Mus musculus
aagctgacctactgaccacagagga

SEQ ID NO: 35142 - DNA, 25 bp, Mus musculus
acctactgaccacagaggagatcct

SEQ ID NO: 35143 - DNA, 25 bp, Mus musculus
tgaccacagaggagatcctgaccct

SEQ ID NO: 35144 - DNA, 25 bp, Mus musculus
accgctaactcctgcttatctgaca

SEQ ID NO: 35145 - DNA, 25 bp, Mus musculus
aactcctgcttatctgacagctgcc

SEQ ID NO: 35146 - DNA, 25 bp, Mus musculus
cactccactcatgcagacattgagc

SEQ ID NO: 35147 - DNA, 25 bp, Mus musculus
actcatgcagacattgagccccgga

SEQ ID NO: 35148 - DNA, 25 bp, Mus musculus
gcagacattgagccccggaacacct

SEQ ID NO: 35149 - DNA, 25 bp, Mus musculus
aacaccttctaagagagctactact

SEQ ID NO: 35150 - DNA, 25 bp, Mus musculus
accttctaagagagctactactcat

SEQ ID NO: 35151 - DNA, 25 bp, Mus musculus
cggacagctttggccgacaacatag

SEQ ID NO: 35152 - DNA, 25 bp, Mus musculus
gctttggccgacaacatagttacct

SEQ ID NO: 35153 - DNA, 25 bp, Mus musculus
gccgacaacatagttacctgcggat

SEQ ID NO: 35154 - DNA, 25 bp, Mus musculus
aacatagttacctgcggatctctct

SEQ ID NO: 35155 - DNA, 25 bp, Mus musculus
tgcggatctctctcacagagaagtg

SEQ ID NO: 35156 - DNA, 25 bp, Mus musculus
tctctctcacagagaagtgcaacct

SEQ ID NO: 35157 - DNA, 25 bp, Mus musculus
agaagtgcaacctccgatgccagta

SEQ ID NO: 35158 - DNA, 25 bp, Mus musculus
gcaacctccgatgccagtattgcat

SEQ ID NO: 35159 - DNA, 25 bp, Mus musculus
tgactcaggcactgcggcgctccct

SEQ ID NO: 35160 - DNA, 25 bp, Mus musculus
ccaagtactcacagctcgagcgcga

SEQ ID NO: 35161 - DNA, 25 bp, Mus musculus
agccgtgcaagtggtggaagcacct

SEQ ID NO: 35162 - DNA, 25 bp, Mus musculus
gcgtgagcctgcaggtcgtgtcatt

SEQ ID NO: 35163 - DNA, 25 bp, Mus musculus
tgagcctgcaggtcgtgtcattgct

SEQ ID NO: 35164 - DNA, 25 bp, Mus musculus
agccacgtggcacaggaccccgacg

SEQ ID NO: 35165 - DNA, 25 bp, Mus musculus
cccgacgggcagcactgctgtggaa

SEQ ID NO: 35166 - DNA, 25 bp, Mus musculus
ttgagacaccgatgcccacacgtac

SEQ ID NO: 35167 - DNA, 25 bp, Mus musculus
ccatccttggctggagccgcaagaa

SEQ ID NO: 35168 - DNA, 25 bp, Mus musculus
agactggaagccaccctgacccctg

SEQ ID NO: 35169 - DNA, 25 bp, Mus musculus
acccctgcaccaacaggaactgtgt

SEQ ID NO: 35170 - DNA, 25 bp, Mus musculus
cctgcaccaacaggaactgtgtcac

SEQ ID NO: 35171 - DNA, 25 bp, Mus musculus
cacagctcgagcgcgaggatgactt

SEQ ID NO: 35172 - DNA, 25 bp, Mus musculus
agctcgagcgcgaggatgacttctt

SEQ ID NO: 35173 - DNA, 25 bp, Mus musculus
aggatgacttcttcgaggctacgga

SEQ ID NO: 35174 - DNA, 25 bp, Mus musculus
tcttcgaggctacggaggccccaga

SEQ ID NO: 35175 - DNA, 25 bp, Mus musculus
tgttttcaaccaagaaccgatggca

SEQ ID NO: 35176 - DNA, 25 bp, Mus musculus
tttcaaccaagaaccgatggcagtt

SEQ ID NO: 35177 - DNA, 25 bp, Mus musculus
caaccaagaaccgatggcagttggt

SEQ ID NO: 35178 - DNA, 25 bp, Mus musculus
actacatcgtgtccgtgaacgggca

SEQ ID NO: 35179 - DNA, 25 bp, Mus musculus
aaatccagttcttcaggaactgcct

SEQ ID NO: 35180 - DNA, 25 bp, Mus musculus
tccagttcttcaggaactgccttcc

SEQ ID NO: 35181 - DNA, 25 bp, Mus musculus
tcatgctgaggtcacatgtataaaa

SEQ ID NO: 35182 - DNA, 25 bp, Mus musculus
tcccaattgtggccattttagttct

SEQ ID NO: 35183 - DNA, 25 bp, Mus musculus
caattgtggccattttagttcttgc

SEQ ID NO: 35184 - DNA, 25 bp, Mus musculus
ccattttagttcttgccatcctatt

SEQ ID NO: 35185 - DNA, 25 bp, Mus musculus
ttgccatcctattcttggctcatcc

SEQ ID NO: 35186 - DNA, 25 bp, Mus musculus
ccatcctattcttggctcatccagt

SEQ ID NO: 35187 - DNA, 25 bp, Mus musculus
tattcttggctcatccagtgttaat

SEQ ID NO: 35188 - DNA, 25 bp, Mus musculus
tggctcatccagtgttaatgcactt

SEQ ID NO: 35189 - DNA, 25 bp, Mus musculus
ttccacagttggacgtggtgttagt

SEQ ID NO: 35190 - DNA, 25 bp, Mus musculus
ctgatcatttgcagttaaggaattt

SEQ ID NO: 35191 - DNA, 25 bp, Mus musculus
tcaggaactgccttcctccctaatt

SEQ ID NO: 35192 - DNA, 25 bp, Mus musculus
aattctgctcttgcttttcagagag

SEQ ID NO: 35193 - DNA, 25 bp, Mus musculus
tctgctcttgcttttcagagagcca

SEQ ID NO: 35194 - DNA, 25 bp, Mus musculus
gcttttcagagagccatcatggtca

SEQ ID NO: 35195 - DNA, 25 bp, Mus musculus
tttcagagagccatcatggtcatgt

SEQ ID NO: 35196 - DNA, 25 bp, Mus musculus
gccatcatggtcatgtcatgctgag

SEQ ID NO: 35197 - DNA, 25 bp, Mus musculus
atcatggtcatgtcatgctgaggtc

SEQ ID NO: 35198 - DNA, 25 bp, Mus musculus
atggtcatgtcatgctgaggtcaca

SEQ ID NO: 35199 - DNA, 25 bp, Mus musculus
gtgaaggaccctcgtttacacatgc

SEQ ID NO: 35200 - DNA, 25 bp, Mus musculus
tgaaggaccctcgtttacacatgcc

SEQ ID NO: 35201 - DNA, 25 bp, Mus musculus
aagctccagctttccttcagccttt

SEQ ID NO: 35202 - DNA, 25 bp, Mus musculus
agctccagctttccttcagcctttg

SEQ ID NO: 35203 - DNA, 25 bp, Mus musculus
ctccagctttccttcagcctttgca

SEQ ID NO: 35204 - DNA, 25 bp, Mus musculus
tccagctttccttcagcctttgcat

SEQ ID NO: 35205 - DNA, 25 bp, Mus musculus
cagctttccttcagcctttgcattt

SEQ ID NO: 35206 - DNA, 25 bp, Mus musculus
agctttccttcagcctttgcatttt

SEQ ID NO: 35207 - DNA, 25 bp, Mus musculus
ctttccttcagcctttgcattttgg

SEQ ID NO: 35208 - DNA, 25 bp, Mus musculus
tttccttcagcctttgcattttgga

SEQ ID NO: 35209 - DNA, 25 bp, Mus musculus
tccttcagcctttgcattttggaga

SEQ ID NO: 35210 - DNA, 25 bp, Mus musculus
ccttcagcctttgcattttggagac

SEQ ID NO: 35211 - DNA, 25 bp, Mus musculus
cgtttacacatgccctctcgtggat

SEQ ID NO: 35212 - DNA, 25 bp, Mus musculus
gtttacacatgccctctcgtggatg

SEQ ID NO: 35213 - DNA, 25 bp, Mus musculus
ttacacatgccctctcgtggatggg

SEQ ID NO: 35214 - DNA, 25 bp, Mus musculus
ggcctcaggtccagggacagaagct

SEQ ID NO: 35215 - DNA, 25 bp, Mus musculus
cctcaggtccagggacagaagctcc

SEQ ID NO: 35216 - DNA, 25 bp, Mus musculus
ctcaggtccagggacagaagctcca

SEQ ID NO: 35217 - DNA, 25 bp, Mus musculus
cagaagctccagctttccttcagcc

SEQ ID NO: 35218 - DNA, 25 bp, Mus musculus
agaagctccagctttccttcagcct

SEQ ID NO: 35219 - DNA, 25 bp, Mus musculus
ccaacgtgctgctgctgggcgaact

SEQ ID NO: 35220 - DNA, 25 bp, Mus musculus
acgtgctgctgctgggcgaactgac

SEQ ID NO: 35221 - DNA, 25 bp, Mus musculus
ttctccaagaaggactccagagaaa

SEQ ID NO: 35222 - DNA, 25 bp, Mus musculus
gcccctagctggacagaggagaaga

SEQ ID NO: 35223 - DNA, 25 bp, Mus musculus
attccagaagcccaaaccactcctg

SEQ ID NO: 35224 - DNA, 25 bp, Mus musculus
caaaccactcctgcgttgtgtaagg

SEQ ID NO: 35225 - DNA, 25 bp, Mus musculus
tgggcacagggctcaccctggagag

SEQ ID NO: 35226 - DNA, 25 bp, Mus musculus
gcacagggctcaccctggagagcca

SEQ ID NO: 35227 - DNA, 25 bp, Mus musculus
agagccacaaggacccatctagcca

SEQ ID NO: 35228 - DNA, 25 bp, Mus musculus
gccatccaggcctagctggccaggg

SEQ ID NO: 35229 - DNA, 25 bp, Mus musculus
atccaggcctagctggccagggaca

SEQ ID NO: 35230 - DNA, 25 bp, Mus musculus
caggcctagctggccagggacaagg

SEQ ID NO: 35231 - DNA, 25 bp, Mus musculus
tgctgctgggcgaactgacggccga

SEQ ID NO: 35232 - DNA, 25 bp, Mus musculus
gctccatctgcaccttctgtctcag

SEQ ID NO: 35233 - DNA, 25 bp, Mus musculus
tctgcaccttctgtctcagcaacca

SEQ ID NO: 35234 - DNA, 25 bp, Mus musculus
gcaccttctgtctcagcaaccagcg

SEQ ID NO: 35235 - DNA, 25 bp, Mus musculus
ccttctgtctcagcaaccagcgcaa

SEQ ID NO: 35236 - DNA, 25 bp, Mus musculus
tctgtctcagcaaccagcgcaaggg

SEQ ID NO: 35237 - DNA, 25 bp, Mus musculus
ggcctcggcgatgaacctggatccc

SEQ ID NO: 35238 - DNA, 25 bp, Mus musculus
gttttctccaagaaggactccagag

SEQ ID NO: 35239 - DNA, 25 bp, Mus musculus
aatttcctgatgctcttacagtctg

SEQ ID NO: 35240 - DNA, 25 bp, Mus musculus
ctgatgctcttacagtctgcctggg

SEQ ID NO: 35241 - DNA, 25 bp, Mus musculus
tgtgtttatctccctggaagtcctg

SEQ ID NO: 35242 - DNA, 25 bp, Mus musculus
tatctccctggaagtcctgccctaa

SEQ ID NO: 35243 - DNA, 25 bp, Mus musculus
agtcctgccctaaatggtctgtcac

SEQ ID NO: 35244 - DNA, 25 bp, Mus musculus
tcacaccctaccgagtatttcctca

SEQ ID NO: 35245 - DNA, 25 bp, Mus musculus
gagtatttcctcagtactttacaga

SEQ ID NO: 35246 - DNA, 25 bp, Mus musculus
aatgtaagctcgtctagagacaggg

SEQ ID NO: 35247 - DNA, 25 bp, Mus musculus
agctcgtctagagacaggggcaatg

SEQ ID NO: 35248 - DNA, 25 bp, Mus musculus
tgtatgttctattgtgcctagtaca

SEQ ID NO: 35249 - DNA, 25 bp, Mus musculus
ttctattgtgcctagtacactgtaa

SEQ ID NO: 35250 - DNA, 25 bp, Mus musculus
tgtgcctagtacactgtaaatgctc

SEQ ID NO: 35251 - DNA, 25 bp, Mus musculus
attcctctatttccatgttgggcac

SEQ ID NO: 35252 - DNA, 25 bp, Mus musculus
tgggcacaggctcacttccctttta

SEQ ID NO: 35253 - DNA, 25 bp, Mus musculus
actgtcttgtcaccaaccattccaa

SEQ ID NO: 35254 - DNA, 25 bp, Mus musculus
ttgtcaccaaccattccaacttggt

SEQ ID NO: 35255 - DNA, 25 bp, Mus musculus
ccaaccattccaacttggtggccat

SEQ ID NO: 35256 - DNA, 25 bp, Mus musculus
attccaacttggtggccatgtattt

SEQ ID NO: 35257 - DNA, 25 bp, Mus musculus
atctttctggctccactcagtgtct

SEQ ID NO: 35258 - DNA, 25 bp, Mus musculus
ctggctccactcagtgtctaagata

SEQ ID NO: 35259 - DNA, 25 bp, Mus musculus
tcgatgttggtggtcgacgagcaga

SEQ ID NO: 35260 - DNA, 25 bp, Mus musculus
gatccccgtcgatgtcaagacagcc

SEQ ID NO: 35261 - DNA, 25 bp, Mus musculus
aagagcactgccatacaatggctgg

SEQ ID NO: 35262 - DNA, 25 bp, Mus musculus
gcactgccatacaatggctggatca

SEQ ID NO: 35263 - DNA, 25 bp, Mus musculus
actgccatacaatggctggatcatc

SEQ ID NO: 35264 - DNA, 25 bp, Mus musculus
atacaatggctggatcatcgcagct

SEQ ID NO: 35265 - DNA, 25 bp, Mus musculus
tggatcatcgcagctcgtagcagtt

SEQ ID NO: 35266 - DNA, 25 bp, Mus musculus
gatcatcgcagctcgtagcagttag

SEQ ID NO: 35267 - DNA, 25 bp, Mus musculus
tcatcgcagctcgtagcagttagac

SEQ ID NO: 35268 - DNA, 25 bp, Mus musculus
cagctcgtagcagttagacgtcatg

SEQ ID NO: 35269 - DNA, 25 bp, Mus musculus
tagacgtcatgttcagacgatgagg

SEQ ID NO: 35270 - DNA, 25 bp, Mus musculus
gacgtcatgttcagacgatgaggcc

SEQ ID NO: 35271 - DNA, 25 bp, Mus musculus
gatgtcaagacagccgtatgatgta

SEQ ID NO: 35272 - DNA, 25 bp, Mus musculus
cgtcatgttcagacgatgaggcctt

SEQ ID NO: 35273 - DNA, 25 bp, Mus musculus
tgtcaagacagccgtatgatgtatc

SEQ ID NO: 35274 - DNA, 25 bp, Mus musculus
tgatgtatcgcgaccaggagcctgg

SEQ ID NO: 35275 - DNA, 25 bp, Mus musculus
accaggagcctggtcatgtgcagga

SEQ ID NO: 35276 - DNA, 25 bp, Mus musculus
agcctggtcatgtgcaggacaccta

SEQ ID NO: 35277 - DNA, 25 bp, Mus musculus
catgtgcaggacacctacaacggca

SEQ ID NO: 35278 - DNA, 25 bp, Mus musculus
caggacacctacaacggcaagagca

SEQ ID NO: 35279 - DNA, 25 bp, Mus musculus
gcaagagcactgccatacaatggct

SEQ ID NO: 35280 - DNA, 25 bp, Mus musculus
gtttctatcatctacaatgattctg

SEQ ID NO: 35281 - DNA, 25 bp, Mus musculus
atcatctacaatgattctggtgagg

SEQ ID NO: 35282 - DNA, 25 bp, Mus musculus
tcacaggtacaccacagccgatcca

SEQ ID NO: 35283 - DNA, 25 bp, Mus musculus
actgacatctatccctccaagtgga

SEQ ID NO: 35284 - DNA, 25 bp, Mus musculus
atctatccctccaagtggatcgcaa

SEQ ID NO: 35285 - DNA, 25 bp, Mus musculus
atcgcaagactccgccacattaagc

SEQ ID NO: 35286 - DNA, 25 bp, Mus musculus
tccaacccaagcttgcctctgatgc

SEQ ID NO: 35287 - DNA, 25 bp, Mus musculus
cagcagatccatgactagagtcctg

SEQ ID NO: 35288 - DNA, 25 bp, Mus musculus
atccatgactagagtcctgtgccag

SEQ ID NO: 35289 - DNA, 25 bp, Mus musculus
gactagagtcctgtgccagccatgt

SEQ ID NO: 35290 - DNA, 25 bp, Mus musculus
tagctgtcctgactgtactcctaca

SEQ ID NO: 35291 - DNA, 25 bp, Mus musculus
tcctgactgtactcctacatgaaat

SEQ ID NO: 35292 - DNA, 25 bp, Mus musculus
tacaatgattctggtgaggacttca

SEQ ID NO: 35293 - DNA, 25 bp, Mus musculus
ggcaccattaagcagggccagttca

SEQ ID NO: 35294 - DNA, 25 bp, Mus musculus
cagttcaactttgtccatgtgatca

SEQ ID NO: 35295 - DNA, 25 bp, Mus musculus
gtccatgtgatcatcacaccgctgg

SEQ ID NO: 35296 - DNA, 25 bp, Mus musculus
gtgatcatcacaccgctggactaca

SEQ ID NO: 35297 - DNA, 25 bp, Mus musculus
ggccctgcatgcaaatgtgagtggt

SEQ ID NO: 35298 - DNA, 25 bp, Mus musculus
ctgctctgtcacctccagatggcct

SEQ ID NO: 35299 - DNA, 25 bp, Mus musculus
atggcctcacaggtacaccacagcc

SEQ ID NO: 35300 - DNA, 25 bp, Mus musculus
tgccgcttcctgaagggtgtctccc

SEQ ID NO: 35301 - DNA, 25 bp, Mus musculus
aacatttgtcaccagtgcccatggg

SEQ ID NO: 35302 - DNA, 25 bp, Mus musculus
catgtacctacatgtgcacatcgga

SEQ ID NO: 35303 - DNA, 25 bp, Mus musculus
cctacatgtgcacatcggatggatg

SEQ ID NO: 35304 - DNA, 25 bp, Mus musculus
tgtgcacatcggatggatgtgttca

SEQ ID NO: 35305 - DNA, 25 bp, Mus musculus
agactggtcctggtcatgagcactt

SEQ ID NO: 35306 - DNA, 25 bp, Mus musculus
gtcctggtcatgagcacttacacag

SEQ ID NO: 35307 - DNA, 25 bp, Mus musculus
agcacttacacagatatgaaggctg

SEQ ID NO: 35308 - DNA, 25 bp, Mus musculus
ctcctcctggcacagtctccaaagt

SEQ ID NO: 35309 - DNA, 25 bp, Mus musculus
cagtctccaaagtgttgataaagca

SEQ ID NO: 35310 - DNA, 25 bp, Mus musculus
ccattacatgctatgtacttttagg

SEQ ID NO: 35311 - DNA, 25 bp, Mus musculus
tcagcttcaataaacatgttctggt

SEQ ID NO: 35312 - DNA, 25 bp, Mus musculus
tgtcaccagtgcccatgggaaatac

SEQ ID NO: 35313 - DNA, 25 bp, Mus musculus
caataaacatgttctggtggttcac

SEQ ID NO: 35314 - DNA, 25 bp, Mus musculus
taggagcctctgggctccaacactg

SEQ ID NO: 35315 - DNA, 25 bp, Mus musculus
aacactgcggctccttcactgacac

SEQ ID NO: 35316 - DNA, 25 bp, Mus musculus
gcggctccttcactgacacaggctg

SEQ ID NO: 35317 - DNA, 25 bp, Mus musculus
ccttcactgacacaggctggtgcct

SEQ ID NO: 35318 - DNA, 25 bp, Mus musculus
caggctggtgcctacatatgcacac

SEQ ID NO: 35319 - DNA, 25 bp, Mus musculus
ggtgcctacatatgcacaccagaga

SEQ ID NO: 35320 - DNA, 25 bp, Mus musculus
atgcaactacatgtgcacaccagag

SEQ ID NO: 35321 - DNA, 25 bp, Mus musculus
aagcatgcgcagtgcttaattacag

SEQ ID NO: 35322 - DNA, 25 bp, Mus musculus
ttaattacaggagggtcgtgcccat

SEQ ID NO: 35323 - DNA, 25 bp, Mus musculus
ctggctacatcttcggcaagcggat

SEQ ID NO: 35324 - DNA, 25 bp, Mus musculus
gctacatcttcggcaagcggatcat

SEQ ID NO: 35325 - DNA, 25 bp, Mus musculus
acatcttcggcaagcggatcattct

SEQ ID NO: 35326 - DNA, 25 bp, Mus musculus
tcttcggcaagcggatcattctgtt

SEQ ID NO: 35327 - DNA, 25 bp, Mus musculus
tcggcaagcggatcattctgttcct

SEQ ID NO: 35328 - DNA, 25 bp, Mus musculus
agcggatcattctgttcctgttcct

SEQ ID NO: 35329 - DNA, 25 bp, Mus musculus
ggatcattctgttcctgttcctcat

SEQ ID NO: 35330 - DNA, 25 bp, Mus musculus
tgttcctcatgtccttcgccgggat

SEQ ID NO: 35331 - DNA, 25 bp, Mus musculus
tcatgtccttcgccgggatactcaa

SEQ ID NO: 35332 - DNA, 25 bp, Mus musculus
tgtccttcgccgggatactcaacca

SEQ ID NO: 35333 - DNA, 25 bp, Mus musculus
gggtcgtgcccatccttgctatgaa

SEQ ID NO: 35334 - DNA, 25 bp, Mus musculus
tcgccgggatactcaaccattacct

SEQ ID NO: 35335 - DNA, 25 bp, Mus musculus
tcgtgcccatccttgctatgaagta

SEQ ID NO: 35336 - DNA, 25 bp, Mus musculus
tgcccatccttgctatgaagtaagt

SEQ ID NO: 35337 - DNA, 25 bp, Mus musculus
ccatccttgctatgaagtaagtggg

SEQ ID NO: 35338 - DNA, 25 bp, Mus musculus
taacgccccgtgtctggaagtggcg

SEQ ID NO: 35339 - DNA, 25 bp, Mus musculus
tgaactgggtgtcgtttgtgatgca

SEQ ID NO: 35340 - DNA, 25 bp, Mus musculus
gcacccctggctacatcttcggcaa

SEQ ID NO: 35341 - DNA, 25 bp, Mus musculus
cccctggctacatcttcggcaagcg

SEQ ID NO: 35342 - DNA, 25 bp, Mus musculus
atcatgtcccttcgagctgctgtgc

SEQ ID NO: 35343 - DNA, 25 bp, Mus musculus
cgagctgctgtgcgctatgacccag

SEQ ID NO: 35344 - DNA, 25 bp, Mus musculus
ctaatgtcttcagatcgcccagggc

SEQ ID NO: 35345 - DNA, 25 bp, Mus musculus
gcctttgaacactatatcaattacc

SEQ ID NO: 35346 - DNA, 25 bp, Mus musculus
tatatcaattaccggaagcaccatg

SEQ ID NO: 35347 - DNA, 25 bp, Mus musculus
aattaccggaagcaccatgtgacac

SEQ ID NO: 35348 - DNA, 25 bp, Mus musculus
caccatgtgacacacttttggccca

SEQ ID NO: 35349 - DNA, 25 bp, Mus musculus
acagacctgcggatgattggagctt

SEQ ID NO: 35350 - DNA, 25 bp, Mus musculus
ccgcctctgttcttagaagtatttg

SEQ ID NO: 35351 - DNA, 25 bp, Mus musculus
acaagttcttgtcattcctgcagca

SEQ ID NO: 35352 - DNA, 25 bp, Mus musculus
tcttgtcattcctgcagcatgactg

SEQ ID NO: 35353 - DNA, 25 bp, Mus musculus
cattgcattccacctgtagcattct

SEQ ID NO: 35354 - DNA, 25 bp, Mus musculus
gacccagacagcgagactctaactt

SEQ ID NO: 35355 - DNA, 25 bp, Mus musculus
tcgtttctttgtgtcaagtgagatc

SEQ ID NO: 35356 - DNA, 25 bp, Mus musculus
gtgacacgaggccagctgaaaaatg

SEQ ID NO: 35357 - DNA, 25 bp, Mus musculus
tttgacctgggcatgtctctgtcat

SEQ ID NO: 35358 - DNA, 25 bp, Mus musculus
atgtctctgtcatctttcaacctgg

SEQ ID NO: 35359 - DNA, 25 bp, Mus musculus
gatgacactgaagtcgccctgcttc

SEQ ID NO: 35360 - DNA, 25 bp, Mus musculus
actgaagtcgccctgcttcaggccg

SEQ ID NO: 35361 - DNA, 25 bp, Mus musculus
caggccgtcctgctaatgtcttcag

SEQ ID NO: 35362 - DNA, 25 bp, Mus musculus
gtcctgctaatgtcttcagatcgcc

SEQ ID NO: 35363 - DNA, 25 bp, Mus musculus
gtcctagccagcatgtcccacagac

SEQ ID NO: 35364 - DNA, 25 bp, Mus musculus
gccagcatgtcccacagactctgtt

SEQ ID NO: 35365 - DNA, 25 bp, Mus musculus
catgtccacccaggattgacgaagg

SEQ ID NO: 35366 - DNA, 25 bp, Mus musculus
gaaggaacttcacactcctctatca

SEQ ID NO: 35367 - DNA, 25 bp, Mus musculus
cactcctctatcatgcaaaaatagt

SEQ ID NO: 35368 - DNA, 25 bp, Mus musculus
ggcagttactcttaaggcgaggtag

SEQ ID NO: 35369 - DNA, 25 bp, Mus musculus
tactcttaaggcgaggtagatacct

SEQ ID NO: 35370 - DNA, 25 bp, Mus musculus
gaggtagatacctcatcctgcaccg

SEQ ID NO: 35371 - DNA, 25 bp, Mus musculus
gcatcaagccaaagtctccaaaact

SEQ ID NO: 35372 - DNA, 25 bp, Mus musculus
agtctccaaaacttgggcattgaat

SEQ ID NO: 35373 - DNA, 25 bp, Mus musculus
ggattttagtcctacaggtgatgat

SEQ ID NO: 35374 - DNA, 25 bp, Mus musculus
tagtcctacaggtgatgattgaacg

SEQ ID NO: 35375 - DNA, 25 bp, Mus musculus
atgtcccacagactctgttgttcct

SEQ ID NO: 35376 - DNA, 25 bp, Mus musculus
agtcctacaggtgatgattgaacgt

SEQ ID NO: 35377 - DNA, 25 bp, Mus musculus
tccaacgcccgtcattagtgacagc

SEQ ID NO: 35378 - DNA, 25 bp, Mus musculus
cattagtgacagctttctctctgag

SEQ ID NO: 35379 - DNA, 25 bp, Mus musculus
tgacagctttctctctgagtttctg

SEQ ID NO: 35380 - DNA, 25 bp, Mus musculus
cccactcaaggacgatgttagcgct

SEQ ID NO: 35381 - DNA, 25 bp, Mus musculus
cacccttgctgtgcagaacctaagg

SEQ ID NO: 35382 - DNA, 25 bp, Mus musculus
cccagactcgagtggacggacatcc

SEQ ID NO: 35383 - DNA, 25 bp, Mus musculus
gacatccatgtccacccaggattga

SEQ ID NO: 35384 - DNA, 25 bp, Mus musculus
acagcatggcttctcttcaaaagtt

SEQ ID NO: 35385 - DNA, 25 bp, Mus musculus
tggcttctcttcaaaagttctatca

SEQ ID NO: 35386 - DNA, 25 bp, Mus musculus
aaatcactccaagtactagcattac

SEQ ID NO: 35387 - DNA, 25 bp, Mus musculus
cttgcatatgtaccattagcgattt

SEQ ID NO: 35388 - DNA, 25 bp, Mus musculus
gcgatttcttctgggatatatatgt

SEQ ID NO: 35389 - DNA, 25 bp, Mus musculus
tatatgtctctgaaagcacttacct

SEQ ID NO: 35390 - DNA, 25 bp, Mus musculus
cttacctaacactatcagcctccat

SEQ ID NO: 35391 - DNA, 25 bp, Mus musculus
taacactatcagcctccattctgcc

SEQ ID NO: 35392 - DNA, 25 bp, Mus musculus
tatcagcctccattctgccatataa

SEQ ID NO: 35393 - DNA, 25 bp, Mus musculus
aatgtcctgactctgacgaaccact

SEQ ID NO: 35394 - DNA, 25 bp, Mus musculus
ctgacgaaccactactatatggcga

SEQ ID NO: 35395 - DNA, 25 bp, Mus musculus
acatcactaacgtactcttggagag

SEQ ID NO: 35396 - DNA, 25 bp, Mus musculus
tctatcaacctggagcagtcacata

SEQ ID NO: 35397 - DNA, 25 bp, Mus musculus
aacctggagcagtcacatatctcct

SEQ ID NO: 35398 - DNA, 25 bp, Mus musculus
gagcagtcacatatctccttattgt

SEQ ID NO: 35399 - DNA, 25 bp, Mus musculus
tattcttacttcaggagactgctgg

SEQ ID NO: 35400 - DNA, 25 bp, Mus musculus
tacttcaggagactgctgggttttg

SEQ ID NO: 35401 - DNA, 25 bp, Mus musculus
ggtaccatggcttacacaatgaacc

SEQ ID NO: 35402 - DNA, 25 bp, Mus musculus
actacacactcacactgaatatgaa

SEQ ID NO: 35403 - DNA, 25 bp, Mus musculus
cactcacactgaatatgaaaatcac

SEQ ID NO: 35404 - DNA, 25 bp, Mus musculus
agctgcgctgttgctgtctgggatt

SEQ ID NO: 35405 - DNA, 25 bp, Mus musculus
gctgtctgggattcccgctgaggcg

SEQ ID NO: 35406 - DNA, 25 bp, Mus musculus
ttggtttataccttcatcaaaatct

SEQ ID NO: 35407 - DNA, 25 bp, Mus musculus
tataccttcatcaaaatctttggct

SEQ ID NO: 35408 - DNA, 25 bp, Mus musculus
acgaacagcactaacgatttctctt

SEQ ID NO: 35409 - DNA, 25 bp, Mus musculus
atcttccacttttcctctaatgtct

SEQ ID NO: 35410 - DNA, 25 bp, Mus musculus
tcctctaatgtctgagatttgtaat

SEQ ID NO: 35411 - DNA, 25 bp, Mus musculus
ttgtaatccctcttgtaggcccagg

SEQ ID NO: 35412 - DNA, 25 bp, Mus musculus
gctagtccttttaggcgactagata

SEQ ID NO: 35413 - DNA, 25 bp, Mus musculus
ccttttaggcgactagatagacagg

SEQ ID NO: 35414 - DNA, 25 bp, Mus musculus
gtctcagcctgcctaaaagactgca

SEQ ID NO: 35415 - DNA, 25 bp, Mus musculus
gactgcactttgtatttctgtcatt

SEQ ID NO: 35416 - DNA, 25 bp, Mus musculus
ccggtccatggacacctacagcaag

SEQ ID NO: 35417 - DNA, 25 bp, Mus musculus
ggacctctgcgtctacttcttcacc

SEQ ID NO: 35418 - DNA, 25 bp, Mus musculus
cttcattttctgtcatgaactgctt

SEQ ID NO: 35419 - DNA, 25 bp, Mus musculus
tttctgtcatgaactgcttgattac

SEQ ID NO: 35420 - DNA, 25 bp, Mus musculus
ttacaaatgacaacaacttctcttt

SEQ ID NO: 35421 - DNA, 25 bp, Mus musculus
acaacttctcttttacactgcagag

SEQ ID NO: 35422 - DNA, 25 bp, Mus musculus
tctcttttacactgcagagtctcta

SEQ ID NO: 35423 - DNA, 25 bp, Mus musculus
ttacactgcagagtctctaaaaggg

SEQ ID NO: 35424 - DNA, 25 bp, Mus musculus
ttggaccccaagatatagatgaact

SEQ ID NO: 35425 - DNA, 25 bp, Mus musculus
taagtgacagccctggggtcatgtg

SEQ ID NO: 35426 - DNA, 25 bp, Mus musculus
caaccatgaggcacgttgccaatct

SEQ ID NO: 35427 - DNA, 25 bp, Mus musculus
ccaatctggatgtcatctctcagaa

SEQ ID NO: 35428 - DNA, 25 bp, Mus musculus
tggatgtcatctctcagaactgaca

SEQ ID NO: 35429 - DNA, 25 bp, Mus musculus
acaccccttgtagcatagagtttat

SEQ ID NO: 35430 - DNA, 25 bp, Mus musculus
gttcctctagctcagctacttgggt

SEQ ID NO: 35431 - DNA, 25 bp, Mus musculus
cagctacttgggtgatccggtggga

SEQ ID NO: 35432 - DNA, 25 bp, Mus musculus
tgtgagcccaggactttgagaccac

SEQ ID NO: 35433 - DNA, 25 bp, Mus musculus
agaccactccgagccacattcatga

SEQ ID NO: 35434 - DNA, 25 bp, Mus musculus
ctccgagccacattcatgagactca

SEQ ID NO: 35435 - DNA, 25 bp, Mus musculus
ttcatgagactcaattcaaggacaa

SEQ ID NO: 35436 - DNA, 25 bp, Mus musculus
gccggccctcacgagtcagacagat

SEQ ID NO: 35437 - DNA, 25 bp, Mus musculus
cctcacgagtcagacagatgtttgc

SEQ ID NO: 35438 - DNA, 25 bp, Mus musculus
tgtttgcttccagagcctgtcggaa

SEQ ID NO: 35439 - DNA, 25 bp, Mus musculus
cttccagagcctgtcggaagtcagt

SEQ ID NO: 35440 - DNA, 25 bp, Mus musculus
gagcctgtcggaagtcagtgatgat

SEQ ID NO: 35441 - DNA, 25 bp, Mus musculus
cggcgctcaatgcgagcgagatgaa

SEQ ID NO: 35442 - DNA, 25 bp, Mus musculus
cccacggcaggccaaccatgaggca

SEQ ID NO: 35443 - DNA, 25 bp, Mus musculus
gcaggccaaccatgaggcacgttgc

SEQ ID NO: 35444 - DNA, 25 bp, Mus musculus
aatatcgagaccagattcctagtcc

SEQ ID NO: 35445 - DNA, 25 bp, Mus musculus
atcgagaccagattcctagtccagg

SEQ ID NO: 35446 - DNA, 25 bp, Mus musculus
aaccgcagactgccttggaatatac

SEQ ID NO: 35447 - DNA, 25 bp, Mus musculus
ccgcagactgccttggaatatacat

SEQ ID NO: 35448 - DNA, 25 bp, Mus musculus
cgcagactgccttggaatatacatt

SEQ ID NO: 35449 - DNA, 25 bp, Mus musculus
aatatacattcagcatgtctgaggc

SEQ ID NO: 35450 - DNA, 25 bp, Mus musculus
tatacattcagcatgtctgaggcaa

SEQ ID NO: 35451 - DNA, 25 bp, Mus musculus
atacattcagcatgtctgaggcaaa

SEQ ID NO: 35452 - DNA, 25 bp, Mus musculus
acattcagcatgtctgaggcaaaga

SEQ ID NO: 35453 - DNA, 25 bp, Mus musculus
cattcagcatgtctgaggcaaagac

SEQ ID NO: 35454 - DNA, 25 bp, Mus musculus
ttcagcatgtctgaggcaaagactt

SEQ ID NO: 35455 - DNA, 25 bp, Mus musculus
tcagcatgtctgaggcaaagacttt

SEQ ID NO: 35456 - DNA, 25 bp, Mus musculus
cgagaccagattcctagtccaggac

SEQ ID NO: 35457 - DNA, 25 bp, Mus musculus
gagaccagattcctagtccaggact

SEQ ID NO: 35458 - DNA, 25 bp, Mus musculus
gaccagattcctagtccaggactta

SEQ ID NO: 35459 - DNA, 25 bp, Mus musculus
cagattcctagtccaggacttatgg

SEQ ID NO: 35460 - DNA, 25 bp, Mus musculus
agattcctagtccaggacttatggt

SEQ ID NO: 35461 - DNA, 25 bp, Mus musculus
ttcccaaaccgcagactgccttgga

SEQ ID NO: 35462 - DNA, 25 bp, Mus musculus
cccaaaccgcagactgccttggaat

SEQ ID NO: 35463 - DNA, 25 bp, Mus musculus
ccaaaccgcagactgccttggaata

SEQ ID NO: 35464 - DNA, 25 bp, Mus musculus
tgtcctggaattcagcgagatctgc

SEQ ID NO: 35465 - DNA, 25 bp, Mus musculus
cccctctgcctctgaagcaaaggca

SEQ ID NO: 35466 - DNA, 25 bp, Mus musculus
caagtggcaaccgcacagaacggct

SEQ ID NO: 35467 - DNA, 25 bp, Mus musculus
gcaaccgcacagaacggctgacctg

SEQ ID NO: 35468 - DNA, 25 bp, Mus musculus
aacggctgacctgtgaggactgtta

SEQ ID NO: 35469 - DNA, 25 bp, Mus musculus
actgttacatgggtgtgagcttcca

SEQ ID NO: 35470 - DNA, 25 bp, Mus musculus
cttttcaattatacattgcttccag

SEQ ID NO: 35471 - DNA, 25 bp, Mus musculus
aattatacattgcttccagacatgt

SEQ ID NO: 35472 - DNA, 25 bp, Mus musculus
cttccagacatgtttctctgcaaca

SEQ ID NO: 35473 - DNA, 25 bp, Mus musculus
tttctctgcaacactttaagatgtt

SEQ ID NO: 35474 - DNA, 25 bp, Mus musculus
agatgttgcacttatgcagtagatg

SEQ ID NO: 35475 - DNA, 25 bp, Mus musculus
tgcacttatgcagtagatggcactg

SEQ ID NO: 35476 - DNA, 25 bp, Mus musculus
tgcctctgaagcaaaggcaggtata

SEQ ID NO: 35477 - DNA, 25 bp, Mus musculus
atcactgtgcattcaagactagtaa

SEQ ID NO: 35478 - DNA, 25 bp, Mus musculus
acagcttttagggctagagagatgg

SEQ ID NO: 35479 - DNA, 25 bp, Mus musculus
gccatctacttagcaaaattaacaa

SEQ ID NO: 35480 - DNA, 25 bp, Mus musculus
atgatgtcaccactccaaatagaaa

SEQ ID NO: 35481 - DNA, 25 bp, Mus musculus
ttagctgttcattctggtaccacag

SEQ ID NO: 35482 - DNA, 25 bp, Mus musculus
gttcattctggtaccacaggtagtg

SEQ ID NO: 35483 - DNA, 25 bp, Mus musculus
aacatgcaagtggcaaccgcacaga

SEQ ID NO: 35484 - DNA, 25 bp, Mus musculus
tcttcattagctattaacagatatc

SEQ ID NO: 35485 - DNA, 25 bp, Mus musculus
tagaagttttctgaccactgataag

SEQ ID NO: 35486 - DNA, 25 bp, Mus musculus
catgagctcaactgcacactctgtg

SEQ ID NO: 35487 - DNA, 25 bp, Mus musculus
tgagctcaactgcacactctgtgtg

SEQ ID NO: 35488 - DNA, 25 bp, Mus musculus
agctcaactgcacactctgtgtggt

SEQ ID NO: 35489 - DNA, 25 bp, Mus musculus
caactgcacactctgtgtggttttc

SEQ ID NO: 35490 - DNA, 25 bp, Mus musculus
tgcacactctgtgtggttttcattt

SEQ ID NO: 35491 - DNA, 25 bp, Mus musculus
ttcatttttccacattggtggaatg

SEQ ID NO: 35492 - DNA, 25 bp, Mus musculus
catttttccacattggtggaatgaa

SEQ ID NO: 35493 - DNA, 25 bp, Mus musculus
agatgctgagctgagttagggtttt

SEQ ID NO: 35494 - DNA, 25 bp, Mus musculus
atgctgagctgagttagggttttga

SEQ ID NO: 35495 - DNA, 25 bp, Mus musculus
atcacaaaggttctgtcggacacaa

SEQ ID NO: 35496 - DNA, 25 bp, Mus musculus
gaagttttctgaccactgataagat

SEQ ID NO: 35497 - DNA, 25 bp, Mus musculus
ttctgaccactgataagatatagtt

SEQ ID NO: 35498 - DNA, 25 bp, Mus musculus
tagtgaaaccttcctgatgaatctg

SEQ ID NO: 35499 - DNA, 25 bp, Mus musculus
aaccttcctgatgaatctgtttaag

SEQ ID NO: 35500 - DNA, 25 bp, Mus musculus
ccttcctgatgaatctgtttaagag

SEQ ID NO: 35501 - DNA, 25 bp, Mus musculus
ctcattaagaacctttagggatcat

SEQ ID NO: 35502 - DNA, 25 bp, Mus musculus
aagacgcatgagctcaactgcacac

SEQ ID NO: 35503 - DNA, 25 bp, Mus musculus
cgcatgagctcaactgcacactctg

SEQ ID NO: 35504 - DNA, 25 bp, Mus musculus
acaagtgcttcagccagagctccca

SEQ ID NO: 35505 - DNA, 25 bp, Mus musculus
caagtgcttcagccagagctcccat

SEQ ID NO: 35506 - DNA, 25 bp, Mus musculus
gatccgccaggtaaagggagccact

SEQ ID NO: 35507 - DNA, 25 bp, Mus musculus
aaagccgctccgaagagtggatgct

SEQ ID NO: 35508 - DNA, 25 bp, Mus musculus
aagccgctccgaagagtggatgctt

SEQ ID NO: 35509 - DNA, 25 bp, Mus musculus
agccgctccgaagagtggatgcttt

SEQ ID NO: 35510 - DNA, 25 bp, Mus musculus
gccgctccgaagagtggatgcttta

SEQ ID NO: 35511 - DNA, 25 bp, Mus musculus
ccgctccgaagagtggatgctttac

SEQ ID NO: 35512 - DNA, 25 bp, Mus musculus
ctttacagtagagcacttagatacc

SEQ ID NO: 35513 - DNA, 25 bp, Mus musculus
aagtgcttcagccagagctcccatc

SEQ ID NO: 35514 - DNA, 25 bp, Mus musculus
gtgcttcagccagagctcccatctg

SEQ ID NO: 35515 - DNA, 25 bp, Mus musculus
gagctcccatctgaggcagcacatg

SEQ ID NO: 35516 - DNA, 25 bp, Mus musculus
gctcccatctgaggcagcacatgaa

SEQ ID NO: 35517 - DNA, 25 bp, Mus musculus
ctcccatctgaggcagcacatgaag

SEQ ID NO: 35518 - DNA, 25 bp, Mus musculus
cccatctgaggcagcacatgaaggt

SEQ ID NO: 35519 - DNA, 25 bp, Mus musculus
ccatctgaggcagcacatgaaggtg

SEQ ID NO: 35520 - DNA, 25 bp, Mus musculus
catctgaggcagcacatgaaggtgc

SEQ ID NO: 35521 - DNA, 25 bp, Mus musculus
acctggaactggccatcgccctcag

SEQ ID NO: 35522 - DNA, 25 bp, Mus musculus
aactggccatcgccctcagcaaggc

SEQ ID NO: 35523 - DNA, 25 bp, Mus musculus
acagggaccttgttgagaggcctca

SEQ ID NO: 35524 - DNA, 25 bp, Mus musculus
accttgttgagaggcctcagacact

SEQ ID NO: 35525 - DNA, 25 bp, Mus musculus
ttgagaggcctcagacactgctcac

SEQ ID NO: 35526 - DNA, 25 bp, Mus musculus
aagtcctggaacctgccagtctctg

SEQ ID NO: 35527 - DNA, 25 bp, Mus musculus
ctgccagtctctgaggtatgatggt

SEQ ID NO: 35528 - DNA, 25 bp, Mus musculus
gttaggctcttccttccaatcattc

SEQ ID NO: 35529 - DNA, 25 bp, Mus musculus
ctcttccttccaatcattcagtggc

SEQ ID NO: 35530 - DNA, 25 bp, Mus musculus
gagaaggcctccagtctcctagctg

SEQ ID NO: 35531 - DNA, 25 bp, Mus musculus
gcctccagtctcctagctgcagaca

SEQ ID NO: 35532 - DNA, 25 bp, Mus musculus
agtctcctagctgcagacaagctcc

SEQ ID NO: 35533 - DNA, 25 bp, Mus musculus
ccatcgccctcagcaaggctgatat

SEQ ID NO: 35534 - DNA, 25 bp, Mus musculus
agctgtatgtacacatcccttcaag

SEQ ID NO: 35535 - DNA, 25 bp, Mus musculus
acatcccttcaagttgtgccatgcc

SEQ ID NO: 35536 - DNA, 25 bp, Mus musculus
cttcaagttgtgccatgccacagcc

SEQ ID NO: 35537 - DNA, 25 bp, Mus musculus
cacagccaaggacagctggccacag

SEQ ID NO: 35538 - DNA, 25 bp, Mus musculus
caaggacagctggccacagggcctc

SEQ ID NO: 35539 - DNA, 25 bp, Mus musculus
gggcctcaggctacagggaccttgt

SEQ ID NO: 35540 - DNA, 25 bp, Mus musculus
caggctacagggaccttgttgagag

SEQ ID NO: 35541 - DNA, 25 bp, Mus musculus
tgtcacagcaagagaactggaagaa

SEQ ID NO: 35542 - DNA, 25 bp, Mus musculus
aaccaaccagaagctagttgctgag

SEQ ID NO: 35543 - DNA, 25 bp, Mus musculus
atgcctgcaaaccaacattgatcac

SEQ ID NO: 35544 - DNA, 25 bp, Mus musculus
cctgcaaaccaacattgatcacctg

SEQ ID NO: 35545 - DNA, 25 bp, Mus musculus
gcaaaccaacattgatcacctgcag

SEQ ID NO: 35546 - DNA, 25 bp, Mus musculus
cattgatcacctgcagagccaagtg

SEQ ID NO: 35547 - DNA, 25 bp, Mus musculus
tgatcacctgcagagccaagtggag

SEQ ID NO: 35548 - DNA, 25 bp, Mus musculus
cctgcagagccaagtggaggagctg

SEQ ID NO: 35549 - DNA, 25 bp, Mus musculus
gaagtcttccagccaaggaagaggg

SEQ ID NO: 35550 - DNA, 25 bp, Mus musculus
cagcttctcctgtctgaaagagctg

SEQ ID NO: 35551 - DNA, 25 bp, Mus musculus
cttctcctgtctgaaagagctgtat

SEQ ID NO: 35552 - DNA, 25 bp, Mus musculus
ctcctgtctgaaagagctgtatgac

SEQ ID NO: 35553 - DNA, 25 bp, Mus musculus
caaccagaagctagttgctgagagc

SEQ ID NO: 35554 - DNA, 25 bp, Mus musculus
ccaacactttgtgtatgaccacgtg

SEQ ID NO: 35555 - DNA, 25 bp, Mus musculus
gagcaaggcctcacagcagaaaatc

SEQ ID NO: 35556 - DNA, 25 bp, Mus musculus
caaggcctcacagcagaaaatcctc

SEQ ID NO: 35557 - DNA, 25 bp, Mus musculus
ggcctcacagcagaaaatcctcagc

SEQ ID NO: 35558 - DNA, 25 bp, Mus musculus
gcagaaaatcctcagcctgacagaa

SEQ ID NO: 35559 - DNA, 25 bp, Mus musculus
cctcagcctgacagaaacaattgaa

SEQ ID NO: 35560 - DNA, 25 bp, Mus musculus
cagcctgacagaaacaattgaatgc

SEQ ID NO: 35561 - DNA, 25 bp, Mus musculus
aattgaatgcctgcaaaccaacatt

SEQ ID NO: 35562 - DNA, 25 bp, Mus musculus
ggctacaacacagactacggcgctg

SEQ ID NO: 35563 - DNA, 25 bp, Mus musculus
aacacagactacggcgctgacgact

SEQ ID NO: 35564 - DNA, 25 bp, Mus musculus
cgggtctctatggcagtgtcattgt

SEQ ID NO: 35565 - DNA, 25 bp, Mus musculus
tcactggcggcaacactctgcttca

SEQ ID NO: 35566 - DNA, 25 bp, Mus musculus
gcggcaacactctgcttcaggggtt

SEQ ID NO: 35567 - DNA, 25 bp, Mus musculus
acactctgcttcaggggttcacaga

SEQ ID NO: 35568 - DNA, 25 bp, Mus musculus
tgcttcaggggttcacagacagact

SEQ ID NO: 35569 - DNA, 25 bp, Mus musculus
tcacagacagacttaatcgggagct

SEQ ID NO: 35570 - DNA, 25 bp, Mus musculus
ttaatcgggagctttctcagaagac

SEQ ID NO: 35571 - DNA, 25 bp, Mus musculus
cgagcatgcgtcttaagctcatcgc

SEQ ID NO: 35572 - DNA, 25 bp, Mus musculus
ttaagctcatcgccagcaacagcac

SEQ ID NO: 35573 - DNA, 25 bp, Mus musculus
tcatcgccagcaacagcaccatgga

SEQ ID NO: 35574 - DNA, 25 bp, Mus musculus
gactacggcgctgacgacttcgaat

SEQ ID NO: 35575 - DNA, 25 bp, Mus musculus
agggcctgtttgatccctctaatgt

SEQ ID NO: 35576 - DNA, 25 bp, Mus musculus
tgtttgatccctctaatgtcaaggg

SEQ ID NO: 35577 - DNA, 25 bp, Mus musculus
atccctctaatgtcaagggcctgtc

SEQ ID NO: 35578 - DNA, 25 bp, Mus musculus
tcaagggcctgtccgggaataccat

SEQ ID NO: 35579 - DNA, 25 bp, Mus musculus
tggtcaccaccagcatcggcatgtg

SEQ ID NO: 35580 - DNA, 25 bp, Mus musculus
gtgacattgacattcgcccgggtct

SEQ ID NO: 35581 - DNA, 25 bp, Mus musculus
ttgacattcgcccgggtctctatgg

SEQ ID NO: 35582 - DNA, 25 bp, Mus musculus
tccttacttttgcactttcagaaga

SEQ ID NO: 35583 - DNA, 25 bp, Mus musculus
cttttgcactttcagaagaggtccg

SEQ ID NO: 35584 - DNA, 25 bp, Mus musculus
tcctgctgaatgctgcttggctcaa

SEQ ID NO: 35585 - DNA, 25 bp, Mus musculus
ctgcttggctcaagcgagatgctga

SEQ ID NO: 35586 - DNA, 25 bp, Mus musculus
atgctgacagcattcaccagtacct

SEQ ID NO: 35587 - DNA, 25 bp, Mus musculus
ttcaccagtacctccttcagcggaa

SEQ ID NO: 35588 - DNA, 25 bp, Mus musculus
cctcactgcctctctgcagggatga

SEQ ID NO: 35589 - DNA, 25 bp, Mus musculus
tgcctctctgcagggatgaggtgga

SEQ ID NO: 35590 - DNA, 25 bp, Mus musculus
agctaccaaacagctgactcacatg

SEQ ID NO: 35591 - DNA, 25 bp, Mus musculus
caaacagctgactcacatgccaaga

SEQ ID NO: 35592 - DNA, 25 bp, Mus musculus
aatctggagtcttacaccagtgggg

SEQ ID NO: 35593 - DNA, 25 bp, Mus musculus
gtaggtccctgctcacactccagaa

SEQ ID NO: 35594 - DNA, 25 bp, Mus musculus
cactttcagaagaggtccgtccgca

SEQ ID NO: 35595 - DNA, 25 bp, Mus musculus
gtccgcaggacactgtgtcggtgat

SEQ ID NO: 35596 - DNA, 25 bp, Mus musculus
aattcatcaaggacaactgggagga

SEQ ID NO: 35597 - DNA, 25 bp, Mus musculus
taatatccagactaataaagctctc

SEQ ID NO: 35598 - DNA, 25 bp, Mus musculus
taataaagctctcagttgaggggtt

SEQ ID NO: 35599 - DNA, 25 bp, Mus musculus
aggctttcttcgagagtcacccagc

SEQ ID NO: 35600 - DNA, 25 bp, Mus musculus
tcttcgagagtcacccagctccttc

SEQ ID NO: 35601 - DNA, 25 bp, Mus musculus
agcgcaccatccagcagtgttgtga

SEQ ID NO: 35602 - DNA, 25 bp, Mus musculus
cacaactccagaagacttcctcagc

SEQ ID NO: 35603 - DNA, 25 bp, Mus musculus
agaagacttcctcagcaacatggac

SEQ ID NO: 35604 - DNA, 25 bp, Mus musculus
gatccctctcttcaatgatgtagag

SEQ ID NO: 35605 - DNA, 25 bp, Mus musculus
ccctctcttcaatgatgtagagtct

SEQ ID NO: 35606 - DNA, 25 bp, Mus musculus
tctcttcaatgatgtagagtctgct

SEQ ID NO: 35607 - DNA, 25 bp, Mus musculus
agagtctgctctgaacaaaagcgag

SEQ ID NO: 35608 - DNA, 25 bp, Mus musculus
gtctgctctgaacaaaagcgagccc

SEQ ID NO: 35609 - DNA, 25 bp, Mus musculus
gccctttctaacctggctgtaatca

SEQ ID NO: 35610 - DNA, 25 bp, Mus musculus
ctttctaacctggctgtaatcacta

SEQ ID NO: 35611 - DNA, 25 bp, Mus musculus
tctaacctggctgtaatcactactg

SEQ ID NO: 35612 - DNA, 25 bp, Mus musculus
aacctggctgtaatcactactgttg

SEQ ID NO: 35613 - DNA, 25 bp, Mus musculus
ctggctgtaatcactactgttgtaa

SEQ ID NO: 35614 - DNA, 25 bp, Mus musculus
agacttcctcagcaacatggacgag

SEQ ID NO: 35615 - DNA, 25 bp, Mus musculus
gctgtaatcactactgttgtaacgt

SEQ ID NO: 35616 - DNA, 25 bp, Mus musculus
cttcctcagcaacatggacgagatg

SEQ ID NO: 35617 - DNA, 25 bp, Mus musculus
tgaaaattccggtcagacacccatg

SEQ ID NO: 35618 - DNA, 25 bp, Mus musculus
cggtcagacacccatgaccgtcaat

SEQ ID NO: 35619 - DNA, 25 bp, Mus musculus
cttccctgatttcctggactgcctt

SEQ ID NO: 35620 - DNA, 25 bp, Mus musculus
ccctgatttcctggactgccttcca

SEQ ID NO: 35621 - DNA, 25 bp, Mus musculus
cctggactgccttccaggaacaaat

SEQ ID NO: 35622 - DNA, 25 bp, Mus musculus
ggactgccttccaggaacaaatgtt

SEQ ID NO: 35623 - DNA, 25 bp, Mus musculus
aaacgtgccagagctgagcctctgg

SEQ ID NO: 35624 - DNA, 25 bp, Mus musculus
cctggcctcaactgagccctcttgt

SEQ ID NO: 35625 - DNA, 25 bp, Mus musculus
cagactcgtgacctctgcacctgca

SEQ ID NO: 35626 - DNA, 25 bp, Mus musculus
gactcgtgacctctgcacctgcaaa

SEQ ID NO: 35627 - DNA, 25 bp, Mus musculus
cgtgacctctgcacctgcaaacgtc

SEQ ID NO: 35628 - DNA, 25 bp, Mus musculus
tgacctctgcacctgcaaacgtctt

SEQ ID NO: 35629 - DNA, 25 bp, Mus musculus
acctctgcacctgcaaacgtcttca

SEQ ID NO: 35630 - DNA, 25 bp, Mus musculus
ctctgcacctgcaaacgtcttcact

SEQ ID NO: 35631 - DNA, 25 bp, Mus musculus
ctgcaaacgtcttcactctccatgc

SEQ ID NO: 35632 - DNA, 25 bp, Mus musculus
gcaaacgtcttcactctccatgctg

SEQ ID NO: 35633 - DNA, 25 bp, Mus musculus
tccatgctgagccaagatggggaat

SEQ ID NO: 35634 - DNA, 25 bp, Mus musculus
catgctgagccaagatggggaatcg

SEQ ID NO: 35635 - DNA, 25 bp, Mus musculus
tggcctcaactgagccctcttgtcc

SEQ ID NO: 35636 - DNA, 25 bp, Mus musculus
ctcaactgagccctcttgtcctttt

SEQ ID NO: 35637 - DNA, 25 bp, Mus musculus
cttttcccccaatgagagaggagca

SEQ ID NO: 35638 - DNA, 25 bp, Mus musculus
tttcccccaatgagagaggagcaag

SEQ ID NO: 35639 - DNA, 25 bp, Mus musculus
tcccccaatgagagaggagcaaggt

SEQ ID NO: 35640 - DNA, 25 bp, Mus musculus
acaataaacagactcgtgacctctg

SEQ ID NO: 35641 - DNA, 25 bp, Mus musculus
taaacagactcgtgacctctgcacc

SEQ ID NO: 35642 - DNA, 25 bp, Mus musculus
aacagactcgtgacctctgcacctg

SEQ ID NO: 35643 - DNA, 25 bp, Mus musculus
actcgaattcactctggagaaaagc

SEQ ID NO: 35644 - DNA, 25 bp, Mus musculus
gagaagccgtacccctgtgaaatct

SEQ ID NO: 35645 - DNA, 25 bp, Mus musculus
gccatcaccaacaccaaggtgcaat

SEQ ID NO: 35646 - DNA, 25 bp, Mus musculus
accaacaccaaggtgcaataccgcg

SEQ ID NO: 35647 - DNA, 25 bp, Mus musculus
gagctccccaaagcctgctgaatga

SEQ ID NO: 35648 - DNA, 25 bp, Mus musculus
cccaaagcctgctgaatgaagcatg

SEQ ID NO: 35649 - DNA, 25 bp, Mus musculus
ccttctcagaatctacccaaaggat

SEQ ID NO: 35650 - DNA, 25 bp, Mus musculus
ttatacaaaggtcatcccatgatgt

SEQ ID NO: 35651 - DNA, 25 bp, Mus musculus
aaaggtcatcccatgatgtagtgcc

SEQ ID NO: 35652 - DNA, 25 bp, Mus musculus
tagtgcctctctcatccactagtgc

SEQ ID NO: 35653 - DNA, 25 bp, Mus musculus
ctctctcatccactagtgcaaatca

SEQ ID NO: 35654 - DNA, 25 bp, Mus musculus
catccactagtgcaaatcatagttg

SEQ ID NO: 35655 - DNA, 25 bp, Mus musculus
caccttcagactctgaagagccatc

SEQ ID NO: 35656 - DNA, 25 bp, Mus musculus
cagactctgaagagccatctgcgca

SEQ ID NO: 35657 - DNA, 25 bp, Mus musculus
ctgaagagccatctgcgcatccaca

SEQ ID NO: 35658 - DNA, 25 bp, Mus musculus
tgtaacctgcactttcgtcacaaaa

SEQ ID NO: 35659 - DNA, 25 bp, Mus musculus
ctgcactttcgtcacaaaagccaac

SEQ ID NO: 35660 - DNA, 25 bp, Mus musculus
agccaactgcgacttcatttgcgcc

SEQ ID NO: 35661 - DNA, 25 bp, Mus musculus
ctgcgacttcatttgcgccagaagc

SEQ ID NO: 35662 - DNA, 25 bp, Mus musculus
ttgcgccagaagcacggcgccatca

SEQ ID NO: 35663 - DNA, 25 bp, Mus musculus
tcctctgtgtaggttccagaactaa

SEQ ID NO: 35664 - DNA, 25 bp, Mus musculus
cctctgtgtaggttccagaactaag

SEQ ID NO: 35665 - DNA, 25 bp, Mus musculus
aatatagctgctgccactggcttag

SEQ ID NO: 35666 - DNA, 25 bp, Mus musculus
atatagctgctgccactggcttagt

SEQ ID NO: 35667 - DNA, 25 bp, Mus musculus
atagctgctgccactggcttagtct

SEQ ID NO: 35668 - DNA, 25 bp, Mus musculus
tagctgctgccactggcttagtcta

SEQ ID NO: 35669 - DNA, 25 bp, Mus musculus
agctgctgccactggcttagtctag

SEQ ID NO: 35670 - DNA, 25 bp, Mus musculus
ctgctgccactggcttagtctagaa

SEQ ID NO: 35671 - DNA, 25 bp, Mus musculus
tgctgccactggcttagtctagaag

SEQ ID NO: 35672 - DNA, 25 bp, Mus musculus
gctgccactggcttagtctagaagg

SEQ ID NO: 35673 - DNA, 25 bp, Mus musculus
tgccactggcttagtctagaaggcc

SEQ ID NO: 35674 - DNA, 25 bp, Mus musculus
gccactggcttagtctagaaggccc

SEQ ID NO: 35675 - DNA, 25 bp, Mus musculus
gtgtgacagcagtcgctcagtagac

SEQ ID NO: 35676 - DNA, 25 bp, Mus musculus
ccactggcttagtctagaaggccca

SEQ ID NO: 35677 - DNA, 25 bp, Mus musculus
tgtgacagcagtcgctcagtagaca

SEQ ID NO: 35678 - DNA, 25 bp, Mus musculus
gtgacagcagtcgctcagtagacag

SEQ ID NO: 35679 - DNA, 25 bp, Mus musculus
gcagtcgctcagtagacagtctaga

SEQ ID NO: 35680 - DNA, 25 bp, Mus musculus
cagtcgctcagtagacagtctagag

SEQ ID NO: 35681 - DNA, 25 bp, Mus musculus
agtcgctcagtagacagtctagaga

SEQ ID NO: 35682 - DNA, 25 bp, Mus musculus
tcgctcagtagacagtctagagagc

SEQ ID NO: 35683 - DNA, 25 bp, Mus musculus
gaatatagctgctgccactggctta

SEQ ID NO: 35684 - DNA, 25 bp, Mus musculus
tgacttcctacagcaaaatgggtac

SEQ ID NO: 35685 - DNA, 25 bp, Mus musculus
cactccttatgacaggttctgtcca

SEQ ID NO: 35686 - DNA, 25 bp, Mus musculus
tctctataaactctcctccatgaaa

SEQ ID NO: 35687 - DNA, 25 bp, Mus musculus
ctcctccatgaaattcaaggatcca

SEQ ID NO: 35688 - DNA, 25 bp, Mus musculus
cgactatgcacagcttcttgaagat

SEQ ID NO: 35689 - DNA, 25 bp, Mus musculus
tgcacagcttcttgaagatatgcag

SEQ ID NO: 35690 - DNA, 25 bp, Mus musculus
tatgcagaatgcattccgtagcctt

SEQ ID NO: 35691 - DNA, 25 bp, Mus musculus
gaatgcattccgtagccttgaagac

SEQ ID NO: 35692 - DNA, 25 bp, Mus musculus
ctgaatttctcatctccaaccctta

SEQ ID NO: 35693 - DNA, 25 bp, Mus musculus
acccttagcttccatattgtgcagc

SEQ ID NO: 35694 - DNA, 25 bp, Mus musculus
catattgtgcagctttgagactagt

SEQ ID NO: 35695 - DNA, 25 bp, Mus musculus
acctttatctgaagtggtgaatgta

SEQ ID NO: 35696 - DNA, 25 bp, Mus musculus
caggttctgtccattctacaagaca

SEQ ID NO: 35697 - DNA, 25 bp, Mus musculus
ctgtccattctacaagacagtgggg

SEQ ID NO: 35698 - DNA, 25 bp, Mus musculus
gatgctgtccaacatgatttcattc

SEQ ID NO: 35699 - DNA, 25 bp, Mus musculus
ttcattctatgacatggcccgccga

SEQ ID NO: 35700 - DNA, 25 bp, Mus musculus
ctatgacatggcccgccgagctgtg

SEQ ID NO: 35701 - DNA, 25 bp, Mus musculus
ccgccgagctgtggagaccactgcc

SEQ ID NO: 35702 - DNA, 25 bp, Mus musculus
cactgcccagagtgacaataagatc

SEQ ID NO: 35703 - DNA, 25 bp, Mus musculus
cacatggtccattatccgggagcac

SEQ ID NO: 35704 - DNA, 25 bp, Mus musculus
tgcgtgctatgccatcggtaaggac

SEQ ID NO: 35705 - DNA, 25 bp, Mus musculus
gaacttcattactcagggtccctat

SEQ ID NO: 35706 - DNA, 25 bp, Mus musculus
gcgtgaccctcctgtgaagtactgg

SEQ ID NO: 35707 - DNA, 25 bp, Mus musculus
ccctcctgtgaagtactggttctgt

SEQ ID NO: 35708 - DNA, 25 bp, Mus musculus
gtactggttctgtttcctgattcct

SEQ ID NO: 35709 - DNA, 25 bp, Mus musculus
ccatcccacctatgagtgggagttt

SEQ ID NO: 35710 - DNA, 25 bp, Mus musculus
gtaactattgtgccagtgttgacag

SEQ ID NO: 35711 - DNA, 25 bp, Mus musculus
actattgtgccagtgttgacagttt

SEQ ID NO: 35712 - DNA, 25 bp, Mus musculus
agagatccctgctcagaaacctcac

SEQ ID NO: 35713 - DNA, 25 bp, Mus musculus
gatccctgctcagaaacctcacctt

SEQ ID NO: 35714 - DNA, 25 bp, Mus musculus
ccctgctcagaaacctcacctttag

SEQ ID NO: 35715 - DNA, 25 bp, Mus musculus
tcagaaacctcacctttagtgcttc

SEQ ID NO: 35716 - DNA, 25 bp, Mus musculus
cttcattactcagggtccctatgaa

SEQ ID NO: 35717 - DNA, 25 bp, Mus musculus
gactttggacattggctggcagttg

SEQ ID NO: 35718 - DNA, 25 bp, Mus musculus
tttggacattggctggcagttgctt

SEQ ID NO: 35719 - DNA, 25 bp, Mus musculus
ggacattggctggcagttgcttcga

SEQ ID NO: 35720 - DNA, 25 bp, Mus musculus
tggctggcagttgcttcgaatcttc

SEQ ID NO: 35721 - DNA, 25 bp, Mus musculus
gcttcgaatcttccccaaagaaatg

SEQ ID NO: 35722 - DNA, 25 bp, Mus musculus
tcgaatcttccccaaagaaatgctg

SEQ ID NO: 35723 - DNA, 25 bp, Mus musculus
aatcttccccaaagaaatgctgaag

SEQ ID NO: 35724 - DNA, 25 bp, Mus musculus
gtaccagctgctggagcctcgaatg

SEQ ID NO: 35725 - DNA, 25 bp, Mus musculus
tgtgcaaatcgaccaggagcctacc

SEQ ID NO: 35726 - DNA, 25 bp, Mus musculus
tctgtctaataccggtaatcagtga

SEQ ID NO: 35727 - DNA, 25 bp, Mus musculus
gtctaataccggtaatcagtgacac

SEQ ID NO: 35728 - DNA, 25 bp, Mus musculus
cggtaatcagtgacacctctgcagc

SEQ ID NO: 35729 - DNA, 25 bp, Mus musculus
taatcagtgacacctctgcagctaa

SEQ ID NO: 35730 - DNA, 25 bp, Mus musculus
ctgcagctaatgccctcgctcagtg

SEQ ID NO: 35731 - DNA, 25 bp, Mus musculus
atgccctcgctcagtgtcaacagca

SEQ ID NO: 35732 - DNA, 25 bp, Mus musculus
tcatctgaggccacagctgttcact

SEQ ID NO: 35733 - DNA, 25 bp, Mus musculus
tctgaggccacagctgttcactggg

SEQ ID NO: 35734 - DNA, 25 bp, Mus musculus
gccacagctgttcactgggtttgca

SEQ ID NO: 35735 - DNA, 25 bp, Mus musculus
gctgttcactgggtttgcagcaggc

SEQ ID NO: 35736 - DNA, 25 bp, Mus musculus
aatcgaccaggagcctacctgcctg

SEQ ID NO: 35737 - DNA, 25 bp, Mus musculus
ccaggagcctacctgcctgaggaac

SEQ ID NO: 35738 - DNA, 25 bp, Mus musculus
gcctacctgcctgaggaacatagct

SEQ ID NO: 35739 - DNA, 25 bp, Mus musculus
tacctgcctgaggaacatagctggt

SEQ ID NO: 35740 - DNA, 25 bp, Mus musculus
ctgagcttcaggaggagcagttccc

SEQ ID NO: 35741 - DNA, 25 bp, Mus musculus
aggagcagttccccacggctgttct

SEQ ID NO: 35742 - DNA, 25 bp, Mus musculus
ctgttctcctggagaagcagattat

SEQ ID NO: 35743 - DNA, 25 bp, Mus musculus
tggcttcctctttctgtctaatacc

SEQ ID NO: 35744 - DNA, 25 bp, Mus musculus
gagctcaagcccaagaagaaagtct

SEQ ID NO: 35745 - DNA, 25 bp, Mus musculus
tttgagaagctgcaggccgacttta

SEQ ID NO: 35746 - DNA, 25 bp, Mus musculus
ggtaacatcagctagccagctctgt

SEQ ID NO: 35747 - DNA, 25 bp, Mus musculus
atcagctagccagctctgtgccctc

SEQ ID NO: 35748 - DNA, 25 bp, Mus musculus
atcccgtctgccggctcgacttgtt

SEQ ID NO: 35749 - DNA, 25 bp, Mus musculus
tctgccggctcgacttgttgcatct

SEQ ID NO: 35750 - DNA, 25 bp, Mus musculus
gccggctcgacttgttgcatctctc

SEQ ID NO: 35751 - DNA, 25 bp, Mus musculus
tgttgcatctctcacccgttccaac

SEQ ID NO: 35752 - DNA, 25 bp, Mus musculus
tctcacccgttccaacaaggtctga

SEQ ID NO: 35753 - DNA, 25 bp, Mus musculus
ccgttccaacaaggtctgaactgct

SEQ ID NO: 35754 - DNA, 25 bp, Mus musculus
caacaaggtctgaactgctgacaag

SEQ ID NO: 35755 - DNA, 25 bp, Mus musculus
ggtctgaactgctgacaaggtgcag

SEQ ID NO: 35756 - DNA, 25 bp, Mus musculus
gagtgcatcgcacagtggaagcaaa

SEQ ID NO: 35757 - DNA, 25 bp, Mus musculus
aactgctgacaaggtgcaggacttg

SEQ ID NO: 35758 - DNA, 25 bp, Mus musculus
tgcatcgcacagtggaagcaaacca

SEQ ID NO: 35759 - DNA, 25 bp, Mus musculus
tggaagcaaaccaacttcatgacca

SEQ ID NO: 35760 - DNA, 25 bp, Mus musculus
caaaccaacttcatgaccaagctgg

SEQ ID NO: 35761 - DNA, 25 bp, Mus musculus
accaacttcatgaccaagctgggat

SEQ ID NO: 35762 - DNA, 25 bp, Mus musculus
aacttcatgaccaagctgggattcg

SEQ ID NO: 35763 - DNA, 25 bp, Mus musculus
atgaccaagctgggattcgtctcct

SEQ ID NO: 35764 - DNA, 25 bp, Mus musculus
aagctgggattcgtctcctgtaaat

SEQ ID NO: 35765 - DNA, 25 bp, Mus musculus
accctttcaggatcctatgtagctc

SEQ ID NO: 35766 - DNA, 25 bp, Mus musculus
tcaggatcctatgtagctcccaaag

SEQ ID NO: 35767 - DNA, 25 bp, Mus musculus
ctgactaacaaggccctgcaggtca

SEQ ID NO: 35768 - DNA, 25 bp, Mus musculus
gccctgcaggtcatgacagattttg

SEQ ID NO: 35769 - DNA, 25 bp, Mus musculus
gattttgctatccagttcaatcgta

SEQ ID NO: 35770 - DNA, 25 bp, Mus musculus
gctatccagttcaatcgtaacagct

SEQ ID NO: 35771 - DNA, 25 bp, Mus musculus
cagttcaatcgtaacagctttggct

SEQ ID NO: 35772 - DNA, 25 bp, Mus musculus
aacagctttggcttggcccctgctg

SEQ ID NO: 35773 - DNA, 25 bp, Mus musculus
gtggagatctccctgcctcttaaca

SEQ ID NO: 35774 - DNA, 25 bp, Mus musculus
ctgcctcttaacacagtgggctcag

SEQ ID NO: 35775 - DNA, 25 bp, Mus musculus
cttaacacagtgggctcagtcttga

SEQ ID NO: 35776 - DNA, 25 bp, Mus musculus
aacacagtgggctcagtcttgaaga

SEQ ID NO: 35777 - DNA, 25 bp, Mus musculus
tcctatgtagctcccaaagcagtct

SEQ ID NO: 35778 - DNA, 25 bp, Mus musculus
acagtgggctcagtcttgaagatgg

SEQ ID NO: 35779 - DNA, 25 bp, Mus musculus
gtagctcccaaagcagtctggctcc

SEQ ID NO: 35780 - DNA, 25 bp, Mus musculus
tggctccctgccatgaaggccaagg

SEQ ID NO: 35781 - DNA, 25 bp, Mus musculus
tctggcaccttcacccggcaggctg

SEQ ID NO: 35782 - DNA, 25 bp, Mus musculus
acccggcaggctggctccatctcta

SEQ ID NO: 35783 - DNA, 25 bp, Mus musculus
ggctccatctctatggacctgcagc

SEQ ID NO: 35784 - DNA, 25 bp, Mus musculus
atctctatggacctgcagctgacta

SEQ ID NO: 35785 - DNA, 25 bp, Mus musculus
atggacctgcagctgactaacaagg

SEQ ID NO: 35786 - DNA, 25 bp, Mus musculus
gaccgacagcagttcaaggaggaga

SEQ ID NO: 35787 - DNA, 25 bp, Mus musculus
aagacaggcaccatccagaggagta

SEQ ID NO: 35788 - DNA, 25 bp, Mus musculus
caggcaggctgtcttctcaggagca

SEQ ID NO: 35789 - DNA, 25 bp, Mus musculus
gcaggctgtcttctcaggagcacag

SEQ ID NO: 35790 - DNA, 25 bp, Mus musculus
acttccccatacaatgctgtgaggc

SEQ ID NO: 35791 - DNA, 25 bp, Mus musculus
gcaggcatgtcctgatacagggtgg

SEQ ID NO: 35792 - DNA, 25 bp, Mus musculus
actgtgtcactgtctcagggccctt

SEQ ID NO: 35793 - DNA, 25 bp, Mus musculus
gtgtcactgtctcagggccctttac

SEQ ID NO: 35794 - DNA, 25 bp, Mus musculus
agccctctggccttactgtgctgta

SEQ ID NO: 35795 - DNA, 25 bp, Mus musculus
gccttactgtgctgtaccagtccag

SEQ ID NO: 35796 - DNA, 25 bp, Mus musculus
tgctgtaccagtccagtggttttgc

SEQ ID NO: 35797 - DNA, 25 bp, Mus musculus
tgtaccagtccagtggttttgctat

SEQ ID NO: 35798 - DNA, 25 bp, Mus musculus
gctgccgactggcatcctgagctgg

SEQ ID NO: 35799 - DNA, 25 bp, Mus musculus
ggtcctgatggacatccggtgccag

SEQ ID NO: 35800 - DNA, 25 bp, Mus musculus
ccagccactgcctaacatctgctgt

SEQ ID NO: 35801 - DNA, 25 bp, Mus musculus
ttcgcccttttccaagatggctcct

SEQ ID NO: 35802 - DNA, 25 bp, Mus musculus
gcccttttccaagatggctccttgg

SEQ ID NO: 35803 - DNA, 25 bp, Mus musculus
gatggctccttgggatggagatagt

SEQ ID NO: 35804 - DNA, 25 bp, Mus musculus
aagttgctagcatacgttgagatat

SEQ ID NO: 35805 - DNA, 25 bp, Mus musculus
ttgctagcatacgttgagatatggc

SEQ ID NO: 35806 - DNA, 25 bp, Mus musculus
tcaggagcccctaaactgcaacagc

SEQ ID NO: 35807 - DNA, 25 bp, Mus musculus
gcccctaaactgcaacagctgttca

SEQ ID NO: 35808 - DNA, 25 bp, Mus musculus
agcctcgcttggtatcctcagggca

SEQ ID NO: 35809 - DNA, 25 bp, Mus musculus
aaggctggaccctatcactggtctg

SEQ ID NO: 35810 - DNA, 25 bp, Mus musculus
ggaccctatcactggtctgtttatt

SEQ ID NO: 35811 - DNA, 25 bp, Mus musculus
ccttccagtctgaggggacatggtc

SEQ ID NO: 35812 - DNA, 25 bp, Mus musculus
catggtcagtcacaggctcattttg

SEQ ID NO: 35813 - DNA, 25 bp, Mus musculus
cagtcacaggctcattttgcctcca

SEQ ID NO: 35814 - DNA, 25 bp, Mus musculus
atgactctagagcgtcataaattag

SEQ ID NO: 35815 - DNA, 25 bp, Mus musculus
gcctagacattcacgggaagtttat

SEQ ID NO: 35816 - DNA, 25 bp, Mus musculus
tatgtctggactcagtttccctatt

SEQ ID NO: 35817 - DNA, 25 bp, Mus musculus
tggactcagtttccctattagagta

SEQ ID NO: 35818 - DNA, 25 bp, Mus musculus
aaactgcaacagctgttcataatgg

SEQ ID NO: 35819 - DNA, 25 bp, Mus musculus
ggccttcccagagactgagaaacta

SEQ ID NO: 35820 - DNA, 25 bp, Mus musculus
ctgttcataatggctgtcctatttt

SEQ ID NO: 35821 - DNA, 25 bp, Mus musculus
tgtgattcttgaggcccagagaagg

SEQ ID NO: 35822 - DNA, 25 bp, Mus musculus
tcttgaggcccagagaaggtgactg

SEQ ID NO: 35823 - DNA, 25 bp, Mus musculus
gtcttgcctgatgtcacacagcgtt

SEQ ID NO: 35824 - DNA, 25 bp, Mus musculus
cctgatgtcacacagcgtttgcagg

SEQ ID NO: 35825 - DNA, 25 bp, Mus musculus
gtcacacagcgtttgcaggacgcag

SEQ ID NO: 35826 - DNA, 25 bp, Mus musculus
cagcgtttgcaggacgcagacccag

SEQ ID NO: 35827 - DNA, 25 bp, Mus musculus
cattttgtcacagttcagacctgct

SEQ ID NO: 35828 - DNA, 25 bp, Mus musculus
tttgtcacagttcagacctgcttcg

SEQ ID NO: 35829 - DNA, 25 bp, Mus musculus
ttcgccaccaaagaattcacacagg

SEQ ID NO: 35830 - DNA, 25 bp, Mus musculus
ccttcattcggagttcaagccttat

SEQ ID NO: 35831 - DNA, 25 bp, Mus musculus
tcattcggagttcaagccttatccg

SEQ ID NO: 35832 - DNA, 25 bp, Mus musculus
gttcaagccttatccgccattacca

SEQ ID NO: 35833 - DNA, 25 bp, Mus musculus
gccttatccgccattaccagatcca

SEQ ID NO: 35834 - DNA, 25 bp, Mus musculus
tccgccattaccagatccacacaga

SEQ ID NO: 35835 - DNA, 25 bp, Mus musculus
gccattaccagatccacacagaagt

SEQ ID NO: 35836 - DNA, 25 bp, Mus musculus
attaccagatccacacagaagttaa

SEQ ID NO: 35837 - DNA, 25 bp, Mus musculus
agatccacacagaagttaaacagta

SEQ ID NO: 35838 - DNA, 25 bp, Mus musculus
actgcggcaaagccgtccgacaccg

SEQ ID NO: 35839 - DNA, 25 bp, Mus musculus
gttcagacctgcttcgacaccagag

SEQ ID NO: 35840 - DNA, 25 bp, Mus musculus
cagacctgcttcgacaccagagggt

SEQ ID NO: 35841 - DNA, 25 bp, Mus musculus
gtttcagtcagagctccttactcat

SEQ ID NO: 35842 - DNA, 25 bp, Mus musculus
tcagtcagagctccttactcattcg

SEQ ID NO: 35843 - DNA, 25 bp, Mus musculus
gtcagagctccttactcattcgcca

SEQ ID NO: 35844 - DNA, 25 bp, Mus musculus
gctccttactcattcgccaccaaag

SEQ ID NO: 35845 - DNA, 25 bp, Mus musculus
ccttactcattcgccaccaaagaat

SEQ ID NO: 35846 - DNA, 25 bp, Mus musculus
tactcattcgccaccaaagaattca

SEQ ID NO: 35847 - DNA, 25 bp, Mus musculus
gcatggctcgtggtccaagaaacac

SEQ ID NO: 35848 - DNA, 25 bp, Mus musculus
catggctcgtggtccaagaaacacc

SEQ ID NO: 35849 - DNA, 25 bp, Mus musculus
tggtcctcacaaggctgagggaatg

SEQ ID NO: 35850 - DNA, 25 bp, Mus musculus
gtcctcacaaggctgagggaatgcc

SEQ ID NO: 35851 - DNA, 25 bp, Mus musculus
tcctcacaaggctgagggaatgcct

SEQ ID NO: 35852 - DNA, 25 bp, Mus musculus
cctcacaaggctgagggaatgcctg

SEQ ID NO: 35853 - DNA, 25 bp, Mus musculus
acttaagtaatgccctgactggaga

SEQ ID NO: 35854 - DNA, 25 bp, Mus musculus
cttaagtaatgccctgactggagat

SEQ ID NO: 35855 - DNA, 25 bp, Mus musculus
taagtaatgccctgactggagatgt

SEQ ID NO: 35856 - DNA, 25 bp, Mus musculus
aagtaatgccctgactggagatgta

SEQ ID NO: 35857 - DNA, 25 bp, Mus musculus
agtaatgccctgactggagatgtag

SEQ ID NO: 35858 - DNA, 25 bp, Mus musculus
taccctgttggggttgatggattca

SEQ ID NO: 35859 - DNA, 25 bp, Mus musculus
atggctcgtggtccaagaaacacct

SEQ ID NO: 35860 - DNA, 25 bp, Mus musculus
cgtggtccaagaaacacctgaagcg

SEQ ID NO: 35861 - DNA, 25 bp, Mus musculus
ccatccactggtcctcacaaggctg

SEQ ID NO: 35862 - DNA, 25 bp, Mus musculus
atccactggtcctcacaaggctgag

SEQ ID NO: 35863 - DNA, 25 bp, Mus musculus
tccactggtcctcacaaggctgagg

SEQ ID NO: 35864 - DNA, 25 bp, Mus musculus
ccactggtcctcacaaggctgaggg

SEQ ID NO: 35865 - DNA, 25 bp, Mus musculus
actggtcctcacaaggctgagggaa

SEQ ID NO: 35866 - DNA, 25 bp, Mus musculus
ctggtcctcacaaggctgagggaat

SEQ ID NO: 35867 - DNA, 25 bp, Mus musculus
ctggacagttcctgcagcccgcagc

SEQ ID NO: 35868 - DNA, 25 bp, Mus musculus
cgtgcaagccaagtggcccgctcaa

SEQ ID NO: 35869 - DNA, 25 bp, Mus musculus
tgtcctggtcctggtcctggtccct

SEQ ID NO: 35870 - DNA, 25 bp, Mus musculus
tcctggtcctggtcctggtccctct

SEQ ID NO: 35871 - DNA, 25 bp, Mus musculus
cctcactcacctaagctggcggagc

SEQ ID NO: 35872 - DNA, 25 bp, Mus musculus
actcacctaagctggcggagcaaac

SEQ ID NO: 35873 - DNA, 25 bp, Mus musculus
tcacctaagctggcggagcaaactc

SEQ ID NO: 35874 - DNA, 25 bp, Mus musculus
cggcgccgttgttctcagtactgtg

SEQ ID NO: 35875 - DNA, 25 bp, Mus musculus
ttttttgaaggttcactctgcgcag

SEQ ID NO: 35876 - DNA, 25 bp, Mus musculus
ttttgaaggttcactctgcgcagtt

SEQ ID NO: 35877 - DNA, 25 bp, Mus musculus
gaaggttcactctgcgcagttttat

SEQ ID NO: 35878 - DNA, 25 bp, Mus musculus
aggttcactctgcgcagttttatct

SEQ ID NO: 35879 - DNA, 25 bp, Mus musculus
tgcaagccaagtggcccgctcaata

SEQ ID NO: 35880 - DNA, 25 bp, Mus musculus
agccaagtggcccgctcaatagtga

SEQ ID NO: 35881 - DNA, 25 bp, Mus musculus
ccaagtggcccgctcaatagtgatg

SEQ ID NO: 35882 - DNA, 25 bp, Mus musculus
gtggcccgctcaatagtgatgagct

SEQ ID NO: 35883 - DNA, 25 bp, Mus musculus
ggcccgctcaatagtgatgagctag

SEQ ID NO: 35884 - DNA, 25 bp, Mus musculus
ttccaggcggtacgccctctctgat

SEQ ID NO: 35885 - DNA, 25 bp, Mus musculus
ctctgatcctggtccatctgtcctg

SEQ ID NO: 35886 - DNA, 25 bp, Mus musculus
ctgatcctggtccatctgtcctggt

SEQ ID NO: 35887 - DNA, 25 bp, Mus musculus
ccccctgggagaatatctggctcgt

SEQ ID NO: 35888 - DNA, 25 bp, Mus musculus
ctggctcgtgggctccatctgcttg

SEQ ID NO: 35889 - DNA, 25 bp, Mus musculus
cacaccgctgaatctggacccagtg

SEQ ID NO: 35890 - DNA, 25 bp, Mus musculus
caccgctgaatctggacccagtgct

SEQ ID NO: 35891 - DNA, 25 bp, Mus musculus
gctgaatctggacccagtgctggtg

SEQ ID NO: 35892 - DNA, 25 bp, Mus musculus
tctggacccagtgctggtgcttctg

SEQ ID NO: 35893 - DNA, 25 bp, Mus musculus
ttctgaaaattctccttgctggtga

SEQ ID NO: 35894 - DNA, 25 bp, Mus musculus
aaattctccttgctggtgaatccaa

SEQ ID NO: 35895 - DNA, 25 bp, Mus musculus
attctccttgctggtgaatccaatg

SEQ ID NO: 35896 - DNA, 25 bp, Mus musculus
tctccttgctggtgaatccaatgat

SEQ ID NO: 35897 - DNA, 25 bp, Mus musculus
agtaacggcttctaaaccatgtgca

SEQ ID NO: 35898 - DNA, 25 bp, Mus musculus
acggcttctaaaccatgtgcagaga

SEQ ID NO: 35899 - DNA, 25 bp, Mus musculus
ctcgtgggctccatctgcttgtcca

SEQ ID NO: 35900 - DNA, 25 bp, Mus musculus
ggcttctaaaccatgtgcagagata

SEQ ID NO: 35901 - DNA, 25 bp, Mus musculus
cgtgggctccatctgcttgtccatg

SEQ ID NO: 35902 - DNA, 25 bp, Mus musculus
ctccatctgcttgtccatgtcactt

SEQ ID NO: 35903 - DNA, 25 bp, Mus musculus
gcttgtccatgtcacttcacttctt

SEQ ID NO: 35904 - DNA, 25 bp, Mus musculus
ttgtccatgtcacttcacttcttga

SEQ ID NO: 35905 - DNA, 25 bp, Mus musculus
gtccatgtcacttcacttcttgatc

SEQ ID NO: 35906 - DNA, 25 bp, Mus musculus
cacttcacttcttgatcctctacgt

SEQ ID NO: 35907 - DNA, 25 bp, Mus musculus
atcacaccgctgaatctggacccag

SEQ ID NO: 35908 - DNA, 25 bp, Mus musculus
tgttgaagatcttcacccacagcac

SEQ ID NO: 35909 - DNA, 25 bp, Mus musculus
tggaagtgttccctaccaacactga

SEQ ID NO: 35910 - DNA, 25 bp, Mus musculus
atatcaaaactgttcgatcctgaag

SEQ ID NO: 35911 - DNA, 25 bp, Mus musculus
aaactgttcgatcctgaagtcctga

SEQ ID NO: 35912 - DNA, 25 bp, Mus musculus
ttcgatcctgaagtcctgaaggaca

SEQ ID NO: 35913 - DNA, 25 bp, Mus musculus
gtcctgaaggacacccctgaccaag

SEQ ID NO: 35914 - DNA, 25 bp, Mus musculus
gatccttgaatacacactgctgccc

SEQ ID NO: 35915 - DNA, 25 bp, Mus musculus
tgaatacacactgctgcccaatgag

SEQ ID NO: 35916 - DNA, 25 bp, Mus musculus
ccccatgtcaatgtccaaggccttg

SEQ ID NO: 35917 - DNA, 25 bp, Mus musculus
gtcaatgtccaaggccttgggatac

SEQ ID NO: 35918 - DNA, 25 bp, Mus musculus
ctcctgatgaagacctgggacagta

SEQ ID NO: 35919 - DNA, 25 bp, Mus musculus
ccaggtcccagccaggagtgtggaa

SEQ ID NO: 35920 - DNA, 25 bp, Mus musculus
ctaccaacactgatgtccggccctt

SEQ ID NO: 35921 - DNA, 25 bp, Mus musculus
aagctcagttcttcacagaagacaa

SEQ ID NO: 35922 - DNA, 25 bp, Mus musculus
agttcttcacagaagacaaccggct

SEQ ID NO: 35923 - DNA, 25 bp, Mus musculus
tcacagaagacaaccggcttatgct

SEQ ID NO: 35924 - DNA, 25 bp, Mus musculus
aagacaaccggcttatgctcaactt

SEQ ID NO: 35925 - DNA, 25 bp, Mus musculus
accggcttatgctcaacttcaataa

SEQ ID NO: 35926 - DNA, 25 bp, Mus musculus
gtattgagcgcatcaagctgatgat

SEQ ID NO: 35927 - DNA, 25 bp, Mus musculus
agcgcatcaagctgatgatctcaga

SEQ ID NO: 35928 - DNA, 25 bp, Mus musculus
aatcagaatcactgattttggtctg

SEQ ID NO: 35929 - DNA, 25 bp, Mus musculus
atagttacggtgttgatgggatgga

SEQ ID NO: 35930 - DNA, 25 bp, Mus musculus
aagatctccaacaaggttgacgtgt

SEQ ID NO: 35931 - DNA, 25 bp, Mus musculus
gatctccaacaaggttgacgtgtgg

SEQ ID NO: 35932 - DNA, 25 bp, Mus musculus
tccaacaaggttgacgtgtggtcag

SEQ ID NO: 35933 - DNA, 25 bp, Mus musculus
tggggtcatcttcttccagtgcctc

SEQ ID NO: 35934 - DNA, 25 bp, Mus musculus
gggtcatcttcttccagtgcctcta

SEQ ID NO: 35935 - DNA, 25 bp, Mus musculus
gtcatcttcttccagtgcctctatg

SEQ ID NO: 35936 - DNA, 25 bp, Mus musculus
ttcttccagtgcctctatggtagaa

SEQ ID NO: 35937 - DNA, 25 bp, Mus musculus
cttccagtgcctctatggtagaaga

SEQ ID NO: 35938 - DNA, 25 bp, Mus musculus
tccagtgcctctatggtagaagacc

SEQ ID NO: 35939 - DNA, 25 bp, Mus musculus
cagtgcctctatggtagaagaccat

SEQ ID NO: 35940 - DNA, 25 bp, Mus musculus
ttacggtgttgatgggatggatctg

SEQ ID NO: 35941 - DNA, 25 bp, Mus musculus
ggatggatctgacttcccagggggc

SEQ ID NO: 35942 - DNA, 25 bp, Mus musculus
cacttactggtatttacctcctgag

SEQ ID NO: 35943 - DNA, 25 bp, Mus musculus
tatttacctcctgagtgctttgtag

SEQ ID NO: 35944 - DNA, 25 bp, Mus musculus
tcctgagtgctttgtagttggaaaa

SEQ ID NO: 35945 - DNA, 25 bp, Mus musculus
agccaccgaagatctccaacaaggt

SEQ ID NO: 35946 - DNA, 25 bp, Mus musculus
ccaccgaagatctccaacaaggttg

SEQ ID NO: 35947 - DNA, 25 bp, Mus musculus
cgaagatctccaacaaggttgacgt

SEQ ID NO: 35948 - DNA, 25 bp, Mus musculus
aactgtgcgccttatggacctgctg

SEQ ID NO: 35949 - DNA, 25 bp, Mus musculus
gcgccttatggacctgctggaagaa

SEQ ID NO: 35950 - DNA, 25 bp, Mus musculus
cctttctcataatcgcctcaatgac

SEQ ID NO: 35951 - DNA, 25 bp, Mus musculus
ttctcataatcgcctcaatgactac

SEQ ID NO: 35952 - DNA, 25 bp, Mus musculus
tcgcctcaatgactacatcttctcc

SEQ ID NO: 35953 - DNA, 25 bp, Mus musculus
cctcaatgactacatcttctccttt

SEQ ID NO: 35954 - DNA, 25 bp, Mus musculus
ctacatcttctcctttgacaagatg

SEQ ID NO: 35955 - DNA, 25 bp, Mus musculus
catcttctcctttgacaagatgctg

SEQ ID NO: 35956 - DNA, 25 bp, Mus musculus
ctcctttgacaagatgctggatgac

SEQ ID NO: 35957 - DNA, 25 bp, Mus musculus
gaacacagctgcttacctactgtat

SEQ ID NO: 35958 - DNA, 25 bp, Mus musculus
agctgcttacctactgtatgccttc

SEQ ID NO: 35959 - DNA, 25 bp, Mus musculus
ttacctactgtatgccttcaccaga

SEQ ID NO: 35960 - DNA, 25 bp, Mus musculus
tatggacctgctggaagaagggctg

SEQ ID NO: 35961 - DNA, 25 bp, Mus musculus
actgtatgccttcaccagaatcagg

SEQ ID NO: 35962 - DNA, 25 bp, Mus musculus
acggtccatggacaagctaaaggag

SEQ ID NO: 35963 - DNA, 25 bp, Mus musculus
gaaagcagctcagacatccgttgca

SEQ ID NO: 35964 - DNA, 25 bp, Mus musculus
agcagctcagacatccgttgcatat

SEQ ID NO: 35965 - DNA, 25 bp, Mus musculus
gacatccgttgcatatggctgcatc

SEQ ID NO: 35966 - DNA, 25 bp, Mus musculus
tggctgcatcaaatacgccgacctt

SEQ ID NO: 35967 - DNA, 25 bp, Mus musculus
catcaaatacgccgacctttctcat

SEQ ID NO: 35968 - DNA, 25 bp, Mus musculus
cgacctttctcataatcgcctcaat

SEQ ID NO: 35969 - DNA, 25 bp, Mus musculus
atgacttcttcatcaaaattgaaac

SEQ ID NO: 35970 - DNA, 25 bp, Mus musculus
catggcacaaacctgacttgggaac

SEQ ID NO: 35971 - DNA, 25 bp, Mus musculus
ctgactgtcctaggatgtgtgccta

SEQ ID NO: 35972 - DNA, 25 bp, Mus musculus
gtcctaggatgtgtgcctataagct

SEQ ID NO: 35973 - DNA, 25 bp, Mus musculus
ttacgaacttacatcgccagctctt

SEQ ID NO: 35974 - DNA, 25 bp, Mus musculus
acttacatcgccagctcttttgttg

SEQ ID NO: 35975 - DNA, 25 bp, Mus musculus
atcgccagctcttttgttggattga

SEQ ID NO: 35976 - DNA, 25 bp, Mus musculus
agctcttttgttggattgacaagtg

SEQ ID NO: 35977 - DNA, 25 bp, Mus musculus
cggctgctgatgcctagatgagccc

SEQ ID NO: 35978 - DNA, 25 bp, Mus musculus
cctagatgagcccctgtaggtcaga

SEQ ID NO: 35979 - DNA, 25 bp, Mus musculus
agacattatcagactgtctacggag

SEQ ID NO: 35980 - DNA, 25 bp, Mus musculus
tatcagactgtctacggagtcaagg

SEQ ID NO: 35981 - DNA, 25 bp, Mus musculus
ttcacggtttagatcccaacacttg

SEQ ID NO: 35982 - DNA, 25 bp, Mus musculus
atcagactgtctacggagtcaaggc

SEQ ID NO: 35983 - DNA, 25 bp, Mus musculus
tccacatagacattgcagatcgaag

SEQ ID NO: 35984 - DNA, 25 bp, Mus musculus
ttgaaccagcagactacaaagctga

SEQ ID NO: 35985 - DNA, 25 bp, Mus musculus
atgaagaccctgcattattccattc

SEQ ID NO: 35986 - DNA, 25 bp, Mus musculus
accctgcattattccattcagtcaa

SEQ ID NO: 35987 - DNA, 25 bp, Mus musculus
cattattccattcagtcaagaccaa

SEQ ID NO: 35988 - DNA, 25 bp, Mus musculus
tccattcagtcaagaccaagagagg

SEQ ID NO: 35989 - DNA, 25 bp, Mus musculus
tggcaaacacccctgactgtcctag

SEQ ID NO: 35990 - DNA, 25 bp, Mus musculus
ctattacctgggaaatgtgccagtt

SEQ ID NO: 35991 - DNA, 25 bp, Mus musculus
atgtgccagttgctaaacctgttgg

SEQ ID NO: 35992 - DNA, 25 bp, Mus musculus
cagtggactccaagtcacgtcagcg

SEQ ID NO: 35993 - DNA, 25 bp, Mus musculus
gtggactccaagtcacgtcagcgtg

SEQ ID NO: 35994 - DNA, 25 bp, Mus musculus
actccaagtcacgtcagcgtggccc

SEQ ID NO: 35995 - DNA, 25 bp, Mus musculus
tccaagtcacgtcagcgtggcccct

SEQ ID NO: 35996 - DNA, 25 bp, Mus musculus
caagtcacgtcagcgtggcccctgc

SEQ ID NO: 35997 - DNA, 25 bp, Mus musculus
tcaccatcttgcaccagcagacaga

SEQ ID NO: 35998 - DNA, 25 bp, Mus musculus
tcttgcaccagcagacagaagcggt

SEQ ID NO: 35999 - DNA, 25 bp, Mus musculus
ttgcaccagcagacagaagcggtgc

SEQ ID NO: 36000 - DNA, 25 bp, Mus musculus
gcaccagcagacagaagcggtgctg

SEQ ID NO: 36001 - DNA, 25 bp, Mus musculus
ttcctggctgtgggcagagatgtgc

SEQ ID NO: 36002 - DNA, 25 bp, Mus musculus
gtgccagttgctaaacctgttgggg

SEQ ID NO: 36003 - DNA, 25 bp, Mus musculus
tggagtcagtcctgtcttccagtag

SEQ ID NO: 36004 - DNA, 25 bp, Mus musculus
gagtcagtcctgtcttccagtagcc

SEQ ID NO: 36005 - DNA, 25 bp, Mus musculus
gtcagtcctgtcttccagtagccgt

SEQ ID NO: 36006 - DNA, 25 bp, Mus musculus
cctgtcttccagtagccgtgagcag

SEQ ID NO: 36007 - DNA, 25 bp, Mus musculus
tgtcttccagtagccgtgagcagtg

SEQ ID NO: 36008 - DNA, 25 bp, Mus musculus
tcttccagtagccgtgagcagtgga

SEQ ID NO: 36009 - DNA, 25 bp, Mus musculus
ccagtagccgtgagcagtggactcc

SEQ ID NO: 36010 - DNA, 25 bp, Mus musculus
gtcctgcctcagggccagcatttcc

SEQ ID NO: 36011 - DNA, 25 bp, Mus musculus
aggctcctcggcttctctattagtc

SEQ ID NO: 36012 - DNA, 25 bp, Mus musculus
tcagtttccccatctgtaaaatggg

SEQ ID NO: 36013 - DNA, 25 bp, Mus musculus
gtataacattcacctacctcgtgta

SEQ ID NO: 36014 - DNA, 25 bp, Mus musculus
cattcacctacctcgtgtatggaca

SEQ ID NO: 36015 - DNA, 25 bp, Mus musculus
cctacctcgtgtatggacagtgcct

SEQ ID NO: 36016 - DNA, 25 bp, Mus musculus
atggacagtgcctcacacagtgctg

SEQ ID NO: 36017 - DNA, 25 bp, Mus musculus
tcacacagtgctgagcacatccaca

SEQ ID NO: 36018 - DNA, 25 bp, Mus musculus
cacagtgctgagcacatccacatgt

SEQ ID NO: 36019 - DNA, 25 bp, Mus musculus
agtgctgagcacatccacatgttca

SEQ ID NO: 36020 - DNA, 25 bp, Mus musculus
gctgagcacatccacatgttcaata

SEQ ID NO: 36021 - DNA, 25 bp, Mus musculus
gagcacatccacatgttcaataaat

SEQ ID NO: 36022 - DNA, 25 bp, Mus musculus
ctcttttcttctctgctcagcactg

SEQ ID NO: 36023 - DNA, 25 bp, Mus musculus
tcttctctgctcagcactgacgagg

SEQ ID NO: 36024 - DNA, 25 bp, Mus musculus
ttctggtgtctgctttccccagttg

SEQ ID NO: 36025 - DNA, 25 bp, Mus musculus
tgtctgctttccccagttggagcca

SEQ ID NO: 36026 - DNA, 25 bp, Mus musculus
ccagttggagccagttctaatagtc

SEQ ID NO: 36027 - DNA, 25 bp, Mus musculus
aatagtctggagcctcaggaagaaa

SEQ ID NO: 36028 - DNA, 25 bp, Mus musculus
agatacaacctgggcatgtttgtgt

SEQ ID NO: 36029 - DNA, 25 bp, Mus musculus
atgcatctgtgaggatgcagaaatg

SEQ ID NO: 36030 - DNA, 25 bp, Mus musculus
ccctggtccagcaacagcaatggga

SEQ ID NO: 36031 - DNA, 25 bp, Mus musculus
ctggtccagcaacagcaatgggacg

SEQ ID NO: 36032 - DNA, 25 bp, Mus musculus
gccaactgcaatcgggtctattaga

SEQ ID NO: 36033 - DNA, 25 bp, Mus musculus
ccaactgcaatcgggtctattagaa

SEQ ID NO: 36034 - DNA, 25 bp, Mus musculus
actgcaatcgggtctattagaaggt

SEQ ID NO: 36035 - DNA, 25 bp, Mus musculus
ttaacttccagaatgaatatgctcc

SEQ ID NO: 36036 - DNA, 25 bp, Mus musculus
ctccattcagtgaacgggcaaattg

SEQ ID NO: 36037 - DNA, 25 bp, Mus musculus
tccattcagtgaacgggcaaattga

SEQ ID NO: 36038 - DNA, 25 bp, Mus musculus
caaattgaaccaacagcttcaattc

SEQ ID NO: 36039 - DNA, 25 bp, Mus musculus
attgaaccaacagcttcaattcctt

SEQ ID NO: 36040 - DNA, 25 bp, Mus musculus
ttgaaccaacagcttcaattccttg

SEQ ID NO: 36041 - DNA, 25 bp, Mus musculus
gaaccaacagcttcaattccttggg

SEQ ID NO: 36042 - DNA, 25 bp, Mus musculus
tggtccagcaacagcaatgggacgg

SEQ ID NO: 36043 - DNA, 25 bp, Mus musculus
gtcattaacaatgccaactgcaatc

SEQ ID NO: 36044 - DNA, 25 bp, Mus musculus
tcattaacaatgccaactgcaatcg

SEQ ID NO: 36045 - DNA, 25 bp, Mus musculus
attaacaatgccaactgcaatcggg

SEQ ID NO: 36046 - DNA, 25 bp, Mus musculus
ttaacaatgccaactgcaatcgggt

SEQ ID NO: 36047 - DNA, 25 bp, Mus musculus
acaatgccaactgcaatcgggtcta

SEQ ID NO: 36048 - DNA, 25 bp, Mus musculus
aatgccaactgcaatcgggtctatt

SEQ ID NO: 36049 - DNA, 25 bp, Mus musculus
atgccaactgcaatcgggtctatta

SEQ ID NO: 36050 - DNA, 25 bp, Mus musculus
attgcggcttctggtaccagcattg

SEQ ID NO: 36051 - DNA, 25 bp, Mus musculus
tgcggcttctggtaccagcattgga

SEQ ID NO: 36052 - DNA, 25 bp, Mus musculus
caaacgctggtccacagccacttac

SEQ ID NO: 36053 - DNA, 25 bp, Mus musculus
aacgctggtccacagccacttactg

SEQ ID NO: 36054 - DNA, 25 bp, Mus musculus
acgctggtccacagccacttactgt

SEQ ID NO: 36055 - DNA, 25 bp, Mus musculus
gctggtccacagccacttactgttg

SEQ ID NO: 36056 - DNA, 25 bp, Mus musculus
ctggtccacagccacttactgttga

SEQ ID NO: 36057 - DNA, 25 bp, Mus musculus
aatgtgatggctgctgcaacctttt

SEQ ID NO: 36058 - DNA, 25 bp, Mus musculus
gatggctgctgcaacctttttgccc

SEQ ID NO: 36059 - DNA, 25 bp, Mus musculus
atggctgctgcaacctttttgccca

SEQ ID NO: 36060 - DNA, 25 bp, Mus musculus
ggctgctgcaacctttttgcccaga

SEQ ID NO: 36061 - DNA, 25 bp, Mus musculus
gctgctgcaacctttttgcccagac

SEQ ID NO: 36062 - DNA, 25 bp, Mus musculus
gcggcttctggtaccagcattggat

SEQ ID NO: 36063 - DNA, 25 bp, Mus musculus
gcttctggtaccagcattggatgtg

SEQ ID NO: 36064 - DNA, 25 bp, Mus musculus
tggtaccagcattggatgtgctgga

SEQ ID NO: 36065 - DNA, 25 bp, Mus musculus
taccagcattggatgtgctggaggc

SEQ ID NO: 36066 - DNA, 25 bp, Mus musculus
accagcattggatgtgctggaggct

SEQ ID NO: 36067 - DNA, 25 bp, Mus musculus
ggcttgacccaaacgctggtccaca

SEQ ID NO: 36068 - DNA, 25 bp, Mus musculus
cttgacccaaacgctggtccacagc

SEQ ID NO: 36069 - DNA, 25 bp, Mus musculus
ttgacccaaacgctggtccacagcc

SEQ ID NO: 36070 - DNA, 25 bp, Mus musculus
tgtcagcttttctcctgtaaaaata

SEQ ID NO: 36071 - DNA, 25 bp, Mus musculus
ttgttatcgtaacctgtagtgccaa

SEQ ID NO: 36072 - DNA, 25 bp, Mus musculus
cttaaaagtcacatcatgtgtagga

SEQ ID NO: 36073 - DNA, 25 bp, Mus musculus
agtcacatcatgtgtaggaattaca

SEQ ID NO: 36074 - DNA, 25 bp, Mus musculus
aattacatgcagcattgcccgggcg

SEQ ID NO: 36075 - DNA, 25 bp, Mus musculus
atgctacaatgttaccactgtgcct

SEQ ID NO: 36076 - DNA, 25 bp, Mus musculus
gccttccaatgtttatatcatcgga

SEQ ID NO: 36077 - DNA, 25 bp, Mus musculus
ttatatcatcggaaacataacataa

SEQ ID NO: 36078 - DNA, 25 bp, Mus musculus
ttcaagtgttacctacctgtgtagc

SEQ ID NO: 36079 - DNA, 25 bp, Mus musculus
tgttacctacctgtgtagccgaagt

SEQ ID NO: 36080 - DNA, 25 bp, Mus musculus
cctgtgtagccgaagtagtgtgcag

SEQ ID NO: 36081 - DNA, 25 bp, Mus musculus
gtgaccgagacgtttcagaatacat

SEQ ID NO: 36082 - DNA, 25 bp, Mus musculus
ttatcgtaacctgtagtgccaactc

SEQ ID NO: 36083 - DNA, 25 bp, Mus musculus
taacctgtagtgccaactctgcttc

SEQ ID NO: 36084 - DNA, 25 bp, Mus musculus
gtagtgccaactctgcttccggagg

SEQ ID NO: 36085 - DNA, 25 bp, Mus musculus
acgaaatgctgaccctgaagttgct

SEQ ID NO: 36086 - DNA, 25 bp, Mus musculus
tgaccctgaagttgcttctcattca

SEQ ID NO: 36087 - DNA, 25 bp, Mus musculus
ccctgaagttgcttctcattcacaa

SEQ ID NO: 36088 - DNA, 25 bp, Mus musculus
agttgcttctcattcacaaatagta

SEQ ID NO: 36089 - DNA, 25 bp, Mus musculus
ttctcattcacaaatagtaaaaagt

SEQ ID NO: 36090 - DNA, 25 bp, Mus musculus
accagctgtgctgcctaatctgtcg

SEQ ID NO: 36091 - DNA, 25 bp, Mus musculus
tgtgctgcctaatctgtcggatgga

SEQ ID NO: 36092 - DNA, 25 bp, Mus musculus
tctcccaatggtctcaaagagcttg

SEQ ID NO: 36093 - DNA, 25 bp, Mus musculus
tcccaatggtctcaaagagcttgta

SEQ ID NO: 36094 - DNA, 25 bp, Mus musculus
agatattgtcccgctcaaatgggta

SEQ ID NO: 36095 - DNA, 25 bp, Mus musculus
atattgtcccgctcaaatgggtaca

SEQ ID NO: 36096 - DNA, 25 bp, Mus musculus
attgtcccgctcaaatgggtacagg

SEQ ID NO: 36097 - DNA, 25 bp, Mus musculus
aaatgggtacaggcccgtggtgatg

SEQ ID NO: 36098 - DNA, 25 bp, Mus musculus
tgtaaagtcgtaccccagctgacca

SEQ ID NO: 36099 - DNA, 25 bp, Mus musculus
taaagtcgtaccccagctgaccaga

SEQ ID NO: 36100 - DNA, 25 bp, Mus musculus
aagtcgtaccccagctgaccagatg

SEQ ID NO: 36101 - DNA, 25 bp, Mus musculus
cgtaccccagctgaccagatgtcca

SEQ ID NO: 36102 - DNA, 25 bp, Mus musculus
tgctgcctaatctgtcggatggaga

SEQ ID NO: 36103 - DNA, 25 bp, Mus musculus
gtaccccagctgaccagatgtccac

SEQ ID NO: 36104 - DNA, 25 bp, Mus musculus
ctgcctaatctgtcggatggagaac

SEQ ID NO: 36105 - DNA, 25 bp, Mus musculus
ctaatctgtcggatggagaaccgct

SEQ ID NO: 36106 - DNA, 25 bp, Mus musculus
ggctcatactccaacatccctcgga

SEQ ID NO: 36107 - DNA, 25 bp, Mus musculus
ccaacatccctcggagtaggtcaga

SEQ ID NO: 36108 - DNA, 25 bp, Mus musculus
aacatccctcggagtaggtcagaga

SEQ ID NO: 36109 - DNA, 25 bp, Mus musculus
catccctcggagtaggtcagagagt

SEQ ID NO: 36110 - DNA, 25 bp, Mus musculus
tccctcggagtaggtcagagagtgg

SEQ ID NO: 36111 - DNA, 25 bp, Mus musculus
cgtggaccttcaacatgtcctggag

SEQ ID NO: 36112 - DNA, 25 bp, Mus musculus
tcaacatgtcctggagagctggtac

SEQ ID NO: 36113 - DNA, 25 bp, Mus musculus
cttcaacgaggccttcgtcttcctg

SEQ ID NO: 36114 - DNA, 25 bp, Mus musculus
cctggttcccgttagccagctccag

SEQ ID NO: 36115 - DNA, 25 bp, Mus musculus
ggttcccgttagccagctccagagt

SEQ ID NO: 36116 - DNA, 25 bp, Mus musculus
cgttagccagctccagagtgtggac

SEQ ID NO: 36117 - DNA, 25 bp, Mus musculus
tctgcagctccggactgagcctgtg

SEQ ID NO: 36118 - DNA, 25 bp, Mus musculus
gcagctccggactgagcctgtgggc

SEQ ID NO: 36119 - DNA, 25 bp, Mus musculus
ccggactgagcctgtgggcaaagtg

SEQ ID NO: 36120 - DNA, 25 bp, Mus musculus
acccctacagcactgggcagacatg

SEQ ID NO: 36121 - DNA, 25 bp, Mus musculus
cctacagcactgggcagacatgctg

SEQ ID NO: 36122 - DNA, 25 bp, Mus musculus
ggcagacatgctggcccatgctcgg

SEQ ID NO: 36123 - DNA, 25 bp, Mus musculus
acatgtcctggagagctggtaccag

SEQ ID NO: 36124 - DNA, 25 bp, Mus musculus
ctgcttaggcctcgctcctgaaagc

SEQ ID NO: 36125 - DNA, 25 bp, Mus musculus
tccagggaccactgagcctgagcag

SEQ ID NO: 36126 - DNA, 25 bp, Mus musculus
gaccactgagcctgagcagatgggg

SEQ ID NO: 36127 - DNA, 25 bp, Mus musculus
gtgcttctcactacgctacgtgccc

SEQ ID NO: 36128 - DNA, 25 bp, Mus musculus
ctacgtgcccagctcaggcagcctg

SEQ ID NO: 36129 - DNA, 25 bp, Mus musculus
cctgactgtggttgtactggaggct

SEQ ID NO: 36130 - DNA, 25 bp, Mus musculus
tgtactggaggctcggggtctgaat

SEQ ID NO: 36131 - DNA, 25 bp, Mus musculus
gagcaaaacatcctccaagaaaggc

SEQ ID NO: 36132 - DNA, 25 bp, Mus musculus
gccaccactgtggagatcttcttga

SEQ ID NO: 36133 - DNA, 25 bp, Mus musculus
ttcttgacgctccagttcgtgctct

SEQ ID NO: 36134 - DNA, 25 bp, Mus musculus
ttcagcaaccactgggtgtactggg

SEQ ID NO: 36135 - DNA, 25 bp, Mus musculus
ctgggcagcctactctatgactttc

SEQ ID NO: 36136 - DNA, 25 bp, Mus musculus
agcctactctatgactttctcctct

SEQ ID NO: 36137 - DNA, 25 bp, Mus musculus
ctgtctatcctgaagggagccagac

SEQ ID NO: 36138 - DNA, 25 bp, Mus musculus
gccagacccagtgactccaatggac

SEQ ID NO: 36139 - DNA, 25 bp, Mus musculus
cccagtgactccaatggacagccag

SEQ ID NO: 36140 - DNA, 25 bp, Mus musculus
gactccaatggacagccagagggta

SEQ ID NO: 36141 - DNA, 25 bp, Mus musculus
actcaggccctgtaaaagctccagt

SEQ ID NO: 36142 - DNA, 25 bp, Mus musculus
gccctgtaaaagctccagttggaga

SEQ ID NO: 36143 - DNA, 25 bp, Mus musculus
cccttttgctgtgtgaaatctttca

SEQ ID NO: 36144 - DNA, 25 bp, Mus musculus
acgctccagttcgtgctctgcatct

SEQ ID NO: 36145 - DNA, 25 bp, Mus musculus
cagttcgtgctctgcatctttgcta

SEQ ID NO: 36146 - DNA, 25 bp, Mus musculus
gtgctctgcatctttgctacatacg

SEQ ID NO: 36147 - DNA, 25 bp, Mus musculus
tgcatctttgctacatacgacgaga

SEQ ID NO: 36148 - DNA, 25 bp, Mus musculus
tttgctacatacgacgagaggcgga

SEQ ID NO: 36149 - DNA, 25 bp, Mus musculus
acatacgacgagaggcggaatggcc

SEQ ID NO: 36150 - DNA, 25 bp, Mus musculus
ctggggcacctctttgggatgtatt

SEQ ID NO: 36151 - DNA, 25 bp, Mus musculus
cacctctttgggatgtattacactg

SEQ ID NO: 36152 - DNA, 25 bp, Mus musculus
gatccctgtgagaaacttcagctta

SEQ ID NO: 36153 - DNA, 25 bp, Mus musculus
aaacttcagcttatgagtgcaggca

SEQ ID NO: 36154 - DNA, 25 bp, Mus musculus
gccagatgcccggccaaggttgaag

SEQ ID NO: 36155 - DNA, 25 bp, Mus musculus
ctgtcctagcctggcacaggccaca

SEQ ID NO: 36156 - DNA, 25 bp, Mus musculus
tagcctggcacaggccacagtgaca

SEQ ID NO: 36157 - DNA, 25 bp, Mus musculus
ggcacaggccacagtgacagagtag

SEQ ID NO: 36158 - DNA, 25 bp, Mus musculus
atgttatctatgaactctgagtgtt

SEQ ID NO: 36159 - DNA, 25 bp, Mus musculus
tctatgaactctgagtgttcccatg

SEQ ID NO: 36160 - DNA, 25 bp, Mus musculus
tgacatggtccctgtacccagatat

SEQ ID NO: 36161 - DNA, 25 bp, Mus musculus
ggtccctgtacccagatatgtcctt

SEQ ID NO: 36162 - DNA, 25 bp, Mus musculus
tgtacccagatatgtccttcagtaa

SEQ ID NO: 36163 - DNA, 25 bp, Mus musculus
gatgagcagcacactcagcaggtgg

SEQ ID NO: 36164 - DNA, 25 bp, Mus musculus
cagcttatgagtgcaggcagcagca

SEQ ID NO: 36165 - DNA, 25 bp, Mus musculus
agcgctagtgcaacccaggaaagaa

SEQ ID NO: 36166 - DNA, 25 bp, Mus musculus
tgtgtgccctctatggagacctcgc

SEQ ID NO: 36167 - DNA, 25 bp, Mus musculus
agtagtctcccaaggttggctgaca

SEQ ID NO: 36168 - DNA, 25 bp, Mus musculus
ctcccaaggttggctgacagcccca

SEQ ID NO: 36169 - DNA, 25 bp, Mus musculus
atctccacttggagcctaggcaggt

SEQ ID NO: 36170 - DNA, 25 bp, Mus musculus
agcctaggcaggttgtgttcaagaa

SEQ ID NO: 36171 - DNA, 25 bp, Mus musculus
ggacaacccagagccagatgcccgg

SEQ ID NO: 36172 - DNA, 25 bp, Mus musculus
cccagagccagatgcccggccaagg

SEQ ID NO: 36173 - DNA, 25 bp, Mus musculus
agggctcaaatctgagctcaactgc

SEQ ID NO: 36174 - DNA, 25 bp, Mus musculus
gctcaaatctgagctcaactgcagt

SEQ ID NO: 36175 - DNA, 25 bp, Mus musculus
gccactagggtcctcacagtgagtg

SEQ ID NO: 36176 - DNA, 25 bp, Mus musculus
actagggtcctcacagtgagtgctg

SEQ ID NO: 36177 - DNA, 25 bp, Mus musculus
agggtcctcacagtgagtgctgcta

SEQ ID NO: 36178 - DNA, 25 bp, Mus musculus
gtcctcacagtgagtgctgctaact

SEQ ID NO: 36179 - DNA, 25 bp, Mus musculus
ctcacagtgagtgctgctaactgac

SEQ ID NO: 36180 - DNA, 25 bp, Mus musculus
agtgctgctaactgactgcccgtgc

SEQ ID NO: 36181 - DNA, 25 bp, Mus musculus
gctgctaactgactgcccgtgcaga

SEQ ID NO: 36182 - DNA, 25 bp, Mus musculus
gctaactgactgcccgtgcagaaac

SEQ ID NO: 36183 - DNA, 25 bp, Mus musculus
aactgactgcccgtgcagaaactgg

SEQ ID NO: 36184 - DNA, 25 bp, Mus musculus
tgactgcccgtgcagaaactgggta

SEQ ID NO: 36185 - DNA, 25 bp, Mus musculus
caaatctgagctcaactgcagtcct

SEQ ID NO: 36186 - DNA, 25 bp, Mus musculus
atctgagctcaactgcagtcctagg

SEQ ID NO: 36187 - DNA, 25 bp, Mus musculus
tgagctcaactgcagtcctagggag

SEQ ID NO: 36188 - DNA, 25 bp, Mus musculus
caactgcagtcctagggagatccac

SEQ ID NO: 36189 - DNA, 25 bp, Mus musculus
tcctagggagatccaccctgggctg

SEQ ID NO: 36190 - DNA, 25 bp, Mus musculus
ccctgggctgccactagggtcctca

SEQ ID NO: 36191 - DNA, 25 bp, Mus musculus
tgggctgccactagggtcctcacag

SEQ ID NO: 36192 - DNA, 25 bp, Mus musculus
gctgccactagggtcctcacagtga

SEQ ID NO: 36193 - DNA, 25 bp, Mus musculus
ttaactttgaggcctggtcagacca

SEQ ID NO: 36194 - DNA, 25 bp, Mus musculus
ttgaggcctggtcagaccagaaagg

SEQ ID NO: 36195 - DNA, 25 bp, Mus musculus
tctttcttcatttgagccgcccttg

SEQ ID NO: 36196 - DNA, 25 bp, Mus musculus
ttcatttgagccgcccttggagagc

SEQ ID NO: 36197 - DNA, 25 bp, Mus musculus
ggccctctcagtgctgttcccatga

SEQ ID NO: 36198 - DNA, 25 bp, Mus musculus
agccctcggaggcaagaacacaagg

SEQ ID NO: 36199 - DNA, 25 bp, Mus musculus
tggcccagatggcacggagtttcag

SEQ ID NO: 36200 - DNA, 25 bp, Mus musculus
agatggcacggagtttcagtgtttg

SEQ ID NO: 36201 - DNA, 25 bp, Mus musculus
ggtcatagggccctcgctggaggtc

SEQ ID NO: 36202 - DNA, 25 bp, Mus musculus
gaactcgccgcggccaataaagctc

SEQ ID NO: 36203 - DNA, 25 bp, Mus musculus
gccgcggccaataaagctcacctgt

SEQ ID NO: 36204 - DNA, 25 bp, Mus musculus
gccaataaagctcacctgtgccctg

SEQ ID NO: 36205 - DNA, 25 bp, Mus musculus
cctggtcagaccagaaagggacttg

SEQ ID NO: 36206 - DNA, 25 bp, Mus musculus
ctcactgtagacccctagtcagact

SEQ ID NO: 36207 - DNA, 25 bp, Mus musculus
atgctgtgacctgcaaccgagaaga

SEQ ID NO: 36208 - DNA, 25 bp, Mus musculus
tgacctgcaaccgagaagaaatcag

SEQ ID NO: 36209 - DNA, 25 bp, Mus musculus
aaatcagttgtcagctcagagctga

SEQ ID NO: 36210 - DNA, 25 bp, Mus musculus
gttgtcagctcagagctgagcttgg

SEQ ID NO: 36211 - DNA, 25 bp, Mus musculus
agctcagagctgagcttggctgcct

SEQ ID NO: 36212 - DNA, 25 bp, Mus musculus
accaacagtgcctctttcttcattt

SEQ ID NO: 36213 - DNA, 25 bp, Mus musculus
ttccagtcctggcttcaggctactg

SEQ ID NO: 36214 - DNA, 25 bp, Mus musculus
tcctggcttcaggctactgctgaga

SEQ ID NO: 36215 - DNA, 25 bp, Mus musculus
tggtctgtcactcgctggacttggg

SEQ ID NO: 36216 - DNA, 25 bp, Mus musculus
gtcactcgctggacttgggcctctg

SEQ ID NO: 36217 - DNA, 25 bp, Mus musculus
cgctggacttgggcctctgacttgg

SEQ ID NO: 36218 - DNA, 25 bp, Mus musculus
gcctctgacttggacacttggactt

SEQ ID NO: 36219 - DNA, 25 bp, Mus musculus
ggccttagctgttgggctctgattt

SEQ ID NO: 36220 - DNA, 25 bp, Mus musculus
agctgttgggctctgattttagaga

SEQ ID NO: 36221 - DNA, 25 bp, Mus musculus
agctggtccattatcagtcttaagg

SEQ ID NO: 36222 - DNA, 25 bp, Mus musculus
tccattatcagtcttaaggagtctg

SEQ ID NO: 36223 - DNA, 25 bp, Mus musculus
agcactccatgcccaagacaatgtt

SEQ ID NO: 36224 - DNA, 25 bp, Mus musculus
ccatgcccaagacaatgttgaatca

SEQ ID NO: 36225 - DNA, 25 bp, Mus musculus
tatcctcaagagggaccaggaagga

SEQ ID NO: 36226 - DNA, 25 bp, Mus musculus
accccgagtcacacactttgcagcg

SEQ ID NO: 36227 - DNA, 25 bp, Mus musculus
acactttgcagcgcgggatacccgg

SEQ ID NO: 36228 - DNA, 25 bp, Mus musculus
gagagtccctcgagttgccacactg

SEQ ID NO: 36229 - DNA, 25 bp, Mus musculus
ccctcgagttgccacactgagtcag

SEQ ID NO: 36230 - DNA, 25 bp, Mus musculus
catgaacctcgagttctgactgata

SEQ ID NO: 36231 - DNA, 25 bp, Mus musculus
cctcgagttctgactgatatggact

SEQ ID NO: 36232 - DNA, 25 bp, Mus musculus
actgatatggactggccctggtctg

SEQ ID NO: 36233 - DNA, 25 bp, Mus musculus
tgcacacagccgcgttctacgatca

SEQ ID NO: 36234 - DNA, 25 bp, Mus musculus
gcacacagccgcgttctacgatcaa

SEQ ID NO: 36235 - DNA, 25 bp, Mus musculus
taatttgtcgcagtggttacacgcg

SEQ ID NO: 36236 - DNA, 25 bp, Mus musculus
atttgtcgcagtggttacacgcggt

SEQ ID NO: 36237 - DNA, 25 bp, Mus musculus
tgtccgcgctgatcgccgagggtcc

SEQ ID NO: 36238 - DNA, 25 bp, Mus musculus
gtggatccttggccgcagaggcttt

SEQ ID NO: 36239 - DNA, 25 bp, Mus musculus
tggatccttggccgcagaggcttta

SEQ ID NO: 36240 - DNA, 25 bp, Mus musculus
gatccttggccgcagaggctttaag

SEQ ID NO: 36241 - DNA, 25 bp, Mus musculus
atccttggccgcagaggctttaagc

SEQ ID NO: 36242 - DNA, 25 bp, Mus musculus
tccttggccgcagaggctttaagcg

SEQ ID NO: 36243 - DNA, 25 bp, Mus musculus
ccttggccgcagaggctttaagcgg

SEQ ID NO: 36244 - DNA, 25 bp, Mus musculus
cttggccgcagaggctttaagcggg

SEQ ID NO: 36245 - DNA, 25 bp, Mus musculus
cacacagccgcgttctacgatcaag

SEQ ID NO: 36246 - DNA, 25 bp, Mus musculus
acagccgcgttctacgatcaagctt

SEQ ID NO: 36247 - DNA, 25 bp, Mus musculus
cagccgcgttctacgatcaagcttt

SEQ ID NO: 36248 - DNA, 25 bp, Mus musculus
agccgcgttctacgatcaagctttc

SEQ ID NO: 36249 - DNA, 25 bp, Mus musculus
gccgcgttctacgatcaagctttcg

SEQ ID NO: 36250 - DNA, 25 bp, Mus musculus
cgcgttctacgatcaagctttcggg

SEQ ID NO: 36251 - DNA, 25 bp, Mus musculus
cgataatttgtcgcagtggttacac

SEQ ID NO: 36252 - DNA, 25 bp, Mus musculus
ataatttgtcgcagtggttacacgc

SEQ ID NO: 36253 - DNA, 25 bp, Mus musculus
ctcacaaagcattttgcacttggac

SEQ ID NO: 36254 - DNA, 25 bp, Mus musculus
aagcattttgcacttggacctgaag

SEQ ID NO: 36255 - DNA, 25 bp, Mus musculus
cgaacctcagtacgtgcagtatgca

SEQ ID NO: 36256 - DNA, 25 bp, Mus musculus
tcagtacgtgcagtatgcagtggtt

SEQ ID NO: 36257 - DNA, 25 bp, Mus musculus
agtggttgcctacaatctgcgcccc

SEQ ID NO: 36258 - DNA, 25 bp, Mus musculus
gacactgcagaacatcatccagagc

SEQ ID NO: 36259 - DNA, 25 bp, Mus musculus
gcagaacatcatccagagctgctgg

SEQ ID NO: 36260 - DNA, 25 bp, Mus musculus
cctgcagaggccgggtgcagaactg

SEQ ID NO: 36261 - DNA, 25 bp, Mus musculus
agaactgctccaaagggacctcaag

SEQ ID NO: 36262 - DNA, 25 bp, Mus musculus
ggctttccgaggggcactaggctga

SEQ ID NO: 36263 - DNA, 25 bp, Mus musculus
ggcactaggctgactccatcgagcc

SEQ ID NO: 36264 - DNA, 25 bp, Mus musculus
aggctgactccatcgagccgattgt

SEQ ID NO: 36265 - DNA, 25 bp, Mus musculus
tttgcacttggacctgaagccagcg

SEQ ID NO: 36266 - DNA, 25 bp, Mus musculus
cacgcaccaagctccggagatcctg

SEQ ID NO: 36267 - DNA, 25 bp, Mus musculus
ccaagctccggagatcctgaaagga

SEQ ID NO: 36268 - DNA, 25 bp, Mus musculus
gcccaaagctgacatctactctttt

SEQ ID NO: 36269 - DNA, 25 bp, Mus musculus
agctgacatctactcttttggaatc

SEQ ID NO: 36270 - DNA, 25 bp, Mus musculus
ctcttttggaatcaccctgtggcag

SEQ ID NO: 36271 - DNA, 25 bp, Mus musculus
tggaatcaccctgtggcagatgacc

SEQ ID NO: 36272 - DNA, 25 bp, Mus musculus
ctccggcgaacctcagtacgtgcag

SEQ ID NO: 36273 - DNA, 25 bp, Mus musculus
aacagcatattgctgaccagtcagt

SEQ ID NO: 36274 - DNA, 25 bp, Mus musculus
atattgctgaccagtcagtgtcatc

SEQ ID NO: 36275 - DNA, 25 bp, Mus musculus
cattcatatacgacaaagtaggagc

SEQ ID NO: 36276 - DNA, 25 bp, Mus musculus
ctgtccccttaggatgcatagctgc

SEQ ID NO: 36277 - DNA, 25 bp, Mus musculus
gatgcatagctgcccctagggtacg

SEQ ID NO: 36278 - DNA, 25 bp, Mus musculus
tagctgcccctagggtacgtagctg

SEQ ID NO: 36279 - DNA, 25 bp, Mus musculus
tgacaatggcgttcttctgaaagag

SEQ ID NO: 36280 - DNA, 25 bp, Mus musculus
tcttctgaaagagccacgtttgggt

SEQ ID NO: 36281 - DNA, 25 bp, Mus musculus
cttttctggatgggtgcaaagtatc

SEQ ID NO: 36282 - DNA, 25 bp, Mus musculus
gtctcgctttactagaccgtctctg

SEQ ID NO: 36283 - DNA, 25 bp, Mus musculus
ctttactagaccgtctctgcacaaa

SEQ ID NO: 36284 - DNA, 25 bp, Mus musculus
tagaccgtctctgcacaaaagttta

SEQ ID NO: 36285 - DNA, 25 bp, Mus musculus
ctgaccagtcagtgtcatctcccgg

SEQ ID NO: 36286 - DNA, 25 bp, Mus musculus
agtcagtgtcatctcccgggtgaat

SEQ ID NO: 36287 - DNA, 25 bp, Mus musculus
tgtcatctcccgggtgaattttgat

SEQ ID NO: 36288 - DNA, 25 bp, Mus musculus
ttttgatgtcacgttatagtcaaat

SEQ ID NO: 36289 - DNA, 25 bp, Mus musculus
ctagattttcttcctctgaaccatg

SEQ ID NO: 36290 - DNA, 25 bp, Mus musculus
tttcttcctctgaaccatgatgcag

SEQ ID NO: 36291 - DNA, 25 bp, Mus musculus
cctctgaaccatgatgcagtaggta

SEQ ID NO: 36292 - DNA, 25 bp, Mus musculus
tatatacattcatatacgacaaagt

SEQ ID NO: 36293 - DNA, 25 bp, Mus musculus
cacggtgcagcggcgagcagacgtc

SEQ ID NO: 36294 - DNA, 25 bp, Mus musculus
acgcggacacagacgcgcctcatct

SEQ ID NO: 36295 - DNA, 25 bp, Mus musculus
gaacagcttccacgtgttatatcac

SEQ ID NO: 36296 - DNA, 25 bp, Mus musculus
cagcttccacgtgttatatcacggc

SEQ ID NO: 36297 - DNA, 25 bp, Mus musculus
agcttccacgtgttatatcacggca

SEQ ID NO: 36298 - DNA, 25 bp, Mus musculus
gcttccacgtgttatatcacggcaa

SEQ ID NO: 36299 - DNA, 25 bp, Mus musculus
ttccacgtgttatatcacggcaagt

SEQ ID NO: 36300 - DNA, 25 bp, Mus musculus
tccacgtgttatatcacggcaagtt

SEQ ID NO: 36301 - DNA, 25 bp, Mus musculus
gttatatcacggcaagtttgccaat

SEQ ID NO: 36302 - DNA, 25 bp, Mus musculus
ttatatcacggcaagtttgccaatg

SEQ ID NO: 36303 - DNA, 25 bp, Mus musculus
tatcacggcaagtttgccaatgaag

SEQ ID NO: 36304 - DNA, 25 bp, Mus musculus
atcacggcaagtttgccaatgaagg

SEQ ID NO: 36305 - DNA, 25 bp, Mus musculus
cgcggacacagacgcgcctcatctg

SEQ ID NO: 36306 - DNA, 25 bp, Mus musculus
tcacggcaagtttgccaatgaaggt

SEQ ID NO: 36307 - DNA, 25 bp, Mus musculus
ggacacagacgcgcctcatctgctg

SEQ ID NO: 36308 - DNA, 25 bp, Mus musculus
gacacagacgcgcctcatctgctgg

SEQ ID NO: 36309 - DNA, 25 bp, Mus musculus
acacagacgcgcctcatctgctgga

SEQ ID NO: 36310 - DNA, 25 bp, Mus musculus
acagacgcgcctcatctgctggagc

SEQ ID NO: 36311 - DNA, 25 bp, Mus musculus
cagacgcgcctcatctgctggagcc

SEQ ID NO: 36312 - DNA, 25 bp, Mus musculus
agacgcgcctcatctgctggagccc

SEQ ID NO: 36313 - DNA, 25 bp, Mus musculus
cgcgcctcatctgctggagcccgag

SEQ ID NO: 36314 - DNA, 25 bp, Mus musculus
ctgtggtcacatctgcaaggaggcc

SEQ ID NO: 36315 - DNA, 25 bp, Mus musculus
tcacatctgcaaggaggccccaaga

SEQ ID NO: 36316 - DNA, 25 bp, Mus musculus
cacagccacaggtatagccacaggt

SEQ ID NO: 36317 - DNA, 25 bp, Mus musculus
agccacaggtatagccacaggtaca

SEQ ID NO: 36318 - DNA, 25 bp, Mus musculus
tatagccacaggtacatgcacaggc

SEQ ID NO: 36319 - DNA, 25 bp, Mus musculus
agccacaggtacatgcacaggcaca

SEQ ID NO: 36320 - DNA, 25 bp, Mus musculus
cacaggtacatgcacaggcacaggc

SEQ ID NO: 36321 - DNA, 25 bp, Mus musculus
atgcacaggcacaggcagagtcaaa

SEQ ID NO: 36322 - DNA, 25 bp, Mus musculus
cagagtcaaagccacaggcagaggc

SEQ ID NO: 36323 - DNA, 25 bp, Mus musculus
agccacaggcagaggcacaggaaca

SEQ ID NO: 36324 - DNA, 25 bp, Mus musculus
cacaggcacagtcacagccagagcc

SEQ ID NO: 36325 - DNA, 25 bp, Mus musculus
aggcacagtcacagccagagccacg

SEQ ID NO: 36326 - DNA, 25 bp, Mus musculus
ctgcaaggaggccccaagaggcagc

SEQ ID NO: 36327 - DNA, 25 bp, Mus musculus
ggccccaagaggcagcgttgcctgt

SEQ ID NO: 36328 - DNA, 25 bp, Mus musculus
tgaatgcaggcctggttttgaactg

SEQ ID NO: 36329 - DNA, 25 bp, Mus musculus
atgcaggcctggttttgaactggcc

SEQ ID NO: 36330 - DNA, 25 bp, Mus musculus
tacagcctacacagaggtcagaaaa

SEQ ID NO: 36331 - DNA, 25 bp, Mus musculus
agcctacacagaggtcagaaaaaca

SEQ ID NO: 36332 - DNA, 25 bp, Mus musculus
aaccacgggcacagccacaggtata

SEQ ID NO: 36333 - DNA, 25 bp, Mus musculus
cacgggcacagccacaggtatagcc

SEQ ID NO: 36334 - DNA, 25 bp, Mus musculus
cacgtcctgcagtccatatgcatga

SEQ ID NO: 36335 - DNA, 25 bp, Mus musculus
cagtccatatgcatgacgagcaagc

SEQ ID NO: 36336 - DNA, 25 bp, Mus musculus
acagtctactatgccagttgttccg

SEQ ID NO: 36337 - DNA, 25 bp, Mus musculus
tatgccagttgttccgtcccagaca

SEQ ID NO: 36338 - DNA, 25 bp, Mus musculus
tgttccgtcccagacagcagttggc

SEQ ID NO: 36339 - DNA, 25 bp, Mus musculus
gtcccagacagcagttggcccaagc

SEQ ID NO: 36340 - DNA, 25 bp, Mus musculus
gacagcagttggcccaagcgcatcc

SEQ ID NO: 36341 - DNA, 25 bp, Mus musculus
cccaagcgcatcctcgatatcactg

SEQ ID NO: 36342 - DNA, 25 bp, Mus musculus
aagcgcatcctcgatatcactgctg

SEQ ID NO: 36343 - DNA, 25 bp, Mus musculus
cgcatcctcgatatcactgctgatt

SEQ ID NO: 36344 - DNA, 25 bp, Mus musculus
ctcgatatcactgctgattttgaga

SEQ ID NO: 36345 - DNA, 25 bp, Mus musculus
atcactgctgattttgagaccgttg

SEQ ID NO: 36346 - DNA, 25 bp, Mus musculus
tccatatgcatgacgagcaagcttt

SEQ ID NO: 36347 - DNA, 25 bp, Mus musculus
gaagatctcgtcatactggtgatat

SEQ ID NO: 36348 - DNA, 25 bp, Mus musculus
ctcgtcatactggtgatatggttga

SEQ ID NO: 36349 - DNA, 25 bp, Mus musculus
atgctggacctgtgattgggtacag

SEQ ID NO: 36350 - DNA, 25 bp, Mus musculus
gatcattaggcgctccgtacagtct

SEQ ID NO: 36351 - DNA, 25 bp, Mus musculus
cattaggcgctccgtacagtctact

SEQ ID NO: 36352 - DNA, 25 bp, Mus musculus
taggcgctccgtacagtctactatg

SEQ ID NO: 36353 - DNA, 25 bp, Mus musculus
cgtacagtctactatgccagttgtt

SEQ ID NO: 36354 - DNA, 25 bp, Mus musculus
accttacctgctcaagtatccaaat

SEQ ID NO: 36355 - DNA, 25 bp, Mus musculus
ttcctgtgtcactgagtctctttcc

SEQ ID NO: 36356 - DNA, 25 bp, Mus musculus
aaagtctgactctggtattctctca

SEQ ID NO: 36357 - DNA, 25 bp, Mus musculus
tggtattctctcaactgtgctcctt

SEQ ID NO: 36358 - DNA, 25 bp, Mus musculus
tctctcaactgtgctccttagagtc

SEQ ID NO: 36359 - DNA, 25 bp, Mus musculus
aactgtgctccttagagtcttgtct

SEQ ID NO: 36360 - DNA, 25 bp, Mus musculus
tgtatacatagtcttcatctcaaca

SEQ ID NO: 36361 - DNA, 25 bp, Mus musculus
catagtcttcatctcaacagtaaat

SEQ ID NO: 36362 - DNA, 25 bp, Mus musculus
agaactgcactgtcatccctccagt

SEQ ID NO: 36363 - DNA, 25 bp, Mus musculus
gcactgtcatccctccagtgtagct

SEQ ID NO: 36364 - DNA, 25 bp, Mus musculus
tcatccctccagtgtagctcttttc

SEQ ID NO: 36365 - DNA, 25 bp, Mus musculus
accatgtaattttccattctgagac

SEQ ID NO: 36366 - DNA, 25 bp, Mus musculus
tgtcactgagtctctttcctgagga

SEQ ID NO: 36367 - DNA, 25 bp, Mus musculus
tgagtctctttcctgaggatcttgt

SEQ ID NO: 36368 - DNA, 25 bp, Mus musculus
atcttgtgatggtttcctgttgggg

SEQ ID NO: 36369 - DNA, 25 bp, Mus musculus
tcagaactggactcctggcacctcc

SEQ ID NO: 36370 - DNA, 25 bp, Mus musculus
caactctgctatttttcagtattta

SEQ ID NO: 36371 - DNA, 25 bp, Mus musculus
aatacccaaccaagcagattggatg

SEQ ID NO: 36372 - DNA, 25 bp, Mus musculus
cccagatccctttgttccttgcatt

SEQ ID NO: 36373 - DNA, 25 bp, Mus musculus
ttgcattttcatttaatctgaaaat

SEQ ID NO: 36374 - DNA, 25 bp, Mus musculus
gatcgagatcctgcggacgctgtac

SEQ ID NO: 36375 - DNA, 25 bp, Mus musculus
cgagatcctgcggacgctgtaccac

SEQ ID NO: 36376 - DNA, 25 bp, Mus musculus
agactacctgccaaggcactgcgta

SEQ ID NO: 36377 - DNA, 25 bp, Mus musculus
gcacgtccgtgctgtttgcccagca

SEQ ID NO: 36378 - DNA, 25 bp, Mus musculus
cgtccgtgctgtttgcccagcagat

SEQ ID NO: 36379 - DNA, 25 bp, Mus musculus
ccgtgctgtttgcccagcagatctg

SEQ ID NO: 36380 - DNA, 25 bp, Mus musculus
cccagcagatctgcgagggcatggc

SEQ ID NO: 36381 - DNA, 25 bp, Mus musculus
agcagatctgcgagggcatggccta

SEQ ID NO: 36382 - DNA, 25 bp, Mus musculus
gcatggcctacctgcacgctcagca

SEQ ID NO: 36383 - DNA, 25 bp, Mus musculus
acctgcacgctcagcactacattca

SEQ ID NO: 36384 - DNA, 25 bp, Mus musculus
tgcacgctcagcactacattcaccg

SEQ ID NO: 36385 - DNA, 25 bp, Mus musculus
acgctcagcactacattcaccgaga

SEQ ID NO: 36386 - DNA, 25 bp, Mus musculus
cctgcggacgctgtaccacgaacat

SEQ ID NO: 36387 - DNA, 25 bp, Mus musculus
ctcagcactacattcaccgagacct

SEQ ID NO: 36388 - DNA, 25 bp, Mus musculus
gacgctgtaccacgaacatattgtc

SEQ ID NO: 36389 - DNA, 25 bp, Mus musculus
gctgtaccacgaacatattgtcaag

SEQ ID NO: 36390 - DNA, 25 bp, Mus musculus
gtaccacgaacatattgtcaagtat

SEQ ID NO: 36391 - DNA, 25 bp, Mus musculus
gtctgtacagctggtcatggagtac

SEQ ID NO: 36392 - DNA, 25 bp, Mus musculus
tgtacagctggtcatggagtacgtc

SEQ ID NO: 36393 - DNA, 25 bp, Mus musculus
acagctggtcatggagtacgtccct

SEQ ID NO: 36394 - DNA, 25 bp, Mus musculus
cagcctccgagactacctgccaagg

SEQ ID NO: 36395 - DNA, 25 bp, Mus musculus
atctatgaccggaaatttctgatgg

SEQ ID NO: 36396 - DNA, 25 bp, Mus musculus
aaggacctgccagccattcctgggg

SEQ ID NO: 36397 - DNA, 25 bp, Mus musculus
cctcataccaggcagacactgggtg

SEQ ID NO: 36398 - DNA, 25 bp, Mus musculus
tgccagctctgccttgaattttgtg

SEQ ID NO: 36399 - DNA, 25 bp, Mus musculus
ctctgccttgaattttgtgaacacc

SEQ ID NO: 36400 - DNA, 25 bp, Mus musculus
gaacaccagcacatacctccttgtg

SEQ ID NO: 36401 - DNA, 25 bp, Mus musculus
ccttgtgcctctgtctataccgagc

SEQ ID NO: 36402 - DNA, 25 bp, Mus musculus
gtctataccgagctgctactgcagg

SEQ ID NO: 36403 - DNA, 25 bp, Mus musculus
accgagctgctactgcaggggaatg

SEQ ID NO: 36404 - DNA, 25 bp, Mus musculus
ctgctactgcaggggaatgactctc

SEQ ID NO: 36405 - DNA, 25 bp, Mus musculus
ccggagcacacccatctttccttag

SEQ ID NO: 36406 - DNA, 25 bp, Mus musculus
cacacccatctttccttaggctggg

SEQ ID NO: 36407 - DNA, 25 bp, Mus musculus
gccattcctggggtcactagcccta

SEQ ID NO: 36408 - DNA, 25 bp, Mus musculus
cctggggtcactagccctaccagcg

SEQ ID NO: 36409 - DNA, 25 bp, Mus musculus
accagcgatgagcctcccatgcaag

SEQ ID NO: 36410 - DNA, 25 bp, Mus musculus
gatgagcctcccatgcaagccagcc

SEQ ID NO: 36411 - DNA, 25 bp, Mus musculus
cccagcagcccggaagataagcggg

SEQ ID NO: 36412 - DNA, 25 bp, Mus musculus
taagggaccagccgtaggacgcaat

SEQ ID NO: 36413 - DNA, 25 bp, Mus musculus
agctgcacagcattcaggcctcata

SEQ ID NO: 36414 - DNA, 25 bp, Mus musculus
ttcaggcctcataccaggcagacac

SEQ ID NO: 36415 - DNA, 25 bp, Mus musculus
tagtccgtatgtggatgcgctcaaa

SEQ ID NO: 36416 - DNA, 25 bp, Mus musculus
ctcctccatggtcaacaagctgaac

SEQ ID NO: 36417 - DNA, 25 bp, Mus musculus
acactctgagctgcaacacgctagt

SEQ ID NO: 36418 - DNA, 25 bp, Mus musculus
actctgagctgcaacacgctagtca

SEQ ID NO: 36419 - DNA, 25 bp, Mus musculus
agctgcaacacgctagtcagccgca

SEQ ID NO: 36420 - DNA, 25 bp, Mus musculus
ctgcaacacgctagtcagccgcagc

SEQ ID NO: 36421 - DNA, 25 bp, Mus musculus
gcaacacgctagtcagccgcagcaa

SEQ ID NO: 36422 - DNA, 25 bp, Mus musculus
ccgcagcaacggctgggcacaatga

SEQ ID NO: 36423 - DNA, 25 bp, Mus musculus
aatgactcgagacttctgggacagc

SEQ ID NO: 36424 - DNA, 25 bp, Mus musculus
tcgagacttctgggacagcctagag

SEQ ID NO: 36425 - DNA, 25 bp, Mus musculus
gacttctgggacagcctagagtaat

SEQ ID NO: 36426 - DNA, 25 bp, Mus musculus
cttctgggacagcctagagtaataa

SEQ ID NO: 36427 - DNA, 25 bp, Mus musculus
cctccatggtcaacaagctgaacct

SEQ ID NO: 36428 - DNA, 25 bp, Mus musculus
agtgtcacagtaggtgcatgcctaa

SEQ ID NO: 36429 - DNA, 25 bp, Mus musculus
gtcaacaagctgaacctgaatcata

SEQ ID NO: 36430 - DNA, 25 bp, Mus musculus
acaagctgaacctgaatcatacatg

SEQ ID NO: 36431 - DNA, 25 bp, Mus musculus
gctgaacctgaatcatacatggaaa

SEQ ID NO: 36432 - DNA, 25 bp, Mus musculus
tgaacctgaatcatacatggaaaac

SEQ ID NO: 36433 - DNA, 25 bp, Mus musculus
aacctgaatcatacatggaaaacta

SEQ ID NO: 36434 - DNA, 25 bp, Mus musculus
ctacggacactctgagctgcaacac

SEQ ID NO: 36435 - DNA, 25 bp, Mus musculus
ggacactctgagctgcaacacgcta

SEQ ID NO: 36436 - DNA, 25 bp, Mus musculus
atgccaggcttttctcaggagcttc

SEQ ID NO: 36437 - DNA, 25 bp, Mus musculus
ggcttttctcaggagcttcaatgag

SEQ ID NO: 36438 - DNA, 25 bp, Mus musculus
aatccaagatgctggcactaggcgt

SEQ ID NO: 36439 - DNA, 25 bp, Mus musculus
tggcactaggcgttattcagtgggc

SEQ ID NO: 36440 - DNA, 25 bp, Mus musculus
ttattcagtgggcccttttgatgga

SEQ ID NO: 36441 - DNA, 25 bp, Mus musculus
agtgggcccttttgatggacatgtg

SEQ ID NO: 36442 - DNA, 25 bp, Mus musculus
gacctgtagcccagtgcccagagca

SEQ ID NO: 36443 - DNA, 25 bp, Mus musculus
tagcccagtgcccagagcatattat

SEQ ID NO: 36444 - DNA, 25 bp, Mus musculus
atattatcataaccacatttcaggg

SEQ ID NO: 36445 - DNA, 25 bp, Mus musculus
tcataaccacatttcaggggacgcc

SEQ ID NO: 36446 - DNA, 25 bp, Mus musculus
ggacgccaacgtccatccacctttg

SEQ ID NO: 36447 - DNA, 25 bp, Mus musculus
acctttgcatcgctacctgcagcga

SEQ ID NO: 36448 - DNA, 25 bp, Mus musculus
gcgtcacctacagacacaagcaggt

SEQ ID NO: 36449 - DNA, 25 bp, Mus musculus
catcgctacctgcagcgagcacagg

SEQ ID NO: 36450 - DNA, 25 bp, Mus musculus
cctacagacacaagcaggtgactgc

SEQ ID NO: 36451 - DNA, 25 bp, Mus musculus
gaatcatgtacaagcctgctttctt

SEQ ID NO: 36452 - DNA, 25 bp, Mus musculus
tgtacaagcctgctttcttctcttg

SEQ ID NO: 36453 - DNA, 25 bp, Mus musculus
tctcttggtttcatttgggtaatca

SEQ ID NO: 36454 - DNA, 25 bp, Mus musculus
agaagccatttgagaccaagtgtga

SEQ ID NO: 36455 - DNA, 25 bp, Mus musculus
tcttctcggaaactgcaaaatccaa

SEQ ID NO: 36456 - DNA, 25 bp, Mus musculus
ctgcaaaatccaagatgctggcact

SEQ ID NO: 36457 - DNA, 25 bp, Mus musculus
tctccgtgaggctgctgccatccat

SEQ ID NO: 36458 - DNA, 25 bp, Mus musculus
tgaggctgctgccatccatgtactg

SEQ ID NO: 36459 - DNA, 25 bp, Mus musculus
gactcttatactcagtgccttgtga

SEQ ID NO: 36460 - DNA, 25 bp, Mus musculus
cagtgccttgtgatttctgctctca

SEQ ID NO: 36461 - DNA, 25 bp, Mus musculus
gctctcagattttttcggactggcc

SEQ ID NO: 36462 - DNA, 25 bp, Mus musculus
gagaggctctctgtacctcggcctc

SEQ ID NO: 36463 - DNA, 25 bp, Mus musculus
cctctggcagagacagcagggtgct

SEQ ID NO: 36464 - DNA, 25 bp, Mus musculus
tcgtagcaggctttcagcctggccc

SEQ ID NO: 36465 - DNA, 25 bp, Mus musculus
aggctcaggtccagcttactgttgc

SEQ ID NO: 36466 - DNA, 25 bp, Mus musculus
ctgttgcagctgcctgagcagcctg

SEQ ID NO: 36467 - DNA, 25 bp, Mus musculus
cagcctggatcctgcctgaggttag

SEQ ID NO: 36468 - DNA, 25 bp, Mus musculus
caatgctttctggcaaaagagaggg

SEQ ID NO: 36469 - DNA, 25 bp, Mus musculus
tgctgccatccatgtactggttaca

SEQ ID NO: 36470 - DNA, 25 bp, Mus musculus
gaaactgctggatccctctatgtcc

SEQ ID NO: 36471 - DNA, 25 bp, Mus musculus
tatgtcccagtagccaaggaccatc

SEQ ID NO: 36472 - DNA, 25 bp, Mus musculus
ccagtagccaaggaccatcctacat

SEQ ID NO: 36473 - DNA, 25 bp, Mus musculus
gccaaggaccatcctacatcggtct

SEQ ID NO: 36474 - DNA, 25 bp, Mus musculus
gaccatcctacatcggtctgccttt

SEQ ID NO: 36475 - DNA, 25 bp, Mus musculus
tgcctttccacagactcttatactc

SEQ ID NO: 36476 - DNA, 25 bp, Mus musculus
tccacagactcttatactcagtgcc

SEQ ID NO: 36477 - DNA, 25 bp, Mus musculus
gtacatgctggtcttagtgctggct

SEQ ID NO: 36478 - DNA, 25 bp, Mus musculus
ctcccagctacaggatgcatcatct

SEQ ID NO: 36479 - DNA, 25 bp, Mus musculus
tcctcaacacttcatagcagacctg

SEQ ID NO: 36480 - DNA, 25 bp, Mus musculus
acacttcatagcagacctgtccaag

SEQ ID NO: 36481 - DNA, 25 bp, Mus musculus
catagcagacctgtccaagaaagag

SEQ ID NO: 36482 - DNA, 25 bp, Mus musculus
agacctgtccaagaaagagaggcca

SEQ ID NO: 36483 - DNA, 25 bp, Mus musculus
ggactagcaacactcttccagagcc

SEQ ID NO: 36484 - DNA, 25 bp, Mus musculus
cgctagcttccaatgtatccctgag

SEQ ID NO: 36485 - DNA, 25 bp, Mus musculus
cttccaatgtatccctgagtcatgt

SEQ ID NO: 36486 - DNA, 25 bp, Mus musculus
atgtatccctgagtcatgtcatgct

SEQ ID NO: 36487 - DNA, 25 bp, Mus musculus
gtcatgtcatgcttgactggagagg

SEQ ID NO: 36488 - DNA, 25 bp, Mus musculus
agacccaagagtagcactaatcaag

SEQ ID NO: 36489 - DNA, 25 bp, Mus musculus
gctacaggatgcatcatctggacca

SEQ ID NO: 36490 - DNA, 25 bp, Mus musculus
cttacttactgctctttcaaaggat

SEQ ID NO: 36491 - DNA, 25 bp, Mus musculus
ggatgcatcatctggaccagggacc

SEQ ID NO: 36492 - DNA, 25 bp, Mus musculus
tggaccagggaccaatgaggacctg

SEQ ID NO: 36493 - DNA, 25 bp, Mus musculus
ggacctggaacagcgccagttcaac

SEQ ID NO: 36494 - DNA, 25 bp, Mus musculus
ggaacagcgccagttcaacaagctg

SEQ ID NO: 36495 - DNA, 25 bp, Mus musculus
gcgccagttcaacaagctgggctca

SEQ ID NO: 36496 - DNA, 25 bp, Mus musculus
agcctctcaccatcgaaggcagctg

SEQ ID NO: 36497 - DNA, 25 bp, Mus musculus
ccagggtcctcaacacttcatagca

SEQ ID NO: 36498 - DNA, 25 bp, Mus musculus
ttgggccttgagcggcagtttccga

SEQ ID NO: 36499 - DNA, 25 bp, Mus musculus
tgggccttgagcggcagtttccgag

SEQ ID NO: 36500 - DNA, 25 bp, Mus musculus
gtgactcgcgctgtgctgctgacct

SEQ ID NO: 36501 - DNA, 25 bp, Mus musculus
tgactcgcgctgtgctgctgacctc

SEQ ID NO: 36502 - DNA, 25 bp, Mus musculus
ctgtgctgctgacctcgtcctggcc

SEQ ID NO: 36503 - DNA, 25 bp, Mus musculus
gggatgctcagctggtactgctccg

SEQ ID NO: 36504 - DNA, 25 bp, Mus musculus
atgctcagctggtactgctccggcc

SEQ ID NO: 36505 - DNA, 25 bp, Mus musculus
ctcagctggtactgctccggccgcg

SEQ ID NO: 36506 - DNA, 25 bp, Mus musculus
tcagctggtactgctccggccgcgg

SEQ ID NO: 36507 - DNA, 25 bp, Mus musculus
cgcggcgcctcatgaacgtcaacgg

SEQ ID NO: 36508 - DNA, 25 bp, Mus musculus
ggcgcctcatgaacgtcaacgggcg

SEQ ID NO: 36509 - DNA, 25 bp, Mus musculus
gcctcatgaacgtcaacgggcgcac

SEQ ID NO: 36510 - DNA, 25 bp, Mus musculus
cttgagcggcagtttccgaggctcg

SEQ ID NO: 36511 - DNA, 25 bp, Mus musculus
cctcatgaacgtcaacgggcgcacg

SEQ ID NO: 36512 - DNA, 25 bp, Mus musculus
ttgagcggcagtttccgaggctcgg

SEQ ID NO: 36513 - DNA, 25 bp, Mus musculus
gcacccggcacagtgtgggcatggc

SEQ ID NO: 36514 - DNA, 25 bp, Mus musculus
catggcggtgctggggcaaatagca

SEQ ID NO: 36515 - DNA, 25 bp, Mus musculus
agaattggactcgtgactcgcgctg

SEQ ID NO: 36516 - DNA, 25 bp, Mus musculus
gaattggactcgtgactcgcgctgt

SEQ ID NO: 36517 - DNA, 25 bp, Mus musculus
gactcgtgactcgcgctgtgctgct

SEQ ID NO: 36518 - DNA, 25 bp, Mus musculus
tcgtgactcgcgctgtgctgctgac

SEQ ID NO: 36519 - DNA, 25 bp, Mus musculus
aacacacagatgtgcagtgagcggg

SEQ ID NO: 36520 - DNA, 25 bp, Mus musculus
gagctcgcagagctgcaggcccgcc

SEQ ID NO: 36521 - DNA, 25 bp, Mus musculus
tgacatcgcccttgggatgacgagc

SEQ ID NO: 36522 - DNA, 25 bp, Mus musculus
catcgcccttgggatgacgagccaa

SEQ ID NO: 36523 - DNA, 25 bp, Mus musculus
gatgacgagccaagcctgaggctga

SEQ ID NO: 36524 - DNA, 25 bp, Mus musculus
gacgagccaagcctgaggctgacac

SEQ ID NO: 36525 - DNA, 25 bp, Mus musculus
ggtgtccaggtcactccaagacaca

SEQ ID NO: 36526 - DNA, 25 bp, Mus musculus
gcaccatggagcccagtgcccggga

SEQ ID NO: 36527 - DNA, 25 bp, Mus musculus
ccatggagcccagtgcccgggacgt

SEQ ID NO: 36528 - DNA, 25 bp, Mus musculus
gtgcccgggacgttactgtcagcat

SEQ ID NO: 36529 - DNA, 25 bp, Mus musculus
acgttactgtcagcatgcctgcagc

SEQ ID NO: 36530 - DNA, 25 bp, Mus musculus
gcatgcctgcagctgttctatagta

SEQ ID NO: 36531 - DNA, 25 bp, Mus musculus
gcagccgtgaacagtctccgcaaac

SEQ ID NO: 36532 - DNA, 25 bp, Mus musculus
gccgtgaacagtctccgcaaacagc

SEQ ID NO: 36533 - DNA, 25 bp, Mus musculus
gtgaacagtctccgcaaacagcatg

SEQ ID NO: 36534 - DNA, 25 bp, Mus musculus
agtctccgcaaacagcatgaggctg

SEQ ID NO: 36535 - DNA, 25 bp, Mus musculus
ctccgcaaacagcatgaggctgctg

SEQ ID NO: 36536 - DNA, 25 bp, Mus musculus
tcatctctgagttctaagtgacatc

SEQ ID NO: 36537 - DNA, 25 bp, Mus musculus
agttctaagtgacatcgcccttggg

SEQ ID NO: 36538 - DNA, 25 bp, Mus musculus
aagtgacatcgcccttgggatgacg

SEQ ID NO: 36539 - DNA, 25 bp, Mus musculus
tgcggcatcttgttttcatagtcta

SEQ ID NO: 36540 - DNA, 25 bp, Mus musculus
atcttgttttcatagtctatataaa

SEQ ID NO: 36541 - DNA, 25 bp, Mus musculus
attaaatacaatcatactcttacat

SEQ ID NO: 36542 - DNA, 25 bp, Mus musculus
tacaatcatactcttacattttagt

SEQ ID NO: 36543 - DNA, 25 bp, Mus musculus
tctttgttcccagctttgctttggc

SEQ ID NO: 36544 - DNA, 25 bp, Mus musculus
ttcccagctttgctttggcaatttt

SEQ ID NO: 36545 - DNA, 25 bp, Mus musculus
tgaacttgaccaaaccacgttgcca

SEQ ID NO: 36546 - DNA, 25 bp, Mus musculus
aaccacgttgccatgctgtgtctag

SEQ ID NO: 36547 - DNA, 25 bp, Mus musculus
gttgccatgctgtgtctagtttacc

SEQ ID NO: 36548 - DNA, 25 bp, Mus musculus
tggtttaacaattcctacctcacag

SEQ ID NO: 36549 - DNA, 25 bp, Mus musculus
ctcacagggatgttgtgaggctaca

SEQ ID NO: 36550 - DNA, 25 bp, Mus musculus
ggctacatccatttgccttgaccgt

SEQ ID NO: 36551 - DNA, 25 bp, Mus musculus
aatcctcatcaaggtcagagagcaa

SEQ ID NO: 36552 - DNA, 25 bp, Mus musculus
tccatttgccttgaccgtaagacat

SEQ ID NO: 36553 - DNA, 25 bp, Mus musculus
attagccaggcagctgtttgagaac

SEQ ID NO: 36554 - DNA, 25 bp, Mus musculus
cagcttccatttttatgttagggct

SEQ ID NO: 36555 - DNA, 25 bp, Mus musculus
tgagttgactctgatcttgagtgta

SEQ ID NO: 36556 - DNA, 25 bp, Mus musculus
gactctgatcttgagtgtaaagtct

SEQ ID NO: 36557 - DNA, 25 bp, Mus musculus
tatatcatctgacttatcatgagaa

SEQ ID NO: 36558 - DNA, 25 bp, Mus musculus
gacagcactctttctctacttcata

SEQ ID NO: 36559 - DNA, 25 bp, Mus musculus
tctctacttcataggaatatgaaag

SEQ ID NO: 36560 - DNA, 25 bp, Mus musculus
gatcattccaggcacagtagttctc

SEQ ID NO: 36561 - DNA, 25 bp, Mus musculus
tccaggcacagtagttctcatcggc

SEQ ID NO: 36562 - DNA, 25 bp, Mus musculus
catggcaccagcatgaaccgtgtta

SEQ ID NO: 36563 - DNA, 25 bp, Mus musculus
gcaggttttgccttcgcatggctgg

SEQ ID NO: 36564 - DNA, 25 bp, Mus musculus
tggctggctgctgtaactcactgtc

SEQ ID NO: 36565 - DNA, 25 bp, Mus musculus
gctgctgtaactcactgtcgctctg

SEQ ID NO: 36566 - DNA, 25 bp, Mus musculus
gtaactcactgtcgctctgctttct

SEQ ID NO: 36567 - DNA, 25 bp, Mus musculus
tctttgctctttgtatcacatcaac

SEQ ID NO: 36568 - DNA, 25 bp, Mus musculus
tccaaaccctaaggatcatgtcatc

SEQ ID NO: 36569 - DNA, 25 bp, Mus musculus
ggatcatgtcatcacaaaagtaatt

SEQ ID NO: 36570 - DNA, 25 bp, Mus musculus
tagaaaaatcctctatgtgtggtga

SEQ ID NO: 36571 - DNA, 25 bp, Mus musculus
aatcctctatgtgtggtgactgctt

SEQ ID NO: 36572 - DNA, 25 bp, Mus musculus
catcggctcaacgagcagtcccgac

SEQ ID NO: 36573 - DNA, 25 bp, Mus musculus
ctcaacgagcagtcccgacacagca

SEQ ID NO: 36574 - DNA, 25 bp, Mus musculus
gagcagtcccgacacagcagcatcc

SEQ ID NO: 36575 - DNA, 25 bp, Mus musculus
cacagcagcatccgagacctcagta

SEQ ID NO: 36576 - DNA, 25 bp, Mus musculus
ctcagtaacaaccccatgactcaca

SEQ ID NO: 36577 - DNA, 25 bp, Mus musculus
cccatgactcacattacacatggca

SEQ ID NO: 36578 - DNA, 25 bp, Mus musculus
actcacattacacatggcaccagca

SEQ ID NO: 36579 - DNA, 25 bp, Mus musculus
attacacatggcaccagcatgaacc

SEQ ID NO: 36580 - DNA, 25 bp, Mus musculus
caaagactctgattcttccaaagag

SEQ ID NO: 36581 - DNA, 25 bp, Mus musculus
aagactctgattcttccaaagagcc

SEQ ID NO: 36582 - DNA, 25 bp, Mus musculus
tcttccaaagagccgttggatgatc

SEQ ID NO: 36583 - DNA, 25 bp, Mus musculus
ttccaaagagccgttggatgatctc

SEQ ID NO: 36584 - DNA, 25 bp, Mus musculus
tccaaagagccgttggatgatctct

SEQ ID NO: 36585 - DNA, 25 bp, Mus musculus
gttggatgatctcttcccaaatgac

SEQ ID NO: 36586 - DNA, 25 bp, Mus musculus
ttggatgatctcttcccaaatgacg

SEQ ID NO: 36587 - DNA, 25 bp, Mus musculus
ggatgatctcttcccaaatgacgag

SEQ ID NO: 36588 - DNA, 25 bp, Mus musculus
gatgatctcttcccaaatgacgagg

SEQ ID NO: 36589 - DNA, 25 bp, Mus musculus
atgatctcttcccaaatgacgagga

SEQ ID NO: 36590 - DNA, 25 bp, Mus musculus
tgatctcttcccaaatgacgaggac

SEQ ID NO: 36591 - DNA, 25 bp, Mus musculus
gatctcttcccaaatgacgaggacg

SEQ ID NO: 36592 - DNA, 25 bp, Mus musculus
agactctgattcttccaaagagccg

SEQ ID NO: 36593 - DNA, 25 bp, Mus musculus
atctcttcccaaatgacgaggacga

SEQ ID NO: 36594 - DNA, 25 bp, Mus musculus
actctgattcttccaaagagccgtt

SEQ ID NO: 36595 - DNA, 25 bp, Mus musculus
ctctgattcttccaaagagccgttg

SEQ ID NO: 36596 - DNA, 25 bp, Mus musculus
tctgattcttccaaagagccgttgg

SEQ ID NO: 36597 - DNA, 25 bp, Mus musculus
ctgattcttccaaagagccgttgga

SEQ ID NO: 36598 - DNA, 25 bp, Mus musculus
gattcttccaaagagccgttggatg

SEQ ID NO: 36599 - DNA, 25 bp, Mus musculus
attcttccaaagagccgttggatga

SEQ ID NO: 36600 - DNA, 25 bp, Mus musculus
ttcttccaaagagccgttggatgat

SEQ ID NO: 36601 - DNA, 25 bp, Mus musculus
acataaacatcttctggcctacact

SEQ ID NO: 36602 - DNA, 25 bp, Mus musculus
acatcttctggcctacactgtctgc

SEQ ID NO: 36603 - DNA, 25 bp, Mus musculus
tccagtggatttctctctcctgaaa

SEQ ID NO: 36604 - DNA, 25 bp, Mus musculus
ggatttctctctcctgaaatttcaa

SEQ ID NO: 36605 - DNA, 25 bp, Mus musculus
ctctctcctgaaatttcaacatccc

SEQ ID NO: 36606 - DNA, 25 bp, Mus musculus
atttcaacatccctaattctaggca

SEQ ID NO: 36607 - DNA, 25 bp, Mus musculus
acatccctaattctaggcagcccct

SEQ ID NO: 36608 - DNA, 25 bp, Mus musculus
ttttgcactgcagcatgcctaatga

SEQ ID NO: 36609 - DNA, 25 bp, Mus musculus
actgcagcatgcctaatgagaggaa

SEQ ID NO: 36610 - DNA, 25 bp, Mus musculus
ggtgatcacttctgacaatcactta

SEQ ID NO: 36611 - DNA, 25 bp, Mus musculus
cacttctgacaatcacttaattcag

SEQ ID NO: 36612 - DNA, 25 bp, Mus musculus
tgacaatcacttaattcagagaaaa

SEQ ID NO: 36613 - DNA, 25 bp, Mus musculus
tctggcctacactgtctgctgttta

SEQ ID NO: 36614 - DNA, 25 bp, Mus musculus
ctacactgtctgctgtttagaactc

SEQ ID NO: 36615 - DNA, 25 bp, Mus musculus
ctgtttagaactctgtagcgcactc

SEQ ID NO: 36616 - DNA, 25 bp, Mus musculus
agaactctgtagcgcactcccagag

SEQ ID NO: 36617 - DNA, 25 bp, Mus musculus
gtcaaaatccttcagtgccttgtcg

SEQ ID NO: 36618 - DNA, 25 bp, Mus musculus
cagtgccttgtcgtaaaacagaatt

SEQ ID NO: 36619 - DNA, 25 bp, Mus musculus
tactgtactaacacacgtaaggtat

SEQ ID NO: 36620 - DNA, 25 bp, Mus musculus
actaacacacgtaaggtatccagtg

SEQ ID NO: 36621 - DNA, 25 bp, Mus musculus
caaattacagtagaccccatggtat

SEQ ID NO: 36622 - DNA, 25 bp, Mus musculus
aaattacagtagaccccatggtatg

SEQ ID NO: 36623 - DNA, 25 bp, Mus musculus
catggcctgaaggacccatggccaa

SEQ ID NO: 36624 - DNA, 25 bp, Mus musculus
gcctgaaggacccatggccaatgct

SEQ ID NO: 36625 - DNA, 25 bp, Mus musculus
ctgaaggacccatggccaatgctgc

SEQ ID NO: 36626 - DNA, 25 bp, Mus musculus
tgaaggacccatggccaatgctgct

SEQ ID NO: 36627 - DNA, 25 bp, Mus musculus
aaggacccatggccaatgctgctgc

SEQ ID NO: 36628 - DNA, 25 bp, Mus musculus
aggacccatggccaatgctgctgcc

SEQ ID NO: 36629 - DNA, 25 bp, Mus musculus
cccacagaagctgattcctccgcaa

SEQ ID NO: 36630 - DNA, 25 bp, Mus musculus
acagaagctgattcctccgcaacca

SEQ ID NO: 36631 - DNA, 25 bp, Mus musculus
agaagctgattcctccgcaaccaac

SEQ ID NO: 36632 - DNA, 25 bp, Mus musculus
gaagctgattcctccgcaaccaaca

SEQ ID NO: 36633 - DNA, 25 bp, Mus musculus
attacagtagaccccatggtatggg

SEQ ID NO: 36634 - DNA, 25 bp, Mus musculus
ttacagtagaccccatggtatggga

SEQ ID NO: 36635 - DNA, 25 bp, Mus musculus
acagtagaccccatggtatgggagg

SEQ ID NO: 36636 - DNA, 25 bp, Mus musculus
tcagccgcctggagggcctcccaag

SEQ ID NO: 36637 - DNA, 25 bp, Mus musculus
ctcccaagccatggcctgaaggacc

SEQ ID NO: 36638 - DNA, 25 bp, Mus musculus
tcccaagccatggcctgaaggaccc

SEQ ID NO: 36639 - DNA, 25 bp, Mus musculus
ccaagccatggcctgaaggacccat

SEQ ID NO: 36640 - DNA, 25 bp, Mus musculus
caagccatggcctgaaggacccatg

SEQ ID NO: 36641 - DNA, 25 bp, Mus musculus
caaagatcgggactgtggggaatct

SEQ ID NO: 36642 - DNA, 25 bp, Mus musculus
ggaatctgcagggcccagttccaag

SEQ ID NO: 36643 - DNA, 25 bp, Mus musculus
tctgcctgttcactcagcttccaga

SEQ ID NO: 36644 - DNA, 25 bp, Mus musculus
tgttcactcagcttccagagctagg

SEQ ID NO: 36645 - DNA, 25 bp, Mus musculus
tgctggcagccattccgacgcttga

SEQ ID NO: 36646 - DNA, 25 bp, Mus musculus
atgaccaactgatttgtcttataaa

SEQ ID NO: 36647 - DNA, 25 bp, Mus musculus
ggttgtctcccagcactgcaaaagg

SEQ ID NO: 36648 - DNA, 25 bp, Mus musculus
ctcccagcactgcaaaaggaaaatt

SEQ ID NO: 36649 - DNA, 25 bp, Mus musculus
tcactgttacagtcttccttgcact

SEQ ID NO: 36650 - DNA, 25 bp, Mus musculus
ttacagtcttccttgcacttaacca

SEQ ID NO: 36651 - DNA, 25 bp, Mus musculus
tcttccttgcacttaaccagctttg

SEQ ID NO: 36652 - DNA, 25 bp, Mus musculus
ttgcacttaaccagctttgtctatg

SEQ ID NO: 36653 - DNA, 25 bp, Mus musculus
tccaaagagcagcgttcctgagact

SEQ ID NO: 36654 - DNA, 25 bp, Mus musculus
cgttcctgagactggcctgatagac

SEQ ID NO: 36655 - DNA, 25 bp, Mus musculus
gatagactgcagcacttcacaggcc

SEQ ID NO: 36656 - DNA, 25 bp, Mus musculus
ctgcagcacttcacaggccgccagt

SEQ ID NO: 36657 - DNA, 25 bp, Mus musculus
acaggccgccagttctccagaacca

SEQ ID NO: 36658 - DNA, 25 bp, Mus musculus
ttctccagaaccaaccagcctcaag

SEQ ID NO: 36659 - DNA, 25 bp, Mus musculus
aaccagcctcaagggctccacatct

SEQ ID NO: 36660 - DNA, 25 bp, Mus musculus
cacatctctgcctgttcactcagct

SEQ ID NO: 36661 - DNA, 25 bp, Mus musculus
tctttcgcatccgcaccatcatgaa

SEQ ID NO: 36662 - DNA, 25 bp, Mus musculus
gcatccgcaccatcatgaagcacga

SEQ ID NO: 36663 - DNA, 25 bp, Mus musculus
ccatgatcgtgggcatcactacggg

SEQ ID NO: 36664 - DNA, 25 bp, Mus musculus
gcttctggatctggtcgggcaagac

SEQ ID NO: 36665 - DNA, 25 bp, Mus musculus
gcaagaccctgcagtcatggcgtcg

SEQ ID NO: 36666 - DNA, 25 bp, Mus musculus
ccctgcagtcatggcgtcgcttcta

SEQ ID NO: 36667 - DNA, 25 bp, Mus musculus
agtcatggcgtcgcttctaccacag

SEQ ID NO: 36668 - DNA, 25 bp, Mus musculus
ggcgtcgcttctaccacagactcag

SEQ ID NO: 36669 - DNA, 25 bp, Mus musculus
gcttctaccacagactcagccacag

SEQ ID NO: 36670 - DNA, 25 bp, Mus musculus
accacagactcagccacagcagcaa

SEQ ID NO: 36671 - DNA, 25 bp, Mus musculus
gactcagccacagcagcaaggggga

SEQ ID NO: 36672 - DNA, 25 bp, Mus musculus
cctccactgagctttaacctggaag

SEQ ID NO: 36673 - DNA, 25 bp, Mus musculus
tgcgcatcggcgtcttcagcgtgct

SEQ ID NO: 36674 - DNA, 25 bp, Mus musculus
tgttggcctgctacttttatgagca

SEQ ID NO: 36675 - DNA, 25 bp, Mus musculus
gcacctggctcctgcagacttgcaa

SEQ ID NO: 36676 - DNA, 25 bp, Mus musculus
ggctcctgcagacttgcaagagcta

SEQ ID NO: 36677 - DNA, 25 bp, Mus musculus
cttgcaagagctacgctgtgccctg

SEQ ID NO: 36678 - DNA, 25 bp, Mus musculus
tgagccccgactttacagtcttcat

SEQ ID NO: 36679 - DNA, 25 bp, Mus musculus
agtacctgatgaccatgatcgtggg

SEQ ID NO: 36680 - DNA, 25 bp, Mus musculus
tgatgaccatgatcgtgggcatcac

SEQ ID NO: 36681 - DNA, 25 bp, Mus musculus
tcatttctccagctcttgattcgct

SEQ ID NO: 36682 - DNA, 25 bp, Mus musculus
catttctccagctcttgattcgctc

SEQ ID NO: 36683 - DNA, 25 bp, Mus musculus
cttatcatgcctgtagtagcctccc

SEQ ID NO: 36684 - DNA, 25 bp, Mus musculus
atcatgcctgtagtagcctccctac

SEQ ID NO: 36685 - DNA, 25 bp, Mus musculus
atgcctgtagtagcctccctactga

SEQ ID NO: 36686 - DNA, 25 bp, Mus musculus
tgcctgtagtagcctccctactgag

SEQ ID NO: 36687 - DNA, 25 bp, Mus musculus
tagtagcctccctactgaggagacc

SEQ ID NO: 36688 - DNA, 25 bp, Mus musculus
gtagcctccctactgaggagaccag

SEQ ID NO: 36689 - DNA, 25 bp, Mus musculus
tagcctccctactgaggagaccagc

SEQ ID NO: 36690 - DNA, 25 bp, Mus musculus
gcctccctactgaggagaccagcag

SEQ ID NO: 36691 - DNA, 25 bp, Mus musculus
cctccctactgaggagaccagcagc

SEQ ID NO: 36692 - DNA, 25 bp, Mus musculus
tccctactgaggagaccagcagccc

SEQ ID NO: 36693 - DNA, 25 bp, Mus musculus
ttctccagctcttgattcgctcctg

SEQ ID NO: 36694 - DNA, 25 bp, Mus musculus
ctccagctcttgattcgctcctgta

SEQ ID NO: 36695 - DNA, 25 bp, Mus musculus
tccagctcttgattcgctcctgtac

SEQ ID NO: 36696 - DNA, 25 bp, Mus musculus
cagctcttgattcgctcctgtacca

SEQ ID NO: 36697 - DNA, 25 bp, Mus musculus
agctcttgattcgctcctgtaccag

SEQ ID NO: 36698 - DNA, 25 bp, Mus musculus
ctcttgattcgctcctgtaccaggg

SEQ ID NO: 36699 - DNA, 25 bp, Mus musculus
ggtcttatcatgcctgtagtagcct

SEQ ID NO: 36700 - DNA, 25 bp, Mus musculus
gtcttatcatgcctgtagtagcctc

SEQ ID NO: 36701 - DNA, 25 bp, Mus musculus
gttgttacagctgtggcctgtaata

SEQ ID NO: 36702 - DNA, 25 bp, Mus musculus
tgttacagctgtggcctgtaataag

SEQ ID NO: 36703 - DNA, 25 bp, Mus musculus
atcttgagaacctgttgatagttgc

SEQ ID NO: 36704 - DNA, 25 bp, Mus musculus
aacctgttgatagttgcccagagta

SEQ ID NO: 36705 - DNA, 25 bp, Mus musculus
cctgttgatagttgcccagagtatc

SEQ ID NO: 36706 - DNA, 25 bp, Mus musculus
tagttgcccagagtatcagcaagat

SEQ ID NO: 36707 - DNA, 25 bp, Mus musculus
gttgcccagagtatcagcaagatct

SEQ ID NO: 36708 - DNA, 25 bp, Mus musculus
atggatacatttcctagcttcagat

SEQ ID NO: 36709 - DNA, 25 bp, Mus musculus
atacatttcctagcttcagatttga

SEQ ID NO: 36710 - DNA, 25 bp, Mus musculus
acatttcctagcttcagatttgatg

SEQ ID NO: 36711 - DNA, 25 bp, Mus musculus
atttcctagcttcagatttgatgat

SEQ ID NO: 36712 - DNA, 25 bp, Mus musculus
ttcctagcttcagatttgatgatcc

SEQ ID NO: 36713 - DNA, 25 bp, Mus musculus
ttacagctgtggcctgtaataagta

SEQ ID NO: 36714 - DNA, 25 bp, Mus musculus
cctagcttcagatttgatgatccca

SEQ ID NO: 36715 - DNA, 25 bp, Mus musculus
ataagtaacttgatcctgtacagaa

SEQ ID NO: 36716 - DNA, 25 bp, Mus musculus
aacttgatcctgtacagaaactctt

SEQ ID NO: 36717 - DNA, 25 bp, Mus musculus
cttgatcctgtacagaaactcttcg

SEQ ID NO: 36718 - DNA, 25 bp, Mus musculus
tgatcctgtacagaaactcttcgtg

SEQ ID NO: 36719 - DNA, 25 bp, Mus musculus
attacgaatcgaggcgacaggcatc

SEQ ID NO: 36720 - DNA, 25 bp, Mus musculus
tcgaggcgacaggcatcttgagaac

SEQ ID NO: 36721 - DNA, 25 bp, Mus musculus
gcatcttgagaacctgttgatagtt

SEQ ID NO: 36722 - DNA, 25 bp, Mus musculus
gcctgccttttctatgagcagcaca

SEQ ID NO: 36723 - DNA, 25 bp, Mus musculus
cttttctatgagcagcacaaccgac

SEQ ID NO: 36724 - DNA, 25 bp, Mus musculus
tccctctacagcgacgtcagtaccg

SEQ ID NO: 36725 - DNA, 25 bp, Mus musculus
tacagcgacgtcagtaccggcctga

SEQ ID NO: 36726 - DNA, 25 bp, Mus musculus
ggcacggccagctctgtatcttacc

SEQ ID NO: 36727 - DNA, 25 bp, Mus musculus
gccagctctgtatcttaccctaagc

SEQ ID NO: 36728 - DNA, 25 bp, Mus musculus
tcttaccctaagcaaatgccattgt

SEQ ID NO: 36729 - DNA, 25 bp, Mus musculus
cctaagcaaatgccattgtcccagg

SEQ ID NO: 36730 - DNA, 25 bp, Mus musculus
caaatgccattgtcccaggtctgaa

SEQ ID NO: 36731 - DNA, 25 bp, Mus musculus
tcccagtgttgactgctatagcatg

SEQ ID NO: 36732 - DNA, 25 bp, Mus musculus
ttaatggtatccattagcagcgggg

SEQ ID NO: 36733 - DNA, 25 bp, Mus musculus
gtatccattagcagcggggacttaa

SEQ ID NO: 36734 - DNA, 25 bp, Mus musculus
tatgagcagcacaaccgaccgcgct

SEQ ID NO: 36735 - DNA, 25 bp, Mus musculus
cagcacaaccgaccgcgctgggagg

SEQ ID NO: 36736 - DNA, 25 bp, Mus musculus
caggctcgcaggcccgattacgcgg

SEQ ID NO: 36737 - DNA, 25 bp, Mus musculus
tacgcggtcttcatgctcaagtact

SEQ ID NO: 36738 - DNA, 25 bp, Mus musculus
gtcttcatgctcaagtacttcatgt

SEQ ID NO: 36739 - DNA, 25 bp, Mus musculus
atgctcaagtacttcatgtgcctag

SEQ ID NO: 36740 - DNA, 25 bp, Mus musculus
ttcatgtgcctagtagtgggcatca

SEQ ID NO: 36741 - DNA, 25 bp, Mus musculus
tggtccggcaagactctggagtcct

SEQ ID NO: 36742 - DNA, 25 bp, Mus musculus
gccaggaccggcaactgaaaatcgt

SEQ ID NO: 36743 - DNA, 25 bp, Mus musculus
gacctccttagctacgtgttttgct

SEQ ID NO: 36744 - DNA, 25 bp, Mus musculus
tgaatgttactcttcaagtttggga

SEQ ID NO: 36745 - DNA, 25 bp, Mus musculus
tgttactcttcaagtttgggatata

SEQ ID NO: 36746 - DNA, 25 bp, Mus musculus
ttactcttcaagtttgggatatagg

SEQ ID NO: 36747 - DNA, 25 bp, Mus musculus
actcttcaagtttgggatataggag

SEQ ID NO: 36748 - DNA, 25 bp, Mus musculus
atacatctatggagcacagggaatc

SEQ ID NO: 36749 - DNA, 25 bp, Mus musculus
acatctatggagcacagggaatcct

SEQ ID NO: 36750 - DNA, 25 bp, Mus musculus
agcacagggaatcctcttggtatat

SEQ ID NO: 36751 - DNA, 25 bp, Mus musculus
cacagggaatcctcttggtatatga

SEQ ID NO: 36752 - DNA, 25 bp, Mus musculus
gggaatcctcttggtatatgatatt

SEQ ID NO: 36753 - DNA, 25 bp, Mus musculus
gaatcctcttggtatatgatattac

SEQ ID NO: 36754 - DNA, 25 bp, Mus musculus
cctccttagctacgtgttttgctca

SEQ ID NO: 36755 - DNA, 25 bp, Mus musculus
tccttagctacgtgttttgctcaag

SEQ ID NO: 36756 - DNA, 25 bp, Mus musculus
cttagctacgtgttttgctcaagag

SEQ ID NO: 36757 - DNA, 25 bp, Mus musculus
tagctacgtgttttgctcaagagac

SEQ ID NO: 36758 - DNA, 25 bp, Mus musculus
gctacgtgttttgctcaagagacat

SEQ ID NO: 36759 - DNA, 25 bp, Mus musculus
tacgtgttttgctcaagagacattt

SEQ ID NO: 36760 - DNA, 25 bp, Mus musculus
ttttgctcaagagacatttgggaag

SEQ ID NO: 36761 - DNA, 25 bp, Mus musculus
tttgaatgttactcttcaagtttgg

SEQ ID NO: 36762 - DNA, 25 bp, Mus musculus
ggaactatggctgcgacagttgtgt

SEQ ID NO: 36763 - DNA, 25 bp, Mus musculus
aactatggctgcgacagttgtgtat

SEQ ID NO: 36764 - DNA, 25 bp, Mus musculus
ctatcattggctatgccaggaaccc

SEQ ID NO: 36765 - DNA, 25 bp, Mus musculus
ggctatgccaggaacccgtctctta

SEQ ID NO: 36766 - DNA, 25 bp, Mus musculus
ctatgccaggaacccgtctcttaag

SEQ ID NO: 36767 - DNA, 25 bp, Mus musculus
atgccaggaacccgtctcttaagca

SEQ ID NO: 36768 - DNA, 25 bp, Mus musculus
tcttaagcaacaactcttctcatac

SEQ ID NO: 36769 - DNA, 25 bp, Mus musculus
ttaagcaacaactcttctcatacgc

SEQ ID NO: 36770 - DNA, 25 bp, Mus musculus
aagcaacaactcttctcatacgcta

SEQ ID NO: 36771 - DNA, 25 bp, Mus musculus
caactcttctcatacgctattctag

SEQ ID NO: 36772 - DNA, 25 bp, Mus musculus
actcttctcatacgctattctaggc

SEQ ID NO: 36773 - DNA, 25 bp, Mus musculus
tcttctcatacgctattctaggctt

SEQ ID NO: 36774 - DNA, 25 bp, Mus musculus
ctatggctgcgacagttgtgtatag

SEQ ID NO: 36775 - DNA, 25 bp, Mus musculus
cttctcatacgctattctaggcttt

SEQ ID NO: 36776 - DNA, 25 bp, Mus musculus
atggctgcgacagttgtgtatagct

SEQ ID NO: 36777 - DNA, 25 bp, Mus musculus
tgtgtatagctggctctgggacaag

SEQ ID NO: 36778 - DNA, 25 bp, Mus musculus
tgtatagctggctctgggacaagga

SEQ ID NO: 36779 - DNA, 25 bp, Mus musculus
ttgggagtctctatcattggctatg

SEQ ID NO: 36780 - DNA, 25 bp, Mus musculus
gagtctctatcattggctatgccag

SEQ ID NO: 36781 - DNA, 25 bp, Mus musculus
gtctctatcattggctatgccagga

SEQ ID NO: 36782 - DNA, 25 bp, Mus musculus
ctctatcattggctatgccaggaac

SEQ ID NO: 36783 - DNA, 25 bp, Mus musculus
tttgttattcccattgaggaagtag

SEQ ID NO: 36784 - DNA, 25 bp, Mus musculus
attcccattgaggaagtagaagttg

SEQ ID NO: 36785 - DNA, 25 bp, Mus musculus
ggatgccaacattcccagaagctta

SEQ ID NO: 36786 - DNA, 25 bp, Mus musculus
atgccaacattcccagaagcttagg

SEQ ID NO: 36787 - DNA, 25 bp, Mus musculus
caacattcccagaagcttaggccga

SEQ ID NO: 36788 - DNA, 25 bp, Mus musculus
acattcccagaagcttaggccgagt

SEQ ID NO: 36789 - DNA, 25 bp, Mus musculus
attcccagaagcttaggccgagttg

SEQ ID NO: 36790 - DNA, 25 bp, Mus musculus
tcccagaagcttaggccgagttggc

SEQ ID NO: 36791 - DNA, 25 bp, Mus musculus
ggccgtagcctagttcggcgatggc

SEQ ID NO: 36792 - DNA, 25 bp, Mus musculus
ccgtagcctagttcggcgatggcca

SEQ ID NO: 36793 - DNA, 25 bp, Mus musculus
gtagcctagttcggcgatggccaag

SEQ ID NO: 36794 - DNA, 25 bp, Mus musculus
agcctagttcggcgatggccaagct

SEQ ID NO: 36795 - DNA, 25 bp, Mus musculus
tagaagttgcctttgcaggggtgaa

SEQ ID NO: 36796 - DNA, 25 bp, Mus musculus
gaagttgcctttgcaggggtgaaag

SEQ ID NO: 36797 - DNA, 25 bp, Mus musculus
ttgcctttgcaggggtgaaagccct

SEQ ID NO: 36798 - DNA, 25 bp, Mus musculus
gaaagccctattccaattcgtaatg

SEQ ID NO: 36799 - DNA, 25 bp, Mus musculus
gccctattccaattcgtaatggatg

SEQ ID NO: 36800 - DNA, 25 bp, Mus musculus
cctattccaattcgtaatggatgcc

SEQ ID NO: 36801 - DNA, 25 bp, Mus musculus
tattccaattcgtaatggatgccaa

SEQ ID NO: 36802 - DNA, 25 bp, Mus musculus
atggatgccaacattcccagaagct

SEQ ID NO: 36803 - DNA, 25 bp, Mus musculus
ttatctgctacacacggatcatcaa

SEQ ID NO: 36804 - DNA, 25 bp, Mus musculus
tcatcaatgttttacacagaagacc

SEQ ID NO: 36805 - DNA, 25 bp, Mus musculus
agtacctctggcagttgtttcggag

SEQ ID NO: 36806 - DNA, 25 bp, Mus musculus
tctggcagttgtttcggaggcatac

SEQ ID NO: 36807 - DNA, 25 bp, Mus musculus
ggcatacagctataaccctgccaca

SEQ ID NO: 36808 - DNA, 25 bp, Mus musculus
cagctataaccctgccacaatggct

SEQ ID NO: 36809 - DNA, 25 bp, Mus musculus
taaccctgccacaatggctgccctt

SEQ ID NO: 36810 - DNA, 25 bp, Mus musculus
gcctcccatccacagtggaaattga

SEQ ID NO: 36811 - DNA, 25 bp, Mus musculus
aaattgagacctctgccgacttata

SEQ ID NO: 36812 - DNA, 25 bp, Mus musculus
agacctctgccgacttataattcag

SEQ ID NO: 36813 - DNA, 25 bp, Mus musculus
ctgccgacttataattcagaccctg

SEQ ID NO: 36814 - DNA, 25 bp, Mus musculus
aattcagaccctggacagaacaaag

SEQ ID NO: 36815 - DNA, 25 bp, Mus musculus
tcctcttggccccttattatctggc

SEQ ID NO: 36816 - DNA, 25 bp, Mus musculus
tggccccttattatctggctgcctt

SEQ ID NO: 36817 - DNA, 25 bp, Mus musculus
ctgcctttgtttctgcttttgaaga

SEQ ID NO: 36818 - DNA, 25 bp, Mus musculus
tattcacccctagttgtttgagaag

SEQ ID NO: 36819 - DNA, 25 bp, Mus musculus
aggtggacctgtccttgatgataac

SEQ ID NO: 36820 - DNA, 25 bp, Mus musculus
acctgtccttgatgataactgaagc

SEQ ID NO: 36821 - DNA, 25 bp, Mus musculus
ctgaagcacttgcctacacccactg

SEQ ID NO: 36822 - DNA, 25 bp, Mus musculus
tccggaagtacctctggcagttgtt

SEQ ID NO: 36823 - DNA, 25 bp, Mus musculus
caccctcactgaaccagtggtaatg

SEQ ID NO: 36824 - DNA, 25 bp, Mus musculus
cactgaaccagtggtaatggcactt

SEQ ID NO: 36825 - DNA, 25 bp, Mus musculus
tccgtccttataccgcaactcaaag

SEQ ID NO: 36826 - DNA, 25 bp, Mus musculus
gacccactggaacaagacaatacac

SEQ ID NO: 36827 - DNA, 25 bp, Mus musculus
caagacaatacacggcttgatatac

SEQ ID NO: 36828 - DNA, 25 bp, Mus musculus
aatacacggcttgatatacaacgcc

SEQ ID NO: 36829 - DNA, 25 bp, Mus musculus
caacgccctgaaactcttcatggag

SEQ ID NO: 36830 - DNA, 25 bp, Mus musculus
cctgaaactcttcatggagatgaac

SEQ ID NO: 36831 - DNA, 25 bp, Mus musculus
gatgaaccaaaaactcttcgatgac

SEQ ID NO: 36832 - DNA, 25 bp, Mus musculus
ccaaaaactcttcgatgactgcact

SEQ ID NO: 36833 - DNA, 25 bp, Mus musculus
cgatgactgcactcagcagttcaaa

SEQ ID NO: 36834 - DNA, 25 bp, Mus musculus
tctagccaaagcgaatccccaggta

SEQ ID NO: 36835 - DNA, 25 bp, Mus musculus
ggtaatggcacttctcaaatactgg

SEQ ID NO: 36836 - DNA, 25 bp, Mus musculus
tctcaaatactggccaaagactcac

SEQ ID NO: 36837 - DNA, 25 bp, Mus musculus
gccaaagactcacagtccaaaagaa

SEQ ID NO: 36838 - DNA, 25 bp, Mus musculus
gactcacagtccaaaagaagtaatg

SEQ ID NO: 36839 - DNA, 25 bp, Mus musculus
tgaaccatcagagtttgtgaagatc

SEQ ID NO: 36840 - DNA, 25 bp, Mus musculus
catggagcctcttttccgacagtta

SEQ ID NO: 36841 - DNA, 25 bp, Mus musculus
cagtgacaacgcagcgaagattctg

SEQ ID NO: 36842 - DNA, 25 bp, Mus musculus
gattctgcccatcatgtttccgtcc

SEQ ID NO: 36843 - DNA, 25 bp, Mus musculus
tgatctgacagctttcccatcagta

SEQ ID NO: 36844 - DNA, 25 bp, Mus musculus
gacagctttcccatcagtagaagtg

SEQ ID NO: 36845 - DNA, 25 bp, Mus musculus
tctttctgttgccaaaactgctttt

SEQ ID NO: 36846 - DNA, 25 bp, Mus musculus
tgttgccaaaactgcttttccacta

SEQ ID NO: 36847 - DNA, 25 bp, Mus musculus
tgcttttccactaattcatgccttt

SEQ ID NO: 36848 - DNA, 25 bp, Mus musculus
tccactaattcatgcctttcaagca

SEQ ID NO: 36849 - DNA, 25 bp, Mus musculus
aattcatgcctttcaagcattttaa

SEQ ID NO: 36850 - DNA, 25 bp, Mus musculus
tgacttcaattttggagtgtagtag

SEQ ID NO: 36851 - DNA, 25 bp, Mus musculus
ttggctcttattgaagccaacacgg

SEQ ID NO: 36852 - DNA, 25 bp, Mus musculus
cttattgaagccaacacggaatttg

SEQ ID NO: 36853 - DNA, 25 bp, Mus musculus
gaagccaacacggaatttgctgctg

SEQ ID NO: 36854 - DNA, 25 bp, Mus musculus
aacacggaatttgctgctgtgtttt

SEQ ID NO: 36855 - DNA, 25 bp, Mus musculus
tatagcttctgatcagtgtagtaga

SEQ ID NO: 36856 - DNA, 25 bp, Mus musculus
tttttagtcatcatcatgacgatgc

SEQ ID NO: 36857 - DNA, 25 bp, Mus musculus
atcatgacgatgctgctcaagtgca

SEQ ID NO: 36858 - DNA, 25 bp, Mus musculus
acgatgctgctcaagtgcagatcca

SEQ ID NO: 36859 - DNA, 25 bp, Mus musculus
ctgctcaagtgcagatccagaacag

SEQ ID NO: 36860 - DNA, 25 bp, Mus musculus
agatccagaacagtacagcgttggg

SEQ ID NO: 36861 - DNA, 25 bp, Mus musculus
gtacagcgttgggttcctagagcat

SEQ ID NO: 36862 - DNA, 25 bp, Mus musculus
gttcctagagcatttggtaaactgt

SEQ ID NO: 36863 - DNA, 25 bp, Mus musculus
agccttatgactagtccgtttgata

SEQ ID NO: 36864 - DNA, 25 bp, Mus musculus
ccttatgactagtccgtttgataca

SEQ ID NO: 36865 - DNA, 25 bp, Mus musculus
tggatgaacctagcctatgatgaat

SEQ ID NO: 36866 - DNA, 25 bp, Mus musculus
gatgaacctagcctatgatgaatgt

SEQ ID NO: 36867 - DNA, 25 bp, Mus musculus
atgaacctagcctatgatgaatgtc

SEQ ID NO: 36868 - DNA, 25 bp, Mus musculus
gaacctagcctatgatgaatgtcag

SEQ ID NO: 36869 - DNA, 25 bp, Mus musculus
aacctagcctatgatgaatgtcagc

SEQ ID NO: 36870 - DNA, 25 bp, Mus musculus
tgaatgtcagcagcgtttggtgcac

SEQ ID NO: 36871 - DNA, 25 bp, Mus musculus
gaatgtcagcagcgtttggtgcacc

SEQ ID NO: 36872 - DNA, 25 bp, Mus musculus
atgtcagcagcgtttggtgcaccaa

SEQ ID NO: 36873 - DNA, 25 bp, Mus musculus
tgtcagcagcgtttggtgcaccaac

SEQ ID NO: 36874 - DNA, 25 bp, Mus musculus
tcagcagcgtttggtgcaccaaccc

SEQ ID NO: 36875 - DNA, 25 bp, Mus musculus
cttatgactagtccgtttgatacag

SEQ ID NO: 36876 - DNA, 25 bp, Mus musculus
tatgactagtccgtttgatacagga

SEQ ID NO: 36877 - DNA, 25 bp, Mus musculus
gactagtccgtttgatacaggagac

SEQ ID NO: 36878 - DNA, 25 bp, Mus musculus
tagtccgtttgatacaggagacctt

SEQ ID NO: 36879 - DNA, 25 bp, Mus musculus
gatacaggagaccttctcatagatg

SEQ ID NO: 36880 - DNA, 25 bp, Mus musculus
tacaggagaccttctcatagatggg

SEQ ID NO: 36881 - DNA, 25 bp, Mus musculus
acaggagaccttctcatagatgggt

SEQ ID NO: 36882 - DNA, 25 bp, Mus musculus
aggagaccttctcatagatgggtgg

SEQ ID NO: 36883 - DNA, 25 bp, Mus musculus
gtaattgttcacatagccatcctgg

SEQ ID NO: 36884 - DNA, 25 bp, Mus musculus
taattgttcacatagccatcctggg

SEQ ID NO: 36885 - DNA, 25 bp, Mus musculus
atggccgtcctcacagaaaactatg

SEQ ID NO: 36886 - DNA, 25 bp, Mus musculus
tggccgtcctcacagaaaactatgg

SEQ ID NO: 36887 - DNA, 25 bp, Mus musculus
ggccgtcctcacagaaaactatggg

SEQ ID NO: 36888 - DNA, 25 bp, Mus musculus
gccgtcctcacagaaaactatgggg

SEQ ID NO: 36889 - DNA, 25 bp, Mus musculus
gtcctcacagaaaactatgggggca

SEQ ID NO: 36890 - DNA, 25 bp, Mus musculus
tcctcacagaaaactatgggggcaa

SEQ ID NO: 36891 - DNA, 25 bp, Mus musculus
aattgttcacatagccatcctgggg

SEQ ID NO: 36892 - DNA, 25 bp, Mus musculus
attgttcacatagccatcctggggt

SEQ ID NO: 36893 - DNA, 25 bp, Mus musculus
ttgttcacatagccatcctggggtc

SEQ ID NO: 36894 - DNA, 25 bp, Mus musculus
tgttcacatagccatcctggggtcg

SEQ ID NO: 36895 - DNA, 25 bp, Mus musculus
aatgatggccgtcctcacagaaaac

SEQ ID NO: 36896 - DNA, 25 bp, Mus musculus
atgatggccgtcctcacagaaaact

SEQ ID NO: 36897 - DNA, 25 bp, Mus musculus
tgatggccgtcctcacagaaaacta

SEQ ID NO: 36898 - DNA, 25 bp, Mus musculus
gatggccgtcctcacagaaaactat

SEQ ID NO: 36899 - DNA, 25 bp, Mus musculus
aactgtagccaactcacagttacaa

SEQ ID NO: 36900 - DNA, 25 bp, Mus musculus
tgtagccaactcacagttacaaagt

SEQ ID NO: 36901 - DNA, 25 bp, Mus musculus
tcttgtgaccttgcaagtgcctgag

SEQ ID NO: 36902 - DNA, 25 bp, Mus musculus
gaccttgcaagtgcctgagtgaagc

SEQ ID NO: 36903 - DNA, 25 bp, Mus musculus
aatttttgtaactcatgacttcatg

SEQ ID NO: 36904 - DNA, 25 bp, Mus musculus
aactcatgacttcatgtgctatttg

SEQ ID NO: 36905 - DNA, 25 bp, Mus musculus
taaattcattcaacatctgctgtca

SEQ ID NO: 36906 - DNA, 25 bp, Mus musculus
attcattcaacatctgctgtcacaa

SEQ ID NO: 36907 - DNA, 25 bp, Mus musculus
cattcaacatctgctgtcacaacag

SEQ ID NO: 36908 - DNA, 25 bp, Mus musculus
tgtgaaaacctagcatcagaagaga

SEQ ID NO: 36909 - DNA, 25 bp, Mus musculus
tttgttcttctatcagccaagcttc

SEQ ID NO: 36910 - DNA, 25 bp, Mus musculus
gccaagcttcgacacatgaagttta

SEQ ID NO: 36911 - DNA, 25 bp, Mus musculus
agccaactcacagttacaaagtagc

SEQ ID NO: 36912 - DNA, 25 bp, Mus musculus
gggtttcaccacagtgtgaagaact

SEQ ID NO: 36913 - DNA, 25 bp, Mus musculus
tgagaaccgctggcctagagctgtc

SEQ ID NO: 36914 - DNA, 25 bp, Mus musculus
gaaccgctggcctagagctgtctgc

SEQ ID NO: 36915 - DNA, 25 bp, Mus musculus
ccgctggcctagagctgtctgccca

SEQ ID NO: 36916 - DNA, 25 bp, Mus musculus
agctgtctgcccaaagcttcttgtg

SEQ ID NO: 36917 - DNA, 25 bp, Mus musculus
cccaaagcttcttgtgaccttgcaa

SEQ ID NO: 36918 - DNA, 25 bp, Mus musculus
aaagcttcttgtgaccttgcaagtg

SEQ ID NO: 36919 - DNA, 25 bp, Mus musculus
ccagctcgtctcggcaccatgagag

SEQ ID NO: 36920 - DNA, 25 bp, Mus musculus
cgtctcggcaccatgagaggcgtca

SEQ ID NO: 36921 - DNA, 25 bp, Mus musculus
ctgccctaatcaacagacgtagcag

SEQ ID NO: 36922 - DNA, 25 bp, Mus musculus
tcaacagacgtagcagccagcagtg

SEQ ID NO: 36923 - DNA, 25 bp, Mus musculus
gtagcagccagcagtgtagggcgct

SEQ ID NO: 36924 - DNA, 25 bp, Mus musculus
tctccgactgtcaacagcattatgg

SEQ ID NO: 36925 - DNA, 25 bp, Mus musculus
ccgactgtcaacagcattatggccg

SEQ ID NO: 36926 - DNA, 25 bp, Mus musculus
gtcaacagcattatggccgcatgct

SEQ ID NO: 36927 - DNA, 25 bp, Mus musculus
agcattatggccgcatgctactcgc

SEQ ID NO: 36928 - DNA, 25 bp, Mus musculus
tactcgcgccacgtccggtagctca

SEQ ID NO: 36929 - DNA, 25 bp, Mus musculus
gtccggtagctcacagttaccactg

SEQ ID NO: 36930 - DNA, 25 bp, Mus musculus
tagctcacagttaccactgtagctt

SEQ ID NO: 36931 - DNA, 25 bp, Mus musculus
ctcggcaccatgagaggcgtcacca

SEQ ID NO: 36932 - DNA, 25 bp, Mus musculus
acagttaccactgtagcttgtcgaa

SEQ ID NO: 36933 - DNA, 25 bp, Mus musculus
gtcccggtgccagctcaactgctga

SEQ ID NO: 36934 - DNA, 25 bp, Mus musculus
ccagctcaactgctgaccatcgaga

SEQ ID NO: 36935 - DNA, 25 bp, Mus musculus
ctgaccatcgagagccggctgtgaa

SEQ ID NO: 36936 - DNA, 25 bp, Mus musculus
accatcgagagccggctgtgaacgt

SEQ ID NO: 36937 - DNA, 25 bp, Mus musculus
atcgagagccggctgtgaacgtgat

SEQ ID NO: 36938 - DNA, 25 bp, Mus musculus
caggttctgccctaatcaacagacg

SEQ ID NO: 36939 - DNA, 25 bp, Mus musculus
gttctgccctaatcaacagacgtag

SEQ ID NO: 36940 - DNA, 25 bp, Mus musculus
cacatattgccaaggtgctgactta

SEQ ID NO: 36941 - DNA, 25 bp, Mus musculus
catattgccaaggtgctgacttata

SEQ ID NO: 36942 - DNA, 25 bp, Mus musculus
atgtacaagccttgcaagaacgtgg

SEQ ID NO: 36943 - DNA, 25 bp, Mus musculus
gccttgcaagaacgtggtggagccg

SEQ ID NO: 36944 - DNA, 25 bp, Mus musculus
agtgttcactgagtcctgacagtga

SEQ ID NO: 36945 - DNA, 25 bp, Mus musculus
ttcactgagtcctgacagtgactgt

SEQ ID NO: 36946 - DNA, 25 bp, Mus musculus
tagaactgctcaatggtgcttattt

SEQ ID NO: 36947 - DNA, 25 bp, Mus musculus
gaactgctcaatggtgcttatttac

SEQ ID NO: 36948 - DNA, 25 bp, Mus musculus
actgctcaatggtgcttatttaccc

SEQ ID NO: 36949 - DNA, 25 bp, Mus musculus
atggtgcttatttacccgcggatga

SEQ ID NO: 36950 - DNA, 25 bp, Mus musculus
ggtgcttatttacccgcggatgaga

SEQ ID NO: 36951 - DNA, 25 bp, Mus musculus
tgcttatttacccgcggatgagatt

SEQ ID NO: 36952 - DNA, 25 bp, Mus musculus
ttataagcatctgtgacagcaaatt

SEQ ID NO: 36953 - DNA, 25 bp, Mus musculus
ttatttacccgcggatgagattatg

SEQ ID NO: 36954 - DNA, 25 bp, Mus musculus
ataagcatctgtgacagcaaattat

SEQ ID NO: 36955 - DNA, 25 bp, Mus musculus
atgatattgcgcggttcaacgaggt

SEQ ID NO: 36956 - DNA, 25 bp, Mus musculus
gatattgcgcggttcaacgaggtcc

SEQ ID NO: 36957 - DNA, 25 bp, Mus musculus
gcggttcaacgaggtcctagattga

SEQ ID NO: 36958 - DNA, 25 bp, Mus musculus
gtactaaattgcgttgacggatgta

SEQ ID NO: 36959 - DNA, 25 bp, Mus musculus
taaattgcgttgacggatgtacaag

SEQ ID NO: 36960 - DNA, 25 bp, Mus musculus
ggatgtacaagccttgcaagaacgt

SEQ ID NO: 36961 - DNA, 25 bp, Mus musculus
tgtaacctggccagtgtaatacttc

SEQ ID NO: 36962 - DNA, 25 bp, Mus musculus
atacttcagctcctagcaatgaaag

SEQ ID NO: 36963 - DNA, 25 bp, Mus musculus
ccttctccagatcacattgaggcgg

SEQ ID NO: 36964 - DNA, 25 bp, Mus musculus
ccagatcacattgaggcggccattg

SEQ ID NO: 36965 - DNA, 25 bp, Mus musculus
cacattgaggcggccattgcccagc

SEQ ID NO: 36966 - DNA, 25 bp, Mus musculus
gccattgcccagctggacctgttag

SEQ ID NO: 36967 - DNA, 25 bp, Mus musculus
gcccagctggacctgttaggtgctc

SEQ ID NO: 36968 - DNA, 25 bp, Mus musculus
ctggacctgttaggtgctcttgaac

SEQ ID NO: 36969 - DNA, 25 bp, Mus musculus
ctgttaggtgctcttgaacataagg

SEQ ID NO: 36970 - DNA, 25 bp, Mus musculus
gatgaccagcttaccctgactccaa

SEQ ID NO: 36971 - DNA, 25 bp, Mus musculus
atggcagcattccctttagagccca

SEQ ID NO: 36972 - DNA, 25 bp, Mus musculus
gcattccctttagagcccagatttg

SEQ ID NO: 36973 - DNA, 25 bp, Mus musculus
cagctcctagcaatgaaagtcccaa

SEQ ID NO: 36974 - DNA, 25 bp, Mus musculus
ctcctgtcctccaaattccactgta

SEQ ID NO: 36975 - DNA, 25 bp, Mus musculus
atgaaagtcccaaatgtgctcacct

SEQ ID NO: 36976 - DNA, 25 bp, Mus musculus
gtcccaaatgtgctcacctttgact

SEQ ID NO: 36977 - DNA, 25 bp, Mus musculus
aatgtgctcacctttgacttcatgt

SEQ ID NO: 36978 - DNA, 25 bp, Mus musculus
ctcacctttgacttcatgtccaaac

SEQ ID NO: 36979 - DNA, 25 bp, Mus musculus
tttgacttcatgtccaaaccttctc

SEQ ID NO: 36980 - DNA, 25 bp, Mus musculus
ttcatgtccaaaccttctccagatc

SEQ ID NO: 36981 - DNA, 25 bp, Mus musculus
tccaaaccttctccagatcacattg

SEQ ID NO: 36982 - DNA, 25 bp, Mus musculus
tctcctacaactccgtacagctcta

SEQ ID NO: 36983 - DNA, 25 bp, Mus musculus
acaactccgtacagctctatactca

SEQ ID NO: 36984 - DNA, 25 bp, Mus musculus
gcaatcttgaacatcttctgactgt

SEQ ID NO: 36985 - DNA, 25 bp, Mus musculus
atcttgaacatcttctgactgtttc

SEQ ID NO: 36986 - DNA, 25 bp, Mus musculus
agatgctccgggatctgctctccat

SEQ ID NO: 36987 - DNA, 25 bp, Mus musculus
tcggtcgctacgtcgttgtacacag

SEQ ID NO: 36988 - DNA, 25 bp, Mus musculus
gtcgctacgtcgttgtacacagggg

SEQ ID NO: 36989 - DNA, 25 bp, Mus musculus
gacgatgacagcggctgtggcgtct

SEQ ID NO: 36990 - DNA, 25 bp, Mus musculus
ggcgtcttctgcactgacgtgcatc

SEQ ID NO: 36991 - DNA, 25 bp, Mus musculus
gtcttctgcactgacgtgcatctga

SEQ ID NO: 36992 - DNA, 25 bp, Mus musculus
ttctgcactgacgtgcatctgaacg

SEQ ID NO: 36993 - DNA, 25 bp, Mus musculus
actgacgtgcatctgaacgatgata

SEQ ID NO: 36994 - DNA, 25 bp, Mus musculus
actccgtacagctctatactcaact

SEQ ID NO: 36995 - DNA, 25 bp, Mus musculus
ccgtacagctctatactcaactgcg

SEQ ID NO: 36996 - DNA, 25 bp, Mus musculus
tctatactcaactgcgaggaggaag

SEQ ID NO: 36997 - DNA, 25 bp, Mus musculus
atactcaactgcgaggaggaagaga

SEQ ID NO: 36998 - DNA, 25 bp, Mus musculus
caccagccaacagagagcatgctac

SEQ ID NO: 36999 - DNA, 25 bp, Mus musculus
cagccgcctgtgcccagtgtcgcaa

SEQ ID NO: 37000 - DNA, 25 bp, Mus musculus
ccgcctgtgcccagtgtcgcaatct

SEQ ID NO: 37001 - DNA, 25 bp, Mus musculus
gtgcccagtgtcgcaatcttgaaca

SEQ ID NO: 37002 - DNA, 25 bp, Mus musculus
gactgaggccctggatgatgcaaaa

SEQ ID NO: 37003 - DNA, 25 bp, Mus musculus
aaggagaccttcaggcaatggtggg

SEQ ID NO: 37004 - DNA, 25 bp, Mus musculus
ctcagatgtgcctgacttagtgaga

SEQ ID NO: 37005 - DNA, 25 bp, Mus musculus
aggctgtgtgtccactagtagctcc

SEQ ID NO: 37006 - DNA, 25 bp, Mus musculus
tgtgtccactagtagctccagtgag

SEQ ID NO: 37007 - DNA, 25 bp, Mus musculus
cactagtagctccagtgaggatggt

SEQ ID NO: 37008 - DNA, 25 bp, Mus musculus
tagtagctccagtgaggatggtgag

SEQ ID NO: 37009 - DNA, 25 bp, Mus musculus
caaagccaagactgtcctagtgact

SEQ ID NO: 37010 - DNA, 25 bp, Mus musculus
gactgtcctagtgactgctagacct

SEQ ID NO: 37011 - DNA, 25 bp, Mus musculus
tgtcctagtgactgctagacctgta

SEQ ID NO: 37012 - DNA, 25 bp, Mus musculus
agtgactgctagacctgtatttggg

SEQ ID NO: 37013 - DNA, 25 bp, Mus musculus
tgctagacctgtatttgggaagaaa

SEQ ID NO: 37014 - DNA, 25 bp, Mus musculus
gagaccttcaggcaatggtgggttt

SEQ ID NO: 37015 - DNA, 25 bp, Mus musculus
ctactgctcagaatcaccccaggaa

SEQ ID NO: 37016 - DNA, 25 bp, Mus musculus
ctcagaatcaccccaggaatcttcc

SEQ ID NO: 37017 - DNA, 25 bp, Mus musculus
ggaatcttcctgtgaggatggagaa

SEQ ID NO: 37018 - DNA, 25 bp, Mus musculus
atcttcctgtgaggatggagaaggt

SEQ ID NO: 37019 - DNA, 25 bp, Mus musculus
aggttcatctgtgatgagtgcacga

SEQ ID NO: 37020 - DNA, 25 bp, Mus musculus
aatcggctgctcagatgtgcctgac

SEQ ID NO: 37021 - DNA, 25 bp, Mus musculus
ctgctcagatgtgcctgacttagtg

SEQ ID NO: 37022 - DNA, 25 bp, Mus musculus
cattcccttgacagcacaggaagaa

SEQ ID NO: 37023 - DNA, 25 bp, Mus musculus
gttactacacaagaggccgaacatt

SEQ ID NO: 37024 - DNA, 25 bp, Mus musculus
atgaacatctaaaaactttgctagg

SEQ ID NO: 37025 - DNA, 25 bp, Mus musculus
gtgtgacatttctgccatggagtta

SEQ ID NO: 37026 - DNA, 25 bp, Mus musculus
cccacatgtatcacatactgcatat

SEQ ID NO: 37027 - DNA, 25 bp, Mus musculus
tgtatcacatactgcatattcccac

SEQ ID NO: 37028 - DNA, 25 bp, Mus musculus
acatactgcatattcccacatgtat

SEQ ID NO: 37029 - DNA, 25 bp, Mus musculus
tgcatattcccacatgtatcacaca

SEQ ID NO: 37030 - DNA, 25 bp, Mus musculus
catgtatcacacatgtattgtaaaa

SEQ ID NO: 37031 - DNA, 25 bp, Mus musculus
atgtggtagccacctgctgcaatgg

SEQ ID NO: 37032 - DNA, 25 bp, Mus musculus
tagccacctgctgcaatggttcctc

SEQ ID NO: 37033 - DNA, 25 bp, Mus musculus
cctgctgcaatggttcctcttgtag

SEQ ID NO: 37034 - DNA, 25 bp, Mus musculus
tctgctcctcacctgcagaagccag

SEQ ID NO: 37035 - DNA, 25 bp, Mus musculus
cctcacctgcagaagccagtttgtt

SEQ ID NO: 37036 - DNA, 25 bp, Mus musculus
aagccagtttgtttggccatgtgac

SEQ ID NO: 37037 - DNA, 25 bp, Mus musculus
gtttgtttggccatgtgacaattgt

SEQ ID NO: 37038 - DNA, 25 bp, Mus musculus
caattgtcctgtgtttttatagcac

SEQ ID NO: 37039 - DNA, 25 bp, Mus musculus
gtttttatagcacccaaatcattct

SEQ ID NO: 37040 - DNA, 25 bp, Mus musculus
atagcacccaaatcattctaaaata

SEQ ID NO: 37041 - DNA, 25 bp, Mus musculus
cccaaatcattctaaaatatgaaca

SEQ ID NO: 37042 - DNA, 25 bp, Mus musculus
aaagggactccattcacgccactgc

SEQ ID NO: 37043 - DNA, 25 bp, Mus musculus
gcaatcagagctcaacatggcggca

SEQ ID NO: 37044 - DNA, 25 bp, Mus musculus
cttctcattctttgcccttgcatct

SEQ ID NO: 37045 - DNA, 25 bp, Mus musculus
cctccatggctcctgcaagataggg

SEQ ID NO: 37046 - DNA, 25 bp, Mus musculus
ggcttcctgactcatagcagccact

SEQ ID NO: 37047 - DNA, 25 bp, Mus musculus
ctgactcatagcagccacttcagtt

SEQ ID NO: 37048 - DNA, 25 bp, Mus musculus
agccacttcagttagggttagatga

SEQ ID NO: 37049 - DNA, 25 bp, Mus musculus
tggctacccttgccttatggctcta

SEQ ID NO: 37050 - DNA, 25 bp, Mus musculus
tgacctacagagcatgctccattaa

SEQ ID NO: 37051 - DNA, 25 bp, Mus musculus
acagagcatgctccattaagaaccc

SEQ ID NO: 37052 - DNA, 25 bp, Mus musculus
acctcattgtcatctccaataaaac

SEQ ID NO: 37053 - DNA, 25 bp, Mus musculus
ttgtcatctccaataaaacaccacg

SEQ ID NO: 37054 - DNA, 25 bp, Mus musculus
agagctcaacatggcggcacttctg

SEQ ID NO: 37055 - DNA, 25 bp, Mus musculus
ctccaataaaacaccacgcacagtc

SEQ ID NO: 37056 - DNA, 25 bp, Mus musculus
caacatggcggcacttctgtcccat

SEQ ID NO: 37057 - DNA, 25 bp, Mus musculus
ggcacttacacctaagacaggagca

SEQ ID NO: 37058 - DNA, 25 bp, Mus musculus
gactcacagctgtagctctgctaga

SEQ ID NO: 37059 - DNA, 25 bp, Mus musculus
tagctctgctagaaaacgggggact

SEQ ID NO: 37060 - DNA, 25 bp, Mus musculus
tcaaccaaaccgggaggcttagcat

SEQ ID NO: 37061 - DNA, 25 bp, Mus musculus
ttagcatctggtgagactggggaac

SEQ ID NO: 37062 - DNA, 25 bp, Mus musculus
catattcaagccaagagccagcctg

SEQ ID NO: 37063 - DNA, 25 bp, Mus musculus
gacagtgccattatgacggggtcct

SEQ ID NO: 37064 - DNA, 25 bp, Mus musculus
gccattatgacggggtcctacaaca

SEQ ID NO: 37065 - DNA, 25 bp, Mus musculus
ctgaagccccggaaagtatgtacag

SEQ ID NO: 37066 - DNA, 25 bp, Mus musculus
attagcgtggacagtttggacttca

SEQ ID NO: 37067 - DNA, 25 bp, Mus musculus
acacagcctggcaccccatggagag

SEQ ID NO: 37068 - DNA, 25 bp, Mus musculus
acagcctggcaccccatggagagca

SEQ ID NO: 37069 - DNA, 25 bp, Mus musculus
cctggcaccccatggagagcattat

SEQ ID NO: 37070 - DNA, 25 bp, Mus musculus
tggcaccccatggagagcattattg

SEQ ID NO: 37071 - DNA, 25 bp, Mus musculus
attattgctgtagctgccaccaata

SEQ ID NO: 37072 - DNA, 25 bp, Mus musculus
ttgctgtagctgccaccaataactt

SEQ ID NO: 37073 - DNA, 25 bp, Mus musculus
gctgccaccaataacttgtatatat

SEQ ID NO: 37074 - DNA, 25 bp, Mus musculus
ccaccaataacttgtatatattcca

SEQ ID NO: 37075 - DNA, 25 bp, Mus musculus
gaaacactcggagggatgttacact

SEQ ID NO: 37076 - DNA, 25 bp, Mus musculus
ttacactggaagcctcaagagagaa

SEQ ID NO: 37077 - DNA, 25 bp, Mus musculus
acactggaagcctcaagagagaaca

SEQ ID NO: 37078 - DNA, 25 bp, Mus musculus
gagagaacagcaaaccccgagccag

SEQ ID NO: 37079 - DNA, 25 bp, Mus musculus
gagaacagcaaaccccgagccagcc

SEQ ID NO: 37080 - DNA, 25 bp, Mus musculus
acagcaaaccccgagccagcctgaa

SEQ ID NO: 37081 - DNA, 25 bp, Mus musculus
gagccagcctgaagccccggaaagt

SEQ ID NO: 37082 - DNA, 25 bp, Mus musculus
gccagcctgaagccccggaaagtat

SEQ ID NO: 37083 - DNA, 25 bp, Mus musculus
tgaccttccaggctttctcttattt

SEQ ID NO: 37084 - DNA, 25 bp, Mus musculus
cctttgacctttactcctgcactgt

SEQ ID NO: 37085 - DNA, 25 bp, Mus musculus
cccagagaccgtgctcaggtgactg

SEQ ID NO: 37086 - DNA, 25 bp, Mus musculus
gaccgtgctcaggtgactgattctt

SEQ ID NO: 37087 - DNA, 25 bp, Mus musculus
agtccagcggggatgtccaggcatc

SEQ ID NO: 37088 - DNA, 25 bp, Mus musculus
atgtccaggcatctcgtgactaccc

SEQ ID NO: 37089 - DNA, 25 bp, Mus musculus
ctcgtgactacccaaggtctctcat

SEQ ID NO: 37090 - DNA, 25 bp, Mus musculus
actacccaaggtctctcatcggagc

SEQ ID NO: 37091 - DNA, 25 bp, Mus musculus
caaggtctctcatcggagccgaagt

SEQ ID NO: 37092 - DNA, 25 bp, Mus musculus
ccgctgtccctggacttgcatccag

SEQ ID NO: 37093 - DNA, 25 bp, Mus musculus
tccctggacttgcatccagaagagc

SEQ ID NO: 37094 - DNA, 25 bp, Mus musculus
gacttgcatccagaagagccttcat

SEQ ID NO: 37095 - DNA, 25 bp, Mus musculus
acctttactcctgcactgtgacaca

SEQ ID NO: 37096 - DNA, 25 bp, Mus musculus
ccctgccttcggatctcctagagaa

SEQ ID NO: 37097 - DNA, 25 bp, Mus musculus
cttcggatctcctagagaatgccct

SEQ ID NO: 37098 - DNA, 25 bp, Mus musculus
atctcctagagaatgccctgtgtgg

SEQ ID NO: 37099 - DNA, 25 bp, Mus musculus
tagagaatgccctgtgtggtgtggc

SEQ ID NO: 37100 - DNA, 25 bp, Mus musculus
cctttgccctcggtgtgctaggcac

SEQ ID NO: 37101 - DNA, 25 bp, Mus musculus
taggcaccatcataggcattgtctt

SEQ ID NO: 37102 - DNA, 25 bp, Mus musculus
tctgctcccagagaccgtgctcagg

SEQ ID NO: 37103 - DNA, 25 bp, Mus musculus
ttgacgacttctggagtacagctct

SEQ ID NO: 37104 - DNA, 25 bp, Mus musculus
acgacttctggagtacagctctaca

SEQ ID NO: 37105 - DNA, 25 bp, Mus musculus
gtcaagaccacgcgctttgcctcct

SEQ ID NO: 37106 - DNA, 25 bp, Mus musculus
tcaagaccacgcgctttgcctcctt

SEQ ID NO: 37107 - DNA, 25 bp, Mus musculus
ttccccgactacctggtcatccaga

SEQ ID NO: 37108 - DNA, 25 bp, Mus musculus
cccgactacctggtcatccagatca

SEQ ID NO: 37109 - DNA, 25 bp, Mus musculus
ccgactacctggtcatccagatcaa

SEQ ID NO: 37110 - DNA, 25 bp, Mus musculus
cgactacctggtcatccagatcaag

SEQ ID NO: 37111 - DNA, 25 bp, Mus musculus
actacctggtcatccagatcaagaa

SEQ ID NO: 37112 - DNA, 25 bp, Mus musculus
ctacctggtcatccagatcaagaag

SEQ ID NO: 37113 - DNA, 25 bp, Mus musculus
tacctggtcatccagatcaagaagt

SEQ ID NO: 37114 - DNA, 25 bp, Mus musculus
gtcatccagatcaagaagttcacct

SEQ ID NO: 37115 - DNA, 25 bp, Mus musculus
gacttctggagtacagctctacagg

SEQ ID NO: 37116 - DNA, 25 bp, Mus musculus
gagtacagctctacaggcgaagtcg

SEQ ID NO: 37117 - DNA, 25 bp, Mus musculus
acaggcgaagtcggtcgctgtcaag

SEQ ID NO: 37118 - DNA, 25 bp, Mus musculus
aagtcggtcgctgtcaagaccacgc

SEQ ID NO: 37119 - DNA, 25 bp, Mus musculus
tcggtcgctgtcaagaccacgcgct

SEQ ID NO: 37120 - DNA, 25 bp, Mus musculus
cggtcgctgtcaagaccacgcgctt

SEQ ID NO: 37121 - DNA, 25 bp, Mus musculus
cgctgtcaagaccacgcgctttgcc

SEQ ID NO: 37122 - DNA, 25 bp, Mus musculus
gctgtcaagaccacgcgctttgcct

SEQ ID NO: 37123 - DNA, 25 bp, Mus musculus
attcagactcctgaggagttccttc

SEQ ID NO: 37124 - DNA, 25 bp, Mus musculus
ttcagactcctgaggagttccttca

SEQ ID NO: 37125 - DNA, 25 bp, Mus musculus
tgttttctgaggtgagctgaaatga

SEQ ID NO: 37126 - DNA, 25 bp, Mus musculus
ccttgtcacgagggcaccgtgtctt

SEQ ID NO: 37127 - DNA, 25 bp, Mus musculus
cttgtcacgagggcaccgtgtctta

SEQ ID NO: 37128 - DNA, 25 bp, Mus musculus
tgtcacgagggcaccgtgtcttagg

SEQ ID NO: 37129 - DNA, 25 bp, Mus musculus
gtcacgagggcaccgtgtcttaggt

SEQ ID NO: 37130 - DNA, 25 bp, Mus musculus
cacgagggcaccgtgtcttaggtga

SEQ ID NO: 37131 - DNA, 25 bp, Mus musculus
acgagggcaccgtgtcttaggtgat

SEQ ID NO: 37132 - DNA, 25 bp, Mus musculus
agggcaccgtgtcttaggtgatcac

SEQ ID NO: 37133 - DNA, 25 bp, Mus musculus
ggcaccgtgtcttaggtgatcacta

SEQ ID NO: 37134 - DNA, 25 bp, Mus musculus
gcaccgtgtcttaggtgatcactaa

SEQ ID NO: 37135 - DNA, 25 bp, Mus musculus
agactcctgaggagttccttcatgc

SEQ ID NO: 37136 - DNA, 25 bp, Mus musculus
actcctgaggagttccttcatgccc

SEQ ID NO: 37137 - DNA, 25 bp, Mus musculus
ctcctgaggagttccttcatgcccc

SEQ ID NO: 37138 - DNA, 25 bp, Mus musculus
tataatgaagtctgtcccaggtgtt

SEQ ID NO: 37139 - DNA, 25 bp, Mus musculus
taatgaagtctgtcccaggtgtttt

SEQ ID NO: 37140 - DNA, 25 bp, Mus musculus
gaagtctgtcccaggtgttttctga

SEQ ID NO: 37141 - DNA, 25 bp, Mus musculus
tcccaggtgttttctgaggtgagct

SEQ ID NO: 37142 - DNA, 25 bp, Mus musculus
gtgttttctgaggtgagctgaaatg

SEQ ID NO: 37143 - DNA, 25 bp, Mus musculus
aatggctccagagtcaccaggactc

SEQ ID NO: 37144 - DNA, 25 bp, Mus musculus
agtaccagcagcagcacagcgtcat

SEQ ID NO: 37145 - DNA, 25 bp, Mus musculus
tgcagcagttacaggccttgggcat

SEQ ID NO: 37146 - DNA, 25 bp, Mus musculus
agcagttacaggccttgggcatcct

SEQ ID NO: 37147 - DNA, 25 bp, Mus musculus
aggccttgggcatcctccaaaagag

SEQ ID NO: 37148 - DNA, 25 bp, Mus musculus
ccttgggcatcctccaaaagagctg

SEQ ID NO: 37149 - DNA, 25 bp, Mus musculus
tgggcatcctccaaaagagctggct

SEQ ID NO: 37150 - DNA, 25 bp, Mus musculus
gcctcctggcctcaactttgacctg

SEQ ID NO: 37151 - DNA, 25 bp, Mus musculus
tcctggcctcaactttgacctggat

SEQ ID NO: 37152 - DNA, 25 bp, Mus musculus
cctcaactttgacctggatgctctc

SEQ ID NO: 37153 - DNA, 25 bp, Mus musculus
caactttgacctggatgctctcaat

SEQ ID NO: 37154 - DNA, 25 bp, Mus musculus
ctttgacctggatgctctcaatctg

SEQ ID NO: 37155 - DNA, 25 bp, Mus musculus
agcagcacagcgtcatggtcaaaat

SEQ ID NO: 37156 - DNA, 25 bp, Mus musculus
cctggatgctctcaatctgtcgggc

SEQ ID NO: 37157 - DNA, 25 bp, Mus musculus
agcacagcgtcatggtcaaaatctg

SEQ ID NO: 37158 - DNA, 25 bp, Mus musculus
ctcagagggctcgctttgaggccat

SEQ ID NO: 37159 - DNA, 25 bp, Mus musculus
gggctcgctttgaggccatgctaga

SEQ ID NO: 37160 - DNA, 25 bp, Mus musculus
gctttgaggccatgctagatctcat

SEQ ID NO: 37161 - DNA, 25 bp, Mus musculus
aggccatgctagatctcatgcagca

SEQ ID NO: 37162 - DNA, 25 bp, Mus musculus
tagatctcatgcagcagttacaggc

SEQ ID NO: 37163 - DNA, 25 bp, Mus musculus
atctcatgcagcagttacaggcctt

SEQ ID NO: 37164 - DNA, 25 bp, Mus musculus
gaagacggctcagcccaatggagac

SEQ ID NO: 37165 - DNA, 25 bp, Mus musculus
ggctcagcccaatggagactggaca

SEQ ID NO: 37166 - DNA, 25 bp, Mus musculus
atggcgcaagtctcattcttccagc

SEQ ID NO: 37167 - DNA, 25 bp, Mus musculus
atccacctacccagaaggacggcat

SEQ ID NO: 37168 - DNA, 25 bp, Mus musculus
ggagattcagactcctgaggattac

SEQ ID NO: 37169 - DNA, 25 bp, Mus musculus
tcagactcctgaggattacttcatg

SEQ ID NO: 37170 - DNA, 25 bp, Mus musculus
ggattacttcatgcccccaacatct

SEQ ID NO: 37171 - DNA, 25 bp, Mus musculus
ttcaggacaccccattttcttgtgt

SEQ ID NO: 37172 - DNA, 25 bp, Mus musculus
acaccccattttcttgtgtcatact

SEQ ID NO: 37173 - DNA, 25 bp, Mus musculus
cttgtgtcatactgcttctattcag

SEQ ID NO: 37174 - DNA, 25 bp, Mus musculus
tcatactgcttctattcagttcccc

SEQ ID NO: 37175 - DNA, 25 bp, Mus musculus
tgcttctattcagttccccttccca

SEQ ID NO: 37176 - DNA, 25 bp, Mus musculus
ataccagacagtctcctacctagcc

SEQ ID NO: 37177 - DNA, 25 bp, Mus musculus
ctgcgtggttcagcacagcgggacc

SEQ ID NO: 37178 - DNA, 25 bp, Mus musculus
ggttcagcacagcgggacctctgag

SEQ ID NO: 37179 - DNA, 25 bp, Mus musculus
gcccatccgcggggactggacacct

SEQ ID NO: 37180 - DNA, 25 bp, Mus musculus
gtcccccatccagacagtgaaggtc

SEQ ID NO: 37181 - DNA, 25 bp, Mus musculus
cttcatcatcttctgtgttggcttc

SEQ ID NO: 37182 - DNA, 25 bp, Mus musculus
catcttctgtgttggcttcttcaga

SEQ ID NO: 37183 - DNA, 25 bp, Mus musculus
tggcttcttcagatggcgcaagtct

SEQ ID NO: 37184 - DNA, 25 bp, Mus musculus
gattcagactcctgaggattacttc

SEQ ID NO: 37185 - DNA, 25 bp, Mus musculus
attcagactcctgaggattacttca

SEQ ID NO: 37186 - DNA, 25 bp, Mus musculus
ttcagactcctgaggattacttcat

SEQ ID NO: 37187 - DNA, 25 bp, Mus musculus
tcagactcctgaggattacttcatg

SEQ ID NO: 37188 - DNA, 25 bp, Mus musculus
cagactcctgaggattacttcatgc

SEQ ID NO: 37189 - DNA, 25 bp, Mus musculus
agactcctgaggattacttcatgcc

SEQ ID NO: 37190 - DNA, 25 bp, Mus musculus
gactcctgaggattacttcatgccc

SEQ ID NO: 37191 - DNA, 25 bp, Mus musculus
ctcctgaggattacttcatgccccc

SEQ ID NO: 37192 - DNA, 25 bp, Mus musculus
gattcagactcctgaggattacttc

SEQ ID NO: 37193 - DNA, 25 bp, Mus musculus
attcagactcctgaggattacttca

SEQ ID NO: 37194 - DNA, 25 bp, Mus musculus
tgcttctattcagttccccttccca

SEQ ID NO: 37195 - DNA, 25 bp, Mus musculus
ttctattcagttccccttcccaatg

SEQ ID NO: 37196 - DNA, 25 bp, Mus musculus
tctattcagttccccttcccaatgt

SEQ ID NO: 37197 - DNA, 25 bp, Mus musculus
ttcagactcctgaggattacttcat

SEQ ID NO: 37198 - DNA, 25 bp, Mus musculus
tcagactcctgaggattacttcatg

SEQ ID NO: 37199 - DNA, 25 bp, Mus musculus
cagactcctgaggattacttcatgc

SEQ ID NO: 37200 - DNA, 25 bp, Mus musculus
agactcctgaggattacttcatgcc

SEQ ID NO: 37201 - DNA, 25 bp, Mus musculus
gactcctgaggattacttcatgccc

SEQ ID NO: 37202 - DNA, 25 bp, Mus musculus
ctcctgaggattacttcatgccccc

SEQ ID NO: 37203 - DNA, 25 bp, Mus musculus
gaggattacttcatgcccccaacat

SEQ ID NO: 37204 - DNA, 25 bp, Mus musculus
aggattacttcatgcccccaacatc

SEQ ID NO: 37205 - DNA, 25 bp, Mus musculus
ttccatcacactgcaaaagatgctg

SEQ ID NO: 37206 - DNA, 25 bp, Mus musculus
gatgctggacccttcgtgagaactg

SEQ ID NO: 37207 - DNA, 25 bp, Mus musculus
gcaagactggacacctcatgtcatg

SEQ ID NO: 37208 - DNA, 25 bp, Mus musculus
ctggacacctcatgtcatgtttcac

SEQ ID NO: 37209 - DNA, 25 bp, Mus musculus
acctcatgtcatgtttcacgtgtgc

SEQ ID NO: 37210 - DNA, 25 bp, Mus musculus
tgtcatgtttcacgtgtgcaaagaa

SEQ ID NO: 37211 - DNA, 25 bp, Mus musculus
gtttcacgtgtgcaaagaagctaaa

SEQ ID NO: 37212 - DNA, 25 bp, Mus musculus
tgtgcagacagccaatccaaatgat

SEQ ID NO: 37213 - DNA, 25 bp, Mus musculus
taagttacttcaactagctgacctg

SEQ ID NO: 37214 - DNA, 25 bp, Mus musculus
acttcaactagctgacctgctcaca

SEQ ID NO: 37215 - DNA, 25 bp, Mus musculus
actagctgacctgctcacaaaaata

SEQ ID NO: 37216 - DNA, 25 bp, Mus musculus
tgacctgctcacaaaaatagaattt

SEQ ID NO: 37217 - DNA, 25 bp, Mus musculus
aagagccatgtgctgaggaggacag

SEQ ID NO: 37218 - DNA, 25 bp, Mus musculus
agagtgacgactattcccaaccatc

SEQ ID NO: 37219 - DNA, 25 bp, Mus musculus
attcccaaccatcgacttccagcag

SEQ ID NO: 37220 - DNA, 25 bp, Mus musculus
cgacttccagcagcattgtttatag

SEQ ID NO: 37221 - DNA, 25 bp, Mus musculus
gcttctccctgaatgccatcgaacc

SEQ ID NO: 37222 - DNA, 25 bp, Mus musculus
atgccatcgaaccatgtgtgatctg

SEQ ID NO: 37223 - DNA, 25 bp, Mus musculus
tcgaaccatgtgtgatctgccaggg

SEQ ID NO: 37224 - DNA, 25 bp, Mus musculus
gcattgttcacggcaagactggaca

SEQ ID NO: 37225 - DNA, 25 bp, Mus musculus
cggccggtcctgagtcagcttgggt

SEQ ID NO: 37226 - DNA, 25 bp, Mus musculus
tcgacgtgtgggtctcgttggaaga

SEQ ID NO: 37227 - DNA, 25 bp, Mus musculus
ctctaaccagttacgtgctgagctg

SEQ ID NO: 37228 - DNA, 25 bp, Mus musculus
tctaaccagttacgtgctgagctgg

SEQ ID NO: 37229 - DNA, 25 bp, Mus musculus
ctaaccagttacgtgctgagctgga

SEQ ID NO: 37230 - DNA, 25 bp, Mus musculus
taaccagttacgtgctgagctggag

SEQ ID NO: 37231 - DNA, 25 bp, Mus musculus
aaccagttacgtgctgagctggaga

SEQ ID NO: 37232 - DNA, 25 bp, Mus musculus
accagttacgtgctgagctggagaa

SEQ ID NO: 37233 - DNA, 25 bp, Mus musculus
ccagttacgtgctgagctggagaag

SEQ ID NO: 37234 - DNA, 25 bp, Mus musculus
cagttacgtgctgagctggagaagc

SEQ ID NO: 37235 - DNA, 25 bp, Mus musculus
agttacgtgctgagctggagaagca

SEQ ID NO: 37236 - DNA, 25 bp, Mus musculus
gttacgtgctgagctggagaagcac

SEQ ID NO: 37237 - DNA, 25 bp, Mus musculus
agatgacttctctaaccagttacgt

SEQ ID NO: 37238 - DNA, 25 bp, Mus musculus
atgacttctctaaccagttacgtgc

SEQ ID NO: 37239 - DNA, 25 bp, Mus musculus
tgacttctctaaccagttacgtgct

SEQ ID NO: 37240 - DNA, 25 bp, Mus musculus
gacttctctaaccagttacgtgctg

SEQ ID NO: 37241 - DNA, 25 bp, Mus musculus
acttctctaaccagttacgtgctga

SEQ ID NO: 37242 - DNA, 25 bp, Mus musculus
cttctctaaccagttacgtgctgag

SEQ ID NO: 37243 - DNA, 25 bp, Mus musculus
ttctctaaccagttacgtgctgagc

SEQ ID NO: 37244 - DNA, 25 bp, Mus musculus
tctctaaccagttacgtgctgagct

SEQ ID NO: 37245 - DNA, 25 bp, Mus musculus
gattcacgcaagaaattctaattga

SEQ ID NO: 37246 - DNA, 25 bp, Mus musculus
ttatgtactgggatttgctgtgtga

SEQ ID NO: 37247 - DNA, 25 bp, Mus musculus
atcttagacatatctagtcaatttc

SEQ ID NO: 37248 - DNA, 25 bp, Mus musculus
catatctagtcaatttctacccaat

SEQ ID NO: 37249 - DNA, 25 bp, Mus musculus
tatctagtcaatttctacccaataa

SEQ ID NO: 37250 - DNA, 25 bp, Mus musculus
tgttcttttgacttacatcatataa

SEQ ID NO: 37251 - DNA, 25 bp, Mus musculus
tcgaaataccctcttgcaatgtata

SEQ ID NO: 37252 - DNA, 25 bp, Mus musculus
gaaataccctcttgcaatgtatagt

SEQ ID NO: 37253 - DNA, 25 bp, Mus musculus
aataccctcttgcaatgtatagttt

SEQ ID NO: 37254 - DNA, 25 bp, Mus musculus
ccctcttgcaatgtatagtttttag

SEQ ID NO: 37255 - DNA, 25 bp, Mus musculus
atatcttgcaaagtgtccccattta

SEQ ID NO: 37256 - DNA, 25 bp, Mus musculus
atcttgcaaagtgtccccatttata

SEQ ID NO: 37257 - DNA, 25 bp, Mus musculus
atgtactgggatttgctgtgtgaac

SEQ ID NO: 37258 - DNA, 25 bp, Mus musculus
tgtgtgaacttgccttcataaccta

SEQ ID NO: 37259 - DNA, 25 bp, Mus musculus
tgtgaacttgccttcataacctagg

SEQ ID NO: 37260 - DNA, 25 bp, Mus musculus
tgaacttgccttcataacctaggta

SEQ ID NO: 37261 - DNA, 25 bp, Mus musculus
ggactttgtctaatctgctaatctt

SEQ ID NO: 37262 - DNA, 25 bp, Mus musculus
actttgtctaatctgctaatcttag

SEQ ID NO: 37263 - DNA, 25 bp, Mus musculus
tctaatctgctaatcttagacatat

SEQ ID NO: 37264 - DNA, 25 bp, Mus musculus
atctgctaatcttagacatatctag

SEQ ID NO: 37265 - DNA, 25 bp, Mus musculus
cccacgtgcagacaacagtttctgc

SEQ ID NO: 37266 - DNA, 25 bp, Mus musculus
caacagtttctgctgtctttgaact

SEQ ID NO: 37267 - DNA, 25 bp, Mus musculus
gagaatggccctgtcaagcacctcc

SEQ ID NO: 37268 - DNA, 25 bp, Mus musculus
acagatttgctagtcctacgcttat

SEQ ID NO: 37269 - DNA, 25 bp, Mus musculus
gtcctacgcttatatttgcttgcga

SEQ ID NO: 37270 - DNA, 25 bp, Mus musculus
cgcttatatttgcttgcgattagga

SEQ ID NO: 37271 - DNA, 25 bp, Mus musculus
aactgcatgtgcaatacggaaacca

SEQ ID NO: 37272 - DNA, 25 bp, Mus musculus
gaaaccagaacggactgcaccttgt

SEQ ID NO: 37273 - DNA, 25 bp, Mus musculus
agaacggactgcaccttgtggaaga

SEQ ID NO: 37274 - DNA, 25 bp, Mus musculus
tacatttagcgtttctagctagcca

SEQ ID NO: 37275 - DNA, 25 bp, Mus musculus
tagcgtttctagctagccaagagac

SEQ ID NO: 37276 - DNA, 25 bp, Mus musculus
ctagccaagagacttcatagcaaca

SEQ ID NO: 37277 - DNA, 25 bp, Mus musculus
tttctgctgtctttgaactcatgca

SEQ ID NO: 37278 - DNA, 25 bp, Mus musculus
ttgaactcatgcatctcatttttaa

SEQ ID NO: 37279 - DNA, 25 bp, Mus musculus
atacaaaagccaacaaggagaggct

SEQ ID NO: 37280 - DNA, 25 bp, Mus musculus
gtgtgcttccgaagcacactaacaa

SEQ ID NO: 37281 - DNA, 25 bp, Mus musculus
agcacactaacaagctcgctcataa

SEQ ID NO: 37282 - DNA, 25 bp, Mus musculus
ctaacaagctcgctcataaccgagc

SEQ ID NO: 37283 - DNA, 25 bp, Mus musculus
agctcgctcataaccgagcccttag

SEQ ID NO: 37284 - DNA, 25 bp, Mus musculus
gacacaagttgcaccttcaaaatat

SEQ ID NO: 37285 - DNA, 25 bp, Mus musculus
gacagtgccaacgtccaccaactcg

SEQ ID NO: 37286 - DNA, 25 bp, Mus musculus
agtgccaacgtccaccaactcgacg

SEQ ID NO: 37287 - DNA, 25 bp, Mus musculus
cggctcgtactcgctcaacagcaga

SEQ ID NO: 37288 - DNA, 25 bp, Mus musculus
gctcgtactcgctcaacagcagacg

SEQ ID NO: 37289 - DNA, 25 bp, Mus musculus
ctcgtactcgctcaacagcagacgg

SEQ ID NO: 37290 - DNA, 25 bp, Mus musculus
tcgtactcgctcaacagcagacggc

SEQ ID NO: 37291 - DNA, 25 bp, Mus musculus
gtactcgctcaacagcagacggcac

SEQ ID NO: 37292 - DNA, 25 bp, Mus musculus
tactcgctcaacagcagacggcacc

SEQ ID NO: 37293 - DNA, 25 bp, Mus musculus
actcgctcaacagcagacggcacca

SEQ ID NO: 37294 - DNA, 25 bp, Mus musculus
tcaacagcagacggcaccaccacta

SEQ ID NO: 37295 - DNA, 25 bp, Mus musculus
caacagcagacggcaccaccactaa

SEQ ID NO: 37296 - DNA, 25 bp, Mus musculus
ggcaccaccactaagtactctctca

SEQ ID NO: 37297 - DNA, 25 bp, Mus musculus
caccaactcgacgtgcctacgctga

SEQ ID NO: 37298 - DNA, 25 bp, Mus musculus
ctgactggagcctccggactcctgg

SEQ ID NO: 37299 - DNA, 25 bp, Mus musculus
actggagcctccggactcctggcat

SEQ ID NO: 37300 - DNA, 25 bp, Mus musculus
tacacgtcctacggcctcggctcgt

SEQ ID NO: 37301 - DNA, 25 bp, Mus musculus
ggcctcggctcgtactcgctcaaca

SEQ ID NO: 37302 - DNA, 25 bp, Mus musculus
gcctcggctcgtactcgctcaacag

SEQ ID NO: 37303 - DNA, 25 bp, Mus musculus
ctcggctcgtactcgctcaacagca

SEQ ID NO: 37304 - DNA, 25 bp, Mus musculus
tcggctcgtactcgctcaacagcag

SEQ ID NO: 37305 - DNA, 25 bp, Mus musculus
cgccgaccgaagtgattccagttgt

SEQ ID NO: 37306 - DNA, 25 bp, Mus musculus
tcacgcagcattcgaagggactgtg

SEQ ID NO: 37307 - DNA, 25 bp, Mus musculus
ttctgaccgtcacaaattgtagtgc

SEQ ID NO: 37308 - DNA, 25 bp, Mus musculus
taacactgattgtctaagagatgaa

SEQ ID NO: 37309 - DNA, 25 bp, Mus musculus
aagtcctccaaagatgacacaggaa

SEQ ID NO: 37310 - DNA, 25 bp, Mus musculus
gaaatgtctgtgttccttgggaatc

SEQ ID NO: 37311 - DNA, 25 bp, Mus musculus
ttccttgggaatcgtgcgctctctg

SEQ ID NO: 37312 - DNA, 25 bp, Mus musculus
gggaatcgtgcgctctctgtagttt

SEQ ID NO: 37313 - DNA, 25 bp, Mus musculus
tccatcattggtgcagttcgaacga

SEQ ID NO: 37314 - DNA, 25 bp, Mus musculus
atgacctcattttcttgagcttgaa

SEQ ID NO: 37315 - DNA, 25 bp, Mus musculus
ctgttctctgcatttagaagtatac

SEQ ID NO: 37316 - DNA, 25 bp, Mus musculus
agtatacacagtacaactgttaatt

SEQ ID NO: 37317 - DNA, 25 bp, Mus musculus
gactgtgcacgctctaaagatcaca

SEQ ID NO: 37318 - DNA, 25 bp, Mus musculus
gatcacagttgcttctaagccagat

SEQ ID NO: 37319 - DNA, 25 bp, Mus musculus
agttgcttctaagccagatttcatt

SEQ ID NO: 37320 - DNA, 25 bp, Mus musculus
ttctaagccagatttcatttctatt

SEQ ID NO: 37321 - DNA, 25 bp, Mus musculus
tttatgtgccaaaccccaaagtgca

SEQ ID NO: 37322 - DNA, 25 bp, Mus musculus
accccaaagtgcattgggcctgaat

SEQ ID NO: 37323 - DNA, 25 bp, Mus musculus
aagtgcattgggcctgaatctctga

SEQ ID NO: 37324 - DNA, 25 bp, Mus musculus
cctgaatctctgaacactgtagacc

SEQ ID NO: 37325 - DNA, 25 bp, Mus musculus
tcgactagctggcggcgcgcacacg

SEQ ID NO: 37326 - DNA, 25 bp, Mus musculus
aggccctgcacagcagcatgcacat

SEQ ID NO: 37327 - DNA, 25 bp, Mus musculus
agcagtcctatgacgtgaccgacga

SEQ ID NO: 37328 - DNA, 25 bp, Mus musculus
cagtcctatgacgtgaccgacgagc

SEQ ID NO: 37329 - DNA, 25 bp, Mus musculus
gtcctatgacgtgaccgacgagctg

SEQ ID NO: 37330 - DNA, 25 bp, Mus musculus
cctatgacgtgaccgacgagctgcc

SEQ ID NO: 37331 - DNA, 25 bp, Mus musculus
tatgacgtgaccgacgagctgccgt

SEQ ID NO: 37332 - DNA, 25 bp, Mus musculus
agatgaccttcacggccactggcag

SEQ ID NO: 37333 - DNA, 25 bp, Mus musculus
ggcaagaccccaggaaggtgatgaa

SEQ ID NO: 37334 - DNA, 25 bp, Mus musculus
caagaccccaggaaggtgatgaatc

SEQ ID NO: 37335 - DNA, 25 bp, Mus musculus
agaccccaggaaggtgatgaatcag

SEQ ID NO: 37336 - DNA, 25 bp, Mus musculus
tgatgaatcagcctctgaatcatgt

SEQ ID NO: 37337 - DNA, 25 bp, Mus musculus
gccctgcacagcagcatgcacatct

SEQ ID NO: 37338 - DNA, 25 bp, Mus musculus
atgaatcagcctctgaatcatgtga

SEQ ID NO: 37339 - DNA, 25 bp, Mus musculus
tgcacagcagcatgcacatctccgc

SEQ ID NO: 37340 - DNA, 25 bp, Mus musculus
agcatgcacatctccgccagcagtc

SEQ ID NO: 37341 - DNA, 25 bp, Mus musculus
catctccgccagcagtcctatgacg

SEQ ID NO: 37342 - DNA, 25 bp, Mus musculus
tctccgccagcagtcctatgacgtg

SEQ ID NO: 37343 - DNA, 25 bp, Mus musculus
tccgccagcagtcctatgacgtgac

SEQ ID NO: 37344 - DNA, 25 bp, Mus musculus
cgccagcagtcctatgacgtgaccg

SEQ ID NO: 37345 - DNA, 25 bp, Mus musculus
ccagcagtcctatgacgtgaccgac

SEQ ID NO: 37346 - DNA, 25 bp, Mus musculus
gaggctcaacatcgcgactcctggc

SEQ ID NO: 37347 - DNA, 25 bp, Mus musculus
catcgcgactcctggcccgatttgt

SEQ ID NO: 37348 - DNA, 25 bp, Mus musculus
catatcacactgaagttaactctga

SEQ ID NO: 37349 - DNA, 25 bp, Mus musculus
aagttaactctgatcatgactctgg

SEQ ID NO: 37350 - DNA, 25 bp, Mus musculus
ctctcataggcacctggcaaatcga

SEQ ID NO: 37351 - DNA, 25 bp, Mus musculus
tcataggcacctggcaaatcgaagg

SEQ ID NO: 37352 - DNA, 25 bp, Mus musculus
taggcacctggcaaatcgaaggata

SEQ ID NO: 37353 - DNA, 25 bp, Mus musculus
aatatcatgtcctcctgagcactag

SEQ ID NO: 37354 - DNA, 25 bp, Mus musculus
atcatgtcctcctgagcactaggct

SEQ ID NO: 37355 - DNA, 25 bp, Mus musculus
atgtcctcctgagcactaggctggc

SEQ ID NO: 37356 - DNA, 25 bp, Mus musculus
tcctgagcactaggctggccatctc

SEQ ID NO: 37357 - DNA, 25 bp, Mus musculus
gcactaggctggccatctcgaagca

SEQ ID NO: 37358 - DNA, 25 bp, Mus musculus
tggcccgatttgtgttcgtagccat

SEQ ID NO: 37359 - DNA, 25 bp, Mus musculus
ggctggccatctcgaagcaactatg

SEQ ID NO: 37360 - DNA, 25 bp, Mus musculus
gatttgtgttcgtagccatgacctt

SEQ ID NO: 37361 - DNA, 25 bp, Mus musculus
cccatgggctccctgatcatgtccg

SEQ ID NO: 37362 - DNA, 25 bp, Mus musculus
atgggctccctgatcatgtccggaa

SEQ ID NO: 37363 - DNA, 25 bp, Mus musculus
atcatgtccggaatatcttagagct

SEQ ID NO: 37364 - DNA, 25 bp, Mus musculus
ctattgaacacgttggaagacaagg

SEQ ID NO: 37365 - DNA, 25 bp, Mus musculus
acagaacatatcacactgaagttaa

SEQ ID NO: 37366 - DNA, 25 bp, Mus musculus
gaacatatcacactgaagttaactc

SEQ ID NO: 37367 - DNA, 25 bp, Mus musculus
tgcatccctttggtgctgatcttgg

SEQ ID NO: 37368 - DNA, 25 bp, Mus musculus
cctttggtgctgatcttgggctgtt

SEQ ID NO: 37369 - DNA, 25 bp, Mus musculus
cccattctttatttcttggctggag

SEQ ID NO: 37370 - DNA, 25 bp, Mus musculus
cgagccaccaggaaagcttccagga

SEQ ID NO: 37371 - DNA, 25 bp, Mus musculus
aaagcttccaggaggagtgaggcca

SEQ ID NO: 37372 - DNA, 25 bp, Mus musculus
gaggccaatttacaatccaagagtg

SEQ ID NO: 37373 - DNA, 25 bp, Mus musculus
atgactctcaatattttgtctgagt

SEQ ID NO: 37374 - DNA, 25 bp, Mus musculus
gagatcctagctcctgagttttgta

SEQ ID NO: 37375 - DNA, 25 bp, Mus musculus
ctagctcctgagttttgtaacatgg

SEQ ID NO: 37376 - DNA, 25 bp, Mus musculus
agacatccctgagatgatctatgca

SEQ ID NO: 37377 - DNA, 25 bp, Mus musculus
ttgaccaaaagaccagtgtgtgcca

SEQ ID NO: 37378 - DNA, 25 bp, Mus musculus
ccagtgtgtgccacctgagtgaggg

SEQ ID NO: 37379 - DNA, 25 bp, Mus musculus
gtgctgatcttgggctgttatggat

SEQ ID NO: 37380 - DNA, 25 bp, Mus musculus
gtgccacctgagtgagggttttcct

SEQ ID NO: 37381 - DNA, 25 bp, Mus musculus
atttacaatgacctggacaactctc

SEQ ID NO: 37382 - DNA, 25 bp, Mus musculus
ctggacaactctccgctccggagga

SEQ ID NO: 37383 - DNA, 25 bp, Mus musculus
aaatccatttacctggtgataattg

SEQ ID NO: 37384 - DNA, 25 bp, Mus musculus
atttacctggtgataattgtcctga

SEQ ID NO: 37385 - DNA, 25 bp, Mus musculus
gtgtcttatatccctttccatgtga

SEQ ID NO: 37386 - DNA, 25 bp, Mus musculus
ggtctagcaagtctcaacagctgtg

SEQ ID NO: 37387 - DNA, 25 bp, Mus musculus
ctcaacagctgtgtggaccccattc

SEQ ID NO: 37388 - DNA, 25 bp, Mus musculus
agggcaccaagcagctactgctgga

SEQ ID NO: 37389 - DNA, 25 bp, Mus musculus
agcagctactgctggaggatggctt

SEQ ID NO: 37390 - DNA, 25 bp, Mus musculus
cacgtcctcccaagatagccgagtt

SEQ ID NO: 37391 - DNA, 25 bp, Mus musculus
agatagccgagttcaccgtcagcat

SEQ ID NO: 37392 - DNA, 25 bp, Mus musculus
tagccgagttcaccgtcagcatcac

SEQ ID NO: 37393 - DNA, 25 bp, Mus musculus
tcaccgtcagcatcaccgagggtgt

SEQ ID NO: 37394 - DNA, 25 bp, Mus musculus
ccgtcagcatcaccgagggtgtcac

SEQ ID NO: 37395 - DNA, 25 bp, Mus musculus
tcagcatcaccgagggtgtcaccga

SEQ ID NO: 37396 - DNA, 25 bp, Mus musculus
tcaccgagggtgtcaccgagaggtt

SEQ ID NO: 37397 - DNA, 25 bp, Mus musculus
aggtctccgtgctggtcctctgtgc

SEQ ID NO: 37398 - DNA, 25 bp, Mus musculus
tgctggtcctctgtgctctgtcctt

SEQ ID NO: 37399 - DNA, 25 bp, Mus musculus
tcacctgtgtcgtcgtcctggttgt

SEQ ID NO: 37400 - DNA, 25 bp, Mus musculus
agctactgctggaggatggcttcga

SEQ ID NO: 37401 - DNA, 25 bp, Mus musculus
tcgtcgtcctggttgtctacagagt

SEQ ID NO: 37402 - DNA, 25 bp, Mus musculus
gcttcgacaccattcctttgatgac

SEQ ID NO: 37403 - DNA, 25 bp, Mus musculus
tcgacaccattcctttgatgacgcc

SEQ ID NO: 37404 - DNA, 25 bp, Mus musculus
acaccattcctttgatgacgcccct

SEQ ID NO: 37405 - DNA, 25 bp, Mus musculus
ccctcgatgtcaaccagctgcagtt

SEQ ID NO: 37406 - DNA, 25 bp, Mus musculus
aatatgagcctgatcgcaataaagg

SEQ ID NO: 37407 - DNA, 25 bp, Mus musculus
aaggtcaagcacgtcctcccaagat

SEQ ID NO: 37408 - DNA, 25 bp, Mus musculus
gtcaagcacgtcctcccaagatagc

SEQ ID NO: 37409 - DNA, 25 bp, Mus musculus
aattctatatcactgtgttgggtaa

SEQ ID NO: 37410 - DNA, 25 bp, Mus musculus
atatcactgtgttgggtaactgttt

SEQ ID NO: 37411 - DNA, 25 bp, Mus musculus
caaaccacccaggagcagcagtggc

SEQ ID NO: 37412 - DNA, 25 bp, Mus musculus
accacccaggagcagcagtggccct

SEQ ID NO: 37413 - DNA, 25 bp, Mus musculus
ctccaggtctcacagttgccatggt

SEQ ID NO: 37414 - DNA, 25 bp, Mus musculus
caggtctcacagttgccatggtaac

SEQ ID NO: 37415 - DNA, 25 bp, Mus musculus
cctccagttcagcaacatatgggga

SEQ ID NO: 37416 - DNA, 25 bp, Mus musculus
agggcctttgggcagagcagaagct

SEQ ID NO: 37417 - DNA, 25 bp, Mus musculus
gtagccacctcatcagctactgtca

SEQ ID NO: 37418 - DNA, 25 bp, Mus musculus
acctcatcagctactgtcatctgtc

SEQ ID NO: 37419 - DNA, 25 bp, Mus musculus
gctactgtcatctgtcctctaaggg

SEQ ID NO: 37420 - DNA, 25 bp, Mus musculus
atctgtcctctaaggggcattataa

SEQ ID NO: 37421 - DNA, 25 bp, Mus musculus
gaacgggtctactgttgtagctcag

SEQ ID NO: 37422 - DNA, 25 bp, Mus musculus
gtctactgttgtagctcagcagttg

SEQ ID NO: 37423 - DNA, 25 bp, Mus musculus
ttgcctaaactgtgcagaaagagac

SEQ ID NO: 37424 - DNA, 25 bp, Mus musculus
ccctttttggagccgagcagtgcac

SEQ ID NO: 37425 - DNA, 25 bp, Mus musculus
tttttggagccgagcagtgcacatc

SEQ ID NO: 37426 - DNA, 25 bp, Mus musculus
agcagtgcacatctcagttctagaa

SEQ ID NO: 37427 - DNA, 25 bp, Mus musculus
agtgcacatctcagttctagaagac

SEQ ID NO: 37428 - DNA, 25 bp, Mus musculus
catctcagttctagaagaccaatgc

SEQ ID NO: 37429 - DNA, 25 bp, Mus musculus
ccaggtacacaaaattcctgactca

SEQ ID NO: 37430 - DNA, 25 bp, Mus musculus
acacaaaattcctgactcagcacca

SEQ ID NO: 37431 - DNA, 25 bp, Mus musculus
gagcctctgcagggttcagacatgt

SEQ ID NO: 37432 - DNA, 25 bp, Mus musculus
tccacttcgatgagtcatttttcag

SEQ ID NO: 37433 - DNA, 25 bp, Mus musculus
agtcatttttcagtctatagtcagc

SEQ ID NO: 37434 - DNA, 25 bp, Mus musculus
cctggcacagacctagctatgtttt

SEQ ID NO: 37435 - DNA, 25 bp, Mus musculus
tagcccagaacactggttccagcgt

SEQ ID NO: 37436 - DNA, 25 bp, Mus musculus
ctggttccagcgttcattgtcaggg

SEQ ID NO: 37437 - DNA, 25 bp, Mus musculus
ccagcgttcattgtcaggggccaga

SEQ ID NO: 37438 - DNA, 25 bp, Mus musculus
acatatgtctcctgatttgcaatgc

SEQ ID NO: 37439 - DNA, 25 bp, Mus musculus
gtctcctgatttgcaatgcacagaa

SEQ ID NO: 37440 - DNA, 25 bp, Mus musculus
gatgtctcaaaagccattaagagtc

SEQ ID NO: 37441 - DNA, 25 bp, Mus musculus
tgactcagcaccatgacgccaagcc

SEQ ID NO: 37442 - DNA, 25 bp, Mus musculus
tcaacacctttatccatggcaacaa

SEQ ID NO: 37443 - DNA, 25 bp, Mus musculus
acatcaaggccatctgtggagcgaa

SEQ ID NO: 37444 - DNA, 25 bp, Mus musculus
tgagcaagtctcccttccaggtcac

SEQ ID NO: 37445 - DNA, 25 bp, Mus musculus
ccttccaggtcaccacttgcaagca

SEQ ID NO: 37446 - DNA, 25 bp, Mus musculus
aggtcaccacttgcaagcacacagg

SEQ ID NO: 37447 - DNA, 25 bp, Mus musculus
catgccagtaccgagcctctgcagg

SEQ ID NO: 37448 - DNA, 25 bp, Mus musculus
agtaccgagcctctgcagggttcag

SEQ ID NO: 37449 - DNA, 25 bp, Mus musculus
acgacacagcccaggtggatcacag

SEQ ID NO: 37450 - DNA, 25 bp, Mus musculus
cagcccaggtggatcacaggttcat

SEQ ID NO: 37451 - DNA, 25 bp, Mus musculus
tggcagccttggcttcggcttcctg

SEQ ID NO: 37452 - DNA, 25 bp, Mus musculus
gtcctcgtcctttcggagacacagc

SEQ ID NO: 37453 - DNA, 25 bp, Mus musculus
ctcgtcctttcggagacacagctgg

SEQ ID NO: 37454 - DNA, 25 bp, Mus musculus
gtcctttcggagacacagctggagc

SEQ ID NO: 37455 - DNA, 25 bp, Mus musculus
acacagctggagcagtgtggccttc

SEQ ID NO: 37456 - DNA, 25 bp, Mus musculus
cagtgtggccttcaacctcttcatg

SEQ ID NO: 37457 - DNA, 25 bp, Mus musculus
ggccttcaacctcttcatgttggcc

SEQ ID NO: 37458 - DNA, 25 bp, Mus musculus
caacctcttcatgttggccctcggg

SEQ ID NO: 37459 - DNA, 25 bp, Mus musculus
aatcttgctggaccatttcctgggc

SEQ ID NO: 37460 - DNA, 25 bp, Mus musculus
ccaggtcctccaatggaacaagatc

SEQ ID NO: 37461 - DNA, 25 bp, Mus musculus
atcacaggttcatggcgagctatca

SEQ ID NO: 37462 - DNA, 25 bp, Mus musculus
acaggttcatggcgagctatcaagt

SEQ ID NO: 37463 - DNA, 25 bp, Mus musculus
gctatcaagtcctccggaatttgac

SEQ ID NO: 37464 - DNA, 25 bp, Mus musculus
tcctccggaatttgaccctcatggc

SEQ ID NO: 37465 - DNA, 25 bp, Mus musculus
tccggaatttgaccctcatggcagc

SEQ ID NO: 37466 - DNA, 25 bp, Mus musculus
atttgaccctcatggcagccttggc

SEQ ID NO: 37467 - DNA, 25 bp, Mus musculus
tgaccctcatggcagccttggcttc

SEQ ID NO: 37468 - DNA, 25 bp, Mus musculus
ccctcatggcagccttggcttcggc

SEQ ID NO: 37469 - DNA, 25 bp, Mus musculus
gaatctgagctctttggacggacga

SEQ ID NO: 37470 - DNA, 25 bp, Mus musculus
atctgagctctttggacggacgatt

SEQ ID NO: 37471 - DNA, 25 bp, Mus musculus
ttccaggccagtctggtcagatgat

SEQ ID NO: 37472 - DNA, 25 bp, Mus musculus
ttctgggaagactcttgaggagaat

SEQ ID NO: 37473 - DNA, 25 bp, Mus musculus
gaaggacccgagcctcccaaagctg

SEQ ID NO: 37474 - DNA, 25 bp, Mus musculus
cgagcctcccaaagctgaagcccag

SEQ ID NO: 37475 - DNA, 25 bp, Mus musculus
cctcccaaagctgaagcccaggagg

SEQ ID NO: 37476 - DNA, 25 bp, Mus musculus
tcccaaagctgaagcccaggaggga

SEQ ID NO: 37477 - DNA, 25 bp, Mus musculus
cggtcaaatcctcaggtgtacatgg

SEQ ID NO: 37478 - DNA, 25 bp, Mus musculus
gtcaaatcctcaggtgtacatggac

SEQ ID NO: 37479 - DNA, 25 bp, Mus musculus
aatcctcaggtgtacatggacatca

SEQ ID NO: 37480 - DNA, 25 bp, Mus musculus
tcctcaggtgtacatggacatcaag

SEQ ID NO: 37481 - DNA, 25 bp, Mus musculus
gagctctttggacggacgattcgtg

SEQ ID NO: 37482 - DNA, 25 bp, Mus musculus
gctctttggacggacgattcgtgtc

SEQ ID NO: 37483 - DNA, 25 bp, Mus musculus
tttggacggacgattcgtgtcaatt

SEQ ID NO: 37484 - DNA, 25 bp, Mus musculus
attcgtgtcaatttggccaagccaa

SEQ ID NO: 37485 - DNA, 25 bp, Mus musculus
gtcaatttggccaagccaatgagaa

SEQ ID NO: 37486 - DNA, 25 bp, Mus musculus
caatttggccaagccaatgagaatt

SEQ ID NO: 37487 - DNA, 25 bp, Mus musculus
attaaagagggctcttccaggccag

SEQ ID NO: 37488 - DNA, 25 bp, Mus musculus
tcttccaggccagtctggtcagatg

SEQ ID NO: 37489 - DNA, 25 bp, Mus musculus
tcttcctgttgggtctggttgtgat

SEQ ID NO: 37490 - DNA, 25 bp, Mus musculus
ccactctgtctcaggatgactccag

SEQ ID NO: 37491 - DNA, 25 bp, Mus musculus
tcaaggccatctgtggaaagaaagg

SEQ ID NO: 37492 - DNA, 25 bp, Mus musculus
tcaccacttgcacacacaaaggaag

SEQ ID NO: 37493 - DNA, 25 bp, Mus musculus
ctccatgcaggtaccgagcctctaa

SEQ ID NO: 37494 - DNA, 25 bp, Mus musculus
ctgtccactttgatgagtcttttat

SEQ ID NO: 37495 - DNA, 25 bp, Mus musculus
cttttatcagtccatagacagcaga

SEQ ID NO: 37496 - DNA, 25 bp, Mus musculus
tcagtccatagacagcagacccctg

SEQ ID NO: 37497 - DNA, 25 bp, Mus musculus
cagcagacccctggcacaggcctag

SEQ ID NO: 37498 - DNA, 25 bp, Mus musculus
tcacagccaaaatcactgttttaac

SEQ ID NO: 37499 - DNA, 25 bp, Mus musculus
tcactgttttaacgttcactgtcac

SEQ ID NO: 37500 - DNA, 25 bp, Mus musculus
atctgaaatatacttctcctgattt

SEQ ID NO: 37501 - DNA, 25 bp, Mus musculus
tgtctcaggatgactccaggtacac

SEQ ID NO: 37502 - DNA, 25 bp, Mus musculus
aggatgactccaggtacacaaaatt

SEQ ID NO: 37503 - DNA, 25 bp, Mus musculus
ctcagcactatgatgccaagccaaa

SEQ ID NO: 37504 - DNA, 25 bp, Mus musculus
actatgatgccaagccaaaaggccg

SEQ ID NO: 37505 - DNA, 25 bp, Mus musculus
gaaagctaacctctttctgcaaaga

SEQ ID NO: 37506 - DNA, 25 bp, Mus musculus
atgtcaacacctttatccatgacac

SEQ ID NO: 37507 - DNA, 25 bp, Mus musculus
atgacaccaagaacaacatcaaggc

SEQ ID NO: 37508 - DNA, 25 bp, Mus musculus
ccaagaacaacatcaaggccatctg

SEQ ID NO: 37509 - DNA, 25 bp, Mus musculus
tcagcccggaagttggccaaccaga

SEQ ID NO: 37510 - DNA, 25 bp, Mus musculus
ctggtcctgagcatgcagtcaagtc

SEQ ID NO: 37511 - DNA, 25 bp, Mus musculus
catggcatgtctcaccacgatcctg

SEQ ID NO: 37512 - DNA, 25 bp, Mus musculus
atgtctcaccacgatcctgttgcta

SEQ ID NO: 37513 - DNA, 25 bp, Mus musculus
caccacgatcctgttgctacatcag

SEQ ID NO: 37514 - DNA, 25 bp, Mus musculus
gatcctgttgctacatcagagtgta

SEQ ID NO: 37515 - DNA, 25 bp, Mus musculus
attttaatggccccatcttctcact

SEQ ID NO: 37516 - DNA, 25 bp, Mus musculus
gcctcttcactgccataacttgttt

SEQ ID NO: 37517 - DNA, 25 bp, Mus musculus
tcactgccataacttgtttgtaaaa

SEQ ID NO: 37518 - DNA, 25 bp, Mus musculus
ttctccattaaacttctactgagca

SEQ ID NO: 37519 - DNA, 25 bp, Mus musculus
attaaacttctactgagcaaatggt

SEQ ID NO: 37520 - DNA, 25 bp, Mus musculus
cttctactgagcaaatggttaataa

SEQ ID NO: 37521 - DNA, 25 bp, Mus musculus
atgcagtcaagtcaacgccggcgca

SEQ ID NO: 37522 - DNA, 25 bp, Mus musculus
accctgcaccagaatggtaatgtgt

SEQ ID NO: 37523 - DNA, 25 bp, Mus musculus
ggccactgcaacccatgagcatcca

SEQ ID NO: 37524 - DNA, 25 bp, Mus musculus
tgcaacccatgagcatccaggtgat

SEQ ID NO: 37525 - DNA, 25 bp, Mus musculus
ccatgagcatccaggtgatcccccg

SEQ ID NO: 37526 - DNA, 25 bp, Mus musculus
gtacagcatgtgtccactccaagac

SEQ ID NO: 37527 - DNA, 25 bp, Mus musculus
ccaagacctgcaggccgggagtcag

SEQ ID NO: 37528 - DNA, 25 bp, Mus musculus
cctgcaggccgggagtcaggattcc

SEQ ID NO: 37529 - DNA, 25 bp, Mus musculus
ttgctgccaatgagactgttcctga

SEQ ID NO: 37530 - DNA, 25 bp, Mus musculus
agactgttcctgagctgattaattc

SEQ ID NO: 37531 - DNA, 25 bp, Mus musculus
tggcaatttcatttcccaatctgac

SEQ ID NO: 37532 - DNA, 25 bp, Mus musculus
caatttcatttcccaatctgacgtc

SEQ ID NO: 37533 - DNA, 25 bp, Mus musculus
tttcatttcccaatctgacgtcaga

SEQ ID NO: 37534 - DNA, 25 bp, Mus musculus
ccaatctgacgtcagatggctatcc

SEQ ID NO: 37535 - DNA, 25 bp, Mus musculus
atctgacgtcagatggctatcctgt

SEQ ID NO: 37536 - DNA, 25 bp, Mus musculus
cagatggctatcctgtactgtaccc

SEQ ID NO: 37537 - DNA, 25 bp, Mus musculus
atcctgtactgtacccaactggatg

SEQ ID NO: 37538 - DNA, 25 bp, Mus musculus
tactgtacccaactggatggtcatc

SEQ ID NO: 37539 - DNA, 25 bp, Mus musculus
ggtcatcttctgataatgtaaactg

SEQ ID NO: 37540 - DNA, 25 bp, Mus musculus
taaactgcagacctcgaagccttga

SEQ ID NO: 37541 - DNA, 25 bp, Mus musculus
ctgttcctgagctgattaattccac

SEQ ID NO: 37542 - DNA, 25 bp, Mus musculus
gcagacctcgaagccttgaggaccc

SEQ ID NO: 37543 - DNA, 25 bp, Mus musculus
tgattaattccaccaaggacattgg

SEQ ID NO: 37544 - DNA, 25 bp, Mus musculus
aaattaatgtcttctacacgattag

SEQ ID NO: 37545 - DNA, 25 bp, Mus musculus
ttaatgtcttctacacgattagaaa

SEQ ID NO: 37546 - DNA, 25 bp, Mus musculus
atgtcttctacacgattagaaaaag

SEQ ID NO: 37547 - DNA, 25 bp, Mus musculus
atttcccaatgccagaacttcggct

SEQ ID NO: 37548 - DNA, 25 bp, Mus musculus
caatgccagaacttcggctggcaat

SEQ ID NO: 37549 - DNA, 25 bp, Mus musculus
cagaacttcggctggcaatttcatt

SEQ ID NO: 37550 - DNA, 25 bp, Mus musculus
cctgttccatttgcttatccaaatc

SEQ ID NO: 37551 - DNA, 25 bp, Mus musculus
ccatttgcttatccaaatccaggaa

SEQ ID NO: 37552 - DNA, 25 bp, Mus musculus
ttagcacctcactagctcctttcat

SEQ ID NO: 37553 - DNA, 25 bp, Mus musculus
gcacctcactagctcctttcattgt

SEQ ID NO: 37554 - DNA, 25 bp, Mus musculus
cactagctcctttcattgtgttgat

SEQ ID NO: 37555 - DNA, 25 bp, Mus musculus
tagctcctttcattgtgttgatgtc

SEQ ID NO: 37556 - DNA, 25 bp, Mus musculus
ccttcctatatactaagagttcata

SEQ ID NO: 37557 - DNA, 25 bp, Mus musculus
tatattgtgcattgactctgttgga

SEQ ID NO: 37558 - DNA, 25 bp, Mus musculus
gtgcattgactctgttggatacaaa

SEQ ID NO: 37559 - DNA, 25 bp, Mus musculus
cgatgtgttctagcacctttgagca

SEQ ID NO: 37560 - DNA, 25 bp, Mus musculus
ctagcacctttgagcatttacttta

SEQ ID NO: 37561 - DNA, 25 bp, Mus musculus
gcacctttgagcatttactttatgg

SEQ ID NO: 37562 - DNA, 25 bp, Mus musculus
gcttatccaaatccaggaaggaaga

SEQ ID NO: 37563 - DNA, 25 bp, Mus musculus
tatccaaatccaggaaggaagaata

SEQ ID NO: 37564 - DNA, 25 bp, Mus musculus
ccattccgcccaattccagtgacat

SEQ ID NO: 37565 - DNA, 25 bp, Mus musculus
cgcccaattccagtgacatgggtac

SEQ ID NO: 37566 - DNA, 25 bp, Mus musculus
ccaattccagtgacatgggtacctc

SEQ ID NO: 37567 - DNA, 25 bp, Mus musculus
cactggattaatcctcacatgttag

SEQ ID NO: 37568 - DNA, 25 bp, Mus musculus
aatcctcacatgttagcacctcact

SEQ ID NO: 37569 - DNA, 25 bp, Mus musculus
atgttagcacctcactagctccttt

SEQ ID NO: 37570 - DNA, 25 bp, Mus musculus
cctggcctcccaacgttcattgtct

SEQ ID NO: 37571 - DNA, 25 bp, Mus musculus
ggcctcccaacgttcattgtcttgg

SEQ ID NO: 37572 - DNA, 25 bp, Mus musculus
ttctggaagccttcctgaacatcta

SEQ ID NO: 37573 - DNA, 25 bp, Mus musculus
tggaagccttcctgaacatctaaat

SEQ ID NO: 37574 - DNA, 25 bp, Mus musculus
aagccttcctgaacatctaaattgt

SEQ ID NO: 37575 - DNA, 25 bp, Mus musculus
ccttcctgaacatctaaattgtact

SEQ ID NO: 37576 - DNA, 25 bp, Mus musculus
acatctaaattgtactctgcacctc

SEQ ID NO: 37577 - DNA, 25 bp, Mus musculus
tctaaattgtactctgcacctctgc

SEQ ID NO: 37578 - DNA, 25 bp, Mus musculus
aaattgtactctgcacctctgcatc

SEQ ID NO: 37579 - DNA, 25 bp, Mus musculus
accctaccacagaggtcctgacaga

SEQ ID NO: 37580 - DNA, 25 bp, Mus musculus
ctaccacagaggtcctgacagaaag

SEQ ID NO: 37581 - DNA, 25 bp, Mus musculus
ccacagaggtcctgacagaaagtac

SEQ ID NO: 37582 - DNA, 25 bp, Mus musculus
ccaacgttcattgtcttggtatcta

SEQ ID NO: 37583 - DNA, 25 bp, Mus musculus
ttcattgtcttggtatctaacccat

SEQ ID NO: 37584 - DNA, 25 bp, Mus musculus
taaccctgcactctgaaaacctctc

SEQ ID NO: 37585 - DNA, 25 bp, Mus musculus
tgcactctgaaaacctctctgcact

SEQ ID NO: 37586 - DNA, 25 bp, Mus musculus
actctgaaaacctctctgcacttct

SEQ ID NO: 37587 - DNA, 25 bp, Mus musculus
acctctctgcacttctggaagcctt

SEQ ID NO: 37588 - DNA, 25 bp, Mus musculus
tctctgcacttctggaagccttcct

SEQ ID NO: 37589 - DNA, 25 bp, Mus musculus
ctgcacttctggaagccttcctgaa

SEQ ID NO: 37590 - DNA, 25 bp, Mus musculus
ctccacagcacagacagacactcag

SEQ ID NO: 37591 - DNA, 25 bp, Mus musculus
ccacagcacagacagacactcagga

SEQ ID NO: 37592 - DNA, 25 bp, Mus musculus
caaaggccgcaacaatgcggttcga

SEQ ID NO: 37593 - DNA, 25 bp, Mus musculus
ggccgcaacaatgcggttcgaaaca

SEQ ID NO: 37594 - DNA, 25 bp, Mus musculus
gccgcaacaatgcggttcgaaacaa

SEQ ID NO: 37595 - DNA, 25 bp, Mus musculus
ggtgctgaaccctggactctaaaat

SEQ ID NO: 37596 - DNA, 25 bp, Mus musculus
gtgctgaaccctggactctaaaata

SEQ ID NO: 37597 - DNA, 25 bp, Mus musculus
gctgaaccctggactctaaaataag

SEQ ID NO: 37598 - DNA, 25 bp, Mus musculus
tgaaccctggactctaaaataagct

SEQ ID NO: 37599 - DNA, 25 bp, Mus musculus
ctctaaaataagcttcgcagtaagg

SEQ ID NO: 37600 - DNA, 25 bp, Mus musculus
ataagcttcgcagtaaggagacaac

SEQ ID NO: 37601 - DNA, 25 bp, Mus musculus
taagcttcgcagtaaggagacaaca

SEQ ID NO: 37602 - DNA, 25 bp, Mus musculus
cacagcacagacagacactcaggag

SEQ ID NO: 37603 - DNA, 25 bp, Mus musculus
acagcacagacagacactcaggagc

SEQ ID NO: 37604 - DNA, 25 bp, Mus musculus
cagcacagacagacactcaggagcc

SEQ ID NO: 37605 - DNA, 25 bp, Mus musculus
gcacagacagacactcaggagccag

SEQ ID NO: 37606 - DNA, 25 bp, Mus musculus
cacagacagacactcaggagccagc

SEQ ID NO: 37607 - DNA, 25 bp, Mus musculus
acagacagacactcaggagccagcc

SEQ ID NO: 37608 - DNA, 25 bp, Mus musculus
cagacagacactcaggagccagcca

SEQ ID NO: 37609 - DNA, 25 bp, Mus musculus
agacactcaggagccagccagccag

SEQ ID NO: 37610 - DNA, 25 bp, Mus musculus
ataagaagtgctctgctgagaagaa

SEQ ID NO: 37611 - DNA, 25 bp, Mus musculus
agtgctctgctgagaagaagtcaga

SEQ ID NO: 37612 - DNA, 25 bp, Mus musculus
taatgttccagaccttcattgggcc

SEQ ID NO: 37613 - DNA, 25 bp, Mus musculus
gttccagaccttcattgggcctgga

SEQ ID NO: 37614 - DNA, 25 bp, Mus musculus
cagaccttcattgggcctggaggaa

SEQ ID NO: 37615 - DNA, 25 bp, Mus musculus
gaccttcattgggcctggaggaaat

SEQ ID NO: 37616 - DNA, 25 bp, Mus musculus
ccttcattgggcctggaggaaatat

SEQ ID NO: 37617 - DNA, 25 bp, Mus musculus
ttcattgggcctggaggaaatatgc

SEQ ID NO: 37618 - DNA, 25 bp, Mus musculus
aatatgcctggatatctgagaccag

SEQ ID NO: 37619 - DNA, 25 bp, Mus musculus
agaccagaaactgcacagggaattt

SEQ ID NO: 37620 - DNA, 25 bp, Mus musculus
gaaattgccttttgctgctgcccag

SEQ ID NO: 37621 - DNA, 25 bp, Mus musculus
aattgccttttgctgctgcccagat

SEQ ID NO: 37622 - DNA, 25 bp, Mus musculus
aaagtgtcttggcccagcttgataa

SEQ ID NO: 37623 - DNA, 25 bp, Mus musculus
ttgccttttgctgctgcccagattg

SEQ ID NO: 37624 - DNA, 25 bp, Mus musculus
agtgtcttggcccagcttgataact

SEQ ID NO: 37625 - DNA, 25 bp, Mus musculus
tgtcttggcccagcttgataactat

SEQ ID NO: 37626 - DNA, 25 bp, Mus musculus
ttggcccagcttgataactatggac

SEQ ID NO: 37627 - DNA, 25 bp, Mus musculus
acaagaacttgcggatctttttgtg

SEQ ID NO: 37628 - DNA, 25 bp, Mus musculus
acttgcggatctttttgtgaactat

SEQ ID NO: 37629 - DNA, 25 bp, Mus musculus
ttaacttaatgttccagaccttcat

SEQ ID NO: 37630 - DNA, 25 bp, Mus musculus
cttaatgttccagaccttcattggg

SEQ ID NO: 37631 - DNA, 25 bp, Mus musculus
gtacccactgcagaggaagaaccct

SEQ ID NO: 37632 - DNA, 25 bp, Mus musculus
cagcagctttgtccttggctacaaa

SEQ ID NO: 37633 - DNA, 25 bp, Mus musculus
tccagagcatttcagctgggagatc

SEQ ID NO: 37634 - DNA, 25 bp, Mus musculus
gcatttcagctgggagatctccctc

SEQ ID NO: 37635 - DNA, 25 bp, Mus musculus
actctggctactgttaaaatcctga

SEQ ID NO: 37636 - DNA, 25 bp, Mus musculus
atcctgatgtttctgtggaatcctc

SEQ ID NO: 37637 - DNA, 25 bp, Mus musculus
atgtttctgtggaatcctcagtgtt

SEQ ID NO: 37638 - DNA, 25 bp, Mus musculus
ctgtggaatcctcagtgtttaatcc

SEQ ID NO: 37639 - DNA, 25 bp, Mus musculus
aatcctcagtgtttaatcccactca

SEQ ID NO: 37640 - DNA, 25 bp, Mus musculus
ttaatcccactcaatagtatcatta

SEQ ID NO: 37641 - DNA, 25 bp, Mus musculus
atcattacagttttctgtaagagaa

SEQ ID NO: 37642 - DNA, 25 bp, Mus musculus
ccagtattcctagcctgtcaacata

SEQ ID NO: 37643 - DNA, 25 bp, Mus musculus
ctacaaactgttacaacgtcacaca

SEQ ID NO: 37644 - DNA, 25 bp, Mus musculus
actgttacaacgtcacacaatgaag

SEQ ID NO: 37645 - DNA, 25 bp, Mus musculus
gactccatactcagtgacagggcag

SEQ ID NO: 37646 - DNA, 25 bp, Mus musculus
atactcagtgacagggcaggaagag

SEQ ID NO: 37647 - DNA, 25 bp, Mus musculus
gccaaagataaccacagccacagcc

SEQ ID NO: 37648 - DNA, 25 bp, Mus musculus
cacagccacagcctgtggagaccag

SEQ ID NO: 37649 - DNA, 25 bp, Mus musculus
cacagcctgtggagaccagggttgg

SEQ ID NO: 37650 - DNA, 25 bp, Mus musculus
aggcatctgcattgtgggatgttaa

SEQ ID NO: 37651 - DNA, 25 bp, Mus musculus
ctgtggcctagcacggctcaccaac

SEQ ID NO: 37652 - DNA, 25 bp, Mus musculus
tggcctagcacggctcaccaacatc

SEQ ID NO: 37653 - DNA, 25 bp, Mus musculus
ggccttcttactgaggattgaagct

SEQ ID NO: 37654 - DNA, 25 bp, Mus musculus
cttcttactgaggattgaagctgcg

SEQ ID NO: 37655 - DNA, 25 bp, Mus musculus
gaccagaaacatcatcccagggtat

SEQ ID NO: 37656 - DNA, 25 bp, Mus musculus
catcatcccagggtatacttgggca

SEQ ID NO: 37657 - DNA, 25 bp, Mus musculus
catcccagggtatacttgggcacag

SEQ ID NO: 37658 - DNA, 25 bp, Mus musculus
gttgcctctctgagaaaagcggcag

SEQ ID NO: 37659 - DNA, 25 bp, Mus musculus
gtgcctagcggactgtctgtcagtc

SEQ ID NO: 37660 - DNA, 25 bp, Mus musculus
cctagcggactgtctgtcagtcagg

SEQ ID NO: 37661 - DNA, 25 bp, Mus musculus
agcggactgtctgtcagtcagggta

SEQ ID NO: 37662 - DNA, 25 bp, Mus musculus
ctgtctgtcagtcagggtaccccgt

SEQ ID NO: 37663 - DNA, 25 bp, Mus musculus
acggctcaccaacatctttgccagt

SEQ ID NO: 37664 - DNA, 25 bp, Mus musculus
tttcagacaccttcattaacttcta

SEQ ID NO: 37665 - DNA, 25 bp, Mus musculus
gctcaccaacatctttgccagttct

SEQ ID NO: 37666 - DNA, 25 bp, Mus musculus
caacatctttgccagttctcgggcc

SEQ ID NO: 37667 - DNA, 25 bp, Mus musculus
tcgggccttctcctggtctgggaag

SEQ ID NO: 37668 - DNA, 25 bp, Mus musculus
cttaacatctaccaccagagtggac

SEQ ID NO: 37669 - DNA, 25 bp, Mus musculus
aacatctaccaccagagtggacagt

SEQ ID NO: 37670 - DNA, 25 bp, Mus musculus
atctaccaccagagtggacagtccc

SEQ ID NO: 37671 - DNA, 25 bp, Mus musculus
ctccacggccttcttactgaggatt

SEQ ID NO: 37672 - DNA, 25 bp, Mus musculus
tggtacccttcttcttccacagaag

SEQ ID NO: 37673 - DNA, 25 bp, Mus musculus
tcttcttccacagaagccaggttac

SEQ ID NO: 37674 - DNA, 25 bp, Mus musculus
cctgtctcgattctaatgcattgtt

SEQ ID NO: 37675 - DNA, 25 bp, Mus musculus
gtctcgattctaatgcattgttcca

SEQ ID NO: 37676 - DNA, 25 bp, Mus musculus
ctaatgcattgttccactgagggac

SEQ ID NO: 37677 - DNA, 25 bp, Mus musculus
atgcattgttccactgagggacagg

SEQ ID NO: 37678 - DNA, 25 bp, Mus musculus
tgttccactgagggacagggacaag

SEQ ID NO: 37679 - DNA, 25 bp, Mus musculus
attcattgaccatgattcttagatt

SEQ ID NO: 37680 - DNA, 25 bp, Mus musculus
cattgaccatgattcttagatttgg

SEQ ID NO: 37681 - DNA, 25 bp, Mus musculus
ttgttttcagctattaaatgtgata

SEQ ID NO: 37682 - DNA, 25 bp, Mus musculus
atatgtccaaatcaattttcctctg

SEQ ID NO: 37683 - DNA, 25 bp, Mus musculus
tgtccaaatcaattttcctctgaaa

SEQ ID NO: 37684 - DNA, 25 bp, Mus musculus
tcttccacagaagccaggttacctt

SEQ ID NO: 37685 - DNA, 25 bp, Mus musculus
tccacagaagccaggttaccttaga

SEQ ID NO: 37686 - DNA, 25 bp, Mus musculus
ttcctagatccctatttctccacca

SEQ ID NO: 37687 - DNA, 25 bp, Mus musculus
gatccctatttctccaccagaaatc

SEQ ID NO: 37688 - DNA, 25 bp, Mus musculus
tatttctccaccagaaatcaagaga

SEQ ID NO: 37689 - DNA, 25 bp, Mus musculus
ttctccaccagaaatcaagagatac

SEQ ID NO: 37690 - DNA, 25 bp, Mus musculus
ttttagattctctgagaggagttaa

SEQ ID NO: 37691 - DNA, 25 bp, Mus musculus
tcccctgtctcgattctaatgcatt

SEQ ID NO: 37692 - DNA, 25 bp, Mus musculus
gagaactctgtgctgcgcagggaga

SEQ ID NO: 37693 - DNA, 25 bp, Mus musculus
ctgcgtcacctgagcgaggtgctga

SEQ ID NO: 37694 - DNA, 25 bp, Mus musculus
gccagctgtctaccacgatgacacc

SEQ ID NO: 37695 - DNA, 25 bp, Mus musculus
agctgtctaccacgatgacacccca

SEQ ID NO: 37696 - DNA, 25 bp, Mus musculus
tgtctaccacgatgacaccccagct

SEQ ID NO: 37697 - DNA, 25 bp, Mus musculus
gctcggaaccttggtttgcacactc

SEQ ID NO: 37698 - DNA, 25 bp, Mus musculus
aaccttggtttgcacactcaggagt

SEQ ID NO: 37699 - DNA, 25 bp, Mus musculus
cttggtttgcacactcaggagtttc

SEQ ID NO: 37700 - DNA, 25 bp, Mus musculus
actcaggagtttccctacacacctg

SEQ ID NO: 37701 - DNA, 25 bp, Mus musculus
caggagtttccctacacacctgtgt

SEQ ID NO: 37702 - DNA, 25 bp, Mus musculus
gagtttccctacacacctgtgtcca

SEQ ID NO: 37703 - DNA, 25 bp, Mus musculus
tacacacctgtgtccaggggtacat

SEQ ID NO: 37704 - DNA, 25 bp, Mus musculus
cacctgagcgaggtgctgaaggagc

SEQ ID NO: 37705 - DNA, 25 bp, Mus musculus
gccttccagggagctctggggccag

SEQ ID NO: 37706 - DNA, 25 bp, Mus musculus
ctgctgtgtcctatgaactttgtgc

SEQ ID NO: 37707 - DNA, 25 bp, Mus musculus
ctgtgtcctatgaactttgtgcagc

SEQ ID NO: 37708 - DNA, 25 bp, Mus musculus
tgtcctatgaactttgtgcagcttc

SEQ ID NO: 37709 - DNA, 25 bp, Mus musculus
cctatgaactttgtgcagcttcggt

SEQ ID NO: 37710 - DNA, 25 bp, Mus musculus
aactttgtgcagcttcggtcagacc

SEQ ID NO: 37711 - DNA, 25 bp, Mus musculus
tcagaccccgtggccagctgtctac

SEQ ID NO: 37712 - DNA, 25 bp, Mus musculus
gtggccagctgtctaccacgatgac

SEQ ID NO: 37713 - DNA, 25 bp, Mus musculus
actattcaggcgaggctcaagctct

SEQ ID NO: 37714 - DNA, 25 bp, Mus musculus
tattcaggcgaggctcaagctctga

SEQ ID NO: 37715 - DNA, 25 bp, Mus musculus
ggcatgcacggctcaggcatctctc

SEQ ID NO: 37716 - DNA, 25 bp, Mus musculus
gctcaggcatctctcctttagtgga

SEQ ID NO: 37717 - DNA, 25 bp, Mus musculus
tcaggcatctctcctttagtggaat

SEQ ID NO: 37718 - DNA, 25 bp, Mus musculus
aggcatctctcctttagtggaatga

SEQ ID NO: 37719 - DNA, 25 bp, Mus musculus
gcatctctcctttagtggaatgagt

SEQ ID NO: 37720 - DNA, 25 bp, Mus musculus
ctctcctttagtggaatgagtggag

SEQ ID NO: 37721 - DNA, 25 bp, Mus musculus
ctcctgggcatccaccacgatgctg

SEQ ID NO: 37722 - DNA, 25 bp, Mus musculus
tgggcatccaccacgatgctgtcat

SEQ ID NO: 37723 - DNA, 25 bp, Mus musculus
acgatgctgtcatcttcctggcaga

SEQ ID NO: 37724 - DNA, 25 bp, Mus musculus
tgctgtcatcttcctggcagagcag

SEQ ID NO: 37725 - DNA, 25 bp, Mus musculus
cgaggctcaagctctgaggaagagc

SEQ ID NO: 37726 - DNA, 25 bp, Mus musculus
aggctcaagctctgaggaagagcct

SEQ ID NO: 37727 - DNA, 25 bp, Mus musculus
gctcaagctctgaggaagagcctcc

SEQ ID NO: 37728 - DNA, 25 bp, Mus musculus
tggtccacacctgcgctttgagatc

SEQ ID NO: 37729 - DNA, 25 bp, Mus musculus
gtccacacctgcgctttgagatcag

SEQ ID NO: 37730 - DNA, 25 bp, Mus musculus
ccacacctgcgctttgagatcagca

SEQ ID NO: 37731 - DNA, 25 bp, Mus musculus
acacctgcgctttgagatcagcagt

SEQ ID NO: 37732 - DNA, 25 bp, Mus musculus
atgatggcttcagtgtggaggcaga

SEQ ID NO: 37733 - DNA, 25 bp, Mus musculus
agatcgttgacaccaatggagctgg

SEQ ID NO: 37734 - DNA, 25 bp, Mus musculus
ttgacaccaatggagctggagatgc

SEQ ID NO: 37735 - DNA, 25 bp, Mus musculus
aacattatcttctgtctttgcccac

SEQ ID NO: 37736 - DNA, 25 bp, Mus musculus
atcttctgtctttgcccaccatgat

SEQ ID NO: 37737 - DNA, 25 bp, Mus musculus
tgtctttgcccaccatgattctcat

SEQ ID NO: 37738 - DNA, 25 bp, Mus musculus
ccatgattctcattattaccgtaga

SEQ ID NO: 37739 - DNA, 25 bp, Mus musculus
ttattaccgtagagggctcagtgct

SEQ ID NO: 37740 - DNA, 25 bp, Mus musculus
ttatttccatagtctgttagtgcct

SEQ ID NO: 37741 - DNA, 25 bp, Mus musculus
tctgttagtgcctcttaaatgtcac

SEQ ID NO: 37742 - DNA, 25 bp, Mus musculus
agtgcctcttaaatgtcacacagga

SEQ ID NO: 37743 - DNA, 25 bp, Mus musculus
tcttaaatgtcacacaggaatccaa

SEQ ID NO: 37744 - DNA, 25 bp, Mus musculus
atgtcacacaggaatccaacatttc

SEQ ID NO: 37745 - DNA, 25 bp, Mus musculus
ggtttctgtctcagctggtctccaa

SEQ ID NO: 37746 - DNA, 25 bp, Mus musculus
tgtctcagctggtctccaacaagcc

SEQ ID NO: 37747 - DNA, 25 bp, Mus musculus
acaagcctctgactgaatgcatccg

SEQ ID NO: 37748 - DNA, 25 bp, Mus musculus
ggcactatgcagcgagcgtcatcat

SEQ ID NO: 37749 - DNA, 25 bp, Mus musculus
atgcagcgagcgtcatcattaggcg

SEQ ID NO: 37750 - DNA, 25 bp, Mus musculus
cgagcgtcatcattaggcgaactgg

SEQ ID NO: 37751 - DNA, 25 bp, Mus musculus
aactcaggctgtggagtggagactg

SEQ ID NO: 37752 - DNA, 25 bp, Mus musculus
tcctgagacgttcctgccttgagaa

SEQ ID NO: 37753 - DNA, 25 bp, Mus musculus
ccacagtagccgcacttgaaaggcc

SEQ ID NO: 37754 - DNA, 25 bp, Mus musculus
cagtagccgcacttgaaaggccggt

SEQ ID NO: 37755 - DNA, 25 bp, Mus musculus
agaatgcgctgcgtgaaagtcttaa

SEQ ID NO: 37756 - DNA, 25 bp, Mus musculus
ttaaagcactggccgcacttccaga

SEQ ID NO: 37757 - DNA, 25 bp, Mus musculus
aagcactggccgcacttccagagat

SEQ ID NO: 37758 - DNA, 25 bp, Mus musculus
ttccagagatgccagtcgctgaact

SEQ ID NO: 37759 - DNA, 25 bp, Mus musculus
agatgccagtcgctgaactccgagt

SEQ ID NO: 37760 - DNA, 25 bp, Mus musculus
cagtcgctgaactccgagtgcagct

SEQ ID NO: 37761 - DNA, 25 bp, Mus musculus
aactccgagtgcagctggctggttg

SEQ ID NO: 37762 - DNA, 25 bp, Mus musculus
ctcgccaggaccctctgattcttca

SEQ ID NO: 37763 - DNA, 25 bp, Mus musculus
gccaggaccctctgattcttcacgt

SEQ ID NO: 37764 - DNA, 25 bp, Mus musculus
tgattcttcacgttgatttggttaa

SEQ ID NO: 37765 - DNA, 25 bp, Mus musculus
gtgactacgtggttcctcagttctg

SEQ ID NO: 37766 - DNA, 25 bp, Mus musculus
ttaaatcctgcctccatgggcccag

SEQ ID NO: 37767 - DNA, 25 bp, Mus musculus
acgtggttcctcagttctgacggct

SEQ ID NO: 37768 - DNA, 25 bp, Mus musculus
tggttcctcagttctgacggctggg

SEQ ID NO: 37769 - DNA, 25 bp, Mus musculus
ttcctcagttctgacggctgggaaa

SEQ ID NO: 37770 - DNA, 25 bp, Mus musculus
cagtggccacactggtagggtctgt

SEQ ID NO: 37771 - DNA, 25 bp, Mus musculus
tgcgtgcacacatgcatctgcagga

SEQ ID NO: 37772 - DNA, 25 bp, Mus musculus
gtgcacacatgcatctgcaggagaa

SEQ ID NO: 37773 - DNA, 25 bp, Mus musculus
tgcatctgcaggagaatgcgctgcg

SEQ ID NO: 37774 - DNA, 25 bp, Mus musculus
acttccaagcacatctgcagccata

SEQ ID NO: 37775 - DNA, 25 bp, Mus musculus
aacattaaattgccacacatgtgct

SEQ ID NO: 37776 - DNA, 25 bp, Mus musculus
tctctgcaacaaggtctagatgccc

SEQ ID NO: 37777 - DNA, 25 bp, Mus musculus
gatgcccgtgccctacttcttgctc

SEQ ID NO: 37778 - DNA, 25 bp, Mus musculus
ttcaacttcaacaactaatcacatc

SEQ ID NO: 37779 - DNA, 25 bp, Mus musculus
ttcaacaactaatcacatcggctct

SEQ ID NO: 37780 - DNA, 25 bp, Mus musculus
tcacatcggctctgcctgatcacca

SEQ ID NO: 37781 - DNA, 25 bp, Mus musculus
cggctctgcctgatcaccagataag

SEQ ID NO: 37782 - DNA, 25 bp, Mus musculus
tgcctgatcaccagataagaagctc

SEQ ID NO: 37783 - DNA, 25 bp, Mus musculus
ttattgataccccattgcctatgtc

SEQ ID NO: 37784 - DNA, 25 bp, Mus musculus
cattgcctatgtcctctgccttact

SEQ ID NO: 37785 - DNA, 25 bp, Mus musculus
ctatgtcctctgccttactttgctc

SEQ ID NO: 37786 - DNA, 25 bp, Mus musculus
aaattgccacacatgtgcttatatg

SEQ ID NO: 37787 - DNA, 25 bp, Mus musculus
ccacacatgtgcttatatgaatgat

SEQ ID NO: 37788 - DNA, 25 bp, Mus musculus
tgatgcaaaatgtctccgtggagaa

SEQ ID NO: 37789 - DNA, 25 bp, Mus musculus
cactcaaaactcccagcagtgcatg

SEQ ID NO: 37790 - DNA, 25 bp, Mus musculus
gtgcccatctatgaacctcttctct

SEQ ID NO: 37791 - DNA, 25 bp, Mus musculus
atctatgaacctcttctctcatgga

SEQ ID NO: 37792 - DNA, 25 bp, Mus musculus
tcggaatgaacctctctgcaacaag

SEQ ID NO: 37793 - DNA, 25 bp, Mus musculus
tgaacctctctgcaacaaggtctag

SEQ ID NO: 37794 - DNA, 25 bp, Mus musculus
agtggctgcataccgccgagccctt

SEQ ID NO: 37795 - DNA, 25 bp, Mus musculus
ggctgcataccgccgagcccttgaa

SEQ ID NO: 37796 - DNA, 25 bp, Mus musculus
caacctgggagctcaccgtgaggct

SEQ ID NO: 37797 - DNA, 25 bp, Mus musculus
ggctgtggagcactttctggaggct

SEQ ID NO: 37798 - DNA, 25 bp, Mus musculus
tgtggagcactttctggaggctctg

SEQ ID NO: 37799 - DNA, 25 bp, Mus musculus
gcactttctggaggctctgaacatg

SEQ ID NO: 37800 - DNA, 25 bp, Mus musculus
ctttctggaggctctgaacatgcag

SEQ ID NO: 37801 - DNA, 25 bp, Mus musculus
ggctctgaacatgcagaggaagagc

SEQ ID NO: 37802 - DNA, 25 bp, Mus musculus
gaacatctggagtaccctgcgcttg

SEQ ID NO: 37803 - DNA, 25 bp, Mus musculus
catctggagtaccctgcgcttggcg

SEQ ID NO: 37804 - DNA, 25 bp, Mus musculus
ctggagtaccctgcgcttggcgtta

SEQ ID NO: 37805 - DNA, 25 bp, Mus musculus
gcgcttggcgttatccatgttaggc

SEQ ID NO: 37806 - DNA, 25 bp, Mus musculus
agcccttgaactacagcctgggtat

SEQ ID NO: 37807 - DNA, 25 bp, Mus musculus
tgaactacagcctgggtatattcgg

SEQ ID NO: 37808 - DNA, 25 bp, Mus musculus
gtcccggtataacctaggcatcagc

SEQ ID NO: 37809 - DNA, 25 bp, Mus musculus
gtataacctaggcatcagctgcatc

SEQ ID NO: 37810 - DNA, 25 bp, Mus musculus
cctaggcatcagctgcatcaacctg

SEQ ID NO: 37811 - DNA, 25 bp, Mus musculus
aggcatcagctgcatcaacctggga

SEQ ID NO: 37812 - DNA, 25 bp, Mus musculus
catcagctgcatcaacctgggagct

SEQ ID NO: 37813 - DNA, 25 bp, Mus musculus
catcaacctgggagctcaccgtgag

SEQ ID NO: 37814 - DNA, 25 bp, Mus musculus
cttcaacaaccgattctctcacctg

SEQ ID NO: 37815 - DNA, 25 bp, Mus musculus
ttcaacaaccgattctctcacctgc

SEQ ID NO: 37816 - DNA, 25 bp, Mus musculus
ctactcccaacttggccaagctact

SEQ ID NO: 37817 - DNA, 25 bp, Mus musculus
actcccaacttggccaagctactca

SEQ ID NO: 37818 - DNA, 25 bp, Mus musculus
ttggccaagctactcacccagcagt

SEQ ID NO: 37819 - DNA, 25 bp, Mus musculus
tggccaagctactcacccagcagtc

SEQ ID NO: 37820 - DNA, 25 bp, Mus musculus
tcccaactataccccgaacatactg

SEQ ID NO: 37821 - DNA, 25 bp, Mus musculus
tataccccgaacatactgaggtaca

SEQ ID NO: 37822 - DNA, 25 bp, Mus musculus
taccccgaacatactgaggtacagc

SEQ ID NO: 37823 - DNA, 25 bp, Mus musculus
accccgaacatactgaggtacagcg

SEQ ID NO: 37824 - DNA, 25 bp, Mus musculus
gaggtacagcgcaacatcagccagt

SEQ ID NO: 37825 - DNA, 25 bp, Mus musculus
aggtacagcgcaacatcagccagtt

SEQ ID NO: 37826 - DNA, 25 bp, Mus musculus
ctgccccaggtaatgactgacatct

SEQ ID NO: 37827 - DNA, 25 bp, Mus musculus
ggtacagcgcaacatcagccagtta

SEQ ID NO: 37828 - DNA, 25 bp, Mus musculus
gtaatgactgacatctcccaggtac

SEQ ID NO: 37829 - DNA, 25 bp, Mus musculus
aatgactgacatctcccaggtactc

SEQ ID NO: 37830 - DNA, 25 bp, Mus musculus
atgactgacatctcccaggtactca

SEQ ID NO: 37831 - DNA, 25 bp, Mus musculus
cttctccaagctactcccaacttgg

SEQ ID NO: 37832 - DNA, 25 bp, Mus musculus
ttctccaagctactcccaacttggc

SEQ ID NO: 37833 - DNA, 25 bp, Mus musculus
tccaagctactcccaacttggccaa

SEQ ID NO: 37834 - DNA, 25 bp, Mus musculus
gctactcccaacttggccaagctac

SEQ ID NO: 37835 - DNA, 25 bp, Mus musculus
agcccctgcagatagagacctgtgg

SEQ ID NO: 37836 - DNA, 25 bp, Mus musculus
cctgtggcccacaagttcctgagca

SEQ ID NO: 37837 - DNA, 25 bp, Mus musculus
gtcacagagcgctacaggatgcgtt

SEQ ID NO: 37838 - DNA, 25 bp, Mus musculus
tacaggatgcgttcagtgggctctt

SEQ ID NO: 37839 - DNA, 25 bp, Mus musculus
tctggcagcccagataacctgtatt

SEQ ID NO: 37840 - DNA, 25 bp, Mus musculus
agcccagataacctgtattttctca

SEQ ID NO: 37841 - DNA, 25 bp, Mus musculus
gataacctgtattttctcatgtata

SEQ ID NO: 37842 - DNA, 25 bp, Mus musculus
ctgtattttctcatgtataagatct

SEQ ID NO: 37843 - DNA, 25 bp, Mus musculus
accactgctgctgtgctcaggtgtt

SEQ ID NO: 37844 - DNA, 25 bp, Mus musculus
ttattgcagtctggaccaagctgag

SEQ ID NO: 37845 - DNA, 25 bp, Mus musculus
acttctgttctttagacagggatga

SEQ ID NO: 37846 - DNA, 25 bp, Mus musculus
atgatttgcctatgtttggagttga

SEQ ID NO: 37847 - DNA, 25 bp, Mus musculus
gcccacaagttcctgagcaagagct

SEQ ID NO: 37848 - DNA, 25 bp, Mus musculus
tccgggctgcatctccacaggatct

SEQ ID NO: 37849 - DNA, 25 bp, Mus musculus
ctgcatctccacaggatcttgctgg

SEQ ID NO: 37850 - DNA, 25 bp, Mus musculus
ctccacaggatcttgctggcggcta

SEQ ID NO: 37851 - DNA, 25 bp, Mus musculus
ttgctggcggctatacttcttctct

SEQ ID NO: 37852 - DNA, 25 bp, Mus musculus
gcggctatacttcttctcttgcttg

SEQ ID NO: 37853 - DNA, 25 bp, Mus musculus
cttctcttgcttgtcacagagcgct

SEQ ID NO: 37854 - DNA, 25 bp, Mus musculus
ttgcttgtcacagagcgctacagga

SEQ ID NO: 37855 - DNA, 25 bp, Mus musculus
gtgtattcccattgacagccctgat

SEQ ID NO: 37856 - DNA, 25 bp, Mus musculus
gtattcccattgacagccctgatag

SEQ ID NO: 37857 - DNA, 25 bp, Mus musculus
aaatgtgccaataatcgtggttgga

SEQ ID NO: 37858 - DNA, 25 bp, Mus musculus
gtgccaataatcgtggttggaaaca

SEQ ID NO: 37859 - DNA, 25 bp, Mus musculus
aggacgttcggattgacgagcacag

SEQ ID NO: 37860 - DNA, 25 bp, Mus musculus
ttcggattgacgagcacaggagacg

SEQ ID NO: 37861 - DNA, 25 bp, Mus musculus
ttgacgagcacaggagacgggagtc

SEQ ID NO: 37862 - DNA, 25 bp, Mus musculus
tatgagccggttgaccttgagtcag

SEQ ID NO: 37863 - DNA, 25 bp, Mus musculus
tgagccggttgaccttgagtcaggc

SEQ ID NO: 37864 - DNA, 25 bp, Mus musculus
ccggttgaccttgagtcaggcagag

SEQ ID NO: 37865 - DNA, 25 bp, Mus musculus
ggttgaccttgagtcaggcagagat

SEQ ID NO: 37866 - DNA, 25 bp, Mus musculus
ttgaccttgagtcaggcagagatat

SEQ ID NO: 37867 - DNA, 25 bp, Mus musculus
tcccattgacagccctgatagttta

SEQ ID NO: 37868 - DNA, 25 bp, Mus musculus
gtttagaaaacatcccagacaaatg

SEQ ID NO: 37869 - DNA, 25 bp, Mus musculus
ttagaaaacatcccagacaaatgga

SEQ ID NO: 37870 - DNA, 25 bp, Mus musculus
catcccagacaaatggactccagaa

SEQ ID NO: 37871 - DNA, 25 bp, Mus musculus
atggactccagaagtcaagcatttc

SEQ ID NO: 37872 - DNA, 25 bp, Mus musculus
gcatttctgtccaaatgtgccaata

SEQ ID NO: 37873 - DNA, 25 bp, Mus musculus
ttctgtccaaatgtgccaataatcg

SEQ ID NO: 37874 - DNA, 25 bp, Mus musculus
ctgtccaaatgtgccaataatcgtg

SEQ ID NO: 37875 - DNA, 25 bp, Mus musculus
atgcagcgctgcgaggaggatctcg

SEQ ID NO: 37876 - DNA, 25 bp, Mus musculus
aggaggatctcgtcctctggctatg

SEQ ID NO: 37877 - DNA, 25 bp, Mus musculus
cgtcctctggctatgaacgacctgg

SEQ ID NO: 37878 - DNA, 25 bp, Mus musculus
cctgcgtcctcacgcgaaaggggct

SEQ ID NO: 37879 - DNA, 25 bp, Mus musculus
ctgcgtcctcacgcgaaaggggcta

SEQ ID NO: 37880 - DNA, 25 bp, Mus musculus
tgcgtcctcacgcgaaaggggctat

SEQ ID NO: 37881 - DNA, 25 bp, Mus musculus
gcgtcctcacgcgaaaggggctatt

SEQ ID NO: 37882 - DNA, 25 bp, Mus musculus
cgtcctcacgcgaaaggggctattg

SEQ ID NO: 37883 - DNA, 25 bp, Mus musculus
tcacgcgaaaggggctattgcatct

SEQ ID NO: 37884 - DNA, 25 bp, Mus musculus
gaggatctcgtcctctggctatgaa

SEQ ID NO: 37885 - DNA, 25 bp, Mus musculus
aggatctcgtcctctggctatgaac

SEQ ID NO: 37886 - DNA, 25 bp, Mus musculus
ggatctcgtcctctggctatgaacg

SEQ ID NO: 37887 - DNA, 25 bp, Mus musculus
gatctcgtcctctggctatgaacga

SEQ ID NO: 37888 - DNA, 25 bp, Mus musculus
atctcgtcctctggctatgaacgac

SEQ ID NO: 37889 - DNA, 25 bp, Mus musculus
tctcgtcctctggctatgaacgacc

SEQ ID NO: 37890 - DNA, 25 bp, Mus musculus
ctcgtcctctggctatgaacgacct

SEQ ID NO: 37891 - DNA, 25 bp, Mus musculus
tcgtcctctggctatgaacgacctg

SEQ ID NO: 37892 - DNA, 25 bp, Mus musculus
ccccaggtctagtgcagtgccaaga

SEQ ID NO: 37893 - DNA, 25 bp, Mus musculus
tgcagtgccaagatctggtggttct

SEQ ID NO: 37894 - DNA, 25 bp, Mus musculus
ttcgtggctttgtgatgacaaatct

SEQ ID NO: 37895 - DNA, 25 bp, Mus musculus
acccgtgtgcacagaagtgagatca

SEQ ID NO: 37896 - DNA, 25 bp, Mus musculus
gggagacagacaaccttctgcctga

SEQ ID NO: 37897 - DNA, 25 bp, Mus musculus
accttctgcctgaaccaagatggtg

SEQ ID NO: 37898 - DNA, 25 bp, Mus musculus
gccatgttttctaacccagagcctg

SEQ ID NO: 37899 - DNA, 25 bp, Mus musculus
gagcctgtctttttagcagacctca

SEQ ID NO: 37900 - DNA, 25 bp, Mus musculus
gacctcaataaatctcctgcctcag

SEQ ID NO: 37901 - DNA, 25 bp, Mus musculus
ttctgtttccacatcctgcctgatg

SEQ ID NO: 37902 - DNA, 25 bp, Mus musculus
tacagtgttgcatggtcctatggta

SEQ ID NO: 37903 - DNA, 25 bp, Mus musculus
gttgcatggtcctatggtagaaaga

SEQ ID NO: 37904 - DNA, 25 bp, Mus musculus
ttttgagacagggcctcactgtgcg

SEQ ID NO: 37905 - DNA, 25 bp, Mus musculus
gaccaggctaacctggaactcagcg

SEQ ID NO: 37906 - DNA, 25 bp, Mus musculus
gctaacctggaactcagcgaacatg

SEQ ID NO: 37907 - DNA, 25 bp, Mus musculus
ctggaactcagcgaacatgtctgcc

SEQ ID NO: 37908 - DNA, 25 bp, Mus musculus
aggccacagcaatcatcctttctca

SEQ ID NO: 37909 - DNA, 25 bp, Mus musculus
tcatcctttctcaaccacctgaagg

SEQ ID NO: 37910 - DNA, 25 bp, Mus musculus
aaccacctgaaggtgacagcatacg

SEQ ID NO: 37911 - DNA, 25 bp, Mus musculus
gtgacagcatacgccgtcgtgtgtg

SEQ ID NO: 37912 - DNA, 25 bp, Mus musculus
atcactgtttgtgcctctgtgggag

SEQ ID NO: 37913 - DNA, 25 bp, Mus musculus
ctatgtgcggccacttcgacggctt

SEQ ID NO: 37914 - DNA, 25 bp, Mus musculus
tacagggacatggccaccaaggaca

SEQ ID NO: 37915 - DNA, 25 bp, Mus musculus
agggacatggccaccaaggacacag

SEQ ID NO: 37916 - DNA, 25 bp, Mus musculus
gacatggccaccaaggacacagtgg

SEQ ID NO: 37917 - DNA, 25 bp, Mus musculus
accaaggacacagtggctggccttg

SEQ ID NO: 37918 - DNA, 25 bp, Mus musculus
aaggacacagtggctggccttgctg

SEQ ID NO: 37919 - DNA, 25 bp, Mus musculus
atgacctctgtgccccgcatggagg

SEQ ID NO: 37920 - DNA, 25 bp, Mus musculus
ctgaggtctctctttgtaggagagt

SEQ ID NO: 37921 - DNA, 25 bp, Mus musculus
aggtctctctttgtaggagagtggg

SEQ ID NO: 37922 - DNA, 25 bp, Mus musculus
agcagcaggtgacgcccctgtatgt

SEQ ID NO: 37923 - DNA, 25 bp, Mus musculus
agcaggtgacgcccctgtatgtaga

SEQ ID NO: 37924 - DNA, 25 bp, Mus musculus
gcggccacttcgacggcttctgtgt

SEQ ID NO: 37925 - DNA, 25 bp, Mus musculus
tcgacggcttctgtgtgtgcatctt

SEQ ID NO: 37926 - DNA, 25 bp, Mus musculus
tgtgcatctttcccacatgcccgac

SEQ ID NO: 37927 - DNA, 25 bp, Mus musculus
catccccatgtgaatggtgcgctta

SEQ ID NO: 37928 - DNA, 25 bp, Mus musculus
ccccatgtgaatggtgcgcttagtt

SEQ ID NO: 37929 - DNA, 25 bp, Mus musculus
aatcaatcttcagacatatcagata

SEQ ID NO: 37930 - DNA, 25 bp, Mus musculus
tcttcagacatatcagatatggagg

SEQ ID NO: 37931 - DNA, 25 bp, Mus musculus
ctcgggccagactacagggacatgg

SEQ ID NO: 37932 - DNA, 25 bp, Mus musculus
tgccaccaatgctgctggctggagc

SEQ ID NO: 37933 - DNA, 25 bp, Mus musculus
tgctggctggagccctggagtctgt

SEQ ID NO: 37934 - DNA, 25 bp, Mus musculus
tgaagccacattcgtcagctgaatg

SEQ ID NO: 37935 - DNA, 25 bp, Mus musculus
cacattcgtcagctgaatgcaactt

SEQ ID NO: 37936 - DNA, 25 bp, Mus musculus
ctgaatgcaacttctgcaggaggcc

SEQ ID NO: 37937 - DNA, 25 bp, Mus musculus
ggaggcccctgcactttgaagtgat

SEQ ID NO: 37938 - DNA, 25 bp, Mus musculus
cctatttctcaggcatgagcaagat

SEQ ID NO: 37939 - DNA, 25 bp, Mus musculus
ctgcccaggcctgactctgactcag

SEQ ID NO: 37940 - DNA, 25 bp, Mus musculus
aggcctgactctgactcagttattc

SEQ ID NO: 37941 - DNA, 25 bp, Mus musculus
gactctgactcagttattcacaaac

SEQ ID NO: 37942 - DNA, 25 bp, Mus musculus
ccattaccatacccacatagtagcc

SEQ ID NO: 37943 - DNA, 25 bp, Mus musculus
ccatacccacatagtagccagaatt

SEQ ID NO: 37944 - DNA, 25 bp, Mus musculus
ccctggagtctgtgcggatcctgaa

SEQ ID NO: 37945 - DNA, 25 bp, Mus musculus
agcaccagcgaaatgtcaagcttct

SEQ ID NO: 37946 - DNA, 25 bp, Mus musculus
atgtcaagcttctgaggcagatgct

SEQ ID NO: 37947 - DNA, 25 bp, Mus musculus
gtccgagtcacatcatccctgtgcg

SEQ ID NO: 37948 - DNA, 25 bp, Mus musculus
ctgtgcgggttgccgatgctgctaa

SEQ ID NO: 37949 - DNA, 25 bp, Mus musculus
ataatatctacgtccaggccatcaa

SEQ ID NO: 37950 - DNA, 25 bp, Mus musculus
tctacgtccaggccatcaattaccc

SEQ ID NO: 37951 - DNA, 25 bp, Mus musculus
tccaggccatcaattacccaacagt

SEQ ID NO: 37952 - DNA, 25 bp, Mus musculus
tccagtcagcaggatcatgagtttg

SEQ ID NO: 37953 - DNA, 25 bp, Mus musculus
gaaccagccagggttacaaagagag

SEQ ID NO: 37954 - DNA, 25 bp, Mus musculus
ccagaccattctaagcgtattccat

SEQ ID NO: 37955 - DNA, 25 bp, Mus musculus
cattctaagcgtattccatttccta

SEQ ID NO: 37956 - DNA, 25 bp, Mus musculus
attccatttcctacagccctgatag

SEQ ID NO: 37957 - DNA, 25 bp, Mus musculus
agcctgcttctgcctctgtgtacat

SEQ ID NO: 37958 - DNA, 25 bp, Mus musculus
cttctgcctctgtgtacatggcatt

SEQ ID NO: 37959 - DNA, 25 bp, Mus musculus
cctctgtgtacatggcatttgtctt

SEQ ID NO: 37960 - DNA, 25 bp, Mus musculus
gcatcatacgaatcatgattctgtt

SEQ ID NO: 37961 - DNA, 25 bp, Mus musculus
tcatgattctgttctctcaagccac

SEQ ID NO: 37962 - DNA, 25 bp, Mus musculus
ttctgttctctcaagccacctggtt

SEQ ID NO: 37963 - DNA, 25 bp, Mus musculus
tctctcaagccacctggttaaatta

SEQ ID NO: 37964 - DNA, 25 bp, Mus musculus
gaccgagtctcaaaaccaatcaaca

SEQ ID NO: 37965 - DNA, 25 bp, Mus musculus
aatatggccagtcctccagatccat

SEQ ID NO: 37966 - DNA, 25 bp, Mus musculus
cctccagatccatggagagctgatt

SEQ ID NO: 37967 - DNA, 25 bp, Mus musculus
gctgattccaggagtccccaaattt

SEQ ID NO: 37968 - DNA, 25 bp, Mus musculus
tccaggagtccccaaatttctggat

SEQ ID NO: 37969 - DNA, 25 bp, Mus musculus
gagtcccctgttgaaaacagtgcag

SEQ ID NO: 37970 - DNA, 25 bp, Mus musculus
tgtcccagtcatgcctcacaccgtt

SEQ ID NO: 37971 - DNA, 25 bp, Mus musculus
acctctccagaccattctaagcgta

SEQ ID NO: 37972 - DNA, 25 bp, Mus musculus
tggctgacggctttcccaaaactag

SEQ ID NO: 37973 - DNA, 25 bp, Mus musculus
ctagcctttgacttttcagagatac

SEQ ID NO: 37974 - DNA, 25 bp, Mus musculus
gccattgtcctgtgccgtcagctgg

SEQ ID NO: 37975 - DNA, 25 bp, Mus musculus
attgtcctgtgccgtcagctgggat

SEQ ID NO: 37976 - DNA, 25 bp, Mus musculus
gtcctgtgccgtcagctgggatgtg

SEQ ID NO: 37977 - DNA, 25 bp, Mus musculus
ctgtgccgtcagctgggatgtggcc

SEQ ID NO: 37978 - DNA, 25 bp, Mus musculus
cgtcagctgggatgtggccaggctc

SEQ ID NO: 37979 - DNA, 25 bp, Mus musculus
ccaggccgaggcccaatcctcttgg

SEQ ID NO: 37980 - DNA, 25 bp, Mus musculus
ggcccaatcctcttggacaatgtca

SEQ ID NO: 37981 - DNA, 25 bp, Mus musculus
ccaatcctcttggacaatgtcaaat

SEQ ID NO: 37982 - DNA, 25 bp, Mus musculus
atcctcttggacaatgtcaaatgcc

SEQ ID NO: 37983 - DNA, 25 bp, Mus musculus
caatgtcaaatgccgaggagatgag

SEQ ID NO: 37984 - DNA, 25 bp, Mus musculus
gcctttgacttttcagagataccaa

SEQ ID NO: 37985 - DNA, 25 bp, Mus musculus
aatgtcaaatgccgaggagatgaga

SEQ ID NO: 37986 - DNA, 25 bp, Mus musculus
cacctccgtctggctagtggaacac

SEQ ID NO: 37987 - DNA, 25 bp, Mus musculus
ctccgtctggctagtggaacacacc

SEQ ID NO: 37988 - DNA, 25 bp, Mus musculus
gatgatgcctgggacctacgggcag

SEQ ID NO: 37989 - DNA, 25 bp, Mus musculus
tgggacctacgggcagccattgtcc

SEQ ID NO: 37990 - DNA, 25 bp, Mus musculus
gacctacgggcagccattgtcctgt

SEQ ID NO: 37991 - DNA, 25 bp, Mus musculus
ctacgggcagccattgtcctgtgcc

SEQ ID NO: 37992 - DNA, 25 bp, Mus musculus
gcagccattgtcctgtgccgtcagc

SEQ ID NO: 37993 - DNA, 25 bp, Mus musculus
taattcgccagagatttgaaaacct

SEQ ID NO: 37994 - DNA, 25 bp, Mus musculus
gatttgaaaacctgctgtggtccag

SEQ ID NO: 37995 - DNA, 25 bp, Mus musculus
aggtgtccatctatggcttctggcc

SEQ ID NO: 37996 - DNA, 25 bp, Mus musculus
ccatctatggcttctggcccttctc

SEQ ID NO: 37997 - DNA, 25 bp, Mus musculus
ccttctcggtgaacatgcaagggga

SEQ ID NO: 37998 - DNA, 25 bp, Mus musculus
accctatcagtcaccactactatga

SEQ ID NO: 37999 - DNA, 25 bp, Mus musculus
actatgacaacgtcttgcccttctc

SEQ ID NO: 38000 - DNA, 25 bp, Mus musculus
caggctaccatgccatgcctgagga

SEQ ID NO: 38001 - DNA, 25 bp, Mus musculus
accatgccatgcctgaggaattcct

SEQ ID NO: 38002 - DNA, 25 bp, Mus musculus
ctgaggaattccttcagctttggta

SEQ ID NO: 38003 - DNA, 25 bp, Mus musculus
ttcagctttggtatcttcacaaaat

SEQ ID NO: 38004 - DNA, 25 bp, Mus musculus
acccgtgtgaggagccgtcaccaca

SEQ ID NO: 38005 - DNA, 25 bp, Mus musculus
agatctataaccacagttacatcta

SEQ ID NO: 38006 - DNA, 25 bp, Mus musculus
gcccacttcctagggactgcagaag

SEQ ID NO: 38007 - DNA, 25 bp, Mus musculus
acatgcctgccttttctatgaagac

SEQ ID NO: 38008 - DNA, 25 bp, Mus musculus
cgtctctccgtgtgtattacacact

SEQ ID NO: 38009 - DNA, 25 bp, Mus musculus
tgtattacacactgaaagatgttgg

SEQ ID NO: 38010 - DNA, 25 bp, Mus musculus
ttcttcggaacattggaaagttctg

SEQ ID NO: 38011 - DNA, 25 bp, Mus musculus
ggatccacgccaagcgcttgtctac

SEQ ID NO: 38012 - DNA, 25 bp, Mus musculus
acgccaagcgcttgtctacaggact

SEQ ID NO: 38013 - DNA, 25 bp, Mus musculus
caggactctttttggtgagtgcagc

SEQ ID NO: 38014 - DNA, 25 bp, Mus musculus
gtttccctccaggaccatgcgcggc

SEQ ID NO: 38015 - DNA, 25 bp, Mus musculus
cctccaggaccatgcgcggctcgga

SEQ ID NO: 38016 - DNA, 25 bp, Mus musculus
atccgcgcggcagtcactgggctgt

SEQ ID NO: 38017 - DNA, 25 bp, Mus musculus
agtcactgggctgtgggacacttaa

SEQ ID NO: 38018 - DNA, 25 bp, Mus musculus
gtcactgggctgtgggacacttaat

SEQ ID NO: 38019 - DNA, 25 bp, Mus musculus
cactgggctgtgggacacttaatgg

SEQ ID NO: 38020 - DNA, 25 bp, Mus musculus
ccgtccctgtatgcggctgacagag

SEQ ID NO: 38021 - DNA, 25 bp, Mus musculus
tccctgtatgcggctgacagagacg

SEQ ID NO: 38022 - DNA, 25 bp, Mus musculus
ccctgtatgcggctgacagagacgg

SEQ ID NO: 38023 - DNA, 25 bp, Mus musculus
tatgcggctgacagagacggcctga

SEQ ID NO: 38024 - DNA, 25 bp, Mus musculus
atgcggctgacagagacggcctgaa

SEQ ID NO: 38025 - DNA, 25 bp, Mus musculus
ggtacgtccgctgggaagaagctgc

SEQ ID NO: 38026 - DNA, 25 bp, Mus musculus
tggctctggtcctctgccaggcgcc

SEQ ID NO: 38027 - DNA, 25 bp, Mus musculus
gggatttgctggacctcctagaagc

SEQ ID NO: 38028 - DNA, 25 bp, Mus musculus
gcacggtcctggctaagatgtatcc

SEQ ID NO: 38029 - DNA, 25 bp, Mus musculus
acggtcctggctaagatgtatccgc

SEQ ID NO: 38030 - DNA, 25 bp, Mus musculus
ctaagatgtatccgcgcggcagtca

SEQ ID NO: 38031 - DNA, 25 bp, Mus musculus
agatgtatccgcgcggcagtcactg

SEQ ID NO: 38032 - DNA, 25 bp, Mus musculus
atgtatccgcgcggcagtcactggg

SEQ ID NO: 38033 - DNA, 25 bp, Mus musculus
tgtatccgcgcggcagtcactgggc

SEQ ID NO: 38034 - DNA, 25 bp, Mus musculus
tatccgcgcggcagtcactgggctg

SEQ ID NO: 38035 - DNA, 25 bp, Mus musculus
gggcaaatcagcgctggctactcgc

SEQ ID NO: 38036 - DNA, 25 bp, Mus musculus
agcgctggctactcgccagtcatcg

SEQ ID NO: 38037 - DNA, 25 bp, Mus musculus
atgtctgcacctccgcttgtaagag

SEQ ID NO: 38038 - DNA, 25 bp, Mus musculus
tctgcacctccgcttgtaagaggct

SEQ ID NO: 38039 - DNA, 25 bp, Mus musculus
agaggctctacgtcagcgactggat

SEQ ID NO: 38040 - DNA, 25 bp, Mus musculus
ggctctacgtcagcgactggatgct

SEQ ID NO: 38041 - DNA, 25 bp, Mus musculus
tctacgtcagcgactggatgctcgc

SEQ ID NO: 38042 - DNA, 25 bp, Mus musculus
tcagcgactggatgctcgccatcaa

SEQ ID NO: 38043 - DNA, 25 bp, Mus musculus
actggatgctcgccatcaaagtcca

SEQ ID NO: 38044 - DNA, 25 bp, Mus musculus
tgctcgccatcaaagtccagtggaa

SEQ ID NO: 38045 - DNA, 25 bp, Mus musculus
tcgccatcaaagtccagtggaaatt

SEQ ID NO: 38046 - DNA, 25 bp, Mus musculus
ccatcaaagtccagtggaaattctt

SEQ ID NO: 38047 - DNA, 25 bp, Mus musculus
gctggctactcgccagtcatcgact

SEQ ID NO: 38048 - DNA, 25 bp, Mus musculus
ggctactcgccagtcatcgactgtc

SEQ ID NO: 38049 - DNA, 25 bp, Mus musculus
tcgccagtcatcgactgtcacacgg

SEQ ID NO: 38050 - DNA, 25 bp, Mus musculus
gtcatcgactgtcacacggcccaca

SEQ ID NO: 38051 - DNA, 25 bp, Mus musculus
aaggtcacaaaatccgcacagaagg

SEQ ID NO: 38052 - DNA, 25 bp, Mus musculus
gtcacaaaatccgcacagaaggcgc

SEQ ID NO: 38053 - DNA, 25 bp, Mus musculus
tccgcacagaaggcgcagaaagcgg

SEQ ID NO: 38054 - DNA, 25 bp, Mus musculus
cgcatgtctgcacctccgcttgtaa

SEQ ID NO: 38055 - DNA, 25 bp, Mus musculus
tttgaatgtcccactggactaacct

SEQ ID NO: 38056 - DNA, 25 bp, Mus musculus
tattccacaagggttaagtcaatga

SEQ ID NO: 38057 - DNA, 25 bp, Mus musculus
ggtttctgctggccctgcagcttgc

SEQ ID NO: 38058 - DNA, 25 bp, Mus musculus
agcttgcttccctgcggattaggcc

SEQ ID NO: 38059 - DNA, 25 bp, Mus musculus
cttccctgcggattaggcctttgct

SEQ ID NO: 38060 - DNA, 25 bp, Mus musculus
ggattaggcctttgctcatgctata

SEQ ID NO: 38061 - DNA, 25 bp, Mus musculus
ctttgctcatgctatagccttcatg

SEQ ID NO: 38062 - DNA, 25 bp, Mus musculus
tgctcatgctatagccttcatgtgg

SEQ ID NO: 38063 - DNA, 25 bp, Mus musculus
tatagccttcatgtgggtgctacct

SEQ ID NO: 38064 - DNA, 25 bp, Mus musculus
agccttcatgtgggtgctacctaga

SEQ ID NO: 38065 - DNA, 25 bp, Mus musculus
cttcatgtgggtgctacctagagca

SEQ ID NO: 38066 - DNA, 25 bp, Mus musculus
gctacctagagcaggcgtgaactgc

SEQ ID NO: 38067 - DNA, 25 bp, Mus musculus
aagcacaatcagtctttcctttgaa

SEQ ID NO: 38068 - DNA, 25 bp, Mus musculus
cacaatcagtctttcctttgaaaat

SEQ ID NO: 38069 - DNA, 25 bp, Mus musculus
tttctttggggaacatgcagttttg

SEQ ID NO: 38070 - DNA, 25 bp, Mus musculus
tcctctggcaccctggcttgttgaa

SEQ ID NO: 38071 - DNA, 25 bp, Mus musculus
tctggcaccctggcttgttgaaagg

SEQ ID NO: 38072 - DNA, 25 bp, Mus musculus
aaggtggctttagctgtgtgctgtg

SEQ ID NO: 38073 - DNA, 25 bp, Mus musculus
tgctgtgtacctgcttacgtggcct

SEQ ID NO: 38074 - DNA, 25 bp, Mus musculus
gtacctgcttacgtggcctgctgtc

SEQ ID NO: 38075 - DNA, 25 bp, Mus musculus
ccaccacttagagacagctgaaatt

SEQ ID NO: 38076 - DNA, 25 bp, Mus musculus
gagcattaatccccctggaaataga

SEQ ID NO: 38077 - DNA, 25 bp, Mus musculus
atactttggctctcctgtaaatcaa

SEQ ID NO: 38078 - DNA, 25 bp, Mus musculus
tggctctcctgtaaatcaaatgttg

SEQ ID NO: 38079 - DNA, 25 bp, Mus musculus
ctctcctgtaaatcaaatgttgtga

SEQ ID NO: 38080 - DNA, 25 bp, Mus musculus
atttatacaagtacacactccactg

SEQ ID NO: 38081 - DNA, 25 bp, Mus musculus
tatacaagtacacactccactgaga

SEQ ID NO: 38082 - DNA, 25 bp, Mus musculus
acaagtacacactccactgagaatc

SEQ ID NO: 38083 - DNA, 25 bp, Mus musculus
acacactccactgagaatcgttttg

SEQ ID NO: 38084 - DNA, 25 bp, Mus musculus
tgctcgtttgtatcgtctgtgtata

SEQ ID NO: 38085 - DNA, 25 bp, Mus musculus
tcgtttgtatcgtctgtgtataaca

SEQ ID NO: 38086 - DNA, 25 bp, Mus musculus
tttgtatcgtctgtgtataacaagt

SEQ ID NO: 38087 - DNA, 25 bp, Mus musculus
gaaatatgcatcatacacaatattc

SEQ ID NO: 38088 - DNA, 25 bp, Mus musculus
atatgcatcatacacaatattcaat

SEQ ID NO: 38089 - DNA, 25 bp, Mus musculus
tgcatcatacacaatattcaatcta

SEQ ID NO: 38090 - DNA, 25 bp, Mus musculus
atacacaatattcaatctagattcc

SEQ ID NO: 38091 - DNA, 25 bp, Mus musculus
aatattcaatctagattccagtcta

SEQ ID NO: 38092 - DNA, 25 bp, Mus musculus
attcaatctagattccagtctatgg

SEQ ID NO: 38093 - DNA, 25 bp, Mus musculus
caatctagattccagtctatggggg

SEQ ID NO: 38094 - DNA, 25 bp, Mus musculus
ggtatactttggctctcctgtaaat

SEQ ID NO: 38095 - DNA, 25 bp, Mus musculus
tccatggctatccttgcacagcgct

SEQ ID NO: 38096 - DNA, 25 bp, Mus musculus
atggctatccttgcacagcgctgta

SEQ ID NO: 38097 - DNA, 25 bp, Mus musculus
attgctgtagttgctagagtcgtgc

SEQ ID NO: 38098 - DNA, 25 bp, Mus musculus
gttgctagagtcgtgcagagcattc

SEQ ID NO: 38099 - DNA, 25 bp, Mus musculus
gtgcagagcattctctatggcgact

SEQ ID NO: 38100 - DNA, 25 bp, Mus musculus
cagagcattctctatggcgactact

SEQ ID NO: 38101 - DNA, 25 bp, Mus musculus
agcattctctatggcgactacttct

SEQ ID NO: 38102 - DNA, 25 bp, Mus musculus
attctctatggcgactacttctaat

SEQ ID NO: 38103 - DNA, 25 bp, Mus musculus
ctctatggcgactacttctaattgt

SEQ ID NO: 38104 - DNA, 25 bp, Mus musculus
tatggcgactacttctaattgtaga

SEQ ID NO: 38105 - DNA, 25 bp, Mus musculus
ggcgactacttctaattgtagatta

SEQ ID NO: 38106 - DNA, 25 bp, Mus musculus
gactacttctaattgtagattacaa

SEQ ID NO: 38107 - DNA, 25 bp, Mus musculus
gctatccttgcacagcgctgtatga

SEQ ID NO: 38108 - DNA, 25 bp, Mus musculus
cactatgtattcttaatgggcctct

SEQ ID NO: 38109 - DNA, 25 bp, Mus musculus
gtattcttaatgggcctctacggcg

SEQ ID NO: 38110 - DNA, 25 bp, Mus musculus
tacggcgctctgtacatgatcaaat

SEQ ID NO: 38111 - DNA, 25 bp, Mus musculus
tactttgatctgattgctgtagttg

SEQ ID NO: 38112 - DNA, 25 bp, Mus musculus
tttgatctgattgctgtagttgcta

SEQ ID NO: 38113 - DNA, 25 bp, Mus musculus
gatctgattgctgtagttgctagag

SEQ ID NO: 38114 - DNA, 25 bp, Mus musculus
ctgattgctgtagttgctagagtcg

SEQ ID NO: 38115 - DNA, 25 bp, Mus musculus
agatcttcaggacagcagactctga

SEQ ID NO: 38116 - DNA, 25 bp, Mus musculus
tcaggacagcagactctgaaaagcc

SEQ ID NO: 38117 - DNA, 25 bp, Mus musculus
ctttcctgagtatgacagatgtggg

SEQ ID NO: 38118 - DNA, 25 bp, Mus musculus
gagagcccctggtctattctaattg

SEQ ID NO: 38119 - DNA, 25 bp, Mus musculus
agcccaacaacaatggtggagcaga

SEQ ID NO: 38120 - DNA, 25 bp, Mus musculus
agatcttcaccaatgggcaatggaa

SEQ ID NO: 38121 - DNA, 25 bp, Mus musculus
agcagcgccttgttatctgtgagtt

SEQ ID NO: 38122 - DNA, 25 bp, Mus musculus
ttatctgtgagttctgagccactgg

SEQ ID NO: 38123 - DNA, 25 bp, Mus musculus
tgtactatggctcagacctgtatgt

SEQ ID NO: 38124 - DNA, 25 bp, Mus musculus
atggctcagacctgtatgttgccaa

SEQ ID NO: 38125 - DNA, 25 bp, Mus musculus
tgtatgttgccaacatcctaataaa

SEQ ID NO: 38126 - DNA, 25 bp, Mus musculus
ttgccaacatcctaataaaaggtgt

SEQ ID NO: 38127 - DNA, 25 bp, Mus musculus
actctgaaaagccttttgaggatgc

SEQ ID NO: 38128 - DNA, 25 bp, Mus musculus
cttttgaggatgcccaggagatgtg

SEQ ID NO: 38129 - DNA, 25 bp, Mus musculus
aggatgcccaggagatgtgcaaaca

SEQ ID NO: 38130 - DNA, 25 bp, Mus musculus
cacgttctgctactgagaatgctgc

SEQ ID NO: 38131 - DNA, 25 bp, Mus musculus
atgctgccatacagcaactcatcac

SEQ ID NO: 38132 - DNA, 25 bp, Mus musculus
cagcccacaacaaggctgctttcct

SEQ ID NO: 38133 - DNA, 25 bp, Mus musculus
acaacaaggctgctttcctgagtat

SEQ ID NO: 38134 - DNA, 25 bp, Mus musculus
aggctgctttcctgagtatgacaga

SEQ ID NO: 38135 - DNA, 25 bp, Mus musculus
actgaagcagctgatgcgggagttt

SEQ ID NO: 38136 - DNA, 25 bp, Mus musculus
tgaagcagctgatgcgggagtttaa

SEQ ID NO: 38137 - DNA, 25 bp, Mus musculus
aggagatactcgatgcccgtgaaga

SEQ ID NO: 38138 - DNA, 25 bp, Mus musculus
gagatactcgatgcccgtgaagaag

SEQ ID NO: 38139 - DNA, 25 bp, Mus musculus
tactcgatgcccgtgaagaagaaat

SEQ ID NO: 38140 - DNA, 25 bp, Mus musculus
ctcgatgcccgtgaagaagaaatga

SEQ ID NO: 38141 - DNA, 25 bp, Mus musculus
tgacggacctgcagacccagctcga

SEQ ID NO: 38142 - DNA, 25 bp, Mus musculus
ggacctgcagacccagctcgaggag

SEQ ID NO: 38143 - DNA, 25 bp, Mus musculus
acctgcagacccagctcgaggagct

SEQ ID NO: 38144 - DNA, 25 bp, Mus musculus
acccagctcgaggagctccagaaga

SEQ ID NO: 38145 - DNA, 25 bp, Mus musculus
ccagctcgaggagctccagaagaaa

SEQ ID NO: 38146 - DNA, 25 bp, Mus musculus
agctcgaggagctccagaagaaata

SEQ ID NO: 38147 - DNA, 25 bp, Mus musculus
agtttaacacacaactggcacagaa

SEQ ID NO: 38148 - DNA, 25 bp, Mus musculus
tttaacacacaactggcacagaagg

SEQ ID NO: 38149 - DNA, 25 bp, Mus musculus
acacaactggcacagaaggagcagg

SEQ ID NO: 38150 - DNA, 25 bp, Mus musculus
accattgataaggcccaagaggtgg

SEQ ID NO: 38151 - DNA, 25 bp, Mus musculus
cattgataaggcccaagaggtggaa

SEQ ID NO: 38152 - DNA, 25 bp, Mus musculus
ttgataaggcccaagaggtggaagc

SEQ ID NO: 38153 - DNA, 25 bp, Mus musculus
gaacttctggaaagccaccaagaag

SEQ ID NO: 38154 - DNA, 25 bp, Mus musculus
acttctggaaagccaccaagaagag

SEQ ID NO: 38155 - DNA, 25 bp, Mus musculus
atatctcagttaatatcgtgctatc

SEQ ID NO: 38156 - DNA, 25 bp, Mus musculus
ttaatatcgtgctatcggtctgtta

SEQ ID NO: 38157 - DNA, 25 bp, Mus musculus
taatgcttggtggcactgtacccca

SEQ ID NO: 38158 - DNA, 25 bp, Mus musculus
atgcttggtggcactgtaccccagt

SEQ ID NO: 38159 - DNA, 25 bp, Mus musculus
gtggcactgtaccccagtgctccaa

SEQ ID NO: 38160 - DNA, 25 bp, Mus musculus
ggcactgtaccccagtgctccaagg

SEQ ID NO: 38161 - DNA, 25 bp, Mus musculus
gcactgtaccccagtgctccaaggg

SEQ ID NO: 38162 - DNA, 25 bp, Mus musculus
ctgtaccccagtgctccaaggggat

SEQ ID NO: 38163 - DNA, 25 bp, Mus musculus
agtgctccaaggggatttgtcctca

SEQ ID NO: 38164 - DNA, 25 bp, Mus musculus
gggatttgtcctcactagcggtctt

SEQ ID NO: 38165 - DNA, 25 bp, Mus musculus
ggatttgtcctcactagcggtcttt

SEQ ID NO: 38166 - DNA, 25 bp, Mus musculus
tgtcctcactagcggtcttttaaag

SEQ ID NO: 38167 - DNA, 25 bp, Mus musculus
aatatcgtgctatcggtctgttaca

SEQ ID NO: 38168 - DNA, 25 bp, Mus musculus
atatcgtgctatcggtctgttacaa

SEQ ID NO: 38169 - DNA, 25 bp, Mus musculus
gtgctatcggtctgttacaacctga

SEQ ID NO: 38170 - DNA, 25 bp, Mus musculus
ctatcggtctgttacaacctgatgc

SEQ ID NO: 38171 - DNA, 25 bp, Mus musculus
gattagaacatcttctacttcgacc

SEQ ID NO: 38172 - DNA, 25 bp, Mus musculus
attagaacatcttctacttcgacct

SEQ ID NO: 38173 - DNA, 25 bp, Mus musculus
tgaacagggatcccgaagggcaata

SEQ ID NO: 38174 - DNA, 25 bp, Mus musculus
ataatgcttggtggcactgtacccc

SEQ ID NO: 38175 - DNA, 25 bp, Mus musculus
catcagactctccttagaacaagcc

SEQ ID NO: 38176 - DNA, 25 bp, Mus musculus
tgagcctgttagcaagcttcggatt

SEQ ID NO: 38177 - DNA, 25 bp, Mus musculus
gagcacctttcctaggagagatgta

SEQ ID NO: 38178 - DNA, 25 bp, Mus musculus
aactcagctagaccccaataagtca

SEQ ID NO: 38179 - DNA, 25 bp, Mus musculus
gctagaccccaataagtcattattg

SEQ ID NO: 38180 - DNA, 25 bp, Mus musculus
tggaagcagccactcctgacgagcc

SEQ ID NO: 38181 - DNA, 25 bp, Mus musculus
ctcctgacgagccagcggcacgtgt

SEQ ID NO: 38182 - DNA, 25 bp, Mus musculus
acgagccagcggcacgtgtcaagag

SEQ ID NO: 38183 - DNA, 25 bp, Mus musculus
cagcggcacgtgtcaagagatgggc

SEQ ID NO: 38184 - DNA, 25 bp, Mus musculus
tcgtgtcactcagttcaatgtcaca

SEQ ID NO: 38185 - DNA, 25 bp, Mus musculus
cactcagttcaatgtcacacttctg

SEQ ID NO: 38186 - DNA, 25 bp, Mus musculus
gcctcttgcaagattgctggaaaaa

SEQ ID NO: 38187 - DNA, 25 bp, Mus musculus
tgttagcaagcttcggattcgaacc

SEQ ID NO: 38188 - DNA, 25 bp, Mus musculus
tcggattcgaacccccagtggcgag

SEQ ID NO: 38189 - DNA, 25 bp, Mus musculus
cctggccagcaataagctccagatt

SEQ ID NO: 38190 - DNA, 25 bp, Mus musculus
cagcaataagctccagattgtcttt

SEQ ID NO: 38191 - DNA, 25 bp, Mus musculus
taagctccagattgtctttgatttc

SEQ ID NO: 38192 - DNA, 25 bp, Mus musculus
tgatttcgtggcttccaagggattt

SEQ ID NO: 38193 - DNA, 25 bp, Mus musculus
ttccaagggatttccatgggatgaa

SEQ ID NO: 38194 - DNA, 25 bp, Mus musculus
gttactgagcacctttcctaggaga

SEQ ID NO: 38195 - DNA, 25 bp, Mus musculus
caaagcctacgacaacctcttcaag

SEQ ID NO: 38196 - DNA, 25 bp, Mus musculus
gcctacgacaacctcttcaagttgc

SEQ ID NO: 38197 - DNA, 25 bp, Mus musculus
ctgatcattcgctttgcagaggaaa

SEQ ID NO: 38198 - DNA, 25 bp, Mus musculus
gatcattcgctttgcagaggaaaat

SEQ ID NO: 38199 - DNA, 25 bp, Mus musculus
tcattcgctttgcagaggaaaattt

SEQ ID NO: 38200 - DNA, 25 bp, Mus musculus
attcgctttgcagaggaaaatttca

SEQ ID NO: 38201 - DNA, 25 bp, Mus musculus
aagcatttaaatctctaccatcgga

SEQ ID NO: 38202 - DNA, 25 bp, Mus musculus
gcatttaaatctctaccatcggaat

SEQ ID NO: 38203 - DNA, 25 bp, Mus musculus
atttaaatctctaccatcggaattg

SEQ ID NO: 38204 - DNA, 25 bp, Mus musculus
ttaaatctctaccatcggaattgat

SEQ ID NO: 38205 - DNA, 25 bp, Mus musculus
aaatctctaccatcggaattgattt

SEQ ID NO: 38206 - DNA, 25 bp, Mus musculus
ctctaccatcggaattgatttcaag

SEQ ID NO: 38207 - DNA, 25 bp, Mus musculus
gacaacctcttcaagttgctgctca

SEQ ID NO: 38208 - DNA, 25 bp, Mus musculus
caacctcttcaagttgctgctcatc

SEQ ID NO: 38209 - DNA, 25 bp, Mus musculus
ctcttcaagttgctgctcatcgggg

SEQ ID NO: 38210 - DNA, 25 bp, Mus musculus
cttcaagttgctgctcatcggggat

SEQ ID NO: 38211 - DNA, 25 bp, Mus musculus
agactggtctgatcattcgctttgc

SEQ ID NO: 38212 - DNA, 25 bp, Mus musculus
actggtctgatcattcgctttgcag

SEQ ID NO: 38213 - DNA, 25 bp, Mus musculus
tggtctgatcattcgctttgcagag

SEQ ID NO: 38214 - DNA, 25 bp, Mus musculus
gtctgatcattcgctttgcagagga

SEQ ID NO: 38215 - DNA, 25 bp, Mus musculus
tactcgaagctgttgcgggaaacaa

SEQ ID NO: 38216 - DNA, 25 bp, Mus musculus
ctcgaagctgttgcgggaaacaatc

SEQ ID NO: 38217 - DNA, 25 bp, Mus musculus
ttggtactacagtctggaagcaacc

SEQ ID NO: 38218 - DNA, 25 bp, Mus musculus
tactacagtctggaagcaaccagga

SEQ ID NO: 38219 - DNA, 25 bp, Mus musculus
agtctggaagcaaccaggagcccct

SEQ ID NO: 38220 - DNA, 25 bp, Mus musculus
ttttgtaaattccggccattgcatt

SEQ ID NO: 38221 - DNA, 25 bp, Mus musculus
ttgtaaattccggccattgcattta

SEQ ID NO: 38222 - DNA, 25 bp, Mus musculus
gtaaattccggccattgcatttaag

SEQ ID NO: 38223 - DNA, 25 bp, Mus musculus
aaattccggccattgcatttaagag

SEQ ID NO: 38224 - DNA, 25 bp, Mus musculus
attccggccattgcatttaagagac

SEQ ID NO: 38225 - DNA, 25 bp, Mus musculus
tccggccattgcatttaagagacca

SEQ ID NO: 38226 - DNA, 25 bp, Mus musculus
atttaagagaccatgcgcgtgtatt

SEQ ID NO: 38227 - DNA, 25 bp, Mus musculus
tgcataaatggcccggatgacggca

SEQ ID NO: 38228 - DNA, 25 bp, Mus musculus
ttaagagaccatgcgcgtgtattct

SEQ ID NO: 38229 - DNA, 25 bp, Mus musculus
cataaatggcccggatgacggcagt

SEQ ID NO: 38230 - DNA, 25 bp, Mus musculus
taaatggcccggatgacggcagtgt

SEQ ID NO: 38231 - DNA, 25 bp, Mus musculus
aatggcccggatgacggcagtgttg

SEQ ID NO: 38232 - DNA, 25 bp, Mus musculus
ttgccagtctggtcattggcccggt

SEQ ID NO: 38233 - DNA, 25 bp, Mus musculus
tcattggcccggtgttggtactaca

SEQ ID NO: 38234 - DNA, 25 bp, Mus musculus
tggcccggtgttggtactacagtct

SEQ ID NO: 38235 - DNA, 25 bp, Mus musculus
tgttggtactacagtctggaagcaa

SEQ ID NO: 38236 - DNA, 25 bp, Mus musculus
ccatgcgcacgcttgcagctcacga

SEQ ID NO: 38237 - DNA, 25 bp, Mus musculus
gatcaacagcatgctcatgacaatg

SEQ ID NO: 38238 - DNA, 25 bp, Mus musculus
gtgccacctgttggccatggcttcc

SEQ ID NO: 38239 - DNA, 25 bp, Mus musculus
ggccatggcttccacctgtgtcaac

SEQ ID NO: 38240 - DNA, 25 bp, Mus musculus
catctatggctttctcaacatcaac

SEQ ID NO: 38241 - DNA, 25 bp, Mus musculus
tggctttctcaacatcaacttcaag

SEQ ID NO: 38242 - DNA, 25 bp, Mus musculus
tatcaaggctctggtgctgacctgc

SEQ ID NO: 38243 - DNA, 25 bp, Mus musculus
ggtgctgacctgccattgcaggtca

SEQ ID NO: 38244 - DNA, 25 bp, Mus musculus
cctctccaagggatcgatgaggatg

SEQ ID NO: 38245 - DNA, 25 bp, Mus musculus
acacattgcaggctgtgatagcatc

SEQ ID NO: 38246 - DNA, 25 bp, Mus musculus
ctgtgatagcatcctgtcatttctg

SEQ ID NO: 38247 - DNA, 25 bp, Mus musculus
tagcatcctgtcatttctggctttt

SEQ ID NO: 38248 - DNA, 25 bp, Mus musculus
ggtgactgcctttgcagttctctgg

SEQ ID NO: 38249 - DNA, 25 bp, Mus musculus
aagcttggcattcagatggtttagc

SEQ ID NO: 38250 - DNA, 25 bp, Mus musculus
gctacccctgcatgtgttcaacact

SEQ ID NO: 38251 - DNA, 25 bp, Mus musculus
cctgcatgtgttcaacactctggag

SEQ ID NO: 38252 - DNA, 25 bp, Mus musculus
tgtgttcaacactctggaggactgg

SEQ ID NO: 38253 - DNA, 25 bp, Mus musculus
ggaagccatccctgcttgccatggc

SEQ ID NO: 38254 - DNA, 25 bp, Mus musculus
tgcttgccatggcaacctcatcttc

SEQ ID NO: 38255 - DNA, 25 bp, Mus musculus
ccatggcaacctcatcttcttgatg

SEQ ID NO: 38256 - DNA, 25 bp, Mus musculus
catcttcttgatgtgccacctgttg

SEQ ID NO: 38257 - DNA, 25 bp, Mus musculus
cccttcctgtatctggaccagtgac

SEQ ID NO: 38258 - DNA, 25 bp, Mus musculus
ccttcctgtatctggaccagtgaca

SEQ ID NO: 38259 - DNA, 25 bp, Mus musculus
gaccagtgacagctcctgttcccag

SEQ ID NO: 38260 - DNA, 25 bp, Mus musculus
accagtgacagctcctgttcccagg

SEQ ID NO: 38261 - DNA, 25 bp, Mus musculus
ccagtgacagctcctgttcccaggc

SEQ ID NO: 38262 - DNA, 25 bp, Mus musculus
cagtgacagctcctgttcccaggcc

SEQ ID NO: 38263 - DNA, 25 bp, Mus musculus
tcggccgtttcctcaggagaaggag

SEQ ID NO: 38264 - DNA, 25 bp, Mus musculus
ggccgtttcctcaggagaaggagct

SEQ ID NO: 38265 - DNA, 25 bp, Mus musculus
cgtttcctcaggagaaggagctaat

SEQ ID NO: 38266 - DNA, 25 bp, Mus musculus
gtttcctcaggagaaggagctaata

SEQ ID NO: 38267 - DNA, 25 bp, Mus musculus
tatcccaacttcgccaggtcctaga

SEQ ID NO: 38268 - DNA, 25 bp, Mus musculus
atcccaacttcgccaggtcctagag

SEQ ID NO: 38269 - DNA, 25 bp, Mus musculus
ttcctgtatctggaccagtgacagc

SEQ ID NO: 38270 - DNA, 25 bp, Mus musculus
cctgtatctggaccagtgacagctc

SEQ ID NO: 38271 - DNA, 25 bp, Mus musculus
ctgtatctggaccagtgacagctcc

SEQ ID NO: 38272 - DNA, 25 bp, Mus musculus
tgtatctggaccagtgacagctcct

SEQ ID NO: 38273 - DNA, 25 bp, Mus musculus
gtatctggaccagtgacagctcctg

SEQ ID NO: 38274 - DNA, 25 bp, Mus musculus
atctggaccagtgacagctcctgtt

SEQ ID NO: 38275 - DNA, 25 bp, Mus musculus
tctggaccagtgacagctcctgttc

SEQ ID NO: 38276 - DNA, 25 bp, Mus musculus
tggaccagtgacagctcctgttccc

SEQ ID NO: 38277 - DNA, 25 bp, Mus musculus
tccactcagtcctcagaatcgtggg

SEQ ID NO: 38278 - DNA, 25 bp, Mus musculus
cagtcctcagaatcgtggggtcagt

SEQ ID NO: 38279 - DNA, 25 bp, Mus musculus
atgtacatgcagcgattcattgaca

SEQ ID NO: 38280 - DNA, 25 bp, Mus musculus
tacatgcagcgattcattgacagtg

SEQ ID NO: 38281 - DNA, 25 bp, Mus musculus
ttcattgacagtgatgcgaaaatca

SEQ ID NO: 38282 - DNA, 25 bp, Mus musculus
atgtcctacccttgtgtgtttatgt

SEQ ID NO: 38283 - DNA, 25 bp, Mus musculus
atcatgagcattcgacaagacatga

SEQ ID NO: 38284 - DNA, 25 bp, Mus musculus
tgtgatctatggcaccaggaatctc

SEQ ID NO: 38285 - DNA, 25 bp, Mus musculus
ctatggcaccaggaatctctttgct

SEQ ID NO: 38286 - DNA, 25 bp, Mus musculus
tggcaccaggaatctctttgctggt

SEQ ID NO: 38287 - DNA, 25 bp, Mus musculus
gaatctctttgctggttcaacgtat

SEQ ID NO: 38288 - DNA, 25 bp, Mus musculus
tctctttgctggttcaacgtatgac

SEQ ID NO: 38289 - DNA, 25 bp, Mus musculus
tacctccgtctgatcattttcataa

SEQ ID NO: 38290 - DNA, 25 bp, Mus musculus
ctctttgctggttcaacgtatgaca

SEQ ID NO: 38291 - DNA, 25 bp, Mus musculus
cgtctgatcattttcataagcaaca

SEQ ID NO: 38292 - DNA, 25 bp, Mus musculus
ttcataagcaacagacttacatact

SEQ ID NO: 38293 - DNA, 25 bp, Mus musculus
ataagcaacagacttacatactccc

SEQ ID NO: 38294 - DNA, 25 bp, Mus musculus
agcaacagacttacatactccctta

SEQ ID NO: 38295 - DNA, 25 bp, Mus musculus
agacttacatactcccttactgtat

SEQ ID NO: 38296 - DNA, 25 bp, Mus musculus
cttacatactcccttactgtatatg

SEQ ID NO: 38297 - DNA, 25 bp, Mus musculus
aacatgtacatgcagcgattcattg

SEQ ID NO: 38298 - DNA, 25 bp, Mus musculus
gctcgtacaggtcatcaagaagacc

SEQ ID NO: 38299 - DNA, 25 bp, Mus musculus
caagaagaccgagtccgacgcagcg

SEQ ID NO: 38300 - DNA, 25 bp, Mus musculus
atcctttctgaatgggcacttctaa

SEQ ID NO: 38301 - DNA, 25 bp, Mus musculus
caacggcagtccccagtctggtctt

SEQ ID NO: 38302 - DNA, 25 bp, Mus musculus
ccggcccaatgttaatcaatgcaca

SEQ ID NO: 38303 - DNA, 25 bp, Mus musculus
tgttaatcaatgcacagcactctac

SEQ ID NO: 38304 - DNA, 25 bp, Mus musculus
atgcacagcactctacgttgcgttt

SEQ ID NO: 38305 - DNA, 25 bp, Mus musculus
cacagcactctacgttgcgtttata

SEQ ID NO: 38306 - DNA, 25 bp, Mus musculus
taacctcgaagtctgagcggtctgt

SEQ ID NO: 38307 - DNA, 25 bp, Mus musculus
cctcgaagtctgagcggtctgttcc

SEQ ID NO: 38308 - DNA, 25 bp, Mus musculus
aaatccctgaaaactaatctgcact

SEQ ID NO: 38309 - DNA, 25 bp, Mus musculus
tggcccaaggttagccatttaaatg

SEQ ID NO: 38310 - DNA, 25 bp, Mus musculus
agcgctgcacccactgttgcaagag

SEQ ID NO: 38311 - DNA, 25 bp, Mus musculus
gcacccactgttgcaagagatctac

SEQ ID NO: 38312 - DNA, 25 bp, Mus musculus
catgtactgatctttcctgagatgg

SEQ ID NO: 38313 - DNA, 25 bp, Mus musculus
gtactgatctttcctgagatggcag

SEQ ID NO: 38314 - DNA, 25 bp, Mus musculus
ctgatctttcctgagatggcaggcc

SEQ ID NO: 38315 - DNA, 25 bp, Mus musculus
gcaggccattaccactgttcaggga

SEQ ID NO: 38316 - DNA, 25 bp, Mus musculus
cattaccactgttcagggacctccg

SEQ ID NO: 38317 - DNA, 25 bp, Mus musculus
cactgttcagggacctccgaggcct

SEQ ID NO: 38318 - DNA, 25 bp, Mus musculus
ctcacattcaaacgacagttccagg

SEQ ID NO: 38319 - DNA, 25 bp, Mus musculus
acagttccaggttcgagaaccacag

SEQ ID NO: 38320 - DNA, 25 bp, Mus musculus
agtcgcacatggatgtggagaacac

SEQ ID NO: 38321 - DNA, 25 bp, Mus musculus
gatatgtgcaggctcgaatgggctg

SEQ ID NO: 38322 - DNA, 25 bp, Mus musculus
taagagttccgtacattccagattg

SEQ ID NO: 38323 - DNA, 25 bp, Mus musculus
aagagttccgtacattccagattgg

SEQ ID NO: 38324 - DNA, 25 bp, Mus musculus
gagttccgtacattccagattggtc

SEQ ID NO: 38325 - DNA, 25 bp, Mus musculus
gttccgtacattccagattggtcct

SEQ ID NO: 38326 - DNA, 25 bp, Mus musculus
ttccgtacattccagattggtcctg

SEQ ID NO: 38327 - DNA, 25 bp, Mus musculus
ccgtacattccagattggtcctgat

SEQ ID NO: 38328 - DNA, 25 bp, Mus musculus
cgtacattccagattggtcctgatg

SEQ ID NO: 38329 - DNA, 25 bp, Mus musculus
gtacattccagattggtcctgatgc

SEQ ID NO: 38330 - DNA, 25 bp, Mus musculus
cagttccaggttcgagaaccacaga

SEQ ID NO: 38331 - DNA, 25 bp, Mus musculus
tacattccagattggtcctgatgct

SEQ ID NO: 38332 - DNA, 25 bp, Mus musculus
gttccaggttcgagaaccacagagt

SEQ ID NO: 38333 - DNA, 25 bp, Mus musculus
ttccaggttcgagaaccacagagtc

SEQ ID NO: 38334 - DNA, 25 bp, Mus musculus
tccaggttcgagaaccacagagtcg

SEQ ID NO: 38335 - DNA, 25 bp, Mus musculus
gttcgagaaccacagagtcgcacat

SEQ ID NO: 38336 - DNA, 25 bp, Mus musculus
ttcgagaaccacagagtcgcacatg

SEQ ID NO: 38337 - DNA, 25 bp, Mus musculus
agagtcgcacatggatgtggagaac

SEQ ID NO: 38338 - DNA, 25 bp, Mus musculus
gagtcgcacatggatgtggagaaca

SEQ ID NO: 38339 - DNA, 25 bp, Mus musculus
acagcaccatgcctggaacagtaac

SEQ ID NO: 38340 - DNA, 25 bp, Mus musculus
cagtaacgtcatcctgttcccctgg

SEQ ID NO: 38341 - DNA, 25 bp, Mus musculus
agtcgtgccttccacatagggacag

SEQ ID NO: 38342 - DNA, 25 bp, Mus musculus
gccttccacatagggacagacactt

SEQ ID NO: 38343 - DNA, 25 bp, Mus musculus
ggagcaatggccactgctgaagagc

SEQ ID NO: 38344 - DNA, 25 bp, Mus musculus
caaacccatagtcttgccttctcct

SEQ ID NO: 38345 - DNA, 25 bp, Mus musculus
ttctcctggatccagagctttcgga

SEQ ID NO: 38346 - DNA, 25 bp, Mus musculus
tggatccagagctttcggagaacat

SEQ ID NO: 38347 - DNA, 25 bp, Mus musculus
taactgtgaccaaaggccgcactct

SEQ ID NO: 38348 - DNA, 25 bp, Mus musculus
tgaccaaaggccgcactcttgcctt

SEQ ID NO: 38349 - DNA, 25 bp, Mus musculus
aaggccgcactcttgccttgggctc

SEQ ID NO: 38350 - DNA, 25 bp, Mus musculus
gcactcttgccttgggctcttcatc

SEQ ID NO: 38351 - DNA, 25 bp, Mus musculus
ggccttcgtctcctggttcaggact

SEQ ID NO: 38352 - DNA, 25 bp, Mus musculus
tgccttgggctcttcatcacccgct

SEQ ID NO: 38353 - DNA, 25 bp, Mus musculus
cgtctcctggttcaggactccatgc

SEQ ID NO: 38354 - DNA, 25 bp, Mus musculus
gccccacagcatctcaaaataactc

SEQ ID NO: 38355 - DNA, 25 bp, Mus musculus
ctcaaaataactccaaagcagcaat

SEQ ID NO: 38356 - DNA, 25 bp, Mus musculus
ataactccaaagcagcaatgaactc

SEQ ID NO: 38357 - DNA, 25 bp, Mus musculus
ttaactcctcgggatcatggtaccg

SEQ ID NO: 38358 - DNA, 25 bp, Mus musculus
gatcatggtaccgttggaatcatcc

SEQ ID NO: 38359 - DNA, 25 bp, Mus musculus
gttggaatcatcctacctacctcca

SEQ ID NO: 38360 - DNA, 25 bp, Mus musculus
atcctcagtgcagtcggctccttcc

SEQ ID NO: 38361 - DNA, 25 bp, Mus musculus
agtgcagtcggctccttccgcatgc

SEQ ID NO: 38362 - DNA, 25 bp, Mus musculus
atccacgttaacatgagcactgttc

SEQ ID NO: 38363 - DNA, 25 bp, Mus musculus
gttaacatgagcactgttcggattc

SEQ ID NO: 38364 - DNA, 25 bp, Mus musculus
cggattcttcgctctctggaccaag

SEQ ID NO: 38365 - DNA, 25 bp, Mus musculus
gacacgtactggcttgtgggcagac

SEQ ID NO: 38366 - DNA, 25 bp, Mus musculus
cttgtgggcagacttggcttcaaca

SEQ ID NO: 38367 - DNA, 25 bp, Mus musculus
attcccaaaccacctgatctgcagc

SEQ ID NO: 38368 - DNA, 25 bp, Mus musculus
cctgatctgcagccaggggccagca

SEQ ID NO: 38369 - DNA, 25 bp, Mus musculus
ctgcagccaggggccagcaaccatg

SEQ ID NO: 38370 - DNA, 25 bp, Mus musculus
agcctgcaggagattcccccagaga

SEQ ID NO: 38371 - DNA, 25 bp, Mus musculus
attcccccagagagacgcaagaagc

SEQ ID NO: 38372 - DNA, 25 bp, Mus musculus
atgcccgaggtaccggtgcgcatcc

SEQ ID NO: 38373 - DNA, 25 bp, Mus musculus
ccggtgcgcatccgcattggtttgc

SEQ ID NO: 38374 - DNA, 25 bp, Mus musculus
cgcattggtttgcactcaggcccgt

SEQ ID NO: 38375 - DNA, 25 bp, Mus musculus
ggtttgcactcaggcccgtgcgtgg

SEQ ID NO: 38376 - DNA, 25 bp, Mus musculus
accatgcctcggtactgcctgttcg

SEQ ID NO: 38377 - DNA, 25 bp, Mus musculus
acggtcaacactgcctcgagaatgg

SEQ ID NO: 38378 - DNA, 25 bp, Mus musculus
actggactgccttaccgcatccacg

SEQ ID NO: 38379 - DNA, 25 bp, Mus musculus
taccgcatccacgttaacatgagca

SEQ ID NO: 38380 - DNA, 25 bp, Mus musculus
ggaccagccgcccagagaatgccat

SEQ ID NO: 38381 - DNA, 25 bp, Mus musculus
gccgcccagagaatgccattattta

SEQ ID NO: 38382 - DNA, 25 bp, Mus musculus
cagtgtctgctgccgtagtgggtga

SEQ ID NO: 38383 - DNA, 25 bp, Mus musculus
ctgctgccgtagtgggtgaacctgg

SEQ ID NO: 38384 - DNA, 25 bp, Mus musculus
ctcgcctggctgtcagccaagtacc

SEQ ID NO: 38385 - DNA, 25 bp, Mus musculus
tggctgtcagccaagtaccacgaag

SEQ ID NO: 38386 - DNA, 25 bp, Mus musculus
aagtaccacgaagtggcaagccagc

SEQ ID NO: 38387 - DNA, 25 bp, Mus musculus
gtggcaagccagctgagctactgaa

SEQ ID NO: 38388 - DNA, 25 bp, Mus musculus
agccagctgagctactgaagatgtt

SEQ ID NO: 38389 - DNA, 25 bp, Mus musculus
ccattgtgcaagctgtgaaaggcct

SEQ ID NO: 38390 - DNA, 25 bp, Mus musculus
gaactacacattccagggaggttct

SEQ ID NO: 38391 - DNA, 25 bp, Mus musculus
cacattccagggaggttctggcaga

SEQ ID NO: 38392 - DNA, 25 bp, Mus musculus
tccaggtcggccaagccaaggtggt

SEQ ID NO: 38393 - DNA, 25 bp, Mus musculus
ctctgcatgaggccttggctgctgc

SEQ ID NO: 38394 - DNA, 25 bp, Mus musculus
atgaggccttggctgctgcagagag

SEQ ID NO: 38395 - DNA, 25 bp, Mus musculus
ccttggctgctgcagagagtctaaa

SEQ ID NO: 38396 - DNA, 25 bp, Mus musculus
ataagatcagcatccgggtgctgga

SEQ ID NO: 38397 - DNA, 25 bp, Mus musculus
acaggaaactcatcctagactctgc

SEQ ID NO: 38398 - DNA, 25 bp, Mus musculus
tcctagactctgcccgagcaaccaa

SEQ ID NO: 38399 - DNA, 25 bp, Mus musculus
accactactacgaaggtggcatagg

SEQ ID NO: 38400 - DNA, 25 bp, Mus musculus
ttatgcctttgtgaagcttaaggaa

SEQ ID NO: 38401 - DNA, 25 bp, Mus musculus
ctacatccccatcttttagcattct

SEQ ID NO: 38402 - DNA, 25 bp, Mus musculus
ccagcttccatgaccccttctggga

SEQ ID NO: 38403 - DNA, 25 bp, Mus musculus
gcttccatgaccccttctgggacta

SEQ ID NO: 38404 - DNA, 25 bp, Mus musculus
agattccctccagagcagagaggcc

SEQ ID NO: 38405 - DNA, 25 bp, Mus musculus
cagccctatgtttacagccactgac

SEQ ID NO: 38406 - DNA, 25 bp, Mus musculus
agccactgacatgtctaagaaactt

SEQ ID NO: 38407 - DNA, 25 bp, Mus musculus
tgtatgactttcatgtccctcctta

SEQ ID NO: 38408 - DNA, 25 bp, Mus musculus
acccctgggacagtgtcataggtca

SEQ ID NO: 38409 - DNA, 25 bp, Mus musculus
gtgtcataggtcatccccagaacct

SEQ ID NO: 38410 - DNA, 25 bp, Mus musculus
tcataggtcatccccagaacctgtg

SEQ ID NO: 38411 - DNA, 25 bp, Mus musculus
cccagaacctgtgggaagagtagag

SEQ ID NO: 38412 - DNA, 25 bp, Mus musculus
catccccatcttttagcattctaac

SEQ ID NO: 38413 - DNA, 25 bp, Mus musculus
catcttttagcattctaacttaagg

SEQ ID NO: 38414 - DNA, 25 bp, Mus musculus
gcccagggctcacttgtctgacctg

SEQ ID NO: 38415 - DNA, 25 bp, Mus musculus
tgacctggtgaggtgtagcattgtc

SEQ ID NO: 38416 - DNA, 25 bp, Mus musculus
gtgtagcattgtcctgggattgttt

SEQ ID NO: 38417 - DNA, 25 bp, Mus musculus
tagcattgtcctgggattgtttgcc

SEQ ID NO: 38418 - DNA, 25 bp, Mus musculus
cattgtcctgggattgtttgcccag

SEQ ID NO: 38419 - DNA, 25 bp, Mus musculus
attgtttgcccagcttccatgaccc

SEQ ID NO: 38420 - DNA, 25 bp, Mus musculus
gctggagccccctggatatgtttct

SEQ ID NO: 38421 - DNA, 25 bp, Mus musculus
ttcgttctttgctggcagaacccat

SEQ ID NO: 38422 - DNA, 25 bp, Mus musculus
gatcctctaaaacaggagagagagc

SEQ ID NO: 38423 - DNA, 25 bp, Mus musculus
tgttgcctaactctggggaatcgta

SEQ ID NO: 38424 - DNA, 25 bp, Mus musculus
aatcgtactccacagctagcagaga

SEQ ID NO: 38425 - DNA, 25 bp, Mus musculus
cccagtaatcatcaagaccaccatt

SEQ ID NO: 38426 - DNA, 25 bp, Mus musculus
aatcatcaagaccaccatttttgtc

SEQ ID NO: 38427 - DNA, 25 bp, Mus musculus
ttagcagtaactgccaccttgctgg

SEQ ID NO: 38428 - DNA, 25 bp, Mus musculus
gatgtggcccacttgcaaaatgggc

SEQ ID NO: 38429 - DNA, 25 bp, Mus musculus
ttcctcctcttaagacttgagcaga

SEQ ID NO: 38430 - DNA, 25 bp, Mus musculus
ctcttaagacttgagcagaggccat

SEQ ID NO: 38431 - DNA, 25 bp, Mus musculus
agacttgagcagaggccatggttta

SEQ ID NO: 38432 - DNA, 25 bp, Mus musculus
ttctcctagaaaacactatatctgg

SEQ ID NO: 38433 - DNA, 25 bp, Mus musculus
acactatatctggtacacgggctga

SEQ ID NO: 38434 - DNA, 25 bp, Mus musculus
tatctggtacacgggctgagagagg

SEQ ID NO: 38435 - DNA, 25 bp, Mus musculus
caacttctttcactgcccaagaaat

SEQ ID NO: 38436 - DNA, 25 bp, Mus musculus
ctttcactgcccaagaaattcaaat

SEQ ID NO: 38437 - DNA, 25 bp, Mus musculus
tgcttcagcaatccaggaggaaagc

SEQ ID NO: 38438 - DNA, 25 bp, Mus musculus
actgcctctgtccaatgcctgaaga

SEQ ID NO: 38439 - DNA, 25 bp, Mus musculus
caatgcctgaagactctggggatga

SEQ ID NO: 38440 - DNA, 25 bp, Mus musculus
gaattcctggaggcaatgctgtgca

SEQ ID NO: 38441 - DNA, 25 bp, Mus musculus
attcctggaggcaatgctgtgcact

SEQ ID NO: 38442 - DNA, 25 bp, Mus musculus
tgaaccctgaatccaacacctcggg

SEQ ID NO: 38443 - DNA, 25 bp, Mus musculus
ccctgaatccaacacctcgggactg

SEQ ID NO: 38444 - DNA, 25 bp, Mus musculus
ctgaatccaacacctcgggactgga

SEQ ID NO: 38445 - DNA, 25 bp, Mus musculus
gaatccaacacctcgggactggaca

SEQ ID NO: 38446 - DNA, 25 bp, Mus musculus
atccaacacctcgggactggacata

SEQ ID NO: 38447 - DNA, 25 bp, Mus musculus
ccaacacctcgggactggacatatt

SEQ ID NO: 38448 - DNA, 25 bp, Mus musculus
aacacctcgggactggacatatttg

SEQ ID NO: 38449 - DNA, 25 bp, Mus musculus
cacctcgggactggacatatttgca

SEQ ID NO: 38450 - DNA, 25 bp, Mus musculus
aaagttatctgcatacatcatgaaa

SEQ ID NO: 38451 - DNA, 25 bp, Mus musculus
agttatctgcatacatcatgaaatc

SEQ ID NO: 38452 - DNA, 25 bp, Mus musculus
gcaatgctgtgcactcacaggtacc

SEQ ID NO: 38453 - DNA, 25 bp, Mus musculus
atctgcatacatcatgaaatcaaac

SEQ ID NO: 38454 - DNA, 25 bp, Mus musculus
aatgctgtgcactcacaggtaccca

SEQ ID NO: 38455 - DNA, 25 bp, Mus musculus
tgctgtgcactcacaggtacccaaa

SEQ ID NO: 38456 - DNA, 25 bp, Mus musculus
gtgcactcacaggtacccaaagctg

SEQ ID NO: 38457 - DNA, 25 bp, Mus musculus
tcacaggtacccaaagctggctgca

SEQ ID NO: 38458 - DNA, 25 bp, Mus musculus
aggtacccaaagctggctgcactga

SEQ ID NO: 38459 - DNA, 25 bp, Mus musculus
gtacccaaagctggctgcactgaac

SEQ ID NO: 38460 - DNA, 25 bp, Mus musculus
actgaaccctgaatccaacacctcg

SEQ ID NO: 38461 - DNA, 25 bp, Mus musculus
cggccacagcgatgaccggcagaga

SEQ ID NO: 38462 - DNA, 25 bp, Mus musculus
ggccacagcgatgaccggcagagat

SEQ ID NO: 38463 - DNA, 25 bp, Mus musculus
tggctgcaaccaactctataattct

SEQ ID NO: 38464 - DNA, 25 bp, Mus musculus
ggctgcaaccaactctataattcta

SEQ ID NO: 38465 - DNA, 25 bp, Mus musculus
ctgcaaccaactctataattctatt

SEQ ID NO: 38466 - DNA, 25 bp, Mus musculus
tgcaaccaactctataattctattc

SEQ ID NO: 38467 - DNA, 25 bp, Mus musculus
caaccaactctataattctattcct

SEQ ID NO: 38468 - DNA, 25 bp, Mus musculus
ccaactctataattctattcctcaa

SEQ ID NO: 38469 - DNA, 25 bp, Mus musculus
caactctataattctattcctcaac

SEQ ID NO: 38470 - DNA, 25 bp, Mus musculus
actctataattctattcctcaacaa

SEQ ID NO: 38471 - DNA, 25 bp, Mus musculus
taattctattcctcaacaagcaaag

SEQ ID NO: 38472 - DNA, 25 bp, Mus musculus
aattctattcctcaacaagcaaagc

SEQ ID NO: 38473 - DNA, 25 bp, Mus musculus
ccacagcgatgaccggcagagatgg

SEQ ID NO: 38474 - DNA, 25 bp, Mus musculus
cagcgatgaccggcagagatggatc

SEQ ID NO: 38475 - DNA, 25 bp, Mus musculus
agcgatgaccggcagagatggatcc

SEQ ID NO: 38476 - DNA, 25 bp, Mus musculus
gacaacacaagactaaacgcctgca

SEQ ID NO: 38477 - DNA, 25 bp, Mus musculus
caacacaagactaaacgcctgcagg

SEQ ID NO: 38478 - DNA, 25 bp, Mus musculus
aacacaagactaaacgcctgcagga

SEQ ID NO: 38479 - DNA, 25 bp, Mus musculus
acaacaaatggctgcaaccaactct

SEQ ID NO: 38480 - DNA, 25 bp, Mus musculus
aatggctgcaaccaactctataatt

SEQ ID NO: 38481 - DNA, 25 bp, Mus musculus
atgctgtcttaactacgatgctcaa

SEQ ID NO: 38482 - DNA, 25 bp, Mus musculus
tcttaactacgatgctcaatgatta

SEQ ID NO: 38483 - DNA, 25 bp, Mus musculus
tggtctacagactttaactcaagct

SEQ ID NO: 38484 - DNA, 25 bp, Mus musculus
acagactttaactcaagctaagact

SEQ ID NO: 38485 - DNA, 25 bp, Mus musculus
taagactaaacttgctactttgttg

SEQ ID NO: 38486 - DNA, 25 bp, Mus musculus
taaacttgctactttgttgaatgat

SEQ ID NO: 38487 - DNA, 25 bp, Mus musculus
tgtatcaactgaactgaatgtttgc

SEQ ID NO: 38488 - DNA, 25 bp, Mus musculus
actgaatgtttgcctttcagcaaca

SEQ ID NO: 38489 - DNA, 25 bp, Mus musculus
tgtttgcctttcagcaacaactttc

SEQ ID NO: 38490 - DNA, 25 bp, Mus musculus
tgtttaactcaccaacttggtgtat

SEQ ID NO: 38491 - DNA, 25 bp, Mus musculus
actcaccaacttggtgtataatgaa

SEQ ID NO: 38492 - DNA, 25 bp, Mus musculus
caccaacttggtgtataatgaagac

SEQ ID NO: 38493 - DNA, 25 bp, Mus musculus
tgcttgacccctttcttctgaagcc

SEQ ID NO: 38494 - DNA, 25 bp, Mus musculus
acccctttcttctgaagccatcaat

SEQ ID NO: 38495 - DNA, 25 bp, Mus musculus
ttcttctgaagccatcaatacgaag

SEQ ID NO: 38496 - DNA, 25 bp, Mus musculus
accggcctctcaacagctaacatag

SEQ ID NO: 38497 - DNA, 25 bp, Mus musculus
ctctcaacagctaacatagggtttg

SEQ ID NO: 38498 - DNA, 25 bp, Mus musculus
agcattagatcctttgtagcaatct

SEQ ID NO: 38499 - DNA, 25 bp, Mus musculus
agatcctttgtagcaatctggtcta

SEQ ID NO: 38500 - DNA, 25 bp, Mus musculus
gcaatctggtctacagactttaact

SEQ ID NO: 38501 - DNA, 25 bp, Mus musculus
cagtggcagcctggtgtccatgcag

SEQ ID NO: 38502 - DNA, 25 bp, Mus musculus
cctggtgtccatgcaggacgaggcc

SEQ ID NO: 38503 - DNA, 25 bp, Mus musculus
gcaaagctagatcccgtgcttaagt

SEQ ID NO: 38504 - DNA, 25 bp, Mus musculus
aagctagatcccgtgcttaagtgag

SEQ ID NO: 38505 - DNA, 25 bp, Mus musculus
gatcccgtgcttaagtgagccaccg

SEQ ID NO: 38506 - DNA, 25 bp, Mus musculus
gtgtgacatcccagcttccatctcc

SEQ ID NO: 38507 - DNA, 25 bp, Mus musculus
ttccatctccagcactgagggtgag

SEQ ID NO: 38508 - DNA, 25 bp, Mus musculus
catctccagcactgagggtgagaac

SEQ ID NO: 38509 - DNA, 25 bp, Mus musculus
tgagaactgcgcgctttatcacttg

SEQ ID NO: 38510 - DNA, 25 bp, Mus musculus
gaactgcgcgctttatcacttgtcc

SEQ ID NO: 38511 - DNA, 25 bp, Mus musculus
ctgcgcgctttatcacttgtccacg

SEQ ID NO: 38512 - DNA, 25 bp, Mus musculus
gccccatcatgtgtcaggcacagct

SEQ ID NO: 38513 - DNA, 25 bp, Mus musculus
ggtgtccatgcaggacgaggccttc

SEQ ID NO: 38514 - DNA, 25 bp, Mus musculus
tcatgtgtcaggcacagctctctat

SEQ ID NO: 38515 - DNA, 25 bp, Mus musculus
gaacaacagttcctcactgtgaccc

SEQ ID NO: 38516 - DNA, 25 bp, Mus musculus
caacagttcctcactgtgacccagg

SEQ ID NO: 38517 - DNA, 25 bp, Mus musculus
ttcctcactgtgacccaggttggtg

SEQ ID NO: 38518 - DNA, 25 bp, Mus musculus
acccaggttggtgctgtggctccat

SEQ ID NO: 38519 - DNA, 25 bp, Mus musculus
gctgtggctccatgtgcaaagctag

SEQ ID NO: 38520 - DNA, 25 bp, Mus musculus
gtggctccatgtgcaaagctagatc

SEQ ID NO: 38521 - DNA, 25 bp, Mus musculus
gctccatgtgcaaagctagatcccg

SEQ ID NO: 38522 - DNA, 25 bp, Mus musculus
tttttggctggagcaggttcatccc

SEQ ID NO: 38523 - DNA, 25 bp, Mus musculus
gcctgcagtgctcctgtggcccaga

SEQ ID NO: 38524 - DNA, 25 bp, Mus musculus
aagagtctgctacgacacaaaaggc

SEQ ID NO: 38525 - DNA, 25 bp, Mus musculus
ctgctacgacacaaaaggctgaacg

SEQ ID NO: 38526 - DNA, 25 bp, Mus musculus
tgggatccttctgtctctgctacgt

SEQ ID NO: 38527 - DNA, 25 bp, Mus musculus
tgccctatgctgccctggccatgta

SEQ ID NO: 38528 - DNA, 25 bp, Mus musculus
atgctgccctggccatgtacatggt

SEQ ID NO: 38529 - DNA, 25 bp, Mus musculus
ccctggccatgtacatggtcaacaa

SEQ ID NO: 38530 - DNA, 25 bp, Mus musculus
ccttcttttccaagagctcctgtgt

SEQ ID NO: 38531 - DNA, 25 bp, Mus musculus
acgaatctgacgtgtctggctctca

SEQ ID NO: 38532 - DNA, 25 bp, Mus musculus
ctgacgtgtctggctctcagaaaac

SEQ ID NO: 38533 - DNA, 25 bp, Mus musculus
ctgtctcttctagcaaagttggccc

SEQ ID NO: 38534 - DNA, 25 bp, Mus musculus
cctgtggcccagactggtacactgt

SEQ ID NO: 38535 - DNA, 25 bp, Mus musculus
gcccagactggtacactgtgggcac

SEQ ID NO: 38536 - DNA, 25 bp, Mus musculus
actggtacactgtgggcaccaagta

SEQ ID NO: 38537 - DNA, 25 bp, Mus musculus
gcgagtactacacctggttcctctt

SEQ ID NO: 38538 - DNA, 25 bp, Mus musculus
actacacctggttcctcttcatctt

SEQ ID NO: 38539 - DNA, 25 bp, Mus musculus
cctactcccagttgctgaggactct

SEQ ID NO: 38540 - DNA, 25 bp, Mus musculus
tcagagctgtggcagctcagcagca

SEQ ID NO: 38541 - DNA, 25 bp, Mus musculus
ctgtggcagctcagcagcaagagtc

SEQ ID NO: 38542 - DNA, 25 bp, Mus musculus
actgcgaccatggcgacccctggca

SEQ ID NO: 38543 - DNA, 25 bp, Mus musculus
tcctccgtcctggcgagcaagacca

SEQ ID NO: 38544 - DNA, 25 bp, Mus musculus
ctgagccacgttcaaatccctgtca

SEQ ID NO: 38545 - DNA, 25 bp, Mus musculus
gttcaaatccctgtcatgttgatgc

SEQ ID NO: 38546 - DNA, 25 bp, Mus musculus
atccctgtcatgttgatgcctgatg

SEQ ID NO: 38547 - DNA, 25 bp, Mus musculus
cctgtcatgttgatgcctgatgact

SEQ ID NO: 38548 - DNA, 25 bp, Mus musculus
gtcatgttgatgcctgatgacttca

SEQ ID NO: 38549 - DNA, 25 bp, Mus musculus
ttgatgcctgatgacttcaaagcct

SEQ ID NO: 38550 - DNA, 25 bp, Mus musculus
atgcctgatgacttcaaagcctact

SEQ ID NO: 38551 - DNA, 25 bp, Mus musculus
cctgatgacttcaaagcctactcaa

SEQ ID NO: 38552 - DNA, 25 bp, Mus musculus
gatgacttcaaagcctactcaagag

SEQ ID NO: 38553 - DNA, 25 bp, Mus musculus
gacttcaaagcctactcaagagata

SEQ ID NO: 38554 - DNA, 25 bp, Mus musculus
tccgtcctggcgagcaagaccaaga

SEQ ID NO: 38555 - DNA, 25 bp, Mus musculus
ttcaaagcctactcaagagataaga

SEQ ID NO: 38556 - DNA, 25 bp, Mus musculus
gtcctggcgagcaagaccaagacga

SEQ ID NO: 38557 - DNA, 25 bp, Mus musculus
cacttcgtggctcagaaagtgaagc

SEQ ID NO: 38558 - DNA, 25 bp, Mus musculus
ggggtcaaccattcgatcaatgaac

SEQ ID NO: 38559 - DNA, 25 bp, Mus musculus
gtcaaccattcgatcaatgaactga

SEQ ID NO: 38560 - DNA, 25 bp, Mus musculus
aaccattcgatcaatgaactgagcc

SEQ ID NO: 38561 - DNA, 25 bp, Mus musculus
cattcgatcaatgaactgagccacg

SEQ ID NO: 38562 - DNA, 25 bp, Mus musculus
aatgaactgagccacgttcaaatcc

SEQ ID NO: 38563 - DNA, 25 bp, Mus musculus
aaactgctcaagaacagagatattt

SEQ ID NO: 38564 - DNA, 25 bp, Mus musculus
acattgccagtgacactacagagaa

SEQ ID NO: 38565 - DNA, 25 bp, Mus musculus
gacttggtgccgatttagagagaag

SEQ ID NO: 38566 - DNA, 25 bp, Mus musculus
agcttttgcagcatcaacgtgtatt

SEQ ID NO: 38567 - DNA, 25 bp, Mus musculus
tgcagcatcaacgtgtatttgtcgc

SEQ ID NO: 38568 - DNA, 25 bp, Mus musculus
ttgtcgcttatttcccctgcagcaa

SEQ ID NO: 38569 - DNA, 25 bp, Mus musculus
ccagtactgacctaatttggatcta

SEQ ID NO: 38570 - DNA, 25 bp, Mus musculus
gctgcaaaggctcctttgcctttct

SEQ ID NO: 38571 - DNA, 25 bp, Mus musculus
attgttcttacaagtttctgatcaa

SEQ ID NO: 38572 - DNA, 25 bp, Mus musculus
agtttctgatcaaaatcccgtgaat

SEQ ID NO: 38573 - DNA, 25 bp, Mus musculus
tgatcaaaatcccgtgaatctaaat

SEQ ID NO: 38574 - DNA, 25 bp, Mus musculus
tcaaaatcccgtgaatctaaattat

SEQ ID NO: 38575 - DNA, 25 bp, Mus musculus
actcctttgggaattgctatagaat

SEQ ID NO: 38576 - DNA, 25 bp, Mus musculus
tctttaatggacttcatcggctgaa

SEQ ID NO: 38577 - DNA, 25 bp, Mus musculus
atggacttcatcggctgaacctagg

SEQ ID NO: 38578 - DNA, 25 bp, Mus musculus
ttcatcggctgaacctaggatctgg

SEQ ID NO: 38579 - DNA, 25 bp, Mus musculus
gtgaatcccacaaaaatcagagcat

SEQ ID NO: 38580 - DNA, 25 bp, Mus musculus
cccacaaaaatcagagcatgctaca

SEQ ID NO: 38581 - DNA, 25 bp, Mus musculus
agaacagatgccctcatcaccaagg

SEQ ID NO: 38582 - DNA, 25 bp, Mus musculus
gatgccctcatcaccaaggacttgg

SEQ ID NO: 38583 - DNA, 25 bp, Mus musculus
cagttctcctcaagcagtgagctct

SEQ ID NO: 38584 - DNA, 25 bp, Mus musculus
tcctcaagcagtgagctctacctgc

SEQ ID NO: 38585 - DNA, 25 bp, Mus musculus
gtcaacgagcacgctcgcagactga

SEQ ID NO: 38586 - DNA, 25 bp, Mus musculus
gagcacgctcgcagactgattgagc

SEQ ID NO: 38587 - DNA, 25 bp, Mus musculus
cttttaagcaagatcacctttgaca

SEQ ID NO: 38588 - DNA, 25 bp, Mus musculus
agcaagatcacctttgacaaatgta

SEQ ID NO: 38589 - DNA, 25 bp, Mus musculus
ttcttcgtgtgtcaagtatgtggct

SEQ ID NO: 38590 - DNA, 25 bp, Mus musculus
caagtatgtggctttcggagcagac

SEQ ID NO: 38591 - DNA, 25 bp, Mus musculus
tgtggctttcggagcagacttcaca

SEQ ID NO: 38592 - DNA, 25 bp, Mus musculus
tttcggagcagacttcacacaaatg

SEQ ID NO: 38593 - DNA, 25 bp, Mus musculus
agcagacttcacacaaatgtcaaca

SEQ ID NO: 38594 - DNA, 25 bp, Mus musculus
cttcacacaaatgtcaacagacacg

SEQ ID NO: 38595 - DNA, 25 bp, Mus musculus
agcagtgagctctacctgcacttcc

SEQ ID NO: 38596 - DNA, 25 bp, Mus musculus
tacctgcacttccaggagcatagcc

SEQ ID NO: 38597 - DNA, 25 bp, Mus musculus
cacttccaggagcatagccgtgatg

SEQ ID NO: 38598 - DNA, 25 bp, Mus musculus
gagcagtacctgtgccagttctgtg

SEQ ID NO: 38599 - DNA, 25 bp, Mus musculus
tacctgtgccagttctgtgagcacg

SEQ ID NO: 38600 - DNA, 25 bp, Mus musculus
tgccagttctgtgagcacgagacag

SEQ ID NO: 38601 - DNA, 25 bp, Mus musculus
gacttgcacagccacgttgtcaacg

SEQ ID NO: 38602 - DNA, 25 bp, Mus musculus
cacagccacgttgtcaacgagcacg

SEQ ID NO: 38603 - DNA, 25 bp, Mus musculus
tcatctttgctgcttatagtttcac

SEQ ID NO: 38604 - DNA, 25 bp, Mus musculus
tctttgctgcttatagtttcacaag

SEQ ID NO: 38605 - DNA, 25 bp, Mus musculus
ctgttgttatcctcgttgtccacgt

SEQ ID NO: 38606 - DNA, 25 bp, Mus musculus
ttgttatcctcgttgtccacgtctc

SEQ ID NO: 38607 - DNA, 25 bp, Mus musculus
ttatcctcgttgtccacgtctccgt

SEQ ID NO: 38608 - DNA, 25 bp, Mus musculus
cgtaatcggccattttgcttctcct

SEQ ID NO: 38609 - DNA, 25 bp, Mus musculus
aatcggccattttgcttctcctgtt

SEQ ID NO: 38610 - DNA, 25 bp, Mus musculus
ctttcttcttgtagaatatcagcaa

SEQ ID NO: 38611 - DNA, 25 bp, Mus musculus
aattcatgggcatcttgttgcatgt

SEQ ID NO: 38612 - DNA, 25 bp, Mus musculus
tcatgggcatcttgttgcatgtagt

SEQ ID NO: 38613 - DNA, 25 bp, Mus musculus
gcatcttgttgcatgtagttgtcaa

SEQ ID NO: 38614 - DNA, 25 bp, Mus musculus
tagttgtcaaacagctcgttttctt

SEQ ID NO: 38615 - DNA, 25 bp, Mus musculus
ttgctgcttatagtttcacaagtaa

SEQ ID NO: 38616 - DNA, 25 bp, Mus musculus
agacacctggtttcattagttaatg

SEQ ID NO: 38617 - DNA, 25 bp, Mus musculus
ttagttaatgttccctgaaagatct

SEQ ID NO: 38618 - DNA, 25 bp, Mus musculus
gttaatgttccctgaaagatctcgt

SEQ ID NO: 38619 - DNA, 25 bp, Mus musculus
aatgttccctgaaagatctcgtgga

SEQ ID NO: 38620 - DNA, 25 bp, Mus musculus
tgaaagatctcgtggacccaggttg

SEQ ID NO: 38621 - DNA, 25 bp, Mus musculus
gttgggtctggtgtgctgttgttat

SEQ ID NO: 38622 - DNA, 25 bp, Mus musculus
gtgctgttgttatcctcgttgtcca

SEQ ID NO: 38623 - DNA, 25 bp, Mus musculus
tgaatctgtgtagtctctgacccta

SEQ ID NO: 38624 - DNA, 25 bp, Mus musculus
atctgtgtagtctctgaccctaagt

SEQ ID NO: 38625 - DNA, 25 bp, Mus musculus
ttgcattttgctcttcatttccgca

SEQ ID NO: 38626 - DNA, 25 bp, Mus musculus
tttgctcttcatttccgcatgtgtg

SEQ ID NO: 38627 - DNA, 25 bp, Mus musculus
gctcttcatttccgcatgtgtgtgg

SEQ ID NO: 38628 - DNA, 25 bp, Mus musculus
aagtctgtccagtagagtgattttg

SEQ ID NO: 38629 - DNA, 25 bp, Mus musculus
gctttcattattaccaagtcaaggt

SEQ ID NO: 38630 - DNA, 25 bp, Mus musculus
catgcgaagcagggctgtgaactat

SEQ ID NO: 38631 - DNA, 25 bp, Mus musculus
tgtgaactatcaccacacagtgcat

SEQ ID NO: 38632 - DNA, 25 bp, Mus musculus
ctatcaccacacagtgcattgtccc

SEQ ID NO: 38633 - DNA, 25 bp, Mus musculus
tcaccacacagtgcattgtcccgtg

SEQ ID NO: 38634 - DNA, 25 bp, Mus musculus
agtgcattgtcccgtggaggtgtga

SEQ ID NO: 38635 - DNA, 25 bp, Mus musculus
ctttggtgtcagggtcctgtggagt

SEQ ID NO: 38636 - DNA, 25 bp, Mus musculus
aagtccaccctgtggtgtcatttct

SEQ ID NO: 38637 - DNA, 25 bp, Mus musculus
ctgagctctgtacagtattgctgct

SEQ ID NO: 38638 - DNA, 25 bp, Mus musculus
gtacagtattgctgctcatacactg

SEQ ID NO: 38639 - DNA, 25 bp, Mus musculus
tattgctgctcatacactgaggagg

SEQ ID NO: 38640 - DNA, 25 bp, Mus musculus
atgaactacactgcttggtcacacg

SEQ ID NO: 38641 - DNA, 25 bp, Mus musculus
aactacactgcttggtcacacgctg

SEQ ID NO: 38642 - DNA, 25 bp, Mus musculus
actgcttggtcacacgctgggatca

SEQ ID NO: 38643 - DNA, 25 bp, Mus musculus
atcttaagcagttattcttgccaag

SEQ ID NO: 38644 - DNA, 25 bp, Mus musculus
tattcctggacggttaccctgcaca

SEQ ID NO: 38645 - DNA, 25 bp, Mus musculus
tgagtggtcgcattggttcatgtcc

SEQ ID NO: 38646 - DNA, 25 bp, Mus musculus
tatactttctctcgcggttcgccgc

SEQ ID NO: 38647 - DNA, 25 bp, Mus musculus
gccgcgatcgtcgattgttccgcgt

SEQ ID NO: 38648 - DNA, 25 bp, Mus musculus
cgatcgtcgattgttccgcgtcgtt

SEQ ID NO: 38649 - DNA, 25 bp, Mus musculus
atcgtcgattgttccgcgtcgttgt

SEQ ID NO: 38650 - DNA, 25 bp, Mus musculus
cgtcgttgtaccctggtggcatcag

SEQ ID NO: 38651 - DNA, 25 bp, Mus musculus
tcgttgtaccctggtggcatcagcc

SEQ ID NO: 38652 - DNA, 25 bp, Mus musculus
gttgtaccctggtggcatcagcctt

SEQ ID NO: 38653 - DNA, 25 bp, Mus musculus
tgtaccctggtggcatcagccttta

SEQ ID NO: 38654 - DNA, 25 bp, Mus musculus
taccctggtggcatcagcctttagt

SEQ ID NO: 38655 - DNA, 25 bp, Mus musculus
ccctggtggcatcagcctttagtcg

SEQ ID NO: 38656 - DNA, 25 bp, Mus musculus
tggtcgcattggttcatgtccgctg

SEQ ID NO: 38657 - DNA, 25 bp, Mus musculus
gtcgcattggttcatgtccgctgtg

SEQ ID NO: 38658 - DNA, 25 bp, Mus musculus
ttggttcatgtccgctgtgtggcct

SEQ ID NO: 38659 - DNA, 25 bp, Mus musculus
ttcatgtccgctgtgtggcctgtat

SEQ ID NO: 38660 - DNA, 25 bp, Mus musculus
tgtccgctgtgtggcctgtatactt

SEQ ID NO: 38661 - DNA, 25 bp, Mus musculus
ctgtgtggcctgtatactttctctc

SEQ ID NO: 38662 - DNA, 25 bp, Mus musculus
ggcctgtatactttctctcgcggtt

SEQ ID NO: 38663 - DNA, 25 bp, Mus musculus
cctgtatactttctctcgcggttcg

SEQ ID NO: 38664 - DNA, 25 bp, Mus musculus
ttcggcactaggggcacagtcttca

SEQ ID NO: 38665 - DNA, 25 bp, Mus musculus
ggcacagtcttcatggcggaagatc

SEQ ID NO: 38666 - DNA, 25 bp, Mus musculus
tagaagacaatcaccatggaggcat

SEQ ID NO: 38667 - DNA, 25 bp, Mus musculus
aagacaatcaccatggaggcatagc

SEQ ID NO: 38668 - DNA, 25 bp, Mus musculus
atcaccatggaggcatagccagacc

SEQ ID NO: 38669 - DNA, 25 bp, Mus musculus
agatgttccagacattgatgctgcc

SEQ ID NO: 38670 - DNA, 25 bp, Mus musculus
tgttccagacattgatgctgccggc

SEQ ID NO: 38671 - DNA, 25 bp, Mus musculus
cattgatgctgccggccttcatgaa

SEQ ID NO: 38672 - DNA, 25 bp, Mus musculus
tgatgctgccggccttcatgaactg

SEQ ID NO: 38673 - DNA, 25 bp, Mus musculus
tgccggccttcatgaactggcccaa

SEQ ID NO: 38674 - DNA, 25 bp, Mus musculus
ccttcatgaactggcccaatgagat

SEQ ID NO: 38675 - DNA, 25 bp, Mus musculus
tgaactggcccaatgagatttccag

SEQ ID NO: 38676 - DNA, 25 bp, Mus musculus
acagtcttcatggcggaagatctcc

SEQ ID NO: 38677 - DNA, 25 bp, Mus musculus
ggattcctccaaccagggcaatcag

SEQ ID NO: 38678 - DNA, 25 bp, Mus musculus
gcggaagatctccacacagtcagga

SEQ ID NO: 38679 - DNA, 25 bp, Mus musculus
ctccacacagtcaggagtgttccag

SEQ ID NO: 38680 - DNA, 25 bp, Mus musculus
ccaggtgtggccacatgtagcccat

SEQ ID NO: 38681 - DNA, 25 bp, Mus musculus
acatgtagcccatgcaaagtggtag

SEQ ID NO: 38682 - DNA, 25 bp, Mus musculus
tgtagcccatgcaaagtggtagtaa

SEQ ID NO: 38683 - DNA, 25 bp, Mus musculus
taatagaagccccaggccagcacca

SEQ ID NO: 38684 - DNA, 25 bp, Mus musculus
ccccaggccagcaccatgatgtagt

SEQ ID NO: 38685 - DNA, 25 bp, Mus musculus
tctatggccatctcctaccatgagg

SEQ ID NO: 38686 - DNA, 25 bp, Mus musculus
gccatctcctaccatgagggagcta

SEQ ID NO: 38687 - DNA, 25 bp, Mus musculus
ccgtctgccttgttggggttctgtg

SEQ ID NO: 38688 - DNA, 25 bp, Mus musculus
ttgcctgtgccgtgtgacggtcacg

SEQ ID NO: 38689 - DNA, 25 bp, Mus musculus
tgtgacggtcacgtgggcctggtct

SEQ ID NO: 38690 - DNA, 25 bp, Mus musculus
gcctggcatgttggggtcctcctgc

SEQ ID NO: 38691 - DNA, 25 bp, Mus musculus
gttgacctgcctgttcacctcatga

SEQ ID NO: 38692 - DNA, 25 bp, Mus musculus
ctgcctgttcacctcatgagtgaag

SEQ ID NO: 38693 - DNA, 25 bp, Mus musculus
gttcacctcatgagtgaaggcgtct

SEQ ID NO: 38694 - DNA, 25 bp, Mus musculus
gaactgaggggtctctgtgtagagt

SEQ ID NO: 38695 - DNA, 25 bp, Mus musculus
tacaagcttcctgtgctccggttgc

SEQ ID NO: 38696 - DNA, 25 bp, Mus musculus
gttttgcactaaagtttctgtgact

SEQ ID NO: 38697 - DNA, 25 bp, Mus musculus
tcctaccatgagggagctacccagc

SEQ ID NO: 38698 - DNA, 25 bp, Mus musculus
ggagctacccagcttcctgtggtac

SEQ ID NO: 38699 - DNA, 25 bp, Mus musculus
gatcaggcctttagagcgatggaag

SEQ ID NO: 38700 - DNA, 25 bp, Mus musculus
gtggccattgtcatagcacagagat

SEQ ID NO: 38701 - DNA, 25 bp, Mus musculus
tttcagaagcacctgcaggtggctt

SEQ ID NO: 38702 - DNA, 25 bp, Mus musculus
gtggcttgcttgggatgttgctgtc

SEQ ID NO: 38703 - DNA, 25 bp, Mus musculus
ccctgggtcaccttccattctgctt

SEQ ID NO: 38704 - DNA, 25 bp, Mus musculus
gtcaccttccattctgctttcctgt

SEQ ID NO: 38705 - DNA, 25 bp, Mus musculus
tagataaatgtccccgtaagagcca

SEQ ID NO: 38706 - DNA, 25 bp, Mus musculus
gataaatgtccccgtaagagccaga

SEQ ID NO: 38707 - DNA, 25 bp, Mus musculus
gatcttccgcaccagtttgtattat

SEQ ID NO: 38708 - DNA, 25 bp, Mus musculus
tcttccgcaccagtttgtattatcc

SEQ ID NO: 38709 - DNA, 25 bp, Mus musculus
cagtttgtattatccaccgacgata

SEQ ID NO: 38710 - DNA, 25 bp, Mus musculus
ttgtattatccaccgacgataaatt

SEQ ID NO: 38711 - DNA, 25 bp, Mus musculus
gtattatccaccgacgataaattcg

SEQ ID NO: 38712 - DNA, 25 bp, Mus musculus
tatccaccgacgataaattcggcct

SEQ ID NO: 38713 - DNA, 25 bp, Mus musculus
cgataaattcggccttggagccgct

SEQ ID NO: 38714 - DNA, 25 bp, Mus musculus
aaattcggccttggagccgctgctg

SEQ ID NO: 38715 - DNA, 25 bp, Mus musculus
attcggccttggagccgctgctgct

SEQ ID NO: 38716 - DNA, 25 bp, Mus musculus
tcggccttggagccgctgctgctcg

SEQ ID NO: 38717 - DNA, 25 bp, Mus musculus
aatgtccccgtaagagccagattcg

SEQ ID NO: 38718 - DNA, 25 bp, Mus musculus
tgtccccgtaagagccagattcgat

SEQ ID NO: 38719 - DNA, 25 bp, Mus musculus
tccccgtaagagccagattcgatct

SEQ ID NO: 38720 - DNA, 25 bp, Mus musculus
agagccagattcgatcttccgcacc

SEQ ID NO: 38721 - DNA, 25 bp, Mus musculus
agccagattcgatcttccgcaccag

SEQ ID NO: 38722 - DNA, 25 bp, Mus musculus
ccagattcgatcttccgcaccagtt

SEQ ID NO: 38723 - DNA, 25 bp, Mus musculus
attcgatcttccgcaccagtttgta

SEQ ID NO: 38724 - DNA, 25 bp, Mus musculus
tcgatcttccgcaccagtttgtatt

SEQ ID NO: 38725 - DNA, 25 bp, Mus musculus
cagtttggacacgtggtagatattg

SEQ ID NO: 38726 - DNA, 25 bp, Mus musculus
agtttggacacgtggtagatattgt

SEQ ID NO: 38727 - DNA, 25 bp, Mus musculus
attcagtacgcaaaaacagattctg

SEQ ID NO: 38728 - DNA, 25 bp, Mus musculus
aaatgcgtggtactttcgctgacaa

SEQ ID NO: 38729 - DNA, 25 bp, Mus musculus
atgcgtggtactttcgctgacaagg

SEQ ID NO: 38730 - DNA, 25 bp, Mus musculus
aagctaaaaccatggaacaggctgc

SEQ ID NO: 38731 - DNA, 25 bp, Mus musculus
accatggaacaggctgcagctgctg

SEQ ID NO: 38732 - DNA, 25 bp, Mus musculus
aacaggctgcagctgctgcaaacaa

SEQ ID NO: 38733 - DNA, 25 bp, Mus musculus
caggctgcagctgctgcaaacaaga

SEQ ID NO: 38734 - DNA, 25 bp, Mus musculus
aggctgcagctgctgcaaacaagaa

SEQ ID NO: 38735 - DNA, 25 bp, Mus musculus
ggctgcagctgctgcaaacaagaag

SEQ ID NO: 38736 - DNA, 25 bp, Mus musculus
caagaagcctggtcagggaacacca

SEQ ID NO: 38737 - DNA, 25 bp, Mus musculus
aactgggttcatccacaaatgcttt

SEQ ID NO: 38738 - DNA, 25 bp, Mus musculus
ctgggttcatccacaaatgctttga

SEQ ID NO: 38739 - DNA, 25 bp, Mus musculus
tgggttcatccacaaatgctttgag

SEQ ID NO: 38740 - DNA, 25 bp, Mus musculus
ggttcatccacaaatgctttgagac

SEQ ID NO: 38741 - DNA, 25 bp, Mus musculus
gttcatccacaaatgctttgagaca

SEQ ID NO: 38742 - DNA, 25 bp, Mus musculus
tcatccacaaatgctttgagacagt

SEQ ID NO: 38743 - DNA, 25 bp, Mus musculus
catccacaaatgctttgagacagtt

SEQ ID NO: 38744 - DNA, 25 bp, Mus musculus
tccacaaatgctttgagacagttac

SEQ ID NO: 38745 - DNA, 25 bp, Mus musculus
ataccagcaacaatggcggcgtcga

SEQ ID NO: 38746 - DNA, 25 bp, Mus musculus
gcgtcgaatacctctttgaggttgt

SEQ ID NO: 38747 - DNA, 25 bp, Mus musculus
accggcttctctttgcacttgtcca

SEQ ID NO: 38748 - DNA, 25 bp, Mus musculus
ttgcacttgtccagttctatgagca

SEQ ID NO: 38749 - DNA, 25 bp, Mus musculus
ttgtccagttctatgagcactttga

SEQ ID NO: 38750 - DNA, 25 bp, Mus musculus
tccctgaggtccgactgtgtcccga

SEQ ID NO: 38751 - DNA, 25 bp, Mus musculus
accacgatgatgcgggcctttggtc

SEQ ID NO: 38752 - DNA, 25 bp, Mus musculus
atgatgcgggcctttggtcagtgac

SEQ ID NO: 38753 - DNA, 25 bp, Mus musculus
cgtcgaatctctggagaccactgat

SEQ ID NO: 38754 - DNA, 25 bp, Mus musculus
atctctggagaccactgatcgccca

SEQ ID NO: 38755 - DNA, 25 bp, Mus musculus
ggagaccactgatcgcccacgttct

SEQ ID NO: 38756 - DNA, 25 bp, Mus musculus
cactgatcgcccacgttcttgaaac

SEQ ID NO: 38757 - DNA, 25 bp, Mus musculus
aatacctctttgaggttgttctgag

SEQ ID NO: 38758 - DNA, 25 bp, Mus musculus
tcgcccacgttcttgaaacaagtgt

SEQ ID NO: 38759 - DNA, 25 bp, Mus musculus
ttctgagtcaacgctgagcactcga

SEQ ID NO: 38760 - DNA, 25 bp, Mus musculus
gtcaacgctgagcactcgatgtagg

SEQ ID NO: 38761 - DNA, 25 bp, Mus musculus
gctgagcactcgatgtaggagacag

SEQ ID NO: 38762 - DNA, 25 bp, Mus musculus
gagacagctttgacttcctccgcgc

SEQ ID NO: 38763 - DNA, 25 bp, Mus musculus
gctttgacttcctccgcgcacagct

SEQ ID NO: 38764 - DNA, 25 bp, Mus musculus
tccgcgcacagcttcgtggcctctt

SEQ ID NO: 38765 - DNA, 25 bp, Mus musculus
tcaggcaccggcttctctttgcact

SEQ ID NO: 38766 - DNA, 25 bp, Mus musculus
acgacaggacagtctctgtgtgtaa

SEQ ID NO: 38767 - DNA, 25 bp, Mus musculus
cgacaggacagtctctgtgtgtaac

SEQ ID NO: 38768 - DNA, 25 bp, Mus musculus
acaactggtgatcagtgctgacata

SEQ ID NO: 38769 - DNA, 25 bp, Mus musculus
ccagctctatgcacgccatgatctc

SEQ ID NO: 38770 - DNA, 25 bp, Mus musculus
cagctctatgcacgccatgatctca

SEQ ID NO: 38771 - DNA, 25 bp, Mus musculus
agctctatgcacgccatgatctcag

SEQ ID NO: 38772 - DNA, 25 bp, Mus musculus
gctctatgcacgccatgatctcagc

SEQ ID NO: 38773 - DNA, 25 bp, Mus musculus
ctctatgcacgccatgatctcagcc

SEQ ID NO: 38774 - DNA, 25 bp, Mus musculus
tctatgcacgccatgatctcagcca

SEQ ID NO: 38775 - DNA, 25 bp, Mus musculus
ctatgcacgccatgatctcagccac

SEQ ID NO: 38776 - DNA, 25 bp, Mus musculus
tatgcacgccatgatctcagccaca

SEQ ID NO: 38777 - DNA, 25 bp, Mus musculus
gacaggacagtctctgtgtgtaaca

SEQ ID NO: 38778 - DNA, 25 bp, Mus musculus
acaggacagtctctgtgtgtaacac

SEQ ID NO: 38779 - DNA, 25 bp, Mus musculus
aggacagtctctgtgtgtaacacga

SEQ ID NO: 38780 - DNA, 25 bp, Mus musculus
actgctgtacaatcatctgatgaag

SEQ ID NO: 38781 - DNA, 25 bp, Mus musculus
ctgtacaatcatctgatgaagatcc

SEQ ID NO: 38782 - DNA, 25 bp, Mus musculus
tgtacaatcatctgatgaagatcct

SEQ ID NO: 38783 - DNA, 25 bp, Mus musculus
tcctccgggacatcagacaactggt

SEQ ID NO: 38784 - DNA, 25 bp, Mus musculus
acatcagacaactggtgatcagtgc

SEQ ID NO: 38785 - DNA, 25 bp, Mus musculus
ggtgaagcctcaggcatcaagccca

SEQ ID NO: 38786 - DNA, 25 bp, Mus musculus
gtgaagcctcaggcatcaagcccaa

SEQ ID NO: 38787 - DNA, 25 bp, Mus musculus
caaagctccagtaaggccaggctta

SEQ ID NO: 38788 - DNA, 25 bp, Mus musculus
aaagctccagtaaggccaggcttag

SEQ ID NO: 38789 - DNA, 25 bp, Mus musculus
aagctccagtaaggccaggcttagc

SEQ ID NO: 38790 - DNA, 25 bp, Mus musculus
agctccagtaaggccaggcttagct

SEQ ID NO: 38791 - DNA, 25 bp, Mus musculus
gctccagtaaggccaggcttagctc

SEQ ID NO: 38792 - DNA, 25 bp, Mus musculus
ctccagtaaggccaggcttagctca

SEQ ID NO: 38793 - DNA, 25 bp, Mus musculus
tccagtaaggccaggcttagctcag

SEQ ID NO: 38794 - DNA, 25 bp, Mus musculus
tgaagcctcaggcatcaagcccaag

SEQ ID NO: 38795 - DNA, 25 bp, Mus musculus
tcaccccaagctgggaagcggattc

SEQ ID NO: 38796 - DNA, 25 bp, Mus musculus
caccccaagctgggaagcggattcg

SEQ ID NO: 38797 - DNA, 25 bp, Mus musculus
cgaagctacatggccaagggtagag

SEQ ID NO: 38798 - DNA, 25 bp, Mus musculus
gaagctacatggccaagggtagagg

SEQ ID NO: 38799 - DNA, 25 bp, Mus musculus
aagctacatggccaagggtagaggc

SEQ ID NO: 38800 - DNA, 25 bp, Mus musculus
tgcaaccgaagcctaaggtcaaaca

SEQ ID NO: 38801 - DNA, 25 bp, Mus musculus
gcaaagctccagtaaggccaggctt

SEQ ID NO: 38802 - DNA, 25 bp, Mus musculus
tacagaaaccctggccttcattcac

SEQ ID NO: 38803 - DNA, 25 bp, Mus musculus
ggccttcattcactgctgccttaac

SEQ ID NO: 38804 - DNA, 25 bp, Mus musculus
tgacttccgtgacgctttgtaaggt

SEQ ID NO: 38805 - DNA, 25 bp, Mus musculus
ccgtgacgctttgtaaggtgtgagt

SEQ ID NO: 38806 - DNA, 25 bp, Mus musculus
agcacctgctcgccttgtttcagtc

SEQ ID NO: 38807 - DNA, 25 bp, Mus musculus
tgctcgccttgtttcagtcagggtg

SEQ ID NO: 38808 - DNA, 25 bp, Mus musculus
caagatggcttctcaccctgcaggt

SEQ ID NO: 38809 - DNA, 25 bp, Mus musculus
ggcttctcaccctgcaggtggctcc

SEQ ID NO: 38810 - DNA, 25 bp, Mus musculus
tggctcccaagaggttcagagccct

SEQ ID NO: 38811 - DNA, 25 bp, Mus musculus
accccttcatgacaatgagcccttg

SEQ ID NO: 38812 - DNA, 25 bp, Mus musculus
caatgagcccttgagtggatctcta

SEQ ID NO: 38813 - DNA, 25 bp, Mus musculus
gcccttgagtggatctctagttttg

SEQ ID NO: 38814 - DNA, 25 bp, Mus musculus
caagtacatcacccaactcttcaga

SEQ ID NO: 38815 - DNA, 25 bp, Mus musculus
tcccctcgtgctctgcaaacactgt

SEQ ID NO: 38816 - DNA, 25 bp, Mus musculus
cgtgctctgcaaacactgtgacttc

SEQ ID NO: 38817 - DNA, 25 bp, Mus musculus
ctgcaaacactgtgacttcctccag

SEQ ID NO: 38818 - DNA, 25 bp, Mus musculus
tgacttcctccaggtctactcggct

SEQ ID NO: 38819 - DNA, 25 bp, Mus musculus
cctccaggtctactcggctgacatg

SEQ ID NO: 38820 - DNA, 25 bp, Mus musculus
ggtctactcggctgacatgtccagc

SEQ ID NO: 38821 - DNA, 25 bp, Mus musculus
ggatcatgacttccgtgacgctttg

SEQ ID NO: 38822 - DNA, 25 bp, Mus musculus
accccagtcatctgaaaactcagat

SEQ ID NO: 38823 - DNA, 25 bp, Mus musculus
tgaaaactcagatgcctggaaggtc

SEQ ID NO: 38824 - DNA, 25 bp, Mus musculus
aatcactcaagttcttgcactttcg

SEQ ID NO: 38825 - DNA, 25 bp, Mus musculus
gttctgatagtcacttatggcaacc

SEQ ID NO: 38826 - DNA, 25 bp, Mus musculus
atagtcacttatggcaacccaggta

SEQ ID NO: 38827 - DNA, 25 bp, Mus musculus
acttatggcaacccaggtacattca

SEQ ID NO: 38828 - DNA, 25 bp, Mus musculus
ccaggtacattcaactaggatgaaa

SEQ ID NO: 38829 - DNA, 25 bp, Mus musculus
tctgccttagcccagtagtatgtct

SEQ ID NO: 38830 - DNA, 25 bp, Mus musculus
ttagcccagtagtatgtctgtgttt

SEQ ID NO: 38831 - DNA, 25 bp, Mus musculus
tgtaaggacccagctgattttccca

SEQ ID NO: 38832 - DNA, 25 bp, Mus musculus
cctccatctgtaagccactaataaa

SEQ ID NO: 38833 - DNA, 25 bp, Mus musculus
tctgtaagccactaataaagtgcat

SEQ ID NO: 38834 - DNA, 25 bp, Mus musculus
ctgacctcaatgactacacataata

SEQ ID NO: 38835 - DNA, 25 bp, Mus musculus
gctcaaccagaggacctgggttcaa

SEQ ID NO: 38836 - DNA, 25 bp, Mus musculus
atttccacttagatggcagctcaaa

SEQ ID NO: 38837 - DNA, 25 bp, Mus musculus
gctcaaactatctataattccaatt

SEQ ID NO: 38838 - DNA, 25 bp, Mus musculus
tcaccttgacatgaccatcttgagc

SEQ ID NO: 38839 - DNA, 25 bp, Mus musculus
gaccatcttgagctacagccatcct

SEQ ID NO: 38840 - DNA, 25 bp, Mus musculus
cttgagctacagccatcctaactgc

SEQ ID NO: 38841 - DNA, 25 bp, Mus musculus
ctacagccatcctaactgcctcaga

SEQ ID NO: 38842 - DNA, 25 bp, Mus musculus
gcctggtgcccgagcgacttcagag

SEQ ID NO: 38843 - DNA, 25 bp, Mus musculus
tggtgcccgagcgacttcagaggcg

SEQ ID NO: 38844 - DNA, 25 bp, Mus musculus
aagatgcggccaactaactccaggg

SEQ ID NO: 38845 - DNA, 25 bp, Mus musculus
gatgcggccaactaactccagggcc

SEQ ID NO: 38846 - DNA, 25 bp, Mus musculus
atgcggccaactaactccagggcct

SEQ ID NO: 38847 - DNA, 25 bp, Mus musculus
tgcggccaactaactccagggcctg

SEQ ID NO: 38848 - DNA, 25 bp, Mus musculus
cggccaactaactccagggcctgcg

SEQ ID NO: 38849 - DNA, 25 bp, Mus musculus
ggccaactaactccagggcctgcgg

SEQ ID NO: 38850 - DNA, 25 bp, Mus musculus
gccaactaactccagggcctgcgga

SEQ ID NO: 38851 - DNA, 25 bp, Mus musculus
taactccagggcctgcggaactcct

SEQ ID NO: 38852 - DNA, 25 bp, Mus musculus
aactccagggcctgcggaactcctg

SEQ ID NO: 38853 - DNA, 25 bp, Mus musculus
actccagggcctgcggaactcctga

SEQ ID NO: 38854 - DNA, 25 bp, Mus musculus
ggtgcccgagcgacttcagaggcgc

SEQ ID NO: 38855 - DNA, 25 bp, Mus musculus
cagggcctgcggaactcctgaacga

SEQ ID NO: 38856 - DNA, 25 bp, Mus musculus
gtgcccgagcgacttcagaggcgcg

SEQ ID NO: 38857 - DNA, 25 bp, Mus musculus
cccgagcgacttcagaggcgcgaac

SEQ ID NO: 38858 - DNA, 25 bp, Mus musculus
ccgagcgacttcagaggcgcgaaca

SEQ ID NO: 38859 - DNA, 25 bp, Mus musculus
gagcgacttcagaggcgcgaacagg

SEQ ID NO: 38860 - DNA, 25 bp, Mus musculus
agcgacttcagaggcgcgaacagga

SEQ ID NO: 38861 - DNA, 25 bp, Mus musculus
gagaacagcggcttcttcgccgccg

SEQ ID NO: 38862 - DNA, 25 bp, Mus musculus
agaacagcggcttcttcgccgccgc

SEQ ID NO: 38863 - DNA, 25 bp, Mus musculus
tagcttgtaagcctcttcagctgct

SEQ ID NO: 38864 - DNA, 25 bp, Mus musculus
agcctcttcagctgctgcgaagatg

SEQ ID NO: 38865 - DNA, 25 bp, Mus musculus
cagctgctcatagggacttataggt

SEQ ID NO: 38866 - DNA, 25 bp, Mus musculus
taccagaactagaccacaatacgta

SEQ ID NO: 38867 - DNA, 25 bp, Mus musculus
aactagaccacaatacgtatagata

SEQ ID NO: 38868 - DNA, 25 bp, Mus musculus
tagaccacaatacgtatagataagt

SEQ ID NO: 38869 - DNA, 25 bp, Mus musculus
attatgtagcacagcgcgctcgtga

SEQ ID NO: 38870 - DNA, 25 bp, Mus musculus
tagcacagcgcgctcgtgaaggtag

SEQ ID NO: 38871 - DNA, 25 bp, Mus musculus
gtcaattgctactacaagtatgtca

SEQ ID NO: 38872 - DNA, 25 bp, Mus musculus
aattgctactacaagtatgtcactg

SEQ ID NO: 38873 - DNA, 25 bp, Mus musculus
aagtatgtcactgttccgtaagtga

SEQ ID NO: 38874 - DNA, 25 bp, Mus musculus
taagtgacggagctgacaggtcttt

SEQ ID NO: 38875 - DNA, 25 bp, Mus musculus
aggatccatgtcaaccatgttctgg

SEQ ID NO: 38876 - DNA, 25 bp, Mus musculus
atccatgtcaaccatgttctggcca

SEQ ID NO: 38877 - DNA, 25 bp, Mus musculus
gtcaaccatgttctggccactgtag

SEQ ID NO: 38878 - DNA, 25 bp, Mus musculus
aaccatgttctggccactgtaggca

SEQ ID NO: 38879 - DNA, 25 bp, Mus musculus
catgttctggccactgtaggcatta

SEQ ID NO: 38880 - DNA, 25 bp, Mus musculus
ctggccactgtaggcattagtacta

SEQ ID NO: 38881 - DNA, 25 bp, Mus musculus
attagtactatcgtctacataaata

SEQ ID NO: 38882 - DNA, 25 bp, Mus musculus
aataggcagctgctcatagggactt

SEQ ID NO: 38883 - DNA, 25 bp, Mus musculus
ccattgctgtctaggtcggacatgc

SEQ ID NO: 38884 - DNA, 25 bp, Mus musculus
gacatgctaaggcccacttcagctt

SEQ ID NO: 38885 - DNA, 25 bp, Mus musculus
ccagcttgcccagggaggtcatgct

SEQ ID NO: 38886 - DNA, 25 bp, Mus musculus
gcttgcccagggaggtcatgctcag

SEQ ID NO: 38887 - DNA, 25 bp, Mus musculus
tcatgctcagagcaatgatgaacac

SEQ ID NO: 38888 - DNA, 25 bp, Mus musculus
tgaacactcagaagtcgatggtgct

SEQ ID NO: 38889 - DNA, 25 bp, Mus musculus
acactcagaagtcgatggtgctgac

SEQ ID NO: 38890 - DNA, 25 bp, Mus musculus
cgatggtgctgacactgttggtgtc

SEQ ID NO: 38891 - DNA, 25 bp, Mus musculus
tggtgctgacactgttggtgtcaaa

SEQ ID NO: 38892 - DNA, 25 bp, Mus musculus
tgctgacactgttggtgtcaaacat

SEQ ID NO: 38893 - DNA, 25 bp, Mus musculus
tgtctctgtaggggaagaagttggc

SEQ ID NO: 38894 - DNA, 25 bp, Mus musculus
agaagttggcctagatcttgaaatt

SEQ ID NO: 38895 - DNA, 25 bp, Mus musculus
atgctaaggcccacttcagcttctg

SEQ ID NO: 38896 - DNA, 25 bp, Mus musculus
ctaaggcccacttcagcttctgttc

SEQ ID NO: 38897 - DNA, 25 bp, Mus musculus
aggcccacttcagcttctgttccag

SEQ ID NO: 38898 - DNA, 25 bp, Mus musculus
cccacttcagcttctgttccagctt

SEQ ID NO: 38899 - DNA, 25 bp, Mus musculus
acttcagcttctgttccagcttgcc

SEQ ID NO: 38900 - DNA, 25 bp, Mus musculus
tcagcttctgttccagcttgcccag

SEQ ID NO: 38901 - DNA, 25 bp, Mus musculus
gcttctgttccagcttgcccaggga

SEQ ID NO: 38902 - DNA, 25 bp, Mus musculus
tctgttccagcttgcccagggaggt

SEQ ID NO: 38903 - DNA, 25 bp, Mus musculus
aaatcttcgatgctccaaaggaatt

SEQ ID NO: 38904 - DNA, 25 bp, Mus musculus
tcttcgatgctccaaaggaatttag

SEQ ID NO: 38905 - DNA, 25 bp, Mus musculus
aggctgcatgtgctgagctccgtga

SEQ ID NO: 38906 - DNA, 25 bp, Mus musculus
ctgcatgtgctgagctccgtgattt

SEQ ID NO: 38907 - DNA, 25 bp, Mus musculus
catgtgctgagctccgtgatttggt

SEQ ID NO: 38908 - DNA, 25 bp, Mus musculus
gtgctgagctccgtgatttggtgca

SEQ ID NO: 38909 - DNA, 25 bp, Mus musculus
ctgagctccgtgatttggtgcactc

SEQ ID NO: 38910 - DNA, 25 bp, Mus musculus
ccaaatgcaaccgctactcttgttt

SEQ ID NO: 38911 - DNA, 25 bp, Mus musculus
aatgcaaccgctactcttgtttgaa

SEQ ID NO: 38912 - DNA, 25 bp, Mus musculus
gcaaccgctactcttgtttgaaaat

SEQ ID NO: 38913 - DNA, 25 bp, Mus musculus
gctactcttgtttgaaaatggcaaa

SEQ ID NO: 38914 - DNA, 25 bp, Mus musculus
gtcatggcaatcatttcaggataag

SEQ ID NO: 38915 - DNA, 25 bp, Mus musculus
ttaggttcgatcggttcatagaaga

SEQ ID NO: 38916 - DNA, 25 bp, Mus musculus
cttttggactcggaacaagcaaatg

SEQ ID NO: 38917 - DNA, 25 bp, Mus musculus
agctactgctgattgagcttttaac

SEQ ID NO: 38918 - DNA, 25 bp, Mus musculus
ggctaaatcacagtcggatgttttt

SEQ ID NO: 38919 - DNA, 25 bp, Mus musculus
taaatcacagtcggatgtttttagg

SEQ ID NO: 38920 - DNA, 25 bp, Mus musculus
atcacagtcggatgtttttaggtat

SEQ ID NO: 38921 - DNA, 25 bp, Mus musculus
taggtattcagcaccccgattctgc

SEQ ID NO: 38922 - DNA, 25 bp, Mus musculus
gtaaggctgcatgtgctgagctccg

SEQ ID NO: 38923 - DNA, 25 bp, Mus musculus
ttctttatgcatcatggtaaagcat

SEQ ID NO: 38924 - DNA, 25 bp, Mus musculus
aaagcattgcagcagtgttgttttg

SEQ ID NO: 38925 - DNA, 25 bp, Mus musculus
tcatgagcactttaactctaaactc

SEQ ID NO: 38926 - DNA, 25 bp, Mus musculus
tgagcactttaactctaaactctga

SEQ ID NO: 38927 - DNA, 25 bp, Mus musculus
gcactttaactctaaactctgaatt

SEQ ID NO: 38928 - DNA, 25 bp, Mus musculus
aatttcaaagcttgatgtgaagtcc

SEQ ID NO: 38929 - DNA, 25 bp, Mus musculus
atttactaaggtgtgctgggtcctg

SEQ ID NO: 38930 - DNA, 25 bp, Mus musculus
attatactggtctctgggattactc

SEQ ID NO: 38931 - DNA, 25 bp, Mus musculus
atactggtctctgggattactctct

SEQ ID NO: 38932 - DNA, 25 bp, Mus musculus
ctggtctctgggattactctctcag

SEQ ID NO: 38933 - DNA, 25 bp, Mus musculus
gggattactctctcagctgtattaa

SEQ ID NO: 38934 - DNA, 25 bp, Mus musculus
tttcataatctttcataaagaagtt

SEQ ID NO: 38935 - DNA, 25 bp, Mus musculus
tgaagtgcacactctatggtacgag

SEQ ID NO: 38936 - DNA, 25 bp, Mus musculus
agtgcacactctatggtacgaggtg

SEQ ID NO: 38937 - DNA, 25 bp, Mus musculus
cactctatggtacgaggtgtttagt

SEQ ID NO: 38938 - DNA, 25 bp, Mus musculus
gtttagtatacccaagcagataggt

SEQ ID NO: 38939 - DNA, 25 bp, Mus musculus
tatacccaagcagataggtgtcgat

SEQ ID NO: 38940 - DNA, 25 bp, Mus musculus
gagaatacttccaacagttgaggtg

SEQ ID NO: 38941 - DNA, 25 bp, Mus musculus
gttaccaaaccacttgagaattcat

SEQ ID NO: 38942 - DNA, 25 bp, Mus musculus
accaaaccacttgagaattcatgag

SEQ ID NO: 38943 - DNA, 25 bp, Mus musculus
gcccgtctcgttacgtgctcgggat

SEQ ID NO: 38944 - DNA, 25 bp, Mus musculus
ccgtctcgttacgtgctcgggatgc

SEQ ID NO: 38945 - DNA, 25 bp, Mus musculus
tccgaggccacagcaagacgcgcga

SEQ ID NO: 38946 - DNA, 25 bp, Mus musculus
aggccacagcaagacgcgcgaattc

SEQ ID NO: 38947 - DNA, 25 bp, Mus musculus
aagacgcgcgaattcccggcgcaca

SEQ ID NO: 38948 - DNA, 25 bp, Mus musculus
cgcgaattcccggcgcacagtgcta

SEQ ID NO: 38949 - DNA, 25 bp, Mus musculus
ggtccttcgacaagactgccagcgt

SEQ ID NO: 38950 - DNA, 25 bp, Mus musculus
tccttcgacaagactgccagcgtgt

SEQ ID NO: 38951 - DNA, 25 bp, Mus musculus
cttcgacaagactgccagcgtgttc

SEQ ID NO: 38952 - DNA, 25 bp, Mus musculus
tcgacaagactgccagcgtgttctt

SEQ ID NO: 38953 - DNA, 25 bp, Mus musculus
agcgtgttcttgctggagaaggacc

SEQ ID NO: 38954 - DNA, 25 bp, Mus musculus
tgttcttgctggagaaggaccggct

SEQ ID NO: 38955 - DNA, 25 bp, Mus musculus
gtctcgttacgtgctcgggatgcag

SEQ ID NO: 38956 - DNA, 25 bp, Mus musculus
ctcgttacgtgctcgggatgcagga

SEQ ID NO: 38957 - DNA, 25 bp, Mus musculus
ttacgtgctcgggatgcaggagctc

SEQ ID NO: 38958 - DNA, 25 bp, Mus musculus
acgtgctcgggatgcaggagctctt

SEQ ID NO: 38959 - DNA, 25 bp, Mus musculus
gatgcaggagctcttccgaggccac

SEQ ID NO: 38960 - DNA, 25 bp, Mus musculus
agctcttccgaggccacagcaagac

SEQ ID NO: 38961 - DNA, 25 bp, Mus musculus
ctcttccgaggccacagcaagacgc

SEQ ID NO: 38962 - DNA, 25 bp, Mus musculus
cttccgaggccacagcaagacgcgc

SEQ ID NO: 38963 - DNA, 25 bp, Mus musculus
cagatgattccttgcatcagctccg

SEQ ID NO: 38964 - DNA, 25 bp, Mus musculus
attccttgcatcagctccgaaaagc

SEQ ID NO: 38965 - DNA, 25 bp, Mus musculus
atttctgcttcaaatcagagccgtg

SEQ ID NO: 38966 - DNA, 25 bp, Mus musculus
gcttcaaatcagagccgtgggctac

SEQ ID NO: 38967 - DNA, 25 bp, Mus musculus
aagcgtgttctatcctatttccact

SEQ ID NO: 38968 - DNA, 25 bp, Mus musculus
gttctatcctatttccactcatcta

SEQ ID NO: 38969 - DNA, 25 bp, Mus musculus
tcctatttccactcatctattcaga

SEQ ID NO: 38970 - DNA, 25 bp, Mus musculus
ttccactcatctattcagaaatgaa

SEQ ID NO: 38971 - DNA, 25 bp, Mus musculus
tccacgtgcagtcaagtcccttggg

SEQ ID NO: 38972 - DNA, 25 bp, Mus musculus
tagaactgtgtcacttccacagtgg

SEQ ID NO: 38973 - DNA, 25 bp, Mus musculus
ttgtttctacaaatcagtgctaaca

SEQ ID NO: 38974 - DNA, 25 bp, Mus musculus
atcagtgctaacactcaagtttttc

SEQ ID NO: 38975 - DNA, 25 bp, Mus musculus
tgcatcagctccgaaaagcttgctt

SEQ ID NO: 38976 - DNA, 25 bp, Mus musculus
agctccgaaaagcttgctttctgta

SEQ ID NO: 38977 - DNA, 25 bp, Mus musculus
gtcctgttgggttgctttcaatatt

SEQ ID NO: 38978 - DNA, 25 bp, Mus musculus
ctcaccctctggtgttgattcgaca

SEQ ID NO: 38979 - DNA, 25 bp, Mus musculus
ttcgacacttcttttccgttgcaat

SEQ ID NO: 38980 - DNA, 25 bp, Mus musculus
tttccgttgcaatctacgccacgta

SEQ ID NO: 38981 - DNA, 25 bp, Mus musculus
ttgcaatctacgccacgtatttctg

SEQ ID NO: 38982 - DNA, 25 bp, Mus musculus
ccacgtatttctgcttcaaatcaga

SEQ ID NO: 38983 - DNA, 25 bp, Mus musculus
gccctcagtggtacaacctctgctg

SEQ ID NO: 38984 - DNA, 25 bp, Mus musculus
aagctcttcagcacagagacgtcac

SEQ ID NO: 38985 - DNA, 25 bp, Mus musculus
tgtccagactgtggcaaggccttcc

SEQ ID NO: 38986 - DNA, 25 bp, Mus musculus
ccagactgtggcaaggccttccgcc

SEQ ID NO: 38987 - DNA, 25 bp, Mus musculus
ttccgccagagtacccatctgaaag

SEQ ID NO: 38988 - DNA, 25 bp, Mus musculus
cgccagagtacccatctgaaagacc

SEQ ID NO: 38989 - DNA, 25 bp, Mus musculus
acccatctgaaagaccacagacgcc

SEQ ID NO: 38990 - DNA, 25 bp, Mus musculus
catctgaaagaccacagacgcctac

SEQ ID NO: 38991 - DNA, 25 bp, Mus musculus
ctgaaagaccacagacgcctacaca

SEQ ID NO: 38992 - DNA, 25 bp, Mus musculus
agacgcctacacacaggcgagcggc

SEQ ID NO: 38993 - DNA, 25 bp, Mus musculus
ctacacacaggcgagcggccctttg

SEQ ID NO: 38994 - DNA, 25 bp, Mus musculus
cacacaggcgagcggccctttgcgt

SEQ ID NO: 38995 - DNA, 25 bp, Mus musculus
ttcagcacagagacgtcactacagg

SEQ ID NO: 38996 - DNA, 25 bp, Mus musculus
agcacagagacgtcactacaggtcc

SEQ ID NO: 38997 - DNA, 25 bp, Mus musculus
acagagacgtcactacaggtccatc

SEQ ID NO: 38998 - DNA, 25 bp, Mus musculus
acgtcactacaggtccatcggcgca

SEQ ID NO: 38999 - DNA, 25 bp, Mus musculus
tcactacaggtccatcggcgcatcc

SEQ ID NO: 39000 - DNA, 25 bp, Mus musculus
ctacaggtccatcggcgcatccaca

SEQ ID NO: 39001 - DNA, 25 bp, Mus musculus
gagcggccatacccctgtccagact

SEQ ID NO: 39002 - DNA, 25 bp, Mus musculus
ccctgtccagactgtggcaaggcct

SEQ ID NO: 39003 - DNA, 25 bp, Mus musculus
tgtctgctgttacgccctgtctcac

SEQ ID NO: 39004 - DNA, 25 bp, Mus musculus
ggaatccttgctgagttggcatctc

SEQ ID NO: 39005 - DNA, 25 bp, Mus musculus
ggccacgcatcctgttggcatatga

SEQ ID NO: 39006 - DNA, 25 bp, Mus musculus
gcatcctgttggcatatgataaata

SEQ ID NO: 39007 - DNA, 25 bp, Mus musculus
attgatgccagtgaccacttttaat

SEQ ID NO: 39008 - DNA, 25 bp, Mus musculus
gccagtgaccacttttaatgcagga

SEQ ID NO: 39009 - DNA, 25 bp, Mus musculus
ttttaatgcaggacttggagccttc

SEQ ID NO: 39010 - DNA, 25 bp, Mus musculus
acttggagccttcacagggccctag

SEQ ID NO: 39011 - DNA, 25 bp, Mus musculus
agccttcacagggccctagatgtac

SEQ ID NO: 39012 - DNA, 25 bp, Mus musculus
gccctagatgtactggggtgtcatt

SEQ ID NO: 39013 - DNA, 25 bp, Mus musculus
tgtcattctcaggagctggctgcag

SEQ ID NO: 39014 - DNA, 25 bp, Mus musculus
tctcaggagctggctgcaggttagg

SEQ ID NO: 39015 - DNA, 25 bp, Mus musculus
cttgctgagttggcatctctgaaca

SEQ ID NO: 39016 - DNA, 25 bp, Mus musculus
cagcttcctaacagcactgtgaatg

SEQ ID NO: 39017 - DNA, 25 bp, Mus musculus
ccaccactggggcatcttaggcagt

SEQ ID NO: 39018 - DNA, 25 bp, Mus musculus
catcttaggcagtctttctttatag

SEQ ID NO: 39019 - DNA, 25 bp, Mus musculus
ggacatccatcattactttgcagat

SEQ ID NO: 39020 - DNA, 25 bp, Mus musculus
ccatcattactttgcagatgggaaa

SEQ ID NO: 39021 - DNA, 25 bp, Mus musculus
ttactttgcagatgggaaagcagtg

SEQ ID NO: 39022 - DNA, 25 bp, Mus musculus
gcttatggccacgcatcctgttggc

SEQ ID NO: 39023 - DNA, 25 bp, Mus musculus
ggcggcatcagtcaccacaggttct

SEQ ID NO: 39024 - DNA, 25 bp, Mus musculus
ggcatcagtcaccacaggttcttga

SEQ ID NO: 39025 - DNA, 25 bp, Mus musculus
agtggcctcaggtgcccaagcacat

SEQ ID NO: 39026 - DNA, 25 bp, Mus musculus
ctcaggtgcccaagcacatgatccc

SEQ ID NO: 39027 - DNA, 25 bp, Mus musculus
aggtgcccaagcacatgatcccaaa

SEQ ID NO: 39028 - DNA, 25 bp, Mus musculus
tgcccaagcacatgatcccaaattg

SEQ ID NO: 39029 - DNA, 25 bp, Mus musculus
ccaagcacatgatcccaaattggat

SEQ ID NO: 39030 - DNA, 25 bp, Mus musculus
acatgatcccaaattggatgctgag

SEQ ID NO: 39031 - DNA, 25 bp, Mus musculus
tgatcccaaattggatgctgagtgg

SEQ ID NO: 39032 - DNA, 25 bp, Mus musculus
tgcaaaatcatacagtccggaagaa

SEQ ID NO: 39033 - DNA, 25 bp, Mus musculus
atcatacagtccggaagaagcactg

SEQ ID NO: 39034 - DNA, 25 bp, Mus musculus
caaactgcacaacaaggagaatagt

SEQ ID NO: 39035 - DNA, 25 bp, Mus musculus
atcagtcaccacaggttcttgaaac

SEQ ID NO: 39036 - DNA, 25 bp, Mus musculus
ttcttgaaacatgactcctactgtc

SEQ ID NO: 39037 - DNA, 25 bp, Mus musculus
catgactcctactgtccttctgtta

SEQ ID NO: 39038 - DNA, 25 bp, Mus musculus
gactcctactgtccttctgttaatc

SEQ ID NO: 39039 - DNA, 25 bp, Mus musculus
tcctactgtccttctgttaatcctg

SEQ ID NO: 39040 - DNA, 25 bp, Mus musculus
ccttctgttaatcctgtgctttgga

SEQ ID NO: 39041 - DNA, 25 bp, Mus musculus
gttaatcctgtgctttggagtggcc

SEQ ID NO: 39042 - DNA, 25 bp, Mus musculus
aatcctgtgctttggagtggcctca

SEQ ID NO: 39043 - DNA, 25 bp, Mus musculus
ggctggctccaggattggagccttc

SEQ ID NO: 39044 - DNA, 25 bp, Mus musculus
gattggagccttctcctacggctca

SEQ ID NO: 39045 - DNA, 25 bp, Mus musculus
agacacaagcaatctcttcccaggt

SEQ ID NO: 39046 - DNA, 25 bp, Mus musculus
aagcaatctcttcccaggtacttgg

SEQ ID NO: 39047 - DNA, 25 bp, Mus musculus
gtaccttgaacgagtggatgagatg

SEQ ID NO: 39048 - DNA, 25 bp, Mus musculus
gagatccatgcaacaattccccggg

SEQ ID NO: 39049 - DNA, 25 bp, Mus musculus
agccgagctgctacccaaacagcat

SEQ ID NO: 39050 - DNA, 25 bp, Mus musculus
acccaaacagcatctgcttaaaatc

SEQ ID NO: 39051 - DNA, 25 bp, Mus musculus
ctagacacagcagcctcataggatc

SEQ ID NO: 39052 - DNA, 25 bp, Mus musculus
gcctcataggatctgctctgtggtg

SEQ ID NO: 39053 - DNA, 25 bp, Mus musculus
agcccacaggctcatgctgctgtgg

SEQ ID NO: 39054 - DNA, 25 bp, Mus musculus
gaccagagctcccctgtgaagaggg

SEQ ID NO: 39055 - DNA, 25 bp, Mus musculus
cggctcaggcttagcagcaagtttc

SEQ ID NO: 39056 - DNA, 25 bp, Mus musculus
cttttcattccgagtgtccaaggat

SEQ ID NO: 39057 - DNA, 25 bp, Mus musculus
attccgagtgtccaaggatgcttcc

SEQ ID NO: 39058 - DNA, 25 bp, Mus musculus
tctagactcccggagacgcatgtcc

SEQ ID NO: 39059 - DNA, 25 bp, Mus musculus
ctcccggagacgcatgtcccctgag

SEQ ID NO: 39060 - DNA, 25 bp, Mus musculus
gagacgcatgtcccctgaggaattc

SEQ ID NO: 39061 - DNA, 25 bp, Mus musculus
ttaccacaaggtgaacttctctcca

SEQ ID NO: 39062 - DNA, 25 bp, Mus musculus
ctctccacctggagacacaagcaat

SEQ ID NO: 39063 - DNA, 25 bp, Mus musculus
cattgatgtccaccactgccacatc

SEQ ID NO: 39064 - DNA, 25 bp, Mus musculus
ccactgccacatcatatccaaacta

SEQ ID NO: 39065 - DNA, 25 bp, Mus musculus
gaactggcactatactttcatcatt

SEQ ID NO: 39066 - DNA, 25 bp, Mus musculus
ctggcactatactttcatcattatc

SEQ ID NO: 39067 - DNA, 25 bp, Mus musculus
ctatactttcatcattatcatgtct

SEQ ID NO: 39068 - DNA, 25 bp, Mus musculus
tactttcatcattatcatgtctctc

SEQ ID NO: 39069 - DNA, 25 bp, Mus musculus
tttcatcattatcatgtctctccac

SEQ ID NO: 39070 - DNA, 25 bp, Mus musculus
catcattatcatgtctctccaccaa

SEQ ID NO: 39071 - DNA, 25 bp, Mus musculus
cattatcatgtctctccaccaactt

SEQ ID NO: 39072 - DNA, 25 bp, Mus musculus
tatcatgtctctccaccaacttcat

SEQ ID NO: 39073 - DNA, 25 bp, Mus musculus
tcatagggcccatcttcaaatgatg

SEQ ID NO: 39074 - DNA, 25 bp, Mus musculus
tagggcccatcttcaaatgatgtta

SEQ ID NO: 39075 - DNA, 25 bp, Mus musculus
catcatatccaaactaggaatccag

SEQ ID NO: 39076 - DNA, 25 bp, Mus musculus
ggcccatcttcaaatgatgttattg

SEQ ID NO: 39077 - DNA, 25 bp, Mus musculus
ttggagcaccagactctacagttat

SEQ ID NO: 39078 - DNA, 25 bp, Mus musculus
caccagactctacagttatgttatc

SEQ ID NO: 39079 - DNA, 25 bp, Mus musculus
cagactctacagttatgttatcttt

SEQ ID NO: 39080 - DNA, 25 bp, Mus musculus
caatacacttccctgtagccagtgt

SEQ ID NO: 39081 - DNA, 25 bp, Mus musculus
tacacttccctgtagccagtgtaac

SEQ ID NO: 39082 - DNA, 25 bp, Mus musculus
ctgtagccagtgtaacgcctaggta

SEQ ID NO: 39083 - DNA, 25 bp, Mus musculus
tagccagtgtaacgcctaggtatct

SEQ ID NO: 39084 - DNA, 25 bp, Mus musculus
accggcctggctccactgaatcagg

SEQ ID NO: 39085 - DNA, 25 bp, Mus musculus
ctggctccactgaatcaggaaggtc

SEQ ID NO: 39086 - DNA, 25 bp, Mus musculus
gatcccacgatcctcgggatgctgg

SEQ ID NO: 39087 - DNA, 25 bp, Mus musculus
ctcgggatgctggcttcaggtcacg

SEQ ID NO: 39088 - DNA, 25 bp, Mus musculus
gcttcaggtcacgggaccctcagta

SEQ ID NO: 39089 - DNA, 25 bp, Mus musculus
ggtcacgggaccctcagtatgatgg

SEQ ID NO: 39090 - DNA, 25 bp, Mus musculus
gggaccctcagtatgatgggcgact

SEQ ID NO: 39091 - DNA, 25 bp, Mus musculus
cgccttactctgagactgactcgca

SEQ ID NO: 39092 - DNA, 25 bp, Mus musculus
actctgagactgactcgcaggcctc

SEQ ID NO: 39093 - DNA, 25 bp, Mus musculus
agactgactcgcaggcctcgaggga

SEQ ID NO: 39094 - DNA, 25 bp, Mus musculus
tctgatcccacgttttgttatgtag

SEQ ID NO: 39095 - DNA, 25 bp, Mus musculus
tgaaactcttcaccaagcctaataa

SEQ ID NO: 39096 - DNA, 25 bp, Mus musculus
atgcacctccgagaagtcgcagccg

SEQ ID NO: 39097 - DNA, 25 bp, Mus musculus
ctccgagaagtcgcagccgggatga

SEQ ID NO: 39098 - DNA, 25 bp, Mus musculus
gaagtcgcagccgggatgacctcta

SEQ ID NO: 39099 - DNA, 25 bp, Mus musculus
gggatgacctctatgaccccgacga

SEQ ID NO: 39100 - DNA, 25 bp, Mus musculus
acctctatgaccccgacgatcctag

SEQ ID NO: 39101 - DNA, 25 bp, Mus musculus
atgaccccgacgatcctagagactt

SEQ ID NO: 39102 - DNA, 25 bp, Mus musculus
ccgacgatcctagagacttgccaca

SEQ ID NO: 39103 - DNA, 25 bp, Mus musculus
gagatccccactattatgatgattt

SEQ ID NO: 39104 - DNA, 25 bp, Mus musculus
gcaagcccgggtttcatgtatgaaa

SEQ ID NO: 39105 - DNA, 25 bp, Mus musculus
acacaagcctaaaggctcagggatc

SEQ ID NO: 39106 - DNA, 25 bp, Mus musculus
caggtgtctccaatgctgtctcact

SEQ ID NO: 39107 - DNA, 25 bp, Mus musculus
tctccaatgctgtctcactgggtgt

SEQ ID NO: 39108 - DNA, 25 bp, Mus musculus
atgctgtctcactgggtgtatcaac

SEQ ID NO: 39109 - DNA, 25 bp, Mus musculus
tatcaacacctcagggcccacacaa

SEQ ID NO: 39110 - DNA, 25 bp, Mus musculus
cttttgctttgcatttctgcacaca

SEQ ID NO: 39111 - DNA, 25 bp, Mus musculus
ctttgcatttctgcacacacacaat

SEQ ID NO: 39112 - DNA, 25 bp, Mus musculus
atttctgcacacacacaatccctca

SEQ ID NO: 39113 - DNA, 25 bp, Mus musculus
tccctcacacatacaaacagtgaca

SEQ ID NO: 39114 - DNA, 25 bp, Mus musculus
acacatacaaacagtgacaccacac

SEQ ID NO: 39115 - DNA, 25 bp, Mus musculus
tgtcacaggtcatccagaactcatg

SEQ ID NO: 39116 - DNA, 25 bp, Mus musculus
gacttccagacacaacagatgcaca

SEQ ID NO: 39117 - DNA, 25 bp, Mus musculus
gtcacaggtcatccagaactcatgg

SEQ ID NO: 39118 - DNA, 25 bp, Mus musculus
cagacacaacagatgcacattatga

SEQ ID NO: 39119 - DNA, 25 bp, Mus musculus
atgcacattatgaactctcaagagt

SEQ ID NO: 39120 - DNA, 25 bp, Mus musculus
aactctcaagagtccatgcagtgtg

SEQ ID NO: 39121 - DNA, 25 bp, Mus musculus
caagagtccatgcagtgtgtgcagg

SEQ ID NO: 39122 - DNA, 25 bp, Mus musculus
tccatgcagtgtgtgcaggttcaag

SEQ ID NO: 39123 - DNA, 25 bp, Mus musculus
cagtgtgtgcaggttcaaggaagac

SEQ ID NO: 39124 - DNA, 25 bp, Mus musculus
tgtaattgacacctgctagcaaata

SEQ ID NO: 39125 - DNA, 25 bp, Mus musculus
agctgtttacttcccagaccatgat

SEQ ID NO: 39126 - DNA, 25 bp, Mus musculus
ttacttcccagaccatgatgaagtt

SEQ ID NO: 39127 - DNA, 25 bp, Mus musculus
actgctacactagggatctggtgta

SEQ ID NO: 39128 - DNA, 25 bp, Mus musculus
aagtatgtaccttcaaggagctggt

SEQ ID NO: 39129 - DNA, 25 bp, Mus musculus
taagattgcctggctgtgcccgcca

SEQ ID NO: 39130 - DNA, 25 bp, Mus musculus
catatccagtagccactgaatgtca

SEQ ID NO: 39131 - DNA, 25 bp, Mus musculus
cagtagccactgaatgtcactgtgg

SEQ ID NO: 39132 - DNA, 25 bp, Mus musculus
ccactgaatgtcactgtggcaagtg

SEQ ID NO: 39133 - DNA, 25 bp, Mus musculus
aatgtcactgtggcaagtgtgacag

SEQ ID NO: 39134 - DNA, 25 bp, Mus musculus
gtgacagcgacagcactgactgcac

SEQ ID NO: 39135 - DNA, 25 bp, Mus musculus
gcgacagcactgactgcaccgtgag

SEQ ID NO: 39136 - DNA, 25 bp, Mus musculus
ccagctactgctccttcagtgaaat

SEQ ID NO: 39137 - DNA, 25 bp, Mus musculus
gcatcttattctggtgctggagagc

SEQ ID NO: 39138 - DNA, 25 bp, Mus musculus
tattctggtgctggagagcaatctg

SEQ ID NO: 39139 - DNA, 25 bp, Mus musculus
gctgccatagctgtgaattgaccaa

SEQ ID NO: 39140 - DNA, 25 bp, Mus musculus
tgaccaacatcaccatctcagtaga

SEQ ID NO: 39141 - DNA, 25 bp, Mus musculus
acatcaccatctcagtagagaagga

SEQ ID NO: 39142 - DNA, 25 bp, Mus musculus
gccgtttctgcataagcatcaatac

SEQ ID NO: 39143 - DNA, 25 bp, Mus musculus
taagcatcaataccacttggtgtgc

SEQ ID NO: 39144 - DNA, 25 bp, Mus musculus
ccacttggtgtgcgggctactgcta

SEQ ID NO: 39145 - DNA, 25 bp, Mus musculus
tattcagcagttcttactaactctg

SEQ ID NO: 39146 - DNA, 25 bp, Mus musculus
gtgaattgcagttctgcaggtgaag

SEQ ID NO: 39147 - DNA, 25 bp, Mus musculus
ctgggtcagacccacaggctcattc

SEQ ID NO: 39148 - DNA, 25 bp, Mus musculus
cagacccacaggctcattctggccg

SEQ ID NO: 39149 - DNA, 25 bp, Mus musculus
cacaggctcattctggccgggagat

SEQ ID NO: 39150 - DNA, 25 bp, Mus musculus
ctcattctggccgggagatgctgtc

SEQ ID NO: 39151 - DNA, 25 bp, Mus musculus
tctataagccctactggaattccag

SEQ ID NO: 39152 - DNA, 25 bp, Mus musculus
agccctactggaattccagattgta

SEQ ID NO: 39153 - DNA, 25 bp, Mus musculus
gggccaagctctgtctttttgagtt

SEQ ID NO: 39154 - DNA, 25 bp, Mus musculus
gtctttttgagttctcatggccttg

SEQ ID NO: 39155 - DNA, 25 bp, Mus musculus
ttgagttctcatggccttgttggga

SEQ ID NO: 39156 - DNA, 25 bp, Mus musculus
tctcatggccttgttgggagaagaa

SEQ ID NO: 39157 - DNA, 25 bp, Mus musculus
gagctcaaattcccagcatcccctt

SEQ ID NO: 39158 - DNA, 25 bp, Mus musculus
gaccacattgctgctataggtagtc

SEQ ID NO: 39159 - DNA, 25 bp, Mus musculus
gaagccacttggctagtcagggtgt

SEQ ID NO: 39160 - DNA, 25 bp, Mus musculus
tgcacacatgggactgctacacatt

SEQ ID NO: 39161 - DNA, 25 bp, Mus musculus
actgctacacattcctgtccccatg

SEQ ID NO: 39162 - DNA, 25 bp, Mus musculus
tcctgtccccatgcagtcttagcca

SEQ ID NO: 39163 - DNA, 25 bp, Mus musculus
ccccatgcagtcttagccatcaggt

SEQ ID NO: 39164 - DNA, 25 bp, Mus musculus
ttagccatcaggttgaaaccagtag

SEQ ID NO: 39165 - DNA, 25 bp, Mus musculus
gctgctgctgagcccaagtgtggtg

SEQ ID NO: 39166 - DNA, 25 bp, Mus musculus
gtgccggcctgtcaacgcaactctg

SEQ ID NO: 39167 - DNA, 25 bp, Mus musculus
gcctcagccagtgtgcacctaccgg

SEQ ID NO: 39168 - DNA, 25 bp, Mus musculus
gccagtgtgcacctaccgggagctt

SEQ ID NO: 39169 - DNA, 25 bp, Mus musculus
gtgcacctaccgggagcttgcgttc

SEQ ID NO: 39170 - DNA, 25 bp, Mus musculus
catagtctcctttcctgtagccctc

SEQ ID NO: 39171 - DNA, 25 bp, Mus musculus
ctgccggctcagtagctctgactgt

SEQ ID NO: 39172 - DNA, 25 bp, Mus musculus
tcaccaccagcaggtgttctaatca

SEQ ID NO: 39173 - DNA, 25 bp, Mus musculus
aaaggctttccaactgcgcttccat

SEQ ID NO: 39174 - DNA, 25 bp, Mus musculus
tttccaactgcgcttccatgttctt

SEQ ID NO: 39175 - DNA, 25 bp, Mus musculus
actgcgcttccatgttctttagtag

SEQ ID NO: 39176 - DNA, 25 bp, Mus musculus
cttccatgttctttagtaggctctg

SEQ ID NO: 39177 - DNA, 25 bp, Mus musculus
gcctgtcaacgcaactctggccgca

SEQ ID NO: 39178 - DNA, 25 bp, Mus musculus
tctttagtaggctctgaggacacag

SEQ ID NO: 39179 - DNA, 25 bp, Mus musculus
caacgcaactctggccgcagagaat

SEQ ID NO: 39180 - DNA, 25 bp, Mus musculus
aactctggccgcagagaatgagttc

SEQ ID NO: 39181 - DNA, 25 bp, Mus musculus
caccagcatctgtgccggctactgt

SEQ ID NO: 39182 - DNA, 25 bp, Mus musculus
catctgtgccggctactgtcctagc

SEQ ID NO: 39183 - DNA, 25 bp, Mus musculus
tcctagcatggtccgagtactgccg

SEQ ID NO: 39184 - DNA, 25 bp, Mus musculus
catggtccgagtactgccggctgct

SEQ ID NO: 39185 - DNA, 25 bp, Mus musculus
tcctgtgcctcagccagtgtgcacc

SEQ ID NO: 39186 - DNA, 25 bp, Mus musculus
tgtagtttcccaccatggcatcgcg

SEQ ID NO: 39187 - DNA, 25 bp, Mus musculus
agtttcccaccatggcatcgcgctt

SEQ ID NO: 39188 - DNA, 25 bp, Mus musculus
cttcacaaacatttcttcggtgctt

SEQ ID NO: 39189 - DNA, 25 bp, Mus musculus
cacaaacatttcttcggtgctttgc

SEQ ID NO: 39190 - DNA, 25 bp, Mus musculus
catttcttcggtgctttgcgcctcc

SEQ ID NO: 39191 - DNA, 25 bp, Mus musculus
ttcttcggtgctttgcgcctccaca

SEQ ID NO: 39192 - DNA, 25 bp, Mus musculus
ttcggtgctttgcgcctccacatta

SEQ ID NO: 39193 - DNA, 25 bp, Mus musculus
ttgcgcctccacattacggacgatg

SEQ ID NO: 39194 - DNA, 25 bp, Mus musculus
cgcctccacattacggacgatgcaa

SEQ ID NO: 39195 - DNA, 25 bp, Mus musculus
cacattacggacgatgcaagggatg

SEQ ID NO: 39196 - DNA, 25 bp, Mus musculus
attacggacgatgcaagggatgacc

SEQ ID NO: 39197 - DNA, 25 bp, Mus musculus
gaccacagtttcattgcatgaagtg

SEQ ID NO: 39198 - DNA, 25 bp, Mus musculus
ttcccaccatggcatcgcgcttatc

SEQ ID NO: 39199 - DNA, 25 bp, Mus musculus
ccatggcatcgcgcttatccatttt

SEQ ID NO: 39200 - DNA, 25 bp, Mus musculus
tggcatcgcgcttatccattttcaa

SEQ ID NO: 39201 - DNA, 25 bp, Mus musculus
catcgcgcttatccattttcaaaga

SEQ ID NO: 39202 - DNA, 25 bp, Mus musculus
gcttatccattttcaaagaggcaat

SEQ ID NO: 39203 - DNA, 25 bp, Mus musculus
gttcaacttccacttcacaaacatt

SEQ ID NO: 39204 - DNA, 25 bp, Mus musculus
caacttccacttcacaaacatttct

SEQ ID NO: 39205 - DNA, 25 bp, Mus musculus
ccacttcacaaacatttcttcggtg

SEQ ID NO: 39206 - DNA, 25 bp, Mus musculus
ttactggtccagaactctggtagca

SEQ ID NO: 39207 - DNA, 25 bp, Mus musculus
gtgttctggcccacgcacagctctc

SEQ ID NO: 39208 - DNA, 25 bp, Mus musculus
ttgttcatgagcgcctcgcagccct

SEQ ID NO: 39209 - DNA, 25 bp, Mus musculus
ttcatgagcgcctcgcagccctggc

SEQ ID NO: 39210 - DNA, 25 bp, Mus musculus
tacgcctgcgtccagtacggtgcac

SEQ ID NO: 39211 - DNA, 25 bp, Mus musculus
gcctgcgtccagtacggtgcacaca

SEQ ID NO: 39212 - DNA, 25 bp, Mus musculus
tgcgtccagtacggtgcacacaggc

SEQ ID NO: 39213 - DNA, 25 bp, Mus musculus
cacaggcgcgtacatggagcacagg

SEQ ID NO: 39214 - DNA, 25 bp, Mus musculus
gagctcggcgtacgactgcaccttc

SEQ ID NO: 39215 - DNA, 25 bp, Mus musculus
ggcgtacgactgcaccttcaccaga

SEQ ID NO: 39216 - DNA, 25 bp, Mus musculus
gtacgactgcaccttcaccagaggg

SEQ ID NO: 39217 - DNA, 25 bp, Mus musculus
cgactgcaccttcaccagagggtag

SEQ ID NO: 39218 - DNA, 25 bp, Mus musculus
gcgccgtgcaccgggaacttctcgc

SEQ ID NO: 39219 - DNA, 25 bp, Mus musculus
ctgcaccttcaccagagggtagaac

SEQ ID NO: 39220 - DNA, 25 bp, Mus musculus
ccgtgcaccgggaacttctcgcact

SEQ ID NO: 39221 - DNA, 25 bp, Mus musculus
accgggaacttctcgcacttgagtg

SEQ ID NO: 39222 - DNA, 25 bp, Mus musculus
gggaacttctcgcacttgagtgtgt

SEQ ID NO: 39223 - DNA, 25 bp, Mus musculus
aacttctcgcacttgagtgtgtctg

SEQ ID NO: 39224 - DNA, 25 bp, Mus musculus
tcgcacttgagtgtgtctggccact

SEQ ID NO: 39225 - DNA, 25 bp, Mus musculus
tctggccactggaagccgaacttgt

SEQ ID NO: 39226 - DNA, 25 bp, Mus musculus
aagccgaacttgttcatgagcgcct

SEQ ID NO: 39227 - DNA, 25 bp, Mus musculus
ctttactgtcttaataactggatga

SEQ ID NO: 39228 - DNA, 25 bp, Mus musculus
aattatcactctgaaaatgtattta

SEQ ID NO: 39229 - DNA, 25 bp, Mus musculus
gtatgatccacactgttaaaacata

SEQ ID NO: 39230 - DNA, 25 bp, Mus musculus
tccacactgttaaaacataggcagc

SEQ ID NO: 39231 - DNA, 25 bp, Mus musculus
aggcagcagctcagggccctggaca

SEQ ID NO: 39232 - DNA, 25 bp, Mus musculus
agggccctggacagcctgagtcaac

SEQ ID NO: 39233 - DNA, 25 bp, Mus musculus
agtcaacctagagtagctggaacca

SEQ ID NO: 39234 - DNA, 25 bp, Mus musculus
aattatccattgagaagctgaacaa

SEQ ID NO: 39235 - DNA, 25 bp, Mus musculus
accacgttacactgagaacacttca

SEQ ID NO: 39236 - DNA, 25 bp, Mus musculus
ttacactgagaacacttcagttctt

SEQ ID NO: 39237 - DNA, 25 bp, Mus musculus
caactaccattatgttttgaataca

SEQ ID NO: 39238 - DNA, 25 bp, Mus musculus
gaatacacctttcaataaaatgatt

SEQ ID NO: 39239 - DNA, 25 bp, Mus musculus
tgataaaacactccagacattttta

SEQ ID NO: 39240 - DNA, 25 bp, Mus musculus
ccagacatttttactacagactgtt

SEQ ID NO: 39241 - DNA, 25 bp, Mus musculus
actacagactgtttctataaaactg

SEQ ID NO: 39242 - DNA, 25 bp, Mus musculus
gccattgcttctaatggagaatttt

SEQ ID NO: 39243 - DNA, 25 bp, Mus musculus
attgctgagtctatctgcaaaacct

SEQ ID NO: 39244 - DNA, 25 bp, Mus musculus
atctgcaaaacctttctctaagtct

SEQ ID NO: 39245 - DNA, 25 bp, Mus musculus
agccgttgtgctcagagtctccatg

SEQ ID NO: 39246 - DNA, 25 bp, Mus musculus
ctccatgctggcttgaatgtatgat

SEQ ID NO: 39247 - DNA, 25 bp, Mus musculus
cgtgtcgtcctcaggaactccccat

SEQ ID NO: 39248 - DNA, 25 bp, Mus musculus
gtcgtcctcaggaactccccataag

SEQ ID NO: 39249 - DNA, 25 bp, Mus musculus
gcgtgtcccgagatcaagatccaac

SEQ ID NO: 39250 - DNA, 25 bp, Mus musculus
tgtcccgagatcaagatccaactgg

SEQ ID NO: 39251 - DNA, 25 bp, Mus musculus
atccaactggaaacatctgagcagc

SEQ ID NO: 39252 - DNA, 25 bp, Mus musculus
ccccagatgggctgctagctgtcac

SEQ ID NO: 39253 - DNA, 25 bp, Mus musculus
ggctgctagctgtcacctcatcagc

SEQ ID NO: 39254 - DNA, 25 bp, Mus musculus
tgctagctgtcacctcatcagcagg

SEQ ID NO: 39255 - DNA, 25 bp, Mus musculus
tagctgtcacctcatcagcaggcgg

SEQ ID NO: 39256 - DNA, 25 bp, Mus musculus
tcacctcatcagcaggcgggactga

SEQ ID NO: 39257 - DNA, 25 bp, Mus musculus
catcagcaggcgggactgagcagag

SEQ ID NO: 39258 - DNA, 25 bp, Mus musculus
aggcctcagaagcacaagaagatgc

SEQ ID NO: 39259 - DNA, 25 bp, Mus musculus
gtcctcaggaactccccataagcgg

SEQ ID NO: 39260 - DNA, 25 bp, Mus musculus
ctccttcctctacagcacatggctg

SEQ ID NO: 39261 - DNA, 25 bp, Mus musculus
cttcctctacagcacatggctggac

SEQ ID NO: 39262 - DNA, 25 bp, Mus musculus
cctctacagcacatggctggacgac

SEQ ID NO: 39263 - DNA, 25 bp, Mus musculus
ctacagcacatggctggacgacagc

SEQ ID NO: 39264 - DNA, 25 bp, Mus musculus
cagcacatggctggacgacagcgtg

SEQ ID NO: 39265 - DNA, 25 bp, Mus musculus
cacatggctggacgacagcgtgaca

SEQ ID NO: 39266 - DNA, 25 bp, Mus musculus
atggctggacgacagcgtgacacca

SEQ ID NO: 39267 - DNA, 25 bp, Mus musculus
atgatgtcgccatcttggatgcctc

SEQ ID NO: 39268 - DNA, 25 bp, Mus musculus
gaattgggaaccacctcttgaacat

SEQ ID NO: 39269 - DNA, 25 bp, Mus musculus
aaacttggcgtgatggtccgcatcc

SEQ ID NO: 39270 - DNA, 25 bp, Mus musculus
cttggcgtgatggtccgcatccgga

SEQ ID NO: 39271 - DNA, 25 bp, Mus musculus
gtccgcatccggatgccaatgaagc

SEQ ID NO: 39272 - DNA, 25 bp, Mus musculus
cgcatccggatgccaatgaagcgct

SEQ ID NO: 39273 - DNA, 25 bp, Mus musculus
ccaatgaagcgcttcttccagtctt

SEQ ID NO: 39274 - DNA, 25 bp, Mus musculus
aagcgcttcttccagtctttcacat

SEQ ID NO: 39275 - DNA, 25 bp, Mus musculus
cgcttcttccagtctttcacatgct

SEQ ID NO: 39276 - DNA, 25 bp, Mus musculus
cagtctttcacatgcttgttttgga

SEQ ID NO: 39277 - DNA, 25 bp, Mus musculus
tctttcacatgcttgttttggaact

SEQ ID NO: 39278 - DNA, 25 bp, Mus musculus
ttcacatgcttgttttggaactcag

SEQ ID NO: 39279 - DNA, 25 bp, Mus musculus
accacctcttgaacatatattccac

SEQ ID NO: 39280 - DNA, 25 bp, Mus musculus
acctcttgaacatatattccactgc

SEQ ID NO: 39281 - DNA, 25 bp, Mus musculus
acatatattccactgctgaccgctg

SEQ ID NO: 39282 - DNA, 25 bp, Mus musculus
tatattccactgctgaccgctggaa

SEQ ID NO: 39283 - DNA, 25 bp, Mus musculus
attccactgctgaccgctggaaagt

SEQ ID NO: 39284 - DNA, 25 bp, Mus musculus
ctgaccgctggaaagtctgggttgg

SEQ ID NO: 39285 - DNA, 25 bp, Mus musculus
tctgggttggcggccttcagttcct

SEQ ID NO: 39286 - DNA, 25 bp, Mus musculus
tccaccaaacttggcgtgatggtcc

SEQ ID NO: 39287 - DNA, 25 bp, Mus musculus
tatttcatcaaagactccatgggtt

SEQ ID NO: 39288 - DNA, 25 bp, Mus musculus
tgtatatttactaacttccaagaga

SEQ ID NO: 39289 - DNA, 25 bp, Mus musculus
ctccggtaggcagcatgctgctatg

SEQ ID NO: 39290 - DNA, 25 bp, Mus musculus
taggcagcatgctgctatgtacaaa

SEQ ID NO: 39291 - DNA, 25 bp, Mus musculus
tgctgctatgtacaaacttgtacca

SEQ ID NO: 39292 - DNA, 25 bp, Mus musculus
caaacttgtaccaaatgttgcagaa

SEQ ID NO: 39293 - DNA, 25 bp, Mus musculus
acttgtaccaaatgttgcagaagca

SEQ ID NO: 39294 - DNA, 25 bp, Mus musculus
tgagttttatctccagaggaagaga

SEQ ID NO: 39295 - DNA, 25 bp, Mus musculus
ttatctccagaggaagagatgtccc

SEQ ID NO: 39296 - DNA, 25 bp, Mus musculus
gagatgtccctgtactgaactctgt

SEQ ID NO: 39297 - DNA, 25 bp, Mus musculus
gtgctttcctggtgtcagagtgggc

SEQ ID NO: 39298 - DNA, 25 bp, Mus musculus
ctttcctggtgtcagagtgggctcg

SEQ ID NO: 39299 - DNA, 25 bp, Mus musculus
atatttactaacttccaagagacat

SEQ ID NO: 39300 - DNA, 25 bp, Mus musculus
agtccagtgtcccaagctggagcag

SEQ ID NO: 39301 - DNA, 25 bp, Mus musculus
gtgtcccaagctggagcagtgagac

SEQ ID NO: 39302 - DNA, 25 bp, Mus musculus
ctcctgcattgtggtgcagctccac

SEQ ID NO: 39303 - DNA, 25 bp, Mus musculus
ctgcattgtggtgcagctccacctg

SEQ ID NO: 39304 - DNA, 25 bp, Mus musculus
ggtgcagctccacctgccatatgtg

SEQ ID NO: 39305 - DNA, 25 bp, Mus musculus
ccaaggcttgcaagccaggctagcc

SEQ ID NO: 39306 - DNA, 25 bp, Mus musculus
aggcttgcaagccaggctagcccct

SEQ ID NO: 39307 - DNA, 25 bp, Mus musculus
gctctcacaggaagcctgcaagtct

SEQ ID NO: 39308 - DNA, 25 bp, Mus musculus
tgtccatcttcagctaacagcatcg

SEQ ID NO: 39309 - DNA, 25 bp, Mus musculus
ttaccagctccaaatgtcactacct

SEQ ID NO: 39310 - DNA, 25 bp, Mus musculus
gctccaaatgtcactacctgaaggc

SEQ ID NO: 39311 - DNA, 25 bp, Mus musculus
actacctgaaggcagtgtgcacaca

SEQ ID NO: 39312 - DNA, 25 bp, Mus musculus
gcacacaaagcaaggtcttgcctag

SEQ ID NO: 39313 - DNA, 25 bp, Mus musculus
ctcctctgtaaaaggccagaacttg

SEQ ID NO: 39314 - DNA, 25 bp, Mus musculus
tccaacttttctctgaggagaaatg

SEQ ID NO: 39315 - DNA, 25 bp, Mus musculus
atcattgtgccgacttccctactaa

SEQ ID NO: 39316 - DNA, 25 bp, Mus musculus
gtgccgacttccctactaatcccat

SEQ ID NO: 39317 - DNA, 25 bp, Mus musculus
acttccctactaatcccatgacaat

SEQ ID NO: 39318 - DNA, 25 bp, Mus musculus
ctactaatcccatgacaataaagaa

SEQ ID NO: 39319 - DNA, 25 bp, Mus musculus
gagacactaggactgactggtaaaa

SEQ ID NO: 39320 - DNA, 25 bp, Mus musculus
aaagttctctagtgtctcccactgc

SEQ ID NO: 39321 - DNA, 25 bp, Mus musculus
tgtctcccactgcatagctgtgaag

SEQ ID NO: 39322 - DNA, 25 bp, Mus musculus
ccactgcatagctgtgaaggctaag

SEQ ID NO: 39323 - DNA, 25 bp, Mus musculus
tatgaaacctttcatctaggcttgt

SEQ ID NO: 39324 - DNA, 25 bp, Mus musculus
acctttcatctaggcttgtatatgc

SEQ ID NO: 39325 - DNA, 25 bp, Mus musculus
ctgacctaaaagacaccagcagcta

SEQ ID NO: 39326 - DNA, 25 bp, Mus musculus
gttgtcttaccagctccaaatgtca

SEQ ID NO: 39327 - DNA, 25 bp, Mus musculus
ctggctcttcaaagcctgtgcgctc

SEQ ID NO: 39328 - DNA, 25 bp, Mus musculus
gctcttcaaagcctgtgcgctcatt

SEQ ID NO: 39329 - DNA, 25 bp, Mus musculus
ctgaatcagcaaccttgccggtctc

SEQ ID NO: 39330 - DNA, 25 bp, Mus musculus
aatcagcaaccttgccggtctcact

SEQ ID NO: 39331 - DNA, 25 bp, Mus musculus
cagcaaccttgccggtctcactagt

SEQ ID NO: 39332 - DNA, 25 bp, Mus musculus
caaccttgccggtctcactagtgtc

SEQ ID NO: 39333 - DNA, 25 bp, Mus musculus
ccttgccggtctcactagtgtcatg

SEQ ID NO: 39334 - DNA, 25 bp, Mus musculus
tgccggtctcactagtgtcatgggc

SEQ ID NO: 39335 - DNA, 25 bp, Mus musculus
cggtctcactagtgtcatgggctgc

SEQ ID NO: 39336 - DNA, 25 bp, Mus musculus
tctcactagtgtcatgggctgcagt

SEQ ID NO: 39337 - DNA, 25 bp, Mus musculus
cactagtgtcatgggctgcagttta

SEQ ID NO: 39338 - DNA, 25 bp, Mus musculus
tagtgtcatgggctgcagtttacgg

SEQ ID NO: 39339 - DNA, 25 bp, Mus musculus
cttcaaagcctgtgcgctcattctc

SEQ ID NO: 39340 - DNA, 25 bp, Mus musculus
caaagcctgtgcgctcattctctgg

SEQ ID NO: 39341 - DNA, 25 bp, Mus musculus
ctgtgcgctcattctctggtctgtg

SEQ ID NO: 39342 - DNA, 25 bp, Mus musculus
ctggtctgtggtgcgatctaatcgg

SEQ ID NO: 39343 - DNA, 25 bp, Mus musculus
gcgatctaatcggggcgaagattct

SEQ ID NO: 39344 - DNA, 25 bp, Mus musculus
atctaatcggggcgaagattctggc

SEQ ID NO: 39345 - DNA, 25 bp, Mus musculus
agattctggcgagttgaggcaggtc

SEQ ID NO: 39346 - DNA, 25 bp, Mus musculus
ggtctgaatcagcaaccttgccggt

SEQ ID NO: 39347 - DNA, 25 bp, Mus musculus
agtttcacctggactacctagtgca

SEQ ID NO: 39348 - DNA, 25 bp, Mus musculus
acctggactacctagtgcagacctt

SEQ ID NO: 39349 - DNA, 25 bp, Mus musculus
ctcctccagctgtagagacttgtgc

SEQ ID NO: 39350 - DNA, 25 bp, Mus musculus
tatccacggaacacaccaataacag

SEQ ID NO: 39351 - DNA, 25 bp, Mus musculus
tctacatcatgaaggccgacacagt

SEQ ID NO: 39352 - DNA, 25 bp, Mus musculus
tcatgaaggccgacacagtgatcgt

SEQ ID NO: 39353 - DNA, 25 bp, Mus musculus
acacagtgatcgtgggctctgtaaa

SEQ ID NO: 39354 - DNA, 25 bp, Mus musculus
tgatcgtgggctctgtaaaaactga

SEQ ID NO: 39355 - DNA, 25 bp, Mus musculus
ctccagcagggtctacagagtctga

SEQ ID NO: 39356 - DNA, 25 bp, Mus musculus
aggagacagaaccacctctgggcag

SEQ ID NO: 39357 - DNA, 25 bp, Mus musculus
cagaaccacctctgggcagctgcac

SEQ ID NO: 39358 - DNA, 25 bp, Mus musculus
ccacgactgtctctgagaagtgaca

SEQ ID NO: 39359 - DNA, 25 bp, Mus musculus
actacctagtgcagaccttccagcc

SEQ ID NO: 39360 - DNA, 25 bp, Mus musculus
agaccttccagcccaagatggagca

SEQ ID NO: 39361 - DNA, 25 bp, Mus musculus
tccagcccaagatggagcagacaga

SEQ ID NO: 39362 - DNA, 25 bp, Mus musculus
ctgaaaagctaacccagccacagag

SEQ ID NO: 39363 - DNA, 25 bp, Mus musculus
agctaacccagccacagagaagcgg

SEQ ID NO: 39364 - DNA, 25 bp, Mus musculus
tgacagatcccagcacgggacacaa

SEQ ID NO: 39365 - DNA, 25 bp, Mus musculus
atcccagcacgggacacaagttgag

SEQ ID NO: 39366 - DNA, 25 bp, Mus musculus
gacacaagttgagcccagtgagccc

SEQ ID NO: 39367 - DNA, 25 bp, Mus musculus
ccttgtagcagttgttgttgaagcg

SEQ ID NO: 39368 - DNA, 25 bp, Mus musculus
gattgtagctgcctagggctgtgag

SEQ ID NO: 39369 - DNA, 25 bp, Mus musculus
ctttgaccagtcaggcttgagatag

SEQ ID NO: 39370 - DNA, 25 bp, Mus musculus
tgaccagtcaggcttgagatagtag

SEQ ID NO: 39371 - DNA, 25 bp, Mus musculus
gtagatgataccatccagggctcca

SEQ ID NO: 39372 - DNA, 25 bp, Mus musculus
gatgataccatccagggctccaggc

SEQ ID NO: 39373 - DNA, 25 bp, Mus musculus
tcgcaccagcagcacaacgaggacc

SEQ ID NO: 39374 - DNA, 25 bp, Mus musculus
caccagcagcacaacgaggaccacg

SEQ ID NO: 39375 - DNA, 25 bp, Mus musculus
cagcacaacgaggaccacgtagggg

SEQ ID NO: 39376 - DNA, 25 bp, Mus musculus
gaagtacacgatctttcctgttgac

SEQ ID NO: 39377 - DNA, 25 bp, Mus musculus
gtacacgatctttcctgttgacttg

SEQ ID NO: 39378 - DNA, 25 bp, Mus musculus
cacgatctttcctgttgacttgacc

SEQ ID NO: 39379 - DNA, 25 bp, Mus musculus
gggcccccaggctagtggataagag

SEQ ID NO: 39380 - DNA, 25 bp, Mus musculus
cccccaggctagtggataagagaag

SEQ ID NO: 39381 - DNA, 25 bp, Mus musculus
aatctgggtcccagcatctatccat

SEQ ID NO: 39382 - DNA, 25 bp, Mus musculus
cccagcatctatccatacctgaggg

SEQ ID NO: 39383 - DNA, 25 bp, Mus musculus
agcatctatccatacctgaggggac

SEQ ID NO: 39384 - DNA, 25 bp, Mus musculus
tatccatacctgaggggaccctagc

SEQ ID NO: 39385 - DNA, 25 bp, Mus musculus
ggaccctagctttgaccagtcaggc

SEQ ID NO: 39386 - DNA, 25 bp, Mus musculus
ccctagctttgaccagtcaggcttg

SEQ ID NO: 39387 - DNA, 25 bp, Mus musculus
taaagttgtccttattggagattct

SEQ ID NO: 39388 - DNA, 25 bp, Mus musculus
aaagttgtccttattggagattctg

SEQ ID NO: 39389 - DNA, 25 bp, Mus musculus
tcctgtctcgatttactcgaaatga

SEQ ID NO: 39390 - DNA, 25 bp, Mus musculus
cctgtctcgatttactcgaaatgag

SEQ ID NO: 39391 - DNA, 25 bp, Mus musculus
ctgtctcgatttactcgaaatgagt

SEQ ID NO: 39392 - DNA, 25 bp, Mus musculus
agaagcatccaggttgatgggaaaa

SEQ ID NO: 39393 - DNA, 25 bp, Mus musculus
gaagcatccaggttgatgggaaaac

SEQ ID NO: 39394 - DNA, 25 bp, Mus musculus
aagcatccaggttgatgggaaaaca

SEQ ID NO: 39395 - DNA, 25 bp, Mus musculus
agcatccaggttgatgggaaaacaa

SEQ ID NO: 39396 - DNA, 25 bp, Mus musculus
aagttgtccttattggagattctgg

SEQ ID NO: 39397 - DNA, 25 bp, Mus musculus
tgtccttattggagattctggtgtt

SEQ ID NO: 39398 - DNA, 25 bp, Mus musculus
gtccttattggagattctggtgttg

SEQ ID NO: 39399 - DNA, 25 bp, Mus musculus
gaaagagtaacctcctgtctcgatt

SEQ ID NO: 39400 - DNA, 25 bp, Mus musculus
gagtaacctcctgtctcgatttact

SEQ ID NO: 39401 - DNA, 25 bp, Mus musculus
gtaacctcctgtctcgatttactcg

SEQ ID NO: 39402 - DNA, 25 bp, Mus musculus
taacctcctgtctcgatttactcga

SEQ ID NO: 39403 - DNA, 25 bp, Mus musculus
cctcctgtctcgatttactcgaaat

SEQ ID NO: 39404 - DNA, 25 bp, Mus musculus
atcacccggtggaaatttagctctg

SEQ ID NO: 39405 - DNA, 25 bp, Mus musculus
tcacccggtggaaatttagctctgt

SEQ ID NO: 39406 - DNA, 25 bp, Mus musculus
ctgtctttcaattttgaaactcata

SEQ ID NO: 39407 - DNA, 25 bp, Mus musculus
tgtctttcaattttgaaactcatag

SEQ ID NO: 39408 - DNA, 25 bp, Mus musculus
aattttgaaactcataggagatata

SEQ ID NO: 39409 - DNA, 25 bp, Mus musculus
attttgaaactcataggagatatag

SEQ ID NO: 39410 - DNA, 25 bp, Mus musculus
ttttgaaactcataggagatataga

SEQ ID NO: 39411 - DNA, 25 bp, Mus musculus
taatagttgcagtgttgacgataaa

SEQ ID NO: 39412 - DNA, 25 bp, Mus musculus
aatagttgcagtgttgacgataaag

SEQ ID NO: 39413 - DNA, 25 bp, Mus musculus
atagttgcagtgttgacgataaaga

SEQ ID NO: 39414 - DNA, 25 bp, Mus musculus
tagttgcagtgttgacgataaagat

SEQ ID NO: 39415 - DNA, 25 bp, Mus musculus
tagtgaaaccaatactattttagat

SEQ ID NO: 39416 - DNA, 25 bp, Mus musculus
ggaaatttagctctgtctttcaatt

SEQ ID NO: 39417 - DNA, 25 bp, Mus musculus
gaaatttagctctgtctttcaattt

SEQ ID NO: 39418 - DNA, 25 bp, Mus musculus
ttagctctgtctttcaattttgaaa

SEQ ID NO: 39419 - DNA, 25 bp, Mus musculus
tagctctgtctttcaattttgaaac

SEQ ID NO: 39420 - DNA, 25 bp, Mus musculus
agctctgtctttcaattttgaaact

SEQ ID NO: 39421 - DNA, 25 bp, Mus musculus
gctctgtctttcaattttgaaactc

SEQ ID NO: 39422 - DNA, 25 bp, Mus musculus
ctctgtctttcaattttgaaactca

SEQ ID NO: 39423 - DNA, 25 bp, Mus musculus
tctgtctttcaattttgaaactcat

SEQ ID NO: 39424 - DNA, 25 bp, Mus musculus
aaccgtggctgtgaggctgctgcag

SEQ ID NO: 39425 - DNA, 25 bp, Mus musculus
ggtggaccagcacacagtgaccttg

SEQ ID NO: 39426 - DNA, 25 bp, Mus musculus
tggtcacactgtgatcctgcatgcc

SEQ ID NO: 39427 - DNA, 25 bp, Mus musculus
tcacactgtgatcctgcatgcccag

SEQ ID NO: 39428 - DNA, 25 bp, Mus musculus
tgtgatcctgcatgcccagcctggg

SEQ ID NO: 39429 - DNA, 25 bp, Mus musculus
gacttgtggtctctgtgggaacttc

SEQ ID NO: 39430 - DNA, 25 bp, Mus musculus
ttgtggtctctgtgggaacttcaat

SEQ ID NO: 39431 - DNA, 25 bp, Mus musculus
tctctgtgggaacttcaatggcttt

SEQ ID NO: 39432 - DNA, 25 bp, Mus musculus
gaacttcaatggctttgccaggatg

SEQ ID NO: 39433 - DNA, 25 bp, Mus musculus
ctttgccaggatgatctgcagggtc

SEQ ID NO: 39434 - DNA, 25 bp, Mus musculus
tgccaggatgatctgcagggtccgg

SEQ ID NO: 39435 - DNA, 25 bp, Mus musculus
ctgcccacagaggcttcgtttggga

SEQ ID NO: 39436 - DNA, 25 bp, Mus musculus
ggaccagcacacagtgaccttgccc

SEQ ID NO: 39437 - DNA, 25 bp, Mus musculus
cctccgggagccactgctgtacatt

SEQ ID NO: 39438 - DNA, 25 bp, Mus musculus
actgctgtacattgagcttcgtggt

SEQ ID NO: 39439 - DNA, 25 bp, Mus musculus
gctgtacattgagcttcgtggtcac

SEQ ID NO: 39440 - DNA, 25 bp, Mus musculus
gtacattgagcttcgtggtcacact

SEQ ID NO: 39441 - DNA, 25 bp, Mus musculus
cattgagcttcgtggtcacactgtg

SEQ ID NO: 39442 - DNA, 25 bp, Mus musculus
gcttcgtggtcacactgtgatcctg

SEQ ID NO: 39443 - DNA, 25 bp, Mus musculus
tcgtggtcacactgtgatcctgcat

SEQ ID NO: 39444 - DNA, 25 bp, Mus musculus
tctcttagagacctccgctccgtac

SEQ ID NO: 39445 - DNA, 25 bp, Mus musculus
tcttagagacctccgctccgtacac

SEQ ID NO: 39446 - DNA, 25 bp, Mus musculus
gagctgcctacgatgagacaaaacg

SEQ ID NO: 39447 - DNA, 25 bp, Mus musculus
gctgcctacgatgagacaaaacggt

SEQ ID NO: 39448 - DNA, 25 bp, Mus musculus
tactgggtctttcagggcaaacctg

SEQ ID NO: 39449 - DNA, 25 bp, Mus musculus
gtctttcagggcaaacctgtgatgc

SEQ ID NO: 39450 - DNA, 25 bp, Mus musculus
gggcaaacctgtgatgcccagtcaa

SEQ ID NO: 39451 - DNA, 25 bp, Mus musculus
gcaaacctgtgatgcccagtcaaaa

SEQ ID NO: 39452 - DNA, 25 bp, Mus musculus
acctgtgatgcccagtcaaaacacc

SEQ ID NO: 39453 - DNA, 25 bp, Mus musculus
ctgtgatgcccagtcaaaacacctt

SEQ ID NO: 39454 - DNA, 25 bp, Mus musculus
gtgatgcccagtcaaaacaccttcg

SEQ ID NO: 39455 - DNA, 25 bp, Mus musculus
gatgcccagtcaaaacaccttcgaa

SEQ ID NO: 39456 - DNA, 25 bp, Mus musculus
tacacctccagctttttccactaca

SEQ ID NO: 39457 - DNA, 25 bp, Mus musculus
tccagctttttccactacaccgaga

SEQ ID NO: 39458 - DNA, 25 bp, Mus musculus
cagctttttccactacaccgagaca

SEQ ID NO: 39459 - DNA, 25 bp, Mus musculus
gctttttccactacaccgagacaga

SEQ ID NO: 39460 - DNA, 25 bp, Mus musculus
tttccactacaccgagacagataaa

SEQ ID NO: 39461 - DNA, 25 bp, Mus musculus
tccactacaccgagacagataaaag

SEQ ID NO: 39462 - DNA, 25 bp, Mus musculus
cactacaccgagacagataaaagag

SEQ ID NO: 39463 - DNA, 25 bp, Mus musculus
cactctgggagctgcctacgatgag

SEQ ID NO: 39464 - DNA, 25 bp, Mus musculus
ggagccaggcatctacttcattgac

SEQ ID NO: 39465 - DNA, 25 bp, Mus musculus
aggcatctacttcattgaccacctc

SEQ ID NO: 39466 - DNA, 25 bp, Mus musculus
tggccttgtaagctctgtgatgtca

SEQ ID NO: 39467 - DNA, 25 bp, Mus musculus
gatcacatttgatcctaccaaaacc

SEQ ID NO: 39468 - DNA, 25 bp, Mus musculus
atttgatcctaccaaaaccactgct

SEQ ID NO: 39469 - DNA, 25 bp, Mus musculus
cactgctgctgtttctgagaaaaga

SEQ ID NO: 39470 - DNA, 25 bp, Mus musculus
aaagcattttattcacctgcaagat

SEQ ID NO: 39471 - DNA, 25 bp, Mus musculus
ttttattcacctgcaagatcacatc

SEQ ID NO: 39472 - DNA, 25 bp, Mus musculus
ccctagctttgattttgcttaaatg

SEQ ID NO: 39473 - DNA, 25 bp, Mus musculus
taactcgatttttgtgctcagggaa

SEQ ID NO: 39474 - DNA, 25 bp, Mus musculus
gatttttgtgctcagggaagatgca

SEQ ID NO: 39475 - DNA, 25 bp, Mus musculus
aaatcaacatgcagaatggaatttg

SEQ ID NO: 39476 - DNA, 25 bp, Mus musculus
ctacttcattgaccacctcttggac

SEQ ID NO: 39477 - DNA, 25 bp, Mus musculus
taaccaagaggtcctgcagcgcttc

SEQ ID NO: 39478 - DNA, 25 bp, Mus musculus
tgtcgtgactgacagcggcatggag

SEQ ID NO: 39479 - DNA, 25 bp, Mus musculus
gactgacagcggcatggagctgctg

SEQ ID NO: 39480 - DNA, 25 bp, Mus musculus
gacatgtgtaccccggactgtggag

SEQ ID NO: 39481 - DNA, 25 bp, Mus musculus
gtgcatggcaggctgcgacaaggca

SEQ ID NO: 39482 - DNA, 25 bp, Mus musculus
ctgcgacaaggcatctgtgcccttc

SEQ ID NO: 39483 - DNA, 25 bp, Mus musculus
ccagctgagacactcagtgagactg

SEQ ID NO: 39484 - DNA, 25 bp, Mus musculus
ggcttccaacaggctaagcaagcct

SEQ ID NO: 39485 - DNA, 25 bp, Mus musculus
cttccaacaggctaagcaagcctcc

SEQ ID NO: 39486 - DNA, 25 bp, Mus musculus
agccactcatgatattcccacctgt

SEQ ID NO: 39487 - DNA, 25 bp, Mus musculus
cactcatgatattcccacctgtctc

SEQ ID NO: 39488 - DNA, 25 bp, Mus musculus
actcatgatattcccacctgtctcc

SEQ ID NO: 39489 - DNA, 25 bp, Mus musculus
tcatgatattcccacctgtctcctc

SEQ ID NO: 39490 - DNA, 25 bp, Mus musculus
tcgcaggaaaaccctgttggcaaca

SEQ ID NO: 39491 - DNA, 25 bp, Mus musculus
ctgttggcaacacttggtataaaag

SEQ ID NO: 39492 - DNA, 25 bp, Mus musculus
tggtacatcttattttcttctcaaa

SEQ ID NO: 39493 - DNA, 25 bp, Mus musculus
attttcttctcaaattacaggccag

SEQ ID NO: 39494 - DNA, 25 bp, Mus musculus
ttttcttctcaaattacaggccagc

SEQ ID NO: 39495 - DNA, 25 bp, Mus musculus
ttcttctcaaattacaggccagcaa

SEQ ID NO: 39496 - DNA, 25 bp, Mus musculus
ttccaacaggctaagcaagcctcct

SEQ ID NO: 39497 - DNA, 25 bp, Mus musculus
tcttctcaaattacaggccagcaaa

SEQ ID NO: 39498 - DNA, 25 bp, Mus musculus
aatatactggaagccactcatgata

SEQ ID NO: 39499 - DNA, 25 bp, Mus musculus
tatactggaagccactcatgatatt

SEQ ID NO: 39500 - DNA, 25 bp, Mus musculus
atactggaagccactcatgatattc

SEQ ID NO: 39501 - DNA, 25 bp, Mus musculus
actggaagccactcatgatattccc

SEQ ID NO: 39502 - DNA, 25 bp, Mus musculus
ctggaagccactcatgatattccca

SEQ ID NO: 39503 - DNA, 25 bp, Mus musculus
ggaagccactcatgatattcccacc

SEQ ID NO: 39504 - DNA, 25 bp, Mus musculus
gaagccactcatgatattcccacct

SEQ ID NO: 39505 - DNA, 25 bp, Mus musculus
gcccacagcaccgattctgatgtgg

SEQ ID NO: 39506 - DNA, 25 bp, Mus musculus
agcaccgattctgatgtggcccaac

SEQ ID NO: 39507 - DNA, 25 bp, Mus musculus
ccctagaggcctttgctcacaggca

SEQ ID NO: 39508 - DNA, 25 bp, Mus musculus
cccagctgtctcctctccatgtaag

SEQ ID NO: 39509 - DNA, 25 bp, Mus musculus
tgtctcctctccatgtaagtgctgt

SEQ ID NO: 39510 - DNA, 25 bp, Mus musculus
ctctccatgtaagtgctgttttggg

SEQ ID NO: 39511 - DNA, 25 bp, Mus musculus
ttttgggcaagagttgccaggcagg

SEQ ID NO: 39512 - DNA, 25 bp, Mus musculus
gcaagagttgccaggcagggtgaca

SEQ ID NO: 39513 - DNA, 25 bp, Mus musculus
gttgccaggcagggtgacatcgaca

SEQ ID NO: 39514 - DNA, 25 bp, Mus musculus
atcgacaaccatgtacaaagccacc

SEQ ID NO: 39515 - DNA, 25 bp, Mus musculus
gtacaaagccaccgcagctgctgcc

SEQ ID NO: 39516 - DNA, 25 bp, Mus musculus
cgctctgccgcctgtacaaaggaaa

SEQ ID NO: 39517 - DNA, 25 bp, Mus musculus
gattctgatgtggcccaacctgtca

SEQ ID NO: 39518 - DNA, 25 bp, Mus musculus
gatgtggcccaacctgtcatgactc

SEQ ID NO: 39519 - DNA, 25 bp, Mus musculus
cctgtcatgactcaagctcaccagc

SEQ ID NO: 39520 - DNA, 25 bp, Mus musculus
tgctcttgggcctgcttttacttct

SEQ ID NO: 39521 - DNA, 25 bp, Mus musculus
tgcttttacttctgttggccagttc

SEQ ID NO: 39522 - DNA, 25 bp, Mus musculus
tacttctgttggccagttctaccac

SEQ ID NO: 39523 - DNA, 25 bp, Mus musculus
tggaccactctctttcctgcattct

SEQ ID NO: 39524 - DNA, 25 bp, Mus musculus
actctctttcctgcattctgtagag

SEQ ID NO: 39525 - DNA, 25 bp, Mus musculus
gaataccagcatctatgtgcattag

SEQ ID NO: 39526 - DNA, 25 bp, Mus musculus
tttgatttctcacaaagccaaaggg

SEQ ID NO: 39527 - DNA, 25 bp, Mus musculus
gtactgctggagccttatgccaaac

SEQ ID NO: 39528 - DNA, 25 bp, Mus musculus
gccaaactgcatttccagaggctga

SEQ ID NO: 39529 - DNA, 25 bp, Mus musculus
ctgcatttccagaggctgagagagg

SEQ ID NO: 39530 - DNA, 25 bp, Mus musculus
gggcactctatgggcagatgttgct

SEQ ID NO: 39531 - DNA, 25 bp, Mus musculus
tctatgggcagatgttgctgaagga

SEQ ID NO: 39532 - DNA, 25 bp, Mus musculus
acacaaccacacattctggtaccct

SEQ ID NO: 39533 - DNA, 25 bp, Mus musculus
tctgtatctagaacccatagtagca

SEQ ID NO: 39534 - DNA, 25 bp, Mus musculus
tctagaacccatagtagcagaggat

SEQ ID NO: 39535 - DNA, 25 bp, Mus musculus
tggacacagcaggccccttgtactg

SEQ ID NO: 39536 - DNA, 25 bp, Mus musculus
cagcaggccccttgtactgaacttc

SEQ ID NO: 39537 - DNA, 25 bp, Mus musculus
ttctcacaaagccaaagggtcctcg

SEQ ID NO: 39538 - DNA, 25 bp, Mus musculus
ctgcaccggcagcaataaaggccaa

SEQ ID NO: 39539 - DNA, 25 bp, Mus musculus
cctgtgtctctgtgagcccaacagg

SEQ ID NO: 39540 - DNA, 25 bp, Mus musculus
tgagcccaacaggccacacatgcca

SEQ ID NO: 39541 - DNA, 25 bp, Mus musculus
caacaggccacacatgccaatgtct

SEQ ID NO: 39542 - DNA, 25 bp, Mus musculus
gccacacatgccaatgtctggaacc

SEQ ID NO: 39543 - DNA, 25 bp, Mus musculus
catgccaatgtctggaaccactttt

SEQ ID NO: 39544 - DNA, 25 bp, Mus musculus
cccacagtactgctggagccttatg

SEQ ID NO: 39545 - DNA, 25 bp, Mus musculus
cagctgagctttgctgctggactgg

SEQ ID NO: 39546 - DNA, 25 bp, Mus musculus
agctttgctgctggactggtgtact

SEQ ID NO: 39547 - DNA, 25 bp, Mus musculus
taccccgagatgagcgcccacgagc

SEQ ID NO: 39548 - DNA, 25 bp, Mus musculus
gcccacgagcgtccttagatttcct

SEQ ID NO: 39549 - DNA, 25 bp, Mus musculus
cgtccttagatttcctcattgagct

SEQ ID NO: 39550 - DNA, 25 bp, Mus musculus
ccttagatttcctcattgagctgct

SEQ ID NO: 39551 - DNA, 25 bp, Mus musculus
tagatttcctcattgagctgctgca

SEQ ID NO: 39552 - DNA, 25 bp, Mus musculus
tcattgagctgctgcacaaggatca

SEQ ID NO: 39553 - DNA, 25 bp, Mus musculus
ttgagctgctgcacaaggatcagct

SEQ ID NO: 39554 - DNA, 25 bp, Mus musculus
tgctgcacaaggatcagctggatga

SEQ ID NO: 39555 - DNA, 25 bp, Mus musculus
aggccatcaagtattaccagcatct

SEQ ID NO: 39556 - DNA, 25 bp, Mus musculus
ccatcaagtattaccagcatctgta

SEQ ID NO: 39557 - DNA, 25 bp, Mus musculus
gtgtactcgctgagtctgctgcagg

SEQ ID NO: 39558 - DNA, 25 bp, Mus musculus
agtattaccagcatctgtacagcat

SEQ ID NO: 39559 - DNA, 25 bp, Mus musculus
agtctgctgcaggccacgctgcacc

SEQ ID NO: 39560 - DNA, 25 bp, Mus musculus
ctgcaggccacgctgcaccgctatg

SEQ ID NO: 39561 - DNA, 25 bp, Mus musculus
acgctgcaccgctatgagcatgccc

SEQ ID NO: 39562 - DNA, 25 bp, Mus musculus
ctgcaccgctatgagcatgccctct

SEQ ID NO: 39563 - DNA, 25 bp, Mus musculus
cgctatgagcatgccctctctcagt

SEQ ID NO: 39564 - DNA, 25 bp, Mus musculus
ctctctcagtgcagtgtggacgtgt

SEQ ID NO: 39565 - DNA, 25 bp, Mus musculus
agcctgtaccccgagatgagcgccc

SEQ ID NO: 39566 - DNA, 25 bp, Mus musculus
tggtttgtacctcctagtttgcgca

SEQ ID NO: 39567 - DNA, 25 bp, Mus musculus
ttgcgcactctggaagacaatgaag

SEQ ID NO: 39568 - DNA, 25 bp, Mus musculus
gaaatcgaacgcctcggacaagatt

SEQ ID NO: 39569 - DNA, 25 bp, Mus musculus
gaacgcctcggacaagatttgtaat

SEQ ID NO: 39570 - DNA, 25 bp, Mus musculus
tcacctcactcatcaaactgtttca

SEQ ID NO: 39571 - DNA, 25 bp, Mus musculus
cactcatcaaactgtttcagttctc

SEQ ID NO: 39572 - DNA, 25 bp, Mus musculus
tcaaactgtttcagttctctaggta

SEQ ID NO: 39573 - DNA, 25 bp, Mus musculus
tgtttcagttctctaggtagacagc

SEQ ID NO: 39574 - DNA, 25 bp, Mus musculus
ctaagttgtcacaaactgtgtaaat

SEQ ID NO: 39575 - DNA, 25 bp, Mus musculus
aattctatttctatatcgtggtgtc

SEQ ID NO: 39576 - DNA, 25 bp, Mus musculus
atttctatatcgtggtgtcacagta

SEQ ID NO: 39577 - DNA, 25 bp, Mus musculus
atatcgtggtgtcacagtagagtac

SEQ ID NO: 39578 - DNA, 25 bp, Mus musculus
atgagccgcctctcaaaggtggcgc

SEQ ID NO: 39579 - DNA, 25 bp, Mus musculus
tcaaaggtggcgccagtgattaaag

SEQ ID NO: 39580 - DNA, 25 bp, Mus musculus
gggaccacaatggtcagctaccaac

SEQ ID NO: 39581 - DNA, 25 bp, Mus musculus
acaatggtcagctaccaacccttag

SEQ ID NO: 39582 - DNA, 25 bp, Mus musculus
atggtcatctcaaaccctgcagcaa

SEQ ID NO: 39583 - DNA, 25 bp, Mus musculus
aaccctgcagcaactcaccaagaca

SEQ ID NO: 39584 - DNA, 25 bp, Mus musculus
caagacattgacttccttattgaag

SEQ ID NO: 39585 - DNA, 25 bp, Mus musculus
attgacttccttattgaagaaatcg

SEQ ID NO: 39586 - DNA, 25 bp, Mus musculus
acagtatcgatctcatctacgtaca

SEQ ID NO: 39587 - DNA, 25 bp, Mus musculus
tcgatctcatctacgtacactatgc

SEQ ID NO: 39588 - DNA, 25 bp, Mus musculus
attgctaaaaagttcacctgagcct

SEQ ID NO: 39589 - DNA, 25 bp, Mus musculus
ttcacctgagcctccgtggctactg

SEQ ID NO: 39590 - DNA, 25 bp, Mus musculus
gctactgccttggccaacagcgtct

SEQ ID NO: 39591 - DNA, 25 bp, Mus musculus
gccttggccaacagcgtcttcctat

SEQ ID NO: 39592 - DNA, 25 bp, Mus musculus
gccaacagcgtcttcctatagtcag

SEQ ID NO: 39593 - DNA, 25 bp, Mus musculus
ttcctatagtcagggggccccagca

SEQ ID NO: 39594 - DNA, 25 bp, Mus musculus
cccagcaacaggtctctctctggaa

SEQ ID NO: 39595 - DNA, 25 bp, Mus musculus
tctggaatcttggcactgagatgaa

SEQ ID NO: 39596 - DNA, 25 bp, Mus musculus
atcttggcactgagatgaatgaatc

SEQ ID NO: 39597 - DNA, 25 bp, Mus musculus
ctctctgtgctcttcagataatcgc

SEQ ID NO: 39598 - DNA, 25 bp, Mus musculus
tcatctacgtacactatgcaaggtc

SEQ ID NO: 39599 - DNA, 25 bp, Mus musculus
actatgcaaggtcgtcttgctcgtg

SEQ ID NO: 39600 - DNA, 25 bp, Mus musculus
aggcttcgcactcgggcagttccca

SEQ ID NO: 39601 - DNA, 25 bp, Mus musculus
cgcactcgggcagttcccagatctc

SEQ ID NO: 39602 - DNA, 25 bp, Mus musculus
agatctccaatcacttccacaaact

SEQ ID NO: 39603 - DNA, 25 bp, Mus musculus
ccaatcacttccacaaactcttggc

SEQ ID NO: 39604 - DNA, 25 bp, Mus musculus
acttccacaaactcttggccagcca

SEQ ID NO: 39605 - DNA, 25 bp, Mus musculus
ccagccattgctaaaaagttcacct

SEQ ID NO: 39606 - DNA, 25 bp, Mus musculus
ttggatgactttcacgtggaatcca

SEQ ID NO: 39607 - DNA, 25 bp, Mus musculus
gactttcacgtggaatccatagata

SEQ ID NO: 39608 - DNA, 25 bp, Mus musculus
acttttctgcagatgacaggacaga

SEQ ID NO: 39609 - DNA, 25 bp, Mus musculus
gaaatgctctttctcctcaagtaac

SEQ ID NO: 39610 - DNA, 25 bp, Mus musculus
ctcctcaagtaacactacggaccag

SEQ ID NO: 39611 - DNA, 25 bp, Mus musculus
ctcaagtaacactacggaccagaga

SEQ ID NO: 39612 - DNA, 25 bp, Mus musculus
gagagaaccttggctcccacgagaa

SEQ ID NO: 39613 - DNA, 25 bp, Mus musculus
gctcccacgagaatggttatcagca

SEQ ID NO: 39614 - DNA, 25 bp, Mus musculus
gttatcagcacttggcatttccttt

SEQ ID NO: 39615 - DNA, 25 bp, Mus musculus
tggcatttccttttacaaacatgaa

SEQ ID NO: 39616 - DNA, 25 bp, Mus musculus
tgaaacttgtctttccagagttgca

SEQ ID NO: 39617 - DNA, 25 bp, Mus musculus
ttgtctttccagagttgcagatatt

SEQ ID NO: 39618 - DNA, 25 bp, Mus musculus
tccatagataccgccagaataatat

SEQ ID NO: 39619 - DNA, 25 bp, Mus musculus
ctcaaaaaacttccacaagagcaga

SEQ ID NO: 39620 - DNA, 25 bp, Mus musculus
gagcagattgccctggatgtatgtg

SEQ ID NO: 39621 - DNA, 25 bp, Mus musculus
cagattgccctggatgtatgtgctt

SEQ ID NO: 39622 - DNA, 25 bp, Mus musculus
attgccctggatgtatgtgcttaca

SEQ ID NO: 39623 - DNA, 25 bp, Mus musculus
cccaaatctggctggctgacttttc

SEQ ID NO: 39624 - DNA, 25 bp, Mus musculus
tctggctggctgacttttctgcaga

SEQ ID NO: 39625 - DNA, 25 bp, Mus musculus
ctgacttttctgcagatgacaggac

SEQ ID NO: 39626 - DNA, 25 bp, Mus musculus
tgacactactttgtatcacacacac

SEQ ID NO: 39627 - DNA, 25 bp, Mus musculus
tactttgtatcacacacacacatct

SEQ ID NO: 39628 - DNA, 25 bp, Mus musculus
tgaaattttgctacaaccagctcag

SEQ ID NO: 39629 - DNA, 25 bp, Mus musculus
tttgctacaaccagctcagcctttt

SEQ ID NO: 39630 - DNA, 25 bp, Mus musculus
acaaccagctcagccttttgcctaa

SEQ ID NO: 39631 - DNA, 25 bp, Mus musculus
agctcagccttttgcctaatgcaat

SEQ ID NO: 39632 - DNA, 25 bp, Mus musculus
gccttttgcctaatgcaatgaaaaa

SEQ ID NO: 39633 - DNA, 25 bp, Mus musculus
ttttggacgctctgtgtagagttct

SEQ ID NO: 39634 - DNA, 25 bp, Mus musculus
gagttctatgcctttctctcctatt

SEQ ID NO: 39635 - DNA, 25 bp, Mus musculus
tttctctcctattaagtgtgctgac

SEQ ID NO: 39636 - DNA, 25 bp, Mus musculus
tgctgactttccagagtgttaccca

SEQ ID NO: 39637 - DNA, 25 bp, Mus musculus
agagtgttacccactggccaggagg

SEQ ID NO: 39638 - DNA, 25 bp, Mus musculus
gtatcacacacacacatctgtagtg

SEQ ID NO: 39639 - DNA, 25 bp, Mus musculus
cacacacacatctgtagtgttcaaa

SEQ ID NO: 39640 - DNA, 25 bp, Mus musculus
gtctccaagtttgtacctcaaatga

SEQ ID NO: 39641 - DNA, 25 bp, Mus musculus
aaatggacttcctgatttgcaagga

SEQ ID NO: 39642 - DNA, 25 bp, Mus musculus
gcaaggaactacctccacacttcca

SEQ ID NO: 39643 - DNA, 25 bp, Mus musculus
acgaacttgcagcctatatcactca

SEQ ID NO: 39644 - DNA, 25 bp, Mus musculus
ttgcagcctatatcactcattgatt

SEQ ID NO: 39645 - DNA, 25 bp, Mus musculus
cctatatcactcattgatttccttc

SEQ ID NO: 39646 - DNA, 25 bp, Mus musculus
atgctaacatgttcccagctcttat

SEQ ID NO: 39647 - DNA, 25 bp, Mus musculus
acatgttcccagctcttattagtat

SEQ ID NO: 39648 - DNA, 25 bp, Mus musculus
gcattaatccttactgtgctttgat

SEQ ID NO: 39649 - DNA, 25 bp, Mus musculus
caccccaggttgatcttagccagca

SEQ ID NO: 39650 - DNA, 25 bp, Mus musculus
aggttgatcttagccagcagcagta

SEQ ID NO: 39651 - DNA, 25 bp, Mus musculus
atcttagccagcagcagtacatctt

SEQ ID NO: 39652 - DNA, 25 bp, Mus musculus
acatcttccagcagtgtgaagctcc

SEQ ID NO: 39653 - DNA, 25 bp, Mus musculus
tttgaagcaatcctctccttcttgt

SEQ ID NO: 39654 - DNA, 25 bp, Mus musculus
ttcttgttcctgtgtcagaccaggc

SEQ ID NO: 39655 - DNA, 25 bp, Mus musculus
ttcctgtgtcagaccaggctatcca

SEQ ID NO: 39656 - DNA, 25 bp, Mus musculus
tgtcagaccaggctatccagtcagt

SEQ ID NO: 39657 - DNA, 25 bp, Mus musculus
agtcagtcctctgtggagccacgtc

SEQ ID NO: 39658 - DNA, 25 bp, Mus musculus
ctgcttgggccatcacaaatgcaac

SEQ ID NO: 39659 - DNA, 25 bp, Mus musculus
tatggagctaatctctcaagttttc

SEQ ID NO: 39660 - DNA, 25 bp, Mus musculus
tcacaaatgcaacttctggaggatc

SEQ ID NO: 39661 - DNA, 25 bp, Mus musculus
atgcaacttctggaggatcagctga

SEQ ID NO: 39662 - DNA, 25 bp, Mus musculus
cttctggaggatcagctgagcagat

SEQ ID NO: 39663 - DNA, 25 bp, Mus musculus
agccactctgtgatctcctcactgt

SEQ ID NO: 39664 - DNA, 25 bp, Mus musculus
atctcctcactgtcatggatgcaaa

SEQ ID NO: 39665 - DNA, 25 bp, Mus musculus
tacaggttgccctaaatggcttaga

SEQ ID NO: 39666 - DNA, 25 bp, Mus musculus
gaaacggctcaggcattaatcctta

SEQ ID NO: 39667 - DNA, 25 bp, Mus musculus
atggatgccttagcactgaagaaag

SEQ ID NO: 39668 - DNA, 25 bp, Mus musculus
gatgccttagcactgaagaaaggtt

SEQ ID NO: 39669 - DNA, 25 bp, Mus musculus
atagcatttatctctcaacctcttc

SEQ ID NO: 39670 - DNA, 25 bp, Mus musculus
tgtcacagattatcttccaacgcct

SEQ ID NO: 39671 - DNA, 25 bp, Mus musculus
cacagattatcttccaacgccttat

SEQ ID NO: 39672 - DNA, 25 bp, Mus musculus
atcaagcctggaaacttctaaatgt

SEQ ID NO: 39673 - DNA, 25 bp, Mus musculus
gctcttatcttgccaaggttgaaaa

SEQ ID NO: 39674 - DNA, 25 bp, Mus musculus
aaattctgactttgagcttatgaac

SEQ ID NO: 39675 - DNA, 25 bp, Mus musculus
ttctgactttgagcttatgaactaa

SEQ ID NO: 39676 - DNA, 25 bp, Mus musculus
gaactaacatagacagctcaggatt

SEQ ID NO: 39677 - DNA, 25 bp, Mus musculus
ctaacatagacagctcaggattaac

SEQ ID NO: 39678 - DNA, 25 bp, Mus musculus
acatagacagctcaggattaacagg

SEQ ID NO: 39679 - DNA, 25 bp, Mus musculus
attgctgctattttctgcctcctca

SEQ ID NO: 39680 - DNA, 25 bp, Mus musculus
ttctgcctcctcagtacctttgcaa

SEQ ID NO: 39681 - DNA, 25 bp, Mus musculus
acctttgcaactgcctctttcctca

SEQ ID NO: 39682 - DNA, 25 bp, Mus musculus
tttgcaactgcctctttcctcatag

SEQ ID NO: 39683 - DNA, 25 bp, Mus musculus
actgcctctttcctcatagcattta

SEQ ID NO: 39684 - DNA, 25 bp, Mus musculus
gcctctttcctcatagcatttatct

SEQ ID NO: 39685 - DNA, 25 bp, Mus musculus
tctttcctcatagcatttatctctc

SEQ ID NO: 39686 - DNA, 25 bp, Mus musculus
ctcatagcatttatctctcaacctc

SEQ ID NO: 39687 - DNA, 25 bp, Mus musculus
agtatcatagagggcccaagataca

SEQ ID NO: 39688 - DNA, 25 bp, Mus musculus
tatcatagagggcccaagatacatg

SEQ ID NO: 39689 - DNA, 25 bp, Mus musculus
ccatgacccatatgcaaagggacgg

SEQ ID NO: 39690 - DNA, 25 bp, Mus musculus
catgacccatatgcaaagggacgga

SEQ ID NO: 39691 - DNA, 25 bp, Mus musculus
atgacccatatgcaaagggacggac

SEQ ID NO: 39692 - DNA, 25 bp, Mus musculus
tgacccatatgcaaagggacggaca

SEQ ID NO: 39693 - DNA, 25 bp, Mus musculus
acccatatgcaaagggacggacaca

SEQ ID NO: 39694 - DNA, 25 bp, Mus musculus
ggacggacacagggtcgatgctgtt

SEQ ID NO: 39695 - DNA, 25 bp, Mus musculus
atcatagagggcccaagatacatgc

SEQ ID NO: 39696 - DNA, 25 bp, Mus musculus
tcaggtgccatgacccatatgcaaa

SEQ ID NO: 39697 - DNA, 25 bp, Mus musculus
caggtgccatgacccatatgcaaag

SEQ ID NO: 39698 - DNA, 25 bp, Mus musculus
aggtgccatgacccatatgcaaagg

SEQ ID NO: 39699 - DNA, 25 bp, Mus musculus
ggtgccatgacccatatgcaaaggg

SEQ ID NO: 39700 - DNA, 25 bp, Mus musculus
gtgccatgacccatatgcaaaggga

SEQ ID NO: 39701 - DNA, 25 bp, Mus musculus
tgccatgacccatatgcaaagggac

SEQ ID NO: 39702 - DNA, 25 bp, Mus musculus
gccatgacccatatgcaaagggacg

SEQ ID NO: 39703 - DNA, 25 bp, Mus musculus
cctggaaacactcggataggccgtg

SEQ ID NO: 39704 - DNA, 25 bp, Mus musculus
aacactcggataggccgtggcactt

SEQ ID NO: 39705 - DNA, 25 bp, Mus musculus
ggatctagtctgtcttcagagcact

SEQ ID NO: 39706 - DNA, 25 bp, Mus musculus
tcttcagagcactttaaactgtacc

SEQ ID NO: 39707 - DNA, 25 bp, Mus musculus
ctgtaccttttcttggcgtggactg

SEQ ID NO: 39708 - DNA, 25 bp, Mus musculus
cttttcttggcgtggactgtggctt

SEQ ID NO: 39709 - DNA, 25 bp, Mus musculus
ttggcgtggactgtggcttctagaa

SEQ ID NO: 39710 - DNA, 25 bp, Mus musculus
gtggcttctagaaccatccttggga

SEQ ID NO: 39711 - DNA, 25 bp, Mus musculus
accatccttgggatgtgccggttat

SEQ ID NO: 39712 - DNA, 25 bp, Mus musculus
cttgggatgtgccggttatgtggac

SEQ ID NO: 39713 - DNA, 25 bp, Mus musculus
attcacttgtgatcgatggcagtct

SEQ ID NO: 39714 - DNA, 25 bp, Mus musculus
tcgatggcagtctaggctgagcatc

SEQ ID NO: 39715 - DNA, 25 bp, Mus musculus
ggccgtggcacttcaactggacctt

SEQ ID NO: 39716 - DNA, 25 bp, Mus musculus
aacaggttgccattcctagcacccg

SEQ ID NO: 39717 - DNA, 25 bp, Mus musculus
tcaactggaccttcaagcccttctg

SEQ ID NO: 39718 - DNA, 25 bp, Mus musculus
tcaagcccttctgtcatctcaaaaa

SEQ ID NO: 39719 - DNA, 25 bp, Mus musculus
ccttctgtcatctcaaaaactctgc

SEQ ID NO: 39720 - DNA, 25 bp, Mus musculus
tcaaaaactctgctaagttctgtct

SEQ ID NO: 39721 - DNA, 25 bp, Mus musculus
tgaaattattccagccaatggaatt

SEQ ID NO: 39722 - DNA, 25 bp, Mus musculus
tattccagccaatggaatttcacat

SEQ ID NO: 39723 - DNA, 25 bp, Mus musculus
ttccttggatctagtctgtcttcag

SEQ ID NO: 39724 - DNA, 25 bp, Mus musculus
cccgtatgcaggctccacagatgag

SEQ ID NO: 39725 - DNA, 25 bp, Mus musculus
gtatgcaggctccacagatgagaac

SEQ ID NO: 39726 - DNA, 25 bp, Mus musculus
gaccgctttcaatggcgagctcgag

SEQ ID NO: 39727 - DNA, 25 bp, Mus musculus
ggtccagttcgtcatcacggcccag

SEQ ID NO: 39728 - DNA, 25 bp, Mus musculus
gttcgtcatcacggcccaggagtgg

SEQ ID NO: 39729 - DNA, 25 bp, Mus musculus
caactttgaggaggccctgatggaa

SEQ ID NO: 39730 - DNA, 25 bp, Mus musculus
gccccaggcctgagtgtacacctgt

SEQ ID NO: 39731 - DNA, 25 bp, Mus musculus
agtgtacacctgtgtacgtgcagat

SEQ ID NO: 39732 - DNA, 25 bp, Mus musculus
cacctgtgtacgtgcagatgtgcac

SEQ ID NO: 39733 - DNA, 25 bp, Mus musculus
tgtgcacatgtatgcacaggcctga

SEQ ID NO: 39734 - DNA, 25 bp, Mus musculus
catgtatgcacaggcctgagtgcac

SEQ ID NO: 39735 - DNA, 25 bp, Mus musculus
tgcacaggcctgagtgcacacgtgt

SEQ ID NO: 39736 - DNA, 25 bp, Mus musculus
tgcaggctccacagatgagaacaca

SEQ ID NO: 39737 - DNA, 25 bp, Mus musculus
ggctgacctgccaatcccagagctc

SEQ ID NO: 39738 - DNA, 25 bp, Mus musculus
aatcccagagctcccagacttcttc

SEQ ID NO: 39739 - DNA, 25 bp, Mus musculus
gggcaaacacttcttcctgtatggc

SEQ ID NO: 39740 - DNA, 25 bp, Mus musculus
acacttcttcctgtatggcgagttc

SEQ ID NO: 39741 - DNA, 25 bp, Mus musculus
gaggctcatccgctacgtgaccgct

SEQ ID NO: 39742 - DNA, 25 bp, Mus musculus
catccgctacgtgaccgctttcaat

SEQ ID NO: 39743 - DNA, 25 bp, Mus musculus
ctacgtgaccgctttcaatggcgag

SEQ ID NO: 39744 - DNA, 25 bp, Mus musculus
gaagcaaggcctcctgtctatagca

SEQ ID NO: 39745 - DNA, 25 bp, Mus musculus
aggcctcctgtctatagcagcttcc

SEQ ID NO: 39746 - DNA, 25 bp, Mus musculus
taggccttcttcctgctagtgcatg

SEQ ID NO: 39747 - DNA, 25 bp, Mus musculus
ttcttcctgctagtgcatggagctc

SEQ ID NO: 39748 - DNA, 25 bp, Mus musculus
tgtgccaaccctaagagaatcaagt

SEQ ID NO: 39749 - DNA, 25 bp, Mus musculus
agactggccaaacctcattccctca

SEQ ID NO: 39750 - DNA, 25 bp, Mus musculus
tattctatacctttgcaccactggt

SEQ ID NO: 39751 - DNA, 25 bp, Mus musculus
atacctttgcaccactggtggctga

SEQ ID NO: 39752 - DNA, 25 bp, Mus musculus
gcctgtgtagctgttctgcatgtga

SEQ ID NO: 39753 - DNA, 25 bp, Mus musculus
gttctgcatgtgaatgctgcatgtc

SEQ ID NO: 39754 - DNA, 25 bp, Mus musculus
gcatgtctggtccgggatttggatg

SEQ ID NO: 39755 - DNA, 25 bp, Mus musculus
ctggtccgggatttggatgttgcac

SEQ ID NO: 39756 - DNA, 25 bp, Mus musculus
tatagcagcttcctcagcttactac

SEQ ID NO: 39757 - DNA, 25 bp, Mus musculus
ctcagcttactactgccttaggagg

SEQ ID NO: 39758 - DNA, 25 bp, Mus musculus
ttactactgccttaggaggccctgc

SEQ ID NO: 39759 - DNA, 25 bp, Mus musculus
ccttcccttggcttgtccttgattg

SEQ ID NO: 39760 - DNA, 25 bp, Mus musculus
cttggcttgtccttgattggtgggt

SEQ ID NO: 39761 - DNA, 25 bp, Mus musculus
ttagtctgatcccattaagtgtttc

SEQ ID NO: 39762 - DNA, 25 bp, Mus musculus
tgatcccattaagtgtttctggggt

SEQ ID NO: 39763 - DNA, 25 bp, Mus musculus
ggtttataggccttcttcctgctag

SEQ ID NO: 39764 - DNA, 25 bp, Mus musculus
cagatcactggagccagtctatagt

SEQ ID NO: 39765 - DNA, 25 bp, Mus musculus
atcactggagccagtctatagtgca

SEQ ID NO: 39766 - DNA, 25 bp, Mus musculus
tgcacaggtgtctccagtgtgtcag

SEQ ID NO: 39767 - DNA, 25 bp, Mus musculus
acaggtgtctccagtgtgtcagcca

SEQ ID NO: 39768 - DNA, 25 bp, Mus musculus
gtgtcagccacttcttcctgttcat

SEQ ID NO: 39769 - DNA, 25 bp, Mus musculus
gccacttcttcctgttcatcccaga

SEQ ID NO: 39770 - DNA, 25 bp, Mus musculus
acttcttcctgttcatcccagacaa

SEQ ID NO: 39771 - DNA, 25 bp, Mus musculus
tcttcctgttcatcccagacaatag

SEQ ID NO: 39772 - DNA, 25 bp, Mus musculus
tgttcatcccagacaatagcaacta

SEQ ID NO: 39773 - DNA, 25 bp, Mus musculus
tcatcccagacaatagcaactaaag

SEQ ID NO: 39774 - DNA, 25 bp, Mus musculus
tcccagacaatagcaactaaagatg

SEQ ID NO: 39775 - DNA, 25 bp, Mus musculus
gttttaacaccttttggtgatgcag

SEQ ID NO: 39776 - DNA, 25 bp, Mus musculus
ctatagtgcacaaccaacagctgcc

SEQ ID NO: 39777 - DNA, 25 bp, Mus musculus
tgcacaaccaacagctgccaacagt

SEQ ID NO: 39778 - DNA, 25 bp, Mus musculus
acaaccaacagctgccaacagtggg

SEQ ID NO: 39779 - DNA, 25 bp, Mus musculus
accaacagctgccaacagtgggatg

SEQ ID NO: 39780 - DNA, 25 bp, Mus musculus
tgggatgcctcctagaactgtgcag

SEQ ID NO: 39781 - DNA, 25 bp, Mus musculus
gatgcctcctagaactgtgcaggtg

SEQ ID NO: 39782 - DNA, 25 bp, Mus musculus
gcctcctagaactgtgcaggtgcaa

SEQ ID NO: 39783 - DNA, 25 bp, Mus musculus
agtgtcttggtgtgcacaggtgtct

SEQ ID NO: 39784 - DNA, 25 bp, Mus musculus
tttcgtaggtcgatcgcctgtcagc

SEQ ID NO: 39785 - DNA, 25 bp, Mus musculus
cgtaggtcgatcgcctgtcagcttt

SEQ ID NO: 39786 - DNA, 25 bp, Mus musculus
ggattccttactagaagacaacaat

SEQ ID NO: 39787 - DNA, 25 bp, Mus musculus
caacaatcacaagtcacaggtagac

SEQ ID NO: 39788 - DNA, 25 bp, Mus musculus
gtcacaggtagacactcaagaccaa

SEQ ID NO: 39789 - DNA, 25 bp, Mus musculus
cactcaagaccaagccaggagattg

SEQ ID NO: 39790 - DNA, 25 bp, Mus musculus
tcaagaccaagccaggagattggca

SEQ ID NO: 39791 - DNA, 25 bp, Mus musculus
agaccaagccaggagattggcagag

SEQ ID NO: 39792 - DNA, 25 bp, Mus musculus
agtggtgacagccatcagtgctggc

SEQ ID NO: 39793 - DNA, 25 bp, Mus musculus
ggtgacagccatcagtgctggccca

SEQ ID NO: 39794 - DNA, 25 bp, Mus musculus
cagtgctggcccaaggactctaaat

SEQ ID NO: 39795 - DNA, 25 bp, Mus musculus
tgctggcccaaggactctaaatttc

SEQ ID NO: 39796 - DNA, 25 bp, Mus musculus
aggtcgatcgcctgtcagctttcca

SEQ ID NO: 39797 - DNA, 25 bp, Mus musculus
tgtcagctttccagagtattggctc

SEQ ID NO: 39798 - DNA, 25 bp, Mus musculus
ttggctcttccaccagaaagcttga

SEQ ID NO: 39799 - DNA, 25 bp, Mus musculus
gctcttccaccagaaagcttgatca

SEQ ID NO: 39800 - DNA, 25 bp, Mus musculus
atcaagtcaatatctgctgttccag

SEQ ID NO: 39801 - DNA, 25 bp, Mus musculus
aagtcaatatctgctgttccagttt

SEQ ID NO: 39802 - DNA, 25 bp, Mus musculus
tcaatatctgctgttccagtttcaa

SEQ ID NO: 39803 - DNA, 25 bp, Mus musculus
tcagctttcggtggattccttacta

SEQ ID NO: 39804 - DNA, 25 bp, Mus musculus
cacccaagatctttgtggcacacag

SEQ ID NO: 39805 - DNA, 25 bp, Mus musculus
ttgtcattctcagtgcccacaagct

SEQ ID NO: 39806 - DNA, 25 bp, Mus musculus
agctaggccacagcactcagcagtt

SEQ ID NO: 39807 - DNA, 25 bp, Mus musculus
gcgtcctgggccagctagctgctgc

SEQ ID NO: 39808 - DNA, 25 bp, Mus musculus
agctagctgctgcctgagagcagag

SEQ ID NO: 39809 - DNA, 25 bp, Mus musculus
cgatgctctgagctacccagcattc

SEQ ID NO: 39810 - DNA, 25 bp, Mus musculus
tctgagctacccagcattcattcct

SEQ ID NO: 39811 - DNA, 25 bp, Mus musculus
agcattcattcctcttgaaaacgga

SEQ ID NO: 39812 - DNA, 25 bp, Mus musculus
tcttgaaaacggagctcctgcaggt

SEQ ID NO: 39813 - DNA, 25 bp, Mus musculus
gacaggtaaccccagctctgccttg

SEQ ID NO: 39814 - DNA, 25 bp, Mus musculus
tgccttgggcctggtgccctcaact

SEQ ID NO: 39815 - DNA, 25 bp, Mus musculus
ctcaactgtccagggatttgtacat

SEQ ID NO: 39816 - DNA, 25 bp, Mus musculus
ttctcagtgcccacaagcttgtgtt

SEQ ID NO: 39817 - DNA, 25 bp, Mus musculus
gggacacactgtcacggcaggcaaa

SEQ ID NO: 39818 - DNA, 25 bp, Mus musculus
ctgatgtccgaagccaagtgaccca

SEQ ID NO: 39819 - DNA, 25 bp, Mus musculus
gccaagtgacccactacagcaatct

SEQ ID NO: 39820 - DNA, 25 bp, Mus musculus
tgacccactacagcaatctgctgtg

SEQ ID NO: 39821 - DNA, 25 bp, Mus musculus
gcaatctgctgtgtgacctcctgcg

SEQ ID NO: 39822 - DNA, 25 bp, Mus musculus
cttccgctgcccaggacatggtgga

SEQ ID NO: 39823 - DNA, 25 bp, Mus musculus
ctgcccaggacatggtggacagggt

SEQ ID NO: 39824 - DNA, 25 bp, Mus musculus
ttaagttctgccaagccatagatgc

SEQ ID NO: 39825 - DNA, 25 bp, Mus musculus
agttctgccaagccatagatgccat

SEQ ID NO: 39826 - DNA, 25 bp, Mus musculus
tcgccatccaactcacagagagcat

SEQ ID NO: 39827 - DNA, 25 bp, Mus musculus
cagagagcatcgcgctcttccacag

SEQ ID NO: 39828 - DNA, 25 bp, Mus musculus
ccatcctgtatgtcttcatgggggc

SEQ ID NO: 39829 - DNA, 25 bp, Mus musculus
tgtatgtcttcatgggggcctcctt

SEQ ID NO: 39830 - DNA, 25 bp, Mus musculus
atgtcttcatgggggcctccttcaa

SEQ ID NO: 39831 - DNA, 25 bp, Mus musculus
gggcctccttcaaaaactatatcat

SEQ ID NO: 39832 - DNA, 25 bp, Mus musculus
cctccttcaaaaactatatcatgaa

SEQ ID NO: 39833 - DNA, 25 bp, Mus musculus
cttttgattctgagggtcctacaga

SEQ ID NO: 39834 - DNA, 25 bp, Mus musculus
gtcctacagagccaaccagttcttt

SEQ ID NO: 39835 - DNA, 25 bp, Mus musculus
cagagccaaccagttcttttaccat

SEQ ID NO: 39836 - DNA, 25 bp, Mus musculus
gccaagccatagatgccatctacct

SEQ ID NO: 39837 - DNA, 25 bp, Mus musculus
ccatagatgccatctacctgctgat

SEQ ID NO: 39838 - DNA, 25 bp, Mus musculus
ccatctacctgctgatcaccagctg

SEQ ID NO: 39839 - DNA, 25 bp, Mus musculus
tctacctgctgatcaccagctgcga

SEQ ID NO: 39840 - DNA, 25 bp, Mus musculus
tgctgatcaccagctgcgatatgag

SEQ ID NO: 39841 - DNA, 25 bp, Mus musculus
tcaccagctgcgatatgagcaaacg

SEQ ID NO: 39842 - DNA, 25 bp, Mus musculus
gcatggatgtcgccatccaactcac

SEQ ID NO: 39843 - DNA, 25 bp, Mus musculus
atgtcgccatccaactcacagagag

SEQ ID NO: 39844 - DNA, 25 bp, Mus musculus
agagacatgtcccagatttctgttt

SEQ ID NO: 39845 - DNA, 25 bp, Mus musculus
cagatttctgtttcccaagccacgg

SEQ ID NO: 39846 - DNA, 25 bp, Mus musculus
taagccacaggcagattgtgtaaaa

SEQ ID NO: 39847 - DNA, 25 bp, Mus musculus
acaggaacagcagcggctgtttcag

SEQ ID NO: 39848 - DNA, 25 bp, Mus musculus
acagcagcggctgtttcagctgtgg

SEQ ID NO: 39849 - DNA, 25 bp, Mus musculus
gcggctgtttcagctgtgggaaacg

SEQ ID NO: 39850 - DNA, 25 bp, Mus musculus
gtttcagctgtgggaaacgagcttt

SEQ ID NO: 39851 - DNA, 25 bp, Mus musculus
atgcagcaggctctatctcagaggt

SEQ ID NO: 39852 - DNA, 25 bp, Mus musculus
caggctctatctcagaggtgctgct

SEQ ID NO: 39853 - DNA, 25 bp, Mus musculus
tcttgcaggtgacctggttgcatag

SEQ ID NO: 39854 - DNA, 25 bp, Mus musculus
tactgctttctggtcatttgaagag

SEQ ID NO: 39855 - DNA, 25 bp, Mus musculus
tgaagagccctttagttttgatgat

SEQ ID NO: 39856 - DNA, 25 bp, Mus musculus
gatctgatgacctctcacagtgctc

SEQ ID NO: 39857 - DNA, 25 bp, Mus musculus
tctcacagtgctcagtgagcctttt

SEQ ID NO: 39858 - DNA, 25 bp, Mus musculus
gaacttaaggtccagccagacttca

SEQ ID NO: 39859 - DNA, 25 bp, Mus musculus
cagccagacttcaggatctgttgca

SEQ ID NO: 39860 - DNA, 25 bp, Mus musculus
gacttcaggatctgttgcaggagtt

SEQ ID NO: 39861 - DNA, 25 bp, Mus musculus
aggatctgttgcaggagttggactc

SEQ ID NO: 39862 - DNA, 25 bp, Mus musculus
tggactcactgtgggaaaagcagcg

SEQ ID NO: 39863 - DNA, 25 bp, Mus musculus
tctccttaagccacaggcagattgt

SEQ ID NO: 39864 - DNA, 25 bp, Mus musculus
ctacctggtttatattctcaatgaa

SEQ ID NO: 39865 - DNA, 25 bp, Mus musculus
ttatattctcaatgaactggctgga

SEQ ID NO: 39866 - DNA, 25 bp, Mus musculus
gagaacagctttgctgctccgaaat

SEQ ID NO: 39867 - DNA, 25 bp, Mus musculus
agctttgctgctccgaaatctcggg

SEQ ID NO: 39868 - DNA, 25 bp, Mus musculus
tttgctgctccgaaatctcgggttc

SEQ ID NO: 39869 - DNA, 25 bp, Mus musculus
gctgctccgaaatctcgggttcact

SEQ ID NO: 39870 - DNA, 25 bp, Mus musculus
gctccgaaatctcgggttcactgcc

SEQ ID NO: 39871 - DNA, 25 bp, Mus musculus
tcagagcaagcgcctcggatccctt

SEQ ID NO: 39872 - DNA, 25 bp, Mus musculus
caagcgcctcggatcccttaataag

SEQ ID NO: 39873 - DNA, 25 bp, Mus musculus
gaggtccattcttctagcgactgat

SEQ ID NO: 39874 - DNA, 25 bp, Mus musculus
gtccattcttctagcgactgatgtc

SEQ ID NO: 39875 - DNA, 25 bp, Mus musculus
cattcttctagcgactgatgtccca

SEQ ID NO: 39876 - DNA, 25 bp, Mus musculus
tattctcaatgaactggctggaaac

SEQ ID NO: 39877 - DNA, 25 bp, Mus musculus
tcttctagcgactgatgtcccagca

SEQ ID NO: 39878 - DNA, 25 bp, Mus musculus
tctcaatgaactggctggaaactcc

SEQ ID NO: 39879 - DNA, 25 bp, Mus musculus
ctcctttatgatattctgcagcacc

SEQ ID NO: 39880 - DNA, 25 bp, Mus musculus
tatgatattctgcagcacctgtaac

SEQ ID NO: 39881 - DNA, 25 bp, Mus musculus
gatattctgcagcacctgtaacaac

SEQ ID NO: 39882 - DNA, 25 bp, Mus musculus
cacctgtaacaacactcagagaaca

SEQ ID NO: 39883 - DNA, 25 bp, Mus musculus
ctgtaacaacactcagagaacagct

SEQ ID NO: 39884 - DNA, 25 bp, Mus musculus
caacactcagagaacagctttgctg

SEQ ID NO: 39885 - DNA, 25 bp, Mus musculus
gagcactgccaacaaactagtccgt

SEQ ID NO: 39886 - DNA, 25 bp, Mus musculus
gcactgccaacaaactagtccgtcg

SEQ ID NO: 39887 - DNA, 25 bp, Mus musculus
cgtgccaacgcatctcggcgtaaac

SEQ ID NO: 39888 - DNA, 25 bp, Mus musculus
tgccaacgcatctcggcgtaaactc

SEQ ID NO: 39889 - DNA, 25 bp, Mus musculus
cgcatctcggcgtaaactccaaagg

SEQ ID NO: 39890 - DNA, 25 bp, Mus musculus
acgacgccactgaggccaatgaagg

SEQ ID NO: 39891 - DNA, 25 bp, Mus musculus
gacgccactgaggccaatgaaggcc

SEQ ID NO: 39892 - DNA, 25 bp, Mus musculus
cgcgaggtcagcactctcaagaacc

SEQ ID NO: 39893 - DNA, 25 bp, Mus musculus
aggtcagcactctcaagaaccggct

SEQ ID NO: 39894 - DNA, 25 bp, Mus musculus
gtcagcactctcaagaaccggctca

SEQ ID NO: 39895 - DNA, 25 bp, Mus musculus
cagcactctcaagaaccggctcagg

SEQ ID NO: 39896 - DNA, 25 bp, Mus musculus
gcactctcaagaaccggctcaggcg

SEQ ID NO: 39897 - DNA, 25 bp, Mus musculus
caaactagtccgtcgaacagagaag

SEQ ID NO: 39898 - DNA, 25 bp, Mus musculus
aatcttcatgcaggttgaagacgag

SEQ ID NO: 39899 - DNA, 25 bp, Mus musculus
gcgtcggcatgcggatcagtataag

SEQ ID NO: 39900 - DNA, 25 bp, Mus musculus
gaagaggccacacgtgccaacgcat

SEQ ID NO: 39901 - DNA, 25 bp, Mus musculus
agaggccacacgtgccaacgcatct

SEQ ID NO: 39902 - DNA, 25 bp, Mus musculus
aggccacacgtgccaacgcatctcg

SEQ ID NO: 39903 - DNA, 25 bp, Mus musculus
cacacgtgccaacgcatctcggcgt

SEQ ID NO: 39904 - DNA, 25 bp, Mus musculus
cacgtgccaacgcatctcggcgtaa

SEQ ID NO: 39905 - DNA, 25 bp, Mus musculus
gtttgctacatcccagtctggacac

SEQ ID NO: 39906 - DNA, 25 bp, Mus musculus
tacatcccagtctggacactactca

SEQ ID NO: 39907 - DNA, 25 bp, Mus musculus
catctgttgtcttccggccggatga

SEQ ID NO: 39908 - DNA, 25 bp, Mus musculus
aagcaaccacagtctacactaagcc

SEQ ID NO: 39909 - DNA, 25 bp, Mus musculus
ccacagtctacactaagcctgaaga

SEQ ID NO: 39910 - DNA, 25 bp, Mus musculus
tctacactaagcctgaagacctgac

SEQ ID NO: 39911 - DNA, 25 bp, Mus musculus
ctaagcctgaagacctgacagcata

SEQ ID NO: 39912 - DNA, 25 bp, Mus musculus
atgagtattctgtcctgggcaggag

SEQ ID NO: 39913 - DNA, 25 bp, Mus musculus
attctgtcctgggcaggagcatcct

SEQ ID NO: 39914 - DNA, 25 bp, Mus musculus
gcatcctgaatgtatcaggtacagg

SEQ ID NO: 39915 - DNA, 25 bp, Mus musculus
cctgtttgtcttcagtgtctccctc

SEQ ID NO: 39916 - DNA, 25 bp, Mus musculus
tgtcttcagtgtctccctcatcttc

SEQ ID NO: 39917 - DNA, 25 bp, Mus musculus
ccagtctggacactactcaaaatac

SEQ ID NO: 39918 - DNA, 25 bp, Mus musculus
acacaggcgagtcaggtgggacaca

SEQ ID NO: 39919 - DNA, 25 bp, Mus musculus
acatcggatgactgcagagaggcca

SEQ ID NO: 39920 - DNA, 25 bp, Mus musculus
aggccagctgacagcccctggaaga

SEQ ID NO: 39921 - DNA, 25 bp, Mus musculus
gaaggtcccaggacacatgggaatg

SEQ ID NO: 39922 - DNA, 25 bp, Mus musculus
aattcacatttgcttgctaacctgc

SEQ ID NO: 39923 - DNA, 25 bp, Mus musculus
cttgctaacctgctaccctaagaag

SEQ ID NO: 39924 - DNA, 25 bp, Mus musculus
ctaccctaagaagtgccttgccctg

SEQ ID NO: 39925 - DNA, 25 bp, Mus musculus
agcctaaacagagacccgcggctga

SEQ ID NO: 39926 - DNA, 25 bp, Mus musculus
gcctaaacagagacccgcggctgac

SEQ ID NO: 39927 - DNA, 25 bp, Mus musculus
ctcagcaaacttacttgcattttta

SEQ ID NO: 39928 - DNA, 25 bp, Mus musculus
tcagcaaacttacttgcatttttaa

SEQ ID NO: 39929 - DNA, 25 bp, Mus musculus
ttttaaaacagttcgtgctattgat

SEQ ID NO: 39930 - DNA, 25 bp, Mus musculus
attttcagcaaggaatgtggattca

SEQ ID NO: 39931 - DNA, 25 bp, Mus musculus
tctcctctgaatggggtgaaaacca

SEQ ID NO: 39932 - DNA, 25 bp, Mus musculus
ccacgtttctcagcaaacttacttg

SEQ ID NO: 39933 - DNA, 25 bp, Mus musculus
cacgtttctcagcaaacttacttgc

SEQ ID NO: 39934 - DNA, 25 bp, Mus musculus
acgtttctcagcaaacttacttgca

SEQ ID NO: 39935 - DNA, 25 bp, Mus musculus
cgtttctcagcaaacttacttgcat

SEQ ID NO: 39936 - DNA, 25 bp, Mus musculus
gtttctcagcaaacttacttgcatt

SEQ ID NO: 39937 - DNA, 25 bp, Mus musculus
tttctcagcaaacttacttgcattt

SEQ ID NO: 39938 - DNA, 25 bp, Mus musculus
ttctcagcaaacttacttgcatttt

SEQ ID NO: 39939 - DNA, 25 bp, Mus musculus
tctcagcaaacttacttgcattttt

SEQ ID NO: 39940 - DNA, 25 bp, Mus musculus
gcctaaacagagacccgcggctgac

SEQ ID NO: 39941 - DNA, 25 bp, Mus musculus
ccacgtttctcagcaaacttacttg

SEQ ID NO: 39942 - DNA, 25 bp, Mus musculus
gattcagaattgtctgccctccaca

SEQ ID NO: 39943 - DNA, 25 bp, Mus musculus
attcagaattgtctgccctccacaa

SEQ ID NO: 39944 - DNA, 25 bp, Mus musculus
ttcagaattgtctgccctccacaat

SEQ ID NO: 39945 - DNA, 25 bp, Mus musculus
cagaattgtctgccctccacaatga

SEQ ID NO: 39946 - DNA, 25 bp, Mus musculus
ctgccctccacaatgaaaagaaggt

SEQ ID NO: 39947 - DNA, 25 bp, Mus musculus
tgccctccacaatgaaaagaaggtg

SEQ ID NO: 39948 - DNA, 25 bp, Mus musculus
actgcttcgtgtttgtttttctgtg

SEQ ID NO: 39949 - DNA, 25 bp, Mus musculus
ctgcttcgtgtttgtttttctgtgg

SEQ ID NO: 39950 - DNA, 25 bp, Mus musculus
tatttttcttcagtatttgaagtat

SEQ ID NO: 39951 - DNA, 25 bp, Mus musculus
tctcctctgaatggggtgaaaacca

SEQ ID NO: 39952 - DNA, 25 bp, Mus musculus
acgtttctcagcaaacttacttgca

SEQ ID NO: 39953 - DNA, 25 bp, Mus musculus
cgtttctcagcaaacttacttgcat

SEQ ID NO: 39954 - DNA, 25 bp, Mus musculus
gtttctcagcaaacttacttgcatt

SEQ ID NO: 39955 - DNA, 25 bp, Mus musculus
ttctcagcaaacttacttgcatttt

SEQ ID NO: 39956 - DNA, 25 bp, Mus musculus
tctcagcaaacttacttgcattttt

SEQ ID NO: 39957 - DNA, 25 bp, Mus musculus
ctcagcaaacttacttgcattttta

SEQ ID NO: 39958 - DNA, 25 bp, Mus musculus
ttttaaaacagttcgtgctattgat

SEQ ID NO: 39959 - DNA, 25 bp, Mus musculus
attttcagcaaggaatgtggattca

SEQ ID NO: 39960 - DNA, 25 bp, Mus musculus
tccttccgtcatcgtgcagcctggg

SEQ ID NO: 39961 - DNA, 25 bp, Mus musculus
cgtcatcgtgcagcctgggaagaga

SEQ ID NO: 39962 - DNA, 25 bp, Mus musculus
gagacatttccgaaaacacactggg

SEQ ID NO: 39963 - DNA, 25 bp, Mus musculus
gatcaaacctttccagtgtccagac

SEQ ID NO: 39964 - DNA, 25 bp, Mus musculus
acctttccagtgtccagactgtgac

SEQ ID NO: 39965 - DNA, 25 bp, Mus musculus
ccagtgtccagactgtgaccgaagc

SEQ ID NO: 39966 - DNA, 25 bp, Mus musculus
tccagactgtgaccgaagcttctct

SEQ ID NO: 39967 - DNA, 25 bp, Mus musculus
cctacacaggaaacgccacatgcta

SEQ ID NO: 39968 - DNA, 25 bp, Mus musculus
acgccacatgctagtctgaaaacct

SEQ ID NO: 39969 - DNA, 25 bp, Mus musculus
catgctagtctgaaaacctgtctcc

SEQ ID NO: 39970 - DNA, 25 bp, Mus musculus
agtctgaaaacctgtctccagctca

SEQ ID NO: 39971 - DNA, 25 bp, Mus musculus
tgtctccagctcacacactaagggg

SEQ ID NO: 39972 - DNA, 25 bp, Mus musculus
gaagagacctctacctgtggaatcc

SEQ ID NO: 39973 - DNA, 25 bp, Mus musculus
tacccaaaggaagcgcaggatacac

SEQ ID NO: 39974 - DNA, 25 bp, Mus musculus
gatacacagatgcgactatgatggg

SEQ ID NO: 39975 - DNA, 25 bp, Mus musculus
ctacactaagagctcgcacttgaaa

SEQ ID NO: 39976 - DNA, 25 bp, Mus musculus
taagagctcgcacttgaaagcacac

SEQ ID NO: 39977 - DNA, 25 bp, Mus musculus
agcacacagaagaactcatacagga

SEQ ID NO: 39978 - DNA, 25 bp, Mus musculus
gccgtacaaatgcacctgggaaggc

SEQ ID NO: 39979 - DNA, 25 bp, Mus musculus
caaatgcacctgggaaggctgcacg

SEQ ID NO: 39980 - DNA, 25 bp, Mus musculus
ctcccagactcagatgagacactac

SEQ ID NO: 39981 - DNA, 25 bp, Mus musculus
catagttgggtccttagcagtggcc

SEQ ID NO: 39982 - DNA, 25 bp, Mus musculus
tgaaatcgtgccttagcttcagtct

SEQ ID NO: 39983 - DNA, 25 bp, Mus musculus
cgtgccttagcttcagtcttgcagc

SEQ ID NO: 39984 - DNA, 25 bp, Mus musculus
tcagtcttgcagctatcaggatggg

SEQ ID NO: 39985 - DNA, 25 bp, Mus musculus
gacaccccaactgcaatgtctctgc

SEQ ID NO: 39986 - DNA, 25 bp, Mus musculus
catctgcagagttcttgccaggaca

SEQ ID NO: 39987 - DNA, 25 bp, Mus musculus
cagagttcttgccaggacagtcact

SEQ ID NO: 39988 - DNA, 25 bp, Mus musculus
tcttgccaggacagtcacttttatt

SEQ ID NO: 39989 - DNA, 25 bp, Mus musculus
ccttctctctgggtgcagggcctca

SEQ ID NO: 39990 - DNA, 25 bp, Mus musculus
cccatgagcctcaaggaacagaggg

SEQ ID NO: 39991 - DNA, 25 bp, Mus musculus
gtcctgggcactggagtcaataaat

SEQ ID NO: 39992 - DNA, 25 bp, Mus musculus
tgggtccttagcagtggccccatgt

SEQ ID NO: 39993 - DNA, 25 bp, Mus musculus
tcctgggcactggagtcaataaatt

SEQ ID NO: 39994 - DNA, 25 bp, Mus musculus
cttagcagtggccccatgtgtctcc

SEQ ID NO: 39995 - DNA, 25 bp, Mus musculus
agtggccccatgtgtctcccttcct

SEQ ID NO: 39996 - DNA, 25 bp, Mus musculus
tcagtgaccagggagtgccaatggc

SEQ ID NO: 39997 - DNA, 25 bp, Mus musculus
caatggctcacagacccctcggaag

SEQ ID NO: 39998 - DNA, 25 bp, Mus musculus
gggctcagcgactgtgcctgttcct

SEQ ID NO: 39999 - DNA, 25 bp, Mus musculus
acactgctcttggatgccctggctt

SEQ ID NO: 40000 - DNA, 25 bp, Mus musculus
gatgccctggctttctcctgaaatc

SEQ ID NO: 40001 - DNA, 25 bp, Mus musculus
ttcctgctcttgaacctagtgttcc

SEQ ID NO: 40002 - DNA, 25 bp, Mus musculus
ctcttgaacctagtgttcctgttct

SEQ ID NO: 40003 - DNA, 25 bp, Mus musculus
atgaaatgctaccgcagcaatgcct

SEQ ID NO: 40004 - DNA, 25 bp, Mus musculus
tgctaccgcagcaatgcctacacca

SEQ ID NO: 40005 - DNA, 25 bp, Mus musculus
atcacgaccagctcgcggatggcca

SEQ ID NO: 40006 - DNA, 25 bp, Mus musculus
accagctcgcggatggccaaaagaa

SEQ ID NO: 40007 - DNA, 25 bp, Mus musculus
cctcccgtgagcaggaccataacca

SEQ ID NO: 40008 - DNA, 25 bp, Mus musculus
aggaccataaccaaagactccatct

SEQ ID NO: 40009 - DNA, 25 bp, Mus musculus
ataaccaaagactccatctatgact

SEQ ID NO: 40010 - DNA, 25 bp, Mus musculus
tccatctatgactcatttgaccggg

SEQ ID NO: 40011 - DNA, 25 bp, Mus musculus
tatgactcatttgaccgggaggcca

SEQ ID NO: 40012 - DNA, 25 bp, Mus musculus
tcactgttatgtgccagagattaaa

SEQ ID NO: 40013 - DNA, 25 bp, Mus musculus
gtgttcctgttctcctggctacctt

SEQ ID NO: 40014 - DNA, 25 bp, Mus musculus
ctacctttccatgtggctcagctct

SEQ ID NO: 40015 - DNA, 25 bp, Mus musculus
ttccatgtggctcagctctggcatc

SEQ ID NO: 40016 - DNA, 25 bp, Mus musculus
tggcatccccatgagcaagactaca

SEQ ID NO: 40017 - DNA, 25 bp, Mus musculus
cttgtcttcacggcagtcacgtggg

SEQ ID NO: 40018 - DNA, 25 bp, Mus musculus
ttcagctcttcagcctcgaaaccca

SEQ ID NO: 40019 - DNA, 25 bp, Mus musculus
tcttcagcctcgaaacccactctgt

SEQ ID NO: 40020 - DNA, 25 bp, Mus musculus
gcctcgaaacccactctgtactcta

SEQ ID NO: 40021 - DNA, 25 bp, Mus musculus
caaactgataatctctcagactatg

SEQ ID NO: 40022 - DNA, 25 bp, Mus musculus
aaactgataatctctcagactatgc

SEQ ID NO: 40023 - DNA, 25 bp, Mus musculus
tatgccatggagcaccgagcaccag

SEQ ID NO: 40024 - DNA, 25 bp, Mus musculus
tgccatggagcaccgagcaccagac

SEQ ID NO: 40025 - DNA, 25 bp, Mus musculus
ccatggagcaccgagcaccagacat

SEQ ID NO: 40026 - DNA, 25 bp, Mus musculus
atggagcaccgagcaccagacatca

SEQ ID NO: 40027 - DNA, 25 bp, Mus musculus
tggagcaccgagcaccagacatcat

SEQ ID NO: 40028 - DNA, 25 bp, Mus musculus
ggagcaccgagcaccagacatcatc

SEQ ID NO: 40029 - DNA, 25 bp, Mus musculus
agcaccgagcaccagacatcatcca

SEQ ID NO: 40030 - DNA, 25 bp, Mus musculus
ccgagcaccagacatcatccactat

SEQ ID NO: 40031 - DNA, 25 bp, Mus musculus
cgagcaccagacatcatccactata

SEQ ID NO: 40032 - DNA, 25 bp, Mus musculus
gagcaccagacatcatccactatat

SEQ ID NO: 40033 - DNA, 25 bp, Mus musculus
actgataatctctcagactatgcca

SEQ ID NO: 40034 - DNA, 25 bp, Mus musculus
gcaccagacatcatccactatatgc

SEQ ID NO: 40035 - DNA, 25 bp, Mus musculus
ctgataatctctcagactatgccat

SEQ ID NO: 40036 - DNA, 25 bp, Mus musculus
tgataatctctcagactatgccatg

SEQ ID NO: 40037 - DNA, 25 bp, Mus musculus
tctcagactatgccatggagcaccg

SEQ ID NO: 40038 - DNA, 25 bp, Mus musculus
tcagactatgccatggagcaccgag

SEQ ID NO: 40039 - DNA, 25 bp, Mus musculus
cagactatgccatggagcaccgagc

SEQ ID NO: 40040 - DNA, 25 bp, Mus musculus
actatgccatggagcaccgagcacc

SEQ ID NO: 40041 - DNA, 25 bp, Mus musculus
ctatgccatggagcaccgagcacca

SEQ ID NO: 40042 - DNA, 25 bp, Mus musculus
ggaccttatcaggtttgcacagacg

SEQ ID NO: 40043 - DNA, 25 bp, Mus musculus
tatcaggtttgcacagacgcgggag

SEQ ID NO: 40044 - DNA, 25 bp, Mus musculus
agcaccagtgggtactctgtacatg

SEQ ID NO: 40045 - DNA, 25 bp, Mus musculus
agtgggtactctgtacatggtagag

SEQ ID NO: 40046 - DNA, 25 bp, Mus musculus
tactctgtacatggtagagggtgcc

SEQ ID NO: 40047 - DNA, 25 bp, Mus musculus
agcattttcctcacggtggacatga

SEQ ID NO: 40048 - DNA, 25 bp, Mus musculus
ttcctcacggtggacatgaggcagg

SEQ ID NO: 40049 - DNA, 25 bp, Mus musculus
gaacgtgtgctttacctcagacagt

SEQ ID NO: 40050 - DNA, 25 bp, Mus musculus
tacctcagacagtcagtgttctgca

SEQ ID NO: 40051 - DNA, 25 bp, Mus musculus
agacagtcagtgttctgcatactgt

SEQ ID NO: 40052 - DNA, 25 bp, Mus musculus
aatcacatggtgccatatttagcta

SEQ ID NO: 40053 - DNA, 25 bp, Mus musculus
ttagctactaaaaagctcttcgcaa

SEQ ID NO: 40054 - DNA, 25 bp, Mus musculus
caaggacctggctggctgtatccat

SEQ ID NO: 40055 - DNA, 25 bp, Mus musculus
tggctgtatccatggcctcagcaat

SEQ ID NO: 40056 - DNA, 25 bp, Mus musculus
tatccatggcctcagcaatgtgaag

SEQ ID NO: 40057 - DNA, 25 bp, Mus musculus
gctgaacgagcacttcctgaacacc

SEQ ID NO: 40058 - DNA, 25 bp, Mus musculus
cgagcacttcctgaacaccacagac

SEQ ID NO: 40059 - DNA, 25 bp, Mus musculus
cttcctgaacaccacagacttcctg

SEQ ID NO: 40060 - DNA, 25 bp, Mus musculus
cttcctggacaccattaagagcaac

SEQ ID NO: 40061 - DNA, 25 bp, Mus musculus
tctgggcaagcagtaggggtgacac

SEQ ID NO: 40062 - DNA, 25 bp, Mus musculus
acttcacagacctttttgactatct

SEQ ID NO: 40063 - DNA, 25 bp, Mus musculus
tcacagacctttttgactatcttcc

SEQ ID NO: 40064 - DNA, 25 bp, Mus musculus
tcgatcgcctacaggaagttcctca

SEQ ID NO: 40065 - DNA, 25 bp, Mus musculus
atcgcctacaggaagttcctcatga

SEQ ID NO: 40066 - DNA, 25 bp, Mus musculus
gcctacaggaagttcctcatgaggg

SEQ ID NO: 40067 - DNA, 25 bp, Mus musculus
aagttcctcatgagggtccaatgtg

SEQ ID NO: 40068 - DNA, 25 bp, Mus musculus
ttcctcatgagggtccaatgtgtga

SEQ ID NO: 40069 - DNA, 25 bp, Mus musculus
ggatatctcctcggggagctggtta

SEQ ID NO: 40070 - DNA, 25 bp, Mus musculus
tatctcctcggggagctggttatac

SEQ ID NO: 40071 - DNA, 25 bp, Mus musculus
ctggttatacctttggccaagatat

SEQ ID NO: 40072 - DNA, 25 bp, Mus musculus
atgccaatggcctcacgttggtgtc

SEQ ID NO: 40073 - DNA, 25 bp, Mus musculus
ccaatggcctcacgttggtgtccag

SEQ ID NO: 40074 - DNA, 25 bp, Mus musculus
tgtcaccatccatagacacactgga

SEQ ID NO: 40075 - DNA, 25 bp, Mus musculus
caccatccatagacacactggatca

SEQ ID NO: 40076 - DNA, 25 bp, Mus musculus
ccatagacacactggatcacatccg

SEQ ID NO: 40077 - DNA, 25 bp, Mus musculus
tagacacactggatcacatccgagc

SEQ ID NO: 40078 - DNA, 25 bp, Mus musculus
acacactggatcacatccgagcact

SEQ ID NO: 40079 - DNA, 25 bp, Mus musculus
cactggatcacatccgagcactcga

SEQ ID NO: 40080 - DNA, 25 bp, Mus musculus
atcacatccgagcactcgatcgcct

SEQ ID NO: 40081 - DNA, 25 bp, Mus musculus
acatccgagcactcgatcgcctaca

SEQ ID NO: 40082 - DNA, 25 bp, Mus musculus
atctctttgattatcttccacttac

SEQ ID NO: 40083 - DNA, 25 bp, Mus musculus
cacttacagctttagtagatggaca

SEQ ID NO: 40084 - DNA, 25 bp, Mus musculus
gcatttctccacgtggtgctggcta

SEQ ID NO: 40085 - DNA, 25 bp, Mus musculus
ctggctacacatttggacaagacat

SEQ ID NO: 40086 - DNA, 25 bp, Mus musculus
tggtgtctcgtgctcaccagcttgt

SEQ ID NO: 40087 - DNA, 25 bp, Mus musculus
ctcgtgctcaccagcttgtaatgga

SEQ ID NO: 40088 - DNA, 25 bp, Mus musculus
ctcaccagcttgtaatggaaggata

SEQ ID NO: 40089 - DNA, 25 bp, Mus musculus
tggtcaccatttttagtgcgcccaa

SEQ ID NO: 40090 - DNA, 25 bp, Mus musculus
ccatttttagtgcgcccaattactg

SEQ ID NO: 40091 - DNA, 25 bp, Mus musculus
ttagtgcgcccaattactgctaccg

SEQ ID NO: 40092 - DNA, 25 bp, Mus musculus
ggaaccaggctgctatcatggaatt

SEQ ID NO: 40093 - DNA, 25 bp, Mus musculus
attcatttcttcagtttgacccagc

SEQ ID NO: 40094 - DNA, 25 bp, Mus musculus
tgtctccatccatagatacactgga

SEQ ID NO: 40095 - DNA, 25 bp, Mus musculus
tagatacactggaccacataagagc

SEQ ID NO: 40096 - DNA, 25 bp, Mus musculus
cactggaccacataagagccctgga

SEQ ID NO: 40097 - DNA, 25 bp, Mus musculus
taagagccctggatcgcttgcaaga

SEQ ID NO: 40098 - DNA, 25 bp, Mus musculus
aagttccacatgagggcccaatgtg

SEQ ID NO: 40099 - DNA, 25 bp, Mus musculus
caatgtgtgatctcttatggtcaga

SEQ ID NO: 40100 - DNA, 25 bp, Mus musculus
gtgatctcttatggtcagatccgga

SEQ ID NO: 40101 - DNA, 25 bp, Mus musculus
tcttatggtcagatccggatgaccg

SEQ ID NO: 40102 - DNA, 25 bp, Mus musculus
gccacaccttggacaatcattgctg

SEQ ID NO: 40103 - DNA, 25 bp, Mus musculus
acaccttggacaatcattgctgtct

SEQ ID NO: 40104 - DNA, 25 bp, Mus musculus
cactgtcgtgggcttgatcagatag

SEQ ID NO: 40105 - DNA, 25 bp, Mus musculus
cagatagcctttacagatgtagcag

SEQ ID NO: 40106 - DNA, 25 bp, Mus musculus
gcctttacagatgtagcaggtgatg

SEQ ID NO: 40107 - DNA, 25 bp, Mus musculus
cctttgggtagccattcgaggtcag

SEQ ID NO: 40108 - DNA, 25 bp, Mus musculus
ggtagccattcgaggtcagctggct

SEQ ID NO: 40109 - DNA, 25 bp, Mus musculus
cattcgaggtcagctggcttgagca

SEQ ID NO: 40110 - DNA, 25 bp, Mus musculus
tcgaggtcagctggcttgagcagtt

SEQ ID NO: 40111 - DNA, 25 bp, Mus musculus
agatgcaaagctgctcccaggagct

SEQ ID NO: 40112 - DNA, 25 bp, Mus musculus
aaagctgctcccaggagctagcgca

SEQ ID NO: 40113 - DNA, 25 bp, Mus musculus
gctcccaggagctagcgcaatgttc

SEQ ID NO: 40114 - DNA, 25 bp, Mus musculus
ccttggacaatcattgctgtcttca

SEQ ID NO: 40115 - DNA, 25 bp, Mus musculus
acaatcattgctgtcttcaaagtgc

SEQ ID NO: 40116 - DNA, 25 bp, Mus musculus
atcattgctgtcttcaaagtgctgg

SEQ ID NO: 40117 - DNA, 25 bp, Mus musculus
attgctgtcttcaaagtgctggaca

SEQ ID NO: 40118 - DNA, 25 bp, Mus musculus
aatacaggtcttacagaatgtatgg

SEQ ID NO: 40119 - DNA, 25 bp, Mus musculus
gaggcattccgtcactgtcgtgggc

SEQ ID NO: 40120 - DNA, 25 bp, Mus musculus
ttccgtcactgtcgtgggcttgatc

SEQ ID NO: 40121 - DNA, 25 bp, Mus musculus
cgtcactgtcgtgggcttgatcaga

SEQ ID NO: 40122 - DNA, 25 bp, Mus musculus
aaattagcatcagtcacaccactac

SEQ ID NO: 40123 - DNA, 25 bp, Mus musculus
ttagcatcagtcacaccactacatt

SEQ ID NO: 40124 - DNA, 25 bp, Mus musculus
tagtcaggaccatgctgaataaaag

SEQ ID NO: 40125 - DNA, 25 bp, Mus musculus
aggttcttctgttcttccacagaat

SEQ ID NO: 40126 - DNA, 25 bp, Mus musculus
ttctgttcttccacagaatatggct

SEQ ID NO: 40127 - DNA, 25 bp, Mus musculus
tgttcttccacagaatatggcttta

SEQ ID NO: 40128 - DNA, 25 bp, Mus musculus
tcttccacagaatatggctttagga

SEQ ID NO: 40129 - DNA, 25 bp, Mus musculus
aactttttgtaagtctgtggctcag

SEQ ID NO: 40130 - DNA, 25 bp, Mus musculus
tttttgtaagtctgtggctcagaca

SEQ ID NO: 40131 - DNA, 25 bp, Mus musculus
tgtggctcagacatgctgaatgtat

SEQ ID NO: 40132 - DNA, 25 bp, Mus musculus
tattccaaggcagtctgcggtttgg

SEQ ID NO: 40133 - DNA, 25 bp, Mus musculus
accataagtcctggactaggaatct

SEQ ID NO: 40134 - DNA, 25 bp, Mus musculus
gtcacaccactacattcttcaagca

SEQ ID NO: 40135 - DNA, 25 bp, Mus musculus
acaccactacattcttcaagcaagg

SEQ ID NO: 40136 - DNA, 25 bp, Mus musculus
ctacattcttcaagcaaggagactg

SEQ ID NO: 40137 - DNA, 25 bp, Mus musculus
tcttcaagcaaggagactggaaact

SEQ ID NO: 40138 - DNA, 25 bp, Mus musculus
ggaaactgacatgccctatagtcag

SEQ ID NO: 40139 - DNA, 25 bp, Mus musculus
aactgacatgccctatagtcaggac

SEQ ID NO: 40140 - DNA, 25 bp, Mus musculus
gccctatagtcaggaccatgctgaa

SEQ ID NO: 40141 - DNA, 25 bp, Mus musculus
ctatagtcaggaccatgctgaataa

SEQ ID NO: 40142 - DNA, 25 bp, Mus musculus
ccacacacaggcaaaaaggtagaat

SEQ ID NO: 40143 - DNA, 25 bp, Mus musculus
gaatgcactgagctgaccagactcg

SEQ ID NO: 40144 - DNA, 25 bp, Mus musculus
gctgtgcttcgttttggagaagtgc

SEQ ID NO: 40145 - DNA, 25 bp, Mus musculus
gtgcttcgttttggagaagtgcatc

SEQ ID NO: 40146 - DNA, 25 bp, Mus musculus
aattttatccaacacatactcctga

SEQ ID NO: 40147 - DNA, 25 bp, Mus musculus
tttatccaacacatactcctgaatt

SEQ ID NO: 40148 - DNA, 25 bp, Mus musculus
atccaacacatactcctgaattatg

SEQ ID NO: 40149 - DNA, 25 bp, Mus musculus
caacacatactcctgaattatggca

SEQ ID NO: 40150 - DNA, 25 bp, Mus musculus
cacatactcctgaattatggcatga

SEQ ID NO: 40151 - DNA, 25 bp, Mus musculus
atactcctgaattatggcatgaata

SEQ ID NO: 40152 - DNA, 25 bp, Mus musculus
aattatcgccactagcatgtagaac

SEQ ID NO: 40153 - DNA, 25 bp, Mus musculus
aactgtagccaagtctttgatacca

SEQ ID NO: 40154 - DNA, 25 bp, Mus musculus
actgagctgaccagactcgttaaac

SEQ ID NO: 40155 - DNA, 25 bp, Mus musculus
gtctttgataccatagtgatatagg

SEQ ID NO: 40156 - DNA, 25 bp, Mus musculus
gagctgaccagactcgttaaacttg

SEQ ID NO: 40157 - DNA, 25 bp, Mus musculus
ctgaccagactcgttaaacttgctg

SEQ ID NO: 40158 - DNA, 25 bp, Mus musculus
accagactcgttaaacttgctgtgc

SEQ ID NO: 40159 - DNA, 25 bp, Mus musculus
agactcgttaaacttgctgtgcttc

SEQ ID NO: 40160 - DNA, 25 bp, Mus musculus
ctcgttaaacttgctgtgcttcgtt

SEQ ID NO: 40161 - DNA, 25 bp, Mus musculus
gttaaacttgctgtgcttcgttttg

SEQ ID NO: 40162 - DNA, 25 bp, Mus musculus
aaacttgctgtgcttcgttttggag

SEQ ID NO: 40163 - DNA, 25 bp, Mus musculus
tacccggctgggcacacataaaagc

SEQ ID NO: 40164 - DNA, 25 bp, Mus musculus
acccggctgggcacacataaaagca

SEQ ID NO: 40165 - DNA, 25 bp, Mus musculus
cagtccggcacttctcggatcctca

SEQ ID NO: 40166 - DNA, 25 bp, Mus musculus
ggcacttctcggatcctcagcccag

SEQ ID NO: 40167 - DNA, 25 bp, Mus musculus
gcacttctcggatcctcagcccagt

SEQ ID NO: 40168 - DNA, 25 bp, Mus musculus
cacttctcggatcctcagcccagtg

SEQ ID NO: 40169 - DNA, 25 bp, Mus musculus
gtgcccttctcgctgctgggacctc

SEQ ID NO: 40170 - DNA, 25 bp, Mus musculus
gcccttctcgctgctgggacctcga

SEQ ID NO: 40171 - DNA, 25 bp, Mus musculus
ctgctgggacctcgagctgggaacc

SEQ ID NO: 40172 - DNA, 25 bp, Mus musculus
gctgggacctcgagctgggaaccat

SEQ ID NO: 40173 - DNA, 25 bp, Mus musculus
cgatgcagtggtcgcagtggttcag

SEQ ID NO: 40174 - DNA, 25 bp, Mus musculus
gatgcagtggtcgcagtggttcagc

SEQ ID NO: 40175 - DNA, 25 bp, Mus musculus
gcacacataaaagcacgctggggct

SEQ ID NO: 40176 - DNA, 25 bp, Mus musculus
cacacataaaagcacgctggggctc

SEQ ID NO: 40177 - DNA, 25 bp, Mus musculus
acacataaaagcacgctggggctcc

SEQ ID NO: 40178 - DNA, 25 bp, Mus musculus
acataaaagcacgctggggctccag

SEQ ID NO: 40179 - DNA, 25 bp, Mus musculus
cataaaagcacgctggggctccagt

SEQ ID NO: 40180 - DNA, 25 bp, Mus musculus
aaagcacgctggggctccagtccgg

SEQ ID NO: 40181 - DNA, 25 bp, Mus musculus
gctccagtccggcacttctcggatc

SEQ ID NO: 40182 - DNA, 25 bp, Mus musculus
tccagtccggcacttctcggatcct

SEQ ID NO: 40183 - DNA, 25 bp, Mus musculus
tgggctctgacagcgaccttgtcat

SEQ ID NO: 40184 - DNA, 25 bp, Mus musculus
ctgacagcgaccttgtcatctggga

SEQ ID NO: 40185 - DNA, 25 bp, Mus musculus
cattctctgactatgtctataagcg

SEQ ID NO: 40186 - DNA, 25 bp, Mus musculus
agatggcagacctgcatgcagtccc

SEQ ID NO: 40187 - DNA, 25 bp, Mus musculus
cagacctgcatgcagtcccaagagg

SEQ ID NO: 40188 - DNA, 25 bp, Mus musculus
cagtcccaagaggcatgtatgatgg

SEQ ID NO: 40189 - DNA, 25 bp, Mus musculus
cagtgaggaacctccatcagtcagg

SEQ ID NO: 40190 - DNA, 25 bp, Mus musculus
tccatcagtcaggatttagcctgtc

SEQ ID NO: 40191 - DNA, 25 bp, Mus musculus
gatttagcctgtcaggcacccaagt

SEQ ID NO: 40192 - DNA, 25 bp, Mus musculus
gcctgtcaggcacccaagtggatga

SEQ ID NO: 40193 - DNA, 25 bp, Mus musculus
gttctaacatcacatccctgagtta

SEQ ID NO: 40194 - DNA, 25 bp, Mus musculus
acatcacatccctgagttaagccct

SEQ ID NO: 40195 - DNA, 25 bp, Mus musculus
gcgaccttgtcatctgggatccaga

SEQ ID NO: 40196 - DNA, 25 bp, Mus musculus
atccagatgccttgaagattgtctc

SEQ ID NO: 40197 - DNA, 25 bp, Mus musculus
tgaagattgtctctgccaagaacca

SEQ ID NO: 40198 - DNA, 25 bp, Mus musculus
ttgtctctgccaagaaccaccagtc

SEQ ID NO: 40199 - DNA, 25 bp, Mus musculus
accagtcggttgccgaatacaacat

SEQ ID NO: 40200 - DNA, 25 bp, Mus musculus
tctgccagggcaagatcatgctgga

SEQ ID NO: 40201 - DNA, 25 bp, Mus musculus
aagatggcaacctgcacgtgaccca

SEQ ID NO: 40202 - DNA, 25 bp, Mus musculus
ttccctgcagcccattctctgacta

SEQ ID NO: 40203 - DNA, 25 bp, Mus musculus
attgcgacctactctgcctggtctg

SEQ ID NO: 40204 - DNA, 25 bp, Mus musculus
acctactctgcctggtctggactgg

SEQ ID NO: 40205 - DNA, 25 bp, Mus musculus
gtaaatacttaccttgaggtcatca

SEQ ID NO: 40206 - DNA, 25 bp, Mus musculus
aatacttaccttgaggtcatcaaat

SEQ ID NO: 40207 - DNA, 25 bp, Mus musculus
acttaccttgaggtcatcaaataca

SEQ ID NO: 40208 - DNA, 25 bp, Mus musculus
gttgatcaaaacaactgctaatagc

SEQ ID NO: 40209 - DNA, 25 bp, Mus musculus
gatcaaaacaactgctaatagcagg

SEQ ID NO: 40210 - DNA, 25 bp, Mus musculus
tatatatcctgcttctgagatgccc

SEQ ID NO: 40211 - DNA, 25 bp, Mus musculus
tcctgcttctgagatgcccctttat

SEQ ID NO: 40212 - DNA, 25 bp, Mus musculus
tgcttctgagatgcccctttataag

SEQ ID NO: 40213 - DNA, 25 bp, Mus musculus
ttctgagatgcccctttataagaca

SEQ ID NO: 40214 - DNA, 25 bp, Mus musculus
gatgcccctttataagacattacgg

SEQ ID NO: 40215 - DNA, 25 bp, Mus musculus
tactctgcctggtctggactggcat

SEQ ID NO: 40216 - DNA, 25 bp, Mus musculus
tctgcctggtctggactggcatctt

SEQ ID NO: 40217 - DNA, 25 bp, Mus musculus
gcatctttgcagtcaagcaatgaag

SEQ ID NO: 40218 - DNA, 25 bp, Mus musculus
tctttgcagtcaagcaatgaagatg

SEQ ID NO: 40219 - DNA, 25 bp, Mus musculus
tctttttataccatgatccgctgcc

SEQ ID NO: 40220 - DNA, 25 bp, Mus musculus
ttttataccatgatccgctgcctgc

SEQ ID NO: 40221 - DNA, 25 bp, Mus musculus
accatgatccgctgcctgctcagag

SEQ ID NO: 40222 - DNA, 25 bp, Mus musculus
ctgctcagagattctcgaaaagtaa

SEQ ID NO: 40223 - DNA, 25 bp, Mus musculus
cagttctcggtataacctgctagtg

SEQ ID NO: 40224 - DNA, 25 bp, Mus musculus
ttctcggtataacctgctagtgaaa

SEQ ID NO: 40225 - DNA, 25 bp, Mus musculus
cacattagccgctgtctctgtagac

SEQ ID NO: 40226 - DNA, 25 bp, Mus musculus
attagccgctgtctctgtagactgt

SEQ ID NO: 40227 - DNA, 25 bp, Mus musculus
cgctgtctctgtagactgtttacca

SEQ ID NO: 40228 - DNA, 25 bp, Mus musculus
tgtctctgtagactgtttaccagag

SEQ ID NO: 40229 - DNA, 25 bp, Mus musculus
ctctgtagactgtttaccagaggaa

SEQ ID NO: 40230 - DNA, 25 bp, Mus musculus
agactgtttaccagaggaagccagt

SEQ ID NO: 40231 - DNA, 25 bp, Mus musculus
cacattttccatagtttccgtggca

SEQ ID NO: 40232 - DNA, 25 bp, Mus musculus
attttccatagtttccgtggcagct

SEQ ID NO: 40233 - DNA, 25 bp, Mus musculus
ttccatagtttccgtggcagctgta

SEQ ID NO: 40234 - DNA, 25 bp, Mus musculus
agtttccgtggcagctgtagaggtg

SEQ ID NO: 40235 - DNA, 25 bp, Mus musculus
tcggtataacctgctagtgaaatct

SEQ ID NO: 40236 - DNA, 25 bp, Mus musculus
taacctgctagtgaaatcttctgct

SEQ ID NO: 40237 - DNA, 25 bp, Mus musculus
gaaatcttctgcttcaattttccca

SEQ ID NO: 40238 - DNA, 25 bp, Mus musculus
atcttctgcttcaattttcccatcc

SEQ ID NO: 40239 - DNA, 25 bp, Mus musculus
ttctgcttcaattttcccatccagt

SEQ ID NO: 40240 - DNA, 25 bp, Mus musculus
ttgtactaagtctttcacattagcc

SEQ ID NO: 40241 - DNA, 25 bp, Mus musculus
tactaagtctttcacattagccgct

SEQ ID NO: 40242 - DNA, 25 bp, Mus musculus
taagtctttcacattagccgctgtc

SEQ ID NO: 40243 - DNA, 25 bp, Mus musculus
tctctcagtctcctttagaagtgtg

SEQ ID NO: 40244 - DNA, 25 bp, Mus musculus
agtctcctttagaagtgtgctctaa

SEQ ID NO: 40245 - DNA, 25 bp, Mus musculus
actgtgctccagctccaggttagtg

SEQ ID NO: 40246 - DNA, 25 bp, Mus musculus
ttgtcctgtggacattgcagtgaag

SEQ ID NO: 40247 - DNA, 25 bp, Mus musculus
gaacccatagtaactcttccagaga

SEQ ID NO: 40248 - DNA, 25 bp, Mus musculus
atagtaactcttccagagaaatctt

SEQ ID NO: 40249 - DNA, 25 bp, Mus musculus
actcttccagagaaatcttccaggg

SEQ ID NO: 40250 - DNA, 25 bp, Mus musculus
gccgcagttgtccaatatgaataca

SEQ ID NO: 40251 - DNA, 25 bp, Mus musculus
acagctcctagagctctgatagatc

SEQ ID NO: 40252 - DNA, 25 bp, Mus musculus
atagatctctcccaggtggtaaagg

SEQ ID NO: 40253 - DNA, 25 bp, Mus musculus
gtgacactctgggacctgattgggg

SEQ ID NO: 40254 - DNA, 25 bp, Mus musculus
gtcttcacagtgatgggtcgtgtcc

SEQ ID NO: 40255 - DNA, 25 bp, Mus musculus
cattgctaccttctccaactgggtc

SEQ ID NO: 40256 - DNA, 25 bp, Mus musculus
taccttctccaactgggtcctctgt

SEQ ID NO: 40257 - DNA, 25 bp, Mus musculus
ctccaactgggtcctctgtcagttc

SEQ ID NO: 40258 - DNA, 25 bp, Mus musculus
ctgggtcctctgtcagttctgggaa

SEQ ID NO: 40259 - DNA, 25 bp, Mus musculus
cctctgtcagttctgggaacttcca

SEQ ID NO: 40260 - DNA, 25 bp, Mus musculus
tcagttctgggaacttccaagatct

SEQ ID NO: 40261 - DNA, 25 bp, Mus musculus
acttccaagatcttccttgaactct

SEQ ID NO: 40262 - DNA, 25 bp, Mus musculus
gaactctcacagctttccttctcac

SEQ ID NO: 40263 - DNA, 25 bp, Mus musculus
ttggcacacctggagccaagtggca

SEQ ID NO: 40264 - DNA, 25 bp, Mus musculus
tgctaggcttgtgcgtagaaagcca

SEQ ID NO: 40265 - DNA, 25 bp, Mus musculus
tacatacttcccgaggacctatgac

SEQ ID NO: 40266 - DNA, 25 bp, Mus musculus
tgcaatacaaaacatcaccatccac

SEQ ID NO: 40267 - DNA, 25 bp, Mus musculus
catcaccatccacattgcttaggaa

SEQ ID NO: 40268 - DNA, 25 bp, Mus musculus
catccacattgcttaggaactgcca

SEQ ID NO: 40269 - DNA, 25 bp, Mus musculus
ttaggaactgccagtgttcccagtg

SEQ ID NO: 40270 - DNA, 25 bp, Mus musculus
actgccagtgttcccagtggcgact

SEQ ID NO: 40271 - DNA, 25 bp, Mus musculus
agtgttcccagtggcgactgcgact

SEQ ID NO: 40272 - DNA, 25 bp, Mus musculus
taacatttatctcttgtatatacga

SEQ ID NO: 40273 - DNA, 25 bp, Mus musculus
ttatctcttgtatatacgacgtgtc

SEQ ID NO: 40274 - DNA, 25 bp, Mus musculus
tatacgacgtgtcctactccaacgg

SEQ ID NO: 40275 - DNA, 25 bp, Mus musculus
aaagccagcagcggagtgcgcacta

SEQ ID NO: 40276 - DNA, 25 bp, Mus musculus
gtgttctgctcgcttgacaacacaa

SEQ ID NO: 40277 - DNA, 25 bp, Mus musculus
tgctcgcttgacaacacaaaagtgg

SEQ ID NO: 40278 - DNA, 25 bp, Mus musculus
ggaaaatcctggatctacaagtctt

SEQ ID NO: 40279 - DNA, 25 bp, Mus musculus
tcctggatctacaagtcttgcttgg

SEQ ID NO: 40280 - DNA, 25 bp, Mus musculus
tgcttggtcttgtccgcttcggttg

SEQ ID NO: 40281 - DNA, 25 bp, Mus musculus
gtcttgtccgcttcggttgtggctt

SEQ ID NO: 40282 - DNA, 25 bp, Mus musculus
tccgcttcggttgtggcttccacgg

SEQ ID NO: 40283 - DNA, 25 bp, Mus musculus
cagactttctattgtggcaaaggaa

SEQ ID NO: 40284 - DNA, 25 bp, Mus musculus
cactgccgtggccaaaataatgtct

SEQ ID NO: 40285 - DNA, 25 bp, Mus musculus
tgagtccacaagattgattgacctg

SEQ ID NO: 40286 - DNA, 25 bp, Mus musculus
attgattgacctgtccattcaaaac

SEQ ID NO: 40287 - DNA, 25 bp, Mus musculus
tgacctgtccattcaaaactaccac

SEQ ID NO: 40288 - DNA, 25 bp, Mus musculus
cctgtccattcaaaactaccacgtg

SEQ ID NO: 40289 - DNA, 25 bp, Mus musculus
ctaccacgtgtttctcagatacatc

SEQ ID NO: 40290 - DNA, 25 bp, Mus musculus
cgtgtttctcagatacatcaccgag

SEQ ID NO: 40291 - DNA, 25 bp, Mus musculus
gtttctcagatacatcaccgagtta

SEQ ID NO: 40292 - DNA, 25 bp, Mus musculus
tctcagatacatcaccgagttactg

SEQ ID NO: 40293 - DNA, 25 bp, Mus musculus
atacatcaccgagttactgagaaag

SEQ ID NO: 40294 - DNA, 25 bp, Mus musculus
catcaccgagttactgagaaagctg

SEQ ID NO: 40295 - DNA, 25 bp, Mus musculus
gcagttccactccaatctgcaggat

SEQ ID NO: 40296 - DNA, 25 bp, Mus musculus
gttccactccaatctgcaggatttt

SEQ ID NO: 40297 - DNA, 25 bp, Mus musculus
ccactccaatctgcaggatttttca

SEQ ID NO: 40298 - DNA, 25 bp, Mus musculus
caatctgcaggatttttcagaccaa

SEQ ID NO: 40299 - DNA, 25 bp, Mus musculus
tttttcagaccaactctctagctac

SEQ ID NO: 40300 - DNA, 25 bp, Mus musculus
ttcagaccaactctctagctactat

SEQ ID NO: 40301 - DNA, 25 bp, Mus musculus
agaccaactctctagctactatgaa

SEQ ID NO: 40302 - DNA, 25 bp, Mus musculus
actctctagctactatgaaaaattt

SEQ ID NO: 40303 - DNA, 25 bp, Mus musculus
gggactgttgcagccaagtggacca

SEQ ID NO: 40304 - DNA, 25 bp, Mus musculus
tggaccattgacctgaagagcggct

SEQ ID NO: 40305 - DNA, 25 bp, Mus musculus
gccttcttcagtggcaggctgaagg

SEQ ID NO: 40306 - DNA, 25 bp, Mus musculus
ttcagtggcaggctgaaggccagag

SEQ ID NO: 40307 - DNA, 25 bp, Mus musculus
atcatgctgagccagaaactacaga

SEQ ID NO: 40308 - DNA, 25 bp, Mus musculus
cccactgtgtgctgttaaaggagtc

SEQ ID NO: 40309 - DNA, 25 bp, Mus musculus
ttaaatactgtctacccagctgagc

SEQ ID NO: 40310 - DNA, 25 bp, Mus musculus
tacccagctgagccgcagccttctg

SEQ ID NO: 40311 - DNA, 25 bp, Mus musculus
ccttctgcgatccacaggagtgtgc

SEQ ID NO: 40312 - DNA, 25 bp, Mus musculus
aaatcgcttcacatttccagattca

SEQ ID NO: 40313 - DNA, 25 bp, Mus musculus
atttccagattcagataacttgcat

SEQ ID NO: 40314 - DNA, 25 bp, Mus musculus
tcattctgttcatagatctgtatct

SEQ ID NO: 40315 - DNA, 25 bp, Mus musculus
taccaaggccccgcaaagggctctg

SEQ ID NO: 40316 - DNA, 25 bp, Mus musculus
ggccccgcaaagggctctgctgatg

SEQ ID NO: 40317 - DNA, 25 bp, Mus musculus
gcaaagggctctgctgatgtgacca

SEQ ID NO: 40318 - DNA, 25 bp, Mus musculus
gtgaccatcatcatttccgatgagg

SEQ ID NO: 40319 - DNA, 25 bp, Mus musculus
gtggtcttcggcaagcttgacccac

SEQ ID NO: 40320 - DNA, 25 bp, Mus musculus
ttcggcaagcttgacccacagaagg

SEQ ID NO: 40321 - DNA, 25 bp, Mus musculus
gacccacagaaggccttcttcagtg

SEQ ID NO: 40322 - DNA, 25 bp, Mus musculus
cagaaggccttcttcagtggcaggc

SEQ ID NO: 40323 - DNA, 25 bp, Mus musculus
acagatgcgactgcgtcgcctcaat

SEQ ID NO: 40324 - DNA, 25 bp, Mus musculus
gcgactgcgtcgcctcaattctacc

SEQ ID NO: 40325 - DNA, 25 bp, Mus musculus
atttccactcacaacagtggagacc

SEQ ID NO: 40326 - DNA, 25 bp, Mus musculus
actcacaacagtggagacctacaca

SEQ ID NO: 40327 - DNA, 25 bp, Mus musculus
agcctgtgccagcagacacatagcc

SEQ ID NO: 40328 - DNA, 25 bp, Mus musculus
tgccagcagacacatagccatcaga

SEQ ID NO: 40329 - DNA, 25 bp, Mus musculus
cagacacatagccatcagatgtccc

SEQ ID NO: 40330 - DNA, 25 bp, Mus musculus
catcaaagctaccgggactctgcat

SEQ ID NO: 40331 - DNA, 25 bp, Mus musculus
agctaccgggactctgcatagactc

SEQ ID NO: 40332 - DNA, 25 bp, Mus musculus
tctgcatagactctggtctacccgc

SEQ ID NO: 40333 - DNA, 25 bp, Mus musculus
acgtcacatcaataaaacaagctca

SEQ ID NO: 40334 - DNA, 25 bp, Mus musculus
catcaataaaacaagctcatgacac

SEQ ID NO: 40335 - DNA, 25 bp, Mus musculus
gcgtcgcctcaattctaccgcaggc

SEQ ID NO: 40336 - DNA, 25 bp, Mus musculus
atcaataaaacaagctcatgacacc

SEQ ID NO: 40337 - DNA, 25 bp, Mus musculus
ccctacaccagccattaccttgagg

SEQ ID NO: 40338 - DNA, 25 bp, Mus musculus
accagccattaccttgaggccctgg

SEQ ID NO: 40339 - DNA, 25 bp, Mus musculus
ggaagttctacccactaccactgca

SEQ ID NO: 40340 - DNA, 25 bp, Mus musculus
gactgacctagaggtggaagagata

SEQ ID NO: 40341 - DNA, 25 bp, Mus musculus
gatggacacaggccttacatttcca

SEQ ID NO: 40342 - DNA, 25 bp, Mus musculus
cacaggccttacatttccactcaca

SEQ ID NO: 40343 - DNA, 25 bp, Mus musculus
ccttacatttccactcacaacagtg

SEQ ID NO: 40344 - DNA, 25 bp, Mus musculus
gcggtcactccataaacccaagcca

SEQ ID NO: 40345 - DNA, 25 bp, Mus musculus
ggtcactccataaacccaagccaca

SEQ ID NO: 40346 - DNA, 25 bp, Mus musculus
tagtgccactagctgagtagtagtc

SEQ ID NO: 40347 - DNA, 25 bp, Mus musculus
gaagacgtacattccaccatcagtc

SEQ ID NO: 40348 - DNA, 25 bp, Mus musculus
agacgtacattccaccatcagtcac

SEQ ID NO: 40349 - DNA, 25 bp, Mus musculus
acgtacattccaccatcagtcacca

SEQ ID NO: 40350 - DNA, 25 bp, Mus musculus
gtacattccaccatcagtcaccatg

SEQ ID NO: 40351 - DNA, 25 bp, Mus musculus
attccaccatcagtcaccatggaga

SEQ ID NO: 40352 - DNA, 25 bp, Mus musculus
tccaccatcagtcaccatggagaga

SEQ ID NO: 40353 - DNA, 25 bp, Mus musculus
caccatcagtcaccatggagagatc

SEQ ID NO: 40354 - DNA, 25 bp, Mus musculus
ccatcagtcaccatggagagatcga

SEQ ID NO: 40355 - DNA, 25 bp, Mus musculus
cagtcaccatggagagatcgatgac

SEQ ID NO: 40356 - DNA, 25 bp, Mus musculus
tccataaacccaagccacaactaca

SEQ ID NO: 40357 - DNA, 25 bp, Mus musculus
taaacccaagccacaactacacact

SEQ ID NO: 40358 - DNA, 25 bp, Mus musculus
agccacaactacacactcccaaaag

SEQ ID NO: 40359 - DNA, 25 bp, Mus musculus
ctacacactcccaaaaggcttgcca

SEQ ID NO: 40360 - DNA, 25 bp, Mus musculus
tcccaaaaggcttgccaaagcaggg

SEQ ID NO: 40361 - DNA, 25 bp, Mus musculus
aaggcttgccaaagcaggggtagtg

SEQ ID NO: 40362 - DNA, 25 bp, Mus musculus
cttgccaaagcaggggtagtgccac

SEQ ID NO: 40363 - DNA, 25 bp, Mus musculus
ggtagtgccactagctgagtagtag

SEQ ID NO: 40364 - DNA, 25 bp, Mus musculus
tcctcagccattgaccaggccaaga

SEQ ID NO: 40365 - DNA, 25 bp, Mus musculus
cctcagccattgaccaggccaagaa

SEQ ID NO: 40366 - DNA, 25 bp, Mus musculus
aacagtgaccttagcgccgcgtgcc

SEQ ID NO: 40367 - DNA, 25 bp, Mus musculus
acagtgaccttagcgccgcgtgcca

SEQ ID NO: 40368 - DNA, 25 bp, Mus musculus
agtgaccttagcgccgcgtgccact

SEQ ID NO: 40369 - DNA, 25 bp, Mus musculus
gtgaccttagcgccgcgtgccactt

SEQ ID NO: 40370 - DNA, 25 bp, Mus musculus
tgaccttagcgccgcgtgccacttc

SEQ ID NO: 40371 - DNA, 25 bp, Mus musculus
tagcgccgcgtgccacttctcagct

SEQ ID NO: 40372 - DNA, 25 bp, Mus musculus
agcgccgcgtgccacttctcagctg

SEQ ID NO: 40373 - DNA, 25 bp, Mus musculus
acgccgagcgtgggaaccattccag

SEQ ID NO: 40374 - DNA, 25 bp, Mus musculus
ccattccagggactggtaccctgca

SEQ ID NO: 40375 - DNA, 25 bp, Mus musculus
cattccagggactggtaccctgcac

SEQ ID NO: 40376 - DNA, 25 bp, Mus musculus
tcagccattgaccaggccaagaaca

SEQ ID NO: 40377 - DNA, 25 bp, Mus musculus
cagccattgaccaggccaagaacag

SEQ ID NO: 40378 - DNA, 25 bp, Mus musculus
agccattgaccaggccaagaacagt

SEQ ID NO: 40379 - DNA, 25 bp, Mus musculus
ccattgaccaggccaagaacagtga

SEQ ID NO: 40380 - DNA, 25 bp, Mus musculus
cattgaccaggccaagaacagtgac

SEQ ID NO: 40381 - DNA, 25 bp, Mus musculus
attgaccaggccaagaacagtgacc

SEQ ID NO: 40382 - DNA, 25 bp, Mus musculus
tgaccaggccaagaacagtgacctt

SEQ ID NO: 40383 - DNA, 25 bp, Mus musculus
gaacagtgaccttagcgccgcgtgc

SEQ ID NO: 40384 - DNA, 25 bp, Mus musculus
caccaaagtgcgcaaacaggaaatt

SEQ ID NO: 40385 - DNA, 25 bp, Mus musculus
gtgcgaccctggaatgacagccttt

SEQ ID NO: 40386 - DNA, 25 bp, Mus musculus
ccgcatcactcagtacctggatgca

SEQ ID NO: 40387 - DNA, 25 bp, Mus musculus
cactcagtacctggatgcaggcggc

SEQ ID NO: 40388 - DNA, 25 bp, Mus musculus
gtacctggatgcaggcggcataccc

SEQ ID NO: 40389 - DNA, 25 bp, Mus musculus
gcagatcgtccacttccacagatct

SEQ ID NO: 40390 - DNA, 25 bp, Mus musculus
gtccctgcgtcctcgttcgcagaga

SEQ ID NO: 40391 - DNA, 25 bp, Mus musculus
tcgttcgcagagatccgctctttgt

SEQ ID NO: 40392 - DNA, 25 bp, Mus musculus
gcagagatccgctctttgtccgtgg

SEQ ID NO: 40393 - DNA, 25 bp, Mus musculus
atccgctctttgtccgtggaatgtg

SEQ ID NO: 40394 - DNA, 25 bp, Mus musculus
tctttgtccgtggaatgtggctgct

SEQ ID NO: 40395 - DNA, 25 bp, Mus musculus
tccgtggaatgtggctgctggttct

SEQ ID NO: 40396 - DNA, 25 bp, Mus musculus
ccctggaatgacagcctttgaacca

SEQ ID NO: 40397 - DNA, 25 bp, Mus musculus
aatgtggctgctggttctcctttgg

SEQ ID NO: 40398 - DNA, 25 bp, Mus musculus
aatgacagcctttgaaccagaggcc

SEQ ID NO: 40399 - DNA, 25 bp, Mus musculus
gggcctggactttcatcgattctat

SEQ ID NO: 40400 - DNA, 25 bp, Mus musculus
ggactttcatcgattctattttgaa

SEQ ID NO: 40401 - DNA, 25 bp, Mus musculus
tcatcgattctattttgaaaacttg

SEQ ID NO: 40402 - DNA, 25 bp, Mus musculus
catccacctgatgggtgacgagtca

SEQ ID NO: 40403 - DNA, 25 bp, Mus musculus
cgagtcagcctgcatcgcctatatc

SEQ ID NO: 40404 - DNA, 25 bp, Mus musculus
agcctgcatcgcctatatccgcatc

SEQ ID NO: 40405 - DNA, 25 bp, Mus musculus
ccatcattacacatacacaagtttt

SEQ ID NO: 40406 - DNA, 25 bp, Mus musculus
ttacacatacacaagttttagtctg

SEQ ID NO: 40407 - DNA, 25 bp, Mus musculus
ccagctacttgggagtttgaggcaa

SEQ ID NO: 40408 - DNA, 25 bp, Mus musculus
ttcttatcttgagacctcacgtctt

SEQ ID NO: 40409 - DNA, 25 bp, Mus musculus
tcttgagacctcacgtcttggctgc

SEQ ID NO: 40410 - DNA, 25 bp, Mus musculus
gacctcacgtcttggctgcaggcat

SEQ ID NO: 40411 - DNA, 25 bp, Mus musculus
tggctgcaggcatccaaacagattt

SEQ ID NO: 40412 - DNA, 25 bp, Mus musculus
caggcatccaaacagatttcctcca

SEQ ID NO: 40413 - DNA, 25 bp, Mus musculus
tccaaacagatttcctccagagcct

SEQ ID NO: 40414 - DNA, 25 bp, Mus musculus
tcctccagagcctcatttgcaacat

SEQ ID NO: 40415 - DNA, 25 bp, Mus musculus
agagcctcatttgcaacattttcaa

SEQ ID NO: 40416 - DNA, 25 bp, Mus musculus
tcatttgcaacattttcaataaaga

SEQ ID NO: 40417 - DNA, 25 bp, Mus musculus
tagaaccaatagatcttctagaaat

SEQ ID NO: 40418 - DNA, 25 bp, Mus musculus
ctctttctttctgcttccaatgaaa

SEQ ID NO: 40419 - DNA, 25 bp, Mus musculus
ctttctgcttccaatgaaaacttag

SEQ ID NO: 40420 - DNA, 25 bp, Mus musculus
gattcagacatctcattatctacct

SEQ ID NO: 40421 - DNA, 25 bp, Mus musculus
tcattatctacctgaagtcctggta

SEQ ID NO: 40422 - DNA, 25 bp, Mus musculus
tgaagtcctggtatacttagcttga

SEQ ID NO: 40423 - DNA, 25 bp, Mus musculus
ttctgttggtggttaccatgaacaa

SEQ ID NO: 40424 - DNA, 25 bp, Mus musculus
gatttcccagctacttgggagtttg

SEQ ID NO: 40425 - DNA, 25 bp, Mus musculus
atatacatccaagtggacgaatgac

SEQ ID NO: 40426 - DNA, 25 bp, Mus musculus
ctactccatggtgttgacaggagct

SEQ ID NO: 40427 - DNA, 25 bp, Mus musculus
ctttgcccagcgacagagctgcatg

SEQ ID NO: 40428 - DNA, 25 bp, Mus musculus
ccagcgacagagctgcatgaataca

SEQ ID NO: 40429 - DNA, 25 bp, Mus musculus
gaatacatttgccagctggtttggc

SEQ ID NO: 40430 - DNA, 25 bp, Mus musculus
atttgccagctggtttggctacatg

SEQ ID NO: 40431 - DNA, 25 bp, Mus musculus
gtttggctacatgccgctgatccat

SEQ ID NO: 40432 - DNA, 25 bp, Mus musculus
gatccattctcagatgaggctggac

SEQ ID NO: 40433 - DNA, 25 bp, Mus musculus
taaagaccaagtctcaattctgagg

SEQ ID NO: 40434 - DNA, 25 bp, Mus musculus
ccaagtctcaattctgaggaagaaa

SEQ ID NO: 40435 - DNA, 25 bp, Mus musculus
tggagccagactgtgccaagtatca

SEQ ID NO: 40436 - DNA, 25 bp, Mus musculus
cagactgtgccaagtatcaaaaaat

SEQ ID NO: 40437 - DNA, 25 bp, Mus musculus
aggagctgctatctaccacaaatat

SEQ ID NO: 40438 - DNA, 25 bp, Mus musculus
ttatcactacctgtattcccattac

SEQ ID NO: 40439 - DNA, 25 bp, Mus musculus
cctgccagccagcctgaagaacatg

SEQ ID NO: 40440 - DNA, 25 bp, Mus musculus
ccaactggccaactgtgaggacatt

SEQ ID NO: 40441 - DNA, 25 bp, Mus musculus
tctcatgaatttcctggtgtctgct

SEQ ID NO: 40442 - DNA, 25 bp, Mus musculus
gaatttcctggtgtctgctgtgaca

SEQ ID NO: 40443 - DNA, 25 bp, Mus musculus
gcctccaatcaaagtgacccagaag

SEQ ID NO: 40444 - DNA, 25 bp, Mus musculus
tgaccactttgcccagcgacagagc

SEQ ID NO: 40445 - DNA, 25 bp, Mus musculus
agatgtaccagcagaagcagaaaga

SEQ ID NO: 40446 - DNA, 25 bp, Mus musculus
gggcaagtccaccaagcaagcggaa

SEQ ID NO: 40447 - DNA, 25 bp, Mus musculus
agtcctgactcgaaaacagcagaag

SEQ ID NO: 40448 - DNA, 25 bp, Mus musculus
gtcctgactcgaaaacagcagaagt

SEQ ID NO: 40449 - DNA, 25 bp, Mus musculus
tcctgactcgaaaacagcagaagtg

SEQ ID NO: 40450 - DNA, 25 bp, Mus musculus
cctgactcgaaaacagcagaagtgc

SEQ ID NO: 40451 - DNA, 25 bp, Mus musculus
aaggagtacaccgtgcgcttcacct

SEQ ID NO: 40452 - DNA, 25 bp, Mus musculus
aggagtacaccgtgcgcttcacctt

SEQ ID NO: 40453 - DNA, 25 bp, Mus musculus
ggagtacaccgtgcgcttcaccttc

SEQ ID NO: 40454 - DNA, 25 bp, Mus musculus
gagtacaccgtgcgcttcaccttcc

SEQ ID NO: 40455 - DNA, 25 bp, Mus musculus
agcccacctgtgctgggcctgcacg

SEQ ID NO: 40456 - DNA, 25 bp, Mus musculus
tgctgggcctgcacggtgtgacgtt

SEQ ID NO: 40457 - DNA, 25 bp, Mus musculus
ggcaagtccaccaagcaagcggaaa

SEQ ID NO: 40458 - DNA, 25 bp, Mus musculus
gcaagtccaccaagcaagcggaaaa

SEQ ID NO: 40459 - DNA, 25 bp, Mus musculus
caagtccaccaagcaagcggaaaag

SEQ ID NO: 40460 - DNA, 25 bp, Mus musculus
agtccaccaagcaagcggaaaagca

SEQ ID NO: 40461 - DNA, 25 bp, Mus musculus
tccaccaagcaagcggaaaagcaaa

SEQ ID NO: 40462 - DNA, 25 bp, Mus musculus
aggaagtcctgactcgaaaacagca

SEQ ID NO: 40463 - DNA, 25 bp, Mus musculus
gaagtcctgactcgaaaacagcaga

SEQ ID NO: 40464 - DNA, 25 bp, Mus musculus
aagtcctgactcgaaaacagcagaa

SEQ ID NO: 40465 - DNA, 25 bp, Mus musculus
ctttcatcttcctcattcactgtct

SEQ ID NO: 40466 - DNA, 25 bp, Mus musculus
tcttcctcattcactgtctgctcaa

SEQ ID NO: 40467 - DNA, 25 bp, Mus musculus
tggaaccaaactccaggagtttcat

SEQ ID NO: 40468 - DNA, 25 bp, Mus musculus
tcttttgtgccttacaactatgaag

SEQ ID NO: 40469 - DNA, 25 bp, Mus musculus
gtgccttacaactatgaagctccac

SEQ ID NO: 40470 - DNA, 25 bp, Mus musculus
tatgaagctccacatgttttgaaaa

SEQ ID NO: 40471 - DNA, 25 bp, Mus musculus
gctccacatgttttgaaaagagcac

SEQ ID NO: 40472 - DNA, 25 bp, Mus musculus
gtgtttcctatgcactttcttgtgg

SEQ ID NO: 40473 - DNA, 25 bp, Mus musculus
cctatgcactttcttgtggtgttcc

SEQ ID NO: 40474 - DNA, 25 bp, Mus musculus
cactttcttgtggtgttccagaaat

SEQ ID NO: 40475 - DNA, 25 bp, Mus musculus
ttttcatttaatacccatcaagcag

SEQ ID NO: 40476 - DNA, 25 bp, Mus musculus
tttaatacccatcaagcagtaaaca

SEQ ID NO: 40477 - DNA, 25 bp, Mus musculus
tcattcactgtctgctcaaccgtca

SEQ ID NO: 40478 - DNA, 25 bp, Mus musculus
tcctcaccaggaagactgaccttag

SEQ ID NO: 40479 - DNA, 25 bp, Mus musculus
agactgaccttagctcccattccca

SEQ ID NO: 40480 - DNA, 25 bp, Mus musculus
agacttctgggattttactgtcatc

SEQ ID NO: 40481 - DNA, 25 bp, Mus musculus
tgtcatctatgccatccacttccaa

SEQ ID NO: 40482 - DNA, 25 bp, Mus musculus
ctatgccatccacttccaagatggg

SEQ ID NO: 40483 - DNA, 25 bp, Mus musculus
catccacttccaagatgggttaaca

SEQ ID NO: 40484 - DNA, 25 bp, Mus musculus
tttttagctcaaaacatggatagat

SEQ ID NO: 40485 - DNA, 25 bp, Mus musculus
gatcatgacccaggtgggcaacaga

SEQ ID NO: 40486 - DNA, 25 bp, Mus musculus
caacagagtcacatgctgtttcaag

SEQ ID NO: 40487 - DNA, 25 bp, Mus musculus
cctacacagatcacctaaggggtct

SEQ ID NO: 40488 - DNA, 25 bp, Mus musculus
tgatttgctgctgtgcacacactgt

SEQ ID NO: 40489 - DNA, 25 bp, Mus musculus
tttgctgctgtgcacacactgtgat

SEQ ID NO: 40490 - DNA, 25 bp, Mus musculus
gtgcacacactgtgatttgccctag

SEQ ID NO: 40491 - DNA, 25 bp, Mus musculus
tgatttgccctagctgtgcgatgca

SEQ ID NO: 40492 - DNA, 25 bp, Mus musculus
tttgccctagctgtgcgatgcaatc

SEQ ID NO: 40493 - DNA, 25 bp, Mus musculus
gccctagctgtgcgatgcaatcaag

SEQ ID NO: 40494 - DNA, 25 bp, Mus musculus
ggagctatcacttttcattagagaa

SEQ ID NO: 40495 - DNA, 25 bp, Mus musculus
atcacttttcattagagaaggagac

SEQ ID NO: 40496 - DNA, 25 bp, Mus musculus
atgactatcgttttgcattttgaaa

SEQ ID NO: 40497 - DNA, 25 bp, Mus musculus
agtcacatgctgtttcaaggtgcca

SEQ ID NO: 40498 - DNA, 25 bp, Mus musculus
atgctgtttcaaggtgccaccgaat

SEQ ID NO: 40499 - DNA, 25 bp, Mus musculus
tttcaaggtgccaccgaatccagaa

SEQ ID NO: 40500 - DNA, 25 bp, Mus musculus
caaggtgccaccgaatccagaactg

SEQ ID NO: 40501 - DNA, 25 bp, Mus musculus
gaatccagaactgaccctacacaga

SEQ ID NO: 40502 - DNA, 25 bp, Mus musculus
tccagaactgaccctacacagatca

SEQ ID NO: 40503 - DNA, 25 bp, Mus musculus
actgaccctacacagatcacctaag

SEQ ID NO: 40504 - DNA, 25 bp, Mus musculus
gaccctacacagatcacctaagggg

SEQ ID NO: 40505 - DNA, 25 bp, Mus musculus
ccattcagtttccatgttaagctaa

SEQ ID NO: 40506 - DNA, 25 bp, Mus musculus
ataatagcttttcctggtaaggcag

SEQ ID NO: 40507 - DNA, 25 bp, Mus musculus
tactggtttcagcactgctgcattc

SEQ ID NO: 40508 - DNA, 25 bp, Mus musculus
cagcactgctgcattcaatgtggcg

SEQ ID NO: 40509 - DNA, 25 bp, Mus musculus
attcaatgtggcgacgcattgtttg

SEQ ID NO: 40510 - DNA, 25 bp, Mus musculus
caatgtggcgacgcattgtttggtc

SEQ ID NO: 40511 - DNA, 25 bp, Mus musculus
tgtggcgacgcattgtttggtcaac

SEQ ID NO: 40512 - DNA, 25 bp, Mus musculus
ttgtttggtcaacataggggcataa

SEQ ID NO: 40513 - DNA, 25 bp, Mus musculus
agtataatgcattctcaccatgtaa

SEQ ID NO: 40514 - DNA, 25 bp, Mus musculus
ataatgcattctcaccatgtaacag

SEQ ID NO: 40515 - DNA, 25 bp, Mus musculus
atgcattctcaccatgtaacagtcc

SEQ ID NO: 40516 - DNA, 25 bp, Mus musculus
acagtcctactgacaaatcaagaaa

SEQ ID NO: 40517 - DNA, 25 bp, Mus musculus
tttcctggtaaggcagacccagtat

SEQ ID NO: 40518 - DNA, 25 bp, Mus musculus
aaggcagacccagtatgaaatagta

SEQ ID NO: 40519 - DNA, 25 bp, Mus musculus
acagttatagcttggcaggtgttga

SEQ ID NO: 40520 - DNA, 25 bp, Mus musculus
atagcttggcaggtgttgaggagac

SEQ ID NO: 40521 - DNA, 25 bp, Mus musculus
tgggccttacatgacctgtgacgct

SEQ ID NO: 40522 - DNA, 25 bp, Mus musculus
gccttacatgacctgtgacgctact

SEQ ID NO: 40523 - DNA, 25 bp, Mus musculus
catgacctgtgacgctactggtttc

SEQ ID NO: 40524 - DNA, 25 bp, Mus musculus
cgctactggtttcagcactgctgca

SEQ ID NO: 40525 - DNA, 25 bp, Mus musculus
gaagtgtcccatctgcgagaaggtg

SEQ ID NO: 40526 - DNA, 25 bp, Mus musculus
gtgtcccatctgcgagaaggtgatt

SEQ ID NO: 40527 - DNA, 25 bp, Mus musculus
gacctgaagaaccacatgcgggtgc

SEQ ID NO: 40528 - DNA, 25 bp, Mus musculus
cacatgcgggtgcacacggggctgc

SEQ ID NO: 40529 - DNA, 25 bp, Mus musculus
gtgcacacggggctgcggcatacca

SEQ ID NO: 40530 - DNA, 25 bp, Mus musculus
cacacggggctgcggcataccagtg

SEQ ID NO: 40531 - DNA, 25 bp, Mus musculus
cataccagtgcgatactgctgcaag

SEQ ID NO: 40532 - DNA, 25 bp, Mus musculus
accagtgcgatactgctgcaagacc

SEQ ID NO: 40533 - DNA, 25 bp, Mus musculus
agtgcgatactgctgcaagaccttt

SEQ ID NO: 40534 - DNA, 25 bp, Mus musculus
gcgatactgctgcaagacctttgtg

SEQ ID NO: 40535 - DNA, 25 bp, Mus musculus
atactgctgcaagacctttgtgcgc

SEQ ID NO: 40536 - DNA, 25 bp, Mus musculus
ctgctgcaagacctttgtgcgctcc

SEQ ID NO: 40537 - DNA, 25 bp, Mus musculus
cacgcacacgggcgagaagcctacg

SEQ ID NO: 40538 - DNA, 25 bp, Mus musculus
aaagttcgattcaccagacaggaca

SEQ ID NO: 40539 - DNA, 25 bp, Mus musculus
gttcgattcaccagacaggacaagc

SEQ ID NO: 40540 - DNA, 25 bp, Mus musculus
ttcaccagacaggacaagctgaagg

SEQ ID NO: 40541 - DNA, 25 bp, Mus musculus
ccgtacctgtgccagcagtgcgggc

SEQ ID NO: 40542 - DNA, 25 bp, Mus musculus
cgccttcggcacaactacgacctga

SEQ ID NO: 40543 - DNA, 25 bp, Mus musculus
cttcggcacaactacgacctgaaga

SEQ ID NO: 40544 - DNA, 25 bp, Mus musculus
tacgacctgaagaaccacatgcggg

SEQ ID NO: 40545 - DNA, 25 bp, Mus musculus
ctgcaactgtgttgggagctcagat

SEQ ID NO: 40546 - DNA, 25 bp, Mus musculus
caactgtgttgggagctcagatctt

SEQ ID NO: 40547 - DNA, 25 bp, Mus musculus
aaattggcgacgattacagtctctg

SEQ ID NO: 40548 - DNA, 25 bp, Mus musculus
gcgacgattacagtctctgggtttc

SEQ ID NO: 40549 - DNA, 25 bp, Mus musculus
attacagtctctgggtttcatctcc

SEQ ID NO: 40550 - DNA, 25 bp, Mus musculus
acagtctctgggtttcatctcccct

SEQ ID NO: 40551 - DNA, 25 bp, Mus musculus
gtctctgggtttcatctcccctgaa

SEQ ID NO: 40552 - DNA, 25 bp, Mus musculus
catctcccctgaaagggcaacatgt

SEQ ID NO: 40553 - DNA, 25 bp, Mus musculus
aacatgtccgagaacccgtgcataa

SEQ ID NO: 40554 - DNA, 25 bp, Mus musculus
atgtccgagaacccgtgcataaagt

SEQ ID NO: 40555 - DNA, 25 bp, Mus musculus
tccgagaacccgtgcataaagttgg

SEQ ID NO: 40556 - DNA, 25 bp, Mus musculus
tcttggactatgactctggacacat

SEQ ID NO: 40557 - DNA, 25 bp, Mus musculus
gagctcagatcttcacctgcgggag

SEQ ID NO: 40558 - DNA, 25 bp, Mus musculus
actctggacacatagccttctacaa

SEQ ID NO: 40559 - DNA, 25 bp, Mus musculus
agatcttcacctgcgggagacacta

SEQ ID NO: 40560 - DNA, 25 bp, Mus musculus
tcttcacctgcgggagacactactg

SEQ ID NO: 40561 - DNA, 25 bp, Mus musculus
tcacctgcgggagacactactggga

SEQ ID NO: 40562 - DNA, 25 bp, Mus musculus
ggatctgcaaggactctgtgaacag

SEQ ID NO: 40563 - DNA, 25 bp, Mus musculus
ccggggacctcttctcactcatagg

SEQ ID NO: 40564 - DNA, 25 bp, Mus musculus
acctcttctcactcataggcttaaa

SEQ ID NO: 40565 - DNA, 25 bp, Mus musculus
tcttctcactcataggcttaaaaat

SEQ ID NO: 40566 - DNA, 25 bp, Mus musculus
ccttgccccgttgcatagaaggatt

SEQ ID NO: 40567 - DNA, 25 bp, Mus musculus
tgccccgttgcatagaaggattcca

SEQ ID NO: 40568 - DNA, 25 bp, Mus musculus
cagcaggccattgccgagcacgaac

SEQ ID NO: 40569 - DNA, 25 bp, Mus musculus
gccattgccgagcacgaaccaacgg

SEQ ID NO: 40570 - DNA, 25 bp, Mus musculus
gagcacgaaccaacggcgctggtag

SEQ ID NO: 40571 - DNA, 25 bp, Mus musculus
gtagttagtccacttgaggagccaa

SEQ ID NO: 40572 - DNA, 25 bp, Mus musculus
cttgaggagccaacccttgtagctg

SEQ ID NO: 40573 - DNA, 25 bp, Mus musculus
ccaacccttgtagctgtccagaggt

SEQ ID NO: 40574 - DNA, 25 bp, Mus musculus
tgagaccatttggacaccaatccct

SEQ ID NO: 40575 - DNA, 25 bp, Mus musculus
gaccatttggacaccaatccctgac

SEQ ID NO: 40576 - DNA, 25 bp, Mus musculus
catttggacaccaatccctgacacc

SEQ ID NO: 40577 - DNA, 25 bp, Mus musculus
ttggacaccaatccctgacaccgga

SEQ ID NO: 40578 - DNA, 25 bp, Mus musculus
gattccacaagagtcctctgtttca

SEQ ID NO: 40579 - DNA, 25 bp, Mus musculus
tccacaagagtcctctgtttcaaag

SEQ ID NO: 40580 - DNA, 25 bp, Mus musculus
acaagagtcctctgtttcaaagtgt

SEQ ID NO: 40581 - DNA, 25 bp, Mus musculus
agagtcctctgtttcaaagtgtgtg

SEQ ID NO: 40582 - DNA, 25 bp, Mus musculus
gtcctctgtttcaaagtgtgtggag

SEQ ID NO: 40583 - DNA, 25 bp, Mus musculus
ctctgtttcaaagtgtgtggaggcc

SEQ ID NO: 40584 - DNA, 25 bp, Mus musculus
catttcaccctggtttctgtagtag

SEQ ID NO: 40585 - DNA, 25 bp, Mus musculus
ggacagcaggccattgccgagcacg

SEQ ID NO: 40586 - DNA, 25 bp, Mus musculus
tcctccgtgcagcggctgtgagaag

SEQ ID NO: 40587 - DNA, 25 bp, Mus musculus
gcgccccagaccagagaccgtagct

SEQ ID NO: 40588 - DNA, 25 bp, Mus musculus
gccttgaactcacagggatcgattg

SEQ ID NO: 40589 - DNA, 25 bp, Mus musculus
tgaactcacagggatcgattgcctc

SEQ ID NO: 40590 - DNA, 25 bp, Mus musculus
aactcacagggatcgattgcctctg

SEQ ID NO: 40591 - DNA, 25 bp, Mus musculus
tcgattgcctctgattcttgaatgc

SEQ ID NO: 40592 - DNA, 25 bp, Mus musculus
gattgcctctgattcttgaatgcac

SEQ ID NO: 40593 - DNA, 25 bp, Mus musculus
ttatagccatcatggcgacttcatc

SEQ ID NO: 40594 - DNA, 25 bp, Mus musculus
atagccatcatggcgacttcatcag

SEQ ID NO: 40595 - DNA, 25 bp, Mus musculus
agccatcatggcgacttcatcagaa

SEQ ID NO: 40596 - DNA, 25 bp, Mus musculus
atcatggcgacttcatcagaagaag

SEQ ID NO: 40597 - DNA, 25 bp, Mus musculus
catggcgacttcatcagaagaagtg

SEQ ID NO: 40598 - DNA, 25 bp, Mus musculus
ccacctggttttctctgtataacag

SEQ ID NO: 40599 - DNA, 25 bp, Mus musculus
ctggttttctctgtataacagccct

SEQ ID NO: 40600 - DNA, 25 bp, Mus musculus
ttctctgtataacagccctgactgg

SEQ ID NO: 40601 - DNA, 25 bp, Mus musculus
ctctgtataacagccctgactggcc

SEQ ID NO: 40602 - DNA, 25 bp, Mus musculus
ctgtataacagccctgactggcctt

SEQ ID NO: 40603 - DNA, 25 bp, Mus musculus
ataacagccctgactggccttgaac

SEQ ID NO: 40604 - DNA, 25 bp, Mus musculus
aacagccctgactggccttgaactc

SEQ ID NO: 40605 - DNA, 25 bp, Mus musculus
gccctgactggccttgaactcacag

SEQ ID NO: 40606 - DNA, 25 bp, Mus musculus
cagtgtctctttggcctctaagcta

SEQ ID NO: 40607 - DNA, 25 bp, Mus musculus
ctctttggcctctaagctaacagca

SEQ ID NO: 40608 - DNA, 25 bp, Mus musculus
ctttgttcacaatttcagaaacttg

SEQ ID NO: 40609 - DNA, 25 bp, Mus musculus
ctatctggaggtatcttttggcgaa

SEQ ID NO: 40610 - DNA, 25 bp, Mus musculus
tacaaatctattgccattggttaat

SEQ ID NO: 40611 - DNA, 25 bp, Mus musculus
gaagatcatttttcccattgaataa

SEQ ID NO: 40612 - DNA, 25 bp, Mus musculus
catttttcccattgaataatactca

SEQ ID NO: 40613 - DNA, 25 bp, Mus musculus
tgaataatactcacatgctatcaat

SEQ ID NO: 40614 - DNA, 25 bp, Mus musculus
atactcacatgctatcaattaccta

SEQ ID NO: 40615 - DNA, 25 bp, Mus musculus
acatgctatcaattacctagccata

SEQ ID NO: 40616 - DNA, 25 bp, Mus musculus
tatcaattacctagccatagaactt

SEQ ID NO: 40617 - DNA, 25 bp, Mus musculus
atttatctatttcaaatcttgtcaa

SEQ ID NO: 40618 - DNA, 25 bp, Mus musculus
taagctaacagcagggcagttgaga

SEQ ID NO: 40619 - DNA, 25 bp, Mus musculus
tatttcaaatcttgtcaaaacaatg

SEQ ID NO: 40620 - DNA, 25 bp, Mus musculus
tataattccttacaagacacaattc

SEQ ID NO: 40621 - DNA, 25 bp, Mus musculus
tccttacaagacacaattccaaaca

SEQ ID NO: 40622 - DNA, 25 bp, Mus musculus
acaattccaaacaagtagacacacg

SEQ ID NO: 40623 - DNA, 25 bp, Mus musculus
cagaccactcttattccatgctgtc

SEQ ID NO: 40624 - DNA, 25 bp, Mus musculus
actcttattccatgctgtcatatgg

SEQ ID NO: 40625 - DNA, 25 bp, Mus musculus
ttgctccttaaagtctagactcaag

SEQ ID NO: 40626 - DNA, 25 bp, Mus musculus
gtctagactcaagagcccttgaaac

SEQ ID NO: 40627 - DNA, 25 bp, Mus musculus
tccatcacttagacttattcatgca

SEQ ID NO: 40628 - DNA, 25 bp, Mus musculus
acttagacttattcatgcagtcaga

SEQ ID NO: 40629 - DNA, 25 bp, Mus musculus
attctggccatttcccaaggatctg

SEQ ID NO: 40630 - DNA, 25 bp, Mus musculus
ttccaacgccagtcctcacaggatg

SEQ ID NO: 40631 - DNA, 25 bp, Mus musculus
cgccagtcctcacaggatgccatta

SEQ ID NO: 40632 - DNA, 25 bp, Mus musculus
tcctcacaggatgccattagaattt

SEQ ID NO: 40633 - DNA, 25 bp, Mus musculus
ctgggattcagcatccaccacttga

SEQ ID NO: 40634 - DNA, 25 bp, Mus musculus
atccaccacttgactgagtagctga

SEQ ID NO: 40635 - DNA, 25 bp, Mus musculus
aattcaccaccagctgatgaaaacc

SEQ ID NO: 40636 - DNA, 25 bp, Mus musculus
ctgcaagtgctctgactacaacata

SEQ ID NO: 40637 - DNA, 25 bp, Mus musculus
gtgctctgactacaacatattctga

SEQ ID NO: 40638 - DNA, 25 bp, Mus musculus
ctagtaagtgccacttccatgaaga

SEQ ID NO: 40639 - DNA, 25 bp, Mus musculus
acttattcatgcagtcagaggatac

SEQ ID NO: 40640 - DNA, 25 bp, Mus musculus
tcctatcaaaagacctagcacaggt

SEQ ID NO: 40641 - DNA, 25 bp, Mus musculus
acctagcacaggtctcctcatgtat

SEQ ID NO: 40642 - DNA, 25 bp, Mus musculus
catgtatacacttgccaccagattc

SEQ ID NO: 40643 - DNA, 25 bp, Mus musculus
tacacttgccaccagattctgtgat

SEQ ID NO: 40644 - DNA, 25 bp, Mus musculus
tgccaccagattctgtgatgaaatt

SEQ ID NO: 40645 - DNA, 25 bp, Mus musculus
tcacctttatggattctggccattt

SEQ ID NO: 40646 - DNA, 25 bp, Mus musculus
ttatggattctggccatttcccaag

SEQ ID NO: 40647 - DNA, 25 bp, Mus musculus
cctcagctttgatcagctaagatca

SEQ ID NO: 40648 - DNA, 25 bp, Mus musculus
aagatcatgatcgatcggcgcgtgc

SEQ ID NO: 40649 - DNA, 25 bp, Mus musculus
ttcgcgctggtcagtttgccagatg

SEQ ID NO: 40650 - DNA, 25 bp, Mus musculus
gcgctggtcagtttgccagatgact

SEQ ID NO: 40651 - DNA, 25 bp, Mus musculus
ctggtcagtttgccagatgacttgg

SEQ ID NO: 40652 - DNA, 25 bp, Mus musculus
agtttgccagatgacttggtcgcag

SEQ ID NO: 40653 - DNA, 25 bp, Mus musculus
ttgccagatgacttggtcgcagtgt

SEQ ID NO: 40654 - DNA, 25 bp, Mus musculus
ccagatgacttggtcgcagtgttca

SEQ ID NO: 40655 - DNA, 25 bp, Mus musculus
gatgacttggtcgcagtgttcagcc

SEQ ID NO: 40656 - DNA, 25 bp, Mus musculus
gacttggtcgcagtgttcagccgcc

SEQ ID NO: 40657 - DNA, 25 bp, Mus musculus
ttggtcgcagtgttcagccgccctg

SEQ ID NO: 40658 - DNA, 25 bp, Mus musculus
cgccctgctttgcccggatacgttg

SEQ ID NO: 40659 - DNA, 25 bp, Mus musculus
tcgctgctggcgacgcgactctcgt

SEQ ID NO: 40660 - DNA, 25 bp, Mus musculus
ctggcgacgcgactctcgtaatcat

SEQ ID NO: 40661 - DNA, 25 bp, Mus musculus
gcgacgcgactctcgtaatcattcc

SEQ ID NO: 40662 - DNA, 25 bp, Mus musculus
acgcgactctcgtaatcattccggg

SEQ ID NO: 40663 - DNA, 25 bp, Mus musculus
cgactctcgtaatcattccgggact

SEQ ID NO: 40664 - DNA, 25 bp, Mus musculus
cctgtacagtgccggctcttcggat

SEQ ID NO: 40665 - DNA, 25 bp, Mus musculus
ctcttcggataagctttcgcgctgg

SEQ ID NO: 40666 - DNA, 25 bp, Mus musculus
ggataagctttcgcgctggtcagtt

SEQ ID NO: 40667 - DNA, 25 bp, Mus musculus
cggcgcgcaccagaactcggcggtg

SEQ ID NO: 40668 - DNA, 25 bp, Mus musculus
gcgccctcggatctctggtcaagtc

SEQ ID NO: 40669 - DNA, 25 bp, Mus musculus
ccaggactccgaggcgctgacacca

SEQ ID NO: 40670 - DNA, 25 bp, Mus musculus
gactccgaggcgctgacaccagact

SEQ ID NO: 40671 - DNA, 25 bp, Mus musculus
ctccgaggcgctgacaccagactgg

SEQ ID NO: 40672 - DNA, 25 bp, Mus musculus
cgctgacaccagactggcctcttag

SEQ ID NO: 40673 - DNA, 25 bp, Mus musculus
ctgacaccagactggcctcttagac

SEQ ID NO: 40674 - DNA, 25 bp, Mus musculus
gacaccagactggcctcttagactg

SEQ ID NO: 40675 - DNA, 25 bp, Mus musculus
caccagactggcctcttagactgaa

SEQ ID NO: 40676 - DNA, 25 bp, Mus musculus
agactggcctcttagactgaacttt

SEQ ID NO: 40677 - DNA, 25 bp, Mus musculus
actggcctcttagactgaactttgg

SEQ ID NO: 40678 - DNA, 25 bp, Mus musculus
tggcctcttagactgaactttggtg

SEQ ID NO: 40679 - DNA, 25 bp, Mus musculus
gccctcggatctctggtcaagtcgg

SEQ ID NO: 40680 - DNA, 25 bp, Mus musculus
ttttcatgagaccttttgtacagta

SEQ ID NO: 40681 - DNA, 25 bp, Mus musculus
cctcggatctctggtcaagtcggag

SEQ ID NO: 40682 - DNA, 25 bp, Mus musculus
ggatctctggtcaagtcggagccga

SEQ ID NO: 40683 - DNA, 25 bp, Mus musculus
tcaagtcggagccgagcggcagtcc

SEQ ID NO: 40684 - DNA, 25 bp, Mus musculus
tcaacggcacggtgcccctgacgca

SEQ ID NO: 40685 - DNA, 25 bp, Mus musculus
gacactgcggcttaaggccggcgcc

SEQ ID NO: 40686 - DNA, 25 bp, Mus musculus
tcgataaaaggccgctctggagagc

SEQ ID NO: 40687 - DNA, 25 bp, Mus musculus
ttccccaggactccgaggcgctgac

SEQ ID NO: 40688 - DNA, 25 bp, Mus musculus
tggacacgtacacgcacgtgaacgg

SEQ ID NO: 40689 - DNA, 25 bp, Mus musculus
gggccaacggcgcctactcgctcgt

SEQ ID NO: 40690 - DNA, 25 bp, Mus musculus
tgcagtacagccccatgatgccacc

SEQ ID NO: 40691 - DNA, 25 bp, Mus musculus
ccggcgcccagagctacatgaacgc

SEQ ID NO: 40692 - DNA, 25 bp, Mus musculus
gctccgtggtgaagtcggagcccag

SEQ ID NO: 40693 - DNA, 25 bp, Mus musculus
tgaagtcggagcccagctctccgcc

SEQ ID NO: 40694 - DNA, 25 bp, Mus musculus
tccgttcgcactcgcagcgcgcgtg

SEQ ID NO: 40695 - DNA, 25 bp, Mus musculus
ggctgcacggcgtgcaccagcacta

SEQ ID NO: 40696 - DNA, 25 bp, Mus musculus
tgcacggcgtgcaccagcactacca

SEQ ID NO: 40697 - DNA, 25 bp, Mus musculus
acggcgtgcaccagcactaccaggg

SEQ ID NO: 40698 - DNA, 25 bp, Mus musculus
gcgtgcaccagcactaccagggcgc

SEQ ID NO: 40699 - DNA, 25 bp, Mus musculus
tcaatggaacggtgccgctgaccca

SEQ ID NO: 40700 - DNA, 25 bp, Mus musculus
acggcgcctactcgctcgtgcagga

SEQ ID NO: 40701 - DNA, 25 bp, Mus musculus
cctactcgctcgtgcaggagcagct

SEQ ID NO: 40702 - DNA, 25 bp, Mus musculus
actcgctcgtgcaggagcagctggg

SEQ ID NO: 40703 - DNA, 25 bp, Mus musculus
tgcctcagatgcaccgctacgacat

SEQ ID NO: 40704 - DNA, 25 bp, Mus musculus
ctcagatgcaccgctacgacatggc

SEQ ID NO: 40705 - DNA, 25 bp, Mus musculus
agatgcaccgctacgacatggccgg

SEQ ID NO: 40706 - DNA, 25 bp, Mus musculus
ccggcctgcagtacagccccatgat

SEQ ID NO: 40707 - DNA, 25 bp, Mus musculus
gcctgcagtacagccccatgatgcc

SEQ ID NO: 40708 - DNA, 25 bp, Mus musculus
gatgtcactgcaagtaccactggtg

SEQ ID NO: 40709 - DNA, 25 bp, Mus musculus
tcacctgccgcaggtgtgagcgcac

SEQ ID NO: 40710 - DNA, 25 bp, Mus musculus
ggaagacaccacaccaggaggcctg

SEQ ID NO: 40711 - DNA, 25 bp, Mus musculus
agacaccacaccaggaggcctggtc

SEQ ID NO: 40712 - DNA, 25 bp, Mus musculus
gccacatgttgccttccaggctgct

SEQ ID NO: 40713 - DNA, 25 bp, Mus musculus
acatgttgccttccaggctgctcca

SEQ ID NO: 40714 - DNA, 25 bp, Mus musculus
tgttgccttccaggctgctccaaga

SEQ ID NO: 40715 - DNA, 25 bp, Mus musculus
ggctgctccaagaagtcagggcagg

SEQ ID NO: 40716 - DNA, 25 bp, Mus musculus
agactgtgcatttgacctttcaagg

SEQ ID NO: 40717 - DNA, 25 bp, Mus musculus
tgacctttcaaggccagaaagaccg

SEQ ID NO: 40718 - DNA, 25 bp, Mus musculus
caccacatggaaccactaacttggg

SEQ ID NO: 40719 - DNA, 25 bp, Mus musculus
cacatggaaccactaacttgggttg

SEQ ID NO: 40720 - DNA, 25 bp, Mus musculus
tggagcgctacgtctgcaagtgaga

SEQ ID NO: 40721 - DNA, 25 bp, Mus musculus
agcgctacgtctgcaagtgagacca

SEQ ID NO: 40722 - DNA, 25 bp, Mus musculus
gaggacccactcaagggcctagaga

SEQ ID NO: 40723 - DNA, 25 bp, Mus musculus
gacccactcaagggcctagagacct

SEQ ID NO: 40724 - DNA, 25 bp, Mus musculus
ctagagaccttggtggacttccctg

SEQ ID NO: 40725 - DNA, 25 bp, Mus musculus
gacttccctgcagatgccagatgcc

SEQ ID NO: 40726 - DNA, 25 bp, Mus musculus
ttccctgcagatgccagatgccagg

SEQ ID NO: 40727 - DNA, 25 bp, Mus musculus
gtgcctccacttggaagacaccaca

SEQ ID NO: 40728 - DNA, 25 bp, Mus musculus
atgctttctctaaagatgaatcata

SEQ ID NO: 40729 - DNA, 25 bp, Mus musculus
gagcaagcacggactccatactatg

SEQ ID NO: 40730 - DNA, 25 bp, Mus musculus
cacatcgcgctacgagactaggccg

SEQ ID NO: 40731 - DNA, 25 bp, Mus musculus
catcgcgctacgagactaggccgct

SEQ ID NO: 40732 - DNA, 25 bp, Mus musculus
gctacgagactaggccgctgtcaga

SEQ ID NO: 40733 - DNA, 25 bp, Mus musculus
tacgagactaggccgctgtcagaac

SEQ ID NO: 40734 - DNA, 25 bp, Mus musculus
ccgctgtcagaactcgactcgggcc

SEQ ID NO: 40735 - DNA, 25 bp, Mus musculus
ctcgactcgggccctgtagaagaca

SEQ ID NO: 40736 - DNA, 25 bp, Mus musculus
cgactcgggccctgtagaagacaag

SEQ ID NO: 40737 - DNA, 25 bp, Mus musculus
tagcccccggagtcagaaactgagc

SEQ ID NO: 40738 - DNA, 25 bp, Mus musculus
tcagaaactgagccagcgcctgact

SEQ ID NO: 40739 - DNA, 25 bp, Mus musculus
aaactgagccagcgcctgactgtcg

SEQ ID NO: 40740 - DNA, 25 bp, Mus musculus
aagcacggactccatactatgatga

SEQ ID NO: 40741 - DNA, 25 bp, Mus musculus
gcacggactccatactatgatgagg

SEQ ID NO: 40742 - DNA, 25 bp, Mus musculus
acggactccatactatgatgaggag

SEQ ID NO: 40743 - DNA, 25 bp, Mus musculus
ggactccatactatgatgaggagga

SEQ ID NO: 40744 - DNA, 25 bp, Mus musculus
tccatactatgatgaggaggaacac

SEQ ID NO: 40745 - DNA, 25 bp, Mus musculus
gaggaacacacatcgcgctacgaga

SEQ ID NO: 40746 - DNA, 25 bp, Mus musculus
aacacacatcgcgctacgagactag

SEQ ID NO: 40747 - DNA, 25 bp, Mus musculus
cacacatcgcgctacgagactaggc

SEQ ID NO: 40748 - DNA, 25 bp, Mus musculus
ctgagaacagcgtcatctgcagctt

SEQ ID NO: 40749 - DNA, 25 bp, Mus musculus
acagcgtcatctgcagcttcctgca

SEQ ID NO: 40750 - DNA, 25 bp, Mus musculus
agatcacacaaagccacctaagctg

SEQ ID NO: 40751 - DNA, 25 bp, Mus musculus
cacaaagccacctaagctggtactt

SEQ ID NO: 40752 - DNA, 25 bp, Mus musculus
taagctggtacttcagcccagagac

SEQ ID NO: 40753 - DNA, 25 bp, Mus musculus
cagaagaactccagcggcgctggat

SEQ ID NO: 40754 - DNA, 25 bp, Mus musculus
ccacactgtctgaggacaaggagat

SEQ ID NO: 40755 - DNA, 25 bp, Mus musculus
agacaccagtggcagcctcaggagc

SEQ ID NO: 40756 - DNA, 25 bp, Mus musculus
caggagccactgctgaacctcctga

SEQ ID NO: 40757 - DNA, 25 bp, Mus musculus
cccagacccgagacaagacctagag

SEQ ID NO: 40758 - DNA, 25 bp, Mus musculus
cacactccagctgcccatgttcaat

SEQ ID NO: 40759 - DNA, 25 bp, Mus musculus
gttcaattgggggctccagcccact

SEQ ID NO: 40760 - DNA, 25 bp, Mus musculus
tcatctgcagcttcctgcactacat

SEQ ID NO: 40761 - DNA, 25 bp, Mus musculus
tcctgcactacatggagaagggtgg

SEQ ID NO: 40762 - DNA, 25 bp, Mus musculus
catggtttgtggttcctgagaatga

SEQ ID NO: 40763 - DNA, 25 bp, Mus musculus
agaatgaacccttggtgctgtacat

SEQ ID NO: 40764 - DNA, 25 bp, Mus musculus
aacccttggtgctgtacatctatgg

SEQ ID NO: 40765 - DNA, 25 bp, Mus musculus
gagcccctcaggatgtgaaagccca

SEQ ID NO: 40766 - DNA, 25 bp, Mus musculus
ctcctgaggcaggagagcggccaga

SEQ ID NO: 40767 - DNA, 25 bp, Mus musculus
tcttcaagatcacacaaagccacct

SEQ ID NO: 40768 - DNA, 25 bp, Mus musculus
cggtgctgctctatgctctctgtgc

SEQ ID NO: 40769 - DNA, 25 bp, Mus musculus
tgctgctctatgctctctgtgcctt

SEQ ID NO: 40770 - DNA, 25 bp, Mus musculus
cgtctcctaatcgaagtcttcagct

SEQ ID NO: 40771 - DNA, 25 bp, Mus musculus
ctaatcgaagtcttcagctgtacaa

SEQ ID NO: 40772 - DNA, 25 bp, Mus musculus
gaagtcttcagctgtacaatcatga

SEQ ID NO: 40773 - DNA, 25 bp, Mus musculus
atcatgaccagattctaacttccga

SEQ ID NO: 40774 - DNA, 25 bp, Mus musculus
atgaccagattctaacttccgagac

SEQ ID NO: 40775 - DNA, 25 bp, Mus musculus
ttctaacttccgagacgtcagcttg

SEQ ID NO: 40776 - DNA, 25 bp, Mus musculus
taacttccgagacgtcagcttgcag

SEQ ID NO: 40777 - DNA, 25 bp, Mus musculus
cttccgagacgtcagcttgcagcaa

SEQ ID NO: 40778 - DNA, 25 bp, Mus musculus
cgtcagcttgcagcaaggacgcaag

SEQ ID NO: 40779 - DNA, 25 bp, Mus musculus
cagcttgcagcaaggacgcaagaac

SEQ ID NO: 40780 - DNA, 25 bp, Mus musculus
gtgccttagcgtcttgggagccctc

SEQ ID NO: 40781 - DNA, 25 bp, Mus musculus
tagcgtcttgggagccctcgttatc

SEQ ID NO: 40782 - DNA, 25 bp, Mus musculus
gggagccctcgttatccaatcgtgc

SEQ ID NO: 40783 - DNA, 25 bp, Mus musculus
agccctcgttatccaatcgtgctgc

SEQ ID NO: 40784 - DNA, 25 bp, Mus musculus
cgttatccaatcgtgctgcgtctcc

SEQ ID NO: 40785 - DNA, 25 bp, Mus musculus
tatccaatcgtgctgcgtctcctaa

SEQ ID NO: 40786 - DNA, 25 bp, Mus musculus
gtgctgcgtctcctaatcgaagtct

SEQ ID NO: 40787 - DNA, 25 bp, Mus musculus
ctgcgtctcctaatcgaagtcttca

SEQ ID NO: 40788 - DNA, 25 bp, Mus musculus
agatgccatcaccaaaatgaaagat

SEQ ID NO: 40789 - DNA, 25 bp, Mus musculus
tgtgtacctaaagaaccctcagatg

SEQ ID NO: 40790 - DNA, 25 bp, Mus musculus
tgatggccagacacaccagacggtc

SEQ ID NO: 40791 - DNA, 25 bp, Mus musculus
ccagacacaccagacggtcactaac

SEQ ID NO: 40792 - DNA, 25 bp, Mus musculus
acaccagacggtcactaactgtgcc

SEQ ID NO: 40793 - DNA, 25 bp, Mus musculus
gacggtcactaactgtgcccaggac

SEQ ID NO: 40794 - DNA, 25 bp, Mus musculus
ggagccgcttccagccatagggacc

SEQ ID NO: 40795 - DNA, 25 bp, Mus musculus
agggacctgcaaggccctctacaca

SEQ ID NO: 40796 - DNA, 25 bp, Mus musculus
ctgcaaggccctctacacatttgaa

SEQ ID NO: 40797 - DNA, 25 bp, Mus musculus
ggccctctacacatttgaaggtcag

SEQ ID NO: 40798 - DNA, 25 bp, Mus musculus
agagacgctgagcgtgattgaagag

SEQ ID NO: 40799 - DNA, 25 bp, Mus musculus
gactcgcatccgcagaaatgaagac

SEQ ID NO: 40800 - DNA, 25 bp, Mus musculus
gaaccctcagatgggagacccagcc

SEQ ID NO: 40801 - DNA, 25 bp, Mus musculus
cagcctggaccagaagctcaccgaa

SEQ ID NO: 40802 - DNA, 25 bp, Mus musculus
ggaccagaagctcaccgaagtcacc

SEQ ID NO: 40803 - DNA, 25 bp, Mus musculus
gaagctcaccgaagtcacccagaac

SEQ ID NO: 40804 - DNA, 25 bp, Mus musculus
agtcacccagaacatagagaaactg

SEQ ID NO: 40805 - DNA, 25 bp, Mus musculus
agaaggcagactcccagctcggagt

SEQ ID NO: 40806 - DNA, 25 bp, Mus musculus
cagactcccagctcggagtgagcag

SEQ ID NO: 40807 - DNA, 25 bp, Mus musculus
cccagctcggagtgagcaggcacgc

SEQ ID NO: 40808 - DNA, 25 bp, Mus musculus
gcattgtctgatctgcgctgtcgtc

SEQ ID NO: 40809 - DNA, 25 bp, Mus musculus
ttgtctgatctgcgctgtcgtctag

SEQ ID NO: 40810 - DNA, 25 bp, Mus musculus
ccacagggcacctgtacgtagttcg

SEQ ID NO: 40811 - DNA, 25 bp, Mus musculus
ggcacctgtacgtagttcggcctat

SEQ ID NO: 40812 - DNA, 25 bp, Mus musculus
cacctgtacgtagttcggcctatgt

SEQ ID NO: 40813 - DNA, 25 bp, Mus musculus
ctgtacgtagttcggcctatgtctc

SEQ ID NO: 40814 - DNA, 25 bp, Mus musculus
tgtacgtagttcggcctatgtctca

SEQ ID NO: 40815 - DNA, 25 bp, Mus musculus
tacgtagttcggcctatgtctcact

SEQ ID NO: 40816 - DNA, 25 bp, Mus musculus
acgtagttcggcctatgtctcacta

SEQ ID NO: 40817 - DNA, 25 bp, Mus musculus
gtagttcggcctatgtctcactaca

SEQ ID NO: 40818 - DNA, 25 bp, Mus musculus
tagttcggcctatgtctcactacat

SEQ ID NO: 40819 - DNA, 25 bp, Mus musculus
gttcggcctatgtctcactacatga

SEQ ID NO: 40820 - DNA, 25 bp, Mus musculus
tctgatctgcgctgtcgtctagcct

SEQ ID NO: 40821 - DNA, 25 bp, Mus musculus
tcggcctatgtctcactacatgact

SEQ ID NO: 40822 - DNA, 25 bp, Mus musculus
ctgatctgcgctgtcgtctagcctg

SEQ ID NO: 40823 - DNA, 25 bp, Mus musculus
cgctgtcgtctagcctgtgcaacca

SEQ ID NO: 40824 - DNA, 25 bp, Mus musculus
gctgtcgtctagcctgtgcaaccac

SEQ ID NO: 40825 - DNA, 25 bp, Mus musculus
gcctgtgcaaccacagggcacctgt

SEQ ID NO: 40826 - DNA, 25 bp, Mus musculus
tgtgcaaccacagggcacctgtacg

SEQ ID NO: 40827 - DNA, 25 bp, Mus musculus
gtgcaaccacagggcacctgtacgt

SEQ ID NO: 40828 - DNA, 25 bp, Mus musculus
caaccacagggcacctgtacgtagt

SEQ ID NO: 40829 - DNA, 25 bp, Mus musculus
gtccctgcacaggcgatcttgtcta

SEQ ID NO: 40830 - DNA, 25 bp, Mus musculus
cctgcacaggcgatcttgtctatgg

SEQ ID NO: 40831 - DNA, 25 bp, Mus musculus
aaagcgtcctgagctgaataccatg

SEQ ID NO: 40832 - DNA, 25 bp, Mus musculus
aactgaggctactatccgtgaagtt

SEQ ID NO: 40833 - DNA, 25 bp, Mus musculus
ggctactatccgtgaagttattgac

SEQ ID NO: 40834 - DNA, 25 bp, Mus musculus
tactatccgtgaagttattgacaag

SEQ ID NO: 40835 - DNA, 25 bp, Mus musculus
ggcattgcaatctgcatcctgtgta

SEQ ID NO: 40836 - DNA, 25 bp, Mus musculus
attgcaatctgcatcctgtgtacgc

SEQ ID NO: 40837 - DNA, 25 bp, Mus musculus
atctgcatcctgtgtacgctcctat

SEQ ID NO: 40838 - DNA, 25 bp, Mus musculus
tgtacgctcctatcaggagttagag

SEQ ID NO: 40839 - DNA, 25 bp, Mus musculus
acgctcctatcaggagttagagtca

SEQ ID NO: 40840 - DNA, 25 bp, Mus musculus
ctcctatcaggagttagagtcaata

SEQ ID NO: 40841 - DNA, 25 bp, Mus musculus
atgctcgctgtgggaatacctcact

SEQ ID NO: 40842 - DNA, 25 bp, Mus musculus
tcaatagccaatagacgtggtggta

SEQ ID NO: 40843 - DNA, 25 bp, Mus musculus
ggaatacctcactggactaaagcaa

SEQ ID NO: 40844 - DNA, 25 bp, Mus musculus
cctcactggactaaagcaatcgcta

SEQ ID NO: 40845 - DNA, 25 bp, Mus musculus
gccagcttcatctccatcaaagcgt

SEQ ID NO: 40846 - DNA, 25 bp, Mus musculus
agcttcatctccatcaaagcgtcct

SEQ ID NO: 40847 - DNA, 25 bp, Mus musculus
ttcatctccatcaaagcgtcctgag

SEQ ID NO: 40848 - DNA, 25 bp, Mus musculus
tccatcaaagcgtcctgagctgaat

SEQ ID NO: 40849 - DNA, 25 bp, Mus musculus
atcaaagcgtcctgagctgaatacc

SEQ ID NO: 40850 - DNA, 25 bp, Mus musculus
tcggcactaggcagcgcaacacctc

SEQ ID NO: 40851 - DNA, 25 bp, Mus musculus
cccccagtgctcagctgggagaaac

SEQ ID NO: 40852 - DNA, 25 bp, Mus musculus
tgagcaacccgcctatgagtgtagc

SEQ ID NO: 40853 - DNA, 25 bp, Mus musculus
agcaacccgcctatgagtgtagcca

SEQ ID NO: 40854 - DNA, 25 bp, Mus musculus
ccactgccgcaagacgttcagctcg

SEQ ID NO: 40855 - DNA, 25 bp, Mus musculus
ccgcaagacgttcagctcgcggaaa

SEQ ID NO: 40856 - DNA, 25 bp, Mus musculus
gcaagacgttcagctcgcggaaaaa

SEQ ID NO: 40857 - DNA, 25 bp, Mus musculus
ttcagctcgcggaaaaactacacca

SEQ ID NO: 40858 - DNA, 25 bp, Mus musculus
aaactacaccaagcacatgttcatc

SEQ ID NO: 40859 - DNA, 25 bp, Mus musculus
actacaccaagcacatgttcatcca

SEQ ID NO: 40860 - DNA, 25 bp, Mus musculus
caccaagcacatgttcatccactct

SEQ ID NO: 40861 - DNA, 25 bp, Mus musculus
tcatccactctggggagaagccaca

SEQ ID NO: 40862 - DNA, 25 bp, Mus musculus
cagtgctcagctgggagaaacgcag

SEQ ID NO: 40863 - DNA, 25 bp, Mus musculus
gtgctcagctgggagaaacgcaggc

SEQ ID NO: 40864 - DNA, 25 bp, Mus musculus
gaaacgcaggcggtgcagcggcccc

SEQ ID NO: 40865 - DNA, 25 bp, Mus musculus
gccgtcaggccacagccatctctgg

SEQ ID NO: 40866 - DNA, 25 bp, Mus musculus
cgtcaggccacagccatctctggca

SEQ ID NO: 40867 - DNA, 25 bp, Mus musculus
cacagccatctctggcactcctgtg

SEQ ID NO: 40868 - DNA, 25 bp, Mus musculus
aggtgctgagcaacccgcctatgag

SEQ ID NO: 40869 - DNA, 25 bp, Mus musculus
gtgctgagcaacccgcctatgagtg

SEQ ID NO: 40870 - DNA, 25 bp, Mus musculus
ctttggcactgtcaatgagatctat

SEQ ID NO: 40871 - DNA, 25 bp, Mus musculus
tttccagggtagccttcctgccagg

SEQ ID NO: 40872 - DNA, 25 bp, Mus musculus
gcctttcatcaaggcatgactataa

SEQ ID NO: 40873 - DNA, 25 bp, Mus musculus
tttcatcaaggcatgactataagta

SEQ ID NO: 40874 - DNA, 25 bp, Mus musculus
actataagtagccatgctgatgttg

SEQ ID NO: 40875 - DNA, 25 bp, Mus musculus
catgctgatgttgactccggaggtt

SEQ ID NO: 40876 - DNA, 25 bp, Mus musculus
tttttacaaatgatgctgggaagta

SEQ ID NO: 40877 - DNA, 25 bp, Mus musculus
tctaatttcacttatgttgctgggt

SEQ ID NO: 40878 - DNA, 25 bp, Mus musculus
acttatgttgctgggtgtgagagaa

SEQ ID NO: 40879 - DNA, 25 bp, Mus musculus
agaggtgcacagctactgagatggg

SEQ ID NO: 40880 - DNA, 25 bp, Mus musculus
ggtgcacagctactgagatgggaag

SEQ ID NO: 40881 - DNA, 25 bp, Mus musculus
agcacatctacttaaatcatattaa

SEQ ID NO: 40882 - DNA, 25 bp, Mus musculus
cagggctgcttaccaagtcgctgct

SEQ ID NO: 40883 - DNA, 25 bp, Mus musculus
ggctgcttaccaagtcgctgcttta

SEQ ID NO: 40884 - DNA, 25 bp, Mus musculus
ccaagtcgctgctttaccaagagga

SEQ ID NO: 40885 - DNA, 25 bp, Mus musculus
cgctgctttaccaagaggaagtcga

SEQ ID NO: 40886 - DNA, 25 bp, Mus musculus
aatcgaagcaatcgctgtccagggg

SEQ ID NO: 40887 - DNA, 25 bp, Mus musculus
agcaatcgctgtccaggggcctttc

SEQ ID NO: 40888 - DNA, 25 bp, Mus musculus
cgctgtccaggggcctttcatcaag

SEQ ID NO: 40889 - DNA, 25 bp, Mus musculus
tgtccaggggcctttcatcaaggca

SEQ ID NO: 40890 - DNA, 25 bp, Mus musculus
gacaaggcctacgttgaatacttga

SEQ ID NO: 40891 - DNA, 25 bp, Mus musculus
ccttcccaagatgtctggagataaa

SEQ ID NO: 40892 - DNA, 25 bp, Mus musculus
gtcactttcaacatacaaaacagca

SEQ ID NO: 40893 - DNA, 25 bp, Mus musculus
cactttcaacatacaaaacagcata

SEQ ID NO: 40894 - DNA, 25 bp, Mus musculus
actttcaacatacaaaacagcatac

SEQ ID NO: 40895 - DNA, 25 bp, Mus musculus
ctttcaacatacaaaacagcatacc

SEQ ID NO: 40896 - DNA, 25 bp, Mus musculus
tttcaacatacaaaacagcatacca

SEQ ID NO: 40897 - DNA, 25 bp, Mus musculus
acagcataccaacaacataagatgg

SEQ ID NO: 40898 - DNA, 25 bp, Mus musculus
cagcataccaacaacataagatggt

SEQ ID NO: 40899 - DNA, 25 bp, Mus musculus
gcataccaacaacataagatggtga

SEQ ID NO: 40900 - DNA, 25 bp, Mus musculus
cataccaacaacataagatggtgag

SEQ ID NO: 40901 - DNA, 25 bp, Mus musculus
ataccaacaacataagatggtgagg

SEQ ID NO: 40902 - DNA, 25 bp, Mus musculus
cttcccaagatgtctggagataaag

SEQ ID NO: 40903 - DNA, 25 bp, Mus musculus
ttcccaagatgtctggagataaaga

SEQ ID NO: 40904 - DNA, 25 bp, Mus musculus
agatcacggtcactttcaacataca

SEQ ID NO: 40905 - DNA, 25 bp, Mus musculus
gatcacggtcactttcaacatacaa

SEQ ID NO: 40906 - DNA, 25 bp, Mus musculus
atcacggtcactttcaacatacaaa

SEQ ID NO: 40907 - DNA, 25 bp, Mus musculus
tcacggtcactttcaacatacaaaa

SEQ ID NO: 40908 - DNA, 25 bp, Mus musculus
cggtcactttcaacatacaaaacag

SEQ ID NO: 40909 - DNA, 25 bp, Mus musculus
ggtcactttcaacatacaaaacagc

SEQ ID NO: 40910 - DNA, 25 bp, Mus musculus
cgacaccttccgacacttggctgca

SEQ ID NO: 40911 - DNA, 25 bp, Mus musculus
caccttccgacacttggctgcaact

SEQ ID NO: 40912 - DNA, 25 bp, Mus musculus
ctccgcctgctgaggagacagctgc

SEQ ID NO: 40913 - DNA, 25 bp, Mus musculus
cagctgctcatctgtccttctgcgg

SEQ ID NO: 40914 - DNA, 25 bp, Mus musculus
ctgctcatctgtccttctgcggcac

SEQ ID NO: 40915 - DNA, 25 bp, Mus musculus
atctgtccttctgcggcacacggtg

SEQ ID NO: 40916 - DNA, 25 bp, Mus musculus
tgtccttctgcggcacacggtggta

SEQ ID NO: 40917 - DNA, 25 bp, Mus musculus
tctgcggcacacggtggtatcgatg

SEQ ID NO: 40918 - DNA, 25 bp, Mus musculus
gcggcacacggtggtatcgatggtc

SEQ ID NO: 40919 - DNA, 25 bp, Mus musculus
gcacacggtggtatcgatggtcttg

SEQ ID NO: 40920 - DNA, 25 bp, Mus musculus
cttgagcactacagatctaaggaga

SEQ ID NO: 40921 - DNA, 25 bp, Mus musculus
gagcactacagatctaaggagagcc

SEQ ID NO: 40922 - DNA, 25 bp, Mus musculus
ccgacacttggctgcaactagcttg

SEQ ID NO: 40923 - DNA, 25 bp, Mus musculus
acacttggctgcaactagcttgttt

SEQ ID NO: 40924 - DNA, 25 bp, Mus musculus
cttggctgcaactagcttgtttctc

SEQ ID NO: 40925 - DNA, 25 bp, Mus musculus
ggctgcaactagcttgtttctcttc

SEQ ID NO: 40926 - DNA, 25 bp, Mus musculus
tgcaactagcttgtttctcttcctc

SEQ ID NO: 40927 - DNA, 25 bp, Mus musculus
gtttctcttcctcaggagtcgaagc

SEQ ID NO: 40928 - DNA, 25 bp, Mus musculus
tctcttcctcaggagtcgaagcttc

SEQ ID NO: 40929 - DNA, 25 bp, Mus musculus
gagtcgaagcttctccgcctgctga

SEQ ID NO: 40930 - DNA, 25 bp, Mus musculus
cacctgtgtgccacctcactgtgcg

SEQ ID NO: 40931 - DNA, 25 bp, Mus musculus
acctcactgtgcggatcagttctgc

SEQ ID NO: 40932 - DNA, 25 bp, Mus musculus
acgtctgcttttagaagtggagctt

SEQ ID NO: 40933 - DNA, 25 bp, Mus musculus
aaggcagcctctgtccttaagaaga

SEQ ID NO: 40934 - DNA, 25 bp, Mus musculus
agattgttaccaagactccaggcta

SEQ ID NO: 40935 - DNA, 25 bp, Mus musculus
ttaccaagactccaggctaggagag

SEQ ID NO: 40936 - DNA, 25 bp, Mus musculus
agttatccaccaatcatacagtgtg

SEQ ID NO: 40937 - DNA, 25 bp, Mus musculus
atcatacagtgtgctatgcttctgt

SEQ ID NO: 40938 - DNA, 25 bp, Mus musculus
cagtgtgctatgcttctgtgctgga

SEQ ID NO: 40939 - DNA, 25 bp, Mus musculus
gctatgcttctgtgctggacacaaa

SEQ ID NO: 40940 - DNA, 25 bp, Mus musculus
cttctgtgctggacacaaatttcta

SEQ ID NO: 40941 - DNA, 25 bp, Mus musculus
atttctataaacttgtgctctgagc

SEQ ID NO: 40942 - DNA, 25 bp, Mus musculus
ctgtgcggatcagttctgcgaaatt

SEQ ID NO: 40943 - DNA, 25 bp, Mus musculus
ctcaataaattgctaacctgctgtg

SEQ ID NO: 40944 - DNA, 25 bp, Mus musculus
ggatcagttctgcgaaattggtgtc

SEQ ID NO: 40945 - DNA, 25 bp, Mus musculus
atagctggattcctttactcattaa

SEQ ID NO: 40946 - DNA, 25 bp, Mus musculus
ggattcctttactcattaatgccgt

SEQ ID NO: 40947 - DNA, 25 bp, Mus musculus
ctttactcattaatgccgttgacca

SEQ ID NO: 40948 - DNA, 25 bp, Mus musculus
aggcgctcactcagcgtgcagctga

SEQ ID NO: 40949 - DNA, 25 bp, Mus musculus
cccacgatccagtgtctgctttacc

SEQ ID NO: 40950 - DNA, 25 bp, Mus musculus
atccagtgtctgctttacctattta

SEQ ID NO: 40951 - DNA, 25 bp, Mus musculus
cctgagccctgcagtgagtgcgaaa

SEQ ID NO: 40952 - DNA, 25 bp, Mus musculus
gagccctgcagtgagtgcgaaatcc

SEQ ID NO: 40953 - DNA, 25 bp, Mus musculus
agtggcacaacctgtcaagagaaga

SEQ ID NO: 40954 - DNA, 25 bp, Mus musculus
gtggcacaacctgtcaagagaagaa

SEQ ID NO: 40955 - DNA, 25 bp, Mus musculus
ggcacaacctgtcaagagaagaaca

SEQ ID NO: 40956 - DNA, 25 bp, Mus musculus
gcacaacctgtcaagagaagaacag

SEQ ID NO: 40957 - DNA, 25 bp, Mus musculus
atactatgagcttgcccggaaagaa

SEQ ID NO: 40958 - DNA, 25 bp, Mus musculus
actatgagcttgcccggaaagaacg

SEQ ID NO: 40959 - DNA, 25 bp, Mus musculus
ctatgagcttgcccggaaagaacgg

SEQ ID NO: 40960 - DNA, 25 bp, Mus musculus
atgagcttgcccggaaagaacggca

SEQ ID NO: 40961 - DNA, 25 bp, Mus musculus
tgagcttgcccggaaagaacggcag

SEQ ID NO: 40962 - DNA, 25 bp, Mus musculus
agcttgcccggaaagaacggcagct

SEQ ID NO: 40963 - DNA, 25 bp, Mus musculus
gccctgcagtgagtgcgaaatcccc

SEQ ID NO: 40964 - DNA, 25 bp, Mus musculus
tgcgaaatccccagttacggtgaag

SEQ ID NO: 40965 - DNA, 25 bp, Mus musculus
tgaaaaagcccctgaatgccttcat

SEQ ID NO: 40966 - DNA, 25 bp, Mus musculus
tggccgagtgtaccctgaaggaaag

SEQ ID NO: 40967 - DNA, 25 bp, Mus musculus
cgagtgtaccctgaaggaaagtgca

SEQ ID NO: 40968 - DNA, 25 bp, Mus musculus
aaagtgcagccattaaccaaatcct

SEQ ID NO: 40969 - DNA, 25 bp, Mus musculus
tgcagccattaaccaaatcctggga

SEQ ID NO: 40970 - DNA, 25 bp, Mus musculus
aaagtggcacaacctgtcaagagaa

SEQ ID NO: 40971 - DNA, 25 bp, Mus musculus
tcgaatgtctcggactagtgtatag

SEQ ID NO: 40972 - DNA, 25 bp, Mus musculus
aatgtctcggactagtgtataggag

SEQ ID NO: 40973 - DNA, 25 bp, Mus musculus
ctgagcctagttcgtgtcgactgtt

SEQ ID NO: 40974 - DNA, 25 bp, Mus musculus
ctagttcgtgtcgactgttctagag

SEQ ID NO: 40975 - DNA, 25 bp, Mus musculus
gttcgtgtcgactgttctagagagc

SEQ ID NO: 40976 - DNA, 25 bp, Mus musculus
caaagcgcacttattgccgaccagg

SEQ ID NO: 40977 - DNA, 25 bp, Mus musculus
agcgcacttattgccgaccaggacc

SEQ ID NO: 40978 - DNA, 25 bp, Mus musculus
attgccgaccaggaccaatagcaca

SEQ ID NO: 40979 - DNA, 25 bp, Mus musculus
gccgaccaggaccaatagcacatcg

SEQ ID NO: 40980 - DNA, 25 bp, Mus musculus
caatagcacatcgtaagagtccttg

SEQ ID NO: 40981 - DNA, 25 bp, Mus musculus
cacatcgtaagagtccttgactcat

SEQ ID NO: 40982 - DNA, 25 bp, Mus musculus
gtccttgactcatgaagttggttca

SEQ ID NO: 40983 - DNA, 25 bp, Mus musculus
gtctcggactagtgtataggaggca

SEQ ID NO: 40984 - DNA, 25 bp, Mus musculus
aacacacctgtcttgtctgatgctg

SEQ ID NO: 40985 - DNA, 25 bp, Mus musculus
cctgtcttgtctgatgctgaggtct

SEQ ID NO: 40986 - DNA, 25 bp, Mus musculus
ttgtctgatgctgaggtctcgatga

SEQ ID NO: 40987 - DNA, 25 bp, Mus musculus
ggaatcccgtagactccttgctgac

SEQ ID NO: 40988 - DNA, 25 bp, Mus musculus
atcccgtagactccttgctgactcc

SEQ ID NO: 40989 - DNA, 25 bp, Mus musculus
actccttgctgactcctgagcctag

SEQ ID NO: 40990 - DNA, 25 bp, Mus musculus
ccttgctgactcctgagcctagttc

SEQ ID NO: 40991 - DNA, 25 bp, Mus musculus
agtgccccgcaaagcgtgaggatcg

SEQ ID NO: 40992 - DNA, 25 bp, Mus musculus
ccccgcaaagcgtgaggatcgacac

SEQ ID NO: 40993 - DNA, 25 bp, Mus musculus
cacgttcctgaagctggacaacctt

SEQ ID NO: 40994 - DNA, 25 bp, Mus musculus
cgttcctgaagctggacaaccttag

SEQ ID NO: 40995 - DNA, 25 bp, Mus musculus
gttcctgaagctggacaaccttagc

SEQ ID NO: 40996 - DNA, 25 bp, Mus musculus
tggacaaccttagcctgcatcctta

SEQ ID NO: 40997 - DNA, 25 bp, Mus musculus
ggacaaccttagcctgcatccttat

SEQ ID NO: 40998 - DNA, 25 bp, Mus musculus
gacaaccttagcctgcatccttatc

SEQ ID NO: 40999 - DNA, 25 bp, Mus musculus
acaaccttagcctgcatccttatca

SEQ ID NO: 41000 - DNA, 25 bp, Mus musculus
caaccttagcctgcatccttatcag

SEQ ID NO: 41001 - DNA, 25 bp, Mus musculus
aaccttagcctgcatccttatcagg

SEQ ID NO: 41002 - DNA, 25 bp, Mus musculus
ttagcctgcatccttatcagggctt

SEQ ID NO: 41003 - DNA, 25 bp, Mus musculus
tgaggatcgacacgttcctgaagct

SEQ ID NO: 41004 - DNA, 25 bp, Mus musculus
gaggatcgacacgttcctgaagctg

SEQ ID NO: 41005 - DNA, 25 bp, Mus musculus
aggatcgacacgttcctgaagctgg

SEQ ID NO: 41006 - DNA, 25 bp, Mus musculus
ggatcgacacgttcctgaagctgga

SEQ ID NO: 41007 - DNA, 25 bp, Mus musculus
gatcgacacgttcctgaagctggac

SEQ ID NO: 41008 - DNA, 25 bp, Mus musculus
atcgacacgttcctgaagctggaca

SEQ ID NO: 41009 - DNA, 25 bp, Mus musculus
tcgacacgttcctgaagctggacaa

SEQ ID NO: 41010 - DNA, 25 bp, Mus musculus
cgacacgttcctgaagctggacaac

SEQ ID NO: 41011 - DNA, 25 bp, Mus musculus
cagagatccaagctgctttttgctg

SEQ ID NO: 41012 - DNA, 25 bp, Mus musculus
caggcctgatcctcttggtttttat

SEQ ID NO: 41013 - DNA, 25 bp, Mus musculus
gagttctccagcctgctatcaggga

SEQ ID NO: 41014 - DNA, 25 bp, Mus musculus
tccagcctgctatcagggaaggtga

SEQ ID NO: 41015 - DNA, 25 bp, Mus musculus
agcattggtcccaggctctcaaaat

SEQ ID NO: 41016 - DNA, 25 bp, Mus musculus
ggtcccaggctctcaaaatagtgca

SEQ ID NO: 41017 - DNA, 25 bp, Mus musculus
tagtgcagcctcttcttcccaagct

SEQ ID NO: 41018 - DNA, 25 bp, Mus musculus
ccaagctctggggtgcaccctgtgt

SEQ ID NO: 41019 - DNA, 25 bp, Mus musculus
gtgcaccctgtgtccttggttacca

SEQ ID NO: 41020 - DNA, 25 bp, Mus musculus
ccagacctagattattcaggagagt

SEQ ID NO: 41021 - DNA, 25 bp, Mus musculus
tatcccctgtgtttcccagtctgag

SEQ ID NO: 41022 - DNA, 25 bp, Mus musculus
ttcccagtctgagtgaccaataaaa

SEQ ID NO: 41023 - DNA, 25 bp, Mus musculus
ttcaagtctgccagagtcagaaatc

SEQ ID NO: 41024 - DNA, 25 bp, Mus musculus
taactcgccagtgaagagatctggc

SEQ ID NO: 41025 - DNA, 25 bp, Mus musculus
ccttaacttaagccagccacgtcag

SEQ ID NO: 41026 - DNA, 25 bp, Mus musculus
tgctgagcctatggaccaataaata

SEQ ID NO: 41027 - DNA, 25 bp, Mus musculus
tcaccataccctgagttgggccaag

SEQ ID NO: 41028 - DNA, 25 bp, Mus musculus
gaagagtctccaccatagtccccaa

SEQ ID NO: 41029 - DNA, 25 bp, Mus musculus
tctccaccatagtccccaagggctg

SEQ ID NO: 41030 - DNA, 25 bp, Mus musculus
ccatagtccccaagggctgagttct

SEQ ID NO: 41031 - DNA, 25 bp, Mus musculus
cataaacagcactttcaggctacat

SEQ ID NO: 41032 - DNA, 25 bp, Mus musculus
cagcactttcaggctacattttaaa

SEQ ID NO: 41033 - DNA, 25 bp, Mus musculus
agagcatattttctctttttgcctg

SEQ ID NO: 41034 - DNA, 25 bp, Mus musculus
tgcactctgccattgcactttgtaa

SEQ ID NO: 41035 - DNA, 25 bp, Mus musculus
actctgccattgcactttgtaaatc

SEQ ID NO: 41036 - DNA, 25 bp, Mus musculus
ctgccattgcactttgtaaatctgt

SEQ ID NO: 41037 - DNA, 25 bp, Mus musculus
ccattgcactttgtaaatctgtaga

SEQ ID NO: 41038 - DNA, 25 bp, Mus musculus
aatctgtagaatcgctcgtataaaa

SEQ ID NO: 41039 - DNA, 25 bp, Mus musculus
atatcagctttgatagtcatgtacc

SEQ ID NO: 41040 - DNA, 25 bp, Mus musculus
atagtcatgtaccttgacatagtga

SEQ ID NO: 41041 - DNA, 25 bp, Mus musculus
gtcatgtaccttgacatagtgaagg

SEQ ID NO: 41042 - DNA, 25 bp, Mus musculus
attggccaagatcgctatggaaaaa

SEQ ID NO: 41043 - DNA, 25 bp, Mus musculus
aaactacatttgtctaagatatctc

SEQ ID NO: 41044 - DNA, 25 bp, Mus musculus
tctaagatatctctgctattgacac

SEQ ID NO: 41045 - DNA, 25 bp, Mus musculus
aagatatctctgctattgacacatg

SEQ ID NO: 41046 - DNA, 25 bp, Mus musculus
atatctctgctattgacacatgatg

SEQ ID NO: 41047 - DNA, 25 bp, Mus musculus
tctctgctattgacacatgatgcct

SEQ ID NO: 41048 - DNA, 25 bp, Mus musculus
ctattgacacatgatgcctttgaat

SEQ ID NO: 41049 - DNA, 25 bp, Mus musculus
ttgacacatgatgcctttgaatgtc

SEQ ID NO: 41050 - DNA, 25 bp, Mus musculus
acacatgatgcctttgaatgtcata

SEQ ID NO: 41051 - DNA, 25 bp, Mus musculus
gactgcttcgagatcctcagccgtt

SEQ ID NO: 41052 - DNA, 25 bp, Mus musculus
gagatcctcagccgttatcagcctc

SEQ ID NO: 41053 - DNA, 25 bp, Mus musculus
atgatccattccgggactgatacct

SEQ ID NO: 41054 - DNA, 25 bp, Mus musculus
atccattccgggactgatacctggc

SEQ ID NO: 41055 - DNA, 25 bp, Mus musculus
actgatacctggcacactatcggct

SEQ ID NO: 41056 - DNA, 25 bp, Mus musculus
acctggcacactatcggctctttga

SEQ ID NO: 41057 - DNA, 25 bp, Mus musculus
tggcacactatcggctctttgatca

SEQ ID NO: 41058 - DNA, 25 bp, Mus musculus
cacactatcggctctttgatcaagc

SEQ ID NO: 41059 - DNA, 25 bp, Mus musculus
tgcattgttgcccgatgagtaatcg

SEQ ID NO: 41060 - DNA, 25 bp, Mus musculus
attgttgcccgatgagtaatcgcag

SEQ ID NO: 41061 - DNA, 25 bp, Mus musculus
atcgcagttgttcaacgcagcgtgg

SEQ ID NO: 41062 - DNA, 25 bp, Mus musculus
gcagttgttcaacgcagcgtgggtg

SEQ ID NO: 41063 - DNA, 25 bp, Mus musculus
atcctcagccgttatcagcctctaa

SEQ ID NO: 41064 - DNA, 25 bp, Mus musculus
tatcagcctctaacatgacctagcg

SEQ ID NO: 41065 - DNA, 25 bp, Mus musculus
cagcctctaacatgacctagcgccg

SEQ ID NO: 41066 - DNA, 25 bp, Mus musculus
gtttgcccttctctctgctgcagag

SEQ ID NO: 41067 - DNA, 25 bp, Mus musculus
tctctctgctgcagagccgacgcta

SEQ ID NO: 41068 - DNA, 25 bp, Mus musculus
tgcagagccgacgctatgatccatt

SEQ ID NO: 41069 - DNA, 25 bp, Mus musculus
agagccgacgctatgatccattccg

SEQ ID NO: 41070 - DNA, 25 bp, Mus musculus
gccgacgctatgatccattccggga

SEQ ID NO: 41071 - DNA, 25 bp, Mus musculus
ccccttcgcgaagctcattgtggag

SEQ ID NO: 41072 - DNA, 25 bp, Mus musculus
cttcgcgaagctcattgtggagacc

SEQ ID NO: 41073 - DNA, 25 bp, Mus musculus
gaacaactacacggcgctgcagaac

SEQ ID NO: 41074 - DNA, 25 bp, Mus musculus
ctacacggcgctgcagaacgccaag

SEQ ID NO: 41075 - DNA, 25 bp, Mus musculus
gcagaacgccaagtacgagggctgg

SEQ ID NO: 41076 - DNA, 25 bp, Mus musculus
cttcatgaagcgcctgccgcggggc

SEQ ID NO: 41077 - DNA, 25 bp, Mus musculus
cctgcgcttcgagttcctcaactac

SEQ ID NO: 41078 - DNA, 25 bp, Mus musculus
cggcagccagaggacttgggccccg

SEQ ID NO: 41079 - DNA, 25 bp, Mus musculus
ccagccggccgaggaatccagcggg

SEQ ID NO: 41080 - DNA, 25 bp, Mus musculus
ggagctgccttctagttgtgcatat

SEQ ID NO: 41081 - DNA, 25 bp, Mus musculus
gctgccttctagttgtgcatattgt

SEQ ID NO: 41082 - DNA, 25 bp, Mus musculus
gccttctagttgtgcatattgtttg

SEQ ID NO: 41083 - DNA, 25 bp, Mus musculus
aagcagagtccgagttcgcggcgca

SEQ ID NO: 41084 - DNA, 25 bp, Mus musculus
ccgagttcgcggcgcagagacaggt

SEQ ID NO: 41085 - DNA, 25 bp, Mus musculus
agttcgcggcgcagagacaggtctc

SEQ ID NO: 41086 - DNA, 25 bp, Mus musculus
gacaggtctctacatctgcatgaac

SEQ ID NO: 41087 - DNA, 25 bp, Mus musculus
tctctacatctgcatgaacaagaag

SEQ ID NO: 41088 - DNA, 25 bp, Mus musculus
ctgcgtattcacagagatcgtgctg

SEQ ID NO: 41089 - DNA, 25 bp, Mus musculus
cgtattcacagagatcgtgctggag

SEQ ID NO: 41090 - DNA, 25 bp, Mus musculus
cacagagatcgtgctggagaacaac

SEQ ID NO: 41091 - DNA, 25 bp, Mus musculus
agagatacaggcacttcccctgacc

SEQ ID NO: 41092 - DNA, 25 bp, Mus musculus
gatacaggcacttcccctgacccag

SEQ ID NO: 41093 - DNA, 25 bp, Mus musculus
gacgctgcagcaatattgagcaatt

SEQ ID NO: 41094 - DNA, 25 bp, Mus musculus
catgtatagccacttttgtatctgc

SEQ ID NO: 41095 - DNA, 25 bp, Mus musculus
gtatagccacttttgtatctgcacc

SEQ ID NO: 41096 - DNA, 25 bp, Mus musculus
tagccacttttgtatctgcaccatt

SEQ ID NO: 41097 - DNA, 25 bp, Mus musculus
ccacttttgtatctgcaccatttgt

SEQ ID NO: 41098 - DNA, 25 bp, Mus musculus
cttttgtatctgcaccatttgtctc

SEQ ID NO: 41099 - DNA, 25 bp, Mus musculus
ttgtatctgcaccatttgtctctat

SEQ ID NO: 41100 - DNA, 25 bp, Mus musculus
tatctgcaccatttgtctctattta

SEQ ID NO: 41101 - DNA, 25 bp, Mus musculus
taatttctcaaattatcatgtgcaa

SEQ ID NO: 41102 - DNA, 25 bp, Mus musculus
tttctcaaattatcatgtgcaatta

SEQ ID NO: 41103 - DNA, 25 bp, Mus musculus
acctccctggactagaacactgcac

SEQ ID NO: 41104 - DNA, 25 bp, Mus musculus
aacactgcacctgcactttataagc

SEQ ID NO: 41105 - DNA, 25 bp, Mus musculus
gtgtgaacacaatcaacctgccaag

SEQ ID NO: 41106 - DNA, 25 bp, Mus musculus
acacaatcaacctgccaagacgctg

SEQ ID NO: 41107 - DNA, 25 bp, Mus musculus
caatcaacctgccaagacgctgcag

SEQ ID NO: 41108 - DNA, 25 bp, Mus musculus
tcaacctgccaagacgctgcagcaa

SEQ ID NO: 41109 - DNA, 25 bp, Mus musculus
tgccaagacgctgcagcaatattga

SEQ ID NO: 41110 - DNA, 25 bp, Mus musculus
caagacgctgcagcaatattgagca

SEQ ID NO: 41111 - DNA, 25 bp, Mus musculus
tcattgctggaggtcaaacgtggag

SEQ ID NO: 41112 - DNA, 25 bp, Mus musculus
caccattatcaatgtcaagtggagc

SEQ ID NO: 41113 - DNA, 25 bp, Mus musculus
gctgaacctcaaggtgcaaatgcct

SEQ ID NO: 41114 - DNA, 25 bp, Mus musculus
gccacttcctgatgcagactcgggc

SEQ ID NO: 41115 - DNA, 25 bp, Mus musculus
gcccactgcagcctttcgggctgtg

SEQ ID NO: 41116 - DNA, 25 bp, Mus musculus
tgcagcctttcgggctgtgtgacct

SEQ ID NO: 41117 - DNA, 25 bp, Mus musculus
gtgacctcctgaactgtctccgagc

SEQ ID NO: 41118 - DNA, 25 bp, Mus musculus
actgtctccgagcctcctgagggag

SEQ ID NO: 41119 - DNA, 25 bp, Mus musculus
tgtcctcccatggatccctgctttt

SEQ ID NO: 41120 - DNA, 25 bp, Mus musculus
gatccctgcttttgtggcctgcttc

SEQ ID NO: 41121 - DNA, 25 bp, Mus musculus
tgcttttgtggcctgcttcagtttc

SEQ ID NO: 41122 - DNA, 25 bp, Mus musculus
gttgttttccatctccacataaatt

SEQ ID NO: 41123 - DNA, 25 bp, Mus musculus
gcacagcctctcactgtggacctag

SEQ ID NO: 41124 - DNA, 25 bp, Mus musculus
tccatctccacataaatttggcccc

SEQ ID NO: 41125 - DNA, 25 bp, Mus musculus
cctctcactgtggacctagattcat

SEQ ID NO: 41126 - DNA, 25 bp, Mus musculus
gattcatcagccagatcttctgtgc

SEQ ID NO: 41127 - DNA, 25 bp, Mus musculus
tcagccagatcttctgtgcctgtgg

SEQ ID NO: 41128 - DNA, 25 bp, Mus musculus
atcgttcttggtttattgctggtgg

SEQ ID NO: 41129 - DNA, 25 bp, Mus musculus
ttattgctggtggtagtggccatcg

SEQ ID NO: 41130 - DNA, 25 bp, Mus musculus
gccatcgcaggcggtgtgctgctgt

SEQ ID NO: 41131 - DNA, 25 bp, Mus musculus
ggtgacctgttgcctggtgggaact

SEQ ID NO: 41132 - DNA, 25 bp, Mus musculus
agggcacacgagagccgccgcttct

SEQ ID NO: 41133 - DNA, 25 bp, Mus musculus
gctcgcaccgtgtcccagtctgatc

SEQ ID NO: 41134 - DNA, 25 bp, Mus musculus
gagccagtcgtcattagagatcgct

SEQ ID NO: 41135 - DNA, 25 bp, Mus musculus
attagagatcgctcttacttcaaaa

SEQ ID NO: 41136 - DNA, 25 bp, Mus musculus
gatcgctcttacttcaaaaggaaat

SEQ ID NO: 41137 - DNA, 25 bp, Mus musculus
aagatttcaaatcacattcatgctg

SEQ ID NO: 41138 - DNA, 25 bp, Mus musculus
tcaaatcacattcatgctgtgtaca

SEQ ID NO: 41139 - DNA, 25 bp, Mus musculus
aatcacattcatgctgtgtacacat

SEQ ID NO: 41140 - DNA, 25 bp, Mus musculus
caattcccagtgtctgctgtgtaat

SEQ ID NO: 41141 - DNA, 25 bp, Mus musculus
ccccacgtacacagtgtattgattc

SEQ ID NO: 41142 - DNA, 25 bp, Mus musculus
ttgtcacccatcaataaagatcaca

SEQ ID NO: 41143 - DNA, 25 bp, Mus musculus
tcacccatcaataaagatcacaaag

SEQ ID NO: 41144 - DNA, 25 bp, Mus musculus
cgcaccgtgtcccagtctgatcgcg

SEQ ID NO: 41145 - DNA, 25 bp, Mus musculus
tcccagtctgatcgcgtagtggaat

SEQ ID NO: 41146 - DNA, 25 bp, Mus musculus
cagtctgatcgcgtagtggaataag

SEQ ID NO: 41147 - DNA, 25 bp, Mus musculus
tctgatcgcgtagtggaataagtcc

SEQ ID NO: 41148 - DNA, 25 bp, Mus musculus
ccgcaccagcagctcttgtaaattt

SEQ ID NO: 41149 - DNA, 25 bp, Mus musculus
cagcagctcttgtaaatttgtgaaa

SEQ ID NO: 41150 - DNA, 25 bp, Mus musculus
taattcatcacactctcctccttta

SEQ ID NO: 41151 - DNA, 25 bp, Mus musculus
aacgagccagtcgtcattagagatc

SEQ ID NO: 41152 - DNA, 25 bp, Mus musculus
gccttcagccgaacgctcaacacga

SEQ ID NO: 41153 - DNA, 25 bp, Mus musculus
gacgtcaaccacttcgctccggagc

SEQ ID NO: 41154 - DNA, 25 bp, Mus musculus
cgctccggagcgtctacaagtgaac

SEQ ID NO: 41155 - DNA, 25 bp, Mus musculus
gctccggagcgtctacaagtgaacg

SEQ ID NO: 41156 - DNA, 25 bp, Mus musculus
ctccggagcgtctacaagtgaacga

SEQ ID NO: 41157 - DNA, 25 bp, Mus musculus
tccggagcgtctacaagtgaacgac

SEQ ID NO: 41158 - DNA, 25 bp, Mus musculus
tggagatccatggcagcacgaagaa

SEQ ID NO: 41159 - DNA, 25 bp, Mus musculus
gagatccatggcagcacgaagaatg

SEQ ID NO: 41160 - DNA, 25 bp, Mus musculus
agatccatggcagcacgaagaatgg

SEQ ID NO: 41161 - DNA, 25 bp, Mus musculus
gatccatggcagcacgaagaatggc

SEQ ID NO: 41162 - DNA, 25 bp, Mus musculus
atccatggcagcacgaagaatggca

SEQ ID NO: 41163 - DNA, 25 bp, Mus musculus
tccatggcagcacgaagaatggcag

SEQ ID NO: 41164 - DNA, 25 bp, Mus musculus
cgtcaaccacttcgctccggagcgt

SEQ ID NO: 41165 - DNA, 25 bp, Mus musculus
gtcaaccacttcgctccggagcgtc

SEQ ID NO: 41166 - DNA, 25 bp, Mus musculus
tcaaccacttcgctccggagcgtct

SEQ ID NO: 41167 - DNA, 25 bp, Mus musculus
accacttcgctccggagcgtctaca

SEQ ID NO: 41168 - DNA, 25 bp, Mus musculus
ccacttcgctccggagcgtctacaa

SEQ ID NO: 41169 - DNA, 25 bp, Mus musculus
cacttcgctccggagcgtctacaag

SEQ ID NO: 41170 - DNA, 25 bp, Mus musculus
cttcgctccggagcgtctacaagtg

SEQ ID NO: 41171 - DNA, 25 bp, Mus musculus
tcgctccggagcgtctacaagtgaa

SEQ ID NO: 41172 - DNA, 25 bp, Mus musculus
aatcacgtttgtgtcattagtgaaa

SEQ ID NO: 41173 - DNA, 25 bp, Mus musculus
ggtgttctagtcctgtggccatctg

SEQ ID NO: 41174 - DNA, 25 bp, Mus musculus
tgagcctataggccagcctaccctc

SEQ ID NO: 41175 - DNA, 25 bp, Mus musculus
tataggccagcctaccctctggtag

SEQ ID NO: 41176 - DNA, 25 bp, Mus musculus
ccagcctaccctctggtagattgtc

SEQ ID NO: 41177 - DNA, 25 bp, Mus musculus
gattgtcgcttatcttgtaagaaaa

SEQ ID NO: 41178 - DNA, 25 bp, Mus musculus
acgagtctgaagctctcgatttcct

SEQ ID NO: 41179 - DNA, 25 bp, Mus musculus
ctgaagctctcgatttcctatcagt

SEQ ID NO: 41180 - DNA, 25 bp, Mus musculus
ctctcgatttcctatcagtaacagc

SEQ ID NO: 41181 - DNA, 25 bp, Mus musculus
atttcctatcagtaacagcatctaa

SEQ ID NO: 41182 - DNA, 25 bp, Mus musculus
tatcagtaacagcatctaagaggtt

SEQ ID NO: 41183 - DNA, 25 bp, Mus musculus
catgtttcagcagtgttggctgtat

SEQ ID NO: 41184 - DNA, 25 bp, Mus musculus
ctagtcctgtggccatctgcctagt

SEQ ID NO: 41185 - DNA, 25 bp, Mus musculus
ctgtggccatctgcctagtaaagct

SEQ ID NO: 41186 - DNA, 25 bp, Mus musculus
ccatctgcctagtaaagctttttgc

SEQ ID NO: 41187 - DNA, 25 bp, Mus musculus
tttttgcatgaaccttctatgaatg

SEQ ID NO: 41188 - DNA, 25 bp, Mus musculus
tcagttgctgcgtccccagactttt

SEQ ID NO: 41189 - DNA, 25 bp, Mus musculus
tccccagacttttgatttgcactat

SEQ ID NO: 41190 - DNA, 25 bp, Mus musculus
gacttttgatttgcactatgagcct

SEQ ID NO: 41191 - DNA, 25 bp, Mus musculus
tgatttgcactatgagcctataggc

SEQ ID NO: 41192 - DNA, 25 bp, Mus musculus
tgtttttcccaatggaaatggcact

SEQ ID NO: 41193 - DNA, 25 bp, Mus musculus
tggcacttacctctcctgggcagag

SEQ ID NO: 41194 - DNA, 25 bp, Mus musculus
gtcttccatgggccactgtacaaca

SEQ ID NO: 41195 - DNA, 25 bp, Mus musculus
catgggccactgtacaacagccagc

SEQ ID NO: 41196 - DNA, 25 bp, Mus musculus
ccacagactgagttcactctcaatg

SEQ ID NO: 41197 - DNA, 25 bp, Mus musculus
actgagttcactctcaatgtcagat

SEQ ID NO: 41198 - DNA, 25 bp, Mus musculus
gtcagatcaatcaccttgccttgta

SEQ ID NO: 41199 - DNA, 25 bp, Mus musculus
cctccttgattaatctgtcaaccct

SEQ ID NO: 41200 - DNA, 25 bp, Mus musculus
tgattaatctgtcaaccctcacaat

SEQ ID NO: 41201 - DNA, 25 bp, Mus musculus
atctgtcaaccctcacaattgccct

SEQ ID NO: 41202 - DNA, 25 bp, Mus musculus
tcacaattgccctcatgcctagaac

SEQ ID NO: 41203 - DNA, 25 bp, Mus musculus
tcatgcctagaacagcacagaaagg

SEQ ID NO: 41204 - DNA, 25 bp, Mus musculus
ggacatagaccccttcttctgcctc

SEQ ID NO: 41205 - DNA, 25 bp, Mus musculus
attgtgaacatcttcatattcactc

SEQ ID NO: 41206 - DNA, 25 bp, Mus musculus
cttcttctgcctcatagatcacagg

SEQ ID NO: 41207 - DNA, 25 bp, Mus musculus
ctgcctcatagatcacagggggttt

SEQ ID NO: 41208 - DNA, 25 bp, Mus musculus
caatgttgtagctcagcctcagtaa

SEQ ID NO: 41209 - DNA, 25 bp, Mus musculus
tgtagctcagcctcagtaagttacc

SEQ ID NO: 41210 - DNA, 25 bp, Mus musculus
tcagcctcagtaagttaccctctct

SEQ ID NO: 41211 - DNA, 25 bp, Mus musculus
gtcaatgtcatcaacaaggtcttcc

SEQ ID NO: 41212 - DNA, 25 bp, Mus musculus
gtcatcaacaaggtcttccatgggc

SEQ ID NO: 41213 - DNA, 25 bp, Mus musculus
tagtcctcaactcagatgagttgcg

SEQ ID NO: 41214 - DNA, 25 bp, Mus musculus
tcaactcagatgagttgcgatagct

SEQ ID NO: 41215 - DNA, 25 bp, Mus musculus
ttcctctatcggacacagacgggca

SEQ ID NO: 41216 - DNA, 25 bp, Mus musculus
actactgtgggctgcatactctctc

SEQ ID NO: 41217 - DNA, 25 bp, Mus musculus
ctctctcatacgacggacactaaca

SEQ ID NO: 41218 - DNA, 25 bp, Mus musculus
catacgacggacactaacatcatcc

SEQ ID NO: 41219 - DNA, 25 bp, Mus musculus
acggacactaacatcatcctcaagt

SEQ ID NO: 41220 - DNA, 25 bp, Mus musculus
atcatcctcaagtgtatctatatgg

SEQ ID NO: 41221 - DNA, 25 bp, Mus musculus
agttcggatagcatgcccgagagag

SEQ ID NO: 41222 - DNA, 25 bp, Mus musculus
gatagcatgcccgagagagtgatcc

SEQ ID NO: 41223 - DNA, 25 bp, Mus musculus
gtgatccccagaggtgaagatctat

SEQ ID NO: 41224 - DNA, 25 bp, Mus musculus
gatctattgtctcaacgtgagcagc

SEQ ID NO: 41225 - DNA, 25 bp, Mus musculus
agttgcgatagctctacgcgcctgc

SEQ ID NO: 41226 - DNA, 25 bp, Mus musculus
ttgtctcaacgtgagcagcatcctg

SEQ ID NO: 41227 - DNA, 25 bp, Mus musculus
tctacgcgcctgccgtctgagagac

SEQ ID NO: 41228 - DNA, 25 bp, Mus musculus
cgcctgccgtctgagagacctatat

SEQ ID NO: 41229 - DNA, 25 bp, Mus musculus
cctatatagccgtcttcgacgtaga

SEQ ID NO: 41230 - DNA, 25 bp, Mus musculus
tagccgtcttcgacgtagatgtcaa

SEQ ID NO: 41231 - DNA, 25 bp, Mus musculus
tcttcgacgtagatgtcaagcaggt

SEQ ID NO: 41232 - DNA, 25 bp, Mus musculus
atgtcaagcaggtggtgcttcctct

SEQ ID NO: 41233 - DNA, 25 bp, Mus musculus
tggtgcttcctctatcggacacaga

SEQ ID NO: 41234 - DNA, 25 bp, Mus musculus
accaaagctcttcagagaatatctt

SEQ ID NO: 41235 - DNA, 25 bp, Mus musculus
agttactgtcaactaaattccatgg

SEQ ID NO: 41236 - DNA, 25 bp, Mus musculus
tccatctcaaaagatcagtgacctg

SEQ ID NO: 41237 - DNA, 25 bp, Mus musculus
ttgaagaccttgacttcaggtattt

SEQ ID NO: 41238 - DNA, 25 bp, Mus musculus
atggtgcttttctctctgcagcagt

SEQ ID NO: 41239 - DNA, 25 bp, Mus musculus
ctgcagcagtgtgtgctagaaacag

SEQ ID NO: 41240 - DNA, 25 bp, Mus musculus
ggcatctaagtgcacagaggagtgc

SEQ ID NO: 41241 - DNA, 25 bp, Mus musculus
gtgcgctggacttctcagtagcaaa

SEQ ID NO: 41242 - DNA, 25 bp, Mus musculus
cgctggacttctcagtagcaaaaca

SEQ ID NO: 41243 - DNA, 25 bp, Mus musculus
tggacttctcagtagcaaaacacta

SEQ ID NO: 41244 - DNA, 25 bp, Mus musculus
tagcaaaacactaaactctactgtg

SEQ ID NO: 41245 - DNA, 25 bp, Mus musculus
actaaactctactgtggtgatattt

SEQ ID NO: 41246 - DNA, 25 bp, Mus musculus
gtcatgcctgtctaacacttttaaa

SEQ ID NO: 41247 - DNA, 25 bp, Mus musculus
ttacttgagatccaggggttcatac

SEQ ID NO: 41248 - DNA, 25 bp, Mus musculus
atacatgtagctactgggacccaga

SEQ ID NO: 41249 - DNA, 25 bp, Mus musculus
gtagctactgggacccagagacatg

SEQ ID NO: 41250 - DNA, 25 bp, Mus musculus
actgggacccagagacatgaggatt

SEQ ID NO: 41251 - DNA, 25 bp, Mus musculus
actccatgagtttgaagcagcctca

SEQ ID NO: 41252 - DNA, 25 bp, Mus musculus
gtttgaagcagcctcagcaaaccta

SEQ ID NO: 41253 - DNA, 25 bp, Mus musculus
tgaagcagcctcagcaaacctaggg

SEQ ID NO: 41254 - DNA, 25 bp, Mus musculus
taggccaggcacaaccctcgaagag

SEQ ID NO: 41255 - DNA, 25 bp, Mus musculus
tctctgccctgatctccaagtccag

SEQ ID NO: 41256 - DNA, 25 bp, Mus musculus
ccttctttctggcttgcccagggat

SEQ ID NO: 41257 - DNA, 25 bp, Mus musculus
ggatacggccctagctccgtaccag

SEQ ID NO: 41258 - DNA, 25 bp, Mus musculus
tacggccctagctccgtaccagtgt

SEQ ID NO: 41259 - DNA, 25 bp, Mus musculus
ggccctagctccgtaccagtgtagc

SEQ ID NO: 41260 - DNA, 25 bp, Mus musculus
agctccgtaccagtgtagcctcatc

SEQ ID NO: 41261 - DNA, 25 bp, Mus musculus
tccgtaccagtgtagcctcatcctc

SEQ ID NO: 41262 - DNA, 25 bp, Mus musculus
gtaccagtgtagcctcatcctctgt

SEQ ID NO: 41263 - DNA, 25 bp, Mus musculus
gtgtagcctcatcctctgtgatggc

SEQ ID NO: 41264 - DNA, 25 bp, Mus musculus
tagcctcatcctctgtgatggcacc

SEQ ID NO: 41265 - DNA, 25 bp, Mus musculus
cctcatcctctgtgatggcaccgga

SEQ ID NO: 41266 - DNA, 25 bp, Mus musculus
ccctgatctccaagtccagagtagt

SEQ ID NO: 41267 - DNA, 25 bp, Mus musculus
caccggagtctccttcgagttcagt

SEQ ID NO: 41268 - DNA, 25 bp, Mus musculus
tgatctccaagtccagagtagtagg

SEQ ID NO: 41269 - DNA, 25 bp, Mus musculus
tctccaagtccagagtagtaggggt

SEQ ID NO: 41270 - DNA, 25 bp, Mus musculus
gacaagcagcattctcagttgtagg

SEQ ID NO: 41271 - DNA, 25 bp, Mus musculus
tctcagttgtaggcttggcaaggca

SEQ ID NO: 41272 - DNA, 25 bp, Mus musculus
tgagtcccaaacagttggaatgata

SEQ ID NO: 41273 - DNA, 25 bp, Mus musculus
gtcccaaacagttggaatgatagaa

SEQ ID NO: 41274 - DNA, 25 bp, Mus musculus
agtccttctttctggcttgcccagg

SEQ ID NO: 41275 - DNA, 25 bp, Mus musculus
agataactaatattcccgtcgtctg

SEQ ID NO: 41276 - DNA, 25 bp, Mus musculus
ctaatattcccgtcgtctgtcgtag

SEQ ID NO: 41277 - DNA, 25 bp, Mus musculus
caacctctcgaaccaaatgtgcatg

SEQ ID NO: 41278 - DNA, 25 bp, Mus musculus
gtgcatgagccttattgtgtacata

SEQ ID NO: 41279 - DNA, 25 bp, Mus musculus
gcgtgtccatcgcactgatcatggc

SEQ ID NO: 41280 - DNA, 25 bp, Mus musculus
ccatcgcactgatcatggcctgcat

SEQ ID NO: 41281 - DNA, 25 bp, Mus musculus
cctgcatggccatgaagatgtactg

SEQ ID NO: 41282 - DNA, 25 bp, Mus musculus
tgtactgatacaccagcttggtgaa

SEQ ID NO: 41283 - DNA, 25 bp, Mus musculus
gatacaccagcttggtgaagccgcg

SEQ ID NO: 41284 - DNA, 25 bp, Mus musculus
tggtgaagccgcgcttgtcttcgtc

SEQ ID NO: 41285 - DNA, 25 bp, Mus musculus
agccgcgcttgtcttcgtcagagta

SEQ ID NO: 41286 - DNA, 25 bp, Mus musculus
cgcgcttgtcttcgtcagagtagcc

SEQ ID NO: 41287 - DNA, 25 bp, Mus musculus
tcgtctgtcgtagcactcctggatt

SEQ ID NO: 41288 - DNA, 25 bp, Mus musculus
cttcgtcagagtagcccgacacgtg

SEQ ID NO: 41289 - DNA, 25 bp, Mus musculus
gtcgtagcactcctggattccagga

SEQ ID NO: 41290 - DNA, 25 bp, Mus musculus
gcactcctggattccaggatcattc

SEQ ID NO: 41291 - DNA, 25 bp, Mus musculus
tccaggatcattccacaagctctta

SEQ ID NO: 41292 - DNA, 25 bp, Mus musculus
atcattccacaagctcttaatagca

SEQ ID NO: 41293 - DNA, 25 bp, Mus musculus
ccacaagctcttaatagcatcatac

SEQ ID NO: 41294 - DNA, 25 bp, Mus musculus
aatagcatcatacatatggattctc

SEQ ID NO: 41295 - DNA, 25 bp, Mus musculus
gattctcaaaagcagacaccttctc

SEQ ID NO: 41296 - DNA, 25 bp, Mus musculus
acgaccctgtactgcagaggattgt

SEQ ID NO: 41297 - DNA, 25 bp, Mus musculus
ttctttatgccacagatgaaggctt

SEQ ID NO: 41298 - DNA, 25 bp, Mus musculus
tacctcttcttcaaagtgcactttg

SEQ ID NO: 41299 - DNA, 25 bp, Mus musculus
aaagtgcactttgcagaagtctcac

SEQ ID NO: 41300 - DNA, 25 bp, Mus musculus
cactttgcagaagtctcaccttctc

SEQ ID NO: 41301 - DNA, 25 bp, Mus musculus
gcagaagtctcaccttctccgatga

SEQ ID NO: 41302 - DNA, 25 bp, Mus musculus
ccttctccgatgagtttgagttagg

SEQ ID NO: 41303 - DNA, 25 bp, Mus musculus
agttaggagctttggccttgtagca

SEQ ID NO: 41304 - DNA, 25 bp, Mus musculus
gagctttggccttgtagcagagcag

SEQ ID NO: 41305 - DNA, 25 bp, Mus musculus
tggccttgtagcagagcagtattaa

SEQ ID NO: 41306 - DNA, 25 bp, Mus musculus
ggccaaccatggggctcttcatgtg

SEQ ID NO: 41307 - DNA, 25 bp, Mus musculus
ccatggggctcttcatgtggatgct

SEQ ID NO: 41308 - DNA, 25 bp, Mus musculus
aagcagcctggaccagcagagcaac

SEQ ID NO: 41309 - DNA, 25 bp, Mus musculus
cctggaccagcagagcaacatccga

SEQ ID NO: 41310 - DNA, 25 bp, Mus musculus
ccagcagagcaacatccgaagtctt

SEQ ID NO: 41311 - DNA, 25 bp, Mus musculus
gagcaacatccgaagtcttcactcc

SEQ ID NO: 41312 - DNA, 25 bp, Mus musculus
catccgaagtcttcactccaaatca

SEQ ID NO: 41313 - DNA, 25 bp, Mus musculus
aagtcttcactccaaatcatgtgct

SEQ ID NO: 41314 - DNA, 25 bp, Mus musculus
tcactccaaatcatgtgcttaactg

SEQ ID NO: 41315 - DNA, 25 bp, Mus musculus
caaatcatgtgcttaactgttaata

SEQ ID NO: 41316 - DNA, 25 bp, Mus musculus
ttgggcaatgtctccaacagtaatg

SEQ ID NO: 41317 - DNA, 25 bp, Mus musculus
ggcaatgtctccaacagtaatgtca

SEQ ID NO: 41318 - DNA, 25 bp, Mus musculus
gaactgcttctccatgctccagtcg

SEQ ID NO: 41319 - DNA, 25 bp, Mus musculus
ctccatgctccagtcgttgaaagcc

SEQ ID NO: 41320 - DNA, 25 bp, Mus musculus
catgctccagtcgttgaaagccgtc

SEQ ID NO: 41321 - DNA, 25 bp, Mus musculus
gctccagtcgttgaaagccgtcacc

SEQ ID NO: 41322 - DNA, 25 bp, Mus musculus
gttgaaagccgtcaccaacaccaca

SEQ ID NO: 41323 - DNA, 25 bp, Mus musculus
acacaccaccgacaagaggatcgca

SEQ ID NO: 41324 - DNA, 25 bp, Mus musculus
caccaccgacaagaggatcgcagct

SEQ ID NO: 41325 - DNA, 25 bp, Mus musculus
gaggatcgcagctccttcaatccac

SEQ ID NO: 41326 - DNA, 25 bp, Mus musculus
aacagaaacttctccacaaagtgca

SEQ ID NO: 41327 - DNA, 25 bp, Mus musculus
aacttctccacaaagtgcattatcc

SEQ ID NO: 41328 - DNA, 25 bp, Mus musculus
gtctccaacagtaatgtcagctaca

SEQ ID NO: 41329 - DNA, 25 bp, Mus musculus
aatgtcagctacaggtatctggatg

SEQ ID NO: 41330 - DNA, 25 bp, Mus musculus
gtcagctacaggtatctggatgacc

SEQ ID NO: 41331 - DNA, 25 bp, Mus musculus
cttctgttcctgctcaattcgactc

SEQ ID NO: 41332 - DNA, 25 bp, Mus musculus
ctgttcctgctcaattcgactctgc

SEQ ID NO: 41333 - DNA, 25 bp, Mus musculus
ctcaattcgactctgcaggcctcgg

SEQ ID NO: 41334 - DNA, 25 bp, Mus musculus
aattcgactctgcaggcctcggaac

SEQ ID NO: 41335 - DNA, 25 bp, Mus musculus
actctgcaggcctcggaactgcttc

SEQ ID NO: 41336 - DNA, 25 bp, Mus musculus
caatgaatctacttgtgttgctgac

SEQ ID NO: 41337 - DNA, 25 bp, Mus musculus
tgaatctacttgtgttgctgaccat

SEQ ID NO: 41338 - DNA, 25 bp, Mus musculus
tgtcctcggtgagttcaatgacttt

SEQ ID NO: 41339 - DNA, 25 bp, Mus musculus
gttcaatgactttcttcaatccata

SEQ ID NO: 41340 - DNA, 25 bp, Mus musculus
ctttcttcaatccatacttcaggag

SEQ ID NO: 41341 - DNA, 25 bp, Mus musculus
ctacaagctacagcaggtccatcag

SEQ ID NO: 41342 - DNA, 25 bp, Mus musculus
caagctacagcaggtccatcagtat

SEQ ID NO: 41343 - DNA, 25 bp, Mus musculus
gctacagcaggtccatcagtatatg

SEQ ID NO: 41344 - DNA, 25 bp, Mus musculus
acagcaggtccatcagtatatgaag

SEQ ID NO: 41345 - DNA, 25 bp, Mus musculus
gtatatgaaggcccttcgtgaagag

SEQ ID NO: 41346 - DNA, 25 bp, Mus musculus
gtattttgatccgagcatggttggg

SEQ ID NO: 41347 - DNA, 25 bp, Mus musculus
tgatccgagcatggttgggtggaca

SEQ ID NO: 41348 - DNA, 25 bp, Mus musculus
tacttgtgttgctgaccatatcaac

SEQ ID NO: 41349 - DNA, 25 bp, Mus musculus
ttgtgttgctgaccatatcaacatg

SEQ ID NO: 41350 - DNA, 25 bp, Mus musculus
tgttgctgaccatatcaacatggtt

SEQ ID NO: 41351 - DNA, 25 bp, Mus musculus
tgctgaccatatcaacatggttttc

SEQ ID NO: 41352 - DNA, 25 bp, Mus musculus
ccatatcaacatggttttcaaaata

SEQ ID NO: 41353 - DNA, 25 bp, Mus musculus
catatactttgtcctcggtgagttc

SEQ ID NO: 41354 - DNA, 25 bp, Mus musculus
atactttgtcctcggtgagttcaat

SEQ ID NO: 41355 - DNA, 25 bp, Mus musculus
ctttgtcctcggtgagttcaatgac

SEQ ID NO: 41356 - DNA, 25 bp, Mus musculus
ctatgctgtgttggccaacactttc

SEQ ID NO: 41357 - DNA, 25 bp, Mus musculus
tgctgtgttggccaacactttccag

SEQ ID NO: 41358 - DNA, 25 bp, Mus musculus
ttcttttccagggctgacagcaggg

SEQ ID NO: 41359 - DNA, 25 bp, Mus musculus
ttttccagggctgacagcagggctt

SEQ ID NO: 41360 - DNA, 25 bp, Mus musculus
gacagcagggcttggggtagtcttt

SEQ ID NO: 41361 - DNA, 25 bp, Mus musculus
tagagccgagactgggacaggactc

SEQ ID NO: 41362 - DNA, 25 bp, Mus musculus
tttgacttctctctcagtagatgag

SEQ ID NO: 41363 - DNA, 25 bp, Mus musculus
gacttctctctcagtagatgaggga

SEQ ID NO: 41364 - DNA, 25 bp, Mus musculus
gtagacatgacctccaggcactggg

SEQ ID NO: 41365 - DNA, 25 bp, Mus musculus
tccctcctgcagcctagttagacca

SEQ ID NO: 41366 - DNA, 25 bp, Mus musculus
ctcctgcagcctagttagaccacac

SEQ ID NO: 41367 - DNA, 25 bp, Mus musculus
ctgcagcctagttagaccacacaga

SEQ ID NO: 41368 - DNA, 25 bp, Mus musculus
ggccaacactttccagggtgccgct

SEQ ID NO: 41369 - DNA, 25 bp, Mus musculus
caacactttccagggtgccgctgta

SEQ ID NO: 41370 - DNA, 25 bp, Mus musculus
ctccctggcagccagcagctgtata

SEQ ID NO: 41371 - DNA, 25 bp, Mus musculus
cctggcagccagcagctgtatattt

SEQ ID NO: 41372 - DNA, 25 bp, Mus musculus
agccagcagctgtatatttgacaaa

SEQ ID NO: 41373 - DNA, 25 bp, Mus musculus
tggattgcccttgcactttacctgt

SEQ ID NO: 41374 - DNA, 25 bp, Mus musculus
attgcccttgcactttacctgttct

SEQ ID NO: 41375 - DNA, 25 bp, Mus musculus
tacctgttcttttccagggctgaca

SEQ ID NO: 41376 - DNA, 25 bp, Mus musculus
tcactggcggttcaggtcgaagaac

SEQ ID NO: 41377 - DNA, 25 bp, Mus musculus
agctgactgcgcatctctctggggt

SEQ ID NO: 41378 - DNA, 25 bp, Mus musculus
ctctagaagatcctgcttgtgtaag

SEQ ID NO: 41379 - DNA, 25 bp, Mus musculus
tagaagatcctgcttgtgtaagaac

SEQ ID NO: 41380 - DNA, 25 bp, Mus musculus
atcctgcttgtgtaagaacagagtc

SEQ ID NO: 41381 - DNA, 25 bp, Mus musculus
tgctttgctcgccaccatgcaggac

SEQ ID NO: 41382 - DNA, 25 bp, Mus musculus
catgcaggactcattgtctgactcg

SEQ ID NO: 41383 - DNA, 25 bp, Mus musculus
ctcattgtctgactcgacaagaact

SEQ ID NO: 41384 - DNA, 25 bp, Mus musculus
attgtctgactcgacaagaacttga

SEQ ID NO: 41385 - DNA, 25 bp, Mus musculus
gtctgactcgacaagaacttgatca

SEQ ID NO: 41386 - DNA, 25 bp, Mus musculus
ttgatcatatgcgctaagcgctact

SEQ ID NO: 41387 - DNA, 25 bp, Mus musculus
atatgcgctaagcgctactagatac

SEQ ID NO: 41388 - DNA, 25 bp, Mus musculus
tgactgcgcatctctctggggtcca

SEQ ID NO: 41389 - DNA, 25 bp, Mus musculus
atctctctggggtccatcatattct

SEQ ID NO: 41390 - DNA, 25 bp, Mus musculus
tctctggggtccatcatattctggg

SEQ ID NO: 41391 - DNA, 25 bp, Mus musculus
ctggggtccatcatattctgggaag

SEQ ID NO: 41392 - DNA, 25 bp, Mus musculus
tccatcatattctgggaagtagtcg

SEQ ID NO: 41393 - DNA, 25 bp, Mus musculus
atacatgagtagctcctctagaaga

SEQ ID NO: 41394 - DNA, 25 bp, Mus musculus
catgagtagctcctctagaagatcc

SEQ ID NO: 41395 - DNA, 25 bp, Mus musculus
ctcctctagaagatcctgcttgtgt

SEQ ID NO: 41396 - DNA, 25 bp, Mus musculus
gagcttccgcattttgctgggaaat

SEQ ID NO: 41397 - DNA, 25 bp, Mus musculus
cttccgcattttgctgggaaatact

SEQ ID NO: 41398 - DNA, 25 bp, Mus musculus
gatttcagtgaccttcagcgagaca

SEQ ID NO: 41399 - DNA, 25 bp, Mus musculus
ttcagtgaccttcagcgagacacga

SEQ ID NO: 41400 - DNA, 25 bp, Mus musculus
agtgaccttcagcgagacacgagaa

SEQ ID NO: 41401 - DNA, 25 bp, Mus musculus
gaccttcagcgagacacgagaaaag

SEQ ID NO: 41402 - DNA, 25 bp, Mus musculus
ggtcttggagtctgttctgtcctcc

SEQ ID NO: 41403 - DNA, 25 bp, Mus musculus
cttggagtctgttctgtcctcccag

SEQ ID NO: 41404 - DNA, 25 bp, Mus musculus
gccctcagtaggagcacgtattaat

SEQ ID NO: 41405 - DNA, 25 bp, Mus musculus
tgctactaatgatcatcttgaaaaa

SEQ ID NO: 41406 - DNA, 25 bp, Mus musculus
ttaatcagatagcttcagggggatt

SEQ ID NO: 41407 - DNA, 25 bp, Mus musculus
atcagatagcttcagggggattcta

SEQ ID NO: 41408 - DNA, 25 bp, Mus musculus
tacttgactttgcaaactcattttg

SEQ ID NO: 41409 - DNA, 25 bp, Mus musculus
actttgcaaactcattttgtgatat

SEQ ID NO: 41410 - DNA, 25 bp, Mus musculus
ttgcaaactcattttgtgatataaa

SEQ ID NO: 41411 - DNA, 25 bp, Mus musculus
accataagcatagcatcgctgtctt

SEQ ID NO: 41412 - DNA, 25 bp, Mus musculus
ataagcatagcatcgctgtcttttt

SEQ ID NO: 41413 - DNA, 25 bp, Mus musculus
ttgttgccttttgatttcagtgacc

SEQ ID NO: 41414 - DNA, 25 bp, Mus musculus
ttgccttttgatttcagtgaccttc

SEQ ID NO: 41415 - DNA, 25 bp, Mus musculus
ccttttgatttcagtgaccttcagc

SEQ ID NO: 41416 - DNA, 25 bp, Mus musculus
gggacccacaagcgcaaactcagtg

SEQ ID NO: 41417 - DNA, 25 bp, Mus musculus
acccacaagcgcaaactcagtgcct

SEQ ID NO: 41418 - DNA, 25 bp, Mus musculus
agcgctcaggttccagctacggtca

SEQ ID NO: 41419 - DNA, 25 bp, Mus musculus
gctcaggttccagctacggtcatcc

SEQ ID NO: 41420 - DNA, 25 bp, Mus musculus
gttccagctacggtcatccagtgcc

SEQ ID NO: 41421 - DNA, 25 bp, Mus musculus
ccagctacggtcatccagtgccata

SEQ ID NO: 41422 - DNA, 25 bp, Mus musculus
gctacggtcatccagtgccataact

SEQ ID NO: 41423 - DNA, 25 bp, Mus musculus
acggtcatccagtgccataactttt

SEQ ID NO: 41424 - DNA, 25 bp, Mus musculus
ggtcatccagtgccataacttttaa

SEQ ID NO: 41425 - DNA, 25 bp, Mus musculus
gtcatccagtgccataacttttaaa

SEQ ID NO: 41426 - DNA, 25 bp, Mus musculus
tccagtgccataacttttaaaggat

SEQ ID NO: 41427 - DNA, 25 bp, Mus musculus
cagtgccataacttttaaaggatat

SEQ ID NO: 41428 - DNA, 25 bp, Mus musculus
cacaagcgcaaactcagtgcctagc

SEQ ID NO: 41429 - DNA, 25 bp, Mus musculus
gccagactctcgcccagagggcttg

SEQ ID NO: 41430 - DNA, 25 bp, Mus musculus
agactctcgcccagagggcttgggc

SEQ ID NO: 41431 - DNA, 25 bp, Mus musculus
ctctcgcccagagggcttgggccca

SEQ ID NO: 41432 - DNA, 25 bp, Mus musculus
gatgcggacgccatgctaaaagcca

SEQ ID NO: 41433 - DNA, 25 bp, Mus musculus
gacgccatgctaaaagccaaaatgg

SEQ ID NO: 41434 - DNA, 25 bp, Mus musculus
gccaaaatggctgccccaaggatgc

SEQ ID NO: 41435 - DNA, 25 bp, Mus musculus
atggctgccccaaggatgcccgcag

SEQ ID NO: 41436 - DNA, 25 bp, Mus musculus
gcagcgacggtcttgtgtgttgcag

SEQ ID NO: 41437 - DNA, 25 bp, Mus musculus
cagcgacggtcttgtgtgttgcaga

SEQ ID NO: 41438 - DNA, 25 bp, Mus musculus
tttagaagcggcacgagcggtcaag

SEQ ID NO: 41439 - DNA, 25 bp, Mus musculus
ttagaagcggcacgagcggtcaaga

SEQ ID NO: 41440 - DNA, 25 bp, Mus musculus
agaagcggcacgagcggtcaagatg

SEQ ID NO: 41441 - DNA, 25 bp, Mus musculus
aagcggcacgagcggtcaagatgat

SEQ ID NO: 41442 - DNA, 25 bp, Mus musculus
agcggcacgagcggtcaagatgatg

SEQ ID NO: 41443 - DNA, 25 bp, Mus musculus
cggcacgagcggtcaagatgatgaa

SEQ ID NO: 41444 - DNA, 25 bp, Mus musculus
agcgacggtcttgtgtgttgcagag

SEQ ID NO: 41445 - DNA, 25 bp, Mus musculus
ggctcctagtcgccgcggtcctgaa

SEQ ID NO: 41446 - DNA, 25 bp, Mus musculus
tcctagtcgccgcggtcctgaacct

SEQ ID NO: 41447 - DNA, 25 bp, Mus musculus
agatgtgccgggtatatttggggat

SEQ ID NO: 41448 - DNA, 25 bp, Mus musculus
atgtgccgggtatatttggggatga

SEQ ID NO: 41449 - DNA, 25 bp, Mus musculus
tgtgccgggtatatttggggatgaa

SEQ ID NO: 41450 - DNA, 25 bp, Mus musculus
cttttagaagcggcacgagcggtca

SEQ ID NO: 41451 - DNA, 25 bp, Mus musculus
ttttagaagcggcacgagcggtcaa

SEQ ID NO: 41452 - DNA, 25 bp, Mus musculus
gttatctgctcaggtatcaaggatg

SEQ ID NO: 41453 - DNA, 25 bp, Mus musculus
ttatctgctcaggtatcaaggatgc

SEQ ID NO: 41454 - DNA, 25 bp, Mus musculus
tcattgcctgaggatgccatttgcg

SEQ ID NO: 41455 - DNA, 25 bp, Mus musculus
attgcctgaggatgccatttgcgtt

SEQ ID NO: 41456 - DNA, 25 bp, Mus musculus
ttgcctgaggatgccatttgcgtta

SEQ ID NO: 41457 - DNA, 25 bp, Mus musculus
gatgccatttgcgttagttctagtc

SEQ ID NO: 41458 - DNA, 25 bp, Mus musculus
tgccatttgcgttagttctagtcgt

SEQ ID NO: 41459 - DNA, 25 bp, Mus musculus
gccatttgcgttagttctagtcgtg

SEQ ID NO: 41460 - DNA, 25 bp, Mus musculus
ttgcgttagttctagtcgtgcagaa

SEQ ID NO: 41461 - DNA, 25 bp, Mus musculus
tgcgttagttctagtcgtgcagaat

SEQ ID NO: 41462 - DNA, 25 bp, Mus musculus
cgttagttctagtcgtgcagaatgt

SEQ ID NO: 41463 - DNA, 25 bp, Mus musculus
gttagttctagtcgtgcagaatgtt

SEQ ID NO: 41464 - DNA, 25 bp, Mus musculus
atctgctcaggtatcaaggatgcct

SEQ ID NO: 41465 - DNA, 25 bp, Mus musculus
ttagttctagtcgtgcagaatgttc

SEQ ID NO: 41466 - DNA, 25 bp, Mus musculus
tctgctcaggtatcaaggatgcctt

SEQ ID NO: 41467 - DNA, 25 bp, Mus musculus
atcaaggatgccttcaaactctttt

SEQ ID NO: 41468 - DNA, 25 bp, Mus musculus
aggatgccttcaaactcttttccag

SEQ ID NO: 41469 - DNA, 25 bp, Mus musculus
gatgccttcaaactcttttccagta

SEQ ID NO: 41470 - DNA, 25 bp, Mus musculus
gcagaatcattgcctgaggatgcca

SEQ ID NO: 41471 - DNA, 25 bp, Mus musculus
agaatcattgcctgaggatgccatt

SEQ ID NO: 41472 - DNA, 25 bp, Mus musculus
atcattgcctgaggatgccatttgc

SEQ ID NO: 41473 - DNA, 25 bp, Mus musculus
gctcgagcacttttaggccaacatt

SEQ ID NO: 41474 - DNA, 25 bp, Mus musculus
gagatttcccaccagaaccttgtag

SEQ ID NO: 41475 - DNA, 25 bp, Mus musculus
aaccttgtagcacgtgtgagagcat

SEQ ID NO: 41476 - DNA, 25 bp, Mus musculus
aagactctggagctgagctacaagg

SEQ ID NO: 41477 - DNA, 25 bp, Mus musculus
tgtagcaaggtctcaacggatcggc

SEQ ID NO: 41478 - DNA, 25 bp, Mus musculus
agcaaggtctcaacggatcggcaca

SEQ ID NO: 41479 - DNA, 25 bp, Mus musculus
tctgagtaccagaaaccaccaacaa

SEQ ID NO: 41480 - DNA, 25 bp, Mus musculus
ctgagtaccagaaaccaccaacaag

SEQ ID NO: 41481 - DNA, 25 bp, Mus musculus
tgagtaccagaaaccaccaacaaga

SEQ ID NO: 41482 - DNA, 25 bp, Mus musculus
gagtaccagaaaccaccaacaagag

SEQ ID NO: 41483 - DNA, 25 bp, Mus musculus
taccagaaaccaccaacaagagcct

SEQ ID NO: 41484 - DNA, 25 bp, Mus musculus
agagcctaaagacaacacttgaaga

SEQ ID NO: 41485 - DNA, 25 bp, Mus musculus
ttcccaccagaaccttgtagcacgt

SEQ ID NO: 41486 - DNA, 25 bp, Mus musculus
tcccaccagaaccttgtagcacgtg

SEQ ID NO: 41487 - DNA, 25 bp, Mus musculus
cccaccagaaccttgtagcacgtgt

SEQ ID NO: 41488 - DNA, 25 bp, Mus musculus
ccaccagaaccttgtagcacgtgtg

SEQ ID NO: 41489 - DNA, 25 bp, Mus musculus
accagaaccttgtagcacgtgtgag

SEQ ID NO: 41490 - DNA, 25 bp, Mus musculus
ccagaaccttgtagcacgtgtgaga

SEQ ID NO: 41491 - DNA, 25 bp, Mus musculus
cagaaccttgtagcacgtgtgagag

SEQ ID NO: 41492 - DNA, 25 bp, Mus musculus
agaaccttgtagcacgtgtgagagc

SEQ ID NO: 41493 - DNA, 25 bp, Mus musculus
ttactgtttttctgtgaagcacata

SEQ ID NO: 41494 - DNA, 25 bp, Mus musculus
agttgctccagtcactccctctata

SEQ ID NO: 41495 - DNA, 25 bp, Mus musculus
tggacaagtgccactgcatcatagt

SEQ ID NO: 41496 - DNA, 25 bp, Mus musculus
agtgccactgcatcatagtatgctc

SEQ ID NO: 41497 - DNA, 25 bp, Mus musculus
actgcatcatagtatgctcggagaa

SEQ ID NO: 41498 - DNA, 25 bp, Mus musculus
aatttactgttgccactgccaggtc

SEQ ID NO: 41499 - DNA, 25 bp, Mus musculus
ctgttgccactgccaggtcacactg

SEQ ID NO: 41500 - DNA, 25 bp, Mus musculus
ccactgccaggtcacactggtgttt

SEQ ID NO: 41501 - DNA, 25 bp, Mus musculus
aatactgggtgcttcatataggaac

SEQ ID NO: 41502 - DNA, 25 bp, Mus musculus
taaaccattcaacctgtgattggtg

SEQ ID NO: 41503 - DNA, 25 bp, Mus musculus
attcaacctgtgattggtgatgttt

SEQ ID NO: 41504 - DNA, 25 bp, Mus musculus
gatgttttcctgtcattttaagagt

SEQ ID NO: 41505 - DNA, 25 bp, Mus musculus
cactccctctatagccatactgtct

SEQ ID NO: 41506 - DNA, 25 bp, Mus musculus
agccatactgtcttgttttctgtaa

SEQ ID NO: 41507 - DNA, 25 bp, Mus musculus
actgtcttgttttctgtaactcagg

SEQ ID NO: 41508 - DNA, 25 bp, Mus musculus
tctctattctctgctgcagaaaagg

SEQ ID NO: 41509 - DNA, 25 bp, Mus musculus
gatagacctcagccaaactggctgg

SEQ ID NO: 41510 - DNA, 25 bp, Mus musculus
cctcagccaaactggctgggttttg

SEQ ID NO: 41511 - DNA, 25 bp, Mus musculus
tcatgttctttcttcccttgaaggg

SEQ ID NO: 41512 - DNA, 25 bp, Mus musculus
tggtaccagttctggacaagtgcca

SEQ ID NO: 41513 - DNA, 25 bp, Mus musculus
cttcatggaccactctgtagctttc

SEQ ID NO: 41514 - DNA, 25 bp, Mus musculus
catggaccactctgtagctttcagg

SEQ ID NO: 41515 - DNA, 25 bp, Mus musculus
agtccatcacttcactaaggtggag

SEQ ID NO: 41516 - DNA, 25 bp, Mus musculus
ccatcacttcactaaggtggagatg

SEQ ID NO: 41517 - DNA, 25 bp, Mus musculus
cttcactaaggtggagatgtttggg

SEQ ID NO: 41518 - DNA, 25 bp, Mus musculus
gactcgcagctgttggatgagtcct

SEQ ID NO: 41519 - DNA, 25 bp, Mus musculus
agatcttgacggagctgggcttgac

SEQ ID NO: 41520 - DNA, 25 bp, Mus musculus
tgacttccgggtactggacatgcca

SEQ ID NO: 41521 - DNA, 25 bp, Mus musculus
cttccgggtactggacatgccacca

SEQ ID NO: 41522 - DNA, 25 bp, Mus musculus
actggacatgccaccagaactggcc

SEQ ID NO: 41523 - DNA, 25 bp, Mus musculus
ggacatgccaccagaactggccttc

SEQ ID NO: 41524 - DNA, 25 bp, Mus musculus
catgccaccagaactggccttcctg

SEQ ID NO: 41525 - DNA, 25 bp, Mus musculus
ggaccactctgtagctttcagggac

SEQ ID NO: 41526 - DNA, 25 bp, Mus musculus
ctctgtagctttcagggaccttcca

SEQ ID NO: 41527 - DNA, 25 bp, Mus musculus
cagggaccttccagtcaggatggtc

SEQ ID NO: 41528 - DNA, 25 bp, Mus musculus
ggaccttccagtcaggatggtctgt

SEQ ID NO: 41529 - DNA, 25 bp, Mus musculus
ctgtgccagcacctgctaccgggca

SEQ ID NO: 41530 - DNA, 25 bp, Mus musculus
tgccagcacctgctaccgggcagag

SEQ ID NO: 41531 - DNA, 25 bp, Mus musculus
cagcacctgctaccgggcagagaca

SEQ ID NO: 41532 - DNA, 25 bp, Mus musculus
ctgctaccgggcagagacagacact

SEQ ID NO: 41533 - DNA, 25 bp, Mus musculus
atgtaatgccacgaactccattggc

SEQ ID NO: 41534 - DNA, 25 bp, Mus musculus
gtaatgccacgaactccattggctc

SEQ ID NO: 41535 - DNA, 25 bp, Mus musculus
gaaatcatcatccttgtggtgatca

SEQ ID NO: 41536 - DNA, 25 bp, Mus musculus
atgatgaaccagctgggccaatgaa

SEQ ID NO: 41537 - DNA, 25 bp, Mus musculus
gatgaaccagctgggccaatgaaaa

SEQ ID NO: 41538 - DNA, 25 bp, Mus musculus
tgaaccagctgggccaatgaaaacc

SEQ ID NO: 41539 - DNA, 25 bp, Mus musculus
caactctaccaacaatcacaaagat

SEQ ID NO: 41540 - DNA, 25 bp, Mus musculus
actctaccaacaatcacaaagatca

SEQ ID NO: 41541 - DNA, 25 bp, Mus musculus
tctaccaacaatcacaaagatcaga

SEQ ID NO: 41542 - DNA, 25 bp, Mus musculus
atcacaaagatcagaacttgcgcca

SEQ ID NO: 41543 - DNA, 25 bp, Mus musculus
aagatcagaacttgcgccagagaga

SEQ ID NO: 41544 - DNA, 25 bp, Mus musculus
gatcagaacttgcgccagagagaca

SEQ ID NO: 41545 - DNA, 25 bp, Mus musculus
aatgccacgaactccattggctctg

SEQ ID NO: 41546 - DNA, 25 bp, Mus musculus
ccacgaactccattggctctgcgtt

SEQ ID NO: 41547 - DNA, 25 bp, Mus musculus
acgaactccattggctctgcgttcg

SEQ ID NO: 41548 - DNA, 25 bp, Mus musculus
gaactccattggctctgcgttcgtt

SEQ ID NO: 41549 - DNA, 25 bp, Mus musculus
actccattggctctgcgttcgtttc

SEQ ID NO: 41550 - DNA, 25 bp, Mus musculus
ttcttgggaattctggctgaaatca

SEQ ID NO: 41551 - DNA, 25 bp, Mus musculus
aattctggctgaaatcatcatcctt

SEQ ID NO: 41552 - DNA, 25 bp, Mus musculus
ctgaaatcatcatccttgtggtgat

SEQ ID NO: 41553 - DNA, 25 bp, Mus musculus
cataaccccagtccgtggatctctg

SEQ ID NO: 41554 - DNA, 25 bp, Mus musculus
taaccccagtccgtggatctctgga

SEQ ID NO: 41555 - DNA, 25 bp, Mus musculus
aactgcgtcgctaggatgaagctcg

SEQ ID NO: 41556 - DNA, 25 bp, Mus musculus
atgggacacaagtccatggaacaat

SEQ ID NO: 41557 - DNA, 25 bp, Mus musculus
cacaagtccatggaacaatcacagg

SEQ ID NO: 41558 - DNA, 25 bp, Mus musculus
acaatcacaggtgtagatgtcagca

SEQ ID NO: 41559 - DNA, 25 bp, Mus musculus
atgtcagcatgaacacacaccttaa

SEQ ID NO: 41560 - DNA, 25 bp, Mus musculus
gtcagcatgaacacacaccttaaag

SEQ ID NO: 41561 - DNA, 25 bp, Mus musculus
gcatgaacacacaccttaaagctgt

SEQ ID NO: 41562 - DNA, 25 bp, Mus musculus
atgaacacacaccttaaagctgtga

SEQ ID NO: 41563 - DNA, 25 bp, Mus musculus
acacacaccttaaagctgtgaaaat

SEQ ID NO: 41564 - DNA, 25 bp, Mus musculus
acacaccttaaagctgtgaaaatga

SEQ ID NO: 41565 - DNA, 25 bp, Mus musculus
ccgtggatctctggagcctgaattc

SEQ ID NO: 41566 - DNA, 25 bp, Mus musculus
gtggatctctggagcctgaattctg

SEQ ID NO: 41567 - DNA, 25 bp, Mus musculus
atctctggagcctgaattctgtgaa

SEQ ID NO: 41568 - DNA, 25 bp, Mus musculus
agcctgaattctgtgaacagtcggg

SEQ ID NO: 41569 - DNA, 25 bp, Mus musculus
tgaattctgtgaacagtcgggccag

SEQ ID NO: 41570 - DNA, 25 bp, Mus musculus
aattctgtgaacagtcgggccagaa

SEQ ID NO: 41571 - DNA, 25 bp, Mus musculus
ctgtgaacagtcgggccagaaggga

SEQ ID NO: 41572 - DNA, 25 bp, Mus musculus
acagtcgggccagaagggagaactg

SEQ ID NO: 41573 - DNA, 25 bp, Mus musculus
ttcattcgaccattctacaagatga

SEQ ID NO: 41574 - DNA, 25 bp, Mus musculus
attcgaccattctacaagatgatgc

SEQ ID NO: 41575 - DNA, 25 bp, Mus musculus
gaacttgacctcatgttctgcatag

SEQ ID NO: 41576 - DNA, 25 bp, Mus musculus
cttgacctcatgttctgcatagacg

SEQ ID NO: 41577 - DNA, 25 bp, Mus musculus
gacctcatgttctgcatagacgaag

SEQ ID NO: 41578 - DNA, 25 bp, Mus musculus
ctcatgttctgcatagacgaagaga

SEQ ID NO: 41579 - DNA, 25 bp, Mus musculus
atgttctgcatagacgaagagaact

SEQ ID NO: 41580 - DNA, 25 bp, Mus musculus
acataccaagtggatctgaagccca

SEQ ID NO: 41581 - DNA, 25 bp, Mus musculus
tacattgacttagtcatccagtgga

SEQ ID NO: 41582 - DNA, 25 bp, Mus musculus
attgacttagtcatccagtggagat

SEQ ID NO: 41583 - DNA, 25 bp, Mus musculus
gacttagtcatccagtggagatttg

SEQ ID NO: 41584 - DNA, 25 bp, Mus musculus
ttagtcatccagtggagatttgtga

SEQ ID NO: 41585 - DNA, 25 bp, Mus musculus
cgaccattctacaagatgatgctgg

SEQ ID NO: 41586 - DNA, 25 bp, Mus musculus
ccattctacaagatgatgctgggga

SEQ ID NO: 41587 - DNA, 25 bp, Mus musculus
ttctacaagatgatgctggggaagc

SEQ ID NO: 41588 - DNA, 25 bp, Mus musculus
atggagtccgtggacagcgagtact

SEQ ID NO: 41589 - DNA, 25 bp, Mus musculus
agcgagtactacaactctttgaagt

SEQ ID NO: 41590 - DNA, 25 bp, Mus musculus
gaccccacggaacttgacctcatgt

SEQ ID NO: 41591 - DNA, 25 bp, Mus musculus
cccacggaacttgacctcatgttct

SEQ ID NO: 41592 - DNA, 25 bp, Mus musculus
acggaacttgacctcatgttctgca

SEQ ID NO: 41593 - DNA, 25 bp, Mus musculus
ccccgcagccaggtctatgaagacc

SEQ ID NO: 41594 - DNA, 25 bp, Mus musculus
agctggttccaggcttgaactcctg

SEQ ID NO: 41595 - DNA, 25 bp, Mus musculus
tgcccatggctggagctgggaccct

SEQ ID NO: 41596 - DNA, 25 bp, Mus musculus
tggctggagctgggaccctacactt

SEQ ID NO: 41597 - DNA, 25 bp, Mus musculus
ggaccctacacttctatagtcaagg

SEQ ID NO: 41598 - DNA, 25 bp, Mus musculus
gtgcttagcctcaaggttgcagatg

SEQ ID NO: 41599 - DNA, 25 bp, Mus musculus
agcctcaaggttgcagatgcaccct

SEQ ID NO: 41600 - DNA, 25 bp, Mus musculus
gcagatgcaccctctagtactctgg

SEQ ID NO: 41601 - DNA, 25 bp, Mus musculus
gcaccctctagtactctgggtgcag

SEQ ID NO: 41602 - DNA, 25 bp, Mus musculus
tctagtactctgggtgcagactgta

SEQ ID NO: 41603 - DNA, 25 bp, Mus musculus
actctgggtgcagactgtacactgg

SEQ ID NO: 41604 - DNA, 25 bp, Mus musculus
atgattctgggcttttgacaccaca

SEQ ID NO: 41605 - DNA, 25 bp, Mus musculus
ccaaagagctgggcatccaggcttt

SEQ ID NO: 41606 - DNA, 25 bp, Mus musculus
agctgggcatccaggcttttggtca

SEQ ID NO: 41607 - DNA, 25 bp, Mus musculus
gcatccaggcttttggtcaccatgg

SEQ ID NO: 41608 - DNA, 25 bp, Mus musculus
aggcttttggtcaccatggcactac

SEQ ID NO: 41609 - DNA, 25 bp, Mus musculus
ggcttttcctgttcagtgagcagga

SEQ ID NO: 41610 - DNA, 25 bp, Mus musculus
tcctgttcagtgagcaggaattcag

SEQ ID NO: 41611 - DNA, 25 bp, Mus musculus
tccctgacttaccttgacccatggc

SEQ ID NO: 41612 - DNA, 25 bp, Mus musculus
ctgaaggctccatgcccatggctgg

SEQ ID NO: 41613 - DNA, 25 bp, Mus musculus
gccagaggacccttcactattagag

SEQ ID NO: 41614 - DNA, 25 bp, Mus musculus
gattgccgccaagcacgagaaaacc

SEQ ID NO: 41615 - DNA, 25 bp, Mus musculus
tgtttaagcccagcctgcctgacat

SEQ ID NO: 41616 - DNA, 25 bp, Mus musculus
tcctgctataggcaaggctgtgttt

SEQ ID NO: 41617 - DNA, 25 bp, Mus musculus
cccacgctgaaccagggacagactg

SEQ ID NO: 41618 - DNA, 25 bp, Mus musculus
cagactgttgcgagcaaatgcgact

SEQ ID NO: 41619 - DNA, 25 bp, Mus musculus
agcaaatgcgactcggagaagcgaa

SEQ ID NO: 41620 - DNA, 25 bp, Mus musculus
aagcgaacggacatctccttcacta

SEQ ID NO: 41621 - DNA, 25 bp, Mus musculus
atctccttcactaatttgacctgac

SEQ ID NO: 41622 - DNA, 25 bp, Mus musculus
ttcactaatttgacctgaccggatg

SEQ ID NO: 41623 - DNA, 25 bp, Mus musculus
gtttgtcaacaaccaggaactctgg

SEQ ID NO: 41624 - DNA, 25 bp, Mus musculus
caacaaccaggaactctggtaacat

SEQ ID NO: 41625 - DNA, 25 bp, Mus musculus
tctgattcggtttcacatccagagg

SEQ ID NO: 41626 - DNA, 25 bp, Mus musculus
gccatcacgtatacaggagaacatt

SEQ ID NO: 41627 - DNA, 25 bp, Mus musculus
ggccactatccttagcttcaacaga

SEQ ID NO: 41628 - DNA, 25 bp, Mus musculus
tatccttagcttcaacagaaactgg

SEQ ID NO: 41629 - DNA, 25 bp, Mus musculus
ctgagtcagcccacgaggcttcctt

SEQ ID NO: 41630 - DNA, 25 bp, Mus musculus
tcctctttgctgatgcacacttccc

SEQ ID NO: 41631 - DNA, 25 bp, Mus musculus
ttgctgatgcacacttccctcctgg

SEQ ID NO: 41632 - DNA, 25 bp, Mus musculus
gagtcctgtttaagcccagcctgcc

SEQ ID NO: 41633 - DNA, 25 bp, Mus musculus
gcctgaatctctggctgactacatc

SEQ ID NO: 41634 - DNA, 25 bp, Mus musculus
ctacatcaccgcagcatatgtggag

SEQ ID NO: 41635 - DNA, 25 bp, Mus musculus
ctgcatatctcgtggcttcacacca

SEQ ID NO: 41636 - DNA, 25 bp, Mus musculus
tggcttcacaccagcccagttccag

SEQ ID NO: 41637 - DNA, 25 bp, Mus musculus
agcccagttccaggcagctctggat

SEQ ID NO: 41638 - DNA, 25 bp, Mus musculus
gttccaggcagctctggatgaatat

SEQ ID NO: 41639 - DNA, 25 bp, Mus musculus
taatacttctcggacacggatcacc

SEQ ID NO: 41640 - DNA, 25 bp, Mus musculus
ttctcggacacggatcacctttgtc

SEQ ID NO: 41641 - DNA, 25 bp, Mus musculus
gacacggatcacctttgtctgatag

SEQ ID NO: 41642 - DNA, 25 bp, Mus musculus
ctttgtctgatagccagtttttaca

SEQ ID NO: 41643 - DNA, 25 bp, Mus musculus
ctgcctacaccagagggcatgctga

SEQ ID NO: 41644 - DNA, 25 bp, Mus musculus
aatctcattctcccatgctgcactt

SEQ ID NO: 41645 - DNA, 25 bp, Mus musculus
caccgcagcatatgtggagatgagg

SEQ ID NO: 41646 - DNA, 25 bp, Mus musculus
ctatacttctgcccggaccctgctg

SEQ ID NO: 41647 - DNA, 25 bp, Mus musculus
ggccattctccgactttccactgct

SEQ ID NO: 41648 - DNA, 25 bp, Mus musculus
tctccgactttccactgctctggct

SEQ ID NO: 41649 - DNA, 25 bp, Mus musculus
acagacagctaggacccagaggcca

SEQ ID NO: 41650 - DNA, 25 bp, Mus musculus
atttgccaccatccgtgaattggtg

SEQ ID NO: 41651 - DNA, 25 bp, Mus musculus
caccatccgtgaattggtgtcacgg

SEQ ID NO: 41652 - DNA, 25 bp, Mus musculus
acagcgctgcatatctcgtggcttc

SEQ ID NO: 41653 - DNA, 25 bp, Mus musculus
cactactgtagttgtggtcctcctt

SEQ ID NO: 41654 - DNA, 25 bp, Mus musculus
tactgtagttgtggtcctccttcgg

SEQ ID NO: 41655 - DNA, 25 bp, Mus musculus
tattccttatggctgccgtcatccc

SEQ ID NO: 41656 - DNA, 25 bp, Mus musculus
tccttatggctgccgtcatcccaat

SEQ ID NO: 41657 - DNA, 25 bp, Mus musculus
tggctgccgtcatcccaatgggagt

SEQ ID NO: 41658 - DNA, 25 bp, Mus musculus
ctgccgtcatcccaatgggagtgat

SEQ ID NO: 41659 - DNA, 25 bp, Mus musculus
tgattggtaacggccggacaccagg

SEQ ID NO: 41660 - DNA, 25 bp, Mus musculus
gaaacagccctcgactcagaaccct

SEQ ID NO: 41661 - DNA, 25 bp, Mus musculus
tcgctccattttgtatcactcctgg

SEQ ID NO: 41662 - DNA, 25 bp, Mus musculus
ctccattttgtatcactcctggaga

SEQ ID NO: 41663 - DNA, 25 bp, Mus musculus
cattttgtatcactcctggagaaac

SEQ ID NO: 41664 - DNA, 25 bp, Mus musculus
gtatcactcctggagaaacttgcag

SEQ ID NO: 41665 - DNA, 25 bp, Mus musculus
ccttcggatcgccactgaccactgg

SEQ ID NO: 41666 - DNA, 25 bp, Mus musculus
tcggatcgccactgaccactgggga

SEQ ID NO: 41667 - DNA, 25 bp, Mus musculus
gatcgccactgaccactggggagcc

SEQ ID NO: 41668 - DNA, 25 bp, Mus musculus
cactgaccactggggagccacatgg

SEQ ID NO: 41669 - DNA, 25 bp, Mus musculus
cagtccgcatcctgcaactggtgat

SEQ ID NO: 41670 - DNA, 25 bp, Mus musculus
tccgcatcctgcaactggtgatgct

SEQ ID NO: 41671 - DNA, 25 bp, Mus musculus
gcatcctgcaactggtgatgctatt

SEQ ID NO: 41672 - DNA, 25 bp, Mus musculus
tgctattccttatggctgccgtcat

SEQ ID NO: 41673 - DNA, 25 bp, Mus musculus
ctcaggcaacatcacccgctgcttt

SEQ ID NO: 41674 - DNA, 25 bp, Mus musculus
ttatgagccatacagtgtgcccatc

SEQ ID NO: 41675 - DNA, 25 bp, Mus musculus
gctgccctggaccctagcagagttg

SEQ ID NO: 41676 - DNA, 25 bp, Mus musculus
caacttccatcaggctattaatgat

SEQ ID NO: 41677 - DNA, 25 bp, Mus musculus
cctcagcaccaactgtgtcttagat

SEQ ID NO: 41678 - DNA, 25 bp, Mus musculus
gttttacagcatgcgcagtagccgg

SEQ ID NO: 41679 - DNA, 25 bp, Mus musculus
cagcatgcgcagtagccggaagtgc

SEQ ID NO: 41680 - DNA, 25 bp, Mus musculus
gaagtgctccagagccacgagtgac

SEQ ID NO: 41681 - DNA, 25 bp, Mus musculus
ctccagagccacgagtgacacgtgc

SEQ ID NO: 41682 - DNA, 25 bp, Mus musculus
agccacgagtgacacgtgcaccgag

SEQ ID NO: 41683 - DNA, 25 bp, Mus musculus
gagtgacacgtgcaccgaggtgata

SEQ ID NO: 41684 - DNA, 25 bp, Mus musculus
ccagactcctattgtgtcgctgaaa

SEQ ID NO: 41685 - DNA, 25 bp, Mus musculus
gccatacagtgtgcccatccttgtt

SEQ ID NO: 41686 - DNA, 25 bp, Mus musculus
gcccatccttgttgttcatgtcttc

SEQ ID NO: 41687 - DNA, 25 bp, Mus musculus
ccttgttgttcatgtcttcatcgcc

SEQ ID NO: 41688 - DNA, 25 bp, Mus musculus
cttctactgcaacttggtcatcatc

SEQ ID NO: 41689 - DNA, 25 bp, Mus musculus
ctgcaacttggtcatcatccacacg

SEQ ID NO: 41690 - DNA, 25 bp, Mus musculus
gctgctcacgcagcccatgaggcag

SEQ ID NO: 41691 - DNA, 25 bp, Mus musculus
ggtcttggcggtattcatcatctgt

SEQ ID NO: 41692 - DNA, 25 bp, Mus musculus
tcacgtggtccagctgccctggacc

SEQ ID NO: 41693 - DNA, 25 bp, Mus musculus
atggtcccctgagcacagccgactc

SEQ ID NO: 41694 - DNA, 25 bp, Mus musculus
ggtcccctgagcacagccgactctt

SEQ ID NO: 41695 - DNA, 25 bp, Mus musculus
acactcgttcagcaccgctgggtgg

SEQ ID NO: 41696 - DNA, 25 bp, Mus musculus
gatacgtgcacaagctgcacgccgc

SEQ ID NO: 41697 - DNA, 25 bp, Mus musculus
gcacaagctgcacgccgcgaacgca

SEQ ID NO: 41698 - DNA, 25 bp, Mus musculus
acaagctgcacgccgcgaacgcaga

SEQ ID NO: 41699 - DNA, 25 bp, Mus musculus
caagctgcacgccgcgaacgcagac

SEQ ID NO: 41700 - DNA, 25 bp, Mus musculus
agctgcacgccgcgaacgcagacga

SEQ ID NO: 41701 - DNA, 25 bp, Mus musculus
gcacgccgcgaacgcagacgagcac

SEQ ID NO: 41702 - DNA, 25 bp, Mus musculus
cgccgcgaacgcagacgagcacgag

SEQ ID NO: 41703 - DNA, 25 bp, Mus musculus
ccgcgaacgcagacgagcacgagac

SEQ ID NO: 41704 - DNA, 25 bp, Mus musculus
acttcagccgaacgctcaacagaca

SEQ ID NO: 41705 - DNA, 25 bp, Mus musculus
gcacagccgactcttcgatcaacca

SEQ ID NO: 41706 - DNA, 25 bp, Mus musculus
tcttcgatcaaccattcggggtaca

SEQ ID NO: 41707 - DNA, 25 bp, Mus musculus
acaccggttgcgcgatgagtggtca

SEQ ID NO: 41708 - DNA, 25 bp, Mus musculus
tgagtggtcacactcgttcagcacc

SEQ ID NO: 41709 - DNA, 25 bp, Mus musculus
agtggtcacactcgttcagcaccgc

SEQ ID NO: 41710 - DNA, 25 bp, Mus musculus
gtggtcacactcgttcagcaccgct

SEQ ID NO: 41711 - DNA, 25 bp, Mus musculus
ggtcacactcgttcagcaccgctgg

SEQ ID NO: 41712 - DNA, 25 bp, Mus musculus
cacactcgttcagcaccgctgggtg

SEQ ID NO: 41713 - DNA, 25 bp, Mus musculus
tctgcctggatgctgccatgttccc

SEQ ID NO: 41714 - DNA, 25 bp, Mus musculus
gcctggatgctgccatgttccctcc

SEQ ID NO: 41715 - DNA, 25 bp, Mus musculus
gagacctcaccagcactgatgcagt

SEQ ID NO: 41716 - DNA, 25 bp, Mus musculus
acctcaccagcactgatgcagtagg

SEQ ID NO: 41717 - DNA, 25 bp, Mus musculus
tcaccagcactgatgcagtaggagg

SEQ ID NO: 41718 - DNA, 25 bp, Mus musculus
catctcaggagatgggctggcaagg

SEQ ID NO: 41719 - DNA, 25 bp, Mus musculus
gccagagtggctgttgcagactgtg

SEQ ID NO: 41720 - DNA, 25 bp, Mus musculus
gtggctgttgcagactgtggcatct

SEQ ID NO: 41721 - DNA, 25 bp, Mus musculus
gactgtggcatctcaggccacagag

SEQ ID NO: 41722 - DNA, 25 bp, Mus musculus
tgtggcatctcaggccacagagaag

SEQ ID NO: 41723 - DNA, 25 bp, Mus musculus
catatttcagcagcagagtggtctc

SEQ ID NO: 41724 - DNA, 25 bp, Mus musculus
atttcagcagcagagtggtctccct

SEQ ID NO: 41725 - DNA, 25 bp, Mus musculus
atgctgccatgttccctccttgatg

SEQ ID NO: 41726 - DNA, 25 bp, Mus musculus
ctgccatgttccctccttgatgata

SEQ ID NO: 41727 - DNA, 25 bp, Mus musculus
ccatgttccctccttgatgataatg

SEQ ID NO: 41728 - DNA, 25 bp, Mus musculus
tccctccttgatgataatggactga

SEQ ID NO: 41729 - DNA, 25 bp, Mus musculus
ggactgaacctctgaacttgtggca

SEQ ID NO: 41730 - DNA, 25 bp, Mus musculus
aacctctgaacttgtggcagggctg

SEQ ID NO: 41731 - DNA, 25 bp, Mus musculus
ctctgaacttgtggcagggctgaga

SEQ ID NO: 41732 - DNA, 25 bp, Mus musculus
tgaacttgtggcagggctgagacct

SEQ ID NO: 41733 - DNA, 25 bp, Mus musculus
gcagcctgtactgcagagtgggcat

SEQ ID NO: 41734 - DNA, 25 bp, Mus musculus
tcggtttccatctgcagatctaccc

SEQ ID NO: 41735 - DNA, 25 bp, Mus musculus
cgatccacagaactgaaaagacagg

SEQ ID NO: 41736 - DNA, 25 bp, Mus musculus
tcctacccaggttcaagcagtccga

SEQ ID NO: 41737 - DNA, 25 bp, Mus musculus
ccaggttcaagcagtccgagcaacc

SEQ ID NO: 41738 - DNA, 25 bp, Mus musculus
tcaagcagtccgagcaaccggaact

SEQ ID NO: 41739 - DNA, 25 bp, Mus musculus
tcaccgtcactgttccagaaaagaa

SEQ ID NO: 41740 - DNA, 25 bp, Mus musculus
tgaaaccaaaggtgcccctgtcgca

SEQ ID NO: 41741 - DNA, 25 bp, Mus musculus
tgcccctgtcgcagcctcgcagaag

SEQ ID NO: 41742 - DNA, 25 bp, Mus musculus
tgtcgcagcctcgcagaagtcccag

SEQ ID NO: 41743 - DNA, 25 bp, Mus musculus
tgaagtttcgctttggatgatgctc

SEQ ID NO: 41744 - DNA, 25 bp, Mus musculus
ttcgctttggatgatgctcatcgtc

SEQ ID NO: 41745 - DNA, 25 bp, Mus musculus
tccatctgcagatctacccggatgg

SEQ ID NO: 41746 - DNA, 25 bp, Mus musculus
tgcagatctacccggatggcaaagt

SEQ ID NO: 41747 - DNA, 25 bp, Mus musculus
ctgtgtctcaggggattgtaggaat

SEQ ID NO: 41748 - DNA, 25 bp, Mus musculus
aactccatgcaagtgccaaatttac

SEQ ID NO: 41749 - DNA, 25 bp, Mus musculus
acagctataatacctatgcgtccgc

SEQ ID NO: 41750 - DNA, 25 bp, Mus musculus
ataatacctatgcgtccgcgatcca

SEQ ID NO: 41751 - DNA, 25 bp, Mus musculus
cctatgcgtccgcgatccacagaac

SEQ ID NO: 41752 - DNA, 25 bp, Mus musculus
cgtccgcgatccacagaactgaaaa

SEQ ID NO: 41753 - DNA, 25 bp, Mus musculus
ctccttagttttctcatagcactaa

SEQ ID NO: 41754 - DNA, 25 bp, Mus musculus
agttttctcatagcactaactaatc

SEQ ID NO: 41755 - DNA, 25 bp, Mus musculus
atgtactgtagtccttcagcgtcaa

SEQ ID NO: 41756 - DNA, 25 bp, Mus musculus
tgtagtccttcagcgtcaatgttca

SEQ ID NO: 41757 - DNA, 25 bp, Mus musculus
ccttcagcgtcaatgttcattgtca

SEQ ID NO: 41758 - DNA, 25 bp, Mus musculus
ctgatcatgcattgtcgaggtggtc

SEQ ID NO: 41759 - DNA, 25 bp, Mus musculus
atgcattgtcgaggtggtctgaatg

SEQ ID NO: 41760 - DNA, 25 bp, Mus musculus
taccctgaggtctttcgacatgtgg

SEQ ID NO: 41761 - DNA, 25 bp, Mus musculus
gaggtctttcgacatgtggaaagtg

SEQ ID NO: 41762 - DNA, 25 bp, Mus musculus
attgtttgcttattgttccaggaca

SEQ ID NO: 41763 - DNA, 25 bp, Mus musculus
tgcttattgttccaggacattgtca

SEQ ID NO: 41764 - DNA, 25 bp, Mus musculus
ttgttccaggacattgtcaataaaa

SEQ ID NO: 41765 - DNA, 25 bp, Mus musculus
ctcatagcactaactaatctgttgg

SEQ ID NO: 41766 - DNA, 25 bp, Mus musculus
gcactaactaatctgttgggttcat

SEQ ID NO: 41767 - DNA, 25 bp, Mus musculus
actaatctgttgggttcattattgg

SEQ ID NO: 41768 - DNA, 25 bp, Mus musculus
attgtatctagtgcagctgatttta

SEQ ID NO: 41769 - DNA, 25 bp, Mus musculus
acctactgtgttcctggcaatagcg

SEQ ID NO: 41770 - DNA, 25 bp, Mus musculus
tgtgttcctggcaatagcgtgttcc

SEQ ID NO: 41771 - DNA, 25 bp, Mus musculus
atagctatatccatgtactgtagtc

SEQ ID NO: 41772 - DNA, 25 bp, Mus musculus
atatccatgtactgtagtccttcag

SEQ ID NO: 41773 - DNA, 25 bp, Mus musculus
taccagtgtatgggctgttgcttct

SEQ ID NO: 41774 - DNA, 25 bp, Mus musculus
acaatgctggttccaaagaatatta

SEQ ID NO: 41775 - DNA, 25 bp, Mus musculus
ctgacggctgcggagccgagccatt

SEQ ID NO: 41776 - DNA, 25 bp, Mus musculus
agccattcaatggcgctgtgtgtca

SEQ ID NO: 41777 - DNA, 25 bp, Mus musculus
gacttctgacgcgcttcagttacac

SEQ ID NO: 41778 - DNA, 25 bp, Mus musculus
gcttcagttacacactgcctcttta

SEQ ID NO: 41779 - DNA, 25 bp, Mus musculus
acatcccttatacttcagtacaatc

SEQ ID NO: 41780 - DNA, 25 bp, Mus musculus
tacaatctgcagtctcttctcgtta

SEQ ID NO: 41781 - DNA, 25 bp, Mus musculus
ctgcagtctcttctcgttagggaaa

SEQ ID NO: 41782 - DNA, 25 bp, Mus musculus
tctcttctcgttagggaaatatgta

SEQ ID NO: 41783 - DNA, 25 bp, Mus musculus
gccttttaaatcatcaatcccgcag

SEQ ID NO: 41784 - DNA, 25 bp, Mus musculus
taaatcatcaatcccgcaggcactg

SEQ ID NO: 41785 - DNA, 25 bp, Mus musculus
gaggccacatgctgtgtggccaaag

SEQ ID NO: 41786 - DNA, 25 bp, Mus musculus
acatgctgtgtggccaaagcattta

SEQ ID NO: 41787 - DNA, 25 bp, Mus musculus
gcatttactaaggccacagtaatgg

SEQ ID NO: 41788 - DNA, 25 bp, Mus musculus
aatcatacggagtgccactgtagca

SEQ ID NO: 41789 - DNA, 25 bp, Mus musculus
tgccactgtagcacttgctactacc

SEQ ID NO: 41790 - DNA, 25 bp, Mus musculus
tgtagcacttgctactaccacaagt

SEQ ID NO: 41791 - DNA, 25 bp, Mus musculus
acttgctactaccacaagtcgtagc

SEQ ID NO: 41792 - DNA, 25 bp, Mus musculus
tactaccacaagtcgtagcttctga

SEQ ID NO: 41793 - DNA, 25 bp, Mus musculus
cgccctgtggagctcgtctgagaaa

SEQ ID NO: 41794 - DNA, 25 bp, Mus musculus
cctgtggagctcgtctgagaaaaat

SEQ ID NO: 41795 - DNA, 25 bp, Mus musculus
catgtactcaccggagagcctcagt

SEQ ID NO: 41796 - DNA, 25 bp, Mus musculus
gtactcaccggagagcctcagtctg

SEQ ID NO: 41797 - DNA, 25 bp, Mus musculus
ctcaccggagagcctcagtctggct

SEQ ID NO: 41798 - DNA, 25 bp, Mus musculus
gaacactagcaacgtgcgggacgac

SEQ ID NO: 41799 - DNA, 25 bp, Mus musculus
cactagcaacgtgcgggacgacgac

SEQ ID NO: 41800 - DNA, 25 bp, Mus musculus
tagcaacgtgcgggacgacgacatc

SEQ ID NO: 41801 - DNA, 25 bp, Mus musculus
caacgtgcgggacgacgacatcttc

SEQ ID NO: 41802 - DNA, 25 bp, Mus musculus
ggacgacgacatcttcattgtcacc

SEQ ID NO: 41803 - DNA, 25 bp, Mus musculus
cgacgacatcttcattgtcacctac

SEQ ID NO: 41804 - DNA, 25 bp, Mus musculus
aggtaccaactggatgattgagatc

SEQ ID NO: 41805 - DNA, 25 bp, Mus musculus
tgtttccgaaatgagctggaatttt

SEQ ID NO: 41806 - DNA, 25 bp, Mus musculus
aggtatcccttttcctgtcggcatg

SEQ ID NO: 41807 - DNA, 25 bp, Mus musculus
tatcccttttcctgtcggcatgtac

SEQ ID NO: 41808 - DNA, 25 bp, Mus musculus
cccttttcctgtcggcatgtactca

SEQ ID NO: 41809 - DNA, 25 bp, Mus musculus
ttttcctgtcggcatgtactcaccg

SEQ ID NO: 41810 - DNA, 25 bp, Mus musculus
tcctgtcggcatgtactcaccggag

SEQ ID NO: 41811 - DNA, 25 bp, Mus musculus
tgtcggcatgtactcaccggagagc

SEQ ID NO: 41812 - DNA, 25 bp, Mus musculus
cggcatgtactcaccggagagcctc

SEQ ID NO: 41813 - DNA, 25 bp, Mus musculus
ttgggcccatctggcaacctcttgg

SEQ ID NO: 41814 - DNA, 25 bp, Mus musculus
tgggcccatctggcaacctcttggc

SEQ ID NO: 41815 - DNA, 25 bp, Mus musculus
gcaacctcttggctacctgcagcag

SEQ ID NO: 41816 - DNA, 25 bp, Mus musculus
caacctcttggctacctgcagcaga

SEQ ID NO: 41817 - DNA, 25 bp, Mus musculus
aacctcttggctacctgcagcagag

SEQ ID NO: 41818 - DNA, 25 bp, Mus musculus
tcttggctacctgcagcagagataa

SEQ ID NO: 41819 - DNA, 25 bp, Mus musculus
cttggctacctgcagcagagataag

SEQ ID NO: 41820 - DNA, 25 bp, Mus musculus
ttggctacctgcagcagagataaga

SEQ ID NO: 41821 - DNA, 25 bp, Mus musculus
tggctacctgcagcagagataagag

SEQ ID NO: 41822 - DNA, 25 bp, Mus musculus
ggctacctgcagcagagataagagc

SEQ ID NO: 41823 - DNA, 25 bp, Mus musculus
gctacctgcagcagagataagagcg

SEQ ID NO: 41824 - DNA, 25 bp, Mus musculus
ctacctgcagcagagataagagcgt

SEQ ID NO: 41825 - DNA, 25 bp, Mus musculus
gggcccatctggcaacctcttggct

SEQ ID NO: 41826 - DNA, 25 bp, Mus musculus
ggcccatctggcaacctcttggcta

SEQ ID NO: 41827 - DNA, 25 bp, Mus musculus
ccatctggcaacctcttggctacct

SEQ ID NO: 41828 - DNA, 25 bp, Mus musculus
catctggcaacctcttggctacctg

SEQ ID NO: 41829 - DNA, 25 bp, Mus musculus
atctggcaacctcttggctacctgc

SEQ ID NO: 41830 - DNA, 25 bp, Mus musculus
tctggcaacctcttggctacctgca

SEQ ID NO: 41831 - DNA, 25 bp, Mus musculus
ctggcaacctcttggctacctgcag

SEQ ID NO: 41832 - DNA, 25 bp, Mus musculus
ggcaacctcttggctacctgcagca

SEQ ID NO: 41833 - DNA, 25 bp, Mus musculus
ctgtcttcaatgcattccatggcat

SEQ ID NO: 41834 - DNA, 25 bp, Mus musculus
tcttcaatgcattccatggcatcac

SEQ ID NO: 41835 - DNA, 25 bp, Mus musculus
tgttctgcccctgtcatgggctcct

SEQ ID NO: 41836 - DNA, 25 bp, Mus musculus
gtcatgggctccttcctctggcagg

SEQ ID NO: 41837 - DNA, 25 bp, Mus musculus
ccttggaccaatcaactgattgatt

SEQ ID NO: 41838 - DNA, 25 bp, Mus musculus
tggaccaatcaactgattgattttt

SEQ ID NO: 41839 - DNA, 25 bp, Mus musculus
ttttctctctggatggaacaggctg

SEQ ID NO: 41840 - DNA, 25 bp, Mus musculus
ctaggagacccactaaggagatcag

SEQ ID NO: 41841 - DNA, 25 bp, Mus musculus
gacccactaaggagatcagtttaga

SEQ ID NO: 41842 - DNA, 25 bp, Mus musculus
ttggttagctctcagcttcacttcc

SEQ ID NO: 41843 - DNA, 25 bp, Mus musculus
cagcttcacttcctgccttaggctc

SEQ ID NO: 41844 - DNA, 25 bp, Mus musculus
cacttcctgccttaggctcctcaga

SEQ ID NO: 41845 - DNA, 25 bp, Mus musculus
atgcattccatggcatcacatctgt

SEQ ID NO: 41846 - DNA, 25 bp, Mus musculus
tccatggcatcacatctgtcctggg

SEQ ID NO: 41847 - DNA, 25 bp, Mus musculus
ccacccttcagtgtctctgtctttt

SEQ ID NO: 41848 - DNA, 25 bp, Mus musculus
agtgtctctgtcttttaagatcttc

SEQ ID NO: 41849 - DNA, 25 bp, Mus musculus
gtctctgtcttttaagatcttcaac

SEQ ID NO: 41850 - DNA, 25 bp, Mus musculus
taagatcttcaactgcttctttatc

SEQ ID NO: 41851 - DNA, 25 bp, Mus musculus
tccagcttattttaccatcccaagc

SEQ ID NO: 41852 - DNA, 25 bp, Mus musculus
aagccttgttctgcccctgtcatgg

SEQ ID NO: 41853 - DNA, 25 bp, Mus musculus
cagacgacttcgatgatggagaaca

SEQ ID NO: 41854 - DNA, 25 bp, Mus musculus
agcagaaatctgtcatctcctggct

SEQ ID NO: 41855 - DNA, 25 bp, Mus musculus
aagtgctgcaccacacgctggccaa

SEQ ID NO: 41856 - DNA, 25 bp, Mus musculus
acacgctggccaacatagatgggaa

SEQ ID NO: 41857 - DNA, 25 bp, Mus musculus
cctaccgcaccatgatgagtcagat

SEQ ID NO: 41858 - DNA, 25 bp, Mus musculus
accgcaccatgatgagtcagatctt

SEQ ID NO: 41859 - DNA, 25 bp, Mus musculus
tgagtcagatcttctgccagcacat

SEQ ID NO: 41860 - DNA, 25 bp, Mus musculus
ccgctatagactacacctacgacag

SEQ ID NO: 41861 - DNA, 25 bp, Mus musculus
ctatagactacacctacgacagtga

SEQ ID NO: 41862 - DNA, 25 bp, Mus musculus
tagactacacctacgacagtgacat

SEQ ID NO: 41863 - DNA, 25 bp, Mus musculus
acacctacgacagtgacatcctgaa

SEQ ID NO: 41864 - DNA, 25 bp, Mus musculus
acgacagtgacatcctgaagggcaa

SEQ ID NO: 41865 - DNA, 25 bp, Mus musculus
aatctgtcatctcctggctgttgaa

SEQ ID NO: 41866 - DNA, 25 bp, Mus musculus
tcatctcctggctgttgaaccatga

SEQ ID NO: 41867 - DNA, 25 bp, Mus musculus
tctcctggctgttgaaccatgatcc

SEQ ID NO: 41868 - DNA, 25 bp, Mus musculus
tgttgaaccatgatccagctaaacg

SEQ ID NO: 41869 - DNA, 25 bp, Mus musculus
tgaaccatgatccagctaaacggcc

SEQ ID NO: 41870 - DNA, 25 bp, Mus musculus
atccagctaaacggcccacggctat

SEQ ID NO: 41871 - DNA, 25 bp, Mus musculus
cagctaaacggcccacggctatgga

SEQ ID NO: 41872 - DNA, 25 bp, Mus musculus
aggagtccgagctgcatgaagtgct

SEQ ID NO: 41873 - DNA, 25 bp, Mus musculus
caccctgcagaggttttccaagaat

SEQ ID NO: 41874 - DNA, 25 bp, Mus musculus
ggttttccaagaatccctcggcatg

SEQ ID NO: 41875 - DNA, 25 bp, Mus musculus
cttgttcacttttgccatcgcgtca

SEQ ID NO: 41876 - DNA, 25 bp, Mus musculus
ttgttcacttttgccatcgcgtcaa

SEQ ID NO: 41877 - DNA, 25 bp, Mus musculus
tgttcacttttgccatcgcgtcaat

SEQ ID NO: 41878 - DNA, 25 bp, Mus musculus
gttcacttttgccatcgcgtcaatc

SEQ ID NO: 41879 - DNA, 25 bp, Mus musculus
ttcacttttgccatcgcgtcaatct

SEQ ID NO: 41880 - DNA, 25 bp, Mus musculus
tcacttttgccatcgcgtcaatctc

SEQ ID NO: 41881 - DNA, 25 bp, Mus musculus
tttgccatcgcgtcaatctctgctt

SEQ ID NO: 41882 - DNA, 25 bp, Mus musculus
ttgccatcgcgtcaatctctgctta

SEQ ID NO: 41883 - DNA, 25 bp, Mus musculus
caagaatccctcggcatggcaagac

SEQ ID NO: 41884 - DNA, 25 bp, Mus musculus
aatccctcggcatggcaagacaagg

SEQ ID NO: 41885 - DNA, 25 bp, Mus musculus
atccctcggcatggcaagacaaggc

SEQ ID NO: 41886 - DNA, 25 bp, Mus musculus
tccctcggcatggcaagacaaggct

SEQ ID NO: 41887 - DNA, 25 bp, Mus musculus
ccctcggcatggcaagacaaggctg

SEQ ID NO: 41888 - DNA, 25 bp, Mus musculus
cctcggcatggcaagacaaggctgt

SEQ ID NO: 41889 - DNA, 25 bp, Mus musculus
tccttgttcacttttgccatcgcgt

SEQ ID NO: 41890 - DNA, 25 bp, Mus musculus
ccttgttcacttttgccatcgcgtc

SEQ ID NO: 41891 - DNA, 25 bp, Mus musculus
catacagcgaaggtgcccacttcag

SEQ ID NO: 41892 - DNA, 25 bp, Mus musculus
aaggtgcccacttcagtgactccca

SEQ ID NO: 41893 - DNA, 25 bp, Mus musculus
gcaccttgagtcaggctggcttcct

SEQ ID NO: 41894 - DNA, 25 bp, Mus musculus
tcctgccaggtgagctgagcctcag

SEQ ID NO: 41895 - DNA, 25 bp, Mus musculus
tgagcctcagcagtcccgggccact

SEQ ID NO: 41896 - DNA, 25 bp, Mus musculus
gcatcaagagcagctcccagtatta

SEQ ID NO: 41897 - DNA, 25 bp, Mus musculus
agagcagctcccagtattacccctc

SEQ ID NO: 41898 - DNA, 25 bp, Mus musculus
gcagctcccagtattacccctcatt

SEQ ID NO: 41899 - DNA, 25 bp, Mus musculus
ccagcaaccctcgtcggagagctgc

SEQ ID NO: 41900 - DNA, 25 bp, Mus musculus
accctcgtcggagagctgcagatgg

SEQ ID NO: 41901 - DNA, 25 bp, Mus musculus
gagctgcagatggtggcctggatac

SEQ ID NO: 41902 - DNA, 25 bp, Mus musculus
atggtggcctggatactcagccgaa

SEQ ID NO: 41903 - DNA, 25 bp, Mus musculus
acttcagtgactcccacagcagcct

SEQ ID NO: 41904 - DNA, 25 bp, Mus musculus
tgccgccttccacgttcctaggagc

SEQ ID NO: 41905 - DNA, 25 bp, Mus musculus
cgccttccacgttcctaggagctgg

SEQ ID NO: 41906 - DNA, 25 bp, Mus musculus
cttccacgttcctaggagctgggct

SEQ ID NO: 41907 - DNA, 25 bp, Mus musculus
atgcctatgccacctttgggagaga

SEQ ID NO: 41908 - DNA, 25 bp, Mus musculus
atgccacctttgggagagacaccag

SEQ ID NO: 41909 - DNA, 25 bp, Mus musculus
gtgttggcaccttgagtcaggctgg

SEQ ID NO: 41910 - DNA, 25 bp, Mus musculus
ttggcaccttgagtcaggctggctt

SEQ ID NO: 41911 - DNA, 25 bp, Mus musculus
ggagctactcaaggactttggagtg

SEQ ID NO: 41912 - DNA, 25 bp, Mus musculus
ctactcaaggactttggagtgataa

SEQ ID NO: 41913 - DNA, 25 bp, Mus musculus
gttcccatgatgttgcctacactgc

SEQ ID NO: 41914 - DNA, 25 bp, Mus musculus
tcccatgatgttgcctacactgcta

SEQ ID NO: 41915 - DNA, 25 bp, Mus musculus
gatgttgcctacactgctagactac

SEQ ID NO: 41916 - DNA, 25 bp, Mus musculus
tgttgcctacactgctagactacag

SEQ ID NO: 41917 - DNA, 25 bp, Mus musculus
ttgcctacactgctagactacagta

SEQ ID NO: 41918 - DNA, 25 bp, Mus musculus
gcctacactgctagactacagtatt

SEQ ID NO: 41919 - DNA, 25 bp, Mus musculus
actgctagactacagtattgctttg

SEQ ID NO: 41920 - DNA, 25 bp, Mus musculus
ctagactacagtattgctttgtatc

SEQ ID NO: 41921 - DNA, 25 bp, Mus musculus
cagtattgctttgtatcatgaggcc

SEQ ID NO: 41922 - DNA, 25 bp, Mus musculus
gtattgctttgtatcatgaggccaa

SEQ ID NO: 41923 - DNA, 25 bp, Mus musculus
ttttccacttgagaactactttatg

SEQ ID NO: 41924 - DNA, 25 bp, Mus musculus
ttaaaaatgccttcttggtatcagt

SEQ ID NO: 41925 - DNA, 25 bp, Mus musculus
gccttcttggtatcagttagaaatt

SEQ ID NO: 41926 - DNA, 25 bp, Mus musculus
tgtttacatgcaagtgcattttata

SEQ ID NO: 41927 - DNA, 25 bp, Mus musculus
atgttggctggtgcaaaaggcctgg

SEQ ID NO: 41928 - DNA, 25 bp, Mus musculus
tttttctggttcccatgatgttgcc

SEQ ID NO: 41929 - DNA, 25 bp, Mus musculus
tttctggttcccatgatgttgccta

SEQ ID NO: 41930 - DNA, 25 bp, Mus musculus
tggttcccatgatgttgcctacact

SEQ ID NO: 41931 - DNA, 25 bp, Mus musculus
gtggagacgccatacactcttggac

SEQ ID NO: 41932 - DNA, 25 bp, Mus musculus
tggagacgccatacactcttggact

SEQ ID NO: 41933 - DNA, 25 bp, Mus musculus
gacttccagatactgcaggcaatag

SEQ ID NO: 41934 - DNA, 25 bp, Mus musculus
cttccagatactgcaggcaatagcg

SEQ ID NO: 41935 - DNA, 25 bp, Mus musculus
ttccagatactgcaggcaatagcga

SEQ ID NO: 41936 - DNA, 25 bp, Mus musculus
tccagatactgcaggcaatagcgat

SEQ ID NO: 41937 - DNA, 25 bp, Mus musculus
agatactgcaggcaatagcgattat

SEQ ID NO: 41938 - DNA, 25 bp, Mus musculus
gatactgcaggcaatagcgattatg

SEQ ID NO: 41939 - DNA, 25 bp, Mus musculus
atgtcattctagtatgcatctcagt

SEQ ID NO: 41940 - DNA, 25 bp, Mus musculus
tgtcattctagtatgcatctcagtg

SEQ ID NO: 41941 - DNA, 25 bp, Mus musculus
cattctagtatgcatctcagtggac

SEQ ID NO: 41942 - DNA, 25 bp, Mus musculus
attctagtatgcatctcagtggact

SEQ ID NO: 41943 - DNA, 25 bp, Mus musculus
ggagacgccatacactcttggactt

SEQ ID NO: 41944 - DNA, 25 bp, Mus musculus
agacgccatacactcttggacttcc

SEQ ID NO: 41945 - DNA, 25 bp, Mus musculus
gacgccatacactcttggacttcca

SEQ ID NO: 41946 - DNA, 25 bp, Mus musculus
acgccatacactcttggacttccag

SEQ ID NO: 41947 - DNA, 25 bp, Mus musculus
tcttggacttccagatactgcaggc

SEQ ID NO: 41948 - DNA, 25 bp, Mus musculus
cttggacttccagatactgcaggca

SEQ ID NO: 41949 - DNA, 25 bp, Mus musculus
tggacttccagatactgcaggcaat

SEQ ID NO: 41950 - DNA, 25 bp, Mus musculus
ggacttccagatactgcaggcaata

SEQ ID NO: 41951 - DNA, 25 bp, Mus musculus
gctgctactgctgagtatgtacaga

SEQ ID NO: 41952 - DNA, 25 bp, Mus musculus
aaattccccgaggatggcagtgagc

SEQ ID NO: 41953 - DNA, 25 bp, Mus musculus
cctgtggcctatatcatcgagcaag

SEQ ID NO: 41954 - DNA, 25 bp, Mus musculus
gcctatatcatcgagcaagcaggag

SEQ ID NO: 41955 - DNA, 25 bp, Mus musculus
atcatcgagcaagcaggaggtatgg

SEQ ID NO: 41956 - DNA, 25 bp, Mus musculus
ggtatggcaaccacaggcacccagc

SEQ ID NO: 41957 - DNA, 25 bp, Mus musculus
acaggcacccagccagtactggatg

SEQ ID NO: 41958 - DNA, 25 bp, Mus musculus
aagagtatctcagctgtgtgcagag

SEQ ID NO: 41959 - DNA, 25 bp, Mus musculus
atctcagctgtgtgcagagaaacca

SEQ ID NO: 41960 - DNA, 25 bp, Mus musculus
gaaaccaggcaggcaggtagtgagc

SEQ ID NO: 41961 - DNA, 25 bp, Mus musculus
aagtgacacaggtcacggtcagaac

SEQ ID NO: 41962 - DNA, 25 bp, Mus musculus
tcagaacagcgccctgctgctaagg

SEQ ID NO: 41963 - DNA, 25 bp, Mus musculus
agtgagccttatggagccaggtacg

SEQ ID NO: 41964 - DNA, 25 bp, Mus musculus
gatgtgcatcgcaccttggtctatg

SEQ ID NO: 41965 - DNA, 25 bp, Mus musculus
catcgcaccttggtctatggaggaa

SEQ ID NO: 41966 - DNA, 25 bp, Mus musculus
atgtacccagccaaccagaagagtc

SEQ ID NO: 41967 - DNA, 25 bp, Mus musculus
ccagccaaccagaagagtcctaatg

SEQ ID NO: 41968 - DNA, 25 bp, Mus musculus
cctaatggcaagctccggctcctgt

SEQ ID NO: 41969 - DNA, 25 bp, Mus musculus
ggcaagctccggctcctgtatgaat

SEQ ID NO: 41970 - DNA, 25 bp, Mus musculus
tgcaatcctgtggcctatatcatcg

SEQ ID NO: 41971 - DNA, 25 bp, Mus musculus
agatcagcgcagagattggagctcc

SEQ ID NO: 41972 - DNA, 25 bp, Mus musculus
attggagctcctgcccaccaacgag

SEQ ID NO: 41973 - DNA, 25 bp, Mus musculus
cgttcaggttgcgctactgaaagga

SEQ ID NO: 41974 - DNA, 25 bp, Mus musculus
caggttgcgctactgaaaggattcc

SEQ ID NO: 41975 - DNA, 25 bp, Mus musculus
ggattccgaccgaagcttaacatca

SEQ ID NO: 41976 - DNA, 25 bp, Mus musculus
attccgaccgaagcttaacatcagc

SEQ ID NO: 41977 - DNA, 25 bp, Mus musculus
tccgaccgaagcttaacatcagcaa

SEQ ID NO: 41978 - DNA, 25 bp, Mus musculus
aagcttaacatcagcaaccatggag

SEQ ID NO: 41979 - DNA, 25 bp, Mus musculus
gcttaacatcagcaaccatggaggt

SEQ ID NO: 41980 - DNA, 25 bp, Mus musculus
aacatcagcaaccatggaggtcagc

SEQ ID NO: 41981 - DNA, 25 bp, Mus musculus
catcagcaaccatggaggtcagcga

SEQ ID NO: 41982 - DNA, 25 bp, Mus musculus
agcaaccatggaggtcagcgaatgg

SEQ ID NO: 41983 - DNA, 25 bp, Mus musculus
ctgcccaccaacgagtaagacgaat

SEQ ID NO: 41984 - DNA, 25 bp, Mus musculus
gcccaccaacgagtaagacgaattg

SEQ ID NO: 41985 - DNA, 25 bp, Mus musculus
tttccatgaactttacagtgcaatc

SEQ ID NO: 41986 - DNA, 25 bp, Mus musculus
tccatgaactttacagtgcaatccg

SEQ ID NO: 41987 - DNA, 25 bp, Mus musculus
aactttacagtgcaatccgtgccta

SEQ ID NO: 41988 - DNA, 25 bp, Mus musculus
caatccgtgcctacggcgttcaggt

SEQ ID NO: 41989 - DNA, 25 bp, Mus musculus
ctacggcgttcaggttgcgctactg

SEQ ID NO: 41990 - DNA, 25 bp, Mus musculus
acggcgttcaggttgcgctactgaa

SEQ ID NO: 41991 - DNA, 25 bp, Mus musculus
catcttacatgtcattatcttagtc

SEQ ID NO: 41992 - DNA, 25 bp, Mus musculus
cattatcttagtctacatttttaag

SEQ ID NO: 41993 - DNA, 25 bp, Mus musculus
taaactgttccttgttcgacagttg

SEQ ID NO: 41994 - DNA, 25 bp, Mus musculus
gttccttgttcgacagttgtaatgc

SEQ ID NO: 41995 - DNA, 25 bp, Mus musculus
gtaatgcacacagatcctctagcaa

SEQ ID NO: 41996 - DNA, 25 bp, Mus musculus
cacacagatcctctagcaaggacag

SEQ ID NO: 41997 - DNA, 25 bp, Mus musculus
gatcctctagcaaggacagctaagt

SEQ ID NO: 41998 - DNA, 25 bp, Mus musculus
aggacagctaagtcctgcaaacagt

SEQ ID NO: 41999 - DNA, 25 bp, Mus musculus
tcctgcaaacagtcactcctctgtc

SEQ ID NO: 42000 - DNA, 25 bp, Mus musculus
ctctgtcaatacctcacttcaccat

SEQ ID NO: 42001 - DNA, 25 bp, Mus musculus
ctcacttcaccatgctgtgcttgca

SEQ ID NO: 42002 - DNA, 25 bp, Mus musculus
agtttgcctcgatggagaagcctct

SEQ ID NO: 42003 - DNA, 25 bp, Mus musculus
aatttgtcatatctctaaaatcttt

SEQ ID NO: 42004 - DNA, 25 bp, Mus musculus
tcatatctctaaaatctttaaattg

SEQ ID NO: 42005 - DNA, 25 bp, Mus musculus
gacactttctcagtttcgatttggt

SEQ ID NO: 42006 - DNA, 25 bp, Mus musculus
ctgactattttactcatagcacgaa

SEQ ID NO: 42007 - DNA, 25 bp, Mus musculus
ctcatagcacgaactatatttgcta

SEQ ID NO: 42008 - DNA, 25 bp, Mus musculus
atagaaataccaacaacaatgtgtg

SEQ ID NO: 42009 - DNA, 25 bp, Mus musculus
ataccaacaacaatgtgtgctctga

SEQ ID NO: 42010 - DNA, 25 bp, Mus musculus
acaacaatgtgtgctctgagcaatg

SEQ ID NO: 42011 - DNA, 25 bp, Mus musculus
tcacttagctcgggatttcgggtat

SEQ ID NO: 42012 - DNA, 25 bp, Mus musculus
tgctaaagccgtgtccgagtatttg

SEQ ID NO: 42013 - DNA, 25 bp, Mus musculus
atttacggatctgctggctcaggac

SEQ ID NO: 42014 - DNA, 25 bp, Mus musculus
ggatctgctggctcaggacaggaca

SEQ ID NO: 42015 - DNA, 25 bp, Mus musculus
gccgggcatccaaagctgtctcacg

SEQ ID NO: 42016 - DNA, 25 bp, Mus musculus
catccaaagctgtctcacgcacttc

SEQ ID NO: 42017 - DNA, 25 bp, Mus musculus
aagctgtctcacgcacttcagtctc

SEQ ID NO: 42018 - DNA, 25 bp, Mus musculus
ctgtctcacgcacttcagtctcatc

SEQ ID NO: 42019 - DNA, 25 bp, Mus musculus
ggccatttgcgctgcgctcacggcc

SEQ ID NO: 42020 - DNA, 25 bp, Mus musculus
cttgaacaacaccactaacaggcac

SEQ ID NO: 42021 - DNA, 25 bp, Mus musculus
gaacaacaccactaacaggcacacg

SEQ ID NO: 42022 - DNA, 25 bp, Mus musculus
cactaacaggcacacgtctggggaa

SEQ ID NO: 42023 - DNA, 25 bp, Mus musculus
gaacagacagcacacggaccccagt

SEQ ID NO: 42024 - DNA, 25 bp, Mus musculus
acagcacacggaccccagtgacctg

SEQ ID NO: 42025 - DNA, 25 bp, Mus musculus
ggaccccagtgacctgcactccagg

SEQ ID NO: 42026 - DNA, 25 bp, Mus musculus
ccccagtgacctgcactccaggaag

SEQ ID NO: 42027 - DNA, 25 bp, Mus musculus
tgacctgcactccaggaagaatatg

SEQ ID NO: 42028 - DNA, 25 bp, Mus musculus
gctgctggccaccaagcaactttgt

SEQ ID NO: 42029 - DNA, 25 bp, Mus musculus
gctggccaccaagcaactttgtaaa

SEQ ID NO: 42030 - DNA, 25 bp, Mus musculus
agaatttacggatctgctggctcag

SEQ ID NO: 42031 - DNA, 25 bp, Mus musculus
acatgtcaatgctgccaatgacagc

SEQ ID NO: 42032 - DNA, 25 bp, Mus musculus
accatccagtatgtcgacaggtgac

SEQ ID NO: 42033 - DNA, 25 bp, Mus musculus
cctgaccagcattgcagcacagctg

SEQ ID NO: 42034 - DNA, 25 bp, Mus musculus
attgcagcacagctgtcatgcagtc

SEQ ID NO: 42035 - DNA, 25 bp, Mus musculus
tgcagcacagctgtcatgcagtctt

SEQ ID NO: 42036 - DNA, 25 bp, Mus musculus
acagctgtcatgcagtcttcagcag

SEQ ID NO: 42037 - DNA, 25 bp, Mus musculus
agctgtcatgcagtcttcagcagag

SEQ ID NO: 42038 - DNA, 25 bp, Mus musculus
ctgtcatgcagtcttcagcagagac

SEQ ID NO: 42039 - DNA, 25 bp, Mus musculus
gtcatgcagtcttcagcagagacca

SEQ ID NO: 42040 - DNA, 25 bp, Mus musculus
catgcagtcttcagcagagaccaca

SEQ ID NO: 42041 - DNA, 25 bp, Mus musculus
tgcagtcttcagcagagaccacagc

SEQ ID NO: 42042 - DNA, 25 bp, Mus musculus
cagtcttcagcagagaccacagcca

SEQ ID NO: 42043 - DNA, 25 bp, Mus musculus
catccagtatgtcgacaggtgaccc

SEQ ID NO: 42044 - DNA, 25 bp, Mus musculus
gtcttcagcagagaccacagccatt

SEQ ID NO: 42045 - DNA, 25 bp, Mus musculus
tccagtatgtcgacaggtgacccac

SEQ ID NO: 42046 - DNA, 25 bp, Mus musculus
atgtcgacaggtgacccactggctt

SEQ ID NO: 42047 - DNA, 25 bp, Mus musculus
cactcatggaaccggtcggtgacct

SEQ ID NO: 42048 - DNA, 25 bp, Mus musculus
ctcatggaaccggtcggtgacctga

SEQ ID NO: 42049 - DNA, 25 bp, Mus musculus
gaaccggtcggtgacctgaccagca

SEQ ID NO: 42050 - DNA, 25 bp, Mus musculus
gtcggtgacctgaccagcattgcag

SEQ ID NO: 42051 - DNA, 25 bp, Mus musculus
gacctgaccagcattgcagcacagc

SEQ ID NO: 42052 - DNA, 25 bp, Mus musculus
tcgatccaacaaaggtagtgatagc

SEQ ID NO: 42053 - DNA, 25 bp, Mus musculus
gtgggcaccatgctaactacatcag

SEQ ID NO: 42054 - DNA, 25 bp, Mus musculus
taactacatcagtatcagtagtgac

SEQ ID NO: 42055 - DNA, 25 bp, Mus musculus
actacatcagtatcagtagtgacat

SEQ ID NO: 42056 - DNA, 25 bp, Mus musculus
ctacatcagtatcagtagtgacata

SEQ ID NO: 42057 - DNA, 25 bp, Mus musculus
acataaattcctaaatgctgagaag

SEQ ID NO: 42058 - DNA, 25 bp, Mus musculus
cataaattcctaaatgctgagaagg

SEQ ID NO: 42059 - DNA, 25 bp, Mus musculus
taaattcctaaatgctgagaaggac

SEQ ID NO: 42060 - DNA, 25 bp, Mus musculus
aaattcctaaatgctgagaaggaca

SEQ ID NO: 42061 - DNA, 25 bp, Mus musculus
attcctaaatgctgagaaggacact

SEQ ID NO: 42062 - DNA, 25 bp, Mus musculus
ttcctaaatgctgagaaggacactg

SEQ ID NO: 42063 - DNA, 25 bp, Mus musculus
atcgagactcgggtatgtggaggca

SEQ ID NO: 42064 - DNA, 25 bp, Mus musculus
tgggcaccatgctaactacatcagt

SEQ ID NO: 42065 - DNA, 25 bp, Mus musculus
ggcaccatgctaactacatcagtat

SEQ ID NO: 42066 - DNA, 25 bp, Mus musculus
gcaccatgctaactacatcagtatc

SEQ ID NO: 42067 - DNA, 25 bp, Mus musculus
accatgctaactacatcagtatcag

SEQ ID NO: 42068 - DNA, 25 bp, Mus musculus
ccatgctaactacatcagtatcagt

SEQ ID NO: 42069 - DNA, 25 bp, Mus musculus
atgctaactacatcagtatcagtag

SEQ ID NO: 42070 - DNA, 25 bp, Mus musculus
tgctaactacatcagtatcagtagt

SEQ ID NO: 42071 - DNA, 25 bp, Mus musculus
ctaactacatcagtatcagtagtga

SEQ ID NO: 42072 - DNA, 25 bp, Mus musculus
gcggcctttctgaacacaatgccct

SEQ ID NO: 42073 - DNA, 25 bp, Mus musculus
tttctgaacacaatgccctgctcca

SEQ ID NO: 42074 - DNA, 25 bp, Mus musculus
ctctccgccgtgtacccaatggcta

SEQ ID NO: 42075 - DNA, 25 bp, Mus musculus
tacccaatggctatcactgcacttt

SEQ ID NO: 42076 - DNA, 25 bp, Mus musculus
atggctatcactgcactttgggact

SEQ ID NO: 42077 - DNA, 25 bp, Mus musculus
atcactgcactttgggactcaacac

SEQ ID NO: 42078 - DNA, 25 bp, Mus musculus
gcactttgggactcaacactggcgt

SEQ ID NO: 42079 - DNA, 25 bp, Mus musculus
accccgatcaggaccactggtgcta

SEQ ID NO: 42080 - DNA, 25 bp, Mus musculus
atcaggaccactggtgctagcttca

SEQ ID NO: 42081 - DNA, 25 bp, Mus musculus
accactggtgctagcttcaccacga

SEQ ID NO: 42082 - DNA, 25 bp, Mus musculus
accacccatgtaccagctccatggg

SEQ ID NO: 42083 - DNA, 25 bp, Mus musculus
gggccctcacatctcggcctctgtg

SEQ ID NO: 42084 - DNA, 25 bp, Mus musculus
atgccctgctccagaaagagcccct

SEQ ID NO: 42085 - DNA, 25 bp, Mus musculus
agcctctagctcctggctcccgaat

SEQ ID NO: 42086 - DNA, 25 bp, Mus musculus
ctggctcccgaattggctctgaccc

SEQ ID NO: 42087 - DNA, 25 bp, Mus musculus
ttggctctgacccttacctagggca

SEQ ID NO: 42088 - DNA, 25 bp, Mus musculus
ccctgcctgaggatacactcacctt

SEQ ID NO: 42089 - DNA, 25 bp, Mus musculus
ctgaggatacactcacctttgaaga

SEQ ID NO: 42090 - DNA, 25 bp, Mus musculus
aggcagtggccaccaactctggccg

SEQ ID NO: 42091 - DNA, 25 bp, Mus musculus
gctcctccaggacttcctatgtgtc

SEQ ID NO: 42092 - DNA, 25 bp, Mus musculus
atgtacgccttttatcacagactta

SEQ ID NO: 42093 - DNA, 25 bp, Mus musculus
gccttttatcacagacttaagagcc

SEQ ID NO: 42094 - DNA, 25 bp, Mus musculus
tctacctttgttctagaaggcgctc

SEQ ID NO: 42095 - DNA, 25 bp, Mus musculus
tttgttctagaaggcgctcctttca

SEQ ID NO: 42096 - DNA, 25 bp, Mus musculus
ctagaaggcgctcctttcagggttg

SEQ ID NO: 42097 - DNA, 25 bp, Mus musculus
ccaagtgtggcccagcactaaccca

SEQ ID NO: 42098 - DNA, 25 bp, Mus musculus
tcttgggttgagccctggcagttct

SEQ ID NO: 42099 - DNA, 25 bp, Mus musculus
aggtcctgccctgcatcatggcttg

SEQ ID NO: 42100 - DNA, 25 bp, Mus musculus
tggagcacttccccttcagaggtct

SEQ ID NO: 42101 - DNA, 25 bp, Mus musculus
ccttcagaggtctacattctagggt

SEQ ID NO: 42102 - DNA, 25 bp, Mus musculus
gaggtctacattctagggtgtaggc

SEQ ID NO: 42103 - DNA, 25 bp, Mus musculus
ctgagttcttctgtaaagagacgaa

SEQ ID NO: 42104 - DNA, 25 bp, Mus musculus
catgaacagttcccttctgtgtcta

SEQ ID NO: 42105 - DNA, 25 bp, Mus musculus
cttatattcaacactttatgatgcc

SEQ ID NO: 42106 - DNA, 25 bp, Mus musculus
ttcaacactttatgatgcccttttg

SEQ ID NO: 42107 - DNA, 25 bp, Mus musculus
actttatgatgcccttttgtcacta

SEQ ID NO: 42108 - DNA, 25 bp, Mus musculus
tgatgcccttttgtcactatcctac

SEQ ID NO: 42109 - DNA, 25 bp, Mus musculus
ccttttgtcactatcctactcaaag

SEQ ID NO: 42110 - DNA, 25 bp, Mus musculus
cagacctgtcccagtgactctacct

SEQ ID NO: 42111 - DNA, 25 bp, Mus musculus
agtgactctacctttgttctagaag

SEQ ID NO: 42112 - DNA, 25 bp, Mus musculus
ccatcagctggagttcatcctcagg

SEQ ID NO: 42113 - DNA, 25 bp, Mus musculus
atcagctggagttcatcctcaggct

SEQ ID NO: 42114 - DNA, 25 bp, Mus musculus
ttttctatttgtcctgccttgagcc

SEQ ID NO: 42115 - DNA, 25 bp, Mus musculus
tggatactgcttgtctctgttgaag

SEQ ID NO: 42116 - DNA, 25 bp, Mus musculus
gatactgcttgtctctgttgaagct

SEQ ID NO: 42117 - DNA, 25 bp, Mus musculus
ctctgttgaagctgtggtgacctgg

SEQ ID NO: 42118 - DNA, 25 bp, Mus musculus
ctccccagggagatgggagctactc

SEQ ID NO: 42119 - DNA, 25 bp, Mus musculus
gagctactcaaggacagctcaggcc

SEQ ID NO: 42120 - DNA, 25 bp, Mus musculus
gctactcaaggacagctcaggcctc

SEQ ID NO: 42121 - DNA, 25 bp, Mus musculus
tactcaaggacagctcaggcctctg

SEQ ID NO: 42122 - DNA, 25 bp, Mus musculus
ctcaaggacagctcaggcctctgca

SEQ ID NO: 42123 - DNA, 25 bp, Mus musculus
caaggacagctcaggcctctgcagt

SEQ ID NO: 42124 - DNA, 25 bp, Mus musculus
cagctggagttcatcctcaggctcc

SEQ ID NO: 42125 - DNA, 25 bp, Mus musculus
aaggacagctcaggcctctgcagtt

SEQ ID NO: 42126 - DNA, 25 bp, Mus musculus
tcaggcaccaggggttcaccctcag

SEQ ID NO: 42127 - DNA, 25 bp, Mus musculus
tcaaatcctggggtgcaccctgctc

SEQ ID NO: 42128 - DNA, 25 bp, Mus musculus
gtggtcttttcccattgccagtcct

SEQ ID NO: 42129 - DNA, 25 bp, Mus musculus
ggtcttttcccattgccagtccttg

SEQ ID NO: 42130 - DNA, 25 bp, Mus musculus
tcttttcccattgccagtccttgga

SEQ ID NO: 42131 - DNA, 25 bp, Mus musculus
ttttcccattgccagtccttggaag

SEQ ID NO: 42132 - DNA, 25 bp, Mus musculus
ttcccattgccagtccttggaaggt

SEQ ID NO: 42133 - DNA, 25 bp, Mus musculus
catcttggctgcagaagtcttacgg

SEQ ID NO: 42134 - DNA, 25 bp, Mus musculus
acccgtttgcttgagtgctttggca

SEQ ID NO: 42135 - DNA, 25 bp, Mus musculus
agcctgcagatcttccgcctgaatg

SEQ ID NO: 42136 - DNA, 25 bp, Mus musculus
ctgcagatcttccgcctgaatgact

SEQ ID NO: 42137 - DNA, 25 bp, Mus musculus
atcttccgcctgaatgactgggcca

SEQ ID NO: 42138 - DNA, 25 bp, Mus musculus
ttccgcctgaatgactgggccagaa

SEQ ID NO: 42139 - DNA, 25 bp, Mus musculus
agaccatatcgctgccctgagcagc

SEQ ID NO: 42140 - DNA, 25 bp, Mus musculus
aagctctcggatattgcccggccaa

SEQ ID NO: 42141 - DNA, 25 bp, Mus musculus
ctctcggatattgcccggccaagga

SEQ ID NO: 42142 - DNA, 25 bp, Mus musculus
tcggatattgcccggccaaggatgt

SEQ ID NO: 42143 - DNA, 25 bp, Mus musculus
attgcccggccaaggatgttttgcg

SEQ ID NO: 42144 - DNA, 25 bp, Mus musculus
gcccggccaaggatgttttgcgaga

SEQ ID NO: 42145 - DNA, 25 bp, Mus musculus
ttgcttgagtgctttggcaatgtag

SEQ ID NO: 42146 - DNA, 25 bp, Mus musculus
tttggcaatgtagtcgcgtgagacg

SEQ ID NO: 42147 - DNA, 25 bp, Mus musculus
aatgtagtcgcgtgagacgtcgtcc

SEQ ID NO: 42148 - DNA, 25 bp, Mus musculus
ttgtaaatcaaagccttgtgccaat

SEQ ID NO: 42149 - DNA, 25 bp, Mus musculus
taaatcaaagccttgtgccaatggg

SEQ ID NO: 42150 - DNA, 25 bp, Mus musculus
aaagccttgtgccaatgggcgactg

SEQ ID NO: 42151 - DNA, 25 bp, Mus musculus
gccttgtgccaatgggcgactgaaa

SEQ ID NO: 42152 - DNA, 25 bp, Mus musculus
ggcagcctgcagatcttccgcctga

SEQ ID NO: 42153 - DNA, 25 bp, Mus musculus
atgcgaacatctggctgggcctcaa

SEQ ID NO: 42154 - DNA, 25 bp, Mus musculus
acatctggctgggcctcaacgacat

SEQ ID NO: 42155 - DNA, 25 bp, Mus musculus
acaagcaatgccgcgatcagttgcc

SEQ ID NO: 42156 - DNA, 25 bp, Mus musculus
agcaatgccgcgatcagttgcccta

SEQ ID NO: 42157 - DNA, 25 bp, Mus musculus
aatgccgcgatcagttgccctacat

SEQ ID NO: 42158 - DNA, 25 bp, Mus musculus
gcgatcagttgccctacatctgcca

SEQ ID NO: 42159 - DNA, 25 bp, Mus musculus
atcagttgccctacatctgccagtt

SEQ ID NO: 42160 - DNA, 25 bp, Mus musculus
agttgccctacatctgccagtttgc

SEQ ID NO: 42161 - DNA, 25 bp, Mus musculus
acatctgccagtttgccattgtgta

SEQ ID NO: 42162 - DNA, 25 bp, Mus musculus
tctgccagtttgccattgtgtagta

SEQ ID NO: 42163 - DNA, 25 bp, Mus musculus
agtttgccattgtgtagtacagccg

SEQ ID NO: 42164 - DNA, 25 bp, Mus musculus
tgtagtacagccgctactagcccag

SEQ ID NO: 42165 - DNA, 25 bp, Mus musculus
gcctcaacgacatggccgcggaagg

SEQ ID NO: 42166 - DNA, 25 bp, Mus musculus
tcaacgacatggccgcggaaggcgc

SEQ ID NO: 42167 - DNA, 25 bp, Mus musculus
gcctcctggcctacaagaactggga

SEQ ID NO: 42168 - DNA, 25 bp, Mus musculus
tcctggcctacaagaactgggagac

SEQ ID NO: 42169 - DNA, 25 bp, Mus musculus
tggcctacaagaactgggagacgga

SEQ ID NO: 42170 - DNA, 25 bp, Mus musculus
agatcacgacgcaacccgacggcgg

SEQ ID NO: 42171 - DNA, 25 bp, Mus musculus
cacgcaacggcaagtggttcgacaa

SEQ ID NO: 42172 - DNA, 25 bp, Mus musculus
ggttcgacaagcaatgccgcgatca

SEQ ID NO: 42173 - DNA, 25 bp, Mus musculus
atgatcatgaccgagcgccgatagc

SEQ ID NO: 42174 - DNA, 25 bp, Mus musculus
cgatagcacttctcgctgctgcgac

SEQ ID NO: 42175 - DNA, 25 bp, Mus musculus
ttcaggcgagcgctcaaccgatcag

SEQ ID NO: 42176 - DNA, 25 bp, Mus musculus
caggcgagcgctcaaccgatcagct

SEQ ID NO: 42177 - DNA, 25 bp, Mus musculus
ggcgagcgctcaaccgatcagctca

SEQ ID NO: 42178 - DNA, 25 bp, Mus musculus
ctcaaccgatcagctcagcaactgt

SEQ ID NO: 42179 - DNA, 25 bp, Mus musculus
caaccgatcagctcagcaactgtgt

SEQ ID NO: 42180 - DNA, 25 bp, Mus musculus
aaccgatcagctcagcaactgtgtc

SEQ ID NO: 42181 - DNA, 25 bp, Mus musculus
accgatcagctcagcaactgtgtct

SEQ ID NO: 42182 - DNA, 25 bp, Mus musculus
ccgatcagctcagcaactgtgtctc

SEQ ID NO: 42183 - DNA, 25 bp, Mus musculus
cgatcagctcagcaactgtgtctcg

SEQ ID NO: 42184 - DNA, 25 bp, Mus musculus
gatcagctcagcaactgtgtctcgg

SEQ ID NO: 42185 - DNA, 25 bp, Mus musculus
gatagcacttctcgctgctgcgacc

SEQ ID NO: 42186 - DNA, 25 bp, Mus musculus
atccattccgggactggtagtctga

SEQ ID NO: 42187 - DNA, 25 bp, Mus musculus
tccattccgggactggtagtctgaa

SEQ ID NO: 42188 - DNA, 25 bp, Mus musculus
atgccggtcgcgaccagccgatggc

SEQ ID NO: 42189 - DNA, 25 bp, Mus musculus
gaccagccgatggccccgcgtgcgt

SEQ ID NO: 42190 - DNA, 25 bp, Mus musculus
accagccgatggccccgcgtgcgtg

SEQ ID NO: 42191 - DNA, 25 bp, Mus musculus
tgcgtgaccctggccgcatgagcct

SEQ ID NO: 42192 - DNA, 25 bp, Mus musculus
tgagccttcaggcgagcgctcaacc

SEQ ID NO: 42193 - DNA, 25 bp, Mus musculus
ttcgcctgccaactctgggctggtt

SEQ ID NO: 42194 - DNA, 25 bp, Mus musculus
gcctgccaactctgggctggttcaa

SEQ ID NO: 42195 - DNA, 25 bp, Mus musculus
agaagtccccctagcagagagaact

SEQ ID NO: 42196 - DNA, 25 bp, Mus musculus
ccccctagcagagagaactgtctca

SEQ ID NO: 42197 - DNA, 25 bp, Mus musculus
gagaactgtctcacatggtattgta

SEQ ID NO: 42198 - DNA, 25 bp, Mus musculus
aactgtctcacatggtattgtattg

SEQ ID NO: 42199 - DNA, 25 bp, Mus musculus
tgtctcacatggtattgtattgggg

SEQ ID NO: 42200 - DNA, 25 bp, Mus musculus
gactctgtttccaatacgctctaaa

SEQ ID NO: 42201 - DNA, 25 bp, Mus musculus
ttcaaatgaagccgctgtaaccaac

SEQ ID NO: 42202 - DNA, 25 bp, Mus musculus
tgaagccgctgtaaccaacctctcc

SEQ ID NO: 42203 - DNA, 25 bp, Mus musculus
tatcgtctctgtaatgccagaagat

SEQ ID NO: 42204 - DNA, 25 bp, Mus musculus
cgtctctgtaatgccagaagatatt

SEQ ID NO: 42205 - DNA, 25 bp, Mus musculus
tccactattctctccttctcggtca

SEQ ID NO: 42206 - DNA, 25 bp, Mus musculus
gtcaatctgggcttttcactccgcg

SEQ ID NO: 42207 - DNA, 25 bp, Mus musculus
aatctgggcttttcactccgcgagt

SEQ ID NO: 42208 - DNA, 25 bp, Mus musculus
ggcttttcactccgcgagtggctgt

SEQ ID NO: 42209 - DNA, 25 bp, Mus musculus
cactgtggtcctttatgcaacacgt

SEQ ID NO: 42210 - DNA, 25 bp, Mus musculus
ttatgcaacacgtctatggacttaa

SEQ ID NO: 42211 - DNA, 25 bp, Mus musculus
tgcaacacgtctatggacttaactt

SEQ ID NO: 42212 - DNA, 25 bp, Mus musculus
gttcgaagaagtccccctagcagag

SEQ ID NO: 42213 - DNA, 25 bp, Mus musculus
gagcctcagtccttgtgacttccat

SEQ ID NO: 42214 - DNA, 25 bp, Mus musculus
gcctcagtccttgtgacttccatag

SEQ ID NO: 42215 - DNA, 25 bp, Mus musculus
ccgcagcgctttgttagcaccctag

SEQ ID NO: 42216 - DNA, 25 bp, Mus musculus
cgcagcgctttgttagcaccctagg

SEQ ID NO: 42217 - DNA, 25 bp, Mus musculus
cagcgctttgttagcaccctagggt

SEQ ID NO: 42218 - DNA, 25 bp, Mus musculus
agcgctttgttagcaccctagggtg

SEQ ID NO: 42219 - DNA, 25 bp, Mus musculus
gcgctttgttagcaccctagggtgt

SEQ ID NO: 42220 - DNA, 25 bp, Mus musculus
gtcgtccgggtccatggagtagctt

SEQ ID NO: 42221 - DNA, 25 bp, Mus musculus
tcgtccgggtccatggagtagcttc

SEQ ID NO: 42222 - DNA, 25 bp, Mus musculus
gcacatccggtcgacgcctggaaac

SEQ ID NO: 42223 - DNA, 25 bp, Mus musculus
catccggtcgacgcctggaaacgag

SEQ ID NO: 42224 - DNA, 25 bp, Mus musculus
ttaccgcatcgaggaggaaaaccag

SEQ ID NO: 42225 - DNA, 25 bp, Mus musculus
cctcagtccttgtgacttccatagg

SEQ ID NO: 42226 - DNA, 25 bp, Mus musculus
ctcagtccttgtgacttccataggt

SEQ ID NO: 42227 - DNA, 25 bp, Mus musculus
cagtccttgtgacttccataggtta

SEQ ID NO: 42228 - DNA, 25 bp, Mus musculus
ttgtgacttccataggttacggtcg

SEQ ID NO: 42229 - DNA, 25 bp, Mus musculus
taagctgagccgcagcgctttgtta

SEQ ID NO: 42230 - DNA, 25 bp, Mus musculus
aagctgagccgcagcgctttgttag

SEQ ID NO: 42231 - DNA, 25 bp, Mus musculus
agctgagccgcagcgctttgttagc

SEQ ID NO: 42232 - DNA, 25 bp, Mus musculus
gccgcagcgctttgttagcacccta

SEQ ID NO: 42233 - DNA, 25 bp, Mus musculus
cccaaccagagcgacttgatcgaac

SEQ ID NO: 42234 - DNA, 25 bp, Mus musculus
aaccagagcgacttgatcgaacagg

SEQ ID NO: 42235 - DNA, 25 bp, Mus musculus
caagccgccagcaacttcaagagcc

SEQ ID NO: 42236 - DNA, 25 bp, Mus musculus
aacttcaagagcccagtcaagacta

SEQ ID NO: 42237 - DNA, 25 bp, Mus musculus
ttcaagagcccagtcaagactattc

SEQ ID NO: 42238 - DNA, 25 bp, Mus musculus
agcccagtcaagactattcgctgat

SEQ ID NO: 42239 - DNA, 25 bp, Mus musculus
gtcaagactattcgctgattgccca

SEQ ID NO: 42240 - DNA, 25 bp, Mus musculus
tccctctgtctgtgacaccaccatt

SEQ ID NO: 42241 - DNA, 25 bp, Mus musculus
ctctgtctgtgacaccaccattcct

SEQ ID NO: 42242 - DNA, 25 bp, Mus musculus
ctgtgacaccaccattcctctgctg

SEQ ID NO: 42243 - DNA, 25 bp, Mus musculus
tctgctgccaccctttcaggaagtc

SEQ ID NO: 42244 - DNA, 25 bp, Mus musculus
gctgccaccctttcaggaagtctat

SEQ ID NO: 42245 - DNA, 25 bp, Mus musculus
ttgatcgaacaggcagctgagatgc

SEQ ID NO: 42246 - DNA, 25 bp, Mus musculus
atcgaacaggcagctgagatgcttt

SEQ ID NO: 42247 - DNA, 25 bp, Mus musculus
ctcaccaaccgaggcatcgcacaaa

SEQ ID NO: 42248 - DNA, 25 bp, Mus musculus
cagtttgtacccaggctctatggtt

SEQ ID NO: 42249 - DNA, 25 bp, Mus musculus
aagatccatccaatggcttaccagc

SEQ ID NO: 42250 - DNA, 25 bp, Mus musculus
ccaatggcttaccagctgcagctcc

SEQ ID NO: 42251 - DNA, 25 bp, Mus musculus
gcttaccagctgcagctccaagccg

SEQ ID NO: 42252 - DNA, 25 bp, Mus musculus
ctccaagccgccagcaacttcaaga

SEQ ID NO: 42253 - DNA, 25 bp, Mus musculus
tgcatccgttcctctctaccaaggc

SEQ ID NO: 42254 - DNA, 25 bp, Mus musculus
tctctaccaaggcttcctgatcatt

SEQ ID NO: 42255 - DNA, 25 bp, Mus musculus
gctctacaaggacctgcttaagggg

SEQ ID NO: 42256 - DNA, 25 bp, Mus musculus
gcggccactgtcctacaagacgttc

SEQ ID NO: 42257 - DNA, 25 bp, Mus musculus
gttaatcagcatctatcaagggagc

SEQ ID NO: 42258 - DNA, 25 bp, Mus musculus
ctatcaagggagcaccatcatgtac

SEQ ID NO: 42259 - DNA, 25 bp, Mus musculus
gagcaccatcatgtacggggcgctg

SEQ ID NO: 42260 - DNA, 25 bp, Mus musculus
caccatcatgtacggggcgctgctg

SEQ ID NO: 42261 - DNA, 25 bp, Mus musculus
catgtacggggcgctgctgctgttc

SEQ ID NO: 42262 - DNA, 25 bp, Mus musculus
tgtacacatcgtggcaatctccttc

SEQ ID NO: 42263 - DNA, 25 bp, Mus musculus
acacatcgtggcaatctccttcaca

SEQ ID NO: 42264 - DNA, 25 bp, Mus musculus
catcgtggcaatctccttcacatcc

SEQ ID NO: 42265 - DNA, 25 bp, Mus musculus
ctaccaaggcttcctgatcattggg

SEQ ID NO: 42266 - DNA, 25 bp, Mus musculus
ccaaggcttcctgatcattgggtat

SEQ ID NO: 42267 - DNA, 25 bp, Mus musculus
tgggtattctaccatctacacgatg

SEQ ID NO: 42268 - DNA, 25 bp, Mus musculus
catctacacgatgtttcccgtgttc

SEQ ID NO: 42269 - DNA, 25 bp, Mus musculus
cgccatgttgtatcctgagctctac

SEQ ID NO: 42270 - DNA, 25 bp, Mus musculus
catgttgtatcctgagctctacaag

SEQ ID NO: 42271 - DNA, 25 bp, Mus musculus
tcctgagctctacaaggacctgctt

SEQ ID NO: 42272 - DNA, 25 bp, Mus musculus
tgagctctacaaggacctgcttaag

SEQ ID NO: 42273 - DNA, 25 bp, Mus musculus
cttctgttgttgcaaatggagtgtg

SEQ ID NO: 42274 - DNA, 25 bp, Mus musculus
tgcttgcccctttgtctacaaccta

SEQ ID NO: 42275 - DNA, 25 bp, Mus musculus
acacgtactgggcttgtggcgtgat

SEQ ID NO: 42276 - DNA, 25 bp, Mus musculus
gcgtgatcctcatcatcgcgggtat

SEQ ID NO: 42277 - DNA, 25 bp, Mus musculus
tcctcatcatcgcgggtatctatct

SEQ ID NO: 42278 - DNA, 25 bp, Mus musculus
tcatcgcgggtatctatctcttcat

SEQ ID NO: 42279 - DNA, 25 bp, Mus musculus
tctatctcttcattggcatgggcat

SEQ ID NO: 42280 - DNA, 25 bp, Mus musculus
tcttcattggcatgggcatcaacta

SEQ ID NO: 42281 - DNA, 25 bp, Mus musculus
tgggcatcaactatcgacttcttgc

SEQ ID NO: 42282 - DNA, 25 bp, Mus musculus
atcgacttcttgccaaagaacagaa

SEQ ID NO: 42283 - DNA, 25 bp, Mus musculus
tgaaagctgcacagtcgccgcagca

SEQ ID NO: 42284 - DNA, 25 bp, Mus musculus
agcacagctccggggaccccacaga

SEQ ID NO: 42285 - DNA, 25 bp, Mus musculus
tgtctacaacctacgttgggttctg

SEQ ID NO: 42286 - DNA, 25 bp, Mus musculus
gtgtctacgccggagtctttggatt

SEQ ID NO: 42287 - DNA, 25 bp, Mus musculus
ttggttggctcagctctgtattatt

SEQ ID NO: 42288 - DNA, 25 bp, Mus musculus
tggacctcattggaccccagaggtt

SEQ ID NO: 42289 - DNA, 25 bp, Mus musculus
tcattggaccccagaggttctccag

SEQ ID NO: 42290 - DNA, 25 bp, Mus musculus
agaggttctccagtgctgtgggctt

SEQ ID NO: 42291 - DNA, 25 bp, Mus musculus
cacttttaggccgcctcaatgacat

SEQ ID NO: 42292 - DNA, 25 bp, Mus musculus
taggccgcctcaatgacatgtatgg

SEQ ID NO: 42293 - DNA, 25 bp, Mus musculus
ctgccttctccttcgtcgttgtcgg

SEQ ID NO: 42294 - DNA, 25 bp, Mus musculus
agtactgcttcatctgcctgtgcat

SEQ ID NO: 42295 - DNA, 25 bp, Mus musculus
tgctttgtactgaggaagcgatgat

SEQ ID NO: 42296 - DNA, 25 bp, Mus musculus
tgcttcaattgttgagctgtcttta

SEQ ID NO: 42297 - DNA, 25 bp, Mus musculus
tgttgagctgtctttactttgaggt

SEQ ID NO: 42298 - DNA, 25 bp, Mus musculus
tgacagtacatccagttttcctaca

SEQ ID NO: 42299 - DNA, 25 bp, Mus musculus
cagtacatccagttttcctacattc

SEQ ID NO: 42300 - DNA, 25 bp, Mus musculus
atccagttttcctacattcagctat

SEQ ID NO: 42301 - DNA, 25 bp, Mus musculus
cagttttcctacattcagctatgtt

SEQ ID NO: 42302 - DNA, 25 bp, Mus musculus
tacattcagctatgttttctaatgt

SEQ ID NO: 42303 - DNA, 25 bp, Mus musculus
attgattagcttctggtatgattgt

SEQ ID NO: 42304 - DNA, 25 bp, Mus musculus
gattagcttctggtatgattgtaat

SEQ ID NO: 42305 - DNA, 25 bp, Mus musculus
actgcttcatctgcctgtgcatcta

SEQ ID NO: 42306 - DNA, 25 bp, Mus musculus
gcttcatctgcctgtgcatctacct

SEQ ID NO: 42307 - DNA, 25 bp, Mus musculus
tctgcctgtgcatctacctgtccat

SEQ ID NO: 42308 - DNA, 25 bp, Mus musculus
gcctgtgcatctacctgtccatcgt

SEQ ID NO: 42309 - DNA, 25 bp, Mus musculus
tgtgcatctacctgtccatcgtcct

SEQ ID NO: 42310 - DNA, 25 bp, Mus musculus
tttgggttcctctgctgctttgtac

SEQ ID NO: 42311 - DNA, 25 bp, Mus musculus
ctctgctgctttgtactgaggaagc

SEQ ID NO: 42312 - DNA, 25 bp, Mus musculus
tgctgctttgtactgaggaagcgat

SEQ ID NO: 42313 - DNA, 25 bp, Mus musculus
ctttctcatcagaattgtctttctc

SEQ ID NO: 42314 - DNA, 25 bp, Mus musculus
aaatgctgccacataaatctcagta

SEQ ID NO: 42315 - DNA, 25 bp, Mus musculus
gtgtcctatctgatagagtaaatgg

SEQ ID NO: 42316 - DNA, 25 bp, Mus musculus
gtccagcatgcatgcaatgtccaca

SEQ ID NO: 42317 - DNA, 25 bp, Mus musculus
tgcaatgtccacatgagagaactaa

SEQ ID NO: 42318 - DNA, 25 bp, Mus musculus
accttttctctgtgagcatccctct

SEQ ID NO: 42319 - DNA, 25 bp, Mus musculus
tgagcatccctctctgacttgagtc

SEQ ID NO: 42320 - DNA, 25 bp, Mus musculus
tccctctctgacttgagtctttatt

SEQ ID NO: 42321 - DNA, 25 bp, Mus musculus
gaatcatttctatgctaagttagcc

SEQ ID NO: 42322 - DNA, 25 bp, Mus musculus
tgcacaacctactgactggcccaat

SEQ ID NO: 42323 - DNA, 25 bp, Mus musculus
acctactgactggcccaatctagcc

SEQ ID NO: 42324 - DNA, 25 bp, Mus musculus
tgactggcccaatctagcccatcac

SEQ ID NO: 42325 - DNA, 25 bp, Mus musculus
tgccacataaatctcagtagaacca

SEQ ID NO: 42326 - DNA, 25 bp, Mus musculus
agaaccaccacaatgtcaggaactg

SEQ ID NO: 42327 - DNA, 25 bp, Mus musculus
accacaatgtcaggaactgacaaag

SEQ ID NO: 42328 - DNA, 25 bp, Mus musculus
tttgccccatgttacagtatcagca

SEQ ID NO: 42329 - DNA, 25 bp, Mus musculus
tacagtatcagcattagtggcagaa

SEQ ID NO: 42330 - DNA, 25 bp, Mus musculus
ttttggcttccaagtcagtgttgct

SEQ ID NO: 42331 - DNA, 25 bp, Mus musculus
tgttgctgctgagtgtcctatctga

SEQ ID NO: 42332 - DNA, 25 bp, Mus musculus
tgctgagtgtcctatctgatagagt

SEQ ID NO: 42333 - DNA, 25 bp, Mus musculus
tgccctgtttctggctcagcagggc

SEQ ID NO: 42334 - DNA, 25 bp, Mus musculus
gtttctggctcagcagggccaggtt

SEQ ID NO: 42335 - DNA, 25 bp, Mus musculus
ctcgtcttaccgtacagtactgcta

SEQ ID NO: 42336 - DNA, 25 bp, Mus musculus
gtcttaccgtacagtactgctaggt

SEQ ID NO: 42337 - DNA, 25 bp, Mus musculus
ttaccgtacagtactgctaggttgt

SEQ ID NO: 42338 - DNA, 25 bp, Mus musculus
tacagtactgctaggttgttcagag

SEQ ID NO: 42339 - DNA, 25 bp, Mus musculus
agtactgctaggttgttcagagtcg

SEQ ID NO: 42340 - DNA, 25 bp, Mus musculus
ttgttcagagtcgctgccaccgcgg

SEQ ID NO: 42341 - DNA, 25 bp, Mus musculus
ttcagagtcgctgccaccgcggggt

SEQ ID NO: 42342 - DNA, 25 bp, Mus musculus
tctctgcccagggttttctcgcgga

SEQ ID NO: 42343 - DNA, 25 bp, Mus musculus
ctgcccagggttttctcgcggatag

SEQ ID NO: 42344 - DNA, 25 bp, Mus musculus
tacaccagggccaagatgattttca

SEQ ID NO: 42345 - DNA, 25 bp, Mus musculus
tctggctcagcagggccaggttatt

SEQ ID NO: 42346 - DNA, 25 bp, Mus musculus
tatttttctgtttggcaacatcagg

SEQ ID NO: 42347 - DNA, 25 bp, Mus musculus
tctgtttggcaacatcaggatgatc

SEQ ID NO: 42348 - DNA, 25 bp, Mus musculus
gatgatcctttcccagaaccttctc

SEQ ID NO: 42349 - DNA, 25 bp, Mus musculus
tctccctgatctccagggctcgttt

SEQ ID NO: 42350 - DNA, 25 bp, Mus musculus
tgatctccagggctcgtttacacag

SEQ ID NO: 42351 - DNA, 25 bp, Mus musculus
tctccagggctcgtttacacagcgg

SEQ ID NO: 42352 - DNA, 25 bp, Mus musculus
tccctcgtcttaccgtacagtactg

SEQ ID NO: 42353 - DNA, 25 bp, Mus musculus
ttgaagatccagccgatgcttcggt

SEQ ID NO: 42354 - DNA, 25 bp, Mus musculus
ccgatgcttcggttgcaggaacaga

SEQ ID NO: 42355 - DNA, 25 bp, Mus musculus
tcactttagatgcaaccccactgga

SEQ ID NO: 42356 - DNA, 25 bp, Mus musculus
tagatgcaaccccactggattctta

SEQ ID NO: 42357 - DNA, 25 bp, Mus musculus
tattacacaatatgatcattgtaga

SEQ ID NO: 42358 - DNA, 25 bp, Mus musculus
ttgtagacacctgcatttagtgcct

SEQ ID NO: 42359 - DNA, 25 bp, Mus musculus
ttcttttcaccagatgtgactaatt

SEQ ID NO: 42360 - DNA, 25 bp, Mus musculus
tcaactcctgacctgttctcttgca

SEQ ID NO: 42361 - DNA, 25 bp, Mus musculus
tcttgcatcttagccatactctgga

SEQ ID NO: 42362 - DNA, 25 bp, Mus musculus
atcttagccatactctggattgatc

SEQ ID NO: 42363 - DNA, 25 bp, Mus musculus
gccatactctggattgatcatgcca

SEQ ID NO: 42364 - DNA, 25 bp, Mus musculus
attgatcatgccaaatctgcagcag

SEQ ID NO: 42365 - DNA, 25 bp, Mus musculus
caaagctctcaagacccaaagaagc

SEQ ID NO: 42366 - DNA, 25 bp, Mus musculus
gttatcagccttcactatagatctt

SEQ ID NO: 42367 - DNA, 25 bp, Mus musculus
attttcaagatcagcaccccatgct

SEQ ID NO: 42368 - DNA, 25 bp, Mus musculus
aagatcagcaccccatgcttctcaa

SEQ ID NO: 42369 - DNA, 25 bp, Mus musculus
agcaccccatgcttctcaaaaagca

SEQ ID NO: 42370 - DNA, 25 bp, Mus musculus
aattctcatcgcctacctatgtact

SEQ ID NO: 42371 - DNA, 25 bp, Mus musculus
catcgcctacctatgtactgtcgcc

SEQ ID NO: 42372 - DNA, 25 bp, Mus musculus
tgtcgccattgcccaaaaaagcaag

SEQ ID NO: 42373 - DNA, 25 bp, Mus musculus
tttgtccacagtgaaaaggcagcct

SEQ ID NO: 42374 - DNA, 25 bp, Mus musculus
tcaccagccaacttcatcaagccag

SEQ ID NO: 42375 - DNA, 25 bp, Mus musculus
gccaacttcatcaagccaggtaagc

SEQ ID NO: 42376 - DNA, 25 bp, Mus musculus
gatcaggtggtgactgcaggcctga

SEQ ID NO: 42377 - DNA, 25 bp, Mus musculus
aagattcggcaccaccatacagaag

SEQ ID NO: 42378 - DNA, 25 bp, Mus musculus
cccaccttcatcgctgtagttcagg

SEQ ID NO: 42379 - DNA, 25 bp, Mus musculus
ttcatcgctgtagttcaggctgtcg

SEQ ID NO: 42380 - DNA, 25 bp, Mus musculus
gctgtcgttcgagcatcaggtggtt

SEQ ID NO: 42381 - DNA, 25 bp, Mus musculus
gcatcaggtggttgggcagctgcct

SEQ ID NO: 42382 - DNA, 25 bp, Mus musculus
cctgctggctactgagtgcccggaa

SEQ ID NO: 42383 - DNA, 25 bp, Mus musculus
ggctactgagtgcccggaagaggca

SEQ ID NO: 42384 - DNA, 25 bp, Mus musculus
tgagtgcccggaagaggcaagattg

SEQ ID NO: 42385 - DNA, 25 bp, Mus musculus
aagattgacccgcagccaagggacg

SEQ ID NO: 42386 - DNA, 25 bp, Mus musculus
ttcatcaagccaggtaagcagcctc

SEQ ID NO: 42387 - DNA, 25 bp, Mus musculus
cagcctctttcatccatgtgtccct

SEQ ID NO: 42388 - DNA, 25 bp, Mus musculus
tccatgtgtccctcaatcatcctgg

SEQ ID NO: 42389 - DNA, 25 bp, Mus musculus
tcaatcatcctggataaggacggcc

SEQ ID NO: 42390 - DNA, 25 bp, Mus musculus
cagatcaccacatctgttgcactgg

SEQ ID NO: 42391 - DNA, 25 bp, Mus musculus
accacatctgttgcactggccatca

SEQ ID NO: 42392 - DNA, 25 bp, Mus musculus
tctgttgcactggccatcatcaaca

SEQ ID NO: 42393 - DNA, 25 bp, Mus musculus
gcactggccatcatcaacagcctgt

SEQ ID NO: 42394 - DNA, 25 bp, Mus musculus
ctccttacaaattgagtttgcgagg

SEQ ID NO: 42395 - DNA, 25 bp, Mus musculus
cttgtaatctcagcacttggaagac

SEQ ID NO: 42396 - DNA, 25 bp, Mus musculus
ctcagctccaaggaactggaaagtt

SEQ ID NO: 42397 - DNA, 25 bp, Mus musculus
gtcccaaactctaaatctaagcact

SEQ ID NO: 42398 - DNA, 25 bp, Mus musculus
aactctaaatctaagcactttatat

SEQ ID NO: 42399 - DNA, 25 bp, Mus musculus
tattttatctcccagtcctcactag

SEQ ID NO: 42400 - DNA, 25 bp, Mus musculus
tcccagtcctcactagactgaaata

SEQ ID NO: 42401 - DNA, 25 bp, Mus musculus
ttacatagttggcacatgtgagaca

SEQ ID NO: 42402 - DNA, 25 bp, Mus musculus
ttcaaggccagtcttggtgacactg

SEQ ID NO: 42403 - DNA, 25 bp, Mus musculus
aaggccagtcttggtgacactgtct

SEQ ID NO: 42404 - DNA, 25 bp, Mus musculus
gccagtcttggtgacactgtctcca

SEQ ID NO: 42405 - DNA, 25 bp, Mus musculus
agtcttggtgacactgtctccaaaa

SEQ ID NO: 42406 - DNA, 25 bp, Mus musculus
gtaatctcagcacttggaagacaga

SEQ ID NO: 42407 - DNA, 25 bp, Mus musculus
atctcagcacttggaagacagacca

SEQ ID NO: 42408 - DNA, 25 bp, Mus musculus
tgagctcaaagacaacctggaagag

SEQ ID NO: 42409 - DNA, 25 bp, Mus musculus
tttaaagctatattctctctcagct

SEQ ID NO: 42410 - DNA, 25 bp, Mus musculus
aaagctatattctctctcagctcca

SEQ ID NO: 42411 - DNA, 25 bp, Mus musculus
atattctctctcagctccaaggaac

SEQ ID NO: 42412 - DNA, 25 bp, Mus musculus
ttctctctcagctccaaggaactgg

SEQ ID NO: 42413 - DNA, 25 bp, Mus musculus
tctctcagctccaaggaactggaaa

SEQ ID NO: 42414 - DNA, 25 bp, Mus musculus
ctctgacccatgtgttctcttggac

SEQ ID NO: 42415 - DNA, 25 bp, Mus musculus
tggactaggctcggtgcctgtgagc

SEQ ID NO: 42416 - DNA, 25 bp, Mus musculus
gacatggtcagcagcaactgggcgt

SEQ ID NO: 42417 - DNA, 25 bp, Mus musculus
catggtcagcagcaactgggcgtca

SEQ ID NO: 42418 - DNA, 25 bp, Mus musculus
tggtcagcagcaactgggcgtcagt

SEQ ID NO: 42419 - DNA, 25 bp, Mus musculus
cagcagcaactgggcgtcagtgagc

SEQ ID NO: 42420 - DNA, 25 bp, Mus musculus
agcaactgggcgtcagtgagcaccg

SEQ ID NO: 42421 - DNA, 25 bp, Mus musculus
caactgggcgtcagtgagcaccgtc

SEQ ID NO: 42422 - DNA, 25 bp, Mus musculus
cgtcagtgagcaccgtctcgatggt

SEQ ID NO: 42423 - DNA, 25 bp, Mus musculus
tcagtgagcaccgtctcgatggtat

SEQ ID NO: 42424 - DNA, 25 bp, Mus musculus
tgagcaccgtctcgatggtatccag

SEQ ID NO: 42425 - DNA, 25 bp, Mus musculus
agcaccgtctcgatggtatccagtg

SEQ ID NO: 42426 - DNA, 25 bp, Mus musculus
gctcggtgcctgtgagcgtagtgtc

SEQ ID NO: 42427 - DNA, 25 bp, Mus musculus
tgcctgtgagcgtagtgtctgctta

SEQ ID NO: 42428 - DNA, 25 bp, Mus musculus
cctgtgagcgtagtgtctgcttatc

SEQ ID NO: 42429 - DNA, 25 bp, Mus musculus
cgtagtgtctgcttatcagccttca

SEQ ID NO: 42430 - DNA, 25 bp, Mus musculus
tagtgtctgcttatcagccttcaac

SEQ ID NO: 42431 - DNA, 25 bp, Mus musculus
gtgtctgcttatcagccttcaacac

SEQ ID NO: 42432 - DNA, 25 bp, Mus musculus
gtctgcttatcagccttcaacacac

SEQ ID NO: 42433 - DNA, 25 bp, Mus musculus
ctgacgtgtgctgacatggtcagca

SEQ ID NO: 42434 - DNA, 25 bp, Mus musculus
ccacctgtccaagggtgcagatagc

SEQ ID NO: 42435 - DNA, 25 bp, Mus musculus
cagtgcacagcttttaactcttgtc

SEQ ID NO: 42436 - DNA, 25 bp, Mus musculus
cggtgcatccatgggctgctagact

SEQ ID NO: 42437 - DNA, 25 bp, Mus musculus
atccatgggctgctagactcttgcg

SEQ ID NO: 42438 - DNA, 25 bp, Mus musculus
ctagactcttgcgggtagagtctcc

SEQ ID NO: 42439 - DNA, 25 bp, Mus musculus
agtctcccctggacttagcattgtg

SEQ ID NO: 42440 - DNA, 25 bp, Mus musculus
ccctggacttagcattgtgagatgg

SEQ ID NO: 42441 - DNA, 25 bp, Mus musculus
cctaaggctcggaggccatggcctt

SEQ ID NO: 42442 - DNA, 25 bp, Mus musculus
tgctctccctgctgatgataaagta

SEQ ID NO: 42443 - DNA, 25 bp, Mus musculus
aatctctggagtcacacctgggcca

SEQ ID NO: 42444 - DNA, 25 bp, Mus musculus
tatcatgaagccttgctgaactaag

SEQ ID NO: 42445 - DNA, 25 bp, Mus musculus
gaagccttgctgaactaagttttgt

SEQ ID NO: 42446 - DNA, 25 bp, Mus musculus
acagcttttaactcttgtcttctgt

SEQ ID NO: 42447 - DNA, 25 bp, Mus musculus
tgagttttccgtcctctgtagtcac

SEQ ID NO: 42448 - DNA, 25 bp, Mus musculus
ttccgtcctctgtagtcacgtgcct

SEQ ID NO: 42449 - DNA, 25 bp, Mus musculus
cctctgtagtcacgtgcctgcacac

SEQ ID NO: 42450 - DNA, 25 bp, Mus musculus
tagtcacgtgcctgcacaccgttct

SEQ ID NO: 42451 - DNA, 25 bp, Mus musculus
ctccttcccacagagaagcagggct

SEQ ID NO: 42452 - DNA, 25 bp, Mus musculus
caggccttcccttggagtcggtgca

SEQ ID NO: 42453 - DNA, 25 bp, Mus musculus
tggagtcggtgcatccatgggctgc

SEQ ID NO: 42454 - DNA, 25 bp, Mus musculus
ttgacacccttgtggataacatctc

SEQ ID NO: 42455 - DNA, 25 bp, Mus musculus
acatctctgtggatcctgtgacagg

SEQ ID NO: 42456 - DNA, 25 bp, Mus musculus
ctctttactgtgatctgtgacaagc

SEQ ID NO: 42457 - DNA, 25 bp, Mus musculus
atctgtgacaagccagctgcacgca

SEQ ID NO: 42458 - DNA, 25 bp, Mus musculus
ccattatttcaatcctttgccatac

SEQ ID NO: 42459 - DNA, 25 bp, Mus musculus
tttcaatcctttgccatactgtaag

SEQ ID NO: 42460 - DNA, 25 bp, Mus musculus
taccacagtgatctctgctaactaa

SEQ ID NO: 42461 - DNA, 25 bp, Mus musculus
agtgatctctgctaactaatgaatg

SEQ ID NO: 42462 - DNA, 25 bp, Mus musculus
atgaatgctgaccttagtctcagac

SEQ ID NO: 42463 - DNA, 25 bp, Mus musculus
gctgaccttagtctcagacataaga

SEQ ID NO: 42464 - DNA, 25 bp, Mus musculus
cttagtctcagacataagaaggtat

SEQ ID NO: 42465 - DNA, 25 bp, Mus musculus
tttcctggcaatagatcctaactag

SEQ ID NO: 42466 - DNA, 25 bp, Mus musculus
ctgtggatcctgtgacaggggacct

SEQ ID NO: 42467 - DNA, 25 bp, Mus musculus
gccatcccaacggaatgaggatctt

SEQ ID NO: 42468 - DNA, 25 bp, Mus musculus
ggatctttttctatgacgcagagaa

SEQ ID NO: 42469 - DNA, 25 bp, Mus musculus
ccggctcagaggtgcttcgaatcca

SEQ ID NO: 42470 - DNA, 25 bp, Mus musculus
tgcttcgaatccagaacattttatc

SEQ ID NO: 42471 - DNA, 25 bp, Mus musculus
atggtaccgtcctgcaaggcaccac

SEQ ID NO: 42472 - DNA, 25 bp, Mus musculus
aactgctgattggcactgtgttcca

SEQ ID NO: 42473 - DNA, 25 bp, Mus musculus
tgattggcactgtgttccacaaagc

SEQ ID NO: 42474 - DNA, 25 bp, Mus musculus
cttcagaaagcatcctacttctcaa

SEQ ID NO: 42475 - DNA, 25 bp, Mus musculus
gcatcctacttctcaacttaaaatt

SEQ ID NO: 42476 - DNA, 25 bp, Mus musculus
ttcattcctcaccaattcaaccatg

SEQ ID NO: 42477 - DNA, 25 bp, Mus musculus
cctcaccaattcaaccatgctgggg

SEQ ID NO: 42478 - DNA, 25 bp, Mus musculus
caccaattcaaccatgctggggcgc

SEQ ID NO: 42479 - DNA, 25 bp, Mus musculus
caattcaaccatgctggggcgcaca

SEQ ID NO: 42480 - DNA, 25 bp, Mus musculus
ttcaaccatgctggggcgcacatat

SEQ ID NO: 42481 - DNA, 25 bp, Mus musculus
catgctggggcgcacatatttagac

SEQ ID NO: 42482 - DNA, 25 bp, Mus musculus
atatttagacagactgaccgtatgc

SEQ ID NO: 42483 - DNA, 25 bp, Mus musculus
tttagacagactgaccgtatgcagt

SEQ ID NO: 42484 - DNA, 25 bp, Mus musculus
agacagactgaccgtatgcagtgat

SEQ ID NO: 42485 - DNA, 25 bp, Mus musculus
gctgctctcgaaggtctcacaggaa

SEQ ID NO: 42486 - DNA, 25 bp, Mus musculus
tcctacttctcaacttaaaattgag

SEQ ID NO: 42487 - DNA, 25 bp, Mus musculus
gctctcgaaggtctcacaggaagac

SEQ ID NO: 42488 - DNA, 25 bp, Mus musculus
tcttctgctggtttataatctgccg

SEQ ID NO: 42489 - DNA, 25 bp, Mus musculus
gaatcttcaaggctttgtctggcac

SEQ ID NO: 42490 - DNA, 25 bp, Mus musculus
tcttcaaggctttgtctggcacaaa

SEQ ID NO: 42491 - DNA, 25 bp, Mus musculus
tcaaggctttgtctggcacaaaggg

SEQ ID NO: 42492 - DNA, 25 bp, Mus musculus
tccagttgaccattttaagatagca

SEQ ID NO: 42493 - DNA, 25 bp, Mus musculus
agcaagccattcattcctcaccaat

SEQ ID NO: 42494 - DNA, 25 bp, Mus musculus
aagccattcattcctcaccaattca

SEQ ID NO: 42495 - DNA, 25 bp, Mus musculus
ctttactcacggagccatcttctca

SEQ ID NO: 42496 - DNA, 25 bp, Mus musculus
cacaccctttatttctgcttaatgt

SEQ ID NO: 42497 - DNA, 25 bp, Mus musculus
cactgagccatctttgcagccctac

SEQ ID NO: 42498 - DNA, 25 bp, Mus musculus
tcaaaggccatattgctttgatggt

SEQ ID NO: 42499 - DNA, 25 bp, Mus musculus
tgatggttttcactcaattgtctca

SEQ ID NO: 42500 - DNA, 25 bp, Mus musculus
ctcaattgtctcatttcatcaatct

SEQ ID NO: 42501 - DNA, 25 bp, Mus musculus
tgatgctcaagtcccataattctta

SEQ ID NO: 42502 - DNA, 25 bp, Mus musculus
tgctcaagtcccataattcttattt

SEQ ID NO: 42503 - DNA, 25 bp, Mus musculus
atttttactcactacatagagtata

SEQ ID NO: 42504 - DNA, 25 bp, Mus musculus
actcactacatagagtatatctgcc

SEQ ID NO: 42505 - DNA, 25 bp, Mus musculus
atctgccaatagacttgacaacatt

SEQ ID NO: 42506 - DNA, 25 bp, Mus musculus
tgacaacattcctattgttggattt

SEQ ID NO: 42507 - DNA, 25 bp, Mus musculus
tatttctgcttaatgtatatgggtg

SEQ ID NO: 42508 - DNA, 25 bp, Mus musculus
tgtatctatgtgcacatttgggagc

SEQ ID NO: 42509 - DNA, 25 bp, Mus musculus
tgccagatccgcctggagcagaatt

SEQ ID NO: 42510 - DNA, 25 bp, Mus musculus
cagatccgcctggagcagaattata

SEQ ID NO: 42511 - DNA, 25 bp, Mus musculus
ttgtgaactgtcatgtgggtcctga

SEQ ID NO: 42512 - DNA, 25 bp, Mus musculus
tctaaaagtacacttaaccactgag

SEQ ID NO: 42513 - DNA, 25 bp, Mus musculus
acacttaaccactgagccatctttg

SEQ ID NO: 42514 - DNA, 25 bp, Mus musculus
cttaaccactgagccatctttgcag

SEQ ID NO: 42515 - DNA, 25 bp, Mus musculus
tcttctacacagtaaaccggtcatg

SEQ ID NO: 42516 - DNA, 25 bp, Mus musculus
ttctacacagtaaaccggtcatggt

SEQ ID NO: 42517 - DNA, 25 bp, Mus musculus
tctcgcgtgaggagctaacgcgcac

SEQ ID NO: 42518 - DNA, 25 bp, Mus musculus
gagctaacgcgcacgagcttcctgc

SEQ ID NO: 42519 - DNA, 25 bp, Mus musculus
agctaacgcgcacgagcttcctgca

SEQ ID NO: 42520 - DNA, 25 bp, Mus musculus
ctaacgcgcacgagcttcctgcagg

SEQ ID NO: 42521 - DNA, 25 bp, Mus musculus
taacgcgcacgagcttcctgcaggc

SEQ ID NO: 42522 - DNA, 25 bp, Mus musculus
acgcgcacgagcttcctgcaggctg

SEQ ID NO: 42523 - DNA, 25 bp, Mus musculus
cgcacgagcttcctgcaggctgtgt

SEQ ID NO: 42524 - DNA, 25 bp, Mus musculus
tgacgtcgtacgtctcttatgatct

SEQ ID NO: 42525 - DNA, 25 bp, Mus musculus
acgtcgtacgtctcttatgatcttt

SEQ ID NO: 42526 - DNA, 25 bp, Mus musculus
cgtcgtacgtctcttatgatctttt

SEQ ID NO: 42527 - DNA, 25 bp, Mus musculus
tacacagtaaaccggtcatggtcaa

SEQ ID NO: 42528 - DNA, 25 bp, Mus musculus
acacagtaaaccggtcatggtcaag

SEQ ID NO: 42529 - DNA, 25 bp, Mus musculus
cagtaaaccggtcatggtcaaggat

SEQ ID NO: 42530 - DNA, 25 bp, Mus musculus
gtaaaccggtcatggtcaaggatga

SEQ ID NO: 42531 - DNA, 25 bp, Mus musculus
taaaccggtcatggtcaaggatgat

SEQ ID NO: 42532 - DNA, 25 bp, Mus musculus
aaccggtcatggtcaaggatgatct

SEQ ID NO: 42533 - DNA, 25 bp, Mus musculus
accggtcatggtcaaggatgatctc

SEQ ID NO: 42534 - DNA, 25 bp, Mus musculus
atctcgcgtgaggagctaacgcgca

SEQ ID NO: 42535 - DNA, 25 bp, Mus musculus
gattgtcctatctccagcggccctg

SEQ ID NO: 42536 - DNA, 25 bp, Mus musculus
tgtcctatctccagcggccctgtca

SEQ ID NO: 42537 - DNA, 25 bp, Mus musculus
cctgctgccatgtggcctggtgcaa

SEQ ID NO: 42538 - DNA, 25 bp, Mus musculus
gccatgtggcctggtgcaagttgag

SEQ ID NO: 42539 - DNA, 25 bp, Mus musculus
agttgaggacttcttgctggtctag

SEQ ID NO: 42540 - DNA, 25 bp, Mus musculus
ggacttcttgctggtctagtcacac

SEQ ID NO: 42541 - DNA, 25 bp, Mus musculus
cttgctggtctagtcacacatgcag

SEQ ID NO: 42542 - DNA, 25 bp, Mus musculus
ggtctagtcacacatgcagtgttgg

SEQ ID NO: 42543 - DNA, 25 bp, Mus musculus
ctagtcacacatgcagtgttgggga

SEQ ID NO: 42544 - DNA, 25 bp, Mus musculus
atgccttggtttttactgctctgag

SEQ ID NO: 42545 - DNA, 25 bp, Mus musculus
ccttggtttttactgctctgagaat

SEQ ID NO: 42546 - DNA, 25 bp, Mus musculus
ttactgctctgagaattgttgagat

SEQ ID NO: 42547 - DNA, 25 bp, Mus musculus
cctgtcatccagctcactcatcaat

SEQ ID NO: 42548 - DNA, 25 bp, Mus musculus
gtcatccagctcactcatcaatggg

SEQ ID NO: 42549 - DNA, 25 bp, Mus musculus
ctcactcatcaatggggccacacag

SEQ ID NO: 42550 - DNA, 25 bp, Mus musculus
actcatcaatggggccacacagtca

SEQ ID NO: 42551 - DNA, 25 bp, Mus musculus
catcaatggggccacacagtcaggc

SEQ ID NO: 42552 - DNA, 25 bp, Mus musculus
ggccacacagtcaggcccaggcact

SEQ ID NO: 42553 - DNA, 25 bp, Mus musculus
cacacagtcaggcccaggcactggg

SEQ ID NO: 42554 - DNA, 25 bp, Mus musculus
cccaggcactgggctccggaggact

SEQ ID NO: 42555 - DNA, 25 bp, Mus musculus
ttctcttaagcaggagaagccaact

SEQ ID NO: 42556 - DNA, 25 bp, Mus musculus
aagactttcaatttttgctgataag

SEQ ID NO: 42557 - DNA, 25 bp, Mus musculus
gttcccagtcaacaatgaagcaggt

SEQ ID NO: 42558 - DNA, 25 bp, Mus musculus
aggaccaatccgtctgttcatggag

SEQ ID NO: 42559 - DNA, 25 bp, Mus musculus
tctgttcatggagctggtgacctgt

SEQ ID NO: 42560 - DNA, 25 bp, Mus musculus
catggagctggtgacctgtggcctt

SEQ ID NO: 42561 - DNA, 25 bp, Mus musculus
gctggtgacctgtggcctttccaaa

SEQ ID NO: 42562 - DNA, 25 bp, Mus musculus
tggcctttccaaaaacccatatctg

SEQ ID NO: 42563 - DNA, 25 bp, Mus musculus
ttccaaaaacccatatctgagtgtt

SEQ ID NO: 42564 - DNA, 25 bp, Mus musculus
aaacccatatctgagtgttaaacag

SEQ ID NO: 42565 - DNA, 25 bp, Mus musculus
taatatagcgttcacttaacatcac

SEQ ID NO: 42566 - DNA, 25 bp, Mus musculus
agcgttcacttaacatcacaaagaa

SEQ ID NO: 42567 - DNA, 25 bp, Mus musculus
ttcaatttttgctgataaggcgttt

SEQ ID NO: 42568 - DNA, 25 bp, Mus musculus
tgctgatgaaccacctgaaccagaa

SEQ ID NO: 42569 - DNA, 25 bp, Mus musculus
tgaaccacctgaaccagaagcatca

SEQ ID NO: 42570 - DNA, 25 bp, Mus musculus
acctgaaccagaagcatcaccttct

SEQ ID NO: 42571 - DNA, 25 bp, Mus musculus
tgctaagcagttagcctcggtagct

SEQ ID NO: 42572 - DNA, 25 bp, Mus musculus
gcagttagcctcggtagctgaccag

SEQ ID NO: 42573 - DNA, 25 bp, Mus musculus
agcctcggtagctgaccagcccttt

SEQ ID NO: 42574 - DNA, 25 bp, Mus musculus
ggtagctgaccagccctttgagaat

SEQ ID NO: 42575 - DNA, 25 bp, Mus musculus
tcttgggttgcatgggctcaatcaa

SEQ ID NO: 42576 - DNA, 25 bp, Mus musculus
gttgcatgggctcaatcaaggaaaa

SEQ ID NO: 42577 - DNA, 25 bp, Mus musculus
attatcactctgacaacagcactat

SEQ ID NO: 42578 - DNA, 25 bp, Mus musculus
acaacagcactatgaaggcatggga

SEQ ID NO: 42579 - DNA, 25 bp, Mus musculus
catgggacttcatccagacacaact

SEQ ID NO: 42580 - DNA, 25 bp, Mus musculus
acttcatccagacacaactgcagtg

SEQ ID NO: 42581 - DNA, 25 bp, Mus musculus
tccagacacaactgcagtgttgtgg

SEQ ID NO: 42582 - DNA, 25 bp, Mus musculus
cacaactgcagtgttgtggtgtaaa

SEQ ID NO: 42583 - DNA, 25 bp, Mus musculus
attggaccagtggtccaccatcttc

SEQ ID NO: 42584 - DNA, 25 bp, Mus musculus
cctgcccatcaggtgcagatgttca

SEQ ID NO: 42585 - DNA, 25 bp, Mus musculus
ttcactccaatttcttgtatattgg

SEQ ID NO: 42586 - DNA, 25 bp, Mus musculus
tgatacaggtgctgggaatgtcctt

SEQ ID NO: 42587 - DNA, 25 bp, Mus musculus
tgctgctgattattctccttgctga

SEQ ID NO: 42588 - DNA, 25 bp, Mus musculus
tgattattctccttgctgaggtgac

SEQ ID NO: 42589 - DNA, 25 bp, Mus musculus
ttctccttgctgaggtgaccatagc

SEQ ID NO: 42590 - DNA, 25 bp, Mus musculus
ccatcctgctctttgtgtatgaaca

SEQ ID NO: 42591 - DNA, 25 bp, Mus musculus
tcaacactttagtggctgagggtct

SEQ ID NO: 42592 - DNA, 25 bp, Mus musculus
tgaatgacagcatccaacattatca

SEQ ID NO: 42593 - DNA, 25 bp, Mus musculus
acagcatccaacattatcactctga

SEQ ID NO: 42594 - DNA, 25 bp, Mus musculus
tccaacattatcactctgacaacag

SEQ ID NO: 42595 - DNA, 25 bp, Mus musculus
ctgggcgccactggagtgagcagac

SEQ ID NO: 42596 - DNA, 25 bp, Mus musculus
gtgagcagacagcactccggcatgg

SEQ ID NO: 42597 - DNA, 25 bp, Mus musculus
aaagcctgctctaccagcttgctct

SEQ ID NO: 42598 - DNA, 25 bp, Mus musculus
tgctctaccagcttgctctcggagg

SEQ ID NO: 42599 - DNA, 25 bp, Mus musculus
ctctaccagcttgctctcggaggca

SEQ ID NO: 42600 - DNA, 25 bp, Mus musculus
gcagggtctatcctccagaaggagc

SEQ ID NO: 42601 - DNA, 25 bp, Mus musculus
tatcctccagaaggagcctttgcct

SEQ ID NO: 42602 - DNA, 25 bp, mus musculus
cagaaggagcctttgcctggttctt

SEQ ID NO: 42603 - DNA, 25 bp, mus musculus
tggttcttcctgggaacgtggcact

SEQ ID NO: 42604 - DNA, 25 bp, mus musculus
ttcttcctgggaacgtggcactttg

SEQ ID NO: 42605 - DNA, 25 bp, mus musculus
tcttcctgggaacgtggcactttga

SEQ ID NO: 42606 - DNA, 25 bp, mus musculus
cctgggaacgtggcactttgatgaa

SEQ ID NO: 42607 - DNA, 25 bp, mus musculus
tgagcagacagcactccggcatggt

SEQ ID NO: 42608 - DNA, 25 bp, mus musculus
agcagacagcactccggcatggttg

SEQ ID NO: 42609 - DNA, 25 bp, mus musculus
agacagcactccggcatggttggga

SEQ ID NO: 42610 - DNA, 25 bp, mus musculus
gacagcactccggcatggttgggag

SEQ ID NO: 42611 - DNA, 25 bp, mus musculus
cagcactccggcatggttgggagaa

SEQ ID NO: 42612 - DNA, 25 bp, mus musculus
actccggcatggttgggagaagctg

SEQ ID NO: 42613 - DNA, 25 bp, mus musculus
ggcactcctagaggagagaggtccc

SEQ ID NO: 42614 - DNA, 25 bp, mus musculus
gcactcctagaggagagaggtccca

SEQ ID NO: 42615 - DNA, 25 bp, mus musculus
catctcctatagagttgaataattg

SEQ ID NO: 42616 - DNA, 25 bp, mus musculus
atctcctatagagttgaataattgt

SEQ ID NO: 42617 - DNA, 25 bp, mus musculus
gttccctcaggtgttctgtcttcca

SEQ ID NO: 42618 - DNA, 25 bp, mus musculus
agttttgagctagtcagtgtagttg

SEQ ID NO: 42619 - DNA, 25 bp, mus musculus
gttagacactccttctgtctatgac

SEQ ID NO: 42620 - DNA, 25 bp, mus musculus
ttagacactccttctgtctatgaca

SEQ ID NO: 42621 - DNA, 25 bp, mus musculus
tggcatctgtttgatccctatagtt

SEQ ID NO: 42622 - DNA, 25 bp, mus musculus
ggcatctgtttgatccctatagttc

SEQ ID NO: 42623 - DNA, 25 bp, mus musculus
catctgtttgatccctatagttcta

SEQ ID NO: 42624 - DNA, 25 bp, mus musculus
tttgatccctatagttctatttggg

SEQ ID NO: 42625 - DNA, 25 bp, mus musculus
gatccctatagttctatttgggctc

SEQ ID NO: 42626 - DNA, 25 bp, mus musculus
atccctatagttctatttgggctcg

SEQ ID NO: 42627 - DNA, 25 bp, mus musculus
taattgtctatcagtttgctccctt

SEQ ID NO: 42628 - DNA, 25 bp, mus musculus
attgtctatcagtttgctcccttta

SEQ ID NO: 42629 - DNA, 25 bp, mus musculus
ttgtctatcagtttgctccctttac

SEQ ID NO: 42630 - DNA, 25 bp, mus musculus
gtctatcagtttgctccctttacat

SEQ ID NO: 42631 - DNA, 25 bp, mus musculus
tctatcagtttgctccctttacatt

SEQ ID NO: 42632 - DNA, 25 bp, mus musculus
tatcagtttgctccctttacattct

SEQ ID NO: 42633 - DNA, 25 bp, mus musculus
atcagtttgctccctttacattctg

SEQ ID NO: 42634 - DNA, 25 bp, mus musculus
agtttgctccctttacattctggct

SEQ ID NO: 42635 - DNA, 25 bp, mus musculus
agaatgagctgcagctggaggagta

SEQ ID NO: 42636 - DNA, 25 bp, mus musculus
aggcctaccaggtcagcttgcaagg

SEQ ID NO: 42637 - DNA, 25 bp, mus musculus
cttctgtaacatggctcatccctgg

SEQ ID NO: 42638 - DNA, 25 bp, mus musculus
taacatggctcatccctggttcaaa

SEQ ID NO: 42639 - DNA, 25 bp, mus musculus
cacccacaggctgagagctgctgct

SEQ ID NO: 42640 - DNA, 25 bp, mus musculus
tgctgctgttacacacaggacacga

SEQ ID NO: 42641 - DNA, 25 bp, mus musculus
tgttacacacaggacacgagtatac

SEQ ID NO: 42642 - DNA, 25 bp, mus musculus
cgagcattaacttgcacacatatga

SEQ ID NO: 42643 - DNA, 25 bp, mus musculus
ttaacttgcacacatatgaccgtca

SEQ ID NO: 42644 - DNA, 25 bp, mus musculus
tgcacacatatgaccgtcagttaca

SEQ ID NO: 42645 - DNA, 25 bp, mus musculus
catatgaccgtcagttacacgcaat

SEQ ID NO: 42646 - DNA, 25 bp, mus musculus
accgtcagttacacgcaatatatac

SEQ ID NO: 42647 - DNA, 25 bp, mus musculus
accaggtcagcttgcaaggttgaat

SEQ ID NO: 42648 - DNA, 25 bp, mus musculus
gaaagatacatgccatccggtggtg

SEQ ID NO: 42649 - DNA, 25 bp, mus musculus
tgttctgacgcctgtagtgcagcta

SEQ ID NO: 42650 - DNA, 25 bp, mus musculus
gacgcctgtagtgcagctagctttc

SEQ ID NO: 42651 - DNA, 25 bp, mus musculus
gcagctagctttctgttctaaattc

SEQ ID NO: 42652 - DNA, 25 bp, mus musculus
taaattctgtagttcctaggtgtgt

SEQ ID NO: 42653 - DNA, 25 bp, mus musculus
tatcaactccatcttctgtaacatg

SEQ ID NO: 42654 - DNA, 25 bp, mus musculus
ctccatcttctgtaacatggctcat

SEQ ID NO: 42655 - DNA, 25 bp, mus musculus
gcttcccacagttctttctggtact

SEQ ID NO: 42656 - DNA, 25 bp, mus musculus
agttctttctggtactcctgtgaga

SEQ ID NO: 42657 - DNA, 25 bp, mus musculus
agttcattggccagaatgccaacga

SEQ ID NO: 42658 - DNA, 25 bp, mus musculus
ttggccagaatgccaacgattttgc

SEQ ID NO: 42659 - DNA, 25 bp, mus musculus
agaatgccaacgattttgctgaaac

SEQ ID NO: 42660 - DNA, 25 bp, mus musculus
atgccaacgattttgctgaaaccgg

SEQ ID NO: 42661 - DNA, 25 bp, mus musculus
attttgctgaaaccggcatctggat

SEQ ID NO: 42662 - DNA, 25 bp, mus musculus
acttctcgagttctttcctcatgtt

SEQ ID NO: 42663 - DNA, 25 bp, mus musculus
tgttactgatctcctcctctgtgaa

SEQ ID NO: 42664 - DNA, 25 bp, mus musculus
tctcctcctctgtgaaatccacttt

SEQ ID NO: 42665 - DNA, 25 bp, mus musculus
cctctgtgaaatccacttttcccag

SEQ ID NO: 42666 - DNA, 25 bp, mus musculus
tgaaatccacttttcccagcaaatc

SEQ ID NO: 42667 - DNA, 25 bp, mus musculus
tactcctgtgagaggctgtcgtcca

SEQ ID NO: 42668 - DNA, 25 bp, mus musculus
ctgtcgtccacacaagttaacactg

SEQ ID NO: 42669 - DNA, 25 bp, mus musculus
tcgtccacacaagttaacactgcgt

SEQ ID NO: 42670 - DNA, 25 bp, mus musculus
ttttcaatagcctcattaatagcta

SEQ ID NO: 42671 - DNA, 25 bp, mus musculus
actgcagcatgtagtgcagcttcgt

SEQ ID NO: 42672 - DNA, 25 bp, mus musculus
gcagcttcgtccacagacagttcat

SEQ ID NO: 42673 - DNA, 25 bp, mus musculus
tccacagacagttcattggccagaa

SEQ ID NO: 42674 - DNA, 25 bp, mus musculus
acagacagttcattggccagaatgc

SEQ ID NO: 42675 - DNA, 25 bp, mus musculus
caagccaggctttagggctgtgact

SEQ ID NO: 42676 - DNA, 25 bp, mus musculus
gccaggctttagggctgtgacttgc

SEQ ID NO: 42677 - DNA, 25 bp, mus musculus
tcctctctagaaagtcaaagcatcc

SEQ ID NO: 42678 - DNA, 25 bp, mus musculus
aaagtcaaagcatccattccatgag

SEQ ID NO: 42679 - DNA, 25 bp, mus musculus
gtcaaagcatccattccatgagaac

SEQ ID NO: 42680 - DNA, 25 bp, mus musculus
caaagcatccattccatgagaactt

SEQ ID NO: 42681 - DNA, 25 bp, mus musculus
aaagcatccattccatgagaactta

SEQ ID NO: 42682 - DNA, 25 bp, mus musculus
agcatccattccatgagaacttaaa

SEQ ID NO: 42683 - DNA, 25 bp, mus musculus
gcatccattccatgagaacttaaac

SEQ ID NO: 42684 - DNA, 25 bp, mus musculus
atccattccatgagaacttaaacaa

SEQ ID NO: 42685 - DNA, 25 bp, mus musculus
acttaaacaattacctgcctgactg

SEQ ID NO: 42686 - DNA, 25 bp, mus musculus
taaacaattacctgcctgactggca

SEQ ID NO: 42687 - DNA, 25 bp, mus musculus
ccaggctttagggctgtgacttgca

SEQ ID NO: 42688 - DNA, 25 bp, mus musculus
caattacctgcctgactggcatttt

SEQ ID NO: 42689 - DNA, 25 bp, mus musculus
ggctttagggctgtgacttgcaact

SEQ ID NO: 42690 - DNA, 25 bp, mus musculus
ctttagggctgtgacttgcaacttc

SEQ ID NO: 42691 - DNA, 25 bp, mus musculus
taagtgacttattcctctctagaaa

SEQ ID NO: 42692 - DNA, 25 bp, mus musculus
aagtgacttattcctctctagaaag

SEQ ID NO: 42693 - DNA, 25 bp, mus musculus
gtgacttattcctctctagaaagtc

SEQ ID NO: 42694 - DNA, 25 bp, mus musculus
cttattcctctctagaaagtcaaag

SEQ ID NO: 42695 - DNA, 25 bp, mus musculus
attcctctctagaaagtcaaagcat

SEQ ID NO: 42696 - DNA, 25 bp, mus musculus
attatcattgaagtcctgaagaaga

SEQ ID NO: 42697 - DNA, 25 bp, mus musculus
agacattccggggactttggagcag

SEQ ID NO: 42698 - DNA, 25 bp, mus musculus
tgcagtgttctaccttagcagagaa

SEQ ID NO: 42699 - DNA, 25 bp, mus musculus
gttctaccttagcagagaacagaag

SEQ ID NO: 42700 - DNA, 25 bp, mus musculus
ccctccagcccagaggtgcaaagtg

SEQ ID NO: 42701 - DNA, 25 bp, mus musculus
ggccttcgtcagctctgccgggtca

SEQ ID NO: 42702 - DNA, 25 bp, mus musculus
ctctgccgggtcatgctcaggtctc

SEQ ID NO: 42703 - DNA, 25 bp, mus musculus
aatctcttttccactgtcacatttg

SEQ ID NO: 42704 - DNA, 25 bp, mus musculus
ttttccactgtcacatttgacccca

SEQ ID NO: 42705 - DNA, 25 bp, mus musculus
gaccccaaatccaagtcactgacta

SEQ ID NO: 42706 - DNA, 25 bp, mus musculus
aaatccaagtcactgactagcagac

SEQ ID NO: 42707 - DNA, 25 bp, mus musculus
aagtcactgactagcagaccctgac

SEQ ID NO: 42708 - DNA, 25 bp, mus musculus
tccggggactttggagcagatgctc

SEQ ID NO: 42709 - DNA, 25 bp, mus musculus
gccctggagctcttccggaatgaca

SEQ ID NO: 42710 - DNA, 25 bp, mus musculus
gagctcttccggaatgacattgccg

SEQ ID NO: 42711 - DNA, 25 bp, mus musculus
ttccggaatgacattgccgccaagt

SEQ ID NO: 42712 - DNA, 25 bp, mus musculus
aatgacattgccgccaagtacaagg

SEQ ID NO: 42713 - DNA, 25 bp, mus musculus
gagctaggcttccagggctgagcca

SEQ ID NO: 42714 - DNA, 25 bp, mus musculus
ggcttccagggctgagccatgggct

SEQ ID NO: 42715 - DNA, 25 bp, mus musculus
tgagccatgggctcccactgtccag

SEQ ID NO: 42716 - DNA, 25 bp, mus musculus
caggcacacctgtcatcgcaggacc

SEQ ID NO: 42717 - DNA, 25 bp, mus musculus
cacctgtcatcgcaggacccactga

SEQ ID NO: 42718 - DNA, 25 bp, mus musculus
atctcacggcacagtattacgtcgt

SEQ ID NO: 42719 - DNA, 25 bp, mus musculus
cggcacagtattacgtcgtgcagta

SEQ ID NO: 42720 - DNA, 25 bp, mus musculus
acgtcgtgcagtatgctcagggtga

SEQ ID NO: 42721 - DNA, 25 bp, mus musculus
atgctcagggtgacgtccgcctctg

SEQ ID NO: 42722 - DNA, 25 bp, mus musculus
gcctctgcttgtccggcttcctggc

SEQ ID NO: 42723 - DNA, 25 bp, mus musculus
tcctggcctgggacatcgcttcgcc

SEQ ID NO: 42724 - DNA, 25 bp, mus musculus
cctgggacatcgcttcgcctccagt

SEQ ID NO: 42725 - DNA, 25 bp, mus musculus
acatcgcttcgcctccagtacctgt

SEQ ID NO: 42726 - DNA, 25 bp, mus musculus
cttcgcctccagtacctgtgtggat

SEQ ID NO: 42727 - DNA, 25 bp, mus musculus
tacctgtgtggatccgcgacgacgt

SEQ ID NO: 42728 - DNA, 25 bp, mus musculus
tcatcgcaggacccactgaggagat

SEQ ID NO: 42729 - DNA, 25 bp, mus musculus
ccctgcatgcagccattgggggaat

SEQ ID NO: 42730 - DNA, 25 bp, mus musculus
agtacatcatccggtgctcagacat

SEQ ID NO: 42731 - DNA, 25 bp, mus musculus
tcatccggtgctcagacatcccaga

SEQ ID NO: 42732 - DNA, 25 bp, mus musculus
ggtgctcagacatcccagagatgct

SEQ ID NO: 42733 - DNA, 25 bp, mus musculus
cagacatcccagagatgctagtagt

SEQ ID NO: 42734 - DNA, 25 bp, mus musculus
tagtagtctcactcatcattgcggg

SEQ ID NO: 42735 - DNA, 25 bp, mus musculus
ggcttaatctcacggcacagtatta

SEQ ID NO: 42736 - DNA, 25 bp, mus musculus
tgcatatgtctacctggtgagtaag

SEQ ID NO: 42737 - DNA, 25 bp, mus musculus
atatgtctacctggtgagtaaggcc

SEQ ID NO: 42738 - DNA, 25 bp, mus musculus
acccaaagagctccaggcagtgtgg

SEQ ID NO: 42739 - DNA, 25 bp, mus musculus
caaagagctccaggcagtgtggtgg

SEQ ID NO: 42740 - DNA, 25 bp, mus musculus
aaggtcctcaccagagttggcagga

SEQ ID NO: 42741 - DNA, 25 bp, mus musculus
ctcaccagagttggcaggaacctgc

SEQ ID NO: 42742 - DNA, 25 bp, mus musculus
ggcaggaacctgcacaaccagcagc

SEQ ID NO: 42743 - DNA, 25 bp, mus musculus
aggaacctgcacaaccagcagcatc

SEQ ID NO: 42744 - DNA, 25 bp, mus musculus
catcaccctctgtggctgatcaagg

SEQ ID NO: 42745 - DNA, 25 bp, mus musculus
caccctctgtggctgatcaaggaga

SEQ ID NO: 42746 - DNA, 25 bp, mus musculus
gagcacttctacaagcagtatgtgg

SEQ ID NO: 42747 - DNA, 25 bp, mus musculus
cacttctacaagcagtatgtgggcc

SEQ ID NO: 42748 - DNA, 25 bp, mus musculus
taaggccagtcacatctccagaggc

SEQ ID NO: 42749 - DNA, 25 bp, mus musculus
ggccagtcacatctccagaggccat

SEQ ID NO: 42750 - DNA, 25 bp, mus musculus
cagtcacatctccagaggccatagc

SEQ ID NO: 42751 - DNA, 25 bp, mus musculus
ctccagaggccatagcaccaggcct

SEQ ID NO: 42752 - DNA, 25 bp, mus musculus
cagaggccatagcaccaggcctggg

SEQ ID NO: 42753 - DNA, 25 bp, mus musculus
ccatagcaccaggcctggggatcga

SEQ ID NO: 42754 - DNA, 25 bp, mus musculus
gagtgtgccacccaaagagctccag

SEQ ID NO: 42755 - DNA, 25 bp, mus musculus
tgtgccacccaaagagctccaggca

SEQ ID NO: 42756 - DNA, 25 bp, mus musculus
gtattggctgccatcaccctgctgg

SEQ ID NO: 42757 - DNA, 25 bp, mus musculus
gctgccatcaccctgctggaagtgc

SEQ ID NO: 42758 - DNA, 25 bp, mus musculus
tcagccacaagcacagacctgttgt

SEQ ID NO: 42759 - DNA, 25 bp, mus musculus
acaagcacagacctgttgtggctcc

SEQ ID NO: 42760 - DNA, 25 bp, mus musculus
tggctcctttgtaccactttcagct

SEQ ID NO: 42761 - DNA, 25 bp, mus musculus
ctttgtaccactttcagctgggctt

SEQ ID NO: 42762 - DNA, 25 bp, mus musculus
accactttcagctgggcttagggca

SEQ ID NO: 42763 - DNA, 25 bp, mus musculus
caccacggctgaggatctgagtaag

SEQ ID NO: 42764 - DNA, 25 bp, mus musculus
gttgtcttctgacctttacaaacat

SEQ ID NO: 42765 - DNA, 25 bp, mus musculus
cctttacaaacatgctgtagcgcac

SEQ ID NO: 42766 - DNA, 25 bp, mus musculus
ctctcgtacatgtacatgcacacac

SEQ ID NO: 42767 - DNA, 25 bp, mus musculus
tacatgcacacacacacgtattaaa

SEQ ID NO: 42768 - DNA, 25 bp, mus musculus
atcaccctgctggaagtgccacatg

SEQ ID NO: 42769 - DNA, 25 bp, mus musculus
ccacatgctgcaccaagggaagtgg

SEQ ID NO: 42770 - DNA, 25 bp, mus musculus
gagcacaaccttgcagagaaagcca

SEQ ID NO: 42771 - DNA, 25 bp, mus musculus
aggagcaagctcagagctgggcatt

SEQ ID NO: 42772 - DNA, 25 bp, mus musculus
aagctcagagctgggcattcttcaa

SEQ ID NO: 42773 - DNA, 25 bp, mus musculus
gggcattcttcaagtcagagacttg

SEQ ID NO: 42774 - DNA, 25 bp, mus musculus
tcttcaagtcagagacttgtcttgg

SEQ ID NO: 42775 - DNA, 25 bp, mus musculus
gttggttcagccacaagcacagacc

SEQ ID NO: 42776 - DNA, 25 bp, mus musculus
gagccggttcgatctgaggaaggcc

SEQ ID NO: 42777 - DNA, 25 bp, mus musculus
caggatcagtgcctttggctacctc

SEQ ID NO: 42778 - DNA, 25 bp, mus musculus
gtaggactccatgctgccagtttct

SEQ ID NO: 42779 - DNA, 25 bp, mus musculus
aggactccatgctgccagtttcttt

SEQ ID NO: 42780 - DNA, 25 bp, mus musculus
tttctgcccaggactgcatgagatt

SEQ ID NO: 42781 - DNA, 25 bp, mus musculus
tctgcccaggactgcatgagatttc

SEQ ID NO: 42782 - DNA, 25 bp, mus musculus
cctgcctttcctgagcagggctcct

SEQ ID NO: 42783 - DNA, 25 bp, mus musculus
tgcctttcctgagcagggctcctcc

SEQ ID NO: 42784 - DNA, 25 bp, mus musculus
tggggctcttagtccctctggcctt

SEQ ID NO: 42785 - DNA, 25 bp, mus musculus
cccatattacacaccagcactttat

SEQ ID NO: 42786 - DNA, 25 bp, mus musculus
catattacacaccagcactttatat

SEQ ID NO: 42787 - DNA, 25 bp, mus musculus
tttggctcacaggaggagtctaggg

SEQ ID NO: 42788 - DNA, 25 bp, mus musculus
ggatcagtgcctttggctacctcga

SEQ ID NO: 42789 - DNA, 25 bp, mus musculus
cagtgcctttggctacctcgagtgc

SEQ ID NO: 42790 - DNA, 25 bp, mus musculus
gtgcctttggctacctcgagtgctc

SEQ ID NO: 42791 - DNA, 25 bp, mus musculus
gcctacaggtccggaagaataagcg

SEQ ID NO: 42792 - DNA, 25 bp, mus musculus
gtcccattctctgacttccccaaag

SEQ ID NO: 42793 - DNA, 25 bp, mus musculus
cattctctgacttccccaaagcttc

SEQ ID NO: 42794 - DNA, 25 bp, mus musculus
cgccatccttgtaggactccatgct

SEQ ID NO: 42795 - DNA, 25 bp, mus musculus
ccttgtaggactccatgctgccagt

SEQ ID NO: 42796 - DNA, 25 bp, mus musculus
tatacatgaccacggcggcaatgaa

SEQ ID NO: 42797 - DNA, 25 bp, mus musculus
tacatgaccacggcggcaatgaagg

SEQ ID NO: 42798 - DNA, 25 bp, mus musculus
gcacctctggcctgaggaggagtct

SEQ ID NO: 42799 - DNA, 25 bp, mus musculus
acctctggcctgaggaggagtctgg

SEQ ID NO: 42800 - DNA, 25 bp, mus musculus
atcaggtctaggtcatccttgacgt

SEQ ID NO: 42801 - DNA, 25 bp, mus musculus
caggtctaggtcatccttgacgtcc

SEQ ID NO: 42802 - DNA, 25 bp, mus musculus
ggtctaggtcatccttgacgtccag

SEQ ID NO: 42803 - DNA, 25 bp, mus musculus
tctaggtcatccttgacgtccagag

SEQ ID NO: 42804 - DNA, 25 bp, mus musculus
taggtcatccttgacgtccagagtt

SEQ ID NO: 42805 - DNA, 25 bp, mus musculus
ggtcatccttgacgtccagagtttc

SEQ ID NO: 42806 - DNA, 25 bp, mus musculus
tcatccttgacgtccagagtttcca

SEQ ID NO: 42807 - DNA, 25 bp, mus musculus
atccttgacgtccagagtttccagg

SEQ ID NO: 42808 - DNA, 25 bp, mus musculus
catgaccacggcggcaatgaaggtc

SEQ ID NO: 42809 - DNA, 25 bp, mus musculus
ttgacgtccagagtttccaggtcaa

SEQ ID NO: 42810 - DNA, 25 bp, mus musculus
tgaccacggcggcaatgaaggtctt

SEQ ID NO: 42811 - DNA, 25 bp, mus musculus
ttgcagaacagcgcgctccgggaga

SEQ ID NO: 42812 - DNA, 25 bp, mus musculus
atgtccagctggtagtcgcgcacgg

SEQ ID NO: 42813 - DNA, 25 bp, mus musculus
gtagatccacagggctcccgcagcc

SEQ ID NO: 42814 - DNA, 25 bp, mus musculus
ggatccagctgccgctcagcctcgt

SEQ ID NO: 42815 - DNA, 25 bp, mus musculus
ccagcagcacctctggcctgaggag

SEQ ID NO: 42816 - DNA, 25 bp, mus musculus
agcagcacctctggcctgaggagga

SEQ ID NO: 42817 - DNA, 25 bp, mus musculus
ggaactgacttacatcgaaattgtg

SEQ ID NO: 42818 - DNA, 25 bp, mus musculus
cttctagactctatcatgggtaaaa

SEQ ID NO: 42819 - DNA, 25 bp, mus musculus
tgactgcgctggcttctgttaccat

SEQ ID NO: 42820 - DNA, 25 bp, mus musculus
cttctgttaccatccaattcaggca

SEQ ID NO: 42821 - DNA, 25 bp, mus musculus
ttaccatccaattcaggcagagggt

SEQ ID NO: 42822 - DNA, 25 bp, mus musculus
tactctatatctcccttcatgttta

SEQ ID NO: 42823 - DNA, 25 bp, mus musculus
cccttcatgtttatccatttgtgac

SEQ ID NO: 42824 - DNA, 25 bp, mus musculus
atgtttatccatttgtgaccacttc

SEQ ID NO: 42825 - DNA, 25 bp, mus musculus
ttgtgaccacttccactgtgactca

SEQ ID NO: 42826 - DNA, 25 bp, mus musculus
ccacttccactgtgactcattcaca

SEQ ID NO: 42827 - DNA, 25 bp, mus musculus
ccactgtgactcattcacagaggca

SEQ ID NO: 42828 - DNA, 25 bp, mus musculus
attcacagaggcatgttttatacta

SEQ ID NO: 42829 - DNA, 25 bp, mus musculus
tcccatccaagttggtatcttatgc

SEQ ID NO: 42830 - DNA, 25 bp, mus musculus
tttaaacagctaatgcctctagact

SEQ ID NO: 42831 - DNA, 25 bp, mus musculus
cagctaatgcctctagactaaattc

SEQ ID NO: 42832 - DNA, 25 bp, mus musculus
cttaccattaatctttcatgcttct

SEQ ID NO: 42833 - DNA, 25 bp, mus musculus
attaatctttcatgcttctttgaaa

SEQ ID NO: 42834 - DNA, 25 bp, mus musculus
ctttcatgcttctttgaaattccac

SEQ ID NO: 42835 - DNA, 25 bp, mus musculus
tgcttctttgaaattccacctaagt

SEQ ID NO: 42836 - DNA, 25 bp, mus musculus
acacaaagggcacacttgtgaagaa

SEQ ID NO: 42837 - DNA, 25 bp, mus musculus
accatctgggatggcgagcagaaga

SEQ ID NO: 42838 - DNA, 25 bp, mus musculus
acccattgcttcaaggagcggactc

SEQ ID NO: 42839 - DNA, 25 bp, mus musculus
gataccggtgctctctggacagtta

SEQ ID NO: 42840 - DNA, 25 bp, mus musculus
accggtgctctctggacagttagag

SEQ ID NO: 42841 - DNA, 25 bp, mus musculus
ggtgctctctggacagttagagaaa

SEQ ID NO: 42842 - DNA, 25 bp, mus musculus
gctctctggacagttagagaaaagt

SEQ ID NO: 42843 - DNA, 25 bp, mus musculus
acaactggctgtgggtttatatact

SEQ ID NO: 42844 - DNA, 25 bp, mus musculus
tttatatactgctttgctcaagaag

SEQ ID NO: 42845 - DNA, 25 bp, mus musculus
atatactgctttgctcaagaagggc

SEQ ID NO: 42846 - DNA, 25 bp, mus musculus
tactgctttgctcaagaagggcttt

SEQ ID NO: 42847 - DNA, 25 bp, mus musculus
tgctttgctcaagaagggctttttt

SEQ ID NO: 42848 - DNA, 25 bp, mus musculus
tcagagccagcgctgtgtgagcatg

SEQ ID NO: 42849 - DNA, 25 bp, mus musculus
cattgcttcaaggagcggactcgga

SEQ ID NO: 42850 - DNA, 25 bp, mus musculus
tgcttcaaggagcggactcggagcc

SEQ ID NO: 42851 - DNA, 25 bp, mus musculus
ccacaggctccgggctagaaaaatg

SEQ ID NO: 42852 - DNA, 25 bp, mus musculus
ggcggctgatccagttctggagata

SEQ ID NO: 42853 - DNA, 25 bp, mus musculus
ggctgatccagttctggagataccg

SEQ ID NO: 42854 - DNA, 25 bp, mus musculus
tgatccagttctggagataccggtg

SEQ ID NO: 42855 - DNA, 25 bp, mus musculus
tccagttctggagataccggtgctc

SEQ ID NO: 42856 - DNA, 25 bp, mus musculus
ggagataccggtgctctctggacag

SEQ ID NO: 42857 - DNA, 25 bp, mus musculus
tgtccgaccacctcaagaagagcaa

SEQ ID NO: 42858 - DNA, 25 bp, mus musculus
agaacagcttcagcctcatgagaat

SEQ ID NO: 42859 - DNA, 25 bp, mus musculus
gatatttgtcgacttctctttatga

SEQ ID NO: 42860 - DNA, 25 bp, mus musculus
taagacagacagcaccgagtcagca

SEQ ID NO: 42861 - DNA, 25 bp, mus musculus
caccgagtcagcacgttacatagca

SEQ ID NO: 42862 - DNA, 25 bp, mus musculus
gtcagcacgttacatagcatagtac

SEQ ID NO: 42863 - DNA, 25 bp, mus musculus
catagcatagtacctcttcagttac

SEQ ID NO: 42864 - DNA, 25 bp, mus musculus
cagttactgttcctaattgactgtg

SEQ ID NO: 42865 - DNA, 25 bp, mus musculus
tagaccttagcatcagtaagtttgc

SEQ ID NO: 42866 - DNA, 25 bp, mus musculus
agtttgcacaggcacttagaacagg

SEQ ID NO: 42867 - DNA, 25 bp, mus musculus
gtacacattacactacagttgactt

SEQ ID NO: 42868 - DNA, 25 bp, mus musculus
attacactacagttgacttcataag

SEQ ID NO: 42869 - DNA, 25 bp, mus musculus
ttcttaagtggcgccactctgtccg

SEQ ID NO: 42870 - DNA, 25 bp, mus musculus
agttcaccaccgtgctggtgatttc

SEQ ID NO: 42871 - DNA, 25 bp, mus musculus
ccaccgtgctggtgatttcaacatc

SEQ ID NO: 42872 - DNA, 25 bp, mus musculus
tgatttcaacatctctcctgaagag

SEQ ID NO: 42873 - DNA, 25 bp, mus musculus
tcccaggactgtattgctgagagca

SEQ ID NO: 42874 - DNA, 25 bp, mus musculus
attgctgagagcacccagcagtctc

SEQ ID NO: 42875 - DNA, 25 bp, mus musculus
gagagcacccagcagtctcagttta

SEQ ID NO: 42876 - DNA, 25 bp, mus musculus
cagtctcagtttatccacaaaattg

SEQ ID NO: 42877 - DNA, 25 bp, mus musculus
aagagcctctgtgtaatccaaggct

SEQ ID NO: 42878 - DNA, 25 bp, mus musculus
ctctgtgtaatccaaggcttggctg

SEQ ID NO: 42879 - DNA, 25 bp, mus musculus
aatcggctggacaccttcctgagcc

SEQ ID NO: 42880 - DNA, 25 bp, mus musculus
acacaagcataggactctcatctca

SEQ ID NO: 42881 - DNA, 25 bp, mus musculus
gactctcatctcagggcccttcagc

SEQ ID NO: 42882 - DNA, 25 bp, mus musculus
agggcccttcagccgaactgcatct

SEQ ID NO: 42883 - DNA, 25 bp, mus musculus
cttcagccgaactgcatcttttcct

SEQ ID NO: 42884 - DNA, 25 bp, mus musculus
ccgaactgcatcttttcctgttatc

SEQ ID NO: 42885 - DNA, 25 bp, mus musculus
acattttctcattatgtgttcatga

SEQ ID NO: 42886 - DNA, 25 bp, mus musculus
catttgtgtcacagttaagttggta

SEQ ID NO: 42887 - DNA, 25 bp, mus musculus
gtgctgttattgttgcttggaaccc

SEQ ID NO: 42888 - DNA, 25 bp, mus musculus
ttattgttgcttggaacccttcaat

SEQ ID NO: 42889 - DNA, 25 bp, mus musculus
gtaatccaaggcttggctgacattt

SEQ ID NO: 42890 - DNA, 25 bp, mus musculus
gacatttacatcttctcagaggaca

SEQ ID NO: 42891 - DNA, 25 bp, mus musculus
tacatcttctcagaggacaccacgt

SEQ ID NO: 42892 - DNA, 25 bp, mus musculus
ttctcagaggacaccacgtacaagt

SEQ ID NO: 42893 - DNA, 25 bp, mus musculus
gaggacaccacgtacaagtgggact

SEQ ID NO: 42894 - DNA, 25 bp, mus musculus
gatttgccacagctgctgtatcatg

SEQ ID NO: 42895 - DNA, 25 bp, mus musculus
ccacagctgctgtatcatgtggaaa

SEQ ID NO: 42896 - DNA, 25 bp, mus musculus
tacaggtccaggaatcggctggaca

SEQ ID NO: 42897 - DNA, 25 bp, mus musculus
tggttttcatttcggggatgccaga

SEQ ID NO: 42898 - DNA, 25 bp, mus musculus
tcatttcggggatgccagacccgac

SEQ ID NO: 42899 - DNA, 25 bp, mus musculus
attgctgagcctgtagacagacagc

SEQ ID NO: 42900 - DNA, 25 bp, mus musculus
tggcatagtccatagcccagctgac

SEQ ID NO: 42901 - DNA, 25 bp, mus musculus
catagtccatagcccagctgaccag

SEQ ID NO: 42902 - DNA, 25 bp, mus musculus
agtccatagcccagctgaccagtgc

SEQ ID NO: 42903 - DNA, 25 bp, mus musculus
tagcccagctgaccagtgccatgag

SEQ ID NO: 42904 - DNA, 25 bp, mus musculus
cccagctgaccagtgccatgaggag

SEQ ID NO: 42905 - DNA, 25 bp, mus musculus
agctgaccagtgccatgaggagccc

SEQ ID NO: 42906 - DNA, 25 bp, mus musculus
tgaccagtgccatgaggagccccaa

SEQ ID NO: 42907 - DNA, 25 bp, mus musculus
tgaggagccccaacagaaccaggaa

SEQ ID NO: 42908 - DNA, 25 bp, mus musculus
ggagccccaacagaaccaggaagat

SEQ ID NO: 42909 - DNA, 25 bp, mus musculus
acccgacagcctgtggggccaggat

SEQ ID NO: 42910 - DNA, 25 bp, mus musculus
gccccaacagaaccaggaagatcca

SEQ ID NO: 42911 - DNA, 25 bp, mus musculus
cgacagcctgtggggccaggatctg

SEQ ID NO: 42912 - DNA, 25 bp, mus musculus
cccaagccaggtactggagtaagat

SEQ ID NO: 42913 - DNA, 25 bp, mus musculus
tgtttaagccccgggacatccattg

SEQ ID NO: 42914 - DNA, 25 bp, mus musculus
ttaagccccgggacatccattgctg

SEQ ID NO: 42915 - DNA, 25 bp, mus musculus
agccccgggacatccattgctgagc

SEQ ID NO: 42916 - DNA, 25 bp, mus musculus
cccgggacatccattgctgagcctg

SEQ ID NO: 42917 - DNA, 25 bp, mus musculus
acatccattgctgagcctgtagaca

SEQ ID NO: 42918 - DNA, 25 bp, mus musculus
gaactggaagctgctggtcagagga

SEQ ID NO: 42919 - DNA, 25 bp, mus musculus
ctggaagctgctggtcagaggactc

SEQ ID NO: 42920 - DNA, 25 bp, mus musculus
ctcctggccacagaaccgagaggat

SEQ ID NO: 42921 - DNA, 25 bp, mus musculus
ctggccacagaaccgagaggatcca

SEQ ID NO: 42922 - DNA, 25 bp, mus musculus
cctctttccgtttgagaagctgtga

SEQ ID NO: 42923 - DNA, 25 bp, mus musculus
aagccagtgtcctccagccagagaa

SEQ ID NO: 42924 - DNA, 25 bp, mus musculus
ccagtgtcctccagccagagaaggc

SEQ ID NO: 42925 - DNA, 25 bp, mus musculus
agtctgacaccaacccagccggatc

SEQ ID NO: 42926 - DNA, 25 bp, mus musculus
acccagccggatccccataggctgg

SEQ ID NO: 42927 - DNA, 25 bp, mus musculus
cagccggatccccataggctggtgc

SEQ ID NO: 42928 - DNA, 25 bp, mus musculus
gatccccataggctggtgctggtga

SEQ ID NO: 42929 - DNA, 25 bp, mus musculus
ccccataggctggtgctggtgagct

SEQ ID NO: 42930 - DNA, 25 bp, mus musculus
aggactcctcatcagagagaggctg

SEQ ID NO: 42931 - DNA, 25 bp, mus musculus
actcctcatcagagagaggctgaaa

SEQ ID NO: 42932 - DNA, 25 bp, mus musculus
gaggctgaaactccgctatggggcc

SEQ ID NO: 42933 - DNA, 25 bp, mus musculus
gaaactccgctatggggccaagagc

SEQ ID NO: 42934 - DNA, 25 bp, mus musculus
ccgctatggggccaagagcgaggca

SEQ ID NO: 42935 - DNA, 25 bp, mus musculus
cgaggcagcagctccccatgctgct

SEQ ID NO: 42936 - DNA, 25 bp, mus musculus
ggcagcagctccccatgctgctgga

SEQ ID NO: 42937 - DNA, 25 bp, mus musculus
cggactctcttctgatgaagaggaa

SEQ ID NO: 42938 - DNA, 25 bp, mus musculus
gcagtgtctttaacccgcagaatct

SEQ ID NO: 42939 - DNA, 25 bp, mus musculus
ttaacccgcagaatctgctctctta

SEQ ID NO: 42940 - DNA, 25 bp, mus musculus
aattgctccgttcctgcagtgtcca

SEQ ID NO: 42941 - DNA, 25 bp, mus musculus
gttcctgcagtgtccaagatgtgaa

SEQ ID NO: 42942 - DNA, 25 bp, mus musculus
agcatacactgctgtgcatctactt

SEQ ID NO: 42943 - DNA, 25 bp, mus musculus
atacactgctgtgcatctacttcaa

SEQ ID NO: 42944 - DNA, 25 bp, mus musculus
cactgctgtgcatctacttcaactt

SEQ ID NO: 42945 - DNA, 25 bp, mus musculus
gcatctacttcaacttgctttctat

SEQ ID NO: 42946 - DNA, 25 bp, mus musculus
tctacttcaacttgctttctataag

SEQ ID NO: 42947 - DNA, 25 bp, mus musculus
acttgctttctataagagagcagat

SEQ ID NO: 42948 - DNA, 25 bp, mus musculus
atgatgttccaatgattctggttgg

SEQ ID NO: 42949 - DNA, 25 bp, mus musculus
ttccaatgattctggttggcaataa

SEQ ID NO: 42950 - DNA, 25 bp, mus musculus
tgctctcttagatcttgtaagtcgt

SEQ ID NO: 42951 - DNA, 25 bp, mus musculus
gtcgactgtgctgtgatggagtaaa

SEQ ID NO: 42952 - DNA, 25 bp, mus musculus
gcgaacgcttgtccgttcttcatgt

SEQ ID NO: 42953 - DNA, 25 bp, mus musculus
tgtccgttcttcatgtacaggtccc

SEQ ID NO: 42954 - DNA, 25 bp, mus musculus
ttcatgtacaggtccctcatggctg

SEQ ID NO: 42955 - DNA, 25 bp, mus musculus
atgtacaggtccctcatggctgtga

SEQ ID NO: 42956 - DNA, 25 bp, mus musculus
tacaggtccctcatggctgtgaatt

SEQ ID NO: 42957 - DNA, 25 bp, mus musculus
tccctcatggctgtgaattgctccg

SEQ ID NO: 42958 - DNA, 25 bp, mus musculus
tagaattaggctctctggagcaggg

SEQ ID NO: 42959 - DNA, 25 bp, mus musculus
atctctgggtggttctattctgagc

SEQ ID NO: 42960 - DNA, 25 bp, mus musculus
gactgaactgctgttgctgtccaca

SEQ ID NO: 42961 - DNA, 25 bp, mus musculus
ttgcgcctagggtgttttccagata

SEQ ID NO: 42962 - DNA, 25 bp, mus musculus
agcccagagttccagctttgacagc

SEQ ID NO: 42963 - DNA, 25 bp, mus musculus
tgacagcctgatgacctccattttc

SEQ ID NO: 42964 - DNA, 25 bp, mus musculus
cctgatgacctccattttcatatga

SEQ ID NO: 42965 - DNA, 25 bp, mus musculus
gacctccattttcatatgaatggtg

SEQ ID NO: 42966 - DNA, 25 bp, mus musculus
cacacctctgactcatcctatgggt

SEQ ID NO: 42967 - DNA, 25 bp, mus musculus
tcatcctatgggtgttccaaggcac

SEQ ID NO: 42968 - DNA, 25 bp, mus musculus
tgttccaaggcacccaatgctccac

SEQ ID NO: 42969 - DNA, 25 bp, mus musculus
aatacagtttcttatggtggttgtg

SEQ ID NO: 42970 - DNA, 25 bp, mus musculus
cccggccatgcacattgagtatgat

SEQ ID NO: 42971 - DNA, 25 bp, mus musculus
aaaggccagaactccagtgtcctgt

SEQ ID NO: 42972 - DNA, 25 bp, mus musculus
cagaactccagtgtcctgtgagatt

SEQ ID NO: 42973 - DNA, 25 bp, mus musculus
tccagtgtcctgtgagattggctga

SEQ ID NO: 42974 - DNA, 25 bp, mus musculus
tggctgacccgagcgaggtattatc

SEQ ID NO: 42975 - DNA, 25 bp, mus musculus
tattatctcggtcttcagccgctgg

SEQ ID NO: 42976 - DNA, 25 bp, mus musculus
ggtccctgaccttatggccatcttg

SEQ ID NO: 42977 - DNA, 25 bp, mus musculus
tgaccttatggccatcttggaggtc

SEQ ID NO: 42978 - DNA, 25 bp, mus musculus
ctgttactactgtacattgggatgt

SEQ ID NO: 42979 - DNA, 25 bp, mus musculus
ttactactgtacattgggatgtatt

SEQ ID NO: 42980 - DNA, 25 bp, mus musculus
ctatactgaatccttgcctcacaga

SEQ ID NO: 42981 - DNA, 25 bp, mus musculus
atccttgcctcacagaaattgagtc

SEQ ID NO: 42982 - DNA, 25 bp, mus musculus
cattgccatgctaatctgctagctc

SEQ ID NO: 42983 - DNA, 25 bp, mus musculus
tgccatgctaatctgctagctctaa

SEQ ID NO: 42984 - DNA, 25 bp, mus musculus
aatctgctagctctaatctatgaga

SEQ ID NO: 42985 - DNA, 25 bp, mus musculus
ctgctagctctaatctatgagaaaa

SEQ ID NO: 42986 - DNA, 25 bp, mus musculus
acctggtctgtgctttttagcagta

SEQ ID NO: 42987 - DNA, 25 bp, mus musculus
tggtctgtgctttttagcagtaaaa

SEQ ID NO: 42988 - DNA, 25 bp, mus musculus
atgttcccgtatgtattgtaactgg

SEQ ID NO: 42989 - DNA, 25 bp, mus musculus
tatgtctgggcaggccatattggtc

SEQ ID NO: 42990 - DNA, 25 bp, mus musculus
ctactgtacattgggatgtatttca

SEQ ID NO: 42991 - DNA, 25 bp, mus musculus
atgagtctacctcacctttctgcac

SEQ ID NO: 42992 - DNA, 25 bp, mus musculus
agtctacctcacctttctgcactgt

SEQ ID NO: 42993 - DNA, 25 bp, mus musculus
cacctttctgcactgtcatacacat

SEQ ID NO: 42994 - DNA, 25 bp, mus musculus
ctttctgcactgtcatacacattct

SEQ ID NO: 42995 - DNA, 25 bp, mus musculus
ctgtcatacacattctcacctttaa

SEQ ID NO: 42996 - DNA, 25 bp, mus musculus
tcatacacattctcacctttaatta

SEQ ID NO: 42997 - DNA, 25 bp, mus musculus
cccagtcccctatactgaatccttg

SEQ ID NO: 42998 - DNA, 25 bp, mus musculus
cacaccaactgctttgagatcacgg

SEQ ID NO: 42999 - DNA, 25 bp, mus musculus
gaggccctgtacacactctggcagc

SEQ ID NO: 43000 - DNA, 25 bp, mus musculus
cggatctcagtcaaaggcattcgcc

SEQ ID NO: 43001 - DNA, 25 bp, mus musculus
atctcagtcaaaggcattcgccacg

SEQ ID NO: 43002 - DNA, 25 bp, mus musculus
tcagtcaaaggcattcgccacgaca

SEQ ID NO: 43003 - DNA, 25 bp, mus musculus
aaaggcattcgccacgacatcacca

SEQ ID NO: 43004 - DNA, 25 bp, mus musculus
ggcattcgccacgacatcaccacag

SEQ ID NO: 43005 - DNA, 25 bp, mus musculus
acagccccagatggtgactactgga

SEQ ID NO: 43006 - DNA, 25 bp, mus musculus
ccaggtatccacattgtcattgccc

SEQ ID NO: 43007 - DNA, 25 bp, mus musculus
atccacattgtcattgcccaagccc

SEQ ID NO: 43008 - DNA, 25 bp, mus musculus
attgtcattgcccaagcccctggct

SEQ ID NO: 43009 - DNA, 25 bp, mus musculus
gtcattgcccaagcccctggctacg

SEQ ID NO: 43010 - DNA, 25 bp, mus musculus
gccctgtacacactctggcagcaca

SEQ ID NO: 43011 - DNA, 25 bp, mus musculus
caagcccctggctacgccaaagtca

SEQ ID NO: 43012 - DNA, 25 bp, mus musculus
ctgtacacactctggcagcacaaca

SEQ ID NO: 43013 - DNA, 25 bp, mus musculus
acactctggcagcacaacaaggagt

SEQ ID NO: 43014 - DNA, 25 bp, mus musculus
ctctggcagcacaacaaggagtcac

SEQ ID NO: 43015 - DNA, 25 bp, mus musculus
cacaacaaggagtcactcctgaatt

SEQ ID NO: 43016 - DNA, 25 bp, mus musculus
aaggagtcactcctgaatttcgtgg

SEQ ID NO: 43017 - DNA, 25 bp, mus musculus
gtcaaaaacgcccggatctcagtca

SEQ ID NO: 43018 - DNA, 25 bp, mus musculus
aacgcccggatctcagtcaaaggca

SEQ ID NO: 43019 - DNA, 25 bp, mus musculus
ccttggcgtcagtggccttgtagca

SEQ ID NO: 43020 - DNA, 25 bp, mus musculus
cgtcagtggccttgtagcatgatgt

SEQ ID NO: 43021 - DNA, 25 bp, mus musculus
tcttcactcctaaactgatactcaa

SEQ ID NO: 43022 - DNA, 25 bp, mus musculus
ctcctaaactgatactcaattacgt

SEQ ID NO: 43023 - DNA, 25 bp, mus musculus
attttgcagtggttcacaatgagaa

SEQ ID NO: 43024 - DNA, 25 bp, mus musculus
tagcccccttgttctctattcacgt

SEQ ID NO: 43025 - DNA, 25 bp, mus musculus
tctctattcacgttgtaaataaaca

SEQ ID NO: 43026 - DNA, 25 bp, mus musculus
ctgttagcttaacacttgtatagaa

SEQ ID NO: 43027 - DNA, 25 bp, mus musculus
tttttatctgtgcaatgctgagtgc

SEQ ID NO: 43028 - DNA, 25 bp, mus musculus
caatgctgagtgcaggccctttaga

SEQ ID NO: 43029 - DNA, 25 bp, mus musculus
tgagtgcaggccctttagagcacac

SEQ ID NO: 43030 - DNA, 25 bp, mus musculus
caggccctttagagcacactggcgg

SEQ ID NO: 43031 - DNA, 25 bp, mus musculus
tgtgcatctgtcccggttaatggtc

SEQ ID NO: 43032 - DNA, 25 bp, mus musculus
aatggtccacctcaactgcagacct

SEQ ID NO: 43033 - DNA, 25 bp, mus musculus
caactgcagaccttcaggtagctgg

SEQ ID NO: 43034 - DNA, 25 bp, mus musculus
cagaccttcaggtagctggatggaa

SEQ ID NO: 43035 - DNA, 25 bp, mus musculus
acagcaaaggcacacgtccccattg

SEQ ID NO: 43036 - DNA, 25 bp, mus musculus
aaggcacacgtccccattggcgtgg

SEQ ID NO: 43037 - DNA, 25 bp, mus musculus
cccattggcgtggcttggtgctatt

SEQ ID NO: 43038 - DNA, 25 bp, mus musculus
gctgtctcttcactcctaaactgat

SEQ ID NO: 43039 - DNA, 25 bp, mus musculus
gaaggtctatgcgtccttggaggcc

SEQ ID NO: 43040 - DNA, 25 bp, mus musculus
aaggtctatgcgtccttggaggcct

SEQ ID NO: 43041 - DNA, 25 bp, mus musculus
gcgtccttggaggcctactgcaagc

SEQ ID NO: 43042 - DNA, 25 bp, mus musculus
cgtccttggaggcctactgcaagca

SEQ ID NO: 43043 - DNA, 25 bp, mus musculus
tccttggaggcctactgcaagcaca

SEQ ID NO: 43044 - DNA, 25 bp, mus musculus
ccttggaggcctactgcaagcacaa

SEQ ID NO: 43045 - DNA, 25 bp, mus musculus
ggcctactgcaagcacaagtaccca

SEQ ID NO: 43046 - DNA, 25 bp, mus musculus
gaaggttcgctaagctcttgctccg

SEQ ID NO: 43047 - DNA, 25 bp, mus musculus
aaggttcgctaagctcttgctccgc

SEQ ID NO: 43048 - DNA, 25 bp, mus musculus
gctaagctcttgctccgcctgccgg

SEQ ID NO: 43049 - DNA, 25 bp, mus musculus
ggctcaaatgcctggaacatctctt

SEQ ID NO: 43050 - DNA, 25 bp, mus musculus
gctcaaatgcctggaacatctcttc

SEQ ID NO: 43051 - DNA, 25 bp, mus musculus
aggtctatgcgtccttggaggccta

SEQ ID NO: 43052 - DNA, 25 bp, mus musculus
ggtctatgcgtccttggaggcctac

SEQ ID NO: 43053 - DNA, 25 bp, mus musculus
gtctatgcgtccttggaggcctact

SEQ ID NO: 43054 - DNA, 25 bp, mus musculus
tctatgcgtccttggaggcctactg

SEQ ID NO: 43055 - DNA, 25 bp, mus musculus
ctatgcgtccttggaggcctactgc

SEQ ID NO: 43056 - DNA, 25 bp, mus musculus
tatgcgtccttggaggcctactgca

SEQ ID NO: 43057 - DNA, 25 bp, mus musculus
atgcgtccttggaggcctactgcaa

SEQ ID NO: 43058 - DNA, 25 bp, mus musculus
tgcgtccttggaggcctactgcaag

SEQ ID NO: 43059 - DNA, 25 bp, mus musculus
gctgtggcagccttcacattgggaa

SEQ ID NO: 43060 - DNA, 25 bp, mus musculus
gcagccttcacattgggaaggagga

SEQ ID NO: 43061 - DNA, 25 bp, mus musculus
aatgcttagccaagaacaatgagat

SEQ ID NO: 43062 - DNA, 25 bp, mus musculus
tcccaggatctatcagactgaaggc

SEQ ID NO: 43063 - DNA, 25 bp, mus musculus
agtgtctacaatcacaggcaactgt

SEQ ID NO: 43064 - DNA, 25 bp, mus musculus
tacaatcacaggcaactgtgagctg

SEQ ID NO: 43065 - DNA, 25 bp, mus musculus
cacaggcaactgtgagctgagcact

SEQ ID NO: 43066 - DNA, 25 bp, mus musculus
tggtggcagccatgctttctctcgc

SEQ ID NO: 43067 - DNA, 25 bp, mus musculus
cagccatgctttctctcgctagact

SEQ ID NO: 43068 - DNA, 25 bp, mus musculus
ccatgtatagccaactttctccatc

SEQ ID NO: 43069 - DNA, 25 bp, mus musculus
aactttctccatctgtagtgtcgat

SEQ ID NO: 43070 - DNA, 25 bp, mus musculus
cttacaatactgcaatactgaatat

SEQ ID NO: 43071 - DNA, 25 bp, mus musculus
acacacattgaccgtggccaacctc

SEQ ID NO: 43072 - DNA, 25 bp, mus musculus
agtgaaacaacccagacattggctc

SEQ ID NO: 43073 - DNA, 25 bp, mus musculus
cagacattggctccacaagcacaga

SEQ ID NO: 43074 - DNA, 25 bp, mus musculus
ttggctccacaagcacagattccca

SEQ ID NO: 43075 - DNA, 25 bp, mus musculus
ccacaagcacagattcccagaaaag

SEQ ID NO: 43076 - DNA, 25 bp, mus musculus
cttggcacccagatacatggtgact

SEQ ID NO: 43077 - DNA, 25 bp, mus musculus
tcccttagcacaaatgcttagccaa

SEQ ID NO: 43078 - DNA, 25 bp, mus musculus
agcacaaatgcttagccaagaacaa

SEQ ID NO: 43079 - DNA, 25 bp, mus musculus
atcttgctacgaaacaatggcagat

SEQ ID NO: 43080 - DNA, 25 bp, mus musculus
aatggcagatgcctccactgagctt

SEQ ID NO: 43081 - DNA, 25 bp, mus musculus
ctgtttcttcctggtcctgaaatat

SEQ ID NO: 43082 - DNA, 25 bp, mus musculus
cttcctggtcctgaaatatagaggc

SEQ ID NO: 43083 - DNA, 25 bp, mus musculus
taaatactggtttcacactccacca

SEQ ID NO: 43084 - DNA, 25 bp, mus musculus
ctggtttcacactccaccaagcatc

SEQ ID NO: 43085 - DNA, 25 bp, mus musculus
tccaccaagcatcccattacagata

SEQ ID NO: 43086 - DNA, 25 bp, mus musculus
accaagcatcccattacagatagaa

SEQ ID NO: 43087 - DNA, 25 bp, mus musculus
aagcatcccattacagatagaagag

SEQ ID NO: 43088 - DNA, 25 bp, mus musculus
tcagcccatcttagaggccttggac

SEQ ID NO: 43089 - DNA, 25 bp, mus musculus
gcccatcttagaggccttggacaag

SEQ ID NO: 43090 - DNA, 25 bp, mus musculus
caaggacagctcaccaaaggatgac

SEQ ID NO: 43091 - DNA, 25 bp, mus musculus
agatgcctccactgagcttcagcaa

SEQ ID NO: 43092 - DNA, 25 bp, mus musculus
tgcctccactgagcttcagcaagtc

SEQ ID NO: 43093 - DNA, 25 bp, mus musculus
tgagcttcagcaagtcatcctgatc

SEQ ID NO: 43094 - DNA, 25 bp, mus musculus
gcttcagcaagtcatcctgatctcc

SEQ ID NO: 43095 - DNA, 25 bp, mus musculus
agtcatcctgatctccgtgggaaca

SEQ ID NO: 43096 - DNA, 25 bp, mus musculus
catcctgatctccgtgggaacattt

SEQ ID NO: 43097 - DNA, 25 bp, mus musculus
cctgatctccgtgggaacattttcg

SEQ ID NO: 43098 - DNA, 25 bp, mus musculus
aggagcctgtttcttcctggtcctg

SEQ ID NO: 43099 - DNA, 25 bp, mus musculus
ctctttaagcctccagtgttagtat

SEQ ID NO: 43100 - DNA, 25 bp, mus musculus
tttaagcctccagtgttagtatttg

SEQ ID NO: 43101 - DNA, 25 bp, mus musculus
atctatacattcggagaagtcgcaa

SEQ ID NO: 43102 - DNA, 25 bp, mus musculus
aggcctagacttgatcagtgtcagg

SEQ ID NO: 43103 - DNA, 25 bp, mus musculus
gacttgatcagtgtcaggctggttg

SEQ ID NO: 43104 - DNA, 25 bp, mus musculus
cttgatcagtgtcaggctggttgtc

SEQ ID NO: 43105 - DNA, 25 bp, mus musculus
ttgatcagtgtcaggctggttgtca

SEQ ID NO: 43106 - DNA, 25 bp, mus musculus
gatcagtgtcaggctggttgtcaat

SEQ ID NO: 43107 - DNA, 25 bp, mus musculus
atcagtgtcaggctggttgtcaatt

SEQ ID NO: 43108 - DNA, 25 bp, mus musculus
cagtgtcaggctggttgtcaatttt

SEQ ID NO: 43109 - DNA, 25 bp, mus musculus
agtgtcaggctggttgtcaattttg

SEQ ID NO: 43110 - DNA, 25 bp, mus musculus
tgtcaggctggttgtcaattttgat

SEQ ID NO: 43111 - DNA, 25 bp, mus musculus
taagcctccagtgttagtatttgtg

SEQ ID NO: 43112 - DNA, 25 bp, mus musculus
aagcctccagtgttagtatttgtgg

SEQ ID NO: 43113 - DNA, 25 bp, mus musculus
gcctccagtgttagtatttgtggac

SEQ ID NO: 43114 - DNA, 25 bp, mus musculus
tttgtggactgcaaactaggagcag

SEQ ID NO: 43115 - DNA, 25 bp, mus musculus
aagcatatctatacattcggagaag

SEQ ID NO: 43116 - DNA, 25 bp, mus musculus
agcatatctatacattcggagaagt

SEQ ID NO: 43117 - DNA, 25 bp, mus musculus
catatctatacattcggagaagtcg

SEQ ID NO: 43118 - DNA, 25 bp, mus musculus
atatctatacattcggagaagtcgc

SEQ ID NO: 43119 - DNA, 25 bp, mus musculus
cagatcttcccagtgagacttcatt

SEQ ID NO: 43120 - DNA, 25 bp, mus musculus
agacttcatttccttgtccagtgga

SEQ ID NO: 43121 - DNA, 25 bp, mus musculus
ggttccaaaatcgccgagcaaagat

SEQ ID NO: 43122 - DNA, 25 bp, mus musculus
tccaaaatcgccgagcaaagatgaa

SEQ ID NO: 43123 - DNA, 25 bp, mus musculus
ccttcaacccagatcttctgaaata

SEQ ID NO: 43124 - DNA, 25 bp, mus musculus
acccagatcttctgaaataggtaga

SEQ ID NO: 43125 - DNA, 25 bp, mus musculus
gttggcttctcttccagttgtatag

SEQ ID NO: 43126 - DNA, 25 bp, mus musculus
tcttccagttgtatagtacagaaga

SEQ ID NO: 43127 - DNA, 25 bp, mus musculus
aatgttacagttctctcctgtatct

SEQ ID NO: 43128 - DNA, 25 bp, mus musculus
gttctctcctgtatctaatctagat

SEQ ID NO: 43129 - DNA, 25 bp, mus musculus
ctctcctgtatctaatctagatttt

SEQ ID NO: 43130 - DNA, 25 bp, mus musculus
agattttgtcattctttctgaaaat

SEQ ID NO: 43131 - DNA, 25 bp, mus musculus
catttccttgtccagtggatcaccc

SEQ ID NO: 43132 - DNA, 25 bp, mus musculus
cttgtccagtggatcacccaaggcc

SEQ ID NO: 43133 - DNA, 25 bp, mus musculus
tggatcacccaaggccagaagaaag

SEQ ID NO: 43134 - DNA, 25 bp, mus musculus
cagcctccgaaacacgctctttgaa

SEQ ID NO: 43135 - DNA, 25 bp, mus musculus
tcacccagaaccaggtcgaagtatt

SEQ ID NO: 43136 - DNA, 25 bp, mus musculus
gagtgaactgctaccctggcattga

SEQ ID NO: 43137 - DNA, 25 bp, mus musculus
gctaccctggcattgacatcagaga

SEQ ID NO: 43138 - DNA, 25 bp, mus musculus
accctggcattgacatcagagagga

SEQ ID NO: 43139 - DNA, 25 bp, mus musculus
ctgactctcaaaatccacagcctgc

SEQ ID NO: 43140 - DNA, 25 bp, mus musculus
cacagcctgccacagcagatttgct

SEQ ID NO: 43141 - DNA, 25 bp, mus musculus
agtcctcgccttgttggttctgaat

SEQ ID NO: 43142 - DNA, 25 bp, mus musculus
cctcgccttgttggttctgaatctg

SEQ ID NO: 43143 - DNA, 25 bp, mus musculus
cgccttgttggttctgaatctgact

SEQ ID NO: 43144 - DNA, 25 bp, mus musculus
cttgttggttctgaatctgactttg

SEQ ID NO: 43145 - DNA, 25 bp, mus musculus
tctgaatctgactttgcttccggta

SEQ ID NO: 43146 - DNA, 25 bp, mus musculus
gaatctgactttgcttccggtacaa

SEQ ID NO: 43147 - DNA, 25 bp, mus musculus
tctgactttgcttccggtacaaaca

SEQ ID NO: 43148 - DNA, 25 bp, mus musculus
gcttccggtacaaacaggccacctg

SEQ ID NO: 43149 - DNA, 25 bp, mus musculus
tccggtacaaacaggccacctgagc

SEQ ID NO: 43150 - DNA, 25 bp, mus musculus
ggtacaaacaggccacctgagcact

SEQ ID NO: 43151 - DNA, 25 bp, mus musculus
agcctgccacagcagatttgctaaa

SEQ ID NO: 43152 - DNA, 25 bp, mus musculus
ctgccacagcagatttgctaaaaag

SEQ ID NO: 43153 - DNA, 25 bp, mus musculus
gtccaactcatgccctgtacccagg

SEQ ID NO: 43154 - DNA, 25 bp, mus musculus
atgccctgtacccaggccctaggag

SEQ ID NO: 43155 - DNA, 25 bp, mus musculus
ggtcagagcctgagtcctcgccttg

SEQ ID NO: 43156 - DNA, 25 bp, mus musculus
cagagcctgagtcctcgccttgttg

SEQ ID NO: 43157 - DNA, 25 bp, mus musculus
agcctgagtcctcgccttgttggtt

SEQ ID NO: 43158 - DNA, 25 bp, mus musculus
ctgagtcctcgccttgttggttctg

SEQ ID NO: 43159 - DNA, 25 bp, mus musculus
cagggtcaccctagaatcagatctg

SEQ ID NO: 43160 - DNA, 25 bp, mus musculus
ggtcaccctagaatcagatctgctc

SEQ ID NO: 43161 - DNA, 25 bp, mus musculus
ctgctactttggatggccatgacgg

SEQ ID NO: 43162 - DNA, 25 bp, mus musculus
ctactttggatggccatgacgggct

SEQ ID NO: 43163 - DNA, 25 bp, mus musculus
atggccatgacgggctggagctgcc

SEQ ID NO: 43164 - DNA, 25 bp, mus musculus
gccatgacgggctggagctgccttg

SEQ ID NO: 43165 - DNA, 25 bp, mus musculus
atgacgggctggagctgccttgtga

SEQ ID NO: 43166 - DNA, 25 bp, mus musculus
aggatcatccgcctcttggtgaagg

SEQ ID NO: 43167 - DNA, 25 bp, mus musculus
atcatccgcctcttggtgaaggaga

SEQ ID NO: 43168 - DNA, 25 bp, mus musculus
atccgcctcttggtgaaggagaagg

SEQ ID NO: 43169 - DNA, 25 bp, mus musculus
gtcttggacaaggccttcggaccag

SEQ ID NO: 43170 - DNA, 25 bp, mus musculus
gacaaggccttcggaccagaattga

SEQ ID NO: 43171 - DNA, 25 bp, mus musculus
cctagaatcagatctgctccccagc

SEQ ID NO: 43172 - DNA, 25 bp, mus musculus
gctccccagcatcttctgtttcctg

SEQ ID NO: 43173 - DNA, 25 bp, mus musculus
ccccagcatcttctgtttcctggtg

SEQ ID NO: 43174 - DNA, 25 bp, mus musculus
cagcatcttctgtttcctggtgagt

SEQ ID NO: 43175 - DNA, 25 bp, mus musculus
catcttctgtttcctggtgagtgat

SEQ ID NO: 43176 - DNA, 25 bp, mus musculus
ctgtttcctggtgagtgattcctgc

SEQ ID NO: 43177 - DNA, 25 bp, mus musculus
tgattcctgctactttggatggcca

SEQ ID NO: 43178 - DNA, 25 bp, mus musculus
ttcctgctactttggatggccatga

SEQ ID NO: 43179 - DNA, 25 bp, mus musculus
gtaatcaaatctggctccttccact

SEQ ID NO: 43180 - DNA, 25 bp, mus musculus
tcaaatctggctccttccacttctg

SEQ ID NO: 43181 - DNA, 25 bp, mus musculus
cccactgggggaccggatcatcaat

SEQ ID NO: 43182 - DNA, 25 bp, mus musculus
ggatcatcaatgccttctttccaga

SEQ ID NO: 43183 - DNA, 25 bp, mus musculus
catcaatgccttctttccagaggga

SEQ ID NO: 43184 - DNA, 25 bp, mus musculus
tcaatgccttctttccagagggaga

SEQ ID NO: 43185 - DNA, 25 bp, mus musculus
aggtaaacttccgtggattcatgcg

SEQ ID NO: 43186 - DNA, 25 bp, mus musculus
gtaaacttccgtggattcatgcgaa

SEQ ID NO: 43187 - DNA, 25 bp, mus musculus
aaacttccgtggattcatgcgaact

SEQ ID NO: 43188 - DNA, 25 bp, mus musculus
ggattcatgcgaactttggctcatt

SEQ ID NO: 43189 - DNA, 25 bp, mus musculus
tcatgcgaactttggctcatttccg

SEQ ID NO: 43190 - DNA, 25 bp, mus musculus
atgcgaactttggctcatttccgcc

SEQ ID NO: 43191 - DNA, 25 bp, mus musculus
aaatctggctccttccacttctgag

SEQ ID NO: 43192 - DNA, 25 bp, mus musculus
atctggctccttccacttctgagtt

SEQ ID NO: 43193 - DNA, 25 bp, mus musculus
ccacttctgagttggtgcaagaaac

SEQ ID NO: 43194 - DNA, 25 bp, mus musculus
gaaacacttggcagctattaaagtg

SEQ ID NO: 43195 - DNA, 25 bp, mus musculus
taaagtgctattctttgcagttatt

SEQ ID NO: 43196 - DNA, 25 bp, mus musculus
tataatttgccacagaagtaaattc

SEQ ID NO: 43197 - DNA, 25 bp, mus musculus
taatttgccacagaagtaaattcca

SEQ ID NO: 43198 - DNA, 25 bp, mus musculus
attccagaacttgccatcaacccac

SEQ ID NO: 43199 - DNA, 25 bp, mus musculus
caccatctcagttaagtcacttggt

SEQ ID NO: 43200 - DNA, 25 bp, mus musculus
ctcagttaagtcacttggttgcctt

SEQ ID NO: 43201 - DNA, 25 bp, mus musculus
agaagtgcctggcctacctacatat

SEQ ID NO: 43202 - DNA, 25 bp, mus musculus
gcctggcctacctacatatagtggc

SEQ ID NO: 43203 - DNA, 25 bp, mus musculus
ctgaaatcctagcacttgagagttg

SEQ ID NO: 43204 - DNA, 25 bp, mus musculus
tcctagcacttgagagttgagaact

SEQ ID NO: 43205 - DNA, 25 bp, mus musculus
tgcactttacagcagcctgagctac

SEQ ID NO: 43206 - DNA, 25 bp, mus musculus
cagcctgagctacaaatgagatgtt

SEQ ID NO: 43207 - DNA, 25 bp, mus musculus
tctccccaaaacacacaaaagcaag

SEQ ID NO: 43208 - DNA, 25 bp, mus musculus
aagcaagtgcctttacctggagata

SEQ ID NO: 43209 - DNA, 25 bp, mus musculus
gtgcctttacctggagataacttgt

SEQ ID NO: 43210 - DNA, 25 bp, mus musculus
ttacagccctgggtgctagttgtga

SEQ ID NO: 43211 - DNA, 25 bp, mus musculus
taagtcacttggttgccttacagtt

SEQ ID NO: 43212 - DNA, 25 bp, mus musculus
ttgccttacagttggccaagaggac

SEQ ID NO: 43213 - DNA, 25 bp, mus musculus
agaggacatctgtctcacatccttg

SEQ ID NO: 43214 - DNA, 25 bp, mus musculus
atccttggaggccatcagacagcag

SEQ ID NO: 43215 - DNA, 25 bp, mus musculus
caagacccctgtgaggactgtggtt

SEQ ID NO: 43216 - DNA, 25 bp, mus musculus
ggtagcaccttgcctccatggtggt

SEQ ID NO: 43217 - DNA, 25 bp, mus musculus
accttgcctccatggtggtctgtaa

SEQ ID NO: 43218 - DNA, 25 bp, mus musculus
cctccatggtggtctgtaagaagtg

SEQ ID NO: 43219 - DNA, 25 bp, mus musculus
tcctctttggtctcagaacaggcct

SEQ ID NO: 43220 - DNA, 25 bp, mus musculus
ttggtctcagaacaggcctagaggc

SEQ ID NO: 43221 - DNA, 25 bp, mus musculus
gtggctattgtgtgcccctttcctg

SEQ ID NO: 43222 - DNA, 25 bp, mus musculus
gctattgtgtgcccctttcctggcg

SEQ ID NO: 43223 - DNA, 25 bp, mus musculus
tgcccctttcctggcgctgtgatgg

SEQ ID NO: 43224 - DNA, 25 bp, mus musculus
ccctttcctggcgctgtgatgggga

SEQ ID NO: 43225 - DNA, 25 bp, mus musculus
gggaccaggactgctctgatggcag

SEQ ID NO: 43226 - DNA, 25 bp, mus musculus
accaggactgctctgatggcagtga

SEQ ID NO: 43227 - DNA, 25 bp, mus musculus
actgctctgatggcagtgacgagga

SEQ ID NO: 43228 - DNA, 25 bp, mus musculus
gctctgatggcagtgacgaggaaga

SEQ ID NO: 43229 - DNA, 25 bp, mus musculus
agtcatgtgctcagaatgggcagtg

SEQ ID NO: 43230 - DNA, 25 bp, mus musculus
catgtgctcagaatgggcagtgcaa

SEQ ID NO: 43231 - DNA, 25 bp, mus musculus
gggtccaagtctccggctctagagc

SEQ ID NO: 43232 - DNA, 25 bp, mus musculus
aagtctccggctctagagctgactc

SEQ ID NO: 43233 - DNA, 25 bp, mus musculus
gctctagagctgactcctgcccgac

SEQ ID NO: 43234 - DNA, 25 bp, mus musculus
ctagagctgactcctgcccgacaga

SEQ ID NO: 43235 - DNA, 25 bp, mus musculus
cagacaccttccagtgtcttaccag

SEQ ID NO: 43236 - DNA, 25 bp, mus musculus
acaccttccagtgtcttaccagtgg

SEQ ID NO: 43237 - DNA, 25 bp, mus musculus
agtgtcttaccagtggctattgtgt

SEQ ID NO: 43238 - DNA, 25 bp, mus musculus
gtcttaccagtggctattgtgtgcc

SEQ ID NO: 43239 - DNA, 25 bp, mus musculus
gtattcttttcagccacaccaccgg

SEQ ID NO: 43240 - DNA, 25 bp, mus musculus
tttcctaacaacatgagaagtccac

SEQ ID NO: 43241 - DNA, 25 bp, mus musculus
ttacaaaactgcttggcagccccgg

SEQ ID NO: 43242 - DNA, 25 bp, mus musculus
ttgtgttcaagggctgcacccaggt

SEQ ID NO: 43243 - DNA, 25 bp, mus musculus
gctgcacccaggtgttgtaccctgt

SEQ ID NO: 43244 - DNA, 25 bp, mus musculus
gcacccaggtgttgtaccctgtcag

SEQ ID NO: 43245 - DNA, 25 bp, mus musculus
tgttgtaccctgtcagcatgatacc

SEQ ID NO: 43246 - DNA, 25 bp, mus musculus
accctgtcagcatgataccagaaat

SEQ ID NO: 43247 - DNA, 25 bp, mus musculus
attattctggagcctcaaataagca

SEQ ID NO: 43248 - DNA, 25 bp, mus musculus
agcattataacttctgtggttatga

SEQ ID NO: 43249 - DNA, 25 bp, mus musculus
attataacttctgtggttatgattg

SEQ ID NO: 43250 - DNA, 25 bp, mus musculus
ataacttctgtggttatgattgcct

SEQ ID NO: 43251 - DNA, 25 bp, mus musculus
atgagaagtccaccttgtgttcact

SEQ ID NO: 43252 - DNA, 25 bp, mus musculus
ccaccttgtgttcactcagacaaac

SEQ ID NO: 43253 - DNA, 25 bp, mus musculus
tgtgttcactcagacaaaccttcat

SEQ ID NO: 43254 - DNA, 25 bp, mus musculus
cactcagacaaaccttcattgttta

SEQ ID NO: 43255 - DNA, 25 bp, mus musculus
tcagacaaaccttcattgtttattg

SEQ ID NO: 43256 - DNA, 25 bp, mus musculus
aatcttcggaaacttgcacaaacag

SEQ ID NO: 43257 - DNA, 25 bp, mus musculus
gacagccagcactcaaggttttact

SEQ ID NO: 43258 - DNA, 25 bp, mus musculus
agccagcactcaaggttttactgtg

SEQ ID NO: 43259 - DNA, 25 bp, mus musculus
tggccagcagcaaccagcagcactg

SEQ ID NO: 43260 - DNA, 25 bp, mus musculus
gcagcaaccagcagcactgagagca

SEQ ID NO: 43261 - DNA, 25 bp, mus musculus
gccctgctacgggaagatggagact

SEQ ID NO: 43262 - DNA, 25 bp, mus musculus
tttgtcctcacaggcatgcacaatg

SEQ ID NO: 43263 - DNA, 25 bp, mus musculus
gtctttgacagcatcagccacctca

SEQ ID NO: 43264 - DNA, 25 bp, mus musculus
gacagcatcagccacctcatcaatt

SEQ ID NO: 43265 - DNA, 25 bp, mus musculus
cacctcatcaattaccacctcgaga

SEQ ID NO: 43266 - DNA, 25 bp, mus musculus
atcaattaccacctcgagagcagcc

SEQ ID NO: 43267 - DNA, 25 bp, mus musculus
ctcgagagcagcctgcccattgtct

SEQ ID NO: 43268 - DNA, 25 bp, mus musculus
attgtctctgccgggagtgagcttt

SEQ ID NO: 43269 - DNA, 25 bp, mus musculus
tgtctccagcaaccagtggagagga

SEQ ID NO: 43270 - DNA, 25 bp, mus musculus
cttatgccaggtcaggaagactggc

SEQ ID NO: 43271 - DNA, 25 bp, mus musculus
accagcagcactgagagcagcccac

SEQ ID NO: 43272 - DNA, 25 bp, mus musculus
actgtctgtggccatcacattaaag

SEQ ID NO: 43273 - DNA, 25 bp, mus musculus
agcactgagagcagcccacggaagg

SEQ ID NO: 43274 - DNA, 25 bp, mus musculus
ctgggccccatgttgagcaaagccg

SEQ ID NO: 43275 - DNA, 25 bp, mus musculus
aaagccgcgtctgtggagtgcatca

SEQ ID NO: 43276 - DNA, 25 bp, mus musculus
tgcatcagcccggtcacacccagag

SEQ ID NO: 43277 - DNA, 25 bp, mus musculus
gatgccaggatgctggaggagctta

SEQ ID NO: 43278 - DNA, 25 bp, mus musculus
aacgctgagccctggtaccaaggag

SEQ ID NO: 43279 - DNA, 25 bp, mus musculus
gagccctggtaccaaggagagatga

SEQ ID NO: 43280 - DNA, 25 bp, mus musculus
tatttctgtgccccaaggtcaacac

SEQ ID NO: 43281 - DNA, 25 bp, mus musculus
tgtgccccaaggtcaacacacatgc

SEQ ID NO: 43282 - DNA, 25 bp, mus musculus
cctacgagtcagagacagtgggtgt

SEQ ID NO: 43283 - DNA, 25 bp, mus musculus
gtacagggcactcaagctgtatgta

SEQ ID NO: 43284 - DNA, 25 bp, mus musculus
ggcactcaagctgtatgtagaaaaa

SEQ ID NO: 43285 - DNA, 25 bp, mus musculus
agctctggtggtcagcagaaagcac

SEQ ID NO: 43286 - DNA, 25 bp, mus musculus
agaatgctagctcatttgttgctac

SEQ ID NO: 43287 - DNA, 25 bp, mus musculus
atgctagctcatttgttgctacaga

SEQ ID NO: 43288 - DNA, 25 bp, mus musculus
gctcatttgttgctacagatttgcc

SEQ ID NO: 43289 - DNA, 25 bp, mus musculus
agtcatccagtagactccctacatc

SEQ ID NO: 43290 - DNA, 25 bp, mus musculus
ccagtagactccctacatcagggct

SEQ ID NO: 43291 - DNA, 25 bp, mus musculus
gactccctacatcagggctctcagc

SEQ ID NO: 43292 - DNA, 25 bp, mus musculus
ccaaggtcaacacacatgcccagtc

SEQ ID NO: 43293 - DNA, 25 bp, mus musculus
acacacatgcccagtcctgggtcag

SEQ ID NO: 43294 - DNA, 25 bp, mus musculus
cacatgcccagtcctgggtcagtcc

SEQ ID NO: 43295 - DNA, 25 bp, mus musculus
ggtgttatcacaccggaaagcctct

SEQ ID NO: 43296 - DNA, 25 bp, mus musculus
atcacaccggaaagcctcttcacct

SEQ ID NO: 43297 - DNA, 25 bp, mus musculus
ttcacctggaggtacagagggagag

SEQ ID NO: 43298 - DNA, 25 bp, mus musculus
tccactcagcctacgagtcagagac

SEQ ID NO: 43299 - DNA, 25 bp, mus musculus
actcagcctacgagtcagagacagt

SEQ ID NO: 43300 - DNA, 25 bp, mus musculus
ggcttcaaacatccgttcgccatag

SEQ ID NO: 43301 - DNA, 25 bp, mus musculus
ttcaaacatccgttcgccatagaga

SEQ ID NO: 43302 - DNA, 25 bp, mus musculus
gtgccagtcaaggctctgtgccact

SEQ ID NO: 43303 - DNA, 25 bp, mus musculus
aaggctctgtgccactcggcaaacc

SEQ ID NO: 43304 - DNA, 25 bp, mus musculus
gctctgtgccactcggcaaaccaga

SEQ ID NO: 43305 - DNA, 25 bp, mus musculus
ctgtgccactcggcaaaccagagcc

SEQ ID NO: 43306 - DNA, 25 bp, mus musculus
cactcggcaaaccagagcctgccag

SEQ ID NO: 43307 - DNA, 25 bp, mus musculus
tcggcaaaccagagcctgccagctg

SEQ ID NO: 43308 - DNA, 25 bp, mus musculus
agcctgccagctgtaccggtgccca

SEQ ID NO: 43309 - DNA, 25 bp, mus musculus
ctgccagctgtaccggtgcccatca

SEQ ID NO: 43310 - DNA, 25 bp, mus musculus
gggagctccctacactcggtgttgg

SEQ ID NO: 43311 - DNA, 25 bp, mus musculus
cactcggtgttggtgcattcttagg

SEQ ID NO: 43312 - DNA, 25 bp, mus musculus
ccgttcgccatagagaacatcatcg

SEQ ID NO: 43313 - DNA, 25 bp, mus musculus
gactacaagggcgtgctgcaggctg

SEQ ID NO: 43314 - DNA, 25 bp, mus musculus
ttgcctttggcgtcggtcatgcacc

SEQ ID NO: 43315 - DNA, 25 bp, mus musculus
cctttggcgtcggtcatgcaccact

SEQ ID NO: 43316 - DNA, 25 bp, mus musculus
gtcatgcaccacttgggctaccccg

SEQ ID NO: 43317 - DNA, 25 bp, mus musculus
ccgggccagctcagcaatgttgtcg

SEQ ID NO: 43318 - DNA, 25 bp, mus musculus
ctcagcaatgttgtcggctccgtgt

SEQ ID NO: 43319 - DNA, 25 bp, mus musculus
ggctccgtgtggcctcatgttggcg

SEQ ID NO: 43320 - DNA, 25 bp, mus musculus
cagactgagcccagcagcttctact

SEQ ID NO: 43321 - DNA, 25 bp, mus musculus
gactgagcccagcagcttctactta

SEQ ID NO: 43322 - DNA, 25 bp, mus musculus
gtcaggtcccaaacagtgtccccag

SEQ ID NO: 43323 - DNA, 25 bp, mus musculus
acaccaaccaagtgagtgggattct

SEQ ID NO: 43324 - DNA, 25 bp, mus musculus
atagagatgtggcccctcagagcag

SEQ ID NO: 43325 - DNA, 25 bp, mus musculus
agagatgtggcccctcagagcagag

SEQ ID NO: 43326 - DNA, 25 bp, mus musculus
cccctcagagcagaggtaggcattt

SEQ ID NO: 43327 - DNA, 25 bp, mus musculus
taggcatttctgcattctgcagaga

SEQ ID NO: 43328 - DNA, 25 bp, mus musculus
cattctgcagagatgcacagatgcc

SEQ ID NO: 43329 - DNA, 25 bp, mus musculus
gcacagatgcccagagagagccatg

SEQ ID NO: 43330 - DNA, 25 bp, mus musculus
agatgcccagagagagccatgcttg

SEQ ID NO: 43331 - DNA, 25 bp, mus musculus
atgcccagagagagccatgcttgtg

SEQ ID NO: 43332 - DNA, 25 bp, mus musculus
ctgagcccagcagcttctacttacc

SEQ ID NO: 43333 - DNA, 25 bp, mus musculus
ccagcagcttctacttacctaccta

SEQ ID NO: 43334 - DNA, 25 bp, mus musculus
agcagcttctacttacctacctagg

SEQ ID NO: 43335 - DNA, 25 bp, mus musculus
cagcttctacttacctacctaggtg

SEQ ID NO: 43336 - DNA, 25 bp, mus musculus
ttctacttacctacctaggtgcttg

SEQ ID NO: 43337 - DNA, 25 bp, mus musculus
ctacctaggtgcttgaggatggaac

SEQ ID NO: 43338 - DNA, 25 bp, mus musculus
acctaggtgcttgaggatggaactc

SEQ ID NO: 43339 - DNA, 25 bp, mus musculus
tctggtcaggtcccaaacagtgtcc

SEQ ID NO: 43340 - DNA, 25 bp, mus musculus
aaccattgactgggtagcttttgca

SEQ ID NO: 43341 - DNA, 25 bp, mus musculus
tgactgggtagcttttgcagagatc

SEQ ID NO: 43342 - DNA, 25 bp, mus musculus
ctccaggttggctgctttacctgag

SEQ ID NO: 43343 - DNA, 25 bp, mus musculus
caggttggctgctttacctgagaat

SEQ ID NO: 43344 - DNA, 25 bp, mus musculus
gttggctgctttacctgagaatcca

SEQ ID NO: 43345 - DNA, 25 bp, mus musculus
tgctttacctgagaatccaccagct

SEQ ID NO: 43346 - DNA, 25 bp, mus musculus
tttacctgagaatccaccagctatc

SEQ ID NO: 43347 - DNA, 25 bp, mus musculus
acctgagaatccaccagctatcgac

SEQ ID NO: 43348 - DNA, 25 bp, mus musculus
gaatccaccagctatcgactgggct

SEQ ID NO: 43349 - DNA, 25 bp, mus musculus
tccaccagctatcgactgggcttac

SEQ ID NO: 43350 - DNA, 25 bp, mus musculus
ttactacaaggccaatgtggcatag

SEQ ID NO: 43351 - DNA, 25 bp, mus musculus
ggttcccgtgccagaggataaatat

SEQ ID NO: 43352 - DNA, 25 bp, mus musculus
tgcagagatcataccccagaaccaa

SEQ ID NO: 43353 - DNA, 25 bp, mus musculus
agagatcataccccagaaccaaaag

SEQ ID NO: 43354 - DNA, 25 bp, mus musculus
ccagaaccaaaaggccattgctagt

SEQ ID NO: 43355 - DNA, 25 bp, mus musculus
ccaaaaggccattgctagttccctg

SEQ ID NO: 43356 - DNA, 25 bp, mus musculus
ggccattgctagttccctgaaatcc

SEQ ID NO: 43357 - DNA, 25 bp, mus musculus
tgctagttccctgaaatcctggaat

SEQ ID NO: 43358 - DNA, 25 bp, mus musculus
tagttccctgaaatcctggaatgag

SEQ ID NO: 43359 - DNA, 25 bp, mus musculus
cctcacctccaggttggctgcttta

SEQ ID NO: 43360 - DNA, 25 bp, mus musculus
tccaaatttacctgccaaactgcaa

SEQ ID NO: 43361 - DNA, 25 bp, mus musculus
gtgcgtctacccttggaatgggaag

SEQ ID NO: 43362 - DNA, 25 bp, mus musculus
ggggagaccccaactgccagatgta

SEQ ID NO: 43363 - DNA, 25 bp, mus musculus
gagaccccaactgccagatgtattt

SEQ ID NO: 43364 - DNA, 25 bp, mus musculus
agaccccaactgccagatgtatttt

SEQ ID NO: 43365 - DNA, 25 bp, mus musculus
ataatgttctgtcacgtgaaatatt

SEQ ID NO: 43366 - DNA, 25 bp, mus musculus
taatgttctgtcacgtgaaatattt

SEQ ID NO: 43367 - DNA, 25 bp, mus musculus
atttatactctagaacatgcacatt

SEQ ID NO: 43368 - DNA, 25 bp, mus musculus
tttatactctagaacatgcacattt

SEQ ID NO: 43369 - DNA, 25 bp, mus musculus
ttatactctagaacatgcacattta

SEQ ID NO: 43370 - DNA, 25 bp, mus musculus
atactctagaacatgcacatttata

SEQ ID NO: 43371 - DNA, 25 bp, mus musculus
tactctagaacatgcacatttatat

SEQ ID NO: 43372 - DNA, 25 bp, mus musculus
tgcgtctacccttggaatgggaaga

SEQ ID NO: 43373 - DNA, 25 bp, mus musculus
tctacccttggaatgggaagaggat

SEQ ID NO: 43374 - DNA, 25 bp, mus musculus
aagaggatccctgggtctccagaga

SEQ ID NO: 43375 - DNA, 25 bp, mus musculus
aggatccctgggtctccagagatca

SEQ ID NO: 43376 - DNA, 25 bp, mus musculus
tgggtctccagagatcaggggagac

SEQ ID NO: 43377 - DNA, 25 bp, mus musculus
gggtctccagagatcaggggagacc

SEQ ID NO: 43378 - DNA, 25 bp, mus musculus
gtctccagagatcaggggagacccc

SEQ ID NO: 43379 - DNA, 25 bp, mus musculus
tctccagagatcaggggagacccca

SEQ ID NO: 43380 - DNA, 25 bp, mus musculus
agatgtcctctggacagatctttct

SEQ ID NO: 43381 - DNA, 25 bp, mus musculus
atgtcctctggacagatctttctgt

SEQ ID NO: 43382 - DNA, 25 bp, mus musculus
cctctctgcacagaattcgcatggc

SEQ ID NO: 43383 - DNA, 25 bp, mus musculus
tctgcacagaattcgcatggcattt

SEQ ID NO: 43384 - DNA, 25 bp, mus musculus
cacagaattcgcatggcattttaaa

SEQ ID NO: 43385 - DNA, 25 bp, mus musculus
attgatgtccttgttctcagcatgc

SEQ ID NO: 43386 - DNA, 25 bp, mus musculus
tgatgtccttgttctcagcatgccc

SEQ ID NO: 43387 - DNA, 25 bp, mus musculus
gttctcagcatgcccattttaagac

SEQ ID NO: 43388 - DNA, 25 bp, mus musculus
tctcagcatgcccattttaagacag

SEQ ID NO: 43389 - DNA, 25 bp, mus musculus
tcagcatgcccattttaagacagaa

SEQ ID NO: 43390 - DNA, 25 bp, mus musculus
agcatgcccattttaagacagaagt

SEQ ID NO: 43391 - DNA, 25 bp, mus musculus
catgcccattttaagacagaagttt

SEQ ID NO: 43392 - DNA, 25 bp, mus musculus
cctctggacagatctttctgttaaa

SEQ ID NO: 43393 - DNA, 25 bp, mus musculus
tggtatgttccttttagcattctag

SEQ ID NO: 43394 - DNA, 25 bp, mus musculus
gtatgttccttttagcattctaggt

SEQ ID NO: 43395 - DNA, 25 bp, mus musculus
tccttttagcattctaggtaattga

SEQ ID NO: 43396 - DNA, 25 bp, mus musculus
acaacccaatagttgttccattgtg

SEQ ID NO: 43397 - DNA, 25 bp, mus musculus
cccaatagttgttccattgtgacct

SEQ ID NO: 43398 - DNA, 25 bp, mus musculus
tcttcctctctgcacagaattcgca

SEQ ID NO: 43399 - DNA, 25 bp, mus musculus
ttcctctctgcacagaattcgcatg

SEQ ID NO: 43400 - DNA, 25 bp, mus musculus
ctgtctttgcccggtccactgtggt

SEQ ID NO: 43401 - DNA, 25 bp, mus musculus
tctttgcccggtccactgtggtcca

SEQ ID NO: 43402 - DNA, 25 bp, mus musculus
gcagctctgtgcccagctactgcca

SEQ ID NO: 43403 - DNA, 25 bp, mus musculus
ccatcaccactgtgacggcttctgc

SEQ ID NO: 43404 - DNA, 25 bp, mus musculus
ctgtgacggcttctgcttcggtgac

SEQ ID NO: 43405 - DNA, 25 bp, mus musculus
cttcggtgactgttgctgtgcatcc

SEQ ID NO: 43406 - DNA, 25 bp, mus musculus
cctgtccaggctatgagagctaccc

SEQ ID NO: 43407 - DNA, 25 bp, mus musculus
gctatgagagctaccctgagactga

SEQ ID NO: 43408 - DNA, 25 bp, mus musculus
atgagagctaccctgagactgatca

SEQ ID NO: 43409 - DNA, 25 bp, mus musculus
ctgatcacggggtatttgaggatcc

SEQ ID NO: 43410 - DNA, 25 bp, mus musculus
tatttgaggatcctcatgtgccttt

SEQ ID NO: 43411 - DNA, 25 bp, mus musculus
ttgaggatcctcatgtgccttttca

SEQ ID NO: 43412 - DNA, 25 bp, mus musculus
ccactgtggtccatccggactccag

SEQ ID NO: 43413 - DNA, 25 bp, mus musculus
tggtccatccggactccagacatca

SEQ ID NO: 43414 - DNA, 25 bp, mus musculus
aaggccagcagcctcgaagggatcc

SEQ ID NO: 43415 - DNA, 25 bp, mus musculus
cctacagaccgcgcagagacgcttt

SEQ ID NO: 43416 - DNA, 25 bp, mus musculus
tttctactgaagggcattctggccc

SEQ ID NO: 43417 - DNA, 25 bp, mus musculus
ctagcaatagggaccgctcagggcc

SEQ ID NO: 43418 - DNA, 25 bp, mus musculus
gcaatagggaccgctcagggccccg

SEQ ID NO: 43419 - DNA, 25 bp, mus musculus
ccgccatgggcagctctgtgcccag

SEQ ID NO: 43420 - DNA, 25 bp, mus musculus
cttcacctggactgacagcaaaccc

SEQ ID NO: 43421 - DNA, 25 bp, mus musculus
gactgacagcaaacccaaggcctcg

SEQ ID NO: 43422 - DNA, 25 bp, mus musculus
cagtttctgccattccagctgtggg

SEQ ID NO: 43423 - DNA, 25 bp, mus musculus
tttctgccattccagctgtgggcac

SEQ ID NO: 43424 - DNA, 25 bp, mus musculus
ctgccattccagctgtgggcacgtc

SEQ ID NO: 43425 - DNA, 25 bp, mus musculus
ccattccagctgtgggcacgtcagc

SEQ ID NO: 43426 - DNA, 25 bp, mus musculus
ctgtgggcacgtcagcgaaggcaag

SEQ ID NO: 43427 - DNA, 25 bp, mus musculus
caagcgcaggttcacctacgaccac

SEQ ID NO: 43428 - DNA, 25 bp, mus musculus
caggttcacctacgaccacgctgag

SEQ ID NO: 43429 - DNA, 25 bp, mus musculus
gttcacctacgaccacgctgagctg

SEQ ID NO: 43430 - DNA, 25 bp, mus musculus
cacctacgaccacgctgagctggaa

SEQ ID NO: 43431 - DNA, 25 bp, mus musculus
ccacgctgagctggaaaggaaaatc

SEQ ID NO: 43432 - DNA, 25 bp, mus musculus
tgacagcaaacccaaggcctcgctc

SEQ ID NO: 43433 - DNA, 25 bp, mus musculus
caaacccaaggcctcgctcaagatt

SEQ ID NO: 43434 - DNA, 25 bp, mus musculus
acccaaggcctcgctcaagattgac

SEQ ID NO: 43435 - DNA, 25 bp, mus musculus
ggcctcgctcaagattgacttgaga

SEQ ID NO: 43436 - DNA, 25 bp, mus musculus
taaggagtcggggctgtctgatgtc

SEQ ID NO: 43437 - DNA, 25 bp, mus musculus
cagcaggcccagtttctgccattcc

SEQ ID NO: 43438 - DNA, 25 bp, mus musculus
caggcccagtttctgccattccagc

SEQ ID NO: 43439 - DNA, 25 bp, mus musculus
gcccagtttctgccattccagctgt

SEQ ID NO: 43440 - DNA, 25 bp, mus musculus
tcacttgcactgtctctgggttttc

SEQ ID NO: 43441 - DNA, 25 bp, mus musculus
cacttgcactgtctctgggttttca

SEQ ID NO: 43442 - DNA, 25 bp, mus musculus
ttcggctctcatgtccagactgagc

SEQ ID NO: 43443 - DNA, 25 bp, mus musculus
tcggctctcatgtccagactgagca

SEQ ID NO: 43444 - DNA, 25 bp, mus musculus
caaactgatgacacagccatgtact

SEQ ID NO: 43445 - DNA, 25 bp, mus musculus
actgatgacacagccatgtactact

SEQ ID NO: 43446 - DNA, 25 bp, mus musculus
cagccatgtactactgtgccagagc

SEQ ID NO: 43447 - DNA, 25 bp, mus musculus
gccatgtactactgtgccagagcgg

SEQ ID NO: 43448 - DNA, 25 bp, mus musculus
gattagactactggggccaaggcac

SEQ ID NO: 43449 - DNA, 25 bp, mus musculus
actctcacagtctcctcagagtctg

SEQ ID NO: 43450 - DNA, 25 bp, mus musculus
tctcacagtctcctcagagtctgcg

SEQ ID NO: 43451 - DNA, 25 bp, mus musculus
ctcacagtctcctcagagtctgcga

SEQ ID NO: 43452 - DNA, 25 bp, mus musculus
acttgcactgtctctgggttttcat

SEQ ID NO: 43453 - DNA, 25 bp, mus musculus
ttgcactgtctctgggttttcatta

SEQ ID NO: 43454 - DNA, 25 bp, mus musculus
gcactgtctctgggttttcattaac

SEQ ID NO: 43455 - DNA, 25 bp, mus musculus
tgtctctgggttttcattaaccagc

SEQ ID NO: 43456 - DNA, 25 bp, mus musculus
gtaatatgggctggtggaagcacaa

SEQ ID NO: 43457 - DNA, 25 bp, mus musculus
tataattcggctctcatgtccagac

SEQ ID NO: 43458 - DNA, 25 bp, mus musculus
ataattcggctctcatgtccagact

SEQ ID NO: 43459 - DNA, 25 bp, mus musculus
attcggctctcatgtccagactgag

SEQ ID NO: 43460 - DNA, 25 bp, mus musculus
attcgaattcacaatgcagagctgc

SEQ ID NO: 43461 - DNA, 25 bp, mus musculus
gaattcacaatgcagagctgcagcg

SEQ ID NO: 43462 - DNA, 25 bp, mus musculus
ctggcaaccttactaaaggaggatg

SEQ ID NO: 43463 - DNA, 25 bp, mus musculus
atgtgaaaatgctctcccatctgct

SEQ ID NO: 43464 - DNA, 25 bp, mus musculus
gtgaaaatgctctcccatctgctcc

SEQ ID NO: 43465 - DNA, 25 bp, mus musculus
gctctcccatctgctccaggcttta

SEQ ID NO: 43466 - DNA, 25 bp, mus musculus
tctcccatctgctccaggctttaga

SEQ ID NO: 43467 - DNA, 25 bp, mus musculus
ccatctgctccaggctttagattat

SEQ ID NO: 43468 - DNA, 25 bp, mus musculus
atctgctccaggctttagattatgg

SEQ ID NO: 43469 - DNA, 25 bp, mus musculus
ctgctccaggctttagattatgggg

SEQ ID NO: 43470 - DNA, 25 bp, mus musculus
gctccaggctttagattatggggca

SEQ ID NO: 43471 - DNA, 25 bp, mus musculus
attgccttagggttagacagactga

SEQ ID NO: 43472 - DNA, 25 bp, mus musculus
attcacaatgcagagctgcagcgtt

SEQ ID NO: 43473 - DNA, 25 bp, mus musculus
tcacaatgcagagctgcagcgttat

SEQ ID NO: 43474 - DNA, 25 bp, mus musculus
acaatgcagagctgcagcgttatat

SEQ ID NO: 43475 - DNA, 25 bp, mus musculus
tgcagagctgcagcgttatatcctg

SEQ ID NO: 43476 - DNA, 25 bp, mus musculus
gctgcagcgttatatcctggcaacc

SEQ ID NO: 43477 - DNA, 25 bp, mus musculus
cagcgttatatcctggcaaccttac

SEQ ID NO: 43478 - DNA, 25 bp, mus musculus
gcgttatatcctggcaaccttacta

SEQ ID NO: 43479 - DNA, 25 bp, mus musculus
tatatcctggcaaccttactaaagg

SEQ ID NO: 43480 - DNA, 25 bp, mus musculus
agcaaaactacgcacatagtcgagg

SEQ ID NO: 43481 - DNA, 25 bp, mus musculus
acgcacatagtcgaggatggacttt

SEQ ID NO: 43482 - DNA, 25 bp, mus musculus
agcgaagctctccagctttggctaa

SEQ ID NO: 43483 - DNA, 25 bp, mus musculus
gctctccagctttggctaacccaat

SEQ ID NO: 43484 - DNA, 25 bp, mus musculus
cagctttggctaacccaatccgagc

SEQ ID NO: 43485 - DNA, 25 bp, mus musculus
ctttggctaacccaatccgagcaca

SEQ ID NO: 43486 - DNA, 25 bp, mus musculus
acccaatccgagcacatcaagagct

SEQ ID NO: 43487 - DNA, 25 bp, mus musculus
caatccgagcacatcaagagcttca

SEQ ID NO: 43488 - DNA, 25 bp, mus musculus
tccgagcacatcaagagcttcagtc

SEQ ID NO: 43489 - DNA, 25 bp, mus musculus
atcaagagcttcagtcttgtgacag

SEQ ID NO: 43490 - DNA, 25 bp, mus musculus
aagagcttcagtcttgtgacagtaa

SEQ ID NO: 43491 - DNA, 25 bp, mus musculus
tattctttcttgttgaatgcagtcc

SEQ ID NO: 43492 - DNA, 25 bp, mus musculus
gatggactttgtccttcatggcttt

SEQ ID NO: 43493 - DNA, 25 bp, mus musculus
ggactttgtccttcatggctttggt

SEQ ID NO: 43494 - DNA, 25 bp, mus musculus
tgtccttcatggctttggtatcctg

SEQ ID NO: 43495 - DNA, 25 bp, mus musculus
tttcatattgtttgctgattggcag

SEQ ID NO: 43496 - DNA, 25 bp, mus musculus
attgtttgctgattggcaggtagtt

SEQ ID NO: 43497 - DNA, 25 bp, mus musculus
agataacatactaacttttcaatga

SEQ ID NO: 43498 - DNA, 25 bp, mus musculus
gcttcgtctgaagatgctggtgaaa

SEQ ID NO: 43499 - DNA, 25 bp, mus musculus
tcgtctgaagatgctggtgaaagca

SEQ ID NO: 43500 - DNA, 25 bp, mus musculus
tgggtaaagccctgaacttgcctgg

SEQ ID NO: 43501 - DNA, 25 bp, mus musculus
ttctttccccgctttggcatcgctg

SEQ ID NO: 43502 - DNA, 25 bp, mus musculus
aggctccatggagcaccgaagcagt

SEQ ID NO: 43503 - DNA, 25 bp, mus musculus
ggctccatggagcaccgaagcagtg

SEQ ID NO: 43504 - DNA, 25 bp, mus musculus
ctccatggagcaccgaagcagtgtt

SEQ ID NO: 43505 - DNA, 25 bp, mus musculus
tccatggagcaccgaagcagtgttt

SEQ ID NO: 43506 - DNA, 25 bp, mus musculus
catggagcaccgaagcagtgtttac

SEQ ID NO: 43507 - DNA, 25 bp, mus musculus
tgtttactgcgctgcctgcagataa

SEQ ID NO: 43508 - DNA, 25 bp, mus musculus
gtttactgcgctgcctgcagataag

SEQ ID NO: 43509 - DNA, 25 bp, mus musculus
tactgcgctgcctgcagataagaaa

SEQ ID NO: 43510 - DNA, 25 bp, mus musculus
ctgcgctgcctgcagataagaaacg

SEQ ID NO: 43511 - DNA, 25 bp, mus musculus
tgcgctgcctgcagataagaaacga

SEQ ID NO: 43512 - DNA, 25 bp, mus musculus
tttccccgctttggcatcgctgtga

SEQ ID NO: 43513 - DNA, 25 bp, mus musculus
cccgctttggcatcgctgtgacgaa

SEQ ID NO: 43514 - DNA, 25 bp, mus musculus
cgctttggcatcgctgtgacgaaag

SEQ ID NO: 43515 - DNA, 25 bp, mus musculus
ctgtgacgaaagcccttaggctcca

SEQ ID NO: 43516 - DNA, 25 bp, mus musculus
acgaaagcccttaggctccatggag

SEQ ID NO: 43517 - DNA, 25 bp, mus musculus
cgaaagcccttaggctccatggagc

SEQ ID NO: 43518 - DNA, 25 bp, mus musculus
aaagcccttaggctccatggagcac

SEQ ID NO: 43519 - DNA, 25 bp, mus musculus
ttaggctccatggagcaccgaagca

SEQ ID NO: 43520 - DNA, 25 bp, mus musculus
agtatgcgagccccgatgtcttcaa

SEQ ID NO: 43521 - DNA, 25 bp, mus musculus
gtgaagacttcatcagctttgtgtt

SEQ ID NO: 43522 - DNA, 25 bp, mus musculus
tgtctacgttaagagccctatgtgg

SEQ ID NO: 43523 - DNA, 25 bp, mus musculus
aagcaatatacccagacattgtgcg

SEQ ID NO: 43524 - DNA, 25 bp, mus musculus
tatacccagacattgtgcgactcca

SEQ ID NO: 43525 - DNA, 25 bp, mus musculus
cagacattgtgcgactccattttcc

SEQ ID NO: 43526 - DNA, 25 bp, mus musculus
ctccattatacaaggaattgttcac

SEQ ID NO: 43527 - DNA, 25 bp, mus musculus
tgttcacttcagaatttgagccagc

SEQ ID NO: 43528 - DNA, 25 bp, mus musculus
aatttgagccagccatgcaaatcga

SEQ ID NO: 43529 - DNA, 25 bp, mus musculus
agccagccatgcaaatcgatgggta

SEQ ID NO: 43530 - DNA, 25 bp, mus musculus
aaatgtcgcgcccgagcacttctag

SEQ ID NO: 43531 - DNA, 25 bp, mus musculus
cttctagaacatctggagtacaaca

SEQ ID NO: 43532 - DNA, 25 bp, mus musculus
tgtgttctatgcacctgaccgaaga

SEQ ID NO: 43533 - DNA, 25 bp, mus musculus
ctatgcacctgaccgaagacgaaat

SEQ ID NO: 43534 - DNA, 25 bp, mus musculus
tattttctgcattcgtactgatgtc

SEQ ID NO: 43535 - DNA, 25 bp, mus musculus
ctgcattcgtactgatgtcagcgga

SEQ ID NO: 43536 - DNA, 25 bp, mus musculus
cagcggatccgtcgtggcttcagga

SEQ ID NO: 43537 - DNA, 25 bp, mus musculus
acatggcccttcagcacgtcctaca

SEQ ID NO: 43538 - DNA, 25 bp, mus musculus
atggaattctaaccaagctaatatg

SEQ ID NO: 43539 - DNA, 25 bp, mus musculus
ttctaaccaagctaatatgcaaggt

SEQ ID NO: 43540 - DNA, 25 bp, mus musculus
cctgaccatcggcatgggcaagatc

SEQ ID NO: 43541 - DNA, 25 bp, mus musculus
ggtctccttcctggatgccgtgtcc

SEQ ID NO: 43542 - DNA, 25 bp, mus musculus
caagtctctggcatcgagtttgttt

SEQ ID NO: 43543 - DNA, 25 bp, mus musculus
ccataccttgccagcggtgtcttcc

SEQ ID NO: 43544 - DNA, 25 bp, mus musculus
tctgcttctctctggatgtccttca

SEQ ID NO: 43545 - DNA, 25 bp, mus musculus
tctctctggatgtccttcattctct

SEQ ID NO: 43546 - DNA, 25 bp, mus musculus
tggatgtccttcattctctgtgtta

SEQ ID NO: 43547 - DNA, 25 bp, mus musculus
attctctgtgttacctgttggccta

SEQ ID NO: 43548 - DNA, 25 bp, mus musculus
tgtgttacctgttggcctaggccgc

SEQ ID NO: 43549 - DNA, 25 bp, mus musculus
tggcctaggccgcaggctcatcatg

SEQ ID NO: 43550 - DNA, 25 bp, mus musculus
aggccgcaggctcatcatgtctctg

SEQ ID NO: 43551 - DNA, 25 bp, mus musculus
caggctcatcatgtctctgacccag

SEQ ID NO: 43552 - DNA, 25 bp, mus musculus
cttcctggatgccgtgtccttccgt

SEQ ID NO: 43553 - DNA, 25 bp, mus musculus
cttccgtgggctgctcgagtgcccc

SEQ ID NO: 43554 - DNA, 25 bp, mus musculus
tgttcagctgcaggagcccgtggcg

SEQ ID NO: 43555 - DNA, 25 bp, mus musculus
cgtggcgaccaagcctgagaggaaa

SEQ ID NO: 43556 - DNA, 25 bp, mus musculus
gggctttgccaaactggactgagcc

SEQ ID NO: 43557 - DNA, 25 bp, mus musculus
tgccaaactggactgagccgttcag

SEQ ID NO: 43558 - DNA, 25 bp, mus musculus
actggactgagccgttcagcgcccc

SEQ ID NO: 43559 - DNA, 25 bp, mus musculus
gacctgagttctgctccccaagtct

SEQ ID NO: 43560 - DNA, 25 bp, mus musculus
gctatctcccagctgggactccctg

SEQ ID NO: 43561 - DNA, 25 bp, mus musculus
gttttctggctcccagggtcaactg

SEQ ID NO: 43562 - DNA, 25 bp, mus musculus
tagcttcatgacctctttctccaaa

SEQ ID NO: 43563 - DNA, 25 bp, mus musculus
catgacctctttctccaaatagggc

SEQ ID NO: 43564 - DNA, 25 bp, mus musculus
ctccaaatagggcctctgccagcta

SEQ ID NO: 43565 - DNA, 25 bp, mus musculus
agaggccatgcagaactttgacaca

SEQ ID NO: 43566 - DNA, 25 bp, mus musculus
gaactttgacacagcgcagggagca

SEQ ID NO: 43567 - DNA, 25 bp, mus musculus
attcagtcagcacccagggctctgg

SEQ ID NO: 43568 - DNA, 25 bp, mus musculus
tcagcacccagggctctggctggga

SEQ ID NO: 43569 - DNA, 25 bp, mus musculus
atacaatcctgtatagttcccattt

SEQ ID NO: 43570 - DNA, 25 bp, mus musculus
catttacaacagacttcctgccctt

SEQ ID NO: 43571 - DNA, 25 bp, mus musculus
cccacttgaactggccagtctgtgt

SEQ ID NO: 43572 - DNA, 25 bp, mus musculus
tggctcccagggtcaactgcaaccc

SEQ ID NO: 43573 - DNA, 25 bp, mus musculus
agatgtcctgagacacccagcctgg

SEQ ID NO: 43574 - DNA, 25 bp, mus musculus
agcctggccgcagaagagcgtatgg

SEQ ID NO: 43575 - DNA, 25 bp, mus musculus
tactggggctacaggtcaggcctcc

SEQ ID NO: 43576 - DNA, 25 bp, mus musculus
tgcgagctgccacaacagctacatc

SEQ ID NO: 43577 - DNA, 25 bp, mus musculus
ctgccacaacagctacatcgtcctg

SEQ ID NO: 43578 - DNA, 25 bp, mus musculus
caacagctacatcgtcctgtgcatt

SEQ ID NO: 43579 - DNA, 25 bp, mus musculus
ctacatcgtcctgtgcattgagaat

SEQ ID NO: 43580 - DNA, 25 bp, mus musculus
tgactccctgcatatctgccaaaga

SEQ ID NO: 43581 - DNA, 25 bp, mus musculus
tatctgccaaagacatcgtgtacat

SEQ ID NO: 43582 - DNA, 25 bp, mus musculus
gtactgtgaacacggcagtggcttt

SEQ ID NO: 43583 - DNA, 25 bp, mus musculus
tgaacacggcagtggctttaacctt

SEQ ID NO: 43584 - DNA, 25 bp, mus musculus
tggctttaaccttggcttgcttcgg

SEQ ID NO: 43585 - DNA, 25 bp, mus musculus
taaccttggcttgcttcggaactca

SEQ ID NO: 43586 - DNA, 25 bp, mus musculus
accataagccagggactgactacct

SEQ ID NO: 43587 - DNA, 25 bp, mus musculus
ttaaaccacctaagtgactgtgaat

SEQ ID NO: 43588 - DNA, 25 bp, mus musculus
tgcgccacatgaaaaccatctgggg

SEQ ID NO: 43589 - DNA, 25 bp, mus musculus
aaaccatctggggcatcacagcaaa

SEQ ID NO: 43590 - DNA, 25 bp, mus musculus
gcatcacagcaaagcagacagaact

SEQ ID NO: 43591 - DNA, 25 bp, mus musculus
cagaactaagcaaacgccttctcct

SEQ ID NO: 43592 - DNA, 25 bp, mus musculus
acatcgtgtacattggcttgcgaga

SEQ ID NO: 43593 - DNA, 25 bp, mus musculus
tgtacattggcttgcgagacgtaga

SEQ ID NO: 43594 - DNA, 25 bp, mus musculus
aagagaccttcagctacctgctggg

SEQ ID NO: 43595 - DNA, 25 bp, mus musculus
ggccgattcacctgagctttgatgt

SEQ ID NO: 43596 - DNA, 25 bp, mus musculus
tgagctttgatgtcgacgggctgga

SEQ ID NO: 43597 - DNA, 25 bp, mus musculus
ttgatgtcgacgggctggacccagc

SEQ ID NO: 43598 - DNA, 25 bp, mus musculus
acaagacagggctcctttcaggact

SEQ ID NO: 43599 - DNA, 25 bp, mus musculus
cagggctcctttcaggactagatat

SEQ ID NO: 43600 - DNA, 25 bp, mus musculus
atagccagctctcaaaagagtctcc

SEQ ID NO: 43601 - DNA, 25 bp, mus musculus
agccagctctcaaaagagtctccaa

SEQ ID NO: 43602 - DNA, 25 bp, mus musculus
gccagtaccaacatgtgaagaaaga

SEQ ID NO: 43603 - DNA, 25 bp, mus musculus
accaaatacctgtaatcctagcact

SEQ ID NO: 43604 - DNA, 25 bp, mus musculus
ggattgcctgcactcaggagttcaa

SEQ ID NO: 43605 - DNA, 25 bp, mus musculus
attgcctgcactcaggagttcaaga

SEQ ID NO: 43606 - DNA, 25 bp, mus musculus
tgcctgcactcaggagttcaagacc

SEQ ID NO: 43607 - DNA, 25 bp, mus musculus
agttcaagaccagctgggcaacatg

SEQ ID NO: 43608 - DNA, 25 bp, mus musculus
ttcaagaccagctgggcaacatggt

SEQ ID NO: 43609 - DNA, 25 bp, mus musculus
caagaccagctgggcaacatggtga

SEQ ID NO: 43610 - DNA, 25 bp, mus musculus
agaccagctgggcaacatggtgaaa

SEQ ID NO: 43611 - DNA, 25 bp, mus musculus
accagctgggcaacatggtgaaacc

SEQ ID NO: 43612 - DNA, 25 bp, mus musculus
ccagctctcaaaagagtctccaata

SEQ ID NO: 43613 - DNA, 25 bp, mus musculus
agctctcaaaagagtctccaatagg

SEQ ID NO: 43614 - DNA, 25 bp, mus musculus
ctctcaaaagagtctccaataggaa

SEQ ID NO: 43615 - DNA, 25 bp, mus musculus
ctcaaaagagtctccaataggaaag

SEQ ID NO: 43616 - DNA, 25 bp, mus musculus
aatctgtatctagccagtaccaaca

SEQ ID NO: 43617 - DNA, 25 bp, mus musculus
tctgtatctagccagtaccaacatg

SEQ ID NO: 43618 - DNA, 25 bp, mus musculus
tctagccagtaccaacatgtgaaga

SEQ ID NO: 43619 - DNA, 25 bp, mus musculus
tagccagtaccaacatgtgaagaaa

SEQ ID NO: 43620 - DNA, 25 bp, mus musculus
tcgaagccatgtgttctcttgggct

SEQ ID NO: 43621 - DNA, 25 bp, mus musculus
gaagccatgtgttctcttgggctag

SEQ ID NO: 43622 - DNA, 25 bp, mus musculus
ctccagcgagtggttcaccacctgt

SEQ ID NO: 43623 - DNA, 25 bp, mus musculus
cgagtggttcaccacctgttgcttc

SEQ ID NO: 43624 - DNA, 25 bp, mus musculus
agtggttcaccacctgttgcttctc

SEQ ID NO: 43625 - DNA, 25 bp, mus musculus
tggttcaccacctgttgcttctctt

SEQ ID NO: 43626 - DNA, 25 bp, mus musculus
acaccagccacagggcctggtccag

SEQ ID NO: 43627 - DNA, 25 bp, mus musculus
cagccacagggcctggtccagccag

SEQ ID NO: 43628 - DNA, 25 bp, mus musculus
caggtgcccagccagactatggtgc

SEQ ID NO: 43629 - DNA, 25 bp, mus musculus
ggtgcccagccagactatggtgctc

SEQ ID NO: 43630 - DNA, 25 bp, mus musculus
gccagactatggtgctcggcccgca

SEQ ID NO: 43631 - DNA, 25 bp, mus musculus
cagactatggtgctcggcccgcacg

SEQ ID NO: 43632 - DNA, 25 bp, mus musculus
acacactcacgtgtgcggacagggc

SEQ ID NO: 43633 - DNA, 25 bp, mus musculus
acactcacgtgtgcggacagggcca

SEQ ID NO: 43634 - DNA, 25 bp, mus musculus
acagggccagcagcacctgggcctc

SEQ ID NO: 43635 - DNA, 25 bp, mus musculus
cccagctcgatggcctccagcgagt

SEQ ID NO: 43636 - DNA, 25 bp, mus musculus
gctcgatggcctccagcgagtggtt

SEQ ID NO: 43637 - DNA, 25 bp, mus musculus
gatggcctccagcgagtggttcacc

SEQ ID NO: 43638 - DNA, 25 bp, mus musculus
tggcctccagcgagtggttcaccac

SEQ ID NO: 43639 - DNA, 25 bp, mus musculus
gcctccagcgagtggttcaccacct

SEQ ID NO: 43640 - DNA, 25 bp, mus musculus
ctttgacaatgtccttcaatatgat

SEQ ID NO: 43641 - DNA, 25 bp, mus musculus
caatgtccttcaatatgatgggttt

SEQ ID NO: 43642 - DNA, 25 bp, mus musculus
tccccagtgaagttcacatgcacat

SEQ ID NO: 43643 - DNA, 25 bp, mus musculus
ttcacatgcacatcatcataagtca

SEQ ID NO: 43644 - DNA, 25 bp, mus musculus
tgcacatcatcataagtcactgcat

SEQ ID NO: 43645 - DNA, 25 bp, mus musculus
tcatcataagtcactgcatccttgg

SEQ ID NO: 43646 - DNA, 25 bp, mus musculus
taagtcactgcatccttggacagaa

SEQ ID NO: 43647 - DNA, 25 bp, mus musculus
actgcatccttggacagaagcccca

SEQ ID NO: 43648 - DNA, 25 bp, mus musculus
tccttggacagaagccccaagtggg

SEQ ID NO: 43649 - DNA, 25 bp, mus musculus
ctcactggaacttggaacagactca

SEQ ID NO: 43650 - DNA, 25 bp, mus musculus
tggaacagactcactgccagcaact

SEQ ID NO: 43651 - DNA, 25 bp, mus musculus
agactcactgccagcaactcagggt

SEQ ID NO: 43652 - DNA, 25 bp, mus musculus
aggttccagtaggtctccagcatca

SEQ ID NO: 43653 - DNA, 25 bp, mus musculus
tggtgccaccttcctgagatgaggg

SEQ ID NO: 43654 - DNA, 25 bp, mus musculus
cagtaggtctccagcatcacatctt

SEQ ID NO: 43655 - DNA, 25 bp, mus musculus
gtctccagcatcacatctttgtaga

SEQ ID NO: 43656 - DNA, 25 bp, mus musculus
agcatcacatctttgtagagactct

SEQ ID NO: 43657 - DNA, 25 bp, mus musculus
ttgtagagactcttctgggaaggat

SEQ ID NO: 43658 - DNA, 25 bp, mus musculus
agactcttctgggaaggatccagca

SEQ ID NO: 43659 - DNA, 25 bp, mus musculus
gaaggatccagcaacttccactctt

SEQ ID NO: 43660 - DNA, 25 bp, mus musculus
cactcttccccagtgaagttcacat

SEQ ID NO: 43661 - DNA, 25 bp, mus musculus
ggtatcatcacttttcctgcggtga

SEQ ID NO: 43662 - DNA, 25 bp, mus musculus
atcacttttcctgcggtgacttctc

SEQ ID NO: 43663 - DNA, 25 bp, mus musculus
agcattcctgcctttgtatttcagg

SEQ ID NO: 43664 - DNA, 25 bp, mus musculus
gatacattatatcggccatgttccc

SEQ ID NO: 43665 - DNA, 25 bp, mus musculus
ttttcctaacacttaagatcatata

SEQ ID NO: 43666 - DNA, 25 bp, mus musculus
cactagacctttccattgtatcaga

SEQ ID NO: 43667 - DNA, 25 bp, mus musculus
tagacctttccattgtatcagagta

SEQ ID NO: 43668 - DNA, 25 bp, mus musculus
acctttccattgtatcagagtatcc

SEQ ID NO: 43669 - DNA, 25 bp, mus musculus
agtatccaattacatttacaattat

SEQ ID NO: 43670 - DNA, 25 bp, mus musculus
atccaattacatttacaattatgac

SEQ ID NO: 43671 - DNA, 25 bp, mus musculus
tatttcacaggaatgctcaagtttt

SEQ ID NO: 43672 - DNA, 25 bp, mus musculus
tattaaacctgatgttctctttcta

SEQ ID NO: 43673 - DNA, 25 bp, mus musculus
tttcctgcggtgacttctccaaact

SEQ ID NO: 43674 - DNA, 25 bp, mus musculus
cctgcggtgacttctccaaactgaa

SEQ ID NO: 43675 - DNA, 25 bp, mus musculus
gtgacttctccaaactgaaactgct

SEQ ID NO: 43676 - DNA, 25 bp, mus musculus
acttctccaaactgaaactgctaag

SEQ ID NO: 43677 - DNA, 25 bp, mus musculus
ccaaactgaaactgctaaggcagtt

SEQ ID NO: 43678 - DNA, 25 bp, mus musculus
aactgctaaggcagttttggctaag

SEQ ID NO: 43679 - DNA, 25 bp, mus musculus
aatgacagcattcctgcctttgtat

SEQ ID NO: 43680 - DNA, 25 bp, mus musculus
gacagcattcctgcctttgtatttc

SEQ ID NO: 43681 - DNA, 25 bp, mus musculus
ccgccatgaacatcttccggctgac

SEQ ID NO: 43682 - DNA, 25 bp, mus musculus
tgaacatcttccggctgactgggga

SEQ ID NO: 43683 - DNA, 25 bp, mus musculus
agagtcagctcctgttcgcactggt

SEQ ID NO: 43684 - DNA, 25 bp, mus musculus
agctcctgttcgcactggtcttcac

SEQ ID NO: 43685 - DNA, 25 bp, mus musculus
tcctgttcgcactggtcttcacgac

SEQ ID NO: 43686 - DNA, 25 bp, mus musculus
tgttcgcactggtcttcacgactcg

SEQ ID NO: 43687 - DNA, 25 bp, mus musculus
cactggtcttcacgactcgctacct

SEQ ID NO: 43688 - DNA, 25 bp, mus musculus
tggtcttcacgactcgctacctgga

SEQ ID NO: 43689 - DNA, 25 bp, mus musculus
tcttcacgactcgctacctggacct

SEQ ID NO: 43690 - DNA, 25 bp, mus musculus
tcacttccttcatttccttatacaa

SEQ ID NO: 43691 - DNA, 25 bp, mus musculus
tcatttccttatacaacacgtctat

SEQ ID NO: 43692 - DNA, 25 bp, mus musculus
tttccttatacaacacgtctatgaa

SEQ ID NO: 43693 - DNA, 25 bp, mus musculus
acatcttccggctgactggggacct

SEQ ID NO: 43694 - DNA, 25 bp, mus musculus
ccttatacaacacgtctatgaagct

SEQ ID NO: 43695 - DNA, 25 bp, mus musculus
tcttccggctgactggggacctgtc

SEQ ID NO: 43696 - DNA, 25 bp, mus musculus
cggccatcgtcatcctactgctgaa

SEQ ID NO: 43697 - DNA, 25 bp, mus musculus
ccatcgtcatcctactgctgaagat

SEQ ID NO: 43698 - DNA, 25 bp, mus musculus
tcatcctactgctgaagatctggaa

SEQ ID NO: 43699 - DNA, 25 bp, mus musculus
tcctactgctgaagatctggaagac

SEQ ID NO: 43700 - DNA, 25 bp, mus musculus
gctcctgtgctgggatctctgggaa

SEQ ID NO: 43701 - DNA, 25 bp, mus musculus
gtgctgggatctctgggaagagtca

SEQ ID NO: 43702 - DNA, 25 bp, mus musculus
cgtacatagctcctattattggagc

SEQ ID NO: 43703 - DNA, 25 bp, mus musculus
tagctcctattattggagcaatgta

SEQ ID NO: 43704 - DNA, 25 bp, mus musculus
ctctgtgtccagctgagatctctat

SEQ ID NO: 43705 - DNA, 25 bp, mus musculus
gtccagctgagatctctattgtttc

SEQ ID NO: 43706 - DNA, 25 bp, mus musculus
ttgtttcctcttgaatgtccacgaa

SEQ ID NO: 43707 - DNA, 25 bp, mus musculus
cctcttgaatgtccacgaaccactg

SEQ ID NO: 43708 - DNA, 25 bp, mus musculus
accactgtaatagcatcagaccctt

SEQ ID NO: 43709 - DNA, 25 bp, mus musculus
gtaatagcatcagacccttaaatga

SEQ ID NO: 43710 - DNA, 25 bp, mus musculus
taactgcacttcttgatattcaaat

SEQ ID NO: 43711 - DNA, 25 bp, mus musculus
tgtgaaaaacactccactactgtag

SEQ ID NO: 43712 - DNA, 25 bp, mus musculus
atgtgaccaacttcaactacaacag

SEQ ID NO: 43713 - DNA, 25 bp, mus musculus
ccaacttcaactacaacagtgttgt

SEQ ID NO: 43714 - DNA, 25 bp, mus musculus
gagttaaaaactccaacatgaatgg

SEQ ID NO: 43715 - DNA, 25 bp, mus musculus
gatggttctacatgttgctggagga

SEQ ID NO: 43716 - DNA, 25 bp, mus musculus
tctacatgttgctggaggactttta

SEQ ID NO: 43717 - DNA, 25 bp, mus musculus
tcacaccctgccaatgattctcagt

SEQ ID NO: 43718 - DNA, 25 bp, mus musculus
tttttgcctggaggaactgtctaga

SEQ ID NO: 43719 - DNA, 25 bp, mus musculus
attaaccacctcatttctaagctgc

SEQ ID NO: 43720 - DNA, 25 bp, mus musculus
cacctcatttctaagctgccaaaca

SEQ ID NO: 43721 - DNA, 25 bp, mus musculus
atttctaagctgccaaacaggtctt

SEQ ID NO: 43722 - DNA, 25 bp, mus musculus
tacaaagcctcttgtcatcaaaagc

SEQ ID NO: 43723 - DNA, 25 bp, mus musculus
aaagcctcttgtcatcaaaagccgt

SEQ ID NO: 43724 - DNA, 25 bp, mus musculus
tgcatgctgacgcgacattgttggt

SEQ ID NO: 43725 - DNA, 25 bp, mus musculus
atgctgacgcgacattgttggtcag

SEQ ID NO: 43726 - DNA, 25 bp, mus musculus
ctgacgcgacattgttggtcaggaa

SEQ ID NO: 43727 - DNA, 25 bp, mus musculus
ggaatccagttcctggaatagcgca

SEQ ID NO: 43728 - DNA, 25 bp, mus musculus
atccagttcctggaatagcgcaatt

SEQ ID NO: 43729 - DNA, 25 bp, mus musculus
ttcctggaatagcgcaattggaagt

SEQ ID NO: 43730 - DNA, 25 bp, mus musculus
taactttggcttccttgagagactg

SEQ ID NO: 43731 - DNA, 25 bp, mus musculus
ctttggcttccttgagagactgcag

SEQ ID NO: 43732 - DNA, 25 bp, mus musculus
tggcttccttgagagactgcagtta

SEQ ID NO: 43733 - DNA, 25 bp, mus musculus
cttccttgagagactgcagttatgg

SEQ ID NO: 43734 - DNA, 25 bp, mus musculus
gcctcttgtcatcaaaagccgtgac

SEQ ID NO: 43735 - DNA, 25 bp, mus musculus
tcaattgagacttcacttagctgta

SEQ ID NO: 43736 - DNA, 25 bp, mus musculus
tcttgtcatcaaaagccgtgaccac

SEQ ID NO: 43737 - DNA, 25 bp, mus musculus
tgtcatcaaaagccgtgaccacttt

SEQ ID NO: 43738 - DNA, 25 bp, mus musculus
catcaaaagccgtgaccactttgga

SEQ ID NO: 43739 - DNA, 25 bp, mus musculus
ccgtgaccactttggaatgaaccag

SEQ ID NO: 43740 - DNA, 25 bp, mus musculus
ccagttcattgcatgctgacgcgac

SEQ ID NO: 43741 - DNA, 25 bp, mus musculus
gttcattgcatgctgacgcgacatt

SEQ ID NO: 43742 - DNA, 25 bp, mus musculus
cattgcatgctgacgcgacattgtt

SEQ ID NO: 43743 - DNA, 25 bp, mus musculus
gagcccactgataagcatgactgcc

SEQ ID NO: 43744 - DNA, 25 bp, mus musculus
aagcatgactgccgagttctacccc

SEQ ID NO: 43745 - DNA, 25 bp, mus musculus
tgggccatctaaatgcggagcctgc

SEQ ID NO: 43746 - DNA, 25 bp, mus musculus
atctaaatgcggagcctgccattca

SEQ ID NO: 43747 - DNA, 25 bp, mus musculus
atgcggagcctgccattcagagaaa

SEQ ID NO: 43748 - DNA, 25 bp, mus musculus
tagacctactaggaacaaaagctct

SEQ ID NO: 43749 - DNA, 25 bp, mus musculus
gaacaaaagctctaactgtgtgcag

SEQ ID NO: 43750 - DNA, 25 bp, mus musculus
taactgtgtgcagcttcttaagcag

SEQ ID NO: 43751 - DNA, 25 bp, mus musculus
tgtgcagcttcttaagcagaatgag

SEQ ID NO: 43752 - DNA, 25 bp, mus musculus
ccatcttccagctcagtggtcactc

SEQ ID NO: 43753 - DNA, 25 bp, mus musculus
tccagctcagtggtcactcctccag

SEQ ID NO: 43754 - DNA, 25 bp, mus musculus
acattgcaagaatcccagacattaa

SEQ ID NO: 43755 - DNA, 25 bp, mus musculus
acctctcttcatcttcggcgctgtc

SEQ ID NO: 43756 - DNA, 25 bp, mus musculus
tgtcactgccctgctgccagagacc

SEQ ID NO: 43757 - DNA, 25 bp, mus musculus
tgccctgctgccagagaccttgggc

SEQ ID NO: 43758 - DNA, 25 bp, mus musculus
gctgccagagaccttgggccagccg

SEQ ID NO: 43759 - DNA, 25 bp, mus musculus
tgatacagtgcaggacctgaagagc

SEQ ID NO: 43760 - DNA, 25 bp, mus musculus
acagcagctggaacagcagaagcag

SEQ ID NO: 43761 - DNA, 25 bp, mus musculus
accactccaggtctcaacacaagag

SEQ ID NO: 43762 - DNA, 25 bp, mus musculus
ccaggtctcaacacaagagaagaac

SEQ ID NO: 43763 - DNA, 25 bp, mus musculus
aaagttgcaacttcagctcctccat

SEQ ID NO: 43764 - DNA, 25 bp, mus musculus
cctccatcacttcctacagacagag

SEQ ID NO: 43765 - DNA, 25 bp, mus musculus
tttctgacataaactcatgactaat

SEQ ID NO: 43766 - DNA, 25 bp, mus musculus
acataaactcatgactaatctttgt

SEQ ID NO: 43767 - DNA, 25 bp, mus musculus
taaactcatgactaatctttgtgca

SEQ ID NO: 43768 - DNA, 25 bp, mus musculus
actcatgactaatctttgtgcaatc

SEQ ID NO: 43769 - DNA, 25 bp, mus musculus
gactaatctttgtgcaatcatgaac

SEQ ID NO: 43770 - DNA, 25 bp, mus musculus
taatctttgtgcaatcatgaacttt

SEQ ID NO: 43771 - DNA, 25 bp, mus musculus
gtcccagccatttttgtatatgttg

SEQ ID NO: 43772 - DNA, 25 bp, mus musculus
atatctatatacatacaatgttata

SEQ ID NO: 43773 - DNA, 25 bp, mus musculus
tttacggctgtggggcagtttctgt

SEQ ID NO: 43774 - DNA, 25 bp, mus musculus
ttcatattagtctttgcaaatggat

SEQ ID NO: 43775 - DNA, 25 bp, mus musculus
tcacttcctacagacagagcggctc

SEQ ID NO: 43776 - DNA, 25 bp, mus musculus
cctacagacagagcggctcccaggc

SEQ ID NO: 43777 - DNA, 25 bp, mus musculus
gtgccccacaggcagcccattgtac

SEQ ID NO: 43778 - DNA, 25 bp, mus musculus
aggcagcccattgtacacttcagcg

SEQ ID NO: 43779 - DNA, 25 bp, mus musculus
cagcccattgtacacttcagcgacg

SEQ ID NO: 43780 - DNA, 25 bp, mus musculus
attgtacacttcagcgacgtgagca

SEQ ID NO: 43781 - DNA, 25 bp, mus musculus
cacttcagcgacgtgagcagcgatg

SEQ ID NO: 43782 - DNA, 25 bp, mus musculus
aggcttgtcatagcaacctaatggt

SEQ ID NO: 43783 - DNA, 25 bp, mus musculus
cagaggccctggctctccagggaac

SEQ ID NO: 43784 - DNA, 25 bp, mus musculus
ccctggctctccagggaactggaga

SEQ ID NO: 43785 - DNA, 25 bp, mus musculus
gcagtagcccgtggactttgaccga

SEQ ID NO: 43786 - DNA, 25 bp, mus musculus
gcccgtggactttgaccgatacaag

SEQ ID NO: 43787 - DNA, 25 bp, mus musculus
ggactttgaccgatacaagtctggg

SEQ ID NO: 43788 - DNA, 25 bp, mus musculus
atacaagtctgggttgtgtgtcttc

SEQ ID NO: 43789 - DNA, 25 bp, mus musculus
tgtcttcgtggtacagctacgggaa

SEQ ID NO: 43790 - DNA, 25 bp, mus musculus
ccgactcctggagggcccttgcagc

SEQ ID NO: 43791 - DNA, 25 bp, mus musculus
ttgcagcccaccggttgtctctgcc

SEQ ID NO: 43792 - DNA, 25 bp, mus musculus
cgggactaactgccaagccagattc

SEQ ID NO: 43793 - DNA, 25 bp, mus musculus
taactgccaagccagattctcttga

SEQ ID NO: 43794 - DNA, 25 bp, mus musculus
ccaagccagattctcttgaataaag

SEQ ID NO: 43795 - DNA, 25 bp, mus musculus
ctctccagggaactggagaagagaa

SEQ ID NO: 43796 - DNA, 25 bp, mus musculus
ggcctagaacctgccctgattccca

SEQ ID NO: 43797 - DNA, 25 bp, mus musculus
gacccagtctactgtatcctggaga

SEQ ID NO: 43798 - DNA, 25 bp, mus musculus
gtctactgtatcctggagatgggac

SEQ ID NO: 43799 - DNA, 25 bp, mus musculus
tgtatcctggagatgggacaggaca

SEQ ID NO: 43800 - DNA, 25 bp, mus musculus
attcggctctggagagcagagcttg

SEQ ID NO: 43801 - DNA, 25 bp, mus musculus
tttatgcttcaccctttgcaaaggt

SEQ ID NO: 43802 - DNA, 25 bp, mus musculus
tctctggaacacaggcagagtggcc

SEQ ID NO: 43803 - DNA, 25 bp, mus musculus
cgtcgctgaccatcgcggatgcgtt

SEQ ID NO: 43804 - DNA, 25 bp, mus musculus
cccggctgcccagcaggttcatctg

SEQ ID NO: 43805 - DNA, 25 bp, mus musculus
cagcgccagttacaacaaagcctgg

SEQ ID NO: 43806 - DNA, 25 bp, mus musculus
gccagttacaacaaagcctggaagc

SEQ ID NO: 43807 - DNA, 25 bp, mus musculus
gttacaacaaagcctggaagctaga

SEQ ID NO: 43808 - DNA, 25 bp, mus musculus
tacaacaaagcctggaagctagacg

SEQ ID NO: 43809 - DNA, 25 bp, mus musculus
caacaaagcctggaagctagacgcg

SEQ ID NO: 43810 - DNA, 25 bp, mus musculus
gaagctagacgcgcacctatgcaaa

SEQ ID NO: 43811 - DNA, 25 bp, mus musculus
ctagacgcgcacctatgcaaacaca

SEQ ID NO: 43812 - DNA, 25 bp, mus musculus
agacgcgcacctatgcaaacacacg

SEQ ID NO: 43813 - DNA, 25 bp, mus musculus
acgcgcacctatgcaaacacacggg

SEQ ID NO: 43814 - DNA, 25 bp, mus musculus
gcgcacctatgcaaacacacggggg

SEQ ID NO: 43815 - DNA, 25 bp, mus musculus
cggctgcccagcaggttcatctgct

SEQ ID NO: 43816 - DNA, 25 bp, mus musculus
gctgcccagcaggttcatctgctcc

SEQ ID NO: 43817 - DNA, 25 bp, mus musculus
cccagcaggttcatctgctcctttc

SEQ ID NO: 43818 - DNA, 25 bp, mus musculus
cagcaggttcatctgctcctttccc

SEQ ID NO: 43819 - DNA, 25 bp, mus musculus
aggttcatctgctcctttcccgact

SEQ ID NO: 43820 - DNA, 25 bp, mus musculus
ctttcccgactgcagcgccagttac

SEQ ID NO: 43821 - DNA, 25 bp, mus musculus
cccgactgcagcgccagttacaaca

SEQ ID NO: 43822 - DNA, 25 bp, mus musculus
tgcagcgccagttacaacaaagcct

SEQ ID NO: 43823 - DNA, 25 bp, mus musculus
ttcatagcagcagttaagtgacgca

SEQ ID NO: 43824 - DNA, 25 bp, mus musculus
tggatgcctgggatgctgtagtgaa

SEQ ID NO: 43825 - DNA, 25 bp, mus musculus
gctgtctgtcaagttcagcatcttt

SEQ ID NO: 43826 - DNA, 25 bp, mus musculus
tgtcaagttcagcatctttgtttca

SEQ ID NO: 43827 - DNA, 25 bp, mus musculus
caagttcagcatctttgtttcattc

SEQ ID NO: 43828 - DNA, 25 bp, mus musculus
gttcagcatctttgtttcattcctg

SEQ ID NO: 43829 - DNA, 25 bp, mus musculus
attcctgttgatatgtgtgactttc

SEQ ID NO: 43830 - DNA, 25 bp, mus musculus
ctagcaaaagccgtagcctcttcgt

SEQ ID NO: 43831 - DNA, 25 bp, mus musculus
gcaaaagccgtagcctcttcgtgtg

SEQ ID NO: 43832 - DNA, 25 bp, mus musculus
aaagccgtagcctcttcgtgtgttg

SEQ ID NO: 43833 - DNA, 25 bp, mus musculus
gtagcctcttcgtgtgttgtttctg

SEQ ID NO: 43834 - DNA, 25 bp, mus musculus
tatactgcatgtgttcactaaaata

SEQ ID NO: 43835 - DNA, 25 bp, mus musculus
atgagcaggccggtttcacgatgtc

SEQ ID NO: 43836 - DNA, 25 bp, mus musculus
ccggtttcacgatgtctagaagatt

SEQ ID NO: 43837 - DNA, 25 bp, mus musculus
gtttcacgatgtctagaagatttct

SEQ ID NO: 43838 - DNA, 25 bp, mus musculus
ttctttaaactactgatcagttatc

SEQ ID NO: 43839 - DNA, 25 bp, mus musculus
ctactgatcagttatctaggttaac

SEQ ID NO: 43840 - DNA, 25 bp, mus musculus
tctcgagtatttgctgtctgtcaag

SEQ ID NO: 43841 - DNA, 25 bp, mus musculus
gtatttgctgtctgtcaagttcagc

SEQ ID NO: 43842 - DNA, 25 bp, mus musculus
tttgctgtctgtcaagttcagcatc

SEQ ID NO: 43843 - DNA, 25 bp, mus musculus
tgatcaaggccatcctcatcttcaa

SEQ ID NO: 43844 - DNA, 25 bp, mus musculus
tcaaggccatcctcatcttcaacaa

SEQ ID NO: 43845 - DNA, 25 bp, mus musculus
acacgcaacagcaaatcatcaggga

SEQ ID NO: 43846 - DNA, 25 bp, mus musculus
cgcaacagcaaatcatcagggagac

SEQ ID NO: 43847 - DNA, 25 bp, mus musculus
aacagcaaatcatcagggagacttt

SEQ ID NO: 43848 - DNA, 25 bp, mus musculus
atttggtgtctaagcgcgatgagaa

SEQ ID NO: 43849 - DNA, 25 bp, mus musculus
tggtgtctaagcgcgatgagaacgt

SEQ ID NO: 43850 - DNA, 25 bp, mus musculus
gaggctctgacaacaagctcattta

SEQ ID NO: 43851 - DNA, 25 bp, mus musculus
gctctgacaacaagctcatttacag

SEQ ID NO: 43852 - DNA, 25 bp, mus musculus
acaagctcatttacagacattatgc

SEQ ID NO: 43853 - DNA, 25 bp, mus musculus
agctcatttacagacattatgcaac

SEQ ID NO: 43854 - DNA, 25 bp, mus musculus
tcatttacagacattatgcaacact

SEQ ID NO: 43855 - DNA, 25 bp, mus musculus
tcctcatcttcaacaaccacgggaa

SEQ ID NO: 43856 - DNA, 25 bp, mus musculus
tcttcaacaaccacgggaagccgcg

SEQ ID NO: 43857 - DNA, 25 bp, mus musculus
ggctctccaagttctaccagcccta

SEQ ID NO: 43858 - DNA, 25 bp, mus musculus
tctccaagttctaccagccctatag

SEQ ID NO: 43859 - DNA, 25 bp, mus musculus
ccaagttctaccagccctatagtga

SEQ ID NO: 43860 - DNA, 25 bp, mus musculus
agttctaccagccctatagtgaaga

SEQ ID NO: 43861 - DNA, 25 bp, mus musculus
accagccctatagtgaagacacgca

SEQ ID NO: 43862 - DNA, 25 bp, mus musculus
aagacacgcaacagcaaatcatcag

SEQ ID NO: 43863 - DNA, 25 bp, mus musculus
tatactaccacaaaccacgtacaca

SEQ ID NO: 43864 - DNA, 25 bp, mus musculus
gtacacacttagttcaaatgctctc

SEQ ID NO: 43865 - DNA, 25 bp, mus musculus
ttacccaagtgctcttattccggtg

SEQ ID NO: 43866 - DNA, 25 bp, mus musculus
aagtgctcttattccggtgagaaga

SEQ ID NO: 43867 - DNA, 25 bp, mus musculus
tcttattccggtgagaagaacctca

SEQ ID NO: 43868 - DNA, 25 bp, mus musculus
gagaagaacctcacttccatgattt

SEQ ID NO: 43869 - DNA, 25 bp, mus musculus
aacctcacttccatgatttgggaag

SEQ ID NO: 43870 - DNA, 25 bp, mus musculus
acttccatgatttgggaaggaatgg

SEQ ID NO: 43871 - DNA, 25 bp, mus musculus
ggcatcaccggacaccaccagagac

SEQ ID NO: 43872 - DNA, 25 bp, mus musculus
accggacaccaccagagactaggat

SEQ ID NO: 43873 - DNA, 25 bp, mus musculus
ctcctgagccaggattgtccagtgg

SEQ ID NO: 43874 - DNA, 25 bp, mus musculus
agccaggattgtccagtggttgaaa

SEQ ID NO: 43875 - DNA, 25 bp, mus musculus
ttcaaatgctctcacttgggcaagg

SEQ ID NO: 43876 - DNA, 25 bp, mus musculus
tgctctcacttgggcaagggtgctt

SEQ ID NO: 43877 - DNA, 25 bp, mus musculus
tccctgggatctcattctgttgctg

SEQ ID NO: 43878 - DNA, 25 bp, mus musculus
cattctgttgctgcctgcctgcctt

SEQ ID NO: 43879 - DNA, 25 bp, mus musculus
gttgctgcctgcctgccttagccca

SEQ ID NO: 43880 - DNA, 25 bp, mus musculus
gcctgcctgccttagcccagacttg

SEQ ID NO: 43881 - DNA, 25 bp, mus musculus
ctgccttagcccagacttggtgatt

SEQ ID NO: 43882 - DNA, 25 bp, mus musculus
ctactgttacccaagtgctcttatt

SEQ ID NO: 43883 - DNA, 25 bp, mus musculus
aagacctacttctaccagctgtggt

SEQ ID NO: 43884 - DNA, 25 bp, mus musculus
acctacttctaccagctgtggtatg

SEQ ID NO: 43885 - DNA, 25 bp, mus musculus
gtcctctactactcagccaccaaga

SEQ ID NO: 43886 - DNA, 25 bp, mus musculus
ctctactactcagccaccaagaacg

SEQ ID NO: 43887 - DNA, 25 bp, mus musculus
tactactcagccaccaagaacggca

SEQ ID NO: 43888 - DNA, 25 bp, mus musculus
tactcagccaccaagaacggcatcc

SEQ ID NO: 43889 - DNA, 25 bp, mus musculus
gccaccaagaacggcatcctgtacc

SEQ ID NO: 43890 - DNA, 25 bp, mus musculus
accaagaacggcatcctgtaccgag

SEQ ID NO: 43891 - DNA, 25 bp, mus musculus
aacggcatcctgtaccgagttggtg

SEQ ID NO: 43892 - DNA, 25 bp, mus musculus
atcctgtaccgagttggtgatggtg

SEQ ID NO: 43893 - DNA, 25 bp, mus musculus
ctgtaccgagttggtgatggtgtgt

SEQ ID NO: 43894 - DNA, 25 bp, mus musculus
taccgagttggtgatggtgtgtacc

SEQ ID NO: 43895 - DNA, 25 bp, mus musculus
tatgatcaagactacgcgagattcg

SEQ ID NO: 43896 - DNA, 25 bp, mus musculus
caagactacgcgagattcgagtccc

SEQ ID NO: 43897 - DNA, 25 bp, mus musculus
aagttcaaattctgtgtgagctgtg

SEQ ID NO: 43898 - DNA, 25 bp, mus musculus
aaattctgtgtgagctgtgcccgtc

SEQ ID NO: 43899 - DNA, 25 bp, mus musculus
ttctgtgtgagctgtgcccgtctgg

SEQ ID NO: 43900 - DNA, 25 bp, mus musculus
gcccgtctggctgagatgaggcaaa

SEQ ID NO: 43901 - DNA, 25 bp, mus musculus
cccagggtcctggagcagctcgagg

SEQ ID NO: 43902 - DNA, 25 bp, mus musculus
agggtcctggagcagctcgaggacc

SEQ ID NO: 43903 - DNA, 25 bp, mus musculus
atgaccacctgggtcagtccgaagc

SEQ ID NO: 43904 - DNA, 25 bp, mus musculus
ccgcagtcacggacttggatcattt

SEQ ID NO: 43905 - DNA, 25 bp, mus musculus
aactaacacaggaatgtgtgttcag

SEQ ID NO: 43906 - DNA, 25 bp, mus musculus
cttccaacctctataaacatgtgga

SEQ ID NO: 43907 - DNA, 25 bp, mus musculus
aacatgtggacaccggaaggagata

SEQ ID NO: 43908 - DNA, 25 bp, mus musculus
ctagaccagtggaccctgacaaagt

SEQ ID NO: 43909 - DNA, 25 bp, mus musculus
cagtggaccctgacaaagtacctga

SEQ ID NO: 43910 - DNA, 25 bp, mus musculus
atattctaagccaaagctgacaaag

SEQ ID NO: 43911 - DNA, 25 bp, mus musculus
gacagtgtcttcacttgagccctta

SEQ ID NO: 43912 - DNA, 25 bp, mus musculus
gtcttcacttgagcccttaaaacat

SEQ ID NO: 43913 - DNA, 25 bp, mus musculus
taaccactataaatgctttcatgcg

SEQ ID NO: 43914 - DNA, 25 bp, mus musculus
ccactataaatgctttcatgcggtg

SEQ ID NO: 43915 - DNA, 25 bp, mus musculus
tagagatcttccccaacggtactat

SEQ ID NO: 43916 - DNA, 25 bp, mus musculus
ggaaagaccacagccgcttcggcat

SEQ ID NO: 43917 - DNA, 25 bp, mus musculus
acagccgcttcggcattctggaatt

SEQ ID NO: 43918 - DNA, 25 bp, mus musculus
gcctggtcagcattcgcggtgtgga

SEQ ID NO: 43919 - DNA, 25 bp, mus musculus
ttcgcggtgtggacagtggactcta

SEQ ID NO: 43920 - DNA, 25 bp, mus musculus
acagtggactctacctcggcatgaa

SEQ ID NO: 43921 - DNA, 25 bp, mus musculus
gactctacctcggcatgaacgagaa

SEQ ID NO: 43922 - DNA, 25 bp, mus musculus
tctacctcggcatgaacgagaaggg

SEQ ID NO: 43923 - DNA, 25 bp, mus musculus
ctcctgtggagctttattggagcgg

SEQ ID NO: 43924 - DNA, 25 bp, mus musculus
gttcctaaactcaggctttcagatg

SEQ ID NO: 43925 - DNA, 25 bp, mus musculus
ctgctgtgtatgtgctgatgcagtg

SEQ ID NO: 43926 - DNA, 25 bp, mus musculus
tgctgatgcagtgccctagaagggg

SEQ ID NO: 43927 - DNA, 25 bp, mus musculus
tttgacaaccttgttctaaggtgat

SEQ ID NO: 43928 - DNA, 25 bp, mus musculus
ccaaactcctggaacagttgtgctt

SEQ ID NO: 43929 - DNA, 25 bp, mus musculus
tcctggaacagttgtgctttcccgt

SEQ ID NO: 43930 - DNA, 25 bp, mus musculus
tctgctgcccaggttgtgacttaga

SEQ ID NO: 43931 - DNA, 25 bp, mus musculus
acttagaactccgtcctgagtagat

SEQ ID NO: 43932 - DNA, 25 bp, mus musculus
cccggagcatcacagctacagacgg

SEQ ID NO: 43933 - DNA, 25 bp, mus musculus
cagctacagacggcctggggcacag

SEQ ID NO: 43934 - DNA, 25 bp, mus musculus
cagacggcctggggcacagtccgta

SEQ ID NO: 43935 - DNA, 25 bp, mus musculus
cagccatttttctgtagcaggacct

SEQ ID NO: 43936 - DNA, 25 bp, mus musculus
tcctcctaacggaaggcacaattca

SEQ ID NO: 43937 - DNA, 25 bp, mus musculus
caattcagtgcgttcagaaccagga

SEQ ID NO: 43938 - DNA, 25 bp, mus musculus
ttcagaaccaggacaccaacatcag

SEQ ID NO: 43939 - DNA, 25 bp, mus musculus
acaccaacatcagtgcaggctgtgt

SEQ ID NO: 43940 - DNA, 25 bp, mus musculus
acatcagtgcaggctgtgtgacaag

SEQ ID NO: 43941 - DNA, 25 bp, mus musculus
acattaactcaggcatttcttcctc

SEQ ID NO: 43942 - DNA, 25 bp, mus musculus
cttggctggttctctgtcctgctgt

SEQ ID NO: 43943 - DNA, 25 bp, mus musculus
ccttcagcgccacagttaatgcgac

SEQ ID NO: 43944 - DNA, 25 bp, mus musculus
tcagcgccacagttaatgcgaccac

SEQ ID NO: 43945 - DNA, 25 bp, mus musculus
tgttgctgcctatcaaagaagacta

SEQ ID NO: 43946 - DNA, 25 bp, mus musculus
aggtcaaggccaccacagatggagg

SEQ ID NO: 43947 - DNA, 25 bp, mus musculus
atggcaccagtagtgagcagatcag

SEQ ID NO: 43948 - DNA, 25 bp, mus musculus
gatccacgtcagccatttctaacat

SEQ ID NO: 43949 - DNA, 25 bp, mus musculus
ccacgtcagccatttctaacatcca

SEQ ID NO: 43950 - DNA, 25 bp, mus musculus
tttctaacatccaccctttgtcagg

SEQ ID NO: 43951 - DNA, 25 bp, mus musculus
accctttgtcaggttatatgtctgt

SEQ ID NO: 43952 - DNA, 25 bp, mus musculus
tcctactgttctttattgtaaatgc

SEQ ID NO: 43953 - DNA, 25 bp, mus musculus
ttattgtaaatgctttgtggtgata

SEQ ID NO: 43954 - DNA, 25 bp, mus musculus
atgctttgtggtgatagggcttttt

SEQ ID NO: 43955 - DNA, 25 bp, mus musculus
ctcccagtcagccaccaggaaatgt

SEQ ID NO: 43956 - DNA, 25 bp, mus musculus
ccagtcagccaccaggaaatgttgt

SEQ ID NO: 43957 - DNA, 25 bp, mus musculus
atgctacagacactaaagtgctact

SEQ ID NO: 43958 - DNA, 25 bp, mus musculus
atgtgcacgtgctgaacacaaataa

SEQ ID NO: 43959 - DNA, 25 bp, mus musculus
aaacttcagctgaactgttgctgcc

SEQ ID NO: 43960 - DNA, 25 bp, mus musculus
cttcagctgaactgttgctgcctat

SEQ ID NO: 43961 - DNA, 25 bp, mus musculus
cagctgaactgttgctgcctatcaa

SEQ ID NO: 43962 - DNA, 25 bp, mus musculus
aactgttgctgcctatcaaagaaga

SEQ ID NO: 43963 - DNA, 25 bp, mus musculus
tccctggctccaaaagtgagaggtc

SEQ ID NO: 43964 - DNA, 25 bp, mus musculus
cctggctccaaaagtgagaggtcag

SEQ ID NO: 43965 - DNA, 25 bp, mus musculus
tcctattgccaccctgccgtgctaa

SEQ ID NO: 43966 - DNA, 25 bp, mus musculus
aatcttcctttcagctataaggtat

SEQ ID NO: 43967 - DNA, 25 bp, mus musculus
ttcctttcagctataaggtatagtg

SEQ ID NO: 43968 - DNA, 25 bp, mus musculus
ggtagtatctctcctattatcccag

SEQ ID NO: 43969 - DNA, 25 bp, mus musculus
tagtatctctcctattatcccagca

SEQ ID NO: 43970 - DNA, 25 bp, mus musculus
atctctcctattatcccagcactca

SEQ ID NO: 43971 - DNA, 25 bp, mus musculus
ctctcctattatcccagcactcaaa

SEQ ID NO: 43972 - DNA, 25 bp, mus musculus
ctcctattatcccagcactcaaaaa

SEQ ID NO: 43973 - DNA, 25 bp, mus musculus
gtccagactggtctggaatatgtag

SEQ ID NO: 43974 - DNA, 25 bp, mus musculus
atatgcagcaggacacatgtatact

SEQ ID NO: 43975 - DNA, 25 bp, mus musculus
atgcagttcaagcttgatgttacag

SEQ ID NO: 43976 - DNA, 25 bp, mus musculus
ttcaagcttgatgttacaggtacag

SEQ ID NO: 43977 - DNA, 25 bp, mus musculus
tgttaatgttgtgcccacctttggg

SEQ ID NO: 43978 - DNA, 25 bp, mus musculus
tgttgtgcccacctttgggaagaag

SEQ ID NO: 43979 - DNA, 25 bp, mus musculus
aatgccaattcctaagtcctattgc

SEQ ID NO: 43980 - DNA, 25 bp, mus musculus
tgccaattcctaagtcctattgcca

SEQ ID NO: 43981 - DNA, 25 bp, mus musculus
taagtcctattgccaccctgccgtg

SEQ ID NO: 43982 - DNA, 25 bp, mus musculus
agtcctattgccaccctgccgtgct

SEQ ID NO: 43983 - DNA, 25 bp, mus musculus
acagcagcaccatacgctacagctt

SEQ ID NO: 43984 - DNA, 25 bp, mus musculus
gcaccatacgctacagcttcatctg

SEQ ID NO: 43985 - DNA, 25 bp, mus musculus
attcgagtcgagccaccaacaagaa

SEQ ID NO: 43986 - DNA, 25 bp, mus musculus
gtcgagccaccaacaagaacaattt

SEQ ID NO: 43987 - DNA, 25 bp, mus musculus
ccaccaacaagaacaatttcatcaa

SEQ ID NO: 43988 - DNA, 25 bp, mus musculus
acaatttcatcaatatcagacttct

SEQ ID NO: 43989 - DNA, 25 bp, mus musculus
tcatcaatatcagacttcttcaaat

SEQ ID NO: 43990 - DNA, 25 bp, mus musculus
atatcagacttcttcaaatcagaat

SEQ ID NO: 43991 - DNA, 25 bp, mus musculus
ttcaaatcagaatcttccaacactt

SEQ ID NO: 43992 - DNA, 25 bp, mus musculus
tcttccaacactttctggacgggct

SEQ ID NO: 43993 - DNA, 25 bp, mus musculus
aacactttctggacgggcttcatag

SEQ ID NO: 43994 - DNA, 25 bp, mus musculus
ttctggacgggcttcatagtagacc

SEQ ID NO: 43995 - DNA, 25 bp, mus musculus
tacgctacagcttcatctgggttta

SEQ ID NO: 43996 - DNA, 25 bp, mus musculus
tgcaatgtcctgaattcagagtcta

SEQ ID NO: 43997 - DNA, 25 bp, mus musculus
acagcttcatctgggtttatgccac

SEQ ID NO: 43998 - DNA, 25 bp, mus musculus
tcatctgggtttatgccacgggatg

SEQ ID NO: 43999 - DNA, 25 bp, mus musculus
atgccacgggatggttccttgccat

SEQ ID NO: 44000 - DNA, 25 bp, mus musculus
ggttccttgccattgaagaactctt

SEQ ID NO: 44001 - DNA, 25 bp, mus musculus
ttgaagaactctttaaccagttgct

SEQ ID NO: 44002 - DNA, 25 bp, mus musculus
aactctttaaccagttgctgaatct

SEQ ID NO: 44003 - DNA, 25 bp, mus musculus
ttaaccagttgctgaatctttggaa

SEQ ID NO: 44004 - DNA, 25 bp, mus musculus
aacacactggaactcttgaggtttg

SEQ ID NO: 44005 - DNA, 25 bp, mus musculus
acacactggaactcttgaggtttgg

SEQ ID NO: 44006 - DNA, 25 bp, mus musculus
atgtgtagttcaccctgtagagata

SEQ ID NO: 44007 - DNA, 25 bp, mus musculus
tgtagttcaccctgtagagatagat

SEQ ID NO: 44008 - DNA, 25 bp, mus musculus
gtagttcaccctgtagagatagatg

SEQ ID NO: 44009 - DNA, 25 bp, mus musculus
atagatgctcttattcttagtgtgt

SEQ ID NO: 44010 - DNA, 25 bp, mus musculus
agatgctcttattcttagtgtgtga

SEQ ID NO: 44011 - DNA, 25 bp, mus musculus
gatgctcttattcttagtgtgtgat

SEQ ID NO: 44012 - DNA, 25 bp, mus musculus
tgctcttattcttagtgtgtgatca

SEQ ID NO: 44013 - DNA, 25 bp, mus musculus
gctcttattcttagtgtgtgatcaa

SEQ ID NO: 44014 - DNA, 25 bp, mus musculus
tcttattcttagtgtgtgatcaaca

SEQ ID NO: 44015 - DNA, 25 bp, mus musculus
gtgatcaacagttctttggtcaaat

SEQ ID NO: 44016 - DNA, 25 bp, mus musculus
cactggaactcttgaggtttggagt

SEQ ID NO: 44017 - DNA, 25 bp, mus musculus
ggagttttcgctcaggcaaacaagt

SEQ ID NO: 44018 - DNA, 25 bp, mus musculus
gagttttcgctcaggcaaacaagtt

SEQ ID NO: 44019 - DNA, 25 bp, mus musculus
gttttcgctcaggcaaacaagttgc

SEQ ID NO: 44020 - DNA, 25 bp, mus musculus
ttcgctcaggcaaacaagttgcttt

SEQ ID NO: 44021 - DNA, 25 bp, mus musculus
tcgctcaggcaaacaagttgctttt

SEQ ID NO: 44022 - DNA, 25 bp, mus musculus
tctaacctcttacccagaaaatgtg

SEQ ID NO: 44023 - DNA, 25 bp, mus musculus
aaatgtgtagttcaccctgtagaga

SEQ ID NO: 44024 - DNA, 25 bp, mus musculus
atctgcctgcctggcacggactatg

SEQ ID NO: 44025 - DNA, 25 bp, mus musculus
tgcctgcctggcacggactatgtgt

SEQ ID NO: 44026 - DNA, 25 bp, mus musculus
ttccggaccattcaggagaaggaag

SEQ ID NO: 44027 - DNA, 25 bp, mus musculus
gaagtcatcatcctgaacaacaaag

SEQ ID NO: 44028 - DNA, 25 bp, mus musculus
gtcatcatcctgaacaacaaagagt

SEQ ID NO: 44029 - DNA, 25 bp, mus musculus
atcatcctgaacaacaaagagtgtg

SEQ ID NO: 44030 - DNA, 25 bp, mus musculus
atcctgaacaacaaagagtgtgaca

SEQ ID NO: 44031 - DNA, 25 bp, mus musculus
tgtgacaatttctaccacaacttca

SEQ ID NO: 44032 - DNA, 25 bp, mus musculus
gacaatttctaccacaacttcacca

SEQ ID NO: 44033 - DNA, 25 bp, mus musculus
gaggacacccacagggagaagttct

SEQ ID NO: 44034 - DNA, 25 bp, mus musculus
gacacccacagggagaagttctgct

SEQ ID NO: 44035 - DNA, 25 bp, mus musculus
ttctgctatgagctaactggagagc

SEQ ID NO: 44036 - DNA, 25 bp, mus musculus
ttgaaggaccattcccgctgcactg

SEQ ID NO: 44037 - DNA, 25 bp, mus musculus
aaggaccattcccgctgcactgtga

SEQ ID NO: 44038 - DNA, 25 bp, mus musculus
cattcccgctgcactgtgacgggct

SEQ ID NO: 44039 - DNA, 25 bp, mus musculus
ggactttccaaggctgacggcatgt

SEQ ID NO: 44040 - DNA, 25 bp, mus musculus
atgtggcctcagttccggaccattc

SEQ ID NO: 44041 - DNA, 25 bp, mus musculus
tggcctcagttccggaccattcagg

SEQ ID NO: 44042 - DNA, 25 bp, mus musculus
cctcagttccggaccattcaggaga

SEQ ID NO: 44043 - DNA, 25 bp, mus musculus
cagttccggaccattcaggagaagg

SEQ ID NO: 44044 - DNA, 25 bp, mus musculus
gcataccccagtcttgccaacagga

SEQ ID NO: 44045 - DNA, 25 bp, mus musculus
cccagtcttgccaacaggactccag

SEQ ID NO: 44046 - DNA, 25 bp, mus musculus
gaggactttgctgacctgggcatgt

SEQ ID NO: 44047 - DNA, 25 bp, mus musculus
ggcatgttccctccattttctgagt

SEQ ID NO: 44048 - DNA, 25 bp, mus musculus
ccattttctgagtagcttcaggcaa

SEQ ID NO: 44049 - DNA, 25 bp, mus musculus
ggcttctactgcccagacgctatta

SEQ ID NO: 44050 - DNA, 25 bp, mus musculus
tactgcccagacgctattatcatgc

SEQ ID NO: 44051 - DNA, 25 bp, mus musculus
ccagacgctattatcatgccataga

SEQ ID NO: 44052 - DNA, 25 bp, mus musculus
gctattatcatgccatagatgccca

SEQ ID NO: 44053 - DNA, 25 bp, mus musculus
tggacatggcatcacctggctctaa

SEQ ID NO: 44054 - DNA, 25 bp, mus musculus
tggcatcacctggctctaacccaca

SEQ ID NO: 44055 - DNA, 25 bp, mus musculus
taaatcccattgtgaataatctatt

SEQ ID NO: 44056 - DNA, 25 bp, mus musculus
aacaggactccagggtttgctgaga

SEQ ID NO: 44057 - DNA, 25 bp, mus musculus
tcccagtggcagagccagcatcacg

SEQ ID NO: 44058 - DNA, 25 bp, mus musculus
tcgcatcagcagcctggccagactg

SEQ ID NO: 44059 - DNA, 25 bp, mus musculus
cagcagcctggccagactgaagtgt

SEQ ID NO: 44060 - DNA, 25 bp, mus musculus
ttccaggacatgctacccatgccgg

SEQ ID NO: 44061 - DNA, 25 bp, mus musculus
gacatgctacccatgccgggcgacc

SEQ ID NO: 44062 - DNA, 25 bp, mus musculus
ccgacgcaggggactggcaactata

SEQ ID NO: 44063 - DNA, 25 bp, mus musculus
actggcaactataacatcgaggact

SEQ ID NO: 44064 - DNA, 25 bp, mus musculus
atgggaccatctgctccatacacct

SEQ ID NO: 44065 - DNA, 25 bp, mus musculus
gctccatacaccttgcaggtggtag

SEQ ID NO: 44066 - DNA, 25 bp, mus musculus
gatgtcaccacaaatgctgtgttag

SEQ ID NO: 44067 - DNA, 25 bp, mus musculus
gaagccgaattccagcacactggcg

SEQ ID NO: 44068 - DNA, 25 bp, mus musculus
tggatccgagctcggtaccaagctt

SEQ ID NO: 44069 - DNA, 25 bp, mus musculus
cgagctcggtaccaagcttgatgca

SEQ ID NO: 44070 - DNA, 25 bp, mus musculus
cggtaccaagcttgatgcatagctt

SEQ ID NO: 44071 - DNA, 25 bp, mus musculus
ttctatagtgtcacctaaatagctt

SEQ ID NO: 44072 - DNA, 25 bp, mus musculus
atagcttggcgtaatcatggtcata

SEQ ID NO: 44073 - DNA, 25 bp, mus musculus
attgttatccgctcacaattccaca

SEQ ID NO: 44074 - DNA, 25 bp, mus musculus
tcacaattccacacaacatacgagc

SEQ ID NO: 44075 - DNA, 25 bp, mus musculus
aagcctgggtgcctaatgagtgagc

SEQ ID NO: 44076 - DNA, 25 bp, mus musculus
tacaccttgcaggtggtagacatgg

SEQ ID NO: 44077 - DNA, 25 bp, mus musculus
tggcaccaaacagccagagctacct

SEQ ID NO: 44078 - DNA, 25 bp, mus musculus
caaacagccagagctaccttatccc

SEQ ID NO: 44079 - DNA, 25 bp, mus musculus
tcccttgacatgttactggggactg

SEQ ID NO: 44080 - DNA, 25 bp, mus musculus
gacatgttactggggactggtcagt

SEQ ID NO: 44081 - DNA, 25 bp, mus musculus
tccccttcttctcagatcaaattat

SEQ ID NO: 44082 - DNA, 25 bp, mus musculus
tcttctcagatcaaattatctaagg

SEQ ID NO: 44083 - DNA, 25 bp, mus musculus
ttaaaagatgtcaccacaaatgctg

SEQ ID NO: 44084 - DNA, 25 bp, mus musculus
agaattccatacgacataatctgtc

SEQ ID NO: 44085 - DNA, 25 bp, mus musculus
ccatacgacataatctgtcattgaa

SEQ ID NO: 44086 - DNA, 25 bp, mus musculus
ataacactgatcaggatggtagtga

SEQ ID NO: 44087 - DNA, 25 bp, mus musculus
acactgatcaggatggtagtgatag

SEQ ID NO: 44088 - DNA, 25 bp, mus musculus
gtagtgatagcccacgcagtagcct

SEQ ID NO: 44089 - DNA, 25 bp, mus musculus
gtgatagcccacgcagtagccttaa

SEQ ID NO: 44090 - DNA, 25 bp, mus musculus
atagcccacgcagtagccttaacaa

SEQ ID NO: 44091 - DNA, 25 bp, mus musculus
gccttaacaacagtctctcagacca

SEQ ID NO: 44092 - DNA, 25 bp, mus musculus
acaacagtctctcagaccagagttt

SEQ ID NO: 44093 - DNA, 25 bp, mus musculus
acagtctctcagaccagagtttggc

SEQ ID NO: 44094 - DNA, 25 bp, mus musculus
gtctctcagaccagagtttggcatc

SEQ ID NO: 44095 - DNA, 25 bp, mus musculus
tctcagaccagagtttggcatctgt

SEQ ID NO: 44096 - DNA, 25 bp, mus musculus
tacgacataatctgtcattgaacaa

SEQ ID NO: 44097 - DNA, 25 bp, mus musculus
tgcatagttatacaccggtgacaag

SEQ ID NO: 44098 - DNA, 25 bp, mus musculus
ttaaagtgcctcgatctaaggatga

SEQ ID NO: 44099 - DNA, 25 bp, mus musculus
aagtgcctcgatctaaggatgaccc

SEQ ID NO: 44100 - DNA, 25 bp, mus musculus
gggcaatagacaccaatccgaagga

SEQ ID NO: 44101 - DNA, 25 bp, mus musculus
caatagacaccaatccgaaggaaga

SEQ ID NO: 44102 - DNA, 25 bp, mus musculus
acaccaatccgaaggaagatgcgct

SEQ ID NO: 44103 - DNA, 25 bp, mus musculus
atgcgctgcctactcggccaaagaa

SEQ ID NO: 44104 - DNA, 25 bp, mus musculus
cgctgcctactcggccaaagaagag

SEQ ID NO: 44105 - DNA, 25 bp, mus musculus
atacaatgattttcacgttgttggt

SEQ ID NO: 44106 - DNA, 25 bp, mus musculus
tggtatatctcctctaggttttgct

SEQ ID NO: 44107 - DNA, 25 bp, mus musculus
tagacatttctattgcttctaaata

SEQ ID NO: 44108 - DNA, 25 bp, mus musculus
tctttccttatgtactgtacagtta

SEQ ID NO: 44109 - DNA, 25 bp, mus musculus
ttccttatgtactgtacagttaatc

SEQ ID NO: 44110 - DNA, 25 bp, mus musculus
gttaatcttatttgccatcccttga

SEQ ID NO: 44111 - DNA, 25 bp, mus musculus
aatcttatttgccatcccttgaaca

SEQ ID NO: 44112 - DNA, 25 bp, mus musculus
cttatttgccatcccttgaacacaa

SEQ ID NO: 44113 - DNA, 25 bp, mus musculus
atttgccatcccttgaacacaaatg

SEQ ID NO: 44114 - DNA, 25 bp, mus musculus
tgccatcccttgaacacaaatgtgt

SEQ ID NO: 44115 - DNA, 25 bp, mus musculus
catcccttgaacacaaatgtgtatt

SEQ ID NO: 44116 - DNA, 25 bp, mus musculus
cccttgaacacaaatgtgtatttag

SEQ ID NO: 44117 - DNA, 25 bp, mus musculus
tatatctcctctaggttttgcttga

SEQ ID NO: 44118 - DNA, 25 bp, mus musculus
cattcttttctaaagaccgctgtct

SEQ ID NO: 44119 - DNA, 25 bp, mus musculus
tcttttctaaagaccgctgtcttgc

SEQ ID NO: 44120 - DNA, 25 bp, mus musculus
tttctaaagaccgctgtcttgctat

SEQ ID NO: 44121 - DNA, 25 bp, mus musculus
aagaccgctgtcttgctatagctac

SEQ ID NO: 44122 - DNA, 25 bp, mus musculus
accgctgtcttgctatagctactaa

SEQ ID NO: 44123 - DNA, 25 bp, mus musculus
ctatagctactaacggggcattgtg

SEQ ID NO: 44124 - DNA, 25 bp, mus musculus
gttacaaacctgtgggcctgttgca

SEQ ID NO: 44125 - DNA, 25 bp, mus musculus
acgaattccaggtgtccctgagcag

SEQ ID NO: 44126 - DNA, 25 bp, mus musculus
gaattccaggtgtccctgagcagct

SEQ ID NO: 44127 - DNA, 25 bp, mus musculus
agatcacccagaagatcggcgtgca

SEQ ID NO: 44128 - DNA, 25 bp, mus musculus
atcacccagaagatcggcgtgcacg

SEQ ID NO: 44129 - DNA, 25 bp, mus musculus
cacccagaagatcggcgtgcacgcg

SEQ ID NO: 44130 - DNA, 25 bp, mus musculus
agatcggcgtgcacgcgttccagca

SEQ ID NO: 44131 - DNA, 25 bp, mus musculus
gcgtgcacgcgttccagcagcgtct

SEQ ID NO: 44132 - DNA, 25 bp, mus musculus
gcacgcgttccagcagcgtctggct

SEQ ID NO: 44133 - DNA, 25 bp, mus musculus
acgcgttccagcagcgtctggctgt

SEQ ID NO: 44134 - DNA, 25 bp, mus musculus
gcgttccagcagcgtctggctgtcc

SEQ ID NO: 44135 - DNA, 25 bp, mus musculus
aaatgcgacgaacctctgaacatcc

SEQ ID NO: 44136 - DNA, 25 bp, mus musculus
atgcgacgaacctctgaacatcctg

SEQ ID NO: 44137 - DNA, 25 bp, mus musculus
caggtgtccctgagcagctccatgt

SEQ ID NO: 44138 - DNA, 25 bp, mus musculus
gcgacgaacctctgaacatcctggt

SEQ ID NO: 44139 - DNA, 25 bp, mus musculus
cctgagcagctccatgtcggtgtca

SEQ ID NO: 44140 - DNA, 25 bp, mus musculus
tgagcagctccatgtcggtgtcaga

SEQ ID NO: 44141 - DNA, 25 bp, mus musculus
agcagctccatgtcggtgtcagagc

SEQ ID NO: 44142 - DNA, 25 bp, mus musculus
catgtcggtgtcagagctgaaggcg

SEQ ID NO: 44143 - DNA, 25 bp, mus musculus
aggcgcagatcacccagaagatcgg

SEQ ID NO: 44144 - DNA, 25 bp, mus musculus
gcgcagatcacccagaagatcggcg

SEQ ID NO: 44145 - DNA, 25 bp, mus musculus
gcagatcacccagaagatcggcgtg

SEQ ID NO: 44146 - DNA, 25 bp, mus musculus
acgcatttttccataactgagacct

SEQ ID NO: 44147 - DNA, 25 bp, mus musculus
cgccggttctgcagctctccagagc

SEQ ID NO: 44148 - DNA, 25 bp, mus musculus
ctcccttctctcgtggagagcatct

SEQ ID NO: 44149 - DNA, 25 bp, mus musculus
caagagacttcctccacattcccaa

SEQ ID NO: 44150 - DNA, 25 bp, mus musculus
acctccaacaggccagaggagttgg

SEQ ID NO: 44151 - DNA, 25 bp, mus musculus
cctccaacaggccagaggagttggt

SEQ ID NO: 44152 - DNA, 25 bp, mus musculus
tccaacaggccagaggagttggtaa

SEQ ID NO: 44153 - DNA, 25 bp, mus musculus
ccaacaggccagaggagttggtaag

SEQ ID NO: 44154 - DNA, 25 bp, mus musculus
ggtgctgagtctcgggatagtgtct

SEQ ID NO: 44155 - DNA, 25 bp, mus musculus
gtgctgagtctcgggatagtgtctc

SEQ ID NO: 44156 - DNA, 25 bp, mus musculus
caaacaaacagacacagagcttcca

SEQ ID NO: 44157 - DNA, 25 bp, mus musculus
agttggtatctcttccttctcgaag

SEQ ID NO: 44158 - DNA, 25 bp, mus musculus
agctctccagagcggcgtgctctct

SEQ ID NO: 44159 - DNA, 25 bp, mus musculus
gagagccaagccaatttgtaactag

SEQ ID NO: 44160 - DNA, 25 bp, mus musculus
gctctccagagcggcgtgctctctt

SEQ ID NO: 44161 - DNA, 25 bp, mus musculus
tctccagagcggcgtgctctcttac

SEQ ID NO: 44162 - DNA, 25 bp, mus musculus
ctccagagcggcgtgctctcttacc

SEQ ID NO: 44163 - DNA, 25 bp, mus musculus
cagagcggcgtgctctcttacctgt

SEQ ID NO: 44164 - DNA, 25 bp, mus musculus
gcttgcctctggggactcgccttct

SEQ ID NO: 44165 - DNA, 25 bp, mus musculus
ttgcctctggggactcgccttctct

SEQ ID NO: 44166 - DNA, 25 bp, mus musculus
tgcctctggggactcgccttctctc

SEQ ID NO: 44167 - DNA, 25 bp, mus musculus
aaatccagctccatacaacgctccg

SEQ ID NO: 44168 - DNA, 25 bp, mus musculus
ctgccgacagctccgtcactatgga

SEQ ID NO: 44169 - DNA, 25 bp, mus musculus
tccaagatcaacgcgagcaagaatc

SEQ ID NO: 44170 - DNA, 25 bp, mus musculus
ccaagatcaacgcgagcaagaatca

SEQ ID NO: 44171 - DNA, 25 bp, mus musculus
acagagtacttgtctcgatttgggg

SEQ ID NO: 44172 - DNA, 25 bp, mus musculus
cagagtacttgtctcgatttgggga

SEQ ID NO: 44173 - DNA, 25 bp, mus musculus
gagtacttgtctcgatttggggaag

SEQ ID NO: 44174 - DNA, 25 bp, mus musculus
tgtctcgatttggggaagttgtaga

SEQ ID NO: 44175 - DNA, 25 bp, mus musculus
ttaaaacagatccagtcactgggag

SEQ ID NO: 44176 - DNA, 25 bp, mus musculus
acagatccagtcactgggagatcaa

SEQ ID NO: 44177 - DNA, 25 bp, mus musculus
cagatccagtcactgggagatcaag

SEQ ID NO: 44178 - DNA, 25 bp, mus musculus
gatccagtcactgggagatcaagag

SEQ ID NO: 44179 - DNA, 25 bp, mus musculus
ccgacagctccgtcactatggagga

SEQ ID NO: 44180 - DNA, 25 bp, mus musculus
atccagtcactgggagatcaagagg

SEQ ID NO: 44181 - DNA, 25 bp, mus musculus
gacagctccgtcactatggaggata

SEQ ID NO: 44182 - DNA, 25 bp, mus musculus
acagctccgtcactatggaggatat

SEQ ID NO: 44183 - DNA, 25 bp, mus musculus
agctccgtcactatggaggatatga

SEQ ID NO: 44184 - DNA, 25 bp, mus musculus
gctccgtcactatggaggatatgaa

SEQ ID NO: 44185 - DNA, 25 bp, mus musculus
aattcgcagagggatccaagatcaa

SEQ ID NO: 44186 - DNA, 25 bp, mus musculus
ggatccaagatcaacgcgagcaaga

SEQ ID NO: 44187 - DNA, 25 bp, mus musculus
gatccaagatcaacgcgagcaagaa

SEQ ID NO: 44188 - DNA, 25 bp, mus musculus
ctactgaccttcctgggctcccaag

SEQ ID NO: 44189 - DNA, 25 bp, mus musculus
tcccaagcctgctactctttaggga

SEQ ID NO: 44190 - DNA, 25 bp, mus musculus
agaatactgcatgccggtcaccagc

SEQ ID NO: 44191 - DNA, 25 bp, mus musculus
gccttatcctgggtctgtggtcttc

SEQ ID NO: 44192 - DNA, 25 bp, mus musculus
tcctgggtctgtggtcttcagtatg

SEQ ID NO: 44193 - DNA, 25 bp, mus musculus
ggtcacccatcaaatgcttcatggt

SEQ ID NO: 44194 - DNA, 25 bp, mus musculus
ccatcaaatgcttcatggtcactat

SEQ ID NO: 44195 - DNA, 25 bp, mus musculus
aatgcttcatggtcactatagtttg

SEQ ID NO: 44196 - DNA, 25 bp, mus musculus
tgttaagacctgtctgctttggttt

SEQ ID NO: 44197 - DNA, 25 bp, mus musculus
gacctgtctgctttggttttcatag

SEQ ID NO: 44198 - DNA, 25 bp, mus musculus
ttcatagtatcttaacctggagtaa

SEQ ID NO: 44199 - DNA, 25 bp, mus musculus
gtatcttaacctggagtaaattctg

SEQ ID NO: 44200 - DNA, 25 bp, mus musculus
gcctgctactctttagggagtcacc

SEQ ID NO: 44201 - DNA, 25 bp, mus musculus
cctcagccatggctgtcttgggccc

SEQ ID NO: 44202 - DNA, 25 bp, mus musculus
ccatggctgtcttgggccctgaaga

SEQ ID NO: 44203 - DNA, 25 bp, mus musculus
actaatgtcatctcagtctgtaagc

SEQ ID NO: 44204 - DNA, 25 bp, mus musculus
tcagtctgtaagcctctggaaagct

SEQ ID NO: 44205 - DNA, 25 bp, mus musculus
cctctggaaagcttcggcaaaaatg

SEQ ID NO: 44206 - DNA, 25 bp, mus musculus
ctcccagtcagctttcctaacattt

SEQ ID NO: 44207 - DNA, 25 bp, mus musculus
gtcagctttcctaacatttttgaga

SEQ ID NO: 44208 - DNA, 25 bp, mus musculus
aaagcccacatttgaggtggctcat

SEQ ID NO: 44209 - DNA, 25 bp, mus musculus
aagcccacatttgaggtggctcatc

SEQ ID NO: 44210 - DNA, 25 bp, mus musculus
gcaagacatacatttccactatggt

SEQ ID NO: 44211 - DNA, 25 bp, mus musculus
caagacatacatttccactatggtc

SEQ ID NO: 44212 - DNA, 25 bp, mus musculus
agacatacatttccactatggtcgg

SEQ ID NO: 44213 - DNA, 25 bp, mus musculus
catacatttccactatggtcggttt

SEQ ID NO: 44214 - DNA, 25 bp, mus musculus
acatttccactatggtcggtttcag

SEQ ID NO: 44215 - DNA, 25 bp, mus musculus
catttccactatggtcggtttcagg

SEQ ID NO: 44216 - DNA, 25 bp, mus musculus
ttccactatggtcggtttcaggaat

SEQ ID NO: 44217 - DNA, 25 bp, mus musculus
aaatctgacgtcaatgcaattatcc

SEQ ID NO: 44218 - DNA, 25 bp, mus musculus
atctgacgtcaatgcaattatccat

SEQ ID NO: 44219 - DNA, 25 bp, mus musculus
cgtcaatgcaattatccattattta

SEQ ID NO: 44220 - DNA, 25 bp, mus musculus
gcccacatttgaggtggctcatcta

SEQ ID NO: 44221 - DNA, 25 bp, mus musculus
atttgaggtggctcatctagacctg

SEQ ID NO: 44222 - DNA, 25 bp, mus musculus
ggtggctcatctagacctggcaaga

SEQ ID NO: 44223 - DNA, 25 bp, mus musculus
gtggctcatctagacctggcaagaa

SEQ ID NO: 44224 - DNA, 25 bp, mus musculus
gctcatctagacctggcaagaatgt

SEQ ID NO: 44225 - DNA, 25 bp, mus musculus
tcatctagacctggcaagaatgtat

SEQ ID NO: 44226 - DNA, 25 bp, mus musculus
catctagacctggcaagaatgtata

SEQ ID NO: 44227 - DNA, 25 bp, mus musculus
tctagacctggcaagaatgtatata

SEQ ID NO: 44228 - DNA, 25 bp, mus musculus
taatactttcaaagttctcacaagg

SEQ ID NO: 44229 - DNA, 25 bp, mus musculus
caaagttctcacaagggataagcgt

SEQ ID NO: 44230 - DNA, 25 bp, mus musculus
tgaagtccctgctgtaaaggatatg

SEQ ID NO: 44231 - DNA, 25 bp, mus musculus
ggctattaaactggccactaatgct

SEQ ID NO: 44232 - DNA, 25 bp, mus musculus
tattaaactggccactaatgctgca

SEQ ID NO: 44233 - DNA, 25 bp, mus musculus
cactaatgctgcagtcactgtacta

SEQ ID NO: 44234 - DNA, 25 bp, mus musculus
taatgctgcagtcactgtactaaga

SEQ ID NO: 44235 - DNA, 25 bp, mus musculus
tgcagtcactgtactaagagtggat

SEQ ID NO: 44236 - DNA, 25 bp, mus musculus
agtcactgtactaagagtggatcag

SEQ ID NO: 44237 - DNA, 25 bp, mus musculus
catcatggcaaaaccagctggtggg

SEQ ID NO: 44238 - DNA, 25 bp, mus musculus
tgtactctgctgggtggtacaataa

SEQ ID NO: 44239 - DNA, 25 bp, mus musculus
actctgctgggtggtacaataaatg

SEQ ID NO: 44240 - DNA, 25 bp, mus musculus
agttctcacaagggataagcgtctt

SEQ ID NO: 44241 - DNA, 25 bp, mus musculus
ggataagcgtcttgtacctggaggt

SEQ ID NO: 44242 - DNA, 25 bp, mus musculus
taaacaaatcacatcatatggagag

SEQ ID NO: 44243 - DNA, 25 bp, mus musculus
aatcacatcatatggagagacgtgt

SEQ ID NO: 44244 - DNA, 25 bp, mus musculus
agagacgtgtcctgggcttgaacag

SEQ ID NO: 44245 - DNA, 25 bp, mus musculus
gtttgaagcgattccacgggcactg

SEQ ID NO: 44246 - DNA, 25 bp, mus musculus
agcgattccacgggcactggcagaa

SEQ ID NO: 44247 - DNA, 25 bp, mus musculus
ttctggcgtgaaggccaatgaagtt

SEQ ID NO: 44248 - DNA, 25 bp, mus musculus
aagtcctggcatttgatctgaccgt

SEQ ID NO: 44249 - DNA, 25 bp, mus musculus
tggcatttgatctgaccgttccaac

SEQ ID NO: 44250 - DNA, 25 bp, mus musculus
cagaaacacttgctgcatttacggg

SEQ ID NO: 44251 - DNA, 25 bp, mus musculus
atgagattgtgccttgcctgagtga

SEQ ID NO: 44252 - DNA, 25 bp, mus musculus
cttgcctgagtgagctgcataaagc

SEQ ID NO: 44253 - DNA, 25 bp, mus musculus
acaaggcttcgaagtacctgcacgt

SEQ ID NO: 44254 - DNA, 25 bp, mus musculus
tcatggagccgcctgtagttcttcc

SEQ ID NO: 44255 - DNA, 25 bp, mus musculus
agccgcctgtagttcttcccctgca

SEQ ID NO: 44256 - DNA, 25 bp, mus musculus
ttggccacatcagcaggcttgctct

SEQ ID NO: 44257 - DNA, 25 bp, mus musculus
gcaggcttgctctgaggtttctgag

SEQ ID NO: 44258 - DNA, 25 bp, mus musculus
ggccaactaacgtcagttgtacata

SEQ ID NO: 44259 - DNA, 25 bp, mus musculus
gtacataacaccttcaacatgagaa

SEQ ID NO: 44260 - DNA, 25 bp, mus musculus
tcctccttcagtacctaaggcgtca

SEQ ID NO: 44261 - DNA, 25 bp, mus musculus
tgagccttctggaagctgacccgtt

SEQ ID NO: 44262 - DNA, 25 bp, mus musculus
ttctggaagctgacccgttcttgaa

SEQ ID NO: 44263 - DNA, 25 bp, mus musculus
aagctgacccgttcttgaagtatct

SEQ ID NO: 44264 - DNA, 25 bp, mus musculus
ttgctgcagcagcttactgcctggc

SEQ ID NO: 44265 - DNA, 25 bp, mus musculus
cttactgcctggcaaactatattgt

SEQ ID NO: 44266 - DNA, 25 bp, mus musculus
gacacttctggccagaaacacttgc

SEQ ID NO: 44267 - DNA, 25 bp, mus musculus
tctggccagaaacacttgctgcatt

SEQ ID NO: 44268 - DNA, 25 bp, mus musculus
accgacagctgaccatcgtagtctc

SEQ ID NO: 44269 - DNA, 25 bp, mus musculus
cgacagctgaccatcgtagtctcgg

SEQ ID NO: 44270 - DNA, 25 bp, mus musculus
tacaccagtgatgatcaaggaatgc

SEQ ID NO: 44271 - DNA, 25 bp, mus musculus
tcaaggaatgcgtcgtggagatcat

SEQ ID NO: 44272 - DNA, 25 bp, mus musculus
ggagatcattcgcaagcaagagtac

SEQ ID NO: 44273 - DNA, 25 bp, mus musculus
agatcattcgcaagcaagagtacat

SEQ ID NO: 44274 - DNA, 25 bp, mus musculus
atcattcgcaagcaagagtacatgc

SEQ ID NO: 44275 - DNA, 25 bp, mus musculus
tacatgcaagacgagcatggcctac

SEQ ID NO: 44276 - DNA, 25 bp, mus musculus
acgagcatggcctacatctgtagat

SEQ ID NO: 44277 - DNA, 25 bp, mus musculus
ggcctacatctgtagatgctttaac

SEQ ID NO: 44278 - DNA, 25 bp, mus musculus
cctacatctgtagatgctttaaccg

SEQ ID NO: 44279 - DNA, 25 bp, mus musculus
gatgctttaaccgggtatagacgct

SEQ ID NO: 44280 - DNA, 25 bp, mus musculus
agctgaccatcgtagtctcggagat

SEQ ID NO: 44281 - DNA, 25 bp, mus musculus
gtatagacgctactgtaggtgtgga

SEQ ID NO: 44282 - DNA, 25 bp, mus musculus
gaccatcgtagtctcggagatgcta

SEQ ID NO: 44283 - DNA, 25 bp, mus musculus
ccatcgtagtctcggagatgctata

SEQ ID NO: 44284 - DNA, 25 bp, mus musculus
atcgtagtctcggagatgctataga

SEQ ID NO: 44285 - DNA, 25 bp, mus musculus
cgtagtctcggagatgctatagatg

SEQ ID NO: 44286 - DNA, 25 bp, mus musculus
ccgtgtccctggagttgaatcagtt

SEQ ID NO: 44287 - DNA, 25 bp, mus musculus
gaatcagttggcgccggaggtacac

SEQ ID NO: 44288 - DNA, 25 bp, mus musculus
atcagttggcgccggaggtacacca

SEQ ID NO: 44289 - DNA, 25 bp, mus musculus
ctggtttgcactggtctgagctctg

SEQ ID NO: 44290 - DNA, 25 bp, mus musculus
ggtctgagctctgtgaatgaagtaa

SEQ ID NO: 44291 - DNA, 25 bp, mus musculus
tagcactataggggcacctttggaa

SEQ ID NO: 44292 - DNA, 25 bp, mus musculus
cttaagcacatcagagtcctaacgc

SEQ ID NO: 44293 - DNA, 25 bp, mus musculus
agagtcctaacgctcccatctccag

SEQ ID NO: 44294 - DNA, 25 bp, mus musculus
tctccaggctaagggagctcccaag

SEQ ID NO: 44295 - DNA, 25 bp, mus musculus
aagtaagtagctccttgcagctctg

SEQ ID NO: 44296 - DNA, 25 bp, mus musculus
gtagctccttgcagctctgaaaatt

SEQ ID NO: 44297 - DNA, 25 bp, mus musculus
atgtaggccaggatgctctaattct

SEQ ID NO: 44298 - DNA, 25 bp, mus musculus
atgctctaattcttgctaccaggac

SEQ ID NO: 44299 - DNA, 25 bp, mus musculus
ttgctaccaggactgcccatgaaaa

SEQ ID NO: 44300 - DNA, 25 bp, mus musculus
gtttgcccatttttctcttgaacag

SEQ ID NO: 44301 - DNA, 25 bp, mus musculus
atataacagctcactgtatcccatc

SEQ ID NO: 44302 - DNA, 25 bp, mus musculus
cagctcactgtatcccatctgtcct

SEQ ID NO: 44303 - DNA, 25 bp, mus musculus
tcccatctgtcctggattgggtcac

SEQ ID NO: 44304 - DNA, 25 bp, mus musculus
ctctgaaaggtgccccattttatag

SEQ ID NO: 44305 - DNA, 25 bp, mus musculus
ctctggctccaaaataatcatttct

SEQ ID NO: 44306 - DNA, 25 bp, mus musculus
ctccaaaataatcatttcttcttct

SEQ ID NO: 44307 - DNA, 25 bp, mus musculus
ttcactatctgatagcactataggg

SEQ ID NO: 44308 - DNA, 25 bp, mus musculus
atctgatagcactataggggcacct

SEQ ID NO: 44309 - DNA, 25 bp, mus musculus
cgcatcagtagccgacgccgaagag

SEQ ID NO: 44310 - DNA, 25 bp, mus musculus
atcagtagccgacgccgaagaggac

SEQ ID NO: 44311 - DNA, 25 bp, mus musculus
gctgctcatcctgcagcaggcggtg

SEQ ID NO: 44312 - DNA, 25 bp, mus musculus
cctgcagcaggcggtgcaggtcatc

SEQ ID NO: 44313 - DNA, 25 bp, mus musculus
gcaggtcatcctgggcctggagcag

SEQ ID NO: 44314 - DNA, 25 bp, mus musculus
cgggcacctgtgagccgtcacagct

SEQ ID NO: 44315 - DNA, 25 bp, mus musculus
gcacctgtgagccgtcacagcttct

SEQ ID NO: 44316 - DNA, 25 bp, mus musculus
gtgagccgtcacagcttcttcgttg

SEQ ID NO: 44317 - DNA, 25 bp, mus musculus
ggaccagggaccaccatatctctgc

SEQ ID NO: 44318 - DNA, 25 bp, mus musculus
gtgcatcaggacggttctggatgag

SEQ ID NO: 44319 - DNA, 25 bp, mus musculus
tgagacaggtctccatcgaagcatg

SEQ ID NO: 44320 - DNA, 25 bp, mus musculus
tctccatcgaagcatgagcagagag

SEQ ID NO: 44321 - DNA, 25 bp, mus musculus
ggacctgaaggtcccacgcacgcgc

SEQ ID NO: 44322 - DNA, 25 bp, mus musculus
cacgcgcaccagcagtacagatgag

SEQ ID NO: 44323 - DNA, 25 bp, mus musculus
cattaacgaggccttccgggagctg

SEQ ID NO: 44324 - DNA, 25 bp, mus musculus
catgtgccagctgcacctcaagtcg

SEQ ID NO: 44325 - DNA, 25 bp, mus musculus
ccagctgcacctcaagtcggataag

SEQ ID NO: 44326 - DNA, 25 bp, mus musculus
gcacctcaagtcggataaggcgcag

SEQ ID NO: 44327 - DNA, 25 bp, mus musculus
ggcgcagaccaagctgctcatcctg

SEQ ID NO: 44328 - DNA, 25 bp, mus musculus
gaccaagctgctcatcctgcagcag

SEQ ID NO: 44329 - DNA, 25 bp, mus musculus
cctgttcggtctcaatcctatcatg

SEQ ID NO: 44330 - DNA, 25 bp, mus musculus
cggtctcaatcctatcatgcaagat

SEQ ID NO: 44331 - DNA, 25 bp, mus musculus
gggctatctcggcagtccaagccac

SEQ ID NO: 44332 - DNA, 25 bp, mus musculus
tctcggcagtccaagccacgtccag

SEQ ID NO: 44333 - DNA, 25 bp, mus musculus
aagccacgtccaggaaaactgctgt

SEQ ID NO: 44334 - DNA, 25 bp, mus musculus
gaccttcactggtccatcagctcca

SEQ ID NO: 44335 - DNA, 25 bp, mus musculus
tccatcagctccaaagtaaaaccga

SEQ ID NO: 44336 - DNA, 25 bp, mus musculus
aaaccgaaaagctaatcttgcatgg

SEQ ID NO: 44337 - DNA, 25 bp, mus musculus
gaattgcctattgatacgtattgac

SEQ ID NO: 44338 - DNA, 25 bp, mus musculus
tattgacagtcttctgccctgtgtc

SEQ ID NO: 44339 - DNA, 25 bp, mus musculus
tctgccctgtgtctcttggaaaaat

SEQ ID NO: 44340 - DNA, 25 bp, mus musculus
gagaccaaatcgtcactatgtaggg

SEQ ID NO: 44341 - DNA, 25 bp, mus musculus
acgggcactaatacaccccatggct

SEQ ID NO: 44342 - DNA, 25 bp, mus musculus
acaccccatggctgtttccacagga

SEQ ID NO: 44343 - DNA, 25 bp, mus musculus
tgtttccacaggacacttttgctgc

SEQ ID NO: 44344 - DNA, 25 bp, mus musculus
acacttttgctgcaatctagagact

SEQ ID NO: 44345 - DNA, 25 bp, mus musculus
tttagctggagtgtgttgagggctc

SEQ ID NO: 44346 - DNA, 25 bp, mus musculus
ctggagtcacagcccaggacctttg

SEQ ID NO: 44347 - DNA, 25 bp, mus musculus
aatttcacagtgatagatggcccag

SEQ ID NO: 44348 - DNA, 25 bp, mus musculus
atagatggcccagggttaggatgct

SEQ ID NO: 44349 - DNA, 25 bp, mus musculus
cctacagaacacacctgagcctctt

SEQ ID NO: 44350 - DNA, 25 bp, mus musculus
gaacacacctgagcctcttggggta

SEQ ID NO: 44351 - DNA, 25 bp, mus musculus
tcccttcctgactgccagtggaagt

SEQ ID NO: 44352 - DNA, 25 bp, mus musculus
attcagtggaccttagtcaagtcca

SEQ ID NO: 44353 - DNA, 25 bp, mus musculus
tctatagagagccctgtccactgcc

SEQ ID NO: 44354 - DNA, 25 bp, mus musculus
cctgtccactgcctgctgcctggag

SEQ ID NO: 44355 - DNA, 25 bp, mus musculus
gcataaatgtctctgccacagctga

SEQ ID NO: 44356 - DNA, 25 bp, mus musculus
atgtctctgccacagctgactgtcc

SEQ ID NO: 44357 - DNA, 25 bp, mus musculus
ctgccacagctgactgtccaagatt

SEQ ID NO: 44358 - DNA, 25 bp, mus musculus
actgtccaagattgtgtgagaggca

SEQ ID NO: 44359 - DNA, 25 bp, mus musculus
agaggcagctagccagggtgtcttc

SEQ ID NO: 44360 - DNA, 25 bp, mus musculus
ttccttctgctacttttgagatgag

SEQ ID NO: 44361 - DNA, 25 bp, mus musculus
ggatacccagcacagcctagctttt

SEQ ID NO: 44362 - DNA, 25 bp, mus musculus
ccagcacagcctagcttttttcagt

SEQ ID NO: 44363 - DNA, 25 bp, mus musculus
ctccctctggggactttgggatcag

SEQ ID NO: 44364 - DNA, 25 bp, mus musculus
ggagccactgtagcctcaggaacct

SEQ ID NO: 44365 - DNA, 25 bp, mus musculus
actgtagcctcaggaacctgtccag

SEQ ID NO: 44366 - DNA, 25 bp, mus musculus
aatgctgtccagttatttacagcag

SEQ ID NO: 44367 - DNA, 25 bp, mus musculus
gtccagttatttacagcaggtggct

SEQ ID NO: 44368 - DNA, 25 bp, mus musculus
ttatttacagcaggtggctcccttc

SEQ ID NO: 44369 - DNA, 25 bp, mus musculus
gtcaactatacttggtccaccaggt

SEQ ID NO: 44370 - DNA, 25 bp, mus musculus
tatacttggtccaccaggttctgta

SEQ ID NO: 44371 - DNA, 25 bp, mus musculus
agtcatctgcctggatattctgaaa

SEQ ID NO: 44372 - DNA, 25 bp, mus musculus
ctggagtcctgctttgactatttca

SEQ ID NO: 44373 - DNA, 25 bp, mus musculus
ctctatttgttcccttttgacagat

SEQ ID NO: 44374 - DNA, 25 bp, mus musculus
ttgttcccttttgacagattgcaac

SEQ ID NO: 44375 - DNA, 25 bp, mus musculus
ttgcaaccctgcggatcctctggtc

SEQ ID NO: 44376 - DNA, 25 bp, mus musculus
catagccactcagtatttgaccaac

SEQ ID NO: 44377 - DNA, 25 bp, mus musculus
aacataattcacatcatttgtatgc

SEQ ID NO: 44378 - DNA, 25 bp, mus musculus
attcacatcatttgtatgcagtgtg

SEQ ID NO: 44379 - DNA, 25 bp, mus musculus
ttcccactgtgctgcggatctttat

SEQ ID NO: 44380 - DNA, 25 bp, mus musculus
ctgtgctgcggatctttatagcctt

SEQ ID NO: 44381 - DNA, 25 bp, mus musculus
tggtccaccaggttctgtatatgaa

SEQ ID NO: 44382 - DNA, 25 bp, mus musculus
agcctttacaatacggacttctgtg

SEQ ID NO: 44383 - DNA, 25 bp, mus musculus
ggatatcacattttcttcagattat

SEQ ID NO: 44384 - DNA, 25 bp, mus musculus
cacattttcttcagattatccattt

SEQ ID NO: 44385 - DNA, 25 bp, mus musculus
ttcttcagattatccatttaagcca

SEQ ID NO: 44386 - DNA, 25 bp, mus musculus
agattatccatttaagccaccaaag

SEQ ID NO: 44387 - DNA, 25 bp, mus musculus
tttccgtaccagaatctatcactgc

SEQ ID NO: 44388 - DNA, 25 bp, mus musculus
aatctatcactgcaacatcaacagt

SEQ ID NO: 44389 - DNA, 25 bp, mus musculus
caacatcaacagtcagggagtcatc

SEQ ID NO: 44390 - DNA, 25 bp, mus musculus
gtgcttcacagccaacggtgcagat

SEQ ID NO: 44391 - DNA, 25 bp, mus musculus
gcttcacagccaacggtgcagatta

SEQ ID NO: 44392 - DNA, 25 bp, mus musculus
acgagactttccagcatccgtacaa

SEQ ID NO: 44393 - DNA, 25 bp, mus musculus
cgagactttccagcatccgtacaac

SEQ ID NO: 44394 - DNA, 25 bp, mus musculus
agactttccagcatccgtacaacac

SEQ ID NO: 44395 - DNA, 25 bp, mus musculus
gactttccagcatccgtacaacacg

SEQ ID NO: 44396 - DNA, 25 bp, mus musculus
ctttccagcatccgtacaacacgct

SEQ ID NO: 44397 - DNA, 25 bp, mus musculus
tttccagcatccgtacaacacgctg

SEQ ID NO: 44398 - DNA, 25 bp, mus musculus
tccagcatccgtacaacacgctgaa

SEQ ID NO: 44399 - DNA, 25 bp, mus musculus
ccagcatccgtacaacacgctgaag

SEQ ID NO: 44400 - DNA, 25 bp, mus musculus
agcatccgtacaacacgctgaagta

SEQ ID NO: 44401 - DNA, 25 bp, mus musculus
gcatccgtacaacacgctgaagtac

SEQ ID NO: 44402 - DNA, 25 bp, mus musculus
cttcacagccaacggtgcagattac

SEQ ID NO: 44403 - DNA, 25 bp, mus musculus
cacagccaacggtgcagattacagg

SEQ ID NO: 44404 - DNA, 25 bp, mus musculus
aacacagagctggacagcgctgcaa

SEQ ID NO: 44405 - DNA, 25 bp, mus musculus
cacagagctggacagcgctgcaagg

SEQ ID NO: 44406 - DNA, 25 bp, mus musculus
ggaagccatgtctgttctggaacga

SEQ ID NO: 44407 - DNA, 25 bp, mus musculus
gaagccatgtctgttctggaacgag

SEQ ID NO: 44408 - DNA, 25 bp, mus musculus
agccatgtctgttctggaacgagac

SEQ ID NO: 44409 - DNA, 25 bp, mus musculus
gaacgagactttccagcatccgtac

SEQ ID NO: 44410 - DNA, 25 bp, mus musculus
agcctttcgcttgttcccactgcgg

SEQ ID NO: 44411 - DNA, 25 bp, mus musculus
ttgttcccactgcgggcagagcttc

SEQ ID NO: 44412 - DNA, 25 bp, mus musculus
ctgcatctcaccgagggtcgtcctt

SEQ ID NO: 44413 - DNA, 25 bp, mus musculus
gcatctcaccgagggtcgtcctttt

SEQ ID NO: 44414 - DNA, 25 bp, mus musculus
gtcgtccttttgggtgcgatgaatg

SEQ ID NO: 44415 - DNA, 25 bp, mus musculus
cttttgggtgcgatgaatgtgcact

SEQ ID NO: 44416 - DNA, 25 bp, mus musculus
gaatgtgcactcggcaccaacgtgg

SEQ ID NO: 44417 - DNA, 25 bp, mus musculus
atgtgcactcggcaccaacgtggac

SEQ ID NO: 44418 - DNA, 25 bp, mus musculus
gtgcactcggcaccaacgtggaccc

SEQ ID NO: 44419 - DNA, 25 bp, mus musculus
ctgcccggactgcgggcgatgcttt

SEQ ID NO: 44420 - DNA, 25 bp, mus musculus
ccggactgcgggcgatgctttgcca

SEQ ID NO: 44421 - DNA, 25 bp, mus musculus
cgatgctttgccacgggcagcacct

SEQ ID NO: 44422 - DNA, 25 bp, mus musculus
tcccactgcgggcagagcttcggct

SEQ ID NO: 44423 - DNA, 25 bp, mus musculus
ccactgcgggcagagcttcggctgg

SEQ ID NO: 44424 - DNA, 25 bp, mus musculus
ctcgctacgcaccagagtctgcatc

SEQ ID NO: 44425 - DNA, 25 bp, mus musculus
ctacgcaccagagtctgcatctcac

SEQ ID NO: 44426 - DNA, 25 bp, mus musculus
acgcaccagagtctgcatctcaccg

SEQ ID NO: 44427 - DNA, 25 bp, mus musculus
gcaccagagtctgcatctcaccgag

SEQ ID NO: 44428 - DNA, 25 bp, mus musculus
gagtctgcatctcaccgagggtcgt

SEQ ID NO: 44429 - DNA, 25 bp, mus musculus
gtctgcatctcaccgagggtcgtcc

SEQ ID NO: 44430 - DNA, 25 bp, mus musculus
gttcttacatgatttgtctgtcaca

SEQ ID NO: 44431 - DNA, 25 bp, mus musculus
cttacatgatttgtctgtcacagaa

SEQ ID NO: 44432 - DNA, 25 bp, mus musculus
gttccattgatcagcttaaatttgt

SEQ ID NO: 44433 - DNA, 25 bp, mus musculus
tttgttacctcgtatatgtaaaatg

SEQ ID NO: 44434 - DNA, 25 bp, mus musculus
aatggacacctggctacaagacacc

SEQ ID NO: 44435 - DNA, 25 bp, mus musculus
ggacacctggctacaagacaccatg

SEQ ID NO: 44436 - DNA, 25 bp, mus musculus
cacctggctacaagacaccatgtag

SEQ ID NO: 44437 - DNA, 25 bp, mus musculus
gctacaagacaccatgtagttaatg

SEQ ID NO: 44438 - DNA, 25 bp, mus musculus
acaagacaccatgtagttaatgtat

SEQ ID NO: 44439 - DNA, 25 bp, mus musculus
taccttaagctgttaactgtaagtg

SEQ ID NO: 44440 - DNA, 25 bp, mus musculus
gtttagacttcttacgtctgcattt

SEQ ID NO: 44441 - DNA, 25 bp, mus musculus
tagacttcttacgtctgcatttgtg

SEQ ID NO: 44442 - DNA, 25 bp, mus musculus
tgatttgtctgtcacagaagagagc

SEQ ID NO: 44443 - DNA, 25 bp, mus musculus
agacttcttacgtctgcatttgtgc

SEQ ID NO: 44444 - DNA, 25 bp, mus musculus
tttgtctgtcacagaagagagctgc

SEQ ID NO: 44445 - DNA, 25 bp, mus musculus
atattattcagtcttacttcccagg

SEQ ID NO: 44446 - DNA, 25 bp, mus musculus
ttattcagtcttacttcccaggatt

SEQ ID NO: 44447 - DNA, 25 bp, mus musculus
ttcagtcttacttcccaggattttg

SEQ ID NO: 44448 - DNA, 25 bp, mus musculus
atcttgctacagtagacaaactggt

SEQ ID NO: 44449 - DNA, 25 bp, mus musculus
acttgtgttccattgatcagcttaa

SEQ ID NO: 44450 - DNA, 25 bp, mus musculus
tgtgttccattgatcagcttaaatt

SEQ ID NO: 44451 - DNA, 25 bp, mus musculus
catcccggagctctgtgtcatagcc

SEQ ID NO: 44452 - DNA, 25 bp, mus musculus
cccggagctctgtgtcatagccagc

SEQ ID NO: 44453 - DNA, 25 bp, mus musculus
cgatgtagcccttggcagcagccac

SEQ ID NO: 44454 - DNA, 25 bp, mus musculus
ccttggcagcagccacatgcagggc

SEQ ID NO: 44455 - DNA, 25 bp, mus musculus
tggcagcagccacatgcagggcaga

SEQ ID NO: 44456 - DNA, 25 bp, mus musculus
cagcagccacatgcagggcagaggc

SEQ ID NO: 44457 - DNA, 25 bp, mus musculus
tcagccagcaccttgtgtcatgaag

SEQ ID NO: 44458 - DNA, 25 bp, mus musculus
gccagcaccttgtgtcatgaagcag

SEQ ID NO: 44459 - DNA, 25 bp, mus musculus
agcaccttgtgtcatgaagcagcaa

SEQ ID NO: 44460 - DNA, 25 bp, mus musculus
gcagcaattcttcttcagcccgctt

SEQ ID NO: 44461 - DNA, 25 bp, mus musculus
gcaattcttcttcagcccgcttggc

SEQ ID NO: 44462 - DNA, 25 bp, mus musculus
gagtgatctctgccttcagcagccc

SEQ ID NO: 44463 - DNA, 25 bp, mus musculus
ctgtgtcatagccagcttggagtag

SEQ ID NO: 44464 - DNA, 25 bp, mus musculus
catctgactcagccaggtccaaagg

SEQ ID NO: 44465 - DNA, 25 bp, mus musculus
tgtcatagccagcttggagtagcaa

SEQ ID NO: 44466 - DNA, 25 bp, mus musculus
catagccagcttggagtagcaacct

SEQ ID NO: 44467 - DNA, 25 bp, mus musculus
ggagtagcaacctcatcacctcgat

SEQ ID NO: 44468 - DNA, 25 bp, mus musculus
gcaacctcatcacctcgatgtagcc

SEQ ID NO: 44469 - DNA, 25 bp, mus musculus
acctcatcacctcgatgtagccctt

SEQ ID NO: 44470 - DNA, 25 bp, mus musculus
tcatcacctcgatgtagcccttggc

SEQ ID NO: 44471 - DNA, 25 bp, mus musculus
cctcgatgtagcccttggcagcagc

SEQ ID NO: 44472 - DNA, 25 bp, mus musculus
tctagaacttcctgatgctgcactg

SEQ ID NO: 44473 - DNA, 25 bp, mus musculus
acttcctgatgctgcactggtacac

SEQ ID NO: 44474 - DNA, 25 bp, mus musculus
aggccaagctggactagagaccctg

SEQ ID NO: 44475 - DNA, 25 bp, mus musculus
tttatggccactgaatgtaatttga

SEQ ID NO: 44476 - DNA, 25 bp, mus musculus
aatttgagccctttgtgctcactaa

SEQ ID NO: 44477 - DNA, 25 bp, mus musculus
agccctttgtgctcactaaaacaag

SEQ ID NO: 44478 - DNA, 25 bp, mus musculus
ttgtgctcactaaaacaaggatcac

SEQ ID NO: 44479 - DNA, 25 bp, mus musculus
ggatcacatttaacttgtgacaaac

SEQ ID NO: 44480 - DNA, 25 bp, mus musculus
gttggccccatgcgggacagacatg

SEQ ID NO: 44481 - DNA, 25 bp, mus musculus
cccatgcgggacagacatgaacatt

SEQ ID NO: 44482 - DNA, 25 bp, mus musculus
gaacattttggattcccaaggagca

SEQ ID NO: 44483 - DNA, 25 bp, mus musculus
tttggattcccaaggagcaaagaga

SEQ ID NO: 44484 - DNA, 25 bp, mus musculus
tgatgctgcactggtacacacaacc

SEQ ID NO: 44485 - DNA, 25 bp, mus musculus
tgcactggtacacacaaccaaagag

SEQ ID NO: 44486 - DNA, 25 bp, mus musculus
tgactagagctcttacttggcacac

SEQ ID NO: 44487 - DNA, 25 bp, mus musculus
gagctcttacttggcacacatgaag

SEQ ID NO: 44488 - DNA, 25 bp, mus musculus
ttacttggcacacatgaagtcctag

SEQ ID NO: 44489 - DNA, 25 bp, mus musculus
ggcacctacctataagcccagcact

SEQ ID NO: 44490 - DNA, 25 bp, mus musculus
tacctataagcccagcactttggag

SEQ ID NO: 44491 - DNA, 25 bp, mus musculus
acagtcatcttgaactatacaggga

SEQ ID NO: 44492 - DNA, 25 bp, mus musculus
aacgctggtcagagggagagactgt

SEQ ID NO: 44493 - DNA, 25 bp, mus musculus
tcaggaagtccttctctgctaactc

SEQ ID NO: 44494 - DNA, 25 bp, mus musculus
gcttagcgtcctggtcgaaagcaaa

SEQ ID NO: 44495 - DNA, 25 bp, mus musculus
tagcgtcctggtcgaaagcaaagat

SEQ ID NO: 44496 - DNA, 25 bp, mus musculus
cgtcctggtcgaaagcaaagatcta

SEQ ID NO: 44497 - DNA, 25 bp, mus musculus
tgcaatgtagctggtcttgttacca

SEQ ID NO: 44498 - DNA, 25 bp, mus musculus
gtagctggtcttgttaccaggggca

SEQ ID NO: 44499 - DNA, 25 bp, mus musculus
gctggtcttgttaccaggggcagca

SEQ ID NO: 44500 - DNA, 25 bp, mus musculus
ggtcttgttaccaggggcagcacag

SEQ ID NO: 44501 - DNA, 25 bp, mus musculus
cttgttaccaggggcagcacaggca

SEQ ID NO: 44502 - DNA, 25 bp, mus musculus
ggccttgtcctgcaggatgagatgg

SEQ ID NO: 44503 - DNA, 25 bp, mus musculus
cttgtcctgcaggatgagatggcca

SEQ ID NO: 44504 - DNA, 25 bp, mus musculus
ggaagtccttctctgctaactcgca

SEQ ID NO: 44505 - DNA, 25 bp, mus musculus
agtccttctctgctaactcgcagca

SEQ ID NO: 44506 - DNA, 25 bp, mus musculus
ccttctctgctaactcgcagcaaga

SEQ ID NO: 44507 - DNA, 25 bp, mus musculus
gagccaccaacgtcgccatggctgc

SEQ ID NO: 44508 - DNA, 25 bp, mus musculus
ccatggctgccagccgcttagcgtc

SEQ ID NO: 44509 - DNA, 25 bp, mus musculus
ctgccagccgcttagcgtcctggtc

SEQ ID NO: 44510 - DNA, 25 bp, mus musculus
ccagccgcttagcgtcctggtcgaa

SEQ ID NO: 44511 - DNA, 25 bp, mus musculus
gccgcttagcgtcctggtcgaaagc

SEQ ID NO: 44512 - DNA, 25 bp, mus musculus
ctgcacacaccatgtatacactcat

SEQ ID NO: 44513 - DNA, 25 bp, mus musculus
ccatgtatacactcatcccttagag

SEQ ID NO: 44514 - DNA, 25 bp, mus musculus
tgctcatagcacgagagagccatct

SEQ ID NO: 44515 - DNA, 25 bp, mus musculus
tgatcttcattctcgtggaggactc

SEQ ID NO: 44516 - DNA, 25 bp, mus musculus
tcttcattctcgtggaggactcata

SEQ ID NO: 44517 - DNA, 25 bp, mus musculus
tcattctcgtggaggactcatactc

SEQ ID NO: 44518 - DNA, 25 bp, mus musculus
aggactcatactctagtgattcgca

SEQ ID NO: 44519 - DNA, 25 bp, mus musculus
actctagtgattcgcaatggcgcat

SEQ ID NO: 44520 - DNA, 25 bp, mus musculus
attcgcaatggcgcatgaagatgct

SEQ ID NO: 44521 - DNA, 25 bp, mus musculus
tgaagatgcttcccatctgcagctg

SEQ ID NO: 44522 - DNA, 25 bp, mus musculus
ggctgtgcatctcaacaccgatgct

SEQ ID NO: 44523 - DNA, 25 bp, mus musculus
gcatctcaacaccgatgctggagga

SEQ ID NO: 44524 - DNA, 25 bp, mus musculus
tgtatacactcatcccttagagtgg

SEQ ID NO: 44525 - DNA, 25 bp, mus musculus
atacactcatcccttagagtggttc

SEQ ID NO: 44526 - DNA, 25 bp, mus musculus
tcatcccttagagtggttctccatt

SEQ ID NO: 44527 - DNA, 25 bp, mus musculus
tcccggcctcaatctaagaaccatg

SEQ ID NO: 44528 - DNA, 25 bp, mus musculus
cctcaatctaagaaccatgcataaa

SEQ ID NO: 44529 - DNA, 25 bp, mus musculus
taaacatatagcgtgtgcagaagct

SEQ ID NO: 44530 - DNA, 25 bp, mus musculus
tgaatccggtgctcatagcacgaga

SEQ ID NO: 44531 - DNA, 25 bp, mus musculus
atccggtgctcatagcacgagagag

SEQ ID NO: 44532 - DNA, 25 bp, mus musculus
aaagcttcgctggactcttgaggct

SEQ ID NO: 44533 - DNA, 25 bp, mus musculus
agcttcgctggactcttgaggctcc

SEQ ID NO: 44534 - DNA, 25 bp, mus musculus
aaccaccattctgtatcagttctta

SEQ ID NO: 44535 - DNA, 25 bp, mus musculus
ccaccattctgtatcagttcttaat

SEQ ID NO: 44536 - DNA, 25 bp, mus musculus
accattctgtatcagttcttaatga

SEQ ID NO: 44537 - DNA, 25 bp, mus musculus
aagtagtgcatacttctccaaccat

SEQ ID NO: 44538 - DNA, 25 bp, mus musculus
gtagtgcatacttctccaaccatag

SEQ ID NO: 44539 - DNA, 25 bp, mus musculus
agtgcatacttctccaaccatagga

SEQ ID NO: 44540 - DNA, 25 bp, mus musculus
catacttctccaaccataggaagcg

SEQ ID NO: 44541 - DNA, 25 bp, mus musculus
tacttctccaaccataggaagcgat

SEQ ID NO: 44542 - DNA, 25 bp, mus musculus
cttctccaaccataggaagcgatgt

SEQ ID NO: 44543 - DNA, 25 bp, mus musculus
tctccaaccataggaagcgatgttg

SEQ ID NO: 44544 - DNA, 25 bp, mus musculus
acctgccgcgagtgctgcccaggaa

SEQ ID NO: 44545 - DNA, 25 bp, mus musculus
cgagtgctgcccaggaagtctgtcc

SEQ ID NO: 44546 - DNA, 25 bp, mus musculus
ctgcccaggaagtctgtcccgtccg

SEQ ID NO: 44547 - DNA, 25 bp, mus musculus
ctgatcttcgctaaactgtggagcc

SEQ ID NO: 44548 - DNA, 25 bp, mus musculus
tcttcgctaaactgtggagcctttt

SEQ ID NO: 44549 - DNA, 25 bp, mus musculus
tttttgtaaccaagagcacagagta

SEQ ID NO: 44550 - DNA, 25 bp, mus musculus
ggggaaaaccaccattctgtatcag

SEQ ID NO: 44551 - DNA, 25 bp, mus musculus
ggaaaaccaccattctgtatcagtt

SEQ ID NO: 44552 - DNA, 25 bp, mus musculus
acctagaacgcatcctgcacagcgt

SEQ ID NO: 44553 - DNA, 25 bp, mus musculus
aacgcatcctgcacagcgtgcacct

SEQ ID NO: 44554 - DNA, 25 bp, mus musculus
atctattacaattcgatggcgaagg

SEQ ID NO: 44555 - DNA, 25 bp, mus musculus
acactgctatccgtttaacgttgag

SEQ ID NO: 44556 - DNA, 25 bp, mus musculus
cgcagctcgctggaattcccaaaat

SEQ ID NO: 44557 - DNA, 25 bp, mus musculus
agagactcaacgaactatgcaaaat

SEQ ID NO: 44558 - DNA, 25 bp, mus musculus
tccaaactccagaaaagacatccta

SEQ ID NO: 44559 - DNA, 25 bp, mus musculus
catcctaatttatcttgacatgttt

SEQ ID NO: 44560 - DNA, 25 bp, mus musculus
tcttgacatgttttcagttaccttc

SEQ ID NO: 44561 - DNA, 25 bp, mus musculus
catgttttcagttaccttctaggtg

SEQ ID NO: 44562 - DNA, 25 bp, mus musculus
taccttctaggtgaagcctcagaga

SEQ ID NO: 44563 - DNA, 25 bp, mus musculus
gaagcctcagagactctctctttac

SEQ ID NO: 44564 - DNA, 25 bp, mus musculus
acagcgtgcacctctaccacatagt

SEQ ID NO: 44565 - DNA, 25 bp, mus musculus
tctaccacatagttcaaagagaagg

SEQ ID NO: 44566 - DNA, 25 bp, mus musculus
tttaccataaaccgaagtatgcatt

SEQ ID NO: 44567 - DNA, 25 bp, mus musculus
tgagcatcgacgttgaaggaaagat

SEQ ID NO: 44568 - DNA, 25 bp, mus musculus
tctccataacacacaggccttctct

SEQ ID NO: 44569 - DNA, 25 bp, mus musculus
taacacacaggccttctctgtggaa

SEQ ID NO: 44570 - DNA, 25 bp, mus musculus
acaggccttctctgtggaaatacca

SEQ ID NO: 44571 - DNA, 25 bp, mus musculus
aataccacactcatctattacaatt

SEQ ID NO: 44572 - DNA, 25 bp, mus musculus
tcctctttggggccaagctgtactc

SEQ ID NO: 44573 - DNA, 25 bp, mus musculus
ccaagctgtactccacgtccatcga

SEQ ID NO: 44574 - DNA, 25 bp, mus musculus
aatggcctgccatgaccaagctgcc

SEQ ID NO: 44575 - DNA, 25 bp, mus musculus
tgaccaagctgccagactataagcc

SEQ ID NO: 44576 - DNA, 25 bp, mus musculus
caatgtacccagctacaacatcctt

SEQ ID NO: 44577 - DNA, 25 bp, mus musculus
catccttggtgaacgtcgtgcccaa

SEQ ID NO: 44578 - DNA, 25 bp, mus musculus
gggacctgttgcagaacctattgaa

SEQ ID NO: 44579 - DNA, 25 bp, mus musculus
tgttgcagaacctattgaagtgtaa

SEQ ID NO: 44580 - DNA, 25 bp, mus musculus
agtgtaaccctgtgcagcgcatctc

SEQ ID NO: 44581 - DNA, 25 bp, mus musculus
accctgtgcagcgcatctcagcaga

SEQ ID NO: 44582 - DNA, 25 bp, mus musculus
tgcagcgcatctcagcagaggaggc

SEQ ID NO: 44583 - DNA, 25 bp, mus musculus
cataggctctctgaaccccagtggc

SEQ ID NO: 44584 - DNA, 25 bp, mus musculus
tgtactccacgtccatcgacatgtg

SEQ ID NO: 44585 - DNA, 25 bp, mus musculus
ccacgtccatcgacatgtggtcagc

SEQ ID NO: 44586 - DNA, 25 bp, mus musculus
ggtcagccggctgcatctttgcaga

SEQ ID NO: 44587 - DNA, 25 bp, mus musculus
ccggctgcatctttgcagagctggc

SEQ ID NO: 44588 - DNA, 25 bp, mus musculus
gcatctttgcagagctggctaatgc

SEQ ID NO: 44589 - DNA, 25 bp, mus musculus
tcttccctggcaatgatgtggatga

SEQ ID NO: 44590 - DNA, 25 bp, mus musculus
tggatgaccagctgaagaggatctt

SEQ ID NO: 44591 - DNA, 25 bp, mus musculus
tgctagggacaccgactgaggaaca

SEQ ID NO: 44592 - DNA, 25 bp, mus musculus
ttaggccagcaacgcttgtagtgct

SEQ ID NO: 44593 - DNA, 25 bp, mus musculus
cagcaacgcttgtagtgctcactct

SEQ ID NO: 44594 - DNA, 25 bp, mus musculus
agagaattcgcagccctagcctgga

SEQ ID NO: 44595 - DNA, 25 bp, mus musculus
gccctagcctggagtcaggagacag

SEQ ID NO: 44596 - DNA, 25 bp, mus musculus
tagatgacgacttctggccctggcc

SEQ ID NO: 44597 - DNA, 25 bp, mus musculus
tctggccctggccctgacctgcttt

SEQ ID NO: 44598 - DNA, 25 bp, mus musculus
cctgacctgctttcccaacagcttt

SEQ ID NO: 44599 - DNA, 25 bp, mus musculus
tgcactccacttctgtcactgcaga

SEQ ID NO: 44600 - DNA, 25 bp, mus musculus
cactctccaccttgtattctgcagt

SEQ ID NO: 44601 - DNA, 25 bp, mus musculus
ccaccttgtattctgcagtctccag

SEQ ID NO: 44602 - DNA, 25 bp, mus musculus
tctccaggcctgttgctatagtgcc

SEQ ID NO: 44603 - DNA, 25 bp, mus musculus
ttgctatagtgcccacctgaatgtc

SEQ ID NO: 44604 - DNA, 25 bp, mus musculus
cgcttgtagtgctcactctgggcca

SEQ ID NO: 44605 - DNA, 25 bp, mus musculus
agtgcccacctgaatgtcaataaag

SEQ ID NO: 44606 - DNA, 25 bp, mus musculus
tcactctgggccatagtgtggcgct

SEQ ID NO: 44607 - DNA, 25 bp, mus musculus
attaatgcctctaaaacatgcaata

SEQ ID NO: 44608 - DNA, 25 bp, mus musculus
cagctattattcagggccctacctg

SEQ ID NO: 44609 - DNA, 25 bp, mus musculus
ggaaaccctgactttatcacagaag

SEQ ID NO: 44610 - DNA, 25 bp, mus musculus
cctgactttatcacagaagggcggc

SEQ ID NO: 44611 - DNA, 25 bp, mus musculus
cagcatctctggactttgcttctgt

SEQ ID NO: 44612 - DNA, 25 bp, mus musculus
ctctggactttgcttctgtagaaag

SEQ ID NO: 44613 - DNA, 25 bp, mus musculus
atggttcgtctgcctctgcagtgcg

SEQ ID NO: 44614 - DNA, 25 bp, mus musculus
cgtctgcctctgcagtgcgtcctct

SEQ ID NO: 44615 - DNA, 25 bp, mus musculus
ttgtgccagccaggacagaaactgg

SEQ ID NO: 44616 - DNA, 25 bp, mus musculus
gactgcacagagttcactgaaacgg

SEQ ID NO: 44617 - DNA, 25 bp, mus musculus
gaaacggaatgccttccttgcggtg

SEQ ID NO: 44618 - DNA, 25 bp, mus musculus
gaatgccttccttgcggtgaaagcg

SEQ ID NO: 44619 - DNA, 25 bp, mus musculus
tgccttccttgcggtgaaagcgaat

SEQ ID NO: 44620 - DNA, 25 bp, mus musculus
agcgaattcctagacacctggaaca

SEQ ID NO: 44621 - DNA, 25 bp, mus musculus
gaattcctagacacctggaacagag

SEQ ID NO: 44622 - DNA, 25 bp, mus musculus
agagagacacactgccaccagcaca

SEQ ID NO: 44623 - DNA, 25 bp, mus musculus
cactgccaccagcacaaatactgcg

SEQ ID NO: 44624 - DNA, 25 bp, mus musculus
tgccaccagcacaaatactgcgacc

SEQ ID NO: 44625 - DNA, 25 bp, mus musculus
ctgcctctgcagtgcgtcctctggg

SEQ ID NO: 44626 - DNA, 25 bp, mus musculus
cctctgcagtgcgtcctctggggct

SEQ ID NO: 44627 - DNA, 25 bp, mus musculus
ctgcagtgcgtcctctggggctgct

SEQ ID NO: 44628 - DNA, 25 bp, mus musculus
ttgctgaccgctgtccatccagaac

SEQ ID NO: 44629 - DNA, 25 bp, mus musculus
cccactgcatgcagagaaaaacagt

SEQ ID NO: 44630 - DNA, 25 bp, mus musculus
tacctaataaacagtcagtgctgtt

SEQ ID NO: 44631 - DNA, 25 bp, mus musculus
aacagtcagtgctgttctttgtgcc

SEQ ID NO: 44632 - DNA, 25 bp, mus musculus
tctttgtgccagccaggacagaaac

SEQ ID NO: 44633 - DNA, 25 bp, mus musculus
gcctacatcctgtccattcaagcag

SEQ ID NO: 44634 - DNA, 25 bp, mus musculus
atcctgtccattcaagcagacgagc

SEQ ID NO: 44635 - DNA, 25 bp, mus musculus
ctaactcgaggaggagctggaatct

SEQ ID NO: 44636 - DNA, 25 bp, mus musculus
ggaatctctcgtgagagtaaggaga

SEQ ID NO: 44637 - DNA, 25 bp, mus musculus
atctctcgtgagagtaaggagaacg

SEQ ID NO: 44638 - DNA, 25 bp, mus musculus
tccttctgacagaactgatgcgctg

SEQ ID NO: 44639 - DNA, 25 bp, mus musculus
tgacagaactgatgcgctggaatta

SEQ ID NO: 44640 - DNA, 25 bp, mus musculus
atgcatgctcaaagcctaacctcac

SEQ ID NO: 44641 - DNA, 25 bp, mus musculus
catgctcaaagcctaacctcacaac

SEQ ID NO: 44642 - DNA, 25 bp, mus musculus
taactgcctcaaacttaaatagtat

SEQ ID NO: 44643 - DNA, 25 bp, mus musculus
atctatccaattttcccatgtaaat

SEQ ID NO: 44644 - DNA, 25 bp, mus musculus
tatccaattttcccatgtaaatagg

SEQ ID NO: 44645 - DNA, 25 bp, mus musculus
gacgagcacaagctcacctctgaaa

SEQ ID NO: 44646 - DNA, 25 bp, mus musculus
cacaagctcacctctgaaaaggact

SEQ ID NO: 44647 - DNA, 25 bp, mus musculus
ctcacctctgaaaaggacttattga

SEQ ID NO: 44648 - DNA, 25 bp, mus musculus
cacaaactcgaacagcttcgaaact

SEQ ID NO: 44649 - DNA, 25 bp, mus musculus
aaactcgaacagcttcgaaactctg

SEQ ID NO: 44650 - DNA, 25 bp, mus musculus
cagcttcgaaactctggtgcataaa

SEQ ID NO: 44651 - DNA, 25 bp, mus musculus
gcataaactgacctaactcgaggag

SEQ ID NO: 44652 - DNA, 25 bp, mus musculus
actgacctaactcgaggaggagctg

SEQ ID NO: 44653 - DNA, 25 bp, mus musculus
tgtttcctggcaacggagatgaaca

SEQ ID NO: 44654 - DNA, 25 bp, mus musculus
agtacgtcatgggtcacttccgctg

SEQ ID NO: 44655 - DNA, 25 bp, mus musculus
acaagcgttacggtggcttcatgac

SEQ ID NO: 44656 - DNA, 25 bp, mus musculus
gtggcttcatgacctccgagaagag

SEQ ID NO: 44657 - DNA, 25 bp, mus musculus
tcatgacctccgagaagagccagac

SEQ ID NO: 44658 - DNA, 25 bp, mus musculus
agaagagccagacgcccctggtgac

SEQ ID NO: 44659 - DNA, 25 bp, mus musculus
cgcccctggtgacgctcttcaagaa

SEQ ID NO: 44660 - DNA, 25 bp, mus musculus
cgctcttcaagaacgccatcatcaa

SEQ ID NO: 44661 - DNA, 25 bp, mus musculus
tcaagaacgccatcatcaagaacgc

SEQ ID NO: 44662 - DNA, 25 bp, mus musculus
acgccatcatcaagaacgcgcacaa

SEQ ID NO: 44663 - DNA, 25 bp, mus musculus
tcatcaagaacgcgcacaagaaggg

SEQ ID NO: 44664 - DNA, 25 bp, mus musculus
agaacgcgcacaagaagggccagtg

SEQ ID NO: 44665 - DNA, 25 bp, mus musculus
tcatgggtcacttccgctgggaccg

SEQ ID NO: 44666 - DNA, 25 bp, mus musculus
gccccaggaacagcagcagtgctgg

SEQ ID NO: 44667 - DNA, 25 bp, mus musculus
gcagtccagagccgagtccacgcga

SEQ ID NO: 44668 - DNA, 25 bp, mus musculus
cagagccgagtccacgcgagggcaa

SEQ ID NO: 44669 - DNA, 25 bp, mus musculus
cgagtccacgcgagggcaagcgctc

SEQ ID NO: 44670 - DNA, 25 bp, mus musculus
agggcaagcgctcctactccatgga

SEQ ID NO: 44671 - DNA, 25 bp, mus musculus
agcgctcctactccatggagcactt

SEQ ID NO: 44672 - DNA, 25 bp, mus musculus
cctactccatggagcacttccgctg

SEQ ID NO: 44673 - DNA, 25 bp, mus musculus
ttttcattatctggaatgagttcca

SEQ ID NO: 44674 - DNA, 25 bp, mus musculus
ttattgctacactggatcagcagcc

SEQ ID NO: 44675 - DNA, 25 bp, mus musculus
tgaccctccattgtgaattcttgca

SEQ ID NO: 44676 - DNA, 25 bp, mus musculus
gtgaattcttgcaacctcaggaatg

SEQ ID NO: 44677 - DNA, 25 bp, mus musculus
tcttgcaacctcaggaatgttaacg

SEQ ID NO: 44678 - DNA, 25 bp, mus musculus
gttttgctctttggaatatagctgt

SEQ ID NO: 44679 - DNA, 25 bp, mus musculus
tgtacatttgtcacgtaggtttagg

SEQ ID NO: 44680 - DNA, 25 bp, mus musculus
gtttaggctggccttaaactcacag

SEQ ID NO: 44681 - DNA, 25 bp, mus musculus
cttaaactcacagttctcttgcctc

SEQ ID NO: 44682 - DNA, 25 bp, mus musculus
gttctcttgcctcagccttctgagt

SEQ ID NO: 44683 - DNA, 25 bp, mus musculus
tgcttggattacggatgtgggccag

SEQ ID NO: 44684 - DNA, 25 bp, mus musculus
gattacggatgtgggccagaatatc

SEQ ID NO: 44685 - DNA, 25 bp, mus musculus
ctacactggatcagcagccttgcaa

SEQ ID NO: 44686 - DNA, 25 bp, mus musculus
aatactgggccatttcattagagga

SEQ ID NO: 44687 - DNA, 25 bp, mus musculus
gcatgctacatgttcagttgaaagg

SEQ ID NO: 44688 - DNA, 25 bp, mus musculus
ggaagacctcaagctctgcaaatgg

SEQ ID NO: 44689 - DNA, 25 bp, mus musculus
agaggttagcctttgtgctgtacta

SEQ ID NO: 44690 - DNA, 25 bp, mus musculus
ttgtgctgtactaggcttcttgctg

SEQ ID NO: 44691 - DNA, 25 bp, mus musculus
tgtactaggcttcttgctgatcgtc

SEQ ID NO: 44692 - DNA, 25 bp, mus musculus
cttgctgatcgtctggagagtttct

SEQ ID NO: 44693 - DNA, 25 bp, mus musculus
cttgatacccgaatgcagacaggaa

SEQ ID NO: 44694 - DNA, 25 bp, mus musculus
tatcacccagcttacatcaacttcc

SEQ ID NO: 44695 - DNA, 25 bp, mus musculus
acctctccaagaacagcaagtgctc

SEQ ID NO: 44696 - DNA, 25 bp, mus musculus
acagcaagtgctctttgctactgag

SEQ ID NO: 44697 - DNA, 25 bp, mus musculus
agtgctctttgctactgagccttat

SEQ ID NO: 44698 - DNA, 25 bp, mus musculus
ctttgctactgagccttatctccct

SEQ ID NO: 44699 - DNA, 25 bp, mus musculus
tcctctaatacatttcttaataaga

SEQ ID NO: 44700 - DNA, 25 bp, mus musculus
ggcaagtcccacagtaagcttcaca

SEQ ID NO: 44701 - DNA, 25 bp, mus musculus
tcccacagtaagcttcacaataaag

SEQ ID NO: 44702 - DNA, 25 bp, mus musculus
gactgtcatggccagttatcacatc

SEQ ID NO: 44703 - DNA, 25 bp, mus musculus
cagttatcacatcgtttgtagcaat

SEQ ID NO: 44704 - DNA, 25 bp, mus musculus
tcacatcgtttgtagcaatgtatga

SEQ ID NO: 44705 - DNA, 25 bp, mus musculus
tcccagccactctacttctaagaaa

SEQ ID NO: 44706 - DNA, 25 bp, mus musculus
tatctctgtgggactcatcttcata

SEQ ID NO: 44707 - DNA, 25 bp, mus musculus
attatttgcatttgcatttgcaatg

SEQ ID NO: 44708 - DNA, 25 bp, mus musculus
tgcatttgcatttgcaatgtgaaga

SEQ ID NO: 44709 - DNA, 25 bp, mus musculus
tattatacccaaggagaggccagag

SEQ ID NO: 44710 - DNA, 25 bp, mus musculus
catcggatcctgtggaactggagtt

SEQ ID NO: 44711 - DNA, 25 bp, mus musculus
actgaatccaggacctctccaagaa

SEQ ID NO: 44712 - DNA, 25 bp, mus musculus
tccaggacctctccaagaacagcaa

SEQ ID NO: 44713 - DNA, 25 bp, mus musculus
cctcagaacagcatcggtgccgtag

SEQ ID NO: 44714 - DNA, 25 bp, mus musculus
aacagcatcggtgccgtaggaagtg

SEQ ID NO: 44715 - DNA, 25 bp, mus musculus
ttcatcagcgatggcaatgtgcttg

SEQ ID NO: 44716 - DNA, 25 bp, mus musculus
gtgcttgctttacatcggctgcttt

SEQ ID NO: 44717 - DNA, 25 bp, mus musculus
catcggctgctttggaacaatcagg

SEQ ID NO: 44718 - DNA, 25 bp, mus musculus
attggccagtatctttccagtaaca

SEQ ID NO: 44719 - DNA, 25 bp, mus musculus
cagtatctttccagtaacagggatc

SEQ ID NO: 44720 - DNA, 25 bp, mus musculus
ctttccagtaacagggatcataaag

SEQ ID NO: 44721 - DNA, 25 bp, mus musculus
aagatggccacacttctcgcgtatc

SEQ ID NO: 44722 - DNA, 25 bp, mus musculus
gccacacttctcgcgtatctgggtc

SEQ ID NO: 44723 - DNA, 25 bp, mus musculus
cttctcgcgtatctgggtcctccag

SEQ ID NO: 44724 - DNA, 25 bp, mus musculus
gcgtatctgggtcctccagagcaca

SEQ ID NO: 44725 - DNA, 25 bp, mus musculus
tttctcagattcatcaatcctgcca

SEQ ID NO: 44726 - DNA, 25 bp, mus musculus
agattcatcaatcctgccattgtct

SEQ ID NO: 44727 - DNA, 25 bp, mus musculus
atcaatcctgccattgtctcgccgt

SEQ ID NO: 44728 - DNA, 25 bp, mus musculus
attgtctcgccgtatgaagcaggga

SEQ ID NO: 44729 - DNA, 25 bp, mus musculus
agcattgccaatcatgtactgttca

SEQ ID NO: 44730 - DNA, 25 bp, mus musculus
agcaactttgacttggcacgaaggt

SEQ ID NO: 44731 - DNA, 25 bp, mus musculus
tcagattgtcccacaagtgatgcag

SEQ ID NO: 44732 - DNA, 25 bp, mus musculus
catagtctttccttcatcagcgatg

SEQ ID NO: 44733 - DNA, 25 bp, mus musculus
cctggcacctgctgcacgagtcatc

SEQ ID NO: 44734 - DNA, 25 bp, mus musculus
ctggcacctgctgcacgagtcatcg

SEQ ID NO: 44735 - DNA, 25 bp, mus musculus
gagtcacttggtggatgcgcacact

SEQ ID NO: 44736 - DNA, 25 bp, mus musculus
agtcacttggtggatgcgcacactg

SEQ ID NO: 44737 - DNA, 25 bp, mus musculus
tggatgcgcacactgccgaagtcaa

SEQ ID NO: 44738 - DNA, 25 bp, mus musculus
ggatgcgcacactgccgaagtcaac

SEQ ID NO: 44739 - DNA, 25 bp, mus musculus
gatgcgcacactgccgaagtcaact

SEQ ID NO: 44740 - DNA, 25 bp, mus musculus
atgcgcacactgccgaagtcaactg

SEQ ID NO: 44741 - DNA, 25 bp, mus musculus
tgcgcacactgccgaagtcaactgc

SEQ ID NO: 44742 - DNA, 25 bp, mus musculus
gcgcacactgccgaagtcaactgcc

SEQ ID NO: 44743 - DNA, 25 bp, mus musculus
cgcacactgccgaagtcaactgcct

SEQ ID NO: 44744 - DNA, 25 bp, mus musculus
gcacactgccgaagtcaactgcctc

SEQ ID NO: 44745 - DNA, 25 bp, mus musculus
tggcacctgctgcacgagtcatcgt

SEQ ID NO: 44746 - DNA, 25 bp, mus musculus
ggcacctgctgcacgagtcatcgtt

SEQ ID NO: 44747 - DNA, 25 bp, mus musculus
gcacctgctgcacgagtcatcgttt

SEQ ID NO: 44748 - DNA, 25 bp, mus musculus
cacctgctgcacgagtcatcgtttg

SEQ ID NO: 44749 - DNA, 25 bp, mus musculus
acctgctgcacgagtcatcgtttgg

SEQ ID NO: 44750 - DNA, 25 bp, mus musculus
cacctccaagccgagtcacttggtg

SEQ ID NO: 44751 - DNA, 25 bp, mus musculus
acctccaagccgagtcacttggtgg

SEQ ID NO: 44752 - DNA, 25 bp, mus musculus
cctccaagccgagtcacttggtgga

SEQ ID NO: 44753 - DNA, 25 bp, mus musculus
caggaggacccacgagtttgagcgg

SEQ ID NO: 44754 - DNA, 25 bp, mus musculus
acccagaagtgtctgagctgcgcca

SEQ ID NO: 44755 - DNA, 25 bp, mus musculus
cttagtgtttcctctgaaagttcat

SEQ ID NO: 44756 - DNA, 25 bp, mus musculus
gtttcctctgaaagttcatattggt

SEQ ID NO: 44757 - DNA, 25 bp, mus musculus
tattggttccttctttgcctgagaa

SEQ ID NO: 44758 - DNA, 25 bp, mus musculus
tggttccttctttgcctgagaaata

SEQ ID NO: 44759 - DNA, 25 bp, mus musculus
aatgtcatttgccatcgaaaggaga

SEQ ID NO: 44760 - DNA, 25 bp, mus musculus
tgcatcagcaaagccattttattga

SEQ ID NO: 44761 - DNA, 25 bp, mus musculus
atcagcaaagccattttattgaagc

SEQ ID NO: 44762 - DNA, 25 bp, mus musculus
ttggctaccagcactcgtgtttgta

SEQ ID NO: 44763 - DNA, 25 bp, mus musculus
accagcactcgtgtttgtatgtact

SEQ ID NO: 44764 - DNA, 25 bp, mus musculus
agcactcgtgtttgtatgtactgga

SEQ ID NO: 44765 - DNA, 25 bp, mus musculus
catttcatggcattatgtggatgtt

SEQ ID NO: 44766 - DNA, 25 bp, mus musculus
ttcatggcattatgtggatgtttac

SEQ ID NO: 44767 - DNA, 25 bp, mus musculus
actttcccagcaggctttcttcagt

SEQ ID NO: 44768 - DNA, 25 bp, mus musculus
ggctttcttcagtataccaacgctt

SEQ ID NO: 44769 - DNA, 25 bp, mus musculus
tataccaacgcttgacagagatcac

SEQ ID NO: 44770 - DNA, 25 bp, mus musculus
gatgttcacgtccgctgacttagtg

SEQ ID NO: 44771 - DNA, 25 bp, mus musculus
gtccgctgacttagtgtttcctctg

SEQ ID NO: 44772 - DNA, 25 bp, mus musculus
cgctgacttagtgtttcctctgaaa

SEQ ID NO: 44773 - DNA, 25 bp, mus musculus
tccaggagaccaaccaactcctcag

SEQ ID NO: 44774 - DNA, 25 bp, mus musculus
agtttcagcaacccagcatgtacct

SEQ ID NO: 44775 - DNA, 25 bp, mus musculus
cttgacatagccaacgaagagttac

SEQ ID NO: 44776 - DNA, 25 bp, mus musculus
ctactgatatacttctagtttgtta

SEQ ID NO: 44777 - DNA, 25 bp, mus musculus
atatacttctagtttgttagactgt

SEQ ID NO: 44778 - DNA, 25 bp, mus musculus
tttgttagactgtccaagaagaatg

SEQ ID NO: 44779 - DNA, 25 bp, mus musculus
agtgttgtttgttctgcatgctgtc

SEQ ID NO: 44780 - DNA, 25 bp, mus musculus
gtttgttctgcatgctgtcattgtc

SEQ ID NO: 44781 - DNA, 25 bp, mus musculus
tagacaaattcacaacattgcatgg

SEQ ID NO: 44782 - DNA, 25 bp, mus musculus
caacattgcatggtctcttttctaa

SEQ ID NO: 44783 - DNA, 25 bp, mus musculus
tgcatggtctcttttctaaaaagtg

SEQ ID NO: 44784 - DNA, 25 bp, mus musculus
tttccagactagtatggtaatgtgg

SEQ ID NO: 44785 - DNA, 25 bp, mus musculus
tgtacctgttaccaagacaacagta

SEQ ID NO: 44786 - DNA, 25 bp, mus musculus
tgttaccaagacaacagtacgtcat

SEQ ID NO: 44787 - DNA, 25 bp, mus musculus
aacagtacgtcatccaataagaaca

SEQ ID NO: 44788 - DNA, 25 bp, mus musculus
tttaataaccttgacagttttgcat

SEQ ID NO: 44789 - DNA, 25 bp, mus musculus
aaccttgacagttttgcatgtgatg

SEQ ID NO: 44790 - DNA, 25 bp, mus musculus
tgtgatgctatcactcattggctac

SEQ ID NO: 44791 - DNA, 25 bp, mus musculus
gctatcactcattggctacttgaca

SEQ ID NO: 44792 - DNA, 25 bp, mus musculus
actcattggctacttgacatagcca

SEQ ID NO: 44793 - DNA, 25 bp, mus musculus
ggacctcatctacagaatgttacag

SEQ ID NO: 44794 - DNA, 25 bp, mus musculus
gttacagccagatgtcaaccgccgg

SEQ ID NO: 44795 - DNA, 25 bp, mus musculus
acgatctgaggcccggtctgagtca

SEQ ID NO: 44796 - DNA, 25 bp, mus musculus
agatactttgcaggtggtcaggcag

SEQ ID NO: 44797 - DNA, 25 bp, mus musculus
tttgcaggtggtcaggcagtcagag

SEQ ID NO: 44798 - DNA, 25 bp, mus musculus
gggcctcagcagcgaactgaacagg

SEQ ID NO: 44799 - DNA, 25 bp, mus musculus
acagccttcagagacacatacttag

SEQ ID NO: 44800 - DNA, 25 bp, mus musculus
ttcagagacacatacttagtgagcc

SEQ ID NO: 44801 - DNA, 25 bp, mus musculus
aggaagacactcccggatgagctat

SEQ ID NO: 44802 - DNA, 25 bp, mus musculus
acactcccggatgagctattttcgt

SEQ ID NO: 44803 - DNA, 25 bp, mus musculus
gagctattttcgtcactttcttctc

SEQ ID NO: 44804 - DNA, 25 bp, mus musculus
taactcacacggctaaagaagcaat

SEQ ID NO: 44805 - DNA, 25 bp, mus musculus
ccgccggctgcacatcgatgagatc

SEQ ID NO: 44806 - DNA, 25 bp, mus musculus
ccttaaccactgctgggtgcagccc

SEQ ID NO: 44807 - DNA, 25 bp, mus musculus
ccactgctgggtgcagcccaaggca

SEQ ID NO: 44808 - DNA, 25 bp, mus musculus
acgaggtctgtcctctggagccatc

SEQ ID NO: 44809 - DNA, 25 bp, mus musculus
tctgtcctctggagccatcaacaag

SEQ ID NO: 44810 - DNA, 25 bp, mus musculus
ctcatggatccctgaacctggtgct

SEQ ID NO: 44811 - DNA, 25 bp, mus musculus
tgaacctggtgctgataagaagtct

SEQ ID NO: 44812 - DNA, 25 bp, mus musculus
tgccaccaagttggagcctagggaa

SEQ ID NO: 44813 - DNA, 25 bp, mus musculus
ttataaactctgaccagaacacctg

SEQ ID NO: 44814 - DNA, 25 bp, mus musculus
actctgaccagaacacctgtgtttc

SEQ ID NO: 44815 - DNA, 25 bp, mus musculus
agccctggagctgttgcagcagctc

SEQ ID NO: 44816 - DNA, 25 bp, mus musculus
gttgcagcagctcttcagaacgcct

SEQ ID NO: 44817 - DNA, 25 bp, mus musculus
cgagcttctgcaaaccctgaccgca

SEQ ID NO: 44818 - DNA, 25 bp, mus musculus
agcttctgcaaaccctgaccgcagt

SEQ ID NO: 44819 - DNA, 25 bp, mus musculus
cttctgcaaaccctgaccgcagtcg

SEQ ID NO: 44820 - DNA, 25 bp, mus musculus
tctgcaaaccctgaccgcagtcggg

SEQ ID NO: 44821 - DNA, 25 bp, mus musculus
tgggcagctcaccgctgctaaggag

SEQ ID NO: 44822 - DNA, 25 bp, mus musculus
ggcagctcaccgctgctaaggagga

SEQ ID NO: 44823 - DNA, 25 bp, mus musculus
cagctcaccgctgctaaggaggagt

SEQ ID NO: 44824 - DNA, 25 bp, mus musculus
gctcaccgctgctaaggaggagtct

SEQ ID NO: 44825 - DNA, 25 bp, mus musculus
tctgaccagaacacctgtgtttctc

SEQ ID NO: 44826 - DNA, 25 bp, mus musculus
gaacacctgtgtttctctgtttcta

SEQ ID NO: 44827 - DNA, 25 bp, mus musculus
gaccacaatgttgtgaccggagccc

SEQ ID NO: 44828 - DNA, 25 bp, mus musculus
ccacaatgttgtgaccggagccctg

SEQ ID NO: 44829 - DNA, 25 bp, mus musculus
tgttgtgaccggagccctggagctg

SEQ ID NO: 44830 - DNA, 25 bp, mus musculus
ttgtgaccggagccctggagctgtt

SEQ ID NO: 44831 - DNA, 25 bp, mus musculus
gaccggagccctggagctgttgcag

SEQ ID NO: 44832 - DNA, 25 bp, mus musculus
ggagccctggagctgttgcagcagc

SEQ ID NO: 44833 - DNA, 25 bp, mus musculus
caggtcctcctggatattgtgattc

SEQ ID NO: 44834 - DNA, 25 bp, mus musculus
gtgattcatcccagtgtgccagcat

SEQ ID NO: 44835 - DNA, 25 bp, mus musculus
ggatctcgtggcgatccaacatttt

SEQ ID NO: 44836 - DNA, 25 bp, mus musculus
gatccaacattttcggttctgtatt

SEQ ID NO: 44837 - DNA, 25 bp, mus musculus
ttctaaagcacaaaacactttccat

SEQ ID NO: 44838 - DNA, 25 bp, mus musculus
agcacaaaacactttccataattag

SEQ ID NO: 44839 - DNA, 25 bp, mus musculus
ctcctgtatttctggatttgccaaa

SEQ ID NO: 44840 - DNA, 25 bp, mus musculus
tggatttgccaaaccacaccattaa

SEQ ID NO: 44841 - DNA, 25 bp, mus musculus
ccattaacttctctacaactctttg

SEQ ID NO: 44842 - DNA, 25 bp, mus musculus
attatttctgcaatccaatctacat

SEQ ID NO: 44843 - DNA, 25 bp, mus musculus
tctgcaatccaatctacatataata

SEQ ID NO: 44844 - DNA, 25 bp, mus musculus
atccaatctacatataatagcaaac

SEQ ID NO: 44845 - DNA, 25 bp, mus musculus
catcccagtgtgccagcatcccgta

SEQ ID NO: 44846 - DNA, 25 bp, mus musculus
agtgtgccagcatcccgtacaatgg

SEQ ID NO: 44847 - DNA, 25 bp, mus musculus
ccagcatcccgtacaatgggcaagg

SEQ ID NO: 44848 - DNA, 25 bp, mus musculus
tcccgtacaatgggcaaggctatcc

SEQ ID NO: 44849 - DNA, 25 bp, mus musculus
gctatccaggtatgttgctgccatc

SEQ ID NO: 44850 - DNA, 25 bp, mus musculus
tgttgctgccatcataaggactcca

SEQ ID NO: 44851 - DNA, 25 bp, mus musculus
tgccatcataaggactccagtttcc

SEQ ID NO: 44852 - DNA, 25 bp, mus musculus
agatagggatctcgtggcgatccaa

SEQ ID NO: 44853 - DNA, 25 bp, mus musculus
ctgcttctgttttgaatccctatgt

SEQ ID NO: 44854 - DNA, 25 bp, mus musculus
cttctgttttgaatccctatgtgaa

SEQ ID NO: 44855 - DNA, 25 bp, mus musculus
tgatgagtgtccatcgcggagaggt

SEQ ID NO: 44856 - DNA, 25 bp, mus musculus
tgagtgtccatcgcggagaggtacc

SEQ ID NO: 44857 - DNA, 25 bp, mus musculus
taccttgcacagtgacctctgcatc

SEQ ID NO: 44858 - DNA, 25 bp, mus musculus
cttgcacagtgacctctgcatctcc

SEQ ID NO: 44859 - DNA, 25 bp, mus musculus
gcacagtgacctctgcatctccttt

SEQ ID NO: 44860 - DNA, 25 bp, mus musculus
ctgcatctcctttagaagaagccac

SEQ ID NO: 44861 - DNA, 25 bp, mus musculus
tagaagaagccacactctctgaatt

SEQ ID NO: 44862 - DNA, 25 bp, mus musculus
ctgtcctcaagagcttcctaagtca

SEQ ID NO: 44863 - DNA, 25 bp, mus musculus
tcctcaagagcttcctaagtcaagg

SEQ ID NO: 44864 - DNA, 25 bp, mus musculus
tcaagagcttcctaagtcaaggcca

SEQ ID NO: 44865 - DNA, 25 bp, mus musculus
atccctatgtgaagcgttccattaa

SEQ ID NO: 44866 - DNA, 25 bp, mus musculus
gcttcctaagtcaaggccaagtatt

SEQ ID NO: 44867 - DNA, 25 bp, mus musculus
gcctaaatgacatcacagcaaaaga

SEQ ID NO: 44868 - DNA, 25 bp, mus musculus
ctaccaacctgatcaatttgcttgc

SEQ ID NO: 44869 - DNA, 25 bp, mus musculus
acctgatcaatttgcttgctgaaaa

SEQ ID NO: 44870 - DNA, 25 bp, mus musculus
tcaatttgcttgctgaaaatggtcg

SEQ ID NO: 44871 - DNA, 25 bp, mus musculus
gattaagcaatacccaaggagtcgt

SEQ ID NO: 44872 - DNA, 25 bp, mus musculus
gcaatacccaaggagtcgtttctgc

SEQ ID NO: 44873 - DNA, 25 bp, mus musculus
ccttttctaccatgatgagtgtcca

SEQ ID NO: 44874 - DNA, 25 bp, mus musculus
gatctgggccaatgtcatcttgtta

SEQ ID NO: 44875 - DNA, 25 bp, mus musculus
caatgtcatcttgttatacagaagc

SEQ ID NO: 44876 - DNA, 25 bp, mus musculus
gggcaatctttcttcctgacgaatc

SEQ ID NO: 44877 - DNA, 25 bp, mus musculus
tctttcttcctgacgaatcaatctg

SEQ ID NO: 44878 - DNA, 25 bp, mus musculus
ttcttcctgacgaatcaatctggcc

SEQ ID NO: 44879 - DNA, 25 bp, mus musculus
aatcaatctggccacagaaatcata

SEQ ID NO: 44880 - DNA, 25 bp, mus musculus
cataaaatccacatatgctgtacaa

SEQ ID NO: 44881 - DNA, 25 bp, mus musculus
atatgctgtacaagcctctttatag

SEQ ID NO: 44882 - DNA, 25 bp, mus musculus
tgctgtacaagcctctttatagatt

SEQ ID NO: 44883 - DNA, 25 bp, mus musculus
tgtacaagcctctttatagattcca

SEQ ID NO: 44884 - DNA, 25 bp, mus musculus
ctctttatagattccagtgcattca

SEQ ID NO: 44885 - DNA, 25 bp, mus musculus
tttatagattccagtgcattcatag

SEQ ID NO: 44886 - DNA, 25 bp, mus musculus
tggatcatttcgatcttcaggttta

SEQ ID NO: 44887 - DNA, 25 bp, mus musculus
atcatttcgatcttcaggtttagcc

SEQ ID NO: 44888 - DNA, 25 bp, mus musculus
tcgatcttcaggtttagccgtagca

SEQ ID NO: 44889 - DNA, 25 bp, mus musculus
ttcaggtttagccgtagcattggca

SEQ ID NO: 44890 - DNA, 25 bp, mus musculus
tttagccgtagcattggcaatttct

SEQ ID NO: 44891 - DNA, 25 bp, mus musculus
tttattcatttccaaagcaagctgg

SEQ ID NO: 44892 - DNA, 25 bp, mus musculus
catttccaaagcaagctggttttca

SEQ ID NO: 44893 - DNA, 25 bp, mus musculus
ctggttttcatcgatgggcaatctt

SEQ ID NO: 44894 - DNA, 25 bp, mus musculus
gatgtccccgttaagaaaatgcagc

SEQ ID NO: 44895 - DNA, 25 bp, mus musculus
atgcagctgctcgcctcttccagag

SEQ ID NO: 44896 - DNA, 25 bp, mus musculus
cggctgtggccttgatgctttcgta

SEQ ID NO: 44897 - DNA, 25 bp, mus musculus
ctgtggccttgatgctttcgtatct

SEQ ID NO: 44898 - DNA, 25 bp, mus musculus
ccttgatgctttcgtatcttatctg

SEQ ID NO: 44899 - DNA, 25 bp, mus musculus
tgatgctttcgtatcttatctgtag

SEQ ID NO: 44900 - DNA, 25 bp, mus musculus
tgctttcgtatcttatctgtagaga

SEQ ID NO: 44901 - DNA, 25 bp, mus musculus
cttgttctatacaaacacggccttg

SEQ ID NO: 44902 - DNA, 25 bp, mus musculus
cttgccttctagactcagcttttaa

SEQ ID NO: 44903 - DNA, 25 bp, mus musculus
gccttctagactcagcttttaacca

SEQ ID NO: 44904 - DNA, 25 bp, mus musculus
ttctagactcagcttttaaccaggg

SEQ ID NO: 44905 - DNA, 25 bp, mus musculus
tagactcagcttttaaccagggaca

SEQ ID NO: 44906 - DNA, 25 bp, mus musculus
tcttccagagcaccaccatctaagg

SEQ ID NO: 44907 - DNA, 25 bp, mus musculus
tccagagcaccaccatctaaggtca

SEQ ID NO: 44908 - DNA, 25 bp, mus musculus
cagtttaacccctgtgagcctcagt

SEQ ID NO: 44909 - DNA, 25 bp, mus musculus
attgcactagatcatgtcttgacag

SEQ ID NO: 44910 - DNA, 25 bp, mus musculus
ctagatcatgtcttgacaggtcctg

SEQ ID NO: 44911 - DNA, 25 bp, mus musculus
catgtcttgacaggtcctgagattc

SEQ ID NO: 44912 - DNA, 25 bp, mus musculus
gtcttgacaggtcctgagattcctc

SEQ ID NO: 44913 - DNA, 25 bp, mus musculus
cctgagattcctcggctgtggcctt

SEQ ID NO: 44914 - DNA, 25 bp, mus musculus
atcattgggccctgggtgatggctc

SEQ ID NO: 44915 - DNA, 25 bp, mus musculus
cattgggccctgggtgatggctctg

SEQ ID NO: 44916 - DNA, 25 bp, mus musculus
gccgttgccatgttgacggtgagag

SEQ ID NO: 44917 - DNA, 25 bp, mus musculus
gccatgttgacggtgagaggcatca

SEQ ID NO: 44918 - DNA, 25 bp, mus musculus
ccggttcatcattggcttcagcgca

SEQ ID NO: 44919 - DNA, 25 bp, mus musculus
gcttcagcgcacccatgtccatcgt

SEQ ID NO: 44920 - DNA, 25 bp, mus musculus
acccatgtccatcgttgctgtcagt

SEQ ID NO: 44921 - DNA, 25 bp, mus musculus
ccatgtccatcgttgctgtcagtta

SEQ ID NO: 44922 - DNA, 25 bp, mus musculus
atgtccatcgttgctgtcagttatg

SEQ ID NO: 44923 - DNA, 25 bp, mus musculus
atcgttgctgtcagttatgggctta

SEQ ID NO: 44924 - DNA, 25 bp, mus musculus
cgttgctgtcagttatgggcttatt

SEQ ID NO: 44925 - DNA, 25 bp, mus musculus
ttgctgtcagttatgggcttattgc

SEQ ID NO: 44926 - DNA, 25 bp, mus musculus
gggccctgggtgatggctctgctcc

SEQ ID NO: 44927 - DNA, 25 bp, mus musculus
tgatggctctgctcctcacattgcc

SEQ ID NO: 44928 - DNA, 25 bp, mus musculus
ctctgctcctcacattgccagttat

SEQ ID NO: 44929 - DNA, 25 bp, mus musculus
ctgctcctcacattgccagttatca

SEQ ID NO: 44930 - DNA, 25 bp, mus musculus
tcattcgtgtgactacagtacctgg

SEQ ID NO: 44931 - DNA, 25 bp, mus musculus
tcgtgtgactacagtacctggtaaa

SEQ ID NO: 44932 - DNA, 25 bp, mus musculus
gacagtagcctgcacttttaacttt

SEQ ID NO: 44933 - DNA, 25 bp, mus musculus
taaatgtggccgttgccatgttgac

SEQ ID NO: 44934 - DNA, 25 bp, mus musculus
agagctcaacccagacacctgtagg

SEQ ID NO: 44935 - DNA, 25 bp, mus musculus
gtgacaagctgctttccagactcca

SEQ ID NO: 44936 - DNA, 25 bp, mus musculus
atctcccagagctgccatctaacaa

SEQ ID NO: 44937 - DNA, 25 bp, mus musculus
cagagctgccatctaacaattgtca

SEQ ID NO: 44938 - DNA, 25 bp, mus musculus
tgccatctaacaattgtcaaggaac

SEQ ID NO: 44939 - DNA, 25 bp, mus musculus
aaggaacctcatgtctcacctcagg

SEQ ID NO: 44940 - DNA, 25 bp, mus musculus
cctcatgtctcacctcaggggccag

SEQ ID NO: 44941 - DNA, 25 bp, mus musculus
gtctcacctcaggggccagggtact

SEQ ID NO: 44942 - DNA, 25 bp, mus musculus
cctcaggggccagggtactctctca

SEQ ID NO: 44943 - DNA, 25 bp, mus musculus
tctctcacttaaccaccctggtcaa

SEQ ID NO: 44944 - DNA, 25 bp, mus musculus
ccaccctggtcaagtgagcatcttc

SEQ ID NO: 44945 - DNA, 25 bp, mus musculus
acactcacactctgataaaagagat

SEQ ID NO: 44946 - DNA, 25 bp, mus musculus
agctgctttccagactccacgggcc

SEQ ID NO: 44947 - DNA, 25 bp, mus musculus
tttccagactccacgggcccggctg

SEQ ID NO: 44948 - DNA, 25 bp, mus musculus
gcttttatggccctgcttcacaggg

SEQ ID NO: 44949 - DNA, 25 bp, mus musculus
atggccctgcttcacagggagaaga

SEQ ID NO: 44950 - DNA, 25 bp, mus musculus
ctgcttcacagggagaagagtggag

SEQ ID NO: 44951 - DNA, 25 bp, mus musculus
gcacaggcgaacctcctcagtctgg

SEQ ID NO: 44952 - DNA, 25 bp, mus musculus
tagagagctctctcgccatctttta

SEQ ID NO: 44953 - DNA, 25 bp, mus musculus
tcgccatcttttatctcccagagct

SEQ ID NO: 44954 - DNA, 25 bp, mus musculus
tgccttcctggatttcctggtccag

SEQ ID NO: 44955 - DNA, 25 bp, mus musculus
cctggatttcctggtccaggtgaga

SEQ ID NO: 44956 - DNA, 25 bp, mus musculus
ctgtcctgctggaattgaaacagca

SEQ ID NO: 44957 - DNA, 25 bp, mus musculus
ccaagaagcctggcttcttgaccaa

SEQ ID NO: 44958 - DNA, 25 bp, mus musculus
agcctggcttcttgaccaaccgtct

SEQ ID NO: 44959 - DNA, 25 bp, mus musculus
gcttcttgaccaaccgtctctgcta

SEQ ID NO: 44960 - DNA, 25 bp, mus musculus
accgtctctgctatcatagggacca

SEQ ID NO: 44961 - DNA, 25 bp, mus musculus
tctgctatcatagggaccatctggc

SEQ ID NO: 44962 - DNA, 25 bp, mus musculus
atcatagggaccatctggctgagcc

SEQ ID NO: 44963 - DNA, 25 bp, mus musculus
ctgagccacagcccacaaagatgcc

SEQ ID NO: 44964 - DNA, 25 bp, mus musculus
cgggacctcgcagatgcacttaata

SEQ ID NO: 44965 - DNA, 25 bp, mus musculus
ctcgcagatgcacttaataaggatc

SEQ ID NO: 44966 - DNA, 25 bp, mus musculus
ccaggactgcttctggaaggagctc

SEQ ID NO: 44967 - DNA, 25 bp, mus musculus
cacagacctgggcctgcagctggcc

SEQ ID NO: 44968 - DNA, 25 bp, mus musculus
gctggccaacttctttgcttttgtc

SEQ ID NO: 44969 - DNA, 25 bp, mus musculus
caacttctttgcttttgtcaacagc

SEQ ID NO: 44970 - DNA, 25 bp, mus musculus
ctttgcttttgtcaacagctgcctg

SEQ ID NO: 44971 - DNA, 25 bp, mus musculus
ttttgtcaacagctgcctgaaccca

SEQ ID NO: 44972 - DNA, 25 bp, mus musculus
ctgcctgaacccactgatttatgtc

SEQ ID NO: 44973 - DNA, 25 bp, mus musculus
actgatttatgtctttgcaggccgg

SEQ ID NO: 44974 - DNA, 25 bp, mus musculus
ctgagcagcttcacaaagggtggca

SEQ ID NO: 44975 - DNA, 25 bp, mus musculus
agcttcacaaagggtggcaaaggat

SEQ ID NO: 44976 - DNA, 25 bp, mus musculus
ttgtctctcttcttatccccagagt

SEQ ID NO: 44977 - DNA, 25 bp, mus musculus
ctgtgtcctcactgtgaatgtcgac

SEQ ID NO: 44978 - DNA, 25 bp, mus musculus
cctcactgtgaatgtcgacagacca

SEQ ID NO: 44979 - DNA, 25 bp, mus musculus
tgtcgacagaccaatccttgatgtc

SEQ ID NO: 44980 - DNA, 25 bp, mus musculus
cagaccaatccttgatgtcccctga

SEQ ID NO: 44981 - DNA, 25 bp, mus musculus
aatccttgatgtcccctgaacagac

SEQ ID NO: 44982 - DNA, 25 bp, mus musculus
tgatgtcccctgaacagacacaccc

SEQ ID NO: 44983 - DNA, 25 bp, mus musculus
gccgctgctatcatcaccagaaata

SEQ ID NO: 44984 - DNA, 25 bp, mus musculus
gctatcatcaccagaaataaacaca

SEQ ID NO: 44985 - DNA, 25 bp, mus musculus
atcaccagaaataaacacactctgt

SEQ ID NO: 44986 - DNA, 25 bp, mus musculus
ttggaccaggcaccctcaggaccca

SEQ ID NO: 44987 - DNA, 25 bp, mus musculus
tcctgcccggactgtgaactcatct

SEQ ID NO: 44988 - DNA, 25 bp, mus musculus
tgtgaactcatctcctcgaagccat

SEQ ID NO: 44989 - DNA, 25 bp, mus musculus
ctcatctcctcgaagccataatgtc

SEQ ID NO: 44990 - DNA, 25 bp, mus musculus
tcctcgaagccataatgtccgagcg

SEQ ID NO: 44991 - DNA, 25 bp, mus musculus
aagccataatgtccgagcggctggt

SEQ ID NO: 44992 - DNA, 25 bp, mus musculus
gcagcaggcccagctccctgtttca

SEQ ID NO: 44993 - DNA, 25 bp, mus musculus
ggcccagctccctgtttcagggtgg

SEQ ID NO: 44994 - DNA, 25 bp, mus musculus
aactgccccaaagcaatgaagaggc

SEQ ID NO: 44995 - DNA, 25 bp, mus musculus
aggctggtagctgactgtgtgaaga

SEQ ID NO: 44996 - DNA, 25 bp, mus musculus
tccgagccatccttgcatcgggcag

SEQ ID NO: 44997 - DNA, 25 bp, mus musculus
gcagcccacactgaggatatcaatg

SEQ ID NO: 44998 - DNA, 25 bp, mus musculus
gatatcaatgcttgcacgctgacca

SEQ ID NO: 44999 - DNA, 25 bp, mus musculus
aggctgcctgtcttctagttgactt

SEQ ID NO: 45000 - DNA, 25 bp, mus musculus
ctgcctgtcttctagttgactttgc

SEQ ID NO: 45001 - DNA, 25 bp, mus musculus
ttctagttgactttgcacctgtctt

SEQ ID NO: 45002 - DNA, 25 bp, mus musculus
tagttgactttgcacctgtcttcag

SEQ ID NO: 45003 - DNA, 25 bp, mus musculus
actttgcacctgtcttcaggctgcc

SEQ ID NO: 45004 - DNA, 25 bp, mus musculus
cacctgtcttcaggctgccagggga

SEQ ID NO: 45005 - DNA, 25 bp, mus musculus
agaagccagcaggcaccacttttct

SEQ ID NO: 45006 - DNA, 25 bp, mus musculus
tttccccagatcctgtcttccattg

SEQ ID NO: 45007 - DNA, 25 bp, mus musculus
ccccagatcctgtcttccattgagc

SEQ ID NO: 45008 - DNA, 25 bp, mus musculus
ctgtcttccattgagctgctccaac

SEQ ID NO: 45009 - DNA, 25 bp, mus musculus
tcttccattgagctgctccaacact

SEQ ID NO: 45010 - DNA, 25 bp, mus musculus
tccattgagctgctccaacactctc

SEQ ID NO: 45011 - DNA, 25 bp, mus musculus
ctaccgaagatcaaccggagcgctt

SEQ ID NO: 45012 - DNA, 25 bp, mus musculus
atcaaccggagcgcttccgagccat

SEQ ID NO: 45013 - DNA, 25 bp, mus musculus
gcttccgagccatccttgcatcggg

SEQ ID NO: 45014 - DNA, 25 bp, mus musculus
tgtatctataggtctttttgatggg

SEQ ID NO: 45015 - DNA, 25 bp, mus musculus
atctataggtctttttgatgggctg

SEQ ID NO: 45016 - DNA, 25 bp, mus musculus
aacacacttatgtgttgggaagagg

SEQ ID NO: 45017 - DNA, 25 bp, mus musculus
cacacttatgtgttgggaagaggaa

SEQ ID NO: 45018 - DNA, 25 bp, mus musculus
acacttatgtgttgggaagaggaat

SEQ ID NO: 45019 - DNA, 25 bp, mus musculus
agttattttacatagtcctgaagag

SEQ ID NO: 45020 - DNA, 25 bp, mus musculus
gttattttacatagtcctgaagagc

SEQ ID NO: 45021 - DNA, 25 bp, mus musculus
ttattttacatagtcctgaagagct

SEQ ID NO: 45022 - DNA, 25 bp, mus musculus
attttacatagtcctgaagagctaa

SEQ ID NO: 45023 - DNA, 25 bp, mus musculus
ttttacatagtcctgaagagctaaa

SEQ ID NO: 45024 - DNA, 25 bp, mus musculus
tacatagtcctgaagagctaaagac

SEQ ID NO: 45025 - DNA, 25 bp, mus musculus
acatagtcctgaagagctaaagaca

SEQ ID NO: 45026 - DNA, 25 bp, mus musculus
tctataggtctttttgatgggctga

SEQ ID NO: 45027 - DNA, 25 bp, mus musculus
tctttttgatgggctgaacatagaa

SEQ ID NO: 45028 - DNA, 25 bp, mus musculus
atagaagcaaacacacttatgtgtt

SEQ ID NO: 45029 - DNA, 25 bp, mus musculus
tagaagcaaacacacttatgtgttg

SEQ ID NO: 45030 - DNA, 25 bp, mus musculus
gaagcaaacacacttatgtgttggg

SEQ ID NO: 45031 - DNA, 25 bp, mus musculus
aagcaaacacacttatgtgttggga

SEQ ID NO: 45032 - DNA, 25 bp, mus musculus
agcaaacacacttatgtgttgggaa

SEQ ID NO: 45033 - DNA, 25 bp, mus musculus
caaacacacttatgtgttgggaaga

SEQ ID NO: 45034 - DNA, 25 bp, mus musculus
atttatgacatacaaaactgacttg

SEQ ID NO: 45035 - DNA, 25 bp, mus musculus
atgacatacaaaactgacttgctcc

SEQ ID NO: 45036 - DNA, 25 bp, mus musculus
acttgctcctagcattgaacattgc

SEQ ID NO: 45037 - DNA, 25 bp, mus musculus
cttgctcctagcattgaacattgct

SEQ ID NO: 45038 - DNA, 25 bp, mus musculus
ttgctcctagcattgaacattgcta

SEQ ID NO: 45039 - DNA, 25 bp, mus musculus
tgctcctagcattgaacattgctaa

SEQ ID NO: 45040 - DNA, 25 bp, mus musculus
gctcctagcattgaacattgctaaa

SEQ ID NO: 45041 - DNA, 25 bp, mus musculus
ctcctagcattgaacattgctaaaa

SEQ ID NO: 45042 - DNA, 25 bp, mus musculus
tcctagcattgaacattgctaaaaa

SEQ ID NO: 45043 - DNA, 25 bp, mus musculus
tgacatacaaaactgacttgctcct

SEQ ID NO: 45044 - DNA, 25 bp, mus musculus
acatacaaaactgacttgctcctag

SEQ ID NO: 45045 - DNA, 25 bp, mus musculus
catacaaaactgacttgctcctagc

SEQ ID NO: 45046 - DNA, 25 bp, mus musculus
atacaaaactgacttgctcctagca

SEQ ID NO: 45047 - DNA, 25 bp, mus musculus
tacaaaactgacttgctcctagcat

SEQ ID NO: 45048 - DNA, 25 bp, mus musculus
aaactgacttgctcctagcattgaa

SEQ ID NO: 45049 - DNA, 25 bp, mus musculus
aactgacttgctcctagcattgaac

SEQ ID NO: 45050 - DNA, 25 bp, mus musculus
actgacttgctcctagcattgaaca

SEQ ID NO: 45051 - DNA, 25 bp, mus musculus
ttcacgagcagttggtcacttacga

SEQ ID NO: 45052 - DNA, 25 bp, mus musculus
acaccaccagctatgatgtgtcagt

SEQ ID NO: 45053 - DNA, 25 bp, mus musculus
tgagcaccaattcctccgactctga

SEQ ID NO: 45054 - DNA, 25 bp, mus musculus
cctccgactctgacatcgattatga

SEQ ID NO: 45055 - DNA, 25 bp, mus musculus
attatgacttcctcaacgactgggg

SEQ ID NO: 45056 - DNA, 25 bp, mus musculus
acggctcagatccccaggaggaact

SEQ ID NO: 45057 - DNA, 25 bp, mus musculus
cagatccccaggaggaactcatcat

SEQ ID NO: 45058 - DNA, 25 bp, mus musculus
aggaactcatcatctagggttctgg

SEQ ID NO: 45059 - DNA, 25 bp, mus musculus
ccaacctcattgcaacctggatcag

SEQ ID NO: 45060 - DNA, 25 bp, mus musculus
caacctggatcagacaccggacact

SEQ ID NO: 45061 - DNA, 25 bp, mus musculus
ccctgatttccaaggagtgacacca

SEQ ID NO: 45062 - DNA, 25 bp, mus musculus
tttccaaggagtgacaccagactct

SEQ ID NO: 45063 - DNA, 25 bp, mus musculus
tgtcagtgcttaattctgtgcgcgg

SEQ ID NO: 45064 - DNA, 25 bp, mus musculus
attctgtgcgcggtggctccactaa

SEQ ID NO: 45065 - DNA, 25 bp, mus musculus
agatggccaccatgatcgacgtgaa

SEQ ID NO: 45066 - DNA, 25 bp, mus musculus
ccaccatgatcgacgtgaagaaaga

SEQ ID NO: 45067 - DNA, 25 bp, mus musculus
catacgacacactgcacatctacgg

SEQ ID NO: 45068 - DNA, 25 bp, mus musculus
tgcacatctacggctacgagggcgc

SEQ ID NO: 45069 - DNA, 25 bp, mus musculus
tctacggctacgagggcgcagagtc

SEQ ID NO: 45070 - DNA, 25 bp, mus musculus
gttccctgagcaccaattcctccga

SEQ ID NO: 45071 - DNA, 25 bp, mus musculus
ctgggcatgctcagctggacataca

SEQ ID NO: 45072 - DNA, 25 bp, mus musculus
tgggcatgctcagctggacatacag

SEQ ID NO: 45073 - DNA, 25 bp, mus musculus
gctgtactcccttacattatgcagc

SEQ ID NO: 45074 - DNA, 25 bp, mus musculus
ctgtactcccttacattatgcagct

SEQ ID NO: 45075 - DNA, 25 bp, mus musculus
tgtactcccttacattatgcagctt

SEQ ID NO: 45076 - DNA, 25 bp, mus musculus
gtactcccttacattatgcagcttc

SEQ ID NO: 45077 - DNA, 25 bp, mus musculus
tactcccttacattatgcagcttcg

SEQ ID NO: 45078 - DNA, 25 bp, mus musculus
tcccttacattatgcagcttcgaaa

SEQ ID NO: 45079 - DNA, 25 bp, mus musculus
cccttacattatgcagcttcgaaaa

SEQ ID NO: 45080 - DNA, 25 bp, mus musculus
ccttacattatgcagcttcgaaaaa

SEQ ID NO: 45081 - DNA, 25 bp, mus musculus
ttacattatgcagcttcgaaaaaca

SEQ ID NO: 45082 - DNA, 25 bp, mus musculus
gatcgctgtcatgttactggaaggc

SEQ ID NO: 45083 - DNA, 25 bp, mus musculus
gggcatgctcagctggacatacaga

SEQ ID NO: 45084 - DNA, 25 bp, mus musculus
ggcatgctcagctggacatacagaa

SEQ ID NO: 45085 - DNA, 25 bp, mus musculus
catgctcagctggacatacagaaat

SEQ ID NO: 45086 - DNA, 25 bp, mus musculus
atgctcagctggacatacagaaatt

SEQ ID NO: 45087 - DNA, 25 bp, mus musculus
aaatggctgtactcccttacattat

SEQ ID NO: 45088 - DNA, 25 bp, mus musculus
aatggctgtactcccttacattatg

SEQ ID NO: 45089 - DNA, 25 bp, mus musculus
tggctgtactcccttacattatgca

SEQ ID NO: 45090 - DNA, 25 bp, mus musculus
ggctgtactcccttacattatgcag

SEQ ID NO: 45091 - DNA, 25 bp, mus musculus
tctgaagtccatagtgtcagattat

SEQ ID NO: 45092 - DNA, 25 bp, mus musculus
agattatcacgtaacaactgcatga

SEQ ID NO: 45093 - DNA, 25 bp, mus musculus
tcaaaagctgcttttgccaacctgc

SEQ ID NO: 45094 - DNA, 25 bp, mus musculus
gctgcttttgccaacctgcaggcac

SEQ ID NO: 45095 - DNA, 25 bp, mus musculus
tttgccaacctgcaggcacggtcag

SEQ ID NO: 45096 - DNA, 25 bp, mus musculus
aacctgcaggcacggtcaggggaat

SEQ ID NO: 45097 - DNA, 25 bp, mus musculus
cgaataggatgcgttggtggaagtt

SEQ ID NO: 45098 - DNA, 25 bp, mus musculus
tctgtcattgcaatatcactagcag

SEQ ID NO: 45099 - DNA, 25 bp, mus musculus
attgcaatatcactagcagctttat

SEQ ID NO: 45100 - DNA, 25 bp, mus musculus
atatcactagcagctttataagcca

SEQ ID NO: 45101 - DNA, 25 bp, mus musculus
gctttataagccactaggctgttct

SEQ ID NO: 45102 - DNA, 25 bp, mus musculus
taagccactaggctgttctccgcag

SEQ ID NO: 45103 - DNA, 25 bp, mus musculus
tcacgtaacaactgcatgataagtg

SEQ ID NO: 45104 - DNA, 25 bp, mus musculus
tccttatagctttcttcactcagcg

SEQ ID NO: 45105 - DNA, 25 bp, mus musculus
tagctttcttcactcagcgtatcca

SEQ ID NO: 45106 - DNA, 25 bp, mus musculus
tcttcactcagcgtatccagttctg

SEQ ID NO: 45107 - DNA, 25 bp, mus musculus
ctcagcgtatccagttctgcaattg

SEQ ID NO: 45108 - DNA, 25 bp, mus musculus
gtatccagttctgcaattgcatcat

SEQ ID NO: 45109 - DNA, 25 bp, mus musculus
agttctgcaattgcatcatcaaaag

SEQ ID NO: 45110 - DNA, 25 bp, mus musculus
gcatcatcaaaagctgcttttgcca

SEQ ID NO: 45111 - DNA, 25 bp, mus musculus
cgtgtcggcccagaatggtgacttc

SEQ ID NO: 45112 - DNA, 25 bp, mus musculus
caattacatccgcagcttgatccgc

SEQ ID NO: 45113 - DNA, 25 bp, mus musculus
aaggtcatctgctgtcaggggcaag

SEQ ID NO: 45114 - DNA, 25 bp, mus musculus
atctgctgtcaggggcaagttggat

SEQ ID NO: 45115 - DNA, 25 bp, mus musculus
gccaggatccctggtagatggatgg

SEQ ID NO: 45116 - DNA, 25 bp, mus musculus
atccctggtagatggatggccctct

SEQ ID NO: 45117 - DNA, 25 bp, mus musculus
ttcgctcaggcctctagtaatctaa

SEQ ID NO: 45118 - DNA, 25 bp, mus musculus
caggcctctagtaatctaagggtca

SEQ ID NO: 45119 - DNA, 25 bp, mus musculus
gcaagcccggacatctatgcagcat

SEQ ID NO: 45120 - DNA, 25 bp, mus musculus
ccggacatctatgcagcatttgtgt

SEQ ID NO: 45121 - DNA, 25 bp, mus musculus
atctatgcagcatttgtgttcccag

SEQ ID NO: 45122 - DNA, 25 bp, mus musculus
gcagcatttgtgttcccaggagtgc

SEQ ID NO: 45123 - DNA, 25 bp, mus musculus
tgcggaccccagtgaacacatgtat

SEQ ID NO: 45124 - DNA, 25 bp, mus musculus
cagcatttgtgttcccaggagtgcc

SEQ ID NO: 45125 - DNA, 25 bp, mus musculus
tgaacacatgtatgctcctaaatac

SEQ ID NO: 45126 - DNA, 25 bp, mus musculus
catgtatgctcctaaatacctgctc

SEQ ID NO: 45127 - DNA, 25 bp, mus musculus
ctatgaccagttccgctacttgctg

SEQ ID NO: 45128 - DNA, 25 bp, mus musculus
ccagttccgctacttgctggaaaat

SEQ ID NO: 45129 - DNA, 25 bp, mus musculus
tccctaccgggagcccaagagcact

SEQ ID NO: 45130 - DNA, 25 bp, mus musculus
gcgccagaaccagggctcagatgga

SEQ ID NO: 45131 - DNA, 25 bp, mus musculus
gaaccagggctcagatggaaggtca

SEQ ID NO: 45132 - DNA, 25 bp, mus musculus
taattggcttcgcaaggagagatca

SEQ ID NO: 45133 - DNA, 25 bp, mus musculus
atggagacagcttcccctttgatgg

SEQ ID NO: 45134 - DNA, 25 bp, mus musculus
tgatgtaccctacctatcaaagaga

SEQ ID NO: 45135 - DNA, 25 bp, mus musculus
actactcagaagacttcagtcttac

SEQ ID NO: 45136 - DNA, 25 bp, mus musculus
acgacattgcaggcattcagaagtt

SEQ ID NO: 45137 - DNA, 25 bp, mus musculus
cattgcatccctcagctggcatgaa

SEQ ID NO: 45138 - DNA, 25 bp, mus musculus
atccctcagctggcatgaacaaatg

SEQ ID NO: 45139 - DNA, 25 bp, mus musculus
gcatgaacaaatgcccttcctgagc

SEQ ID NO: 45140 - DNA, 25 bp, mus musculus
ccctcttccttgtgctgtggatgga

SEQ ID NO: 45141 - DNA, 25 bp, mus musculus
agggtcatcttgacggaatgattct

SEQ ID NO: 45142 - DNA, 25 bp, mus musculus
tgattctgactaatctcaggtaaca

SEQ ID NO: 45143 - DNA, 25 bp, mus musculus
tgactaatctcaggtaacatgaagt

SEQ ID NO: 45144 - DNA, 25 bp, mus musculus
acagcttcccctttgatgggccagg

SEQ ID NO: 45145 - DNA, 25 bp, mus musculus
ggaacactctaggtcatgccttcgc

SEQ ID NO: 45146 - DNA, 25 bp, mus musculus
gagtgaacttcctgtttgctgccac

SEQ ID NO: 45147 - DNA, 25 bp, mus musculus
acttcctgtttgctgccacccatga

SEQ ID NO: 45148 - DNA, 25 bp, mus musculus
tgtttgctgccacccatgaatttgg

SEQ ID NO: 45149 - DNA, 25 bp, mus musculus
aatttggccactctctgggtctgag

SEQ ID NO: 45150 - DNA, 25 bp, mus musculus
gccactctctgggtctgagtcactc

SEQ ID NO: 45151 - DNA, 25 bp, mus musculus
cttctgttcccggtactgtgatgta

SEQ ID NO: 45152 - DNA, 25 bp, mus musculus
tctaactcagatgactgctccccga

SEQ ID NO: 45153 - DNA, 25 bp, mus musculus
gactgctccccgagtctgggaggct

SEQ ID NO: 45154 - DNA, 25 bp, mus musculus
ttgtgacttgttggccattatttga

SEQ ID NO: 45155 - DNA, 25 bp, mus musculus
atgtacaaacgccttgctgcatccc

SEQ ID NO: 45156 - DNA, 25 bp, mus musculus
cttgctgcatcccgtccggtgtaca

SEQ ID NO: 45157 - DNA, 25 bp, mus musculus
gcatcccgtccggtgtacaacatcc

SEQ ID NO: 45158 - DNA, 25 bp, mus musculus
atatttgctggcaatattgaagaat

SEQ ID NO: 45159 - DNA, 25 bp, mus musculus
tttcattacaaatgtctcgatgttg

SEQ ID NO: 45160 - DNA, 25 bp, mus musculus
tacaaatgtctcgatgttggttaac

SEQ ID NO: 45161 - DNA, 25 bp, mus musculus
tgtctcgatgttggttaactaattt

SEQ ID NO: 45162 - DNA, 25 bp, mus musculus
ctaatttttgccaggaccattattg

SEQ ID NO: 45163 - DNA, 25 bp, mus musculus
tttgccaggaccattattgatcaag

SEQ ID NO: 45164 - DNA, 25 bp, mus musculus
taggcagccagatctcactgtcaag

SEQ ID NO: 45165 - DNA, 25 bp, mus musculus
gccagatctcactgtcaagtgagtg

SEQ ID NO: 45166 - DNA, 25 bp, mus musculus
tctcactgtcaagtgagtggcccca

SEQ ID NO: 45167 - DNA, 25 bp, mus musculus
gtcccctgtggctctgaagacaaat

SEQ ID NO: 45168 - DNA, 25 bp, mus musculus
tcccacactctaaagtgagcgacaa

SEQ ID NO: 45169 - DNA, 25 bp, mus musculus
aagtgagcgacaaacccgcaggagg

SEQ ID NO: 45170 - DNA, 25 bp, mus musculus
tgttcgcctctgcctattgcactgt

SEQ ID NO: 45171 - DNA, 25 bp, mus musculus
gcactgttgtgacttgttggccatt

SEQ ID NO: 45172 - DNA, 25 bp, mus musculus
tattaccccagaaagtggtggagct

SEQ ID NO: 45173 - DNA, 25 bp, mus musculus
ttaccccagaaagtggtggagctgg

SEQ ID NO: 45174 - DNA, 25 bp, mus musculus
atagagccaaaccgggatcagctgg

SEQ ID NO: 45175 - DNA, 25 bp, mus musculus
agagccaaaccgggatcagctggaa

SEQ ID NO: 45176 - DNA, 25 bp, mus musculus
agccaaaccgggatcagctggaaag

SEQ ID NO: 45177 - DNA, 25 bp, mus musculus
aagtgtttgcagaggcccagcctga

SEQ ID NO: 45178 - DNA, 25 bp, mus musculus
gtttgcagaggcccagcctgatcat

SEQ ID NO: 45179 - DNA, 25 bp, mus musculus
ttgcagaggcccagcctgatcatta

SEQ ID NO: 45180 - DNA, 25 bp, mus musculus
agaggcccagcctgatcattataga

SEQ ID NO: 45181 - DNA, 25 bp, mus musculus
aggcccagcctgatcattatagagc

SEQ ID NO: 45182 - DNA, 25 bp, mus musculus
agagccaagaacagcagctggcttt

SEQ ID NO: 45183 - DNA, 25 bp, mus musculus
ccaagaacagcagctggctttggag

SEQ ID NO: 45184 - DNA, 25 bp, mus musculus
ggatgacaccagacaggacaggagc

SEQ ID NO: 45185 - DNA, 25 bp, mus musculus
atgacaccagacaggacaggagcaa

SEQ ID NO: 45186 - DNA, 25 bp, mus musculus
gacaccagacaggacaggagcaagc

SEQ ID NO: 45187 - DNA, 25 bp, mus musculus
caggaagcaaagccccctattgata

SEQ ID NO: 45188 - DNA, 25 bp, mus musculus
ggaagcaaagccccctattgataga

SEQ ID NO: 45189 - DNA, 25 bp, mus musculus
aagcaaagccccctattgatagagc

SEQ ID NO: 45190 - DNA, 25 bp, mus musculus
gcaaagccccctattgatagagcca

SEQ ID NO: 45191 - DNA, 25 bp, mus musculus
attgatagagccaaaccgggatcag

SEQ ID NO: 45192 - DNA, 25 bp, mus musculus
acttccttgctcctggtagaaatgc

SEQ ID NO: 45193 - DNA, 25 bp, mus musculus
gcacccagacagacgctgataattc

SEQ ID NO: 45194 - DNA, 25 bp, mus musculus
gctttcacacaaatctatggaaatt

SEQ ID NO: 45195 - DNA, 25 bp, mus musculus
ttcacacaaatctatggaaattgat

SEQ ID NO: 45196 - DNA, 25 bp, mus musculus
tgatttccctctactaataattgaa

SEQ ID NO: 45197 - DNA, 25 bp, mus musculus
gaggctgtcttactgcttagactta

SEQ ID NO: 45198 - DNA, 25 bp, mus musculus
gctgtcttactgcttagacttaccc

SEQ ID NO: 45199 - DNA, 25 bp, mus musculus
ctgcttagacttaccctctgttggt

SEQ ID NO: 45200 - DNA, 25 bp, mus musculus
cttaccctctgttggtcctgtgatt

SEQ ID NO: 45201 - DNA, 25 bp, mus musculus
accctctgttggtcctgtgattgat

SEQ ID NO: 45202 - DNA, 25 bp, mus musculus
ctctgttggtcctgtgattgatggc

SEQ ID NO: 45203 - DNA, 25 bp, mus musculus
tggtcctgtgattgatggcagaggt

SEQ ID NO: 45204 - DNA, 25 bp, mus musculus
cccagacagacgctgataattcttg

SEQ ID NO: 45205 - DNA, 25 bp, mus musculus
ctgataattcttgctctgcacactg

SEQ ID NO: 45206 - DNA, 25 bp, mus musculus
cttgctctgcacactgaccacctta

SEQ ID NO: 45207 - DNA, 25 bp, mus musculus
cacactgaccaccttattgctgagt

SEQ ID NO: 45208 - DNA, 25 bp, mus musculus
atgtcacagtgtctttataaccgag

SEQ ID NO: 45209 - DNA, 25 bp, mus musculus
ctgtatttttggcttgctttcacac

SEQ ID NO: 45210 - DNA, 25 bp, mus musculus
tatttttggcttgctttcacacaaa

SEQ ID NO: 45211 - DNA, 25 bp, mus musculus
cttgctttcacacaaatctatggaa

SEQ ID NO: 45212 - DNA, 25 bp, mus musculus
attgtccagagccatgcctgaagac

SEQ ID NO: 45213 - DNA, 25 bp, mus musculus
catgcctgaagacctgatcaccaga

SEQ ID NO: 45214 - DNA, 25 bp, mus musculus
ttgtgctaccaatgctgtgaccttc

SEQ ID NO: 45215 - DNA, 25 bp, mus musculus
taccaatgctgtgaccttcagtctt

SEQ ID NO: 45216 - DNA, 25 bp, mus musculus
tgctgtgaccttcagtcttaatccc

SEQ ID NO: 45217 - DNA, 25 bp, mus musculus
gttgactctcatcctcatcttcaag

SEQ ID NO: 45218 - DNA, 25 bp, mus musculus
tctcatcctcatcttcaagggctcc

SEQ ID NO: 45219 - DNA, 25 bp, mus musculus
cctcatcttcaagggctcctgagcc

SEQ ID NO: 45220 - DNA, 25 bp, mus musculus
gggctcctgagcctcttaacattgc

SEQ ID NO: 45221 - DNA, 25 bp, mus musculus
ggctacacttttcatggctcaggat

SEQ ID NO: 45222 - DNA, 25 bp, mus musculus
acttttcatggctcaggattcatct

SEQ ID NO: 45223 - DNA, 25 bp, mus musculus
catggctcaggattcatctgaaggg

SEQ ID NO: 45224 - DNA, 25 bp, mus musculus
tgaagacctgatcaccagatgctga

SEQ ID NO: 45225 - DNA, 25 bp, mus musculus
caccagatgctgaggctgctgtcta

SEQ ID NO: 45226 - DNA, 25 bp, mus musculus
atgctgaggctgctgtctatcctgc

SEQ ID NO: 45227 - DNA, 25 bp, mus musculus
aggctgctgtctatcctgcttatga

SEQ ID NO: 45228 - DNA, 25 bp, mus musculus
ctgtctatcctgcttatgagtccca

SEQ ID NO: 45229 - DNA, 25 bp, mus musculus
atcctgcttatgagtcccattgcct

SEQ ID NO: 45230 - DNA, 25 bp, mus musculus
cttatgagtcccattgccttgtgct

SEQ ID NO: 45231 - DNA, 25 bp, mus musculus
agtcccattgccttgtgctaccaat

SEQ ID NO: 45232 - DNA, 25 bp, mus musculus
acctcctgagccatgtgtctcacaa

SEQ ID NO: 45233 - DNA, 25 bp, mus musculus
tgagccatgtgtctcacaagtcaag

SEQ ID NO: 45234 - DNA, 25 bp, mus musculus
tccaatactagcccaacagaagaca

SEQ ID NO: 45235 - DNA, 25 bp, mus musculus
gatgctgagcctcaatttgcattct

SEQ ID NO: 45236 - DNA, 25 bp, mus musculus
gctgagcctcaatttgcattctgtt

SEQ ID NO: 45237 - DNA, 25 bp, mus musculus
cctcaatttgcattctgtttgaata

SEQ ID NO: 45238 - DNA, 25 bp, mus musculus
atactatgccctaatatcacagtcc

SEQ ID NO: 45239 - DNA, 25 bp, mus musculus
ctatgccctaatatcacagtcccac

SEQ ID NO: 45240 - DNA, 25 bp, mus musculus
tgccctaatatcacagtcccacttc

SEQ ID NO: 45241 - DNA, 25 bp, mus musculus
aatatcacagtcccacttctcattt

SEQ ID NO: 45242 - DNA, 25 bp, mus musculus
ttaatcctattaatgttggggctct

SEQ ID NO: 45243 - DNA, 25 bp, mus musculus
atcctattaatgttggggctctggg

SEQ ID NO: 45244 - DNA, 25 bp, mus musculus
atgtgtctcacaagtcaagacaccc

SEQ ID NO: 45245 - DNA, 25 bp, mus musculus
tgttggggctctgggtctagaattc

SEQ ID NO: 45246 - DNA, 25 bp, mus musculus
ctcacaagtcaagacaccctgtgac

SEQ ID NO: 45247 - DNA, 25 bp, mus musculus
acaagtcaagacaccctgtgacacc

SEQ ID NO: 45248 - DNA, 25 bp, mus musculus
gacaccctgtgacaccaaggttcct

SEQ ID NO: 45249 - DNA, 25 bp, mus musculus
accctgtgacaccaaggttcctgag

SEQ ID NO: 45250 - DNA, 25 bp, mus musculus
ctcaactgtcactccaatactagcc

SEQ ID NO: 45251 - DNA, 25 bp, mus musculus
aactgtcactccaatactagcccaa

SEQ ID NO: 45252 - DNA, 25 bp, mus musculus
tgtcactccaatactagcccaacag

SEQ ID NO: 45253 - DNA, 25 bp, mus musculus
ggaagccaacttcactgtatcctca

SEQ ID NO: 45254 - DNA, 25 bp, mus musculus
agccaacttcactgtatcctcaatg

SEQ ID NO: 45255 - DNA, 25 bp, mus musculus
tccctcaggtgtccctcatcattaa

SEQ ID NO: 45256 - DNA, 25 bp, mus musculus
ctcaggtgtccctcatcattaacta

SEQ ID NO: 45257 - DNA, 25 bp, mus musculus
aggtgtccctcatcattaactatga

SEQ ID NO: 45258 - DNA, 25 bp, mus musculus
tgtccctcatcattaactatgatct

SEQ ID NO: 45259 - DNA, 25 bp, mus musculus
ccctcatcattaactatgatctccc

SEQ ID NO: 45260 - DNA, 25 bp, mus musculus
tcattaactatgatctccctaataa

SEQ ID NO: 45261 - DNA, 25 bp, mus musculus
ttaactatgatctccctaataacag

SEQ ID NO: 45262 - DNA, 25 bp, mus musculus
atgatctccctaataacagagaatt

SEQ ID NO: 45263 - DNA, 25 bp, mus musculus
atctccctaataacagagaattgta

SEQ ID NO: 45264 - DNA, 25 bp, mus musculus
tgtacatacacagaattgggagatc

SEQ ID NO: 45265 - DNA, 25 bp, mus musculus
caacttcactgtatcctcaatgcat

SEQ ID NO: 45266 - DNA, 25 bp, mus musculus
cttcactgtatcctcaatgcatgga

SEQ ID NO: 45267 - DNA, 25 bp, mus musculus
cactgtatcctcaatgcatggagac

SEQ ID NO: 45268 - DNA, 25 bp, mus musculus
tgtatcctcaatgcatggagacatg

SEQ ID NO: 45269 - DNA, 25 bp, mus musculus
gggcgccacgagtgcttatttctac

SEQ ID NO: 45270 - DNA, 25 bp, mus musculus
cgccacgagtgcttatttctacaga

SEQ ID NO: 45271 - DNA, 25 bp, mus musculus
tttctacagatgtctgggccagggg

SEQ ID NO: 45272 - DNA, 25 bp, mus musculus
ctacagatgtctgggccagggggtt

SEQ ID NO: 45273 - DNA, 25 bp, mus musculus
ttcaggcctggttcctatgtatatc

SEQ ID NO: 45274 - DNA, 25 bp, mus musculus
aggcctggttcctatgtatatcggt

SEQ ID NO: 45275 - DNA, 25 bp, mus musculus
tgatctgtggcacatcttgcttggc

SEQ ID NO: 45276 - DNA, 25 bp, mus musculus
tctgtggcacatcttgcttggcctg

SEQ ID NO: 45277 - DNA, 25 bp, mus musculus
catcttgcttggcctgtctggtgtg

SEQ ID NO: 45278 - DNA, 25 bp, mus musculus
gcttggcctgtctggtgtgcgagcc

SEQ ID NO: 45279 - DNA, 25 bp, mus musculus
gcgagccatccttcagtctctgcta

SEQ ID NO: 45280 - DNA, 25 bp, mus musculus
agccatccttcagtctctgctactc

SEQ ID NO: 45281 - DNA, 25 bp, mus musculus
gtctctgctactctttttctgtcca

SEQ ID NO: 45282 - DNA, 25 bp, mus musculus
cagatacctttacatcaagttagat

SEQ ID NO: 45283 - DNA, 25 bp, mus musculus
atacctttacatcaagttagatgag

SEQ ID NO: 45284 - DNA, 25 bp, mus musculus
cctttacatcaagttagatgaggaa

SEQ ID NO: 45285 - DNA, 25 bp, mus musculus
ggttcctatgtatatcggtgaaatt

SEQ ID NO: 45286 - DNA, 25 bp, mus musculus
cggtgaaattgctccaaccgctctc

SEQ ID NO: 45287 - DNA, 25 bp, mus musculus
tccaaccgctctcaggggagcactt

SEQ ID NO: 45288 - DNA, 25 bp, mus musculus
aaccgctctcaggggagcacttggc

SEQ ID NO: 45289 - DNA, 25 bp, mus musculus
tggcacttttcatcagctggccatc

SEQ ID NO: 45290 - DNA, 25 bp, mus musculus
cacttttcatcagctggccatcgtc

SEQ ID NO: 45291 - DNA, 25 bp, mus musculus
tcatcagctggccatcgtcacgggc

SEQ ID NO: 45292 - DNA, 25 bp, mus musculus
atttatcttgggcaattatgatctg

SEQ ID NO: 45293 - DNA, 25 bp, mus musculus
gaagatccctttgacttgagactag

SEQ ID NO: 45294 - DNA, 25 bp, mus musculus
agatccctttgacttgagactagta

SEQ ID NO: 45295 - DNA, 25 bp, mus musculus
ccctccttcagagaccggaaatgct

SEQ ID NO: 45296 - DNA, 25 bp, mus musculus
ctccttcagagaccggaaatgctat

SEQ ID NO: 45297 - DNA, 25 bp, mus musculus
ccttcagagaccggaaatgctatgg

SEQ ID NO: 45298 - DNA, 25 bp, mus musculus
gagcagtccctgagcagtgccagca

SEQ ID NO: 45299 - DNA, 25 bp, mus musculus
agtccctgagcagtgccagcacaga

SEQ ID NO: 45300 - DNA, 25 bp, mus musculus
tccctgagcagtgccagcacagatt

SEQ ID NO: 45301 - DNA, 25 bp, mus musculus
tgagcagtgccagcacagattttgg

SEQ ID NO: 45302 - DNA, 25 bp, mus musculus
agcagtgccagcacagattttgggg

SEQ ID NO: 45303 - DNA, 25 bp, mus musculus
cagtgccagcacagattttgggggt

SEQ ID NO: 45304 - DNA, 25 bp, mus musculus
gtgccagcacagattttgggggttt

SEQ ID NO: 45305 - DNA, 25 bp, mus musculus
ccctttgacttgagactagtaggag

SEQ ID NO: 45306 - DNA, 25 bp, mus musculus
gccagcacagattttgggggtttca

SEQ ID NO: 45307 - DNA, 25 bp, mus musculus
acaacctctgctctgggcgactgga

SEQ ID NO: 45308 - DNA, 25 bp, mus musculus
aacctctgctctgggcgactggagg

SEQ ID NO: 45309 - DNA, 25 bp, mus musculus
gctgcacaagggcgtatggggctct

SEQ ID NO: 45310 - DNA, 25 bp, mus musculus
tgcacaagggcgtatggggctctgt

SEQ ID NO: 45311 - DNA, 25 bp, mus musculus
tatggggctctgtctgtgatgacaa

SEQ ID NO: 45312 - DNA, 25 bp, mus musculus
gtatgcaagcaactgggctgttgga

SEQ ID NO: 45313 - DNA, 25 bp, mus musculus
gcaactgggctgttggaagtccctc

SEQ ID NO: 45314 - DNA, 25 bp, mus musculus
atgacagacttctgaagtgtcgtga

SEQ ID NO: 45315 - DNA, 25 bp, mus musculus
catgtgtccaattttgccacttata

SEQ ID NO: 45316 - DNA, 25 bp, mus musculus
tctctggcactgatgccaaagcttt

SEQ ID NO: 45317 - DNA, 25 bp, mus musculus
gcactgatgccaaagctttataact

SEQ ID NO: 45318 - DNA, 25 bp, mus musculus
tgccatgtaggccctgttgtcactc

SEQ ID NO: 45319 - DNA, 25 bp, mus musculus
gtaggccctgttgtcactctgtcct

SEQ ID NO: 45320 - DNA, 25 bp, mus musculus
gtcactctgtcctcctgggtcacag

SEQ ID NO: 45321 - DNA, 25 bp, mus musculus
ctgtcctcctgggtcacagtgctct

SEQ ID NO: 45322 - DNA, 25 bp, mus musculus
tcctgggtcacagtgctcttcactg

SEQ ID NO: 45323 - DNA, 25 bp, mus musculus
ttcactgtcttttgtgttcgatagc

SEQ ID NO: 45324 - DNA, 25 bp, mus musculus
gtcttttgtgttcgatagcattgga

SEQ ID NO: 45325 - DNA, 25 bp, mus musculus
gcttcatctgttcatgtctgccctt

SEQ ID NO: 45326 - DNA, 25 bp, mus musculus
tccaattttgccacttatagaccca

SEQ ID NO: 45327 - DNA, 25 bp, mus musculus
tttgccacttatagacccaatcgta

SEQ ID NO: 45328 - DNA, 25 bp, mus musculus
acttatagacccaatcgtataatgc

SEQ ID NO: 45329 - DNA, 25 bp, mus musculus
ataatgctgaactggttggttagca

SEQ ID NO: 45330 - DNA, 25 bp, mus musculus
tgttctgcttgtaggaaccataggc

SEQ ID NO: 45331 - DNA, 25 bp, mus musculus
tttccatggcaacatagaatcttca

SEQ ID NO: 45332 - DNA, 25 bp, mus musculus
atcttcattctactccctctaccat

SEQ ID NO: 45333 - DNA, 25 bp, mus musculus
ctaccatcttgaaatagattgcact

SEQ ID NO: 45334 - DNA, 25 bp, mus musculus
gaggaatcctatccatatgaggcaa

SEQ ID NO: 45335 - DNA, 25 bp, mus musculus
gaatcctatccatatgaggcaacag

SEQ ID NO: 45336 - DNA, 25 bp, mus musculus
ggctttgtggacatccctaagcagg

SEQ ID NO: 45337 - DNA, 25 bp, mus musculus
tttgtggacatccctaagcaggaga

SEQ ID NO: 45338 - DNA, 25 bp, mus musculus
gacatccctaagcaggagaaggccc

SEQ ID NO: 45339 - DNA, 25 bp, mus musculus
aaggcagttgcaactgtggggccca

SEQ ID NO: 45340 - DNA, 25 bp, mus musculus
atttctgttgctattgatgcaggtc

SEQ ID NO: 45341 - DNA, 25 bp, mus musculus
ggtcatgagtccttcctgttctata

SEQ ID NO: 45342 - DNA, 25 bp, mus musculus
catgagtccttcctgttctataaag

SEQ ID NO: 45343 - DNA, 25 bp, mus musculus
ttcctgttctataaagaaggcattt

SEQ ID NO: 45344 - DNA, 25 bp, mus musculus
tattttgagccagactgtagcagtg

SEQ ID NO: 45345 - DNA, 25 bp, mus musculus
tttgagccagactgtagcagtgaag

SEQ ID NO: 45346 - DNA, 25 bp, mus musculus
tcctatccatatgaggcaacagaag

SEQ ID NO: 45347 - DNA, 25 bp, mus musculus
tgtaagtacaatcccaagtattctg

SEQ ID NO: 45348 - DNA, 25 bp, mus musculus
aagtacaatcccaagtattctgttg

SEQ ID NO: 45349 - DNA, 25 bp, mus musculus
tacaatcccaagtattctgttgcta

SEQ ID NO: 45350 - DNA, 25 bp, mus musculus
cccaagtattctgttgctaatgaca

SEQ ID NO: 45351 - DNA, 25 bp, mus musculus
tattctgttgctaatgacaccggct

SEQ ID NO: 45352 - DNA, 25 bp, mus musculus
gttgctaatgacaccggctttgtgg

SEQ ID NO: 45353 - DNA, 25 bp, mus musculus
aatgacaccggctttgtggacatcc

SEQ ID NO: 45354 - DNA, 25 bp, mus musculus
atttacattgactcagtgaaaggaa

SEQ ID NO: 45355 - DNA, 25 bp, mus musculus
tacattgactcagtgaaaggaaaat

SEQ ID NO: 45356 - DNA, 25 bp, mus musculus
agaccattgttcctaccaaatcaat

SEQ ID NO: 45357 - DNA, 25 bp, mus musculus
ccattgttcctaccaaatcaatgat

SEQ ID NO: 45358 - DNA, 25 bp, mus musculus
ttgttcctaccaaatcaatgattcc

SEQ ID NO: 45359 - DNA, 25 bp, mus musculus
ttcctaccaaatcaatgattccata

SEQ ID NO: 45360 - DNA, 25 bp, mus musculus
ctaccaaatcaatgattccatattt

SEQ ID NO: 45361 - DNA, 25 bp, mus musculus
actatgtcattagcacccagatagc

SEQ ID NO: 45362 - DNA, 25 bp, mus musculus
atgtcattagcacccagatagcttt

SEQ ID NO: 45363 - DNA, 25 bp, mus musculus
attatgcatttcctttttgaagcaa

SEQ ID NO: 45364 - DNA, 25 bp, mus musculus
atgcatttcctttttgaagcaaaat

SEQ ID NO: 45365 - DNA, 25 bp, mus musculus
gcatttcctttttgaagcaaaatgt

SEQ ID NO: 45366 - DNA, 25 bp, mus musculus
actttgatgcaacacatgcactttg

SEQ ID NO: 45367 - DNA, 25 bp, mus musculus
atgcaacacatgcactttgtgtgtc

SEQ ID NO: 45368 - DNA, 25 bp, mus musculus
caacacatgcactttgtgtgtctcc

SEQ ID NO: 45369 - DNA, 25 bp, mus musculus
cactttgtgtgtctccttgattcaa

SEQ ID NO: 45370 - DNA, 25 bp, mus musculus
acttctcttgtatataagactgtac

SEQ ID NO: 45371 - DNA, 25 bp, mus musculus
tataagactgtactgcttaggatat

SEQ ID NO: 45372 - DNA, 25 bp, mus musculus
aagactgtactgcttaggatattaa

SEQ ID NO: 45373 - DNA, 25 bp, mus musculus
gtttctatgtactgagggttgcaga

SEQ ID NO: 45374 - DNA, 25 bp, mus musculus
cctgtctgctatcaccaaaccctgg

SEQ ID NO: 45375 - DNA, 25 bp, mus musculus
tgctatcaccaaaccctgggaagtc

SEQ ID NO: 45376 - DNA, 25 bp, mus musculus
gatcctgcccatgtttgaccgactg

SEQ ID NO: 45377 - DNA, 25 bp, mus musculus
gcccatgtttgaccgactgcaaaat

SEQ ID NO: 45378 - DNA, 25 bp, mus musculus
agcactagctgacgagtatgaggcc

SEQ ID NO: 45379 - DNA, 25 bp, mus musculus
agtttgcaatggtggtccagcaccc

SEQ ID NO: 45380 - DNA, 25 bp, mus musculus
ctgctgtatcctataagccgtgttt

SEQ ID NO: 45381 - DNA, 25 bp, mus musculus
tatcctataagccgtgtttcatggc

SEQ ID NO: 45382 - DNA, 25 bp, mus musculus
actcacccactgcatacggactctg

SEQ ID NO: 45383 - DNA, 25 bp, mus musculus
ccactgcatacggactctgcctata

SEQ ID NO: 45384 - DNA, 25 bp, mus musculus
catacggactctgcctatagcaatt

SEQ ID NO: 45385 - DNA, 25 bp, mus musculus
gactctgcctatagcaatttggtat

SEQ ID NO: 45386 - DNA, 25 bp, mus musculus
aactgtcttggatcaacagcccatt

SEQ ID NO: 45387 - DNA, 25 bp, mus musculus
cttggatcaacagcccattcccatg

SEQ ID NO: 45388 - DNA, 25 bp, mus musculus
agctgagctccctaagctgcaagtt

SEQ ID NO: 45389 - DNA, 25 bp, mus musculus
tggtttcattgacttcgtatgtact

SEQ ID NO: 45390 - DNA, 25 bp, mus musculus
cattgacttcgtatgtactttcgta

SEQ ID NO: 45391 - DNA, 25 bp, mus musculus
ggaattttctcgatttcacgaagag

SEQ ID NO: 45392 - DNA, 25 bp, mus musculus
atttcacgaagagatcctgcccatg

SEQ ID NO: 45393 - DNA, 25 bp, mus musculus
cgaagagatcctgcccatgtttgac

SEQ ID NO: 45394 - DNA, 25 bp, mus musculus
tagcagaagcacccatggtatctga

SEQ ID NO: 45395 - DNA, 25 bp, mus musculus
cagaagcacccatggtatctgagag

SEQ ID NO: 45396 - DNA, 25 bp, mus musculus
ttctgattgctattgcccaagattt

SEQ ID NO: 45397 - DNA, 25 bp, mus musculus
ttgctattgcccaagatttgctttc

SEQ ID NO: 45398 - DNA, 25 bp, mus musculus
ctattgcccaagatttgctttctat

SEQ ID NO: 45399 - DNA, 25 bp, mus musculus
ttgcccaagatttgctttctatgca

SEQ ID NO: 45400 - DNA, 25 bp, mus musculus
atttgctttctatgcacgtattgta

SEQ ID NO: 45401 - DNA, 25 bp, mus musculus
tgctttctatgcacgtattgtacaa

SEQ ID NO: 45402 - DNA, 25 bp, mus musculus
aattgtgctttgtgccacaggtcat

SEQ ID NO: 45403 - DNA, 25 bp, mus musculus
gctttgtgccacaggtcatgatcgt

SEQ ID NO: 45404 - DNA, 25 bp, mus musculus
ttgtgccacaggtcatgatcgtgga

SEQ ID NO: 45405 - DNA, 25 bp, mus musculus
tgccacaggtcatgatcgtggatga

SEQ ID NO: 45406 - DNA, 25 bp, mus musculus
aagcacccatggtatctgagagagc

SEQ ID NO: 45407 - DNA, 25 bp, mus musculus
gatcctcccaagcttagaatttgtt

SEQ ID NO: 45408 - DNA, 25 bp, mus musculus
tgtgggaactttcttcgttgtctgt

SEQ ID NO: 45409 - DNA, 25 bp, mus musculus
tgtctgtttacttcatgtttacaaa

SEQ ID NO: 45410 - DNA, 25 bp, mus musculus
tttacttcatgtttacaaataattg

SEQ ID NO: 45411 - DNA, 25 bp, mus musculus
tatatcagccaaaaccataacttac

SEQ ID NO: 45412 - DNA, 25 bp, mus musculus
gtctactgttcttaggtttctgtgg

SEQ ID NO: 45413 - DNA, 25 bp, mus musculus
tttttctgattgctattgcccaaga

SEQ ID NO: 45414 - DNA, 25 bp, mus musculus
cctgcgtcccgtggtctccatatct

SEQ ID NO: 45415 - DNA, 25 bp, mus musculus
ggtctccatatctgttccaaccgaa

SEQ ID NO: 45416 - DNA, 25 bp, mus musculus
atgtcacttacgtttggggcattgt

SEQ ID NO: 45417 - DNA, 25 bp, mus musculus
cttacgtttggggcattgtgagctg

SEQ ID NO: 45418 - DNA, 25 bp, mus musculus
gaaggtctcttgtttctcaacacaa

SEQ ID NO: 45419 - DNA, 25 bp, mus musculus
ctcttgtttctcaacacaatgtctg

SEQ ID NO: 45420 - DNA, 25 bp, mus musculus
tttctcaacacaatgtctgaagcta

SEQ ID NO: 45421 - DNA, 25 bp, mus musculus
gtatagttagttctcctcagagctg

SEQ ID NO: 45422 - DNA, 25 bp, mus musculus
ttagttctcctcagagctggcaaga

SEQ ID NO: 45423 - DNA, 25 bp, mus musculus
aagcaactcctactggctagtccta

SEQ ID NO: 45424 - DNA, 25 bp, mus musculus
ttttagaattctgccatataatcta

SEQ ID NO: 45425 - DNA, 25 bp, mus musculus
aattctgccatataatctacaataa

SEQ ID NO: 45426 - DNA, 25 bp, mus musculus
catatctgttccaaccgaatgacag

SEQ ID NO: 45427 - DNA, 25 bp, mus musculus
accaaaaagtctactcactcaggtg

SEQ ID NO: 45428 - DNA, 25 bp, mus musculus
taggcaactgctctcagttttaccc

SEQ ID NO: 45429 - DNA, 25 bp, mus musculus
actgctctcagttttacccagatcg

SEQ ID NO: 45430 - DNA, 25 bp, mus musculus
ctcagttttacccagatcgctacta

SEQ ID NO: 45431 - DNA, 25 bp, mus musculus
tttacccagatcgctactatgagaa

SEQ ID NO: 45432 - DNA, 25 bp, mus musculus
gaggccccttggtctgtgaggatac

SEQ ID NO: 45433 - DNA, 25 bp, mus musculus
aggataccaacaatgtcacttacgt

SEQ ID NO: 45434 - DNA, 25 bp, mus musculus
ccaggcactgctgagtgctgcacca

SEQ ID NO: 45435 - DNA, 25 bp, mus musculus
ggcactgctgagtgctgcaccaaag

SEQ ID NO: 45436 - DNA, 25 bp, mus musculus
gaatattccactaattacggacaag

SEQ ID NO: 45437 - DNA, 25 bp, mus musculus
tattccactaattacggacaagctc

SEQ ID NO: 45438 - DNA, 25 bp, mus musculus
tccactaattacggacaagctcctc

SEQ ID NO: 45439 - DNA, 25 bp, mus musculus
actaattacggacaagctcctctgt

SEQ ID NO: 45440 - DNA, 25 bp, mus musculus
caagctcctctgtcacttttagtca

SEQ ID NO: 45441 - DNA, 25 bp, mus musculus
gctcctctgtcacttttagtcagtt

SEQ ID NO: 45442 - DNA, 25 bp, mus musculus
cctctgtcacttttagtcagttaca

SEQ ID NO: 45443 - DNA, 25 bp, mus musculus
ctgtcacttttagtcagttacacca

SEQ ID NO: 45444 - DNA, 25 bp, mus musculus
ttagtcagttacaccaagagttatc

SEQ ID NO: 45445 - DNA, 25 bp, mus musculus
gtcagttacaccaagagttatcttt

SEQ ID NO: 45446 - DNA, 25 bp, mus musculus
tgctgcaccaaagagggcctggaac

SEQ ID NO: 45447 - DNA, 25 bp, mus musculus
tgcaccaaagagggcctggaacgaa

SEQ ID NO: 45448 - DNA, 25 bp, mus musculus
cgaaagctctgcatggctgctctga

SEQ ID NO: 45449 - DNA, 25 bp, mus musculus
aagctctgcatggctgctctgaaac

SEQ ID NO: 45450 - DNA, 25 bp, mus musculus
ctctgcatggctgctctgaaacacc

SEQ ID NO: 45451 - DNA, 25 bp, mus musculus
atggctgctctgaaacaccagccac

SEQ ID NO: 45452 - DNA, 25 bp, mus musculus
ctgaaacaccagccacaggaattcc

SEQ ID NO: 45453 - DNA, 25 bp, mus musculus
atctgtgaggcgttcaggaaagatc

SEQ ID NO: 45454 - DNA, 25 bp, mus musculus
gccatgctgcagggcatagcatctg

SEQ ID NO: 45455 - DNA, 25 bp, mus musculus
tctggcatgaactacctcagtaatc

SEQ ID NO: 45456 - DNA, 25 bp, mus musculus
atcacaattatgtccaccgggacct

SEQ ID NO: 45457 - DNA, 25 bp, mus musculus
tggctgccagaaacatcttcggtga

SEQ ID NO: 45458 - DNA, 25 bp, mus musculus
gctgccagaaacatcttcggtgaat

SEQ ID NO: 45459 - DNA, 25 bp, mus musculus
ctgccagaaacatcttcggtgaatc

SEQ ID NO: 45460 - DNA, 25 bp, mus musculus
gccagaaacatcttcggtgaatcaa

SEQ ID NO: 45461 - DNA, 25 bp, mus musculus
ccagaaacatcttcggtgaatcaaa

SEQ ID NO: 45462 - DNA, 25 bp, mus musculus
aacatcttcggtgaatcaaaacctg

SEQ ID NO: 45463 - DNA, 25 bp, mus musculus
acatcttcggtgaatcaaaacctgt

SEQ ID NO: 45464 - DNA, 25 bp, mus musculus
gacagcccctgaagccattgcccat

SEQ ID NO: 45465 - DNA, 25 bp, mus musculus
agcccctgaagccattgcccatcgg

SEQ ID NO: 45466 - DNA, 25 bp, mus musculus
ctggcatgaactacctcagtaatca

SEQ ID NO: 45467 - DNA, 25 bp, mus musculus
ggcatgaactacctcagtaatcaca

SEQ ID NO: 45468 - DNA, 25 bp, mus musculus
gcatgaactacctcagtaatcacaa

SEQ ID NO: 45469 - DNA, 25 bp, mus musculus
atgaactacctcagtaatcacaatt

SEQ ID NO: 45470 - DNA, 25 bp, mus musculus
tgaactacctcagtaatcacaatta

SEQ ID NO: 45471 - DNA, 25 bp, mus musculus
aactacctcagtaatcacaattatg

SEQ ID NO: 45472 - DNA, 25 bp, mus musculus
tacctcagtaatcacaattatgtcc

SEQ ID NO: 45473 - DNA, 25 bp, mus musculus
acctcagtaatcacaattatgtcca

SEQ ID NO: 45474 - DNA, 25 bp, mus musculus
ctttccattcggccttttgtcatag

SEQ ID NO: 45475 - DNA, 25 bp, mus musculus
ttccattcggccttttgtcataggg

SEQ ID NO: 45476 - DNA, 25 bp, mus musculus
tgtctcccaaacttcctgtttcaga

SEQ ID NO: 45477 - DNA, 25 bp, mus musculus
gtctcccaaacttcctgtttcagag

SEQ ID NO: 45478 - DNA, 25 bp, mus musculus
ctcccaaacttcctgtttcagagat

SEQ ID NO: 45479 - DNA, 25 bp, mus musculus
tcccaaacttcctgtttcagagatg

SEQ ID NO: 45480 - DNA, 25 bp, mus musculus
caaacttcctgtttcagagatgtga

SEQ ID NO: 45481 - DNA, 25 bp, mus musculus
aacttcctgtttcagagatgtgaac

SEQ ID NO: 45482 - DNA, 25 bp, mus musculus
ttcctgtttcagagatgtgaacctt

SEQ ID NO: 45483 - DNA, 25 bp, mus musculus
gatgtgaaccttctatcccccaaag

SEQ ID NO: 45484 - DNA, 25 bp, mus musculus
tgtgaaccttctatcccccaaagct

SEQ ID NO: 45485 - DNA, 25 bp, mus musculus
atcagaggaccccaactcctccatg

SEQ ID NO: 45486 - DNA, 25 bp, mus musculus
cattcggccttttgtcatagggaca

SEQ ID NO: 45487 - DNA, 25 bp, mus musculus
attcggccttttgtcatagggacag

SEQ ID NO: 45488 - DNA, 25 bp, mus musculus
tcggccttttgtcatagggacagaa

SEQ ID NO: 45489 - DNA, 25 bp, mus musculus
ccttttgtcatagggacagaaatct

SEQ ID NO: 45490 - DNA, 25 bp, mus musculus
cccaaactcctgcctagaaggacat

SEQ ID NO: 45491 - DNA, 25 bp, mus musculus
ccaaactcctgcctagaaggacatg

SEQ ID NO: 45492 - DNA, 25 bp, mus musculus
aggacatggaccccatgtctcccaa

SEQ ID NO: 45493 - DNA, 25 bp, mus musculus
acatggaccccatgtctcccaaact

SEQ ID NO: 45494 - DNA, 25 bp, mus musculus
atctggaacgtcactggtgccaagg

SEQ ID NO: 45495 - DNA, 25 bp, mus musculus
gtgttcttgagctgtgaggtcatcg

SEQ ID NO: 45496 - DNA, 25 bp, mus musculus
ccatgagcctctgtagctaaggtgc

SEQ ID NO: 45497 - DNA, 25 bp, mus musculus
gcctctgtagctaaggtgctctcag

SEQ ID NO: 45498 - DNA, 25 bp, mus musculus
gtagctaaggtgctctcagacagcc

SEQ ID NO: 45499 - DNA, 25 bp, mus musculus
ctctcagacagccgacagctataac

SEQ ID NO: 45500 - DNA, 25 bp, mus musculus
gacagccgacagctataaccctgct

SEQ ID NO: 45501 - DNA, 25 bp, mus musculus
tcttgcctgacacacttctcttaac

SEQ ID NO: 45502 - DNA, 25 bp, mus musculus
ccactaacactttattacagccagc

SEQ ID NO: 45503 - DNA, 25 bp, mus musculus
acactttattacagccagctggttt

SEQ ID NO: 45504 - DNA, 25 bp, mus musculus
tattacagccagctggttttacaca

SEQ ID NO: 45505 - DNA, 25 bp, mus musculus
gataacacatcaagactatctacaa

SEQ ID NO: 45506 - DNA, 25 bp, mus musculus
ttgagctgtgaggtcatcgggatcc

SEQ ID NO: 45507 - DNA, 25 bp, mus musculus
cctgtcctcatctggaacaaggtaa

SEQ ID NO: 45508 - DNA, 25 bp, mus musculus
gatcactctggagttcagcggacag

SEQ ID NO: 45509 - DNA, 25 bp, mus musculus
cggacagaactcttgcctggtgacc

SEQ ID NO: 45510 - DNA, 25 bp, mus musculus
ttgcctggtgaccgggaaaatctgg

SEQ ID NO: 45511 - DNA, 25 bp, mus musculus
gagtgccacgcatccaactcccaag

SEQ ID NO: 45512 - DNA, 25 bp, mus musculus
tccaactcccaagggcaggcttccg

SEQ ID NO: 45513 - DNA, 25 bp, mus musculus
cagttataacctgcgaatccatgag

SEQ ID NO: 45514 - DNA, 25 bp, mus musculus
tacaaatctgcataaagttacataa

SEQ ID NO: 45515 - DNA, 25 bp, mus musculus
catataccttttcagaatacaaatg

SEQ ID NO: 45516 - DNA, 25 bp, mus musculus
tcaagcaaatcttccacagttgttc

SEQ ID NO: 45517 - DNA, 25 bp, mus musculus
agcaaatcttccacagttgttcaag

SEQ ID NO: 45518 - DNA, 25 bp, mus musculus
aaatcttccacagttgttcaagaat

SEQ ID NO: 45519 - DNA, 25 bp, mus musculus
gaatcttctaaaggcacacctcggt

SEQ ID NO: 45520 - DNA, 25 bp, mus musculus
tcttctaaaggcacacctcggtctt

SEQ ID NO: 45521 - DNA, 25 bp, mus musculus
ttagcttccagtccaaacccattca

SEQ ID NO: 45522 - DNA, 25 bp, mus musculus
tccagtccaaacccattcagccgtg

SEQ ID NO: 45523 - DNA, 25 bp, mus musculus
aacccattcagccgtgcaaatgcag

SEQ ID NO: 45524 - DNA, 25 bp, mus musculus
ccattcagccgtgcaaatgcagctg

SEQ ID NO: 45525 - DNA, 25 bp, mus musculus
agccgtgcaaatgcagctgaaacca

SEQ ID NO: 45526 - DNA, 25 bp, mus musculus
ataccttttcagaatacaaatgcca

SEQ ID NO: 45527 - DNA, 25 bp, mus musculus
aatacaaatgccaatttgaacatga

SEQ ID NO: 45528 - DNA, 25 bp, mus musculus
aatgctttggttcactctgaatctg

SEQ ID NO: 45529 - DNA, 25 bp, mus musculus
gctttggttcactctgaatctgatg

SEQ ID NO: 45530 - DNA, 25 bp, mus musculus
gttcactctgaatctgatgttggca

SEQ ID NO: 45531 - DNA, 25 bp, mus musculus
cactctgaatctgatgttggcaaca

SEQ ID NO: 45532 - DNA, 25 bp, mus musculus
ggaaaccattcaagcaaatcttcca

SEQ ID NO: 45533 - DNA, 25 bp, mus musculus
cattcaagcaaatcttccacagttg

SEQ ID NO: 45534 - DNA, 25 bp, mus musculus
tatacctacttccgttacaatggct

SEQ ID NO: 45535 - DNA, 25 bp, mus musculus
tacttccgttacaatggctcactaa

SEQ ID NO: 45536 - DNA, 25 bp, mus musculus
ccaggacagctgctgtctttgcccc

SEQ ID NO: 45537 - DNA, 25 bp, mus musculus
tgcctggtagccaacttcctccagt

SEQ ID NO: 45538 - DNA, 25 bp, mus musculus
gtagccaacttcctccagtaatggc

SEQ ID NO: 45539 - DNA, 25 bp, mus musculus
cccacttctggatatctgacctctg

SEQ ID NO: 45540 - DNA, 25 bp, mus musculus
tctggatatctgacctctgacctca

SEQ ID NO: 45541 - DNA, 25 bp, mus musculus
tatctgacctctgacctcagccttt

SEQ ID NO: 45542 - DNA, 25 bp, mus musculus
acctctgacctcagcctttagagga

SEQ ID NO: 45543 - DNA, 25 bp, mus musculus
gacctcagcctttagaggacatggc

SEQ ID NO: 45544 - DNA, 25 bp, mus musculus
atgaggaactggctgtggtgtgcac

SEQ ID NO: 45545 - DNA, 25 bp, mus musculus
tgtgcacacctttaatcccagcctt

SEQ ID NO: 45546 - DNA, 25 bp, mus musculus
cgttacaatggctcactaaccacac

SEQ ID NO: 45547 - DNA, 25 bp, mus musculus
aatggctcactaaccacaccaaact

SEQ ID NO: 45548 - DNA, 25 bp, mus musculus
accacaccaaactgtgatgagactg

SEQ ID NO: 45549 - DNA, 25 bp, mus musculus
gagactgtcatctggactgtgtaca

SEQ ID NO: 45550 - DNA, 25 bp, mus musculus
gtgtacaaacaacccatcaagatcc

SEQ ID NO: 45551 - DNA, 25 bp, mus musculus
cccatcaagatccacaaaaaccagt

SEQ ID NO: 45552 - DNA, 25 bp, mus musculus
gaattctcaaaaaatctgtactatg

SEQ ID NO: 45553 - DNA, 25 bp, mus musculus
ctgcagccgctgggaaaacgccagg

SEQ ID NO: 45554 - DNA, 25 bp, mus musculus
tcccagtacatagactggctggtca

SEQ ID NO: 45555 - DNA, 25 bp, mus musculus
agacacatggactccaagctccagg

SEQ ID NO: 45556 - DNA, 25 bp, mus musculus
cccgtagctgcctcctgtctgcatg

SEQ ID NO: 45557 - DNA, 25 bp, mus musculus
gctgcctcctgtctgcatgcattcg

SEQ ID NO: 45558 - DNA, 25 bp, mus musculus
tcctgtctgcatgcattcggtctgc

SEQ ID NO: 45559 - DNA, 25 bp, mus musculus
gcattcggtctgcagtactacacag

SEQ ID NO: 45560 - DNA, 25 bp, mus musculus
ggtctgcagtactacacagtaggta

SEQ ID NO: 45561 - DNA, 25 bp, mus musculus
cagtactacacagtaggtatgcaca

SEQ ID NO: 45562 - DNA, 25 bp, mus musculus
atgcacatgagcacgtaggacacgt

SEQ ID NO: 45563 - DNA, 25 bp, mus musculus
atgagcacgtaggacacgtgaattg

SEQ ID NO: 45564 - DNA, 25 bp, mus musculus
catcattggcactgttgctcacttg

SEQ ID NO: 45565 - DNA, 25 bp, mus musculus
cctgtgagcaccctgtcttggtttc

SEQ ID NO: 45566 - DNA, 25 bp, mus musculus
cgactcccactactgtagctccttg

SEQ ID NO: 45567 - DNA, 25 bp, mus musculus
ctgtagctccttggatagcccaacc

SEQ ID NO: 45568 - DNA, 25 bp, mus musculus
ggaagctacggcctgtgaagctgtt

SEQ ID NO: 45569 - DNA, 25 bp, mus musculus
tacggcctgtgaagctgttctatgg

SEQ ID NO: 45570 - DNA, 25 bp, mus musculus
tctatggactttcctgctattcttg

SEQ ID NO: 45571 - DNA, 25 bp, mus musculus
gactttcctgctattcttgtgtaag

SEQ ID NO: 45572 - DNA, 25 bp, mus musculus
cctgctattcttgtgtaagggaaga

SEQ ID NO: 45573 - DNA, 25 bp, mus musculus
gagactcacaaagaaactcaagagg

SEQ ID NO: 45574 - DNA, 25 bp, mus musculus
tcaggtcgctcggcctggtggcgac

SEQ ID NO: 45575 - DNA, 25 bp, mus musculus
tggcgacacgatctttgggaagatc

SEQ ID NO: 45576 - DNA, 25 bp, mus musculus
atttttgaggatgaccggtgccttg

SEQ ID NO: 45577 - DNA, 25 bp, mus musculus
cggtgccttgctttccatgacattt

SEQ ID NO: 45578 - DNA, 25 bp, mus musculus
cctcaagcaccaacacattttctgg

SEQ ID NO: 45579 - DNA, 25 bp, mus musculus
caagcaccaacacattttctggtga

SEQ ID NO: 45580 - DNA, 25 bp, mus musculus
acacattttctggtgatacccaaga

SEQ ID NO: 45581 - DNA, 25 bp, mus musculus
tattttactgcatatcaccagtctg

SEQ ID NO: 45582 - DNA, 25 bp, mus musculus
tttactgcatatcaccagtctggaa

SEQ ID NO: 45583 - DNA, 25 bp, mus musculus
actgcatatcaccagtctggaaaag

SEQ ID NO: 45584 - DNA, 25 bp, mus musculus
gcatatcaccagtctggaaaaggat

SEQ ID NO: 45585 - DNA, 25 bp, mus musculus
tatcaccagtctggaaaaggatcag

SEQ ID NO: 45586 - DNA, 25 bp, mus musculus
cgacacgatctttgggaagatcatc

SEQ ID NO: 45587 - DNA, 25 bp, mus musculus
gaagatcatccgcaagaaataccag

SEQ ID NO: 45588 - DNA, 25 bp, mus musculus
catccgcaagaaataccagccaaaa

SEQ ID NO: 45589 - DNA, 25 bp, mus musculus
ccgcaagaaataccagccaaaatca

SEQ ID NO: 45590 - DNA, 25 bp, mus musculus
caagaaataccagccaaaatcattt

SEQ ID NO: 45591 - DNA, 25 bp, mus musculus
gaaataccagccaaaatcatttttg

SEQ ID NO: 45592 - DNA, 25 bp, mus musculus
ataccagccaaaatcatttttgagg

SEQ ID NO: 45593 - DNA, 25 bp, mus musculus
ccagccaaaatcatttttgaggatg

SEQ ID NO: 45594 - DNA, 25 bp, mus musculus
tgcagaaattcctgctgctgaagaa

SEQ ID NO: 45595 - DNA, 25 bp, mus musculus
gctgtcgagtcctgttccatgtctt

SEQ ID NO: 45596 - DNA, 25 bp, mus musculus
tctggagccatggcatgcagggccg

SEQ ID NO: 45597 - DNA, 25 bp, mus musculus
gccatggcatgcagggccgaagcct

SEQ ID NO: 45598 - DNA, 25 bp, mus musculus
gaagcctcgataccaacgaggtgac

SEQ ID NO: 45599 - DNA, 25 bp, mus musculus
agaccaggatcttccgagtactggg

SEQ ID NO: 45600 - DNA, 25 bp, mus musculus
acagggacatcatcctggaaagcat

SEQ ID NO: 45601 - DNA, 25 bp, mus musculus
tcctggaaagcatcccaactgataa

SEQ ID NO: 45602 - DNA, 25 bp, mus musculus
ctgataaccccggggcacacagcaa

SEQ ID NO: 45603 - DNA, 25 bp, mus musculus
gggcacacagcaacctctacatcct

SEQ ID NO: 45604 - DNA, 25 bp, mus musculus
acagcaacctctacatcctcacggg

SEQ ID NO: 45605 - DNA, 25 bp, mus musculus
acatcctcacgggtcaccagagcag

SEQ ID NO: 45606 - DNA, 25 bp, mus musculus
atgtcttgcccctggaagctggcct

SEQ ID NO: 45607 - DNA, 25 bp, mus musculus
cacgggtcaccagagcagctactga

SEQ ID NO: 45608 - DNA, 25 bp, mus musculus
ctggcctgactccagacatcctcat

SEQ ID NO: 45609 - DNA, 25 bp, mus musculus
ggatcccaggttctgcacagcaggt

SEQ ID NO: 45610 - DNA, 25 bp, mus musculus
caggttctgcacagcaggtgatcca

SEQ ID NO: 45611 - DNA, 25 bp, mus musculus
tcctggtcagctttgaacgctgtgt

SEQ ID NO: 45612 - DNA, 25 bp, mus musculus
tcagctttgaacgctgtgtgagaat

SEQ ID NO: 45613 - DNA, 25 bp, mus musculus
cctttgacttcactattgagactgt

SEQ ID NO: 45614 - DNA, 25 bp, mus musculus
ctattgagactgtggtgtgtctgca

SEQ ID NO: 45615 - DNA, 25 bp, mus musculus
ttttaccactgcagtaccagtagcc

SEQ ID NO: 45616 - DNA, 25 bp, mus musculus
ttaccactgcagtaccagtagccag

SEQ ID NO: 45617 - DNA, 25 bp, mus musculus
gcatccagcaggagaaagggctgct

SEQ ID NO: 45618 - DNA, 25 bp, mus musculus
gcctgcagctcccagcgcagacttt

SEQ ID NO: 45619 - DNA, 25 bp, mus musculus
ctgcagctcccagcgcagactttct

SEQ ID NO: 45620 - DNA, 25 bp, mus musculus
agctcccagcgcagactttctcttc

SEQ ID NO: 45621 - DNA, 25 bp, mus musculus
gctcccagcgcagactttctcttca

SEQ ID NO: 45622 - DNA, 25 bp, mus musculus
ctcccagcgcagactttctcttcag

SEQ ID NO: 45623 - DNA, 25 bp, mus musculus
agcgcagactttctcttcagcccct

SEQ ID NO: 45624 - DNA, 25 bp, mus musculus
cgcagactttctcttcagcccctgt

SEQ ID NO: 45625 - DNA, 25 bp, mus musculus
gcagactttctcttcagcccctgtt

SEQ ID NO: 45626 - DNA, 25 bp, mus musculus
cagactttctcttcagcccctgttc

SEQ ID NO: 45627 - DNA, 25 bp, mus musculus
taccactgcagtaccagtagccagt

SEQ ID NO: 45628 - DNA, 25 bp, mus musculus
accactgcagtaccagtagccagta

SEQ ID NO: 45629 - DNA, 25 bp, mus musculus
ccactgcagtaccagtagccagtag

SEQ ID NO: 45630 - DNA, 25 bp, mus musculus
actgcagtaccagtagccagtagcc

SEQ ID NO: 45631 - DNA, 25 bp, mus musculus
ctgcagtaccagtagccagtagccc

SEQ ID NO: 45632 - DNA, 25 bp, mus musculus
tgcagtaccagtagccagtagccca

SEQ ID NO: 45633 - DNA, 25 bp, mus musculus
gcagtaccagtagccagtagcccag

SEQ ID NO: 45634 - DNA, 25 bp, mus musculus
agtaccagtagccagtagcccaggg

SEQ ID NO: 45635 - DNA, 25 bp, mus musculus
gaactaagttctgctctggagaaaa

SEQ ID NO: 45636 - DNA, 25 bp, mus musculus
gaagttatcattcccacagccccac

SEQ ID NO: 45637 - DNA, 25 bp, mus musculus
gacctctactgacatgtgctgtcag

SEQ ID NO: 45638 - DNA, 25 bp, mus musculus
catgtgctgtcagctggagaccgac

SEQ ID NO: 45639 - DNA, 25 bp, mus musculus
gtgctgtcagctggagaccgacctc

SEQ ID NO: 45640 - DNA, 25 bp, mus musculus
ggagaccgacctctccgtaaagcat

SEQ ID NO: 45641 - DNA, 25 bp, mus musculus
gaccgacctctccgtaaagcattct

SEQ ID NO: 45642 - DNA, 25 bp, mus musculus
catcagtagaacccacaataagtta

SEQ ID NO: 45643 - DNA, 25 bp, mus musculus
cagtagaacccacaataagttattg

SEQ ID NO: 45644 - DNA, 25 bp, mus musculus
ttattaatgcactttctaccctctg

SEQ ID NO: 45645 - DNA, 25 bp, mus musculus
atgcactttctaccctctgtaagcg

SEQ ID NO: 45646 - DNA, 25 bp, mus musculus
tttctaccctctgtaagcgtctgtg

SEQ ID NO: 45647 - DNA, 25 bp, mus musculus
acagccccactgtataaacagattc

SEQ ID NO: 45648 - DNA, 25 bp, mus musculus
gccccactgtataaacagattctaa

SEQ ID NO: 45649 - DNA, 25 bp, mus musculus
attctaaatctgtatgcagaggaaa

SEQ ID NO: 45650 - DNA, 25 bp, mus musculus
attgaagacactatcttttaccttg

SEQ ID NO: 45651 - DNA, 25 bp, mus musculus
gtcatagacctggatgtgttcctga

SEQ ID NO: 45652 - DNA, 25 bp, mus musculus
cagttccagctaagggcactaatgc

SEQ ID NO: 45653 - DNA, 25 bp, mus musculus
ggccttagtgacctctactgacatg

SEQ ID NO: 45654 - DNA, 25 bp, mus musculus
cttagtgacctctactgacatgtgc

SEQ ID NO: 45655 - DNA, 25 bp, mus musculus
cctgcatactatgacctcctcttta

SEQ ID NO: 45656 - DNA, 25 bp, mus musculus
agtagctctagctcctaaaacatcc

SEQ ID NO: 45657 - DNA, 25 bp, mus musculus
tcataatcttcaaaccacattggta

SEQ ID NO: 45658 - DNA, 25 bp, mus musculus
tcttcaaaccacattggtattacct

SEQ ID NO: 45659 - DNA, 25 bp, mus musculus
aaccacattggtattacctgctgtg

SEQ ID NO: 45660 - DNA, 25 bp, mus musculus
aggacagaaccctgtagactcctgc

SEQ ID NO: 45661 - DNA, 25 bp, mus musculus
gaaccctgtagactcctgctctctg

SEQ ID NO: 45662 - DNA, 25 bp, mus musculus
ctctctgcctagtcactgtgacacc

SEQ ID NO: 45663 - DNA, 25 bp, mus musculus
gcctagtcactgtgacaccaaatgc

SEQ ID NO: 45664 - DNA, 25 bp, mus musculus
tcactgtgacaccaaatgccccttt

SEQ ID NO: 45665 - DNA, 25 bp, mus musculus
caaatgcccctttacatacccagat

SEQ ID NO: 45666 - DNA, 25 bp, mus musculus
tcaccttgtgaggcctataagagag

SEQ ID NO: 45667 - DNA, 25 bp, mus musculus
tctagctcctaaaacatccatacct

SEQ ID NO: 45668 - DNA, 25 bp, mus musculus
catttgcttccttctgctgggcctt

SEQ ID NO: 45669 - DNA, 25 bp, mus musculus
tcctgccttaccctctatctgaaac

SEQ ID NO: 45670 - DNA, 25 bp, mus musculus
ctgaaacccttattgattcttcaag

SEQ ID NO: 45671 - DNA, 25 bp, mus musculus
ttgattcttcaaggcccaagttcaa

SEQ ID NO: 45672 - DNA, 25 bp, mus musculus
agagccaaagtcctgcccacatcag

SEQ ID NO: 45673 - DNA, 25 bp, mus musculus
ctgcccacatcagttcactcataat

SEQ ID NO: 45674 - DNA, 25 bp, mus musculus
acatcagttcactcataatcttcaa

SEQ ID NO: 45675 - DNA, 25 bp, mus musculus
acttcaacacactgaacaacattga

SEQ ID NO: 45676 - DNA, 25 bp, mus musculus
tcaacacactgaacaacattgatgt

SEQ ID NO: 45677 - DNA, 25 bp, mus musculus
gaattccatgacaatttgagttcag

SEQ ID NO: 45678 - DNA, 25 bp, mus musculus
aagagactggctgctactcaaagtt

SEQ ID NO: 45679 - DNA, 25 bp, mus musculus
agactggctgctactcaaagttgtg

SEQ ID NO: 45680 - DNA, 25 bp, mus musculus
ctggctgctactcaaagttgtggag

SEQ ID NO: 45681 - DNA, 25 bp, mus musculus
gatttagccatgtgttaggtgaaaa

SEQ ID NO: 45682 - DNA, 25 bp, mus musculus
ttagcaacagtttctgacagtatga

SEQ ID NO: 45683 - DNA, 25 bp, mus musculus
gagacttcccattgtgtgtgaatgt

SEQ ID NO: 45684 - DNA, 25 bp, mus musculus
acttcccattgtgtgtgaatgttat

SEQ ID NO: 45685 - DNA, 25 bp, mus musculus
tttgttcatgccatgttacaacact

SEQ ID NO: 45686 - DNA, 25 bp, mus musculus
gttcatgccatgttacaacactatt

SEQ ID NO: 45687 - DNA, 25 bp, mus musculus
acacactgaacaacattgatgtgat

SEQ ID NO: 45688 - DNA, 25 bp, mus musculus
gacagaacccatctcgttgctctgt

SEQ ID NO: 45689 - DNA, 25 bp, mus musculus
acccatctcgttgctctgtttccct

SEQ ID NO: 45690 - DNA, 25 bp, mus musculus
catctcgttgctctgtttccctcag

SEQ ID NO: 45691 - DNA, 25 bp, mus musculus
aacccactgtgtaatttctgtgctg

SEQ ID NO: 45692 - DNA, 25 bp, mus musculus
ctgtgtaatttctgtgctgggatga

SEQ ID NO: 45693 - DNA, 25 bp, mus musculus
aatttctgtgctgggatgatcaagc

SEQ ID NO: 45694 - DNA, 25 bp, mus musculus
atgatcaagccatttgaattccatg

SEQ ID NO: 45695 - DNA, 25 bp, mus musculus
gtttcactctgatcaataagtgcca

SEQ ID NO: 45696 - DNA, 25 bp, mus musculus
ataagtgccaaagtcccaaggatct

SEQ ID NO: 45697 - DNA, 25 bp, mus musculus
atttcacagacgtcaatgggatcat

SEQ ID NO: 45698 - DNA, 25 bp, mus musculus
atgggatcattatccccacagcagt

SEQ ID NO: 45699 - DNA, 25 bp, mus musculus
ggatcattatccccacagcagtcgg

SEQ ID NO: 45700 - DNA, 25 bp, mus musculus
ccacagcagtcggtgctcttatctc

SEQ ID NO: 45701 - DNA, 25 bp, mus musculus
cagtcggtgctcttatctcttaggt

SEQ ID NO: 45702 - DNA, 25 bp, mus musculus
tcggtgctcttatctcttaggtgag

SEQ ID NO: 45703 - DNA, 25 bp, mus musculus
ttccatatatagcccttgtgaggga

SEQ ID NO: 45704 - DNA, 25 bp, mus musculus
catatatagcccttgtgagggaaga

SEQ ID NO: 45705 - DNA, 25 bp, mus musculus
aagatgttcggtgtgtagcgtacgt

SEQ ID NO: 45706 - DNA, 25 bp, mus musculus
atatcttgcttaatgggattgagtg

SEQ ID NO: 45707 - DNA, 25 bp, mus musculus
gccaaagtcccaaggatcttcacat

SEQ ID NO: 45708 - DNA, 25 bp, mus musculus
gcaatctccatcttggcatttgtcc

SEQ ID NO: 45709 - DNA, 25 bp, mus musculus
aaagtcccaaggatcttcacatgga

SEQ ID NO: 45710 - DNA, 25 bp, mus musculus
gtcccaaggatcttcacatggacca

SEQ ID NO: 45711 - DNA, 25 bp, mus musculus
atcttcacatggaccacgtctccac

SEQ ID NO: 45712 - DNA, 25 bp, mus musculus
ttcacatggaccacgtctccacggg

SEQ ID NO: 45713 - DNA, 25 bp, mus musculus
acctttgagcctatttcacagacgt

SEQ ID NO: 45714 - DNA, 25 bp, mus musculus
tttgagcctatttcacagacgtcaa

SEQ ID NO: 45715 - DNA, 25 bp, mus musculus
gagcctatttcacagacgtcaatgg

SEQ ID NO: 45716 - DNA, 25 bp, mus musculus
ccgtcctctgcaaacttgtcgttgc

SEQ ID NO: 45717 - DNA, 25 bp, mus musculus
tcctctgcaaacttgtcgttgcaca

SEQ ID NO: 45718 - DNA, 25 bp, mus musculus
gcatgtccactaggtacgtgagcac

SEQ ID NO: 45719 - DNA, 25 bp, mus musculus
tgtccactaggtacgtgagcaccgt

SEQ ID NO: 45720 - DNA, 25 bp, mus musculus
aggccacacagcacggaccagatgc

SEQ ID NO: 45721 - DNA, 25 bp, mus musculus
ccacacagcacggaccagatgccta

SEQ ID NO: 45722 - DNA, 25 bp, mus musculus
gaccagatgcctatccaggtgcgcg

SEQ ID NO: 45723 - DNA, 25 bp, mus musculus
cagctcactcatggcccgaagtaca

SEQ ID NO: 45724 - DNA, 25 bp, mus musculus
ctcactcatggcccgaagtacatga

SEQ ID NO: 45725 - DNA, 25 bp, mus musculus
actcatggcccgaagtacatgagcc

SEQ ID NO: 45726 - DNA, 25 bp, mus musculus
catggcccgaagtacatgagcccgt

SEQ ID NO: 45727 - DNA, 25 bp, mus musculus
tacatgagcccgtaaaccttggtgg

SEQ ID NO: 45728 - DNA, 25 bp, mus musculus
cggtcctccaacagaaagccagcga

SEQ ID NO: 45729 - DNA, 25 bp, mus musculus
tccaacagaaagccagcgatgtagg

SEQ ID NO: 45730 - DNA, 25 bp, mus musculus
atgtaggccaccgcaccgctgtgta

SEQ ID NO: 45731 - DNA, 25 bp, mus musculus
gcaccgctgtgtaacagccggacag

SEQ ID NO: 45732 - DNA, 25 bp, mus musculus
ctgtgtaacagccggacaggaaaat

SEQ ID NO: 45733 - DNA, 25 bp, mus musculus
agctgaagcgccgcatgtccactag

SEQ ID NO: 45734 - DNA, 25 bp, mus musculus
tgaagcgccgcatgtccactaggta

SEQ ID NO: 45735 - DNA, 25 bp, mus musculus
agcgccgcatgtccactaggtacgt

SEQ ID NO: 45736 - DNA, 25 bp, mus musculus
gggcttcagccacattcaaaataag

SEQ ID NO: 45737 - DNA, 25 bp, mus musculus
tctttgacatcttttaaagagtctg

SEQ ID NO: 45738 - DNA, 25 bp, mus musculus
tcatgctctggtcacccaagctgcc

SEQ ID NO: 45739 - DNA, 25 bp, mus musculus
tctggtcacccaagctgcctcagaa

SEQ ID NO: 45740 - DNA, 25 bp, mus musculus
ctcagaacccatttgcttctctcct

SEQ ID NO: 45741 - DNA, 25 bp, mus musculus
ttgaccccagatgtccagatgtttt

SEQ ID NO: 45742 - DNA, 25 bp, mus musculus
ccagatgtccagatgttttgcagtg

SEQ ID NO: 45743 - DNA, 25 bp, mus musculus
tgtcccttgttcttcgttctgctgc

SEQ ID NO: 45744 - DNA, 25 bp, mus musculus
cttccctcttcatggagtgattatg

SEQ ID NO: 45745 - DNA, 25 bp, mus musculus
ttcttttcactggtttatctacaga

SEQ ID NO: 45746 - DNA, 25 bp, mus musculus
gattcaacactgcactaagggggaa

SEQ ID NO: 45747 - DNA, 25 bp, mus musculus
tcaacactgcactaagggggaaatg

SEQ ID NO: 45748 - DNA, 25 bp, mus musculus
atctgactcgttgctcaatagggtt

SEQ ID NO: 45749 - DNA, 25 bp, mus musculus
ctcgttgctcaatagggtttatttg

SEQ ID NO: 45750 - DNA, 25 bp, mus musculus
cactcctgccagcagtacagggcac

SEQ ID NO: 45751 - DNA, 25 bp, mus musculus
cagtacagggcacagcccaagccac

SEQ ID NO: 45752 - DNA, 25 bp, mus musculus
aagccaccataggccagcctggagt

SEQ ID NO: 45753 - DNA, 25 bp, mus musculus
ccataggccagcctggagtcttttt

SEQ ID NO: 45754 - DNA, 25 bp, mus musculus
gccagcctggagtctttttcatgct

SEQ ID NO: 45755 - DNA, 25 bp, mus musculus
tctttttcatgctctggtcacccaa

SEQ ID NO: 45756 - DNA, 25 bp, mus musculus
tatgcaaatcctctgaatctacatg

SEQ ID NO: 45757 - DNA, 25 bp, mus musculus
gcaaatcctctgaatctacatggta

SEQ ID NO: 45758 - DNA, 25 bp, mus musculus
cacaggacctcaccatgggatggag

SEQ ID NO: 45759 - DNA, 25 bp, mus musculus
aggacctcaccatgggatggagctg

SEQ ID NO: 45760 - DNA, 25 bp, mus musculus
acctcaccatgggatggagctgtat

SEQ ID NO: 45761 - DNA, 25 bp, mus musculus
tccaactgcaggagtcaggacctga

SEQ ID NO: 45762 - DNA, 25 bp, mus musculus
gatacaaattctctagttctgttat

SEQ ID NO: 45763 - DNA, 25 bp, mus musculus
cggtctattactgtgcaagatcggc

SEQ ID NO: 45764 - DNA, 25 bp, mus musculus
tctattactgtgcaagatcggccta

SEQ ID NO: 45765 - DNA, 25 bp, mus musculus
attactgtgcaagatcggcctacta

SEQ ID NO: 45766 - DNA, 25 bp, mus musculus
gtgcaagatcggcctactatgatta

SEQ ID NO: 45767 - DNA, 25 bp, mus musculus
caagatcggcctactatgattacga

SEQ ID NO: 45768 - DNA, 25 bp, mus musculus
aatcctctgaatctacatggtaaat

SEQ ID NO: 45769 - DNA, 25 bp, mus musculus
tgagatcacagttctctctacagtt

SEQ ID NO: 45770 - DNA, 25 bp, mus musculus
gatcacagttctctctacagttact

SEQ ID NO: 45771 - DNA, 25 bp, mus musculus
agttctctctacagttactgagcac

SEQ ID NO: 45772 - DNA, 25 bp, mus musculus
tctctctacagttactgagcacaca

SEQ ID NO: 45773 - DNA, 25 bp, mus musculus
ctctacagttactgagcacacagga

SEQ ID NO: 45774 - DNA, 25 bp, mus musculus
agttactgagcacacaggacctcac

SEQ ID NO: 45775 - DNA, 25 bp, mus musculus
tgagcacacaggacctcaccatggg

SEQ ID NO: 45776 - DNA, 25 bp, mus musculus
ctcacgcatgtagtccatttagtcc

SEQ ID NO: 45777 - DNA, 25 bp, mus musculus
cacgcatgtagtccatttagtcctt

SEQ ID NO: 45778 - DNA, 25 bp, mus musculus
gctttcactcggaggcagtccagag

SEQ ID NO: 45779 - DNA, 25 bp, mus musculus
tttcactcggaggcagtccagagac

SEQ ID NO: 45780 - DNA, 25 bp, mus musculus
tcactcggaggcagtccagagacaa

SEQ ID NO: 45781 - DNA, 25 bp, mus musculus
gcagtccagagacaaccactctgtt

SEQ ID NO: 45782 - DNA, 25 bp, mus musculus
tccagagacaaccactctgttctcg

SEQ ID NO: 45783 - DNA, 25 bp, mus musculus
cagagacaaccactctgttctcgga

SEQ ID NO: 45784 - DNA, 25 bp, mus musculus
gagacaaccactctgttctcggacc

SEQ ID NO: 45785 - DNA, 25 bp, mus musculus
gacaaccactctgttctcggaccgc

SEQ ID NO: 45786 - DNA, 25 bp, mus musculus
accactctgttctcggaccgcctgg

SEQ ID NO: 45787 - DNA, 25 bp, mus musculus
ctgttctcggaccgcctggaactgc

SEQ ID NO: 45788 - DNA, 25 bp, mus musculus
tgtagtccatttagtccttgcagct

SEQ ID NO: 45789 - DNA, 25 bp, mus musculus
tagtccatttagtccttgcagcttt

SEQ ID NO: 45790 - DNA, 25 bp, mus musculus
gtccatttagtccttgcagctttca

SEQ ID NO: 45791 - DNA, 25 bp, mus musculus
ccatttagtccttgcagctttcact

SEQ ID NO: 45792 - DNA, 25 bp, mus musculus
ttagtccttgcagctttcactcgga

SEQ ID NO: 45793 - DNA, 25 bp, mus musculus
tccttgcagctttcactcggaggca

SEQ ID NO: 45794 - DNA, 25 bp, mus musculus
cttgcagctttcactcggaggcagt

SEQ ID NO: 45795 - DNA, 25 bp, mus musculus
cagctttcactcggaggcagtccag

SEQ ID NO: 45796 - DNA, 25 bp, mus musculus
ctattgtcacataacgtttaccatg

SEQ ID NO: 45797 - DNA, 25 bp, mus musculus
tcacataacgtttaccatgagaacc

SEQ ID NO: 45798 - DNA, 25 bp, mus musculus
cttgtgctgccaaagaccaatcaga

SEQ ID NO: 45799 - DNA, 25 bp, mus musculus
ctgccaaagaccaatcagattcagt

SEQ ID NO: 45800 - DNA, 25 bp, mus musculus
aagaccaatcagattcagtaaatgc

SEQ ID NO: 45801 - DNA, 25 bp, mus musculus
aatcctgggtcatttgctcggctat

SEQ ID NO: 45802 - DNA, 25 bp, mus musculus
gggtcatttgctcggctatcttcat

SEQ ID NO: 45803 - DNA, 25 bp, mus musculus
tttgctcggctatcttcatgaaccc

SEQ ID NO: 45804 - DNA, 25 bp, mus musculus
gaaacgtgcctgcactgagaatcct

SEQ ID NO: 45805 - DNA, 25 bp, mus musculus
tgccaccagccctgagagtcctgtg

SEQ ID NO: 45806 - DNA, 25 bp, mus musculus
cagccctgagagtcctgtgacagaa

SEQ ID NO: 45807 - DNA, 25 bp, mus musculus
ctgatttctgacttcacacctaccc

SEQ ID NO: 45808 - DNA, 25 bp, mus musculus
ccacctcaagatccacttcagacgt

SEQ ID NO: 45809 - DNA, 25 bp, mus musculus
caagatccacttcagacgtcaaccc

SEQ ID NO: 45810 - DNA, 25 bp, mus musculus
caaccagcacttctgctgcaaagag

SEQ ID NO: 45811 - DNA, 25 bp, mus musculus
atccaacacactcagaatgcaaaag

SEQ ID NO: 45812 - DNA, 25 bp, mus musculus
gatctacacttgccccgtctgtgac

SEQ ID NO: 45813 - DNA, 25 bp, mus musculus
ccccgtctgtgacagctcctttagg

SEQ ID NO: 45814 - DNA, 25 bp, mus musculus
ctgtgacagctcctttaggggaaag

SEQ ID NO: 45815 - DNA, 25 bp, mus musculus
ggatcacttgtgctgccaaagacca

SEQ ID NO: 45816 - DNA, 25 bp, mus musculus
aggtgtccactccgacatccagctg

SEQ ID NO: 45817 - DNA, 25 bp, mus musculus
gtgtccactccgacatccagctgac

SEQ ID NO: 45818 - DNA, 25 bp, mus musculus
gaactggtaccagcagaagtcaggc

SEQ ID NO: 45819 - DNA, 25 bp, mus musculus
actggtaccagcagaagtcaggcac

SEQ ID NO: 45820 - DNA, 25 bp, mus musculus
gatttatgacacatccaaactggct

SEQ ID NO: 45821 - DNA, 25 bp, mus musculus
tttatgacacatccaaactggcttc

SEQ ID NO: 45822 - DNA, 25 bp, mus musculus
ttatgacacatccaaactggcttct

SEQ ID NO: 45823 - DNA, 25 bp, mus musculus
atgacacatccaaactggcttctgg

SEQ ID NO: 45824 - DNA, 25 bp, mus musculus
cttattactgccagcagtggagcag

SEQ ID NO: 45825 - DNA, 25 bp, mus musculus
ttattactgccagcagtggagcagt

SEQ ID NO: 45826 - DNA, 25 bp, mus musculus
actgccagcagtggagcagtaaccc

SEQ ID NO: 45827 - DNA, 25 bp, mus musculus
ctgccagcagtggagcagtaaccca

SEQ ID NO: 45828 - DNA, 25 bp, mus musculus
agaaggtcaccatgacctgcagtgc

SEQ ID NO: 45829 - DNA, 25 bp, mus musculus
gaaggtcaccatgacctgcagtgcc

SEQ ID NO: 45830 - DNA, 25 bp, mus musculus
aggtcaccatgacctgcagtgccag

SEQ ID NO: 45831 - DNA, 25 bp, mus musculus
gtgccagctcaagtgtaagttacat

SEQ ID NO: 45832 - DNA, 25 bp, mus musculus
tgccagctcaagtgtaagttacatg

SEQ ID NO: 45833 - DNA, 25 bp, mus musculus
acatgaactggtaccagcagaagtc

SEQ ID NO: 45834 - DNA, 25 bp, mus musculus
catgaactggtaccagcagaagtca

SEQ ID NO: 45835 - DNA, 25 bp, mus musculus
tgaactggtaccagcagaagtcagg

SEQ ID NO: 45836 - DNA, 25 bp, mus musculus
gtgatgtccaggttacttgtgtcaa

SEQ ID NO: 45837 - DNA, 25 bp, mus musculus
accgcatccacatagatcttggtac

SEQ ID NO: 45838 - DNA, 25 bp, mus musculus
aacaggattcctatgtagagcgagg

SEQ ID NO: 45839 - DNA, 25 bp, mus musculus
ctccgcacgtggtcgtcaatatagg

SEQ ID NO: 45840 - DNA, 25 bp, mus musculus
cgcacgtggtcgtcaatataggaga

SEQ ID NO: 45841 - DNA, 25 bp, mus musculus
tcaatataggagacccccaggggct

SEQ ID NO: 45842 - DNA, 25 bp, mus musculus
atataggagacccccaggggctgca

SEQ ID NO: 45843 - DNA, 25 bp, mus musculus
cccaggagcacctgagccccaataa

SEQ ID NO: 45844 - DNA, 25 bp, mus musculus
aggagcacctgagccccaataagca

SEQ ID NO: 45845 - DNA, 25 bp, mus musculus
tgagccccaataagcagcaagtaca

SEQ ID NO: 45846 - DNA, 25 bp, mus musculus
gccccaataagcagcaagtacatca

SEQ ID NO: 45847 - DNA, 25 bp, mus musculus
aagtacatcatgttcgtggctgtcc

SEQ ID NO: 45848 - DNA, 25 bp, mus musculus
gcatccacatagatcttggtacaga

SEQ ID NO: 45849 - DNA, 25 bp, mus musculus
atcatgttcgtggctgtccggttac

SEQ ID NO: 45850 - DNA, 25 bp, mus musculus
tccacatagatcttggtacagaaag

SEQ ID NO: 45851 - DNA, 25 bp, mus musculus
agaataaatccacaggctggtccaa

SEQ ID NO: 45852 - DNA, 25 bp, mus musculus
aatccacaggctggtccaaatacca

SEQ ID NO: 45853 - DNA, 25 bp, mus musculus
caggctggtccaaataccaacatcg

SEQ ID NO: 45854 - DNA, 25 bp, mus musculus
gctggtccaaataccaacatcgtga

SEQ ID NO: 45855 - DNA, 25 bp, mus musculus
aataccaacatcgtgaacaggattc

SEQ ID NO: 45856 - DNA, 25 bp, mus musculus
accaacatcgtgaacaggattccta

SEQ ID NO: 45857 - DNA, 25 bp, mus musculus
catacttgaacctacactgggcaaa

SEQ ID NO: 45858 - DNA, 25 bp, mus musculus
ttgattccgccaacgggatcaatat

SEQ ID NO: 45859 - DNA, 25 bp, mus musculus
gtcaccctaatggacagaggctctt

SEQ ID NO: 45860 - DNA, 25 bp, mus musculus
ctacatcagaggtcctccgcattca

SEQ ID NO: 45861 - DNA, 25 bp, mus musculus
cagaggtcctccgcattcagaacat

SEQ ID NO: 45862 - DNA, 25 bp, mus musculus
tcctccgcattcagaacattctatc

SEQ ID NO: 45863 - DNA, 25 bp, mus musculus
gcattcagaacattctatccgagaa

SEQ ID NO: 45864 - DNA, 25 bp, mus musculus
agccatcagtgacaacggtgtatat

SEQ ID NO: 45865 - DNA, 25 bp, mus musculus
tcgtaggcactttataccagaaagc

SEQ ID NO: 45866 - DNA, 25 bp, mus musculus
gcactttataccagaaagccttgta

SEQ ID NO: 45867 - DNA, 25 bp, mus musculus
tataccagaaagccttgtactgtga

SEQ ID NO: 45868 - DNA, 25 bp, mus musculus
ccttgtactgtgaactctaaattgt

SEQ ID NO: 45869 - DNA, 25 bp, mus musculus
tcaatatttcacctgataaaaagta

SEQ ID NO: 45870 - DNA, 25 bp, mus musculus
atgtctacgttgctgacatactggc

SEQ ID NO: 45871 - DNA, 25 bp, mus musculus
acgttgctgacatactggcccatga

SEQ ID NO: 45872 - DNA, 25 bp, mus musculus
tactggcccatgaaatccatgtttt

SEQ ID NO: 45873 - DNA, 25 bp, mus musculus
aggttctgcagttgggcacgctggt

SEQ ID NO: 45874 - DNA, 25 bp, mus musculus
atttatctattgatccttcctcggg

SEQ ID NO: 45875 - DNA, 25 bp, mus musculus
ctattgatccttcctcgggcgacat

SEQ ID NO: 45876 - DNA, 25 bp, mus musculus
tcggctgtcaccctaatggacagag

SEQ ID NO: 45877 - DNA, 25 bp, mus musculus
tccactagctcactggcggcgagaa

SEQ ID NO: 45878 - DNA, 25 bp, mus musculus
ctgcagcttcattcctcatccgctt

SEQ ID NO: 45879 - DNA, 25 bp, mus musculus
gatctctttcatttcatctgcatac

SEQ ID NO: 45880 - DNA, 25 bp, mus musculus
ctctttcatttcatctgcataccga

SEQ ID NO: 45881 - DNA, 25 bp, mus musculus
tttcatttcatctgcataccgacag

SEQ ID NO: 45882 - DNA, 25 bp, mus musculus
catttcatctgcataccgacagaag

SEQ ID NO: 45883 - DNA, 25 bp, mus musculus
atctgcataccgacagaaggcgcct

SEQ ID NO: 45884 - DNA, 25 bp, mus musculus
tgcataccgacagaaggcgcctcca

SEQ ID NO: 45885 - DNA, 25 bp, mus musculus
ccgacagaaggcgcctccaaacttg

SEQ ID NO: 45886 - DNA, 25 bp, mus musculus
gaaggcgcctccaaacttgccccag

SEQ ID NO: 45887 - DNA, 25 bp, mus musculus
tccaaacttgccccaggccttgaag

SEQ ID NO: 45888 - DNA, 25 bp, mus musculus
ccaggccttgaagggcacggtgatg

SEQ ID NO: 45889 - DNA, 25 bp, mus musculus
agctagctgcttcactctgtaaagc

SEQ ID NO: 45890 - DNA, 25 bp, mus musculus
cttgaagggcacggtgatggcattg

SEQ ID NO: 45891 - DNA, 25 bp, mus musculus
ctgcttcactctgtaaagcttatcc

SEQ ID NO: 45892 - DNA, 25 bp, mus musculus
cttcactctgtaaagcttatccctc

SEQ ID NO: 45893 - DNA, 25 bp, mus musculus
tctgtaaagcttatccctctgtcgc

SEQ ID NO: 45894 - DNA, 25 bp, mus musculus
gtaaagcttatccctctgtcgctcc

SEQ ID NO: 45895 - DNA, 25 bp, mus musculus
aagcttatccctctgtcgctcctgg

SEQ ID NO: 45896 - DNA, 25 bp, mus musculus
tcgctcctggatctctttcatttca

SEQ ID NO: 45897 - DNA, 25 bp, mus musculus
ctcctggatctctttcatttcatct

SEQ ID NO: 45898 - DNA, 25 bp, mus musculus
gtcaaagttgtggcccaaggattca

SEQ ID NO: 45899 - DNA, 25 bp, mus musculus
ggattcagttctgccaacggaatca

SEQ ID NO: 45900 - DNA, 25 bp, mus musculus
gatattttggcaggctgccacccta

SEQ ID NO: 45901 - DNA, 25 bp, mus musculus
atctataatcctgagggccctccag

SEQ ID NO: 45902 - DNA, 25 bp, mus musculus
ttgtcagataagcccagggtgagca

SEQ ID NO: 45903 - DNA, 25 bp, mus musculus
acactgtatgcgaacaacggctctg

SEQ ID NO: 45904 - DNA, 25 bp, mus musculus
tatgcgaacaacggctctgtgcttc

SEQ ID NO: 45905 - DNA, 25 bp, mus musculus
agcaccgtggcttctgtgtatcata

SEQ ID NO: 45906 - DNA, 25 bp, mus musculus
actatatttcacaaagctctgtact

SEQ ID NO: 45907 - DNA, 25 bp, mus musculus
aaagctctgtactgtgacctctaga

SEQ ID NO: 45908 - DNA, 25 bp, mus musculus
ctgtactgtgacctctagatctttc

SEQ ID NO: 45909 - DNA, 25 bp, mus musculus
tgtgacctctagatctttctaaaac

SEQ ID NO: 45910 - DNA, 25 bp, mus musculus
agttctgccaacggaatcacagtct

SEQ ID NO: 45911 - DNA, 25 bp, mus musculus
gccaacggaatcacagtctcactag

SEQ ID NO: 45912 - DNA, 25 bp, mus musculus
ggaatcacagtctcactagaccaga

SEQ ID NO: 45913 - DNA, 25 bp, mus musculus
aagtttgtctatgtagctgatgtaa

SEQ ID NO: 45914 - DNA, 25 bp, mus musculus
gatttaactccagtgaaggtcattc

SEQ ID NO: 45915 - DNA, 25 bp, mus musculus
gtcattcagctggggaccttagtgg

SEQ ID NO: 45916 - DNA, 25 bp, mus musculus
gataacctgaccgttgctccagcca

SEQ ID NO: 45917 - DNA, 25 bp, mus musculus
gttgctccagccacgggagatattt

SEQ ID NO: 45918 - DNA, 25 bp, mus musculus
ctggatacacattcactgactccta

SEQ ID NO: 45919 - DNA, 25 bp, mus musculus
acacattcactgactcctacatgaa

SEQ ID NO: 45920 - DNA, 25 bp, mus musculus
gtactagctacaaccagaagttcaa

SEQ ID NO: 45921 - DNA, 25 bp, mus musculus
actagctacaaccagaagttcaagg

SEQ ID NO: 45922 - DNA, 25 bp, mus musculus
tagctacaaccagaagttcaagggc

SEQ ID NO: 45923 - DNA, 25 bp, mus musculus
gtagacaaatctctcagcacagcct

SEQ ID NO: 45924 - DNA, 25 bp, mus musculus
aaatctctcagcacagcctacatgc

SEQ ID NO: 45925 - DNA, 25 bp, mus musculus
atctctcagcacagcctacatgcag

SEQ ID NO: 45926 - DNA, 25 bp, mus musculus
ctctcagcacagcctacatgcagct

SEQ ID NO: 45927 - DNA, 25 bp, mus musculus
ctgcggtctactactgtgcaagaga

SEQ ID NO: 45928 - DNA, 25 bp, mus musculus
tctactactgtgcaagagaggatta

SEQ ID NO: 45929 - DNA, 25 bp, mus musculus
tactactgtgcaagagaggattact

SEQ ID NO: 45930 - DNA, 25 bp, mus musculus
actgactcctacatgaactgggtga

SEQ ID NO: 45931 - DNA, 25 bp, mus musculus
tgactcctacatgaactgggtgaag

SEQ ID NO: 45932 - DNA, 25 bp, mus musculus
agagccttgagtggattggacgtgt

SEQ ID NO: 45933 - DNA, 25 bp, mus musculus
agccttgagtggattggacgtgtta

SEQ ID NO: 45934 - DNA, 25 bp, mus musculus
tgttaatcctagcaatggtggtact

SEQ ID NO: 45935 - DNA, 25 bp, mus musculus
ttaatcctagcaatggtggtactag

SEQ ID NO: 45936 - DNA, 25 bp, mus musculus
aatcctagcaatggtggtactagct

SEQ ID NO: 45937 - DNA, 25 bp, mus musculus
tggtactagctacaaccagaagttc

SEQ ID NO: 45938 - DNA, 25 bp, mus musculus
ctacctatatatcatggacttgagg

SEQ ID NO: 45939 - DNA, 25 bp, mus musculus
atatatcatggacttgaggacagag

SEQ ID NO: 45940 - DNA, 25 bp, mus musculus
tgctgacaccaggagctaccaccgc

SEQ ID NO: 45941 - DNA, 25 bp, mus musculus
caccaggagctaccaccgctgactg

SEQ ID NO: 45942 - DNA, 25 bp, mus musculus
gagctaccaccgctgactgactttg

SEQ ID NO: 45943 - DNA, 25 bp, mus musculus
tgtctatggcagccaactgcatgaa

SEQ ID NO: 45944 - DNA, 25 bp, mus musculus
tggcagccaactgcatgaaccaaag

SEQ ID NO: 45945 - DNA, 25 bp, mus musculus
catcacgcagtgcacaatcatttat

SEQ ID NO: 45946 - DNA, 25 bp, mus musculus
actgacatacaccgcagcatgctaa

SEQ ID NO: 45947 - DNA, 25 bp, mus musculus
tacaccattgacttcatttgatctt

SEQ ID NO: 45948 - DNA, 25 bp, mus musculus
tggatttatctttctgagtggaata

SEQ ID NO: 45949 - DNA, 25 bp, mus musculus
aatgattcactaatctgcctaattg

SEQ ID NO: 45950 - DNA, 25 bp, mus musculus
gagcctaattagccgctggcctctg

SEQ ID NO: 45951 - DNA, 25 bp, mus musculus
tcactaatctgcctaattggttgcc

SEQ ID NO: 45952 - DNA, 25 bp, mus musculus
aattagccgctggcctctgccagag

SEQ ID NO: 45953 - DNA, 25 bp, mus musculus
gcctctgccagagtacaggaaatca

SEQ ID NO: 45954 - DNA, 25 bp, mus musculus
aggcaccagcttcctggcaggcgaa

SEQ ID NO: 45955 - DNA, 25 bp, mus musculus
ttagtctttgccaccagcatgcctg

SEQ ID NO: 45956 - DNA, 25 bp, mus musculus
tttgccaccagcatgcctgaccaca

SEQ ID NO: 45957 - DNA, 25 bp, mus musculus
accagcatgcctgaccacagtattc

SEQ ID NO: 45958 - DNA, 25 bp, mus musculus
gagcattgctgacaccaggagctac

SEQ ID NO: 45959 - DNA, 25 bp, mus musculus
ttgtctgcttcagccaggatgtccc

SEQ ID NO: 45960 - DNA, 25 bp, mus musculus
atgtccctctcagccttgacatggg

SEQ ID NO: 45961 - DNA, 25 bp, mus musculus
tccagcttacaagcgaggcacactt

SEQ ID NO: 45962 - DNA, 25 bp, mus musculus
tccccaaaggcaccgatgcctagag

SEQ ID NO: 45963 - DNA, 25 bp, mus musculus
aaggcaccgatgcctagagtcttga

SEQ ID NO: 45964 - DNA, 25 bp, mus musculus
attttcacaaacatggacttgtcca

SEQ ID NO: 45965 - DNA, 25 bp, mus musculus
ttgtccatcttggccctcttcagcc

SEQ ID NO: 45966 - DNA, 25 bp, mus musculus
atcttggccctcttcagccggttgt

SEQ ID NO: 45967 - DNA, 25 bp, mus musculus
ttcagccggttgtagttagactcct

SEQ ID NO: 45968 - DNA, 25 bp, mus musculus
tagttagactccttctggtagagga

SEQ ID NO: 45969 - DNA, 25 bp, mus musculus
tagaggatcttcctcatctgctcct

SEQ ID NO: 45970 - DNA, 25 bp, mus musculus
tgctcggcctcacagagcccagctt

SEQ ID NO: 45971 - DNA, 25 bp, mus musculus
gccttgacatgggccacttgattcc

SEQ ID NO: 45972 - DNA, 25 bp, mus musculus
cagagcccagctttggccatttcct

SEQ ID NO: 45973 - DNA, 25 bp, mus musculus
gccacttgattccggttcaggacat

SEQ ID NO: 45974 - DNA, 25 bp, mus musculus
tgattccggttcaggacatccttct

SEQ ID NO: 45975 - DNA, 25 bp, mus musculus
aggacatccttcttcctgagagtct

SEQ ID NO: 45976 - DNA, 25 bp, mus musculus
tccttcttcctgagagtcttcatgg

SEQ ID NO: 45977 - DNA, 25 bp, mus musculus
ttcctgagagtcttcatggcgtaca

SEQ ID NO: 45978 - DNA, 25 bp, mus musculus
agagtcttcatggcgtacagagcgt

SEQ ID NO: 45979 - DNA, 25 bp, mus musculus
tgagtgtccagcttacaagcgaggc

SEQ ID NO: 45980 - DNA, 25 bp, mus musculus
agaattgtcgtttagcctgcataaa

SEQ ID NO: 45981 - DNA, 25 bp, mus musculus
attgtcgtttagcctgcataaactc

SEQ ID NO: 45982 - DNA, 25 bp, mus musculus
cgattctcagcctgtgggtcccgac

SEQ ID NO: 45983 - DNA, 25 bp, mus musculus
gatagactggcttgtacttggtagt

SEQ ID NO: 45984 - DNA, 25 bp, mus musculus
ccaccagtgtagcacagtaaagcgt

SEQ ID NO: 45985 - DNA, 25 bp, mus musculus
cgtgtcttccactgcgacattgtga

SEQ ID NO: 45986 - DNA, 25 bp, mus musculus
gtcttccactgcgacattgtgatat

SEQ ID NO: 45987 - DNA, 25 bp, mus musculus
gtgatattcccacctaactcaacgc

SEQ ID NO: 45988 - DNA, 25 bp, mus musculus
tcaacgcaccaaacctctaaatcaa

SEQ ID NO: 45989 - DNA, 25 bp, mus musculus
caccaaacctctaaatcaatgagac

SEQ ID NO: 45990 - DNA, 25 bp, mus musculus
caaacctctaaatcaatgagacaac

SEQ ID NO: 45991 - DNA, 25 bp, mus musculus
acctctaaatcaatgagacaaccac

SEQ ID NO: 45992 - DNA, 25 bp, mus musculus
gtttagcctgcataaactctccgag

SEQ ID NO: 45993 - DNA, 25 bp, mus musculus
aatcaatgagacaaccaccaacatt

SEQ ID NO: 45994 - DNA, 25 bp, mus musculus
cctgcataaactctccgagtgactg

SEQ ID NO: 45995 - DNA, 25 bp, mus musculus
taaactctccgagtgactgaaagtg

SEQ ID NO: 45996 - DNA, 25 bp, mus musculus
actctccgagtgactgaaagtggtt

SEQ ID NO: 45997 - DNA, 25 bp, mus musculus
ggtacacagttcttagagtgtttca

SEQ ID NO: 45998 - DNA, 25 bp, mus musculus
tgtttcatcagaatcacgcagagtc

SEQ ID NO: 45999 - DNA, 25 bp, mus musculus
atcagaatcacgcagagtcatatgg

SEQ ID NO: 46000 - DNA, 25 bp, mus musculus
atcacgcagagtcatatggaattaa

SEQ ID NO: 46001 - DNA, 25 bp, mus musculus
actctataaagaccttgttgtgagc

SEQ ID NO: 46002 - DNA, 25 bp, mus musculus
ctataaagaccttgttgtgagccaa

SEQ ID NO: 46003 - DNA, 25 bp, mus musculus
tggtatttctgcagcatttctggct

SEQ ID NO: 46004 - DNA, 25 bp, mus musculus
ttctgcagcatttctggctgatgtc

SEQ ID NO: 46005 - DNA, 25 bp, mus musculus
tgcagcatttctggctgatgtccgg

SEQ ID NO: 46006 - DNA, 25 bp, mus musculus
agcatttctggctgatgtccggccc

SEQ ID NO: 46007 - DNA, 25 bp, mus musculus
gccccaaacggatggctgtaatggt

SEQ ID NO: 46008 - DNA, 25 bp, mus musculus
taatttaacttctgatatcattgaa

SEQ ID NO: 46009 - DNA, 25 bp, mus musculus
tttaacttctgatatcattgaatct

SEQ ID NO: 46010 - DNA, 25 bp, mus musculus
tatatttaggacctatccagcagta

SEQ ID NO: 46011 - DNA, 25 bp, mus musculus
gacctatccagcagtaaaaatgaaa

SEQ ID NO: 46012 - DNA, 25 bp, mus musculus
ctatccagcagtaaaaatgaaatat

SEQ ID NO: 46013 - DNA, 25 bp, mus musculus
agaccttgttgtgagccaagtgatc

SEQ ID NO: 46014 - DNA, 25 bp, mus musculus
ccttgttgtgagccaagtgatcagt

SEQ ID NO: 46015 - DNA, 25 bp, mus musculus
ccaagtgatcagtgctgaggaattc

SEQ ID NO: 46016 - DNA, 25 bp, mus musculus
attctgggccaatcgtttaaatgtg

SEQ ID NO: 46017 - DNA, 25 bp, mus musculus
tagttctacatccagtcacaagcag

SEQ ID NO: 46018 - DNA, 25 bp, mus musculus
ttctacatccagtcacaagcaggat

SEQ ID NO: 46019 - DNA, 25 bp, mus musculus
tacatccagtcacaagcaggatgtt

SEQ ID NO: 46020 - DNA, 25 bp, mus musculus
cagtcacaagcaggatgttggtatt

SEQ ID NO: 46021 - DNA, 25 bp, mus musculus
gtccttggcctcatagacacagaaa

SEQ ID NO: 46022 - DNA, 25 bp, mus musculus
cttggcctcatagacacagaaacag

SEQ ID NO: 46023 - DNA, 25 bp, mus musculus
cttgcaacacttgcacagtgaaaat

SEQ ID NO: 46024 - DNA, 25 bp, mus musculus
acacttgcacagtgaaaatgtaatt

SEQ ID NO: 46025 - DNA, 25 bp, mus musculus
tgtcacaaaccactttgggcctgca

SEQ ID NO: 46026 - DNA, 25 bp, mus musculus
aaaccactttgggcctgcagttgtg

SEQ ID NO: 46027 - DNA, 25 bp, mus musculus
ctttgggcctgcagttgtgaacttg

SEQ ID NO: 46028 - DNA, 25 bp, mus musculus
tgggcctgcagttgtgaacttgatt

SEQ ID NO: 46029 - DNA, 25 bp, mus musculus
gttgtatcggctttacctcacactg

SEQ ID NO: 46030 - DNA, 25 bp, mus musculus
tcggctttacctcacactgaatgaa

SEQ ID NO: 46031 - DNA, 25 bp, mus musculus
ttacctcacactgaatgaaacaatg

SEQ ID NO: 46032 - DNA, 25 bp, mus musculus
cctcacactgaatgaaacaatgata

SEQ ID NO: 46033 - DNA, 25 bp, mus musculus
gcctcatacttcagtaagccctacc

SEQ ID NO: 46034 - DNA, 25 bp, mus musculus
tacccacaaaagtatctttccagag

SEQ ID NO: 46035 - DNA, 25 bp, mus musculus
ccacaaaagtatctttccagagata

SEQ ID NO: 46036 - DNA, 25 bp, mus musculus
aagtatctttccagagatacacaaa

SEQ ID NO: 46037 - DNA, 25 bp, mus musculus
tatctttccagagatacacaaattt

SEQ ID NO: 46038 - DNA, 25 bp, mus musculus
ctttccagagatacacaaattttgg

SEQ ID NO: 46039 - DNA, 25 bp, mus musculus
gggtacacctcatcatgagaaattc

SEQ ID NO: 46040 - DNA, 25 bp, mus musculus
gaaattcttgcaacacttgcacagt

SEQ ID NO: 46041 - DNA, 25 bp, mus musculus
tagtcttcacttgcttctcagctga

SEQ ID NO: 46042 - DNA, 25 bp, mus musculus
cttcacttgcttctcagctgaccct

SEQ ID NO: 46043 - DNA, 25 bp, mus musculus
tctcatcctacagcagagtggagtc

SEQ ID NO: 46044 - DNA, 25 bp, mus musculus
ctcatcctacagcagagtggagtca

SEQ ID NO: 46045 - DNA, 25 bp, mus musculus
atcctacagcagagtggagtcattt

SEQ ID NO: 46046 - DNA, 25 bp, mus musculus
tcctacagcagagtggagtcatttc

SEQ ID NO: 46047 - DNA, 25 bp, mus musculus
ggagtcatttccttattgatggggt

SEQ ID NO: 46048 - DNA, 25 bp, mus musculus
gagtcatttccttattgatggggtg

SEQ ID NO: 46049 - DNA, 25 bp, mus musculus
agtcatttccttattgatggggtgc

SEQ ID NO: 46050 - DNA, 25 bp, mus musculus
tcatttccttattgatggggtgcaa

SEQ ID NO: 46051 - DNA, 25 bp, mus musculus
catttccttattgatggggtgcaaa

SEQ ID NO: 46052 - DNA, 25 bp, mus musculus
ttccttattgatggggtgcaaaatg

SEQ ID NO: 46053 - DNA, 25 bp, mus musculus
ttcacttgcttctcagctgaccctg

SEQ ID NO: 46054 - DNA, 25 bp, mus musculus
ttctcagctgaccctggtgtctcca

SEQ ID NO: 46055 - DNA, 25 bp, mus musculus
ttcaaagtccagtctcccagtccgt

SEQ ID NO: 46056 - DNA, 25 bp, mus musculus
agtccgtctggctgtgatagaagag

SEQ ID NO: 46057 - DNA, 25 bp, mus musculus
gtccgtctggctgtgatagaagagt

SEQ ID NO: 46058 - DNA, 25 bp, mus musculus
tccgtctggctgtgatagaagagtg

SEQ ID NO: 46059 - DNA, 25 bp, mus musculus
aagagtgacctctctcctctcatcc

SEQ ID NO: 46060 - DNA, 25 bp, mus musculus
ctctcatcctacagcagagtggagt

SEQ ID NO: 46061 - DNA, 25 bp, mus musculus
gtcgcgagattcatcaccctcggaa

SEQ ID NO: 46062 - DNA, 25 bp, mus musculus
cgcgagattcatcaccctcggaact

SEQ ID NO: 46063 - DNA, 25 bp, mus musculus
ttattcaagcatctgcacgataagc

SEQ ID NO: 46064 - DNA, 25 bp, mus musculus
attcaagcatctgcacgataagctg

SEQ ID NO: 46065 - DNA, 25 bp, mus musculus
aagcatctgcacgataagctgcagg

SEQ ID NO: 46066 - DNA, 25 bp, mus musculus
gcatctgcacgataagctgcaggcc

SEQ ID NO: 46067 - DNA, 25 bp, mus musculus
atctgcacgataagctgcaggccac

SEQ ID NO: 46068 - DNA, 25 bp, mus musculus
acgataagctgcaggccacggcggg

SEQ ID NO: 46069 - DNA, 25 bp, mus musculus
taagctgcaggccacggcgggccaa

SEQ ID NO: 46070 - DNA, 25 bp, mus musculus
agctgcaggccacggcgggccaatg

SEQ ID NO: 46071 - DNA, 25 bp, mus musculus
gccaatgatagcacttctgtgttgg

SEQ ID NO: 46072 - DNA, 25 bp, mus musculus
caatgatagcacttctgtgttggcg

SEQ ID NO: 46073 - DNA, 25 bp, mus musculus
cgagattcatcaccctcggaactta

SEQ ID NO: 46074 - DNA, 25 bp, mus musculus
agattcatcaccctcggaacttatt

SEQ ID NO: 46075 - DNA, 25 bp, mus musculus
tcatcaccctcggaacttattcaag

SEQ ID NO: 46076 - DNA, 25 bp, mus musculus
atcaccctcggaacttattcaagca

SEQ ID NO: 46077 - DNA, 25 bp, mus musculus
caccctcggaacttattcaagcatc

SEQ ID NO: 46078 - DNA, 25 bp, mus musculus
ccctcggaacttattcaagcatctg

SEQ ID NO: 46079 - DNA, 25 bp, mus musculus
gaacttattcaagcatctgcacgat

SEQ ID NO: 46080 - DNA, 25 bp, mus musculus
acttattcaagcatctgcacgataa

SEQ ID NO: 46081 - DNA, 25 bp, mus musculus
tacccatgagcatctacagaaaatg

SEQ ID NO: 46082 - DNA, 25 bp, mus musculus
acgtcagcagcatgggaggcacggt

SEQ ID NO: 46083 - DNA, 25 bp, mus musculus
caatcatcagacaggagcttgacaa

SEQ ID NO: 46084 - DNA, 25 bp, mus musculus
caggctcacaggacatttgggataa

SEQ ID NO: 46085 - DNA, 25 bp, mus musculus
actatggccaggactacgtccatac

SEQ ID NO: 46086 - DNA, 25 bp, mus musculus
gccaggactacgtccatacacagaa

SEQ ID NO: 46087 - DNA, 25 bp, mus musculus
cacagaagctcatcatcccgacctt

SEQ ID NO: 46088 - DNA, 25 bp, mus musculus
ctgtgcttcgggacatccagcatgc

SEQ ID NO: 46089 - DNA, 25 bp, mus musculus
ttcgggacatccagcatgccatttc

SEQ ID NO: 46090 - DNA, 25 bp, mus musculus
acatccagcatgccatttctgcaag

SEQ ID NO: 46091 - DNA, 25 bp, mus musculus
agcatgccatttctgcaaggaaccc

SEQ ID NO: 46092 - DNA, 25 bp, mus musculus
cttacctgtgggtctgcttagcagc

SEQ ID NO: 46093 - DNA, 25 bp, mus musculus
gcacggttccacttcaaatgacatc

SEQ ID NO: 46094 - DNA, 25 bp, mus musculus
ttccacttcaaatgacatcagctta

SEQ ID NO: 46095 - DNA, 25 bp, mus musculus
cagcttatgcagccacaaaggcagc

SEQ ID NO: 46096 - DNA, 25 bp, mus musculus
atgcagccacaaaggcagctctaac

SEQ ID NO: 46097 - DNA, 25 bp, mus musculus
ccacaaaggcagctctaaccatgtt

SEQ ID NO: 46098 - DNA, 25 bp, mus musculus
aggcagctctaaccatgttctcaac

SEQ ID NO: 46099 - DNA, 25 bp, mus musculus
ccatgttctcaacaatcatcagaca

SEQ ID NO: 46100 - DNA, 25 bp, mus musculus
tctcaacaatcatcagacaggagct

SEQ ID NO: 46101 - DNA, 25 bp, mus musculus
ccggccattcaacttcttcgaggag

SEQ ID NO: 46102 - DNA, 25 bp, mus musculus
ggatccatccctggcatctagagac

SEQ ID NO: 46103 - DNA, 25 bp, mus musculus
caatgggacctacaagcctgtgtga

SEQ ID NO: 46104 - DNA, 25 bp, mus musculus
tgggacctacaagcctgtgtgatgg

SEQ ID NO: 46105 - DNA, 25 bp, mus musculus
ccagcctctgaagcatatccccaga

SEQ ID NO: 46106 - DNA, 25 bp, mus musculus
tctgaagcatatccccagattctca

SEQ ID NO: 46107 - DNA, 25 bp, mus musculus
gcatatccccagattctcacaaaca

SEQ ID NO: 46108 - DNA, 25 bp, mus musculus
tatccccagattctcacaaacactg

SEQ ID NO: 46109 - DNA, 25 bp, mus musculus
ccccagattctcacaaacactggaa

SEQ ID NO: 46110 - DNA, 25 bp, mus musculus
attctcacaaacactggaaaatcaa

SEQ ID NO: 46111 - DNA, 25 bp, mus musculus
cttctgtttctaccctgcaggctgc

SEQ ID NO: 46112 - DNA, 25 bp, mus musculus
ctgtttctaccctgcaggctgcttt

SEQ ID NO: 46113 - DNA, 25 bp, mus musculus
tccatccctggcatctagagacact

SEQ ID NO: 46114 - DNA, 25 bp, mus musculus
ctaccctgcaggctgctttttagca

SEQ ID NO: 46115 - DNA, 25 bp, mus musculus
tgtgatagtgtggccccaggacaac

SEQ ID NO: 46116 - DNA, 25 bp, mus musculus
gccccaggacaacggtctcaaccat

SEQ ID NO: 46117 - DNA, 25 bp, mus musculus
tctcaaccatgttcagcgctggatc

SEQ ID NO: 46118 - DNA, 25 bp, mus musculus
ctggatccctgagaacagggactgc

SEQ ID NO: 46119 - DNA, 25 bp, mus musculus
gaacagggactgcttggtgtctcct

SEQ ID NO: 46120 - DNA, 25 bp, mus musculus
ggtgtctcctccttttagctacaat

SEQ ID NO: 46121 - DNA, 25 bp, mus musculus
gtctcctccttttagctacaatggg

SEQ ID NO: 46122 - DNA, 25 bp, mus musculus
aggctccttgttcactccaagtcag

SEQ ID NO: 46123 - DNA, 25 bp, mus musculus
cttgttcactccaagtcaggagagg

SEQ ID NO: 46124 - DNA, 25 bp, mus musculus
cattcaaatcagtccttctggggac

SEQ ID NO: 46125 - DNA, 25 bp, mus musculus
tcaaatcagtccttctggggacagt

SEQ ID NO: 46126 - DNA, 25 bp, mus musculus
cagtccttctggggacagtttactg

SEQ ID NO: 46127 - DNA, 25 bp, mus musculus
cagtttactgtctttggctggaaat

SEQ ID NO: 46128 - DNA, 25 bp, mus musculus
tttactgtctttggctggaaatgaa

SEQ ID NO: 46129 - DNA, 25 bp, mus musculus
actgtctttggctggaaatgaagcc

SEQ ID NO: 46130 - DNA, 25 bp, mus musculus
tgaagcctgcaggtacgggccccac

SEQ ID NO: 46131 - DNA, 25 bp, mus musculus
agtgcaccgacgtgtccctcggctc

SEQ ID NO: 46132 - DNA, 25 bp, mus musculus
tcggctcaccgtttccttggccctg

SEQ ID NO: 46133 - DNA, 25 bp, mus musculus
ggctctgtggccatctgaggaagca

SEQ ID NO: 46134 - DNA, 25 bp, mus musculus
gctaggccggctgcagtttcccagg

SEQ ID NO: 46135 - DNA, 25 bp, mus musculus
ccggctgcagtttcccagggctact

SEQ ID NO: 46136 - DNA, 25 bp, mus musculus
gctgcagtttcccagggctacttgt

SEQ ID NO: 46137 - DNA, 25 bp, mus musculus
tcccagggctacttgttccaagcgg

SEQ ID NO: 46138 - DNA, 25 bp, mus musculus
cagggctacttgttccaagcgggtg

SEQ ID NO: 46139 - DNA, 25 bp, mus musculus
gggggccagacccattcaaatcagt

SEQ ID NO: 46140 - DNA, 25 bp, mus musculus
cagacccattcaaatcagtccttct

SEQ ID NO: 46141 - DNA, 25 bp, mus musculus
acccattcaaatcagtccttctggg

SEQ ID NO: 46142 - DNA, 25 bp, mus musculus
aaattctgcgactgatccagtttga

SEQ ID NO: 46143 - DNA, 25 bp, mus musculus
tgcgactgatccagtttgaacctca

SEQ ID NO: 46144 - DNA, 25 bp, mus musculus
aactcctgcttccttttgtcttcag

SEQ ID NO: 46145 - DNA, 25 bp, mus musculus
acactttacctgtctccttctcctg

SEQ ID NO: 46146 - DNA, 25 bp, mus musculus
gcccaggtagccctgtgataatccc

SEQ ID NO: 46147 - DNA, 25 bp, mus musculus
gtagccctgtgataatcccaagctt

SEQ ID NO: 46148 - DNA, 25 bp, mus musculus
ctgtgataatcccaagcttagggcg

SEQ ID NO: 46149 - DNA, 25 bp, mus musculus
gtcctaaatatcattcctgcttaag

SEQ ID NO: 46150 - DNA, 25 bp, mus musculus
aatatcattcctgcttaagctcctt

SEQ ID NO: 46151 - DNA, 25 bp, mus musculus
attcctgcttaagctcctttgggat

SEQ ID NO: 46152 - DNA, 25 bp, mus musculus
gcttaagctcctttgggattgctgg

SEQ ID NO: 46153 - DNA, 25 bp, mus musculus
gctcctttgggattgctggtaagac

SEQ ID NO: 46154 - DNA, 25 bp, mus musculus
tgatccagtttgaacctcaaaaagt

SEQ ID NO: 46155 - DNA, 25 bp, mus musculus
agcattgcaagcatcagcctgtgca

SEQ ID NO: 46156 - DNA, 25 bp, mus musculus
gcaagcatcagcctgtgcacgcaca

SEQ ID NO: 46157 - DNA, 25 bp, mus musculus
ctgtgcacgcacaccctgagtctgg

SEQ ID NO: 46158 - DNA, 25 bp, mus musculus
cctgccaactgaaggtccttagcag

SEQ ID NO: 46159 - DNA, 25 bp, mus musculus
aggtccttagcaggacacaactcct

SEQ ID NO: 46160 - DNA, 25 bp, mus musculus
ttagcaggacacaactcctgcttcc

SEQ ID NO: 46161 - DNA, 25 bp, mus musculus
ggacacaactcctgcttccttttgt

SEQ ID NO: 46162 - DNA, 25 bp, mus musculus
gccaataacatgaccgagcgctgtt

SEQ ID NO: 46163 - DNA, 25 bp, mus musculus
caataacatgaccgagcgctgttgc

SEQ ID NO: 46164 - DNA, 25 bp, mus musculus
tacgtgttcacgatgcccgaagcga

SEQ ID NO: 46165 - DNA, 25 bp, mus musculus
acgtgttcacgatgcccgaagcgac

SEQ ID NO: 46166 - DNA, 25 bp, mus musculus
tgttcacgatgcccgaagcgaccga

SEQ ID NO: 46167 - DNA, 25 bp, mus musculus
gttcacgatgcccgaagcgaccgac

SEQ ID NO: 46168 - DNA, 25 bp, mus musculus
ttcacgatgcccgaagcgaccgacg

SEQ ID NO: 46169 - DNA, 25 bp, mus musculus
cacgatgcccgaagcgaccgacgag

SEQ ID NO: 46170 - DNA, 25 bp, mus musculus
acgatgcccgaagcgaccgacgagg

SEQ ID NO: 46171 - DNA, 25 bp, mus musculus
cgatgcccgaagcgaccgacgagga

SEQ ID NO: 46172 - DNA, 25 bp, mus musculus
atgcccgaagcgaccgacgaggagc

SEQ ID NO: 46173 - DNA, 25 bp, mus musculus
tgcccgaagcgaccgacgaggagcc

SEQ ID NO: 46174 - DNA, 25 bp, mus musculus
gccgcatcttcgatcaagcttatcg

SEQ ID NO: 46175 - DNA, 25 bp, mus musculus
catcttcgatcaagcttatcggggt

SEQ ID NO: 46176 - DNA, 25 bp, mus musculus
atcttcgatcaagcttatcggggtg

SEQ ID NO: 46177 - DNA, 25 bp, mus musculus
tcttcgatcaagcttatcggggtgc

SEQ ID NO: 46178 - DNA, 25 bp, mus musculus
atcaagcttatcggggtgccccgat

SEQ ID NO: 46179 - DNA, 25 bp, mus musculus
tcaagcttatcggggtgccccgata

SEQ ID NO: 46180 - DNA, 25 bp, mus musculus
caagcttatcggggtgccccgatag

SEQ ID NO: 46181 - DNA, 25 bp, mus musculus
gatacgtgttcacgatgcccgaagc

SEQ ID NO: 46182 - DNA, 25 bp, mus musculus
ctgcagagccaggcccaggactcaa

SEQ ID NO: 46183 - DNA, 25 bp, mus musculus
cagagccaggcccaggactcaactc

SEQ ID NO: 46184 - DNA, 25 bp, mus musculus
tacgttgtgggcctggcaggcaatg

SEQ ID NO: 46185 - DNA, 25 bp, mus musculus
ggcctggcaggcaatgcggtccaga

SEQ ID NO: 46186 - DNA, 25 bp, mus musculus
tttacgatgtacagcaccatctatg

SEQ ID NO: 46187 - DNA, 25 bp, mus musculus
atgtacagcaccatctatgagctac

SEQ ID NO: 46188 - DNA, 25 bp, mus musculus
tacagcaccatctatgagctacaag

SEQ ID NO: 46189 - DNA, 25 bp, mus musculus
agcaccatctatgagctacaagaga

SEQ ID NO: 46190 - DNA, 25 bp, mus musculus
accatctatgagctacaagagaaca

SEQ ID NO: 46191 - DNA, 25 bp, mus musculus
aatagctacaatgtcacctccatcc

SEQ ID NO: 46192 - DNA, 25 bp, mus musculus
agctacaatgtcacctccatcctgg

SEQ ID NO: 46193 - DNA, 25 bp, mus musculus
caggaccagggctgtcgctactgga

SEQ ID NO: 46194 - DNA, 25 bp, mus musculus
agccaggcccaggactcaactcaga

SEQ ID NO: 46195 - DNA, 25 bp, mus musculus
aggaccagggctgtcgctactggat

SEQ ID NO: 46196 - DNA, 25 bp, mus musculus
caggcccaggactcaactcagaact

SEQ ID NO: 46197 - DNA, 25 bp, mus musculus
caggactcaactcagaacttgatcc

SEQ ID NO: 46198 - DNA, 25 bp, mus musculus
gactcaactcagaacttgatccctg

SEQ ID NO: 46199 - DNA, 25 bp, mus musculus
ctgcagccagacttccggagcgatc

SEQ ID NO: 46200 - DNA, 25 bp, mus musculus
cagccagacttccggagcgatcagt

SEQ ID NO: 46201 - DNA, 25 bp, mus musculus
ccagacttccggagcgatcagttcc

SEQ ID NO: 46202 - DNA, 25 bp, mus musculus
gacttccggagcgatcagttccggg

SEQ ID NO: 46203 - DNA, 25 bp, mus musculus
tagcggcttgtggtagtcaggcaaa

SEQ ID NO: 46204 - DNA, 25 bp, mus musculus
cagtggatctccacaagcggccaga

SEQ ID NO: 46205 - DNA, 25 bp, mus musculus
ggtgcacctccaggcctgcttcgtc

SEQ ID NO: 46206 - DNA, 25 bp, mus musculus
cgtcctgcgtgtcatggttgaactg

SEQ ID NO: 46207 - DNA, 25 bp, mus musculus
tcctgcgtgtcatggttgaactggt

SEQ ID NO: 46208 - DNA, 25 bp, mus musculus
cctgcgtgtcatggttgaactggtt

SEQ ID NO: 46209 - DNA, 25 bp, mus musculus
tcatggttgaactggttgggcatgt

SEQ ID NO: 46210 - DNA, 25 bp, mus musculus
ttgaactggttgggcatgtgcgtca

SEQ ID NO: 46211 - DNA, 25 bp, mus musculus
aactggttgggcatgtgcgtcaggt

SEQ ID NO: 46212 - DNA, 25 bp, mus musculus
atgtgcgtcaggttgtagccgatgc

SEQ ID NO: 46213 - DNA, 25 bp, mus musculus
tgtgcgtcaggttgtagccgatgcc

SEQ ID NO: 46214 - DNA, 25 bp, mus musculus
gtgcgtcaggttgtagccgatgcct

SEQ ID NO: 46215 - DNA, 25 bp, mus musculus
gtggatctccacaagcggccagaat

SEQ ID NO: 46216 - DNA, 25 bp, mus musculus
tggatctccacaagcggccagaatt

SEQ ID NO: 46217 - DNA, 25 bp, mus musculus
tccacaagcggccagaattggtgca

SEQ ID NO: 46218 - DNA, 25 bp, mus musculus
ccacaagcggccagaattggtgcac

SEQ ID NO: 46219 - DNA, 25 bp, mus musculus
acaagcggccagaattggtgcacct

SEQ ID NO: 46220 - DNA, 25 bp, mus musculus
agaattggtgcacctccaggcctgc

SEQ ID NO: 46221 - DNA, 25 bp, mus musculus
aattggtgcacctccaggcctgctt

SEQ ID NO: 46222 - DNA, 25 bp, mus musculus
attggtgcacctccaggcctgcttc

SEQ ID NO: 46223 - DNA, 25 bp, mus musculus
tctgctctagcctttaaccacacca

SEQ ID NO: 46224 - DNA, 25 bp, mus musculus
tttaaccacaccaacgtctgctaag

SEQ ID NO: 46225 - DNA, 25 bp, mus musculus
ccttatcaatcatgccctcttcact

SEQ ID NO: 46226 - DNA, 25 bp, mus musculus
tgccctcttcactaactgcaggcct

SEQ ID NO: 46227 - DNA, 25 bp, mus musculus
tgtcgagaatgcctcatcttagcct

SEQ ID NO: 46228 - DNA, 25 bp, mus musculus
gaatgcctcatcttagccttgggaa

SEQ ID NO: 46229 - DNA, 25 bp, mus musculus
ctcatcttagccttgggaactctaa

SEQ ID NO: 46230 - DNA, 25 bp, mus musculus
acttggaaactgcactggggaccag

SEQ ID NO: 46231 - DNA, 25 bp, mus musculus
aaactgcactggggaccagggatat

SEQ ID NO: 46232 - DNA, 25 bp, mus musculus
gtgcttgctaagcgtgcatgcatag

SEQ ID NO: 46233 - DNA, 25 bp, mus musculus
ttctcagaactgcataaatctggtg

SEQ ID NO: 46234 - DNA, 25 bp, mus musculus
ctgtccccataaagtgtacacacac

SEQ ID NO: 46235 - DNA, 25 bp, mus musculus
cacaccaacgtctgctaagcaggct

SEQ ID NO: 46236 - DNA, 25 bp, mus musculus
tagcaaagcattgcccaccatgcag

SEQ ID NO: 46237 - DNA, 25 bp, mus musculus
agcattgcccaccatgcaggggctt

SEQ ID NO: 46238 - DNA, 25 bp, mus musculus
tgctctgagataagccctgggaacc

SEQ ID NO: 46239 - DNA, 25 bp, mus musculus
gagataagccctgggaacctgccca

SEQ ID NO: 46240 - DNA, 25 bp, mus musculus
agccctgggaacctgcccatcaact

SEQ ID NO: 46241 - DNA, 25 bp, mus musculus
caccatcttctggtcacaaccggtc

SEQ ID NO: 46242 - DNA, 25 bp, mus musculus
gtcacaaccggtctctgttttattg

SEQ ID NO: 46243 - DNA, 25 bp, mus musculus
ctgctggctgcggaggcttcatttt

SEQ ID NO: 46244 - DNA, 25 bp, mus musculus
gaggcttcattttcctcttcgatct

SEQ ID NO: 46245 - DNA, 25 bp, mus musculus
ttcaactggactggagctactagga

SEQ ID NO: 46246 - DNA, 25 bp, mus musculus
gaactgttgcctgtttctctcaaga

SEQ ID NO: 46247 - DNA, 25 bp, mus musculus
ctgttgcctgtttctctcaagagtc

SEQ ID NO: 46248 - DNA, 25 bp, mus musculus
gtttctctcaagagtctggaagagg

SEQ ID NO: 46249 - DNA, 25 bp, mus musculus
tctctcaagagtctggaagaggccg

SEQ ID NO: 46250 - DNA, 25 bp, mus musculus
gccgctcactgcacactactgtatg

SEQ ID NO: 46251 - DNA, 25 bp, mus musculus
tgcacactactgtatgaaccctcac

SEQ ID NO: 46252 - DNA, 25 bp, mus musculus
acactactgtatgaaccctcactgc

SEQ ID NO: 46253 - DNA, 25 bp, mus musculus
ctactgtatgaaccctcactgccca

SEQ ID NO: 46254 - DNA, 25 bp, mus musculus
accctgcaggaccaagtgcagtaac

SEQ ID NO: 46255 - DNA, 25 bp, mus musculus
tcattttcctcttcgatctcaggac

SEQ ID NO: 46256 - DNA, 25 bp, mus musculus
tcctcttcgatctcaggacttcagg

SEQ ID NO: 46257 - DNA, 25 bp, mus musculus
tcgatctcaggacttcaggcgaaaa

SEQ ID NO: 46258 - DNA, 25 bp, mus musculus
atctcaggacttcaggcgaaaagcg

SEQ ID NO: 46259 - DNA, 25 bp, mus musculus
ccaccgtcctcatggtacttgcggg

SEQ ID NO: 46260 - DNA, 25 bp, mus musculus
gcccattctgatttcaactggactg

SEQ ID NO: 46261 - DNA, 25 bp, mus musculus
tctgatttcaactggactggagcta

SEQ ID NO: 46262 - DNA, 25 bp, mus musculus
gatttcaactggactggagctacta

SEQ ID NO: 46263 - DNA, 25 bp, mus musculus
tcctcaggccgagcagtaggccggc

SEQ ID NO: 46264 - DNA, 25 bp, mus musculus
gactaacctaacatggccgaccaga

SEQ ID NO: 46265 - DNA, 25 bp, mus musculus
aagtcctatcggaagctggccctga

SEQ ID NO: 46266 - DNA, 25 bp, mus musculus
tcctatcggaagctggccctgaagt

SEQ ID NO: 46267 - DNA, 25 bp, mus musculus
tatcggaagctggccctgaagtatc

SEQ ID NO: 46268 - DNA, 25 bp, mus musculus
aagctggccctgaagtatcaccctg

SEQ ID NO: 46269 - DNA, 25 bp, mus musculus
ctggccctgaagtatcaccctgaca

SEQ ID NO: 46270 - DNA, 25 bp, mus musculus
ctgaagtatcaccctgacaagaacc

SEQ ID NO: 46271 - DNA, 25 bp, mus musculus
aagtatcaccctgacaagaaccctg

SEQ ID NO: 46272 - DNA, 25 bp, mus musculus
tatcaccctgacaagaaccctgata

SEQ ID NO: 46273 - DNA, 25 bp, mus musculus
cctgacaagaaccctgataacccag

SEQ ID NO: 46274 - DNA, 25 bp, mus musculus
gacaagaaccctgataacccagagg

SEQ ID NO: 46275 - DNA, 25 bp, mus musculus
taacctaacatggccgaccagaggc

SEQ ID NO: 46276 - DNA, 25 bp, mus musculus
cctaacatggccgaccagaggcagc

SEQ ID NO: 46277 - DNA, 25 bp, mus musculus
aacatggccgaccagaggcagcgct

SEQ ID NO: 46278 - DNA, 25 bp, mus musculus
ctctctacttccggggaatcattat

SEQ ID NO: 46279 - DNA, 25 bp, mus musculus
gaatcattataccatgttcttggac

SEQ ID NO: 46280 - DNA, 25 bp, mus musculus
taccatgttcttggactggacaaga

SEQ ID NO: 46281 - DNA, 25 bp, mus musculus
gacaagaatgcaacctcagatgaca

SEQ ID NO: 46282 - DNA, 25 bp, mus musculus
aatgcaacctcagatgacattaaaa

SEQ ID NO: 46283 - DNA, 25 bp, mus musculus
catctcaaatatgcctgctcaggtg

SEQ ID NO: 46284 - DNA, 25 bp, mus musculus
ctcaaatatgcctgctcaggtggac

SEQ ID NO: 46285 - DNA, 25 bp, mus musculus
tcctcccaggatggcccttgtccag

SEQ ID NO: 46286 - DNA, 25 bp, mus musculus
tcccaggatggcccttgtccagtgc

SEQ ID NO: 46287 - DNA, 25 bp, mus musculus
ggcccttgtccagtgcctgggtgcc

SEQ ID NO: 46288 - DNA, 25 bp, mus musculus
ttttcctcttccactttgagcttgg

SEQ ID NO: 46289 - DNA, 25 bp, mus musculus
tcctcttccactttgagcttggggt

SEQ ID NO: 46290 - DNA, 25 bp, mus musculus
tccggcagggtctcaagggagctac

SEQ ID NO: 46291 - DNA, 25 bp, mus musculus
acagacttgcctgttcctagaggac

SEQ ID NO: 46292 - DNA, 25 bp, mus musculus
gacttgcctgttcctagaggacttt

SEQ ID NO: 46293 - DNA, 25 bp, mus musculus
ttgcctgttcctagaggacttttat

SEQ ID NO: 46294 - DNA, 25 bp, mus musculus
tcttgccaatgtatttttgtaaggc

SEQ ID NO: 46295 - DNA, 25 bp, mus musculus
gcctgctcaggtggaccagggagta

SEQ ID NO: 46296 - DNA, 25 bp, mus musculus
tgctcaggtggaccagggagtagct

SEQ ID NO: 46297 - DNA, 25 bp, mus musculus
cgccaggggcctcatttcagagaca

SEQ ID NO: 46298 - DNA, 25 bp, mus musculus
cctcatttcagagacagagtaagca

SEQ ID NO: 46299 - DNA, 25 bp, mus musculus
agagtaagcaggccctcctacctgg

SEQ ID NO: 46300 - DNA, 25 bp, mus musculus
gtaagcaggccctcctacctggcag

SEQ ID NO: 46301 - DNA, 25 bp, mus musculus
tcctacctggcaggtcctcattgtc

SEQ ID NO: 46302 - DNA, 25 bp, mus musculus
gcaggtcctcattgtccctttctct

SEQ ID NO: 46303 - DNA, 25 bp, mus musculus
agtatgactcatccagagacagaag

SEQ ID NO: 46304 - DNA, 25 bp, mus musculus
atgactcatccagagacagaagcat

SEQ ID NO: 46305 - DNA, 25 bp, mus musculus
aactgcatgcctgatgtcggctatc

SEQ ID NO: 46306 - DNA, 25 bp, mus musculus
actgcatgcctgatgtcggctatcg

SEQ ID NO: 46307 - DNA, 25 bp, mus musculus
atgcctgatgtcggctatcgagcta

SEQ ID NO: 46308 - DNA, 25 bp, mus musculus
cctgatgtcggctatcgagctaccg

SEQ ID NO: 46309 - DNA, 25 bp, mus musculus
ctgatgtcggctatcgagctaccgg

SEQ ID NO: 46310 - DNA, 25 bp, mus musculus
atgtcggctatcgagctaccggcca

SEQ ID NO: 46311 - DNA, 25 bp, mus musculus
gtcggctatcgagctaccggccaac

SEQ ID NO: 46312 - DNA, 25 bp, mus musculus
tcggctatcgagctaccggccaacc

SEQ ID NO: 46313 - DNA, 25 bp, mus musculus
ggctatcgagctaccggccaaccgg

SEQ ID NO: 46314 - DNA, 25 bp, mus musculus
gctatcgagctaccggccaaccggg

SEQ ID NO: 46315 - DNA, 25 bp, mus musculus
ttagataatgcactgcgcagatgag

SEQ ID NO: 46316 - DNA, 25 bp, mus musculus
agataatgcactgcgcagatgagct

SEQ ID NO: 46317 - DNA, 25 bp, mus musculus
gataatgcactgcgcagatgagctt

SEQ ID NO: 46318 - DNA, 25 bp, mus musculus
taatgcactgcgcagatgagcttgg

SEQ ID NO: 46319 - DNA, 25 bp, mus musculus
aatgcactgcgcagatgagcttggg

SEQ ID NO: 46320 - DNA, 25 bp, mus musculus
tgcactgcgcagatgagcttggggc

SEQ ID NO: 46321 - DNA, 25 bp, mus musculus
actgcgcagatgagcttggggcaga

SEQ ID NO: 46322 - DNA, 25 bp, mus musculus
tgaactgcatgcctgatgtcggcta

SEQ ID NO: 46323 - DNA, 25 bp, mus musculus
aacatgaccgtgcgcagcgtagccc

SEQ ID NO: 46324 - DNA, 25 bp, mus musculus
acatgaccgtgcgcagcgtagccct

SEQ ID NO: 46325 - DNA, 25 bp, mus musculus
gtagcccttctcactgctgggagac

SEQ ID NO: 46326 - DNA, 25 bp, mus musculus
agcccttctcactgctgggagaccg

SEQ ID NO: 46327 - DNA, 25 bp, mus musculus
gcccttctcactgctgggagaccga

SEQ ID NO: 46328 - DNA, 25 bp, mus musculus
ttctcactgctgggagaccgatctg

SEQ ID NO: 46329 - DNA, 25 bp, mus musculus
tctcactgctgggagaccgatctgg

SEQ ID NO: 46330 - DNA, 25 bp, mus musculus
tcactgctgggagaccgatctggga

SEQ ID NO: 46331 - DNA, 25 bp, mus musculus
actgctgggagaccgatctgggaac

SEQ ID NO: 46332 - DNA, 25 bp, mus musculus
tgctgggagaccgatctgggaacca

SEQ ID NO: 46333 - DNA, 25 bp, mus musculus
aggcgtagtaccctaggctgcacga

SEQ ID NO: 46334 - DNA, 25 bp, mus musculus
acgagccttcagtcgagcgctcatg

SEQ ID NO: 46335 - DNA, 25 bp, mus musculus
catgaccgtgcgcagcgtagccctt

SEQ ID NO: 46336 - DNA, 25 bp, mus musculus
gtgcgcagcgtagcccttctcactg

SEQ ID NO: 46337 - DNA, 25 bp, mus musculus
tgcgcagcgtagcccttctcactgc

SEQ ID NO: 46338 - DNA, 25 bp, mus musculus
cgcagcgtagcccttctcactgctg

SEQ ID NO: 46339 - DNA, 25 bp, mus musculus
gcagcgtagcccttctcactgctgg

SEQ ID NO: 46340 - DNA, 25 bp, mus musculus
cagcgtagcccttctcactgctggg

SEQ ID NO: 46341 - DNA, 25 bp, mus musculus
gcgtagcccttctcactgctgggag

SEQ ID NO: 46342 - DNA, 25 bp, mus musculus
cgtagcccttctcactgctgggaga

SEQ ID NO: 46343 - DNA, 25 bp, mus musculus
ttgcatcgggtgatctgcgccgcca

SEQ ID NO: 46344 - DNA, 25 bp, mus musculus
taatccggaccttcatatgcgaact

SEQ ID NO: 46345 - DNA, 25 bp, mus musculus
ttgtattagccgagcaggttcctca

SEQ ID NO: 46346 - DNA, 25 bp, mus musculus
tattagccgagcaggttcctcaggc

SEQ ID NO: 46347 - DNA, 25 bp, mus musculus
ccgagcaggttcctcaggctcactc

SEQ ID NO: 46348 - DNA, 25 bp, mus musculus
aggttcctcaggctcactcggaact

SEQ ID NO: 46349 - DNA, 25 bp, mus musculus
ctcaggctcactcggaactactgat

SEQ ID NO: 46350 - DNA, 25 bp, mus musculus
aggctcactcggaactactgatctt

SEQ ID NO: 46351 - DNA, 25 bp, mus musculus
cggaactactgatcttggacattgg

SEQ ID NO: 46352 - DNA, 25 bp, mus musculus
aactactgatcttggacattggctt

SEQ ID NO: 46353 - DNA, 25 bp, mus musculus
tactgatcttggacattggctttgc

SEQ ID NO: 46354 - DNA, 25 bp, mus musculus
tcttggacattggctttgctgtgtt

SEQ ID NO: 46355 - DNA, 25 bp, mus musculus
ggaccttcatatgcgaactgcaggt

SEQ ID NO: 46356 - DNA, 25 bp, mus musculus
tatgcgaactgcaggtacgcgcgga

SEQ ID NO: 46357 - DNA, 25 bp, mus musculus
tgcaggtacgcgcggatgatgcgcc

SEQ ID NO: 46358 - DNA, 25 bp, mus musculus
aggtacgcgcggatgatgcgccagt

SEQ ID NO: 46359 - DNA, 25 bp, mus musculus
tacgcgcggatgatgcgccagtccg

SEQ ID NO: 46360 - DNA, 25 bp, mus musculus
cagccagacatctgctggagtgtct

SEQ ID NO: 46361 - DNA, 25 bp, mus musculus
gtctaagagcagcccgcgttctggt

SEQ ID NO: 46362 - DNA, 25 bp, mus musculus
taagagcagcccgcgttctggttgt

SEQ ID NO: 46363 - DNA, 25 bp, mus musculus
ttgaccgcaagacatttgctgaact

SEQ ID NO: 46364 - DNA, 25 bp, mus musculus
catttgctgaactcggcacattcgg

SEQ ID NO: 46365 - DNA, 25 bp, mus musculus
ccgatgacatgcgcgtatgagagtt

SEQ ID NO: 46366 - DNA, 25 bp, mus musculus
gtggtttctgccttcacaaatgtca

SEQ ID NO: 46367 - DNA, 25 bp, mus musculus
aatgtcattgtctactcatagaaga

SEQ ID NO: 46368 - DNA, 25 bp, mus musculus
attgtctactcatagaagaaccaaa

SEQ ID NO: 46369 - DNA, 25 bp, mus musculus
tgtgtttgcgtactgtactatcttg

SEQ ID NO: 46370 - DNA, 25 bp, mus musculus
tgcgtactgtactatcttgtaaata

SEQ ID NO: 46371 - DNA, 25 bp, mus musculus
ctttcggcactgacagacaaagcca

SEQ ID NO: 46372 - DNA, 25 bp, mus musculus
gcactgacagacaaagccagtgtag

SEQ ID NO: 46373 - DNA, 25 bp, mus musculus
acagacaaagccagtgtaggtttgt

SEQ ID NO: 46374 - DNA, 25 bp, mus musculus
tagctttcagttatcgacagttgta

SEQ ID NO: 46375 - DNA, 25 bp, mus musculus
ctgaactcggcacattcgggaccaa

SEQ ID NO: 46376 - DNA, 25 bp, mus musculus
tcggcacattcgggaccaatatatt

SEQ ID NO: 46377 - DNA, 25 bp, mus musculus
tacatcaagtccctctgacaaaaca

SEQ ID NO: 46378 - DNA, 25 bp, mus musculus
aagtccctctgacaaaacagggcag

SEQ ID NO: 46379 - DNA, 25 bp, mus musculus
tttttctagaaacttcatgcttgac

SEQ ID NO: 46380 - DNA, 25 bp, mus musculus
tagaaacttcatgcttgacacaccc

SEQ ID NO: 46381 - DNA, 25 bp, mus musculus
caccagtattaaccattcccgatga

SEQ ID NO: 46382 - DNA, 25 bp, mus musculus
tattaaccattcccgatgacatgcg

SEQ ID NO: 46383 - DNA, 25 bp, mus musculus
atgcagccctagatctgtctttggc

SEQ ID NO: 46384 - DNA, 25 bp, mus musculus
atctgtctttggcagcccaccgaaa

SEQ ID NO: 46385 - DNA, 25 bp, mus musculus
tggtcagtcagcccagccatcctgg

SEQ ID NO: 46386 - DNA, 25 bp, mus musculus
aggcggccaaggtcattgtgtcagt

SEQ ID NO: 46387 - DNA, 25 bp, mus musculus
tgcctgccatcttctgtggcaagat

SEQ ID NO: 46388 - DNA, 25 bp, mus musculus
ccatcttctgtggcaagattaaagg

SEQ ID NO: 46389 - DNA, 25 bp, mus musculus
aagactctgtgcttcagggttatga

SEQ ID NO: 46390 - DNA, 25 bp, mus musculus
ctgtgcttcagggttatgatatcaa

SEQ ID NO: 46391 - DNA, 25 bp, mus musculus
atatcaacagccaaggagaagagtc

SEQ ID NO: 46392 - DNA, 25 bp, mus musculus
aagtgaactcccaggaaatacacat

SEQ ID NO: 46393 - DNA, 25 bp, mus musculus
actcccaggaaatacacatgcttcc

SEQ ID NO: 46394 - DNA, 25 bp, mus musculus
aggaaatacacatgcttccaattaa

SEQ ID NO: 46395 - DNA, 25 bp, mus musculus
ctttggcagcccaccgaaaagctga

SEQ ID NO: 46396 - DNA, 25 bp, mus musculus
aggctcctccagagacattgtataa

SEQ ID NO: 46397 - DNA, 25 bp, mus musculus
cagcagacatccagggtcacaccat

SEQ ID NO: 46398 - DNA, 25 bp, mus musculus
acatccagggtcacaccatactgga

SEQ ID NO: 46399 - DNA, 25 bp, mus musculus
agggtcacaccatactggagaaact

SEQ ID NO: 46400 - DNA, 25 bp, mus musculus
agtgttctgaagcctcagccatgat

SEQ ID NO: 46401 - DNA, 25 bp, mus musculus
gccacagcagcaacagcaacggcac

SEQ ID NO: 46402 - DNA, 25 bp, mus musculus
acagcaacggcactgagatggtcag

SEQ ID NO: 46403 - DNA, 25 bp, mus musculus
aattcaccaagaagttgcacatgtc

SEQ ID NO: 46404 - DNA, 25 bp, mus musculus
tcaccaagaagttgcacatgtccca

SEQ ID NO: 46405 - DNA, 25 bp, mus musculus
agatgttgccaaaatccttgactac

SEQ ID NO: 46406 - DNA, 25 bp, mus musculus
tgttgccaaaatccttgactacaag

SEQ ID NO: 46407 - DNA, 25 bp, mus musculus
tgccaaaatccttgactacaagtgt

SEQ ID NO: 46408 - DNA, 25 bp, mus musculus
gtgtgttctcagatctaaggctgcc

SEQ ID NO: 46409 - DNA, 25 bp, mus musculus
cagatctaaggctgccgggatccca

SEQ ID NO: 46410 - DNA, 25 bp, mus musculus
atctaaggctgccgggatcccagca

SEQ ID NO: 46411 - DNA, 25 bp, mus musculus
taaggctgccgggatcccagcagca

SEQ ID NO: 46412 - DNA, 25 bp, mus musculus
tgccgggatcccagcagcacatgga

SEQ ID NO: 46413 - DNA, 25 bp, mus musculus
cgggatcccagcagcacatggagcc

SEQ ID NO: 46414 - DNA, 25 bp, mus musculus
agcagcacatggagcctagagattg

SEQ ID NO: 46415 - DNA, 25 bp, mus musculus
gccttcgaacataggggttgttgag

SEQ ID NO: 46416 - DNA, 25 bp, mus musculus
tggcccccgaacgcattagtgcctc

SEQ ID NO: 46417 - DNA, 25 bp, mus musculus
aacgcattagtgcctcaggaaatct

SEQ ID NO: 46418 - DNA, 25 bp, mus musculus
gcattagtgcctcaggaaatctccg

SEQ ID NO: 46419 - DNA, 25 bp, mus musculus
ttagtgcctcaggaaatctccgctt

SEQ ID NO: 46420 - DNA, 25 bp, mus musculus
cctcaggaaatctccgcttaagttg

SEQ ID NO: 46421 - DNA, 25 bp, mus musculus
caggaaatctccgcttaagttgcag

SEQ ID NO: 46422 - DNA, 25 bp, mus musculus
tccgcttaagttgcaggcgaatgaa

SEQ ID NO: 46423 - DNA, 25 bp, mus musculus
gctcgcagctggttcagcgccgctg

SEQ ID NO: 46424 - DNA, 25 bp, mus musculus
acgtcgaccctggtcacatcagcct

SEQ ID NO: 46425 - DNA, 25 bp, mus musculus
gcgcgtgtctctgtacgttaagtac

SEQ ID NO: 46426 - DNA, 25 bp, mus musculus
cgttaagtacttcgcttcggagcat

SEQ ID NO: 46427 - DNA, 25 bp, mus musculus
taagtacttcgcttcggagcatcaa

SEQ ID NO: 46428 - DNA, 25 bp, mus musculus
gtacttcgcttcggagcatcaacac

SEQ ID NO: 46429 - DNA, 25 bp, mus musculus
cttcgcttcggagcatcaacacgtg

SEQ ID NO: 46430 - DNA, 25 bp, mus musculus
cgcttcggagcatcaacacgtgaag

SEQ ID NO: 46431 - DNA, 25 bp, mus musculus
ttcggagcatcaacacgtgaagacc

SEQ ID NO: 46432 - DNA, 25 bp, mus musculus
gcatcaacacgtgaagaccaaggaa

SEQ ID NO: 46433 - DNA, 25 bp, mus musculus
atcaacacgtgaagaccaaggaagg

SEQ ID NO: 46434 - DNA, 25 bp, mus musculus
tcaacacgtgaagaccaaggaaggc

SEQ ID NO: 46435 - DNA, 25 bp, mus musculus
tcgaccctggtcacatcagccttga

SEQ ID NO: 46436 - DNA, 25 bp, mus musculus
accctggtcacatcagccttgaggc

SEQ ID NO: 46437 - DNA, 25 bp, mus musculus
ctggtcacatcagccttgaggcgtg

SEQ ID NO: 46438 - DNA, 25 bp, mus musculus
tcggagatccgacatacgagctgat

SEQ ID NO: 46439 - DNA, 25 bp, mus musculus
gagatccgacatacgagctgattgc

SEQ ID NO: 46440 - DNA, 25 bp, mus musculus
atccgacatacgagctgattgctcg

SEQ ID NO: 46441 - DNA, 25 bp, mus musculus
catacgagctgattgctcgcgcgtg

SEQ ID NO: 46442 - DNA, 25 bp, mus musculus
agctgattgctcgcgcgtgtctctg

SEQ ID NO: 46443 - DNA, 25 bp, mus musculus
gacctgtaagcctcaacatgacagt

SEQ ID NO: 46444 - DNA, 25 bp, mus musculus
cctgtaagcctcaacatgacagtga

SEQ ID NO: 46445 - DNA, 25 bp, mus musculus
cagttcccctttgtggcctgatcct

SEQ ID NO: 46446 - DNA, 25 bp, mus musculus
tcccctttgtggcctgatccttcct

SEQ ID NO: 46447 - DNA, 25 bp, mus musculus
ccctttgtggcctgatccttcctat

SEQ ID NO: 46448 - DNA, 25 bp, mus musculus
cctttgtggcctgatccttcctatg

SEQ ID NO: 46449 - DNA, 25 bp, mus musculus
ttgtggcctgatccttcctatgcag

SEQ ID NO: 46450 - DNA, 25 bp, mus musculus
gtggcctgatccttcctatgcagaa

SEQ ID NO: 46451 - DNA, 25 bp, mus musculus
cctgatccttcctatgcagaaccta

SEQ ID NO: 46452 - DNA, 25 bp, mus musculus
tgatccttcctatgcagaacctacc

SEQ ID NO: 46453 - DNA, 25 bp, mus musculus
attacatacgaattcttatactggg

SEQ ID NO: 46454 - DNA, 25 bp, mus musculus
acatacgaattcttatactgggtgt

SEQ ID NO: 46455 - DNA, 25 bp, mus musculus
ctgtaagcctcaacatgacagtgaa

SEQ ID NO: 46456 - DNA, 25 bp, mus musculus
taagcctcaacatgacagtgaaggg

SEQ ID NO: 46457 - DNA, 25 bp, mus musculus
ctcaacatgacagtgaagggccaga

SEQ ID NO: 46458 - DNA, 25 bp, mus musculus
taggggcctccaacctccctgctgg

SEQ ID NO: 46459 - DNA, 25 bp, mus musculus
cctccctgaagctggaaaacctgag

SEQ ID NO: 46460 - DNA, 25 bp, mus musculus
tgagcctgaatccttatgagggctt

SEQ ID NO: 46461 - DNA, 25 bp, mus musculus
tgttacagttcccctttgtggcctg

SEQ ID NO: 46462 - DNA, 25 bp, mus musculus
tacagttcccctttgtggcctgatc

SEQ ID NO: 46463 - DNA, 25 bp, mus musculus
cgttagtccatctcctatgccaaaa

SEQ ID NO: 46464 - DNA, 25 bp, mus musculus
agtccatctcctatgccaaaatcaa

SEQ ID NO: 46465 - DNA, 25 bp, mus musculus
actgtgggctgctcagtggatgtca

SEQ ID NO: 46466 - DNA, 25 bp, mus musculus
ggctgctcagtggatgtcagagttc

SEQ ID NO: 46467 - DNA, 25 bp, mus musculus
ctgctcagtggatgtcagagttcat

SEQ ID NO: 46468 - DNA, 25 bp, mus musculus
agagaagacctactacatagaatta

SEQ ID NO: 46469 - DNA, 25 bp, mus musculus
agaagacctactacatagaattatg

SEQ ID NO: 46470 - DNA, 25 bp, mus musculus
aagacctactacatagaattatggg

SEQ ID NO: 46471 - DNA, 25 bp, mus musculus
cctactacatagaattatgggatgt

SEQ ID NO: 46472 - DNA, 25 bp, mus musculus
tgggcagtgccagcagcgtgaaaag

SEQ ID NO: 46473 - DNA, 25 bp, mus musculus
cagtgccagcagcgtgaaaagcaca

SEQ ID NO: 46474 - DNA, 25 bp, mus musculus
tattctacaactccgtaaatggtat

SEQ ID NO: 46475 - DNA, 25 bp, mus musculus
tccatctcctatgccaaaatcaagt

SEQ ID NO: 46476 - DNA, 25 bp, mus musculus
catctcctatgccaaaatcaagtgc

SEQ ID NO: 46477 - DNA, 25 bp, mus musculus
tctcctatgccaaaatcaagtgctg

SEQ ID NO: 46478 - DNA, 25 bp, mus musculus
atgccaaaatcaagtgctgggaaat

SEQ ID NO: 46479 - DNA, 25 bp, mus musculus
gggaaatccatcatggactgtgggc

SEQ ID NO: 46480 - DNA, 25 bp, mus musculus
tccatcatggactgtgggctgctca

SEQ ID NO: 46481 - DNA, 25 bp, mus musculus
tcatggactgtgggctgctcagtgg

SEQ ID NO: 46482 - DNA, 25 bp, mus musculus
atggactgtgggctgctcagtggat

SEQ ID NO: 46483 - DNA, 25 bp, mus musculus
agatttcttacaccatctactcgac

SEQ ID NO: 46484 - DNA, 25 bp, mus musculus
cttacaccatctactcgacctgtgg

SEQ ID NO: 46485 - DNA, 25 bp, mus musculus
cacagcttatcacaggctctgctgg

SEQ ID NO: 46486 - DNA, 25 bp, mus musculus
agagccacacacacacagttggctc

SEQ ID NO: 46487 - DNA, 25 bp, mus musculus
aaatcaagcttgctgatagcatcct

SEQ ID NO: 46488 - DNA, 25 bp, mus musculus
ctgatagcatcctagaacgcaagag

SEQ ID NO: 46489 - DNA, 25 bp, mus musculus
gcatcctagaacgcaagaggatctc

SEQ ID NO: 46490 - DNA, 25 bp, mus musculus
gcatcattctgggggcctttatcat

SEQ ID NO: 46491 - DNA, 25 bp, mus musculus
gggcctttatcatctgctggttgcc

SEQ ID NO: 46492 - DNA, 25 bp, mus musculus
tctgcagggactcctgttggatcca

SEQ ID NO: 46493 - DNA, 25 bp, mus musculus
actctctcattaaccccgtcatcta

SEQ ID NO: 46494 - DNA, 25 bp, mus musculus
tcatctacactgtgttcaacgaaga

SEQ ID NO: 46495 - DNA, 25 bp, mus musculus
ccatctactcgacctgtggcgcctt

SEQ ID NO: 46496 - DNA, 25 bp, mus musculus
cctgtggcgccttctatatcccatc

SEQ ID NO: 46497 - DNA, 25 bp, mus musculus
tctatatcccatccatcttgctcat

SEQ ID NO: 46498 - DNA, 25 bp, mus musculus
tcccatccatcttgctcattatcct

SEQ ID NO: 46499 - DNA, 25 bp, mus musculus
tgctcattatcctgtatggccgcat

SEQ ID NO: 46500 - DNA, 25 bp, mus musculus
tgtatggccgcatatacgtggccgc

SEQ ID NO: 46501 - DNA, 25 bp, mus musculus
ggaagcgcttcaccacggcacagct

SEQ ID NO: 46502 - DNA, 25 bp, mus musculus
gcttcaccacggcacagcttatcac

SEQ ID NO: 46503 - DNA, 25 bp, mus musculus
ctgattacccccgaaatatctctga

SEQ ID NO: 46504 - DNA, 25 bp, mus musculus
gattacccccgaaatatctctgacg

SEQ ID NO: 46505 - DNA, 25 bp, mus musculus
agtaccagttccagcaccagcccag

SEQ ID NO: 46506 - DNA, 25 bp, mus musculus
agttccagcaccagcccagtcagga

SEQ ID NO: 46507 - DNA, 25 bp, mus musculus
ccagcaccagcccagtcaggaggag

SEQ ID NO: 46508 - DNA, 25 bp, mus musculus
ccagcccagtcaggaggagtgtgaa

SEQ ID NO: 46509 - DNA, 25 bp, mus musculus
agctccctgtcggctgtgtttgaac

SEQ ID NO: 46510 - DNA, 25 bp, mus musculus
ctccctgtcggctgtgtttgaacac

SEQ ID NO: 46511 - DNA, 25 bp, mus musculus
tgtttgaacactttgccatgatgca

SEQ ID NO: 46512 - DNA, 25 bp, mus musculus
tttgaacactttgccatgatgcagc

SEQ ID NO: 46513 - DNA, 25 bp, mus musculus
tgaacactttgccatgatgcagcgg

SEQ ID NO: 46514 - DNA, 25 bp, mus musculus
aacactttgccatgatgcagcggga

SEQ ID NO: 46515 - DNA, 25 bp, mus musculus
tctgacggcttcgatggcatcccgg

SEQ ID NO: 46516 - DNA, 25 bp, mus musculus
cttcgatggcatcccggacaacgtg

SEQ ID NO: 46517 - DNA, 25 bp, mus musculus
tcgatggcatcccggacaacgtgga

SEQ ID NO: 46518 - DNA, 25 bp, mus musculus
gatggcatcccggacaacgtggatg

SEQ ID NO: 46519 - DNA, 25 bp, mus musculus
gcatcccggacaacgtggatgcagc

SEQ ID NO: 46520 - DNA, 25 bp, mus musculus
cccggacaacgtggatgcagccttg

SEQ ID NO: 46521 - DNA, 25 bp, mus musculus
caacgtggatgcagccttggccctc

SEQ ID NO: 46522 - DNA, 25 bp, mus musculus
gcccatagctacagtggccgggagc

SEQ ID NO: 46523 - DNA, 25 bp, mus musculus
ccaaaagtcataccattgggcctgg

SEQ ID NO: 46524 - DNA, 25 bp, mus musculus
gtcataccattgggcctggaacgtt

SEQ ID NO: 46525 - DNA, 25 bp, mus musculus
gtttcctgagtctgtctccttgaca

SEQ ID NO: 46526 - DNA, 25 bp, mus musculus
tctcctctatcccttatccatcaga

SEQ ID NO: 46527 - DNA, 25 bp, mus musculus
ctatcccttatccatcagaggagtt

SEQ ID NO: 46528 - DNA, 25 bp, mus musculus
cttatccatcagaggagtttccctt

SEQ ID NO: 46529 - DNA, 25 bp, mus musculus
ttcttagcctcctatacaacctcca

SEQ ID NO: 46530 - DNA, 25 bp, mus musculus
acctccacaggacaatgattctcag

SEQ ID NO: 46531 - DNA, 25 bp, mus musculus
ttctcagcttagaagcgggcctcac

SEQ ID NO: 46532 - DNA, 25 bp, mus musculus
gcctcacctgaagctttgataaaac

SEQ ID NO: 46533 - DNA, 25 bp, mus musculus
cgtgttccacgcaggtgtcttcaag

SEQ ID NO: 46534 - DNA, 25 bp, mus musculus
tggtggcctgcttttgatggagaca

SEQ ID NO: 46535 - DNA, 25 bp, mus musculus
ttggcaaacacacccatgccttcta

SEQ ID NO: 46536 - DNA, 25 bp, mus musculus
ccttctacagaaggacgtgacagac

SEQ ID NO: 46537 - DNA, 25 bp, mus musculus
attgtgctccatttctgcactaggc

SEQ ID NO: 46538 - DNA, 25 bp, mus musculus
ctccatttctgcactaggcagaaac

SEQ ID NO: 46539 - DNA, 25 bp, mus musculus
ttctgcactaggcagaaaccctgcc

SEQ ID NO: 46540 - DNA, 25 bp, mus musculus
catttgttagacctcacatgtgaca

SEQ ID NO: 46541 - DNA, 25 bp, mus musculus
ttagacctcacatgtgacaaagttg

SEQ ID NO: 46542 - DNA, 25 bp, mus musculus
ttagtactgtgtcctctctcaggag

SEQ ID NO: 46543 - DNA, 25 bp, mus musculus
caacatccccagatggtgttcacgg

SEQ ID NO: 46544 - DNA, 25 bp, mus musculus
caaagggcagccctcatggtgggca

SEQ ID NO: 46545 - DNA, 25 bp, mus musculus
ttcaacaggagctacagcagtgctt

SEQ ID NO: 46546 - DNA, 25 bp, mus musculus
aggagctacagcagtgctttcaagg

SEQ ID NO: 46547 - DNA, 25 bp, mus musculus
agtgctttcaaggtcttcttctcca

SEQ ID NO: 46548 - DNA, 25 bp, mus musculus
ttcaaggtcttcttctccaagcaac

SEQ ID NO: 46549 - DNA, 25 bp, mus musculus
ttctccaagcaacaatgagagacca

SEQ ID NO: 46550 - DNA, 25 bp, mus musculus
gagtgccttcttcccatagcttgta

SEQ ID NO: 46551 - DNA, 25 bp, mus musculus
gcttgtagctcagtgggttatattg

SEQ ID NO: 46552 - DNA, 25 bp, mus musculus
gtcccatgaacctttgcaggctgcc

SEQ ID NO: 46553 - DNA, 25 bp, mus musculus
tgaacctttgcaggctgcccagctg

SEQ ID NO: 46554 - DNA, 25 bp, mus musculus
tttgcaggctgcccagctgtctttg

SEQ ID NO: 46555 - DNA, 25 bp, mus musculus
gtgtttgtgctctgctggttccctt

SEQ ID NO: 46556 - DNA, 25 bp, mus musculus
tgctggttccctttcttcgtcacag

SEQ ID NO: 46557 - DNA, 25 bp, mus musculus
ttccctttcttcgtcacagagctca

SEQ ID NO: 46558 - DNA, 25 bp, mus musculus
ttcttcgtcacagagctcatcagtc

SEQ ID NO: 46559 - DNA, 25 bp, mus musculus
ttcctgtggttgggctattctaatt

SEQ ID NO: 46560 - DNA, 25 bp, mus musculus
tctaattccttcttcaacccactca

SEQ ID NO: 46561 - DNA, 25 bp, mus musculus
atctacacagcattcaacaggagct

SEQ ID NO: 46562 - DNA, 25 bp, mus musculus
acagcattcaacaggagctacagca

SEQ ID NO: 46563 - DNA, 25 bp, mus musculus
aattttgatgtggggcacgtgccaa

SEQ ID NO: 46564 - DNA, 25 bp, mus musculus
ttttgatgtggggcacgtgccaata

SEQ ID NO: 46565 - DNA, 25 bp, mus musculus
tgtgacttgggcattgtagatccat

SEQ ID NO: 46566 - DNA, 25 bp, mus musculus
caccactgtgtgacattaaagggtc

SEQ ID NO: 46567 - DNA, 25 bp, mus musculus
gtcatatacagcacagtttgaacac

SEQ ID NO: 46568 - DNA, 25 bp, mus musculus
catatacagcacagtttgaacacac

SEQ ID NO: 46569 - DNA, 25 bp, mus musculus
tttgaacacactatactgttgcgtc

SEQ ID NO: 46570 - DNA, 25 bp, mus musculus
tgaacacactatactgttgcgtcca

SEQ ID NO: 46571 - DNA, 25 bp, mus musculus
aacacactatactgttgcgtccaac

SEQ ID NO: 46572 - DNA, 25 bp, mus musculus
ctatactgttgcgtccaacctgtaa

SEQ ID NO: 46573 - DNA, 25 bp, mus musculus
atactgttgcgtccaacctgtaaag

SEQ ID NO: 46574 - DNA, 25 bp, mus musculus
tgttgcgtccaacctgtaaagaagt

SEQ ID NO: 46575 - DNA, 25 bp, mus musculus
gtacccttgccttctgccgaagtag

SEQ ID NO: 46576 - DNA, 25 bp, mus musculus
ccttgccttctgccgaagtaggctg

SEQ ID NO: 46577 - DNA, 25 bp, mus musculus
ttgccttctgccgaagtaggctgga

SEQ ID NO: 46578 - DNA, 25 bp, mus musculus
tctgccgaagtaggctggatcgctt

SEQ ID NO: 46579 - DNA, 25 bp, mus musculus
agtaggctggatcgcttgggagaaa

SEQ ID NO: 46580 - DNA, 25 bp, mus musculus
taggctggatcgcttgggagaaagt

SEQ ID NO: 46581 - DNA, 25 bp, mus musculus
ggctggatcgcttgggagaaagtaa

SEQ ID NO: 46582 - DNA, 25 bp, mus musculus
tctgtgtgacttgggcattgtagat

SEQ ID NO: 46583 - DNA, 25 bp, mus musculus
ggagtgtcaatccctatctacaagg

SEQ ID NO: 46584 - DNA, 25 bp, mus musculus
tcaatccctatctacaaggaaagag

SEQ ID NO: 46585 - DNA, 25 bp, mus musculus
taccaatgcctgtgctttctgctac

SEQ ID NO: 46586 - DNA, 25 bp, mus musculus
ctgtgctttctgctacattagaata

SEQ ID NO: 46587 - DNA, 25 bp, mus musculus
tgctttctgctacattagaataaaa

SEQ ID NO: 46588 - DNA, 25 bp, mus musculus
atactcagatttcttgcagttttgg

SEQ ID NO: 46589 - DNA, 25 bp, mus musculus
ctcagatttcttgcagttttgggtt

SEQ ID NO: 46590 - DNA, 25 bp, mus musculus
ttgggttatgctgtttgggccaagt

SEQ ID NO: 46591 - DNA, 25 bp, mus musculus
tatgctgtttgggccaagtctgtaa

SEQ ID NO: 46592 - DNA, 25 bp, mus musculus
ggtgacacatctcactctgctgctt

SEQ ID NO: 46593 - DNA, 25 bp, mus musculus
gacacatctcactctgctgcttctt

SEQ ID NO: 46594 - DNA, 25 bp, mus musculus
acatctcactctgctgcttcttaat

SEQ ID NO: 46595 - DNA, 25 bp, mus musculus
gtatgtagaaacccatccaatgctt

SEQ ID NO: 46596 - DNA, 25 bp, mus musculus
aacccatccaatgcttatgtgcatg

SEQ ID NO: 46597 - DNA, 25 bp, mus musculus
ccatccaatgcttatgtgcatgttc

SEQ ID NO: 46598 - DNA, 25 bp, mus musculus
gttcatagagcccgtgagtgacagc

SEQ ID NO: 46599 - DNA, 25 bp, mus musculus
catagagcccgtgagtgacagcatg

SEQ ID NO: 46600 - DNA, 25 bp, mus musculus
aagcagctgtccttgcctccatacc

SEQ ID NO: 46601 - DNA, 25 bp, mus musculus
tccttgcctccataccaatgcctgt

SEQ ID NO: 46602 - DNA, 25 bp, mus musculus
ttgcctccataccaatgcctgtgct

SEQ ID NO: 46603 - DNA, 25 bp, mus musculus
ctgttccgtatacaatgagatagaa

SEQ ID NO: 46604 - DNA, 25 bp, mus musculus
cactaccacactgagggtcacaggt

SEQ ID NO: 46605 - DNA, 25 bp, mus musculus
taattcagtagacacgggcagttaa

SEQ ID NO: 46606 - DNA, 25 bp, mus musculus
ctctaccaggaggcctctcttcaat

SEQ ID NO: 46607 - DNA, 25 bp, mus musculus
caggaggcctctcttcaatgttact

SEQ ID NO: 46608 - DNA, 25 bp, mus musculus
gaggcctctcttcaatgttactcac

SEQ ID NO: 46609 - DNA, 25 bp, mus musculus
caatgttactcacccttaaaggctg

SEQ ID NO: 46610 - DNA, 25 bp, mus musculus
tgttactcacccttaaaggctgaca

SEQ ID NO: 46611 - DNA, 25 bp, mus musculus
cagtaattctgcttctaaacatagt

SEQ ID NO: 46612 - DNA, 25 bp, mus musculus
ttctgcttctaaacatagtggtaag

SEQ ID NO: 46613 - DNA, 25 bp, mus musculus
taagctacagcaaatcgttacatgt

SEQ ID NO: 46614 - DNA, 25 bp, mus musculus
aatcgttacatgtatctactttaag

SEQ ID NO: 46615 - DNA, 25 bp, mus musculus
cacactgagggtcacaggtgtcact

SEQ ID NO: 46616 - DNA, 25 bp, mus musculus
ctcctaagccagaaagcaaggactg

SEQ ID NO: 46617 - DNA, 25 bp, mus musculus
aaactggcttagactcctgacagct

SEQ ID NO: 46618 - DNA, 25 bp, mus musculus
ctggcttagactcctgacagctata

SEQ ID NO: 46619 - DNA, 25 bp, mus musculus
tagactcctgacagctataaccaca

SEQ ID NO: 46620 - DNA, 25 bp, mus musculus
cctgacagctataaccacagaacag

SEQ ID NO: 46621 - DNA, 25 bp, mus musculus
gactctacctaattcagtagacacg

SEQ ID NO: 46622 - DNA, 25 bp, mus musculus
tctacctaattcagtagacacgggc

SEQ ID NO: 46623 - DNA, 25 bp, mus musculus
cggaccagaattggtcgtggtctca

SEQ ID NO: 46624 - DNA, 25 bp, mus musculus
agaattggtcgtggtctcagtagcc

SEQ ID NO: 46625 - DNA, 25 bp, mus musculus
agacgcagctgctttcagatgaacg

SEQ ID NO: 46626 - DNA, 25 bp, mus musculus
gacgcagctgctttcagatgaacga

SEQ ID NO: 46627 - DNA, 25 bp, mus musculus
acgcagctgctttcagatgaacgag

SEQ ID NO: 46628 - DNA, 25 bp, mus musculus
cgcagctgctttcagatgaacgagc

SEQ ID NO: 46629 - DNA, 25 bp, mus musculus
agctgctttcagatgaacgagcgaa

SEQ ID NO: 46630 - DNA, 25 bp, mus musculus
gctgctttcagatgaacgagcgaac

SEQ ID NO: 46631 - DNA, 25 bp, mus musculus
gaattggtcgtggtctcagtagcct

SEQ ID NO: 46632 - DNA, 25 bp, mus musculus
aattggtcgtggtctcagtagcctc

SEQ ID NO: 46633 - DNA, 25 bp, mus musculus
attggtcgtggtctcagtagcctcc

SEQ ID NO: 46634 - DNA, 25 bp, mus musculus
ttggtcgtggtctcagtagcctccg

SEQ ID NO: 46635 - DNA, 25 bp, mus musculus
cgtgaagacgcagctgctttcagat

SEQ ID NO: 46636 - DNA, 25 bp, mus musculus
tgaagacgcagctgctttcagatga

SEQ ID NO: 46637 - DNA, 25 bp, mus musculus
gaagacgcagctgctttcagatgaa

SEQ ID NO: 46638 - DNA, 25 bp, mus musculus
aagacgcagctgctttcagatgaac

SEQ ID NO: 46639 - DNA, 25 bp, mus musculus
cagtgactgaggcggcctggtctcc

SEQ ID NO: 46640 - DNA, 25 bp, mus musculus
tgactgaggcggcctggtctccgta

SEQ ID NO: 46641 - DNA, 25 bp, mus musculus
gtcaggctaagcaactctttcgaaa

SEQ ID NO: 46642 - DNA, 25 bp, mus musculus
agcaactctttcgaaagttgaatga

SEQ ID NO: 46643 - DNA, 25 bp, mus musculus
aactctttcgaaagttgaatgagca

SEQ ID NO: 46644 - DNA, 25 bp, mus musculus
ctacccgatgtaccttggaagcagg

SEQ ID NO: 46645 - DNA, 25 bp, mus musculus
cccgatgtaccttggaagcaggagc

SEQ ID NO: 46646 - DNA, 25 bp, mus musculus
gagccatgacttttcactacattat

SEQ ID NO: 46647 - DNA, 25 bp, mus musculus
ccatgacttttcactacattattga

SEQ ID NO: 46648 - DNA, 25 bp, mus musculus
tgacttttcactacattattgagca

SEQ ID NO: 46649 - DNA, 25 bp, mus musculus
cttttcactacattattgagcacgg

SEQ ID NO: 46650 - DNA, 25 bp, mus musculus
ttcactacattattgagcacggggt

SEQ ID NO: 46651 - DNA, 25 bp, mus musculus
cctggtctccgtagccagggaagat

SEQ ID NO: 46652 - DNA, 25 bp, mus musculus
ctccgtagccagggaagatggtgct

SEQ ID NO: 46653 - DNA, 25 bp, mus musculus
agatggtgctgctgacgatgatcgc

SEQ ID NO: 46654 - DNA, 25 bp, mus musculus
tgacgatgatcgcccgtgtggcgga

SEQ ID NO: 46655 - DNA, 25 bp, mus musculus
cctcgatgcaggaggacgagcagtc

SEQ ID NO: 46656 - DNA, 25 bp, mus musculus
gccgggaccttcaacagtatcagag

SEQ ID NO: 46657 - DNA, 25 bp, mus musculus
gggaccttcaacagtatcagagtca

SEQ ID NO: 46658 - DNA, 25 bp, mus musculus
ttcaacagtatcagagtcaggctaa

SEQ ID NO: 46659 - DNA, 25 bp, mus musculus
attctgatccgtgctgtgtccaccg

SEQ ID NO: 46660 - DNA, 25 bp, mus musculus
gctgtgtccaccgtggagtcctaaa

SEQ ID NO: 46661 - DNA, 25 bp, mus musculus
gcctgaaccacatgttgggcctact

SEQ ID NO: 46662 - DNA, 25 bp, mus musculus
accacatgttgggcctactctctga

SEQ ID NO: 46663 - DNA, 25 bp, mus musculus
acatgttgggcctactctctgaggg

SEQ ID NO: 46664 - DNA, 25 bp, mus musculus
tgttgggcctactctctgagggttt

SEQ ID NO: 46665 - DNA, 25 bp, mus musculus
ctgtgacttcccgaatgggctgctt

SEQ ID NO: 46666 - DNA, 25 bp, mus musculus
cttcccgaatgggctgcttggccac

SEQ ID NO: 46667 - DNA, 25 bp, mus musculus
ctgctgtgcccgggagcttcacaaa

SEQ ID NO: 46668 - DNA, 25 bp, mus musculus
ctgtgcccgggagcttcacaaataa

SEQ ID NO: 46669 - DNA, 25 bp, mus musculus
gcttcacaaataaacgtcatctgtg

SEQ ID NO: 46670 - DNA, 25 bp, mus musculus
caaataaacgtcatctgtgtagttg

SEQ ID NO: 46671 - DNA, 25 bp, mus musculus
acctctgcccttaaccatgtgactt

SEQ ID NO: 46672 - DNA, 25 bp, mus musculus
tctgcccttaaccatgtgacttgga

SEQ ID NO: 46673 - DNA, 25 bp, mus musculus
cttaaccatgtgacttggaggagca

SEQ ID NO: 46674 - DNA, 25 bp, mus musculus
aaccatgtgacttggaggagcagcc

SEQ ID NO: 46675 - DNA, 25 bp, mus musculus
ggcaggtcccctaatgcctgaacca

SEQ ID NO: 46676 - DNA, 25 bp, mus musculus
aggtcccctaatgcctgaaccacat

SEQ ID NO: 46677 - DNA, 25 bp, mus musculus
cctaatgcctgaaccacatgttggg

SEQ ID NO: 46678 - DNA, 25 bp, mus musculus
aatgcctgaaccacatgttgggcct

SEQ ID NO: 46679 - DNA, 25 bp, mus musculus
ttctttgacaggttcatccgctgga

SEQ ID NO: 46680 - DNA, 25 bp, mus musculus
ttcatccgctggatctgttagcacc

SEQ ID NO: 46681 - DNA, 25 bp, mus musculus
atcctacctataccttgccctcaag

SEQ ID NO: 46682 - DNA, 25 bp, mus musculus
cccagagtcttcccactgcctgttt

SEQ ID NO: 46683 - DNA, 25 bp, mus musculus
catccactagtcccttctgaaagct

SEQ ID NO: 46684 - DNA, 25 bp, mus musculus
ccttctgaaagctgtctgctggcct

SEQ ID NO: 46685 - DNA, 25 bp, mus musculus
gaaagctgtctgctggcctgcacca

SEQ ID NO: 46686 - DNA, 25 bp, mus musculus
tgtctgctggcctgcaccagtcctg

SEQ ID NO: 46687 - DNA, 25 bp, mus musculus
ctgttatttcctatctcaggagatc

SEQ ID NO: 46688 - DNA, 25 bp, mus musculus
tttcctatctcaggagatcagacct

SEQ ID NO: 46689 - DNA, 25 bp, mus musculus
atctcaggagatcagacctgagagc

SEQ ID NO: 46690 - DNA, 25 bp, mus musculus
tgagagccccatatcacatgcccaa

SEQ ID NO: 46691 - DNA, 25 bp, mus musculus
atctgttagcaccgccatgctcggc

SEQ ID NO: 46692 - DNA, 25 bp, mus musculus
ctccatcccatctgtggtgctaata

SEQ ID NO: 46693 - DNA, 25 bp, mus musculus
cccatctgtggtgctaataggaccc

SEQ ID NO: 46694 - DNA, 25 bp, mus musculus
gctaataggaccctagcctgccggt

SEQ ID NO: 46695 - DNA, 25 bp, mus musculus
tgccggtcccagctagacggtacac

SEQ ID NO: 46696 - DNA, 25 bp, mus musculus
gcccttctcccaaaatcaggacaga

SEQ ID NO: 46697 - DNA, 25 bp, mus musculus
ctcccaaaatcaggacagaaggact

SEQ ID NO: 46698 - DNA, 25 bp, mus musculus
gaccttacctactttcagctctctt

SEQ ID NO: 46699 - DNA, 25 bp, mus musculus
gagcctgccgcatgcctgggggctt

SEQ ID NO: 46700 - DNA, 25 bp, mus musculus
gcatgcctgggggcttcagcctata

SEQ ID NO: 46701 - DNA, 25 bp, mus musculus
tttctcaggatcttctggaaaccca

SEQ ID NO: 46702 - DNA, 25 bp, mus musculus
aagatccaggggttctgaagacaag

SEQ ID NO: 46703 - DNA, 25 bp, mus musculus
aggccaacagagccaagtattggag

SEQ ID NO: 46704 - DNA, 25 bp, mus musculus
ggtagcttctcttcctggagtacca

SEQ ID NO: 46705 - DNA, 25 bp, mus musculus
ttaccctattcttattctctggact

SEQ ID NO: 46706 - DNA, 25 bp, mus musculus
ccctattcttattctctggacttat

SEQ ID NO: 46707 - DNA, 25 bp, mus musculus
ataccttgaggtggcagttcttagg

SEQ ID NO: 46708 - DNA, 25 bp, mus musculus
tcttaggccagccctgctattgcct

SEQ ID NO: 46709 - DNA, 25 bp, mus musculus
taggccagccctgctattgcctgtc

SEQ ID NO: 46710 - DNA, 25 bp, mus musculus
cagtatttaaacatccatcttccct

SEQ ID NO: 46711 - DNA, 25 bp, mus musculus
ctcacagagcctgggtccatcaagg

SEQ ID NO: 46712 - DNA, 25 bp, mus musculus
gggtccatcaaggggccatgagcaa

SEQ ID NO: 46713 - DNA, 25 bp, mus musculus
gggccatgagcaaccagccaggaca

SEQ ID NO: 46714 - DNA, 25 bp, mus musculus
tgtctagggtcacttctgggtggac

SEQ ID NO: 46715 - DNA, 25 bp, mus musculus
tcacttctgggtggacatgtactcc

SEQ ID NO: 46716 - DNA, 25 bp, mus musculus
ggacatgtactccagacccaggagg

SEQ ID NO: 46717 - DNA, 25 bp, mus musculus
catgtactccagacccaggaggcta

SEQ ID NO: 46718 - DNA, 25 bp, mus musculus
gtactccagacccaggaggctagat

SEQ ID NO: 46719 - DNA, 25 bp, mus musculus
accaatgggttctcctagctgtagt

SEQ ID NO: 46720 - DNA, 25 bp, mus musculus
agctgtagtgcctctgccctgggca

SEQ ID NO: 46721 - DNA, 25 bp, mus musculus
aactagtcgacacctggaatcatgg

SEQ ID NO: 46722 - DNA, 25 bp, mus musculus
ctagtcgacacctggaatcatgggc

SEQ ID NO: 46723 - DNA, 25 bp, mus musculus
agtcgacacctggaatcatgggctg

SEQ ID NO: 46724 - DNA, 25 bp, mus musculus
tcgacacctggaatcatgggctgca

SEQ ID NO: 46725 - DNA, 25 bp, mus musculus
gacacctggaatcatgggctgcacc

SEQ ID NO: 46726 - DNA, 25 bp, mus musculus
cacctggaatcatgggctgcaccgc

SEQ ID NO: 46727 - DNA, 25 bp, mus musculus
tggaatcatgggctgcaccgcagcg

SEQ ID NO: 46728 - DNA, 25 bp, mus musculus
gaatcatgggctgcaccgcagcgag

SEQ ID NO: 46729 - DNA, 25 bp, mus musculus
ggctgcaccgcagcgaggatgaaaa

SEQ ID NO: 46730 - DNA, 25 bp, mus musculus
ctgcaccgcagcgaggatgaaaacc

SEQ ID NO: 46731 - DNA, 25 bp, mus musculus
ctgtagtgcctctgccctgggcagg

SEQ ID NO: 46732 - DNA, 25 bp, mus musculus
tgcaccgcagcgaggatgaaaacca

SEQ ID NO: 46733 - DNA, 25 bp, mus musculus
actgccgcccgagcgcaagtgcgca

SEQ ID NO: 46734 - DNA, 25 bp, mus musculus
gcaagtgcgcacaactagtcgacac

SEQ ID NO: 46735 - DNA, 25 bp, mus musculus
aagtgcgcacaactagtcgacacct

SEQ ID NO: 46736 - DNA, 25 bp, mus musculus
gtgcgcacaactagtcgacacctgg

SEQ ID NO: 46737 - DNA, 25 bp, mus musculus
gcgcacaactagtcgacacctggaa

SEQ ID NO: 46738 - DNA, 25 bp, mus musculus
gcacaactagtcgacacctggaatc

SEQ ID NO: 46739 - DNA, 25 bp, mus musculus
acaactagtcgacacctggaatcat

SEQ ID NO: 46740 - DNA, 25 bp, mus musculus
agccatgctgaaccacaaaacaggt

SEQ ID NO: 46741 - DNA, 25 bp, mus musculus
ggtgacacatccattgctggcaatg

SEQ ID NO: 46742 - DNA, 25 bp, mus musculus
catgcccctgtcatggcttgccata

SEQ ID NO: 46743 - DNA, 25 bp, mus musculus
cctgtcatggcttgccatagcatct

SEQ ID NO: 46744 - DNA, 25 bp, mus musculus
atggcttgccatagcatctttctga

SEQ ID NO: 46745 - DNA, 25 bp, mus musculus
ctcctaagcagcaaagattagcagc

SEQ ID NO: 46746 - DNA, 25 bp, mus musculus
tagcagccaaactgctggggctgca

SEQ ID NO: 46747 - DNA, 25 bp, mus musculus
ggctgcaagcggctcagttcagggt

SEQ ID NO: 46748 - DNA, 25 bp, mus musculus
gtgcatttacacgtggcaggtctgg

SEQ ID NO: 46749 - DNA, 25 bp, mus musculus
tttgtgctgactgtctcctaacaca

SEQ ID NO: 46750 - DNA, 25 bp, mus musculus
gtctcctaacacaagatgggtacac

SEQ ID NO: 46751 - DNA, 25 bp, mus musculus
ggtacactacaccttgagatccttc

SEQ ID NO: 46752 - DNA, 25 bp, mus musculus
gttactagtgccaagttgctcagaa

SEQ ID NO: 46753 - DNA, 25 bp, mus musculus
agtgccaagttgctcagaaagtctg

SEQ ID NO: 46754 - DNA, 25 bp, mus musculus
ccgccctactgtcggttgacatcat

SEQ ID NO: 46755 - DNA, 25 bp, mus musculus
tactgtcggttgacatcattaaata

SEQ ID NO: 46756 - DNA, 25 bp, mus musculus
tctctctttgatgagctgctgttgt

SEQ ID NO: 46757 - DNA, 25 bp, mus musculus
gagctgctgttgtggctgtcttgta

SEQ ID NO: 46758 - DNA, 25 bp, mus musculus
ctgttgtggctgtcttgtacaaaat

SEQ ID NO: 46759 - DNA, 25 bp, mus musculus
tgtgcatctctctaacccaggtact

SEQ ID NO: 46760 - DNA, 25 bp, mus musculus
ctgatgagccagaggacctggacac

SEQ ID NO: 46761 - DNA, 25 bp, mus musculus
atgaaggcctcatcagcttcgagga

SEQ ID NO: 46762 - DNA, 25 bp, mus musculus
caagagccacatcagggatgcagct

SEQ ID NO: 46763 - DNA, 25 bp, mus musculus
tagtcacacatgccaggccctggaa

SEQ ID NO: 46764 - DNA, 25 bp, mus musculus
cgaattgtgccaaaggctggcctgg

SEQ ID NO: 46765 - DNA, 25 bp, mus musculus
attgtgccaaaggctggcctggccc

SEQ ID NO: 46766 - DNA, 25 bp, mus musculus
accttcccagggtgacatgggctgc

SEQ ID NO: 46767 - DNA, 25 bp, mus musculus
tgacatgggctgccccaagtatcct

SEQ ID NO: 46768 - DNA, 25 bp, mus musculus
caagtatcctgtgactcttctctgc

SEQ ID NO: 46769 - DNA, 25 bp, mus musculus
gtatcctgtgactcttctctgcagc

SEQ ID NO: 46770 - DNA, 25 bp, mus musculus
tgtgactcttctctgcagcggccgc

SEQ ID NO: 46771 - DNA, 25 bp, mus musculus
gactcttctctgcagcggccgcaag

SEQ ID NO: 46772 - DNA, 25 bp, mus musculus
tcatcagcttcgaggaagagcgggc

SEQ ID NO: 46773 - DNA, 25 bp, mus musculus
tgcagcggccgcaagtctacccaga

SEQ ID NO: 46774 - DNA, 25 bp, mus musculus
tcagcttcgaggaagagcgggccca

SEQ ID NO: 46775 - DNA, 25 bp, mus musculus
ccttcaacactgatacgctctgctg

SEQ ID NO: 46776 - DNA, 25 bp, mus musculus
acactgatacgctctgctgaccatc

SEQ ID NO: 46777 - DNA, 25 bp, mus musculus
atacgctctgctgaccatcaagagc

SEQ ID NO: 46778 - DNA, 25 bp, mus musculus
cgctctgctgaccatcaagagccac

SEQ ID NO: 46779 - DNA, 25 bp, mus musculus
tctgctgaccatcaagagccacatc

SEQ ID NO: 46780 - DNA, 25 bp, mus musculus
catcaagagccacatcagggatgca

SEQ ID NO: 46781 - DNA, 25 bp, mus musculus
catccagccttggaaccgaacacac

SEQ ID NO: 46782 - DNA, 25 bp, mus musculus
tccagccttggaaccgaacacacct

SEQ ID NO: 46783 - DNA, 25 bp, mus musculus
aggccctaccgtggacccagatgca

SEQ ID NO: 46784 - DNA, 25 bp, mus musculus
ccgtggacccagatgcaggtggtca

SEQ ID NO: 46785 - DNA, 25 bp, mus musculus
gtggacccagatgcaggtggtcaga

SEQ ID NO: 46786 - DNA, 25 bp, mus musculus
acccagatgcaggtggtcagaggcc

SEQ ID NO: 46787 - DNA, 25 bp, mus musculus
tcagaggccgaggcagcagggccac

SEQ ID NO: 46788 - DNA, 25 bp, mus musculus
gcagcagggccaccgatgttgccga

SEQ ID NO: 46789 - DNA, 25 bp, mus musculus
agcagggccaccgatgttgccgacc

SEQ ID NO: 46790 - DNA, 25 bp, mus musculus
caggattacatcttctacctggagc

SEQ ID NO: 46791 - DNA, 25 bp, mus musculus
ggattacatcttctacctggagcct

SEQ ID NO: 46792 - DNA, 25 bp, mus musculus
tacatcttctacctggagcctgaga

SEQ ID NO: 46793 - DNA, 25 bp, mus musculus
tggaaccgaacacacctgtatgtgt

SEQ ID NO: 46794 - DNA, 25 bp, mus musculus
cacctgtatgtgtgtgggaccggtg

SEQ ID NO: 46795 - DNA, 25 bp, mus musculus
accggtgcctacaaccccatgtgca

SEQ ID NO: 46796 - DNA, 25 bp, mus musculus
gtgcctacaaccccatgtgcaccta

SEQ ID NO: 46797 - DNA, 25 bp, mus musculus
gcctacaaccccatgtgcacctatg

SEQ ID NO: 46798 - DNA, 25 bp, mus musculus
acaaccccatgtgcacctatgtgaa

SEQ ID NO: 46799 - DNA, 25 bp, mus musculus
aaccccatgtgcacctatgtgaacc

SEQ ID NO: 46800 - DNA, 25 bp, mus musculus
ccccatgtgcacctatgtgaaccgt

SEQ ID NO: 46801 - DNA, 25 bp, mus musculus
gagatcgtcagtcggtcctctggag

SEQ ID NO: 46802 - DNA, 25 bp, mus musculus
tcgtcagtcggtcctctggagacag

SEQ ID NO: 46803 - DNA, 25 bp, mus musculus
acattgtcgtctgctgaggtagtag

SEQ ID NO: 46804 - DNA, 25 bp, mus musculus
attgtcgtctgctgaggtagtagcc

SEQ ID NO: 46805 - DNA, 25 bp, mus musculus
tgtcgtctgctgaggtagtagccat

SEQ ID NO: 46806 - DNA, 25 bp, mus musculus
tcgtctgctgaggtagtagccatca

SEQ ID NO: 46807 - DNA, 25 bp, mus musculus
gtagtagccatcaagctcagatttg

SEQ ID NO: 46808 - DNA, 25 bp, mus musculus
tagccatcaagctcagatttgtgga

SEQ ID NO: 46809 - DNA, 25 bp, mus musculus
gccatcaagctcagatttgtggaga

SEQ ID NO: 46810 - DNA, 25 bp, mus musculus
catcaagctcagatttgtggagagg

SEQ ID NO: 46811 - DNA, 25 bp, mus musculus
tggctccgcatcgagagcgacttct

SEQ ID NO: 46812 - DNA, 25 bp, mus musculus
gcgacttctacaagatgatgtagtg

SEQ ID NO: 46813 - DNA, 25 bp, mus musculus
cagctaccgcgttgcgacattgtcg

SEQ ID NO: 46814 - DNA, 25 bp, mus musculus
gctaccgcgttgcgacattgtcgtc

SEQ ID NO: 46815 - DNA, 25 bp, mus musculus
taccgcgttgcgacattgtcgtctg

SEQ ID NO: 46816 - DNA, 25 bp, mus musculus
ccgcgttgcgacattgtcgtctgct

SEQ ID NO: 46817 - DNA, 25 bp, mus musculus
gcgttgcgacattgtcgtctgctga

SEQ ID NO: 46818 - DNA, 25 bp, mus musculus
gttgcgacattgtcgtctgctgagg

SEQ ID NO: 46819 - DNA, 25 bp, mus musculus
tgcgacattgtcgtctgctgaggta

SEQ ID NO: 46820 - DNA, 25 bp, mus musculus
cgacattgtcgtctgctgaggtagt

SEQ ID NO: 46821 - DNA, 25 bp, mus musculus
catgatatcttttgaccttctcagt

SEQ ID NO: 46822 - DNA, 25 bp, mus musculus
atgatatcttttgaccttctcagtg

SEQ ID NO: 46823 - DNA, 25 bp, mus musculus
ttgaaacttctcgttttggatgtag

SEQ ID NO: 46824 - DNA, 25 bp, mus musculus
tgatatcttttgaccttctcagtga

SEQ ID NO: 46825 - DNA, 25 bp, mus musculus
gatatcttttgaccttctcagtgat

SEQ ID NO: 46826 - DNA, 25 bp, mus musculus
atatcttttgaccttctcagtgatg

SEQ ID NO: 46827 - DNA, 25 bp, mus musculus
tatcttttgaccttctcagtgatga

SEQ ID NO: 46828 - DNA, 25 bp, mus musculus
accttctcagtgatgagctggactt

SEQ ID NO: 46829 - DNA, 25 bp, mus musculus
ccttctcagtgatgagctggacttg

SEQ ID NO: 46830 - DNA, 25 bp, mus musculus
cttctcagtgatgagctggacttga

SEQ ID NO: 46831 - DNA, 25 bp, mus musculus
gacttgaaacttctcgttttggatg

SEQ ID NO: 46832 - DNA, 25 bp, mus musculus
ctttattaccactacttgatgctct

SEQ ID NO: 46833 - DNA, 25 bp, mus musculus
tattaccactacttgatgctctcat

SEQ ID NO: 46834 - DNA, 25 bp, mus musculus
gctacccttctgagtagctgctggg

SEQ ID NO: 46835 - DNA, 25 bp, mus musculus
acccttctgagtagctgctgggtcc

SEQ ID NO: 46836 - DNA, 25 bp, mus musculus
cttctgagtagctgctgggtcctga

SEQ ID NO: 46837 - DNA, 25 bp, mus musculus
ctgagtagctgctgggtcctgacag

SEQ ID NO: 46838 - DNA, 25 bp, mus musculus
acagctgcacactgcttcaaaaggt

SEQ ID NO: 46839 - DNA, 25 bp, mus musculus
gctgcacactgcttcaaaaggtacg

SEQ ID NO: 46840 - DNA, 25 bp, mus musculus
gcacactgcttcaaaaggtacggaa

SEQ ID NO: 46841 - DNA, 25 bp, mus musculus
aactcgaggagctatgcagttcgag

SEQ ID NO: 46842 - DNA, 25 bp, mus musculus
agctatgcagttcgagttggggatt

SEQ ID NO: 46843 - DNA, 25 bp, mus musculus
tatgcagttcgagttggggattatc

SEQ ID NO: 46844 - DNA, 25 bp, mus musculus
atgctctcatctggatgtggactga

SEQ ID NO: 46845 - DNA, 25 bp, mus musculus
ctgcaccgtcggcagaaacggatca

SEQ ID NO: 46846 - DNA, 25 bp, mus musculus
caccgtcggcagaaacggatcattg

SEQ ID NO: 46847 - DNA, 25 bp, mus musculus
caggcttccctcaggctgaggtcgg

SEQ ID NO: 46848 - DNA, 25 bp, mus musculus
gacggcaggctgctttgtggagcta

SEQ ID NO: 46849 - DNA, 25 bp, mus musculus
aggctgctttgtggagctacccttc

SEQ ID NO: 46850 - DNA, 25 bp, mus musculus
ctgctttgtggagctacccttctga

SEQ ID NO: 46851 - DNA, 25 bp, mus musculus
tgtggagctacccttctgagtagct

SEQ ID NO: 46852 - DNA, 25 bp, mus musculus
aactacaccacggaggagaggatct

SEQ ID NO: 46853 - DNA, 25 bp, mus musculus
tacaccacggaggagaggatctttg

SEQ ID NO: 46854 - DNA, 25 bp, mus musculus
aatcgctttctccccaaattgctca

SEQ ID NO: 46855 - DNA, 25 bp, mus musculus
tttctccccaaattgctcagcgcca

SEQ ID NO: 46856 - DNA, 25 bp, mus musculus
cccaaattgctcagcgccaccgata

SEQ ID NO: 46857 - DNA, 25 bp, mus musculus
ttgctcagcgccaccgatactctgg

SEQ ID NO: 46858 - DNA, 25 bp, mus musculus
ctcagcgccaccgatactctggacg

SEQ ID NO: 46859 - DNA, 25 bp, mus musculus
accgatactctggacgaggcggagc

SEQ ID NO: 46860 - DNA, 25 bp, mus musculus
gcccgagcccctagctgtatataca

SEQ ID NO: 46861 - DNA, 25 bp, mus musculus
gcccctagctgtatatacactattt

SEQ ID NO: 46862 - DNA, 25 bp, mus musculus
catcttctgcatgtcttgggctaag

SEQ ID NO: 46863 - DNA, 25 bp, mus musculus
cttctgcatgtcttgggctaagctc

SEQ ID NO: 46864 - DNA, 25 bp, mus musculus
tactggaccaattttgcccgcacag

SEQ ID NO: 46865 - DNA, 25 bp, mus musculus
tggaccaattttgcccgcacagggg

SEQ ID NO: 46866 - DNA, 25 bp, mus musculus
cccaatgaccctcgagactccaaat

SEQ ID NO: 46867 - DNA, 25 bp, mus musculus
cctcgagactccaaatctccacagt

SEQ ID NO: 46868 - DNA, 25 bp, mus musculus
cgagactccaaatctccacagtggc

SEQ ID NO: 46869 - DNA, 25 bp, mus musculus
tccaaatctccacagtggccaccgt

SEQ ID NO: 46870 - DNA, 25 bp, mus musculus
acctgcgccttctggaatcgctttc

SEQ ID NO: 46871 - DNA, 25 bp, mus musculus
tggaatcgctttctccccaaattgc

SEQ ID NO: 46872 - DNA, 25 bp, mus musculus
tttctgctggccataccggtccttg

SEQ ID NO: 46873 - DNA, 25 bp, mus musculus
ctgctggccataccggtccttgtgt

SEQ ID NO: 46874 - DNA, 25 bp, mus musculus
cataaagtcttccatctgctcttcg

SEQ ID NO: 46875 - DNA, 25 bp, mus musculus
aaagtcttccatctgctcttcgaag

SEQ ID NO: 46876 - DNA, 25 bp, mus musculus
gtcttccatctgctcttcgaagcca

SEQ ID NO: 46877 - DNA, 25 bp, mus musculus
catctgctcttcgaagccatcacgg

SEQ ID NO: 46878 - DNA, 25 bp, mus musculus
ctgctcttcgaagccatcacgggct

SEQ ID NO: 46879 - DNA, 25 bp, mus musculus
ctcttcgaagccatcacgggcttcc

SEQ ID NO: 46880 - DNA, 25 bp, mus musculus
acgggcttcctgctgcccttcctag

SEQ ID NO: 46881 - DNA, 25 bp, mus musculus
gtggccagctactctgacatcgggc

SEQ ID NO: 46882 - DNA, 25 bp, mus musculus
gtggtgctcattatcctggccttcg

SEQ ID NO: 46883 - DNA, 25 bp, mus musculus
gtgctcattatcctggccttcgccg

SEQ ID NO: 46884 - DNA, 25 bp, mus musculus
aacaggactctgatctgcgctccga

SEQ ID NO: 46885 - DNA, 25 bp, mus musculus
aggactctgatctgcgctccgaact

SEQ ID NO: 46886 - DNA, 25 bp, mus musculus
actctgatctgcgctccgaactatc

SEQ ID NO: 46887 - DNA, 25 bp, mus musculus
ctgatctgcgctccgaactatccca

SEQ ID NO: 46888 - DNA, 25 bp, mus musculus
atctgcgctccgaactatcccaaca

SEQ ID NO: 46889 - DNA, 25 bp, mus musculus
tgcgctccgaactatcccaacaaag

SEQ ID NO: 46890 - DNA, 25 bp, mus musculus
ccgaactatcccaacaaagagcata

SEQ ID NO: 46891 - DNA, 25 bp, mus musculus
tatcccaacaaagagcataaagtct

SEQ ID NO: 46892 - DNA, 25 bp, mus musculus
ccaagtccccagaaatgtccctgct

SEQ ID NO: 46893 - DNA, 25 bp, mus musculus
agtccccagaaatgtccctgctgag

SEQ ID NO: 46894 - DNA, 25 bp, mus musculus
tgttcttggtcagctttgtagcatc

SEQ ID NO: 46895 - DNA, 25 bp, mus musculus
tcagctttgtagcatccatgtctac

SEQ ID NO: 46896 - DNA, 25 bp, mus musculus
tagcatccatgtctacagaaagcct

SEQ ID NO: 46897 - DNA, 25 bp, mus musculus
catccatgtctacagaaagcctgag

SEQ ID NO: 46898 - DNA, 25 bp, mus musculus
ccatgtctacagaaagcctgagccc

SEQ ID NO: 46899 - DNA, 25 bp, mus musculus
agagcagccgctggagcctggtaag

SEQ ID NO: 46900 - DNA, 25 bp, mus musculus
tggagccactggtgaccagaaccag

SEQ ID NO: 46901 - DNA, 25 bp, mus musculus
agccactggtgaccagaaccaggga

SEQ ID NO: 46902 - DNA, 25 bp, mus musculus
tgaccagaaccagggacagatggca

SEQ ID NO: 46903 - DNA, 25 bp, mus musculus
acagatggcagtggttctggggccc

SEQ ID NO: 46904 - DNA, 25 bp, mus musculus
ccccagaaatgtccctgctgaggtg

SEQ ID NO: 46905 - DNA, 25 bp, mus musculus
cagaaatgtccctgctgaggtgcag

SEQ ID NO: 46906 - DNA, 25 bp, mus musculus
tgtccctgctgaggtgcaggccacg

SEQ ID NO: 46907 - DNA, 25 bp, mus musculus
tgctgaggtgcaggccacgggacct

SEQ ID NO: 46908 - DNA, 25 bp, mus musculus
catcagtctccctttctgtgctgtt

SEQ ID NO: 46909 - DNA, 25 bp, mus musculus
cagtctccctttctgtgctgttctt

SEQ ID NO: 46910 - DNA, 25 bp, mus musculus
ctgtgctgttcttggtcagctttgt

SEQ ID NO: 46911 - DNA, 25 bp, mus musculus
tgctgttcttggtcagctttgtagc

SEQ ID NO: 46912 - DNA, 25 bp, mus musculus
cgcagccaggtcaagggtgagatgc

SEQ ID NO: 46913 - DNA, 25 bp, mus musculus
gagatgctccaagagctgatgcagc

SEQ ID NO: 46914 - DNA, 25 bp, mus musculus
catcacatgattgcagcgcttggac

SEQ ID NO: 46915 - DNA, 25 bp, mus musculus
cacatgattgcagcgcttggacatg

SEQ ID NO: 46916 - DNA, 25 bp, mus musculus
gctcttgcgcacagcgatgttgttg

SEQ ID NO: 46917 - DNA, 25 bp, mus musculus
gcgcacagcgatgttgttgcactca

SEQ ID NO: 46918 - DNA, 25 bp, mus musculus
gatgttgttgcactcaggcgcatgc

SEQ ID NO: 46919 - DNA, 25 bp, mus musculus
gcactcaggcgcatgccggtactac

SEQ ID NO: 46920 - DNA, 25 bp, mus musculus
ctcaggcgcatgccggtactacagg

SEQ ID NO: 46921 - DNA, 25 bp, mus musculus
aggcgcatgccggtactacaggctg

SEQ ID NO: 46922 - DNA, 25 bp, mus musculus
atgccggtactacaggctgccgcgg

SEQ ID NO: 46923 - DNA, 25 bp, mus musculus
gtactacaggctgccgcggtccgga

SEQ ID NO: 46924 - DNA, 25 bp, mus musculus
atgctccaagagctgatgcagctta

SEQ ID NO: 46925 - DNA, 25 bp, mus musculus
ctgatgcagcttatcgttctaggcc

SEQ ID NO: 46926 - DNA, 25 bp, mus musculus
atgcagcttatcgttctaggccgac

SEQ ID NO: 46927 - DNA, 25 bp, mus musculus
atcgttctaggccgacaactccaca

SEQ ID NO: 46928 - DNA, 25 bp, mus musculus
gttctaggccgacaactccacaagc

SEQ ID NO: 46929 - DNA, 25 bp, mus musculus
ggccgacaactccacaagcttctgc

SEQ ID NO: 46930 - DNA, 25 bp, mus musculus
caactccacaagcttctgctgcatc

SEQ ID NO: 46931 - DNA, 25 bp, mus musculus
aagcttctgctgcatcacatgattg

SEQ ID NO: 46932 - DNA, 25 bp, mus musculus
gtctgaactcatcctgcttggaaag

SEQ ID NO: 46933 - DNA, 25 bp, mus musculus
actcatcctgcttggaaagtcctgg

SEQ ID NO: 46934 - DNA, 25 bp, mus musculus
cctgctgctggtggtttcaaacttg

SEQ ID NO: 46935 - DNA, 25 bp, mus musculus
gaaagctgcatcaattcctgaatgt

SEQ ID NO: 46936 - DNA, 25 bp, mus musculus
tgcatcaattcctgaatgtcaaaca

SEQ ID NO: 46937 - DNA, 25 bp, mus musculus
ctgctcagatccccttgtgatcaca

SEQ ID NO: 46938 - DNA, 25 bp, mus musculus
agatccccttgtgatcacatttaag

SEQ ID NO: 46939 - DNA, 25 bp, mus musculus
atttaagaatgcccttcagcgagct

SEQ ID NO: 46940 - DNA, 25 bp, mus musculus
ccttcagcgagctgaagtcatcaat

SEQ ID NO: 46941 - DNA, 25 bp, mus musculus
catcaatattcttgctgataaaatg

SEQ ID NO: 46942 - DNA, 25 bp, mus musculus
caacccattctcagctggacaattt

SEQ ID NO: 46943 - DNA, 25 bp, mus musculus
attctcagctggacaatttgaaaca

SEQ ID NO: 46944 - DNA, 25 bp, mus musculus
tggaaagtcctggccaataatgctg

SEQ ID NO: 46945 - DNA, 25 bp, mus musculus
gtcctggccaataatgctgccattg

SEQ ID NO: 46946 - DNA, 25 bp, mus musculus
gccaataatgctgccattgagtcaa

SEQ ID NO: 46947 - DNA, 25 bp, mus musculus
aatgctgccattgagtcaacctcac

SEQ ID NO: 46948 - DNA, 25 bp, mus musculus
gccattgagtcaacctcacttctgg

SEQ ID NO: 46949 - DNA, 25 bp, mus musculus
gagtcaacctcacttctgggcactc

SEQ ID NO: 46950 - DNA, 25 bp, mus musculus
acctcacttctgggcactcctgctg

SEQ ID NO: 46951 - DNA, 25 bp, mus musculus
cttctgggcactcctgctgctggtg

SEQ ID NO: 46952 - DNA, 25 bp, mus musculus
gccacagtcatcattagagaagcag

SEQ ID NO: 46953 - DNA, 25 bp, mus musculus
attgtgattgacacctcaggtggac

SEQ ID NO: 46954 - DNA, 25 bp, mus musculus
gcagtgctcatagctcaggccctac

SEQ ID NO: 46955 - DNA, 25 bp, mus musculus
atagctcaggccctacaaactatta

SEQ ID NO: 46956 - DNA, 25 bp, mus musculus
gctcaggccctacaaactattaact

SEQ ID NO: 46957 - DNA, 25 bp, mus musculus
actattaactacggccgagacgatg

SEQ ID NO: 46958 - DNA, 25 bp, mus musculus
tgagccacacacagctcgaaggcta

SEQ ID NO: 46959 - DNA, 25 bp, mus musculus
gccacacacagctcgaaggctaaaa

SEQ ID NO: 46960 - DNA, 25 bp, mus musculus
aacgcagcagcaacctgggaaagag

SEQ ID NO: 46961 - DNA, 25 bp, mus musculus
gcagcagcaacctgggaaagagctg

SEQ ID NO: 46962 - DNA, 25 bp, mus musculus
ccaggacagtctaccatagctctcc

SEQ ID NO: 46963 - DNA, 25 bp, mus musculus
ggacagtctaccatagctctccctg

SEQ ID NO: 46964 - DNA, 25 bp, mus musculus
attgacacctcaggtggaccccttg

SEQ ID NO: 46965 - DNA, 25 bp, mus musculus
gacctcatgtcgtgcagagtcgtag

SEQ ID NO: 46966 - DNA, 25 bp, mus musculus
atgtcgtgcagagtcgtagctgctg

SEQ ID NO: 46967 - DNA, 25 bp, mus musculus
tcgtgcagagtcgtagctgctggca

SEQ ID NO: 46968 - DNA, 25 bp, mus musculus
tgcagagtcgtagctgctggcacca

SEQ ID NO: 46969 - DNA, 25 bp, mus musculus
gtagctgctggcaccagagagatgg

SEQ ID NO: 46970 - DNA, 25 bp, mus musculus
gctgctggcaccagagagatggcag

SEQ ID NO: 46971 - DNA, 25 bp, mus musculus
atggcagtgctcatagctcaggccc

SEQ ID NO: 46972 - DNA, 25 bp, mus musculus
ccccgcggtcagagtgctgcagaga

SEQ ID NO: 46973 - DNA, 25 bp, mus musculus
cccgcggtcagagtgctgcagagaa

SEQ ID NO: 46974 - DNA, 25 bp, mus musculus
gttgcagctcagaggagccggaaga

SEQ ID NO: 46975 - DNA, 25 bp, mus musculus
tgcagctcagaggagccggaagaag

SEQ ID NO: 46976 - DNA, 25 bp, mus musculus
gaagcagacccagaaggctgacaag

SEQ ID NO: 46977 - DNA, 25 bp, mus musculus
aagcagacccagaaggctgacaagc

SEQ ID NO: 46978 - DNA, 25 bp, mus musculus
cagacccagaaggctgacaagctcc

SEQ ID NO: 46979 - DNA, 25 bp, mus musculus
aaggctgacaagctccacgaggagc

SEQ ID NO: 46980 - DNA, 25 bp, mus musculus
ggctgacaagctccacgaggagcac

SEQ ID NO: 46981 - DNA, 25 bp, mus musculus
tgacaagctccacgaggagcacgag

SEQ ID NO: 46982 - DNA, 25 bp, mus musculus
gacaagctccacgaggagcacgaga

SEQ ID NO: 46983 - DNA, 25 bp, mus musculus
gctccacgaggagcacgagagcctg

SEQ ID NO: 46984 - DNA, 25 bp, mus musculus
cgcggtcagagtgctgcagagaagc

SEQ ID NO: 46985 - DNA, 25 bp, mus musculus
ctccacgaggagcacgagagcctgg

SEQ ID NO: 46986 - DNA, 25 bp, mus musculus
gaaccagccgcagagccccaaggac

SEQ ID NO: 46987 - DNA, 25 bp, mus musculus
aaccagccgcagagccccaaggacg

SEQ ID NO: 46988 - DNA, 25 bp, mus musculus
cagagccccaaggacgatgacagga

SEQ ID NO: 46989 - DNA, 25 bp, mus musculus
gagccccaaggacgatgacaggaaa

SEQ ID NO: 46990 - DNA, 25 bp, mus musculus
agccccaaggacgatgacaggaaag

SEQ ID NO: 46991 - DNA, 25 bp, mus musculus
aaaccgggttgcagctcagaggagc

SEQ ID NO: 46992 - DNA, 25 bp, mus musculus
aaccgggttgcagctcagaggagcc

SEQ ID NO: 46993 - DNA, 25 bp, mus musculus
gcatccacgaaaccacctataacag

SEQ ID NO: 46994 - DNA, 25 bp, mus musculus
atccacgaaaccacctataacagca

SEQ ID NO: 46995 - DNA, 25 bp, mus musculus
tggatcagcgcctccagttcctttc

SEQ ID NO: 46996 - DNA, 25 bp, mus musculus
gatcagcgcctccagttcctttcca

SEQ ID NO: 46997 - DNA, 25 bp, mus musculus
tcagcgcctccagttcctttccaaa

SEQ ID NO: 46998 - DNA, 25 bp, mus musculus
cgcctccagttcctttccaaatcat

SEQ ID NO: 46999 - DNA, 25 bp, mus musculus
tccagttcctttccaaatcattcct

SEQ ID NO: 47000 - DNA, 25 bp, mus musculus
tcctttccaaatcattcctgcccaa

SEQ ID NO: 47001 - DNA, 25 bp, mus musculus
ctttccaaatcattcctgcccaaag

SEQ ID NO: 47002 - DNA, 25 bp, mus musculus
tgcccaaagctttgatttgttactc

SEQ ID NO: 47003 - DNA, 25 bp, mus musculus
tcagacatgtgctacccttaacttg

SEQ ID NO: 47004 - DNA, 25 bp, mus musculus
agacatgtgctacccttaacttgta

SEQ ID NO: 47005 - DNA, 25 bp, mus musculus
gtccaccgcaaatgcttctaagtcc

SEQ ID NO: 47006 - DNA, 25 bp, mus musculus
ctgctctgcctctagcacacaactg

SEQ ID NO: 47007 - DNA, 25 bp, mus musculus
gctctgcctctagcacacaactgtg

SEQ ID NO: 47008 - DNA, 25 bp, mus musculus
tctagcacacaactgtgaacgtttt

SEQ ID NO: 47009 - DNA, 25 bp, mus musculus
gcacacaactgtgaacgttttgtgg

SEQ ID NO: 47010 - DNA, 25 bp, mus musculus
aactgtgaacgttttgtggatcagc

SEQ ID NO: 47011 - DNA, 25 bp, mus musculus
tttgtggatcagcgcctccagttcc

SEQ ID NO: 47012 - DNA, 25 bp, mus musculus
tgtggatcagcgcctccagttcctt

SEQ ID NO: 47013 - DNA, 25 bp, mus musculus
taccatcccactgatgatcacaaga

SEQ ID NO: 47014 - DNA, 25 bp, mus musculus
acctcaacctagaccacctgcaatg

SEQ ID NO: 47015 - DNA, 25 bp, mus musculus
cgcgagctgctcacaggtcgcagca

SEQ ID NO: 47016 - DNA, 25 bp, mus musculus
cgagctgctcacaggtcgcagcatc

SEQ ID NO: 47017 - DNA, 25 bp, mus musculus
cgcagcccatacgagaatctgtgca

SEQ ID NO: 47018 - DNA, 25 bp, mus musculus
cagcccatacgagaatctgtgcagt

SEQ ID NO: 47019 - DNA, 25 bp, mus musculus
tagaagctctgatccacctagatgg

SEQ ID NO: 47020 - DNA, 25 bp, mus musculus
agctctgatccacctagatggcgac

SEQ ID NO: 47021 - DNA, 25 bp, mus musculus
ctctgatccacctagatggcgacct

SEQ ID NO: 47022 - DNA, 25 bp, mus musculus
ctgatccacctagatggcgacctgt

SEQ ID NO: 47023 - DNA, 25 bp, mus musculus
gatccacctagatggcgacctgtct

SEQ ID NO: 47024 - DNA, 25 bp, mus musculus
atgcggacagcagcagctcgttgac

SEQ ID NO: 47025 - DNA, 25 bp, mus musculus
ctcaacctagaccacctgcaatgtg

SEQ ID NO: 47026 - DNA, 25 bp, mus musculus
acctagaccacctgcaatgtggaga

SEQ ID NO: 47027 - DNA, 25 bp, mus musculus
ctagaccacctgcaatgtggagatg

SEQ ID NO: 47028 - DNA, 25 bp, mus musculus
agaccacctgcaatgtggagatgaa

SEQ ID NO: 47029 - DNA, 25 bp, mus musculus
accacctgcaatgtggagatgaact

SEQ ID NO: 47030 - DNA, 25 bp, mus musculus
ctacgtgcagagctcgcgagctgct

SEQ ID NO: 47031 - DNA, 25 bp, mus musculus
acgtgcagagctcgcgagctgctca

SEQ ID NO: 47032 - DNA, 25 bp, mus musculus
agctcgcgagctgctcacaggtcgc

SEQ ID NO: 47033 - DNA, 25 bp, mus musculus
agcttctggggtttggctctgctct

SEQ ID NO: 47034 - DNA, 25 bp, mus musculus
ggtttggctctgctcttctggacaa

SEQ ID NO: 47035 - DNA, 25 bp, mus musculus
tggcccagcagttctgagccctgga

SEQ ID NO: 47036 - DNA, 25 bp, mus musculus
agcagttctgagccctggacttgcc

SEQ ID NO: 47037 - DNA, 25 bp, mus musculus
tctgagccctggacttgccctggta

SEQ ID NO: 47038 - DNA, 25 bp, mus musculus
gagccctggacttgccctggtatat

SEQ ID NO: 47039 - DNA, 25 bp, mus musculus
ccctggacttgccctggtatatggc

SEQ ID NO: 47040 - DNA, 25 bp, mus musculus
ccagtgccaggcagccctgggagga

SEQ ID NO: 47041 - DNA, 25 bp, mus musculus
cctccagtggcgacagcaaagagcc

SEQ ID NO: 47042 - DNA, 25 bp, mus musculus
gttcatctgctgctgtttacattct

SEQ ID NO: 47043 - DNA, 25 bp, mus musculus
ctgctgctgtttacattctaggggg

SEQ ID NO: 47044 - DNA, 25 bp, mus musculus
tccaggggccgtgtattattgtgag

SEQ ID NO: 47045 - DNA, 25 bp, mus musculus
actttgtgggtgctggaatcatcca

SEQ ID NO: 47046 - DNA, 25 bp, mus musculus
gaatcatccagacgaaggccctgca

SEQ ID NO: 47047 - DNA, 25 bp, mus musculus
ccaatgcccaggcccaaatgtaccg

SEQ ID NO: 47048 - DNA, 25 bp, mus musculus
ccctgcgcaccagcaaagagcctgt

SEQ ID NO: 47049 - DNA, 25 bp, mus musculus
tgcgcaccagcaaagagcctgtctc

SEQ ID NO: 47050 - DNA, 25 bp, mus musculus
aagagcctgtctcccgtcacttgtg

SEQ ID NO: 47051 - DNA, 25 bp, mus musculus
gtcacttgtgtgagctgctggccca

SEQ ID NO: 47052 - DNA, 25 bp, mus musculus
agctgctggcccagcagttctgagc

SEQ ID NO: 47053 - DNA, 25 bp, mus musculus
aaagcaaagcatccgatggacacag

SEQ ID NO: 47054 - DNA, 25 bp, mus musculus
gaagttgacccgaatcctgcaaatt

SEQ ID NO: 47055 - DNA, 25 bp, mus musculus
accgtctctcagagactatgtgaat

SEQ ID NO: 47056 - DNA, 25 bp, mus musculus
cagttctagtccgcagaccagaaga

SEQ ID NO: 47057 - DNA, 25 bp, mus musculus
tagtccgcagaccagaagatcaggc

SEQ ID NO: 47058 - DNA, 25 bp, mus musculus
atcaggctctttgtttgtgcgtctc

SEQ ID NO: 47059 - DNA, 25 bp, mus musculus
tcgtttgtctttgtaccacactgca

SEQ ID NO: 47060 - DNA, 25 bp, mus musculus
gtctttgtaccacactgcagataaa

SEQ ID NO: 47061 - DNA, 25 bp, mus musculus
gtaccacactgcagataaacacccc

SEQ ID NO: 47062 - DNA, 25 bp, mus musculus
acaccccttgtctgaaaactgccat

SEQ ID NO: 47063 - DNA, 25 bp, mus musculus
tgaaaactgccattcacggcacctc

SEQ ID NO: 47064 - DNA, 25 bp, mus musculus
aaatcagggcagtcctgtggttcaa

SEQ ID NO: 47065 - DNA, 25 bp, mus musculus
gacccgaatcctgcaaatttcgtgg

SEQ ID NO: 47066 - DNA, 25 bp, mus musculus
ttcgtggtgctgggcataatacaca

SEQ ID NO: 47067 - DNA, 25 bp, mus musculus
ggctgcttgttgcgcctggagccaa

SEQ ID NO: 47068 - DNA, 25 bp, mus musculus
cgcctggagccaaacctgcaagctc

SEQ ID NO: 47069 - DNA, 25 bp, mus musculus
gagccaaacctgcaagctcagatgt

SEQ ID NO: 47070 - DNA, 25 bp, mus musculus
aacctgcaagctcagatgtatagac

SEQ ID NO: 47071 - DNA, 25 bp, mus musculus
ctcaccttgcgtaccagcaaagaca

SEQ ID NO: 47072 - DNA, 25 bp, mus musculus
ttgcgtaccagcaaagacaccgtct

SEQ ID NO: 47073 - DNA, 25 bp, mus musculus
gattcttcgatcaagctctcgagag

SEQ ID NO: 47074 - DNA, 25 bp, mus musculus
ttcttcgatcaagctctcgagaggt

SEQ ID NO: 47075 - DNA, 25 bp, mus musculus
ctcgatcgagtcgtcgcagtgcttc

SEQ ID NO: 47076 - DNA, 25 bp, mus musculus
cgatcgagtcgtcgcagtgcttcag

SEQ ID NO: 47077 - DNA, 25 bp, mus musculus
atcgagtcgtcgcagtgcttcagcg

SEQ ID NO: 47078 - DNA, 25 bp, mus musculus
cgagtcgtcgcagtgcttcagcgct

SEQ ID NO: 47079 - DNA, 25 bp, mus musculus
cggatacttccgctcgctgctcagc

SEQ ID NO: 47080 - DNA, 25 bp, mus musculus
cgctgctcagccgcgatcgtagagg

SEQ ID NO: 47081 - DNA, 25 bp, mus musculus
gctcagccgcgatcgtagagggcta

SEQ ID NO: 47082 - DNA, 25 bp, mus musculus
tcagccgcgatcgtagagggctacg

SEQ ID NO: 47083 - DNA, 25 bp, mus musculus
agccgcgatcgtagagggctacgcg

SEQ ID NO: 47084 - DNA, 25 bp, mus musculus
agatgacgcttggcgcaccagcctt

SEQ ID NO: 47085 - DNA, 25 bp, mus musculus
cttcgatcaagctctcgagaggtga

SEQ ID NO: 47086 - DNA, 25 bp, mus musculus
cttggcgcaccagccttgagctgat

SEQ ID NO: 47087 - DNA, 25 bp, mus musculus
tcaagctctcgagaggtgatccgtg

SEQ ID NO: 47088 - DNA, 25 bp, mus musculus
gctctcgagaggtgatccgtgttgc

SEQ ID NO: 47089 - DNA, 25 bp, mus musculus
ggtgatccgtgttgctcgatcgagt

SEQ ID NO: 47090 - DNA, 25 bp, mus musculus
atccgtgttgctcgatcgagtcgtc

SEQ ID NO: 47091 - DNA, 25 bp, mus musculus
ccgtgttgctcgatcgagtcgtcgc

SEQ ID NO: 47092 - DNA, 25 bp, mus musculus
gtgttgctcgatcgagtcgtcgcag

SEQ ID NO: 47093 - DNA, 25 bp, mus musculus
gttgctcgatcgagtcgtcgcagtg

SEQ ID NO: 47094 - DNA, 25 bp, mus musculus
gatgaggtcatccctattggtgcag

SEQ ID NO: 47095 - DNA, 25 bp, mus musculus
gaggtcatccctattggtgcagcca

SEQ ID NO: 47096 - DNA, 25 bp, mus musculus
ggatctttacaggtgacgtgcacag

SEQ ID NO: 47097 - DNA, 25 bp, mus musculus
gtgacgtgcacagaccaagacaccg

SEQ ID NO: 47098 - DNA, 25 bp, mus musculus
tgcacagaccaagacaccggcaagt

SEQ ID NO: 47099 - DNA, 25 bp, mus musculus
gaggccattactgttgaggttgcat

SEQ ID NO: 47100 - DNA, 25 bp, mus musculus
gaggttgcatcctgactcttcagat

SEQ ID NO: 47101 - DNA, 25 bp, mus musculus
tcctgactcttcagataaaccaaga

SEQ ID NO: 47102 - DNA, 25 bp, mus musculus
tgactcttcagataaaccaagatgg

SEQ ID NO: 47103 - DNA, 25 bp, mus musculus
ataatatcaacataatttggttttg

SEQ ID NO: 47104 - DNA, 25 bp, mus musculus
taataaactgctttttcaatgaagg

SEQ ID NO: 47105 - DNA, 25 bp, mus musculus
taaactgctttttcaatgaaggtat

SEQ ID NO: 47106 - DNA, 25 bp, mus musculus
gtcatccctattggtgcagccatag

SEQ ID NO: 47107 - DNA, 25 bp, mus musculus
ttcacagtactgtttccctctggga

SEQ ID NO: 47108 - DNA, 25 bp, mus musculus
cgaagacagcacacactgcaggccc

SEQ ID NO: 47109 - DNA, 25 bp, mus musculus
cttgaactctatgagtctgagggga

SEQ ID NO: 47110 - DNA, 25 bp, mus musculus
gaactctatgagtctgaggggaaga

SEQ ID NO: 47111 - DNA, 25 bp, mus musculus
caggttgtactccaggacttagata

SEQ ID NO: 47112 - DNA, 25 bp, mus musculus
atattagctgttcttactatgaaaa

SEQ ID NO: 47113 - DNA, 25 bp, mus musculus
ttagctgttcttactatgaaaaggg

SEQ ID NO: 47114 - DNA, 25 bp, mus musculus
ctttcctcacagcctctcttcaatg

SEQ ID NO: 47115 - DNA, 25 bp, mus musculus
ttcaatgacatcgctccaggcatcc

SEQ ID NO: 47116 - DNA, 25 bp, mus musculus
acagggaccatcacacaagtcatta

SEQ ID NO: 47117 - DNA, 25 bp, mus musculus
accatcacacaagtcattaaagttc

SEQ ID NO: 47118 - DNA, 25 bp, mus musculus
aaagttctgaatccacagaagcaac

SEQ ID NO: 47119 - DNA, 25 bp, mus musculus
ctgaatccacagaagcaacagctgc

SEQ ID NO: 47120 - DNA, 25 bp, mus musculus
cggatcaagctcacatataatcaca

SEQ ID NO: 47121 - DNA, 25 bp, mus musculus
aagctcacatataatcacaagggct

SEQ ID NO: 47122 - DNA, 25 bp, mus musculus
aatcacaagggctcggcaatgcaag

SEQ ID NO: 47123 - DNA, 25 bp, mus musculus
tgcagcaccattctcattcttatcc

SEQ ID NO: 47124 - DNA, 25 bp, mus musculus
cttatcccactcaatcaaaggaatt

SEQ ID NO: 47125 - DNA, 25 bp, mus musculus
taccatgggcacgaggagctgagag

SEQ ID NO: 47126 - DNA, 25 bp, mus musculus
ccctccatcacagcgtacagtaaga

SEQ ID NO: 47127 - DNA, 25 bp, mus musculus
gcctctaacagcacagagctagaca

SEQ ID NO: 47128 - DNA, 25 bp, mus musculus
gcagtaccaaagacattccagctgc

SEQ ID NO: 47129 - DNA, 25 bp, mus musculus
ccaaagacattccagctgcagcttc

SEQ ID NO: 47130 - DNA, 25 bp, mus musculus
acattccagctgcagcttctgtctc

SEQ ID NO: 47131 - DNA, 25 bp, mus musculus
cctagcagcagcgttgtcccagcct

SEQ ID NO: 47132 - DNA, 25 bp, mus musculus
agcagcgttgtcccagcctttaata

SEQ ID NO: 47133 - DNA, 25 bp, mus musculus
ccagcctttaatacagggaccatca

SEQ ID NO: 47134 - DNA, 25 bp, mus musculus
gagccagcgctacaagcccttcagg

SEQ ID NO: 47135 - DNA, 25 bp, mus musculus
gcgctacaagcccttcaggcagctt

SEQ ID NO: 47136 - DNA, 25 bp, mus musculus
ctactgccacacatctcagggagac

SEQ ID NO: 47137 - DNA, 25 bp, mus musculus
atctcagggagacccgattggctta

SEQ ID NO: 47138 - DNA, 25 bp, mus musculus
atctggtgtcaacgacactgccctg

SEQ ID NO: 47139 - DNA, 25 bp, mus musculus
tgtcaacgacactgccctgctgtat

SEQ ID NO: 47140 - DNA, 25 bp, mus musculus
cgacactgccctgctgtataatgag

SEQ ID NO: 47141 - DNA, 25 bp, mus musculus
gtacattgtctacgacattgctcag

SEQ ID NO: 47142 - DNA, 25 bp, mus musculus
tgtctacgacattgctcaggtgaat

SEQ ID NO: 47143 - DNA, 25 bp, mus musculus
tctcaaatacctgctgaaactcaag

SEQ ID NO: 47144 - DNA, 25 bp, mus musculus
atacctgctgaaactcaagttcaat

SEQ ID NO: 47145 - DNA, 25 bp, mus musculus
ttttaagacatccctgtggtaagtg

SEQ ID NO: 47146 - DNA, 25 bp, mus musculus
caagcccttcaggcagcttcacaac

SEQ ID NO: 47147 - DNA, 25 bp, mus musculus
cacccggtggctgtggtatgaattc

SEQ ID NO: 47148 - DNA, 25 bp, mus musculus
cttcaggcagcttcacaaccggagg

SEQ ID NO: 47149 - DNA, 25 bp, mus musculus
tcacaaccggaggctgctgtggcac

SEQ ID NO: 47150 - DNA, 25 bp, mus musculus
caggaccaccaactttgctggcatc

SEQ ID NO: 47151 - DNA, 25 bp, mus musculus
caccaactttgctggcatcctgtcg

SEQ ID NO: 47152 - DNA, 25 bp, mus musculus
gacaggctacatgtttgggaaaggg

SEQ ID NO: 47153 - DNA, 25 bp, mus musculus
gatctactttgccgacatggtgtcc

SEQ ID NO: 47154 - DNA, 25 bp, mus musculus
tgcaaactactgccacacatctcag

SEQ ID NO: 47155 - DNA, 25 bp, mus musculus
ccttcactctgggttctgctccagg

SEQ ID NO: 47156 - DNA, 25 bp, mus musculus
ctctgggttctgctccaggaactct

SEQ ID NO: 47157 - DNA, 25 bp, mus musculus
tccttgtcattgttttgatccatcc

SEQ ID NO: 47158 - DNA, 25 bp, mus musculus
ttttgatccatccctttgttgccat

SEQ ID NO: 47159 - DNA, 25 bp, mus musculus
tgtgtgaccagccaatgcccctgtc

SEQ ID NO: 47160 - DNA, 25 bp, mus musculus
tagacagggcccaaagtgtgccctt

SEQ ID NO: 47161 - DNA, 25 bp, mus musculus
agagttcctcctgagccatgaagag

SEQ ID NO: 47162 - DNA, 25 bp, mus musculus
cctcctgagccatgaagagaatata

SEQ ID NO: 47163 - DNA, 25 bp, mus musculus
ttggactcccagtttatagttgtct

SEQ ID NO: 47164 - DNA, 25 bp, mus musculus
atgagtaccctgccagcacaggagg

SEQ ID NO: 47165 - DNA, 25 bp, mus musculus
tcccttcaatctacccagtctctgg

SEQ ID NO: 47166 - DNA, 25 bp, mus musculus
caatctacccagtctctggtgccaa

SEQ ID NO: 47167 - DNA, 25 bp, mus musculus
gttctgctccaggaactctgccctg

SEQ ID NO: 47168 - DNA, 25 bp, mus musculus
gttcagggcagtgtgtcttttactt

SEQ ID NO: 47169 - DNA, 25 bp, mus musculus
ttggaagtccccagtcctgactcta

SEQ ID NO: 47170 - DNA, 25 bp, mus musculus
gtccccagtcctgactctataccag

SEQ ID NO: 47171 - DNA, 25 bp, mus musculus
agtcctgactctataccagtatggc

SEQ ID NO: 47172 - DNA, 25 bp, mus musculus
gactctataccagtatggctgagcc

SEQ ID NO: 47173 - DNA, 25 bp, mus musculus
tcccttactgccagcagccagaatg

SEQ ID NO: 47174 - DNA, 25 bp, mus musculus
cccaaatccttgtcattgttttgat

SEQ ID NO: 47175 - DNA, 25 bp, mus musculus
tggccatgcttgcacccagaaattt

SEQ ID NO: 47176 - DNA, 25 bp, mus musculus
ttgcacccagaaattttccaatgag

SEQ ID NO: 47177 - DNA, 25 bp, mus musculus
ctactaaccagagctgaactaaggc

SEQ ID NO: 47178 - DNA, 25 bp, mus musculus
ctaaccagagctgaactaaggctgc

SEQ ID NO: 47179 - DNA, 25 bp, mus musculus
gaactaaggctgctccatcaacact

SEQ ID NO: 47180 - DNA, 25 bp, mus musculus
ctgcctacccacttgctattgaaga

SEQ ID NO: 47181 - DNA, 25 bp, mus musculus
cctacccacttgctattgaagaggg

SEQ ID NO: 47182 - DNA, 25 bp, mus musculus
ggtcttcaggctctttcccatcact

SEQ ID NO: 47183 - DNA, 25 bp, mus musculus
cttcaggctctttcccatcactctt

SEQ ID NO: 47184 - DNA, 25 bp, mus musculus
atgctaaatctgccatcccttccag

SEQ ID NO: 47185 - DNA, 25 bp, mus musculus
gcccactgccaataaacaactattt

SEQ ID NO: 47186 - DNA, 25 bp, mus musculus
cactgccaataaacaactatttaag

SEQ ID NO: 47187 - DNA, 25 bp, mus musculus
cacccagaaattttccaatgaggag

SEQ ID NO: 47188 - DNA, 25 bp, mus musculus
agccctgcaggcctctgctctaaag

SEQ ID NO: 47189 - DNA, 25 bp, mus musculus
cctgcaggcctctgctctaaaggcc

SEQ ID NO: 47190 - DNA, 25 bp, mus musculus
agccagtgaatctctcttcatctct

SEQ ID NO: 47191 - DNA, 25 bp, mus musculus
atctctcttcatctctaaccatgcc

SEQ ID NO: 47192 - DNA, 25 bp, mus musculus
tctcttcatctctaaccatgcctac

SEQ ID NO: 47193 - DNA, 25 bp, mus musculus
cttcatctctaaccatgcctactaa

SEQ ID NO: 47194 - DNA, 25 bp, mus musculus
ccatgcctactaaccagagctgaac

SEQ ID NO: 47195 - DNA, 25 bp, mus musculus
tcatagggtacacgtgctgatgctc

SEQ ID NO: 47196 - DNA, 25 bp, mus musculus
ggtacacgtgctgatgctctgactg

SEQ ID NO: 47197 - DNA, 25 bp, mus musculus
tagacatattcttttccaagaagtc

SEQ ID NO: 47198 - DNA, 25 bp, mus musculus
tattcttttccaagaagtctgagtc

SEQ ID NO: 47199 - DNA, 25 bp, mus musculus
ctgagtccttcgcatatagctcatc

SEQ ID NO: 47200 - DNA, 25 bp, mus musculus
agtccttcgcatatagctcatctcc

SEQ ID NO: 47201 - DNA, 25 bp, mus musculus
ccttcgcatatagctcatctccttg

SEQ ID NO: 47202 - DNA, 25 bp, mus musculus
atagctcatctccttggagaagatg

SEQ ID NO: 47203 - DNA, 25 bp, mus musculus
gctcatctccttggagaagatgtat

SEQ ID NO: 47204 - DNA, 25 bp, mus musculus
ttattgtcagccatgtctcaggtac

SEQ ID NO: 47205 - DNA, 25 bp, mus musculus
tcagccatgtctcaggtacttctga

SEQ ID NO: 47206 - DNA, 25 bp, mus musculus
atgtctcaggtacttctgatgagtc

SEQ ID NO: 47207 - DNA, 25 bp, mus musculus
cgtgctgatgctctgactgaatagt

SEQ ID NO: 47208 - DNA, 25 bp, mus musculus
caggtacttctgatgagtcgatccg

SEQ ID NO: 47209 - DNA, 25 bp, mus musculus
atatttcgtacacatagggactgtg

SEQ ID NO: 47210 - DNA, 25 bp, mus musculus
tttcgtacacatagggactgtggat

SEQ ID NO: 47211 - DNA, 25 bp, mus musculus
cgtacacatagggactgtggatcac

SEQ ID NO: 47212 - DNA, 25 bp, mus musculus
taaggactttgcctgccttcacgat

SEQ ID NO: 47213 - DNA, 25 bp, mus musculus
ctgccttcacgattgcttcagtctg

SEQ ID NO: 47214 - DNA, 25 bp, mus musculus
ccttcacgattgcttcagtctgttt

SEQ ID NO: 47215 - DNA, 25 bp, mus musculus
cgattgcttcagtctgtttgtcagt

SEQ ID NO: 47216 - DNA, 25 bp, mus musculus
ctcagcagcaccatcacgccagggt

SEQ ID NO: 47217 - DNA, 25 bp, mus musculus
agcagcaccatcacgccagggttga

SEQ ID NO: 47218 - DNA, 25 bp, mus musculus
ttcaaaagctcgtacacagcgagat

SEQ ID NO: 47219 - DNA, 25 bp, mus musculus
tcgtacacagcgagatcaatgcctg

SEQ ID NO: 47220 - DNA, 25 bp, mus musculus
gcgagatcaatgcctgcgtaaggaa

SEQ ID NO: 47221 - DNA, 25 bp, mus musculus
agatcaatgcctgcgtaaggaatga

SEQ ID NO: 47222 - DNA, 25 bp, mus musculus
tcaatgcctgcgtaaggaatgatgc

SEQ ID NO: 47223 - DNA, 25 bp, mus musculus
atcttcttggcacaaccgtatattc

SEQ ID NO: 47224 - DNA, 25 bp, mus musculus
ttcttggcacaaccgtatattccgg

SEQ ID NO: 47225 - DNA, 25 bp, mus musculus
gcacaaccgtatattccggagtatt

SEQ ID NO: 47226 - DNA, 25 bp, mus musculus
ccgtatattccggagtattgtccag

SEQ ID NO: 47227 - DNA, 25 bp, mus musculus
tgtccagttttggctacagctagcc

SEQ ID NO: 47228 - DNA, 25 bp, mus musculus
accatcacgccagggttgaccgagt

SEQ ID NO: 47229 - DNA, 25 bp, mus musculus
atcacgccagggttgaccgagtctt

SEQ ID NO: 47230 - DNA, 25 bp, mus musculus
ttgaccgagtctttggcaaagttat

SEQ ID NO: 47231 - DNA, 25 bp, mus musculus
gcaaagttatccagccaataagact

SEQ ID NO: 47232 - DNA, 25 bp, mus musculus
ttatccagccaataagacttcaaaa

SEQ ID NO: 47233 - DNA, 25 bp, mus musculus
tccagccaataagacttcaaaagct

SEQ ID NO: 47234 - DNA, 25 bp, mus musculus
taagacttcaaaagctcgtacacag

SEQ ID NO: 47235 - DNA, 25 bp, mus musculus
gacttcaaaagctcgtacacagcga

SEQ ID NO: 47236 - DNA, 25 bp, mus musculus
cacatccgcacagactgctttgagt

SEQ ID NO: 47237 - DNA, 25 bp, mus musculus
cgcacagactgctttgagtcgtaca

SEQ ID NO: 47238 - DNA, 25 bp, mus musculus
cggctggctgcagatccggtcctct

SEQ ID NO: 47239 - DNA, 25 bp, mus musculus
gctgcagatccggtcctctccgggc

SEQ ID NO: 47240 - DNA, 25 bp, mus musculus
tccgggctggcccagatgatgagag

SEQ ID NO: 47241 - DNA, 25 bp, mus musculus
ctcagtcacaatccagagaagccca

SEQ ID NO: 47242 - DNA, 25 bp, mus musculus
aagcccaaagtgattcactagccca

SEQ ID NO: 47243 - DNA, 25 bp, mus musculus
attcactagcccagggccaccaggc

SEQ ID NO: 47244 - DNA, 25 bp, mus musculus
accaggcttcctctgcctaaagtgt

SEQ ID NO: 47245 - DNA, 25 bp, mus musculus
ctgcctaaagtgtgtgctggggcag

SEQ ID NO: 47246 - DNA, 25 bp, mus musculus
aaagtgtgtgctggggcagaagaca

SEQ ID NO: 47247 - DNA, 25 bp, mus musculus
atccagccaaaaatacagctgagct

SEQ ID NO: 47248 - DNA, 25 bp, mus musculus
acagacatctgggcctttggcctag

SEQ ID NO: 47249 - DNA, 25 bp, mus musculus
atctgggcctttggcctagtgctat

SEQ ID NO: 47250 - DNA, 25 bp, mus musculus
atcgcccggcggaccatcatcaatg

SEQ ID NO: 47251 - DNA, 25 bp, mus musculus
atcaatggcattgtggaggattaca

SEQ ID NO: 47252 - DNA, 25 bp, mus musculus
aggccacctttctatgacatggtac

SEQ ID NO: 47253 - DNA, 25 bp, mus musculus
cctttctatgacatggtacccaatg

SEQ ID NO: 47254 - DNA, 25 bp, mus musculus
tatgacatggtacccaatgacccca

SEQ ID NO: 47255 - DNA, 25 bp, mus musculus
cctaaccggctggctgcagatccgg

SEQ ID NO: 47256 - DNA, 25 bp, mus musculus
actgggctacctgctgacagtgacg

SEQ ID NO: 47257 - DNA, 25 bp, mus musculus
tgggctacctgctgacagtgacggt

SEQ ID NO: 47258 - DNA, 25 bp, mus musculus
tgaatgtcagcacctctagacttta

SEQ ID NO: 47259 - DNA, 25 bp, mus musculus
aatgtcagcacctctagactttaca

SEQ ID NO: 47260 - DNA, 25 bp, mus musculus
tcagcacctctagactttacatggt

SEQ ID NO: 47261 - DNA, 25 bp, mus musculus
cgactggccccagcgtcatgctctg

SEQ ID NO: 47262 - DNA, 25 bp, mus musculus
actggccccagcgtcatgctctgag

SEQ ID NO: 47263 - DNA, 25 bp, mus musculus
tggccccagcgtcatgctctgagag

SEQ ID NO: 47264 - DNA, 25 bp, mus musculus
gccccagcgtcatgctctgagagtt

SEQ ID NO: 47265 - DNA, 25 bp, mus musculus
cagcgtcatgctctgagagttggag

SEQ ID NO: 47266 - DNA, 25 bp, mus musculus
catgctctgagagttggagggcaag

SEQ ID NO: 47267 - DNA, 25 bp, mus musculus
aaggcagagcacgccagtataccat

SEQ ID NO: 47268 - DNA, 25 bp, mus musculus
ggctacctgctgacagtgacggtct

SEQ ID NO: 47269 - DNA, 25 bp, mus musculus
ctacctgctgacagtgacggtctct

SEQ ID NO: 47270 - DNA, 25 bp, mus musculus
gctgacagtgacggtctctgcagat

SEQ ID NO: 47271 - DNA, 25 bp, mus musculus
tgacagtgacggtctctgcagatgg

SEQ ID NO: 47272 - DNA, 25 bp, mus musculus
cttctggaggcacggatgcccggac

SEQ ID NO: 47273 - DNA, 25 bp, mus musculus
gatgcccggactatgctgatgggat

SEQ ID NO: 47274 - DNA, 25 bp, mus musculus
tgcccggactatgctgatgggatca

SEQ ID NO: 47275 - DNA, 25 bp, mus musculus
aatgaatgtcagcacctctagactt

SEQ ID NO: 47276 - DNA, 25 bp, mus musculus
agcttccctatcacgacctggtgcc

SEQ ID NO: 47277 - DNA, 25 bp, mus musculus
acccttcttatgaggacatgagaga

SEQ ID NO: 47278 - DNA, 25 bp, mus musculus
tctgacgtcagatacttgtggacag

SEQ ID NO: 47279 - DNA, 25 bp, mus musculus
gaatttcacagaagcatcgttagcc

SEQ ID NO: 47280 - DNA, 25 bp, mus musculus
agcatcgttagcccaagccttgaac

SEQ ID NO: 47281 - DNA, 25 bp, mus musculus
ccaagccttgaacgttagcctactg

SEQ ID NO: 47282 - DNA, 25 bp, mus musculus
cttgaacgttagcctactgcccagt

SEQ ID NO: 47283 - DNA, 25 bp, mus musculus
tgagttcagactttcctggaagaga

SEQ ID NO: 47284 - DNA, 25 bp, mus musculus
cagactttcctggaagagagcacgg

SEQ ID NO: 47285 - DNA, 25 bp, mus musculus
acccagaaacacggattcatcatgg

SEQ ID NO: 47286 - DNA, 25 bp, mus musculus
ggattcatcatggctttctgaggag

SEQ ID NO: 47287 - DNA, 25 bp, mus musculus
tgctttctaagaaagccctgtattt

SEQ ID NO: 47288 - DNA, 25 bp, mus musculus
cattccccaatcgatggagcagtga

SEQ ID NO: 47289 - DNA, 25 bp, mus musculus
atgagtgtctcaggcagatggggaa

SEQ ID NO: 47290 - DNA, 25 bp, mus musculus
gtctcaggcagatggggaagcttat

SEQ ID NO: 47291 - DNA, 25 bp, mus musculus
tgacagagtgctgggcgcagaatcc

SEQ ID NO: 47292 - DNA, 25 bp, mus musculus
cccttgccaaaatgtcagagtccca

SEQ ID NO: 47293 - DNA, 25 bp, mus musculus
ccaaaatgtcagagtcccaggacat

SEQ ID NO: 47294 - DNA, 25 bp, mus musculus
tgtcagagtcccaggacattaaact

SEQ ID NO: 47295 - DNA, 25 bp, mus musculus
ttaaactctgacgtcagatacttgt

SEQ ID NO: 47296 - DNA, 25 bp, mus musculus
ggctgccaggctccaaacagccatg

SEQ ID NO: 47297 - DNA, 25 bp, mus musculus
tgccaggctccaaacagccatgctt

SEQ ID NO: 47298 - DNA, 25 bp, mus musculus
tcaagctctctaagaccaagttcac

SEQ ID NO: 47299 - DNA, 25 bp, mus musculus
tctctaagaccaagttcacagttcc

SEQ ID NO: 47300 - DNA, 25 bp, mus musculus
ctaagaccaagttcacagttccctg

SEQ ID NO: 47301 - DNA, 25 bp, mus musculus
agaccaagttcacagttccctggct

SEQ ID NO: 47302 - DNA, 25 bp, mus musculus
agttcacagttccctggctgccaga

SEQ ID NO: 47303 - DNA, 25 bp, mus musculus
tcacagttccctggctgccagaaga

SEQ ID NO: 47304 - DNA, 25 bp, mus musculus
ttcaccacgtttaatgcagatgaac

SEQ ID NO: 47305 - DNA, 25 bp, mus musculus
aagccgctcattcctgatgactatt

SEQ ID NO: 47306 - DNA, 25 bp, mus musculus
ccgctcattcctgatgactattgtg

SEQ ID NO: 47307 - DNA, 25 bp, mus musculus
ctcattcctgatgactattgtgtca

SEQ ID NO: 47308 - DNA, 25 bp, mus musculus
caggctccaaacagccatgcttaga

SEQ ID NO: 47309 - DNA, 25 bp, mus musculus
ccaaacagccatgcttagagccatt

SEQ ID NO: 47310 - DNA, 25 bp, mus musculus
agccatgcttagagccattgggaat

SEQ ID NO: 47311 - DNA, 25 bp, mus musculus
agccattgggaatccccacggcaca

SEQ ID NO: 47312 - DNA, 25 bp, mus musculus
tgggaatccccacggcacagtggcc

SEQ ID NO: 47313 - DNA, 25 bp, mus musculus
gaatccccacggcacagtggccagg

SEQ ID NO: 47314 - DNA, 25 bp, mus musculus
tccccacggcacagtggccagggtt

SEQ ID NO: 47315 - DNA, 25 bp, mus musculus
gattcaagctctctaagaccaagtt

SEQ ID NO: 47316 - DNA, 25 bp, mus musculus
tggccaccagctccttattcacagg

SEQ ID NO: 47317 - DNA, 25 bp, mus musculus
ccagctccttattcacaggtgaagc

SEQ ID NO: 47318 - DNA, 25 bp, mus musculus
tgttatcacagatgctcagtggacc

SEQ ID NO: 47319 - DNA, 25 bp, mus musculus
cacagatgctcagtggaccaagact

SEQ ID NO: 47320 - DNA, 25 bp, mus musculus
tgctcagtggaccaagactgtctcg

SEQ ID NO: 47321 - DNA, 25 bp, mus musculus
cattgtaattatcatcccgtgtctt

SEQ ID NO: 47322 - DNA, 25 bp, mus musculus
aattatcatcccgtgtctttgctgt

SEQ ID NO: 47323 - DNA, 25 bp, mus musculus
gtgtctttgctgtactcgtgctgaa

SEQ ID NO: 47324 - DNA, 25 bp, mus musculus
ttgctgtactcgtgctgaagtgttt

SEQ ID NO: 47325 - DNA, 25 bp, mus musculus
tactcgtgctgaagtgttttcacag

SEQ ID NO: 47326 - DNA, 25 bp, mus musculus
agtgttttcacagtcctttgtctag

SEQ ID NO: 47327 - DNA, 25 bp, mus musculus
ttcacagtcctttgtctagaagaaa

SEQ ID NO: 47328 - DNA, 25 bp, mus musculus
ccttattcacaggtgaagcagaaac

SEQ ID NO: 47329 - DNA, 25 bp, mus musculus
cagaaactctatgtaaccagcaagc

SEQ ID NO: 47330 - DNA, 25 bp, mus musculus
ctctatgtaaccagcaagcttctgc

SEQ ID NO: 47331 - DNA, 25 bp, mus musculus
gtaaccagcaagcttctgcttttta

SEQ ID NO: 47332 - DNA, 25 bp, mus musculus
acattacaacactggggaaatgaag

SEQ ID NO: 47333 - DNA, 25 bp, mus musculus
ctggtttctctggcacacgtgggca

SEQ ID NO: 47334 - DNA, 25 bp, mus musculus
tctctggcacacgtgggcagtcagc

SEQ ID NO: 47335 - DNA, 25 bp, mus musculus
agtcagccacacttcagacctgaca

SEQ ID NO: 47336 - DNA, 25 bp, mus musculus
ataagtatcgcctgggccgaaagat

SEQ ID NO: 47337 - DNA, 25 bp, mus musculus
tcggcagtggctcctttggagacat

SEQ ID NO: 47338 - DNA, 25 bp, mus musculus
ccatcattgcctctggtgaggaagt

SEQ ID NO: 47339 - DNA, 25 bp, mus musculus
aagtagccatcaagctcgaatgtgt

SEQ ID NO: 47340 - DNA, 25 bp, mus musculus
tgaagacgaaacatccccagctcca

SEQ ID NO: 47341 - DNA, 25 bp, mus musculus
agacgaaacatccccagctccacat

SEQ ID NO: 47342 - DNA, 25 bp, mus musculus
cccagctccacatcgagagcaagtt

SEQ ID NO: 47343 - DNA, 25 bp, mus musculus
tcatggagctgctgtggcccaacct

SEQ ID NO: 47344 - DNA, 25 bp, mus musculus
tgtggcccaacctggatgacctctt

SEQ ID NO: 47345 - DNA, 25 bp, mus musculus
ggcccaacctggatgacctcttcaa

SEQ ID NO: 47346 - DNA, 25 bp, mus musculus
atgacctcttcaacttctgttcccg

SEQ ID NO: 47347 - DNA, 25 bp, mus musculus
tcttcaacttctgttcccggacagt

SEQ ID NO: 47348 - DNA, 25 bp, mus musculus
gtggctcctttggagacatctacct

SEQ ID NO: 47349 - DNA, 25 bp, mus musculus
tcaacttctgttcccggacagttag

SEQ ID NO: 47350 - DNA, 25 bp, mus musculus
gctcctttggagacatctacctggg

SEQ ID NO: 47351 - DNA, 25 bp, mus musculus
cctttggagacatctacctgggtgc

SEQ ID NO: 47352 - DNA, 25 bp, mus musculus
gagacatctacctgggtgccatcat

SEQ ID NO: 47353 - DNA, 25 bp, mus musculus
acatctacctgggtgccatcattgc

SEQ ID NO: 47354 - DNA, 25 bp, mus musculus
tctacctgggtgccatcattgcctc

SEQ ID NO: 47355 - DNA, 25 bp, mus musculus
tgggtgccatcattgcctctggtga

SEQ ID NO: 47356 - DNA, 25 bp, mus musculus
gtgccatcattgcctctggtgagga

SEQ ID NO: 47357 - DNA, 25 bp, mus musculus
cggcagcctcagagctgcgggacct

SEQ ID NO: 47358 - DNA, 25 bp, mus musculus
cctcagagctgcgggacctcccggg

SEQ ID NO: 47359 - DNA, 25 bp, mus musculus
tgctcatcccggagacctaccaagc

SEQ ID NO: 47360 - DNA, 25 bp, mus musculus
agacctaccaagccaacaactgcca

SEQ ID NO: 47361 - DNA, 25 bp, mus musculus
gctacgggaaccacgtggtgctgct

SEQ ID NO: 47362 - DNA, 25 bp, mus musculus
accacgtggtgctgctgctaaaaat

SEQ ID NO: 47363 - DNA, 25 bp, mus musculus
tggtgctgctgctaaaaatgcaggc

SEQ ID NO: 47364 - DNA, 25 bp, mus musculus
cctacgcgggcaagctgctcatcag

SEQ ID NO: 47365 - DNA, 25 bp, mus musculus
agctgctcatcagcctgtccgagga

SEQ ID NO: 47366 - DNA, 25 bp, mus musculus
tgctcatcagcctgtccgaggagcg

SEQ ID NO: 47367 - DNA, 25 bp, mus musculus
tgtccgaggagcgcatcagcgccga

SEQ ID NO: 47368 - DNA, 25 bp, mus musculus
acatggtagccaccgagtgcggctg

SEQ ID NO: 47369 - DNA, 25 bp, mus musculus
cgcgcctgctagcgctgtgtcccaa

SEQ ID NO: 47370 - DNA, 25 bp, mus musculus
tgctagcgctgtgtcccaacgactc

SEQ ID NO: 47371 - DNA, 25 bp, mus musculus
tagcgctgtgtcccaacgactcccg

SEQ ID NO: 47372 - DNA, 25 bp, mus musculus
tgctgctgctaaaggcgctgcaggg

SEQ ID NO: 47373 - DNA, 25 bp, mus musculus
tgctaaaggcgctgcagggcttacg

SEQ ID NO: 47374 - DNA, 25 bp, mus musculus
taaaggcgctgcagggcttacgtgc

SEQ ID NO: 47375 - DNA, 25 bp, mus musculus
agcgttcagtgctcatcccggagac

SEQ ID NO: 47376 - DNA, 25 bp, mus musculus
gttcagtgctcatcccggagaccta

SEQ ID NO: 47377 - DNA, 25 bp, mus musculus
gcccatcatgacgaagactgagaag

SEQ ID NO: 47378 - DNA, 25 bp, mus musculus
ccatcatgacgaagactgagaagaa

SEQ ID NO: 47379 - DNA, 25 bp, mus musculus
agctgttcatctacaacccgagcag

SEQ ID NO: 47380 - DNA, 25 bp, mus musculus
ctgttcatctacaacccgagcagcg

SEQ ID NO: 47381 - DNA, 25 bp, mus musculus
gttcatctacaacccgagcagcgga

SEQ ID NO: 47382 - DNA, 25 bp, mus musculus
tcatctacaacccgagcagcggaga

SEQ ID NO: 47383 - DNA, 25 bp, mus musculus
atctacaacccgagcagcggagagt

SEQ ID NO: 47384 - DNA, 25 bp, mus musculus
ctacaacccgagcagcggagagttt

SEQ ID NO: 47385 - DNA, 25 bp, mus musculus
acaacccgagcagcggagagtttct

SEQ ID NO: 47386 - DNA, 25 bp, mus musculus
aacccgagcagcggagagtttctgg

SEQ ID NO: 47387 - DNA, 25 bp, mus musculus
agtttctggggcgcacctccaagag

SEQ ID NO: 47388 - DNA, 25 bp, mus musculus
tttctggggcgcacctccaagagct

SEQ ID NO: 47389 - DNA, 25 bp, mus musculus
agaagaaatccttccaccagagcct

SEQ ID NO: 47390 - DNA, 25 bp, mus musculus
tccttccaccagagcctggccgagt

SEQ ID NO: 47391 - DNA, 25 bp, mus musculus
cttccaccagagcctggccgagtgg

SEQ ID NO: 47392 - DNA, 25 bp, mus musculus
caccagagcctggccgagtggaagc

SEQ ID NO: 47393 - DNA, 25 bp, mus musculus
ccagagcctggccgagtggaagctg

SEQ ID NO: 47394 - DNA, 25 bp, mus musculus
agagcctggccgagtggaagctgtt

SEQ ID NO: 47395 - DNA, 25 bp, mus musculus
agcctggccgagtggaagctgttca

SEQ ID NO: 47396 - DNA, 25 bp, mus musculus
cctggccgagtggaagctgttcatc

SEQ ID NO: 47397 - DNA, 25 bp, mus musculus
ggtcctggacgaagccacagccgca

SEQ ID NO: 47398 - DNA, 25 bp, mus musculus
cacagccgcagtggatctagagacg

SEQ ID NO: 47399 - DNA, 25 bp, mus musculus
cgcacacaggctgcacaccatcatg

SEQ ID NO: 47400 - DNA, 25 bp, mus musculus
gctgcacaccatcatggacagtgac

SEQ ID NO: 47401 - DNA, 25 bp, mus musculus
gcacaccatcatggacagtgacaag

SEQ ID NO: 47402 - DNA, 25 bp, mus musculus
caccatcatggacagtgacaagata

SEQ ID NO: 47403 - DNA, 25 bp, mus musculus
cctagacagcggcaagattgttgaa

SEQ ID NO: 47404 - DNA, 25 bp, mus musculus
cagtcctgaagaactgctgtccaat

SEQ ID NO: 47405 - DNA, 25 bp, mus musculus
caatatgggtcccttctacttgatg

SEQ ID NO: 47406 - DNA, 25 bp, mus musculus
tatgggtcccttctacttgatggcc

SEQ ID NO: 47407 - DNA, 25 bp, mus musculus
tcccttctacttgatggccaaggaa

SEQ ID NO: 47408 - DNA, 25 bp, mus musculus
gaaccacacggagctctagcagtgc

SEQ ID NO: 47409 - DNA, 25 bp, mus musculus
agccgcagtggatctagagacggat

SEQ ID NO: 47410 - DNA, 25 bp, mus musculus
gacggatagcctcattcagacgacc

SEQ ID NO: 47411 - DNA, 25 bp, mus musculus
ggatagcctcattcagacgaccatc

SEQ ID NO: 47412 - DNA, 25 bp, mus musculus
catccggaacgagttctcccagtgc

SEQ ID NO: 47413 - DNA, 25 bp, mus musculus
gaacgagttctcccagtgcacggtc

SEQ ID NO: 47414 - DNA, 25 bp, mus musculus
ccagtgcacggtcatcactatcgca

SEQ ID NO: 47415 - DNA, 25 bp, mus musculus
cacggtcatcactatcgcacacagg

SEQ ID NO: 47416 - DNA, 25 bp, mus musculus
catcactatcgcacacaggctgcac

SEQ ID NO: 47417 - DNA, 25 bp, mus musculus
cacttgtgttggcaagagagatgaa

SEQ ID NO: 47418 - DNA, 25 bp, mus musculus
tgagaaccttggccactttgtcatg

SEQ ID NO: 47419 - DNA, 25 bp, mus musculus
cgctgccaatattgccacagacgat

SEQ ID NO: 47420 - DNA, 25 bp, mus musculus
ggacaagttcgctggccgtgtggcc

SEQ ID NO: 47421 - DNA, 25 bp, mus musculus
ccacactctcctgtggatgcttctg

SEQ ID NO: 47422 - DNA, 25 bp, mus musculus
tctcctgtggatgcttctggaatgt

SEQ ID NO: 47423 - DNA, 25 bp, mus musculus
caacttctctacctagcctgatgcc

SEQ ID NO: 47424 - DNA, 25 bp, mus musculus
ctagcctgatgcccacacaatttcc

SEQ ID NO: 47425 - DNA, 25 bp, mus musculus
tgatgcccacacaatttccaacatc

SEQ ID NO: 47426 - DNA, 25 bp, mus musculus
caacatcttccaaccttagcttagc

SEQ ID NO: 47427 - DNA, 25 bp, mus musculus
cttccaaccttagcttagccagaga

SEQ ID NO: 47428 - DNA, 25 bp, mus musculus
accttagcttagccagagacagaga

SEQ ID NO: 47429 - DNA, 25 bp, mus musculus
ccttggccactttgtcatgttccct

SEQ ID NO: 47430 - DNA, 25 bp, mus musculus
ccactttgtcatgttccctgctaat

SEQ ID NO: 47431 - DNA, 25 bp, mus musculus
tgtcatgttccctgctaatggcagc

SEQ ID NO: 47432 - DNA, 25 bp, mus musculus
tccctactatggcaaaaagttccat

SEQ ID NO: 47433 - DNA, 25 bp, mus musculus
ctatactcagcctttggtggctgta

SEQ ID NO: 47434 - DNA, 25 bp, mus musculus
tgttgaatgccgcatcaacgctgcc

SEQ ID NO: 47435 - DNA, 25 bp, mus musculus
atgccgcatcaacgctgccaatatt

SEQ ID NO: 47436 - DNA, 25 bp, mus musculus
catcaacgctgccaatattgccaca

SEQ ID NO: 47437 - DNA, 25 bp, mus musculus
gaatttctcaaccgacaacattccg

SEQ ID NO: 47438 - DNA, 25 bp, mus musculus
cgacaacattccgatcccaatgagc

SEQ ID NO: 47439 - DNA, 25 bp, mus musculus
cagagttgcttgacccacttcaacc

SEQ ID NO: 47440 - DNA, 25 bp, mus musculus
tgcttgacccacttcaacctcatct

SEQ ID NO: 47441 - DNA, 25 bp, mus musculus
gccctcaaggccatggacaaaatgt

SEQ ID NO: 47442 - DNA, 25 bp, mus musculus
aacagccacacggacaacagcgcca

SEQ ID NO: 47443 - DNA, 25 bp, mus musculus
gacaacagcgccaaaagcagtgaca

SEQ ID NO: 47444 - DNA, 25 bp, mus musculus
gggaccagccactcctactgctgct

SEQ ID NO: 47445 - DNA, 25 bp, mus musculus
agccactcctactgctgctgctact

SEQ ID NO: 47446 - DNA, 25 bp, mus musculus
tcctactgctgctgctactctgcgt

SEQ ID NO: 47447 - DNA, 25 bp, mus musculus
tgctgctgctactctgcgttgccgc

SEQ ID NO: 47448 - DNA, 25 bp, mus musculus
tcccggagtcctccggattgctctc

SEQ ID NO: 47449 - DNA, 25 bp, mus musculus
cattccgatcccaatgagcaagtgg

SEQ ID NO: 47450 - DNA, 25 bp, mus musculus
gatcccaatgagcaagtggcaagaa

SEQ ID NO: 47451 - DNA, 25 bp, mus musculus
atgctcctggccacaaaacagatct

SEQ ID NO: 47452 - DNA, 25 bp, mus musculus
ctggccacaaaacagatctgcaaag

SEQ ID NO: 47453 - DNA, 25 bp, mus musculus
actgacctgctggctcaggaccgat

SEQ ID NO: 47454 - DNA, 25 bp, mus musculus
aactcgcggcccaatcctatcctgg

SEQ ID NO: 47455 - DNA, 25 bp, mus musculus
aatcctatcctggagcctggcatcc

SEQ ID NO: 47456 - DNA, 25 bp, mus musculus
gagcctggcatccagagttgcttga

SEQ ID NO: 47457 - DNA, 25 bp, mus musculus
gaaggcaccagctgaaggaacatcc

SEQ ID NO: 47458 - DNA, 25 bp, mus musculus
tgaaggaacatccactttttaagag

SEQ ID NO: 47459 - DNA, 25 bp, mus musculus
cgaaccaatgagctgtttcatgacg

SEQ ID NO: 47460 - DNA, 25 bp, mus musculus
aaccaatgagctgtttcatgacgtt

SEQ ID NO: 47461 - DNA, 25 bp, mus musculus
gtttcatgacgtttatactgagttc

SEQ ID NO: 47462 - DNA, 25 bp, mus musculus
ttctttgaaaagctccacactctgg

SEQ ID NO: 47463 - DNA, 25 bp, mus musculus
ttgaaaagctccacactctggtgag

SEQ ID NO: 47464 - DNA, 25 bp, mus musculus
aaagctccacactctggtgagtcat

SEQ ID NO: 47465 - DNA, 25 bp, mus musculus
agctccacactctggtgagtcatga

SEQ ID NO: 47466 - DNA, 25 bp, mus musculus
ccacactctggtgagtcatgaggtt

SEQ ID NO: 47467 - DNA, 25 bp, mus musculus
acactctggtgagtcatgaggttgt

SEQ ID NO: 47468 - DNA, 25 bp, mus musculus
actctggtgagtcatgaggttgttc

SEQ ID NO: 47469 - DNA, 25 bp, mus musculus
ggaacatccactttttaagagctgt

SEQ ID NO: 47470 - DNA, 25 bp, mus musculus
catccactttttaagagctgtatat

SEQ ID NO: 47471 - DNA, 25 bp, mus musculus
tccactttttaagagctgtatatac

SEQ ID NO: 47472 - DNA, 25 bp, mus musculus
gctgtatatacatccatctccactt

SEQ ID NO: 47473 - DNA, 25 bp, mus musculus
catctccacttgcatcacaaataag

SEQ ID NO: 47474 - DNA, 25 bp, mus musculus
tctccacttgcatcacaaataagtt

SEQ ID NO: 47475 - DNA, 25 bp, mus musculus
tccacttgcatcacaaataagttag

SEQ ID NO: 47476 - DNA, 25 bp, mus musculus
cacttgcatcacaaataagttagac

SEQ ID NO: 47477 - DNA, 25 bp, mus musculus
tgcctctgcagcctacattgggcat

SEQ ID NO: 47478 - DNA, 25 bp, mus musculus
tagataactaaccataccctcttct

SEQ ID NO: 47479 - DNA, 25 bp, mus musculus
tatttttctaacgcctggactgagc

SEQ ID NO: 47480 - DNA, 25 bp, mus musculus
tctaacgcctggactgagctggcca

SEQ ID NO: 47481 - DNA, 25 bp, mus musculus
gcctggactgagctggccagtcatt

SEQ ID NO: 47482 - DNA, 25 bp, mus musculus
actgagctggccagtcattctaaag

SEQ ID NO: 47483 - DNA, 25 bp, mus musculus
ctggccagtcattctaaagcagttt

SEQ ID NO: 47484 - DNA, 25 bp, mus musculus
ttggtacttgctcctggcctgtgtg

SEQ ID NO: 47485 - DNA, 25 bp, mus musculus
gtattgtgtgctcctgtgactagag

SEQ ID NO: 47486 - DNA, 25 bp, mus musculus
tgtgctcctgtgactagagactgct

SEQ ID NO: 47487 - DNA, 25 bp, mus musculus
atgggcttccctgtagatgccacct

SEQ ID NO: 47488 - DNA, 25 bp, mus musculus
gtagatgccaccttcggcttttctg

SEQ ID NO: 47489 - DNA, 25 bp, mus musculus
gcaggcatgacctgggtttgctccc

SEQ ID NO: 47490 - DNA, 25 bp, mus musculus
tcgtcaccatctgtcggtcttgcct

SEQ ID NO: 47491 - DNA, 25 bp, mus musculus
cttaacacggacccgctgactgatg

SEQ ID NO: 47492 - DNA, 25 bp, mus musculus
acggacccgctgactgatgctgggc

SEQ ID NO: 47493 - DNA, 25 bp, mus musculus
cactccatactgtacttcctttctc

SEQ ID NO: 47494 - DNA, 25 bp, mus musculus
atactgtacttcctttctcctcaag

SEQ ID NO: 47495 - DNA, 25 bp, mus musculus
tacttcctttctcctcaagcagagt

SEQ ID NO: 47496 - DNA, 25 bp, mus musculus
ctttctcctcaagcagagtattttt

SEQ ID NO: 47497 - DNA, 25 bp, mus musculus
caccgccatgggcctcctgagagat

SEQ ID NO: 47498 - DNA, 25 bp, mus musculus
atgggcctcctgagagatccttaga

SEQ ID NO: 47499 - DNA, 25 bp, mus musculus
agatccttagatccagcggtgcccc

SEQ ID NO: 47500 - DNA, 25 bp, mus musculus
gatccttagatccagcggtgcccct

SEQ ID NO: 47501 - DNA, 25 bp, mus musculus
atccttagatccagcggtgcccctc

SEQ ID NO: 47502 - DNA, 25 bp, mus musculus
tgggcctcctgagagatccttagat

SEQ ID NO: 47503 - DNA, 25 bp, mus musculus
gggcctcctgagagatccttagatc

SEQ ID NO: 47504 - DNA, 25 bp, mus musculus
ggcctcctgagagatccttagatcc

SEQ ID NO: 47505 - DNA, 25 bp, mus musculus
gcctcctgagagatccttagatcca

SEQ ID NO: 47506 - DNA, 25 bp, mus musculus
cctcctgagagatccttagatccag

SEQ ID NO: 47507 - DNA, 25 bp, mus musculus
ctcctgagagatccttagatccagc

SEQ ID NO: 47508 - DNA, 25 bp, mus musculus
agagatccttagatccagcggtgcc

SEQ ID NO: 47509 - DNA, 25 bp, mus musculus
gagatccttagatccagcggtgccc

SEQ ID NO: 47510 - DNA, 25 bp, mus musculus
tgggcctcctgagagatccttagat

SEQ ID NO: 47511 - DNA, 25 bp, mus musculus
gggcctcctgagagatccttagatc

SEQ ID NO: 47512 - DNA, 25 bp, mus musculus
atccttagatccagcggtgcccctc

SEQ ID NO: 47513 - DNA, 25 bp, mus musculus
tccttagatccagcggtgcccctcc

SEQ ID NO: 47514 - DNA, 25 bp, mus musculus
ccttagatccagcggtgcccctcca

SEQ ID NO: 47515 - DNA, 25 bp, mus musculus
cttagatccagcggtgcccctccaa

SEQ ID NO: 47516 - DNA, 25 bp, mus musculus
ttagatccagcggtgcccctccaac

SEQ ID NO: 47517 - DNA, 25 bp, mus musculus
tagatccagcggtgcccctccaacc

SEQ ID NO: 47518 - DNA, 25 bp, mus musculus
agatccagcggtgcccctccaacca

SEQ ID NO: 47519 - DNA, 25 bp, mus musculus
gatccagcggtgcccctccaaccag

SEQ ID NO: 47520 - DNA, 25 bp, mus musculus
atccagcggtgcccctccaaccagg

SEQ ID NO: 47521 - DNA, 25 bp, mus musculus
tccagcggtgcccctccaaccagga

SEQ ID NO: 47522 - DNA, 25 bp, mus musculus
ggcctcctgagagatccttagatcc

SEQ ID NO: 47523 - DNA, 25 bp, mus musculus
gcctcctgagagatccttagatcca

SEQ ID NO: 47524 - DNA, 25 bp, mus musculus
cctcctgagagatccttagatccag

SEQ ID NO: 47525 - DNA, 25 bp, mus musculus
ctcctgagagatccttagatccagc

SEQ ID NO: 47526 - DNA, 25 bp, mus musculus
agagatccttagatccagcggtgcc

SEQ ID NO: 47527 - DNA, 25 bp, mus musculus
gagatccttagatccagcggtgccc

SEQ ID NO: 47528 - DNA, 25 bp, mus musculus
agatccttagatccagcggtgcccc

SEQ ID NO: 47529 - DNA, 25 bp, mus musculus
gatccttagatccagcggtgcccct

SEQ ID NO: 47530 - DNA, 25 bp, mus musculus
ccttgaagtctgactttgggtgatt

SEQ ID NO: 47531 - DNA, 25 bp, mus musculus
tgaagtctgactttgggtgattcac

SEQ ID NO: 47532 - DNA, 25 bp, mus musculus
ttcagcgcgttctacctgatgatct

SEQ ID NO: 47533 - DNA, 25 bp, mus musculus
agcgcgttctacctgatgatctgga

SEQ ID NO: 47534 - DNA, 25 bp, mus musculus
gcgttctacctgatgatctggagcg

SEQ ID NO: 47535 - DNA, 25 bp, mus musculus
ttctacctgatgatctggagcgctt

SEQ ID NO: 47536 - DNA, 25 bp, mus musculus
ctgatgatctggagcgcttgcacag

SEQ ID NO: 47537 - DNA, 25 bp, mus musculus
atctggagcgcttgcacagattgac

SEQ ID NO: 47538 - DNA, 25 bp, mus musculus
acagattgactaatccctatacagc

SEQ ID NO: 47539 - DNA, 25 bp, mus musculus
gattgactaatccctatacagcagg

SEQ ID NO: 47540 - DNA, 25 bp, mus musculus
ctaatccctatacagcaggatgttc

SEQ ID NO: 47541 - DNA, 25 bp, mus musculus
atacagcaggatgttctgcggcccg

SEQ ID NO: 47542 - DNA, 25 bp, mus musculus
ctggtcctggtgctgcagaaggaac

SEQ ID NO: 47543 - DNA, 25 bp, mus musculus
gtcctggtgctgcagaaggaacaag

SEQ ID NO: 47544 - DNA, 25 bp, mus musculus
gatgcttccttgaagacttgttcgg

SEQ ID NO: 47545 - DNA, 25 bp, mus musculus
gcttccttgaagacttgttcggtgt

SEQ ID NO: 47546 - DNA, 25 bp, mus musculus
tgcaagcctggtttggccgttcaga

SEQ ID NO: 47547 - DNA, 25 bp, mus musculus
cctggtttggccgttcagagaatat

SEQ ID NO: 47548 - DNA, 25 bp, mus musculus
gctcaatgattcagcgcgttctacc

SEQ ID NO: 47549 - DNA, 25 bp, mus musculus
caatgattcagcgcgttctacctga

SEQ ID NO: 47550 - DNA, 25 bp, mus musculus
gccttgacgaagccttcgcgatact

SEQ ID NO: 47551 - DNA, 25 bp, mus musculus
ttgacgaagccttcgcgatactcct

SEQ ID NO: 47552 - DNA, 25 bp, mus musculus
gtcaccatgcccgttggactggatg

SEQ ID NO: 47553 - DNA, 25 bp, mus musculus
gatgatcatgcctctctagctccgg

SEQ ID NO: 47554 - DNA, 25 bp, mus musculus
gatcatgcctctctagctccggcta

SEQ ID NO: 47555 - DNA, 25 bp, mus musculus
gcctctctagctccggctacgcgag

SEQ ID NO: 47556 - DNA, 25 bp, mus musculus
gtttgagcagcccaagatccggcga

SEQ ID NO: 47557 - DNA, 25 bp, mus musculus
tgagcagcccaagatccggcgaacg

SEQ ID NO: 47558 - DNA, 25 bp, mus musculus
gcagcccaagatccggcgaacgagc

SEQ ID NO: 47559 - DNA, 25 bp, mus musculus
caagatccggcgaacgagcagcccg

SEQ ID NO: 47560 - DNA, 25 bp, mus musculus
tcagcttgagcgtcagcagttgttt

SEQ ID NO: 47561 - DNA, 25 bp, mus musculus
gcttgagcgtcagcagttgtttctt

SEQ ID NO: 47562 - DNA, 25 bp, mus musculus
acgaagccttcgcgatactcctgct

SEQ ID NO: 47563 - DNA, 25 bp, mus musculus
aagccttcgcgatactcctgctcct

SEQ ID NO: 47564 - DNA, 25 bp, mus musculus
tcgcgatactcctgctcctcgctat

SEQ ID NO: 47565 - DNA, 25 bp, mus musculus
tcgctatctgccaccttcgggtaga

SEQ ID NO: 47566 - DNA, 25 bp, mus musculus
ctatctgccaccttcgggtagagga

SEQ ID NO: 47567 - DNA, 25 bp, mus musculus
tctgccaccttcgggtagaggatct

SEQ ID NO: 47568 - DNA, 25 bp, mus musculus
gtagtggtcaccatgcccgttggac

SEQ ID NO: 47569 - DNA, 25 bp, mus musculus
gtggtcaccatgcccgttggactgg

SEQ ID NO: 47570 - DNA, 25 bp, mus musculus
aagctcggcggccatgagcacttac

SEQ ID NO: 47571 - DNA, 25 bp, mus musculus
ggccatgagcacttacgcaggcatt

SEQ ID NO: 47572 - DNA, 25 bp, mus musculus
caccagaccaggatggtcctacacc

SEQ ID NO: 47573 - DNA, 25 bp, mus musculus
tcctgctcccaactagagcccagag

SEQ ID NO: 47574 - DNA, 25 bp, mus musculus
caactagagcccagagtctttcaga

SEQ ID NO: 47575 - DNA, 25 bp, mus musculus
ctagagcccagagtctttcagagaa

SEQ ID NO: 47576 - DNA, 25 bp, mus musculus
gagcccagagtctttcagagaaaga

SEQ ID NO: 47577 - DNA, 25 bp, mus musculus
tggcgtcgtgtggcttcttttcaga

SEQ ID NO: 47578 - DNA, 25 bp, mus musculus
cgtcgtgtggcttcttttcagaggt

SEQ ID NO: 47579 - DNA, 25 bp, mus musculus
gcttcttttcagaggttcccaggca

SEQ ID NO: 47580 - DNA, 25 bp, mus musculus
tcttttcagaggttcccaggcaagg

SEQ ID NO: 47581 - DNA, 25 bp, mus musculus
aggttcccaggcaagggcatgcaag

SEQ ID NO: 47582 - DNA, 25 bp, mus musculus
catgagcacttacgcaggcattttt

SEQ ID NO: 47583 - DNA, 25 bp, mus musculus
ttcccaggcaagggcatgcaagctt

SEQ ID NO: 47584 - DNA, 25 bp, mus musculus
cacttacgcaggcatttttacagac

SEQ ID NO: 47585 - DNA, 25 bp, mus musculus
ttacgcaggcatttttacagaccac

SEQ ID NO: 47586 - DNA, 25 bp, mus musculus
gtagctgccagcaagccccaagtta

SEQ ID NO: 47587 - DNA, 25 bp, mus musculus
gctgccagcaagccccaagttaggg

SEQ ID NO: 47588 - DNA, 25 bp, mus musculus
aacctgatgacagacaccgcgcctc

SEQ ID NO: 47589 - DNA, 25 bp, mus musculus
tgctcgcatcaccagaccaggatgg

SEQ ID NO: 47590 - DNA, 25 bp, mus musculus
catcaccagaccaggatggtcctac

SEQ ID NO: 47591 - DNA, 25 bp, mus musculus
ataaccctgaagtgctcgacatcac

SEQ ID NO: 47592 - DNA, 25 bp, mus musculus
aaccctgaagtgctcgacatcacag

SEQ ID NO: 47593 - DNA, 25 bp, mus musculus
ctcgacatcacagagcaggccctgc

SEQ ID NO: 47594 - DNA, 25 bp, mus musculus
tcgacatcacagagcaggccctgca

SEQ ID NO: 47595 - DNA, 25 bp, mus musculus
cgacatcacagagcaggccctgcac

SEQ ID NO: 47596 - DNA, 25 bp, mus musculus
catcacagagcaggccctgcactct

SEQ ID NO: 47597 - DNA, 25 bp, mus musculus
cagagcaggccctgcactctcgctt

SEQ ID NO: 47598 - DNA, 25 bp, mus musculus
agcaggccctgcactctcgctttct

SEQ ID NO: 47599 - DNA, 25 bp, mus musculus
ggccctgcactctcgctttctggag

SEQ ID NO: 47600 - DNA, 25 bp, mus musculus
gactgagtacaccttcccacttact

SEQ ID NO: 47601 - DNA, 25 bp, mus musculus
actgagtacaccttcccacttactg

SEQ ID NO: 47602 - DNA, 25 bp, mus musculus
ctgagtacaccttcccacttactga

SEQ ID NO: 47603 - DNA, 25 bp, mus musculus
accctgaagtgctcgacatcacaga

SEQ ID NO: 47604 - DNA, 25 bp, mus musculus
ccctgaagtgctcgacatcacagag

SEQ ID NO: 47605 - DNA, 25 bp, mus musculus
ctgaagtgctcgacatcacagagca

SEQ ID NO: 47606 - DNA, 25 bp, mus musculus
tgaagtgctcgacatcacagagcag

SEQ ID NO: 47607 - DNA, 25 bp, mus musculus
gaagtgctcgacatcacagagcagg

SEQ ID NO: 47608 - DNA, 25 bp, mus musculus
agtgctcgacatcacagagcaggcc

SEQ ID NO: 47609 - DNA, 25 bp, mus musculus
gtgctcgacatcacagagcaggccc

SEQ ID NO: 47610 - DNA, 25 bp, mus musculus
tgctcgacatcacagagcaggccct

SEQ ID NO: 47611 - DNA, 25 bp, mus musculus
gatcagccgatgacaaattgtgagc

SEQ ID NO: 47612 - DNA, 25 bp, mus musculus
agagaaagctggccgccatgtgcgc

SEQ ID NO: 47613 - DNA, 25 bp, mus musculus
gtgttgactgtctgcaacgatgaaa

SEQ ID NO: 47614 - DNA, 25 bp, mus musculus
tgttgactgtctgcaacgatgaaag

SEQ ID NO: 47615 - DNA, 25 bp, mus musculus
gttgactgtctgcaacgatgaaagc

SEQ ID NO: 47616 - DNA, 25 bp, mus musculus
ttgactgtctgcaacgatgaaagcg

SEQ ID NO: 47617 - DNA, 25 bp, mus musculus
tgactgtctgcaacgatgaaagcgg

SEQ ID NO: 47618 - DNA, 25 bp, mus musculus
actgtctgcaacgatgaaagcggcg

SEQ ID NO: 47619 - DNA, 25 bp, mus musculus
aaagctggccgccatgtgcgcactg

SEQ ID NO: 47620 - DNA, 25 bp, mus musculus
tggccgccatgtgcgcactggtgtt

SEQ ID NO: 47621 - DNA, 25 bp, mus musculus
ggccgccatgtgcgcactggtgttg

SEQ ID NO: 47622 - DNA, 25 bp, mus musculus
cgccatgtgcgcactggtgttgact

SEQ ID NO: 47623 - DNA, 25 bp, mus musculus
gccatgtgcgcactggtgttgactg

SEQ ID NO: 47624 - DNA, 25 bp, mus musculus
catgtgcgcactggtgttgactgtc

SEQ ID NO: 47625 - DNA, 25 bp, mus musculus
atgtgcgcactggtgttgactgtct

SEQ ID NO: 47626 - DNA, 25 bp, mus musculus
tgtgcgcactggtgttgactgtctg

SEQ ID NO: 47627 - DNA, 25 bp, mus musculus
tcatagcagatctcgctctcgtaca

SEQ ID NO: 47628 - DNA, 25 bp, mus musculus
tagcagatctcgctctcgtacataa

SEQ ID NO: 47629 - DNA, 25 bp, mus musculus
ttagttaatttccatgctcttcaga

SEQ ID NO: 47630 - DNA, 25 bp, mus musculus
aatttccatgctcttcagactgtga

SEQ ID NO: 47631 - DNA, 25 bp, mus musculus
ttccatgctcttcagactgtgatat

SEQ ID NO: 47632 - DNA, 25 bp, mus musculus
catgctcttcagactgtgatattgt

SEQ ID NO: 47633 - DNA, 25 bp, mus musculus
ctattctgctctggtttgtgtgaaa

SEQ ID NO: 47634 - DNA, 25 bp, mus musculus
acatttcaatcattttaggattgtc

SEQ ID NO: 47635 - DNA, 25 bp, mus musculus
tatgactccaagtgctattgtcaca

SEQ ID NO: 47636 - DNA, 25 bp, mus musculus
tccaagtgctattgtcacagatgaa

SEQ ID NO: 47637 - DNA, 25 bp, mus musculus
cagtattgaccttatactagaaggc

SEQ ID NO: 47638 - DNA, 25 bp, mus musculus
tattgaccttatactagaaggcgag

SEQ ID NO: 47639 - DNA, 25 bp, mus musculus
tcgctctcgtacataagatgattgg

SEQ ID NO: 47640 - DNA, 25 bp, mus musculus
ttgtatacagttttcctttactcag

SEQ ID NO: 47641 - DNA, 25 bp, mus musculus
ctttactcagtacaatcttttcatt

SEQ ID NO: 47642 - DNA, 25 bp, mus musculus
tttaattcaagctgttttgttcaga

SEQ ID NO: 47643 - DNA, 25 bp, mus musculus
tgtaatatccctttctcctaacatc

SEQ ID NO: 47644 - DNA, 25 bp, mus musculus
atccctttctcctaacatctacatt

SEQ ID NO: 47645 - DNA, 25 bp, mus musculus
tcctaacatctacattcccctcatg

SEQ ID NO: 47646 - DNA, 25 bp, mus musculus
tcccctcatgtctttggtaacttgt

SEQ ID NO: 47647 - DNA, 25 bp, mus musculus
ggtctaccgcatgagggatgatgag

SEQ ID NO: 47648 - DNA, 25 bp, mus musculus
tgatgagcaactcttccagaccttc

SEQ ID NO: 47649 - DNA, 25 bp, mus musculus
tatctacctgaggcaaaagcttcgg

SEQ ID NO: 47650 - DNA, 25 bp, mus musculus
ctcatgagagcttgtttggttacac

SEQ ID NO: 47651 - DNA, 25 bp, mus musculus
gtcctacttatgcccaggatctgga

SEQ ID NO: 47652 - DNA, 25 bp, mus musculus
atctggattacccctggggctgatg

SEQ ID NO: 47653 - DNA, 25 bp, mus musculus
attacccctggggctgatgtctgac

SEQ ID NO: 47654 - DNA, 25 bp, mus musculus
gtctgacctgggctttgtcgagggc

SEQ ID NO: 47655 - DNA, 25 bp, mus musculus
ggagctattgcccgagcctgggcta

SEQ ID NO: 47656 - DNA, 25 bp, mus musculus
aatggacctctgaaccctgtactgt

SEQ ID NO: 47657 - DNA, 25 bp, mus musculus
gtactgttacctgatcctgcaaggc

SEQ ID NO: 47658 - DNA, 25 bp, mus musculus
ttacctgatcctgcaaggctgttaa

SEQ ID NO: 47659 - DNA, 25 bp, mus musculus
ggccactctgtgtgcccagctctca

SEQ ID NO: 47660 - DNA, 25 bp, mus musculus
tctgtgtgcccagctctcagcccga

SEQ ID NO: 47661 - DNA, 25 bp, mus musculus
cagccctgctttgtgtcgccacttg

SEQ ID NO: 47662 - DNA, 25 bp, mus musculus
tgctttgtgtcgccacttgatgccc

SEQ ID NO: 47663 - DNA, 25 bp, mus musculus
gatgcccaatgggagcctcccagat

SEQ ID NO: 47664 - DNA, 25 bp, mus musculus
gtattccatgttccagactggggaa

SEQ ID NO: 47665 - DNA, 25 bp, mus musculus
catgttccagactggggaaagttca

SEQ ID NO: 47666 - DNA, 25 bp, mus musculus
acattcccgagtgctgcttatctac

SEQ ID NO: 47667 - DNA, 25 bp, mus musculus
agaatcttaagcgcgtggccaagga

SEQ ID NO: 47668 - DNA, 25 bp, mus musculus
aatcttaagcgcgtggccaaggagc

SEQ ID NO: 47669 - DNA, 25 bp, mus musculus
tttttctactgcaagcacatgtgac

SEQ ID NO: 47670 - DNA, 25 bp, mus musculus
tttctactgcaagcacatgtgacta

SEQ ID NO: 47671 - DNA, 25 bp, mus musculus
tactgcaagcacatgtgactagatt

SEQ ID NO: 47672 - DNA, 25 bp, mus musculus
ctgcaagcacatgtgactagattta

SEQ ID NO: 47673 - DNA, 25 bp, mus musculus
atttagtgcctggcattttgtgaaa

SEQ ID NO: 47674 - DNA, 25 bp, mus musculus
ttagtgcctggcattttgtgaaata

SEQ ID NO: 47675 - DNA, 25 bp, mus musculus
agtgcctggcattttgtgaaatatg

SEQ ID NO: 47676 - DNA, 25 bp, mus musculus
gtaactttagccatgaccttgaatc

SEQ ID NO: 47677 - DNA, 25 bp, mus musculus
aactttagccatgaccttgaatcta

SEQ ID NO: 47678 - DNA, 25 bp, mus musculus
ctttagccatgaccttgaatctatt

SEQ ID NO: 47679 - DNA, 25 bp, mus musculus
caagagttcctgcgcatcatgaaaa

SEQ ID NO: 47680 - DNA, 25 bp, mus musculus
ttagccatgaccttgaatctatttt

SEQ ID NO: 47681 - DNA, 25 bp, mus musculus
agagttcctgcgcatcatgaaaaag

SEQ ID NO: 47682 - DNA, 25 bp, mus musculus
agttcctgcgcatcatgaaaaagac

SEQ ID NO: 47683 - DNA, 25 bp, mus musculus
ttcctgcgcatcatgaaaaagacca

SEQ ID NO: 47684 - DNA, 25 bp, mus musculus
aagaccagcctctattaagatcagt

SEQ ID NO: 47685 - DNA, 25 bp, mus musculus
gaccagcctctattaagatcagtgt

SEQ ID NO: 47686 - DNA, 25 bp, mus musculus
agcctctattaagatcagtgtttct

SEQ ID NO: 47687 - DNA, 25 bp, mus musculus
tctttttctactgcaagcacatgtg

SEQ ID NO: 47688 - DNA, 25 bp, mus musculus
taagctattgggctgcaacatcact

SEQ ID NO: 47689 - DNA, 25 bp, mus musculus
cagcaagcgtgggctggagatcaga

SEQ ID NO: 47690 - DNA, 25 bp, mus musculus
gagtacgtatcagctcgtctttcag

SEQ ID NO: 47691 - DNA, 25 bp, mus musculus
gtatcagctcgtctttcagtttgag

SEQ ID NO: 47692 - DNA, 25 bp, mus musculus
gctcgtctttcagtttgagcctctc

SEQ ID NO: 47693 - DNA, 25 bp, mus musculus
ctttcagtttgagcctctcaggagg

SEQ ID NO: 47694 - DNA, 25 bp, mus musculus
gtttgagcctctcaggaggtgttct

SEQ ID NO: 47695 - DNA, 25 bp, mus musculus
tcttctttaggtctacccagactct

SEQ ID NO: 47696 - DNA, 25 bp, mus musculus
ttaggtctacccagactctcaccct

SEQ ID NO: 47697 - DNA, 25 bp, mus musculus
tcaccctcttgtcttcttttccaat

SEQ ID NO: 47698 - DNA, 25 bp, mus musculus
ttccaatcttgtttcagtactgtac

SEQ ID NO: 47699 - DNA, 25 bp, mus musculus
tcttgtttcagtactgtacctgggg

SEQ ID NO: 47700 - DNA, 25 bp, mus musculus
gacccatgcagacctggctgtagat

SEQ ID NO: 47701 - DNA, 25 bp, mus musculus
tgcagacctggctgtagatcaggga

SEQ ID NO: 47702 - DNA, 25 bp, mus musculus
ggcgtcctgtggtggcttctatccc

SEQ ID NO: 47703 - DNA, 25 bp, mus musculus
ctatccctctctatgttctagtttc

SEQ ID NO: 47704 - DNA, 25 bp, mus musculus
ctaggctctttcttggtgtctggcg

SEQ ID NO: 47705 - DNA, 25 bp, mus musculus
ttattcctctcacattcagccctct

SEQ ID NO: 47706 - DNA, 25 bp, mus musculus
cattcagccctctgttccggaggct

SEQ ID NO: 47707 - DNA, 25 bp, mus musculus
tttcgaagtaactctatcttagtct

SEQ ID NO: 47708 - DNA, 25 bp, mus musculus
ttttctcgtgaccccaatggcctga

SEQ ID NO: 47709 - DNA, 25 bp, mus musculus
tctcgtgaccccaatggcctgagcc

SEQ ID NO: 47710 - DNA, 25 bp, mus musculus
caggccctccagaaacagtttgtag

SEQ ID NO: 47711 - DNA, 25 bp, mus musculus
gccctccagaaacagtttgtagcaa

SEQ ID NO: 47712 - DNA, 25 bp, mus musculus
gtagcaacgtctaggatgtgaagtt

SEQ ID NO: 47713 - DNA, 25 bp, mus musculus
atttctgattagctttcatccggtc

SEQ ID NO: 47714 - DNA, 25 bp, mus musculus
gattagctttcatccggtcttcatc

SEQ ID NO: 47715 - DNA, 25 bp, mus musculus
tagctttcatccggtcttcatctct

SEQ ID NO: 47716 - DNA, 25 bp, mus musculus
ctttcatccggtcttcatctctatt

SEQ ID NO: 47717 - DNA, 25 bp, mus musculus
cttcatctctatttatcttagaagt

SEQ ID NO: 47718 - DNA, 25 bp, mus musculus
cttctctaggtggacattaaaccat

SEQ ID NO: 47719 - DNA, 25 bp, mus musculus
attaaaccatcgtccaaagtacatg

SEQ ID NO: 47720 - DNA, 25 bp, mus musculus
gaccccaatggcctgagcccagaga

SEQ ID NO: 47721 - DNA, 25 bp, mus musculus
aaaccatcgtccaaagtacatgaga

SEQ ID NO: 47722 - DNA, 25 bp, mus musculus
cccaatggcctgagcccagagacac

SEQ ID NO: 47723 - DNA, 25 bp, mus musculus
aatggcctgagcccagagacacgga

SEQ ID NO: 47724 - DNA, 25 bp, mus musculus
ctgagcccagagacacggaggctgg

SEQ ID NO: 47725 - DNA, 25 bp, mus musculus
gagctgtgccgtagagaggcagtac

SEQ ID NO: 47726 - DNA, 25 bp, mus musculus
ttactgtcaaagcaggccctccaga

SEQ ID NO: 47727 - DNA, 25 bp, mus musculus
ctgtcaaagcaggccctccagaaac

SEQ ID NO: 47728 - DNA, 25 bp, mus musculus
aagcaggccctccagaaacagtttg

SEQ ID NO: 47729 - DNA, 25 bp, mus musculus
cttcaatcctcttatctactgtcgg

SEQ ID NO: 47730 - DNA, 25 bp, mus musculus
tatctactgtcggagtccagatttc

SEQ ID NO: 47731 - DNA, 25 bp, mus musculus
ctgtcaaggtactgtgcctagcctt

SEQ ID NO: 47732 - DNA, 25 bp, mus musculus
aggtactgtgcctagccttagcgtt

SEQ ID NO: 47733 - DNA, 25 bp, mus musculus
tgtgcctagccttagcgttgactcc

SEQ ID NO: 47734 - DNA, 25 bp, mus musculus
tagccttagcgttgactcccaagga

SEQ ID NO: 47735 - DNA, 25 bp, mus musculus
tacaaatgactcgccactgtaatac

SEQ ID NO: 47736 - DNA, 25 bp, mus musculus
tgactcgccactgtaatacaggctt

SEQ ID NO: 47737 - DNA, 25 bp, mus musculus
gtaatacaggctttctactctctaa

SEQ ID NO: 47738 - DNA, 25 bp, mus musculus
ctccttgacaggacactaaccagac

SEQ ID NO: 47739 - DNA, 25 bp, mus musculus
attttttagctgcaaacaagagaga

SEQ ID NO: 47740 - DNA, 25 bp, mus musculus
tatagttcagttcctcttgtatgga

SEQ ID NO: 47741 - DNA, 25 bp, mus musculus
tgcctttcaagagcttctgtgcctt

SEQ ID NO: 47742 - DNA, 25 bp, mus musculus
tcaagagcttctgtgccttcgcagg

SEQ ID NO: 47743 - DNA, 25 bp, mus musculus
tcgcaggtcttccttcgaaacctat

SEQ ID NO: 47744 - DNA, 25 bp, mus musculus
ctctagcaatagcaacggcagaacg

SEQ ID NO: 47745 - DNA, 25 bp, mus musculus
caatagcaacggcagaacggactac

SEQ ID NO: 47746 - DNA, 25 bp, mus musculus
cagaacggactacacaggggagcca

SEQ ID NO: 47747 - DNA, 25 bp, mus musculus
ggagccaaacacttgtcagctgggg

SEQ ID NO: 47748 - DNA, 25 bp, mus musculus
acaggaactgctgtgtgaggatccc

SEQ ID NO: 47749 - DNA, 25 bp, mus musculus
accgatgactagaccacgaggtgta

SEQ ID NO: 47750 - DNA, 25 bp, mus musculus
ctctctttccgagagaagttgtcta

SEQ ID NO: 47751 - DNA, 25 bp, mus musculus
catgttcctccacaaatcactctgt

SEQ ID NO: 47752 - DNA, 25 bp, mus musculus
actctgtctccaggctctgtgtctc

SEQ ID NO: 47753 - DNA, 25 bp, mus musculus
ggctctgtgtctctggttagtttga

SEQ ID NO: 47754 - DNA, 25 bp, mus musculus
gtgtctctggttagtttgagagcag

SEQ ID NO: 47755 - DNA, 25 bp, mus musculus
tgaggtttcatccctgtctcctcac

SEQ ID NO: 47756 - DNA, 25 bp, mus musculus
ctatggctctctaagcaccatcttg

SEQ ID NO: 47757 - DNA, 25 bp, mus musculus
ctctctaagcaccatcttggaccat

SEQ ID NO: 47758 - DNA, 25 bp, mus musculus
aagcaccatcttggaccatctctca

SEQ ID NO: 47759 - DNA, 25 bp, mus musculus
catcttggaccatctctcacaatag

SEQ ID NO: 47760 - DNA, 25 bp, mus musculus
tctacctcacagttaggacttcaag

SEQ ID NO: 47761 - DNA, 25 bp, mus musculus
caccttgaacttcactactacctca

SEQ ID NO: 47762 - DNA, 25 bp, mus musculus
gaacttcactactacctcagcagct

SEQ ID NO: 47763 - DNA, 25 bp, mus musculus
cactactacctcagcagctgggacg

SEQ ID NO: 47764 - DNA, 25 bp, mus musculus
ccacctgtgcttgacggccctggga

SEQ ID NO: 47765 - DNA, 25 bp, mus musculus
cctatggccttggaggcctgccagt

SEQ ID NO: 47766 - DNA, 25 bp, mus musculus
tgccagtccctgcctatgtttgtgc

SEQ ID NO: 47767 - DNA, 25 bp, mus musculus
tccctgcctatgtttgtgctgtatg

SEQ ID NO: 47768 - DNA, 25 bp, mus musculus
tgctttcctaaccctgatgatcgac

SEQ ID NO: 47769 - DNA, 25 bp, mus musculus
ccgtagctggcctcacacgaatgga

SEQ ID NO: 47770 - DNA, 25 bp, mus musculus
ctggcctcacacgaatggataagtt

SEQ ID NO: 47771 - DNA, 25 bp, mus musculus
tgattgtccaccgcggacaattgcc

SEQ ID NO: 47772 - DNA, 25 bp, mus musculus
ttgtccaccgcggacaattgccatg

SEQ ID NO: 47773 - DNA, 25 bp, mus musculus
accgcggacaattgccatgcacagt

SEQ ID NO: 47774 - DNA, 25 bp, mus musculus
gcggacaattgccatgcacagtgac

SEQ ID NO: 47775 - DNA, 25 bp, mus musculus
caccatctcctctagattacgctgt

SEQ ID NO: 47776 - DNA, 25 bp, mus musculus
ctcctctagattacgctgttctctc

SEQ ID NO: 47777 - DNA, 25 bp, mus musculus
ctctagattacgctgttctctctga

SEQ ID NO: 47778 - DNA, 25 bp, mus musculus
acgctgttctctctgacttaaagac

SEQ ID NO: 47779 - DNA, 25 bp, mus musculus
ctgttctctctgacttaaagacggt

SEQ ID NO: 47780 - DNA, 25 bp, mus musculus
ttctctctgacttaaagacggtgct

SEQ ID NO: 47781 - DNA, 25 bp, mus musculus
agttctaggcgctgaacgaccacgt

SEQ ID NO: 47782 - DNA, 25 bp, mus musculus
tctaggcgctgaacgaccacgtgat

SEQ ID NO: 47783 - DNA, 25 bp, mus musculus
cgctgaacgaccacgtgatcaacgt

SEQ ID NO: 47784 - DNA, 25 bp, mus musculus
acgaccacgtgatcaacgtacctgg

SEQ ID NO: 47785 - DNA, 25 bp, mus musculus
tgatcaacgtacctggcgaaaatgc

SEQ ID NO: 47786 - DNA, 25 bp, mus musculus
gcgaaaatgctgccctcatgacgac

SEQ ID NO: 47787 - DNA, 25 bp, mus musculus
tttccagcatcatgattgtccaccg

SEQ ID NO: 47788 - DNA, 25 bp, mus musculus
tcatgattgtccaccgcggacaatt

SEQ ID NO: 47789 - DNA, 25 bp, mus musculus
agtcttccttcgtgataactgcaga

SEQ ID NO: 47790 - DNA, 25 bp, mus musculus
atatcaatggcttactatgtgacat

SEQ ID NO: 47791 - DNA, 25 bp, mus musculus
tgctgcacgacgggagcatacacac

SEQ ID NO: 47792 - DNA, 25 bp, mus musculus
tacacacacctggaagaccaaactt

SEQ ID NO: 47793 - DNA, 25 bp, mus musculus
gaagaccaaacttcggctatcatga

SEQ ID NO: 47794 - DNA, 25 bp, mus musculus
caaacttcggctatcatgagactct

SEQ ID NO: 47795 - DNA, 25 bp, mus musculus
tcggctatcatgagactctattcaa

SEQ ID NO: 47796 - DNA, 25 bp, mus musculus
agactctattcaactcatccatcat

SEQ ID NO: 47797 - DNA, 25 bp, mus musculus
tattcaactcatccatcatggagct

SEQ ID NO: 47798 - DNA, 25 bp, mus musculus
actcatccatcatggagctccattc

SEQ ID NO: 47799 - DNA, 25 bp, mus musculus
ccatcatggagctccattcagcgtg

SEQ ID NO: 47800 - DNA, 25 bp, mus musculus
tccattcagcgtgcatccacaaagc

SEQ ID NO: 47801 - DNA, 25 bp, mus musculus
tactatgtgacatcacactggactt

SEQ ID NO: 47802 - DNA, 25 bp, mus musculus
ttcagcgtgcatccacaaagccacc

SEQ ID NO: 47803 - DNA, 25 bp, mus musculus
gtgacatcacactggacttagaaag

SEQ ID NO: 47804 - DNA, 25 bp, mus musculus
tgactacggcaccttccacatcatc

SEQ ID NO: 47805 - DNA, 25 bp, mus musculus
cttccacatcatcccagaagactat

SEQ ID NO: 47806 - DNA, 25 bp, mus musculus
catcatcccagaagactatccactt

SEQ ID NO: 47807 - DNA, 25 bp, mus musculus
cccagaagactatccacttgctgca

SEQ ID NO: 47808 - DNA, 25 bp, mus musculus
agactatccacttgctgcacgacgg

SEQ ID NO: 47809 - DNA, 25 bp, mus musculus
tccacttgctgcacgacgggagcat

SEQ ID NO: 47810 - DNA, 25 bp, mus musculus
caattagccactgcgcttatcgaga

SEQ ID NO: 47811 - DNA, 25 bp, mus musculus
gccactgcgcttatcgagaagagtc

SEQ ID NO: 47812 - DNA, 25 bp, mus musculus
ttgcaaaactgtcataccactgaac

SEQ ID NO: 47813 - DNA, 25 bp, mus musculus
aactgtcataccactgaactgagct

SEQ ID NO: 47814 - DNA, 25 bp, mus musculus
ttatgttgcactgtggatttctcca

SEQ ID NO: 47815 - DNA, 25 bp, mus musculus
gtggatttctccactgacaaagctt

SEQ ID NO: 47816 - DNA, 25 bp, mus musculus
actggtattacctcagtattcatgc

SEQ ID NO: 47817 - DNA, 25 bp, mus musculus
attacctcagtattcatgcactggt

SEQ ID NO: 47818 - DNA, 25 bp, mus musculus
tcagtattcatgcactggtatcata

SEQ ID NO: 47819 - DNA, 25 bp, mus musculus
ttcatgcactggtatcatacagatc

SEQ ID NO: 47820 - DNA, 25 bp, mus musculus
tatcatacagatctctctactatgt

SEQ ID NO: 47821 - DNA, 25 bp, mus musculus
acagatctctctactatgtttctat

SEQ ID NO: 47822 - DNA, 25 bp, mus musculus
ttagggctcttcaagcctcatgatt

SEQ ID NO: 47823 - DNA, 25 bp, mus musculus
ctcttcaagcctcatgattgtacaa

SEQ ID NO: 47824 - DNA, 25 bp, mus musculus
tgtacaacctactcgaaatatgaca

SEQ ID NO: 47825 - DNA, 25 bp, mus musculus
acctactcgaaatatgacagcactg

SEQ ID NO: 47826 - DNA, 25 bp, mus musculus
tatgacagcactgttgatagtgtgt

SEQ ID NO: 47827 - DNA, 25 bp, mus musculus
tgttgctactgtgcttctgtgccta

SEQ ID NO: 47828 - DNA, 25 bp, mus musculus
tactgtgcttctgtgcctataagac

SEQ ID NO: 47829 - DNA, 25 bp, mus musculus
cagtagtctgtcttttcaaggtcat

SEQ ID NO: 47830 - DNA, 25 bp, mus musculus
tggtttacaactttctggcgtctga

SEQ ID NO: 47831 - DNA, 25 bp, mus musculus
ttacaactttctggcgtctgataaa

SEQ ID NO: 47832 - DNA, 25 bp, mus musculus
aactatggcttcacaattcatgaag

SEQ ID NO: 47833 - DNA, 25 bp, mus musculus
ctatggcttcacaattcatgaagaa

SEQ ID NO: 47834 - DNA, 25 bp, mus musculus
atggcttcacaattcatgaagaatt

SEQ ID NO: 47835 - DNA, 25 bp, mus musculus
aggtgacctgtcctgtctgtctgaa

SEQ ID NO: 47836 - DNA, 25 bp, mus musculus
gtgacctgtcctgtctgtctgaacc

SEQ ID NO: 47837 - DNA, 25 bp, mus musculus
gacctgtcctgtctgtctgaacctg

SEQ ID NO: 47838 - DNA, 25 bp, mus musculus
cctgtcctgtctgtctgaacctgat

SEQ ID NO: 47839 - DNA, 25 bp, mus musculus
tcctgtctgtctgaacctgatggtg

SEQ ID NO: 47840 - DNA, 25 bp, mus musculus
gtctgtctgaacctgatggtgaaac

SEQ ID NO: 47841 - DNA, 25 bp, mus musculus
ctgtctgaacctgatggtgaaacct

SEQ ID NO: 47842 - DNA, 25 bp, mus musculus
acaactttctggcgtctgataaagg

SEQ ID NO: 47843 - DNA, 25 bp, mus musculus
ctttctggcgtctgataaagggctg

SEQ ID NO: 47844 - DNA, 25 bp, mus musculus
ttgtttgggcacctgagcagaagtg

SEQ ID NO: 47845 - DNA, 25 bp, mus musculus
gtttgggcacctgagcagaagtgcg

SEQ ID NO: 47846 - DNA, 25 bp, mus musculus
ttgggcacctgagcagaagtgcgag

SEQ ID NO: 47847 - DNA, 25 bp, mus musculus
atcacagcaactatggcttcacaat

SEQ ID NO: 47848 - DNA, 25 bp, mus musculus
cacagcaactatggcttcacaattc

SEQ ID NO: 47849 - DNA, 25 bp, mus musculus
gcaactatggcttcacaattcatga

SEQ ID NO: 47850 - DNA, 25 bp, mus musculus
aggcccaggctcgaccagatagcgc

SEQ ID NO: 47851 - DNA, 25 bp, mus musculus
gcccaggctcgaccagatagcgccg

SEQ ID NO: 47852 - DNA, 25 bp, mus musculus
tggcccccgaagtggcaggacagtg

SEQ ID NO: 47853 - DNA, 25 bp, mus musculus
gacagtgccgggactccgagccctg

SEQ ID NO: 47854 - DNA, 25 bp, mus musculus
ggtctttcattcatcaccttcatct

SEQ ID NO: 47855 - DNA, 25 bp, mus musculus
tttcattcatcaccttcatctgcta

SEQ ID NO: 47856 - DNA, 25 bp, mus musculus
tcattcatcaccttcatctgctacg

SEQ ID NO: 47857 - DNA, 25 bp, mus musculus
attcatcaccttcatctgctacgtg

SEQ ID NO: 47858 - DNA, 25 bp, mus musculus
tcatcaccttcatctgctacgtggt

SEQ ID NO: 47859 - DNA, 25 bp, mus musculus
atcaccttcatctgctacgtggtgt

SEQ ID NO: 47860 - DNA, 25 bp, mus musculus
caccttcatctgctacgtggtgtcc

SEQ ID NO: 47861 - DNA, 25 bp, mus musculus
ttcatctgctacgtggtgtcctccg

SEQ ID NO: 47862 - DNA, 25 bp, mus musculus
tcgaccagatagcgccgctatgtgg

SEQ ID NO: 47863 - DNA, 25 bp, mus musculus
gaccagatagcgccgctatgtggcc

SEQ ID NO: 47864 - DNA, 25 bp, mus musculus
ccagatagcgccgctatgtggcccc

SEQ ID NO: 47865 - DNA, 25 bp, mus musculus
agatagcgccgctatgtggcccccg

SEQ ID NO: 47866 - DNA, 25 bp, mus musculus
acgcagagccagagcccgatccaga

SEQ ID NO: 47867 - DNA, 25 bp, mus musculus
agagccagagcccgatccagagtcc

SEQ ID NO: 47868 - DNA, 25 bp, mus musculus
agcccgatccagagtccgcgcatgg

SEQ ID NO: 47869 - DNA, 25 bp, mus musculus
catggcccccgaagtggcaggacag

SEQ ID NO: 47870 - DNA, 25 bp, mus musculus
attgattacccagcgagagctggtc

SEQ ID NO: 47871 - DNA, 25 bp, mus musculus
tacccagcgagagctggtctccagg

SEQ ID NO: 47872 - DNA, 25 bp, mus musculus
ctctgctgagggtgactccaaggcc

SEQ ID NO: 47873 - DNA, 25 bp, mus musculus
tgactccaaggccgctgagctgatc

SEQ ID NO: 47874 - DNA, 25 bp, mus musculus
caaggccgctgagctgatcgccaac

SEQ ID NO: 47875 - DNA, 25 bp, mus musculus
cgctgagctgatcgccaactcgctg

SEQ ID NO: 47876 - DNA, 25 bp, mus musculus
gctgatcgccaactcgctggccacg

SEQ ID NO: 47877 - DNA, 25 bp, mus musculus
tcggaacatcacctacctgccagcg

SEQ ID NO: 47878 - DNA, 25 bp, mus musculus
ctacctgccagcgggccagtccgtg

SEQ ID NO: 47879 - DNA, 25 bp, mus musculus
cggcctccatcatgctgaatgacgc

SEQ ID NO: 47880 - DNA, 25 bp, mus musculus
ccatcatgctgaatgacgccttcct

SEQ ID NO: 47881 - DNA, 25 bp, mus musculus
tgctgaatgacgccttccttctgcc

SEQ ID NO: 47882 - DNA, 25 bp, mus musculus
tgacctcacagagcgagcggcaaca

SEQ ID NO: 47883 - DNA, 25 bp, mus musculus
atttgggcttatcctggatgacgtg

SEQ ID NO: 47884 - DNA, 25 bp, mus musculus
cctggatgacgtgtccctgacacat

SEQ ID NO: 47885 - DNA, 25 bp, mus musculus
tgacgtgtccctgacacatctgacc

SEQ ID NO: 47886 - DNA, 25 bp, mus musculus
gtccctgacacatctgaccttcggg

SEQ ID NO: 47887 - DNA, 25 bp, mus musculus
tctgaccttcgggaaggagttcaca

SEQ ID NO: 47888 - DNA, 25 bp, mus musculus
ggcagccatcatctctgctgagggt

SEQ ID NO: 47889 - DNA, 25 bp, mus musculus
catcatctctgctgagggtgactcc

SEQ ID NO: 47890 - DNA, 25 bp, mus musculus
tattctatactgtcagtgcaagtca

SEQ ID NO: 47891 - DNA, 25 bp, mus musculus
atactgtcagtgcaagtcaagacca

SEQ ID NO: 47892 - DNA, 25 bp, mus musculus
taccagactggcaaccatttcattc

SEQ ID NO: 47893 - DNA, 25 bp, mus musculus
ttcattcccaacctaggcattgaaa

SEQ ID NO: 47894 - DNA, 25 bp, mus musculus
cccaacctaggcattgaaatctgtt

SEQ ID NO: 47895 - DNA, 25 bp, mus musculus
ttagattgagcttttctctgagggg

SEQ ID NO: 47896 - DNA, 25 bp, mus musculus
tgagcttttctctgaggggcatgat

SEQ ID NO: 47897 - DNA, 25 bp, mus musculus
tttctctgaggggcatgatctcatg

SEQ ID NO: 47898 - DNA, 25 bp, mus musculus
tatttttcaagtcgttgtctccata

SEQ ID NO: 47899 - DNA, 25 bp, mus musculus
ataatatgctgaacctggtatttat

SEQ ID NO: 47900 - DNA, 25 bp, mus musculus
tatttatcataactgctgcttatga

SEQ ID NO: 47901 - DNA, 25 bp, mus musculus
tcataactgctgcttatgagccgga

SEQ ID NO: 47902 - DNA, 25 bp, mus musculus
aagaccatagagcaccttacaggag

SEQ ID NO: 47903 - DNA, 25 bp, mus musculus
atagagcaccttacaggagctagag

SEQ ID NO: 47904 - DNA, 25 bp, mus musculus
caccttacaggagctagagatggct

SEQ ID NO: 47905 - DNA, 25 bp, mus musculus
tggagcagctctcaaatcaaatata

SEQ ID NO: 47906 - DNA, 25 bp, mus musculus
atactggccctgtctgaattttcca

SEQ ID NO: 47907 - DNA, 25 bp, mus musculus
gccctgtctgaattttccagctcct

SEQ ID NO: 47908 - DNA, 25 bp, mus musculus
tctgaattttccagctcctcattgg

SEQ ID NO: 47909 - DNA, 25 bp, mus musculus
agctcctcattggatttttaccaga

SEQ ID NO: 47910 - DNA, 25 bp, mus musculus
gaacatctctaaaacgatcgccaca

SEQ ID NO: 47911 - DNA, 25 bp, mus musculus
aacgatcgccacatcacagaaccga

SEQ ID NO: 47912 - DNA, 25 bp, mus musculus
ggcacacttgtccagcttggaggag

SEQ ID NO: 47913 - DNA, 25 bp, mus musculus
gccccaggcatcatgtgatggactt

SEQ ID NO: 47914 - DNA, 25 bp, mus musculus
tatctgccctcttggattaaggaag

SEQ ID NO: 47915 - DNA, 25 bp, mus musculus
gactgagaccagccctttcagaggc

SEQ ID NO: 47916 - DNA, 25 bp, mus musculus
cagaggctttcctccttcctgtgtt

SEQ ID NO: 47917 - DNA, 25 bp, mus musculus
ctttcctccttcctgtgttggctgg

SEQ ID NO: 47918 - DNA, 25 bp, mus musculus
gtgatttctccgtgatttcctacag

SEQ ID NO: 47919 - DNA, 25 bp, mus musculus
tctccgtgatttcctacagccttga

SEQ ID NO: 47920 - DNA, 25 bp, mus musculus
tgatttcctacagccttgagcctct

SEQ ID NO: 47921 - DNA, 25 bp, mus musculus
ggagataaccaccatgccaggaatt

SEQ ID NO: 47922 - DNA, 25 bp, mus musculus
cgccacatcacagaaccgaatctat

SEQ ID NO: 47923 - DNA, 25 bp, mus musculus
gagataaccaccatgccaggaattc

SEQ ID NO: 47924 - DNA, 25 bp, mus musculus
atcacagaaccgaatctatctcaca

SEQ ID NO: 47925 - DNA, 25 bp, mus musculus
gaaccgaatctatctcacagctgac

SEQ ID NO: 47926 - DNA, 25 bp, mus musculus
aatctatctcacagctgacaacctt

SEQ ID NO: 47927 - DNA, 25 bp, mus musculus
tctcacagctgacaaccttgtgctg

SEQ ID NO: 47928 - DNA, 25 bp, mus musculus
agctgacaaccttgtgctgaatcta

SEQ ID NO: 47929 - DNA, 25 bp, mus musculus
caaccttgtgctgaatctacaggat

SEQ ID NO: 47930 - DNA, 25 bp, mus musculus
aagtgacagcctcattaagggtaag

SEQ ID NO: 47931 - DNA, 25 bp, mus musculus
tggcgttgcggtcattgtgtcgtga

SEQ ID NO: 47932 - DNA, 25 bp, mus musculus
cattgtgtcgtgacggagacgccgg

SEQ ID NO: 47933 - DNA, 25 bp, mus musculus
ttggctgctttagcctggcctgggc

SEQ ID NO: 47934 - DNA, 25 bp, mus musculus
ggctgctttagcctggcctgggctc

SEQ ID NO: 47935 - DNA, 25 bp, mus musculus
gctgctttagcctggcctgggctcc

SEQ ID NO: 47936 - DNA, 25 bp, mus musculus
tgctttagcctggcctgggctccac

SEQ ID NO: 47937 - DNA, 25 bp, mus musculus
gctccacggctgcctggagggtctc

SEQ ID NO: 47938 - DNA, 25 bp, mus musculus
ctccacggctgcctggagggtctct

SEQ ID NO: 47939 - DNA, 25 bp, mus musculus
cacggctgcctggagggtctctgca

SEQ ID NO: 47940 - DNA, 25 bp, mus musculus
cggctgcctggagggtctctgcagc

SEQ ID NO: 47941 - DNA, 25 bp, mus musculus
ctgcctggagggtctctgcagcgcc

SEQ ID NO: 47942 - DNA, 25 bp, mus musculus
acgccagcagcgaccctgagtcggc

SEQ ID NO: 47943 - DNA, 25 bp, mus musculus
attgtgtcgtgacggagacgccggt

SEQ ID NO: 47944 - DNA, 25 bp, mus musculus
tcgtggtttccgcggcagctgttgg

SEQ ID NO: 47945 - DNA, 25 bp, mus musculus
tggtttccgcggcagctgttggctg

SEQ ID NO: 47946 - DNA, 25 bp, mus musculus
gtttccgcggcagctgttggctgct

SEQ ID NO: 47947 - DNA, 25 bp, mus musculus
tttccgcggcagctgttggctgctt

SEQ ID NO: 47948 - DNA, 25 bp, mus musculus
tccgcggcagctgttggctgcttta

SEQ ID NO: 47949 - DNA, 25 bp, mus musculus
ctgttggctgctttagcctggcctg

SEQ ID NO: 47950 - DNA, 25 bp, mus musculus
gttggctgctttagcctggcctggg

SEQ ID NO: 47951 - DNA, 25 bp, mus musculus
tcgatctcatcgtcacaccacagaa

SEQ ID NO: 47952 - DNA, 25 bp, mus musculus
tcacaccacagaacaagtctacatt

SEQ ID NO: 47953 - DNA, 25 bp, mus musculus
ttcacaggatcctgttaacctgaca

SEQ ID NO: 47954 - DNA, 25 bp, mus musculus
tgttaacctgacaagaactcttctc

SEQ ID NO: 47955 - DNA, 25 bp, mus musculus
tcttctcacccaagaaggcaacttg

SEQ ID NO: 47956 - DNA, 25 bp, mus musculus
acagagtcttgccttcatccctagc

SEQ ID NO: 47957 - DNA, 25 bp, mus musculus
cttcatccctagcagtgttcctagc

SEQ ID NO: 47958 - DNA, 25 bp, mus musculus
ccagcgaacaactctggctctattt

SEQ ID NO: 47959 - DNA, 25 bp, mus musculus
gagtttgcatgcatgctctatgaaa

SEQ ID NO: 47960 - DNA, 25 bp, mus musculus
acaagcacaggaccttgtacagtgc

SEQ ID NO: 47961 - DNA, 25 bp, mus musculus
acaggaccttgtacagtgctccacc

SEQ ID NO: 47962 - DNA, 25 bp, mus musculus
ccttgtacagtgctccaccactgac

SEQ ID NO: 47963 - DNA, 25 bp, mus musculus
ctacattttacacctgccaagtcag

SEQ ID NO: 47964 - DNA, 25 bp, mus musculus
gcaatcctgtaagcagcaagaacga

SEQ ID NO: 47965 - DNA, 25 bp, mus musculus
acacagtgtacttcactctaccttg

SEQ ID NO: 47966 - DNA, 25 bp, mus musculus
tagccagatcttctggagtatgttg

SEQ ID NO: 47967 - DNA, 25 bp, mus musculus
gatcttctggagtatgttggactgc

SEQ ID NO: 47968 - DNA, 25 bp, mus musculus
caacttggctagtggtcacaacact

SEQ ID NO: 47969 - DNA, 25 bp, mus musculus
tggtcacaacactcatcattcacag

SEQ ID NO: 47970 - DNA, 25 bp, mus musculus
tcatcattcacaggatcctgttaac

SEQ ID NO: 47971 - DNA, 25 bp, mus musculus
agaccaagaatgccgccatcgtagt

SEQ ID NO: 47972 - DNA, 25 bp, mus musculus
accaagaatgccgccatcgtagtgg

SEQ ID NO: 47973 - DNA, 25 bp, mus musculus
gattagctccagaacagcgccccag

SEQ ID NO: 47974 - DNA, 25 bp, mus musculus
attagctccagaacagcgccccagc

SEQ ID NO: 47975 - DNA, 25 bp, mus musculus
tagctccagaacagcgccccagcag

SEQ ID NO: 47976 - DNA, 25 bp, mus musculus
agctccagaacagcgccccagcaga

SEQ ID NO: 47977 - DNA, 25 bp, mus musculus
tccagaacagcgccccagcagaact

SEQ ID NO: 47978 - DNA, 25 bp, mus musculus
acagcgccccagcagaactgaagtt

SEQ ID NO: 47979 - DNA, 25 bp, mus musculus
agcgccccagcagaactgaagttgg

SEQ ID NO: 47980 - DNA, 25 bp, mus musculus
gcgccccagcagaactgaagttgga

SEQ ID NO: 47981 - DNA, 25 bp, mus musculus
gccccagcagaactgaagttggaat

SEQ ID NO: 47982 - DNA, 25 bp, mus musculus
ccccagcagaactgaagttggaatt

SEQ ID NO: 47983 - DNA, 25 bp, mus musculus
ccaagaatgccgccatcgtagtgga

SEQ ID NO: 47984 - DNA, 25 bp, mus musculus
agaatgccgccatcgtagtggaagt

SEQ ID NO: 47985 - DNA, 25 bp, mus musculus
aatgccgccatcgtagtggaagtgg

SEQ ID NO: 47986 - DNA, 25 bp, mus musculus
atgccgccatcgtagtggaagtgga

SEQ ID NO: 47987 - DNA, 25 bp, mus musculus
gccgccatcgtagtggaagtggaca

SEQ ID NO: 47988 - DNA, 25 bp, mus musculus
ccgccatcgtagtggaagtggacaa

SEQ ID NO: 47989 - DNA, 25 bp, mus musculus
aagaccggcagatgacagtgctaga

SEQ ID NO: 47990 - DNA, 25 bp, mus musculus
aagattagctccagaacagcgcccc

SEQ ID NO: 47991 - DNA, 25 bp, mus musculus
gtacacttcccgggtgatgctcagc

SEQ ID NO: 47992 - DNA, 25 bp, mus musculus
cacttcccgggtgatgctcagcagt

SEQ ID NO: 47993 - DNA, 25 bp, mus musculus
ggacatgtctggcgggacggtcaca

SEQ ID NO: 47994 - DNA, 25 bp, mus musculus
gtctggcgggacggtcacagtccta

SEQ ID NO: 47995 - DNA, 25 bp, mus musculus
gacggtcacagtcctagagaaagtc

SEQ ID NO: 47996 - DNA, 25 bp, mus musculus
ggtatccaaaggccaactgaagcag

SEQ ID NO: 47997 - DNA, 25 bp, mus musculus
gtatttctacgagaccaagtgtaat

SEQ ID NO: 47998 - DNA, 25 bp, mus musculus
gcaatgccgaactacccaatcgtat

SEQ ID NO: 47999 - DNA, 25 bp, mus musculus
atgccgaactacccaatcgtatgtt

SEQ ID NO: 48000 - DNA, 25 bp, mus musculus
aattggctggcgattcataaggata

SEQ ID NO: 48001 - DNA, 25 bp, mus musculus
ttcctgtgtatgtacactgaccatt

SEQ ID NO: 48002 - DNA, 25 bp, mus musculus
tgtatgtacactgaccattaaaagg

SEQ ID NO: 48003 - DNA, 25 bp, mus musculus
ttcccgggtgatgctcagcagtcaa

SEQ ID NO: 48004 - DNA, 25 bp, mus musculus
gatgctcagcagtcaagtgcctttg

SEQ ID NO: 48005 - DNA, 25 bp, mus musculus
gctcagcagtcaagtgcctttggag

SEQ ID NO: 48006 - DNA, 25 bp, mus musculus
tctactctttctgctggaggaatac

SEQ ID NO: 48007 - DNA, 25 bp, mus musculus
actctttctgctggaggaatacaaa

SEQ ID NO: 48008 - DNA, 25 bp, mus musculus
ttacctggatgccgcaaacatgtct

SEQ ID NO: 48009 - DNA, 25 bp, mus musculus
ggatgccgcaaacatgtctatgagg

SEQ ID NO: 48010 - DNA, 25 bp, mus musculus
cgcaaacatgtctatgagggttcgg

SEQ ID NO: 48011 - DNA, 25 bp, mus musculus
cctcatgctgcaggctaggcagtcc

SEQ ID NO: 48012 - DNA, 25 bp, mus musculus
acagttctttgtcagcttcaaggac

SEQ ID NO: 48013 - DNA, 25 bp, mus musculus
cattaaccactaccgcatgaggggt

SEQ ID NO: 48014 - DNA, 25 bp, mus musculus
ccactaccgcatgaggggtcacagc

SEQ ID NO: 48015 - DNA, 25 bp, mus musculus
ctaccgcatgaggggtcacagcccc

SEQ ID NO: 48016 - DNA, 25 bp, mus musculus
ctttgccaaccttaagtcatgctgt

SEQ ID NO: 48017 - DNA, 25 bp, mus musculus
tgccaaccttaagtcatgctgtgtg

SEQ ID NO: 48018 - DNA, 25 bp, mus musculus
gctgagacccatgtccatgctgtat

SEQ ID NO: 48019 - DNA, 25 bp, mus musculus
catgtccatgctgtattacgatgat

SEQ ID NO: 48020 - DNA, 25 bp, mus musculus
tggctgctcctagagtcgccaggtc

SEQ ID NO: 48021 - DNA, 25 bp, mus musculus
ctgctcctagagtcgccaggtccca

SEQ ID NO: 48022 - DNA, 25 bp, mus musculus
tcgccaggtcccagagaaaatggat

SEQ ID NO: 48023 - DNA, 25 bp, mus musculus
gatcattgctccctctggctatcac

SEQ ID NO: 48024 - DNA, 25 bp, mus musculus
tgctccctctggctatcacgccaat

SEQ ID NO: 48025 - DNA, 25 bp, mus musculus
ctctggctatcacgccaattattgt

SEQ ID NO: 48026 - DNA, 25 bp, mus musculus
ggagtgcccaagccacatagcaggc

SEQ ID NO: 48027 - DNA, 25 bp, mus musculus
aagccacatagcaggcacctctggg

SEQ ID NO: 48028 - DNA, 25 bp, mus musculus
cttccactcaacagtcattaaccac

SEQ ID NO: 48029 - DNA, 25 bp, mus musculus
ccactcaacagtcattaaccactac

SEQ ID NO: 48030 - DNA, 25 bp, mus musculus
aacagtcattaaccactaccgcatg

SEQ ID NO: 48031 - DNA, 25 bp, mus musculus
cctgctttcacagatattattccag

SEQ ID NO: 48032 - DNA, 25 bp, mus musculus
ctgctttcacagatattattccagg

SEQ ID NO: 48033 - DNA, 25 bp, mus musculus
ttaacacgccacagatggcactggt

SEQ ID NO: 48034 - DNA, 25 bp, mus musculus
taacacgccacagatggcactggtg

SEQ ID NO: 48035 - DNA, 25 bp, mus musculus
aacacgccacagatggcactggtgg

SEQ ID NO: 48036 - DNA, 25 bp, mus musculus
acacgccacagatggcactggtggc

SEQ ID NO: 48037 - DNA, 25 bp, mus musculus
cacgccacagatggcactggtggca

SEQ ID NO: 48038 - DNA, 25 bp, mus musculus
gccacagatggcactggtggcaggt

SEQ ID NO: 48039 - DNA, 25 bp, mus musculus
ccacagatggcactggtggcaggtc

SEQ ID NO: 48040 - DNA, 25 bp, mus musculus
acagatggcactggtggcaggtcca

SEQ ID NO: 48041 - DNA, 25 bp, mus musculus
cagatggcactggtggcaggtccat

SEQ ID NO: 48042 - DNA, 25 bp, mus musculus
tggcaggtccatctacggagatgga

SEQ ID NO: 48043 - DNA, 25 bp, mus musculus
tgctttcacagatattattccagga

SEQ ID NO: 48044 - DNA, 25 bp, mus musculus
ctttcacagatattattccaggatt

SEQ ID NO: 48045 - DNA, 25 bp, mus musculus
ttcacagatattattccaggattca

SEQ ID NO: 48046 - DNA, 25 bp, mus musculus
tggtgacttaacacgccacagatgg

SEQ ID NO: 48047 - DNA, 25 bp, mus musculus
ggtgacttaacacgccacagatggc

SEQ ID NO: 48048 - DNA, 25 bp, mus musculus
gtgacttaacacgccacagatggca

SEQ ID NO: 48049 - DNA, 25 bp, mus musculus
gacttaacacgccacagatggcact

SEQ ID NO: 48050 - DNA, 25 bp, mus musculus
acttaacacgccacagatggcactg

SEQ ID NO: 48051 - DNA, 25 bp, mus musculus
aatttgcgcagcgggatccaagatg

SEQ ID NO: 48052 - DNA, 25 bp, mus musculus
atttgcgcagcgggatccaagatgg

SEQ ID NO: 48053 - DNA, 25 bp, mus musculus
gctcggccgaccattgcagagcctt

SEQ ID NO: 48054 - DNA, 25 bp, mus musculus
ctcggccgaccattgcagagccttt

SEQ ID NO: 48055 - DNA, 25 bp, mus musculus
tcggccgaccattgcagagcctttc

SEQ ID NO: 48056 - DNA, 25 bp, mus musculus
cggccgaccattgcagagcctttcc

SEQ ID NO: 48057 - DNA, 25 bp, mus musculus
ccgaccattgcagagcctttcccaa

SEQ ID NO: 48058 - DNA, 25 bp, mus musculus
cgaccattgcagagcctttcccaaa

SEQ ID NO: 48059 - DNA, 25 bp, mus musculus
gaccattgcagagcctttcccaaac

SEQ ID NO: 48060 - DNA, 25 bp, mus musculus
accattgcagagcctttcccaaacg

SEQ ID NO: 48061 - DNA, 25 bp, mus musculus
ccattgcagagcctttcccaaacgg

SEQ ID NO: 48062 - DNA, 25 bp, mus musculus
cattgcagagcctttcccaaacggg

SEQ ID NO: 48063 - DNA, 25 bp, mus musculus
tttgcgcagcgggatccaagatggc

SEQ ID NO: 48064 - DNA, 25 bp, mus musculus
ttgcgcagcgggatccaagatggca

SEQ ID NO: 48065 - DNA, 25 bp, mus musculus
tggcaaagctcggccgaccattgca

SEQ ID NO: 48066 - DNA, 25 bp, mus musculus
gcaaagctcggccgaccattgcaga

SEQ ID NO: 48067 - DNA, 25 bp, mus musculus
caaagctcggccgaccattgcagag

SEQ ID NO: 48068 - DNA, 25 bp, mus musculus
aaagctcggccgaccattgcagagc

SEQ ID NO: 48069 - DNA, 25 bp, mus musculus
aagctcggccgaccattgcagagcc

SEQ ID NO: 48070 - DNA, 25 bp, mus musculus
agctcggccgaccattgcagagcct

SEQ ID NO: 48071 - DNA, 25 bp, mus musculus
gttgacccacacaggcgaaactgta

SEQ ID NO: 48072 - DNA, 25 bp, mus musculus
gacccacacaggcgaaactgtactc

SEQ ID NO: 48073 - DNA, 25 bp, mus musculus
atcttctatgaggtagatgttctaa

SEQ ID NO: 48074 - DNA, 25 bp, mus musculus
gatgttctaaacaatccttcgagtg

SEQ ID NO: 48075 - DNA, 25 bp, mus musculus
aatccttcgagtggcctgccagtgt

SEQ ID NO: 48076 - DNA, 25 bp, mus musculus
ggcctgccagtgtttcagggtataa

SEQ ID NO: 48077 - DNA, 25 bp, mus musculus
ctgccagtgtttcagggtataaatg

SEQ ID NO: 48078 - DNA, 25 bp, mus musculus
tttctgtccgtacacacccagaagg

SEQ ID NO: 48079 - DNA, 25 bp, mus musculus
gtgctgtaagtcctcacctttagtt

SEQ ID NO: 48080 - DNA, 25 bp, mus musculus
ccccacagactggctgtcttaagta

SEQ ID NO: 48081 - DNA, 25 bp, mus musculus
attttacgttcatgtacagtataag

SEQ ID NO: 48082 - DNA, 25 bp, mus musculus
ttacgttcatgtacagtataagaca

SEQ ID NO: 48083 - DNA, 25 bp, mus musculus
ttttgcttcttttctaagcgaatga

SEQ ID NO: 48084 - DNA, 25 bp, mus musculus
ttcttttctaagcgaatgattgctt

SEQ ID NO: 48085 - DNA, 25 bp, mus musculus
atgattgctttcaatgtttgcactg

SEQ ID NO: 48086 - DNA, 25 bp, mus musculus
ttcaatgtttgcactgatctagttg

SEQ ID NO: 48087 - DNA, 25 bp, mus musculus
gtttgcactgatctagttgcatggt

SEQ ID NO: 48088 - DNA, 25 bp, mus musculus
actgatctagttgcatggttagtca

SEQ ID NO: 48089 - DNA, 25 bp, mus musculus
agaaggccagcggatcagttttaat

SEQ ID NO: 48090 - DNA, 25 bp, mus musculus
gaggccatcttctatgaggtagatg

SEQ ID NO: 48091 - DNA, 25 bp, mus musculus
tgcctttttgctttgcagatcaatt

SEQ ID NO: 48092 - DNA, 25 bp, mus musculus
cctttttgctttgcagatcaatttc

SEQ ID NO: 48093 - DNA, 25 bp, mus musculus
tctttttcataaacattctaagaat

SEQ ID NO: 48094 - DNA, 25 bp, mus musculus
ttttcataaacattctaagaatcct

SEQ ID NO: 48095 - DNA, 25 bp, mus musculus
aacattctaagaatcctgatgagaa

SEQ ID NO: 48096 - DNA, 25 bp, mus musculus
acattctaagaatcctgatgagaaa

SEQ ID NO: 48097 - DNA, 25 bp, mus musculus
attctaagaatcctgatgagaaaac

SEQ ID NO: 48098 - DNA, 25 bp, mus musculus
ttctaagaatcctgatgagaaaact

SEQ ID NO: 48099 - DNA, 25 bp, mus musculus
ggaaatgaaacacaccattataagc

SEQ ID NO: 48100 - DNA, 25 bp, mus musculus
gaaatgaaacacaccattataagcc

SEQ ID NO: 48101 - DNA, 25 bp, mus musculus
atgaaacacaccattataagcccct

SEQ ID NO: 48102 - DNA, 25 bp, mus musculus
tgaaacacaccattataagcccctg

SEQ ID NO: 48103 - DNA, 25 bp, mus musculus
ctttttgctttgcagatcaatttca

SEQ ID NO: 48104 - DNA, 25 bp, mus musculus
aacacaccattataagcccctggca

SEQ ID NO: 48105 - DNA, 25 bp, mus musculus
cagatcaatttcatctttttcataa

SEQ ID NO: 48106 - DNA, 25 bp, mus musculus
agatcaatttcatctttttcataaa

SEQ ID NO: 48107 - DNA, 25 bp, mus musculus
atcaatttcatctttttcataaaca

SEQ ID NO: 48108 - DNA, 25 bp, mus musculus
tcaatttcatctttttcataaacat

SEQ ID NO: 48109 - DNA, 25 bp, mus musculus
caatttcatctttttcataaacatt

SEQ ID NO: 48110 - DNA, 25 bp, mus musculus
ttcatctttttcataaacattctaa

SEQ ID NO: 48111 - DNA, 25 bp, mus musculus
catctttttcataaacattctaaga

SEQ ID NO: 48112 - DNA, 25 bp, mus musculus
tatttccacataggaatagacttta

SEQ ID NO: 48113 - DNA, 25 bp, mus musculus
cacagcaggccaggagcgatttcac

SEQ ID NO: 48114 - DNA, 25 bp, mus musculus
ctactacagaggagcaatgggcatc

SEQ ID NO: 48115 - DNA, 25 bp, mus musculus
aatgggcatcatgctagtgtatgac

SEQ ID NO: 48116 - DNA, 25 bp, mus musculus
agtgtatgacatcaccaacggtaaa

SEQ ID NO: 48117 - DNA, 25 bp, mus musculus
gtgtatgacatcaccaacggtaaaa

SEQ ID NO: 48118 - DNA, 25 bp, mus musculus
gtatgacatcaccaacggtaaaagc

SEQ ID NO: 48119 - DNA, 25 bp, mus musculus
tatgacatcaccaacggtaaaagct

SEQ ID NO: 48120 - DNA, 25 bp, mus musculus
tgacatcaccaacggtaaaagcttt

SEQ ID NO: 48121 - DNA, 25 bp, mus musculus
gacatcaccaacggtaaaagctttg

SEQ ID NO: 48122 - DNA, 25 bp, mus musculus
catcaccaacggtaaaagctttgag

SEQ ID NO: 48123 - DNA, 25 bp, mus musculus
aacatcagcaagtggcttagaaaca

SEQ ID NO: 48124 - DNA, 25 bp, mus musculus
acagcaggccaggagcgatttcaca

SEQ ID NO: 48125 - DNA, 25 bp, mus musculus
ggagcgatttcacaccatcacaacc

SEQ ID NO: 48126 - DNA, 25 bp, mus musculus
gagcgatttcacaccatcacaacct

SEQ ID NO: 48127 - DNA, 25 bp, mus musculus
acaacctcctactacagaggagcaa

SEQ ID NO: 48128 - DNA, 25 bp, mus musculus
aacctcctactacagaggagcaatg

SEQ ID NO: 48129 - DNA, 25 bp, mus musculus
acctcctactacagaggagcaatgg

SEQ ID NO: 48130 - DNA, 25 bp, mus musculus
ctcctactacagaggagcaatgggc

SEQ ID NO: 48131 - DNA, 25 bp, mus musculus
tcctactacagaggagcaatgggca

SEQ ID NO: 48132 - DNA, 25 bp, mus musculus
ccaacttgcctggggaaagcaagat

SEQ ID NO: 48133 - DNA, 25 bp, mus musculus
gggacacctagctaagagaatgacg

SEQ ID NO: 48134 - DNA, 25 bp, mus musculus
gctccatgcatacataggggaagtt

SEQ ID NO: 48135 - DNA, 25 bp, mus musculus
ctagtacactcaagccaaccgtaca

SEQ ID NO: 48136 - DNA, 25 bp, mus musculus
ggatcccactggggaaaccaatgct

SEQ ID NO: 48137 - DNA, 25 bp, mus musculus
tcccactggggaaaccaatgctata

SEQ ID NO: 48138 - DNA, 25 bp, mus musculus
aaccaatgctatagcttcagagact

SEQ ID NO: 48139 - DNA, 25 bp, mus musculus
caatgctatagcttcagagactgta

SEQ ID NO: 48140 - DNA, 25 bp, mus musculus
ttcagagactgtatcctcattgcag

SEQ ID NO: 48141 - DNA, 25 bp, mus musculus
gactgtatcctcattgcagaaccgt

SEQ ID NO: 48142 - DNA, 25 bp, mus musculus
tgtatcctcattgcagaaccgtgaa

SEQ ID NO: 48143 - DNA, 25 bp, mus musculus
cccagcatccaacaaccagctggga

SEQ ID NO: 48144 - DNA, 25 bp, mus musculus
tcctgtcttcattaggcagaggcaa

SEQ ID NO: 48145 - DNA, 25 bp, mus musculus
tgtcttcattaggcagaggcaatat

SEQ ID NO: 48146 - DNA, 25 bp, mus musculus
taagaagccaacctgggcaggcaag

SEQ ID NO: 48147 - DNA, 25 bp, mus musculus
gaagccaacctgggcaggcaagtcc

SEQ ID NO: 48148 - DNA, 25 bp, mus musculus
caagtcctcaaaccccaggaagcag

SEQ ID NO: 48149 - DNA, 25 bp, mus musculus
gagggtaccactcacatggaaccag

SEQ ID NO: 48150 - DNA, 25 bp, mus musculus
ggtaccactcacatggaaccagagg

SEQ ID NO: 48151 - DNA, 25 bp, mus musculus
actcacatggaaccagaggaagctg

SEQ ID NO: 48152 - DNA, 25 bp, mus musculus
tgctcaaccagggtttcctacaggc

SEQ ID NO: 48153 - DNA, 25 bp, mus musculus
ctgcccctatgacccatgcctggaa

SEQ ID NO: 48154 - DNA, 25 bp, mus musculus
tgagtctagctttgggaagttcctg

SEQ ID NO: 48155 - DNA, 25 bp, mus musculus
acaaggtccactcctgggcctgcct

SEQ ID NO: 48156 - DNA, 25 bp, mus musculus
tgtcctctacccaatgctagaagga

SEQ ID NO: 48157 - DNA, 25 bp, mus musculus
caggctctcatccagtctggcctca

SEQ ID NO: 48158 - DNA, 25 bp, mus musculus
ctcatccagtctggcctcatctcag

SEQ ID NO: 48159 - DNA, 25 bp, mus musculus
ggcctcatctcagactcctgcttag

SEQ ID NO: 48160 - DNA, 25 bp, mus musculus
atctcagactcctgcttaggatggg

SEQ ID NO: 48161 - DNA, 25 bp, mus musculus
cctcgtctcctgttggtacactgtc

SEQ ID NO: 48162 - DNA, 25 bp, mus musculus
ctcctgttggtacactgtccccaca

SEQ ID NO: 48163 - DNA, 25 bp, mus musculus
cactgtccccacaataaaatgccat

SEQ ID NO: 48164 - DNA, 25 bp, mus musculus
cccatgcctggaagacggtggcctg

SEQ ID NO: 48165 - DNA, 25 bp, mus musculus
aagaccagctcttcatgcaggagaa

SEQ ID NO: 48166 - DNA, 25 bp, mus musculus
agctcttcatgcaggagaaagcccg

SEQ ID NO: 48167 - DNA, 25 bp, mus musculus
ggcagctcctgagccgcctgaagtc

SEQ ID NO: 48168 - DNA, 25 bp, mus musculus
tcctgagccgcctgaagtccagcca

SEQ ID NO: 48169 - DNA, 25 bp, mus musculus
caagagccggctctcatgtttacag

SEQ ID NO: 48170 - DNA, 25 bp, mus musculus
gtgaccagcttcaggatgtcttctg

SEQ ID NO: 48171 - DNA, 25 bp, mus musculus
aactacttaggtggcagaagtcacg

SEQ ID NO: 48172 - DNA, 25 bp, mus musculus
ccacatctcccagactggaactgga

SEQ ID NO: 48173 - DNA, 25 bp, mus musculus
ctcccagactggaactggagttgtc

SEQ ID NO: 48174 - DNA, 25 bp, mus musculus
tgaagccaacctcgcagccttcctt

SEQ ID NO: 48175 - DNA, 25 bp, mus musculus
tccaccagtcattattgtacttctc

SEQ ID NO: 48176 - DNA, 25 bp, mus musculus
agtcattattgtacttctccttgat

SEQ ID NO: 48177 - DNA, 25 bp, mus musculus
cattattgtacttctccttgatgtg

SEQ ID NO: 48178 - DNA, 25 bp, mus musculus
tgtacttctccttgatgtgtaggaa

SEQ ID NO: 48179 - DNA, 25 bp, mus musculus
tctccttgatgtgtaggaagtcctt

SEQ ID NO: 48180 - DNA, 25 bp, mus musculus
ggaagtccttgggctcaaaggtgat

SEQ ID NO: 48181 - DNA, 25 bp, mus musculus
agtccttgggctcaaaggtgatggc

SEQ ID NO: 48182 - DNA, 25 bp, mus musculus
cctcatcccctggagacggattgta

SEQ ID NO: 48183 - DNA, 25 bp, mus musculus
catcccctggagacggattgtagcc

SEQ ID NO: 48184 - DNA, 25 bp, mus musculus
tggagttgtcacctgacttactgga

SEQ ID NO: 48185 - DNA, 25 bp, mus musculus
tgtagccaacatttgtccgaacagc

SEQ ID NO: 48186 - DNA, 25 bp, mus musculus
agttgtcacctgacttactggagct

SEQ ID NO: 48187 - DNA, 25 bp, mus musculus
tgtcacctgacttactggagctgag

SEQ ID NO: 48188 - DNA, 25 bp, mus musculus
acttactggagctgaggcggttctg

SEQ ID NO: 48189 - DNA, 25 bp, mus musculus
gggtctgttcctgcagcagacgaag

SEQ ID NO: 48190 - DNA, 25 bp, mus musculus
tctgttcctgcagcagacgaaggct

SEQ ID NO: 48191 - DNA, 25 bp, mus musculus
gttcctgcagcagacgaaggctgtc

SEQ ID NO: 48192 - DNA, 25 bp, mus musculus
cctgcagcagacgaaggctgtccag

SEQ ID NO: 48193 - DNA, 25 bp, mus musculus
tagcagacacgtccagcggatacta

SEQ ID NO: 48194 - DNA, 25 bp, mus musculus
gcagacacgtccagcggatactaaa

SEQ ID NO: 48195 - DNA, 25 bp, mus musculus
atgctcagagtcttcaagtagttca

SEQ ID NO: 48196 - DNA, 25 bp, mus musculus
tcttcaagtagttcatcagcaagac

SEQ ID NO: 48197 - DNA, 25 bp, mus musculus
tagttcatcagcaagacaaactatg

SEQ ID NO: 48198 - DNA, 25 bp, mus musculus
gatgtcatggacgcattggtggcga

SEQ ID NO: 48199 - DNA, 25 bp, mus musculus
tcaagaacaagcttctgttcatggc

SEQ ID NO: 48200 - DNA, 25 bp, mus musculus
agaacaagcttctgttcatggctga

SEQ ID NO: 48201 - DNA, 25 bp, mus musculus
acaagcttctgttcatggctgataa

SEQ ID NO: 48202 - DNA, 25 bp, mus musculus
aagcttctgttcatggctgataaac

SEQ ID NO: 48203 - DNA, 25 bp, mus musculus
cttctgttcatggctgataaactgt

SEQ ID NO: 48204 - DNA, 25 bp, mus musculus
ttctgttcatggctgataaactgta

SEQ ID NO: 48205 - DNA, 25 bp, mus musculus
cagacacgtccagcggatactaaac

SEQ ID NO: 48206 - DNA, 25 bp, mus musculus
gacacgtccagcggatactaaactt

SEQ ID NO: 48207 - DNA, 25 bp, mus musculus
gtagctatcatcacatgctcagagt

SEQ ID NO: 48208 - DNA, 25 bp, mus musculus
tatcatcacatgctcagagtcttca

SEQ ID NO: 48209 - DNA, 25 bp, mus musculus
atcatcacatgctcagagtcttcaa

SEQ ID NO: 48210 - DNA, 25 bp, mus musculus
atcacatgctcagagtcttcaagta

SEQ ID NO: 48211 - DNA, 25 bp, mus musculus
cacatgctcagagtcttcaagtagt

SEQ ID NO: 48212 - DNA, 25 bp, mus musculus
acatgctcagagtcttcaagtagtt

SEQ ID NO: 48213 - DNA, 25 bp, mus musculus
agaggagtctcatccctacttccac

SEQ ID NO: 48214 - DNA, 25 bp, mus musculus
cttccacgagatctacagtgaccgg

SEQ ID NO: 48215 - DNA, 25 bp, mus musculus
tctcctgaaacatctggaaggtatc

SEQ ID NO: 48216 - DNA, 25 bp, mus musculus
tattatcaacatcactctgcccact

SEQ ID NO: 48217 - DNA, 25 bp, mus musculus
cactctgcccactggagttccgatt

SEQ ID NO: 48218 - DNA, 25 bp, mus musculus
gcccactggagttccgattctgctg

SEQ ID NO: 48219 - DNA, 25 bp, mus musculus
tggagttccgattctgctggagttg

SEQ ID NO: 48220 - DNA, 25 bp, mus musculus
tccgattctgctggagttggatgaa

SEQ ID NO: 48221 - DNA, 25 bp, mus musculus
tgggcctcaccagttcctgggcaac

SEQ ID NO: 48222 - DNA, 25 bp, mus musculus
gcctcaccagttcctgggcaaccag

SEQ ID NO: 48223 - DNA, 25 bp, mus musculus
gttcctgggcaaccaggaggccatc

SEQ ID NO: 48224 - DNA, 25 bp, mus musculus
catccaggcagccattaagaaagtg

SEQ ID NO: 48225 - DNA, 25 bp, mus musculus
ctacagtgaccggaggtacaaagtg

SEQ ID NO: 48226 - DNA, 25 bp, mus musculus
tgtgcccttggatcaactgccacgt

SEQ ID NO: 48227 - DNA, 25 bp, mus musculus
cttggatcaactgccacgttcagaa

SEQ ID NO: 48228 - DNA, 25 bp, mus musculus
tcaactgccacgttcagaaagcttg

SEQ ID NO: 48229 - DNA, 25 bp, mus musculus
cattctgatatctgctcacgggaat

SEQ ID NO: 48230 - DNA, 25 bp, mus musculus
gatatctgctcacgggaatagcagt

SEQ ID NO: 48231 - DNA, 25 bp, mus musculus
tagcagtagagctctcctgaaacat

SEQ ID NO: 48232 - DNA, 25 bp, mus musculus
tagagctctcctgaaacatctggaa

SEQ ID NO: 48233 - DNA, 25 bp, mus musculus
cagctctcacggatgggaggcctga

SEQ ID NO: 48234 - DNA, 25 bp, mus musculus
agctctcacggatgggaggcctgag

SEQ ID NO: 48235 - DNA, 25 bp, mus musculus
cacagctctttgtgatgaatctagt

SEQ ID NO: 48236 - DNA, 25 bp, mus musculus
ctagtttccagagccagggagcacg

SEQ ID NO: 48237 - DNA, 25 bp, mus musculus
tagtttccagagccagggagcacga

SEQ ID NO: 48238 - DNA, 25 bp, mus musculus
agtttccagagccagggagcacgat

SEQ ID NO: 48239 - DNA, 25 bp, mus musculus
gtttccagagccagggagcacgatg

SEQ ID NO: 48240 - DNA, 25 bp, mus musculus
tttccagagccagggagcacgatgt

SEQ ID NO: 48241 - DNA, 25 bp, mus musculus
ttccagagccagggagcacgatgtt

SEQ ID NO: 48242 - DNA, 25 bp, mus musculus
tccagagccagggagcacgatgttt

SEQ ID NO: 48243 - DNA, 25 bp, mus musculus
cagagccagggagcacgatgttttt

SEQ ID NO: 48244 - DNA, 25 bp, mus musculus
gaggccctctgtgctagagattacg

SEQ ID NO: 48245 - DNA, 25 bp, mus musculus
ctctcacggatgggaggcctgagtt

SEQ ID NO: 48246 - DNA, 25 bp, mus musculus
tctcacggatgggaggcctgagttg

SEQ ID NO: 48247 - DNA, 25 bp, mus musculus
aggccccacagctctttgtgatgaa

SEQ ID NO: 48248 - DNA, 25 bp, mus musculus
ggccccacagctctttgtgatgaat

SEQ ID NO: 48249 - DNA, 25 bp, mus musculus
gccccacagctctttgtgatgaatc

SEQ ID NO: 48250 - DNA, 25 bp, mus musculus
ccccacagctctttgtgatgaatct

SEQ ID NO: 48251 - DNA, 25 bp, mus musculus
cccacagctctttgtgatgaatcta

SEQ ID NO: 48252 - DNA, 25 bp, mus musculus
ccacagctctttgtgatgaatctag

SEQ ID NO: 48253 - DNA, 25 bp, mus musculus
gctagcatatccttccactttccag

SEQ ID NO: 48254 - DNA, 25 bp, mus musculus
atatccttccactttccaggctggg

SEQ ID NO: 48255 - DNA, 25 bp, mus musculus
cccccaaactactgaagaatgacat

SEQ ID NO: 48256 - DNA, 25 bp, mus musculus
atgacatttggcactgttcctggaa

SEQ ID NO: 48257 - DNA, 25 bp, mus musculus
tttggcactgttcctggaaccacat

SEQ ID NO: 48258 - DNA, 25 bp, mus musculus
accacatggtcactctagccaggtc

SEQ ID NO: 48259 - DNA, 25 bp, mus musculus
ggaccctgattctacattacatttc

SEQ ID NO: 48260 - DNA, 25 bp, mus musculus
tgattctacattacatttcaaatgt

SEQ ID NO: 48261 - DNA, 25 bp, mus musculus
tacattacatttcaaatgttacttg

SEQ ID NO: 48262 - DNA, 25 bp, mus musculus
tatttctgtcatcattggaaatgca

SEQ ID NO: 48263 - DNA, 25 bp, mus musculus
gggtcctttgagacctggctagagt

SEQ ID NO: 48264 - DNA, 25 bp, mus musculus
acctggctagagtgaccatgtggtt

SEQ ID NO: 48265 - DNA, 25 bp, mus musculus
ttccactttccaggctgggagcttg

SEQ ID NO: 48266 - DNA, 25 bp, mus musculus
tagacaagtttccatctaaaagcac

SEQ ID NO: 48267 - DNA, 25 bp, mus musculus
agtttccatctaaaagcacttcagg

SEQ ID NO: 48268 - DNA, 25 bp, mus musculus
catctaaaagcacttcagggtcaaa

SEQ ID NO: 48269 - DNA, 25 bp, mus musculus
aaggcaaccagcttgggtgctgtca

SEQ ID NO: 48270 - DNA, 25 bp, mus musculus
accagcttgggtgctgtcaccttgc

SEQ ID NO: 48271 - DNA, 25 bp, mus musculus
accttgccatagtttctaatactgt

SEQ ID NO: 48272 - DNA, 25 bp, mus musculus
tttctaatactgtatgtctgatagc

SEQ ID NO: 48273 - DNA, 25 bp, mus musculus
atatttggtcgccctcggctgcgct

SEQ ID NO: 48274 - DNA, 25 bp, mus musculus
ctgcgctacgcggtggatactgtgc

SEQ ID NO: 48275 - DNA, 25 bp, mus musculus
ccctccagtctctagggagcctgga

SEQ ID NO: 48276 - DNA, 25 bp, mus musculus
ctctcacatcaactgccagtgctct

SEQ ID NO: 48277 - DNA, 25 bp, mus musculus
caactgccagtgctcttccccatga

SEQ ID NO: 48278 - DNA, 25 bp, mus musculus
ctgccagtgctcttccccatgatag

SEQ ID NO: 48279 - DNA, 25 bp, mus musculus
taagtccctaagtgcctcaactgcc

SEQ ID NO: 48280 - DNA, 25 bp, mus musculus
atgtcagctgcctccttgtccctcg

SEQ ID NO: 48281 - DNA, 25 bp, mus musculus
ggacactgtgctattcgatcttgat

SEQ ID NO: 48282 - DNA, 25 bp, mus musculus
tgtgctattcgatcttgattgtcga

SEQ ID NO: 48283 - DNA, 25 bp, mus musculus
gctattcgatcttgattgtcgaaga

SEQ ID NO: 48284 - DNA, 25 bp, mus musculus
attcgatcttgattgtcgaagagtt

SEQ ID NO: 48285 - DNA, 25 bp, mus musculus
gtgcttcgatatcgatgccgagacg

SEQ ID NO: 48286 - DNA, 25 bp, mus musculus
cttcgatatcgatgccgagacgggc

SEQ ID NO: 48287 - DNA, 25 bp, mus musculus
ctggctcagcgcaacctgccgttga

SEQ ID NO: 48288 - DNA, 25 bp, mus musculus
cagcgcaacctgccgttgatccgct

SEQ ID NO: 48289 - DNA, 25 bp, mus musculus
ccgttgatccgctgccaggagaatg

SEQ ID NO: 48290 - DNA, 25 bp, mus musculus
ttgatccgctgccaggagaatgggc

SEQ ID NO: 48291 - DNA, 25 bp, mus musculus
tccatggacgccccagaaggaccac

SEQ ID NO: 48292 - DNA, 25 bp, mus musculus
ggacagctctcgaggcacaggaagg

SEQ ID NO: 48293 - DNA, 25 bp, mus musculus
tttgaaatggtcaccacgctgctgg

SEQ ID NO: 48294 - DNA, 25 bp, mus musculus
ttgaaatggtcaccacgctgctggc

SEQ ID NO: 48295 - DNA, 25 bp, mus musculus
accacgctgctggcagccgcagttc

SEQ ID NO: 48296 - DNA, 25 bp, mus musculus
ctgctggcagccgcagttctaatgg

SEQ ID NO: 48297 - DNA, 25 bp, mus musculus
tgctggcagccgcagttctaatgga

SEQ ID NO: 48298 - DNA, 25 bp, mus musculus
gctggcagccgcagttctaatggac

SEQ ID NO: 48299 - DNA, 25 bp, mus musculus
ctggcagccgcagttctaatggaca

SEQ ID NO: 48300 - DNA, 25 bp, mus musculus
tggcagccgcagttctaatggacat

SEQ ID NO: 48301 - DNA, 25 bp, mus musculus
ggcagccgcagttctaatggacatc

SEQ ID NO: 48302 - DNA, 25 bp, mus musculus
gcagccgcagttctaatggacatct

SEQ ID NO: 48303 - DNA, 25 bp, mus musculus
cagccgcagttctaatggacatctt

SEQ ID NO: 48304 - DNA, 25 bp, mus musculus
cgtttgacgacgaatacctgaagtg

SEQ ID NO: 48305 - DNA, 25 bp, mus musculus
tgaaatggtcaccacgctgctggca

SEQ ID NO: 48306 - DNA, 25 bp, mus musculus
gaaatggtcaccacgctgctggcag

SEQ ID NO: 48307 - DNA, 25 bp, mus musculus
aaatggtcaccacgctgctggcagc

SEQ ID NO: 48308 - DNA, 25 bp, mus musculus
aatggtcaccacgctgctggcagcc

SEQ ID NO: 48309 - DNA, 25 bp, mus musculus
atggtcaccacgctgctggcagccg

SEQ ID NO: 48310 - DNA, 25 bp, mus musculus
tggtcaccacgctgctggcagccgc

SEQ ID NO: 48311 - DNA, 25 bp, mus musculus
gtcaccacgctgctggcagccgcag

SEQ ID NO: 48312 - DNA, 25 bp, mus musculus
tcaccacgctgctggcagccgcagt

SEQ ID NO: 48313 - DNA, 25 bp, mus musculus
aaagtttcttcctggcagagacact

SEQ ID NO: 48314 - DNA, 25 bp, mus musculus
tcttcctggcagagacactgaagta

SEQ ID NO: 48315 - DNA, 25 bp, mus musculus
tgaactcttattgattggcaaacgt

SEQ ID NO: 48316 - DNA, 25 bp, mus musculus
ggacctcaattccttattcagctag

SEQ ID NO: 48317 - DNA, 25 bp, mus musculus
caattccttattcagctagtagatc

SEQ ID NO: 48318 - DNA, 25 bp, mus musculus
ccacagattctgcctgtctttttct

SEQ ID NO: 48319 - DNA, 25 bp, mus musculus
agaaccgtctaccagtgacctcttg

SEQ ID NO: 48320 - DNA, 25 bp, mus musculus
gtctaccagtgacctcttgattatg

SEQ ID NO: 48321 - DNA, 25 bp, mus musculus
cagtgacctcttgattatgatttga

SEQ ID NO: 48322 - DNA, 25 bp, mus musculus
ctgcaaaacttcttcctcctctatg

SEQ ID NO: 48323 - DNA, 25 bp, mus musculus
atgctgtctgcttcgagctgtaatg

SEQ ID NO: 48324 - DNA, 25 bp, mus musculus
gttttgccatgttgcaaaaagccat

SEQ ID NO: 48325 - DNA, 25 bp, mus musculus
ccgatgatgaccttcttccactaga

SEQ ID NO: 48326 - DNA, 25 bp, mus musculus
ttcttccactagaacactggatctt

SEQ ID NO: 48327 - DNA, 25 bp, mus musculus
cactagaacactggatcttcaacac

SEQ ID NO: 48328 - DNA, 25 bp, mus musculus
ggatcttcaacaccgaggctcatcc

SEQ ID NO: 48329 - DNA, 25 bp, mus musculus
ccgaggctcatcctttccctatact

SEQ ID NO: 48330 - DNA, 25 bp, mus musculus
ctatactccgtgaacagaagaagga

SEQ ID NO: 48331 - DNA, 25 bp, mus musculus
tctgcttcgttccctcactgcatac

SEQ ID NO: 48332 - DNA, 25 bp, mus musculus
taattccttttctggtaatcagaca

SEQ ID NO: 48333 - DNA, 25 bp, mus musculus
tcgctaccaagggcaaccagtgggt

SEQ ID NO: 48334 - DNA, 25 bp, mus musculus
agggcacctgtcagccgaaggaatt

SEQ ID NO: 48335 - DNA, 25 bp, mus musculus
aatgcaaattctcagactctaacct

SEQ ID NO: 48336 - DNA, 25 bp, mus musculus
ccaaaggacaccacttggatcaagt

SEQ ID NO: 48337 - DNA, 25 bp, mus musculus
gacaccacttggatcaagtaggcaa

SEQ ID NO: 48338 - DNA, 25 bp, mus musculus
aatatcttacaggattgagggacca

SEQ ID NO: 48339 - DNA, 25 bp, mus musculus
atactaattataccctctgcaaagc

SEQ ID NO: 48340 - DNA, 25 bp, mus musculus
attataccctctgcaaagcccaact

SEQ ID NO: 48341 - DNA, 25 bp, mus musculus
ccctctgcaaagcccaacttgaatc

SEQ ID NO: 48342 - DNA, 25 bp, mus musculus
gcaaagcccaacttgaatcttcctt

SEQ ID NO: 48343 - DNA, 25 bp, mus musculus
ttgaatcttccttaggactatcgtc

SEQ ID NO: 48344 - DNA, 25 bp, mus musculus
tatcacagctgtcataggtagacta

SEQ ID NO: 48345 - DNA, 25 bp, mus musculus
ccaacgccatcaaggatgccctggc

SEQ ID NO: 48346 - DNA, 25 bp, mus musculus
ccatcaaggatgccctggcttagct

SEQ ID NO: 48347 - DNA, 25 bp, mus musculus
cactctctggccaggagtttaatct

SEQ ID NO: 48348 - DNA, 25 bp, mus musculus
ttaatctcttgcaatgttaagttcc

SEQ ID NO: 48349 - DNA, 25 bp, mus musculus
aggggccacagcaggctcagctatg

SEQ ID NO: 48350 - DNA, 25 bp, mus musculus
cacagcaggctcagctatggagaac

SEQ ID NO: 48351 - DNA, 25 bp, mus musculus
agcagatacacaaccctgttaagga

SEQ ID NO: 48352 - DNA, 25 bp, mus musculus
tacacaaccctgttaaggaatgcaa

SEQ ID NO: 48353 - DNA, 25 bp, mus musculus
ttatgtgaccatgtggtgtttaaat

SEQ ID NO: 48354 - DNA, 25 bp, mus musculus
gattccttttggaattcatgtataa

SEQ ID NO: 48355 - DNA, 25 bp, mus musculus
tatctgtagacctcgaggtgtaagg

SEQ ID NO: 48356 - DNA, 25 bp, mus musculus
tgtagacctcgaggtgtaaggacat

SEQ ID NO: 48357 - DNA, 25 bp, mus musculus
gacttaaatacccactctgtttctg

SEQ ID NO: 48358 - DNA, 25 bp, mus musculus
aatacccactctgtttctgttcagt

SEQ ID NO: 48359 - DNA, 25 bp, mus musculus
tacccactctgtttctgttcagtta

SEQ ID NO: 48360 - DNA, 25 bp, mus musculus
cactctgtttctgttcagttagttc

SEQ ID NO: 48361 - DNA, 25 bp, mus musculus
ctgtttctgttcagttagttcaaca

SEQ ID NO: 48362 - DNA, 25 bp, mus musculus
gtttctgttcagttagttcaacatg

SEQ ID NO: 48363 - DNA, 25 bp, mus musculus
ttctgtcttgatattcaaagtcaaa

SEQ ID NO: 48364 - DNA, 25 bp, mus musculus
ctgtactttaattcttcatgttcca

SEQ ID NO: 48365 - DNA, 25 bp, mus musculus
taaatttacacattacatttgtgat

SEQ ID NO: 48366 - DNA, 25 bp, mus musculus
aatttacacattacatttgtgatac

SEQ ID NO: 48367 - DNA, 25 bp, mus musculus
tttacacattacatttgtgatactg

SEQ ID NO: 48368 - DNA, 25 bp, mus musculus
ttttcatataaagcatcatgatgtg

SEQ ID NO: 48369 - DNA, 25 bp, mus musculus
tattctataagcagttgtgaaatcc

SEQ ID NO: 48370 - DNA, 25 bp, mus musculus
gaaatccaaatgttctctgtaaaca

SEQ ID NO: 48371 - DNA, 25 bp, mus musculus
aatccaaatgttctctgtaaacatt

SEQ ID NO: 48372 - DNA, 25 bp, mus musculus
tgttctctgtaaacatttgtagtgt

SEQ ID NO: 48373 - DNA, 25 bp, mus musculus
ccaacctctaccatgagagatcgcc

SEQ ID NO: 48374 - DNA, 25 bp, mus musculus
caacctctaccatgagagatcgcca

SEQ ID NO: 48375 - DNA, 25 bp, mus musculus
ggatgcctcccagaggagaccacga

SEQ ID NO: 48376 - DNA, 25 bp, mus musculus
gatgcctcccagaggagaccacgat

SEQ ID NO: 48377 - DNA, 25 bp, mus musculus
tgcctcccagaggagaccacgatcg

SEQ ID NO: 48378 - DNA, 25 bp, mus musculus
gcctcccagaggagaccacgatcga

SEQ ID NO: 48379 - DNA, 25 bp, mus musculus
ctcccagaggagaccacgatcgaca

SEQ ID NO: 48380 - DNA, 25 bp, mus musculus
aggagaccacgatcgacatcatgga

SEQ ID NO: 48381 - DNA, 25 bp, mus musculus
ccacgatcgacatcatggaagtcac

SEQ ID NO: 48382 - DNA, 25 bp, mus musculus
acgatcgacatcatggaagtcacgg

SEQ ID NO: 48383 - DNA, 25 bp, mus musculus
acatcatggaagtcacggaggacat

SEQ ID NO: 48384 - DNA, 25 bp, mus musculus
aagtcacggaggacatcctagcaag

SEQ ID NO: 48385 - DNA, 25 bp, mus musculus
acctctaccatgagagatcgccatc

SEQ ID NO: 48386 - DNA, 25 bp, mus musculus
cctctaccatgagagatcgccatca

SEQ ID NO: 48387 - DNA, 25 bp, mus musculus
tctaccatgagagatcgccatcaca

SEQ ID NO: 48388 - DNA, 25 bp, mus musculus
ctaccatgagagatcgccatcacaa

SEQ ID NO: 48389 - DNA, 25 bp, mus musculus
atgagagatcgccatcacaatcact

SEQ ID NO: 48390 - DNA, 25 bp, mus musculus
tgagagatcgccatcacaatcactg

SEQ ID NO: 48391 - DNA, 25 bp, mus musculus
ctggacgctttcaaccctgggtcag

SEQ ID NO: 48392 - DNA, 25 bp, mus musculus
gacgctttcaaccctgggtcagacg

SEQ ID NO: 48393 - DNA, 25 bp, mus musculus
cactgctcatttgtgcagcgctgag

SEQ ID NO: 48394 - DNA, 25 bp, mus musculus
ctgctcatttgtgcagcgctgagtc

SEQ ID NO: 48395 - DNA, 25 bp, mus musculus
ggatcagtagctcgcatttgcacag

SEQ ID NO: 48396 - DNA, 25 bp, mus musculus
atcagtagctcgcatttgcacagtc

SEQ ID NO: 48397 - DNA, 25 bp, mus musculus
cagtagctcgcatttgcacagtctt

SEQ ID NO: 48398 - DNA, 25 bp, mus musculus
gtagctcgcatttgcacagtctttg

SEQ ID NO: 48399 - DNA, 25 bp, mus musculus
agctcgcatttgcacagtctttgat

SEQ ID NO: 48400 - DNA, 25 bp, mus musculus
ctcgcatttgcacagtctttgatat

SEQ ID NO: 48401 - DNA, 25 bp, mus musculus
cgcatttgcacagtctttgatatct

SEQ ID NO: 48402 - DNA, 25 bp, mus musculus
catttgcacagtctttgatatcttg

SEQ ID NO: 48403 - DNA, 25 bp, mus musculus
tttgcacagtctttgatatcttgat

SEQ ID NO: 48404 - DNA, 25 bp, mus musculus
tatcttgattattcgctatgccacg

SEQ ID NO: 48405 - DNA, 25 bp, mus musculus
gctcatttgtgcagcgctgagtcgg

SEQ ID NO: 48406 - DNA, 25 bp, mus musculus
tcttgattattcgctatgccacgaa

SEQ ID NO: 48407 - DNA, 25 bp, mus musculus
ctgtgtccgccacacttggtatcgc

SEQ ID NO: 48408 - DNA, 25 bp, mus musculus
gtgtccgccacacttggtatcgctg

SEQ ID NO: 48409 - DNA, 25 bp, mus musculus
gtccgccacacttggtatcgctgga

SEQ ID NO: 48410 - DNA, 25 bp, mus musculus
cacacttggtatcgctggatcagta

SEQ ID NO: 48411 - DNA, 25 bp, mus musculus
cacttggtatcgctggatcagtagc

SEQ ID NO: 48412 - DNA, 25 bp, mus musculus
tggtatcgctggatcagtagctcgc

SEQ ID NO: 48413 - DNA, 25 bp, mus musculus
atcgctggatcagtagctcgcattt

SEQ ID NO: 48414 - DNA, 25 bp, mus musculus
ggtcgcttcatctgtgcagtgcccg

SEQ ID NO: 48415 - DNA, 25 bp, mus musculus
ttcatctgtgcagtgcccggcttct

SEQ ID NO: 48416 - DNA, 25 bp, mus musculus
aaggggctcttccaggtgttagcag

SEQ ID NO: 48417 - DNA, 25 bp, mus musculus
aagggtcgcatttaccagggcactg

SEQ ID NO: 48418 - DNA, 25 bp, mus musculus
cgcatttaccagggcactgaagccg

SEQ ID NO: 48419 - DNA, 25 bp, mus musculus
ggcactgaagccgacagcatcttca

SEQ ID NO: 48420 - DNA, 25 bp, mus musculus
gacagcatcttcagcggattcctca

SEQ ID NO: 48421 - DNA, 25 bp, mus musculus
atcttcagcggattcctcattttcc

SEQ ID NO: 48422 - DNA, 25 bp, mus musculus
ttcctcattttcccctcggcctgag

SEQ ID NO: 48423 - DNA, 25 bp, mus musculus
ccctcggcctgagctggggatctgc

SEQ ID NO: 48424 - DNA, 25 bp, mus musculus
ccgcactctgcaaagtgaaggggct

SEQ ID NO: 48425 - DNA, 25 bp, mus musculus
ttctgcacactgcccagtggtttct

SEQ ID NO: 48426 - DNA, 25 bp, mus musculus
tgtgcagtgcccggcttctattact

SEQ ID NO: 48427 - DNA, 25 bp, mus musculus
gtgcccggcttctattacttcaact

SEQ ID NO: 48428 - DNA, 25 bp, mus musculus
tattacttcaacttccaagtgatct

SEQ ID NO: 48429 - DNA, 25 bp, mus musculus
ttccaagtgatctccaagtgggacc

SEQ ID NO: 48430 - DNA, 25 bp, mus musculus
gtgatctccaagtgggacctttgtc

SEQ ID NO: 48431 - DNA, 25 bp, mus musculus
tgggacctttgtctgtttatcaagt

SEQ ID NO: 48432 - DNA, 25 bp, mus musculus
ggccagcccagggattccctgagtt

SEQ ID NO: 48433 - DNA, 25 bp, mus musculus
gattccctgagtttctctaacacca

SEQ ID NO: 48434 - DNA, 25 bp, mus musculus
gacgctttccagatgtatgaccgta

SEQ ID NO: 48435 - DNA, 25 bp, mus musculus
acgctttccagatgtatgaccgtac

SEQ ID NO: 48436 - DNA, 25 bp, mus musculus
gaaggccttcctgtgtatgacgcgg

SEQ ID NO: 48437 - DNA, 25 bp, mus musculus
aaggccttcctgtgtatgacgcggc

SEQ ID NO: 48438 - DNA, 25 bp, mus musculus
ggccttcctgtgtatgacgcggctg

SEQ ID NO: 48439 - DNA, 25 bp, mus musculus
gccttcctgtgtatgacgcggctgg

SEQ ID NO: 48440 - DNA, 25 bp, mus musculus
cttcctgtgtatgacgcggctggaa

SEQ ID NO: 48441 - DNA, 25 bp, mus musculus
ttcctgtgtatgacgcggctggaaa

SEQ ID NO: 48442 - DNA, 25 bp, mus musculus
cctgtgtatgacgcggctggaaatg

SEQ ID NO: 48443 - DNA, 25 bp, mus musculus
ctgtgtatgacgcggctggaaatgg

SEQ ID NO: 48444 - DNA, 25 bp, mus musculus
aatggcgtcgtcatggctgctggta

SEQ ID NO: 48445 - DNA, 25 bp, mus musculus
atggcgtcgtcatggctgctggtat

SEQ ID NO: 48446 - DNA, 25 bp, mus musculus
ctgggcagcagctctactaacgccg

SEQ ID NO: 48447 - DNA, 25 bp, mus musculus
tcgtcatggctgctggtatccgtca

SEQ ID NO: 48448 - DNA, 25 bp, mus musculus
atgctgcagaccgtgggcacgacaa

SEQ ID NO: 48449 - DNA, 25 bp, mus musculus
ctgcagaccgtgggcacgacaacgg

SEQ ID NO: 48450 - DNA, 25 bp, mus musculus
tgcagaccgtgggcacgacaacgga

SEQ ID NO: 48451 - DNA, 25 bp, mus musculus
tgggcacgacaacggaccagagaac

SEQ ID NO: 48452 - DNA, 25 bp, mus musculus
ggcacgacaacggaccagagaacct

SEQ ID NO: 48453 - DNA, 25 bp, mus musculus
agaacctactagtattatgtagaag

SEQ ID NO: 48454 - DNA, 25 bp, mus musculus
tagaaggccttcctgtgtatgacgc

SEQ ID NO: 48455 - DNA, 25 bp, mus musculus
atttcacccagaactccgagctcat

SEQ ID NO: 48456 - DNA, 25 bp, mus musculus
agaactccgagctcattgaacatct

SEQ ID NO: 48457 - DNA, 25 bp, mus musculus
acaacttcattagacacatgaaagt

SEQ ID NO: 48458 - DNA, 25 bp, mus musculus
caaagcagtatgcgtgcagggagtg

SEQ ID NO: 48459 - DNA, 25 bp, mus musculus
tgtactgcagtagctctagcctgta

SEQ ID NO: 48460 - DNA, 25 bp, mus musculus
actgcagtagctctagcctgtacaa

SEQ ID NO: 48461 - DNA, 25 bp, mus musculus
gcagtagctctagcctgtacaaaca

SEQ ID NO: 48462 - DNA, 25 bp, mus musculus
aacaccggaagattcacgctcgata

SEQ ID NO: 48463 - DNA, 25 bp, mus musculus
agattcacgctcgataaacccatag

SEQ ID NO: 48464 - DNA, 25 bp, mus musculus
acgctcgataaacccataggagagc

SEQ ID NO: 48465 - DNA, 25 bp, mus musculus
aaacccataggagagccatgagggg

SEQ ID NO: 48466 - DNA, 25 bp, mus musculus
gaggtcccttattcatctccatgaa

SEQ ID NO: 48467 - DNA, 25 bp, mus musculus
actccgagctcattgaacatctaac

SEQ ID NO: 48468 - DNA, 25 bp, mus musculus
ccttattcatctccatgaacacctg

SEQ ID NO: 48469 - DNA, 25 bp, mus musculus
agctcattgaacatctaacagttca

SEQ ID NO: 48470 - DNA, 25 bp, mus musculus
atctaacagttcacggcaagccttt

SEQ ID NO: 48471 - DNA, 25 bp, mus musculus
taacagttcacggcaagcctttcaa

SEQ ID NO: 48472 - DNA, 25 bp, mus musculus
acggcaagcctttcaagtgcaacag

SEQ ID NO: 48473 - DNA, 25 bp, mus musculus
tcaagtgcaacaggtgtggacgagt

SEQ ID NO: 48474 - DNA, 25 bp, mus musculus
attccagctacaacttcattagaca

SEQ ID NO: 48475 - DNA, 25 bp, mus musculus
gctacaacttcattagacacatgaa

SEQ ID NO: 48476 - DNA, 25 bp, mus musculus
ctgtggtcaccaaccctcaggggca

SEQ ID NO: 48477 - DNA, 25 bp, mus musculus
actacacatcgcatacggccaacct

SEQ ID NO: 48478 - DNA, 25 bp, mus musculus
tagagggctccaacagcgtcttctc

SEQ ID NO: 48479 - DNA, 25 bp, mus musculus
acagcgtcttctctggtttcctact

SEQ ID NO: 48480 - DNA, 25 bp, mus musculus
tgtttcccgactagaacggcaggct

SEQ ID NO: 48481 - DNA, 25 bp, mus musculus
ccgactagaacggcaggctgcttcc

SEQ ID NO: 48482 - DNA, 25 bp, mus musculus
aagtccaccctggttcctgatccat

SEQ ID NO: 48483 - DNA, 25 bp, mus musculus
tcggccctgtgtctcctcagagttt

SEQ ID NO: 48484 - DNA, 25 bp, mus musculus
ctcctcagagtttctctgggaacca

SEQ ID NO: 48485 - DNA, 25 bp, mus musculus
tctctgggaaccacctaatggtatt

SEQ ID NO: 48486 - DNA, 25 bp, mus musculus
tggtattattcctgtggccatttat

SEQ ID NO: 48487 - DNA, 25 bp, mus musculus
catttatcaataccttatgagacta

SEQ ID NO: 48488 - DNA, 25 bp, mus musculus
catcgcatacggccaacctgtgcgt

SEQ ID NO: 48489 - DNA, 25 bp, mus musculus
atacggccaacctgtgcgtgcacct

SEQ ID NO: 48490 - DNA, 25 bp, mus musculus
ccaacctgtgcgtgcacctgaacct

SEQ ID NO: 48491 - DNA, 25 bp, mus musculus
tgaacctcaaccttgccagggtggc

SEQ ID NO: 48492 - DNA, 25 bp, mus musculus
tcaaccttgccagggtggccagctt

SEQ ID NO: 48493 - DNA, 25 bp, mus musculus
ccagcttctgcgaccacatgttcaa

SEQ ID NO: 48494 - DNA, 25 bp, mus musculus
tctgcgaccacatgttcaacagcaa

SEQ ID NO: 48495 - DNA, 25 bp, mus musculus
tgttcaacagcaagcaggtcagctc

SEQ ID NO: 48496 - DNA, 25 bp, mus musculus
tacgtattcctctacaagacgactt

SEQ ID NO: 48497 - DNA, 25 bp, mus musculus
atgcatcagtcacagcaagtgttaa

SEQ ID NO: 48498 - DNA, 25 bp, mus musculus
ctataattcttctggatgggcagtg

SEQ ID NO: 48499 - DNA, 25 bp, mus musculus
ttcttctggatgggcagtgcctgtg

SEQ ID NO: 48500 - DNA, 25 bp, mus musculus
gcctgtgctcctgcccaatgatgtt

SEQ ID NO: 48501 - DNA, 25 bp, mus musculus
gaatggcctgcgaaatccatcaaac

SEQ ID NO: 48502 - DNA, 25 bp, mus musculus
cctgcgaaatccatcaaacaatata

SEQ ID NO: 48503 - DNA, 25 bp, mus musculus
atcaaacaatatagccttcaggaaa

SEQ ID NO: 48504 - DNA, 25 bp, mus musculus
caatatagccttcaggaaacaaagc

SEQ ID NO: 48505 - DNA, 25 bp, mus musculus
tatagccttcaggaaacaaagcaaa

SEQ ID NO: 48506 - DNA, 25 bp, mus musculus
aagcaaaccctggttcacatggaag

SEQ ID NO: 48507 - DNA, 25 bp, mus musculus
cccaggactttccaacttagcatct

SEQ ID NO: 48508 - DNA, 25 bp, mus musculus
ctgtaaacatcacccgcgataacat

SEQ ID NO: 48509 - DNA, 25 bp, mus musculus
ctttccaacttagcatcttaccctg

SEQ ID NO: 48510 - DNA, 25 bp, mus musculus
acatcacccgcgataacatcataga

SEQ ID NO: 48511 - DNA, 25 bp, mus musculus
cccgcgataacatcatagatgatgt

SEQ ID NO: 48512 - DNA, 25 bp, mus musculus
tggcaaacgctccagctctcatcag

SEQ ID NO: 48513 - DNA, 25 bp, mus musculus
cagctctcatcagtcaaagaatgtc

SEQ ID NO: 48514 - DNA, 25 bp, mus musculus
tatataatctcattcctttgaaaat

SEQ ID NO: 48515 - DNA, 25 bp, mus musculus
aaaggtgctacccatgtctaaatgg

SEQ ID NO: 48516 - DNA, 25 bp, mus musculus
gctacccatgtctaaatggaggtac

SEQ ID NO: 48517 - DNA, 25 bp, mus musculus
cagggctgcatcgtcttgcagaggt

SEQ ID NO: 48518 - DNA, 25 bp, mus musculus
tgcatcgtcttgcagaggttgacag

SEQ ID NO: 48519 - DNA, 25 bp, mus musculus
aaatcccttacctgtgatagaacag

SEQ ID NO: 48520 - DNA, 25 bp, mus musculus
gctgtatcgttcatacttggggacc

SEQ ID NO: 48521 - DNA, 25 bp, mus musculus
atacttggggacctggctgtacata

SEQ ID NO: 48522 - DNA, 25 bp, mus musculus
tagctacactgttgtgatacaacct

SEQ ID NO: 48523 - DNA, 25 bp, mus musculus
tgtgatacaaccttgggtttgctga

SEQ ID NO: 48524 - DNA, 25 bp, mus musculus
ttttgctctcaaactatcatgttct

SEQ ID NO: 48525 - DNA, 25 bp, mus musculus
tctcaaactatcatgttcttttcta

SEQ ID NO: 48526 - DNA, 25 bp, mus musculus
actatcatgttcttttctagatgtc

SEQ ID NO: 48527 - DNA, 25 bp, mus musculus
atgttcttttctagatgtctctaag

SEQ ID NO: 48528 - DNA, 25 bp, mus musculus
ttttctagatgtctctaagtctata

SEQ ID NO: 48529 - DNA, 25 bp, mus musculus
gacatattcagacgctatgacacgg

SEQ ID NO: 48530 - DNA, 25 bp, mus musculus
ttcagacgctatgacacggatcagg

SEQ ID NO: 48531 - DNA, 25 bp, mus musculus
cgctatgacacggatcaggatggct

SEQ ID NO: 48532 - DNA, 25 bp, mus musculus
gagcaatatctctccatggtcttca

SEQ ID NO: 48533 - DNA, 25 bp, mus musculus
tatctctccatggtcttcagcattg

SEQ ID NO: 48534 - DNA, 25 bp, mus musculus
tccatggtcttcagcattgtataac

SEQ ID NO: 48535 - DNA, 25 bp, mus musculus
aacagcaagcacggcatgcaaaaga

SEQ ID NO: 48536 - DNA, 25 bp, mus musculus
gatgccaaatcccttacctgtgata

SEQ ID NO: 48537 - DNA, 25 bp, mus musculus
aggctgcagctcattgaaggtgtca

SEQ ID NO: 48538 - DNA, 25 bp, mus musculus
tgaaggtgtcagccccatagatatg

SEQ ID NO: 48539 - DNA, 25 bp, mus musculus
tggtcagcgcccgtaggaagaggtt

SEQ ID NO: 48540 - DNA, 25 bp, mus musculus
gacctgtggaaacaccctggtgatg

SEQ ID NO: 48541 - DNA, 25 bp, mus musculus
tgtggaaacaccctggtgatggcct

SEQ ID NO: 48542 - DNA, 25 bp, mus musculus
ggaaacaccctggtgatggccttgg

SEQ ID NO: 48543 - DNA, 25 bp, mus musculus
accctggtgatggccttggggacag

SEQ ID NO: 48544 - DNA, 25 bp, mus musculus
tgatggccttggggacaggccctgc

SEQ ID NO: 48545 - DNA, 25 bp, mus musculus
gacaggccctgcgaaggcagccagc

SEQ ID NO: 48546 - DNA, 25 bp, mus musculus
acaggccctgcgaaggcagccagca

SEQ ID NO: 48547 - DNA, 25 bp, mus musculus
cgaaggcagccagcactgggagcag

SEQ ID NO: 48548 - DNA, 25 bp, mus musculus
aaggcagccagcactgggagcaggc

SEQ ID NO: 48549 - DNA, 25 bp, mus musculus
aaggtgtcagccccatagatatgat

SEQ ID NO: 48550 - DNA, 25 bp, mus musculus
aggtgtcagccccatagatatgatc

SEQ ID NO: 48551 - DNA, 25 bp, mus musculus
gtgtcagccccatagatatgatcgg

SEQ ID NO: 48552 - DNA, 25 bp, mus musculus
tgtcagccccatagatatgatcggt

SEQ ID NO: 48553 - DNA, 25 bp, mus musculus
gtcagccccatagatatgatcggtg

SEQ ID NO: 48554 - DNA, 25 bp, mus musculus
tcagccccatagatatgatcggtgc

SEQ ID NO: 48555 - DNA, 25 bp, mus musculus
agccccatagatatgatcggtgcca

SEQ ID NO: 48556 - DNA, 25 bp, mus musculus
atatgatcggtgccaaacgccgtgg

SEQ ID NO: 48557 - DNA, 25 bp, mus musculus
ctgcgtggcacgctgcatctggacc

SEQ ID NO: 48558 - DNA, 25 bp, mus musculus
acgctgcatctggaccagaaggctg

SEQ ID NO: 48559 - DNA, 25 bp, mus musculus
ttggaatggctccctctctttagaa

SEQ ID NO: 48560 - DNA, 25 bp, mus musculus
gaatggctccctctctttagaaaga

SEQ ID NO: 48561 - DNA, 25 bp, mus musculus
tggctccctctctttagaaagaggc

SEQ ID NO: 48562 - DNA, 25 bp, mus musculus
gagaagcctacagggcactggccct

SEQ ID NO: 48563 - DNA, 25 bp, mus musculus
aagcctacagggcactggccctggt

SEQ ID NO: 48564 - DNA, 25 bp, mus musculus
cctacagggcactggccctggtaca

SEQ ID NO: 48565 - DNA, 25 bp, mus musculus
cactggccctggtacatttctctga

SEQ ID NO: 48566 - DNA, 25 bp, mus musculus
tggtacatttctctgacatttcttg

SEQ ID NO: 48567 - DNA, 25 bp, mus musculus
ctgacatttcttgaggcctcacatt

SEQ ID NO: 48568 - DNA, 25 bp, mus musculus
acatttcttgaggcctcacattggg

SEQ ID NO: 48569 - DNA, 25 bp, mus musculus
catctggaccagaaggctggactgt

SEQ ID NO: 48570 - DNA, 25 bp, mus musculus
ggactgtgagcctttccgatggaag

SEQ ID NO: 48571 - DNA, 25 bp, mus musculus
ctgtgagcctttccgatggaaggat

SEQ ID NO: 48572 - DNA, 25 bp, mus musculus
gactctgacgacaacatgatcccca

SEQ ID NO: 48573 - DNA, 25 bp, mus musculus
ctctcagagcgggaatgtctaaagg

SEQ ID NO: 48574 - DNA, 25 bp, mus musculus
ctctgccctctcagggcttgaactt

SEQ ID NO: 48575 - DNA, 25 bp, mus musculus
agggcttgaacttgctccgatgccc

SEQ ID NO: 48576 - DNA, 25 bp, mus musculus
gatgccctcggtgactttccccact

SEQ ID NO: 48577 - DNA, 25 bp, mus musculus
ttaccactgtccaagggatcgccga

SEQ ID NO: 48578 - DNA, 25 bp, mus musculus
accactgtccaagggatcgccgatg

SEQ ID NO: 48579 - DNA, 25 bp, mus musculus
cagttcctgatacagattcggcatg

SEQ ID NO: 48580 - DNA, 25 bp, mus musculus
gttcctgatacagattcggcatggc

SEQ ID NO: 48581 - DNA, 25 bp, mus musculus
tcctgatacagattcggcatggcta

SEQ ID NO: 48582 - DNA, 25 bp, mus musculus
gatacagattcggcatggctaagga

SEQ ID NO: 48583 - DNA, 25 bp, mus musculus
tacagattcggcatggctaaggacg

SEQ ID NO: 48584 - DNA, 25 bp, mus musculus
cagattcggcatggctaaggacgat

SEQ ID NO: 48585 - DNA, 25 bp, mus musculus
gttttaactgcttgtggctctgtga

SEQ ID NO: 48586 - DNA, 25 bp, mus musculus
ttaagtgagcactccttgcaacgag

SEQ ID NO: 48587 - DNA, 25 bp, mus musculus
aagtgagcactccttgcaacgagta

SEQ ID NO: 48588 - DNA, 25 bp, mus musculus
gcactccttgcaacgagtagaactc

SEQ ID NO: 48589 - DNA, 25 bp, mus musculus
cactgtccaagggatcgccgatgat

SEQ ID NO: 48590 - DNA, 25 bp, mus musculus
ctgtccaagggatcgccgatgatta

SEQ ID NO: 48591 - DNA, 25 bp, mus musculus
acgatactcagagactagtgaaggc

SEQ ID NO: 48592 - DNA, 25 bp, mus musculus
tactcagagactagtgaaggcgttt

SEQ ID NO: 48593 - DNA, 25 bp, mus musculus
agtaattcagctacagggtgaccag

SEQ ID NO: 48594 - DNA, 25 bp, mus musculus
taattcagctacagggtgaccagcg

SEQ ID NO: 48595 - DNA, 25 bp, mus musculus
attcagctacagggtgaccagcgca

SEQ ID NO: 48596 - DNA, 25 bp, mus musculus
gccagttcctgatacagattcggca

SEQ ID NO: 48597 - DNA, 25 bp, mus musculus
cagcctgtggatctggaaaggagag

SEQ ID NO: 48598 - DNA, 25 bp, mus musculus
agggttccttaggcctgatagacag

SEQ ID NO: 48599 - DNA, 25 bp, mus musculus
atgagttccttcgctgtatgattta

SEQ ID NO: 48600 - DNA, 25 bp, mus musculus
agttccttcgctgtatgatttaggc

SEQ ID NO: 48601 - DNA, 25 bp, mus musculus
aggcttctgagtcccacagagtgga

SEQ ID NO: 48602 - DNA, 25 bp, mus musculus
cttctgagtcccacagagtggactc

SEQ ID NO: 48603 - DNA, 25 bp, mus musculus
tggactccttcctcttgctgcgcca

SEQ ID NO: 48604 - DNA, 25 bp, mus musculus
cggacttccaggttctgcccaccag

SEQ ID NO: 48605 - DNA, 25 bp, mus musculus
acttccaggttctgcccaccagctt

SEQ ID NO: 48606 - DNA, 25 bp, mus musculus
ttctgcccaccagcttgcttaatga

SEQ ID NO: 48607 - DNA, 25 bp, mus musculus
tgcccaccagcttgcttaatgatct

SEQ ID NO: 48608 - DNA, 25 bp, mus musculus
ccaccagcttgcttaatgatctagc

SEQ ID NO: 48609 - DNA, 25 bp, mus musculus
gttccttaggcctgatagacagttg

SEQ ID NO: 48610 - DNA, 25 bp, mus musculus
acagttgtgcctgcgttgggtcacg

SEQ ID NO: 48611 - DNA, 25 bp, mus musculus
gttgtgcctgcgttgggtcacggtt

SEQ ID NO: 48612 - DNA, 25 bp, mus musculus
aagcttctgtcgtctccgctgcgat

SEQ ID NO: 48613 - DNA, 25 bp, mus musculus
ctgtcgtctccgctgcgatgcatga

SEQ ID NO: 48614 - DNA, 25 bp, mus musculus
tctccgctgcgatgcatgagttcct

SEQ ID NO: 48615 - DNA, 25 bp, mus musculus
ccgctgcgatgcatgagttccttcg

SEQ ID NO: 48616 - DNA, 25 bp, mus musculus
tgcatgagttccttcgctgtatgat

SEQ ID NO: 48617 - DNA, 25 bp, mus musculus
cagacactcagtggataccaccttt

SEQ ID NO: 48618 - DNA, 25 bp, mus musculus
ctcagtggataccacctttcatcca

SEQ ID NO: 48619 - DNA, 25 bp, mus musculus
aaagctgcctgtctgggataatttg

SEQ ID NO: 48620 - DNA, 25 bp, mus musculus
gacaattcttttgcatgaccctcta

SEQ ID NO: 48621 - DNA, 25 bp, mus musculus
aattcttttgcatgaccctctaaag

SEQ ID NO: 48622 - DNA, 25 bp, mus musculus
tttgcatgaccctctaaagagcagg

SEQ ID NO: 48623 - DNA, 25 bp, mus musculus
tgaccctctaaagagcaggacactc

SEQ ID NO: 48624 - DNA, 25 bp, mus musculus
gacactcctgctctaactggctagg

SEQ ID NO: 48625 - DNA, 25 bp, mus musculus
ctaactggctaggtgttcgcaggtg

SEQ ID NO: 48626 - DNA, 25 bp, mus musculus
actgcctgcagtactggtggccctc

SEQ ID NO: 48627 - DNA, 25 bp, mus musculus
tttctgagccttgtaggtgtacaaa

SEQ ID NO: 48628 - DNA, 25 bp, mus musculus
ttttgttctgtctcgggaaactgca

SEQ ID NO: 48629 - DNA, 25 bp, mus musculus
ggataccacctttcatccacactgt

SEQ ID NO: 48630 - DNA, 25 bp, mus musculus
ctttcatccacactgtgcccaggac

SEQ ID NO: 48631 - DNA, 25 bp, mus musculus
gtaaacatctgccaggctccacttg

SEQ ID NO: 48632 - DNA, 25 bp, mus musculus
caggctccacttgagtggcccaagg

SEQ ID NO: 48633 - DNA, 25 bp, mus musculus
cccaaggccatggaacagtggcagg

SEQ ID NO: 48634 - DNA, 25 bp, mus musculus
ccttgttatctccacaaagctgcct

SEQ ID NO: 48635 - DNA, 25 bp, mus musculus
tgttatctccacaaagctgcctgtc

SEQ ID NO: 48636 - DNA, 25 bp, mus musculus
ctccacaaagctgcctgtctgggat

SEQ ID NO: 48637 - DNA, 25 bp, mus musculus
cataacaacaggttattctccacca

SEQ ID NO: 48638 - DNA, 25 bp, mus musculus
ttctccaccaaagaccaagacaatg

SEQ ID NO: 48639 - DNA, 25 bp, mus musculus
tggtactcccagtgccacacttcca

SEQ ID NO: 48640 - DNA, 25 bp, mus musculus
tgccacacttccaacctgaatggcc

SEQ ID NO: 48641 - DNA, 25 bp, mus musculus
cacacttccaacctgaatggcctct

SEQ ID NO: 48642 - DNA, 25 bp, mus musculus
aacctgaatggcctctacctgaggg

SEQ ID NO: 48643 - DNA, 25 bp, mus musculus
ctgaatggcctctacctgaggggtc

SEQ ID NO: 48644 - DNA, 25 bp, mus musculus
aggggtccccataagagctatgcga

SEQ ID NO: 48645 - DNA, 25 bp, mus musculus
ggtccccataagagctatgcgaatg

SEQ ID NO: 48646 - DNA, 25 bp, mus musculus
gggtacaactacagctgcaaggttt

SEQ ID NO: 48647 - DNA, 25 bp, mus musculus
tacaactacagctgcaaggtttctg

SEQ ID NO: 48648 - DNA, 25 bp, mus musculus
tacagctgcaaggtttctgagatga

SEQ ID NO: 48649 - DNA, 25 bp, mus musculus
accaaagaccaagacaatgacggca

SEQ ID NO: 48650 - DNA, 25 bp, mus musculus
aatgacggcagtacttccagctgtg

SEQ ID NO: 48651 - DNA, 25 bp, mus musculus
gacggcagtacttccagctgtgcca

SEQ ID NO: 48652 - DNA, 25 bp, mus musculus
agtacttccagctgtgccatgggtt

SEQ ID NO: 48653 - DNA, 25 bp, mus musculus
acttccagctgtgccatgggttacc

SEQ ID NO: 48654 - DNA, 25 bp, mus musculus
tccagctgtgccatgggttaccatg

SEQ ID NO: 48655 - DNA, 25 bp, mus musculus
tgtgccatgggttaccatggagcct

SEQ ID NO: 48656 - DNA, 25 bp, mus musculus
atgggttaccatggagcctggtggt

SEQ ID NO: 48657 - DNA, 25 bp, mus musculus
tttctgaagctcggggcgcatcacc

SEQ ID NO: 48658 - DNA, 25 bp, mus musculus
catcaccaggccctgcagaagctgg

SEQ ID NO: 48659 - DNA, 25 bp, mus musculus
gtcacctggattgtgcagaagacgc

SEQ ID NO: 48660 - DNA, 25 bp, mus musculus
cagaagacgcctgttgaggtgtccc

SEQ ID NO: 48661 - DNA, 25 bp, mus musculus
ccgagccagctatccacgttccgga

SEQ ID NO: 48662 - DNA, 25 bp, mus musculus
agccagctatccacgttccggacac

SEQ ID NO: 48663 - DNA, 25 bp, mus musculus
cagctatccacgttccggacactct

SEQ ID NO: 48664 - DNA, 25 bp, mus musculus
ctatccacgttccggacactcttgt

SEQ ID NO: 48665 - DNA, 25 bp, mus musculus
tccacgttccggacactcttgttct

SEQ ID NO: 48666 - DNA, 25 bp, mus musculus
aggtcttaatctcaggatgaagtct

SEQ ID NO: 48667 - DNA, 25 bp, mus musculus
tcttaatctcaggatgaagtctgta

SEQ ID NO: 48668 - DNA, 25 bp, mus musculus
tttccagtggccacgtggcaccgac

SEQ ID NO: 48669 - DNA, 25 bp, mus musculus
gatacacaggtggccatgggaccct

SEQ ID NO: 48670 - DNA, 25 bp, mus musculus
acacaggtggccatgggaccctttg

SEQ ID NO: 48671 - DNA, 25 bp, mus musculus
ctgcctgcctgccgggattactgga

SEQ ID NO: 48672 - DNA, 25 bp, mus musculus
ccgccacttgctgagtcagtcacct

SEQ ID NO: 48673 - DNA, 25 bp, mus musculus
ccacttgctgagtcagtcacctgga

SEQ ID NO: 48674 - DNA, 25 bp, mus musculus
cttgctgagtcagtcacctggattg

SEQ ID NO: 48675 - DNA, 25 bp, mus musculus
gagtcagtcacctggattgtgcaga

SEQ ID NO: 48676 - DNA, 25 bp, mus musculus
tcagtcacctggattgtgcagaaga

SEQ ID NO: 48677 - DNA, 25 bp, mus musculus
gctgcagcctaatggtgaggagatg

SEQ ID NO: 48678 - DNA, 25 bp, mus musculus
ggagatgaccctcaagcagttcctt

SEQ ID NO: 48679 - DNA, 25 bp, mus musculus
tttcttcatgccagctgctaagctc

SEQ ID NO: 48680 - DNA, 25 bp, mus musculus
cttcatgccagctgctaagctcaag

SEQ ID NO: 48681 - DNA, 25 bp, mus musculus
catgccagctgctaagctcaaggaa

SEQ ID NO: 48682 - DNA, 25 bp, mus musculus
gccagctgctaagctcaaggaacga

SEQ ID NO: 48683 - DNA, 25 bp, mus musculus
ccgccatgtgcgggcactggtgctt

SEQ ID NO: 48684 - DNA, 25 bp, mus musculus
ccatgtgcgggcactggtgcttgag

SEQ ID NO: 48685 - DNA, 25 bp, mus musculus
ggtgcttgagctgtgctgcaacgat

SEQ ID NO: 48686 - DNA, 25 bp, mus musculus
gcttgagctgtgctgcaacgatgaa

SEQ ID NO: 48687 - DNA, 25 bp, mus musculus
tgagctgtgctgcaacgatgaaagc

SEQ ID NO: 48688 - DNA, 25 bp, mus musculus
tctcaccgctgctttgtaccttgtt

SEQ ID NO: 48689 - DNA, 25 bp, mus musculus
gatgaccctcaagcagttccttgat

SEQ ID NO: 48690 - DNA, 25 bp, mus musculus
gaccctcaagcagttccttgattac

SEQ ID NO: 48691 - DNA, 25 bp, mus musculus
cctcaagcagttccttgattacttt

SEQ ID NO: 48692 - DNA, 25 bp, mus musculus
caagcagttccttgattactttaag

SEQ ID NO: 48693 - DNA, 25 bp, mus musculus
attggagatcaccatgctgtcccag

SEQ ID NO: 48694 - DNA, 25 bp, mus musculus
ggagatcaccatgctgtcccagggc

SEQ ID NO: 48695 - DNA, 25 bp, mus musculus
gatcaccatgctgtcccagggcgtg

SEQ ID NO: 48696 - DNA, 25 bp, mus musculus
ttctttcttcatgccagctgctaag

SEQ ID NO: 48697 - DNA, 25 bp, mus musculus
gcacacaccacagcttctggaattc

SEQ ID NO: 48698 - DNA, 25 bp, mus musculus
cacaccacagcttctggaattcata

SEQ ID NO: 48699 - DNA, 25 bp, mus musculus
aagcacattcccagagccaagtcat

SEQ ID NO: 48700 - DNA, 25 bp, mus musculus
attcccagagccaagtcatttattt

SEQ ID NO: 48701 - DNA, 25 bp, mus musculus
cccagagccaagtcatttatttcct

SEQ ID NO: 48702 - DNA, 25 bp, mus musculus
atatgctcactagtgtatttcttga

SEQ ID NO: 48703 - DNA, 25 bp, mus musculus
gtttgatctacaacagcttagaaca

SEQ ID NO: 48704 - DNA, 25 bp, mus musculus
tgatctacaacagcttagaacatca

SEQ ID NO: 48705 - DNA, 25 bp, mus musculus
tctacaacagcttagaacatcaaaa

SEQ ID NO: 48706 - DNA, 25 bp, mus musculus
atatacttatggcatatctgaatgt

SEQ ID NO: 48707 - DNA, 25 bp, mus musculus
agcataccagtaatagctttgtttc

SEQ ID NO: 48708 - DNA, 25 bp, mus musculus
atagctttgtttccatatagaaata

SEQ ID NO: 48709 - DNA, 25 bp, mus musculus
accacagcttctggaattcatactt

SEQ ID NO: 48710 - DNA, 25 bp, mus musculus
atccactagtatactatgttaattt

SEQ ID NO: 48711 - DNA, 25 bp, mus musculus
ggaattcatacttttgcacatactg

SEQ ID NO: 48712 - DNA, 25 bp, mus musculus
catacttttgcacatactgcttgtt

SEQ ID NO: 48713 - DNA, 25 bp, mus musculus
acttttgcacatactgcttgttgct

SEQ ID NO: 48714 - DNA, 25 bp, mus musculus
tttgcacatactgcttgttgcttat

SEQ ID NO: 48715 - DNA, 25 bp, mus musculus
catactgcttgttgcttatgtgtag

SEQ ID NO: 48716 - DNA, 25 bp, mus musculus
actgcttgttgcttatgtgtagaaa

SEQ ID NO: 48717 - DNA, 25 bp, mus musculus
taagaaaagcacattcccagagcca

SEQ ID NO: 48718 - DNA, 25 bp, mus musculus
caccaggacatccgaaagcggaact

SEQ ID NO: 48719 - DNA, 25 bp, mus musculus
gttttcatccgtgcctctgtcgaac

SEQ ID NO: 48720 - DNA, 25 bp, mus musculus
gacatgccttgatgccagccacatt

SEQ ID NO: 48721 - DNA, 25 bp, mus musculus
ccttgatgccagccacattctacct

SEQ ID NO: 48722 - DNA, 25 bp, mus musculus
tgccagccacattctacctggactg

SEQ ID NO: 48723 - DNA, 25 bp, mus musculus
ccacattctacctggactgaggtgc

SEQ ID NO: 48724 - DNA, 25 bp, mus musculus
cctgctcaggtgctatgtcccaaga

SEQ ID NO: 48725 - DNA, 25 bp, mus musculus
caggtgctatgtcccaagagccata

SEQ ID NO: 48726 - DNA, 25 bp, mus musculus
gaatctgccttgagattaacttctc

SEQ ID NO: 48727 - DNA, 25 bp, mus musculus
ctttccattcacccagtggtgccct

SEQ ID NO: 48728 - DNA, 25 bp, mus musculus
tatttctctagtgctaggtgggcac

SEQ ID NO: 48729 - DNA, 25 bp, mus musculus
tctagtgctaggtgggcacagcagg

SEQ ID NO: 48730 - DNA, 25 bp, mus musculus
gtcgaactgccccggaagatcctca

SEQ ID NO: 48731 - DNA, 25 bp, mus musculus
cggaagatcctcagctgagtagagc

SEQ ID NO: 48732 - DNA, 25 bp, mus musculus
gtagagccttgtggcttcaagtggg

SEQ ID NO: 48733 - DNA, 25 bp, mus musculus
ggccggacctccttacagcttcttg

SEQ ID NO: 48734 - DNA, 25 bp, mus musculus
ttacagcttcttgggcctaggatgt

SEQ ID NO: 48735 - DNA, 25 bp, mus musculus
gtgcctccaattggtgcttcagccc

SEQ ID NO: 48736 - DNA, 25 bp, mus musculus
ccaattggtgcttcagccctggccc

SEQ ID NO: 48737 - DNA, 25 bp, mus musculus
gaaacacgatcccagggcctgtctc

SEQ ID NO: 48738 - DNA, 25 bp, mus musculus
agaatttctctacgtttatgcgaat

SEQ ID NO: 48739 - DNA, 25 bp, mus musculus
tctctacgtttatgcgaatcaatta

SEQ ID NO: 48740 - DNA, 25 bp, mus musculus
tacttctgagtctgcagattcatct

SEQ ID NO: 48741 - DNA, 25 bp, mus musculus
acttctgagtctgcagattcatctg

SEQ ID NO: 48742 - DNA, 25 bp, mus musculus
cttctgagtctgcagattcatctga

SEQ ID NO: 48743 - DNA, 25 bp, mus musculus
ttctgagtctgcagattcatctgac

SEQ ID NO: 48744 - DNA, 25 bp, mus musculus
agattcatctgactctgcaatggtg

SEQ ID NO: 48745 - DNA, 25 bp, mus musculus
gattcatctgactctgcaatggtgg

SEQ ID NO: 48746 - DNA, 25 bp, mus musculus
attcatctgactctgcaatggtggc

SEQ ID NO: 48747 - DNA, 25 bp, mus musculus
ttcatctgactctgcaatggtggct

SEQ ID NO: 48748 - DNA, 25 bp, mus musculus
tcatctgactctgcaatggtggcta

SEQ ID NO: 48749 - DNA, 25 bp, mus musculus
catctgactctgcaatggtggctac

SEQ ID NO: 48750 - DNA, 25 bp, mus musculus
ctctacgtttatgcgaatcaattac

SEQ ID NO: 48751 - DNA, 25 bp, mus musculus
atctgactctgcaatggtggctacc

SEQ ID NO: 48752 - DNA, 25 bp, mus musculus
aatcaattacttctgagtctgcaga

SEQ ID NO: 48753 - DNA, 25 bp, mus musculus
atcaattacttctgagtctgcagat

SEQ ID NO: 48754 - DNA, 25 bp, mus musculus
tcaattacttctgagtctgcagatt

SEQ ID NO: 48755 - DNA, 25 bp, mus musculus
caattacttctgagtctgcagattc

SEQ ID NO: 48756 - DNA, 25 bp, mus musculus
aattacttctgagtctgcagattca

SEQ ID NO: 48757 - DNA, 25 bp, mus musculus
attacttctgagtctgcagattcat

SEQ ID NO: 48758 - DNA, 25 bp, mus musculus
ttacttctgagtctgcagattcatc

SEQ ID NO: 48759 - DNA, 25 bp, mus musculus
aacatatacctaataaggcagtgca

SEQ ID NO: 48760 - DNA, 25 bp, mus musculus
atatacctaataaggcagtgcatat

SEQ ID NO: 48761 - DNA, 25 bp, mus musculus
atgattttgccactgtacaagttga

SEQ ID NO: 48762 - DNA, 25 bp, mus musculus
attttgccactgtacaagttgacca

SEQ ID NO: 48763 - DNA, 25 bp, mus musculus
ttgccactgtacaagttgaccattt

SEQ ID NO: 48764 - DNA, 25 bp, mus musculus
tacaagttgaccatttctggggctc

SEQ ID NO: 48765 - DNA, 25 bp, mus musculus
aagttgaccatttctggggctcgat

SEQ ID NO: 48766 - DNA, 25 bp, mus musculus
ttcttaatctcatcttctactgcat

SEQ ID NO: 48767 - DNA, 25 bp, mus musculus
ttaatctcatcttctactgcattga

SEQ ID NO: 48768 - DNA, 25 bp, mus musculus
atctcatcttctactgcattgactc

SEQ ID NO: 48769 - DNA, 25 bp, mus musculus
tcttctactgcattgactccctcgg

SEQ ID NO: 48770 - DNA, 25 bp, mus musculus
actgcattgactccctcggcctgtg

SEQ ID NO: 48771 - DNA, 25 bp, mus musculus
gtgaagcttccgtcacaaatcgcca

SEQ ID NO: 48772 - DNA, 25 bp, mus musculus
ttgactccctcggcctgtggattct

SEQ ID NO: 48773 - DNA, 25 bp, mus musculus
aagcttccgtcacaaatcgccacct

SEQ ID NO: 48774 - DNA, 25 bp, mus musculus
aatttatacaacaaacagcctagag

SEQ ID NO: 48775 - DNA, 25 bp, mus musculus
ttatacaacaaacagcctagagccc

SEQ ID NO: 48776 - DNA, 25 bp, mus musculus
tacaacaaacagcctagagcccaaa

SEQ ID NO: 48777 - DNA, 25 bp, mus musculus
cagcctagagcccaaatatctgcct

SEQ ID NO: 48778 - DNA, 25 bp, mus musculus
gcccaaatatctgccttcgtagtga

SEQ ID NO: 48779 - DNA, 25 bp, mus musculus
atatctgccttcgtagtgatgattt

SEQ ID NO: 48780 - DNA, 25 bp, mus musculus
tgcccttcgccatgtacaccttcgt

SEQ ID NO: 48781 - DNA, 25 bp, mus musculus
accttcgtggtgcgcgacgagaata

SEQ ID NO: 48782 - DNA, 25 bp, mus musculus
acccgaggttcaacctgatgctggg

SEQ ID NO: 48783 - DNA, 25 bp, mus musculus
cgactgcccttcgggagactagcgt

SEQ ID NO: 48784 - DNA, 25 bp, mus musculus
gactgcccttcgggagactagcgtg

SEQ ID NO: 48785 - DNA, 25 bp, mus musculus
ctgcccttcgggagactagcgtggc

SEQ ID NO: 48786 - DNA, 25 bp, mus musculus
tgcccttcgggagactagcgtggcg

SEQ ID NO: 48787 - DNA, 25 bp, mus musculus
agactagcgtggcgactccatggag

SEQ ID NO: 48788 - DNA, 25 bp, mus musculus
gactagcgtggcgactccatggagt

SEQ ID NO: 48789 - DNA, 25 bp, mus musculus
ctagcgtggcgactccatggagtgg

SEQ ID NO: 48790 - DNA, 25 bp, mus musculus
cgactccatggagtggtggttggaa

SEQ ID NO: 48791 - DNA, 25 bp, mus musculus
tccatggagtggtggttggaagact

SEQ ID NO: 48792 - DNA, 25 bp, mus musculus
tcgtggtgcgcgacgagaatagcag

SEQ ID NO: 48793 - DNA, 25 bp, mus musculus
ctgctggccaccggctactggaaga

SEQ ID NO: 48794 - DNA, 25 bp, mus musculus
tgctggccaccggctactggaagag

SEQ ID NO: 48795 - DNA, 25 bp, mus musculus
ctggccaccggctactggaagaggc

SEQ ID NO: 48796 - DNA, 25 bp, mus musculus
tggccaccggctactggaagaggct

SEQ ID NO: 48797 - DNA, 25 bp, mus musculus
gccaccggctactggaagaggctac

SEQ ID NO: 48798 - DNA, 25 bp, mus musculus
gagacaacccgaggttcaacctgat

SEQ ID NO: 48799 - DNA, 25 bp, mus musculus
gacaacccgaggttcaacctgatgc

SEQ ID NO: 48800 - DNA, 25 bp, mus musculus
gttcagattgctgccctctgcctgt

SEQ ID NO: 48801 - DNA, 25 bp, mus musculus
cagattgctgccctctgcctgtctg

SEQ ID NO: 48802 - DNA, 25 bp, mus musculus
cctccaactctggcctggcaaaggc

SEQ ID NO: 48803 - DNA, 25 bp, mus musculus
ccaactctggcctggcaaaggcctg

SEQ ID NO: 48804 - DNA, 25 bp, mus musculus
actctggcctggcaaaggcctgaag

SEQ ID NO: 48805 - DNA, 25 bp, mus musculus
ctggcctggcaaaggcctgaaggtg

SEQ ID NO: 48806 - DNA, 25 bp, mus musculus
cctcctgggaaggcatgcctcagcc

SEQ ID NO: 48807 - DNA, 25 bp, mus musculus
aaggcatgcctcagcctggggtaga

SEQ ID NO: 48808 - DNA, 25 bp, mus musculus
gcatgcctcagcctggggtagaggt

SEQ ID NO: 48809 - DNA, 25 bp, mus musculus
tcctgggctaggcagctgggagcca

SEQ ID NO: 48810 - DNA, 25 bp, mus musculus
cctgggctaggcagctgggagccaa

SEQ ID NO: 48811 - DNA, 25 bp, mus musculus
ctaggcagctgggagccaaagttga

SEQ ID NO: 48812 - DNA, 25 bp, mus musculus
cccagtacacgaggctgccttcaaa

SEQ ID NO: 48813 - DNA, 25 bp, mus musculus
agtacacgaggctgccttcaaaggc

SEQ ID NO: 48814 - DNA, 25 bp, mus musculus
ggctgccttcaaaggcccctactgg

SEQ ID NO: 48815 - DNA, 25 bp, mus musculus
cccctactggtttaatagctgctga

SEQ ID NO: 48816 - DNA, 25 bp, mus musculus
tgccgccctttgctgtgtgggcagt

SEQ ID NO: 48817 - DNA, 25 bp, mus musculus
cctttgctgtgtgggcagtactctg

SEQ ID NO: 48818 - DNA, 25 bp, mus musculus
cagtactctgaagcaggcaaatggg

SEQ ID NO: 48819 - DNA, 25 bp, mus musculus
tactctgaagcaggcaaatgggtct

SEQ ID NO: 48820 - DNA, 25 bp, mus musculus
ggtgatgcccacaatcagcgtcatg

SEQ ID NO: 48821 - DNA, 25 bp, mus musculus
gatgcccacaatcagcgtcatgaga

SEQ ID NO: 48822 - DNA, 25 bp, mus musculus
atcacgaaaggcctgttcatagaag

SEQ ID NO: 48823 - DNA, 25 bp, mus musculus
gaggacactatagtctccgatgcgc

SEQ ID NO: 48824 - DNA, 25 bp, mus musculus
gacactatagtctccgatgcgcacc

SEQ ID NO: 48825 - DNA, 25 bp, mus musculus
actatagtctccgatgcgcaccatg

SEQ ID NO: 48826 - DNA, 25 bp, mus musculus
atagtctccgatgcgcaccatgagc

SEQ ID NO: 48827 - DNA, 25 bp, mus musculus
gtctccgatgcgcaccatgagcttc

SEQ ID NO: 48828 - DNA, 25 bp, mus musculus
tccgatgcgcaccatgagcttctcc

SEQ ID NO: 48829 - DNA, 25 bp, mus musculus
caccatgagcttctccagcttctct

SEQ ID NO: 48830 - DNA, 25 bp, mus musculus
catgagcttctccagcttctctgtc

SEQ ID NO: 48831 - DNA, 25 bp, mus musculus
gagcttctccagcttctctgtcttg

SEQ ID NO: 48832 - DNA, 25 bp, mus musculus
gcccacaatcagcgtcatgagatac

SEQ ID NO: 48833 - DNA, 25 bp, mus musculus
cttctctgtcttggtgccgtcatgc

SEQ ID NO: 48834 - DNA, 25 bp, mus musculus
cacaatcagcgtcatgagatacttg

SEQ ID NO: 48835 - DNA, 25 bp, mus musculus
tgtaaagtctgggctcatggtcggg

SEQ ID NO: 48836 - DNA, 25 bp, mus musculus
ggcataactcttgcagctctgggcc

SEQ ID NO: 48837 - DNA, 25 bp, mus musculus
ataactcttgcagctctgggccacc

SEQ ID NO: 48838 - DNA, 25 bp, mus musculus
actcttgcagctctgggccacccag

SEQ ID NO: 48839 - DNA, 25 bp, mus musculus
ctcccactgatcacgaaaggcctgt

SEQ ID NO: 48840 - DNA, 25 bp, mus musculus
ccactgatcacgaaaggcctgttca

SEQ ID NO: 48841 - DNA, 25 bp, mus musculus
ggctccatggctgactagaagttta

SEQ ID NO: 48842 - DNA, 25 bp, mus musculus
ttcaaaatgtccggctcccgcagca

SEQ ID NO: 48843 - DNA, 25 bp, mus musculus
ctgcacacggtagtgttctaacagc

SEQ ID NO: 48844 - DNA, 25 bp, mus musculus
gtgttctaacagcaagcgcaccacc

SEQ ID NO: 48845 - DNA, 25 bp, mus musculus
ttctaacagcaagcgcaccaccttg

SEQ ID NO: 48846 - DNA, 25 bp, mus musculus
taacagcaagcgcaccaccttggcg

SEQ ID NO: 48847 - DNA, 25 bp, mus musculus
caccaccttggcgtgcccattgcgg

SEQ ID NO: 48848 - DNA, 25 bp, mus musculus
actgacatagcccagcaggtagcgg

SEQ ID NO: 48849 - DNA, 25 bp, mus musculus
gacatagcccagcaggtagcggata

SEQ ID NO: 48850 - DNA, 25 bp, mus musculus
atagcccagcaggtagcggatatcg

SEQ ID NO: 48851 - DNA, 25 bp, mus musculus
gatatcgctctctgaccggttaagg

SEQ ID NO: 48852 - DNA, 25 bp, mus musculus
gctctctgaccggttaaggagcaag

SEQ ID NO: 48853 - DNA, 25 bp, mus musculus
cgcagcacaccaaagagcagtggca

SEQ ID NO: 48854 - DNA, 25 bp, mus musculus
agcacaccaaagagcagtggcaccg

SEQ ID NO: 48855 - DNA, 25 bp, mus musculus
aagagcagtggcaccgtcaatgaca

SEQ ID NO: 48856 - DNA, 25 bp, mus musculus
agcagtggcaccgtcaatgacatac

SEQ ID NO: 48857 - DNA, 25 bp, mus musculus
agtggcaccgtcaatgacatacccg

SEQ ID NO: 48858 - DNA, 25 bp, mus musculus
accgtcaatgacatacccgtcgaag

SEQ ID NO: 48859 - DNA, 25 bp, mus musculus
ctgctgggtctgcacacggtagtgt

SEQ ID NO: 48860 - DNA, 25 bp, mus musculus
ctgggtctgcacacggtagtgttct

SEQ ID NO: 48861 - DNA, 25 bp, mus musculus
gcttatgattccaaggcagatgaac

SEQ ID NO: 48862 - DNA, 25 bp, mus musculus
gatgaacctgtacatccccaaattc

SEQ ID NO: 48863 - DNA, 25 bp, mus musculus
caaggccatgctgcaactggatgaa

SEQ ID NO: 48864 - DNA, 25 bp, mus musculus
tgtgctgcctgctgccaccaatggc

SEQ ID NO: 48865 - DNA, 25 bp, mus musculus
ctccgaatcattcaccctcaagtac

SEQ ID NO: 48866 - DNA, 25 bp, mus musculus
caagtacaacaggcccttcatcttc

SEQ ID NO: 48867 - DNA, 25 bp, mus musculus
gcccttcatcttcctggcctttgac

SEQ ID NO: 48868 - DNA, 25 bp, mus musculus
catcttcctggcctttgacaagtac

SEQ ID NO: 48869 - DNA, 25 bp, mus musculus
cctggcctttgacaagtacacatgg

SEQ ID NO: 48870 - DNA, 25 bp, mus musculus
aaaccatggtgccatctgactttga

SEQ ID NO: 48871 - DNA, 25 bp, mus musculus
tggtgccatctgactttgagagcat

SEQ ID NO: 48872 - DNA, 25 bp, mus musculus
catctgactttgagagcatagaagt

SEQ ID NO: 48873 - DNA, 25 bp, mus musculus
catccccaaattctccatgtctgat

SEQ ID NO: 48874 - DNA, 25 bp, mus musculus
ctccatgtctgatacctatgacctt

SEQ ID NO: 48875 - DNA, 25 bp, mus musculus
gtctgatacctatgaccttcaagat

SEQ ID NO: 48876 - DNA, 25 bp, mus musculus
tgaccttcaagatgtgctggcagat

SEQ ID NO: 48877 - DNA, 25 bp, mus musculus
tcaagatgtgctggcagatgtgggc

SEQ ID NO: 48878 - DNA, 25 bp, mus musculus
tgtgctggcagatgtgggcattaag

SEQ ID NO: 48879 - DNA, 25 bp, mus musculus
gttcaccaaccaatctgatttcgca

SEQ ID NO: 48880 - DNA, 25 bp, mus musculus
aacggtactccacaaggccatgctg

SEQ ID NO: 48881 - DNA, 25 bp, mus musculus
aacttcccagccaggaatccattgg

SEQ ID NO: 48882 - DNA, 25 bp, mus musculus
cttcccagccaggaatccattgggt

SEQ ID NO: 48883 - DNA, 25 bp, mus musculus
ttgcctactccgaagtctatgacat

SEQ ID NO: 48884 - DNA, 25 bp, mus musculus
ggattttgccaataatccgaggctt

SEQ ID NO: 48885 - DNA, 25 bp, mus musculus
attttgccaataatccgaggcttgt

SEQ ID NO: 48886 - DNA, 25 bp, mus musculus
ttgccaataatccgaggcttgtaga

SEQ ID NO: 48887 - DNA, 25 bp, mus musculus
tgccaataatccgaggcttgtagat

SEQ ID NO: 48888 - DNA, 25 bp, mus musculus
ccaataatccgaggcttgtagattg

SEQ ID NO: 48889 - DNA, 25 bp, mus musculus
caataatccgaggcttgtagattgc

SEQ ID NO: 48890 - DNA, 25 bp, mus musculus
taatccgaggcttgtagattgccca

SEQ ID NO: 48891 - DNA, 25 bp, mus musculus
gcttgtagattgcccagtgtgtaaa

SEQ ID NO: 48892 - DNA, 25 bp, mus musculus
tgtagattgcccagtgtgtaaaagg

SEQ ID NO: 48893 - DNA, 25 bp, mus musculus
ttcccagccaggaatccattgggtt

SEQ ID NO: 48894 - DNA, 25 bp, mus musculus
ccagccaggaatccattgggttggc

SEQ ID NO: 48895 - DNA, 25 bp, mus musculus
agccaggaatccattgggttggccg

SEQ ID NO: 48896 - DNA, 25 bp, mus musculus
gaatccattgggttggccgactgtc

SEQ ID NO: 48897 - DNA, 25 bp, mus musculus
aatccattgggttggccgactgtct

SEQ ID NO: 48898 - DNA, 25 bp, mus musculus
ccattgggttggccgactgtctcac

SEQ ID NO: 48899 - DNA, 25 bp, mus musculus
taaagagttgcctactccgaagtct

SEQ ID NO: 48900 - DNA, 25 bp, mus musculus
agagttgcctactccgaagtctatg

SEQ ID NO: 48901 - DNA, 25 bp, mus musculus
catgtgactgtgaccagcagatcga

SEQ ID NO: 48902 - DNA, 25 bp, mus musculus
accagcagatcgacagctgtaccta

SEQ ID NO: 48903 - DNA, 25 bp, mus musculus
caccgcagctctcaagtgagattga

SEQ ID NO: 48904 - DNA, 25 bp, mus musculus
agattgaacgcctcatgagtcaggg

SEQ ID NO: 48905 - DNA, 25 bp, mus musculus
aacgcctcatgagtcagggctattc

SEQ ID NO: 48906 - DNA, 25 bp, mus musculus
gtcagggctattcctaccaggacat

SEQ ID NO: 48907 - DNA, 25 bp, mus musculus
gctattcctaccaggacattcagaa

SEQ ID NO: 48908 - DNA, 25 bp, mus musculus
cctaccaggacattcagaaagcttt

SEQ ID NO: 48909 - DNA, 25 bp, mus musculus
aagctttggtcattgcccacaacaa

SEQ ID NO: 48910 - DNA, 25 bp, mus musculus
tggtcattgcccacaacaacattga

SEQ ID NO: 48911 - DNA, 25 bp, mus musculus
ttgcccacaacaacattgagatggc

SEQ ID NO: 48912 - DNA, 25 bp, mus musculus
tttcttctcctgctcacgtagccac

SEQ ID NO: 48913 - DNA, 25 bp, mus musculus
agatcgacagctgtacctatgaagc

SEQ ID NO: 48914 - DNA, 25 bp, mus musculus
cccaagcactgtctgtagcagaaaa

SEQ ID NO: 48915 - DNA, 25 bp, mus musculus
ggaatctggccacagctcacacgag

SEQ ID NO: 48916 - DNA, 25 bp, mus musculus
tggccacagctcacacgagtactgg

SEQ ID NO: 48917 - DNA, 25 bp, mus musculus
ccctgtctgacatctccaatgccag

SEQ ID NO: 48918 - DNA, 25 bp, mus musculus
tgtctttggatggtgaccctacaaa

SEQ ID NO: 48919 - DNA, 25 bp, mus musculus
cattccctcggagaatcaactcaga

SEQ ID NO: 48920 - DNA, 25 bp, mus musculus
aagccagtagctatcaacaaggcgg

SEQ ID NO: 48921 - DNA, 25 bp, mus musculus
gtgcagttccaccaaggcttcggtg

SEQ ID NO: 48922 - DNA, 25 bp, mus musculus
ttccaccaaggcttcggtgacctgg

SEQ ID NO: 48923 - DNA, 25 bp, mus musculus
acgcagacgggtatccagcgtggaa

SEQ ID NO: 48924 - DNA, 25 bp, mus musculus
cagacgggtatccagcgtggaacta

SEQ ID NO: 48925 - DNA, 25 bp, mus musculus
ggtatccagcgtggaactaagaaca

SEQ ID NO: 48926 - DNA, 25 bp, mus musculus
actaagaacaattacccgatgagag

SEQ ID NO: 48927 - DNA, 25 bp, mus musculus
aattacccgatgagagctgcccctg

SEQ ID NO: 48928 - DNA, 25 bp, mus musculus
cccccaggatgccatcaaaacggag

SEQ ID NO: 48929 - DNA, 25 bp, mus musculus
ccaggatgccatcaaaacggagtca

SEQ ID NO: 48930 - DNA, 25 bp, mus musculus
catgcctttggaaaccagaggtcca

SEQ ID NO: 48931 - DNA, 25 bp, mus musculus
tccaatcagaaaagcctgtacacct

SEQ ID NO: 48932 - DNA, 25 bp, mus musculus
cagaaaagcctgtacacctctatgg

SEQ ID NO: 48933 - DNA, 25 bp, mus musculus
caccaaggcttcggtgacctggcta

SEQ ID NO: 48934 - DNA, 25 bp, mus musculus
ttcggtgacctggctatcctcaagc

SEQ ID NO: 48935 - DNA, 25 bp, mus musculus
ggtgacctggctatcctcaagccca

SEQ ID NO: 48936 - DNA, 25 bp, mus musculus
gctatcctcaagcccagcaacaaag

SEQ ID NO: 48937 - DNA, 25 bp, mus musculus
aaagtgctgcaggtcagcatcggac

SEQ ID NO: 48938 - DNA, 25 bp, mus musculus
caggtcagcatcggacccgggctgc

SEQ ID NO: 48939 - DNA, 25 bp, mus musculus
agaagaaacaccgtcaccacgcaga

SEQ ID NO: 48940 - DNA, 25 bp, mus musculus
accacgcagacgggtatccagcgtg

SEQ ID NO: 48941 - DNA, 25 bp, mus musculus
cgacaactttatctttggtcagagt

SEQ ID NO: 48942 - DNA, 25 bp, mus musculus
gacaactttatctttggtcagagtg

SEQ ID NO: 48943 - DNA, 25 bp, mus musculus
gtggactcagtcctagatgtcgtgc

SEQ ID NO: 48944 - DNA, 25 bp, mus musculus
tggactcagtcctagatgtcgtgcg

SEQ ID NO: 48945 - DNA, 25 bp, mus musculus
ggactcagtcctagatgtcgtgcgg

SEQ ID NO: 48946 - DNA, 25 bp, mus musculus
actcagtcctagatgtcgtgcggaa

SEQ ID NO: 48947 - DNA, 25 bp, mus musculus
agaattgtgactgcctgcagggctt

SEQ ID NO: 48948 - DNA, 25 bp, mus musculus
ttccagttgacacactcactgggtt

SEQ ID NO: 48949 - DNA, 25 bp, mus musculus
tccagttgacacactcactgggttg

SEQ ID NO: 48950 - DNA, 25 bp, mus musculus
gggcacagctcaggcatgggcacac

SEQ ID NO: 48951 - DNA, 25 bp, mus musculus
ggcacagctcaggcatgggcacact

SEQ ID NO: 48952 - DNA, 25 bp, mus musculus
cacagctcaggcatgggcacactgc

SEQ ID NO: 48953 - DNA, 25 bp, mus musculus
acaactttatctttggtcagagtgg

SEQ ID NO: 48954 - DNA, 25 bp, mus musculus
caactttatctttggtcagagtggt

SEQ ID NO: 48955 - DNA, 25 bp, mus musculus
ttatctttggtcagagtggtgctgg

SEQ ID NO: 48956 - DNA, 25 bp, mus musculus
atctttggtcagagtggtgctggca

SEQ ID NO: 48957 - DNA, 25 bp, mus musculus
ctttggtcagagtggtgctggcaac

SEQ ID NO: 48958 - DNA, 25 bp, mus musculus
tgctggcaacaactgggccaaaggg

SEQ ID NO: 48959 - DNA, 25 bp, mus musculus
caactgggccaaagggcactatacg

SEQ ID NO: 48960 - DNA, 25 bp, mus musculus
ggtggactcagtcctagatgtcgtg

SEQ ID NO: 48961 - DNA, 25 bp, mus musculus
gccacggccgcatcggtaagcaccg

SEQ ID NO: 48962 - DNA, 25 bp, mus musculus
gcatcggtaagcaccgcaagcaccc

SEQ ID NO: 48963 - DNA, 25 bp, mus musculus
aaactggagttgctcccatcattga

SEQ ID NO: 48964 - DNA, 25 bp, mus musculus
ttgctcccatcattgatgttgttcg

SEQ ID NO: 48965 - DNA, 25 bp, mus musculus
ctcccatcattgatgttgttcgatc

SEQ ID NO: 48966 - DNA, 25 bp, mus musculus
atgttgttcgatcaggctactacaa

SEQ ID NO: 48967 - DNA, 25 bp, mus musculus
caggctactacaaagttctgggcaa

SEQ ID NO: 48968 - DNA, 25 bp, mus musculus
gctactacaaagttctgggcaaggg

SEQ ID NO: 48969 - DNA, 25 bp, mus musculus
ctaagcaacctgtcatcgtgaaggc

SEQ ID NO: 48970 - DNA, 25 bp, mus musculus
ctgtcatcgtgaaggccaaattctt

SEQ ID NO: 48971 - DNA, 25 bp, mus musculus
ccaaattcttcagcagaagagctga

SEQ ID NO: 48972 - DNA, 25 bp, mus musculus
aattcttcagcagaagagctgagga

SEQ ID NO: 48973 - DNA, 25 bp, mus musculus
tcggtaagcaccgcaagcacccaag

SEQ ID NO: 48974 - DNA, 25 bp, mus musculus
gtaagcaccgcaagcacccaagcgg

SEQ ID NO: 48975 - DNA, 25 bp, mus musculus
tgcggcattaccacttgaagaggaa

SEQ ID NO: 48976 - DNA, 25 bp, mus musculus
ggcattaccacttgaagaggaacca

SEQ ID NO: 48977 - DNA, 25 bp, mus musculus
accagagcttctgcccaacagtcaa

SEQ ID NO: 48978 - DNA, 25 bp, mus musculus
agagcttctgcccaacagtcaactt

SEQ ID NO: 48979 - DNA, 25 bp, mus musculus
tctgcccaacagtcaacttggataa

SEQ ID NO: 48980 - DNA, 25 bp, mus musculus
aaccgtggacattggtcagcgagca

SEQ ID NO: 48981 - DNA, 25 bp, mus musculus
ggtaacaaccgagccaagatgttgc

SEQ ID NO: 48982 - DNA, 25 bp, mus musculus
ttgcggaatctgctggcccttcgtc

SEQ ID NO: 48983 - DNA, 25 bp, mus musculus
gttcatctgaaaggcggggcatctg

SEQ ID NO: 48984 - DNA, 25 bp, mus musculus
catctgaaaggcggggcatctgatg

SEQ ID NO: 48985 - DNA, 25 bp, mus musculus
tctgatgcctcctctacagagccac

SEQ ID NO: 48986 - DNA, 25 bp, mus musculus
gcctcctctacagagccacaatggc

SEQ ID NO: 48987 - DNA, 25 bp, mus musculus
tctacagagccacaatggctctgac

SEQ ID NO: 48988 - DNA, 25 bp, mus musculus
acagagccacaatggctctgacgct

SEQ ID NO: 48989 - DNA, 25 bp, mus musculus
caatggctctgacgcttggtggcac

SEQ ID NO: 48990 - DNA, 25 bp, mus musculus
tggctctgacgcttggtggcacagc

SEQ ID NO: 48991 - DNA, 25 bp, mus musculus
cgcttggtggcacagctatgccatc

SEQ ID NO: 48992 - DNA, 25 bp, mus musculus
gtggcacagctatgccatctatctg

SEQ ID NO: 48993 - DNA, 25 bp, mus musculus
cggaatctgctggcccttcgtcaga

SEQ ID NO: 48994 - DNA, 25 bp, mus musculus
aatctgctggcccttcgtcagattg

SEQ ID NO: 48995 - DNA, 25 bp, mus musculus
gcccttcgtcagattgcccagagga

SEQ ID NO: 48996 - DNA, 25 bp, mus musculus
cttcgtcagattgcccagaggacca

SEQ ID NO: 48997 - DNA, 25 bp, mus musculus
cagattgcccagaggaccatcagca

SEQ ID NO: 48998 - DNA, 25 bp, mus musculus
gcccagaggaccatcagcaccactt

SEQ ID NO: 48999 - DNA, 25 bp, mus musculus
aggaccatcagcaccacttcacgaa

SEQ ID NO: 49000 - DNA, 25 bp, mus musculus
ccagttcatctgaaaggcggggcat

SEQ ID NO: 49001 - DNA, 25 bp, mus musculus
cggcacaggttccggtctggtggct

SEQ ID NO: 49002 - DNA, 25 bp, mus musculus
ggcacaggttccggtctggtggctt

SEQ ID NO: 49003 - DNA, 25 bp, mus musculus
gcacaggttccggtctggtggcttt

SEQ ID NO: 49004 - DNA, 25 bp, mus musculus
tctggtggctttcgatttttggcgt

SEQ ID NO: 49005 - DNA, 25 bp, mus musculus
tggctttcgatttttggcgttcagt

SEQ ID NO: 49006 - DNA, 25 bp, mus musculus
ttcgatttttggcgttcagtagtcg

SEQ ID NO: 49007 - DNA, 25 bp, mus musculus
gatttttggcgttcagtagtcgcgg

SEQ ID NO: 49008 - DNA, 25 bp, mus musculus
tgggtaacaaccgagccaagatgtt

SEQ ID NO: 49009 - DNA, 25 bp, mus musculus
cggcacaggttccggtctggtggct

SEQ ID NO: 49010 - DNA, 25 bp, mus musculus
ggcacaggttccggtctggtggctt

SEQ ID NO: 49011 - DNA, 25 bp, mus musculus
gcacaggttccggtctggtggcttt

SEQ ID NO: 49012 - DNA, 25 bp, mus musculus
tctggtggctttcgatttttggcgt

SEQ ID NO: 49013 - DNA, 25 bp, mus musculus
tggctttcgatttttggcgttcagt

SEQ ID NO: 49014 - DNA, 25 bp, mus musculus
ttcgatttttggcgttcagtagtcg

SEQ ID NO: 49015 - DNA, 25 bp, mus musculus
gatttttggcgttcagtagtcgcgg

SEQ ID NO: 49016 - DNA, 25 bp, mus musculus
tgggtaacaaccgagccaagatgtt

SEQ ID NO: 49017 - DNA, 25 bp, mus musculus
ttcattccagaatgcaatgatgacg

SEQ ID NO: 49018 - DNA, 25 bp, mus musculus
tcattccagaatgcaatgatgacgg

SEQ ID NO: 49019 - DNA, 25 bp, mus musculus
cagtgtcacagctacacaggatact

SEQ ID NO: 49020 - DNA, 25 bp, mus musculus
agtgtcacagctacacaggatactg

SEQ ID NO: 49021 - DNA, 25 bp, mus musculus
tgtcacagctacacaggatactgtt

SEQ ID NO: 49022 - DNA, 25 bp, mus musculus
gtcacagctacacaggatactgttg

SEQ ID NO: 49023 - DNA, 25 bp, mus musculus
cacagctacacaggatactgttggt

SEQ ID NO: 49024 - DNA, 25 bp, mus musculus
agctacacaggatactgttggtgtg

SEQ ID NO: 49025 - DNA, 25 bp, mus musculus
gctacacaggatactgttggtgtgt

SEQ ID NO: 49026 - DNA, 25 bp, mus musculus
acacaggatactgttggtgtgttac

SEQ ID NO: 49027 - DNA, 25 bp, mus musculus
tgtgttacaccaaatggaagaccca

SEQ ID NO: 49028 - DNA, 25 bp, mus musculus
acaccaaatggaagacccatcagtg

SEQ ID NO: 49029 - DNA, 25 bp, mus musculus
aatgatgacggcacctacagtcagg

SEQ ID NO: 49030 - DNA, 25 bp, mus musculus
aaatggaagacccatcagtggcact

SEQ ID NO: 49031 - DNA, 25 bp, mus musculus
gatgacggcacctacagtcaggtcc

SEQ ID NO: 49032 - DNA, 25 bp, mus musculus
tacagtcaggtccagtgtcacagct

SEQ ID NO: 49033 - DNA, 25 bp, mus musculus
acagtcaggtccagtgtcacagcta

SEQ ID NO: 49034 - DNA, 25 bp, mus musculus
agtcaggtccagtgtcacagctaca

SEQ ID NO: 49035 - DNA, 25 bp, mus musculus
caggtccagtgtcacagctacacag

SEQ ID NO: 49036 - DNA, 25 bp, mus musculus
aggtccagtgtcacagctacacagg

SEQ ID NO: 49037 - DNA, 25 bp, mus musculus
tccagtgtcacagctacacaggata

SEQ ID NO: 49038 - DNA, 25 bp, mus musculus
ttttcaagtgaagcgacaggttctt

SEQ ID NO: 49039 - DNA, 25 bp, mus musculus
ggttcttctgagtgcggctgaagca

SEQ ID NO: 49040 - DNA, 25 bp, mus musculus
actctgggccagttcatagcaaagt

SEQ ID NO: 49041 - DNA, 25 bp, mus musculus
gaattgacctgtccatgatagcctt

SEQ ID NO: 49042 - DNA, 25 bp, mus musculus
acctgtccatgatagccttaagttt

SEQ ID NO: 49043 - DNA, 25 bp, mus musculus
tgtccatgatagccttaagtttgaa

SEQ ID NO: 49044 - DNA, 25 bp, mus musculus
ccatgatagccttaagtttgaacat

SEQ ID NO: 49045 - DNA, 25 bp, mus musculus
tgaacattagctgaccttctgtgtt

SEQ ID NO: 49046 - DNA, 25 bp, mus musculus
ttagctgaccttctgtgttaaacat

SEQ ID NO: 49047 - DNA, 25 bp, mus musculus
ttcattttccatacaattcagttga

SEQ ID NO: 49048 - DNA, 25 bp, mus musculus
attttccatacaattcagttgattt

SEQ ID NO: 49049 - DNA, 25 bp, mus musculus
atttacaagttcatttctcatactg

SEQ ID NO: 49050 - DNA, 25 bp, mus musculus
tcttctgagtgcggctgaagcagca

SEQ ID NO: 49051 - DNA, 25 bp, mus musculus
tctgagtgcggctgaagcagcagag

SEQ ID NO: 49052 - DNA, 25 bp, mus musculus
cattatcaaagcagcaccaaggaaa

SEQ ID NO: 49053 - DNA, 25 bp, mus musculus
ctgttaagcattcccatttgctgat

SEQ ID NO: 49054 - DNA, 25 bp, mus musculus
agcattcccatttgctgatgaactc

SEQ ID NO: 49055 - DNA, 25 bp, mus musculus
cccatttgctgatgaactctgggcc

SEQ ID NO: 49056 - DNA, 25 bp, mus musculus
atttgctgatgaactctgggccagt

SEQ ID NO: 49057 - DNA, 25 bp, mus musculus
tgaactctgggccagttcatagcaa

SEQ ID NO: 49058 - DNA, 25 bp, mus musculus
cctcgaagcctcggattctcctggt

SEQ ID NO: 49059 - DNA, 25 bp, mus musculus
cgaagcctcggattctcctggtcaa

SEQ ID NO: 49060 - DNA, 25 bp, mus musculus
tctcctggtcaactgaatgtctttg

SEQ ID NO: 49061 - DNA, 25 bp, mus musculus
ctcctggtcaactgaatgtctttgg

SEQ ID NO: 49062 - DNA, 25 bp, mus musculus
tcctggtcaactgaatgtctttggg

SEQ ID NO: 49063 - DNA, 25 bp, mus musculus
tcaactgaatgtctttggggaaaag

SEQ ID NO: 49064 - DNA, 25 bp, mus musculus
aaagcgttgaccgaccagcatgtaa

SEQ ID NO: 49065 - DNA, 25 bp, mus musculus
aagcgttgaccgaccagcatgtaag

SEQ ID NO: 49066 - DNA, 25 bp, mus musculus
agcgttgaccgaccagcatgtaagg

SEQ ID NO: 49067 - DNA, 25 bp, mus musculus
gcgttgaccgaccagcatgtaagga

SEQ ID NO: 49068 - DNA, 25 bp, mus musculus
aagcctcggattctcctggtcaact

SEQ ID NO: 49069 - DNA, 25 bp, mus musculus
ctcggattctcctggtcaactgaat

SEQ ID NO: 49070 - DNA, 25 bp, mus musculus
tcggattctcctggtcaactgaatg

SEQ ID NO: 49071 - DNA, 25 bp, mus musculus
cggattctcctggtcaactgaatgt

SEQ ID NO: 49072 - DNA, 25 bp, mus musculus
ggattctcctggtcaactgaatgtc

SEQ ID NO: 49073 - DNA, 25 bp, mus musculus
gattctcctggtcaactgaatgtct

SEQ ID NO: 49074 - DNA, 25 bp, mus musculus
attctcctggtcaactgaatgtctt

SEQ ID NO: 49075 - DNA, 25 bp, mus musculus
ttctcctggtcaactgaatgtcttt

SEQ ID NO: 49076 - DNA, 25 bp, mus musculus
ctccagttctcagccaccggtagtg

SEQ ID NO: 49077 - DNA, 25 bp, mus musculus
ccagttctcagccaccggtagtgtg

SEQ ID NO: 49078 - DNA, 25 bp, mus musculus
aattatgtaacctggagtgtgcttt

SEQ ID NO: 49079 - DNA, 25 bp, mus musculus
ttatgtaacctggagtgtgcttttc

SEQ ID NO: 49080 - DNA, 25 bp, mus musculus
atgtaacctggagtgtgcttttcca

SEQ ID NO: 49081 - DNA, 25 bp, mus musculus
gtaacctggagtgtgcttttccagt

SEQ ID NO: 49082 - DNA, 25 bp, mus musculus
ccagtggtggcacctttttgtcttg

SEQ ID NO: 49083 - DNA, 25 bp, mus musculus
tggtggcacctttttgtcttgagtt

SEQ ID NO: 49084 - DNA, 25 bp, mus musculus
agaacccaggtgttcagagggtgcg

SEQ ID NO: 49085 - DNA, 25 bp, mus musculus
gtgcgtctgcctggaatcaaagggt

SEQ ID NO: 49086 - DNA, 25 bp, mus musculus
gcgtctgcctggaatcaaagggtct

SEQ ID NO: 49087 - DNA, 25 bp, mus musculus
ttttgcagagttactgcatggttgt

SEQ ID NO: 49088 - DNA, 25 bp, mus musculus
agttctcagccaccggtagtgtgcg

SEQ ID NO: 49089 - DNA, 25 bp, mus musculus
ttctcagccaccggtagtgtgcgag

SEQ ID NO: 49090 - DNA, 25 bp, mus musculus
ctcagccaccggtagtgtgcgagca

SEQ ID NO: 49091 - DNA, 25 bp, mus musculus
cagccaccggtagtgtgcgagcagt

SEQ ID NO: 49092 - DNA, 25 bp, mus musculus
gccttccggctttgtcggatttcat

SEQ ID NO: 49093 - DNA, 25 bp, mus musculus
cggctttgtcggatttcatgaagtt

SEQ ID NO: 49094 - DNA, 25 bp, mus musculus
tttgttgtcttcaaacagaaattgt

SEQ ID NO: 49095 - DNA, 25 bp, mus musculus
ttgtcttcaaacagaaattgtgtcg

SEQ ID NO: 49096 - DNA, 25 bp, mus musculus
gagatctcctttggcactacaaaag

SEQ ID NO: 49097 - DNA, 25 bp, mus musculus
tctctccatgatgccctgtgtgtca

SEQ ID NO: 49098 - DNA, 25 bp, mus musculus
ggcatgaatcccattcagaccatga

SEQ ID NO: 49099 - DNA, 25 bp, mus musculus
aatcccattcagaccatgactgaag

SEQ ID NO: 49100 - DNA, 25 bp, mus musculus
attcagaccatgactgaagttcgag

SEQ ID NO: 49101 - DNA, 25 bp, mus musculus
gttcgagccagacaggtgaaggagt

SEQ ID NO: 49102 - DNA, 25 bp, mus musculus
attgactgtttgcacaagggcagta

SEQ ID NO: 49103 - DNA, 25 bp, mus musculus
tgtttgcacaagggcagtaacgata

SEQ ID NO: 49104 - DNA, 25 bp, mus musculus
cagcagatctctcttgccacccaga

SEQ ID NO: 49105 - DNA, 25 bp, mus musculus
cttgccacccagatggttaggatga

SEQ ID NO: 49106 - DNA, 25 bp, mus musculus
gatgacatccgtaagcctggagaat

SEQ ID NO: 49107 - DNA, 25 bp, mus musculus
actgtaccatttaccactgtgacta

SEQ ID NO: 49108 - DNA, 25 bp, mus musculus
catgatgccctgtgtgtcatccgga

SEQ ID NO: 49109 - DNA, 25 bp, mus musculus
gccctgtgtgtcatccggaacctca

SEQ ID NO: 49110 - DNA, 25 bp, mus musculus
tgtgtcatccggaacctcatccgtg

SEQ ID NO: 49111 - DNA, 25 bp, mus musculus
aacctcatccgtgacaaccgtgttg

SEQ ID NO: 49112 - DNA, 25 bp, mus musculus
gccgaaatatcctgcgccctggcag

SEQ ID NO: 49113 - DNA, 25 bp, mus musculus
atatcctgcgccctggcagtcagcc

SEQ ID NO: 49114 - DNA, 25 bp, mus musculus
gcagacaagtgcccaactttggaac

SEQ ID NO: 49115 - DNA, 25 bp, mus musculus
tttgcagatgccttggaggtcatcc

SEQ ID NO: 49116 - DNA, 25 bp, mus musculus
agagaggtccctacatgatgccatc

SEQ ID NO: 49117 - DNA, 25 bp, mus musculus
gtccctacatgatgccatcatgatt

SEQ ID NO: 49118 - DNA, 25 bp, mus musculus
catcgccgacaacttccaggcattt

SEQ ID NO: 49119 - DNA, 25 bp, mus musculus
cgacaacttccaggcatttgtgtgg

SEQ ID NO: 49120 - DNA, 25 bp, mus musculus
agccatggtgcgcatcaacgctctg

SEQ ID NO: 49121 - DNA, 25 bp, mus musculus
ggtgcgcatcaacgctctgacagca

SEQ ID NO: 49122 - DNA, 25 bp, mus musculus
agcttctgaggctgcatgccttatt

SEQ ID NO: 49123 - DNA, 25 bp, mus musculus
tgaggctgcatgccttattgtgtcc

SEQ ID NO: 49124 - DNA, 25 bp, mus musculus
ccttattgtgtccgtggatgagact

SEQ ID NO: 49125 - DNA, 25 bp, mus musculus
cactgtggatcctccagctccatca

SEQ ID NO: 49126 - DNA, 25 bp, mus musculus
tccatcagctggccgtggcagaggc

SEQ ID NO: 49127 - DNA, 25 bp, mus musculus
ggtctgctgggttctcactgaggtt

SEQ ID NO: 49128 - DNA, 25 bp, mus musculus
atatgccaaggccctggagattatt

SEQ ID NO: 49129 - DNA, 25 bp, mus musculus
acagctatgtgacaacgctggcttt

SEQ ID NO: 49130 - DNA, 25 bp, mus musculus
caacgctggctttgatgccacaaac

SEQ ID NO: 49131 - DNA, 25 bp, mus musculus
tgatgccacaaacatcctcaacaag

SEQ ID NO: 49132 - DNA, 25 bp, mus musculus
cacaaacatcctcaacaagctgcgg

SEQ ID NO: 49133 - DNA, 25 bp, mus musculus
caacaagctgcgggctcgacacgca

SEQ ID NO: 49134 - DNA, 25 bp, mus musculus
acacgcacagggaggtatgtggtat

SEQ ID NO: 49135 - DNA, 25 bp, mus musculus
tgagaacatcgccgacaacttccag

SEQ ID NO: 49136 - DNA, 25 bp, mus musculus
cgatgtcctgtccgggtcgttatgg

SEQ ID NO: 49137 - DNA, 25 bp, mus musculus
gtccgggtcgttatggtctctgctc

SEQ ID NO: 49138 - DNA, 25 bp, mus musculus
tatagttcattgtaccgctacacta

SEQ ID NO: 49139 - DNA, 25 bp, mus musculus
atagttcattgtaccgctacactaa

SEQ ID NO: 49140 - DNA, 25 bp, mus musculus
agttcattgtaccgctacactaatg

SEQ ID NO: 49141 - DNA, 25 bp, mus musculus
tcattgtaccgctacactaatgatt

SEQ ID NO: 49142 - DNA, 25 bp, mus musculus
cattgtaccgctacactaatgattc

SEQ ID NO: 49143 - DNA, 25 bp, mus musculus
tgtaccgctacactaatgattcccg

SEQ ID NO: 49144 - DNA, 25 bp, mus musculus
taccgctacactaatgattcccgtg

SEQ ID NO: 49145 - DNA, 25 bp, mus musculus
accgctacactaatgattcccgtgt

SEQ ID NO: 49146 - DNA, 25 bp, mus musculus
cgctacactaatgattcccgtgtct

SEQ ID NO: 49147 - DNA, 25 bp, mus musculus
tacactaatgattcccgtgtcttcg

SEQ ID NO: 49148 - DNA, 25 bp, mus musculus
gtcgttatggtctctgctccgcttc

SEQ ID NO: 49149 - DNA, 25 bp, mus musculus
acactaatgattcccgtgtcttcgc

SEQ ID NO: 49150 - DNA, 25 bp, mus musculus
tcgttatggtctctgctccgcttcg

SEQ ID NO: 49151 - DNA, 25 bp, mus musculus
tgcacctcgccggataccctgatgc

SEQ ID NO: 49152 - DNA, 25 bp, mus musculus
ggataccctgatgcgcgtcttctag

SEQ ID NO: 49153 - DNA, 25 bp, mus musculus
gacggtctcgtagtcgagtgtatag

SEQ ID NO: 49154 - DNA, 25 bp, mus musculus
cggtctcgtagtcgagtgtatagtt

SEQ ID NO: 49155 - DNA, 25 bp, mus musculus
ggtctcgtagtcgagtgtatagttc

SEQ ID NO: 49156 - DNA, 25 bp, mus musculus
tctcgtagtcgagtgtatagttcat

SEQ ID NO: 49157 - DNA, 25 bp, mus musculus
atgccagcagttgtgcctggaagcc

SEQ ID NO: 49158 - DNA, 25 bp, mus musculus
ccagcagttgtgcctggaagcctta

SEQ ID NO: 49159 - DNA, 25 bp, mus musculus
aacctcatcaagctatggagggaag

SEQ ID NO: 49160 - DNA, 25 bp, mus musculus
ctagaggcacacagcgactgggtcc

SEQ ID NO: 49161 - DNA, 25 bp, mus musculus
cacagcgactgggtccgagatgttg

SEQ ID NO: 49162 - DNA, 25 bp, mus musculus
attggcttgcccaccagcaccattg

SEQ ID NO: 49163 - DNA, 25 bp, mus musculus
agcaccattgccagctgctctcagg

SEQ ID NO: 49164 - DNA, 25 bp, mus musculus
attgccagctgctctcaggatggtc

SEQ ID NO: 49165 - DNA, 25 bp, mus musculus
tctcaggatggtcgagtgtttattt

SEQ ID NO: 49166 - DNA, 25 bp, mus musculus
tttatttggacctgtgacgatgcct

SEQ ID NO: 49167 - DNA, 25 bp, mus musculus
tggacctgtgacgatgcctcaggca

SEQ ID NO: 49168 - DNA, 25 bp, mus musculus
tgtgacgatgcctcaggcaatatgt

SEQ ID NO: 49169 - DNA, 25 bp, mus musculus
gcagttgtgcctggaagccttatag

SEQ ID NO: 49170 - DNA, 25 bp, mus musculus
gatgcctcaggcaatatgtggtcac

SEQ ID NO: 49171 - DNA, 25 bp, mus musculus
gtgcctggaagccttatagaccaac

SEQ ID NO: 49172 - DNA, 25 bp, mus musculus
atagaccaaccatcagggcagaaac

SEQ ID NO: 49173 - DNA, 25 bp, mus musculus
gaccaaccatcagggcagaaaccca

SEQ ID NO: 49174 - DNA, 25 bp, mus musculus
ccatcagggcagaaacccaattaca

SEQ ID NO: 49175 - DNA, 25 bp, mus musculus
cccaattacatcaagaagtttgcat

SEQ ID NO: 49176 - DNA, 25 bp, mus musculus
aagtttgcatcaggtggctgtgaca

SEQ ID NO: 49177 - DNA, 25 bp, mus musculus
gacaacctcatcaagctatggaggg

SEQ ID NO: 49178 - DNA, 25 bp, mus musculus
ccgcagtcccagcaagaacatatac

SEQ ID NO: 49179 - DNA, 25 bp, mus musculus
gcagtcccagcaagaacatatacct

SEQ ID NO: 49180 - DNA, 25 bp, mus musculus
gtgcacatctcagcgcctcgggaga

SEQ ID NO: 49181 - DNA, 25 bp, mus musculus
gcacatctcagcgcctcgggagaag

SEQ ID NO: 49182 - DNA, 25 bp, mus musculus
acatctcagcgcctcgggagaagag

SEQ ID NO: 49183 - DNA, 25 bp, mus musculus
atctcagcgcctcgggagaagagga

SEQ ID NO: 49184 - DNA, 25 bp, mus musculus
ccgaacctggcagccagccactgaa

SEQ ID NO: 49185 - DNA, 25 bp, mus musculus
gaacctggcagccagccactgaaga

SEQ ID NO: 49186 - DNA, 25 bp, mus musculus
ctggcagccagccactgaagacacg

SEQ ID NO: 49187 - DNA, 25 bp, mus musculus
ggcagccagccactgaagacacgca

SEQ ID NO: 49188 - DNA, 25 bp, mus musculus
cagccagccactgaagacacgcaca

SEQ ID NO: 49189 - DNA, 25 bp, mus musculus
gccagccactgaagacacgcacatt

SEQ ID NO: 49190 - DNA, 25 bp, mus musculus
agtcccagcaagaacatatacctga

SEQ ID NO: 49191 - DNA, 25 bp, mus musculus
ccagcaagaacatatacctgaacgt

SEQ ID NO: 49192 - DNA, 25 bp, mus musculus
agaacatatacctgaacgtggccgt

SEQ ID NO: 49193 - DNA, 25 bp, mus musculus
aacatatacctgaacgtggccgtga

SEQ ID NO: 49194 - DNA, 25 bp, mus musculus
catatacctgaacgtggccgtgaac

SEQ ID NO: 49195 - DNA, 25 bp, mus musculus
tatacctgaacgtggccgtgaacac

SEQ ID NO: 49196 - DNA, 25 bp, mus musculus
tggccgtgaacacccttaagaagct

SEQ ID NO: 49197 - DNA, 25 bp, mus musculus
caacaccgtgcccaacagagaggct

SEQ ID NO: 49198 - DNA, 25 bp, mus musculus
ttgaaccctttgcgtgcatgcatac

SEQ ID NO: 49199 - DNA, 25 bp, mus musculus
ttgcgtgcatgcatacctcatgagt

SEQ ID NO: 49200 - DNA, 25 bp, mus musculus
ctaaggctattgaccctagatttct

SEQ ID NO: 49201 - DNA, 25 bp, mus musculus
gattaattacattccttgtttgtga

SEQ ID NO: 49202 - DNA, 25 bp, mus musculus
taattacattccttgtttgtgactg

SEQ ID NO: 49203 - DNA, 25 bp, mus musculus
cattccttgtttgtgactgtaaatt

SEQ ID NO: 49204 - DNA, 25 bp, mus musculus
tacatttttactgtatttgagacat

SEQ ID NO: 49205 - DNA, 25 bp, mus musculus
taattttgcaggatgtgccatatca

SEQ ID NO: 49206 - DNA, 25 bp, mus musculus
gacatagctgctggaccattccatc

SEQ ID NO: 49207 - DNA, 25 bp, mus musculus
ggaccattccatcttatgtttaaag

SEQ ID NO: 49208 - DNA, 25 bp, mus musculus
ttccatcttatgtttaaagaaatct

SEQ ID NO: 49209 - DNA, 25 bp, mus musculus
tatacatatgcagtgtgtgtgccag

SEQ ID NO: 49210 - DNA, 25 bp, mus musculus
cgtgcatgcatacctcatgagtgat

SEQ ID NO: 49211 - DNA, 25 bp, mus musculus
gcatgcatacctcatgagtgattgt

SEQ ID NO: 49212 - DNA, 25 bp, mus musculus
atacctcatgagtgattgtacatac

SEQ ID NO: 49213 - DNA, 25 bp, mus musculus
ttgtacatactttgcctactcctag

SEQ ID NO: 49214 - DNA, 25 bp, mus musculus
ctactcctagagacactcgtgctta

SEQ ID NO: 49215 - DNA, 25 bp, mus musculus
ctagagacactcgtgcttactcatc

SEQ ID NO: 49216 - DNA, 25 bp, mus musculus
cttactcatccttctgtgccttggc

SEQ ID NO: 49217 - DNA, 25 bp, mus musculus
actcatccttctgtgccttggctaa

SEQ ID NO: 49218 - DNA, 25 bp, mus musculus
cagccaggctggagaggctgccaag

SEQ ID NO: 49219 - DNA, 25 bp, mus musculus
ttttggcggcttccaagtggtgccg

SEQ ID NO: 49220 - DNA, 25 bp, mus musculus
cacttcggactccatgtggagaccg

SEQ ID NO: 49221 - DNA, 25 bp, mus musculus
ttcggactccatgtggagaccgtgg

SEQ ID NO: 49222 - DNA, 25 bp, mus musculus
gagaccgtggcggaactgagagcct

SEQ ID NO: 49223 - DNA, 25 bp, mus musculus
gaactgagagcctcaggccactgct

SEQ ID NO: 49224 - DNA, 25 bp, mus musculus
tcaggccactgctacccgtaaagtc

SEQ ID NO: 49225 - DNA, 25 bp, mus musculus
agtgactgaccatgcactgcatttg

SEQ ID NO: 49226 - DNA, 25 bp, mus musculus
gactgaccatgcactgcatttgtat

SEQ ID NO: 49227 - DNA, 25 bp, mus musculus
tgaccatgcactgcatttgtatata

SEQ ID NO: 49228 - DNA, 25 bp, mus musculus
catattggattgcgcctttgtatta

SEQ ID NO: 49229 - DNA, 25 bp, mus musculus
attggattgcgcctttgtattataa

SEQ ID NO: 49230 - DNA, 25 bp, mus musculus
cggcttccaagtggtgccggctcct

SEQ ID NO: 49231 - DNA, 25 bp, mus musculus
tgacggccaatttgcctttctcatc

SEQ ID NO: 49232 - DNA, 25 bp, mus musculus
ggtcatcccggtctacaccagcaac

SEQ ID NO: 49233 - DNA, 25 bp, mus musculus
cccggtctacaccagcaacagtggg

SEQ ID NO: 49234 - DNA, 25 bp, mus musculus
ggtctacaccagcaacagtgggacc

SEQ ID NO: 49235 - DNA, 25 bp, mus musculus
tcctaacgcagtgtcaccttccagt

SEQ ID NO: 49236 - DNA, 25 bp, mus musculus
taacgcagtgtcaccttccagtggc

SEQ ID NO: 49237 - DNA, 25 bp, mus musculus
cgcagtgtcaccttccagtggctcc

SEQ ID NO: 49238 - DNA, 25 bp, mus musculus
atgtcctctctgaagggttgaggcc

SEQ ID NO: 49239 - DNA, 25 bp, mus musculus
tatttttgtccaagcttcaagtgat

SEQ ID NO: 49240 - DNA, 25 bp, mus musculus
atggttttctcctaaataaggcatg

SEQ ID NO: 49241 - DNA, 25 bp, mus musculus
ttctcctaaataaggcatggtgaca

SEQ ID NO: 49242 - DNA, 25 bp, mus musculus
acatgcctgtaagcctagccctttg

SEQ ID NO: 49243 - DNA, 25 bp, mus musculus
gaatttctatgccaactcaggctac

SEQ ID NO: 49244 - DNA, 25 bp, mus musculus
ctatgccaactcaggctacaggaga

SEQ ID NO: 49245 - DNA, 25 bp, mus musculus
caactcaggctacaggagaccccag

SEQ ID NO: 49246 - DNA, 25 bp, mus musculus
ttgaaattatccagccaactccctg

SEQ ID NO: 49247 - DNA, 25 bp, mus musculus
ctccctgttaaacatgtaagatcct

SEQ ID NO: 49248 - DNA, 25 bp, mus musculus
catgtaagatccttgccagtgtaaa

SEQ ID NO: 49249 - DNA, 25 bp, mus musculus
agatccttgccagtgtaaaacacat

SEQ ID NO: 49250 - DNA, 25 bp, mus musculus
tgtccaagcttcaagtgatttggaa

SEQ ID NO: 49251 - DNA, 25 bp, mus musculus
ggacatttgacacctattcaaatta

SEQ ID NO: 49252 - DNA, 25 bp, mus musculus
ttgacacctattcaaattatactgt

SEQ ID NO: 49253 - DNA, 25 bp, mus musculus
gacactcaaagcagctctttttcaa

SEQ ID NO: 49254 - DNA, 25 bp, mus musculus
caaagcagctctttttcaacccact

SEQ ID NO: 49255 - DNA, 25 bp, mus musculus
ttttcaacccactgaacaagatgtt

SEQ ID NO: 49256 - DNA, 25 bp, mus musculus
acccactgaacaagatgttttagct

SEQ ID NO: 49257 - DNA, 25 bp, mus musculus
agatgttttagctacaccgatacaa

SEQ ID NO: 49258 - DNA, 25 bp, mus musculus
gggatgtctgccacagtccaggcaa

SEQ ID NO: 49259 - DNA, 25 bp, mus musculus
gccacagtccaggcaaccacagagg

SEQ ID NO: 49260 - DNA, 25 bp, mus musculus
ctcagcctttctgcaggaggattta

SEQ ID NO: 49261 - DNA, 25 bp, mus musculus
tttactaggggccatcatgggctct

SEQ ID NO: 49262 - DNA, 25 bp, mus musculus
actaggggccatcatgggctctgtg

SEQ ID NO: 49263 - DNA, 25 bp, mus musculus
ggccatcatgggctctgtgaattcc

SEQ ID NO: 49264 - DNA, 25 bp, mus musculus
catcatgggctctgtgaattccaga

SEQ ID NO: 49265 - DNA, 25 bp, mus musculus
gaattccagaggtcacaaggcagag

SEQ ID NO: 49266 - DNA, 25 bp, mus musculus
tcacaaggcagaggcccaggtggta

SEQ ID NO: 49267 - DNA, 25 bp, mus musculus
aatgatgggcctcgactctgctggc

SEQ ID NO: 49268 - DNA, 25 bp, mus musculus
cctcgactctgctggcaagaccaca

SEQ ID NO: 49269 - DNA, 25 bp, mus musculus
cgactctgctggcaagaccacaatt

SEQ ID NO: 49270 - DNA, 25 bp, mus musculus
acagtccaggcaaccacagagggta

SEQ ID NO: 49271 - DNA, 25 bp, mus musculus
cacaattctgtacaaactgaaagga

SEQ ID NO: 49272 - DNA, 25 bp, mus musculus
gtccaggcaaccacagagggtagga

SEQ ID NO: 49273 - DNA, 25 bp, mus musculus
gcaaccacagagggtaggagctcag

SEQ ID NO: 49274 - DNA, 25 bp, mus musculus
aggagctcagtgcatgcatgcatgg

SEQ ID NO: 49275 - DNA, 25 bp, mus musculus
agctcagtgcatgcatgcatggatt

SEQ ID NO: 49276 - DNA, 25 bp, mus musculus
gatttgcatttcttcagaaaagagt

SEQ ID NO: 49277 - DNA, 25 bp, mus musculus
ttgcatttcttcagaaaagagtagc

SEQ ID NO: 49278 - DNA, 25 bp, mus musculus
ctgatgtgcgtcctcagcctttctg

SEQ ID NO: 49279 - DNA, 25 bp, mus musculus
tcggcacgatggtgacttggatatg

SEQ ID NO: 49280 - DNA, 25 bp, mus musculus
gaattcctaattaacccaaatgcag

SEQ ID NO: 49281 - DNA, 25 bp, mus musculus
atttgattgctgtttccaaccacta

SEQ ID NO: 49282 - DNA, 25 bp, mus musculus
ttgattgctgtttccaaccactatg

SEQ ID NO: 49283 - DNA, 25 bp, mus musculus
aggacattatactgcttttgcaaaa

SEQ ID NO: 49284 - DNA, 25 bp, mus musculus
gacattatactgcttttgcaaaaaa

SEQ ID NO: 49285 - DNA, 25 bp, mus musculus
ttctaccagagacaggacactttca

SEQ ID NO: 49286 - DNA, 25 bp, mus musculus
ctaccagagacaggacactttcagt

SEQ ID NO: 49287 - DNA, 25 bp, mus musculus
gacaggacactttcagtgggactgg

SEQ ID NO: 49288 - DNA, 25 bp, mus musculus
caggacactttcagtgggactggct

SEQ ID NO: 49289 - DNA, 25 bp, mus musculus
ggacactttcagtgggactggcttc

SEQ ID NO: 49290 - DNA, 25 bp, mus musculus
acactttcagtgggactggcttctt

SEQ ID NO: 49291 - DNA, 25 bp, mus musculus
ttaacccaaatgcaggtccttgccg

SEQ ID NO: 49292 - DNA, 25 bp, mus musculus
cccaaatgcaggtccttgccgctat

SEQ ID NO: 49293 - DNA, 25 bp, mus musculus
caaatgcaggtccttgccgctataa

SEQ ID NO: 49294 - DNA, 25 bp, mus musculus
aatgcaggtccttgccgctataatt

SEQ ID NO: 49295 - DNA, 25 bp, mus musculus
tgcaggtccttgccgctataatttg

SEQ ID NO: 49296 - DNA, 25 bp, mus musculus
caggtccttgccgctataatttgat

SEQ ID NO: 49297 - DNA, 25 bp, mus musculus
ggtccttgccgctataatttgattg

SEQ ID NO: 49298 - DNA, 25 bp, mus musculus
tccttgccgctataatttgattgct

SEQ ID NO: 49299 - DNA, 25 bp, mus musculus
ggtgcttctgtgtttgtcaacgtga

SEQ ID NO: 49300 - DNA, 25 bp, mus musculus
gcaagccaagtgatccacagagttg

SEQ ID NO: 49301 - DNA, 25 bp, mus musculus
tgctggcagtcttccctatacagca

SEQ ID NO: 49302 - DNA, 25 bp, mus musculus
tccctatacagcaagtcagttagga

SEQ ID NO: 49303 - DNA, 25 bp, mus musculus
tttataaccctaggatcctcctcat

SEQ ID NO: 49304 - DNA, 25 bp, mus musculus
gtacccccaaggcacatagagctgg

SEQ ID NO: 49305 - DNA, 25 bp, mus musculus
tgctccctaagaacttacaatctga

SEQ ID NO: 49306 - DNA, 25 bp, mus musculus
ctaagaacttacaatctgaaacagc

SEQ ID NO: 49307 - DNA, 25 bp, mus musculus
cactgattcagacaaccagaaaaga

SEQ ID NO: 49308 - DNA, 25 bp, mus musculus
ccataatacacagatgacagagctc

SEQ ID NO: 49309 - DNA, 25 bp, mus musculus
cagctcacaatctgttatggttgac

SEQ ID NO: 49310 - DNA, 25 bp, mus musculus
tgttatggttgacctgggctccctg

SEQ ID NO: 49311 - DNA, 25 bp, mus musculus
atccacagagttggcttctcatctt

SEQ ID NO: 49312 - DNA, 25 bp, mus musculus
agagttggcttctcatcttttggct

SEQ ID NO: 49313 - DNA, 25 bp, mus musculus
ggcttctcatcttttggcttactca

SEQ ID NO: 49314 - DNA, 25 bp, mus musculus
tcatcttttggcttactcaaactct

SEQ ID NO: 49315 - DNA, 25 bp, mus musculus
ttactcaaactctgaacagtgcgct

SEQ ID NO: 49316 - DNA, 25 bp, mus musculus
aaactctgaacagtgcgctgtccta

SEQ ID NO: 49317 - DNA, 25 bp, mus musculus
tgaacagtgcgctgtcctaggctgc

SEQ ID NO: 49318 - DNA, 25 bp, mus musculus
gtgcgctgtcctaggctgcagcagg

SEQ ID NO: 49319 - DNA, 25 bp, mus musculus
ccaactatccttgatacaacagctg

SEQ ID NO: 49320 - DNA, 25 bp, mus musculus
caactatccttgatacaacagctga

SEQ ID NO: 49321 - DNA, 25 bp, mus musculus
acagctgacctcatttcccgatacc

SEQ ID NO: 49322 - DNA, 25 bp, mus musculus
agctgacctcatttcccgatacctt

SEQ ID NO: 49323 - DNA, 25 bp, mus musculus
gctgacctcatttcccgataccttt

SEQ ID NO: 49324 - DNA, 25 bp, mus musculus
gccctaagataccctaaagaagcag

SEQ ID NO: 49325 - DNA, 25 bp, mus musculus
ataccctaaagaagcagaagagacg

SEQ ID NO: 49326 - DNA, 25 bp, mus musculus
cgtcgcacattcggcctctgcgact

SEQ ID NO: 49327 - DNA, 25 bp, mus musculus
gtcgcacattcggcctctgcgactc

SEQ ID NO: 49328 - DNA, 25 bp, mus musculus
cgcacattcggcctctgcgactcgg

SEQ ID NO: 49329 - DNA, 25 bp, mus musculus
cacattcggcctctgcgactcgggc

SEQ ID NO: 49330 - DNA, 25 bp, mus musculus
attcggcctctgcgactcgggcaga

SEQ ID NO: 49331 - DNA, 25 bp, mus musculus
aactatccttgatacaacagctgac

SEQ ID NO: 49332 - DNA, 25 bp, mus musculus
ctatccttgatacaacagctgacct

SEQ ID NO: 49333 - DNA, 25 bp, mus musculus
atccttgatacaacagctgacctca

SEQ ID NO: 49334 - DNA, 25 bp, mus musculus
ccttgatacaacagctgacctcatt

SEQ ID NO: 49335 - DNA, 25 bp, mus musculus
cttgatacaacagctgacctcattt

SEQ ID NO: 49336 - DNA, 25 bp, mus musculus
ttgatacaacagctgacctcatttc

SEQ ID NO: 49337 - DNA, 25 bp, mus musculus
caacagctgacctcatttcccgata

SEQ ID NO: 49338 - DNA, 25 bp, mus musculus
aacagctgacctcatttcccgatac

SEQ ID NO: 49339 - DNA, 25 bp, mus musculus
aaggccaagcgccgcaaccaggaga

SEQ ID NO: 49340 - DNA, 25 bp, mus musculus
ttgtcggccgagaacgagaagctgc

SEQ ID NO: 49341 - DNA, 25 bp, mus musculus
gcagcttgggcactggactgcgaga

SEQ ID NO: 49342 - DNA, 25 bp, mus musculus
tgggcactggactgcgagagaagct

SEQ ID NO: 49343 - DNA, 25 bp, mus musculus
gcactggactgcgagagaagctata

SEQ ID NO: 49344 - DNA, 25 bp, mus musculus
agcattttctacgtcttattaccat

SEQ ID NO: 49345 - DNA, 25 bp, mus musculus
ttctacgtcttattaccattgcagc

SEQ ID NO: 49346 - DNA, 25 bp, mus musculus
tacgtcttattaccattgcagctaa

SEQ ID NO: 49347 - DNA, 25 bp, mus musculus
gtcttattaccattgcagctaaggt

SEQ ID NO: 49348 - DNA, 25 bp, mus musculus
ttattaccattgcagctaaggtaca

SEQ ID NO: 49349 - DNA, 25 bp, mus musculus
ttaccattgcagctaaggtacattt

SEQ ID NO: 49350 - DNA, 25 bp, mus musculus
gacatttccgacagacttttgtaga

SEQ ID NO: 49351 - DNA, 25 bp, mus musculus
gagcagctcacccgggacctggctg

SEQ ID NO: 49352 - DNA, 25 bp, mus musculus
actctgaacgacctatacctcagac

SEQ ID NO: 49353 - DNA, 25 bp, mus musculus
gccgcccgaatcgctagtttctttg

SEQ ID NO: 49354 - DNA, 25 bp, mus musculus
gctagtttctttgggacctgcgagc

SEQ ID NO: 49355 - DNA, 25 bp, mus musculus
ttctttgggacctgcgagcgacagg

SEQ ID NO: 49356 - DNA, 25 bp, mus musculus
tttgggacctgcgagcgacaggaag

SEQ ID NO: 49357 - DNA, 25 bp, mus musculus
acctgcgagcgacaggaagctgcag

SEQ ID NO: 49358 - DNA, 25 bp, mus musculus
gaagctgcagcttgggcactggact

SEQ ID NO: 49359 - DNA, 25 bp, mus musculus
gatatgatgcgggccgtgcgctaga

SEQ ID NO: 49360 - DNA, 25 bp, mus musculus
atatgatgcgggccgtgcgctagaa

SEQ ID NO: 49361 - DNA, 25 bp, mus musculus
gtgatcacggtcgtatggaagccca

SEQ ID NO: 49362 - DNA, 25 bp, mus musculus
tgatcacggtcgtatggaagcccaa

SEQ ID NO: 49363 - DNA, 25 bp, mus musculus
tcgtatggaagcccaacgagtgatg

SEQ ID NO: 49364 - DNA, 25 bp, mus musculus
gtatggaagcccaacgagtgatgga

SEQ ID NO: 49365 - DNA, 25 bp, mus musculus
tggaagcccaacgagtgatggagat

SEQ ID NO: 49366 - DNA, 25 bp, mus musculus
ggaagcccaacgagtgatggagatg

SEQ ID NO: 49367 - DNA, 25 bp, mus musculus
aagcccaacgagtgatggagatgaa

SEQ ID NO: 49368 - DNA, 25 bp, mus musculus
agcccaacgagtgatggagatgaat

SEQ ID NO: 49369 - DNA, 25 bp, mus musculus
acatcgttataggtgctgagatacg

SEQ ID NO: 49370 - DNA, 25 bp, mus musculus
gtcacactgggcgataagatgacag

SEQ ID NO: 49371 - DNA, 25 bp, mus musculus
atgatgcgggccgtgcgctagaagc

SEQ ID NO: 49372 - DNA, 25 bp, mus musculus
tgatgcgggccgtgcgctagaagcc

SEQ ID NO: 49373 - DNA, 25 bp, mus musculus
gtgcgctagaagcctaccagcgccg

SEQ ID NO: 49374 - DNA, 25 bp, mus musculus
tgcgctagaagcctaccagcgccga

SEQ ID NO: 49375 - DNA, 25 bp, mus musculus
cgctagaagcctaccagcgccgagg

SEQ ID NO: 49376 - DNA, 25 bp, mus musculus
tagaagcctaccagcgccgaggtga

SEQ ID NO: 49377 - DNA, 25 bp, mus musculus
agcctaccagcgccgaggtgatcac

SEQ ID NO: 49378 - DNA, 25 bp, mus musculus
aggtgatcacggtcgtatggaagcc

SEQ ID NO: 49379 - DNA, 25 bp, mus musculus
agaggactctgactcagacagtgat

SEQ ID NO: 49380 - DNA, 25 bp, mus musculus
catggcttactttgccatggtcaag

SEQ ID NO: 49381 - DNA, 25 bp, mus musculus
ctgctggagatggctggagaagccc

SEQ ID NO: 49382 - DNA, 25 bp, mus musculus
gaagcccagggctttcagcaacgct

SEQ ID NO: 49383 - DNA, 25 bp, mus musculus
cagggctttcagcaacgcttcgcca

SEQ ID NO: 49384 - DNA, 25 bp, mus musculus
ggctttcagcaacgcttcgccaggt

SEQ ID NO: 49385 - DNA, 25 bp, mus musculus
tttcagcaacgcttcgccaggttcc

SEQ ID NO: 49386 - DNA, 25 bp, mus musculus
cgcttcgccaggttccaggctccag

SEQ ID NO: 49387 - DNA, 25 bp, mus musculus
ttcgccaggttccaggctccaggct

SEQ ID NO: 49388 - DNA, 25 bp, mus musculus
aggttccaggctccaggctctgaga

SEQ ID NO: 49389 - DNA, 25 bp, mus musculus
caggctccaggctctgagacaggcc

SEQ ID NO: 49390 - DNA, 25 bp, mus musculus
attagtccctgggctcagggcactg

SEQ ID NO: 49391 - DNA, 25 bp, mus musculus
ggcttactttgccatggtcaagagg

SEQ ID NO: 49392 - DNA, 25 bp, mus musculus
ccccatcgatgaccgagtgcagagt

SEQ ID NO: 49393 - DNA, 25 bp, mus musculus
gaagaaccatgccaggcaggcggga

SEQ ID NO: 49394 - DNA, 25 bp, mus musculus
acatcaaagctgagctgctggacat

SEQ ID NO: 49395 - DNA, 25 bp, mus musculus
tcaaagctgagctgctggacatagc

SEQ ID NO: 49396 - DNA, 25 bp, mus musculus
ctgagctgctggacatagctgtacc

SEQ ID NO: 49397 - DNA, 25 bp, mus musculus
ctcctgcccaaggcagagaactctg

SEQ ID NO: 49398 - DNA, 25 bp, mus musculus
aactctgggcagctgctggagatgg

SEQ ID NO: 49399 - DNA, 25 bp, mus musculus
gcggagaccctttttcagagctctt

SEQ ID NO: 49400 - DNA, 25 bp, mus musculus
ggagaccctttttcagagctctttg

SEQ ID NO: 49401 - DNA, 25 bp, mus musculus
ctctctcttcgtcctttcctgctaa

SEQ ID NO: 49402 - DNA, 25 bp, mus musculus
tcgtcctttcctgctaactccgctt

SEQ ID NO: 49403 - DNA, 25 bp, mus musculus
tcctcatctttctgcttcagcccgg

SEQ ID NO: 49404 - DNA, 25 bp, mus musculus
ctcatctttctgcttcagcccgggg

SEQ ID NO: 49405 - DNA, 25 bp, mus musculus
tcggtgcttctcgctccgtttctac

SEQ ID NO: 49406 - DNA, 25 bp, mus musculus
ggccgccgcatcactacacgcagaa

SEQ ID NO: 49407 - DNA, 25 bp, mus musculus
cgcatcactacacgcagaatcatgg

SEQ ID NO: 49408 - DNA, 25 bp, mus musculus
catcactacacgcagaatcatggag

SEQ ID NO: 49409 - DNA, 25 bp, mus musculus
tcactacacgcagaatcatggagaa

SEQ ID NO: 49410 - DNA, 25 bp, mus musculus
actacacgcagaatcatggagaacg

SEQ ID NO: 49411 - DNA, 25 bp, mus musculus
agaccctttttcagagctctttgat

SEQ ID NO: 49412 - DNA, 25 bp, mus musculus
cctttttcagagctctttgatgact

SEQ ID NO: 49413 - DNA, 25 bp, mus musculus
tttttcagagctctttgatgacttg

SEQ ID NO: 49414 - DNA, 25 bp, mus musculus
tttcagagctctttgatgacttggg

SEQ ID NO: 49415 - DNA, 25 bp, mus musculus
ctttgatgacttgggtgtcttctcg

SEQ ID NO: 49416 - DNA, 25 bp, mus musculus
tgacttgggtgtcttctcggcagct

SEQ ID NO: 49417 - DNA, 25 bp, mus musculus
acttgggtgtcttctcggcagcttc

SEQ ID NO: 49418 - DNA, 25 bp, mus musculus
ttcagacaccagggtccccgactca

SEQ ID NO: 49419 - DNA, 25 bp, mus musculus
acgccacacgctccgtgagagtacc

SEQ ID NO: 49420 - DNA, 25 bp, mus musculus
gctccgtgagagtaccaccgagttc

SEQ ID NO: 49421 - DNA, 25 bp, mus musculus
ctatgccagacagataggggcacag

SEQ ID NO: 49422 - DNA, 25 bp, mus musculus
ggcacagccagatgaccacagcgca

SEQ ID NO: 49423 - DNA, 25 bp, mus musculus
gccagatgaccacagcgcaagagaa

SEQ ID NO: 49424 - DNA, 25 bp, mus musculus
agatgaccacagcgcaagagaacac

SEQ ID NO: 49425 - DNA, 25 bp, mus musculus
agaacacacacatttttcctacatc

SEQ ID NO: 49426 - DNA, 25 bp, mus musculus
attggctgttgtcactatgacgaca

SEQ ID NO: 49427 - DNA, 25 bp, mus musculus
catgtatctctatacgtggtctgta

SEQ ID NO: 49428 - DNA, 25 bp, mus musculus
gtatctctatacgtggtctgtaatg

SEQ ID NO: 49429 - DNA, 25 bp, mus musculus
tctctatacgtggtctgtaatgctg

SEQ ID NO: 49430 - DNA, 25 bp, mus musculus
tacgtggtctgtaatgctggttgtc

SEQ ID NO: 49431 - DNA, 25 bp, mus musculus
tgagagtaccaccgagttcctgctg

SEQ ID NO: 49432 - DNA, 25 bp, mus musculus
cctgtgagtactcatctatgctatc

SEQ ID NO: 49433 - DNA, 25 bp, mus musculus
gtgagtactcatctatgctatcatg

SEQ ID NO: 49434 - DNA, 25 bp, mus musculus
agtactcatctatgctatcatgatc

SEQ ID NO: 49435 - DNA, 25 bp, mus musculus
tgctatcatgatctactatgccaga

SEQ ID NO: 49436 - DNA, 25 bp, mus musculus
tatcatgatctactatgccagacag

SEQ ID NO: 49437 - DNA, 25 bp, mus musculus
gatctactatgccagacagataggg

SEQ ID NO: 49438 - DNA, 25 bp, mus musculus
ctactatgccagacagataggggca

SEQ ID NO: 49439 - DNA, 25 bp, mus musculus
ggtgactgacctccgcatgatcggg

SEQ ID NO: 49440 - DNA, 25 bp, mus musculus
gtgactgacctccgcatgatcgggg

SEQ ID NO: 49441 - DNA, 25 bp, mus musculus
cttcctggaggtctttgaggatcag

SEQ ID NO: 49442 - DNA, 25 bp, mus musculus
ttcctggaggtctttgaggatcagg

SEQ ID NO: 49443 - DNA, 25 bp, mus musculus
aagtctaaagcctcaggcggccaga

SEQ ID NO: 49444 - DNA, 25 bp, mus musculus
tcccatccttggatagatgcagctc

SEQ ID NO: 49445 - DNA, 25 bp, mus musculus
cccatccttggatagatgcagctcc

SEQ ID NO: 49446 - DNA, 25 bp, mus musculus
ccatccttggatagatgcagctccc

SEQ ID NO: 49447 - DNA, 25 bp, mus musculus
gatagatgcagctcccatacacccc

SEQ ID NO: 49448 - DNA, 25 bp, mus musculus
atagatgcagctcccatacacccct

SEQ ID NO: 49449 - DNA, 25 bp, mus musculus
tagatgcagctcccatacacccctg

SEQ ID NO: 49450 - DNA, 25 bp, mus musculus
gcccttggacagggccataaatgaa

SEQ ID NO: 49451 - DNA, 25 bp, mus musculus
tgactgacctccgcatgatcggggc

SEQ ID NO: 49452 - DNA, 25 bp, mus musculus
actgacctccgcatgatcggggcct

SEQ ID NO: 49453 - DNA, 25 bp, mus musculus
tgacctccgcatgatcggggcctgc

SEQ ID NO: 49454 - DNA, 25 bp, mus musculus
cccgctcttcctggaggtctttgag

SEQ ID NO: 49455 - DNA, 25 bp, mus musculus
ccgctcttcctggaggtctttgagg

SEQ ID NO: 49456 - DNA, 25 bp, mus musculus
cgctcttcctggaggtctttgagga

SEQ ID NO: 49457 - DNA, 25 bp, mus musculus
gctcttcctggaggtctttgaggat

SEQ ID NO: 49458 - DNA, 25 bp, mus musculus
tcttcctggaggtctttgaggatca

SEQ ID NO: 49459 - DNA, 25 bp, mus musculus
tacatcacattgttttacattgtct

SEQ ID NO: 49460 - DNA, 25 bp, mus musculus
gcagcagctgcagccactggaggtt

SEQ ID NO: 49461 - DNA, 25 bp, mus musculus
atagctatggcagctcaaatggcag

SEQ ID NO: 49462 - DNA, 25 bp, mus musculus
gcagctcaaatggcagccctgcaag

SEQ ID NO: 49463 - DNA, 25 bp, mus musculus
gctcaaatggcagccctgcaagcta

SEQ ID NO: 49464 - DNA, 25 bp, mus musculus
caaatggcagccctgcaagctaaag

SEQ ID NO: 49465 - DNA, 25 bp, mus musculus
caagctaaagccttggcagagactg

SEQ ID NO: 49466 - DNA, 25 bp, mus musculus
aaagccttggcagagactggcatag

SEQ ID NO: 49467 - DNA, 25 bp, mus musculus
actggcatagcagtgcccagctact

SEQ ID NO: 49468 - DNA, 25 bp, mus musculus
ggcatagcagtgcccagctactaca

SEQ ID NO: 49469 - DNA, 25 bp, mus musculus
atagcagtgcccagctactacaacc

SEQ ID NO: 49470 - DNA, 25 bp, mus musculus
gcagtgcccagctactacaacccag

SEQ ID NO: 49471 - DNA, 25 bp, mus musculus
gttcttaatgttgctgcactgttgg

SEQ ID NO: 49472 - DNA, 25 bp, mus musculus
gtgcccagctactacaacccagcag

SEQ ID NO: 49473 - DNA, 25 bp, mus musculus
cttaatgttgctgcactgttggcat

SEQ ID NO: 49474 - DNA, 25 bp, mus musculus
aatgttgctgcactgttggcatcag

SEQ ID NO: 49475 - DNA, 25 bp, mus musculus
gctgcactgttggcatcaggaacgc

SEQ ID NO: 49476 - DNA, 25 bp, mus musculus
ggaacgcaggttactcctcagatag

SEQ ID NO: 49477 - DNA, 25 bp, mus musculus
acgcaggttactcctcagatagcta

SEQ ID NO: 49478 - DNA, 25 bp, mus musculus
caggttactcctcagatagctatgg

SEQ ID NO: 49479 - DNA, 25 bp, mus musculus
actcctcagatagctatggcagctc

SEQ ID NO: 49480 - DNA, 25 bp, mus musculus
gcctggatccagaggagaggcccac

SEQ ID NO: 49481 - DNA, 25 bp, mus musculus
aaccacagtaccagcctggagacca

SEQ ID NO: 49482 - DNA, 25 bp, mus musculus
cgacgctctgaagccattttataga

SEQ ID NO: 49483 - DNA, 25 bp, mus musculus
tcctctgaccccaagtgttcatttt

SEQ ID NO: 49484 - DNA, 25 bp, mus musculus
tctagggcatcccactcatttcaca

SEQ ID NO: 49485 - DNA, 25 bp, mus musculus
gcatcccactcatttcacagagtaa

SEQ ID NO: 49486 - DNA, 25 bp, mus musculus
tggatgctcagagctcctctctcga

SEQ ID NO: 49487 - DNA, 25 bp, mus musculus
ttcctgtcccattaggctccgacat

SEQ ID NO: 49488 - DNA, 25 bp, mus musculus
tcccattaggctccgacataccgtt

SEQ ID NO: 49489 - DNA, 25 bp, mus musculus
taggctccgacataccgttagtctc

SEQ ID NO: 49490 - DNA, 25 bp, mus musculus
ccatctcctaaaaatactcatcctt

SEQ ID NO: 49491 - DNA, 25 bp, mus musculus
aatactcatcctttgtctagttatt

SEQ ID NO: 49492 - DNA, 25 bp, mus musculus
agtaccagcctggagaccagacata

SEQ ID NO: 49493 - DNA, 25 bp, mus musculus
gagaccagacatagcctgactgggc

SEQ ID NO: 49494 - DNA, 25 bp, mus musculus
agacatagcctgactgggcatcact

SEQ ID NO: 49495 - DNA, 25 bp, mus musculus
agtatgtacttgctcttgccaatcc

SEQ ID NO: 49496 - DNA, 25 bp, mus musculus
tacttgctcttgccaatccccgggc

SEQ ID NO: 49497 - DNA, 25 bp, mus musculus
cactctggtcccagtgcccaagact

SEQ ID NO: 49498 - DNA, 25 bp, mus musculus
cccctgtggaatcctagcacaggat

SEQ ID NO: 49499 - DNA, 25 bp, mus musculus
tggaatcctagcacaggatcagaga

SEQ ID NO: 49500 - DNA, 25 bp, mus musculus
cgactctgacacttcagaacatgag

SEQ ID NO: 49501 - DNA, 25 bp, mus musculus
tgacacttcagaacatgaggggtct

SEQ ID NO: 49502 - DNA, 25 bp, mus musculus
tccctgacagatgcttagactacag

SEQ ID NO: 49503 - DNA, 25 bp, mus musculus
gtactgagcgggcagctaaaaagtg

SEQ ID NO: 49504 - DNA, 25 bp, mus musculus
gccctgtcactctagactggaaggt

SEQ ID NO: 49505 - DNA, 25 bp, mus musculus
tcactctagactggaaggtatgggg

SEQ ID NO: 49506 - DNA, 25 bp, mus musculus
tgcaaggctgaccacaccaacaaaa

SEQ ID NO: 49507 - DNA, 25 bp, mus musculus
aaccgtgtgctcctctccaagtctg

SEQ ID NO: 49508 - DNA, 25 bp, mus musculus
gtgctcctctccaagtctgactcgt

SEQ ID NO: 49509 - DNA, 25 bp, mus musculus
gactcgtcctcaattaatctgtcaa

SEQ ID NO: 49510 - DNA, 25 bp, mus musculus
tcctcaattaatctgtcaacattaa

SEQ ID NO: 49511 - DNA, 25 bp, mus musculus
ctgtcaacattaaactaacagtcat

SEQ ID NO: 49512 - DNA, 25 bp, mus musculus
ttcccagagcctgggccatcactgc

SEQ ID NO: 49513 - DNA, 25 bp, mus musculus
cattaaactaacagtcattaacatc

SEQ ID NO: 49514 - DNA, 25 bp, mus musculus
gggccatcactgccagtggggttct

SEQ ID NO: 49515 - DNA, 25 bp, mus musculus
gggttctcacagtgctagcctctat

SEQ ID NO: 49516 - DNA, 25 bp, mus musculus
tgctagcctctatatttactatgcc

SEQ ID NO: 49517 - DNA, 25 bp, mus musculus
cctctatatttactatgccaactgg

SEQ ID NO: 49518 - DNA, 25 bp, mus musculus
caactggtgcacccctagttctctt

SEQ ID NO: 49519 - DNA, 25 bp, mus musculus
gtgcacccctagttctctttctcca

SEQ ID NO: 49520 - DNA, 25 bp, mus musculus
cgtcccaaactctcgtgtttcaatg

SEQ ID NO: 49521 - DNA, 25 bp, mus musculus
cctgcatgcgacggctgaactttgt

SEQ ID NO: 49522 - DNA, 25 bp, mus musculus
gcatgcgacggctgaactttgtgcg

SEQ ID NO: 49523 - DNA, 25 bp, mus musculus
tgctctacacccgcaagtttgagtc

SEQ ID NO: 49524 - DNA, 25 bp, mus musculus
tttacttcctcagggatgagaaaga

SEQ ID NO: 49525 - DNA, 25 bp, mus musculus
acttcctcagggatgagaaagacag

SEQ ID NO: 49526 - DNA, 25 bp, mus musculus
acatgtttctgcgctgtgtgagcga

SEQ ID NO: 49527 - DNA, 25 bp, mus musculus
tgtttctgcgctgtgtgagcgagct

SEQ ID NO: 49528 - DNA, 25 bp, mus musculus
agtttaccagtgacacaaagcctat

SEQ ID NO: 49529 - DNA, 25 bp, mus musculus
ttaccagtgacacaaagcctattat

SEQ ID NO: 49530 - DNA, 25 bp, mus musculus
ccagtgacacaaagcctattatcaa

SEQ ID NO: 49531 - DNA, 25 bp, mus musculus
acacaaagcctattatcaacaaagt

SEQ ID NO: 49532 - DNA, 25 bp, mus musculus
caaagcctattatcaacaaagttgc

SEQ ID NO: 49533 - DNA, 25 bp, mus musculus
tgcgacggctgaactttgtgcgtct

SEQ ID NO: 49534 - DNA, 25 bp, mus musculus
aaagcctattatcaacaaagttgct

SEQ ID NO: 49535 - DNA, 25 bp, mus musculus
tgaactttgtgcgtctgctcatgct

SEQ ID NO: 49536 - DNA, 25 bp, mus musculus
actttgtgcgtctgctcatgctcta

SEQ ID NO: 49537 - DNA, 25 bp, mus musculus
ttgtgcgtctgctcatgctctacac

SEQ ID NO: 49538 - DNA, 25 bp, mus musculus
tgcgtctgctcatgctctacacccg

SEQ ID NO: 49539 - DNA, 25 bp, mus musculus
gtctgctcatgctctacacccgcaa

SEQ ID NO: 49540 - DNA, 25 bp, mus musculus
tgctcatgctctacacccgcaagtt

SEQ ID NO: 49541 - DNA, 25 bp, mus musculus
tcatgctctacacccgcaagtttga

SEQ ID NO: 49542 - DNA, 25 bp, mus musculus
ccctcagctcgacttgaaacggcaa

SEQ ID NO: 49543 - DNA, 25 bp, mus musculus
gttggaccagctgcttcactacagg

SEQ ID NO: 49544 - DNA, 25 bp, mus musculus
acgagcctttcactgaaggacacca

SEQ ID NO: 49545 - DNA, 25 bp, mus musculus
gacaccattgattcacccacaggca

SEQ ID NO: 49546 - DNA, 25 bp, mus musculus
attgattcacccacaggcagaaagc

SEQ ID NO: 49547 - DNA, 25 bp, mus musculus
tcacccacaggcagaaagcagaatt

SEQ ID NO: 49548 - DNA, 25 bp, mus musculus
atctttgccagaatgctaatgccat

SEQ ID NO: 49549 - DNA, 25 bp, mus musculus
atgccatgtgactagcgtgacttgt

SEQ ID NO: 49550 - DNA, 25 bp, mus musculus
tgtgactagcgtgacttgtagcgta

SEQ ID NO: 49551 - DNA, 25 bp, mus musculus
attcttcctgcaaaatagatgtttc

SEQ ID NO: 49552 - DNA, 25 bp, mus musculus
atgtttcacgtgtctgtgacaatga

SEQ ID NO: 49553 - DNA, 25 bp, mus musculus
acaatgaccgtgttactgttgttga

SEQ ID NO: 49554 - DNA, 25 bp, mus musculus
ccagctgcttcactacaggaagaag

SEQ ID NO: 49555 - DNA, 25 bp, mus musculus
gcttcactacaggaagaaggcagac

SEQ ID NO: 49556 - DNA, 25 bp, mus musculus
tttctacgactcggaggagcagatg

SEQ ID NO: 49557 - DNA, 25 bp, mus musculus
ggggcctcaccaggaggcaaacgat

SEQ ID NO: 49558 - DNA, 25 bp, mus musculus
tcaccaggaggcaaacgatgaaaag

SEQ ID NO: 49559 - DNA, 25 bp, mus musculus
ccagagagttctgacggcggaagag

SEQ ID NO: 49560 - DNA, 25 bp, mus musculus
cttggctgcgatggatctggaactc

SEQ ID NO: 49561 - DNA, 25 bp, mus musculus
gttcagccagcggggctgacagttg

SEQ ID NO: 49562 - DNA, 25 bp, mus musculus
ggagccaagtttcagccatggtgcg

SEQ ID NO: 49563 - DNA, 25 bp, mus musculus
agccaagtttcagccatggtgcgat

SEQ ID NO: 49564 - DNA, 25 bp, mus musculus
ctctctcctatcctggcactgacgg

SEQ ID NO: 49565 - DNA, 25 bp, mus musculus
tctctcctatcctggcactgacggt

SEQ ID NO: 49566 - DNA, 25 bp, mus musculus
tctcctatcctggcactgacggtga

SEQ ID NO: 49567 - DNA, 25 bp, mus musculus
cctatcctggcactgacggtgatct

SEQ ID NO: 49568 - DNA, 25 bp, mus musculus
ctatcctggcactgacggtgatctc

SEQ ID NO: 49569 - DNA, 25 bp, mus musculus
tcctggcactgacggtgatctcatg

SEQ ID NO: 49570 - DNA, 25 bp, mus musculus
ctggcactgacggtgatctcatgtg

SEQ ID NO: 49571 - DNA, 25 bp, mus musculus
tggcactgacggtgatctcatgtgg

SEQ ID NO: 49572 - DNA, 25 bp, mus musculus
gcactgacggtgatctcatgtggtt

SEQ ID NO: 49573 - DNA, 25 bp, mus musculus
cactgacggtgatctcatgtggttc

SEQ ID NO: 49574 - DNA, 25 bp, mus musculus
gccaagtttcagccatggtgcgatc

SEQ ID NO: 49575 - DNA, 25 bp, mus musculus
tgacggtgatctcatgtggttctcc

SEQ ID NO: 49576 - DNA, 25 bp, mus musculus
caagtttcagccatggtgcgatccg

SEQ ID NO: 49577 - DNA, 25 bp, mus musculus
gtttcagccatggtgcgatccgaaa

SEQ ID NO: 49578 - DNA, 25 bp, mus musculus
tttcagccatggtgcgatccgaaag

SEQ ID NO: 49579 - DNA, 25 bp, mus musculus
cagccatggtgcgatccgaaagaag

SEQ ID NO: 49580 - DNA, 25 bp, mus musculus
gccatggtgcgatccgaaagaagct

SEQ ID NO: 49581 - DNA, 25 bp, mus musculus
tgctgcgggctctctcctatcctgg

SEQ ID NO: 49582 - DNA, 25 bp, mus musculus
ggctctctcctatcctggcactgac

SEQ ID NO: 49583 - DNA, 25 bp, mus musculus
cttgcctgcatgaggacaccagccc

SEQ ID NO: 49584 - DNA, 25 bp, mus musculus
tgcatgaggacaccagcccagcctg

SEQ ID NO: 49585 - DNA, 25 bp, mus musculus
gcccttgggaggccttcaatcacct

SEQ ID NO: 49586 - DNA, 25 bp, mus musculus
gggaggccttcaatcacctagagct

SEQ ID NO: 49587 - DNA, 25 bp, mus musculus
atcacctagagctgcacgagctggc

SEQ ID NO: 49588 - DNA, 25 bp, mus musculus
tagagctgcacgagctggcccagta

SEQ ID NO: 49589 - DNA, 25 bp, mus musculus
tgcacgagctggcccagtatggcat

SEQ ID NO: 49590 - DNA, 25 bp, mus musculus
agctggcccagtatggcatcattta

SEQ ID NO: 49591 - DNA, 25 bp, mus musculus
tcatttagtcagatccctgctatgt

SEQ ID NO: 49592 - DNA, 25 bp, mus musculus
agtcagatccctgctatgtgagccc

SEQ ID NO: 49593 - DNA, 25 bp, mus musculus
atccctgctatgtgagccctgggaa

SEQ ID NO: 49594 - DNA, 25 bp, mus musculus
tgccaacccgtggaattgtaatatg

SEQ ID NO: 49595 - DNA, 25 bp, mus musculus
ccagcccagcctgacagagtccaga

SEQ ID NO: 49596 - DNA, 25 bp, mus musculus
agggtcactgcagtgtctctgccag

SEQ ID NO: 49597 - DNA, 25 bp, mus musculus
ccatgaacctggagccacccaaggg

SEQ ID NO: 49598 - DNA, 25 bp, mus musculus
gaccacctaagtttaagcagcggca

SEQ ID NO: 49599 - DNA, 25 bp, mus musculus
ttaagcagcggcaaaccaggcagtt

SEQ ID NO: 49600 - DNA, 25 bp, mus musculus
aaaccaggcagttcaagagcaagcc

SEQ ID NO: 49601 - DNA, 25 bp, mus musculus
tcaccgtcatctgcccttgggaggc

SEQ ID NO: 49602 - DNA, 25 bp, mus musculus
tcatctgcccttgggaggccttcaa

SEQ ID NO: 49603 - DNA, 25 bp, mus musculus
tagcttggctgacagaggagccagg

SEQ ID NO: 49604 - DNA, 25 bp, mus musculus
cagaggtcacacgcacatcccaaag

SEQ ID NO: 49605 - DNA, 25 bp, mus musculus
gcctgcaccaagcatgaacagtggg

SEQ ID NO: 49606 - DNA, 25 bp, mus musculus
ggaagtgtacccagcaccatcgcgc

SEQ ID NO: 49607 - DNA, 25 bp, mus musculus
atcgcgccagcgccaagcatgtgac

SEQ ID NO: 49608 - DNA, 25 bp, mus musculus
ccaagcatgtgaccctgcactgcac

SEQ ID NO: 49609 - DNA, 25 bp, mus musculus
atgtgaccctgcactgcactgcaca

SEQ ID NO: 49610 - DNA, 25 bp, mus musculus
ccctgcactgcactgcacatgctga

SEQ ID NO: 49611 - DNA, 25 bp, mus musculus
gctcggcttgcacatagacggtaca

SEQ ID NO: 49612 - DNA, 25 bp, mus musculus
cttgcacatagacggtacattgttt

SEQ ID NO: 49613 - DNA, 25 bp, mus musculus
attgtttattactgtccatgtccag

SEQ ID NO: 49614 - DNA, 25 bp, mus musculus
tattactgtccatgtccagtaaagt

SEQ ID NO: 49615 - DNA, 25 bp, mus musculus
gctctccagattccagtcagagttc

SEQ ID NO: 49616 - DNA, 25 bp, mus musculus
cagattccagtcagagttctatggc

SEQ ID NO: 49617 - DNA, 25 bp, mus musculus
agagttctatggcccaggaggaaga

SEQ ID NO: 49618 - DNA, 25 bp, mus musculus
tggcacagctagctgaagagaacga

SEQ ID NO: 49619 - DNA, 25 bp, mus musculus
agaacgagcggctcaagcaggaaat

SEQ ID NO: 49620 - DNA, 25 bp, mus musculus
agaccacacggcgggctctgatcga

SEQ ID NO: 49621 - DNA, 25 bp, mus musculus
tgatcgaccgcatggtcagcctgca

SEQ ID NO: 49622 - DNA, 25 bp, mus musculus
tggtcagcctgcaccaagcatgaac

SEQ ID NO: 49623 - DNA, 25 bp, mus musculus
tgctttttcacatgtcagttaaacc

SEQ ID NO: 49624 - DNA, 25 bp, mus musculus
ttcacatgtcagttaaacccagtct

SEQ ID NO: 49625 - DNA, 25 bp, mus musculus
cagatgtttcactcacattccttct

SEQ ID NO: 49626 - DNA, 25 bp, mus musculus
ccctttacacagaatgttcaaagtg

SEQ ID NO: 49627 - DNA, 25 bp, mus musculus
aggatcactgttccattcagaagaa

SEQ ID NO: 49628 - DNA, 25 bp, mus musculus
actgttccattcagaagaatgggac

SEQ ID NO: 49629 - DNA, 25 bp, mus musculus
atgggacacagctgacaggatccag

SEQ ID NO: 49630 - DNA, 25 bp, mus musculus
cacagctgacaggatccagtgcttg

SEQ ID NO: 49631 - DNA, 25 bp, mus musculus
gatccagtgcttgctagatttcatc

SEQ ID NO: 49632 - DNA, 25 bp, mus musculus
atggcagccttaaatacttatctat

SEQ ID NO: 49633 - DNA, 25 bp, mus musculus
gccttaaatacttatctatttgtct

SEQ ID NO: 49634 - DNA, 25 bp, mus musculus
tattgtgatctgtacctaagaataa

SEQ ID NO: 49635 - DNA, 25 bp, mus musculus
taaatacttgttcagctactggcta

SEQ ID NO: 49636 - DNA, 25 bp, mus musculus
cttgttcagctactggctacaagca

SEQ ID NO: 49637 - DNA, 25 bp, mus musculus
ctggctacaagcatggctgatttca

SEQ ID NO: 49638 - DNA, 25 bp, mus musculus
atggctgatttcagtgctgtctttc

SEQ ID NO: 49639 - DNA, 25 bp, mus musculus
gatttcagtgctgtctttcatataa

SEQ ID NO: 49640 - DNA, 25 bp, mus musculus
agtgctgtctttcatataagtggtg

SEQ ID NO: 49641 - DNA, 25 bp, mus musculus
ttcaacattcaccagatgtttcact

SEQ ID NO: 49642 - DNA, 25 bp, mus musculus
attcaccagatgtttcactcacatt

SEQ ID NO: 49643 - DNA, 25 bp, mus musculus
atgtctactggactacttagacaca

SEQ ID NO: 49644 - DNA, 25 bp, mus musculus
actggactacttagacacagcaggt

SEQ ID NO: 49645 - DNA, 25 bp, mus musculus
tgacctggctgctcgcactgttgag

SEQ ID NO: 49646 - DNA, 25 bp, mus musculus
ggctgctcgcactgttgagtctcgg

SEQ ID NO: 49647 - DNA, 25 bp, mus musculus
tcgcactgttgagtctcggcaggcc

SEQ ID NO: 49648 - DNA, 25 bp, mus musculus
tgttgagtctcggcaggcccaggac

SEQ ID NO: 49649 - DNA, 25 bp, mus musculus
ccaggaccttgctcgcagctatggc

SEQ ID NO: 49650 - DNA, 25 bp, mus musculus
tcgcagctatggcatcccctacatt

SEQ ID NO: 49651 - DNA, 25 bp, mus musculus
ctatggcatcccctacattgaaaca

SEQ ID NO: 49652 - DNA, 25 bp, mus musculus
catcccctacattgaaacatcagcc

SEQ ID NO: 49653 - DNA, 25 bp, mus musculus
ctatacactagtccgtgagattcgg

SEQ ID NO: 49654 - DNA, 25 bp, mus musculus
actagtccgtgagattcggcagcat

SEQ ID NO: 49655 - DNA, 25 bp, mus musculus
ctacttagacacagcaggtcaagaa

SEQ ID NO: 49656 - DNA, 25 bp, mus musculus
agagtatagtgccatgcgggaccag

SEQ ID NO: 49657 - DNA, 25 bp, mus musculus
tgtatttgccatcaacaacaccaag

SEQ ID NO: 49658 - DNA, 25 bp, mus musculus
tgccatcaacaacaccaagtccttc

SEQ ID NO: 49659 - DNA, 25 bp, mus musculus
caccaagtccttcgaggacatccat

SEQ ID NO: 49660 - DNA, 25 bp, mus musculus
cgaggacatccatcagtacagggag

SEQ ID NO: 49661 - DNA, 25 bp, mus musculus
catccatcagtacagggagcagatc

SEQ ID NO: 49662 - DNA, 25 bp, mus musculus
caagtgtgacctggctgctcgcact

SEQ ID NO: 49663 - DNA, 25 bp, mus musculus
tgagatgcttcagttcctgctcatt

SEQ ID NO: 49664 - DNA, 25 bp, mus musculus
gatgcttcagttcctgctcatttag

SEQ ID NO: 49665 - DNA, 25 bp, mus musculus
catggacttcatgtgcgagacccca

SEQ ID NO: 49666 - DNA, 25 bp, mus musculus
cttcatgtgcgagaccccatgccag

SEQ ID NO: 49667 - DNA, 25 bp, mus musculus
gtgcgagaccccatgccaggatggt

SEQ ID NO: 49668 - DNA, 25 bp, mus musculus
tgtctggcttcctagccattgcact

SEQ ID NO: 49669 - DNA, 25 bp, mus musculus
ctggcttcctagccattgcactgca

SEQ ID NO: 49670 - DNA, 25 bp, mus musculus
gcttcctagccattgcactgcaggt

SEQ ID NO: 49671 - DNA, 25 bp, mus musculus
tcctagccattgcactgcaggtggg

SEQ ID NO: 49672 - DNA, 25 bp, mus musculus
tagccattgcactgcaggtgggaac

SEQ ID NO: 49673 - DNA, 25 bp, mus musculus
ccattgcactgcaggtgggaacatg

SEQ ID NO: 49674 - DNA, 25 bp, mus musculus
ttgcactgcaggtgggaacatgtcg

SEQ ID NO: 49675 - DNA, 25 bp, mus musculus
gcttcagttcctgctcatttaggaa

SEQ ID NO: 49676 - DNA, 25 bp, mus musculus
tgtaggctccgtctgtcgatttgtt

SEQ ID NO: 49677 - DNA, 25 bp, mus musculus
aggctccgtctgtcgatttgttgcc

SEQ ID NO: 49678 - DNA, 25 bp, mus musculus
ctccgtctgtcgatttgttgccggt

SEQ ID NO: 49679 - DNA, 25 bp, mus musculus
cgtctgtcgatttgttgccggtgcc

SEQ ID NO: 49680 - DNA, 25 bp, mus musculus
atttgttgccggtgccctcatggac

SEQ ID NO: 49681 - DNA, 25 bp, mus musculus
cggtgccctcatggacttcatgtgc

SEQ ID NO: 49682 - DNA, 25 bp, mus musculus
tgccctcatggacttcatgtgcgag

SEQ ID NO: 49683 - DNA, 25 bp, mus musculus
tccttacaggattcaggtatgttgc

SEQ ID NO: 49684 - DNA, 25 bp, mus musculus
ttaggccgtgtggccatgaacctgg

SEQ ID NO: 49685 - DNA, 25 bp, mus musculus
gttaccgcgctctgtttgaaacatg

SEQ ID NO: 49686 - DNA, 25 bp, mus musculus
accgcgctctgtttgaaacatgtct

SEQ ID NO: 49687 - DNA, 25 bp, mus musculus
tacttaaggggccacaccattgaga

SEQ ID NO: 49688 - DNA, 25 bp, mus musculus
aggggccacaccattgagaattttg

SEQ ID NO: 49689 - DNA, 25 bp, mus musculus
ctttcagttgcttgatgtttggaat

SEQ ID NO: 49690 - DNA, 25 bp, mus musculus
tcagttgcttgatgtttggaattat

SEQ ID NO: 49691 - DNA, 25 bp, mus musculus
tttgaatattcctgagcccatgagt

SEQ ID NO: 49692 - DNA, 25 bp, mus musculus
gaatattcctgagcccatgagtccc

SEQ ID NO: 49693 - DNA, 25 bp, mus musculus
tgagcccatgagtccctgaaaatat

SEQ ID NO: 49694 - DNA, 25 bp, mus musculus
gttgtccaactgttgacagttctga

SEQ ID NO: 49695 - DNA, 25 bp, mus musculus
atcgtttcgacttgagtgctacact

SEQ ID NO: 49696 - DNA, 25 bp, mus musculus
aactgttgacagttctgaagaattc

SEQ ID NO: 49697 - DNA, 25 bp, mus musculus
tcgacttgagtgctacactcttgca

SEQ ID NO: 49698 - DNA, 25 bp, mus musculus
tgagtgctacactcttgcacctttc

SEQ ID NO: 49699 - DNA, 25 bp, mus musculus
gtgctacactcttgcacctttccaa

SEQ ID NO: 49700 - DNA, 25 bp, mus musculus
tcttgcacctttccaaagtaagctg

SEQ ID NO: 49701 - DNA, 25 bp, mus musculus
tgcacctttccaaagtaagctggtt

SEQ ID NO: 49702 - DNA, 25 bp, mus musculus
ttggaggtcctgtggtcatgtacga

SEQ ID NO: 49703 - DNA, 25 bp, mus musculus
acgagactgtcaccagttaccgcgc

SEQ ID NO: 49704 - DNA, 25 bp, mus musculus
cagtctgggggcatgcgaggtacct

SEQ ID NO: 49705 - DNA, 25 bp, mus musculus
atgcgaggtacctgttccagaggcc

SEQ ID NO: 49706 - DNA, 25 bp, mus musculus
tacccgtgcacctggctgcacatct

SEQ ID NO: 49707 - DNA, 25 bp, mus musculus
acccgtgcacctggctgcacatctg

SEQ ID NO: 49708 - DNA, 25 bp, mus musculus
cgtgcacctggctgcacatctggcc

SEQ ID NO: 49709 - DNA, 25 bp, mus musculus
gtgcacctggctgcacatctggccg

SEQ ID NO: 49710 - DNA, 25 bp, mus musculus
tgcacctggctgcacatctggccgg

SEQ ID NO: 49711 - DNA, 25 bp, mus musculus
gcacctggctgcacatctggccggg

SEQ ID NO: 49712 - DNA, 25 bp, mus musculus
tgcgaggtacctgttccagaggcct

SEQ ID NO: 49713 - DNA, 25 bp, mus musculus
ctgttccagaggccttatacccgtg

SEQ ID NO: 49714 - DNA, 25 bp, mus musculus
tgttccagaggccttatacccgtgc

SEQ ID NO: 49715 - DNA, 25 bp, mus musculus
cagaggccttatacccgtgcacctg

SEQ ID NO: 49716 - DNA, 25 bp, mus musculus
cttatacccgtgcacctggctgcac

SEQ ID NO: 49717 - DNA, 25 bp, mus musculus
ttatacccgtgcacctggctgcaca

SEQ ID NO: 49718 - DNA, 25 bp, mus musculus
tatacccgtgcacctggctgcacat

SEQ ID NO: 49719 - DNA, 25 bp, mus musculus
atacccgtgcacctggctgcacatc

SEQ ID NO: 49720 - DNA, 25 bp, mus musculus
agagaatggcccctgacggtatgga

SEQ ID NO: 49721 - DNA, 25 bp, mus musculus
gagaatggcccctgacggtatggag

SEQ ID NO: 49722 - DNA, 25 bp, mus musculus
cggacgtctatctgagagtaacgtg

SEQ ID NO: 49723 - DNA, 25 bp, mus musculus
ctcctcctgtggtatttatgcctat

SEQ ID NO: 49724 - DNA, 25 bp, mus musculus
tcctcctgtggtatttatgcctatg

SEQ ID NO: 49725 - DNA, 25 bp, mus musculus
cctcctgtggtatttatgcctatgg

SEQ ID NO: 49726 - DNA, 25 bp, mus musculus
atgtgattgctcaatcccagttgtt

SEQ ID NO: 49727 - DNA, 25 bp, mus musculus
tgtgattgctcaatcccagttgttg

SEQ ID NO: 49728 - DNA, 25 bp, mus musculus
gtgattgctcaatcccagttgttgg

SEQ ID NO: 49729 - DNA, 25 bp, mus musculus
tgattgctcaatcccagttgttgga

SEQ ID NO: 49730 - DNA, 25 bp, mus musculus
gattgctcaatcccagttgttggac

SEQ ID NO: 49731 - DNA, 25 bp, mus musculus
attgctcaatcccagttgttggact

SEQ ID NO: 49732 - DNA, 25 bp, mus musculus
agaatggcccctgacggtatggagc

SEQ ID NO: 49733 - DNA, 25 bp, mus musculus
ttgctcaatcccagttgttggactg

SEQ ID NO: 49734 - DNA, 25 bp, mus musculus
gaatggcccctgacggtatggagcc

SEQ ID NO: 49735 - DNA, 25 bp, mus musculus
gtatggagccggacgtctatctgag

SEQ ID NO: 49736 - DNA, 25 bp, mus musculus
tggagccggacgtctatctgagagt

SEQ ID NO: 49737 - DNA, 25 bp, mus musculus
gagccggacgtctatctgagagtaa

SEQ ID NO: 49738 - DNA, 25 bp, mus musculus
agccggacgtctatctgagagtaac

SEQ ID NO: 49739 - DNA, 25 bp, mus musculus
gccggacgtctatctgagagtaacg

SEQ ID NO: 49740 - DNA, 25 bp, mus musculus
ccggacgtctatctgagagtaacgt

SEQ ID NO: 49741 - DNA, 25 bp, mus musculus
cgcctcctggaagtccaatcattgg

SEQ ID NO: 49742 - DNA, 25 bp, mus musculus
gcctcctggaagtccaatcattggg

SEQ ID NO: 49743 - DNA, 25 bp, mus musculus
ctgtcctctgggttctggccaatga

SEQ ID NO: 49744 - DNA, 25 bp, mus musculus
tgtcctctgggttctggccaatgag

SEQ ID NO: 49745 - DNA, 25 bp, mus musculus
tcctctgggttctggccaatgagaa

SEQ ID NO: 49746 - DNA, 25 bp, mus musculus
cctctgggttctggccaatgagaac

SEQ ID NO: 49747 - DNA, 25 bp, mus musculus
ctctgggttctggccaatgagaacc

SEQ ID NO: 49748 - DNA, 25 bp, mus musculus
ctgggttctggccaatgagaacctg

SEQ ID NO: 49749 - DNA, 25 bp, mus musculus
ttctggccaatgagaacctgcctct

SEQ ID NO: 49750 - DNA, 25 bp, mus musculus
caatgagaacctgcctctccggagc

SEQ ID NO: 49751 - DNA, 25 bp, mus musculus
aatgagaacctgcctctccggagcc

SEQ ID NO: 49752 - DNA, 25 bp, mus musculus
atgagaacctgcctctccggagccc

SEQ ID NO: 49753 - DNA, 25 bp, mus musculus
ctcctggaagtccaatcattgggct

SEQ ID NO: 49754 - DNA, 25 bp, mus musculus
tcctggaagtccaatcattgggctc

SEQ ID NO: 49755 - DNA, 25 bp, mus musculus
cctggaagtccaatcattgggctct

SEQ ID NO: 49756 - DNA, 25 bp, mus musculus
gaagtccaatcattgggctctgtcc

SEQ ID NO: 49757 - DNA, 25 bp, mus musculus
agtccaatcattgggctctgtcctc

SEQ ID NO: 49758 - DNA, 25 bp, mus musculus
gtccaatcattgggctctgtcctct

SEQ ID NO: 49759 - DNA, 25 bp, mus musculus
caatcattgggctctgtcctctggg

SEQ ID NO: 49760 - DNA, 25 bp, mus musculus
aatcattgggctctgtcctctgggt

SEQ ID NO: 49761 - DNA, 25 bp, mus musculus
tgattctgccacaggaccagtgcca

SEQ ID NO: 49762 - DNA, 25 bp, mus musculus
attctgccacaggaccagtgccaag

SEQ ID NO: 49763 - DNA, 25 bp, mus musculus
ctttcagacggagcccacttagctt

SEQ ID NO: 49764 - DNA, 25 bp, mus musculus
ttcagacggagcccacttagcttgt

SEQ ID NO: 49765 - DNA, 25 bp, mus musculus
gacggagcccacttagcttgtccac

SEQ ID NO: 49766 - DNA, 25 bp, mus musculus
cggagcccacttagcttgtccacat

SEQ ID NO: 49767 - DNA, 25 bp, mus musculus
gagcccacttagcttgtccacatgt

SEQ ID NO: 49768 - DNA, 25 bp, mus musculus
gcccacttagcttgtccacatgtat

SEQ ID NO: 49769 - DNA, 25 bp, mus musculus
acttagcttgtccacatgtatctca

SEQ ID NO: 49770 - DNA, 25 bp, mus musculus
ttagcttgtccacatgtatctcaat

SEQ ID NO: 49771 - DNA, 25 bp, mus musculus
agcttgtccacatgtatctcaatgc

SEQ ID NO: 49772 - DNA, 25 bp, mus musculus
cttgtccacatgtatctcaatgcca

SEQ ID NO: 49773 - DNA, 25 bp, mus musculus
tctgccacaggaccagtgccaaggc

SEQ ID NO: 49774 - DNA, 25 bp, mus musculus
tgtccacatgtatctcaatgccaac

SEQ ID NO: 49775 - DNA, 25 bp, mus musculus
aggaccagtgccaaggcaatcagat

SEQ ID NO: 49776 - DNA, 25 bp, mus musculus
gaccagtgccaaggcaatcagatct

SEQ ID NO: 49777 - DNA, 25 bp, mus musculus
ccagtgccaaggcaatcagatcttt

SEQ ID NO: 49778 - DNA, 25 bp, mus musculus
taaacgttcgtggatgaatgccaac

SEQ ID NO: 49779 - DNA, 25 bp, mus musculus
gatgaatgccaactttcagacggag

SEQ ID NO: 49780 - DNA, 25 bp, mus musculus
tgaatgccaactttcagacggagcc

SEQ ID NO: 49781 - DNA, 25 bp, mus musculus
aatgccaactttcagacggagccca

SEQ ID NO: 49782 - DNA, 25 bp, mus musculus
cgtggagactctcatcaaggagaca

SEQ ID NO: 49783 - DNA, 25 bp, mus musculus
agactacaacggctttcctgtgctc

SEQ ID NO: 49784 - DNA, 25 bp, mus musculus
gaggcgcattttcaacctgagccct

SEQ ID NO: 49785 - DNA, 25 bp, mus musculus
cattttcaacctgagccctttcacg

SEQ ID NO: 49786 - DNA, 25 bp, mus musculus
caacctgagccctttcacggtcaca

SEQ ID NO: 49787 - DNA, 25 bp, mus musculus
gagccctttcacggtcacagatcac

SEQ ID NO: 49788 - DNA, 25 bp, mus musculus
gctccgacaatgcctggtgacacgg

SEQ ID NO: 49789 - DNA, 25 bp, mus musculus
tgttctgagacacatggcccagatg

SEQ ID NO: 49790 - DNA, 25 bp, mus musculus
gagacacatggcccagatggcaaac

SEQ ID NO: 49791 - DNA, 25 bp, mus musculus
ggcaaaccaggaccctgaatccatc

SEQ ID NO: 49792 - DNA, 25 bp, mus musculus
ccaggaccctgaatccatcatgttt

SEQ ID NO: 49793 - DNA, 25 bp, mus musculus
ccctgaatccatcatgtttaattag

SEQ ID NO: 49794 - DNA, 25 bp, mus musculus
caacggctttcctgtgctcgtctcc

SEQ ID NO: 49795 - DNA, 25 bp, mus musculus
tgtgctcgtctccagagactcggag

SEQ ID NO: 49796 - DNA, 25 bp, mus musculus
ctcggagcgtctcatcgggtttgcc

SEQ ID NO: 49797 - DNA, 25 bp, mus musculus
gcgtctcatcgggtttgcccagagg

SEQ ID NO: 49798 - DNA, 25 bp, mus musculus
aaatgccaggcagaggcaagagggc

SEQ ID NO: 49799 - DNA, 25 bp, mus musculus
gagcaattccatcatgtacttcaca

SEQ ID NO: 49800 - DNA, 25 bp, mus musculus
tgagctgcctgccaacagcccacat

SEQ ID NO: 49801 - DNA, 25 bp, mus musculus
tccactgaagctgaggcgcattttc

SEQ ID NO: 49802 - DNA, 25 bp, mus musculus
tggctttcctgttataatgtcaaaa

SEQ ID NO: 49803 - DNA, 25 bp, mus musculus
agacctgactattgcaatagaaagt

SEQ ID NO: 49804 - DNA, 25 bp, mus musculus
tggtctgaggcagtgccttgtaact

SEQ ID NO: 49805 - DNA, 25 bp, mus musculus
gtgccttgtaactcacaacggacgc

SEQ ID NO: 49806 - DNA, 25 bp, mus musculus
tcacaacggacgcctccttggcatt

SEQ ID NO: 49807 - DNA, 25 bp, mus musculus
agatatcctccgtcatatggcccag

SEQ ID NO: 49808 - DNA, 25 bp, mus musculus
cctccgtcatatggcccagacggca

SEQ ID NO: 49809 - DNA, 25 bp, mus musculus
tcatatggcccagacggcaaaccaa

SEQ ID NO: 49810 - DNA, 25 bp, mus musculus
gttcaactgagtcctgtagatgagg

SEQ ID NO: 49811 - DNA, 25 bp, mus musculus
aatagcacaattctttaatctgcgg

SEQ ID NO: 49812 - DNA, 25 bp, mus musculus
acaattctttaatctgcgggactcg

SEQ ID NO: 49813 - DNA, 25 bp, mus musculus
ctttaatctgcgggactcgtccact

SEQ ID NO: 49814 - DNA, 25 bp, mus musculus
cagttctcgggtgtgttttgcacag

SEQ ID NO: 49815 - DNA, 25 bp, mus musculus
gtgttttgcacagcatactccatct

SEQ ID NO: 49816 - DNA, 25 bp, mus musculus
gcatactccatctcttccagcagaa

SEQ ID NO: 49817 - DNA, 25 bp, mus musculus
tccatctcttccagcagaaagtcca

SEQ ID NO: 49818 - DNA, 25 bp, mus musculus
tcttccagcagaaagtccacggcca

SEQ ID NO: 49819 - DNA, 25 bp, mus musculus
aagcatccttgacatgagccctttt

SEQ ID NO: 49820 - DNA, 25 bp, mus musculus
catgagcccttttacagtgacagac

SEQ ID NO: 49821 - DNA, 25 bp, mus musculus
agacatctttcgaaagcttggtctg

SEQ ID NO: 49822 - DNA, 25 bp, mus musculus
aattatgagacccagtggggtcttg

SEQ ID NO: 49823 - DNA, 25 bp, mus musculus
gagacccagtggggtcttgctgtca

SEQ ID NO: 49824 - DNA, 25 bp, mus musculus
ggataataacagaaccccatagagc

SEQ ID NO: 49825 - DNA, 25 bp, mus musculus
taacagaaccccatagagcagtgtg

SEQ ID NO: 49826 - DNA, 25 bp, mus musculus
aaccccatagagcagtgtgaacaat

SEQ ID NO: 49827 - DNA, 25 bp, mus musculus
tagatcccacagtgttttctgtgga

SEQ ID NO: 49828 - DNA, 25 bp, mus musculus
acatttgtttcttgctcctggatag

SEQ ID NO: 49829 - DNA, 25 bp, mus musculus
gtttcttgctcctggatagtgagtt

SEQ ID NO: 49830 - DNA, 25 bp, mus musculus
tgctcctggatagtgagttgaaagg

SEQ ID NO: 49831 - DNA, 25 bp, mus musculus
ccccagcatcttcaatactatttca

SEQ ID NO: 49832 - DNA, 25 bp, mus musculus
catcttcaatactatttcacgtatg

SEQ ID NO: 49833 - DNA, 25 bp, mus musculus
tatttcacgtatgacaggtggcagg

SEQ ID NO: 49834 - DNA, 25 bp, mus musculus
gtgccacagtatcaccttccttcct

SEQ ID NO: 49835 - DNA, 25 bp, mus musculus
cagtatcaccttccttcctggttct

SEQ ID NO: 49836 - DNA, 25 bp, mus musculus
gccaactctggagctagaaccaggt

SEQ ID NO: 49837 - DNA, 25 bp, mus musculus
cacctgctagctgtgcaaacttagg

SEQ ID NO: 49838 - DNA, 25 bp, mus musculus
agcctttgagccttttccctctcat

SEQ ID NO: 49839 - DNA, 25 bp, mus musculus
tgagccttttccctctcatctacga

SEQ ID NO: 49840 - DNA, 25 bp, mus musculus
ttttccctctcatctacgaagtgtg

SEQ ID NO: 49841 - DNA, 25 bp, mus musculus
ctctcatctacgaagtgtggataat

SEQ ID NO: 49842 - DNA, 25 bp, mus musculus
tcatgtcccacaaacaagtctacta

SEQ ID NO: 49843 - DNA, 25 bp, mus musculus
atgtcccacaaacaagtctactatt

SEQ ID NO: 49844 - DNA, 25 bp, mus musculus
atattgcccgaggacatagccaaag

SEQ ID NO: 49845 - DNA, 25 bp, mus musculus
tgcccgaggacatagccaaagctgg

SEQ ID NO: 49846 - DNA, 25 bp, mus musculus
gacatagccaaagctggtcgcgaaa

SEQ ID NO: 49847 - DNA, 25 bp, mus musculus
gaacctcggcgtttcactgagtcag

SEQ ID NO: 49848 - DNA, 25 bp, mus musculus
ggtccacgatatgatccatgaagca

SEQ ID NO: 49849 - DNA, 25 bp, mus musculus
tgaagcagagacctcacgtcttact

SEQ ID NO: 49850 - DNA, 25 bp, mus musculus
actgttccgatggccactgcccaag

SEQ ID NO: 49851 - DNA, 25 bp, mus musculus
tgttccgatggccactgcccaagaa

SEQ ID NO: 49852 - DNA, 25 bp, mus musculus
gccactgcccaagaagccatagaaa

SEQ ID NO: 49853 - DNA, 25 bp, mus musculus
cactgcccaagaagccatagaaatg

SEQ ID NO: 49854 - DNA, 25 bp, mus musculus
cacaaacaagtctactattcggaca

SEQ ID NO: 49855 - DNA, 25 bp, mus musculus
caagtctactattcggacaaatacg

SEQ ID NO: 49856 - DNA, 25 bp, mus musculus
tctactattcggacaaatacgacga

SEQ ID NO: 49857 - DNA, 25 bp, mus musculus
tactattcggacaaatacgacgacg

SEQ ID NO: 49858 - DNA, 25 bp, mus musculus
agttcgaataccggcatgtcatatt

SEQ ID NO: 49859 - DNA, 25 bp, mus musculus
ttcgaataccggcatgtcatattgc

SEQ ID NO: 49860 - DNA, 25 bp, mus musculus
aataccggcatgtcatattgcccga

SEQ ID NO: 49861 - DNA, 25 bp, mus musculus
taccggcatgtcatattgcccgagg

SEQ ID NO: 49862 - DNA, 25 bp, mus musculus
ttcacttacacagttctagaggatg

SEQ ID NO: 49863 - DNA, 25 bp, mus musculus
ggctgtactaaacacactggggaat

SEQ ID NO: 49864 - DNA, 25 bp, mus musculus
gccaaactctctgaaaccccagcaa

SEQ ID NO: 49865 - DNA, 25 bp, mus musculus
aaaccacatccatgtgttcatcttg

SEQ ID NO: 49866 - DNA, 25 bp, mus musculus
catccatgtgttcatcttgttttaa

SEQ ID NO: 49867 - DNA, 25 bp, mus musculus
gttttaatcttatcaaccagtgcaa

SEQ ID NO: 49868 - DNA, 25 bp, mus musculus
atcttatcaaccagtgcaagtgacc

SEQ ID NO: 49869 - DNA, 25 bp, mus musculus
tcaaccagtgcaagtgaccaactaa

SEQ ID NO: 49870 - DNA, 25 bp, mus musculus
tttgctgtttcaaccacccaataca

SEQ ID NO: 49871 - DNA, 25 bp, mus musculus
accacccaatacaggtcaaatgctt

SEQ ID NO: 49872 - DNA, 25 bp, mus musculus
caattccaacttcaaaatgtctcaa

SEQ ID NO: 49873 - DNA, 25 bp, mus musculus
caacttcaaaatgtctcaatggtgc

SEQ ID NO: 49874 - DNA, 25 bp, mus musculus
actaaacacactggggaatggagca

SEQ ID NO: 49875 - DNA, 25 bp, mus musculus
gaatatcaaacacgcaaggcaatga

SEQ ID NO: 49876 - DNA, 25 bp, mus musculus
caaacacgcaaggcaatgagactac

SEQ ID NO: 49877 - DNA, 25 bp, mus musculus
gcaatgagactacccatcatagata

SEQ ID NO: 49878 - DNA, 25 bp, mus musculus
agactacccatcatagatatcgcac

SEQ ID NO: 49879 - DNA, 25 bp, mus musculus
cccatcatagatatcgcaccctatg

SEQ ID NO: 49880 - DNA, 25 bp, mus musculus
atagatatcgcaccctatgacattg

SEQ ID NO: 49881 - DNA, 25 bp, mus musculus
ccctatgacattgggggtcctgatc

SEQ ID NO: 49882 - DNA, 25 bp, mus musculus
cgcaccctacataggatatctggga

SEQ ID NO: 49883 - DNA, 25 bp, mus musculus
caccctacataggatatctgggaaa

SEQ ID NO: 49884 - DNA, 25 bp, mus musculus
taggagcccatagcagcacatctat

SEQ ID NO: 49885 - DNA, 25 bp, mus musculus
ggagcccatagcagcacatctatag

SEQ ID NO: 49886 - DNA, 25 bp, mus musculus
cccatagcagcacatctatagaaga

SEQ ID NO: 49887 - DNA, 25 bp, mus musculus
catagcagcacatctatagaagaca

SEQ ID NO: 49888 - DNA, 25 bp, mus musculus
tagcagcacatctatagaagacacc

SEQ ID NO: 49889 - DNA, 25 bp, mus musculus
catctatagaagacacctagcggaa

SEQ ID NO: 49890 - DNA, 25 bp, mus musculus
tctatagaagacacctagcggaagc

SEQ ID NO: 49891 - DNA, 25 bp, mus musculus
tatagaagacacctagcggaagctt

SEQ ID NO: 49892 - DNA, 25 bp, mus musculus
agacacctagcggaagcttagatgt

SEQ ID NO: 49893 - DNA, 25 bp, mus musculus
acacctagcggaagcttagatgtga

SEQ ID NO: 49894 - DNA, 25 bp, mus musculus
tgggaaaactcacattctcagagat

SEQ ID NO: 49895 - DNA, 25 bp, mus musculus
ggaaaactcacattctcagagatgt

SEQ ID NO: 49896 - DNA, 25 bp, mus musculus
ctcacattctcagagatgtctgtcg

SEQ ID NO: 49897 - DNA, 25 bp, mus musculus
cacattctcagagatgtctgtcggc

SEQ ID NO: 49898 - DNA, 25 bp, mus musculus
actgaagctaactgtgtgggaaggt

SEQ ID NO: 49899 - DNA, 25 bp, mus musculus
agtcctactaggagcccatagcagc

SEQ ID NO: 49900 - DNA, 25 bp, mus musculus
ctactaggagcccatagcagcacat

SEQ ID NO: 49901 - DNA, 25 bp, mus musculus
actaggagcccatagcagcacatct

SEQ ID NO: 49902 - DNA, 25 bp, mus musculus
gcagccatgcgacactacatcgtgt

SEQ ID NO: 49903 - DNA, 25 bp, mus musculus
cgacactacatcgtgttcatcgata

SEQ ID NO: 49904 - DNA, 25 bp, mus musculus
caatccgctataagggttccacctg

SEQ ID NO: 49905 - DNA, 25 bp, mus musculus
gttccacctgtcacagaatcactgc

SEQ ID NO: 49906 - DNA, 25 bp, mus musculus
gtcacagaatcactgcagaagtcat

SEQ ID NO: 49907 - DNA, 25 bp, mus musculus
gaatcactgcagaagtcatgtgcaa

SEQ ID NO: 49908 - DNA, 25 bp, mus musculus
ttacacgccataacggtactgaagg

SEQ ID NO: 49909 - DNA, 25 bp, mus musculus
ataacggtactgaaggcaggactat

SEQ ID NO: 49910 - DNA, 25 bp, mus musculus
gcaggactatctagccatagacatc

SEQ ID NO: 49911 - DNA, 25 bp, mus musculus
tctagccatagacatctgataataa

SEQ ID NO: 49912 - DNA, 25 bp, mus musculus
ataataacttatcctagagcataca

SEQ ID NO: 49913 - DNA, 25 bp, mus musculus
acttatcctagagcatacatgtcct

SEQ ID NO: 49914 - DNA, 25 bp, mus musculus
tacatcgtgttcatcgatatcacgg

SEQ ID NO: 49915 - DNA, 25 bp, mus musculus
gtgttcatcgatatcacggaagatg

SEQ ID NO: 49916 - DNA, 25 bp, mus musculus
gaagatcgcatgacgcgcatctcct

SEQ ID NO: 49917 - DNA, 25 bp, mus musculus
cgcatgacgcgcatctccttcgaga

SEQ ID NO: 49918 - DNA, 25 bp, mus musculus
cgcatctccttcgagatgctgtgac

SEQ ID NO: 49919 - DNA, 25 bp, mus musculus
aatgaaactacagcaatctgagcac

SEQ ID NO: 49920 - DNA, 25 bp, mus musculus
actacagcaatctgagcactggaga

SEQ ID NO: 49921 - DNA, 25 bp, mus musculus
gagataaatcaatccgctataaggg

SEQ ID NO: 49922 - DNA, 25 bp, mus musculus
gcatggagccctgagcgtggcactg

SEQ ID NO: 49923 - DNA, 25 bp, mus musculus
tggagccctgagcgtggcactgagc

SEQ ID NO: 49924 - DNA, 25 bp, mus musculus
ccctacttggcctgagttaggcctg

SEQ ID NO: 49925 - DNA, 25 bp, mus musculus
tacttggcctgagttaggcctgcca

SEQ ID NO: 49926 - DNA, 25 bp, mus musculus
tgagttaggcctgccagacagccct

SEQ ID NO: 49927 - DNA, 25 bp, mus musculus
aggcctgccagacagccctggcaat

SEQ ID NO: 49928 - DNA, 25 bp, mus musculus
agacagccctggcaatctgctgcgc

SEQ ID NO: 49929 - DNA, 25 bp, mus musculus
caatctgctgcgcttcatccaggag

SEQ ID NO: 49930 - DNA, 25 bp, mus musculus
gcatgcacattatttgcaccagcga

SEQ ID NO: 49931 - DNA, 25 bp, mus musculus
acattatttgcaccagcgacccctg

SEQ ID NO: 49932 - DNA, 25 bp, mus musculus
ttatttgcaccagcgacccctgcac

SEQ ID NO: 49933 - DNA, 25 bp, mus musculus
acccctgcacacacctattgtcgta

SEQ ID NO: 49934 - DNA, 25 bp, mus musculus
cagtattcgtactactgagacccat

SEQ ID NO: 49935 - DNA, 25 bp, mus musculus
gcacacacctattgtcgtacactgc

SEQ ID NO: 49936 - DNA, 25 bp, mus musculus
tattcgtactactgagacccatgtg

SEQ ID NO: 49937 - DNA, 25 bp, mus musculus
tactgagacccatgtggagcgagtg

SEQ ID NO: 49938 - DNA, 25 bp, mus musculus
ccatgtggagcgagtgctgagtctg

SEQ ID NO: 49939 - DNA, 25 bp, mus musculus
gttccgggatcagagcctcaagcgc

SEQ ID NO: 49940 - DNA, 25 bp, mus musculus
tcagagcctcaagcgctctcttgtg

SEQ ID NO: 49941 - DNA, 25 bp, mus musculus
gagcctcaagcgctctcttgtgcac

SEQ ID NO: 49942 - DNA, 25 bp, mus musculus
tcttgtgcacctccatttccctact

SEQ ID NO: 49943 - DNA, 25 bp, mus musculus
ggactggatccagccatctcgtctt

SEQ ID NO: 49944 - DNA, 25 bp, mus musculus
ccgtggtgtcttcacaccatcactg

SEQ ID NO: 49945 - DNA, 25 bp, mus musculus
aggtgcttgtcagtgacctacatgc

SEQ ID NO: 49946 - DNA, 25 bp, mus musculus
ttccactctgaaagcaaaggtgcta

SEQ ID NO: 49947 - DNA, 25 bp, mus musculus
cacacccagaggcttagcttggaca

SEQ ID NO: 49948 - DNA, 25 bp, mus musculus
ttggacagttcacactcaagtgtcc

SEQ ID NO: 49949 - DNA, 25 bp, mus musculus
cactcaagtgtcctgtcagaatcaa

SEQ ID NO: 49950 - DNA, 25 bp, mus musculus
agtgtcctgtcagaatcaatccaga

SEQ ID NO: 49951 - DNA, 25 bp, mus musculus
ctgtcagaatcaatccagagctttc

SEQ ID NO: 49952 - DNA, 25 bp, mus musculus
gaatcaatccagagctttctccctc

SEQ ID NO: 49953 - DNA, 25 bp, mus musculus
gtaatctgatccaagccagctatct

SEQ ID NO: 49954 - DNA, 25 bp, mus musculus
tgatccaagccagctatctctgcta

SEQ ID NO: 49955 - DNA, 25 bp, mus musculus
tgtcttcacaccatcactgcagttt

SEQ ID NO: 49956 - DNA, 25 bp, mus musculus
cacaccatcactgcagtttccgtct

SEQ ID NO: 49957 - DNA, 25 bp, mus musculus
atcactgcagtttccgtctgtgttc

SEQ ID NO: 49958 - DNA, 25 bp, mus musculus
tgtgttctgtcttccatgctcaaca

SEQ ID NO: 49959 - DNA, 25 bp, mus musculus
tccatgctcaacatgaagcagacct

SEQ ID NO: 49960 - DNA, 25 bp, mus musculus
cagaccttctcatgagttcagcttg

SEQ ID NO: 49961 - DNA, 25 bp, mus musculus
tgagttcagcttgctggattatggc

SEQ ID NO: 49962 - DNA, 25 bp, mus musculus
ttcatcaggtgcttgtcagtgacct

SEQ ID NO: 49963 - DNA, 25 bp, mus musculus
caagagacccagctagaggagcagc

SEQ ID NO: 49964 - DNA, 25 bp, mus musculus
cagctgtaccagcaggcactgaggc

SEQ ID NO: 49965 - DNA, 25 bp, mus musculus
atccgacaatcagcgcctgtctcac

SEQ ID NO: 49966 - DNA, 25 bp, mus musculus
caatcagcgcctgtctcacgtgtct

SEQ ID NO: 49967 - DNA, 25 bp, mus musculus
tcacgtgtctggccaccggtcctat

SEQ ID NO: 49968 - DNA, 25 bp, mus musculus
gtctggccaccggtcctattacctg

SEQ ID NO: 49969 - DNA, 25 bp, mus musculus
tggccaccggtcctattacctgcgt

SEQ ID NO: 49970 - DNA, 25 bp, mus musculus
agccgtcttacagcacggcctggtc

SEQ ID NO: 49971 - DNA, 25 bp, mus musculus
cgtcttacagcacggcctggtcaac

SEQ ID NO: 49972 - DNA, 25 bp, mus musculus
cttacagcacggcctggtcaacttc

SEQ ID NO: 49973 - DNA, 25 bp, mus musculus
cctggtcaacttcaccctcagcaag

SEQ ID NO: 49974 - DNA, 25 bp, mus musculus
cttcaccctcagcaagcttgtcagc

SEQ ID NO: 49975 - DNA, 25 bp, mus musculus
ctgtaccagcaggcactgaggctgc

SEQ ID NO: 49976 - DNA, 25 bp, mus musculus
caccctcagcaagcttgtcagcagg

SEQ ID NO: 49977 - DNA, 25 bp, mus musculus
taccagcaggcactgaggctgccca

SEQ ID NO: 49978 - DNA, 25 bp, mus musculus
caggcactgaggctgcccaaccaga

SEQ ID NO: 49979 - DNA, 25 bp, mus musculus
cgaggccacctggaaattggcgaga

SEQ ID NO: 49980 - DNA, 25 bp, mus musculus
aaactggacatcatccgacaatcag

SEQ ID NO: 49981 - DNA, 25 bp, mus musculus
ctggacatcatccgacaatcagcgc

SEQ ID NO: 49982 - DNA, 25 bp, mus musculus
gacatcatccgacaatcagcgcctg

SEQ ID NO: 49983 - DNA, 25 bp, mus musculus
atcatccgacaatcagcgcctgtct

SEQ ID NO: 49984 - DNA, 25 bp, mus musculus
tgccccgattgggtactcactgaac

SEQ ID NO: 49985 - DNA, 25 bp, mus musculus
gtactcactgaacagagcatttcct

SEQ ID NO: 49986 - DNA, 25 bp, mus musculus
attcatacctttctgtccaattaca

SEQ ID NO: 49987 - DNA, 25 bp, mus musculus
aattacagctgtaattcaccatgtt

SEQ ID NO: 49988 - DNA, 25 bp, mus musculus
agctgtaattcaccatgttaaaagg

SEQ ID NO: 49989 - DNA, 25 bp, mus musculus
atgggcccttccaaagctgcacaat

SEQ ID NO: 49990 - DNA, 25 bp, mus musculus
aaagctgcacaatgcccctcaatta

SEQ ID NO: 49991 - DNA, 25 bp, mus musculus
tgcccctcaattacggaggctgaga

SEQ ID NO: 49992 - DNA, 25 bp, mus musculus
atacctctaactgtgtgaaacagtg

SEQ ID NO: 49993 - DNA, 25 bp, mus musculus
taacttgcttggaatctatgccagg

SEQ ID NO: 49994 - DNA, 25 bp, mus musculus
gcttggaatctatgccagggaaaaa

SEQ ID NO: 49995 - DNA, 25 bp, mus musculus
tttgtcactgctgtaaagcacattt

SEQ ID NO: 49996 - DNA, 25 bp, mus musculus
agatccgcagcttttccagcataaa

SEQ ID NO: 49997 - DNA, 25 bp, mus musculus
tttggctacttcgtttgagcacctt

SEQ ID NO: 49998 - DNA, 25 bp, mus musculus
tacttcgtttgagcaccttccctga

SEQ ID NO: 49999 - DNA, 25 bp, mus musculus
gcaccttccctgagcttgtcacaga

SEQ ID NO: 50000 - DNA, 25 bp, mus musculus
tccctgagcttgtcacagaacacat

SEQ ID NO: 50001 - DNA, 25 bp, mus musculus
agcttgtcacagaacacatttaaac

SEQ ID NO: 50002 - DNA, 25 bp, mus musculus
aacacttgaaacagtgctgtgtctg

SEQ ID NO: 50003 - DNA, 25 bp, mus musculus
gccttaattcatacctttctgtcca

SEQ ID NO: 50004 - DNA, 25 bp, mus musculus
cacctactctgtcctagtcgatggc

SEQ ID NO: 50005 - DNA, 25 bp, mus musculus
acctactctgtcctagtcgatggct

SEQ ID NO: 50006 - DNA, 25 bp, mus musculus
gtcctagtcgatggctgctccaaaa

SEQ ID NO: 50007 - DNA, 25 bp, mus musculus
tcctagtcgatggctgctccaaaaa

SEQ ID NO: 50008 - DNA, 25 bp, mus musculus
cctagtcgatggctgctccaaaaag

SEQ ID NO: 50009 - DNA, 25 bp, mus musculus
ctagtcgatggctgctccaaaaaga

SEQ ID NO: 50010 - DNA, 25 bp, mus musculus
tagtcgatggctgctccaaaaagac

SEQ ID NO: 50011 - DNA, 25 bp, mus musculus
agtcgatggctgctccaaaaagaca

SEQ ID NO: 50012 - DNA, 25 bp, mus musculus
gtcgatggctgctccaaaaagacaa

SEQ ID NO: 50013 - DNA, 25 bp, mus musculus
tcgatggctgctccaaaaagacaaa

SEQ ID NO: 50014 - DNA, 25 bp, mus musculus
cctactctgtcctagtcgatggctg

SEQ ID NO: 50015 - DNA, 25 bp, mus musculus
ctactctgtcctagtcgatggctgc

SEQ ID NO: 50016 - DNA, 25 bp, mus musculus
tactctgtcctagtcgatggctgct

SEQ ID NO: 50017 - DNA, 25 bp, mus musculus
actctgtcctagtcgatggctgctc

SEQ ID NO: 50018 - DNA, 25 bp, mus musculus
ctctgtcctagtcgatggctgctcc

SEQ ID NO: 50019 - DNA, 25 bp, mus musculus
tctgtcctagtcgatggctgctcca

SEQ ID NO: 50020 - DNA, 25 bp, mus musculus
ctgtcctagtcgatggctgctccaa

SEQ ID NO: 50021 - DNA, 25 bp, mus musculus
tgtcctagtcgatggctgctccaaa

SEQ ID NO: 50022 - DNA, 25 bp, mus musculus
agctgattctgtttccacttcgtga

SEQ ID NO: 50023 - DNA, 25 bp, mus musculus
ttctgtttccacttcgtgagtgcta

SEQ ID NO: 50024 - DNA, 25 bp, mus musculus
gtaaacactcttacctctgcagatt

SEQ ID NO: 50025 - DNA, 25 bp, mus musculus
aacactcttacctctgcagatttcc

SEQ ID NO: 50026 - DNA, 25 bp, mus musculus
actcttacctctgcagatttcctcc

SEQ ID NO: 50027 - DNA, 25 bp, mus musculus
ctccccagtagcaagtaagtagctg

SEQ ID NO: 50028 - DNA, 25 bp, mus musculus
tcatcgtatttcattttgctaagag

SEQ ID NO: 50029 - DNA, 25 bp, mus musculus
tcgtatttcattttgctaagagatt

SEQ ID NO: 50030 - DNA, 25 bp, mus musculus
gattcttgaatttcttcttgggaat

SEQ ID NO: 50031 - DNA, 25 bp, mus musculus
tctagttctggttcaacaaatggct

SEQ ID NO: 50032 - DNA, 25 bp, mus musculus
tcctcctcatggcctgcattgatcc

SEQ ID NO: 50033 - DNA, 25 bp, mus musculus
tcctcatggcctgcattgatccacc

SEQ ID NO: 50034 - DNA, 25 bp, mus musculus
tgtttccacttcgtgagtgctagga

SEQ ID NO: 50035 - DNA, 25 bp, mus musculus
tcatggcctgcattgatccacctgt

SEQ ID NO: 50036 - DNA, 25 bp, mus musculus
ttccacttcgtgagtgctaggacta

SEQ ID NO: 50037 - DNA, 25 bp, mus musculus
cacttcgtgagtgctaggactatag

SEQ ID NO: 50038 - DNA, 25 bp, mus musculus
acgggttctgtccactgtccctctg

SEQ ID NO: 50039 - DNA, 25 bp, mus musculus
tctgtccactgtccctctgtaaaca

SEQ ID NO: 50040 - DNA, 25 bp, mus musculus
gtccactgtccctctgtaaacactc

SEQ ID NO: 50041 - DNA, 25 bp, mus musculus
cactgtccctctgtaaacactctta

SEQ ID NO: 50042 - DNA, 25 bp, mus musculus
tctgtaaacactcttacctctgcag

SEQ ID NO: 50043 - DNA, 25 bp, mus musculus
tttcagcgtattcccacttgctaag

SEQ ID NO: 50044 - DNA, 25 bp, mus musculus
cagcgtattcccacttgctaagaga

SEQ ID NO: 50045 - DNA, 25 bp, mus musculus
tgaatcgatacacctgtccttcatg

SEQ ID NO: 50046 - DNA, 25 bp, mus musculus
atcgatacacctgtccttcatgaat

SEQ ID NO: 50047 - DNA, 25 bp, mus musculus
gatacacctgtccttcatgaatggt

SEQ ID NO: 50048 - DNA, 25 bp, mus musculus
cctgtccttcatgaatggttcgaga

SEQ ID NO: 50049 - DNA, 25 bp, mus musculus
gtccttcatgaatggttcgagagtg

SEQ ID NO: 50050 - DNA, 25 bp, mus musculus
tcagaaccaggacacgcttgataag

SEQ ID NO: 50051 - DNA, 25 bp, mus musculus
gaaccaggacacgcttgataaggtt

SEQ ID NO: 50052 - DNA, 25 bp, mus musculus
taaggttctcgtaagcgtgtggact

SEQ ID NO: 50053 - DNA, 25 bp, mus musculus
ggttctcgtaagcgtgtggacttgt

SEQ ID NO: 50054 - DNA, 25 bp, mus musculus
tctcgtaagcgtgtggacttgtaga

SEQ ID NO: 50055 - DNA, 25 bp, mus musculus
cgtattcccacttgctaagagactc

SEQ ID NO: 50056 - DNA, 25 bp, mus musculus
cccacttgctaagagactccggaat

SEQ ID NO: 50057 - DNA, 25 bp, mus musculus
agatgtctagtcctggttcagaact

SEQ ID NO: 50058 - DNA, 25 bp, mus musculus
tgtctagtcctggttcagaactggc

SEQ ID NO: 50059 - DNA, 25 bp, mus musculus
ctagtcctggttcagaactggctga

SEQ ID NO: 50060 - DNA, 25 bp, mus musculus
gtcctggttcagaactggctgaagc

SEQ ID NO: 50061 - DNA, 25 bp, mus musculus
ctcctcctaatggcatgaatcgata

SEQ ID NO: 50062 - DNA, 25 bp, mus musculus
ctcctaatggcatgaatcgatacac

SEQ ID NO: 50063 - DNA, 25 bp, mus musculus
gatcactcatgtcattcctgtggct

SEQ ID NO: 50064 - DNA, 25 bp, mus musculus
cactcatgtcattcctgtggctgaa

SEQ ID NO: 50065 - DNA, 25 bp, mus musculus
gcaactgctgcgagaccgagaagta

SEQ ID NO: 50066 - DNA, 25 bp, mus musculus
actgctgcgagaccgagaagtagga

SEQ ID NO: 50067 - DNA, 25 bp, mus musculus
agaagtaggaatccctcctgagcag

SEQ ID NO: 50068 - DNA, 25 bp, mus musculus
aggaatccctcctgagcagtccttg

SEQ ID NO: 50069 - DNA, 25 bp, mus musculus
aatccctcctgagcagtccttggaa

SEQ ID NO: 50070 - DNA, 25 bp, mus musculus
ccctcctgagcagtccttggaaact

SEQ ID NO: 50071 - DNA, 25 bp, mus musculus
gcagtccttggaaactgcgaaacag

SEQ ID NO: 50072 - DNA, 25 bp, mus musculus
ctacagttatgtctgcccagattta

SEQ ID NO: 50073 - DNA, 25 bp, mus musculus
cagttatgtctgcccagatttagta

SEQ ID NO: 50074 - DNA, 25 bp, mus musculus
caagtatgacaccgatgggtcaaag

SEQ ID NO: 50075 - DNA, 25 bp, mus musculus
tcatgtcattcctgtggctgaagga

SEQ ID NO: 50076 - DNA, 25 bp, mus musculus
tgacaccgatgggtcaaagtggatc

SEQ ID NO: 50077 - DNA, 25 bp, mus musculus
cattcctgtggctgaaggatatgtt

SEQ ID NO: 50078 - DNA, 25 bp, mus musculus
atatgttatcggcagctgtattaaa

SEQ ID NO: 50079 - DNA, 25 bp, mus musculus
tattaaacacattccaatcgcagga

SEQ ID NO: 50080 - DNA, 25 bp, mus musculus
taaacacattccaatcgcaggaaga

SEQ ID NO: 50081 - DNA, 25 bp, mus musculus
acacattccaatcgcaggaagagat

SEQ ID NO: 50082 - DNA, 25 bp, mus musculus
ttttattcagcaactgctgcgagac

SEQ ID NO: 50083 - DNA, 25 bp, mus musculus
tattcagcaactgctgcgagaccga

SEQ ID NO: 50084 - DNA, 25 bp, mus musculus
agtgtgccactacgcccagagaaat

SEQ ID NO: 50085 - DNA, 25 bp, mus musculus
ccactacgcccagagaaatgacagg

SEQ ID NO: 50086 - DNA, 25 bp, mus musculus
gtgtccacggacatggaggagtctc

SEQ ID NO: 50087 - DNA, 25 bp, mus musculus
tgggtactcatttctgatgcacact

SEQ ID NO: 50088 - DNA, 25 bp, mus musculus
ctcatttctgatgcacactggagct

SEQ ID NO: 50089 - DNA, 25 bp, mus musculus
tctgatgcacactggagctggggac

SEQ ID NO: 50090 - DNA, 25 bp, mus musculus
gcaggcactgatgtcacctggcagc

SEQ ID NO: 50091 - DNA, 25 bp, mus musculus
tggcagctgcctagaggacttcaga

SEQ ID NO: 50092 - DNA, 25 bp, mus musculus
tcacttttttgcaaacgagtacagc

SEQ ID NO: 50093 - DNA, 25 bp, mus musculus
gctgaccaccgtgaacccagacctg

SEQ ID NO: 50094 - DNA, 25 bp, mus musculus
aatcagcaggtgccaggtttgcatg

SEQ ID NO: 50095 - DNA, 25 bp, mus musculus
caggtgccaggtttgcatgaagcac

SEQ ID NO: 50096 - DNA, 25 bp, mus musculus
tgacaggtcctactggctgtccagt

SEQ ID NO: 50097 - DNA, 25 bp, mus musculus
gtcctactggctgtccagtgcggct

SEQ ID NO: 50098 - DNA, 25 bp, mus musculus
ctggctgtccagtgcggctcctctt

SEQ ID NO: 50099 - DNA, 25 bp, mus musculus
tcctatgatgccactctcagaggaa

SEQ ID NO: 50100 - DNA, 25 bp, mus musculus
gatgccactctcagaggaagagatc

SEQ ID NO: 50101 - DNA, 25 bp, mus musculus
agagatccgctcttacatcagccgc

SEQ ID NO: 50102 - DNA, 25 bp, mus musculus
ccgctcttacatcagccgctgtgcg

SEQ ID NO: 50103 - DNA, 25 bp, mus musculus
ggtccacagtcaggaccaatccatc

SEQ ID NO: 50104 - DNA, 25 bp, mus musculus
gctgccttcgtcgcttcagtaccat

SEQ ID NO: 50105 - DNA, 25 bp, mus musculus
tgcctttcatgttctgcaacattaa

SEQ ID NO: 50106 - DNA, 25 bp, mus musculus
gccagactattcagattccacactg

SEQ ID NO: 50107 - DNA, 25 bp, mus musculus
agattccacactgtcctcaggggtg

SEQ ID NO: 50108 - DNA, 25 bp, mus musculus
ccttcatgatgcatacaagtgcagg

SEQ ID NO: 50109 - DNA, 25 bp, mus musculus
aaggctctggccaagccctagcctc

SEQ ID NO: 50110 - DNA, 25 bp, mus musculus
gcaattactatgccaattcgtacag

SEQ ID NO: 50111 - DNA, 25 bp, mus musculus
ccaattcgtacagcttttggctggc

SEQ ID NO: 50112 - DNA, 25 bp, mus musculus
gcttttggctggccactgttgatat

SEQ ID NO: 50113 - DNA, 25 bp, mus musculus
ggctggccactgttgatatgtcaga

SEQ ID NO: 50114 - DNA, 25 bp, mus musculus
acatgttcaacaaacctcagtcaga

SEQ ID NO: 50115 - DNA, 25 bp, mus musculus
gtattagccgatgtcaagtatgcat

SEQ ID NO: 50116 - DNA, 25 bp, mus musculus
tcatgttctgcaacattaacaacgt

SEQ ID NO: 50117 - DNA, 25 bp, mus musculus
cagagcccatgccaatgaacatgga

SEQ ID NO: 50118 - DNA, 25 bp, mus musculus
ccatgccaatgaacatggaacccct

SEQ ID NO: 50119 - DNA, 25 bp, mus musculus
caatgaacatggaacccctgaaggg

SEQ ID NO: 50120 - DNA, 25 bp, mus musculus
acatggaacccctgaagggacagag

SEQ ID NO: 50121 - DNA, 25 bp, mus musculus
gacagagcatccagccattcattag

SEQ ID NO: 50122 - DNA, 25 bp, mus musculus
agccattcattagtcgatgtgcagt

SEQ ID NO: 50123 - DNA, 25 bp, mus musculus
tcgctgttcacagccagactattca

SEQ ID NO: 50124 - DNA, 25 bp, mus musculus
ggtgctcaacctgctggagctggtt

SEQ ID NO: 50125 - DNA, 25 bp, mus musculus
caacctgctggagctggttcacctg

SEQ ID NO: 50126 - DNA, 25 bp, mus musculus
tgtaccttggctgcctctctggcgg

SEQ ID NO: 50127 - DNA, 25 bp, mus musculus
ctggcggtccactcctcaaaggcac

SEQ ID NO: 50128 - DNA, 25 bp, mus musculus
tcctcaaaggcacctcagagacaac

SEQ ID NO: 50129 - DNA, 25 bp, mus musculus
cattcgctgggcagaggacctggtc

SEQ ID NO: 50130 - DNA, 25 bp, mus musculus
cctggtcacagatggttctggaata

SEQ ID NO: 50131 - DNA, 25 bp, mus musculus
tggaatacctggagcctttgtgatg

SEQ ID NO: 50132 - DNA, 25 bp, mus musculus
aggacactggctgcttaccagaatg

SEQ ID NO: 50133 - DNA, 25 bp, mus musculus
ctggctgcttaccagaatgtgacac

SEQ ID NO: 50134 - DNA, 25 bp, mus musculus
cagaatgtgacactacccagactgg

SEQ ID NO: 50135 - DNA, 25 bp, mus musculus
gtgacactacccagactgggtcaca

SEQ ID NO: 50136 - DNA, 25 bp, mus musculus
cagtgcctcagacccttaccctgaa

SEQ ID NO: 50137 - DNA, 25 bp, mus musculus
caacgggctctcatccactgagcag

SEQ ID NO: 50138 - DNA, 25 bp, mus musculus
atccactgagcagaactgggccaac

SEQ ID NO: 50139 - DNA, 25 bp, mus musculus
ggccaacttgaccacagaggagaga

SEQ ID NO: 50140 - DNA, 25 bp, mus musculus
caacagctctgcatccaagaagcag

SEQ ID NO: 50141 - DNA, 25 bp, mus musculus
ctctgcatccaagaagcagtatgtg

SEQ ID NO: 50142 - DNA, 25 bp, mus musculus
ggctaatgtcactcaacagagctgc

SEQ ID NO: 50143 - DNA, 25 bp, mus musculus
tcaacagagctgccccgaggagcac

SEQ ID NO: 50144 - DNA, 25 bp, mus musculus
tggctgtggctggactgtctctgtt

SEQ ID NO: 50145 - DNA, 25 bp, mus musculus
tggctggactgtctctgtttctcag

SEQ ID NO: 50146 - DNA, 25 bp, mus musculus
acatgggctcccggaagaatccaga

SEQ ID NO: 50147 - DNA, 25 bp, mus musculus
atccagacgctctggccactgggga

SEQ ID NO: 50148 - DNA, 25 bp, mus musculus
aagtgccaaaccaggagcagattcc

SEQ ID NO: 50149 - DNA, 25 bp, mus musculus
aaggcttcatccacatgcactatag

SEQ ID NO: 50150 - DNA, 25 bp, mus musculus
tcatccacatgcactatagccagaa

SEQ ID NO: 50151 - DNA, 25 bp, mus musculus
acatgcactatagccagaagccaga

SEQ ID NO: 50152 - DNA, 25 bp, mus musculus
actatagccagaagccagagtacgc

SEQ ID NO: 50153 - DNA, 25 bp, mus musculus
agccagagtacgccagtggagcctc

SEQ ID NO: 50154 - DNA, 25 bp, mus musculus
ttagtaaggccagcagcaaagcaag

SEQ ID NO: 50155 - DNA, 25 bp, mus musculus
tgtcagtgtgatcctccttttaggg

SEQ ID NO: 50156 - DNA, 25 bp, mus musculus
gactgtctctgtttctcagcctggc

SEQ ID NO: 50157 - DNA, 25 bp, mus musculus
gtgatcctccttttagggaggccag

SEQ ID NO: 50158 - DNA, 25 bp, mus musculus
gcctggctgaactctaccacctggg

SEQ ID NO: 50159 - DNA, 25 bp, mus musculus
ctgaactctaccacctgggctggaa

SEQ ID NO: 50160 - DNA, 25 bp, mus musculus
agaagatccgacagcgctttggcaa

SEQ ID NO: 50161 - DNA, 25 bp, mus musculus
cccctgacttcaatcagtgcctaaa

SEQ ID NO: 50162 - DNA, 25 bp, mus musculus
acttcaatcagtgcctaaagaacag

SEQ ID NO: 50163 - DNA, 25 bp, mus musculus
gcctaaagaacagctccggagagaa

SEQ ID NO: 50164 - DNA, 25 bp, mus musculus
agaacagctccggagagaaattctt

SEQ ID NO: 50165 - DNA, 25 bp, mus musculus
tggcctgctggtttgccaattccag

SEQ ID NO: 50166 - DNA, 25 bp, mus musculus
cctgctggtttgccaattccaggag

SEQ ID NO: 50167 - DNA, 25 bp, mus musculus
ttcagcctgagcctcagtcattccg

SEQ ID NO: 50168 - DNA, 25 bp, mus musculus
agcctgagcctcagtcattccggag

SEQ ID NO: 50169 - DNA, 25 bp, mus musculus
ctgagcctcagtcattccggagacc

SEQ ID NO: 50170 - DNA, 25 bp, mus musculus
agcctcagtcattccggagaccctg

SEQ ID NO: 50171 - DNA, 25 bp, mus musculus
ctcagtcattccggagaccctgctc

SEQ ID NO: 50172 - DNA, 25 bp, mus musculus
agtcattccggagaccctgctctga

SEQ ID NO: 50173 - DNA, 25 bp, mus musculus
cattccggagaccctgctctgatgg

SEQ ID NO: 50174 - DNA, 25 bp, mus musculus
ttgtgcttttatcgtaagggcaaca

SEQ ID NO: 50175 - DNA, 25 bp, mus musculus
aagggcaacacattttgctggagtc

SEQ ID NO: 50176 - DNA, 25 bp, mus musculus
acattttgctggagtcgctagtgac

SEQ ID NO: 50177 - DNA, 25 bp, mus musculus
gctggtttgccaattccaggagcta

SEQ ID NO: 50178 - DNA, 25 bp, mus musculus
ttgccaattccaggagctaacctca

SEQ ID NO: 50179 - DNA, 25 bp, mus musculus
ccaattccaggagctaacctcaagg

SEQ ID NO: 50180 - DNA, 25 bp, mus musculus
attccaggagctaacctcaaggaga

SEQ ID NO: 50181 - DNA, 25 bp, mus musculus
ggagctaacctcaaggagaggactt

SEQ ID NO: 50182 - DNA, 25 bp, mus musculus
gcagcagttcccacttcagggaaca

SEQ ID NO: 50183 - DNA, 25 bp, mus musculus
acttcagggaacacctggaccatgg

SEQ ID NO: 50184 - DNA, 25 bp, mus musculus
tcagggaacacctggaccatggcca

SEQ ID NO: 50185 - DNA, 25 bp, mus musculus
gatgtctatgccattcgggaggcag

SEQ ID NO: 50186 - DNA, 25 bp, mus musculus
tatgccattcgggaggcagccacca

SEQ ID NO: 50187 - DNA, 25 bp, mus musculus
agaatgaccacgctcttctgcatta

SEQ ID NO: 50188 - DNA, 25 bp, mus musculus
accacgctcttctgcattaatgcac

SEQ ID NO: 50189 - DNA, 25 bp, mus musculus
acgctcttctgcattaatgcactgt

SEQ ID NO: 50190 - DNA, 25 bp, mus musculus
ctcttctgcattaatgcactgtctg

SEQ ID NO: 50191 - DNA, 25 bp, mus musculus
tgcattaatgcactgtctgaagcct

SEQ ID NO: 50192 - DNA, 25 bp, mus musculus
attaatgcactgtctgaagcctgtg

SEQ ID NO: 50193 - DNA, 25 bp, mus musculus
aatgcactgtctgaagcctgtggta

SEQ ID NO: 50194 - DNA, 25 bp, mus musculus
ctgtctgaagcctgtggtaaggaaa

SEQ ID NO: 50195 - DNA, 25 bp, mus musculus
tctgaagcctgtggtaaggaaataa

SEQ ID NO: 50196 - DNA, 25 bp, mus musculus
ataaccactaagcaaatgttgccca

SEQ ID NO: 50197 - DNA, 25 bp, mus musculus
gaggcagccaccaacaacctcatga

SEQ ID NO: 50198 - DNA, 25 bp, mus musculus
gcagccaccaacaacctcatgaagt

SEQ ID NO: 50199 - DNA, 25 bp, mus musculus
gcaaatgaccctaactacttacaca

SEQ ID NO: 50200 - DNA, 25 bp, mus musculus
gaccctaactacttacacagaatga

SEQ ID NO: 50201 - DNA, 25 bp, mus musculus
cctaactacttacacagaatgacca

SEQ ID NO: 50202 - DNA, 25 bp, mus musculus
aactacttacacagaatgaccacgc

SEQ ID NO: 50203 - DNA, 25 bp, mus musculus
ttacacagaatgaccacgctcttct

SEQ ID NO: 50204 - DNA, 25 bp, mus musculus
cacagaatgaccacgctcttctgca

SEQ ID NO: 50205 - DNA, 25 bp, mus musculus
ccccggagcaggtggtgcgatcatg

SEQ ID NO: 50206 - DNA, 25 bp, mus musculus
tgcgatcatggtcacctgtagccct

SEQ ID NO: 50207 - DNA, 25 bp, mus musculus
ttgcagtgccactgtggcctgtggt

SEQ ID NO: 50208 - DNA, 25 bp, mus musculus
ctgtggttccttgctctggccttga

SEQ ID NO: 50209 - DNA, 25 bp, mus musculus
ttccttgctctggccttgaagctct

SEQ ID NO: 50210 - DNA, 25 bp, mus musculus
gctctggccttgaagctctgagacc

SEQ ID NO: 50211 - DNA, 25 bp, mus musculus
ctggccttgaagctctgagaccaga

SEQ ID NO: 50212 - DNA, 25 bp, mus musculus
aagctctgagaccagactcacatgc

SEQ ID NO: 50213 - DNA, 25 bp, mus musculus
ctctgagaccagactcacatgctcc

SEQ ID NO: 50214 - DNA, 25 bp, mus musculus
tgagaccagactcacatgctccatt

SEQ ID NO: 50215 - DNA, 25 bp, mus musculus
cagactcacatgctccatttgctct

SEQ ID NO: 50216 - DNA, 25 bp, mus musculus
cacatgctccatttgctctgacagg

SEQ ID NO: 50217 - DNA, 25 bp, mus musculus
gcagtcccaagctggagcatcggaa

SEQ ID NO: 50218 - DNA, 25 bp, mus musculus
ctccatttgctctgacaggctccca

SEQ ID NO: 50219 - DNA, 25 bp, mus musculus
gtcccaagctggagcatcggaactg

SEQ ID NO: 50220 - DNA, 25 bp, mus musculus
gaggaacccagcatcgagctggtgt

SEQ ID NO: 50221 - DNA, 25 bp, mus musculus
cccagcatcgagctggtgtgagtga

SEQ ID NO: 50222 - DNA, 25 bp, mus musculus
agcatcgagctggtgtgagtgaccc

SEQ ID NO: 50223 - DNA, 25 bp, mus musculus
tgagtgaccctcttgcagtgccact

SEQ ID NO: 50224 - DNA, 25 bp, mus musculus
accctcttgcagtgccactgtggcc

SEQ ID NO: 50225 - DNA, 25 bp, mus musculus
ctcttgcagtgccactgtggcctgt

SEQ ID NO: 50226 - DNA, 25 bp, mus musculus
cggatcatgcggatcatgcgctctg

SEQ ID NO: 50227 - DNA, 25 bp, mus musculus
gatcatgcggatcatgcgctctgca

SEQ ID NO: 50228 - DNA, 25 bp, mus musculus
tctgcagacaaggtcgtgtagaaag

SEQ ID NO: 50229 - DNA, 25 bp, mus musculus
gtcgcagccactatgaggatggtcc

SEQ ID NO: 50230 - DNA, 25 bp, mus musculus
tcgcagccactatgaggatggtccg

SEQ ID NO: 50231 - DNA, 25 bp, mus musculus
cgcagccactatgaggatggtccgg

SEQ ID NO: 50232 - DNA, 25 bp, mus musculus
ccactatgaggatggtccggggaag

SEQ ID NO: 50233 - DNA, 25 bp, mus musculus
cactatgaggatggtccggggaaga

SEQ ID NO: 50234 - DNA, 25 bp, mus musculus
ctatgaggatggtccggggaagaat

SEQ ID NO: 50235 - DNA, 25 bp, mus musculus
ttggatctgggtttgccgcaccttt

SEQ ID NO: 50236 - DNA, 25 bp, mus musculus
ttgccgcacctttctttatagtaag

SEQ ID NO: 50237 - DNA, 25 bp, mus musculus
tgccgcacctttctttatagtaaga

SEQ ID NO: 50238 - DNA, 25 bp, mus musculus
tcatgcggatcatgcgctctgcaga

SEQ ID NO: 50239 - DNA, 25 bp, mus musculus
catgcggatcatgcgctctgcagac

SEQ ID NO: 50240 - DNA, 25 bp, mus musculus
atgcggatcatgcgctctgcagaca

SEQ ID NO: 50241 - DNA, 25 bp, mus musculus
tgcggatcatgcgctctgcagacaa

SEQ ID NO: 50242 - DNA, 25 bp, mus musculus
atcatgcgctctgcagacaaggtcg

SEQ ID NO: 50243 - DNA, 25 bp, mus musculus
atgcgctctgcagacaaggtcgtgt

SEQ ID NO: 50244 - DNA, 25 bp, mus musculus
tgcgctctgcagacaaggtcgtgta

SEQ ID NO: 50245 - DNA, 25 bp, mus musculus
gcgctctgcagacaaggtcgtgtag

SEQ ID NO: 50246 - DNA, 25 bp, mus musculus
tctggaccatcatcctcagatttgc

SEQ ID NO: 50247 - DNA, 25 bp, mus musculus
ggaccatcatcctcagatttgccat

SEQ ID NO: 50248 - DNA, 25 bp, mus musculus
tcaacgtccagaacttccatatcag

SEQ ID NO: 50249 - DNA, 25 bp, mus musculus
acgtccagaacttccatatcagctg

SEQ ID NO: 50250 - DNA, 25 bp, mus musculus
acttccatatcagctggaaggacgg

SEQ ID NO: 50251 - DNA, 25 bp, mus musculus
tccatatcagctggaaggacgggct

SEQ ID NO: 50252 - DNA, 25 bp, mus musculus
tcaatgcactcatccaccggcacag

SEQ ID NO: 50253 - DNA, 25 bp, mus musculus
ggcacaggcctgagctgattgagta

SEQ ID NO: 50254 - DNA, 25 bp, mus musculus
atgatccagtcaccaacctaaacaa

SEQ ID NO: 50255 - DNA, 25 bp, mus musculus
atccagtcaccaacctaaacaatgc

SEQ ID NO: 50256 - DNA, 25 bp, mus musculus
ccaacctaaacaatgcatttgaagt

SEQ ID NO: 50257 - DNA, 25 bp, mus musculus
acctaaacaatgcatttgaagtggc

SEQ ID NO: 50258 - DNA, 25 bp, mus musculus
ccatcatcctcagatttgccatcca

SEQ ID NO: 50259 - DNA, 25 bp, mus musculus
tcagatttgccatccaggacatctc

SEQ ID NO: 50260 - DNA, 25 bp, mus musculus
gatttgccatccaggacatctctgt

SEQ ID NO: 50261 - DNA, 25 bp, mus musculus
ccatccaggacatctctgtggaaga

SEQ ID NO: 50262 - DNA, 25 bp, mus musculus
aggacatctctgtggaagagacctc

SEQ ID NO: 50263 - DNA, 25 bp, mus musculus
agacctctgctaaggaaggactcct

SEQ ID NO: 50264 - DNA, 25 bp, mus musculus
aggaaggactcctcctctggtgcca

SEQ ID NO: 50265 - DNA, 25 bp, mus musculus
acgtcaacgtccagaacttccatat

SEQ ID NO: 50266 - DNA, 25 bp, mus musculus
aggagcttgctcttacacagagtgt

SEQ ID NO: 50267 - DNA, 25 bp, mus musculus
gtgactccagtgctgatcgactctt

SEQ ID NO: 50268 - DNA, 25 bp, mus musculus
acccaccttgggatattcacatgga

SEQ ID NO: 50269 - DNA, 25 bp, mus musculus
atattcacatggagctaccgtatgg

SEQ ID NO: 50270 - DNA, 25 bp, mus musculus
acatggagctaccgtatgggacatt

SEQ ID NO: 50271 - DNA, 25 bp, mus musculus
agatgcgcaggctcaatataccagt

SEQ ID NO: 50272 - DNA, 25 bp, mus musculus
tgcgcaggctcaatataccagtgct

SEQ ID NO: 50273 - DNA, 25 bp, mus musculus
gcaggctcaatataccagtgctaca

SEQ ID NO: 50274 - DNA, 25 bp, mus musculus
tcaatataccagtgctacaggatga

SEQ ID NO: 50275 - DNA, 25 bp, mus musculus
atataccagtgctacaggatgacgg

SEQ ID NO: 50276 - DNA, 25 bp, mus musculus
ttcttttcctctgggtcacaggaag

SEQ ID NO: 50277 - DNA, 25 bp, mus musculus
tcctctgggtcacaggaagggccat

SEQ ID NO: 50278 - DNA, 25 bp, mus musculus
ctgatcgactctttccacctcagtg

SEQ ID NO: 50279 - DNA, 25 bp, mus musculus
atcgactctttccacctcagtggat

SEQ ID NO: 50280 - DNA, 25 bp, mus musculus
gttgtgatatccgctacctggacgt

SEQ ID NO: 50281 - DNA, 25 bp, mus musculus
atatccgctacctggacgtcagtat

SEQ ID NO: 50282 - DNA, 25 bp, mus musculus
tccgctacctggacgtcagtatctt

SEQ ID NO: 50283 - DNA, 25 bp, mus musculus
gctacctggacgtcagtatcttggg

SEQ ID NO: 50284 - DNA, 25 bp, mus musculus
acgtcagtatcttgggcaaatttgc

SEQ ID NO: 50285 - DNA, 25 bp, mus musculus
ctgacccaccttgggatattcacat

SEQ ID NO: 50286 - DNA, 25 bp, mus musculus
cctcccacgtatgatactgtgatgg

SEQ ID NO: 50287 - DNA, 25 bp, mus musculus
gaaaccctcagattatatcccattg

SEQ ID NO: 50288 - DNA, 25 bp, mus musculus
tatctgccctttgggaatggaccca

SEQ ID NO: 50289 - DNA, 25 bp, mus musculus
ggacccaggaactgccttggcatga

SEQ ID NO: 50290 - DNA, 25 bp, mus musculus
aggtttgctctcatgaatatgaaac

SEQ ID NO: 50291 - DNA, 25 bp, mus musculus
atgaaacttgctctcactaaaatta

SEQ ID NO: 50292 - DNA, 25 bp, mus musculus
cttgctctcactaaaattatgcaga

SEQ ID NO: 50293 - DNA, 25 bp, mus musculus
cagatacctctgaaattaagcagac

SEQ ID NO: 50294 - DNA, 25 bp, mus musculus
aaggttgtgccacgggatgcagtca

SEQ ID NO: 50295 - DNA, 25 bp, mus musculus
ggagcatgagtctccctcaaggagt

SEQ ID NO: 50296 - DNA, 25 bp, mus musculus
tgagtctccctcaaggagttcttct

SEQ ID NO: 50297 - DNA, 25 bp, mus musculus
ttcttctgagttcttcagaaaggca

SEQ ID NO: 50298 - DNA, 25 bp, mus musculus
ctcagattatatcccattgctaata

SEQ ID NO: 50299 - DNA, 25 bp, mus musculus
ttatatcccattgctaatagacttg

SEQ ID NO: 50300 - DNA, 25 bp, mus musculus
gtgtatatccccaaagggtcaacag

SEQ ID NO: 50301 - DNA, 25 bp, mus musculus
atccccaaagggtcaacagtgatga

SEQ ID NO: 50302 - DNA, 25 bp, mus musculus
attccatcttatgctcttcaccatg

SEQ ID NO: 50303 - DNA, 25 bp, mus musculus
tcttatgctcttcaccatgacccac

SEQ ID NO: 50304 - DNA, 25 bp, mus musculus
ttccaacctgaaaggttcagcaagg

SEQ ID NO: 50305 - DNA, 25 bp, mus musculus
agcattgatccttatgtatatctgc

SEQ ID NO: 50306 - DNA, 25 bp, mus musculus
ggagcatgagtctccctcaaggagt

SEQ ID NO: 50307 - DNA, 25 bp, mus musculus
gagcatgagtctccctcaaggagtt

SEQ ID NO: 50308 - DNA, 25 bp, mus musculus
catgagtctccctcaaggagttctt

SEQ ID NO: 50309 - DNA, 25 bp, mus musculus
atgagtctccctcaaggagttcttc

SEQ ID NO: 50310 - DNA, 25 bp, mus musculus
tgagtctccctcaaggagttcttct

SEQ ID NO: 50311 - DNA, 25 bp, mus musculus
cttctgagttcttcagaaaggcagt

SEQ ID NO: 50312 - DNA, 25 bp, mus musculus
ttctgagttcttcagaaaggcagtg

SEQ ID NO: 50313 - DNA, 25 bp, mus musculus
ttttagtttcatcatgagtaaaatt

SEQ ID NO: 50314 - DNA, 25 bp, mus musculus
ggagcatgagtctccctcaaggagt

SEQ ID NO: 50315 - DNA, 25 bp, mus musculus
gagcatgagtctccctcaaggagtt

SEQ ID NO: 50316 - DNA, 25 bp, mus musculus
catgagtctccctcaaggagttctt

SEQ ID NO: 50317 - DNA, 25 bp, mus musculus
atgagtctccctcaaggagttcttc

SEQ ID NO: 50318 - DNA, 25 bp, mus musculus
tgagtctccctcaaggagttcttct

SEQ ID NO: 50319 - DNA, 25 bp, mus musculus
cttctgagttcttcagaaaggcagt

SEQ ID NO: 50320 - DNA, 25 bp, mus musculus
ttctgagttcttcagaaaggcagtg

SEQ ID NO: 50321 - DNA, 25 bp, mus musculus
attttagtttcatcatgagtaaaat

SEQ ID NO: 50322 - DNA, 25 bp, mus musculus
ttttagtttcatcatgagtaaaatt

SEQ ID NO: 50323 - DNA, 25 bp, mus musculus
cccgcttcaccattgatacaaaggg

SEQ ID NO: 50324 - DNA, 25 bp, mus musculus
gcttcaccattgatacaaagggtgc

SEQ ID NO: 50325 - DNA, 25 bp, mus musculus
tacccactgagcctggggactacaa

SEQ ID NO: 50326 - DNA, 25 bp, mus musculus
actacaacatcaacatcctttttgc

SEQ ID NO: 50327 - DNA, 25 bp, mus musculus
acaacatcaacatcctttttgctga

SEQ ID NO: 50328 - DNA, 25 bp, mus musculus
acatcaacatcctttttgctgacac

SEQ ID NO: 50329 - DNA, 25 bp, mus musculus
tcctttttgctgacacccacattcc

SEQ ID NO: 50330 - DNA, 25 bp, mus musculus
tttttgctgacacccacattcctgg

SEQ ID NO: 50331 - DNA, 25 bp, mus musculus
ttcctggatccccattcaaggccca

SEQ ID NO: 50332 - DNA, 25 bp, mus musculus
cattcaaggcccatgtggctccttg

SEQ ID NO: 50333 - DNA, 25 bp, mus musculus
tcaaggcccatgtggctccttgttt

SEQ ID NO: 50334 - DNA, 25 bp, mus musculus
aggcccatgtggctccttgttttga

SEQ ID NO: 50335 - DNA, 25 bp, mus musculus
gcctgggcctgacagtggaaggccc

SEQ ID NO: 50336 - DNA, 25 bp, mus musculus
atgtggctccttgttttgatgcatc

SEQ ID NO: 50337 - DNA, 25 bp, mus musculus
cagtggaaggcccctgtgaagcaca

SEQ ID NO: 50338 - DNA, 25 bp, mus musculus
aaggcccctgtgaagcacagcttga

SEQ ID NO: 50339 - DNA, 25 bp, mus musculus
gcccctgtgaagcacagcttgagtg

SEQ ID NO: 50340 - DNA, 25 bp, mus musculus
cctgtgaagcacagcttgagtgcct

SEQ ID NO: 50341 - DNA, 25 bp, mus musculus
atggtacatgctctgtgtcttatgt

SEQ ID NO: 50342 - DNA, 25 bp, mus musculus
catgctctgtgtcttatgtacccac

SEQ ID NO: 50343 - DNA, 25 bp, mus musculus
ctgtgtcttatgtacccactgagcc

SEQ ID NO: 50344 - DNA, 25 bp, mus musculus
cacccagctcattcctgtcagtgaa

SEQ ID NO: 50345 - DNA, 25 bp, mus musculus
cattcctgtcagtgaagccatacct

SEQ ID NO: 50346 - DNA, 25 bp, mus musculus
cagaatttccagctttatgccttgg

SEQ ID NO: 50347 - DNA, 25 bp, mus musculus
cagctttatgccttggattcggaaa

SEQ ID NO: 50348 - DNA, 25 bp, mus musculus
actcctgcaacaaccctagaacaca

SEQ ID NO: 50349 - DNA, 25 bp, mus musculus
ctagaacacaaaacctgtgtctggg

SEQ ID NO: 50350 - DNA, 25 bp, mus musculus
gaacacaaaacctgtgtctgggcca

SEQ ID NO: 50351 - DNA, 25 bp, mus musculus
gccagtgtccagcatcctggggtat

SEQ ID NO: 50352 - DNA, 25 bp, mus musculus
agtgtccagcatcctggggtatggt

SEQ ID NO: 50353 - DNA, 25 bp, mus musculus
cagcatcctggggtatggttgtctg

SEQ ID NO: 50354 - DNA, 25 bp, mus musculus
tggttgtctgagccttaataaagaa

SEQ ID NO: 50355 - DNA, 25 bp, mus musculus
ttgtctgagccttaataaagaaatc

SEQ ID NO: 50356 - DNA, 25 bp, mus musculus
tgaagccatacctcacgagagcttt

SEQ ID NO: 50357 - DNA, 25 bp, mus musculus
acctcacgagagctttgacaatgaa

SEQ ID NO: 50358 - DNA, 25 bp, mus musculus
aacactggtcaatgacatcatgctc

SEQ ID NO: 50359 - DNA, 25 bp, mus musculus
catcatgctcctgaagctggaacgc

SEQ ID NO: 50360 - DNA, 25 bp, mus musculus
cattgtcagttgtcgcttgtgtact

SEQ ID NO: 50361 - DNA, 25 bp, mus musculus
cagttgtcgcttgtgtactgggaca

SEQ ID NO: 50362 - DNA, 25 bp, mus musculus
attcaccagaatttccagctttatg

SEQ ID NO: 50363 - DNA, 25 bp, mus musculus
caccagaatttccagctttatgcct

SEQ ID NO: 50364 - DNA, 25 bp, mus musculus
tcaaggctcgcctggagatggagat

SEQ ID NO: 50365 - DNA, 25 bp, mus musculus
ttgagacctaccgccggctgctgga

SEQ ID NO: 50366 - DNA, 25 bp, mus musculus
ttttccttggattctctatgcaggt

SEQ ID NO: 50367 - DNA, 25 bp, mus musculus
ttggattctctatgcaggttgggtc

SEQ ID NO: 50368 - DNA, 25 bp, mus musculus
acaatatccaatttacaagtctctg

SEQ ID NO: 50369 - DNA, 25 bp, mus musculus
tccaatttacaagtctctgtggctc

SEQ ID NO: 50370 - DNA, 25 bp, mus musculus
gtcttctattgaaccccagatcacc

SEQ ID NO: 50371 - DNA, 25 bp, mus musculus
tattgaaccccagatcaccttacac

SEQ ID NO: 50372 - DNA, 25 bp, mus musculus
tccactaagtttttctggtcgcctg

SEQ ID NO: 50373 - DNA, 25 bp, mus musculus
ttctggtcgcctggaccatttcttt

SEQ ID NO: 50374 - DNA, 25 bp, mus musculus
tttctttaatcccacagctttgatg

SEQ ID NO: 50375 - DNA, 25 bp, mus musculus
taatcccacagctttgatggaaccg

SEQ ID NO: 50376 - DNA, 25 bp, mus musculus
agagctcatccctttccgtctccaa

SEQ ID NO: 50377 - DNA, 25 bp, mus musculus
agacaccatcagtcgattcctctaa

SEQ ID NO: 50378 - DNA, 25 bp, mus musculus
catcagtcgattcctctaaagaccc

SEQ ID NO: 50379 - DNA, 25 bp, mus musculus
tcaagacagtcgtgcaggagatagt

SEQ ID NO: 50380 - DNA, 25 bp, mus musculus
catcccaggttccaggaacttgaag

SEQ ID NO: 50381 - DNA, 25 bp, mus musculus
acacgggctcctctgggatgcgaag

SEQ ID NO: 50382 - DNA, 25 bp, mus musculus
tgcgaagtttccagccaggagttac

SEQ ID NO: 50383 - DNA, 25 bp, mus musculus
ttgattcagcacctgtttgggccag

SEQ ID NO: 50384 - DNA, 25 bp, mus musculus
tgtttgctcccacacagaggacaga

SEQ ID NO: 50385 - DNA, 25 bp, mus musculus
ttgctcccacacagaggacagaagg

SEQ ID NO: 50386 - DNA, 25 bp, mus musculus
agaagaaataccacttgcaagaacg

SEQ ID NO: 50387 - DNA, 25 bp, mus musculus
aataccacttgcaagaacgagttga

SEQ ID NO: 50388 - DNA, 25 bp, mus musculus
agaagagcatcgacctcatccagaa

SEQ ID NO: 50389 - DNA, 25 bp, mus musculus
agagcatcgacctcatccagaagtg

SEQ ID NO: 50390 - DNA, 25 bp, mus musculus
gagcactgaagcacatgctgaagga

SEQ ID NO: 50391 - DNA, 25 bp, mus musculus
tcagtcccaagcagagccccagcag

SEQ ID NO: 50392 - DNA, 25 bp, mus musculus
gcagcagccctactcatgagcgctc

SEQ ID NO: 50393 - DNA, 25 bp, mus musculus
tctctggcaagacttccccatcttc

SEQ ID NO: 50394 - DNA, 25 bp, mus musculus
cctgtgacatcagcgaggatgaaga

SEQ ID NO: 50395 - DNA, 25 bp, mus musculus
cacctccagaagctctctgtcgaat

SEQ ID NO: 50396 - DNA, 25 bp, mus musculus
aaggtatctccacatcagacatcat

SEQ ID NO: 50397 - DNA, 25 bp, mus musculus
acctccagaagctctctgtcgaatt

SEQ ID NO: 50398 - DNA, 25 bp, mus musculus
cagacatcatcacccgcattgtccg

SEQ ID NO: 50399 - DNA, 25 bp, mus musculus
tcatcacccgcattgtccgtgacta

SEQ ID NO: 50400 - DNA, 25 bp, mus musculus
ttgtccgtgactatgatgtgtatgc

SEQ ID NO: 50401 - DNA, 25 bp, mus musculus
ggggctacactgccaaggagctcaa

SEQ ID NO: 50402 - DNA, 25 bp, mus musculus
acactgccaaggagctcaatgtcag

SEQ ID NO: 50403 - DNA, 25 bp, mus musculus
tcaatgtcagctttatcaacgagaa

SEQ ID NO: 50404 - DNA, 25 bp, mus musculus
atgtcagctttatcaacgagaagaa

SEQ ID NO: 50405 - DNA, 25 bp, mus musculus
tggctatggagctgctgtagtagag

SEQ ID NO: 50406 - DNA, 25 bp, mus musculus
cggaacacaacgtgctggaagacag

SEQ ID NO: 50407 - DNA, 25 bp, mus musculus
atgatgttggctacctggattctag

SEQ ID NO: 50408 - DNA, 25 bp, mus musculus
tgttggctacctggattctagagga

SEQ ID NO: 50409 - DNA, 25 bp, mus musculus
ttggctacctggattctagaggact

SEQ ID NO: 50410 - DNA, 25 bp, mus musculus
tagatgtcttgctctggccatgatt

SEQ ID NO: 50411 - DNA, 25 bp, mus musculus
gatgtcttgctctggccatgattta

SEQ ID NO: 50412 - DNA, 25 bp, mus musculus
ttgctctggccatgatttaactgaa

SEQ ID NO: 50413 - DNA, 25 bp, mus musculus
tgatttaactgaaccgattgttgga

SEQ ID NO: 50414 - DNA, 25 bp, mus musculus
atttaactgaaccgattgttggatg

SEQ ID NO: 50415 - DNA, 25 bp, mus musculus
ttaactgaaccgattgttggatgta

SEQ ID NO: 50416 - DNA, 25 bp, mus musculus
taactgaaccgattgttggatgtag

SEQ ID NO: 50417 - DNA, 25 bp, mus musculus
gaacacaacgtgctggaagacagtg

SEQ ID NO: 50418 - DNA, 25 bp, mus musculus
aactgaaccgattgttggatgtagt

SEQ ID NO: 50419 - DNA, 25 bp, mus musculus
tgtagaacctgttctctatcgagga

SEQ ID NO: 50420 - DNA, 25 bp, mus musculus
tagaacctgttctctatcgaggagc

SEQ ID NO: 50421 - DNA, 25 bp, mus musculus
tatcgaggagcgctaactgaacagt

SEQ ID NO: 50422 - DNA, 25 bp, mus musculus
agcgctaactgaacagtgttgctat

SEQ ID NO: 50423 - DNA, 25 bp, mus musculus
ggacatgcaaccgtagatgagcatg

SEQ ID NO: 50424 - DNA, 25 bp, mus musculus
acatgcaaccgtagatgagcatgat

SEQ ID NO: 50425 - DNA, 25 bp, mus musculus
gcatgatgttggctacctggattct

SEQ ID NO: 50426 - DNA, 25 bp, mus musculus
cttacgcaaaatcgccaacttgctg

SEQ ID NO: 50427 - DNA, 25 bp, mus musculus
cgccaacttgctgaagccagacaaa

SEQ ID NO: 50428 - DNA, 25 bp, mus musculus
cgaccgcaagtgcatgaccactgtg

SEQ ID NO: 50429 - DNA, 25 bp, mus musculus
cactgtgagctgggatggtgacaaa

SEQ ID NO: 50430 - DNA, 25 bp, mus musculus
tgacaaactccagtgtgtgcagaag

SEQ ID NO: 50431 - DNA, 25 bp, mus musculus
actccagtgtgtgcagaagggagag

SEQ ID NO: 50432 - DNA, 25 bp, mus musculus
tgatgaacttcacctggaaatgaga

SEQ ID NO: 50433 - DNA, 25 bp, mus musculus
acttcacctggaaatgagagctgag

SEQ ID NO: 50434 - DNA, 25 bp, mus musculus
agtacactgagcagcccgaacagcc

SEQ ID NO: 50435 - DNA, 25 bp, mus musculus
tctgcctaacatggggaccgaaacg

SEQ ID NO: 50436 - DNA, 25 bp, mus musculus
tctgccagcgaagtctctctctttg

SEQ ID NO: 50437 - DNA, 25 bp, mus musculus
agtgaccccaataaaagtgatctct

SEQ ID NO: 50438 - DNA, 25 bp, mus musculus
cttgctgaagccagacaaagagatc

SEQ ID NO: 50439 - DNA, 25 bp, mus musculus
agagatcgtgcaggatggcgaccac

SEQ ID NO: 50440 - DNA, 25 bp, mus musculus
catgatcatccgcacgctgagcact

SEQ ID NO: 50441 - DNA, 25 bp, mus musculus
catccgcacgctgagcacttttcgg

SEQ ID NO: 50442 - DNA, 25 bp, mus musculus
cacgctgagcacttttcggaactat

SEQ ID NO: 50443 - DNA, 25 bp, mus musculus
gagcacttttcggaactatatcatg

SEQ ID NO: 50444 - DNA, 25 bp, mus musculus
tatcatggacttccaagttgggaag

SEQ ID NO: 50445 - DNA, 25 bp, mus musculus
agatctgacaggcatagacgaccgc

SEQ ID NO: 50446 - DNA, 25 bp, mus musculus
attattgttgaggcccataggcaaa

SEQ ID NO: 50447 - DNA, 25 bp, mus musculus
gttgaggcccataggcaaagtgacc

SEQ ID NO: 50448 - DNA, 25 bp, mus musculus
tcatgtcagtaatttccctacttga

SEQ ID NO: 50449 - DNA, 25 bp, mus musculus
taatttccctacttgagatcgtaag

SEQ ID NO: 50450 - DNA, 25 bp, mus musculus
ctgcctgaactacatagtaagttaa

SEQ ID NO: 50451 - DNA, 25 bp, mus musculus
aagttaaataccagcttgaacagct

SEQ ID NO: 50452 - DNA, 25 bp, mus musculus
agcttgaacagcttatggaaatctt

SEQ ID NO: 50453 - DNA, 25 bp, mus musculus
aaatcttgtctcagaaatagaaaag

SEQ ID NO: 50454 - DNA, 25 bp, mus musculus
gcgtaaccatttgctaggccctgtg

SEQ ID NO: 50455 - DNA, 25 bp, mus musculus
ccctgtgttcagccctatgaagaag

SEQ ID NO: 50456 - DNA, 25 bp, mus musculus
tgtgttcagccctatgaagaagaaa

SEQ ID NO: 50457 - DNA, 25 bp, mus musculus
gttcagccctatgaagaagaaacaa

SEQ ID NO: 50458 - DNA, 25 bp, mus musculus
tagatgttctcattcggtttgatct

SEQ ID NO: 50459 - DNA, 25 bp, mus musculus
atgttctcattcggtttgatctcct

SEQ ID NO: 50460 - DNA, 25 bp, mus musculus
tcattcggtttgatctcctaaagcc

SEQ ID NO: 50461 - DNA, 25 bp, mus musculus
ttcggtttgatctcctaaagcctgt

SEQ ID NO: 50462 - DNA, 25 bp, mus musculus
ggtttgatctcctaaagcctgtctg

SEQ ID NO: 50463 - DNA, 25 bp, mus musculus
tcctaaagcctgtctgcttcactat

SEQ ID NO: 50464 - DNA, 25 bp, mus musculus
taaagcctgtctgcttcactataaa

SEQ ID NO: 50465 - DNA, 25 bp, mus musculus
ctgtctgcttcactataaagaatct

SEQ ID NO: 50466 - DNA, 25 bp, mus musculus
cgctcgcgagccggtaacagaccct

SEQ ID NO: 50467 - DNA, 25 bp, mus musculus
gctcgcgagccggtaacagaccctc

SEQ ID NO: 50468 - DNA, 25 bp, mus musculus
gaccccagttactggcgacacaagc

SEQ ID NO: 50469 - DNA, 25 bp, mus musculus
cccagttactggcgacacaagccca

SEQ ID NO: 50470 - DNA, 25 bp, mus musculus
cagttactggcgacacaagcccaag

SEQ ID NO: 50471 - DNA, 25 bp, mus musculus
gttactggcgacacaagcccaagag

SEQ ID NO: 50472 - DNA, 25 bp, mus musculus
ttactggcgacacaagcccaagaga

SEQ ID NO: 50473 - DNA, 25 bp, mus musculus
tactggcgacacaagcccaagagac

SEQ ID NO: 50474 - DNA, 25 bp, mus musculus
tggcgacacaagcccaagagacctt

SEQ ID NO: 50475 - DNA, 25 bp, mus musculus
ggcgacacaagcccaagagaccttg

SEQ ID NO: 50476 - DNA, 25 bp, mus musculus
gcgacacaagcccaagagaccttga

SEQ ID NO: 50477 - DNA, 25 bp, mus musculus
cgacacaagcccaagagaccttgaa

SEQ ID NO: 50478 - DNA, 25 bp, mus musculus
ttttagtactggccatcggacctgc

SEQ ID NO: 50479 - DNA, 25 bp, mus musculus
tttagtactggccatcggacctgcc

SEQ ID NO: 50480 - DNA, 25 bp, mus musculus
ttagtactggccatcggacctgcct

SEQ ID NO: 50481 - DNA, 25 bp, mus musculus
tagtactggccatcggacctgcctt

SEQ ID NO: 50482 - DNA, 25 bp, mus musculus
gtactggccatcggacctgccttac

SEQ ID NO: 50483 - DNA, 25 bp, mus musculus
tactggccatcggacctgccttacc

SEQ ID NO: 50484 - DNA, 25 bp, mus musculus
actggccatcggacctgccttacca

SEQ ID NO: 50485 - DNA, 25 bp, mus musculus
ctggccatcggacctgccttaccaa

SEQ ID NO: 50486 - DNA, 25 bp, mus musculus
tggtccagtcaggagaccgggagat

SEQ ID NO: 50487 - DNA, 25 bp, mus musculus
actcctgagccaccaggatttcatc

SEQ ID NO: 50488 - DNA, 25 bp, mus musculus
aggccaagccagctttctgtcactt

SEQ ID NO: 50489 - DNA, 25 bp, mus musculus
agccagctttctgtcacttatccac

SEQ ID NO: 50490 - DNA, 25 bp, mus musculus
gtcacttatccactgacagcaacgg

SEQ ID NO: 50491 - DNA, 25 bp, mus musculus
tatccactgacagcaacggtcccct

SEQ ID NO: 50492 - DNA, 25 bp, mus musculus
acctctgggtatcttctaacctgtg

SEQ ID NO: 50493 - DNA, 25 bp, mus musculus
gttgccaggaaccagagtgggccca

SEQ ID NO: 50494 - DNA, 25 bp, mus musculus
aggaaccagagtgggcccagtctat

SEQ ID NO: 50495 - DNA, 25 bp, mus musculus
ggcctcttgaacacagtcacaagct

SEQ ID NO: 50496 - DNA, 25 bp, mus musculus
ctattcaagtgccctgaccagcgac

SEQ ID NO: 50497 - DNA, 25 bp, mus musculus
tgctcccaggcttggaatggcccag

SEQ ID NO: 50498 - DNA, 25 bp, mus musculus
tttcatcagcactgtggcactgcca

SEQ ID NO: 50499 - DNA, 25 bp, mus musculus
tgtggcactgccactggaaagccct

SEQ ID NO: 50500 - DNA, 25 bp, mus musculus
actgccactggaaagccctgccttg

SEQ ID NO: 50501 - DNA, 25 bp, mus musculus
gctgctttgctgccctgcaccttta

SEQ ID NO: 50502 - DNA, 25 bp, mus musculus
ttgctgccctgcacctttagacatt

SEQ ID NO: 50503 - DNA, 25 bp, mus musculus
acctttagacatttactattctgca

SEQ ID NO: 50504 - DNA, 25 bp, mus musculus
ttactattctgcaggccaagccagc

SEQ ID NO: 50505 - DNA, 25 bp, mus musculus
ttctgcaggccaagccagctttctg

SEQ ID NO: 50506 - DNA, 25 bp, mus musculus
tatcagcgtctctggaacagtataa

SEQ ID NO: 50507 - DNA, 25 bp, mus musculus
agtataactccgtccgacagaatca

SEQ ID NO: 50508 - DNA, 25 bp, mus musculus
catcgcctcaataagccactagagc

SEQ ID NO: 50509 - DNA, 25 bp, mus musculus
cgcctcaataagccactagagcatt

SEQ ID NO: 50510 - DNA, 25 bp, mus musculus
ctcaataagccactagagcattcac

SEQ ID NO: 50511 - DNA, 25 bp, mus musculus
aagccactagagcattcacagaaat

SEQ ID NO: 50512 - DNA, 25 bp, mus musculus
ccactagagcattcacagaaattag

SEQ ID NO: 50513 - DNA, 25 bp, mus musculus
ctttagctcagcgcaaagagcattg

SEQ ID NO: 50514 - DNA, 25 bp, mus musculus
tagctcagcgcaaagagcattgcca

SEQ ID NO: 50515 - DNA, 25 bp, mus musculus
aagagcattgccatgctcacctcac

SEQ ID NO: 50516 - DNA, 25 bp, mus musculus
atggcatgtttaccagctgttccca

SEQ ID NO: 50517 - DNA, 25 bp, mus musculus
gcatgtttaccagctgttcccaacc

SEQ ID NO: 50518 - DNA, 25 bp, mus musculus
ataactccgtccgacagaatcacca

SEQ ID NO: 50519 - DNA, 25 bp, mus musculus
actccgtccgacagaatcaccagtg

SEQ ID NO: 50520 - DNA, 25 bp, mus musculus
tccgacagaatcaccagtgcataag

SEQ ID NO: 50521 - DNA, 25 bp, mus musculus
gacagaatcaccagtgcataagtat

SEQ ID NO: 50522 - DNA, 25 bp, mus musculus
caggctttgtctttgtatgtatctc

SEQ ID NO: 50523 - DNA, 25 bp, mus musculus
ttgtatgtatctcatcgcctcaata

SEQ ID NO: 50524 - DNA, 25 bp, mus musculus
tatgtatctcatcgcctcaataagc

SEQ ID NO: 50525 - DNA, 25 bp, mus musculus
gtatctcatcgcctcaataagccac

SEQ ID NO: 50526 - DNA, 25 bp, mus musculus
aggaccacacacgggtcatctctat

SEQ ID NO: 50527 - DNA, 25 bp, mus musculus
acacacgggtcatctctatggagaa

SEQ ID NO: 50528 - DNA, 25 bp, mus musculus
gcgtctttgacatctctaatttgga

SEQ ID NO: 50529 - DNA, 25 bp, mus musculus
ttgacatctctaatttggatcgact

SEQ ID NO: 50530 - DNA, 25 bp, mus musculus
atcgacttggcaagtcagaggtgga

SEQ ID NO: 50531 - DNA, 25 bp, mus musculus
tgcagctcgtcatcgatggggtgaa

SEQ ID NO: 50532 - DNA, 25 bp, mus musculus
tccacagcaaacattaactccccat

SEQ ID NO: 50533 - DNA, 25 bp, mus musculus
ccaggacttctgcatatttaacagt

SEQ ID NO: 50534 - DNA, 25 bp, mus musculus
catatttaacagtggcccagtctac

SEQ ID NO: 50535 - DNA, 25 bp, mus musculus
taacagtggcccagtctacttgccc

SEQ ID NO: 50536 - DNA, 25 bp, mus musculus
ctgtcctagtaaagactccacatta

SEQ ID NO: 50537 - DNA, 25 bp, mus musculus
tagtaaagactccacattatgttgc

SEQ ID NO: 50538 - DNA, 25 bp, mus musculus
ttgaaagattctgccggggcctcaa

SEQ ID NO: 50539 - DNA, 25 bp, mus musculus
agtaaagactccacattatgttgca

SEQ ID NO: 50540 - DNA, 25 bp, mus musculus
gattctgccggggcctcaaagaggt

SEQ ID NO: 50541 - DNA, 25 bp, mus musculus
agctgatccaggaacgaggctggga

SEQ ID NO: 50542 - DNA, 25 bp, mus musculus
tcttgacctgtccatctaacctggg

SEQ ID NO: 50543 - DNA, 25 bp, mus musculus
cctgtccatctaacctgggcactgg

SEQ ID NO: 50544 - DNA, 25 bp, mus musculus
gagtccacatcaaactgccactgct

SEQ ID NO: 50545 - DNA, 25 bp, mus musculus
acatcaaactgccactgctgagcaa

SEQ ID NO: 50546 - DNA, 25 bp, mus musculus
agatcctggagaacctaagactgca

SEQ ID NO: 50547 - DNA, 25 bp, mus musculus
tctctctcaaattcatgatgtctta

SEQ ID NO: 50548 - DNA, 25 bp, mus musculus
atatgcataatacctatcatctatc

SEQ ID NO: 50549 - DNA, 25 bp, mus musculus
gattacctctagctcttcatatagg

SEQ ID NO: 50550 - DNA, 25 bp, mus musculus
ctcttcatatagggttctgtctttg

SEQ ID NO: 50551 - DNA, 25 bp, mus musculus
tttcttctgtccatgttgcatgtca

SEQ ID NO: 50552 - DNA, 25 bp, mus musculus
ctgtccatgttgcatgtcaattggt

SEQ ID NO: 50553 - DNA, 25 bp, mus musculus
atgttgcatgtcaattggtgtcagt

SEQ ID NO: 50554 - DNA, 25 bp, mus musculus
tgtcagtatgcaggtcttgtttggg

SEQ ID NO: 50555 - DNA, 25 bp, mus musculus
tatgcaggtcttgtttgggcaacct

SEQ ID NO: 50556 - DNA, 25 bp, mus musculus
actacactgtgctcagaatcagttc

SEQ ID NO: 50557 - DNA, 25 bp, mus musculus
tcagaatcagttcttttctggaata

SEQ ID NO: 50558 - DNA, 25 bp, mus musculus
tgtacctgaacttccccagtccatg

SEQ ID NO: 50559 - DNA, 25 bp, mus musculus
atctatcatctattcatcagtcatc

SEQ ID NO: 50560 - DNA, 25 bp, mus musculus
tccccagtccatgagtcaataaagt

SEQ ID NO: 50561 - DNA, 25 bp, mus musculus
catctattcatcagtcatccatctt

SEQ ID NO: 50562 - DNA, 25 bp, mus musculus
ttcatcagtcatccatcttactgat

SEQ ID NO: 50563 - DNA, 25 bp, mus musculus
agtcatccatcttactgattacatt

SEQ ID NO: 50564 - DNA, 25 bp, mus musculus
agactgattgtccttttctcagcag

SEQ ID NO: 50565 - DNA, 25 bp, mus musculus
cttttctcagcagccactgattacc

SEQ ID NO: 50566 - DNA, 25 bp, mus musculus
tcagcagccactgattacctctagc

SEQ ID NO: 50567 - DNA, 25 bp, mus musculus
gccactgattacctctagctcttca

SEQ ID NO: 50568 - DNA, 25 bp, mus musculus
cactaacaaggtccatggcagcccg

SEQ ID NO: 50569 - DNA, 25 bp, mus musculus
ctaacaaggtccatggcagcccgct

SEQ ID NO: 50570 - DNA, 25 bp, mus musculus
cctgtgcctatgtgtcctcagggaa

SEQ ID NO: 50571 - DNA, 25 bp, mus musculus
ctgtgcctatgtgtcctcagggaac

SEQ ID NO: 50572 - DNA, 25 bp, mus musculus
gtgcctatgtgtcctcagggaactt

SEQ ID NO: 50573 - DNA, 25 bp, mus musculus
tgcctatgtgtcctcagggaacttt

SEQ ID NO: 50574 - DNA, 25 bp, mus musculus
gcctatgtgtcctcagggaactttg

SEQ ID NO: 50575 - DNA, 25 bp, mus musculus
ctatgtgtcctcagggaactttgtg

SEQ ID NO: 50576 - DNA, 25 bp, mus musculus
tatgtgtcctcagggaactttgtgg

SEQ ID NO: 50577 - DNA, 25 bp, mus musculus
atgtgtcctcagggaactttgtggc

SEQ ID NO: 50578 - DNA, 25 bp, mus musculus
tgtcctcagggaactttgtggccct

SEQ ID NO: 50579 - DNA, 25 bp, mus musculus
gtcctcagggaactttgtggccctg

SEQ ID NO: 50580 - DNA, 25 bp, mus musculus
taacaaggtccatggcagcccgctg

SEQ ID NO: 50581 - DNA, 25 bp, mus musculus
aaggtccatggcagcccgctgcgtt

SEQ ID NO: 50582 - DNA, 25 bp, mus musculus
gggtcatgacctgtgcctatgtgtc

SEQ ID NO: 50583 - DNA, 25 bp, mus musculus
ggtcatgacctgtgcctatgtgtcc

SEQ ID NO: 50584 - DNA, 25 bp, mus musculus
gtcatgacctgtgcctatgtgtcct

SEQ ID NO: 50585 - DNA, 25 bp, mus musculus
catgacctgtgcctatgtgtcctca

SEQ ID NO: 50586 - DNA, 25 bp, mus musculus
atgacctgtgcctatgtgtcctcag

SEQ ID NO: 50587 - DNA, 25 bp, mus musculus
tgacctgtgcctatgtgtcctcagg

SEQ ID NO: 50588 - DNA, 25 bp, mus musculus
cagatctcagattcaacctttcagt

SEQ ID NO: 50589 - DNA, 25 bp, mus musculus
atctcagattcaacctttcagtgaa

SEQ ID NO: 50590 - DNA, 25 bp, mus musculus
cacctgcgggattccaccaagacaa

SEQ ID NO: 50591 - DNA, 25 bp, mus musculus
accaagacaatctccctgcagcctg

SEQ ID NO: 50592 - DNA, 25 bp, mus musculus
tccctgcagcctgttccttcacagt

SEQ ID NO: 50593 - DNA, 25 bp, mus musculus
ctgcagcctgttccttcacagtcac

SEQ ID NO: 50594 - DNA, 25 bp, mus musculus
cctgttccttcacagtcaccgaacg

SEQ ID NO: 50595 - DNA, 25 bp, mus musculus
cagtcaccgaacgtccacatcaaac

SEQ ID NO: 50596 - DNA, 25 bp, mus musculus
tcaccgaacgtccacatcaaaccag

SEQ ID NO: 50597 - DNA, 25 bp, mus musculus
gtccacatcaaaccagaggccacca

SEQ ID NO: 50598 - DNA, 25 bp, mus musculus
cacatcaaaccagaggccaccatca

SEQ ID NO: 50599 - DNA, 25 bp, mus musculus
gccaccatcatgacgaaggaccaaa

SEQ ID NO: 50600 - DNA, 25 bp, mus musculus
gattcaacctttcagtgaaagccac

SEQ ID NO: 50601 - DNA, 25 bp, mus musculus
acctttcagtgaaagccacatttgg

SEQ ID NO: 50602 - DNA, 25 bp, mus musculus
ttctccagaaagctccttgccagat

SEQ ID NO: 50603 - DNA, 25 bp, mus musculus
tccagaaagctccttgccagatagt

SEQ ID NO: 50604 - DNA, 25 bp, mus musculus
ctccttgccagatagtaatggctgg

SEQ ID NO: 50605 - DNA, 25 bp, mus musculus
tttcctaggctcaggagtcacctgc

SEQ ID NO: 50606 - DNA, 25 bp, mus musculus
aggctcaggagtcacctgcgggatt

SEQ ID NO: 50607 - DNA, 25 bp, mus musculus
aggagtcacctgcgggattccacca

SEQ ID NO: 50608 - DNA, 25 bp, mus musculus
ccgcagagcctctttgtgtggaaaa

SEQ ID NO: 50609 - DNA, 25 bp, mus musculus
agcctctttgtgtggaaaacgacag

SEQ ID NO: 50610 - DNA, 25 bp, mus musculus
taacttagttcccttgcccatgtgc

SEQ ID NO: 50611 - DNA, 25 bp, mus musculus
ttagttcccttgcccatgtgctgtg

SEQ ID NO: 50612 - DNA, 25 bp, mus musculus
agttcccttgcccatgtgctgtgga

SEQ ID NO: 50613 - DNA, 25 bp, mus musculus
cccttgcccatgtgctgtggagcgt

SEQ ID NO: 50614 - DNA, 25 bp, mus musculus
cttgcccatgtgctgtggagcgtat

SEQ ID NO: 50615 - DNA, 25 bp, mus musculus
cccatgtgctgtggagcgtatacta

SEQ ID NO: 50616 - DNA, 25 bp, mus musculus
agcgtatactaacaactacacctct

SEQ ID NO: 50617 - DNA, 25 bp, mus musculus
tatactaacaactacacctctagta

SEQ ID NO: 50618 - DNA, 25 bp, mus musculus
tactaacaactacacctctagtagg

SEQ ID NO: 50619 - DNA, 25 bp, mus musculus
tacacctctagtagggtcttggaga

SEQ ID NO: 50620 - DNA, 25 bp, mus musculus
gaagacgctagcactaactgacctg

SEQ ID NO: 50621 - DNA, 25 bp, mus musculus
gctagcactaactgacctgggcctg

SEQ ID NO: 50622 - DNA, 25 bp, mus musculus
gcctggtcctttagacaccatgctg

SEQ ID NO: 50623 - DNA, 25 bp, mus musculus
ttagacaccatgctgctgctgctgc

SEQ ID NO: 50624 - DNA, 25 bp, mus musculus
agacaccatgctgctgctgctgctg

SEQ ID NO: 50625 - DNA, 25 bp, mus musculus
gctgctgctgagcacggctccggag

SEQ ID NO: 50626 - DNA, 25 bp, mus musculus
ctgctgagcacggctccggagctgg

SEQ ID NO: 50627 - DNA, 25 bp, mus musculus
ggagcccgcagtgctaacttagttc

SEQ ID NO: 50628 - DNA, 25 bp, mus musculus
ctgaaccggagattccgaagggcat

SEQ ID NO: 50629 - DNA, 25 bp, mus musculus
cgaagggcatccgggacgtgttgct

SEQ ID NO: 50630 - DNA, 25 bp, mus musculus
gctatggtagctgctggctcataac

SEQ ID NO: 50631 - DNA, 25 bp, mus musculus
ctatggtagctgctggctcataact

SEQ ID NO: 50632 - DNA, 25 bp, mus musculus
gtagctgctggctcataactaggag

SEQ ID NO: 50633 - DNA, 25 bp, mus musculus
tgatactggtgactcatgagatggt

SEQ ID NO: 50634 - DNA, 25 bp, mus musculus
atactggtgactcatgagatggttg

SEQ ID NO: 50635 - DNA, 25 bp, mus musculus
tactggtgactcatgagatggttgt

SEQ ID NO: 50636 - DNA, 25 bp, mus musculus
agactttggagacttcttcgtctat

SEQ ID NO: 50637 - DNA, 25 bp, mus musculus
ctttggagacttcttcgtctatcaa

SEQ ID NO: 50638 - DNA, 25 bp, mus musculus
agacttcttcgtctatcaatcgcta

SEQ ID NO: 50639 - DNA, 25 bp, mus musculus
tcttcgtctatcaatcgctatcttc

SEQ ID NO: 50640 - DNA, 25 bp, mus musculus
aagggcatccgggacgtgttgctgc

SEQ ID NO: 50641 - DNA, 25 bp, mus musculus
aggcacccaatctggctgctaactg

SEQ ID NO: 50642 - DNA, 25 bp, mus musculus
gcacccaatctggctgctaactgct

SEQ ID NO: 50643 - DNA, 25 bp, mus musculus
cacccaatctggctgctaactgctg

SEQ ID NO: 50644 - DNA, 25 bp, mus musculus
aatctggctgctaactgctgtttct

SEQ ID NO: 50645 - DNA, 25 bp, mus musculus
ctggctgctaactgctgtttctgtc

SEQ ID NO: 50646 - DNA, 25 bp, mus musculus
tggctgctaactgctgtttctgtca

SEQ ID NO: 50647 - DNA, 25 bp, mus musculus
ctgctaactgctgtttctgtcattg

SEQ ID NO: 50648 - DNA, 25 bp, mus musculus
acttgactccagaagaattcaggac

SEQ ID NO: 50649 - DNA, 25 bp, mus musculus
agaacagctatctgacacctggaag

SEQ ID NO: 50650 - DNA, 25 bp, mus musculus
tcaacactgtggtgtgaactctgag

SEQ ID NO: 50651 - DNA, 25 bp, mus musculus
tgtgaactctgaggcacagtcatac

SEQ ID NO: 50652 - DNA, 25 bp, mus musculus
gaactctgaggcacagtcatactga

SEQ ID NO: 50653 - DNA, 25 bp, mus musculus
cattgccaatttttagctctgaagt

SEQ ID NO: 50654 - DNA, 25 bp, mus musculus
tgccaatttttagctctgaagttcc

SEQ ID NO: 50655 - DNA, 25 bp, mus musculus
ttccttaaatgattctcacaaggat

SEQ ID NO: 50656 - DNA, 25 bp, mus musculus
cttaaatgattctcacaaggatctt

SEQ ID NO: 50657 - DNA, 25 bp, mus musculus
aaatgattctcacaaggatctttag

SEQ ID NO: 50658 - DNA, 25 bp, mus musculus
atatatgccatgatgtcttcaaatt

SEQ ID NO: 50659 - DNA, 25 bp, mus musculus
tatgccatgatgtcttcaaattaaa

SEQ ID NO: 50660 - DNA, 25 bp, mus musculus
tgacacctggaagggctcagccaga

SEQ ID NO: 50661 - DNA, 25 bp, mus musculus
agttgtggcttgactggtaacaata

SEQ ID NO: 50662 - DNA, 25 bp, mus musculus
gagtcttctgtctcctggtatggga

SEQ ID NO: 50663 - DNA, 25 bp, mus musculus
tctgtctcctggtatgggaggaatg

SEQ ID NO: 50664 - DNA, 25 bp, mus musculus
gtctcctggtatgggaggaatgatg

SEQ ID NO: 50665 - DNA, 25 bp, mus musculus
gaagcagcccatcacagtgtccagc

SEQ ID NO: 50666 - DNA, 25 bp, mus musculus
gcccatcacagtgtccagcatgtgc

SEQ ID NO: 50667 - DNA, 25 bp, mus musculus
gtccagcatgtgctgtgtgatatgc

SEQ ID NO: 50668 - DNA, 25 bp, mus musculus
tatgtatcagtgtcgtcccacagtg

SEQ ID NO: 50669 - DNA, 25 bp, mus musculus
cttaggacactaatccatcaggttg

SEQ ID NO: 50670 - DNA, 25 bp, mus musculus
aaggaaatgcctcattcctgagacc

SEQ ID NO: 50671 - DNA, 25 bp, mus musculus
atgcctcattcctgagaccagtagg

SEQ ID NO: 50672 - DNA, 25 bp, mus musculus
cattcctgagaccagtaggtttgtt

SEQ ID NO: 50673 - DNA, 25 bp, mus musculus
gtactatggctcctcgaaaacacaa

SEQ ID NO: 50674 - DNA, 25 bp, mus musculus
ctatggctcctcgaaaacacaaagt

SEQ ID NO: 50675 - DNA, 25 bp, mus musculus
ttaatgccacaggaagcagcagatg

SEQ ID NO: 50676 - DNA, 25 bp, mus musculus
atgccacaggaagcagcagatggta

SEQ ID NO: 50677 - DNA, 25 bp, mus musculus
aactcaatattttccatgaaaatgc

SEQ ID NO: 50678 - DNA, 25 bp, mus musculus
atattttccatgaaaatgcaaccac

SEQ ID NO: 50679 - DNA, 25 bp, mus musculus
atgaaaatgcaaccacatgtataat

SEQ ID NO: 50680 - DNA, 25 bp, mus musculus
ctaatccatcaggttggactcgagg

SEQ ID NO: 50681 - DNA, 25 bp, mus musculus
atccatcaggttggactcgaggtcc

SEQ ID NO: 50682 - DNA, 25 bp, mus musculus
catcaggttggactcgaggtcctgc

SEQ ID NO: 50683 - DNA, 25 bp, mus musculus
gttggactcgaggtcctgcaccaac

SEQ ID NO: 50684 - DNA, 25 bp, mus musculus
ctcgaggtcctgcaccaactggctt

SEQ ID NO: 50685 - DNA, 25 bp, mus musculus
ctgcaccaactggcttggaaactag

SEQ ID NO: 50686 - DNA, 25 bp, mus musculus
tgcataaaccgatggtgatggagtg

SEQ ID NO: 50687 - DNA, 25 bp, mus musculus
ttcttcaatgatttgcaaggaaacc

SEQ ID NO: 50688 - DNA, 25 bp, mus musculus
agcttcctttcctgcagaagagaga

SEQ ID NO: 50689 - DNA, 25 bp, mus musculus
ctttcctgcagaagagagaacgctg

SEQ ID NO: 50690 - DNA, 25 bp, mus musculus
ttcatgaatttcttctctcacaatg

SEQ ID NO: 50691 - DNA, 25 bp, mus musculus
ttaatgcacagtttagggcaatcta

SEQ ID NO: 50692 - DNA, 25 bp, mus musculus
taacttgtctcttgattcctcccgt

SEQ ID NO: 50693 - DNA, 25 bp, mus musculus
tgattcctcccgttgtctatgtgta

SEQ ID NO: 50694 - DNA, 25 bp, mus musculus
gtatctgtgcacacatagagtgcat

SEQ ID NO: 50695 - DNA, 25 bp, mus musculus
agtgcattactgccacctttttcaa

SEQ ID NO: 50696 - DNA, 25 bp, mus musculus
ttactgccacctttttcaataagct

SEQ ID NO: 50697 - DNA, 25 bp, mus musculus
ctaatttagactccttattgccata

SEQ ID NO: 50698 - DNA, 25 bp, mus musculus
tagactccttattgccatatcttta

SEQ ID NO: 50699 - DNA, 25 bp, mus musculus
ttattatctgattgttaggaaggga

SEQ ID NO: 50700 - DNA, 25 bp, mus musculus
ccatccctgtagagatggcccaaac

SEQ ID NO: 50701 - DNA, 25 bp, mus musculus
agatggcccaaactcaccaaaatgg

SEQ ID NO: 50702 - DNA, 25 bp, mus musculus
gtgacactcttcaattccagaccag

SEQ ID NO: 50703 - DNA, 25 bp, mus musculus
ctcttcaattccagaccagaccatt

SEQ ID NO: 50704 - DNA, 25 bp, mus musculus
aattccagaccagaccattggccct

SEQ ID NO: 50705 - DNA, 25 bp, mus musculus
agaccagaccattggcccttcatga

SEQ ID NO: 50706 - DNA, 25 bp, mus musculus
gaccattggcccttcatgaatttct

SEQ ID NO: 50707 - DNA, 25 bp, mus musculus
tggcccttcatgaatttcttctctc

SEQ ID NO: 50708 - DNA, 25 bp, mus musculus
aatagcaaactcattcatgcactgt

SEQ ID NO: 50709 - DNA, 25 bp, mus musculus
aaactcattcatgcactgtggtact

SEQ ID NO: 50710 - DNA, 25 bp, mus musculus
tactgcaacggccagcttgggtgta

SEQ ID NO: 50711 - DNA, 25 bp, mus musculus
aacggccagcttgggtgtaatccat

SEQ ID NO: 50712 - DNA, 25 bp, mus musculus
aatccataagggccatgagaaggaa

SEQ ID NO: 50713 - DNA, 25 bp, mus musculus
taaggacacttctccaggatcagcc

SEQ ID NO: 50714 - DNA, 25 bp, mus musculus
cacttctccaggatcagcctatcag

SEQ ID NO: 50715 - DNA, 25 bp, mus musculus
tccaggatcagcctatcaggaaggg

SEQ ID NO: 50716 - DNA, 25 bp, mus musculus
tctctatgcattgggtctcattcat

SEQ ID NO: 50717 - DNA, 25 bp, mus musculus
tgcattgggtctcattcatgccaat

SEQ ID NO: 50718 - DNA, 25 bp, mus musculus
gggtctcattcatgccaatcatggt

SEQ ID NO: 50719 - DNA, 25 bp, mus musculus
cattcatgccaatcatggtggtgac

SEQ ID NO: 50720 - DNA, 25 bp, mus musculus
attcatgcactgtggtactaccagt

SEQ ID NO: 50721 - DNA, 25 bp, mus musculus
gcactgtggtactaccagtgaccag

SEQ ID NO: 50722 - DNA, 25 bp, mus musculus
tggtactaccagtgaccagtttctt

SEQ ID NO: 50723 - DNA, 25 bp, mus musculus
taccagtgaccagtttcttagagat

SEQ ID NO: 50724 - DNA, 25 bp, mus musculus
gttggccagagccaccaactgggcc

SEQ ID NO: 50725 - DNA, 25 bp, mus musculus
cagagccaccaactgggccaaattt

SEQ ID NO: 50726 - DNA, 25 bp, mus musculus
caccaactgggccaaatttactgca

SEQ ID NO: 50727 - DNA, 25 bp, mus musculus
caaatttactgcaacggccagcttg

SEQ ID NO: 50728 - DNA, 25 bp, mus musculus
agaacacacaatctgagaacaatgc

SEQ ID NO: 50729 - DNA, 25 bp, mus musculus
cctccaggcttcagaaggacactgc

SEQ ID NO: 50730 - DNA, 25 bp, mus musculus
ttctggtatttgatcccagtggact

SEQ ID NO: 50731 - DNA, 25 bp, mus musculus
attcaggccatcatgaatacctcat

SEQ ID NO: 50732 - DNA, 25 bp, mus musculus
gccatcatgaatacctcatgtgtta

SEQ ID NO: 50733 - DNA, 25 bp, mus musculus
atgaatacctcatgtgttatcagaa

SEQ ID NO: 50734 - DNA, 25 bp, mus musculus
acctcatgtgttatcagaagcttct

SEQ ID NO: 50735 - DNA, 25 bp, mus musculus
atcagaagcttctcagaattttggg

SEQ ID NO: 50736 - DNA, 25 bp, mus musculus
agcttctcagaattttgggaatata

SEQ ID NO: 50737 - DNA, 25 bp, mus musculus
aaatcctcctcaataaacaattcat

SEQ ID NO: 50738 - DNA, 25 bp, mus musculus
tcctcaataaacaattcatctaatg

SEQ ID NO: 50739 - DNA, 25 bp, mus musculus
taaccagggcacactaatcaatgaa

SEQ ID NO: 50740 - DNA, 25 bp, mus musculus
atgtaacctatgcccagttgtgcat

SEQ ID NO: 50741 - DNA, 25 bp, mus musculus
cccagttgtgcatcaggacacagga

SEQ ID NO: 50742 - DNA, 25 bp, mus musculus
tgtgcatcaggacacaggaacagaa

SEQ ID NO: 50743 - DNA, 25 bp, mus musculus
acaacagctgaaaccagcaagcagc

SEQ ID NO: 50744 - DNA, 25 bp, mus musculus
gctgaaaccagcaagcagccaacac

SEQ ID NO: 50745 - DNA, 25 bp, mus musculus
accagcaagcagccaacacagaaag

SEQ ID NO: 50746 - DNA, 25 bp, mus musculus
gaagacccagaccccacattccatg

SEQ ID NO: 50747 - DNA, 25 bp, mus musculus
cccacattccatgaatgaaaactag

SEQ ID NO: 50748 - DNA, 25 bp, mus musculus
gggctctgtgctggctacctggttt

SEQ ID NO: 50749 - DNA, 25 bp, mus musculus
gcataacagacccagcttccgagag

SEQ ID NO: 50750 - DNA, 25 bp, mus musculus
tggctttggactggggacagccagc

SEQ ID NO: 50751 - DNA, 25 bp, mus musculus
ttggcacaaccttctggaggccaaa

SEQ ID NO: 50752 - DNA, 25 bp, mus musculus
caaccttctggaggccaaagagcaa

SEQ ID NO: 50753 - DNA, 25 bp, mus musculus
actgctgcttgagacacacccacgg

SEQ ID NO: 50754 - DNA, 25 bp, mus musculus
gcttgagacacacccacgggtccct

SEQ ID NO: 50755 - DNA, 25 bp, mus musculus
caccctgtagccaggaccttggagg

SEQ ID NO: 50756 - DNA, 25 bp, mus musculus
aggaccttggaggcatgcgtatcct

SEQ ID NO: 50757 - DNA, 25 bp, mus musculus
tgtcatatccccggcgtatatcctt

SEQ ID NO: 50758 - DNA, 25 bp, mus musculus
atccccggcgtatatccttgacata

SEQ ID NO: 50759 - DNA, 25 bp, mus musculus
tgacatatccaagtccgtttcctta

SEQ ID NO: 50760 - DNA, 25 bp, mus musculus
cagacccagcttccgagagacattt

SEQ ID NO: 50761 - DNA, 25 bp, mus musculus
cagcttccgagagacatttagatta

SEQ ID NO: 50762 - DNA, 25 bp, mus musculus
tttactacaagcatgcaagggtcta

SEQ ID NO: 50763 - DNA, 25 bp, mus musculus
gcttctacctactgcaggggactgc

SEQ ID NO: 50764 - DNA, 25 bp, mus musculus
acctactgcaggggactgcccggct

SEQ ID NO: 50765 - DNA, 25 bp, mus musculus
tgggcaccctctcagaaaaagcaca

SEQ ID NO: 50766 - DNA, 25 bp, mus musculus
ccctctcagaaaaagcacagtgaaa

SEQ ID NO: 50767 - DNA, 25 bp, mus musculus
tccatcagacatagcaacagcaaaa

SEQ ID NO: 50768 - DNA, 25 bp, mus musculus
ttccagatattgctcttgaaccaga

SEQ ID NO: 50769 - DNA, 25 bp, mus musculus
atattgctcttgaaccagataaaac

SEQ ID NO: 50770 - DNA, 25 bp, mus musculus
agagcgtccacgcactgttcgccgc

SEQ ID NO: 50771 - DNA, 25 bp, mus musculus
tgttcgccgccgtggtggagcagat

SEQ ID NO: 50772 - DNA, 25 bp, mus musculus
agatccataagtttgcccagtactg

SEQ ID NO: 50773 - DNA, 25 bp, mus musculus
tccataagtttgcccagtactggag

SEQ ID NO: 50774 - DNA, 25 bp, mus musculus
ggatttgacccatcctgatgcctgg

SEQ ID NO: 50775 - DNA, 25 bp, mus musculus
tcctgatgcctggctcaataagaaa

SEQ ID NO: 50776 - DNA, 25 bp, mus musculus
tgatgcctggctcaataagaaaaca

SEQ ID NO: 50777 - DNA, 25 bp, mus musculus
ggagaagccactgctgtgtactaaa

SEQ ID NO: 50778 - DNA, 25 bp, mus musculus
gaagccactgctgtgtactaaagac

SEQ ID NO: 50779 - DNA, 25 bp, mus musculus
gccactgctgtgtactaaagacatc

SEQ ID NO: 50780 - DNA, 25 bp, mus musculus
ttgctcttgaaccagataaaactgt

SEQ ID NO: 50781 - DNA, 25 bp, mus musculus
tggacctgtcagatgaggaggctgt

SEQ ID NO: 50782 - DNA, 25 bp, mus musculus
aggctgtgcactacatgcagagtct

SEQ ID NO: 50783 - DNA, 25 bp, mus musculus
ctgtgcactacatgcagagtctgat

SEQ ID NO: 50784 - DNA, 25 bp, mus musculus
tgcactacatgcagagtctgatcga

SEQ ID NO: 50785 - DNA, 25 bp, mus musculus
actacatgcagagtctgatcgacga

SEQ ID NO: 50786 - DNA, 25 bp, mus musculus
tcgacgagagcgtccacgcactgtt

SEQ ID NO: 50787 - DNA, 25 bp, mus musculus
acgagagcgtccacgcactgttcgc

SEQ ID NO: 50788 - DNA, 25 bp, mus musculus
ctggagactctgcagcgggagatca

SEQ ID NO: 50789 - DNA, 25 bp, mus musculus
actctgcagcgggagatcagaatgg

SEQ ID NO: 50790 - DNA, 25 bp, mus musculus
gaaacacagtgttcccaggcacatg

SEQ ID NO: 50791 - DNA, 25 bp, mus musculus
cagtgttcccaggcacatgttctca

SEQ ID NO: 50792 - DNA, 25 bp, mus musculus
tcccaggcacatgttctcagcaata

SEQ ID NO: 50793 - DNA, 25 bp, mus musculus
gcacatgttctcagcaataatgcag

SEQ ID NO: 50794 - DNA, 25 bp, mus musculus
gttctcagcaataatgcagttgcag

SEQ ID NO: 50795 - DNA, 25 bp, mus musculus
gaactttcaggttgtgtcttccaga

SEQ ID NO: 50796 - DNA, 25 bp, mus musculus
tgtgtcttccagatccagagaagaa

SEQ ID NO: 50797 - DNA, 25 bp, mus musculus
atttgtacattggactgctgtagtt

SEQ ID NO: 50798 - DNA, 25 bp, mus musculus
tgtacattggactgctgtagttaca

SEQ ID NO: 50799 - DNA, 25 bp, mus musculus
acattggactgctgtagttacactt

SEQ ID NO: 50800 - DNA, 25 bp, mus musculus
ttggacctagcaatccaggcctacc

SEQ ID NO: 50801 - DNA, 25 bp, mus musculus
atccaggcctaccatcaccaaaaca

SEQ ID NO: 50802 - DNA, 25 bp, mus musculus
gtaagcagcaacttgctgaataatg

SEQ ID NO: 50803 - DNA, 25 bp, mus musculus
gtaaacatttggctctggttatctt

SEQ ID NO: 50804 - DNA, 25 bp, mus musculus
ttatcttcagggatgctgttggctc

SEQ ID NO: 50805 - DNA, 25 bp, mus musculus
ttggctcatgatccaaactcagggg

SEQ ID NO: 50806 - DNA, 25 bp, mus musculus
catgatccaaactcaggggactctg

SEQ ID NO: 50807 - DNA, 25 bp, mus musculus
ccaaactcaggggactctgaaggtg

SEQ ID NO: 50808 - DNA, 25 bp, mus musculus
tctggaccgacccttggagacagat

SEQ ID NO: 50809 - DNA, 25 bp, mus musculus
ccgacccttggagacagattgtcac

SEQ ID NO: 50810 - DNA, 25 bp, mus musculus
tgctgttctctgccgaggtccaagc

SEQ ID NO: 50811 - DNA, 25 bp, mus musculus
tctctgccgaggtccaagcacagaa

SEQ ID NO: 50812 - DNA, 25 bp, mus musculus
tccaagcacagaatcgggcttttac

SEQ ID NO: 50813 - DNA, 25 bp, mus musculus
gggcttttaccatgacttcttcctg

SEQ ID NO: 50814 - DNA, 25 bp, mus musculus
acggacagtccgcagcgcagagttg

SEQ ID NO: 50815 - DNA, 25 bp, mus musculus
gacagtccgcagcgcagagttgccc

SEQ ID NO: 50816 - DNA, 25 bp, mus musculus
cagcgcagagttgcccattttagag

SEQ ID NO: 50817 - DNA, 25 bp, mus musculus
cgcagagttgcccattttagagcgg

SEQ ID NO: 50818 - DNA, 25 bp, mus musculus
agagttgcccattttagagcggatt

SEQ ID NO: 50819 - DNA, 25 bp, mus musculus
tttagagcggatttgccaggagctc

SEQ ID NO: 50820 - DNA, 25 bp, mus musculus
ttgtcacctcagatttctgacattt

SEQ ID NO: 50821 - DNA, 25 bp, mus musculus
tcacctcagatttctgacatttgat

SEQ ID NO: 50822 - DNA, 25 bp, mus musculus
cctcagatttctgacatttgattcc

SEQ ID NO: 50823 - DNA, 25 bp, mus musculus
atttctgacatttgattccccagag

SEQ ID NO: 50824 - DNA, 25 bp, mus musculus
tctgacatttgattccccagagggc

SEQ ID NO: 50825 - DNA, 25 bp, mus musculus
gacatttgattccccagagggcaaa

SEQ ID NO: 50826 - DNA, 25 bp, mus musculus
gttctggcactctagtgccagtgtt

SEQ ID NO: 50827 - DNA, 25 bp, mus musculus
ctggcactctagtgccagtgttctg

SEQ ID NO: 50828 - DNA, 25 bp, mus musculus
ttagccaagtacctgatggagctga

SEQ ID NO: 50829 - DNA, 25 bp, mus musculus
gagctgacgctcgtcgactatgaca

SEQ ID NO: 50830 - DNA, 25 bp, mus musculus
agcagcagactcctgaagatcaagc

SEQ ID NO: 50831 - DNA, 25 bp, mus musculus
atcaagcacgatcctcagctgaact

SEQ ID NO: 50832 - DNA, 25 bp, mus musculus
tccaaaatcatcaaagacctggtct

SEQ ID NO: 50833 - DNA, 25 bp, mus musculus
ggcagcccctaggcactggactccg

SEQ ID NO: 50834 - DNA, 25 bp, mus musculus
gactccgatcctgcgcttctcagat

SEQ ID NO: 50835 - DNA, 25 bp, mus musculus
gatcctgcgcttctcagatcctgta

SEQ ID NO: 50836 - DNA, 25 bp, mus musculus
gcgcttctcagatcctgtatgtatt

SEQ ID NO: 50837 - DNA, 25 bp, mus musculus
tcagactcattttctaattgtgtat

SEQ ID NO: 50838 - DNA, 25 bp, mus musculus
acaataactctgctctgtattgaag

SEQ ID NO: 50839 - DNA, 25 bp, mus musculus
actctgctctgtattgaaggaaaat

SEQ ID NO: 50840 - DNA, 25 bp, mus musculus
acgctcgtcgactatgacatggtgc

SEQ ID NO: 50841 - DNA, 25 bp, mus musculus
atggtgcactaccatccttctcagg

SEQ ID NO: 50842 - DNA, 25 bp, mus musculus
tctcaggtggcagccgctgcctctt

SEQ ID NO: 50843 - DNA, 25 bp, mus musculus
tgcctgtctcagaaggtgctgggcc

SEQ ID NO: 50844 - DNA, 25 bp, mus musculus
tacacaggctacatggagagtgaag

SEQ ID NO: 50845 - DNA, 25 bp, mus musculus
cacatggccaagaacgttgtgaaag

SEQ ID NO: 50846 - DNA, 25 bp, mus musculus
gacaaccgtaccaagttcatcgctg

SEQ ID NO: 50847 - DNA, 25 bp, mus musculus
aagttcatcgctgtcaagaacaagt

SEQ ID NO: 50848 - DNA, 25 bp, mus musculus
caacttctctccggagcagtcacag

SEQ ID NO: 50849 - DNA, 25 bp, mus musculus
ctctccggagcagtcacagtgaaga

SEQ ID NO: 50850 - DNA, 25 bp, mus musculus
gaccccatgctagtgtactcttgcg

SEQ ID NO: 50851 - DNA, 25 bp, mus musculus
ccccatgctagtgtactcttgcgta

SEQ ID NO: 50852 - DNA, 25 bp, mus musculus
ccatgctagtgtactcttgcgtatc

SEQ ID NO: 50853 - DNA, 25 bp, mus musculus
gctagtgtactcttgcgtatcgcct

SEQ ID NO: 50854 - DNA, 25 bp, mus musculus
tagtgtactcttgcgtatcgcctga

SEQ ID NO: 50855 - DNA, 25 bp, mus musculus
tcttgcgtatcgcctgagtgcacac

SEQ ID NO: 50856 - DNA, 25 bp, mus musculus
gtatcgcctgagtgcacacttacag

SEQ ID NO: 50857 - DNA, 25 bp, mus musculus
gcggagatcaccattacgggtactt

SEQ ID NO: 50858 - DNA, 25 bp, mus musculus
ggtacttttcgaggctcgtgccaga

SEQ ID NO: 50859 - DNA, 25 bp, mus musculus
tacttttcgaggctcgtgccagaat

SEQ ID NO: 50860 - DNA, 25 bp, mus musculus
ctccggagcagtcacagtgaagatc

SEQ ID NO: 50861 - DNA, 25 bp, mus musculus
tctcggtgcttcactcggtgatata

SEQ ID NO: 50862 - DNA, 25 bp, mus musculus
tcggtgcttcactcggtgatatacg

SEQ ID NO: 50863 - DNA, 25 bp, mus musculus
ggtgcttcactcggtgatatacgct

SEQ ID NO: 50864 - DNA, 25 bp, mus musculus
tgcttcactcggtgatatacgctca

SEQ ID NO: 50865 - DNA, 25 bp, mus musculus
tcactcggtgatatacgctcactcc

SEQ ID NO: 50866 - DNA, 25 bp, mus musculus
ggtgatatacgctcactccaggtgt

SEQ ID NO: 50867 - DNA, 25 bp, mus musculus
tggaccccatgctagtgtactcttg

SEQ ID NO: 50868 - DNA, 25 bp, mus musculus
acctggacgcaagtgttcaggtcac

SEQ ID NO: 50869 - DNA, 25 bp, mus musculus
gtgttcaggtcacacagctggtagc

SEQ ID NO: 50870 - DNA, 25 bp, mus musculus
tgttcccacggtgcaatgatatccc

SEQ ID NO: 50871 - DNA, 25 bp, mus musculus
gcaatgatatcccctatcaaagtag

SEQ ID NO: 50872 - DNA, 25 bp, mus musculus
atgatatcccctatcaaagtagtgg

SEQ ID NO: 50873 - DNA, 25 bp, mus musculus
atatcccctatcaaagtagtggagg

SEQ ID NO: 50874 - DNA, 25 bp, mus musculus
gctatcagcaagcgcctccaaggga

SEQ ID NO: 50875 - DNA, 25 bp, mus musculus
agcaagcgcctccaagggaaggtca

SEQ ID NO: 50876 - DNA, 25 bp, mus musculus
cgcctccaagggaaggtcatggcag

SEQ ID NO: 50877 - DNA, 25 bp, mus musculus
atggcaggcccattgaactgtacag

SEQ ID NO: 50878 - DNA, 25 bp, mus musculus
gcaggcccattgaactgtacagcaa

SEQ ID NO: 50879 - DNA, 25 bp, mus musculus
aactgtacagcaatttgcatcaaag

SEQ ID NO: 50880 - DNA, 25 bp, mus musculus
aggtcacacagctggtagcgaccac

SEQ ID NO: 50881 - DNA, 25 bp, mus musculus
tcacacagctggtagcgaccaccca

SEQ ID NO: 50882 - DNA, 25 bp, mus musculus
tcaacccgctgctctatttgcttct

SEQ ID NO: 50883 - DNA, 25 bp, mus musculus
tctatttgcttcttgaccggaaggc

SEQ ID NO: 50884 - DNA, 25 bp, mus musculus
tgcttcttgaccggaaggcctttat

SEQ ID NO: 50885 - DNA, 25 bp, mus musculus
ttgaccggaaggcctttatgagata

SEQ ID NO: 50886 - DNA, 25 bp, mus musculus
ttatgagataccttcgcagcctgtt

SEQ ID NO: 50887 - DNA, 25 bp, mus musculus
tgagataccttcgcagcctgttccc

SEQ ID NO: 50888 - DNA, 25 bp, mus musculus
tctcttggttggtcaactttcagat

SEQ ID NO: 50889 - DNA, 25 bp, mus musculus
tcaactttcagatctgaaaccaagt

SEQ ID NO: 50890 - DNA, 25 bp, mus musculus
caatgcctatattgcatctcctagt

SEQ ID NO: 50891 - DNA, 25 bp, mus musculus
ctatattgcatctcctagtgtgaac

SEQ ID NO: 50892 - DNA, 25 bp, mus musculus
tgcatctcctagtgtgaacaaactg

SEQ ID NO: 50893 - DNA, 25 bp, mus musculus
attcaagtgcattctctcagtgccc

SEQ ID NO: 50894 - DNA, 25 bp, mus musculus
ctccacagtgttcttaaatgatgtt

SEQ ID NO: 50895 - DNA, 25 bp, mus musculus
tcttgcttggctcattcatagtagt

SEQ ID NO: 50896 - DNA, 25 bp, mus musculus
cattcatagtagtcttccagggggt

SEQ ID NO: 50897 - DNA, 25 bp, mus musculus
gaattctgacagccagatgggtgtg

SEQ ID NO: 50898 - DNA, 25 bp, mus musculus
ctcctgtcttgtaatgccacctgga

SEQ ID NO: 50899 - DNA, 25 bp, mus musculus
aatgccacctggaaaagaatcctgt

SEQ ID NO: 50900 - DNA, 25 bp, mus musculus
ttcagatctgaaaccaagtatcttt

SEQ ID NO: 50901 - DNA, 25 bp, mus musculus
cccccaagtctcactatcaacagat

SEQ ID NO: 50902 - DNA, 25 bp, mus musculus
tgtatcttgtatatcctgtatagaa

SEQ ID NO: 50903 - DNA, 25 bp, mus musculus
catgcatatactcccaaggagatat

SEQ ID NO: 50904 - DNA, 25 bp, mus musculus
catcaacagtattcctatcagcatt

SEQ ID NO: 50905 - DNA, 25 bp, mus musculus
cagtattcctatcagcattccttac

SEQ ID NO: 50906 - DNA, 25 bp, mus musculus
tcctatcagcattccttacaatgcc

SEQ ID NO: 50907 - DNA, 25 bp, mus musculus
cagcattccttacaatgcctatatt

SEQ ID NO: 50908 - DNA, 25 bp, mus musculus
ccaaacctgccattgcctccaaaga

SEQ ID NO: 50909 - DNA, 25 bp, mus musculus
ttgcctccaaagacagtggtgtgga

SEQ ID NO: 50910 - DNA, 25 bp, mus musculus
ttcacacagatgacacaagcttgaa

SEQ ID NO: 50911 - DNA, 25 bp, mus musculus
tgataggctgtgaccagtggttgtg

SEQ ID NO: 50912 - DNA, 25 bp, mus musculus
gctgtgaccagtggttgtgagcaaa

SEQ ID NO: 50913 - DNA, 25 bp, mus musculus
gagcccacagcctggcctaggctgc

SEQ ID NO: 50914 - DNA, 25 bp, mus musculus
acagcctggcctaggctgcccttct

SEQ ID NO: 50915 - DNA, 25 bp, mus musculus
tccactgtcagccaacagcatgtcc

SEQ ID NO: 50916 - DNA, 25 bp, mus musculus
gtcagccaacagcatgtcctgcctt

SEQ ID NO: 50917 - DNA, 25 bp, mus musculus
catgtcctgccttcatgaactctta

SEQ ID NO: 50918 - DNA, 25 bp, mus musculus
ctgccttcatgaactcttattttgt

SEQ ID NO: 50919 - DNA, 25 bp, mus musculus
tcatgaactcttattttgtaaggtg

SEQ ID NO: 50920 - DNA, 25 bp, mus musculus
agcccctgcagatgctgtgctctat

SEQ ID NO: 50921 - DNA, 25 bp, mus musculus
ggtgcatctcttcaggagcagcagg

SEQ ID NO: 50922 - DNA, 25 bp, mus musculus
acctccagaacaccactgagtgctc

SEQ ID NO: 50923 - DNA, 25 bp, mus musculus
agaacaccactgagtgctccagaag

SEQ ID NO: 50924 - DNA, 25 bp, mus musculus
ccactgagtgctccagaagctgcta

SEQ ID NO: 50925 - DNA, 25 bp, mus musculus
ggtgctacttgacccactggactct

SEQ ID NO: 50926 - DNA, 25 bp, mus musculus
acttgacccactggactcttcacac

SEQ ID NO: 50927 - DNA, 25 bp, mus musculus
ggactcttcacacagatgacacaag

SEQ ID NO: 50928 - DNA, 25 bp, mus musculus
acggtcttccaggacctgtttgcat

SEQ ID NO: 50929 - DNA, 25 bp, mus musculus
ggtcttccaggacctgtttgcatcc

SEQ ID NO: 50930 - DNA, 25 bp, mus musculus
tctcaaacccacagacaagcataag

SEQ ID NO: 50931 - DNA, 25 bp, mus musculus
tcaaacccacagacaagcataagac

SEQ ID NO: 50932 - DNA, 25 bp, mus musculus
aaacccacagacaagcataagaccg

SEQ ID NO: 50933 - DNA, 25 bp, mus musculus
acaagcataagaccgacctcaacca

SEQ ID NO: 50934 - DNA, 25 bp, mus musculus
gcataagaccgacctcaaccacgag

SEQ ID NO: 50935 - DNA, 25 bp, mus musculus
gacctcaaccacgagaccctcaagg

SEQ ID NO: 50936 - DNA, 25 bp, mus musculus
tcaaccacgagaccctcaagggtgg

SEQ ID NO: 50937 - DNA, 25 bp, mus musculus
gacgacctggcacccaaccatgtgc

SEQ ID NO: 50938 - DNA, 25 bp, mus musculus
cacccaaccatgtgctgagcagccg

SEQ ID NO: 50939 - DNA, 25 bp, mus musculus
cccaaccatgtgctgagcagccgcg

SEQ ID NO: 50940 - DNA, 25 bp, mus musculus
tcttccaggacctgtttgcatccat

SEQ ID NO: 50941 - DNA, 25 bp, mus musculus
ccaggacctgtttgcatccatcatc

SEQ ID NO: 50942 - DNA, 25 bp, mus musculus
aggacctgtttgcatccatcatcca

SEQ ID NO: 50943 - DNA, 25 bp, mus musculus
gacctgtttgcatccatcatccagg

SEQ ID NO: 50944 - DNA, 25 bp, mus musculus
cctgtttgcatccatcatccaggac

SEQ ID NO: 50945 - DNA, 25 bp, mus musculus
tttgcatccatcatccaggaccgcc

SEQ ID NO: 50946 - DNA, 25 bp, mus musculus
tggcgctctcaaacccacagacaag

SEQ ID NO: 50947 - DNA, 25 bp, mus musculus
gctctcaaacccacagacaagcata

SEQ ID NO: 50948 - DNA, 25 bp, mus musculus
tgatcttcgctggaattaagaagaa

SEQ ID NO: 50949 - DNA, 25 bp, mus musculus
atcttcgctggaattaagaagaagg

SEQ ID NO: 50950 - DNA, 25 bp, mus musculus
ttaaagcaacagttccagttgtata

SEQ ID NO: 50951 - DNA, 25 bp, mus musculus
caacagttccagttgtatacatgct

SEQ ID NO: 50952 - DNA, 25 bp, mus musculus
acagttccagttgtatacatgctac

SEQ ID NO: 50953 - DNA, 25 bp, mus musculus
agttccagttgtatacatgctacca

SEQ ID NO: 50954 - DNA, 25 bp, mus musculus
ttgtatacatgctaccacggctctc

SEQ ID NO: 50955 - DNA, 25 bp, mus musculus
gtatacatgctaccacggctctccc

SEQ ID NO: 50956 - DNA, 25 bp, mus musculus
atacatgctaccacggctctccctt

SEQ ID NO: 50957 - DNA, 25 bp, mus musculus
ggctctccctttctcaagataagat

SEQ ID NO: 50958 - DNA, 25 bp, mus musculus
ctctccctttctcaagataagattg

SEQ ID NO: 50959 - DNA, 25 bp, mus musculus
ccctttctcaagataagattggact

SEQ ID NO: 50960 - DNA, 25 bp, mus musculus
aatgagtaattccactgccttattt

SEQ ID NO: 50961 - DNA, 25 bp, mus musculus
tgagtaattccactgccttatttat

SEQ ID NO: 50962 - DNA, 25 bp, mus musculus
tgtctcatggcttttaatgtacacc

SEQ ID NO: 50963 - DNA, 25 bp, mus musculus
aattcacacaccaaattcagatcat

SEQ ID NO: 50964 - DNA, 25 bp, mus musculus
ttcacacaccaaattcagatcatga

SEQ ID NO: 50965 - DNA, 25 bp, mus musculus
cacacaccaaattcagatcatgaat

SEQ ID NO: 50966 - DNA, 25 bp, mus musculus
tttgttggacagtcctgatttaagt

SEQ ID NO: 50967 - DNA, 25 bp, mus musculus
tattaaagcaacagttccagttgta

SEQ ID NO: 50968 - DNA, 25 bp, mus musculus
atcatcttcacagccgaggagaaga

SEQ ID NO: 50969 - DNA, 25 bp, mus musculus
catcttcacagccgaggagaagaaa

SEQ ID NO: 50970 - DNA, 25 bp, mus musculus
agacccagtatatgtgctgctcagc

SEQ ID NO: 50971 - DNA, 25 bp, mus musculus
ccagtatatgtgctgctcagctgcc

SEQ ID NO: 50972 - DNA, 25 bp, mus musculus
agtatatgtgctgctcagctgccgt

SEQ ID NO: 50973 - DNA, 25 bp, mus musculus
tatgtgctgctcagctgccgtcggt

SEQ ID NO: 50974 - DNA, 25 bp, mus musculus
tgtgctgctcagctgccgtcggtct

SEQ ID NO: 50975 - DNA, 25 bp, mus musculus
tgctgctcagctgccgtcggtctgt

SEQ ID NO: 50976 - DNA, 25 bp, mus musculus
ctgctcagctgccgtcggtctgtag

SEQ ID NO: 50977 - DNA, 25 bp, mus musculus
tgtaggctgtcaggttgccaagcaa

SEQ ID NO: 50978 - DNA, 25 bp, mus musculus
ctgtcaggttgccaagcaacacgtg

SEQ ID NO: 50979 - DNA, 25 bp, mus musculus
caggttgccaagcaacacgtgcagg

SEQ ID NO: 50980 - DNA, 25 bp, mus musculus
ctcctgcagaatttgctgtcgctgt

SEQ ID NO: 50981 - DNA, 25 bp, mus musculus
ggttgccaagcaacacgtgcaggac

SEQ ID NO: 50982 - DNA, 25 bp, mus musculus
tgcagaatttgctgtcgctgtggca

SEQ ID NO: 50983 - DNA, 25 bp, mus musculus
gaatttgctgtcgctgtggcacaga

SEQ ID NO: 50984 - DNA, 25 bp, mus musculus
atttgctgtcgctgtggcacagagt

SEQ ID NO: 50985 - DNA, 25 bp, mus musculus
ttgctgtcgctgtggcacagagtac

SEQ ID NO: 50986 - DNA, 25 bp, mus musculus
gctgtcgctgtggcacagagtacct

SEQ ID NO: 50987 - DNA, 25 bp, mus musculus
acagagtaccttgtgtcctcctcgg

SEQ ID NO: 50988 - DNA, 25 bp, mus musculus
tgcgtgcgcagtgaggagtgttact

SEQ ID NO: 50989 - DNA, 25 bp, mus musculus
aagattcctctgccatggagtccta

SEQ ID NO: 50990 - DNA, 25 bp, mus musculus
attcctctgccatggagtcctacga

SEQ ID NO: 50991 - DNA, 25 bp, mus musculus
atcagttttgcgttggcattagcag

SEQ ID NO: 50992 - DNA, 25 bp, mus musculus
agttttgcgttggcattagcagtgc

SEQ ID NO: 50993 - DNA, 25 bp, mus musculus
tttgcgttggcattagcagtgcaga

SEQ ID NO: 50994 - DNA, 25 bp, mus musculus
gagcctctcagtgaggatgctagga

SEQ ID NO: 50995 - DNA, 25 bp, mus musculus
cctctcagtgaggatgctaggaacc

SEQ ID NO: 50996 - DNA, 25 bp, mus musculus
aggaacctgactccagccctccaga

SEQ ID NO: 50997 - DNA, 25 bp, mus musculus
ccagccctccagaagaacagcaagt

SEQ ID NO: 50998 - DNA, 25 bp, mus musculus
gccctccagaagaacagcaagtaca

SEQ ID NO: 50999 - DNA, 25 bp, mus musculus
aacagcaaggatccggtgtgattaa

SEQ ID NO: 51000 - DNA, 25 bp, mus musculus
agcaaggatccggtgtgattaaagc

SEQ ID NO: 51001 - DNA, 25 bp, mus musculus
cctctgccatggagtcctacgatgt

SEQ ID NO: 51002 - DNA, 25 bp, mus musculus
ctgccatggagtcctacgatgtgat

SEQ ID NO: 51003 - DNA, 25 bp, mus musculus
ccatggagtcctacgatgtgatcgc

SEQ ID NO: 51004 - DNA, 25 bp, mus musculus
cctacgatgtgatcgccaaccagcc

SEQ ID NO: 51005 - DNA, 25 bp, mus musculus
tgatcgccaaccagcctgttgtgat

SEQ ID NO: 51006 - DNA, 25 bp, mus musculus
ccaaccagcctgttgtgatcgacaa

SEQ ID NO: 51007 - DNA, 25 bp, mus musculus
tgatcgacaacagttatcagttttg

SEQ ID NO: 51008 - DNA, 25 bp, mus musculus
gttatcagttttgcgttggcattag

SEQ ID NO: 51009 - DNA, 25 bp, mus musculus
tccgcactgatctgtgaacgcgagg

SEQ ID NO: 51010 - DNA, 25 bp, mus musculus
gcactgatctgtgaacgcgaggaac

SEQ ID NO: 51011 - DNA, 25 bp, mus musculus
gaagctgccacctgtacaaggagct

SEQ ID NO: 51012 - DNA, 25 bp, mus musculus
acctgtacaaggagctgtggaggct

SEQ ID NO: 51013 - DNA, 25 bp, mus musculus
agctacgaaccctgaacacagcacg

SEQ ID NO: 51014 - DNA, 25 bp, mus musculus
tacgaaccctgaacacagcacgaaa

SEQ ID NO: 51015 - DNA, 25 bp, mus musculus
gaaccctgaacacagcacgaaatcc

SEQ ID NO: 51016 - DNA, 25 bp, mus musculus
tgaacacagcacgaaatccaccaca

SEQ ID NO: 51017 - DNA, 25 bp, mus musculus
acacagcacgaaatccaccacaggc

SEQ ID NO: 51018 - DNA, 25 bp, mus musculus
ggcccagactgacctgatgctaact

SEQ ID NO: 51019 - DNA, 25 bp, mus musculus
gcccagactgacctgatgctaactc

SEQ ID NO: 51020 - DNA, 25 bp, mus musculus
cccagactgacctgatgctaactcc

SEQ ID NO: 51021 - DNA, 25 bp, mus musculus
ctgatctgtgaacgcgaggaacttc

SEQ ID NO: 51022 - DNA, 25 bp, mus musculus
ccagactgacctgatgctaactccc

SEQ ID NO: 51023 - DNA, 25 bp, mus musculus
gaggaacttctccgagcatgaatgt

SEQ ID NO: 51024 - DNA, 25 bp, mus musculus
gaacttctccgagcatgaatgtgcc

SEQ ID NO: 51025 - DNA, 25 bp, mus musculus
cttctccgagcatgaatgtgccgag

SEQ ID NO: 51026 - DNA, 25 bp, mus musculus
tgaatgtgccgagccgagttcacca

SEQ ID NO: 51027 - DNA, 25 bp, mus musculus
accaagtgtggcgtgaaggacgaca

SEQ ID NO: 51028 - DNA, 25 bp, mus musculus
aagtcagaagctgccacctgtacaa

SEQ ID NO: 51029 - DNA, 25 bp, mus musculus
tcagaagctgccacctgtacaagga

SEQ ID NO: 51030 - DNA, 25 bp, mus musculus
taacctattcagtactgactcctct

SEQ ID NO: 51031 - DNA, 25 bp, mus musculus
attcagtactgactcctctgccaag

SEQ ID NO: 51032 - DNA, 25 bp, mus musculus
tctactctgtgacatgagtgtttta

SEQ ID NO: 51033 - DNA, 25 bp, mus musculus
atggagcagctccttataatacaaa

SEQ ID NO: 51034 - DNA, 25 bp, mus musculus
cagctccttataatacaaattgtat

SEQ ID NO: 51035 - DNA, 25 bp, mus musculus
tttcaacagctttcatctgtattgt

SEQ ID NO: 51036 - DNA, 25 bp, mus musculus
cagctttcatctgtattgtcttaac

SEQ ID NO: 51037 - DNA, 25 bp, mus musculus
ctttcatctgtattgtcttaacgtg

SEQ ID NO: 51038 - DNA, 25 bp, mus musculus
tcatctgtattgtcttaacgtggaa

SEQ ID NO: 51039 - DNA, 25 bp, mus musculus
ttgttaaaagcagccttctagcaca

SEQ ID NO: 51040 - DNA, 25 bp, mus musculus
aaagcagccttctagcacaaacact

SEQ ID NO: 51041 - DNA, 25 bp, mus musculus
gcagccttctagcacaaacactttt

SEQ ID NO: 51042 - DNA, 25 bp, mus musculus
cagtactgactcctctgccaagagg

SEQ ID NO: 51043 - DNA, 25 bp, mus musculus
tactgactcctctgccaagagggtc

SEQ ID NO: 51044 - DNA, 25 bp, mus musculus
ctcctctgccaagagggtctcctga

SEQ ID NO: 51045 - DNA, 25 bp, mus musculus
ctctgccaagagggtctcctgagaa

SEQ ID NO: 51046 - DNA, 25 bp, mus musculus
ggtctcctgagaagactgggtcctc

SEQ ID NO: 51047 - DNA, 25 bp, mus musculus
cttgccctgatgtctactctgtgac

SEQ ID NO: 51048 - DNA, 25 bp, mus musculus
gccctgatgtctactctgtgacatg

SEQ ID NO: 51049 - DNA, 25 bp, mus musculus
atgtctactctgtgacatgagtgtt

SEQ ID NO: 51050 - DNA, 25 bp, mus musculus
gatatctgctgcttccagcatcgca

SEQ ID NO: 51051 - DNA, 25 bp, mus musculus
tgcttccagcatcgcaggtgctatg

SEQ ID NO: 51052 - DNA, 25 bp, mus musculus
accaacaaacagatcacatgtgagt

SEQ ID NO: 51053 - DNA, 25 bp, mus musculus
cagatcacatgtgagtccgaggatc

SEQ ID NO: 51054 - DNA, 25 bp, mus musculus
atcacatgtgagtccgaggatccct

SEQ ID NO: 51055 - DNA, 25 bp, mus musculus
tccgaggatccctgtgagcgtctac

SEQ ID NO: 51056 - DNA, 25 bp, mus musculus
ccctgtgagcgtctactgtgtacgt

SEQ ID NO: 51057 - DNA, 25 bp, mus musculus
gagcgtctactgtgtacgtgtgaca

SEQ ID NO: 51058 - DNA, 25 bp, mus musculus
ctactgtgtacgtgtgacaaggctg

SEQ ID NO: 51059 - DNA, 25 bp, mus musculus
tgtgacaaggctgctgtggagtgcc

SEQ ID NO: 51060 - DNA, 25 bp, mus musculus
ctgaacttcctggatgcttccttct

SEQ ID NO: 51061 - DNA, 25 bp, mus musculus
aacttcctggatgcttccttctgcc

SEQ ID NO: 51062 - DNA, 25 bp, mus musculus
ttccagcatcgcaggtgctatgagg

SEQ ID NO: 51063 - DNA, 25 bp, mus musculus
cagactccagagacaactagtggga

SEQ ID NO: 51064 - DNA, 25 bp, mus musculus
cagcatcgcaggtgctatgaggaag

SEQ ID NO: 51065 - DNA, 25 bp, mus musculus
atggactgtctccaagaccctgcca

SEQ ID NO: 51066 - DNA, 25 bp, mus musculus
gaccctgccaagctcagtgcagatg

SEQ ID NO: 51067 - DNA, 25 bp, mus musculus
gccaagctcagtgcagatgtggatt

SEQ ID NO: 51068 - DNA, 25 bp, mus musculus
aagctcagtgcagatgtggattgca

SEQ ID NO: 51069 - DNA, 25 bp, mus musculus
gtggattgcaccaacaaacagatca

SEQ ID NO: 51070 - DNA, 25 bp, mus musculus
tgcaccaacaaacagatcacatgtg

SEQ ID NO: 51071 - DNA, 25 bp, mus musculus
cttccaggtttgcaccagactctcc

SEQ ID NO: 51072 - DNA, 25 bp, mus musculus
tcctgcccttctcaggaggagccag

SEQ ID NO: 51073 - DNA, 25 bp, mus musculus
agaagctccactgattctgttgtgg

SEQ ID NO: 51074 - DNA, 25 bp, mus musculus
gattctgttgtggagctccaatgtc

SEQ ID NO: 51075 - DNA, 25 bp, mus musculus
gagctccaatgtctgagaagagttt

SEQ ID NO: 51076 - DNA, 25 bp, mus musculus
agtctctcaacctctgttcagtata

SEQ ID NO: 51077 - DNA, 25 bp, mus musculus
tcaacctctgttcagtatagatcaa

SEQ ID NO: 51078 - DNA, 25 bp, mus musculus
agatcaacattcctcggcactggaa

SEQ ID NO: 51079 - DNA, 25 bp, mus musculus
acattcctcggcactggaatattcc

SEQ ID NO: 51080 - DNA, 25 bp, mus musculus
actggaatattcccctgcttcaaag

SEQ ID NO: 51081 - DNA, 25 bp, mus musculus
ccctactaaatgtatcttatttgag

SEQ ID NO: 51082 - DNA, 25 bp, mus musculus
attacaatttgtccatagggctcca

SEQ ID NO: 51083 - DNA, 25 bp, mus musculus
gagccaggaactgcattgggaaaca

SEQ ID NO: 51084 - DNA, 25 bp, mus musculus
tttgtccatagggctccaaatcaca

SEQ ID NO: 51085 - DNA, 25 bp, mus musculus
tgacactgctccgcttcgaactact

SEQ ID NO: 51086 - DNA, 25 bp, mus musculus
tgctccgcttcgaactactgccaga

SEQ ID NO: 51087 - DNA, 25 bp, mus musculus
gcttcgaactactgccagatcctac

SEQ ID NO: 51088 - DNA, 25 bp, mus musculus
tagcccgacttgtgctgaagtccaa

SEQ ID NO: 51089 - DNA, 25 bp, mus musculus
ggatctacctacatctcaagaagct

SEQ ID NO: 51090 - DNA, 25 bp, mus musculus
acctacatctcaagaagctccactg

SEQ ID NO: 51091 - DNA, 25 bp, mus musculus
atctcaagaagctccactgattctg

SEQ ID NO: 51092 - DNA, 25 bp, mus musculus
agctggcagctgcatatgagcctga

SEQ ID NO: 51093 - DNA, 25 bp, mus musculus
cagctgcatatgagcctgatactcc

SEQ ID NO: 51094 - DNA, 25 bp, mus musculus
tcgagccccattggaaaggatccta

SEQ ID NO: 51095 - DNA, 25 bp, mus musculus
gatcctatctagtactgctaactac

SEQ ID NO: 51096 - DNA, 25 bp, mus musculus
cctatctagtactgctaactactcc

SEQ ID NO: 51097 - DNA, 25 bp, mus musculus
atctagtactgctaactactccaac

SEQ ID NO: 51098 - DNA, 25 bp, mus musculus
tactgctaactactccaacggctgt

SEQ ID NO: 51099 - DNA, 25 bp, mus musculus
tgctaactactccaacggctgtcaa

SEQ ID NO: 51100 - DNA, 25 bp, mus musculus
taactactccaacggctgtcaaagt

SEQ ID NO: 51101 - DNA, 25 bp, mus musculus
gaattgctgcctggatacatgcctc

SEQ ID NO: 51102 - DNA, 25 bp, mus musculus
ggatacatgcctcacatgtgaagcc

SEQ ID NO: 51103 - DNA, 25 bp, mus musculus
tctggaaggcccaggctacggagaa

SEQ ID NO: 51104 - DNA, 25 bp, mus musculus
catatgagcctgatactcctaagac

SEQ ID NO: 51105 - DNA, 25 bp, mus musculus
cggagaaccctctgaaagtgaagat

SEQ ID NO: 51106 - DNA, 25 bp, mus musculus
ctgatactcctaagacatcgcatca

SEQ ID NO: 51107 - DNA, 25 bp, mus musculus
atactcctaagacatcgcatcagtt

SEQ ID NO: 51108 - DNA, 25 bp, mus musculus
ctaagacatcgcatcagttcgaggt

SEQ ID NO: 51109 - DNA, 25 bp, mus musculus
gagattcattctacgtgaggcaaca

SEQ ID NO: 51110 - DNA, 25 bp, mus musculus
tctacgtgaggcaacatcgtgccca

SEQ ID NO: 51111 - DNA, 25 bp, mus musculus
tgaggcaacatcgtgcccagaggct

SEQ ID NO: 51112 - DNA, 25 bp, mus musculus
agaggctcgagccccattggaaagg

SEQ ID NO: 51113 - DNA, 25 bp, mus musculus
agtggccactaaagggcctgtctct

SEQ ID NO: 51114 - DNA, 25 bp, mus musculus
tgggcatcgacgccagccattcctc

SEQ ID NO: 51115 - DNA, 25 bp, mus musculus
tgttcttgtggttggctatgggact

SEQ ID NO: 51116 - DNA, 25 bp, mus musculus
ttcttgtggttggctatgggactct

SEQ ID NO: 51117 - DNA, 25 bp, mus musculus
tggggccttaactttggtgatcaag

SEQ ID NO: 51118 - DNA, 25 bp, mus musculus
ggatacattcggatggcaagaaata

SEQ ID NO: 51119 - DNA, 25 bp, mus musculus
aaatcactgcggaattgctagttat

SEQ ID NO: 51120 - DNA, 25 bp, mus musculus
gctagttattgctcttacccagaaa

SEQ ID NO: 51121 - DNA, 25 bp, mus musculus
tagttattgctcttacccagaaatc

SEQ ID NO: 51122 - DNA, 25 bp, mus musculus
agttattgctcttacccagaaatct

SEQ ID NO: 51123 - DNA, 25 bp, mus musculus
gttattgctcttacccagaaatcta

SEQ ID NO: 51124 - DNA, 25 bp, mus musculus
tattgctcttacccagaaatctaaa

SEQ ID NO: 51125 - DNA, 25 bp, mus musculus
ttcttcttctacaaaagcggtgtct

SEQ ID NO: 51126 - DNA, 25 bp, mus musculus
cttcttctacaaaagcggtgtctat

SEQ ID NO: 51127 - DNA, 25 bp, mus musculus
ttcttctacaaaagcggtgtctatg

SEQ ID NO: 51128 - DNA, 25 bp, mus musculus
tcttctacaaaagcggtgtctatga

SEQ ID NO: 51129 - DNA, 25 bp, mus musculus
ttctacaaaagcggtgtctatgacg

SEQ ID NO: 51130 - DNA, 25 bp, mus musculus
cctcctgtacgggcaatgtgaatca

SEQ ID NO: 51131 - DNA, 25 bp, mus musculus
ctcctgtacgggcaatgtgaatcat

SEQ ID NO: 51132 - DNA, 25 bp, mus musculus
tcctgtacgggcaatgtgaatcatg

SEQ ID NO: 51133 - DNA, 25 bp, mus musculus
tcaggacagcatcaatccttacatg

SEQ ID NO: 51134 - DNA, 25 bp, mus musculus
ggacagcatcaatccttacatgtac

SEQ ID NO: 51135 - DNA, 25 bp, mus musculus
atcctgtggaccagaaaccaattca

SEQ ID NO: 51136 - DNA, 25 bp, mus musculus
accagaaaccaattcatattgtgaa

SEQ ID NO: 51137 - DNA, 25 bp, mus musculus
tttgaacttgctcagtctctgtgaa

SEQ ID NO: 51138 - DNA, 25 bp, mus musculus
cttgctcagtctctgtgaaagttat

SEQ ID NO: 51139 - DNA, 25 bp, mus musculus
ttatcttctgtggaacataagggtg

SEQ ID NO: 51140 - DNA, 25 bp, mus musculus
tatatccaactccctggttcttgtg

SEQ ID NO: 51141 - DNA, 25 bp, mus musculus
gctgccgatgttcacttcattgtta

SEQ ID NO: 51142 - DNA, 25 bp, mus musculus
gttcacttcattgttactactaaat

SEQ ID NO: 51143 - DNA, 25 bp, mus musculus
actactaaatacccagatttctgat

SEQ ID NO: 51144 - DNA, 25 bp, mus musculus
tacccagatttctgatgagaaaacg

SEQ ID NO: 51145 - DNA, 25 bp, mus musculus
caatccttacatgtacctgcccttt

SEQ ID NO: 51146 - DNA, 25 bp, mus musculus
tccttacatgtacctgccctttggg

SEQ ID NO: 51147 - DNA, 25 bp, mus musculus
ttacatgtacctgccctttgggagt

SEQ ID NO: 51148 - DNA, 25 bp, mus musculus
gaaagttgctcttgtcagagtcctg

SEQ ID NO: 51149 - DNA, 25 bp, mus musculus
tcttgtcagagtcctgcagaacttc

SEQ ID NO: 51150 - DNA, 25 bp, mus musculus
cctgcagaacttcactgtccagcct

SEQ ID NO: 51151 - DNA, 25 bp, mus musculus
cactgtccagccttgtaaggaaact

SEQ ID NO: 51152 - DNA, 25 bp, mus musculus
tgtccagccttgtaaggaaactgag

SEQ ID NO: 51153 - DNA, 25 bp, mus musculus
gtctcacctagaggcgtccggtcgc

SEQ ID NO: 51154 - DNA, 25 bp, mus musculus
cgtccggtcgcagactcccttcgag

SEQ ID NO: 51155 - DNA, 25 bp, mus musculus
ctgaagccgcggcccatagtgcctt

SEQ ID NO: 51156 - DNA, 25 bp, mus musculus
ggcccatagtgccttgcgatggcgg

SEQ ID NO: 51157 - DNA, 25 bp, mus musculus
gtgactctggcagctcgggactcag

SEQ ID NO: 51158 - DNA, 25 bp, mus musculus
cagctcgggactcagtgcaagtgca

SEQ ID NO: 51159 - DNA, 25 bp, mus musculus
gctcgggactcagtgcaagtgcaga

SEQ ID NO: 51160 - DNA, 25 bp, mus musculus
gtgcagagactcagccatggttctg

SEQ ID NO: 51161 - DNA, 25 bp, mus musculus
agagactcagccatggttctgcaga

SEQ ID NO: 51162 - DNA, 25 bp, mus musculus
agactcagccatggttctgcagatg

SEQ ID NO: 51163 - DNA, 25 bp, mus musculus
tcagccatggttctgcagatgattt

SEQ ID NO: 51164 - DNA, 25 bp, mus musculus
ccatggttctgcagatgatttttca

SEQ ID NO: 51165 - DNA, 25 bp, mus musculus
cggtcgcagactcccttcgaggcgc

SEQ ID NO: 51166 - DNA, 25 bp, mus musculus
gtcgcagactcccttcgaggcgcat

SEQ ID NO: 51167 - DNA, 25 bp, mus musculus
ggcgcatcctgtccggtgagcgtcg

SEQ ID NO: 51168 - DNA, 25 bp, mus musculus
tcctgtccggtgagcgtcgaacgac

SEQ ID NO: 51169 - DNA, 25 bp, mus musculus
ctgtccggtgagcgtcgaacgactg

SEQ ID NO: 51170 - DNA, 25 bp, mus musculus
tcgaacgactgaagccgcggcccat

SEQ ID NO: 51171 - DNA, 25 bp, mus musculus
acgactgaagccgcggcccatagtg

SEQ ID NO: 51172 - DNA, 25 bp, mus musculus
gactgaagccgcggcccatagtgcc

SEQ ID NO: 51173 - DNA, 25 bp, mus musculus
aatgtgtatcaccttgactgcttcg

SEQ ID NO: 51174 - DNA, 25 bp, mus musculus
tatcaccttgactgcttcgcctgcc

SEQ ID NO: 51175 - DNA, 25 bp, mus musculus
ggagacaaattcttcctgaagaaca

SEQ ID NO: 51176 - DNA, 25 bp, mus musculus
gacaaattcttcctgaagaacaaca

SEQ ID NO: 51177 - DNA, 25 bp, mus musculus
aaattcttcctgaagaacaacatga

SEQ ID NO: 51178 - DNA, 25 bp, mus musculus
ttcttcctgaagaacaacatgatct

SEQ ID NO: 51179 - DNA, 25 bp, mus musculus
gggcatctcaatggcacctttgaat

SEQ ID NO: 51180 - DNA, 25 bp, mus musculus
catctcaatggcacctttgaatccc

SEQ ID NO: 51181 - DNA, 25 bp, mus musculus
ctcaatggcacctttgaatcccagg

SEQ ID NO: 51182 - DNA, 25 bp, mus musculus
ccatctggcctccaggtccatctgt

SEQ ID NO: 51183 - DNA, 25 bp, mus musculus
cactctgcctgcgcgggctggccag

SEQ ID NO: 51184 - DNA, 25 bp, mus musculus
gccgctgtcctacaagttagaactt

SEQ ID NO: 51185 - DNA, 25 bp, mus musculus
cttgactgcttcgcctgccagctct

SEQ ID NO: 51186 - DNA, 25 bp, mus musculus
gactgcttcgcctgccagctctgca

SEQ ID NO: 51187 - DNA, 25 bp, mus musculus
tgcttcgcctgccagctctgcaatc

SEQ ID NO: 51188 - DNA, 25 bp, mus musculus
ttcgcctgccagctctgcaatcaga

SEQ ID NO: 51189 - DNA, 25 bp, mus musculus
gcctgccagctctgcaatcagagat

SEQ ID NO: 51190 - DNA, 25 bp, mus musculus
tgccagctctgcaatcagagatttt

SEQ ID NO: 51191 - DNA, 25 bp, mus musculus
cagctctgcaatcagagattttgcg

SEQ ID NO: 51192 - DNA, 25 bp, mus musculus
ctctgcaatcagagattttgcgtgg

SEQ ID NO: 51193 - DNA, 25 bp, mus musculus
cttcattttctcgaggtccatggag

SEQ ID NO: 51194 - DNA, 25 bp, mus musculus
gtccttaatgcctgcatcatgagcc

SEQ ID NO: 51195 - DNA, 25 bp, mus musculus
ctgttacctaatgttttctgagccg

SEQ ID NO: 51196 - DNA, 25 bp, mus musculus
gttttctgagccgacctttgatcct

SEQ ID NO: 51197 - DNA, 25 bp, mus musculus
ttctgagccgacctttgatcctaac

SEQ ID NO: 51198 - DNA, 25 bp, mus musculus
cattctctacatagcatgcatacct

SEQ ID NO: 51199 - DNA, 25 bp, mus musculus
tctctacatagcatgcatacctcca

SEQ ID NO: 51200 - DNA, 25 bp, mus musculus
agcatgcatacctccagtgcaatga

SEQ ID NO: 51201 - DNA, 25 bp, mus musculus
catacctccagtgcaatgatgtctg

SEQ ID NO: 51202 - DNA, 25 bp, mus musculus
gaaacctgttacatttgatgctaga

SEQ ID NO: 51203 - DNA, 25 bp, mus musculus
acctgttacatttgatgctagatat

SEQ ID NO: 51204 - DNA, 25 bp, mus musculus
atatctgaatgtttcttggcaataa

SEQ ID NO: 51205 - DNA, 25 bp, mus musculus
cttaatgcctgcatcatgagccaga

SEQ ID NO: 51206 - DNA, 25 bp, mus musculus
gcctgcatcatgagccagatggaag

SEQ ID NO: 51207 - DNA, 25 bp, mus musculus
atcatgagccagatggaaggaggtc

SEQ ID NO: 51208 - DNA, 25 bp, mus musculus
tgggtctacttactacctcacagag

SEQ ID NO: 51209 - DNA, 25 bp, mus musculus
ctacctcacagaggccgtttttgag

SEQ ID NO: 51210 - DNA, 25 bp, mus musculus
cacagaggccgtttttgagacatag

SEQ ID NO: 51211 - DNA, 25 bp, mus musculus
agtgtctcattggcaccatctttac

SEQ ID NO: 51212 - DNA, 25 bp, mus musculus
gtctcattggcaccatctttactgt

SEQ ID NO: 51213 - DNA, 25 bp, mus musculus
caccccaactctagtgtgaatccct

SEQ ID NO: 51214 - DNA, 25 bp, mus musculus
tactttccatagcagtgggtattgc

SEQ ID NO: 51215 - DNA, 25 bp, mus musculus
ccaagtctcttctctgccagtgcct

SEQ ID NO: 51216 - DNA, 25 bp, mus musculus
tctgccagtgcctctgccttagagg

SEQ ID NO: 51217 - DNA, 25 bp, mus musculus
tctgccttagaggaggctgtggatg

SEQ ID NO: 51218 - DNA, 25 bp, mus musculus
gctgctgataccattgggtctggcc

SEQ ID NO: 51219 - DNA, 25 bp, mus musculus
gataccattgggtctggccctgagt

SEQ ID NO: 51220 - DNA, 25 bp, mus musculus
tctgggctccaactctgtaacatca

SEQ ID NO: 51221 - DNA, 25 bp, mus musculus
ctccaactctgtaacatcaccatac

SEQ ID NO: 51222 - DNA, 25 bp, mus musculus
ctctgtaacatcaccatacatgcac

SEQ ID NO: 51223 - DNA, 25 bp, mus musculus
catgcaccaaaccaataaaaccttg

SEQ ID NO: 51224 - DNA, 25 bp, mus musculus
caataaaaccttgacaagagtcatt

SEQ ID NO: 51225 - DNA, 25 bp, mus musculus
gtattgctatgttctccactgttat

SEQ ID NO: 51226 - DNA, 25 bp, mus musculus
ctcaagggccccaagagagactgta

SEQ ID NO: 51227 - DNA, 25 bp, mus musculus
ccgccacttcttgacatacattgga

SEQ ID NO: 51228 - DNA, 25 bp, mus musculus
cttcttgacatacattggacatagc

SEQ ID NO: 51229 - DNA, 25 bp, mus musculus
acatagccattccccacagcagatg

SEQ ID NO: 51230 - DNA, 25 bp, mus musculus
cccacagcagatgctggacagcctg

SEQ ID NO: 51231 - DNA, 25 bp, mus musculus
ttgagccttggaccagtgttggagc

SEQ ID NO: 51232 - DNA, 25 bp, mus musculus
cttggaccagtgttggagctgaagt

SEQ ID NO: 51233 - DNA, 25 bp, mus musculus
acaacctggtgagctacacggccaa

SEQ ID NO: 51234 - DNA, 25 bp, mus musculus
caacctggtgagctacacggccaac

SEQ ID NO: 51235 - DNA, 25 bp, mus musculus
ccattgagctctccctgtgggactg

SEQ ID NO: 51236 - DNA, 25 bp, mus musculus
cattgagctctccctgtgggactgg

SEQ ID NO: 51237 - DNA, 25 bp, mus musculus
attgagctctccctgtgggactgga

SEQ ID NO: 51238 - DNA, 25 bp, mus musculus
ttgagctctccctgtgggactggat

SEQ ID NO: 51239 - DNA, 25 bp, mus musculus
tgagctctccctgtgggactggata

SEQ ID NO: 51240 - DNA, 25 bp, mus musculus
gagctctccctgtgggactggataa

SEQ ID NO: 51241 - DNA, 25 bp, mus musculus
agctctccctgtgggactggataac

SEQ ID NO: 51242 - DNA, 25 bp, mus musculus
gctctccctgtgggactggataact

SEQ ID NO: 51243 - DNA, 25 bp, mus musculus
tctccctgtgggactggataactga

SEQ ID NO: 51244 - DNA, 25 bp, mus musculus
ctccctgtgggactggataactgag

SEQ ID NO: 51245 - DNA, 25 bp, mus musculus
aacctggtgagctacacggccaact

SEQ ID NO: 51246 - DNA, 25 bp, mus musculus
gtgagctacacggccaacttagtgg

SEQ ID NO: 51247 - DNA, 25 bp, mus musculus
gagctacacggccaacttagtggtc

SEQ ID NO: 51248 - DNA, 25 bp, mus musculus
agctacacggccaacttagtggtca

SEQ ID NO: 51249 - DNA, 25 bp, mus musculus
gctacacggccaacttagtggtcag

SEQ ID NO: 51250 - DNA, 25 bp, mus musculus
ctacacggccaacttagtggtcagg

SEQ ID NO: 51251 - DNA, 25 bp, mus musculus
cggccaacttagtggtcaggaacag

SEQ ID NO: 51252 - DNA, 25 bp, mus musculus
aaagtgaatcgtccattgagctctc

SEQ ID NO: 51253 - DNA, 25 bp, mus musculus
gtcaatcaaaacggctgcactccac

SEQ ID NO: 51254 - DNA, 25 bp, mus musculus
tcaatcaaaacggctgcactccact

SEQ ID NO: 51255 - DNA, 25 bp, mus musculus
ccactccattatgcagcttcgaaga

SEQ ID NO: 51256 - DNA, 25 bp, mus musculus
cactccattatgcagcttcgaagaa

SEQ ID NO: 51257 - DNA, 25 bp, mus musculus
cattacgatgctacagcgatgcacc

SEQ ID NO: 51258 - DNA, 25 bp, mus musculus
attacgatgctacagcgatgcaccg

SEQ ID NO: 51259 - DNA, 25 bp, mus musculus
ttacgatgctacagcgatgcaccgg

SEQ ID NO: 51260 - DNA, 25 bp, mus musculus
tacgatgctacagcgatgcaccggg

SEQ ID NO: 51261 - DNA, 25 bp, mus musculus
acgatgctacagcgatgcaccgggc

SEQ ID NO: 51262 - DNA, 25 bp, mus musculus
cgatgctacagcgatgcaccgggca

SEQ ID NO: 51263 - DNA, 25 bp, mus musculus
gatgctacagcgatgcaccgggcag

SEQ ID NO: 51264 - DNA, 25 bp, mus musculus
atgctacagcgatgcaccgggcagc

SEQ ID NO: 51265 - DNA, 25 bp, mus musculus
caatcaaaacggctgcactccactc

SEQ ID NO: 51266 - DNA, 25 bp, mus musculus
tgctacagcgatgcaccgggcagca

SEQ ID NO: 51267 - DNA, 25 bp, mus musculus
aatcaaaacggctgcactccactcc

SEQ ID NO: 51268 - DNA, 25 bp, mus musculus
atcaaaacggctgcactccactcca

SEQ ID NO: 51269 - DNA, 25 bp, mus musculus
tcaaaacggctgcactccactccat

SEQ ID NO: 51270 - DNA, 25 bp, mus musculus
aaacggctgcactccactccattat

SEQ ID NO: 51271 - DNA, 25 bp, mus musculus
acggctgcactccactccattatgc

SEQ ID NO: 51272 - DNA, 25 bp, mus musculus
tgcactccactccattatgcagctt

SEQ ID NO: 51273 - DNA, 25 bp, mus musculus
cactccactccattatgcagcttcg

SEQ ID NO: 51274 - DNA, 25 bp, mus musculus
cagatgccacgggacaaatggagca

SEQ ID NO: 51275 - DNA, 25 bp, mus musculus
ctcctggccagacacatggagagct

SEQ ID NO: 51276 - DNA, 25 bp, mus musculus
tgactcacgttcttaatacccactg

SEQ ID NO: 51277 - DNA, 25 bp, mus musculus
ttaatacccactgtcaggcatgcca

SEQ ID NO: 51278 - DNA, 25 bp, mus musculus
cccactgtcaggcatgccacgtgtc

SEQ ID NO: 51279 - DNA, 25 bp, mus musculus
acgtgtccccagagctttacagagc

SEQ ID NO: 51280 - DNA, 25 bp, mus musculus
agctttacagagccacgacatggct

SEQ ID NO: 51281 - DNA, 25 bp, mus musculus
acagagccacgacatggcttggcta

SEQ ID NO: 51282 - DNA, 25 bp, mus musculus
ccacgacatggcttggctacgtgaa

SEQ ID NO: 51283 - DNA, 25 bp, mus musculus
acagtgccctgaaccctgtgatcta

SEQ ID NO: 51284 - DNA, 25 bp, mus musculus
gcaaagccttcctcaagattctatc

SEQ ID NO: 51285 - DNA, 25 bp, mus musculus
ccttcctcaagattctatcctgctg

SEQ ID NO: 51286 - DNA, 25 bp, mus musculus
gctactacagcatctgccaagacac

SEQ ID NO: 51287 - DNA, 25 bp, mus musculus
cttcctcaagattctatcctgctga

SEQ ID NO: 51288 - DNA, 25 bp, mus musculus
acagcatctgccaagacactgcctt

SEQ ID NO: 51289 - DNA, 25 bp, mus musculus
tctgccaagacactgccttgaggca

SEQ ID NO: 51290 - DNA, 25 bp, mus musculus
aagacactgccttgaggcatccaaa

SEQ ID NO: 51291 - DNA, 25 bp, mus musculus
tgaggcatccaaacttcgaaggagg

SEQ ID NO: 51292 - DNA, 25 bp, mus musculus
tcggggccttcattgtctgttggct

SEQ ID NO: 51293 - DNA, 25 bp, mus musculus
gttggctgcccttcttcttgactca

SEQ ID NO: 51294 - DNA, 25 bp, mus musculus
tcttcttgactcacgttcttaatac

SEQ ID NO: 51295 - DNA, 25 bp, mus musculus
ctctggatgccagaggtggaagaga

SEQ ID NO: 51296 - DNA, 25 bp, mus musculus
gaagagatccccgaggattagatgc

SEQ ID NO: 51297 - DNA, 25 bp, mus musculus
acctggacctagaggacctatgcct

SEQ ID NO: 51298 - DNA, 25 bp, mus musculus
acctagaggacctatgcctagtgga

SEQ ID NO: 51299 - DNA, 25 bp, mus musculus
ctagaggacctatgcctagtggaat

SEQ ID NO: 51300 - DNA, 25 bp, mus musculus
agaggacctatgcctagtggaatcc

SEQ ID NO: 51301 - DNA, 25 bp, mus musculus
gacctatgcctagtggaatccaagg

SEQ ID NO: 51302 - DNA, 25 bp, mus musculus
cctatgcctagtggaatccaaggtc

SEQ ID NO: 51303 - DNA, 25 bp, mus musculus
tatgcctagtggaatccaaggtccc

SEQ ID NO: 51304 - DNA, 25 bp, mus musculus
ggaatccaaggtcccaatccaatga

SEQ ID NO: 51305 - DNA, 25 bp, mus musculus
caaggtcccaatccaatgaacatgg

SEQ ID NO: 51306 - DNA, 25 bp, mus musculus
aggtcccaatccaatgaacatgggg

SEQ ID NO: 51307 - DNA, 25 bp, mus musculus
agagatccccgaggattagatgcac

SEQ ID NO: 51308 - DNA, 25 bp, mus musculus
atccccgaggattagatgcacgggg

SEQ ID NO: 51309 - DNA, 25 bp, mus musculus
ctagatgccagaggactggaagccc

SEQ ID NO: 51310 - DNA, 25 bp, mus musculus
tcgtgccatggaggccagaggactg

SEQ ID NO: 51311 - DNA, 25 bp, mus musculus
gactggacaccagaggcccagtacc

SEQ ID NO: 51312 - DNA, 25 bp, mus musculus
ctggacaccagaggcccagtacctg

SEQ ID NO: 51313 - DNA, 25 bp, mus musculus
cagtacctggacctagaggacctat

SEQ ID NO: 51314 - DNA, 25 bp, mus musculus
gtacctggacctagaggacctatgc

SEQ ID NO: 51315 - DNA, 25 bp, mus musculus
tgtgtcccctgctttggtggaaagt

SEQ ID NO: 51316 - DNA, 25 bp, mus musculus
ccctgctttggtggaaagtgagata

SEQ ID NO: 51317 - DNA, 25 bp, mus musculus
cgcctactttccttggatgtctcca

SEQ ID NO: 51318 - DNA, 25 bp, mus musculus
ctttccttggatgtctccagctcta

SEQ ID NO: 51319 - DNA, 25 bp, mus musculus
agctctatcgtccgcgggcccgaag

SEQ ID NO: 51320 - DNA, 25 bp, mus musculus
cccgaagcacactgacactttgtac

SEQ ID NO: 51321 - DNA, 25 bp, mus musculus
gcacactgacactttgtaccagcgc

SEQ ID NO: 51322 - DNA, 25 bp, mus musculus
tgacactttgtaccagcgcctctga

SEQ ID NO: 51323 - DNA, 25 bp, mus musculus
tttgtaccagcgcctctgaacccga

SEQ ID NO: 51324 - DNA, 25 bp, mus musculus
cggactcgcgattggcctcattcgc

SEQ ID NO: 51325 - DNA, 25 bp, mus musculus
cgcgattggcctcattcgcaggact

SEQ ID NO: 51326 - DNA, 25 bp, mus musculus
tggcctcattcgcaggactttcaag

SEQ ID NO: 51327 - DNA, 25 bp, mus musculus
ataagacctaaatcctgctaggcgt

SEQ ID NO: 51328 - DNA, 25 bp, mus musculus
cctaaatcctgctaggcgtgaccga

SEQ ID NO: 51329 - DNA, 25 bp, mus musculus
tcctgctaggcgtgaccgagggcct

SEQ ID NO: 51330 - DNA, 25 bp, mus musculus
tgaccgagggcctggaagcagtttc

SEQ ID NO: 51331 - DNA, 25 bp, mus musculus
caccctcaattccaaatgcatcagg

SEQ ID NO: 51332 - DNA, 25 bp, mus musculus
gaattattcccaatcctagtactcg

SEQ ID NO: 51333 - DNA, 25 bp, mus musculus
tgactgtcttcacgcctactttcct

SEQ ID NO: 51334 - DNA, 25 bp, mus musculus
tcttcacgcctactttccttggatg

SEQ ID NO: 51335 - DNA, 25 bp, mus musculus
gttaacgccatgctgaagaaagttg

SEQ ID NO: 51336 - DNA, 25 bp, mus musculus
gaaagttgccgttgcgctgcgtcta

SEQ ID NO: 51337 - DNA, 25 bp, mus musculus
gcgtctaagccgcaagttgaaattc

SEQ ID NO: 51338 - DNA, 25 bp, mus musculus
gtctaagccgcaagttgaaattcgc

SEQ ID NO: 51339 - DNA, 25 bp, mus musculus
aattcgccaagacggggatcaggtg

SEQ ID NO: 51340 - DNA, 25 bp, mus musculus
atcaggtgcacatccagacattcaa

SEQ ID NO: 51341 - DNA, 25 bp, mus musculus
tcaggtgcacatccagacattcaat

SEQ ID NO: 51342 - DNA, 25 bp, mus musculus
caggtgcacatccagacattcaata

SEQ ID NO: 51343 - DNA, 25 bp, mus musculus
ggtgcacatccagacattcaataat

SEQ ID NO: 51344 - DNA, 25 bp, mus musculus
atataattcaaggtccgagaaggct

SEQ ID NO: 51345 - DNA, 25 bp, mus musculus
tataattcaaggtccgagaaggctt

SEQ ID NO: 51346 - DNA, 25 bp, mus musculus
taattcaaggtccgagaaggctttg

SEQ ID NO: 51347 - DNA, 25 bp, mus musculus
aaagttgccgttgcgctgcgtctaa

SEQ ID NO: 51348 - DNA, 25 bp, mus musculus
aagttgccgttgcgctgcgtctaag

SEQ ID NO: 51349 - DNA, 25 bp, mus musculus
agttgccgttgcgctgcgtctaagc

SEQ ID NO: 51350 - DNA, 25 bp, mus musculus
ttgccgttgcgctgcgtctaagccg

SEQ ID NO: 51351 - DNA, 25 bp, mus musculus
gccgttgcgctgcgtctaagccgca

SEQ ID NO: 51352 - DNA, 25 bp, mus musculus
tgcgctgcgtctaagccgcaagttg

SEQ ID NO: 51353 - DNA, 25 bp, mus musculus
gcgctgcgtctaagccgcaagttga

SEQ ID NO: 51354 - DNA, 25 bp, mus musculus
tgcgtctaagccgcaagttgaaatt

SEQ ID NO: 51355 - DNA, 25 bp, mus musculus
gtgtaatcctccatcatctctcatt

SEQ ID NO: 51356 - DNA, 25 bp, mus musculus
atctctcattactcgggtttcatac

SEQ ID NO: 51357 - DNA, 25 bp, mus musculus
agatacttttaagcacaccgatgaa

SEQ ID NO: 51358 - DNA, 25 bp, mus musculus
ttttaagcacaccgatgaagagttc

SEQ ID NO: 51359 - DNA, 25 bp, mus musculus
taagcacaccgatgaagagttcctg

SEQ ID NO: 51360 - DNA, 25 bp, mus musculus
cctgaaacaggcttcaagccagaag

SEQ ID NO: 51361 - DNA, 25 bp, mus musculus
gaaacaggcttcaagccagaagcct

SEQ ID NO: 51362 - DNA, 25 bp, mus musculus
acaggcttcaagccagaagcctgcc

SEQ ID NO: 51363 - DNA, 25 bp, mus musculus
ttcaagccagaagcctgcctggaaa

SEQ ID NO: 51364 - DNA, 25 bp, mus musculus
aagccagaagcctgcctggaaagac

SEQ ID NO: 51365 - DNA, 25 bp, mus musculus
ccagaagcctgcctggaaagacggg

SEQ ID NO: 51366 - DNA, 25 bp, mus musculus
gtccactgccacgtgtgtcctggct

SEQ ID NO: 51367 - DNA, 25 bp, mus musculus
tctcattactcgggtttcatacttt

SEQ ID NO: 51368 - DNA, 25 bp, mus musculus
atactttgctgtgtttgatggacat

SEQ ID NO: 51369 - DNA, 25 bp, mus musculus
ctttgctgtgtttgatggacatgga

SEQ ID NO: 51370 - DNA, 25 bp, mus musculus
aatacgagcctcgaaatttgctgca

SEQ ID NO: 51371 - DNA, 25 bp, mus musculus
agcctcgaaatttgctgcacagaat

SEQ ID NO: 51372 - DNA, 25 bp, mus musculus
tgcacagaatttgcaccagaactta

SEQ ID NO: 51373 - DNA, 25 bp, mus musculus
tttgcaccagaacttaatcaggaaa

SEQ ID NO: 51374 - DNA, 25 bp, mus musculus
gcaccagaacttaatcaggaaattt

SEQ ID NO: 51375 - DNA, 25 bp, mus musculus
tgaacctggaccacagcgctctgtt

SEQ ID NO: 51376 - DNA, 25 bp, mus musculus
aacctggaccacagcgctctgttga

SEQ ID NO: 51377 - DNA, 25 bp, mus musculus
tcactggagtccacgaagaagccac

SEQ ID NO: 51378 - DNA, 25 bp, mus musculus
gtccacgaagaagccactgaagaag

SEQ ID NO: 51379 - DNA, 25 bp, mus musculus
aagatatccatgacaaattcgctga

SEQ ID NO: 51380 - DNA, 25 bp, mus musculus
gatatccatgacaaattcgctgaat

SEQ ID NO: 51381 - DNA, 25 bp, mus musculus
tccatgacaaattcgctgaatatgg

SEQ ID NO: 51382 - DNA, 25 bp, mus musculus
atattcaccttaatttggacaggcg

SEQ ID NO: 51383 - DNA, 25 bp, mus musculus
tcaccttaatttggacaggcgcacg

SEQ ID NO: 51384 - DNA, 25 bp, mus musculus
taatttggacaggcgcacgggatac

SEQ ID NO: 51385 - DNA, 25 bp, mus musculus
acaggcgcacgggatacttgaaggg

SEQ ID NO: 51386 - DNA, 25 bp, mus musculus
ctcaggctgccatggaaggactaaa

SEQ ID NO: 51387 - DNA, 25 bp, mus musculus
cctggaccacagcgctctgttgaag

SEQ ID NO: 51388 - DNA, 25 bp, mus musculus
tggaccacagcgctctgttgaaggt

SEQ ID NO: 51389 - DNA, 25 bp, mus musculus
ccacagcgctctgttgaaggttgga

SEQ ID NO: 51390 - DNA, 25 bp, mus musculus
acagcgctctgttgaaggttggatt

SEQ ID NO: 51391 - DNA, 25 bp, mus musculus
ttggattctctttgtcactggagtc

SEQ ID NO: 51392 - DNA, 25 bp, mus musculus
ggattctctttgtcactggagtcca

SEQ ID NO: 51393 - DNA, 25 bp, mus musculus
attctctttgtcactggagtccacg

SEQ ID NO: 51394 - DNA, 25 bp, mus musculus
tttgtcactggagtccacgaagaag

SEQ ID NO: 51395 - DNA, 25 bp, mus musculus
gaaacccagggactgctgctgagaa

SEQ ID NO: 51396 - DNA, 25 bp, mus musculus
ggactgctgctgagaaccaggttca

SEQ ID NO: 51397 - DNA, 25 bp, mus musculus
actatggacagttgctttgaagagt

SEQ ID NO: 51398 - DNA, 25 bp, mus musculus
ggaagcacgcactgcccacacgtct

SEQ ID NO: 51399 - DNA, 25 bp, mus musculus
tgcccacacgtctatcttggattac

SEQ ID NO: 51400 - DNA, 25 bp, mus musculus
ccacacgtctatcttggattactat

SEQ ID NO: 51401 - DNA, 25 bp, mus musculus
gtctatcttggattactatgagcca

SEQ ID NO: 51402 - DNA, 25 bp, mus musculus
ttactatgagccagtctttccttga

SEQ ID NO: 51403 - DNA, 25 bp, mus musculus
ctatgagccagtctttccttgaact

SEQ ID NO: 51404 - DNA, 25 bp, mus musculus
atatttttcatgatatctgtaaagc

SEQ ID NO: 51405 - DNA, 25 bp, mus musculus
tgtacaaaggcacttcgggtctatg

SEQ ID NO: 51406 - DNA, 25 bp, mus musculus
cttcgggtctatgtgactatatttt

SEQ ID NO: 51407 - DNA, 25 bp, mus musculus
ctgctgctgagaaccaggttcaggc

SEQ ID NO: 51408 - DNA, 25 bp, mus musculus
agaaccaggttcaggcgaagctggt

SEQ ID NO: 51409 - DNA, 25 bp, mus musculus
accaggttcaggcgaagctggttct

SEQ ID NO: 51410 - DNA, 25 bp, mus musculus
ttctctcagagttagcagaggcgcc

SEQ ID NO: 51411 - DNA, 25 bp, mus musculus
ccgacactgccagcctaggctttgg

SEQ ID NO: 51412 - DNA, 25 bp, mus musculus
acactgccagcctaggctttggctg

SEQ ID NO: 51413 - DNA, 25 bp, mus musculus
taggctttggctgccgctggactgc

SEQ ID NO: 51414 - DNA, 25 bp, mus musculus
tcccattgcactatggacagttgct

SEQ ID NO: 51415 - DNA, 25 bp, mus musculus
cttagacagactcctttgattgtag

SEQ ID NO: 51416 - DNA, 25 bp, mus musculus
agacagactcctttgattgtagtca

SEQ ID NO: 51417 - DNA, 25 bp, mus musculus
aagagtgcgctcactattcagtttt

SEQ ID NO: 51418 - DNA, 25 bp, mus musculus
gcgctcactattcagtttttccaga

SEQ ID NO: 51419 - DNA, 25 bp, mus musculus
actattcagtttttccagaagatct

SEQ ID NO: 51420 - DNA, 25 bp, mus musculus
aagatctttgtgcctgactacgacc

SEQ ID NO: 51421 - DNA, 25 bp, mus musculus
cccaccattgaagactcctacctga

SEQ ID NO: 51422 - DNA, 25 bp, mus musculus
attgaagactcctacctgaagcata

SEQ ID NO: 51423 - DNA, 25 bp, mus musculus
gactcctacctgaagcatacagaga

SEQ ID NO: 51424 - DNA, 25 bp, mus musculus
attgacaatcagtgggccatcttgg

SEQ ID NO: 51425 - DNA, 25 bp, mus musculus
aatcagtgggccatcttggatgttc

SEQ ID NO: 51426 - DNA, 25 bp, mus musculus
tgggccatcttggatgttctggaca

SEQ ID NO: 51427 - DNA, 25 bp, mus musculus
cagactcctttgattgtagtcatcc

SEQ ID NO: 51428 - DNA, 25 bp, mus musculus
ttgattgtagtcatcctggggttcc

SEQ ID NO: 51429 - DNA, 25 bp, mus musculus
attgtagtcatcctggggttcctcg

SEQ ID NO: 51430 - DNA, 25 bp, mus musculus
gtcatcctggggttcctcggctgcc

SEQ ID NO: 51431 - DNA, 25 bp, mus musculus
ccgggcctgactaccagaaacatgg

SEQ ID NO: 51432 - DNA, 25 bp, mus musculus
ggcctgactaccagaaacatggcga

SEQ ID NO: 51433 - DNA, 25 bp, mus musculus
accagaaacatggcgaccagcgctg

SEQ ID NO: 51434 - DNA, 25 bp, mus musculus
cttcccacatataaactagtagtgg

SEQ ID NO: 51435 - DNA, 25 bp, mus musculus
ctgctgagagtgcctgtggacacac

SEQ ID NO: 51436 - DNA, 25 bp, mus musculus
tgtggacacactgtccttcatagtt

SEQ ID NO: 51437 - DNA, 25 bp, mus musculus
ccgtttctctagacagctttcatat

SEQ ID NO: 51438 - DNA, 25 bp, mus musculus
ttctctagacagctttcatatttag

SEQ ID NO: 51439 - DNA, 25 bp, mus musculus
ctctagacagctttcatatttagtt

SEQ ID NO: 51440 - DNA, 25 bp, mus musculus
acagctttcatatttagttgtaaag

SEQ ID NO: 51441 - DNA, 25 bp, mus musculus
gtagttgacctttctaattcatatt

SEQ ID NO: 51442 - DNA, 25 bp, mus musculus
agttgacctttctaattcatattag

SEQ ID NO: 51443 - DNA, 25 bp, mus musculus
ttgacctttctaattcatattagga

SEQ ID NO: 51444 - DNA, 25 bp, mus musculus
gtaataaccatagcttgttttgtga

SEQ ID NO: 51445 - DNA, 25 bp, mus musculus
taaccatagcttgttttgtgatatt

SEQ ID NO: 51446 - DNA, 25 bp, mus musculus
accatagcttgttttgtgatattgg

SEQ ID NO: 51447 - DNA, 25 bp, mus musculus
tggacacactgtccttcatagtttg

SEQ ID NO: 51448 - DNA, 25 bp, mus musculus
gacacactgtccttcatagtttgct

SEQ ID NO: 51449 - DNA, 25 bp, mus musculus
cacactgtccttcatagtttgcttg

SEQ ID NO: 51450 - DNA, 25 bp, mus musculus
ccttcatagtttgcttgctttgtag

SEQ ID NO: 51451 - DNA, 25 bp, mus musculus
ttcatagtttgcttgctttgtagaa

SEQ ID NO: 51452 - DNA, 25 bp, mus musculus
ttaataatgcccgtttctctagaca

SEQ ID NO: 51453 - DNA, 25 bp, mus musculus
taatgcccgtttctctagacagctt

SEQ ID NO: 51454 - DNA, 25 bp, mus musculus
atgcccgtttctctagacagctttc

SEQ ID NO: 51455 - DNA, 25 bp, mus musculus
gtttgcttccaagccagcagcaaga

SEQ ID NO: 51456 - DNA, 25 bp, mus musculus
tgcttccaagccagcagcaagaaaa

SEQ ID NO: 51457 - DNA, 25 bp, mus musculus
tcctgaaaagctggcccagaagaat

SEQ ID NO: 51458 - DNA, 25 bp, mus musculus
aaagctggcccagaagaatccaatg

SEQ ID NO: 51459 - DNA, 25 bp, mus musculus
gagagaaacaccacctcgttttgct

SEQ ID NO: 51460 - DNA, 25 bp, mus musculus
aacaccacctcgttttgctcagcat

SEQ ID NO: 51461 - DNA, 25 bp, mus musculus
acctcgttttgctcagcatggcaca

SEQ ID NO: 51462 - DNA, 25 bp, mus musculus
tcgttttgctcagcatggcacattt

SEQ ID NO: 51463 - DNA, 25 bp, mus musculus
ttttgctcagcatggcacatttgag

SEQ ID NO: 51464 - DNA, 25 bp, mus musculus
tcagcatggcacatttgagtatgaa

SEQ ID NO: 51465 - DNA, 25 bp, mus musculus
atattctcaacgatggaagtccttg

SEQ ID NO: 51466 - DNA, 25 bp, mus musculus
ttctcaacgatggaagtccttggat

SEQ ID NO: 51467 - DNA, 25 bp, mus musculus
ttccaagccagcagcaagaaaagca

SEQ ID NO: 51468 - DNA, 25 bp, mus musculus
tgttttcctactgacaacgactcct

SEQ ID NO: 51469 - DNA, 25 bp, mus musculus
tttcctactgacaacgactcctcgc

SEQ ID NO: 51470 - DNA, 25 bp, mus musculus
tcgcccagtcattgtggaaccactt

SEQ ID NO: 51471 - DNA, 25 bp, mus musculus
tgtggaaccacttgaacagttagat

SEQ ID NO: 51472 - DNA, 25 bp, mus musculus
ggaaccacttgaacagttagatgac

SEQ ID NO: 51473 - DNA, 25 bp, mus musculus
tggtcttcctgaaaagctggcccag

SEQ ID NO: 51474 - DNA, 25 bp, mus musculus
tcttcctgaaaagctggcccagaag

SEQ ID NO: 51475 - DNA, 25 bp, mus musculus
cccagagctcagactgggagtgtgc

SEQ ID NO: 51476 - DNA, 25 bp, mus musculus
ctcagactgggagtgtgcaggagct

SEQ ID NO: 51477 - DNA, 25 bp, mus musculus
tctggcctaggagactcgatggcgc

SEQ ID NO: 51478 - DNA, 25 bp, mus musculus
ctggcctaggagactcgatggcgca

SEQ ID NO: 51479 - DNA, 25 bp, mus musculus
agtgctcggcctgagatgagacggt

SEQ ID NO: 51480 - DNA, 25 bp, mus musculus
tgctcggcctgagatgagacggtgt

SEQ ID NO: 51481 - DNA, 25 bp, mus musculus
ctcggcctgagatgagacggtgtgc

SEQ ID NO: 51482 - DNA, 25 bp, mus musculus
agcagccagccgtctgcgtgatcag

SEQ ID NO: 51483 - DNA, 25 bp, mus musculus
cagccagccgtctgcgtgatcagga

SEQ ID NO: 51484 - DNA, 25 bp, mus musculus
agccagccgtctgcgtgatcaggag

SEQ ID NO: 51485 - DNA, 25 bp, mus musculus
ctgatccctctggcctaggagactc

SEQ ID NO: 51486 - DNA, 25 bp, mus musculus
tgatccctctggcctaggagactcg

SEQ ID NO: 51487 - DNA, 25 bp, mus musculus
gatccctctggcctaggagactcga

SEQ ID NO: 51488 - DNA, 25 bp, mus musculus
atccctctggcctaggagactcgat

SEQ ID NO: 51489 - DNA, 25 bp, mus musculus
tccctctggcctaggagactcgatg

SEQ ID NO: 51490 - DNA, 25 bp, mus musculus
ccctctggcctaggagactcgatgg

SEQ ID NO: 51491 - DNA, 25 bp, mus musculus
cctctggcctaggagactcgatggc

SEQ ID NO: 51492 - DNA, 25 bp, mus musculus
ctctggcctaggagactcgatggcg

SEQ ID NO: 51493 - DNA, 25 bp, mus musculus
gctgctttccgggaaatgccacggt

SEQ ID NO: 51494 - DNA, 25 bp, mus musculus
aactacatcgtggtgactgggtact

SEQ ID NO: 51495 - DNA, 25 bp, mus musculus
cgctgctggtcaacgacgtcctcgc

SEQ ID NO: 51496 - DNA, 25 bp, mus musculus
tgctggtcaacgacgtcctcgcctc

SEQ ID NO: 51497 - DNA, 25 bp, mus musculus
cctcctgctacgcggttctagagag

SEQ ID NO: 51498 - DNA, 25 bp, mus musculus
cctgctacgcggttctagagagtca

SEQ ID NO: 51499 - DNA, 25 bp, mus musculus
gctacgcggttctagagagtcacca

SEQ ID NO: 51500 - DNA, 25 bp, mus musculus
ttctagagagtcaccagtgggccca

SEQ ID NO: 51501 - DNA, 25 bp, mus musculus
cagtccagccgactggcatgcattg

SEQ ID NO: 51502 - DNA, 25 bp, mus musculus
tccagccgactggcatgcattggta

SEQ ID NO: 51503 - DNA, 25 bp, mus musculus
cgactggcatgcattggtactctcg

SEQ ID NO: 51504 - DNA, 25 bp, mus musculus
gcatgcattggtactctcgcctcct

SEQ ID NO: 51505 - DNA, 25 bp, mus musculus
actgggtactggccgctgatgcagc

SEQ ID NO: 51506 - DNA, 25 bp, mus musculus
cgcgcaaactgttgctcacaccctg

SEQ ID NO: 51507 - DNA, 25 bp, mus musculus
gcaaactgttgctcacaccctggca

SEQ ID NO: 51508 - DNA, 25 bp, mus musculus
tgttgctcacaccctggcatctggt

SEQ ID NO: 51509 - DNA, 25 bp, mus musculus
tcacaccctggcatctggtgttcgc

SEQ ID NO: 51510 - DNA, 25 bp, mus musculus
ctccaggtgactttgcaccggtgtt

SEQ ID NO: 51511 - DNA, 25 bp, mus musculus
tacgtgctggcgactcggtgctggc

SEQ ID NO: 51512 - DNA, 25 bp, mus musculus
gtgctggcgactcggtgctggctcc

SEQ ID NO: 51513 - DNA, 25 bp, mus musculus
caggacacgctgagggacagctaaa

SEQ ID NO: 51514 - DNA, 25 bp, mus musculus
aggacacgctgagggacagctaaaa

SEQ ID NO: 51515 - DNA, 25 bp, mus musculus
ctctcctgtcactgctgctgctgct

SEQ ID NO: 51516 - DNA, 25 bp, mus musculus
ggtgtgccaatatcacctcaaagat

SEQ ID NO: 51517 - DNA, 25 bp, mus musculus
gtgtgccaatatcacctcaaagatt

SEQ ID NO: 51518 - DNA, 25 bp, mus musculus
tgtgccaatatcacctcaaagattg

SEQ ID NO: 51519 - DNA, 25 bp, mus musculus
gtgccaatatcacctcaaagattgc

SEQ ID NO: 51520 - DNA, 25 bp, mus musculus
tgccaatatcacctcaaagattgca

SEQ ID NO: 51521 - DNA, 25 bp, mus musculus
acacgctgagggacagctaaaacac

SEQ ID NO: 51522 - DNA, 25 bp, mus musculus
tgtccgcaggcaagttggctgctgc

SEQ ID NO: 51523 - DNA, 25 bp, mus musculus
gtccgcaggcaagttggctgctgca

SEQ ID NO: 51524 - DNA, 25 bp, mus musculus
tccgcaggcaagttggctgctgcaa

SEQ ID NO: 51525 - DNA, 25 bp, mus musculus
cgcaggcaagttggctgctgcaacc

SEQ ID NO: 51526 - DNA, 25 bp, mus musculus
caagttggctgctgcaaccgcatct

SEQ ID NO: 51527 - DNA, 25 bp, mus musculus
agttggctgctgcaaccgcatctcc

SEQ ID NO: 51528 - DNA, 25 bp, mus musculus
tcctctcctgtcactgctgctgctg

SEQ ID NO: 51529 - DNA, 25 bp, mus musculus
attcggatccatgaactgcttgagt

SEQ ID NO: 51530 - DNA, 25 bp, mus musculus
ttcggatccatgaactgcttgagtg

SEQ ID NO: 51531 - DNA, 25 bp, mus musculus
tctccctcactcttaggctgaattt

SEQ ID NO: 51532 - DNA, 25 bp, mus musculus
ccctcactcttaggctgaatttgac

SEQ ID NO: 51533 - DNA, 25 bp, mus musculus
cctcactcttaggctgaatttgaca

SEQ ID NO: 51534 - DNA, 25 bp, mus musculus
ctcactcttaggctgaatttgacaa

SEQ ID NO: 51535 - DNA, 25 bp, mus musculus
cactcttaggctgaatttgacaaag

SEQ ID NO: 51536 - DNA, 25 bp, mus musculus
tcggatccatgaactgcttgagtgg

SEQ ID NO: 51537 - DNA, 25 bp, mus musculus
cggatccatgaactgcttgagtgga

SEQ ID NO: 51538 - DNA, 25 bp, mus musculus
ggatccatgaactgcttgagtggac

SEQ ID NO: 51539 - DNA, 25 bp, mus musculus
gatccatgaactgcttgagtggaca

SEQ ID NO: 51540 - DNA, 25 bp, mus musculus
atccatgaactgcttgagtggacag

SEQ ID NO: 51541 - DNA, 25 bp, mus musculus
tccatgaactgcttgagtggacagg

SEQ ID NO: 51542 - DNA, 25 bp, mus musculus
ccatgaactgcttgagtggacaggt

SEQ ID NO: 51543 - DNA, 25 bp, mus musculus
agtatgggaggcatccctgggcctc

SEQ ID NO: 51544 - DNA, 25 bp, mus musculus
ttcggatccatgaactgcttgagtg

SEQ ID NO: 51545 - DNA, 25 bp, mus musculus
tcggatccatgaactgcttgagtgg

SEQ ID NO: 51546 - DNA, 25 bp, mus musculus
cccactcaggcaacctacatcccgt

SEQ ID NO: 51547 - DNA, 25 bp, mus musculus
ccactcaggcaacctacatcccgtt

SEQ ID NO: 51548 - DNA, 25 bp, mus musculus
cactcaggcaacctacatcccgttc

SEQ ID NO: 51549 - DNA, 25 bp, mus musculus
tcaggcaacctacatcccgttcctc

SEQ ID NO: 51550 - DNA, 25 bp, mus musculus
caggcaacctacatcccgttcctct

SEQ ID NO: 51551 - DNA, 25 bp, mus musculus
tctccctcactcttaggctgaattt

SEQ ID NO: 51552 - DNA, 25 bp, mus musculus
ccctcactcttaggctgaatttgac

SEQ ID NO: 51553 - DNA, 25 bp, mus musculus
cctcactcttaggctgaatttgaca

SEQ ID NO: 51554 - DNA, 25 bp, mus musculus
ctcactcttaggctgaatttgacaa

SEQ ID NO: 51555 - DNA, 25 bp, mus musculus
cactcttaggctgaatttgacaaag

SEQ ID NO: 51556 - DNA, 25 bp, mus musculus
cggatccatgaactgcttgagtgga

SEQ ID NO: 51557 - DNA, 25 bp, mus musculus
ggatccatgaactgcttgagtggac

SEQ ID NO: 51558 - DNA, 25 bp, mus musculus
gatccatgaactgcttgagtggaca

SEQ ID NO: 51559 - DNA, 25 bp, mus musculus
atccatgaactgcttgagtggacag

SEQ ID NO: 51560 - DNA, 25 bp, mus musculus
tccatgaactgcttgagtggacagg

SEQ ID NO: 51561 - DNA, 25 bp, mus musculus
ccatgaactgcttgagtggacaggt

SEQ ID NO: 51562 - DNA, 25 bp, mus musculus
tgcttgagtggacaggtgggccgtt

SEQ ID NO: 51563 - DNA, 25 bp, mus musculus
agtatgggaggcatccctgggcctc

SEQ ID NO: 51564 - DNA, 25 bp, mus musculus
ctgattcttgccatgcatatattca

SEQ ID NO: 51565 - DNA, 25 bp, mus musculus
attcttgccatgcatatattcaacc

SEQ ID NO: 51566 - DNA, 25 bp, mus musculus
taaatgttctcagataccactggat

SEQ ID NO: 51567 - DNA, 25 bp, mus musculus
atgttctcagataccactggatact

SEQ ID NO: 51568 - DNA, 25 bp, mus musculus
ttctcagataccactggatacttta

SEQ ID NO: 51569 - DNA, 25 bp, mus musculus
tcagataccactggatactttaaaa

SEQ ID NO: 51570 - DNA, 25 bp, mus musculus
tcctttgggttttgcaagagcaaat

SEQ ID NO: 51571 - DNA, 25 bp, mus musculus
agcaaattcttagctttcattcctc

SEQ ID NO: 51572 - DNA, 25 bp, mus musculus
aaattcttagctttcattcctctgg

SEQ ID NO: 51573 - DNA, 25 bp, mus musculus
ttcattcctctggttcttaattaca

SEQ ID NO: 51574 - DNA, 25 bp, mus musculus
gttcttaattacaatcatcaatttg

SEQ ID NO: 51575 - DNA, 25 bp, mus musculus
aattacaatcatcaatttgtatagt

SEQ ID NO: 51576 - DNA, 25 bp, mus musculus
atgcatatattcaaccttgacaagt

SEQ ID NO: 51577 - DNA, 25 bp, mus musculus
catatattcaaccttgacaagtttt

SEQ ID NO: 51578 - DNA, 25 bp, mus musculus
tagtttcagtcactatctggaaagg

SEQ ID NO: 51579 - DNA, 25 bp, mus musculus
tttcagtcactatctggaaaggact

SEQ ID NO: 51580 - DNA, 25 bp, mus musculus
gtgttgcaacctctataaatgttct

SEQ ID NO: 51581 - DNA, 25 bp, mus musculus
ttgcaacctctataaatgttctcag

SEQ ID NO: 51582 - DNA, 25 bp, mus musculus
caacctctataaatgttctcagata

SEQ ID NO: 51583 - DNA, 25 bp, mus musculus
cctctataaatgttctcagatacca

SEQ ID NO: 51584 - DNA, 25 bp, mus musculus
atgacgcctccaacgagtaccagct

SEQ ID NO: 51585 - DNA, 25 bp, mus musculus
agtaccagctcattgagtgcgacga

SEQ ID NO: 51586 - DNA, 25 bp, mus musculus
cccagtctcagctggccacacgtaa

SEQ ID NO: 51587 - DNA, 25 bp, mus musculus
agtctcagctggccacacgtaactt

SEQ ID NO: 51588 - DNA, 25 bp, mus musculus
ccacacgtaacttccacatgttcga

SEQ ID NO: 51589 - DNA, 25 bp, mus musculus
acatgttcgatgtcccgcggcagcg

SEQ ID NO: 51590 - DNA, 25 bp, mus musculus
gcgatcgacgcgcacagtggatcga

SEQ ID NO: 51591 - DNA, 25 bp, mus musculus
catcatcttcgccgtgccagcagta

SEQ ID NO: 51592 - DNA, 25 bp, mus musculus
cgtgccagcagtagctaccagatgg

SEQ ID NO: 51593 - DNA, 25 bp, mus musculus
gccagcagtagctaccagatggcca

SEQ ID NO: 51594 - DNA, 25 bp, mus musculus
agtagctaccagatggccattcgcg

SEQ ID NO: 51595 - DNA, 25 bp, mus musculus
taccagatggccattcgcgacgacc

SEQ ID NO: 51596 - DNA, 25 bp, mus musculus
agctcattgagtgcgacgactactc

SEQ ID NO: 51597 - DNA, 25 bp, mus musculus
atggccattcgcgacgaccaacaga

SEQ ID NO: 51598 - DNA, 25 bp, mus musculus
ttgagtgcgacgactactcactgga

SEQ ID NO: 51599 - DNA, 25 bp, mus musculus
acgactactcactggacaacattga

SEQ ID NO: 51600 - DNA, 25 bp, mus musculus
actactcactggacaacattgacgc

SEQ ID NO: 51601 - DNA, 25 bp, mus musculus
cactggacaacattgacgcgatcca

SEQ ID NO: 51602 - DNA, 25 bp, mus musculus
acaacattgacgcgatccagcacgc

SEQ ID NO: 51603 - DNA, 25 bp, mus musculus
acgcgatccagcacgccgactacgt

SEQ ID NO: 51604 - DNA, 25 bp, mus musculus
ttgagacccagtctcagctggccac

SEQ ID NO: 51605 - DNA, 25 bp, mus musculus
gttcctgcagagctggtagccaccg

SEQ ID NO: 51606 - DNA, 25 bp, mus musculus
gctgctgcagcagctgggcattcgc

SEQ ID NO: 51607 - DNA, 25 bp, mus musculus
ccattcccatagtgatggatcagca

SEQ ID NO: 51608 - DNA, 25 bp, mus musculus
atcagcaagacctctgccagcacac

SEQ ID NO: 51609 - DNA, 25 bp, mus musculus
tctgccagcacacacggagtctttg

SEQ ID NO: 51610 - DNA, 25 bp, mus musculus
agcacacacggagtctttggcttcg

SEQ ID NO: 51611 - DNA, 25 bp, mus musculus
cacggagtctttggcttcggacagc

SEQ ID NO: 51612 - DNA, 25 bp, mus musculus
gtacacgtctgcactctaacaacgg

SEQ ID NO: 51613 - DNA, 25 bp, mus musculus
gtctgcactctaacaacggagccac

SEQ ID NO: 51614 - DNA, 25 bp, mus musculus
tgttatctgactcactgacagactc

SEQ ID NO: 51615 - DNA, 25 bp, mus musculus
cccacgttttagatgcattgagact

SEQ ID NO: 51616 - DNA, 25 bp, mus musculus
tgagactcgacattcctcggtattt

SEQ ID NO: 51617 - DNA, 25 bp, mus musculus
cattcgccgaccttgctttactcag

SEQ ID NO: 51618 - DNA, 25 bp, mus musculus
tactcagccctgacgtggatgggct

SEQ ID NO: 51619 - DNA, 25 bp, mus musculus
gccctgacgtggatgggctaactgc

SEQ ID NO: 51620 - DNA, 25 bp, mus musculus
taactgctcagctcatccgatttca

SEQ ID NO: 51621 - DNA, 25 bp, mus musculus
gatttcactttttcactctcccagc

SEQ ID NO: 51622 - DNA, 25 bp, mus musculus
tcccagccatcagttacaagccata

SEQ ID NO: 51623 - DNA, 25 bp, mus musculus
gttacaagccataagcatgagcccc

SEQ ID NO: 51624 - DNA, 25 bp, mus musculus
tccagggacatcccattcccatagt

SEQ ID NO: 51625 - DNA, 25 bp, mus musculus
tactattctgctgtgctacaagaca

SEQ ID NO: 51626 - DNA, 25 bp, mus musculus
ccaagtccgatgccaccttaccaga

SEQ ID NO: 51627 - DNA, 25 bp, mus musculus
ccctgctagatcccaggaaggacca

SEQ ID NO: 51628 - DNA, 25 bp, mus musculus
tagatcccaggaaggaccatcagca

SEQ ID NO: 51629 - DNA, 25 bp, mus musculus
aggaccatcagcagcttctgagact

SEQ ID NO: 51630 - DNA, 25 bp, mus musculus
atcagcagcttctgagactgcctca

SEQ ID NO: 51631 - DNA, 25 bp, mus musculus
agcttctgagactgcctcatggggc

SEQ ID NO: 51632 - DNA, 25 bp, mus musculus
tgagactgcctcatggggctcactt

SEQ ID NO: 51633 - DNA, 25 bp, mus musculus
atggggctcacttgtctctcaagct

SEQ ID NO: 51634 - DNA, 25 bp, mus musculus
tcaagctctgaatttctcctttgtg

SEQ ID NO: 51635 - DNA, 25 bp, mus musculus
tctgaatttctcctttgtgcatact

SEQ ID NO: 51636 - DNA, 25 bp, mus musculus
ctttgtgcatacttcaagtaatttt

SEQ ID NO: 51637 - DNA, 25 bp, mus musculus
ccgatgccaccttaccagaaagagc

SEQ ID NO: 51638 - DNA, 25 bp, mus musculus
ccaccttaccagaaagagcttgagc

SEQ ID NO: 51639 - DNA, 25 bp, mus musculus
tgttccatggacacaccgctgaagc

SEQ ID NO: 51640 - DNA, 25 bp, mus musculus
atggacacaccgctgaagcaagaca

SEQ ID NO: 51641 - DNA, 25 bp, mus musculus
acaccgctgaagcaagacatgtccc

SEQ ID NO: 51642 - DNA, 25 bp, mus musculus
caagacatgtcccttcacagaaacc

SEQ ID NO: 51643 - DNA, 25 bp, mus musculus
gccctggaactggtcagcttggttc

SEQ ID NO: 51644 - DNA, 25 bp, mus musculus
tgataaactgatcattccgggtaga

SEQ ID NO: 51645 - DNA, 25 bp, mus musculus
cagtgccattcctagcctccctttg

SEQ ID NO: 51646 - DNA, 25 bp, mus musculus
gacaatggctctgcctctaaaggtc

SEQ ID NO: 51647 - DNA, 25 bp, mus musculus
agcaatcttcaaattggccttctgc

SEQ ID NO: 51648 - DNA, 25 bp, mus musculus
aatcttcaaattggccttctgcaca

SEQ ID NO: 51649 - DNA, 25 bp, mus musculus
caaattggccttctgcacaccggct

SEQ ID NO: 51650 - DNA, 25 bp, mus musculus
accggctctgagagcccctgaggtt

SEQ ID NO: 51651 - DNA, 25 bp, mus musculus
tctgagagcccctgaggttccagtg

SEQ ID NO: 51652 - DNA, 25 bp, mus musculus
gagagcccctgaggttccagtggac

SEQ ID NO: 51653 - DNA, 25 bp, mus musculus
agcccctgaggttccagtggacagt

SEQ ID NO: 51654 - DNA, 25 bp, mus musculus
ggacagttccaagctcaataaaggt

SEQ ID NO: 51655 - DNA, 25 bp, mus musculus
cagttccaagctcaataaaggtgtg

SEQ ID NO: 51656 - DNA, 25 bp, mus musculus
ttccaagctcaataaaggtgtggaa

SEQ ID NO: 51657 - DNA, 25 bp, mus musculus
tctgcctctaaaggtcctgagccgg

SEQ ID NO: 51658 - DNA, 25 bp, mus musculus
catggccagcgcagccaaaggagac

SEQ ID NO: 51659 - DNA, 25 bp, mus musculus
agagttcatcccgtatcaccacctc

SEQ ID NO: 51660 - DNA, 25 bp, mus musculus
caccggttatgagcacccttgatgt

SEQ ID NO: 51661 - DNA, 25 bp, mus musculus
tgagcacccttgatgtctcagcaga

SEQ ID NO: 51662 - DNA, 25 bp, mus musculus
cagacacgctctgccagcaatcttc

SEQ ID NO: 51663 - DNA, 25 bp, mus musculus
acacgctctgccagcaatcttcaaa

SEQ ID NO: 51664 - DNA, 25 bp, mus musculus
gccagcaatcttcaaattggccttc

SEQ ID NO: 51665 - DNA, 25 bp, mus musculus
cctggccacactgctctgggagacc

SEQ ID NO: 51666 - DNA, 25 bp, mus musculus
cacactgctctgggagacccagcgc

SEQ ID NO: 51667 - DNA, 25 bp, mus musculus
tgctgttctcctaggcctgggcctg

SEQ ID NO: 51668 - DNA, 25 bp, mus musculus
cctgctggccttgtacctgctccgg

SEQ ID NO: 51669 - DNA, 25 bp, mus musculus
acacacagacgcacactttactctg

SEQ ID NO: 51670 - DNA, 25 bp, mus musculus
acactttactctggccaagatctga

SEQ ID NO: 51671 - DNA, 25 bp, mus musculus
cacggacaacccatatcctgatgcc

SEQ ID NO: 51672 - DNA, 25 bp, mus musculus
caacccatatcctgatgcctgccag

SEQ ID NO: 51673 - DNA, 25 bp, mus musculus
tccacaccgttctaggtgctgggct

SEQ ID NO: 51674 - DNA, 25 bp, mus musculus
tggctctgggctttcctatgtatgc

SEQ ID NO: 51675 - DNA, 25 bp, mus musculus
ctatgcatactacctgcctggtggt

SEQ ID NO: 51676 - DNA, 25 bp, mus musculus
atactacctgcctggtggtgctcct

SEQ ID NO: 51677 - DNA, 25 bp, mus musculus
ggagacccagcgccctacattcagg

SEQ ID NO: 51678 - DNA, 25 bp, mus musculus
attcaggccaaccactgtccaatcc

SEQ ID NO: 51679 - DNA, 25 bp, mus musculus
cactgtccaatccaccacagtctgg

SEQ ID NO: 51680 - DNA, 25 bp, mus musculus
caccacagtctggcccaggacttct

SEQ ID NO: 51681 - DNA, 25 bp, mus musculus
agtctggcccaggacttctgagttg

SEQ ID NO: 51682 - DNA, 25 bp, mus musculus
ggtgactcctgagggccctgcattt

SEQ ID NO: 51683 - DNA, 25 bp, mus musculus
gggccctgcatttgctgttctccta

SEQ ID NO: 51684 - DNA, 25 bp, mus musculus
tgcatttgctgttctcctaggcctg

SEQ ID NO: 51685 - DNA, 25 bp, mus musculus
cgagaaactcatcctgttagaaatt

SEQ ID NO: 51686 - DNA, 25 bp, mus musculus
gaaactcatcctgttagaaattgga

SEQ ID NO: 51687 - DNA, 25 bp, mus musculus
tggaatccctaagccaaatgtcaaa

SEQ ID NO: 51688 - DNA, 25 bp, mus musculus
aatccctaagccaaatgtcaaatgg

SEQ ID NO: 51689 - DNA, 25 bp, mus musculus
tgtcaaatggactacgccaggtggc

SEQ ID NO: 51690 - DNA, 25 bp, mus musculus
caaatggactacgccaggtggcctt

SEQ ID NO: 51691 - DNA, 25 bp, mus musculus
atggactacgccaggtggccttgta

SEQ ID NO: 51692 - DNA, 25 bp, mus musculus
ccttgtaatcgacagacctcaagtc

SEQ ID NO: 51693 - DNA, 25 bp, mus musculus
tgtaatcgacagacctcaagtcggt

SEQ ID NO: 51694 - DNA, 25 bp, mus musculus
aaatggcacgttggtcatcaaagaa

SEQ ID NO: 51695 - DNA, 25 bp, mus musculus
tggcacgttggtcatcaaagaaaca

SEQ ID NO: 51696 - DNA, 25 bp, mus musculus
aacagctcatgacagaggaaattat

SEQ ID NO: 51697 - DNA, 25 bp, mus musculus
actcatcctgttagaaattggacag

SEQ ID NO: 51698 - DNA, 25 bp, mus musculus
gaagccagtcattctgacatacgaa

SEQ ID NO: 51699 - DNA, 25 bp, mus musculus
gccagtcattctgacatacgaaccg

SEQ ID NO: 51700 - DNA, 25 bp, mus musculus
agtcattctgacatacgaaccgggg

SEQ ID NO: 51701 - DNA, 25 bp, mus musculus
cattctgacatacgaaccggggatg

SEQ ID NO: 51702 - DNA, 25 bp, mus musculus
gacatacgaaccggggatgataaag

SEQ ID NO: 51703 - DNA, 25 bp, mus musculus
cctgcattgtgtgtctgatggaatc

SEQ ID NO: 51704 - DNA, 25 bp, mus musculus
tgatggaatccctaagccaaatgtc

SEQ ID NO: 51705 - DNA, 25 bp, mus musculus
aatggcacaaggctttctgccagtg

SEQ ID NO: 51706 - DNA, 25 bp, mus musculus
acaaggctttctgccagtgatttga

SEQ ID NO: 51707 - DNA, 25 bp, mus musculus
gatacccgcgagttctggagttgag

SEQ ID NO: 51708 - DNA, 25 bp, mus musculus
gcagtttgagcctagctgcggatgt

SEQ ID NO: 51709 - DNA, 25 bp, mus musculus
tagctgcggatgtgttgtgaagcca

SEQ ID NO: 51710 - DNA, 25 bp, mus musculus
tgttgtgaagccagcgtgctaatgc

SEQ ID NO: 51711 - DNA, 25 bp, mus musculus
gaagccagcgtgctaatgcagagcc

SEQ ID NO: 51712 - DNA, 25 bp, mus musculus
ctaatgcagagcctctatctacctt

SEQ ID NO: 51713 - DNA, 25 bp, mus musculus
tttgcccctcaacagttgttgctgg

SEQ ID NO: 51714 - DNA, 25 bp, mus musculus
cagttgttgctgggtttgccgagga

SEQ ID NO: 51715 - DNA, 25 bp, mus musculus
ttgctgggtttgccgaggaaactgt

SEQ ID NO: 51716 - DNA, 25 bp, mus musculus
gacaaagtgctgccctgcctccgat

SEQ ID NO: 51717 - DNA, 25 bp, mus musculus
atgctggccacgagctccaatgggt

SEQ ID NO: 51718 - DNA, 25 bp, mus musculus
gccacgagctccaatgggtctcagt

SEQ ID NO: 51719 - DNA, 25 bp, mus musculus
aatgggtctcagtacagcggctcca

SEQ ID NO: 51720 - DNA, 25 bp, mus musculus
tctcagtacagcggctccagggtcg

SEQ ID NO: 51721 - DNA, 25 bp, mus musculus
tacagcggctccagggtcgagaccc

SEQ ID NO: 51722 - DNA, 25 bp, mus musculus
ctccccttcgaatcagcttcaggaa

SEQ ID NO: 51723 - DNA, 25 bp, mus musculus
ttcgaatcagcttcaggaaaaacac

SEQ ID NO: 51724 - DNA, 25 bp, mus musculus
caagaagatacccgcgagttctgga

SEQ ID NO: 51725 - DNA, 25 bp, mus musculus
agcagctggccaagccgctcttgcg

SEQ ID NO: 51726 - DNA, 25 bp, mus musculus
tcttgcgcatctttgagcccatcct

SEQ ID NO: 51727 - DNA, 25 bp, mus musculus
gccgcaactgttgcattggctgccg

SEQ ID NO: 51728 - DNA, 25 bp, mus musculus
actgttgcattggctgccgctccgt

SEQ ID NO: 51729 - DNA, 25 bp, mus musculus
gtaagttctgtcagccacgggagtc

SEQ ID NO: 51730 - DNA, 25 bp, mus musculus
cacacctgaatgccttggaagaacg

SEQ ID NO: 51731 - DNA, 25 bp, mus musculus
ctcgcctctggacacagtgtcaacg

SEQ ID NO: 51732 - DNA, 25 bp, mus musculus
cacagtgtcaacgctgccagggcag

SEQ ID NO: 51733 - DNA, 25 bp, mus musculus
acgtcatctgtaccagccgtgactg

SEQ ID NO: 51734 - DNA, 25 bp, mus musculus
ccagccgtgactgtcccatcttcta

SEQ ID NO: 51735 - DNA, 25 bp, mus musculus
gtcccatcttctacatgcgcaagaa

SEQ ID NO: 51736 - DNA, 25 bp, mus musculus
aagaccaggaacggctgctgcagcg

SEQ ID NO: 51737 - DNA, 25 bp, mus musculus
gcatctttgagcccatcctgggtga

SEQ ID NO: 51738 - DNA, 25 bp, mus musculus
agtctgtgctgctgcgcggtgacca

SEQ ID NO: 51739 - DNA, 25 bp, mus musculus
gtgaccacacacgatgcaagactgt

SEQ ID NO: 51740 - DNA, 25 bp, mus musculus
acacacgatgcaagactgtgctcac

SEQ ID NO: 51741 - DNA, 25 bp, mus musculus
agactgtgctcaccagcaaggtggg

SEQ ID NO: 51742 - DNA, 25 bp, mus musculus
gcggcctcttggccttcaccaagcg

SEQ ID NO: 51743 - DNA, 25 bp, mus musculus
tcttggccttcaccaagcgccgcaa

SEQ ID NO: 51744 - DNA, 25 bp, mus musculus
ccaagcgccgcaactgttgcattgg

SEQ ID NO: 51745 - DNA, 25 bp, mus musculus
aacatcgtgaagttcctggttggct

SEQ ID NO: 51746 - DNA, 25 bp, mus musculus
ctagatgcctcgttccgttatcctc

SEQ ID NO: 51747 - DNA, 25 bp, mus musculus
gagtattccttcatccctgcagagc

SEQ ID NO: 51748 - DNA, 25 bp, mus musculus
tattccttcatccctgcagagccga

SEQ ID NO: 51749 - DNA, 25 bp, mus musculus
ttcatccctgcagagccgatgggag

SEQ ID NO: 51750 - DNA, 25 bp, mus musculus
cctgcagagccgatgggaggacgac

SEQ ID NO: 51751 - DNA, 25 bp, mus musculus
ccctttggtctggttatcaatctga

SEQ ID NO: 51752 - DNA, 25 bp, mus musculus
gttatcaatctgaactacaaagatt

SEQ ID NO: 51753 - DNA, 25 bp, mus musculus
aatgtattccaggatgctgtcttca

SEQ ID NO: 51754 - DNA, 25 bp, mus musculus
gtattccaggatgctgtcttcaatc

SEQ ID NO: 51755 - DNA, 25 bp, mus musculus
gatgctgtcttcaatcagacggtca

SEQ ID NO: 51756 - DNA, 25 bp, mus musculus
gctgtcttcaatcagacggtcacag

SEQ ID NO: 51757 - DNA, 25 bp, mus musculus
gcctcgttccgttatcctcaggact

SEQ ID NO: 51758 - DNA, 25 bp, mus musculus
tatcctcaggactaccagttttaca

SEQ ID NO: 51759 - DNA, 25 bp, mus musculus
caggactaccagttttacatccaga

SEQ ID NO: 51760 - DNA, 25 bp, mus musculus
taccagttttacatccagaatttca

SEQ ID NO: 51761 - DNA, 25 bp, mus musculus
ttttacatccagaatttcacagctc

SEQ ID NO: 51762 - DNA, 25 bp, mus musculus
cttcctctaaacactgtagtgccac

SEQ ID NO: 51763 - DNA, 25 bp, mus musculus
ccccagcggcaggcaacttttgagt

SEQ ID NO: 51764 - DNA, 25 bp, mus musculus
tttgagtattccttcatccctgcag

SEQ ID NO: 51765 - DNA, 25 bp, mus musculus
tacttttactctcatccaccacgaa

SEQ ID NO: 51766 - DNA, 25 bp, mus musculus
catccaccacgaattggaaatttct

SEQ ID NO: 51767 - DNA, 25 bp, mus musculus
ggcccagataaggcacctagagaag

SEQ ID NO: 51768 - DNA, 25 bp, mus musculus
gtactctatcatgaagtctttacag

SEQ ID NO: 51769 - DNA, 25 bp, mus musculus
tatcatgaagtctttacaggatgac

SEQ ID NO: 51770 - DNA, 25 bp, mus musculus
cttcagttacagctgaaccaagaaa

SEQ ID NO: 51771 - DNA, 25 bp, mus musculus
aacctgcagctggaaagcgaagaac

SEQ ID NO: 51772 - DNA, 25 bp, mus musculus
ctgaacatcctcatcagatgtttta

SEQ ID NO: 51773 - DNA, 25 bp, mus musculus
atcctcatcagatgttttaaggatt

SEQ ID NO: 51774 - DNA, 25 bp, mus musculus
aaggatttccaactgcagcgagcca

SEQ ID NO: 51775 - DNA, 25 bp, mus musculus
ttccaactgcagcgagccaataaaa

SEQ ID NO: 51776 - DNA, 25 bp, mus musculus
tactttgctcaggcacgttggcgcc

SEQ ID NO: 51777 - DNA, 25 bp, mus musculus
aatttctaccaacccagctcagtat

SEQ ID NO: 51778 - DNA, 25 bp, mus musculus
ctcaggcacgttggcgcctgacaga

SEQ ID NO: 51779 - DNA, 25 bp, mus musculus
cccagctcagtatgctatgattctg

SEQ ID NO: 51780 - DNA, 25 bp, mus musculus
tgctatgattctggacattgtcaac

SEQ ID NO: 51781 - DNA, 25 bp, mus musculus
tgtcaacaacctgcttctccacgta

SEQ ID NO: 51782 - DNA, 25 bp, mus musculus
gcttctccacgtagaacccaagcgg

SEQ ID NO: 51783 - DNA, 25 bp, mus musculus
caatcctgaggagcagcgcagcagc

SEQ ID NO: 51784 - DNA, 25 bp, mus musculus
gcagcgcagcagcatactacacctg

SEQ ID NO: 51785 - DNA, 25 bp, mus musculus
cagcagcatactacacctgcaggag

SEQ ID NO: 51786 - DNA, 25 bp, mus musculus
aagcgtgagcatcctgctctgcctg

SEQ ID NO: 51787 - DNA, 25 bp, mus musculus
agcgtgagcatcctgctctgcctgg

SEQ ID NO: 51788 - DNA, 25 bp, mus musculus
acttcttgctctagaaattgaacgg

SEQ ID NO: 51789 - DNA, 25 bp, mus musculus
cttcttgctctagaaattgaacggt

SEQ ID NO: 51790 - DNA, 25 bp, mus musculus
ttcttgctctagaaattgaacggtg

SEQ ID NO: 51791 - DNA, 25 bp, mus musculus
aaattgaacggtgctactcacggct

SEQ ID NO: 51792 - DNA, 25 bp, mus musculus
attgaacggtgctactcacggctca

SEQ ID NO: 51793 - DNA, 25 bp, mus musculus
ttgaacggtgctactcacggctcaa

SEQ ID NO: 51794 - DNA, 25 bp, mus musculus
gaacggtgctactcacggctcaagg

SEQ ID NO: 51795 - DNA, 25 bp, mus musculus
aacggtgctactcacggctcaagga

SEQ ID NO: 51796 - DNA, 25 bp, mus musculus
acggtgctactcacggctcaaggag

SEQ ID NO: 51797 - DNA, 25 bp, mus musculus
gtgagcatcctgctctgcctgggga

SEQ ID NO: 51798 - DNA, 25 bp, mus musculus
gagcatcctgctctgcctggggacg

SEQ ID NO: 51799 - DNA, 25 bp, mus musculus
ttgccggccttgctggacgagcaca

SEQ ID NO: 51800 - DNA, 25 bp, mus musculus
aggtgaacttcttgctctagaaatt

SEQ ID NO: 51801 - DNA, 25 bp, mus musculus
ggtgaacttcttgctctagaaattg

SEQ ID NO: 51802 - DNA, 25 bp, mus musculus
gtgaacttcttgctctagaaattga

SEQ ID NO: 51803 - DNA, 25 bp, mus musculus
gaacttcttgctctagaaattgaac

SEQ ID NO: 51804 - DNA, 25 bp, mus musculus
aacttcttgctctagaaattgaacg

SEQ ID NO: 51805 - DNA, 25 bp, mus musculus
ggaactctgctgaagtgttgctgaa

SEQ ID NO: 51806 - DNA, 25 bp, mus musculus
cagttcaacaatccgtggctgctca

SEQ ID NO: 51807 - DNA, 25 bp, mus musculus
atttgtactactggatatctgactg

SEQ ID NO: 51808 - DNA, 25 bp, mus musculus
actactggatatctgactggagccg

SEQ ID NO: 51809 - DNA, 25 bp, mus musculus
ggatatctgactggagccgcaggta

SEQ ID NO: 51810 - DNA, 25 bp, mus musculus
tattgttcttactgaaacacagcat

SEQ ID NO: 51811 - DNA, 25 bp, mus musculus
tgttcttactgaaacacagcatgga

SEQ ID NO: 51812 - DNA, 25 bp, mus musculus
tactgaaacacagcatggaattaac

SEQ ID NO: 51813 - DNA, 25 bp, mus musculus
tatatcatgcctccatcctttatac

SEQ ID NO: 51814 - DNA, 25 bp, mus musculus
atgcctccatcctttatacttctaa

SEQ ID NO: 51815 - DNA, 25 bp, mus musculus
tagtccagacatgtttgacagtatt

SEQ ID NO: 51816 - DNA, 25 bp, mus musculus
ttcaaaccagttagcaaacaatatt

SEQ ID NO: 51817 - DNA, 25 bp, mus musculus
tggctgctcattcttgccgactcct

SEQ ID NO: 51818 - DNA, 25 bp, mus musculus
tcaaaccagttagcaaacaatattt

SEQ ID NO: 51819 - DNA, 25 bp, mus musculus
ccctctgaagcaggttagcattgaa

SEQ ID NO: 51820 - DNA, 25 bp, mus musculus
ggaagcctgcatgcgtgttcaactc

SEQ ID NO: 51821 - DNA, 25 bp, mus musculus
agcctgcatgcgtgttcaactctgt

SEQ ID NO: 51822 - DNA, 25 bp, mus musculus
catgcgtgttcaactctgttcctcc

SEQ ID NO: 51823 - DNA, 25 bp, mus musculus
ctcgctcaacctcttttgttcagta

SEQ ID NO: 51824 - DNA, 25 bp, mus musculus
gctcaacctcttttgttcagtacgt

SEQ ID NO: 51825 - DNA, 25 bp, mus musculus
ctaatttgtactactggatatctga

SEQ ID NO: 51826 - DNA, 25 bp, mus musculus
tggatacaaagcactacccatacat

SEQ ID NO: 51827 - DNA, 25 bp, mus musculus
gatacaaagcactacccatacatct

SEQ ID NO: 51828 - DNA, 25 bp, mus musculus
gagtgcccgctatggacattggcac

SEQ ID NO: 51829 - DNA, 25 bp, mus musculus
ccgcctcattattttcatccttggg

SEQ ID NO: 51830 - DNA, 25 bp, mus musculus
gcctcattattttcatccttggggg

SEQ ID NO: 51831 - DNA, 25 bp, mus musculus
gtgcttacgaagtgacccaggccaa

SEQ ID NO: 51832 - DNA, 25 bp, mus musculus
gcttacgaagtgacccaggccaacg

SEQ ID NO: 51833 - DNA, 25 bp, mus musculus
gaagtgacccaggccaacgcaaggt

SEQ ID NO: 51834 - DNA, 25 bp, mus musculus
agtgacccaggccaacgcaaggtgg

SEQ ID NO: 51835 - DNA, 25 bp, mus musculus
tgacccaggccaacgcaaggtggga

SEQ ID NO: 51836 - DNA, 25 bp, mus musculus
gctgatatgatccacgcacattctc

SEQ ID NO: 51837 - DNA, 25 bp, mus musculus
tgatatgatccacgcacattctcac

SEQ ID NO: 51838 - DNA, 25 bp, mus musculus
tacaaagcactacccatacatctct

SEQ ID NO: 51839 - DNA, 25 bp, mus musculus
caaagcactacccatacatctctac

SEQ ID NO: 51840 - DNA, 25 bp, mus musculus
tccttcagcaccactgctgtgagtg

SEQ ID NO: 51841 - DNA, 25 bp, mus musculus
cttcagcaccactgctgtgagtgcc

SEQ ID NO: 51842 - DNA, 25 bp, mus musculus
agcaccactgctgtgagtgcccgct

SEQ ID NO: 51843 - DNA, 25 bp, mus musculus
caccactgctgtgagtgcccgctat

SEQ ID NO: 51844 - DNA, 25 bp, mus musculus
actgctgtgagtgcccgctatggac

SEQ ID NO: 51845 - DNA, 25 bp, mus musculus
ctgtgagtgcccgctatggacattg

SEQ ID NO: 51846 - DNA, 25 bp, mus musculus
agtaggatccttgccagtgtccaag

SEQ ID NO: 51847 - DNA, 25 bp, mus musculus
aggatccttgccagtgtccaagtga

SEQ ID NO: 51848 - DNA, 25 bp, mus musculus
ttcccagagtggaccatatcctggt

SEQ ID NO: 51849 - DNA, 25 bp, mus musculus
gagtggaccatatcctggttcgtgt

SEQ ID NO: 51850 - DNA, 25 bp, mus musculus
tggaccatatcctggttcgtgttag

SEQ ID NO: 51851 - DNA, 25 bp, mus musculus
atatcctggttcgtgttagagattg

SEQ ID NO: 51852 - DNA, 25 bp, mus musculus
ttagagattggtcgggctagaggct

SEQ ID NO: 51853 - DNA, 25 bp, mus musculus
attggtcgggctagaggctatgact

SEQ ID NO: 51854 - DNA, 25 bp, mus musculus
tatgacttgaggcttagtgggtttt

SEQ ID NO: 51855 - DNA, 25 bp, mus musculus
tggcgattcccttgcaatgagtaga

SEQ ID NO: 51856 - DNA, 25 bp, mus musculus
cgattcccttgcaatgagtagatgt

SEQ ID NO: 51857 - DNA, 25 bp, mus musculus
ttcccttgcaatgagtagatgtccc

SEQ ID NO: 51858 - DNA, 25 bp, mus musculus
cttgccagtgtccaagtgatggctc

SEQ ID NO: 51859 - DNA, 25 bp, mus musculus
agtgtccaagtgatggctcattgtt

SEQ ID NO: 51860 - DNA, 25 bp, mus musculus
aaactatttgaggcttgtgagaaga

SEQ ID NO: 51861 - DNA, 25 bp, mus musculus
ctatttgaggcttgtgagaagaaag

SEQ ID NO: 51862 - DNA, 25 bp, mus musculus
aaagttgcctgtagtgggactgtag

SEQ ID NO: 51863 - DNA, 25 bp, mus musculus
gttgcctgtagtgggactgtagttg

SEQ ID NO: 51864 - DNA, 25 bp, mus musculus
actgtagttgagcgtcctgaatgtg

SEQ ID NO: 51865 - DNA, 25 bp, mus musculus
gggttcccagagtggaccatatcct

SEQ ID NO: 51866 - DNA, 25 bp, mus musculus
tttgcctccattggtaccaggcatg

SEQ ID NO: 51867 - DNA, 25 bp, mus musculus
tccattggtaccaggcatgcatgtg

SEQ ID NO: 51868 - DNA, 25 bp, mus musculus
caccatggttgtcttacggggcact

SEQ ID NO: 51869 - DNA, 25 bp, mus musculus
cacacctccatgaagaagtgttgga

SEQ ID NO: 51870 - DNA, 25 bp, mus musculus
gattactttgctgcttgtaaagaaa

SEQ ID NO: 51871 - DNA, 25 bp, mus musculus
taaatgctgggccaggcatgatgaa

SEQ ID NO: 51872 - DNA, 25 bp, mus musculus
acacttgtaatcccgcagtatctac

SEQ ID NO: 51873 - DNA, 25 bp, mus musculus
gtaatcccgcagtatctacaaggtg

SEQ ID NO: 51874 - DNA, 25 bp, mus musculus
ccagcctggactcctagtgaattcc

SEQ ID NO: 51875 - DNA, 25 bp, mus musculus
cctagtgaattccaggccagcctaa

SEQ ID NO: 51876 - DNA, 25 bp, mus musculus
aatgtgagactccatctcaaaaagc

SEQ ID NO: 51877 - DNA, 25 bp, mus musculus
agactccatctcaaaaagccaacca

SEQ ID NO: 51878 - DNA, 25 bp, mus musculus
gatgcttacgcatacatgcagacaa

SEQ ID NO: 51879 - DNA, 25 bp, mus musculus
ttactgctttgttcatggccagcca

SEQ ID NO: 51880 - DNA, 25 bp, mus musculus
ctttgttcatggccagccacaggca

SEQ ID NO: 51881 - DNA, 25 bp, mus musculus
tcatggccagccacaggcagccttg

SEQ ID NO: 51882 - DNA, 25 bp, mus musculus
ctcccagttcagtcttctgatgcga

SEQ ID NO: 51883 - DNA, 25 bp, mus musculus
gttcagtcttctgatgcgaccattt

SEQ ID NO: 51884 - DNA, 25 bp, mus musculus
tcttctgatgcgaccatttaaagtg

SEQ ID NO: 51885 - DNA, 25 bp, mus musculus
taaagtgagacccaccatggttgtc

SEQ ID NO: 51886 - DNA, 25 bp, mus musculus
tccacccagtaggtgcatttgcaaa

SEQ ID NO: 51887 - DNA, 25 bp, mus musculus
ccacccagtaggtgcatttgcaaaa

SEQ ID NO: 51888 - DNA, 25 bp, mus musculus
agatgtccttcactggaaggcgctt

SEQ ID NO: 51889 - DNA, 25 bp, mus musculus
gatgtccttcactggaaggcgcttg

SEQ ID NO: 51890 - DNA, 25 bp, mus musculus
tgtccttcactggaaggcgcttggt

SEQ ID NO: 51891 - DNA, 25 bp, mus musculus
gtccttcactggaaggcgcttggtc

SEQ ID NO: 51892 - DNA, 25 bp, mus musculus
ccttcactggaaggcgcttggtcgg

SEQ ID NO: 51893 - DNA, 25 bp, mus musculus
cttcactggaaggcgcttggtcgga

SEQ ID NO: 51894 - DNA, 25 bp, mus musculus
gagagtcctcgatggccataaatat

SEQ ID NO: 51895 - DNA, 25 bp, mus musculus
agagtcctcgatggccataaatatg

SEQ ID NO: 51896 - DNA, 25 bp, mus musculus
agtcctcgatggccataaatatgag

SEQ ID NO: 51897 - DNA, 25 bp, mus musculus
gtcctcgatggccataaatatgagg

SEQ ID NO: 51898 - DNA, 25 bp, mus musculus
aatgttctaagatccagttgtagat

SEQ ID NO: 51899 - DNA, 25 bp, mus musculus
atgttctaagatccagttgtagatg

SEQ ID NO: 51900 - DNA, 25 bp, mus musculus
gttctaagatccagttgtagatgtc

SEQ ID NO: 51901 - DNA, 25 bp, mus musculus
ttctaagatccagttgtagatgtcc

SEQ ID NO: 51902 - DNA, 25 bp, mus musculus
ctaagatccagttgtagatgtcctt

SEQ ID NO: 51903 - DNA, 25 bp, mus musculus
gttgtagatgtccttcactggaagg

SEQ ID NO: 51904 - DNA, 25 bp, mus musculus
tgtagatgtccttcactggaaggcg

SEQ ID NO: 51905 - DNA, 25 bp, mus musculus
gtagatgtccttcactggaaggcgc

SEQ ID NO: 51906 - DNA, 25 bp, mus musculus
tcctcaacttcagtgactccacaga

SEQ ID NO: 51907 - DNA, 25 bp, mus musculus
acttcagtgactccacagaaatcca

SEQ ID NO: 51908 - DNA, 25 bp, mus musculus
tagattccatggaaacttgggacta

SEQ ID NO: 51909 - DNA, 25 bp, mus musculus
gggactattatctacctctataaca

SEQ ID NO: 51910 - DNA, 25 bp, mus musculus
tacctctataacattttagaattct

SEQ ID NO: 51911 - DNA, 25 bp, mus musculus
ttctgaagtgttcttccctaacatt

SEQ ID NO: 51912 - DNA, 25 bp, mus musculus
ccagtgaccacattcagtttctttc

SEQ ID NO: 51913 - DNA, 25 bp, mus musculus
accacattcagtttctttcagtagc

SEQ ID NO: 51914 - DNA, 25 bp, mus musculus
ttctttcagtagcttcctctcctga

SEQ ID NO: 51915 - DNA, 25 bp, mus musculus
cttcctctcctgagaggcagttaca

SEQ ID NO: 51916 - DNA, 25 bp, mus musculus
ctcctgagaggcagttacagcaggc

SEQ ID NO: 51917 - DNA, 25 bp, mus musculus
agcaggctcagttcatccaaacaaa

SEQ ID NO: 51918 - DNA, 25 bp, mus musculus
gtgactccacagaaatccaccatgg

SEQ ID NO: 51919 - DNA, 25 bp, mus musculus
ccacagaaatccaccatggctgctc

SEQ ID NO: 51920 - DNA, 25 bp, mus musculus
accatggctgctcaaaacctgcctg

SEQ ID NO: 51921 - DNA, 25 bp, mus musculus
ctgcctgagcagcatgtttccgaaa

SEQ ID NO: 51922 - DNA, 25 bp, mus musculus
agaagccagactttccagcagacac

SEQ ID NO: 51923 - DNA, 25 bp, mus musculus
cagactttccagcagacaccagctg

SEQ ID NO: 51924 - DNA, 25 bp, mus musculus
cagacaccagctgcagaagtatctt

SEQ ID NO: 51925 - DNA, 25 bp, mus musculus
gtatcttcaggatctattagtggag

SEQ ID NO: 51926 - DNA, 25 bp, mus musculus
tggtccctgagtccacgctaaggtg

SEQ ID NO: 51927 - DNA, 25 bp, mus musculus
taaggtgactgtcccttcttcgtat

SEQ ID NO: 51928 - DNA, 25 bp, mus musculus
ttgcatcctcaaagcccagcacata

SEQ ID NO: 51929 - DNA, 25 bp, mus musculus
tactttctgtctctccatgctgaaa

SEQ ID NO: 51930 - DNA, 25 bp, mus musculus
ctccatgctgaaaccctttcggaag

SEQ ID NO: 51931 - DNA, 25 bp, mus musculus
tcggaagccaggcctgatttgggca

SEQ ID NO: 51932 - DNA, 25 bp, mus musculus
gtccatggactcctccagacagcac

SEQ ID NO: 51933 - DNA, 25 bp, mus musculus
ggactcctccagacagcacagtcag

SEQ ID NO: 51934 - DNA, 25 bp, mus musculus
ctccagacagcacagtcagttggaa

SEQ ID NO: 51935 - DNA, 25 bp, mus musculus
aagcgattgccctggaaagatgaaa

SEQ ID NO: 51936 - DNA, 25 bp, mus musculus
gatgaaatactaaccacatggaagt

SEQ ID NO: 51937 - DNA, 25 bp, mus musculus
atactaaccacatggaagtgacaga

SEQ ID NO: 51938 - DNA, 25 bp, mus musculus
ttcgtatcacggtctgcactaatct

SEQ ID NO: 51939 - DNA, 25 bp, mus musculus
tctgcactaatctcacccaaggtgt

SEQ ID NO: 51940 - DNA, 25 bp, mus musculus
tcacccaaggtgtctgaggctggtt

SEQ ID NO: 51941 - DNA, 25 bp, mus musculus
tacgtaactataactggctgctcac

SEQ ID NO: 51942 - DNA, 25 bp, mus musculus
actataactggctgctcactgcgct

SEQ ID NO: 51943 - DNA, 25 bp, mus musculus
cctgtgccttctagatctttgcatc

SEQ ID NO: 51944 - DNA, 25 bp, mus musculus
ccttctagatctttgcatcctcaaa

SEQ ID NO: 51945 - DNA, 25 bp, mus musculus
agatctttgcatcctcaaagcccag

SEQ ID NO: 51946 - DNA, 25 bp, mus musculus
gttgcccagttctgagtagaaaact

SEQ ID NO: 51947 - DNA, 25 bp, mus musculus
tatgctgtgtgtggcggcgcgcacc

SEQ ID NO: 51948 - DNA, 25 bp, mus musculus
attttctcaggaagcaggaagagaa

SEQ ID NO: 51949 - DNA, 25 bp, mus musculus
tcaaaatgcaaatctcagctttttg

SEQ ID NO: 51950 - DNA, 25 bp, mus musculus
aaatgcaaatctcagctttttgata

SEQ ID NO: 51951 - DNA, 25 bp, mus musculus
tgcaaatctcagctttttgataacc

SEQ ID NO: 51952 - DNA, 25 bp, mus musculus
gatgaccacaatcaactgtgagaac

SEQ ID NO: 51953 - DNA, 25 bp, mus musculus
gaccacaatcaactgtgagaactgt

SEQ ID NO: 51954 - DNA, 25 bp, mus musculus
atttctctgtagtttaatcatgtaa

SEQ ID NO: 51955 - DNA, 25 bp, mus musculus
tgacctttgtatgtagtttgagtgt

SEQ ID NO: 51956 - DNA, 25 bp, mus musculus
cattgaaaccgttctctaagatgca

SEQ ID NO: 51957 - DNA, 25 bp, mus musculus
tgaaaccgttctctaagatgcattt

SEQ ID NO: 51958 - DNA, 25 bp, mus musculus
agtcagatctccctgagttcgaggc

SEQ ID NO: 51959 - DNA, 25 bp, mus musculus
tcgaggccaacctggtatatatagt

SEQ ID NO: 51960 - DNA, 25 bp, mus musculus
cgaattctaggacagccagggctac

SEQ ID NO: 51961 - DNA, 25 bp, mus musculus
accctgtctctgcaaaccaaaagag

SEQ ID NO: 51962 - DNA, 25 bp, mus musculus
ctgtctctgcaaaccaaaagagaaa

SEQ ID NO: 51963 - DNA, 25 bp, mus musculus
tctctgcaaaccaaaagagaaaact

SEQ ID NO: 51964 - DNA, 25 bp, mus musculus
aaattgtgcattttctcaggaagca

SEQ ID NO: 51965 - DNA, 25 bp, mus musculus
tgcattttctcaggaagcaggaaga

SEQ ID NO: 51966 - DNA, 25 bp, mus musculus
atgaaccagatctacgggttcgagg

SEQ ID NO: 51967 - DNA, 25 bp, mus musculus
aaggccaagtacacagcccagatgt

SEQ ID NO: 51968 - DNA, 25 bp, mus musculus
atcatgcacggaggcctattcagcg

SEQ ID NO: 51969 - DNA, 25 bp, mus musculus
atgcacggaggcctattcagcgaag

SEQ ID NO: 51970 - DNA, 25 bp, mus musculus
ggcctattcagcgaagatggtgtca

SEQ ID NO: 51971 - DNA, 25 bp, mus musculus
ctattcagcgaagatggtgtcactc

SEQ ID NO: 51972 - DNA, 25 bp, mus musculus
gatggtgtcactctggatgacatcc

SEQ ID NO: 51973 - DNA, 25 bp, mus musculus
gtcactctggatgacatccgaaaga

SEQ ID NO: 51974 - DNA, 25 bp, mus musculus
actctggatgacatccgaaagattg

SEQ ID NO: 51975 - DNA, 25 bp, mus musculus
ccagactcaggtcccatgtgtgacc

SEQ ID NO: 51976 - DNA, 25 bp, mus musculus
gactcaggtcccatgtgtgacctgc

SEQ ID NO: 51977 - DNA, 25 bp, mus musculus
tcaggtcccatgtgtgacctgctgt

SEQ ID NO: 51978 - DNA, 25 bp, mus musculus
gccaagtacacagcccagatgtatg

SEQ ID NO: 51979 - DNA, 25 bp, mus musculus
aagtacacagcccagatgtatgagc

SEQ ID NO: 51980 - DNA, 25 bp, mus musculus
tacacagcccagatgtatgagctct

SEQ ID NO: 51981 - DNA, 25 bp, mus musculus
tatgagctcttcagcgaggtgttcg

SEQ ID NO: 51982 - DNA, 25 bp, mus musculus
ccgctggcgcagtgtatcaatggca

SEQ ID NO: 51983 - DNA, 25 bp, mus musculus
aaagtgctgatcatgcacggaggcc

SEQ ID NO: 51984 - DNA, 25 bp, mus musculus
gtgctgatcatgcacggaggcctat

SEQ ID NO: 51985 - DNA, 25 bp, mus musculus
ctgatcatgcacggaggcctattca

SEQ ID NO: 51986 - DNA, 25 bp, mus musculus
acattccccaaatggaatctgttga

SEQ ID NO: 51987 - DNA, 25 bp, mus musculus
aagctcccatgaaggtatctgacat

SEQ ID NO: 51988 - DNA, 25 bp, mus musculus
atgctccaaaatacttccagagtat

SEQ ID NO: 51989 - DNA, 25 bp, mus musculus
acttccagagtatcttctagtcttg

SEQ ID NO: 51990 - DNA, 25 bp, mus musculus
agagtatcttctagtcttgtacatt

SEQ ID NO: 51991 - DNA, 25 bp, mus musculus
agtcttgtacatttccattgaatgt

SEQ ID NO: 51992 - DNA, 25 bp, mus musculus
gtacatttccattgaatgtgttagg

SEQ ID NO: 51993 - DNA, 25 bp, mus musculus
gtttcatctctgcagggttgatgac

SEQ ID NO: 51994 - DNA, 25 bp, mus musculus
tctctgcagggttgatgactattga

SEQ ID NO: 51995 - DNA, 25 bp, mus musculus
ctattgagactgtcttcacttctgc

SEQ ID NO: 51996 - DNA, 25 bp, mus musculus
agactgtcttcacttctgctcccat

SEQ ID NO: 51997 - DNA, 25 bp, mus musculus
tgtctctgaaccacattcttttcaa

SEQ ID NO: 51998 - DNA, 25 bp, mus musculus
tcatttctcagcaacaatacaacca

SEQ ID NO: 51999 - DNA, 25 bp, mus musculus
acagcaagatcacctggccacagtt

SEQ ID NO: 52000 - DNA, 25 bp, mus musculus
agatcacctggccacagtttgtaaa

SEQ ID NO: 52001 - DNA, 25 bp, mus musculus
cctggccacagtttgtaaagcttct

SEQ ID NO: 52002 - DNA, 25 bp, mus musculus
ttgtaaagcttctccatcaatacca

SEQ ID NO: 52003 - DNA, 25 bp, mus musculus
agcttctccatcaataccagaaaac

SEQ ID NO: 52004 - DNA, 25 bp, mus musculus
tccatcaataccagaaaaccatgac

SEQ ID NO: 52005 - DNA, 25 bp, mus musculus
gctgtaattacttctcattaccaac

SEQ ID NO: 52006 - DNA, 25 bp, mus musculus
ctcgtgcggcacgagggcgttcttg

SEQ ID NO: 52007 - DNA, 25 bp, mus musculus
gcgttcttgctgtggatgaagctca

SEQ ID NO: 52008 - DNA, 25 bp, mus musculus
cactttcagagttctcagcggtctt

SEQ ID NO: 52009 - DNA, 25 bp, mus musculus
cagagttctcagcggtcttccgtct

SEQ ID NO: 52010 - DNA, 25 bp, mus musculus
tcagcggtcttccgtctcctgctca

SEQ ID NO: 52011 - DNA, 25 bp, mus musculus
tcaccggaacgcccatccagaacag

SEQ ID NO: 52012 - DNA, 25 bp, mus musculus
agaacagcctccgggagctctactc

SEQ ID NO: 52013 - DNA, 25 bp, mus musculus
gtggagcctgacctcttctggagag

SEQ ID NO: 52014 - DNA, 25 bp, mus musculus
tggagcctgacctcttctggagaga

SEQ ID NO: 52015 - DNA, 25 bp, mus musculus
ggagcctgacctcttctggagagaa

SEQ ID NO: 52016 - DNA, 25 bp, mus musculus
gagcctgacctcttctggagagaac

SEQ ID NO: 52017 - DNA, 25 bp, mus musculus
agcctgacctcttctggagagaaca

SEQ ID NO: 52018 - DNA, 25 bp, mus musculus
accagagctccctgctgcacaggac

SEQ ID NO: 52019 - DNA, 25 bp, mus musculus
cagagctccctgctgcacaggacac

SEQ ID NO: 52020 - DNA, 25 bp, mus musculus
gagctccctgctgcacaggacactt

SEQ ID NO: 52021 - DNA, 25 bp, mus musculus
tccctgctgcacaggacactttcag

SEQ ID NO: 52022 - DNA, 25 bp, mus musculus
cctgctgcacaggacactttcagag

SEQ ID NO: 52023 - DNA, 25 bp, mus musculus
tgctgcacaggacactttcagagtt

SEQ ID NO: 52024 - DNA, 25 bp, mus musculus
gcacaggacactttcagagttctca

SEQ ID NO: 52025 - DNA, 25 bp, mus musculus
gacactttcagagttctcagcggtc

SEQ ID NO: 52026 - DNA, 25 bp, mus musculus
cgatcacaacgtgcattgtgcttcc

SEQ ID NO: 52027 - DNA, 25 bp, mus musculus
caacgtgcattgtgcttccttgaga

SEQ ID NO: 52028 - DNA, 25 bp, mus musculus
attagatgttctctatcatttaata

SEQ ID NO: 52029 - DNA, 25 bp, mus musculus
taaactggcatatctgcctttattg

SEQ ID NO: 52030 - DNA, 25 bp, mus musculus
gtcattagcctgactagagaggcct

SEQ ID NO: 52031 - DNA, 25 bp, mus musculus
tgaactggaccctgttgctaagcct

SEQ ID NO: 52032 - DNA, 25 bp, mus musculus
ggaccctgttgctaagcctcagcaa

SEQ ID NO: 52033 - DNA, 25 bp, mus musculus
tgttgctaagcctcagcaagcaatc

SEQ ID NO: 52034 - DNA, 25 bp, mus musculus
taagcctcagcaagcaatcatccta

SEQ ID NO: 52035 - DNA, 25 bp, mus musculus
tcagcaagcaatcatcctaggtagg

SEQ ID NO: 52036 - DNA, 25 bp, mus musculus
attgccatattgcacatgtcttaat

SEQ ID NO: 52037 - DNA, 25 bp, mus musculus
atattgcacatgtcttaatgaagtt

SEQ ID NO: 52038 - DNA, 25 bp, mus musculus
gcattgtgcttccttgagaatattt

SEQ ID NO: 52039 - DNA, 25 bp, mus musculus
tgcttccttgagaatatttgaatct

SEQ ID NO: 52040 - DNA, 25 bp, mus musculus
tgaatcttgtctcaatgctcataac

SEQ ID NO: 52041 - DNA, 25 bp, mus musculus
ttgtctcaatgctcataacggatca

SEQ ID NO: 52042 - DNA, 25 bp, mus musculus
gcgactttagtcctgagctcttgtg

SEQ ID NO: 52043 - DNA, 25 bp, mus musculus
ttagtcctgagctcttgtgaggaaa

SEQ ID NO: 52044 - DNA, 25 bp, mus musculus
tggctttatcctctttagagttaga

SEQ ID NO: 52045 - DNA, 25 bp, mus musculus
tatcctctttagagttagactgttg

SEQ ID NO: 52046 - DNA, 25 bp, mus musculus
cgcagagcgtccgcactaacaattg

SEQ ID NO: 52047 - DNA, 25 bp, mus musculus
agagcgtccgcactaacaattgcga

SEQ ID NO: 52048 - DNA, 25 bp, mus musculus
ctgtataccatccgatgacaatccc

SEQ ID NO: 52049 - DNA, 25 bp, mus musculus
tataccatccgatgacaatcccaca

SEQ ID NO: 52050 - DNA, 25 bp, mus musculus
accatccgatgacaatcccacagtt

SEQ ID NO: 52051 - DNA, 25 bp, mus musculus
cgatgacaatcccacagttgccatc

SEQ ID NO: 52052 - DNA, 25 bp, mus musculus
caatcccacagttgccatctaggtt

SEQ ID NO: 52053 - DNA, 25 bp, mus musculus
agttgccatctaggttcctgagcta

SEQ ID NO: 52054 - DNA, 25 bp, mus musculus
tgccatctaggttcctgagctatct

SEQ ID NO: 52055 - DNA, 25 bp, mus musculus
catctaggttcctgagctatctgaa

SEQ ID NO: 52056 - DNA, 25 bp, mus musculus
ctaggttcctgagctatctgaagag

SEQ ID NO: 52057 - DNA, 25 bp, mus musculus
tcctgagctatctgaagaggccctg

SEQ ID NO: 52058 - DNA, 25 bp, mus musculus
gcgtccgcactaacaattgcgatcc

SEQ ID NO: 52059 - DNA, 25 bp, mus musculus
tccgcactaacaattgcgatcctcg

SEQ ID NO: 52060 - DNA, 25 bp, mus musculus
ctaacaattgcgatcctcgttgcga

SEQ ID NO: 52061 - DNA, 25 bp, mus musculus
acaattgcgatcctcgttgcgaggt

SEQ ID NO: 52062 - DNA, 25 bp, mus musculus
ctcgttgcgaggtcgtcagctacct

SEQ ID NO: 52063 - DNA, 25 bp, mus musculus
aggtcgtcagctaccttgtttatag

SEQ ID NO: 52064 - DNA, 25 bp, mus musculus
tcagctaccttgtttatagtacaca

SEQ ID NO: 52065 - DNA, 25 bp, mus musculus
ttcctgtataccatccgatgacaat

SEQ ID NO: 52066 - DNA, 25 bp, mus musculus
ctaagcttgtggtccaccagaggtg

SEQ ID NO: 52067 - DNA, 25 bp, mus musculus
cccaaaacgtcggcaatggctatga

SEQ ID NO: 52068 - DNA, 25 bp, mus musculus
ctgtgaagtccagcatggtgtgcgc

SEQ ID NO: 52069 - DNA, 25 bp, mus musculus
attgccgggcatctaatggccagtg

SEQ ID NO: 52070 - DNA, 25 bp, mus musculus
gggcatctaatggccagtggcaggt

SEQ ID NO: 52071 - DNA, 25 bp, mus musculus
ctaatggccagtggcaggtgcatgg

SEQ ID NO: 52072 - DNA, 25 bp, mus musculus
tgcatggcatcgtgagcttcggctc

SEQ ID NO: 52073 - DNA, 25 bp, mus musculus
tcttcaccagggtctccaactacat

SEQ ID NO: 52074 - DNA, 25 bp, mus musculus
ttgactggatcaactcggtgatggc

SEQ ID NO: 52075 - DNA, 25 bp, mus musculus
ggatcaactcggtgatggcaaggaa

SEQ ID NO: 52076 - DNA, 25 bp, mus musculus
tgaagacattactgccactgtcccc

SEQ ID NO: 52077 - DNA, 25 bp, mus musculus
cattactgccactgtccccctggaa

SEQ ID NO: 52078 - DNA, 25 bp, mus musculus
gctatgacattgccttaatcaaact

SEQ ID NO: 52079 - DNA, 25 bp, mus musculus
acattgccttaatcaaactggccag

SEQ ID NO: 52080 - DNA, 25 bp, mus musculus
ccttaatcaaactggccagcccagt

SEQ ID NO: 52081 - DNA, 25 bp, mus musculus
tcaaactggccagcccagtgaccct

SEQ ID NO: 52082 - DNA, 25 bp, mus musculus
agaacatccagacagcttgcctccc

SEQ ID NO: 52083 - DNA, 25 bp, mus musculus
ctggcaccattctcccgagaaacta

SEQ ID NO: 52084 - DNA, 25 bp, mus musculus
gcctgctgcagaccaatgggaacag

SEQ ID NO: 52085 - DNA, 25 bp, mus musculus
tggactatgccacctgctccagcgc

SEQ ID NO: 52086 - DNA, 25 bp, mus musculus
tggatacgacagactcctccagctt

SEQ ID NO: 52087 - DNA, 25 bp, mus musculus
actcctccagcttcaagacacttaa

SEQ ID NO: 52088 - DNA, 25 bp, mus musculus
gctgtttactacactgggaaccagt

SEQ ID NO: 52089 - DNA, 25 bp, mus musculus
tgccctgaccactggttacctgctg

SEQ ID NO: 52090 - DNA, 25 bp, mus musculus
gaccactggttacctgctgaatagg

SEQ ID NO: 52091 - DNA, 25 bp, mus musculus
cactggttacctgctgaataggcag

SEQ ID NO: 52092 - DNA, 25 bp, mus musculus
tggttacctgctgaataggcagaag

SEQ ID NO: 52093 - DNA, 25 bp, mus musculus
ggtatctgctgatgcccgggaacag

SEQ ID NO: 52094 - DNA, 25 bp, mus musculus
tgctgatgcccgggaacagcacaag

SEQ ID NO: 52095 - DNA, 25 bp, mus musculus
ggaacagcacaagctctttccccca

SEQ ID NO: 52096 - DNA, 25 bp, mus musculus
acagcacaagctctttcccccaagt

SEQ ID NO: 52097 - DNA, 25 bp, mus musculus
acataacaactgcatggctgagtgc

SEQ ID NO: 52098 - DNA, 25 bp, mus musculus
gcttcaagacacttaaccaagaaga

SEQ ID NO: 52099 - DNA, 25 bp, mus musculus
caccatctatgccaaactccgaaac

SEQ ID NO: 52100 - DNA, 25 bp, mus musculus
tcaagacacttaaccaagaagaagg

SEQ ID NO: 52101 - DNA, 25 bp, mus musculus
cagtgccttctcaaagttgctaact

SEQ ID NO: 52102 - DNA, 25 bp, mus musculus
tgccttctcaaagttgctaactggc

SEQ ID NO: 52103 - DNA, 25 bp, mus musculus
aaagttgctaactggccgaaatgca

SEQ ID NO: 52104 - DNA, 25 bp, mus musculus
gctaactggccgaaatgcatctctg

SEQ ID NO: 52105 - DNA, 25 bp, mus musculus
aaatgcatctctgctgtttactaca

SEQ ID NO: 52106 - DNA, 25 bp, mus musculus
atctctgctgtttactacactggga

SEQ ID NO: 52107 - DNA, 25 bp, mus musculus
catcaatggcttcatccagtccaag

SEQ ID NO: 52108 - DNA, 25 bp, mus musculus
caatggcttcatccagtccaagagc

SEQ ID NO: 52109 - DNA, 25 bp, mus musculus
ggtgaccccactgattggcagccct

SEQ ID NO: 52110 - DNA, 25 bp, mus musculus
gccctcctgtggtgtgataaagagg

SEQ ID NO: 52111 - DNA, 25 bp, mus musculus
gttctctgggctgctacatggaagt

SEQ ID NO: 52112 - DNA, 25 bp, mus musculus
ctctgggctgctacatggaagtccc

SEQ ID NO: 52113 - DNA, 25 bp, mus musculus
tggaagtcccaagaccacaccttct

SEQ ID NO: 52114 - DNA, 25 bp, mus musculus
aagtcccaagaccacaccttctgct

SEQ ID NO: 52115 - DNA, 25 bp, mus musculus
tgctcctgctgcttccacagagact

SEQ ID NO: 52116 - DNA, 25 bp, mus musculus
tgctgcttccacagagactctgact

SEQ ID NO: 52117 - DNA, 25 bp, mus musculus
tgcttccacagagactctgactccc

SEQ ID NO: 52118 - DNA, 25 bp, mus musculus
cacccctgagcggaatgagttggtc

SEQ ID NO: 52119 - DNA, 25 bp, mus musculus
tggcttcatccagtccaagagcact

SEQ ID NO: 52120 - DNA, 25 bp, mus musculus
cttcatccagtccaagagcactggc

SEQ ID NO: 52121 - DNA, 25 bp, mus musculus
ccagtccaagagcactggcagagag

SEQ ID NO: 52122 - DNA, 25 bp, mus musculus
gtccaagagcactggcagagagccc

SEQ ID NO: 52123 - DNA, 25 bp, mus musculus
agctccggtgccttatcagaactac

SEQ ID NO: 52124 - DNA, 25 bp, mus musculus
tccggtgccttatcagaactactat

SEQ ID NO: 52125 - DNA, 25 bp, mus musculus
ggtgccttatcagaactactatgac

SEQ ID NO: 52126 - DNA, 25 bp, mus musculus
ggaggtgaccccactgattggcagc

SEQ ID NO: 52127 - DNA, 25 bp, mus musculus
ttcaaggcaacgttgcccgaggctg

SEQ ID NO: 52128 - DNA, 25 bp, mus musculus
ggcccatcctgggcatccaaggaga

SEQ ID NO: 52129 - DNA, 25 bp, mus musculus
gaaagctggtacccagccgtgacca

SEQ ID NO: 52130 - DNA, 25 bp, mus musculus
tggtacccagccgtgaccagacact

SEQ ID NO: 52131 - DNA, 25 bp, mus musculus
tacccagccgtgaccagacactgca

SEQ ID NO: 52132 - DNA, 25 bp, mus musculus
ccagccgtgaccagacactgcagga

SEQ ID NO: 52133 - DNA, 25 bp, mus musculus
gccgtgaccagacactgcaggagga

SEQ ID NO: 52134 - DNA, 25 bp, mus musculus
gtgaccagacactgcaggaggagct

SEQ ID NO: 52135 - DNA, 25 bp, mus musculus
agacactgcaggaggagctggcccg

SEQ ID NO: 52136 - DNA, 25 bp, mus musculus
agctggcccggcagcaggtgaacga

SEQ ID NO: 52137 - DNA, 25 bp, mus musculus
agaggctccggcgacagtttgcagc

SEQ ID NO: 52138 - DNA, 25 bp, mus musculus
gacagtttgcagcccaggctaatgc

SEQ ID NO: 52139 - DNA, 25 bp, mus musculus
ccatcctgggcatccaaggagagat

SEQ ID NO: 52140 - DNA, 25 bp, mus musculus
tcctgggcatccaaggagagatcca

SEQ ID NO: 52141 - DNA, 25 bp, mus musculus
agatttgccaaacatacggactacg

SEQ ID NO: 52142 - DNA, 25 bp, mus musculus
acatcaccctcagttcgcaggacat

SEQ ID NO: 52143 - DNA, 25 bp, mus musculus
tcaccctcagttcgcaggacatcaa

SEQ ID NO: 52144 - DNA, 25 bp, mus musculus
ccctcagttcgcaggacatcaacaa

SEQ ID NO: 52145 - DNA, 25 bp, mus musculus
tcagttcgcaggacatcaacaataa

SEQ ID NO: 52146 - DNA, 25 bp, mus musculus
gttcgcaggacatcaacaataagtg

SEQ ID NO: 52147 - DNA, 25 bp, mus musculus
ttagctgcagaacttgcctctctcc

SEQ ID NO: 52148 - DNA, 25 bp, mus musculus
catcctatttgggaggttcctatgt

SEQ ID NO: 52149 - DNA, 25 bp, mus musculus
cactagtgtgttcgccatgttggga

SEQ ID NO: 52150 - DNA, 25 bp, mus musculus
agaacaaatctacttcagtaaatct

SEQ ID NO: 52151 - DNA, 25 bp, mus musculus
aatctacttcagtaaatctctcatc

SEQ ID NO: 52152 - DNA, 25 bp, mus musculus
cttcagtaaatctctcatctgccca

SEQ ID NO: 52153 - DNA, 25 bp, mus musculus
tctcatctgcccagccaagtgaggg

SEQ ID NO: 52154 - DNA, 25 bp, mus musculus
gtctctcgagacctcctactctact

SEQ ID NO: 52155 - DNA, 25 bp, mus musculus
ctcctactctacttgaagggtagag

SEQ ID NO: 52156 - DNA, 25 bp, mus musculus
ggtagagctattccttcttgggact

SEQ ID NO: 52157 - DNA, 25 bp, mus musculus
acccgatccatagcaaatggaaaat

SEQ ID NO: 52158 - DNA, 25 bp, mus musculus
tacagctctcttgcttacacagaaa

SEQ ID NO: 52159 - DNA, 25 bp, mus musculus
atcagggacccccaagacgcagcca

SEQ ID NO: 52160 - DNA, 25 bp, mus musculus
gcagccatccatcctcatacagagt

SEQ ID NO: 52161 - DNA, 25 bp, mus musculus
atccatcctcatacagagtcatatg

SEQ ID NO: 52162 - DNA, 25 bp, mus musculus
acagagtcatatgcccacctgctcc

SEQ ID NO: 52163 - DNA, 25 bp, mus musculus
ttcctgacacctctctcgaagcttc

SEQ ID NO: 52164 - DNA, 25 bp, mus musculus
ctctcgaagcttccggtctccatgg

SEQ ID NO: 52165 - DNA, 25 bp, mus musculus
aagcttccggtctccatggcctgcc

SEQ ID NO: 52166 - DNA, 25 bp, mus musculus
tccatggcctgccactagtgtgttc

SEQ ID NO: 52167 - DNA, 25 bp, mus musculus
tatgcagttggtgtactggtgcacc

SEQ ID NO: 52168 - DNA, 25 bp, mus musculus
ctaccagcctgccactggtggtcgt

SEQ ID NO: 52169 - DNA, 25 bp, mus musculus
ttattgctctgacgtccttgacgac

SEQ ID NO: 52170 - DNA, 25 bp, mus musculus
attgctctgacgtccttgacgacat

SEQ ID NO: 52171 - DNA, 25 bp, mus musculus
tgctctgacgtccttgacgacatga

SEQ ID NO: 52172 - DNA, 25 bp, mus musculus
ctgacgtccttgacgacatgactgg

SEQ ID NO: 52173 - DNA, 25 bp, mus musculus
gacgtccttgacgacatgactggcc

SEQ ID NO: 52174 - DNA, 25 bp, mus musculus
cgtccttgacgacatgactggccta

SEQ ID NO: 52175 - DNA, 25 bp, mus musculus
tccttgacgacatgactggcctaga

SEQ ID NO: 52176 - DNA, 25 bp, mus musculus
tgacgacatgactggcctagagact

SEQ ID NO: 52177 - DNA, 25 bp, mus musculus
gacatgactggcctagagactgagt

SEQ ID NO: 52178 - DNA, 25 bp, mus musculus
catgactggcctagagactgagtat

SEQ ID NO: 52179 - DNA, 25 bp, mus musculus
accagcctgccactggtggtcgtcc

SEQ ID NO: 52180 - DNA, 25 bp, mus musculus
cagcctgccactggtggtcgtccga

SEQ ID NO: 52181 - DNA, 25 bp, mus musculus
gcattgctcatgcctgggctcgcat

SEQ ID NO: 52182 - DNA, 25 bp, mus musculus
tatctgattgatgtcatgcgtgcct

SEQ ID NO: 52183 - DNA, 25 bp, mus musculus
tctgattgatgtcatgcgtgcctgt

SEQ ID NO: 52184 - DNA, 25 bp, mus musculus
attgatgtcatgcgtgcctgtgtgg

SEQ ID NO: 52185 - DNA, 25 bp, mus musculus
atgtcatgcgtgcctgtgtggactt

SEQ ID NO: 52186 - DNA, 25 bp, mus musculus
ggttattgctctgacgtccttgacg

SEQ ID NO: 52187 - DNA, 25 bp, mus musculus
tgtgacagctgtggcctttagttag

SEQ ID NO: 52188 - DNA, 25 bp, mus musculus
tgacagctgtggcctttagttagga

SEQ ID NO: 52189 - DNA, 25 bp, mus musculus
cgacatgcatcttgaggacctgtgg

SEQ ID NO: 52190 - DNA, 25 bp, mus musculus
atgcatcttgaggacctgtggatag

SEQ ID NO: 52191 - DNA, 25 bp, mus musculus
gcatcttgaggacctgtggatagtg

SEQ ID NO: 52192 - DNA, 25 bp, mus musculus
atcttgaggacctgtggatagtggc

SEQ ID NO: 52193 - DNA, 25 bp, mus musculus
gtatcatcaagatctggacagagag

SEQ ID NO: 52194 - DNA, 25 bp, mus musculus
atcatcaagatctggacagagagct

SEQ ID NO: 52195 - DNA, 25 bp, mus musculus
atgatacgtgtcctagcttcgagtg

SEQ ID NO: 52196 - DNA, 25 bp, mus musculus
tacgtgtcctagcttcgagtggtga

SEQ ID NO: 52197 - DNA, 25 bp, mus musculus
cgtgtcctagcttcgagtggtgatg

SEQ ID NO: 52198 - DNA, 25 bp, mus musculus
tcctagcttcgagtggtgatgagtc

SEQ ID NO: 52199 - DNA, 25 bp, mus musculus
agctgtggcctttagttaggagctg

SEQ ID NO: 52200 - DNA, 25 bp, mus musculus
ctagcttcgagtggtgatgagtcca

SEQ ID NO: 52201 - DNA, 25 bp, mus musculus
ctgtggcctttagttaggagctgga

SEQ ID NO: 52202 - DNA, 25 bp, mus musculus
ggcctttagttaggagctggatcct

SEQ ID NO: 52203 - DNA, 25 bp, mus musculus
agctggatcctgtacagagactctg

SEQ ID NO: 52204 - DNA, 25 bp, mus musculus
ggatcctgtacagagactctgcgtg

SEQ ID NO: 52205 - DNA, 25 bp, mus musculus
tacagagactctgcgtgtacaagat

SEQ ID NO: 52206 - DNA, 25 bp, mus musculus
gaagcgacatgcatcttgaggacct

SEQ ID NO: 52207 - DNA, 25 bp, mus musculus
agcgacatgcatcttgaggacctgt

SEQ ID NO: 52208 - DNA, 25 bp, mus musculus
ggggccagcacacggtcttactagt

SEQ ID NO: 52209 - DNA, 25 bp, mus musculus
gggccagcacacggtcttactagtt

SEQ ID NO: 52210 - DNA, 25 bp, mus musculus
aggaccaggcacagagctgatgaag

SEQ ID NO: 52211 - DNA, 25 bp, mus musculus
ggaccaggcacagagctgatgaagt

SEQ ID NO: 52212 - DNA, 25 bp, mus musculus
gaccaggcacagagctgatgaagtc

SEQ ID NO: 52213 - DNA, 25 bp, mus musculus
accaggcacagagctgatgaagtct

SEQ ID NO: 52214 - DNA, 25 bp, mus musculus
atgaagtctttgtgggcctggcttc

SEQ ID NO: 52215 - DNA, 25 bp, mus musculus
tgaagtctttgtgggcctggcttct

SEQ ID NO: 52216 - DNA, 25 bp, mus musculus
ggccagcacacggtcttactagtta

SEQ ID NO: 52217 - DNA, 25 bp, mus musculus
gccagcacacggtcttactagttaa

SEQ ID NO: 52218 - DNA, 25 bp, mus musculus
ccagcacacggtcttactagttaag

SEQ ID NO: 52219 - DNA, 25 bp, mus musculus
cagcacacggtcttactagttaagg

SEQ ID NO: 52220 - DNA, 25 bp, mus musculus
gttaaggaccaggcacagagctgat

SEQ ID NO: 52221 - DNA, 25 bp, mus musculus
ttaaggaccaggcacagagctgatg

SEQ ID NO: 52222 - DNA, 25 bp, mus musculus
taaggaccaggcacagagctgatga

SEQ ID NO: 52223 - DNA, 25 bp, mus musculus
aaggaccaggcacagagctgatgaa

SEQ ID NO: 52224 - DNA, 25 bp, mus musculus
accagcagcatggcgtagtgcccag

SEQ ID NO: 52225 - DNA, 25 bp, mus musculus
gcgtagtgcccagcctggagcctcg

SEQ ID NO: 52226 - DNA, 25 bp, mus musculus
actgcccaatccaggggctctggga

SEQ ID NO: 52227 - DNA, 25 bp, mus musculus
atatggctgcccgggattacagaaa

SEQ ID NO: 52228 - DNA, 25 bp, mus musculus
ctgcccgggattacagaaagacacg

SEQ ID NO: 52229 - DNA, 25 bp, mus musculus
gccggtcacacccatgctgcttaga

SEQ ID NO: 52230 - DNA, 25 bp, mus musculus
catgctgcttagaagcctaagcctc

SEQ ID NO: 52231 - DNA, 25 bp, mus musculus
aagcctaagcctctgccttcaagct

SEQ ID NO: 52232 - DNA, 25 bp, mus musculus
tcaagctggatcctgtgcagggtgg

SEQ ID NO: 52233 - DNA, 25 bp, mus musculus
ctcacctggactggcacaacttcgg

SEQ ID NO: 52234 - DNA, 25 bp, mus musculus
gggccaagtcctgcatattcactaa

SEQ ID NO: 52235 - DNA, 25 bp, mus musculus
agtcctgcatattcactaataaatc

SEQ ID NO: 52236 - DNA, 25 bp, mus musculus
gaccgagcagccacaagctggaaac

SEQ ID NO: 52237 - DNA, 25 bp, mus musculus
catattcactaataaatcagacatg

SEQ ID NO: 52238 - DNA, 25 bp, mus musculus
gcagccacaagctggaaaccaccgg

SEQ ID NO: 52239 - DNA, 25 bp, mus musculus
acaagctggaaaccaccggccatga

SEQ ID NO: 52240 - DNA, 25 bp, mus musculus
gcacctgttcattcctcccagtgga

SEQ ID NO: 52241 - DNA, 25 bp, mus musculus
gttcattcctcccagtggagacttc

SEQ ID NO: 52242 - DNA, 25 bp, mus musculus
tcctcccagtggagacttcagattg

SEQ ID NO: 52243 - DNA, 25 bp, mus musculus
ccactttacagaactgcccaatcca

SEQ ID NO: 52244 - DNA, 25 bp, mus musculus
tacagaactgcccaatccaggggct

SEQ ID NO: 52245 - DNA, 25 bp, mus musculus
tcgatctatctacctatgccgacat

SEQ ID NO: 52246 - DNA, 25 bp, mus musculus
atctatctacctatgccgacatggt

SEQ ID NO: 52247 - DNA, 25 bp, mus musculus
ctatgccctggccaacttcattcgg

SEQ ID NO: 52248 - DNA, 25 bp, mus musculus
ggccaacttcattcggtctcagagc

SEQ ID NO: 52249 - DNA, 25 bp, mus musculus
cattcggtctcagagcatcagctcc

SEQ ID NO: 52250 - DNA, 25 bp, mus musculus
gtctcagagcatcagctccctgaag

SEQ ID NO: 52251 - DNA, 25 bp, mus musculus
catcagctccctgaaggtgtggact

SEQ ID NO: 52252 - DNA, 25 bp, mus musculus
tcagacagctgaagccctaggcgtc

SEQ ID NO: 52253 - DNA, 25 bp, mus musculus
gacagctgaagccctaggcgtcccc

SEQ ID NO: 52254 - DNA, 25 bp, mus musculus
agctgaagccctaggcgtcccctat

SEQ ID NO: 52255 - DNA, 25 bp, mus musculus
agccctaggcgtcccctatgaacag

SEQ ID NO: 52256 - DNA, 25 bp, mus musculus
cctaggcgtcccctatgaacagtgg

SEQ ID NO: 52257 - DNA, 25 bp, mus musculus
ctacctatgccgacatggtgagagt

SEQ ID NO: 52258 - DNA, 25 bp, mus musculus
cctatgccgacatggtgagagtgaa

SEQ ID NO: 52259 - DNA, 25 bp, mus musculus
atgccgacatggtgagagtgaactc

SEQ ID NO: 52260 - DNA, 25 bp, mus musculus
tgaactcaaccttagaggccgcatt

SEQ ID NO: 52261 - DNA, 25 bp, mus musculus
tagaggccgcattggaggtgactct

SEQ ID NO: 52262 - DNA, 25 bp, mus musculus
cctctcagctcggggcaagcagtat

SEQ ID NO: 52263 - DNA, 25 bp, mus musculus
ctcagctcggggcaagcagtatgcc

SEQ ID NO: 52264 - DNA, 25 bp, mus musculus
gtatgcctatgccctggccaacttc

SEQ ID NO: 52265 - DNA, 25 bp, mus musculus
gattcccgattatgtgctgggccag

SEQ ID NO: 52266 - DNA, 25 bp, mus musculus
cgattatgtgctgggccagagcacc

SEQ ID NO: 52267 - DNA, 25 bp, mus musculus
cctcctggctacatttggatccctg

SEQ ID NO: 52268 - DNA, 25 bp, mus musculus
ggctacatttggatccctggaacag

SEQ ID NO: 52269 - DNA, 25 bp, mus musculus
atttggatccctggaacagctcttc

SEQ ID NO: 52270 - DNA, 25 bp, mus musculus
atccctggaacagctcttcaccgca

SEQ ID NO: 52271 - DNA, 25 bp, mus musculus
gctcttcaccgcatcaagggaggat

SEQ ID NO: 52272 - DNA, 25 bp, mus musculus
cccacagaaggcccgcaggctcttt

SEQ ID NO: 52273 - DNA, 25 bp, mus musculus
cttcctcaaagtgcctcgatgacct

SEQ ID NO: 52274 - DNA, 25 bp, mus musculus
atgacctgctgccacctaggcccat

SEQ ID NO: 52275 - DNA, 25 bp, mus musculus
cacctaggcccatgtcacaataaag

SEQ ID NO: 52276 - DNA, 25 bp, mus musculus
ggcccatgtcacaataaagaatttt

SEQ ID NO: 52277 - DNA, 25 bp, mus musculus
gctgcagagcctggggaagaacttc

SEQ ID NO: 52278 - DNA, 25 bp, mus musculus
tgtgaaagatccccagcaggctctc

SEQ ID NO: 52279 - DNA, 25 bp, mus musculus
cctggagacctacagggcgtatgag

SEQ ID NO: 52280 - DNA, 25 bp, mus musculus
gccagccgacctccttatggaaaag

SEQ ID NO: 52281 - DNA, 25 bp, mus musculus
gcagaacttcctatcacgggccact

SEQ ID NO: 52282 - DNA, 25 bp, mus musculus
ggccactgagtgtctgaccaccgtg

SEQ ID NO: 52283 - DNA, 25 bp, mus musculus
tgagtgtctgaccaccgtgaaatct

SEQ ID NO: 52284 - DNA, 25 bp, mus musculus
tctgaccaccgtgaaatctgtgaac

SEQ ID NO: 52285 - DNA, 25 bp, mus musculus
tgaccaaattaacgcttgcaactgg

SEQ ID NO: 52286 - DNA, 25 bp, mus musculus
cccttgttaatttccatgatcctga

SEQ ID NO: 52287 - DNA, 25 bp, mus musculus
cctatcaggaccaacaagaccagcc

SEQ ID NO: 52288 - DNA, 25 bp, mus musculus
atcaggaccaacaagaccagcctgt

SEQ ID NO: 52289 - DNA, 25 bp, mus musculus
aggaccaacaagaccagcctgtgat

SEQ ID NO: 52290 - DNA, 25 bp, mus musculus
accaacaagaccagcctgtgatacc

SEQ ID NO: 52291 - DNA, 25 bp, mus musculus
tcctggtcggcgacaccgtgtgggt

SEQ ID NO: 52292 - DNA, 25 bp, mus musculus
cgtggatccacgccgctcacgtaaa

SEQ ID NO: 52293 - DNA, 25 bp, mus musculus
tccacgccgctcacgtaaaagcggc

SEQ ID NO: 52294 - DNA, 25 bp, mus musculus
ctccggccggaacagcatcaggacc

SEQ ID NO: 52295 - DNA, 25 bp, mus musculus
ggaacagcatcaggaccgacatgga

SEQ ID NO: 52296 - DNA, 25 bp, mus musculus
agcatcaggaccgacatggaaggtc

SEQ ID NO: 52297 - DNA, 25 bp, mus musculus
ttgttaatttccatgatcctgaaat

SEQ ID NO: 52298 - DNA, 25 bp, mus musculus
atttccatgatcctgaaatgtcaaa

SEQ ID NO: 52299 - DNA, 25 bp, mus musculus
tccatgatcctgaaatgtcaaagtt

SEQ ID NO: 52300 - DNA, 25 bp, mus musculus
agcctctggccgctgcctatcagga

SEQ ID NO: 52301 - DNA, 25 bp, mus musculus
ctctggccgctgcctatcaggacca

SEQ ID NO: 52302 - DNA, 25 bp, mus musculus
tggccgctgcctatcaggaccaaca

SEQ ID NO: 52303 - DNA, 25 bp, mus musculus
ccgctgcctatcaggaccaacaaga

SEQ ID NO: 52304 - DNA, 25 bp, mus musculus
ctgcctatcaggaccaacaagacca

SEQ ID NO: 52305 - DNA, 25 bp, mus musculus
tggatctggtcctgctcctacctgc

SEQ ID NO: 52306 - DNA, 25 bp, mus musculus
tacctgctccttctctgcagattgt

SEQ ID NO: 52307 - DNA, 25 bp, mus musculus
ttgctagccccggctctggtagacc

SEQ ID NO: 52308 - DNA, 25 bp, mus musculus
gctctggtagaccgttctggaatgg

SEQ ID NO: 52309 - DNA, 25 bp, mus musculus
ctatgatcgtcctaggacctgtgct

SEQ ID NO: 52310 - DNA, 25 bp, mus musculus
tgatcgtcctaggacctgtgctacg

SEQ ID NO: 52311 - DNA, 25 bp, mus musculus
ggctctgccctatttcatcttgttg

SEQ ID NO: 52312 - DNA, 25 bp, mus musculus
cagaacattcctaagtctcaagggc

SEQ ID NO: 52313 - DNA, 25 bp, mus musculus
gggctagtttccctgaggagcccag

SEQ ID NO: 52314 - DNA, 25 bp, mus musculus
tctctctcaagctgccacatgtaac

SEQ ID NO: 52315 - DNA, 25 bp, mus musculus
ctctcaagctgccacatgtaacgcc

SEQ ID NO: 52316 - DNA, 25 bp, mus musculus
cacatgtaacgcccttgctgcttct

SEQ ID NO: 52317 - DNA, 25 bp, mus musculus
ctgctccttctctgcagattgttag

SEQ ID NO: 52318 - DNA, 25 bp, mus musculus
cactttgctggggtctcctgcttca

SEQ ID NO: 52319 - DNA, 25 bp, mus musculus
tcctgcttcaagcaggcttctccca

SEQ ID NO: 52320 - DNA, 25 bp, mus musculus
ccccatagcctgagtgatgaggtgg

SEQ ID NO: 52321 - DNA, 25 bp, mus musculus
catagcctgagtgatgaggtggccc

SEQ ID NO: 52322 - DNA, 25 bp, mus musculus
gtggccccagagctgatctctgctg

SEQ ID NO: 52323 - DNA, 25 bp, mus musculus
gccccagagctgatctctgctgctg

SEQ ID NO: 52324 - DNA, 25 bp, mus musculus
atctctgctgctgtgtcttatctac

SEQ ID NO: 52325 - DNA, 25 bp, mus musculus
acctgcggcagcgtgttggagagct

SEQ ID NO: 52326 - DNA, 25 bp, mus musculus
ccactgcctccggagccagaaagtg

SEQ ID NO: 52327 - DNA, 25 bp, mus musculus
gagactgtctgcatgcctcactggg

SEQ ID NO: 52328 - DNA, 25 bp, mus musculus
gtctgcatgcctcactgggcatctt

SEQ ID NO: 52329 - DNA, 25 bp, mus musculus
cactgggcatcttagacttggtcac

SEQ ID NO: 52330 - DNA, 25 bp, mus musculus
gcatcttagacttggtcacagagga

SEQ ID NO: 52331 - DNA, 25 bp, mus musculus
agctctctaagttttgtaccattag

SEQ ID NO: 52332 - DNA, 25 bp, mus musculus
tttgtaccattagtgaaggggtctg

SEQ ID NO: 52333 - DNA, 25 bp, mus musculus
gggtctgtgaccctattccatacac

SEQ ID NO: 52334 - DNA, 25 bp, mus musculus
gtgaccctattccatacacatcgtg

SEQ ID NO: 52335 - DNA, 25 bp, mus musculus
ctattccatacacatcgtggggata

SEQ ID NO: 52336 - DNA, 25 bp, mus musculus
catacacatcgtggggatacaaggc

SEQ ID NO: 52337 - DNA, 25 bp, mus musculus
cctccggagccagaaagtggaactg

SEQ ID NO: 52338 - DNA, 25 bp, mus musculus
gtttggctttcctgctgctcatgaa

SEQ ID NO: 52339 - DNA, 25 bp, mus musculus
ctttcctgctgctcatgaaggactt

SEQ ID NO: 52340 - DNA, 25 bp, mus musculus
gtcgtagaccactaagccatactcc

SEQ ID NO: 52341 - DNA, 25 bp, mus musculus
gaccactaagccatactccccagga

SEQ ID NO: 52342 - DNA, 25 bp, mus musculus
taagccatactccccaggaacaggg

SEQ ID NO: 52343 - DNA, 25 bp, mus musculus
gggtttcccagactgaaggagctgg

SEQ ID NO: 52344 - DNA, 25 bp, mus musculus
ctgccggagactgtctgcatgcctc

SEQ ID NO: 52345 - DNA, 25 bp, mus musculus
tgacgattccatgcgtatgtcccac

SEQ ID NO: 52346 - DNA, 25 bp, mus musculus
cgattccatgcgtatgtcccaccta

SEQ ID NO: 52347 - DNA, 25 bp, mus musculus
agaccttagcctactcacagccact

SEQ ID NO: 52348 - DNA, 25 bp, mus musculus
ccttagcctactcacagccactgtg

SEQ ID NO: 52349 - DNA, 25 bp, mus musculus
actcacagccactgtggtgccacct

SEQ ID NO: 52350 - DNA, 25 bp, mus musculus
cacagccactgtggtgccaccttcg

SEQ ID NO: 52351 - DNA, 25 bp, mus musculus
cactgtggtgccaccttcgggtcga

SEQ ID NO: 52352 - DNA, 25 bp, mus musculus
agaggaaccctgtctgctgaaacgt

SEQ ID NO: 52353 - DNA, 25 bp, mus musculus
ttccttcgtgcccaaggagaccagg

SEQ ID NO: 52354 - DNA, 25 bp, mus musculus
acaacctggtacatttgaagaagat

SEQ ID NO: 52355 - DNA, 25 bp, mus musculus
agattggccagcatgttggcaagca

SEQ ID NO: 52356 - DNA, 25 bp, mus musculus
atcccagtagtgatcagccagttga

SEQ ID NO: 52357 - DNA, 25 bp, mus musculus
catgcgtatgtcccacctaaaggtg

SEQ ID NO: 52358 - DNA, 25 bp, mus musculus
gcgtatgtcccacctaaaggtggtg

SEQ ID NO: 52359 - DNA, 25 bp, mus musculus
tgctgctgatatccccatcaatatc

SEQ ID NO: 52360 - DNA, 25 bp, mus musculus
tgatatccccatcaatatctcagaa

SEQ ID NO: 52361 - DNA, 25 bp, mus musculus
tatccccatcaatatctcagaaaca

SEQ ID NO: 52362 - DNA, 25 bp, mus musculus
caatatctcagaaacagaccttagc

SEQ ID NO: 52363 - DNA, 25 bp, mus musculus
tatctcagaaacagaccttagccta

SEQ ID NO: 52364 - DNA, 25 bp, mus musculus
ctcagaaacagaccttagcctactc

SEQ ID NO: 52365 - DNA, 25 bp, mus musculus
ttctccctgggttactgccccactg

SEQ ID NO: 52366 - DNA, 25 bp, mus musculus
ctgcaccacactaagcccgacaaat

SEQ ID NO: 52367 - DNA, 25 bp, mus musculus
acaggcctgtcaaactctgggagag

SEQ ID NO: 52368 - DNA, 25 bp, mus musculus
ctgtcaaactctgggagagacaccc

SEQ ID NO: 52369 - DNA, 25 bp, mus musculus
gacacccacgtggccctgacaggga

SEQ ID NO: 52370 - DNA, 25 bp, mus musculus
gccctgacagggagatgctggccag

SEQ ID NO: 52371 - DNA, 25 bp, mus musculus
agcagcattgtggggctgccctcca

SEQ ID NO: 52372 - DNA, 25 bp, mus musculus
tgtgtctgacagacttgaaggactt

SEQ ID NO: 52373 - DNA, 25 bp, mus musculus
cctaaccagtgctggcagatgcttc

SEQ ID NO: 52374 - DNA, 25 bp, mus musculus
aaccagtgctggcagatgcttcaat

SEQ ID NO: 52375 - DNA, 25 bp, mus musculus
caattagatttctctggaggcttct

SEQ ID NO: 52376 - DNA, 25 bp, mus musculus
ttagatttctctggaggcttctgct

SEQ ID NO: 52377 - DNA, 25 bp, mus musculus
ctcaagttcgcctattgtggcaagt

SEQ ID NO: 52378 - DNA, 25 bp, mus musculus
tcatctgtcttgagctgtgacattt

SEQ ID NO: 52379 - DNA, 25 bp, mus musculus
tctgtcttgagctgtgacatttcag

SEQ ID NO: 52380 - DNA, 25 bp, mus musculus
gacatttcagcggatgacaaatata

SEQ ID NO: 52381 - DNA, 25 bp, mus musculus
tatattgtaacaggctctggtgaca

SEQ ID NO: 52382 - DNA, 25 bp, mus musculus
attgtaacaggctctggtgacaaga

SEQ ID NO: 52383 - DNA, 25 bp, mus musculus
gtttacgaggtcatctactgaacaa

SEQ ID NO: 52384 - DNA, 25 bp, mus musculus
aggactctaacaggcctgtcaaact

SEQ ID NO: 52385 - DNA, 25 bp, mus musculus
tgtagcctcctttctccagcgagga

SEQ ID NO: 52386 - DNA, 25 bp, mus musculus
tagcctcctttctccagcgaggaaa

SEQ ID NO: 52387 - DNA, 25 bp, mus musculus
agctctgcggtattccggccgcctg

SEQ ID NO: 52388 - DNA, 25 bp, mus musculus
gccgcctgcggaatctggattggaa

SEQ ID NO: 52389 - DNA, 25 bp, mus musculus
ccgcctgcggaatctggattggaac

SEQ ID NO: 52390 - DNA, 25 bp, mus musculus
cgcctgcggaatctggattggaacc

SEQ ID NO: 52391 - DNA, 25 bp, mus musculus
gcctgcggaatctggattggaacct

SEQ ID NO: 52392 - DNA, 25 bp, mus musculus
cctgcggaatctggattggaacctg

SEQ ID NO: 52393 - DNA, 25 bp, mus musculus
gcctcctttctccagcgaggaaacg

SEQ ID NO: 52394 - DNA, 25 bp, mus musculus
cggcctacgaaaccttagctctgcg

SEQ ID NO: 52395 - DNA, 25 bp, mus musculus
ggcctacgaaaccttagctctgcgg

SEQ ID NO: 52396 - DNA, 25 bp, mus musculus
gcctacgaaaccttagctctgcggt

SEQ ID NO: 52397 - DNA, 25 bp, mus musculus
ctacgaaaccttagctctgcggtat

SEQ ID NO: 52398 - DNA, 25 bp, mus musculus
tacgaaaccttagctctgcggtatt

SEQ ID NO: 52399 - DNA, 25 bp, mus musculus
gaaaccttagctctgcggtattccg

SEQ ID NO: 52400 - DNA, 25 bp, mus musculus
ccttagctctgcggtattccggccg

SEQ ID NO: 52401 - DNA, 25 bp, mus musculus
attttgcctgtcagtctatattgct

SEQ ID NO: 52402 - DNA, 25 bp, mus musculus
tatacatcagattctttgtataact

SEQ ID NO: 52403 - DNA, 25 bp, mus musculus
gttaatgctacctccttgtgatcac

SEQ ID NO: 52404 - DNA, 25 bp, mus musculus
tccttgtgatcacagtacccaggtc

SEQ ID NO: 52405 - DNA, 25 bp, mus musculus
ttgtgatcacagtacccaggtcgct

SEQ ID NO: 52406 - DNA, 25 bp, mus musculus
tcacagtacccaggtcgcttagtca

SEQ ID NO: 52407 - DNA, 25 bp, mus musculus
cagtacccaggtcgcttagtcaagt

SEQ ID NO: 52408 - DNA, 25 bp, mus musculus
tacccaggtcgcttagtcaagttgt

SEQ ID NO: 52409 - DNA, 25 bp, mus musculus
aaatgtgtctcccacagtaggctca

SEQ ID NO: 52410 - DNA, 25 bp, mus musculus
gtctcccacagtaggctcattggtt

SEQ ID NO: 52411 - DNA, 25 bp, mus musculus
agtaggctcattggttgtggtgttg

SEQ ID NO: 52412 - DNA, 25 bp, mus musculus
tgtagttggattctccctgtaatat

SEQ ID NO: 52413 - DNA, 25 bp, mus musculus
tagctcatacttttcaagacacccc

SEQ ID NO: 52414 - DNA, 25 bp, mus musculus
ccagtgctgaggtgctaggtaaaca

SEQ ID NO: 52415 - DNA, 25 bp, mus musculus
gacacaatcctacagtgctattttt

SEQ ID NO: 52416 - DNA, 25 bp, mus musculus
ttcaggtatctgagactctgaactc

SEQ ID NO: 52417 - DNA, 25 bp, mus musculus
ctgagactctgaactcctgactcag

SEQ ID NO: 52418 - DNA, 25 bp, mus musculus
ctctgaactcctgactcagtagatt

SEQ ID NO: 52419 - DNA, 25 bp, mus musculus
ggctgccaggaatttgcaggtgtta

SEQ ID NO: 52420 - DNA, 25 bp, mus musculus
ggtgttaatgctacctccttgtgat

SEQ ID NO: 52421 - DNA, 25 bp, mus musculus
atcctcttggcttttgccgcagttg

SEQ ID NO: 52422 - DNA, 25 bp, mus musculus
ttggcttttgccgcagttgaattca

SEQ ID NO: 52423 - DNA, 25 bp, mus musculus
ttttccctgtgttgtgagactttgc

SEQ ID NO: 52424 - DNA, 25 bp, mus musculus
tccctgtgttgtgagactttgcacc

SEQ ID NO: 52425 - DNA, 25 bp, mus musculus
ctttctgcttttgtaaggaaatgtg

SEQ ID NO: 52426 - DNA, 25 bp, mus musculus
gctaacgtcatcacatgatgtcagt

SEQ ID NO: 52427 - DNA, 25 bp, mus musculus
gtcatcacatgatgtcagtgtttac

SEQ ID NO: 52428 - DNA, 25 bp, mus musculus
agcaaactgcactctctccgaaggg

SEQ ID NO: 52429 - DNA, 25 bp, mus musculus
aaactgcactctctccgaagggatt

SEQ ID NO: 52430 - DNA, 25 bp, mus musculus
cactctctccgaagggattttacag

SEQ ID NO: 52431 - DNA, 25 bp, mus musculus
aggactgttctcagcatagctgaga

SEQ ID NO: 52432 - DNA, 25 bp, mus musculus
gagataaactcttcagtgtttgaga

SEQ ID NO: 52433 - DNA, 25 bp, mus musculus
tttgccgcagttgaattcatcttgt

SEQ ID NO: 52434 - DNA, 25 bp, mus musculus
gaattcatcttgtgtctcattcaag

SEQ ID NO: 52435 - DNA, 25 bp, mus musculus
ttcatcttgtgtctcattcaagtaa

SEQ ID NO: 52436 - DNA, 25 bp, mus musculus
atgctcggaggcttatgtggctatt

SEQ ID NO: 52437 - DNA, 25 bp, mus musculus
ttatgtggctattgctgctctcgcc

SEQ ID NO: 52438 - DNA, 25 bp, mus musculus
tgctgctctcgccaacagcaatata

SEQ ID NO: 52439 - DNA, 25 bp, mus musculus
tgctctcgccaacagcaatataact

SEQ ID NO: 52440 - DNA, 25 bp, mus musculus
tctcgccaacagcaatataactgct

SEQ ID NO: 52441 - DNA, 25 bp, mus musculus
tttccagtgcggtgtatgactacag

SEQ ID NO: 52442 - DNA, 25 bp, mus musculus
cacacacacacacttaagagactca

SEQ ID NO: 52443 - DNA, 25 bp, mus musculus
cttttgcaaggttccacagactaag

SEQ ID NO: 52444 - DNA, 25 bp, mus musculus
attgggtctattccagctcattcat

SEQ ID NO: 52445 - DNA, 25 bp, mus musculus
gtattaaaacacttctgtcctgtga

SEQ ID NO: 52446 - DNA, 25 bp, mus musculus
tgtcctgtgaggttttcccaatggt

SEQ ID NO: 52447 - DNA, 25 bp, mus musculus
gtttacccatatgcccacatttagt

SEQ ID NO: 52448 - DNA, 25 bp, mus musculus
tacccatatgcccacatttagtctc

SEQ ID NO: 52449 - DNA, 25 bp, mus musculus
gcccacatttagtctctttattcct

SEQ ID NO: 52450 - DNA, 25 bp, mus musculus
cacatttagtctctttattcctagt

SEQ ID NO: 52451 - DNA, 25 bp, mus musculus
tattcctagttggtgagaaacctgt

SEQ ID NO: 52452 - DNA, 25 bp, mus musculus
aacctgtatctttctatgctgcttt

SEQ ID NO: 52453 - DNA, 25 bp, mus musculus
acacacacacttaagagactcagcc

SEQ ID NO: 52454 - DNA, 25 bp, mus musculus
cacacacttaagagactcagcctgc

SEQ ID NO: 52455 - DNA, 25 bp, mus musculus
aagagactcagcctgcagttaatta

SEQ ID NO: 52456 - DNA, 25 bp, mus musculus
gcttccaagtcagccagctgcccta

SEQ ID NO: 52457 - DNA, 25 bp, mus musculus
tccaagtcagccagctgccctaaat

SEQ ID NO: 52458 - DNA, 25 bp, mus musculus
gccagctgccctaaataacccttca

SEQ ID NO: 52459 - DNA, 25 bp, mus musculus
ttcaacatttcttcacttttgcaag

SEQ ID NO: 52460 - DNA, 25 bp, mus musculus
tcacttttgcaaggttccacagact

SEQ ID NO: 52461 - DNA, 25 bp, mus musculus
ctgaggcaacacgattccgggacta

SEQ ID NO: 52462 - DNA, 25 bp, mus musculus
tgaggcaacacgattccgggactac

SEQ ID NO: 52463 - DNA, 25 bp, mus musculus
ccgggactacacctgagatgaacta

SEQ ID NO: 52464 - DNA, 25 bp, mus musculus
cgggactacacctgagatgaactat

SEQ ID NO: 52465 - DNA, 25 bp, mus musculus
gggactacacctgagatgaactatc

SEQ ID NO: 52466 - DNA, 25 bp, mus musculus
gactacacctgagatgaactatctt

SEQ ID NO: 52467 - DNA, 25 bp, mus musculus
actacacctgagatgaactatcttg

SEQ ID NO: 52468 - DNA, 25 bp, mus musculus
ctacacctgagatgaactatcttgc

SEQ ID NO: 52469 - DNA, 25 bp, mus musculus
atgaactatcttgcagaagcgtctg

SEQ ID NO: 52470 - DNA, 25 bp, mus musculus
tgaactatcttgcagaagcgtctgg

SEQ ID NO: 52471 - DNA, 25 bp, mus musculus
actatcttgcagaagcgtctgggac

SEQ ID NO: 52472 - DNA, 25 bp, mus musculus
ctatcttgcagaagcgtctgggacc

SEQ ID NO: 52473 - DNA, 25 bp, mus musculus
gaggcaacacgattccgggactaca

SEQ ID NO: 52474 - DNA, 25 bp, mus musculus
gcaacacgattccgggactacacct

SEQ ID NO: 52475 - DNA, 25 bp, mus musculus
caacacgattccgggactacacctg

SEQ ID NO: 52476 - DNA, 25 bp, mus musculus
acacgattccgggactacacctgag

SEQ ID NO: 52477 - DNA, 25 bp, mus musculus
cacgattccgggactacacctgaga

SEQ ID NO: 52478 - DNA, 25 bp, mus musculus
acgattccgggactacacctgagat

SEQ ID NO: 52479 - DNA, 25 bp, mus musculus
gattccgggactacacctgagatga

SEQ ID NO: 52480 - DNA, 25 bp, mus musculus
attccgggactacacctgagatgaa

SEQ ID NO: 52481 - DNA, 25 bp, mus musculus
agtgccctggagatgagttgcaaga

SEQ ID NO: 52482 - DNA, 25 bp, mus musculus
gagttgcaagacatccccagtgagg

SEQ ID NO: 52483 - DNA, 25 bp, mus musculus
tgagctgtcttcttttagtacttcc

SEQ ID NO: 52484 - DNA, 25 bp, mus musculus
ctgtcttcttttagtacttcccatg

SEQ ID NO: 52485 - DNA, 25 bp, mus musculus
gtcttcttttagtacttcccatgtg

SEQ ID NO: 52486 - DNA, 25 bp, mus musculus
tcttttagtacttcccatgtgccag

SEQ ID NO: 52487 - DNA, 25 bp, mus musculus
acaaggagtccctccattctacatc

SEQ ID NO: 52488 - DNA, 25 bp, mus musculus
tccattctacatcccacagttcttc

SEQ ID NO: 52489 - DNA, 25 bp, mus musculus
cattctacatcccacagttcttcca

SEQ ID NO: 52490 - DNA, 25 bp, mus musculus
aaacctgcagggtcactcatctaaa

SEQ ID NO: 52491 - DNA, 25 bp, mus musculus
acctgcagggtcactcatctaaagt

SEQ ID NO: 52492 - DNA, 25 bp, mus musculus
tcactcatctaaagtctagtgacct

SEQ ID NO: 52493 - DNA, 25 bp, mus musculus
gttgcaagacatccccagtgaggta

SEQ ID NO: 52494 - DNA, 25 bp, mus musculus
caagacatccccagtgaggtataaa

SEQ ID NO: 52495 - DNA, 25 bp, mus musculus
agtggactttctgctctagatcata

SEQ ID NO: 52496 - DNA, 25 bp, mus musculus
atattctgaagctgagctgtcttct

SEQ ID NO: 52497 - DNA, 25 bp, mus musculus
attctgaagctgagctgtcttcttt

SEQ ID NO: 52498 - DNA, 25 bp, mus musculus
tgaagctgagctgtcttcttttagt

SEQ ID NO: 52499 - DNA, 25 bp, mus musculus
aagctgagctgtcttcttttagtac

SEQ ID NO: 52500 - DNA, 25 bp, mus musculus
gctgagctgtcttcttttagtactt

SEQ ID NO: 52501 - DNA, 25 bp, mus musculus
catccccactataggtgagtccagg

SEQ ID NO: 52502 - DNA, 25 bp, mus musculus
tccccactataggtgagtccaggac

SEQ ID NO: 52503 - DNA, 25 bp, mus musculus
ttctgcctaggcccttatctgtccc

SEQ ID NO: 52504 - DNA, 25 bp, mus musculus
ctgcctaggcccttatctgtccctg

SEQ ID NO: 52505 - DNA, 25 bp, mus musculus
gcctaggcccttatctgtccctgac

SEQ ID NO: 52506 - DNA, 25 bp, mus musculus
aggcccttatctgtccctgaccctg

SEQ ID NO: 52507 - DNA, 25 bp, mus musculus
ctgaccctgacaccagatacagcta

SEQ ID NO: 52508 - DNA, 25 bp, mus musculus
gaccctgacaccagatacagctact

SEQ ID NO: 52509 - DNA, 25 bp, mus musculus
ccctgacaccagatacagctacttg

SEQ ID NO: 52510 - DNA, 25 bp, mus musculus
ctgacaccagatacagctacttgag

SEQ ID NO: 52511 - DNA, 25 bp, mus musculus
gacaccagatacagctacttgagaa

SEQ ID NO: 52512 - DNA, 25 bp, mus musculus
caccagatacagctacttgagaaat

SEQ ID NO: 52513 - DNA, 25 bp, mus musculus
cccactataggtgagtccaggacaa

SEQ ID NO: 52514 - DNA, 25 bp, mus musculus
ccagatacagctacttgagaaatgg

SEQ ID NO: 52515 - DNA, 25 bp, mus musculus
ggaatgtcgctttgagccttgtcgg

SEQ ID NO: 52516 - DNA, 25 bp, mus musculus
aatgtcgctttgagccttgtcgggg

SEQ ID NO: 52517 - DNA, 25 bp, mus musculus
tgtcgctttgagccttgtcggggtc

SEQ ID NO: 52518 - DNA, 25 bp, mus musculus
gctttgagccttgtcggggtctgct

SEQ ID NO: 52519 - DNA, 25 bp, mus musculus
agccttgtcggggtctgctcccact

SEQ ID NO: 52520 - DNA, 25 bp, mus musculus
gggtctgctcccacttctgcctagg

SEQ ID NO: 52521 - DNA, 25 bp, mus musculus
ccacttctgcctaggcccttatctg

SEQ ID NO: 52522 - DNA, 25 bp, mus musculus
ataatgatcaccactctgctgggcc

SEQ ID NO: 52523 - DNA, 25 bp, mus musculus
actctgctgggccaccaagcccgga

SEQ ID NO: 52524 - DNA, 25 bp, mus musculus
cagtacaaaccttcagcgcctctgg

SEQ ID NO: 52525 - DNA, 25 bp, mus musculus
cacttaggaactcctgtactcatcc

SEQ ID NO: 52526 - DNA, 25 bp, mus musculus
ggaactcctgtactcatccttatag

SEQ ID NO: 52527 - DNA, 25 bp, mus musculus
ctcatccttatagccagtgtttgag

SEQ ID NO: 52528 - DNA, 25 bp, mus musculus
cttatagccagtgtttgaggaaaag

SEQ ID NO: 52529 - DNA, 25 bp, mus musculus
ggacaacttcaatcatccaatgcag

SEQ ID NO: 52530 - DNA, 25 bp, mus musculus
cttcaatcatccaatgcaggcttcc

SEQ ID NO: 52531 - DNA, 25 bp, mus musculus
ggtccttcctgcagggaatgaattt

SEQ ID NO: 52532 - DNA, 25 bp, mus musculus
tcctttgcagcccaaagaatttgct

SEQ ID NO: 52533 - DNA, 25 bp, mus musculus
gcagcccaaagaatttgctgttatg

SEQ ID NO: 52534 - DNA, 25 bp, mus musculus
tgagccggtctaacaaggcggcctg

SEQ ID NO: 52535 - DNA, 25 bp, mus musculus
ggagacttcttacattcttctctca

SEQ ID NO: 52536 - DNA, 25 bp, mus musculus
cattcttctctcattgtctccccaa

SEQ ID NO: 52537 - DNA, 25 bp, mus musculus
tctctcattgtctccccaaattgcc

SEQ ID NO: 52538 - DNA, 25 bp, mus musculus
tccccaaattgccacagggccttgg

SEQ ID NO: 52539 - DNA, 25 bp, mus musculus
cacagggccttggctttcagctgcc

SEQ ID NO: 52540 - DNA, 25 bp, mus musculus
gccttggctttcagctgccagtaca

SEQ ID NO: 52541 - DNA, 25 bp, mus musculus
agctgccagtacaaaccttcagcgc

SEQ ID NO: 52542 - DNA, 25 bp, mus musculus
aacgctatcgaagcgctgaaagaat

SEQ ID NO: 52543 - DNA, 25 bp, mus musculus
cgctatcgaagcgctgaaagaatat

SEQ ID NO: 52544 - DNA, 25 bp, mus musculus
atcaaggctcgggacatcgttcctg

SEQ ID NO: 52545 - DNA, 25 bp, mus musculus
caaagtcctgctagacatccgcatc

SEQ ID NO: 52546 - DNA, 25 bp, mus musculus
aaagtcctgctagacatccgcatcc

SEQ ID NO: 52547 - DNA, 25 bp, mus musculus
gtcctgctagacatccgcatcctct

SEQ ID NO: 52548 - DNA, 25 bp, mus musculus
gtgcgaccagtccatcctgacagga

SEQ ID NO: 52549 - DNA, 25 bp, mus musculus
agagtctgtgtctgtcatcaagcac

SEQ ID NO: 52550 - DNA, 25 bp, mus musculus
agtctgtgtctgtcatcaagcacac

SEQ ID NO: 52551 - DNA, 25 bp, mus musculus
gtctgtgtctgtcatcaagcacaca

SEQ ID NO: 52552 - DNA, 25 bp, mus musculus
tgtgtctgtcatcaagcacacagac

SEQ ID NO: 52553 - DNA, 25 bp, mus musculus
tcaagcacacagaccctgtccctga

SEQ ID NO: 52554 - DNA, 25 bp, mus musculus
gctatcgaagcgctgaaagaatatg

SEQ ID NO: 52555 - DNA, 25 bp, mus musculus
agaatatgaacccgagatgggaaag

SEQ ID NO: 52556 - DNA, 25 bp, mus musculus
gaatatgaacccgagatgggaaagg

SEQ ID NO: 52557 - DNA, 25 bp, mus musculus
tgaacccgagatgggaaaggtctat

SEQ ID NO: 52558 - DNA, 25 bp, mus musculus
gtctatcgggctgaccgaaagtcag

SEQ ID NO: 52559 - DNA, 25 bp, mus musculus
ctatcgggctgaccgaaagtcagtg

SEQ ID NO: 52560 - DNA, 25 bp, mus musculus
tatcgggctgaccgaaagtcagtgc

SEQ ID NO: 52561 - DNA, 25 bp, mus musculus
gatcaaggctcgggacatcgttcct

SEQ ID NO: 52562 - DNA, 25 bp, mus musculus
actgctgcagaaatacctgtgtgat

SEQ ID NO: 52563 - DNA, 25 bp, mus musculus
tccacccttgtagtgacttagaaca

SEQ ID NO: 52564 - DNA, 25 bp, mus musculus
gttcttgatgctctatatgatgagg

SEQ ID NO: 52565 - DNA, 25 bp, mus musculus
tcttgatgctctatatgatgaggac

SEQ ID NO: 52566 - DNA, 25 bp, mus musculus
agagccttctacagctgggaacaga

SEQ ID NO: 52567 - DNA, 25 bp, mus musculus
agccttctacagctgggaacagaag

SEQ ID NO: 52568 - DNA, 25 bp, mus musculus
ccttctacagctgggaacagaagga

SEQ ID NO: 52569 - DNA, 25 bp, mus musculus
ttctacagctgggaacagaaggatc

SEQ ID NO: 52570 - DNA, 25 bp, mus musculus
aaggatcctgctgaacacaggcaag

SEQ ID NO: 52571 - DNA, 25 bp, mus musculus
ggatcctgctgaacacaggcaaggg

SEQ ID NO: 52572 - DNA, 25 bp, mus musculus
atcctgctgaacacaggcaagggtg

SEQ ID NO: 52573 - DNA, 25 bp, mus musculus
cctgctgaacacaggcaagggtgtg

SEQ ID NO: 52574 - DNA, 25 bp, mus musculus
gacttagaacagcctgccaacctgc

SEQ ID NO: 52575 - DNA, 25 bp, mus musculus
cttagaacagcctgccaacctgctt

SEQ ID NO: 52576 - DNA, 25 bp, mus musculus
tagaacagcctgccaacctgcttcg

SEQ ID NO: 52577 - DNA, 25 bp, mus musculus
agcctgccaacctgcttcggatgtt

SEQ ID NO: 52578 - DNA, 25 bp, mus musculus
cctgccaacctgcttcggatgttct

SEQ ID NO: 52579 - DNA, 25 bp, mus musculus
tgccaacctgcttcggatgttcttg

SEQ ID NO: 52580 - DNA, 25 bp, mus musculus
ccaacctgcttcggatgttcttgat

SEQ ID NO: 52581 - DNA, 25 bp, mus musculus
tgcttcggatgttcttgatgctcta

SEQ ID NO: 52582 - DNA, 25 bp, mus musculus
aggaaatgtccagcaccgagctgga

SEQ ID NO: 52583 - DNA, 25 bp, mus musculus
gaaatgtccagcaccgagctggaga

SEQ ID NO: 52584 - DNA, 25 bp, mus musculus
gcagagaccggccctactagagacc

SEQ ID NO: 52585 - DNA, 25 bp, mus musculus
agagaccggccctactagagacctg

SEQ ID NO: 52586 - DNA, 25 bp, mus musculus
agaccggccctactagagacctgca

SEQ ID NO: 52587 - DNA, 25 bp, mus musculus
accggccctactagagacctgcaga

SEQ ID NO: 52588 - DNA, 25 bp, mus musculus
cctactagagacctgcagagctgca

SEQ ID NO: 52589 - DNA, 25 bp, mus musculus
tactagagacctgcagagctgcatt

SEQ ID NO: 52590 - DNA, 25 bp, mus musculus
ctagagacctgcagagctgcattga

SEQ ID NO: 52591 - DNA, 25 bp, mus musculus
acctgcagagctgcattgagtacca

SEQ ID NO: 52592 - DNA, 25 bp, mus musculus
ctgcagagctgcattgagtaccaga

SEQ ID NO: 52593 - DNA, 25 bp, mus musculus
tttcaccatttgtggagaaacatta

SEQ ID NO: 52594 - DNA, 25 bp, mus musculus
cagcaccgagctggagactggcagt

SEQ ID NO: 52595 - DNA, 25 bp, mus musculus
gcagtgtcccaatccgggctgtgga

SEQ ID NO: 52596 - DNA, 25 bp, mus musculus
tcccaatccgggctgtggaaaccag

SEQ ID NO: 52597 - DNA, 25 bp, mus musculus
accagaacttcgcttggagaacaga

SEQ ID NO: 52598 - DNA, 25 bp, mus musculus
cagaacttcgcttggagaacagaat

SEQ ID NO: 52599 - DNA, 25 bp, mus musculus
ctcctggacctttaatggaacagat

SEQ ID NO: 52600 - DNA, 25 bp, mus musculus
gagcaccgtcaggaacgcagagacc

SEQ ID NO: 52601 - DNA, 25 bp, mus musculus
gcaccgtcaggaacgcagagaccgg

SEQ ID NO: 52602 - DNA, 25 bp, mus musculus
tgttacgaccttggctgttttcatc

SEQ ID NO: 52603 - DNA, 25 bp, mus musculus
gaccttggctgttttcatccctgct

SEQ ID NO: 52604 - DNA, 25 bp, mus musculus
actgatttcccaacacatcacgact

SEQ ID NO: 52605 - DNA, 25 bp, mus musculus
ttcccaacacatcacgactgaggca

SEQ ID NO: 52606 - DNA, 25 bp, mus musculus
acacatcacgactgaggcattcagg

SEQ ID NO: 52607 - DNA, 25 bp, mus musculus
tttaactcgttccaatatgccttat

SEQ ID NO: 52608 - DNA, 25 bp, mus musculus
tcgttccaatatgccttataaacca

SEQ ID NO: 52609 - DNA, 25 bp, mus musculus
atttaacctgattctgtgaaagttg

SEQ ID NO: 52610 - DNA, 25 bp, mus musculus
tgccctaggctgtagagtgaaggtc

SEQ ID NO: 52611 - DNA, 25 bp, mus musculus
caccatacacaggtgctttacatgt

SEQ ID NO: 52612 - DNA, 25 bp, mus musculus
ctatatgtttgggttcctgcctatt

SEQ ID NO: 52613 - DNA, 25 bp, mus musculus
ttttgaaagaccctcatcattgatg

SEQ ID NO: 52614 - DNA, 25 bp, mus musculus
tttcatccctgctcagaggatgctc

SEQ ID NO: 52615 - DNA, 25 bp, mus musculus
gatgctcttcatcatgggatgactg

SEQ ID NO: 52616 - DNA, 25 bp, mus musculus
cttcatcatgggatgactgtaattc

SEQ ID NO: 52617 - DNA, 25 bp, mus musculus
gtaattccttctaatccctgcggct

SEQ ID NO: 52618 - DNA, 25 bp, mus musculus
tgcggctccatcctaagccaaacaa

SEQ ID NO: 52619 - DNA, 25 bp, mus musculus
aattagactctaacaagctgttcaa

SEQ ID NO: 52620 - DNA, 25 bp, mus musculus
actctaacaagctgttcaactgatt

SEQ ID NO: 52621 - DNA, 25 bp, mus musculus
tgttcaactgatttcccaacacatc

SEQ ID NO: 52622 - DNA, 25 bp, mus musculus
gagaaaccactggtacagtagccat

SEQ ID NO: 52623 - DNA, 25 bp, mus musculus
gaaaccactggtacagtagccatgt

SEQ ID NO: 52624 - DNA, 25 bp, mus musculus
tcttgactgttgttgctggcatcaa

SEQ ID NO: 52625 - DNA, 25 bp, mus musculus
ttgactgttgttgctggcatcaagt

SEQ ID NO: 52626 - DNA, 25 bp, mus musculus
ttgctggcatcaagtgcaatgggac

SEQ ID NO: 52627 - DNA, 25 bp, mus musculus
gaaaccatggtttgcccggcagaga

SEQ ID NO: 52628 - DNA, 25 bp, mus musculus
ccatggtttgcccggcagagatggg

SEQ ID NO: 52629 - DNA, 25 bp, mus musculus
tggacctccaggtcccatgggccct

SEQ ID NO: 52630 - DNA, 25 bp, mus musculus
caggtcccatgggccctcctggagg

SEQ ID NO: 52631 - DNA, 25 bp, mus musculus
tcccatgggccctcctggaggaatg

SEQ ID NO: 52632 - DNA, 25 bp, mus musculus
atgggccctcctggaggaatgccag

SEQ ID NO: 52633 - DNA, 25 bp, mus musculus
cctcctggaggaatgccaggtcttc

SEQ ID NO: 52634 - DNA, 25 bp, mus musculus
aaccactggtacagtagccatgtca

SEQ ID NO: 52635 - DNA, 25 bp, mus musculus
ccactggtacagtagccatgtcact

SEQ ID NO: 52636 - DNA, 25 bp, mus musculus
gtacagtagccatgtcactaggctc

SEQ ID NO: 52637 - DNA, 25 bp, mus musculus
agtagccatgtcactaggctctttg

SEQ ID NO: 52638 - DNA, 25 bp, mus musculus
tagccatgtcactaggctctttggc

SEQ ID NO: 52639 - DNA, 25 bp, mus musculus
ttcaccctcttcttgactgttgttg

SEQ ID NO: 52640 - DNA, 25 bp, mus musculus
caccctcttcttgactgttgttgct

SEQ ID NO: 52641 - DNA, 25 bp, mus musculus
ctcttcttgactgttgttgctggca

SEQ ID NO: 52642 - DNA, 25 bp, mus musculus
ggtctgcagtctccgatacagagac

SEQ ID NO: 52643 - DNA, 25 bp, mus musculus
cagtctccgatacagagaccattca

SEQ ID NO: 52644 - DNA, 25 bp, mus musculus
tcatcgagctggacagctgaccaga

SEQ ID NO: 52645 - DNA, 25 bp, mus musculus
agctggacagctgaccagagactca

SEQ ID NO: 52646 - DNA, 25 bp, mus musculus
actcagatcagactatggcatacca

SEQ ID NO: 52647 - DNA, 25 bp, mus musculus
atctcctctgatggtcagttgtgcc

SEQ ID NO: 52648 - DNA, 25 bp, mus musculus
atggtcagttgtgccctcttcggcg

SEQ ID NO: 52649 - DNA, 25 bp, mus musculus
gtgccctcttcggcgtcctgtggac

SEQ ID NO: 52650 - DNA, 25 bp, mus musculus
cggaacgctgcgcctctggtgatct

SEQ ID NO: 52651 - DNA, 25 bp, mus musculus
tgcgcctctggtgatctcagaacgg

SEQ ID NO: 52652 - DNA, 25 bp, mus musculus
cgcctctggtgatctcagaacggtc

SEQ ID NO: 52653 - DNA, 25 bp, mus musculus
cctctggtgatctcagaacggtcac

SEQ ID NO: 52654 - DNA, 25 bp, mus musculus
gtctccgatacagagaccattcatc

SEQ ID NO: 52655 - DNA, 25 bp, mus musculus
ctccgatacagagaccattcatcga

SEQ ID NO: 52656 - DNA, 25 bp, mus musculus
gatacagagaccattcatcgagctg

SEQ ID NO: 52657 - DNA, 25 bp, mus musculus
tacagagaccattcatcgagctgga

SEQ ID NO: 52658 - DNA, 25 bp, mus musculus
cagagaccattcatcgagctggaca

SEQ ID NO: 52659 - DNA, 25 bp, mus musculus
gagaccattcatcgagctggacagc

SEQ ID NO: 52660 - DNA, 25 bp, mus musculus
ccattcatcgagctggacagctgac

SEQ ID NO: 52661 - DNA, 25 bp, mus musculus
attcatcgagctggacagctgacca

SEQ ID NO: 52662 - DNA, 25 bp, mus musculus
ccagccatgaacatgacctgatcgc

SEQ ID NO: 52663 - DNA, 25 bp, mus musculus
cagccatgaacatgacctgatcgcc

SEQ ID NO: 52664 - DNA, 25 bp, mus musculus
tgggaccctgatctggggaaccatt

SEQ ID NO: 52665 - DNA, 25 bp, mus musculus
gaccctgatctggggaaccattctg

SEQ ID NO: 52666 - DNA, 25 bp, mus musculus
atctggggaaccattctgggactgg

SEQ ID NO: 52667 - DNA, 25 bp, mus musculus
ccgctggtgtggccgctgatactgt

SEQ ID NO: 52668 - DNA, 25 bp, mus musculus
tgtggccgctgatactgtgcgctgc

SEQ ID NO: 52669 - DNA, 25 bp, mus musculus
tggccgctgatactgtgcgctgcgc

SEQ ID NO: 52670 - DNA, 25 bp, mus musculus
ggccgctgatactgtgcgctgcgct

SEQ ID NO: 52671 - DNA, 25 bp, mus musculus
ccgctgatactgtgcgctgcgctgc

SEQ ID NO: 52672 - DNA, 25 bp, mus musculus
cgctgatactgtgcgctgcgctgcc

SEQ ID NO: 52673 - DNA, 25 bp, mus musculus
atactgtgcgctgcgctgcccgtcc

SEQ ID NO: 52674 - DNA, 25 bp, mus musculus
gccatgaacatgacctgatcgccgg

SEQ ID NO: 52675 - DNA, 25 bp, mus musculus
atgaacatgacctgatcgccggttc

SEQ ID NO: 52676 - DNA, 25 bp, mus musculus
tgaacatgacctgatcgccggttcc

SEQ ID NO: 52677 - DNA, 25 bp, mus musculus
acatgacctgatcgccggttcctct

SEQ ID NO: 52678 - DNA, 25 bp, mus musculus
atgacctgatcgccggttcctcttc

SEQ ID NO: 52679 - DNA, 25 bp, mus musculus
cttctcgctgtctgggaccctgatc

SEQ ID NO: 52680 - DNA, 25 bp, mus musculus
ctgtctgggaccctgatctggggaa

SEQ ID NO: 52681 - DNA, 25 bp, mus musculus
tctgggaccctgatctggggaacca

SEQ ID NO: 52682 - DNA, 25 bp, mus musculus
acatctaaggctgcaagggcaaatg

SEQ ID NO: 52683 - DNA, 25 bp, mus musculus
agggcaaatgcggcctcaatgaggg

SEQ ID NO: 52684 - DNA, 25 bp, mus musculus
atacttgtctgcacagacatcgcct

SEQ ID NO: 52685 - DNA, 25 bp, mus musculus
ggcctagacagtgtccacgtggaag

SEQ ID NO: 52686 - DNA, 25 bp, mus musculus
ctagacagtgtccacgtggaagtgg

SEQ ID NO: 52687 - DNA, 25 bp, mus musculus
agtgtccacgtggaagtggttatca

SEQ ID NO: 52688 - DNA, 25 bp, mus musculus
cctaccctgcaggattacatccaca

SEQ ID NO: 52689 - DNA, 25 bp, mus musculus
accctgcaggattacatccacagag

SEQ ID NO: 52690 - DNA, 25 bp, mus musculus
ctgcaggattacatccacagagcag

SEQ ID NO: 52691 - DNA, 25 bp, mus musculus
caggattacatccacagagcaggaa

SEQ ID NO: 52692 - DNA, 25 bp, mus musculus
gattacatccacagagcaggaaggg

SEQ ID NO: 52693 - DNA, 25 bp, mus musculus
tacatccacagagcaggaagggtgg

SEQ ID NO: 52694 - DNA, 25 bp, mus musculus
gcaaatgcggcctcaatgagggcag

SEQ ID NO: 52695 - DNA, 25 bp, mus musculus
aatgcggcctcaatgagggcaggta

SEQ ID NO: 52696 - DNA, 25 bp, mus musculus
atcttccagagtttccagaagggct

SEQ ID NO: 52697 - DNA, 25 bp, mus musculus
ttccagaagggctcccagaacatac

SEQ ID NO: 52698 - DNA, 25 bp, mus musculus
aagggctcccagaacatacttgtct

SEQ ID NO: 52699 - DNA, 25 bp, mus musculus
ggctcccagaacatacttgtctgca

SEQ ID NO: 52700 - DNA, 25 bp, mus musculus
tcccagaacatacttgtctgcacag

SEQ ID NO: 52701 - DNA, 25 bp, mus musculus
aacatacttgtctgcacagacatcg

SEQ ID NO: 52702 - DNA, 25 bp, mus musculus
gcagctagtgcagctcagaacacac

SEQ ID NO: 52703 - DNA, 25 bp, mus musculus
gctcagaacacaccaagtggtacca

SEQ ID NO: 52704 - DNA, 25 bp, mus musculus
gctggcctcaacgttggctcattgg

SEQ ID NO: 52705 - DNA, 25 bp, mus musculus
atggctgctttgaatggtggtctgg

SEQ ID NO: 52706 - DNA, 25 bp, mus musculus
ggtctgggcagcagtggcctttcca

SEQ ID NO: 52707 - DNA, 25 bp, mus musculus
acccaggcgtattctggtatcagca

SEQ ID NO: 52708 - DNA, 25 bp, mus musculus
atcagcaatatgctgctgctgcagc

SEQ ID NO: 52709 - DNA, 25 bp, mus musculus
atttattgacacagcagagtattgg

SEQ ID NO: 52710 - DNA, 25 bp, mus musculus
aaggagccaacctgttcatctatca

SEQ ID NO: 52711 - DNA, 25 bp, mus musculus
gagaccaggacttactgcagatgtt

SEQ ID NO: 52712 - DNA, 25 bp, mus musculus
aggacttactgcagatgtttatgcc

SEQ ID NO: 52713 - DNA, 25 bp, mus musculus
ttatgccctttgggaatgtcgtgtc

SEQ ID NO: 52714 - DNA, 25 bp, mus musculus
aacacaccaagtggtaccaatgctc

SEQ ID NO: 52715 - DNA, 25 bp, mus musculus
ggtaccaatgctctcactacatcca

SEQ ID NO: 52716 - DNA, 25 bp, mus musculus
tcaccgagctccagcagcagtaatt

SEQ ID NO: 52717 - DNA, 25 bp, mus musculus
agctccagcagcagtaattctgtca

SEQ ID NO: 52718 - DNA, 25 bp, mus musculus
atagcctcacttggagccctgcaaa

SEQ ID NO: 52719 - DNA, 25 bp, mus musculus
tcacttggagccctgcaaacattgg

SEQ ID NO: 52720 - DNA, 25 bp, mus musculus
ggagccctgcaaacattggccggag

SEQ ID NO: 52721 - DNA, 25 bp, mus musculus
acattggccggagcaacagctggcc

SEQ ID NO: 52722 - DNA, 25 bp, mus musculus
tcctgtggattctcccatcagccat

SEQ ID NO: 52723 - DNA, 25 bp, mus musculus
ggattctcccatcagccatttggtc

SEQ ID NO: 52724 - DNA, 25 bp, mus musculus
gaattcttagtctcttgtgctgtgc

SEQ ID NO: 52725 - DNA, 25 bp, mus musculus
gctgtgcctagtggcacctgggctg

SEQ ID NO: 52726 - DNA, 25 bp, mus musculus
gacattgccccatctgggtttttat

SEQ ID NO: 52727 - DNA, 25 bp, mus musculus
tcttactcaagttcaaacctccagc

SEQ ID NO: 52728 - DNA, 25 bp, mus musculus
tcaagttcaaacctccagcttgtga

SEQ ID NO: 52729 - DNA, 25 bp, mus musculus
tcaaacctccagcttgtgaaatcaa

SEQ ID NO: 52730 - DNA, 25 bp, mus musculus
aaatcaaccatgtccctgacttgat

SEQ ID NO: 52731 - DNA, 25 bp, mus musculus
accatgtccctgacttgataagcaa

SEQ ID NO: 52732 - DNA, 25 bp, mus musculus
tccctgacttgataagcaagtgtta

SEQ ID NO: 52733 - DNA, 25 bp, mus musculus
atgtgaaacaacttcttgttgtctt

SEQ ID NO: 52734 - DNA, 25 bp, mus musculus
ttctcccatcagccatttggtctta

SEQ ID NO: 52735 - DNA, 25 bp, mus musculus
tcccatcagccatttggtcttactc

SEQ ID NO: 52736 - DNA, 25 bp, mus musculus
cagccatttggtcttactcttaagg

SEQ ID NO: 52737 - DNA, 25 bp, mus musculus
cttactcttaaggccagttgaagat

SEQ ID NO: 52738 - DNA, 25 bp, mus musculus
gcaattgctgggtttccaattcttt

SEQ ID NO: 52739 - DNA, 25 bp, mus musculus
gcttatactcccaaaccctgagtgt

SEQ ID NO: 52740 - DNA, 25 bp, mus musculus
tccagcctttcccctgttgaattct

SEQ ID NO: 52741 - DNA, 25 bp, mus musculus
tcccctgttgaattcttagtctctt

SEQ ID NO: 52742 - DNA, 25 bp, mus musculus
catttgtagtggtctcgtcgtcagc

SEQ ID NO: 52743 - DNA, 25 bp, mus musculus
tttgtagtggtctcgtcgtcagcgc

SEQ ID NO: 52744 - DNA, 25 bp, mus musculus
gctctacacacaagcaactatgact

SEQ ID NO: 52745 - DNA, 25 bp, mus musculus
ttgatatcagcaccagatacgtcct

SEQ ID NO: 52746 - DNA, 25 bp, mus musculus
gatatcagcaccagatacgtcctgt

SEQ ID NO: 52747 - DNA, 25 bp, mus musculus
agatacgtcctgtgtgggtgtcttc

SEQ ID NO: 52748 - DNA, 25 bp, mus musculus
agattaatctggggatgcggccaag

SEQ ID NO: 52749 - DNA, 25 bp, mus musculus
attaatctggggatgcggccaagaa

SEQ ID NO: 52750 - DNA, 25 bp, mus musculus
aacctcaccaacacagtgtttagat

SEQ ID NO: 52751 - DNA, 25 bp, mus musculus
cctcaccaacacagtgtttagatgc

SEQ ID NO: 52752 - DNA, 25 bp, mus musculus
tcaccaacacagtgtttagatgcca

SEQ ID NO: 52753 - DNA, 25 bp, mus musculus
accaacacagtgtttagatgccaaa

SEQ ID NO: 52754 - DNA, 25 bp, mus musculus
tagtggtctcgtcgtcagcgcactg

SEQ ID NO: 52755 - DNA, 25 bp, mus musculus
gtcgtcagcgcactgagctctacac

SEQ ID NO: 52756 - DNA, 25 bp, mus musculus
cgtcagcgcactgagctctacacac

SEQ ID NO: 52757 - DNA, 25 bp, mus musculus
tcagcgcactgagctctacacacaa

SEQ ID NO: 52758 - DNA, 25 bp, mus musculus
agcgcactgagctctacacacaagc

SEQ ID NO: 52759 - DNA, 25 bp, mus musculus
cactgagctctacacacaagcaact

SEQ ID NO: 52760 - DNA, 25 bp, mus musculus
ctgagctctacacacaagcaactat

SEQ ID NO: 52761 - DNA, 25 bp, mus musculus
gagctctacacacaagcaactatga

SEQ ID NO: 52762 - DNA, 25 bp, mus musculus
ttttctaccgtgtggcatttgccac

SEQ ID NO: 52763 - DNA, 25 bp, mus musculus
tcgtttctccattaaattctcatat

SEQ ID NO: 52764 - DNA, 25 bp, mus musculus
gggccatcctgactctgcggaccgc

SEQ ID NO: 52765 - DNA, 25 bp, mus musculus
tcctgactctgcggaccgcaccggg

SEQ ID NO: 52766 - DNA, 25 bp, mus musculus
gcactgactgtctgttttccaagac

SEQ ID NO: 52767 - DNA, 25 bp, mus musculus
tgttttccaagacgaaaatgatgct

SEQ ID NO: 52768 - DNA, 25 bp, mus musculus
tttgacttttctgcagctgtcagtg

SEQ ID NO: 52769 - DNA, 25 bp, mus musculus
ttttctgcagctgtcagtgtgaaga

SEQ ID NO: 52770 - DNA, 25 bp, mus musculus
acaccaacctggtaaaaatgctgct

SEQ ID NO: 52771 - DNA, 25 bp, mus musculus
tcttgatgctctcctgatcccacaa

SEQ ID NO: 52772 - DNA, 25 bp, mus musculus
tgctctcctgatcccacaattaaac

SEQ ID NO: 52773 - DNA, 25 bp, mus musculus
cctgatcccacaattaaactgcacg

SEQ ID NO: 52774 - DNA, 25 bp, mus musculus
tttattgcattgctgggaaagaccc

SEQ ID NO: 52775 - DNA, 25 bp, mus musculus
agtttctagactcaatacacaggct

SEQ ID NO: 52776 - DNA, 25 bp, mus musculus
tagactcaatacacaggctgctggc

SEQ ID NO: 52777 - DNA, 25 bp, mus musculus
caatacacaggctgctggctggagc

SEQ ID NO: 52778 - DNA, 25 bp, mus musculus
tgctggctggagcccctttttgtct

SEQ ID NO: 52779 - DNA, 25 bp, mus musculus
cagcagacactgtagcccgtggccc

SEQ ID NO: 52780 - DNA, 25 bp, mus musculus
cggctgccccatgatgcagggccat

SEQ ID NO: 52781 - DNA, 25 bp, mus musculus
ccccatgatgcagggccatcctgac

SEQ ID NO: 52782 - DNA, 25 bp, mus musculus
tctccacttcaccgaacatctaaga

SEQ ID NO: 52783 - DNA, 25 bp, mus musculus
ctccacttcaccgaacatctaagag

SEQ ID NO: 52784 - DNA, 25 bp, mus musculus
atctaagagagtcgcgccgccgcga

SEQ ID NO: 52785 - DNA, 25 bp, mus musculus
cagatcgactggatggcgagacata

SEQ ID NO: 52786 - DNA, 25 bp, mus musculus
agatcgactggatggcgagacatag

SEQ ID NO: 52787 - DNA, 25 bp, mus musculus
acatagggctgtggtttctgcttct

SEQ ID NO: 52788 - DNA, 25 bp, mus musculus
acggtaccaccagaggaggtgtgca

SEQ ID NO: 52789 - DNA, 25 bp, mus musculus
cggtaccaccagaggaggtgtgcag

SEQ ID NO: 52790 - DNA, 25 bp, mus musculus
gtaccaccagaggaggtgtgcagct

SEQ ID NO: 52791 - DNA, 25 bp, mus musculus
taccaccagaggaggtgtgcagctc

SEQ ID NO: 52792 - DNA, 25 bp, mus musculus
accaccagaggaggtgtgcagctcc

SEQ ID NO: 52793 - DNA, 25 bp, mus musculus
ccaccagaggaggtgtgcagctccg

SEQ ID NO: 52794 - DNA, 25 bp, mus musculus
tccacttcaccgaacatctaagaga

SEQ ID NO: 52795 - DNA, 25 bp, mus musculus
ccacttcaccgaacatctaagagag

SEQ ID NO: 52796 - DNA, 25 bp, mus musculus
cacttcaccgaacatctaagagagt

SEQ ID NO: 52797 - DNA, 25 bp, mus musculus
acttcaccgaacatctaagagagtc

SEQ ID NO: 52798 - DNA, 25 bp, mus musculus
cttcaccgaacatctaagagagtcg

SEQ ID NO: 52799 - DNA, 25 bp, mus musculus
ttcaccgaacatctaagagagtcgc

SEQ ID NO: 52800 - DNA, 25 bp, mus musculus
tcaccgaacatctaagagagtcgcg

SEQ ID NO: 52801 - DNA, 25 bp, mus musculus
catctaagagagtcgcgccgccgcg

SEQ ID NO: 52802 - DNA, 25 bp, mus musculus
aatatcagcaggaactttgtcacca

SEQ ID NO: 52803 - DNA, 25 bp, mus musculus
ctttgtcaccaacagcaatttccac

SEQ ID NO: 52804 - DNA, 25 bp, mus musculus
ctatatcaccaggaactatgtcttt

SEQ ID NO: 52805 - DNA, 25 bp, mus musculus
atatcaccaggaactatgtctttag

SEQ ID NO: 52806 - DNA, 25 bp, mus musculus
atcaccaggaactatgtctttagct

SEQ ID NO: 52807 - DNA, 25 bp, mus musculus
tgtctttagctttaattcgttgcac

SEQ ID NO: 52808 - DNA, 25 bp, mus musculus
tctttagctttaattcgttgcacac

SEQ ID NO: 52809 - DNA, 25 bp, mus musculus
tagctttaattcgttgcacactctt

SEQ ID NO: 52810 - DNA, 25 bp, mus musculus
cagcatttctttcctgcaacaaacc

SEQ ID NO: 52811 - DNA, 25 bp, mus musculus
ttctttcctgcaacaaacccacgat

SEQ ID NO: 52812 - DNA, 25 bp, mus musculus
ctttcctgcaacaaacccacgattg

SEQ ID NO: 52813 - DNA, 25 bp, mus musculus
ttcctgcaacaaacccacgattgca

SEQ ID NO: 52814 - DNA, 25 bp, mus musculus
gtcaccaacagcaatttccactata

SEQ ID NO: 52815 - DNA, 25 bp, mus musculus
cctgcaacaaacccacgattgcatt

SEQ ID NO: 52816 - DNA, 25 bp, mus musculus
caccaacagcaatttccactatatc

SEQ ID NO: 52817 - DNA, 25 bp, mus musculus
aacagcaatttccactatatcacca

SEQ ID NO: 52818 - DNA, 25 bp, mus musculus
cagcaatttccactatatcaccagg

SEQ ID NO: 52819 - DNA, 25 bp, mus musculus
gcaatttccactatatcaccaggaa

SEQ ID NO: 52820 - DNA, 25 bp, mus musculus
aatttccactatatcaccaggaact

SEQ ID NO: 52821 - DNA, 25 bp, mus musculus
tttccactatatcaccaggaactat

SEQ ID NO: 52822 - DNA, 25 bp, mus musculus
tccactatatcaccaggaactatgt

SEQ ID NO: 52823 - DNA, 25 bp, mus musculus
gtccctgttaagtggactgcccctg

SEQ ID NO: 52824 - DNA, 25 bp, mus musculus
tacggacgctactcctcagagagtg

SEQ ID NO: 52825 - DNA, 25 bp, mus musculus
ctcatggagcagtgctgggcctatg

SEQ ID NO: 52826 - DNA, 25 bp, mus musculus
tgctgggcctatgagcctgggcaga

SEQ ID NO: 52827 - DNA, 25 bp, mus musculus
agacctagtttcagcatcatctgcc

SEQ ID NO: 52828 - DNA, 25 bp, mus musculus
agtttcagcatcatctgccaggagc

SEQ ID NO: 52829 - DNA, 25 bp, mus musculus
atctgccaggagctccacagtatcc

SEQ ID NO: 52830 - DNA, 25 bp, mus musculus
caggagctccacagtatccgcaagc

SEQ ID NO: 52831 - DNA, 25 bp, mus musculus
agtatccgcaagcggcatcggtgag

SEQ ID NO: 52832 - DNA, 25 bp, mus musculus
cactcactgctggacagctccaaga

SEQ ID NO: 52833 - DNA, 25 bp, mus musculus
gacagctccaagaccagggttccaa

SEQ ID NO: 52834 - DNA, 25 bp, mus musculus
ttcttcctgcccaaattcctctctt

SEQ ID NO: 52835 - DNA, 25 bp, mus musculus
cgctactcctcagagagtgatgtgt

SEQ ID NO: 52836 - DNA, 25 bp, mus musculus
tttggcattttgctgtgggagacct

SEQ ID NO: 52837 - DNA, 25 bp, mus musculus
gagaccttcagcctgggggcctcac

SEQ ID NO: 52838 - DNA, 25 bp, mus musculus
ctcaccaatcagcagacacgggagt

SEQ ID NO: 52839 - DNA, 25 bp, mus musculus
aatcagcagacacgggagtttgtag

SEQ ID NO: 52840 - DNA, 25 bp, mus musculus
ccttgcccagagctgtgccctgatg

SEQ ID NO: 52841 - DNA, 25 bp, mus musculus
ctgtgccctgatgcggtcttcaggc

SEQ ID NO: 52842 - DNA, 25 bp, mus musculus
ttcaggctcatggagcagtgctggg

SEQ ID NO: 52843 - DNA, 25 bp, mus musculus
atggactgcccggcttggaccatgt

SEQ ID NO: 52844 - DNA, 25 bp, mus musculus
gactgcccggcttggaccatgtaac

SEQ ID NO: 52845 - DNA, 25 bp, mus musculus
tttctattccagtagatccagagtg

SEQ ID NO: 52846 - DNA, 25 bp, mus musculus
ctattccagtagatccagagtggcg

SEQ ID NO: 52847 - DNA, 25 bp, mus musculus
tagatccagagtggcgagataacca

SEQ ID NO: 52848 - DNA, 25 bp, mus musculus
gagataaccaggccagccacgtagc

SEQ ID NO: 52849 - DNA, 25 bp, mus musculus
ataaccaggccagccacgtagccaa

SEQ ID NO: 52850 - DNA, 25 bp, mus musculus
ccagccacgtagccaaaaggtcgct

SEQ ID NO: 52851 - DNA, 25 bp, mus musculus
gccacgtagccaaaaggtcgctccg

SEQ ID NO: 52852 - DNA, 25 bp, mus musculus
tagccaaaaggtcgctccgagtgta

SEQ ID NO: 52853 - DNA, 25 bp, mus musculus
ttgagatctaaaccaaccgatgctt

SEQ ID NO: 52854 - DNA, 25 bp, mus musculus
tctaaaccaaccgatgctttattat

SEQ ID NO: 52855 - DNA, 25 bp, mus musculus
tgcccggcttggaccatgtaacttc

SEQ ID NO: 52856 - DNA, 25 bp, mus musculus
tggaccatgtaacttctgcacaccc

SEQ ID NO: 52857 - DNA, 25 bp, mus musculus
accatgtaacttctgcacaccctta

SEQ ID NO: 52858 - DNA, 25 bp, mus musculus
cttctgcacacccttatggaatctg

SEQ ID NO: 52859 - DNA, 25 bp, mus musculus
ctgcacacccttatggaatctgcac

SEQ ID NO: 52860 - DNA, 25 bp, mus musculus
acccttatggaatctgcacagagaa

SEQ ID NO: 52861 - DNA, 25 bp, mus musculus
tatgtaagctgctttctattccagt

SEQ ID NO: 52862 - DNA, 25 bp, mus musculus
agctgctttctattccagtagatcc

SEQ ID NO: 52863 - DNA, 25 bp, mus musculus
gtatgccgagtacgcgcttccctga

SEQ ID NO: 52864 - DNA, 25 bp, mus musculus
cgagtacgcgcttccctgaagagct

SEQ ID NO: 52865 - DNA, 25 bp, mus musculus
tgagttgcaacctcatcactgtgat

SEQ ID NO: 52866 - DNA, 25 bp, mus musculus
gcaacctcatcactgtgatgtgtca

SEQ ID NO: 52867 - DNA, 25 bp, mus musculus
acctcatcactgtgatgtgtcagcg

SEQ ID NO: 52868 - DNA, 25 bp, mus musculus
tcatcactgtgatgtgtcagcgatt

SEQ ID NO: 52869 - DNA, 25 bp, mus musculus
tcactgtgatgtgtcagcgattgga

SEQ ID NO: 52870 - DNA, 25 bp, mus musculus
agaatgccgttgcgagttgtatcct

SEQ ID NO: 52871 - DNA, 25 bp, mus musculus
ttgcgagttgtatcctcttgggaac

SEQ ID NO: 52872 - DNA, 25 bp, mus musculus
gtatcctcttgggaacgaacaagag

SEQ ID NO: 52873 - DNA, 25 bp, mus musculus
tcctcttgggaacgaacaagagcag

SEQ ID NO: 52874 - DNA, 25 bp, mus musculus
agcttgcgttggcgtcgaattcaga

SEQ ID NO: 52875 - DNA, 25 bp, mus musculus
gtacgcgcttccctgaagagctgac

SEQ ID NO: 52876 - DNA, 25 bp, mus musculus
gcttccctgaagagctgacccagac

SEQ ID NO: 52877 - DNA, 25 bp, mus musculus
aagagctgacccagaccttcatgag

SEQ ID NO: 52878 - DNA, 25 bp, mus musculus
agctgacccagaccttcatgagttg

SEQ ID NO: 52879 - DNA, 25 bp, mus musculus
tgacccagaccttcatgagttgcaa

SEQ ID NO: 52880 - DNA, 25 bp, mus musculus
agaccttcatgagttgcaacctcat

SEQ ID NO: 52881 - DNA, 25 bp, mus musculus
ccttcatgagttgcaacctcatcac

SEQ ID NO: 52882 - DNA, 25 bp, mus musculus
tcatgagttgcaacctcatcactgt

SEQ ID NO: 52883 - DNA, 25 bp, mus musculus
agacgacatgagccggggagcagca

SEQ ID NO: 52884 - DNA, 25 bp, mus musculus
aatgttgtatgggctacgcggccca

SEQ ID NO: 52885 - DNA, 25 bp, mus musculus
catctcaagatcatggccttgccct

SEQ ID NO: 52886 - DNA, 25 bp, mus musculus
atggccttgcccttggactcatcct

SEQ ID NO: 52887 - DNA, 25 bp, mus musculus
ttgcccttggactcatcctcagaga

SEQ ID NO: 52888 - DNA, 25 bp, mus musculus
ttggactcatcctcagagaagttaa

SEQ ID NO: 52889 - DNA, 25 bp, mus musculus
tcatcctcagagaagttaagcatta

SEQ ID NO: 52890 - DNA, 25 bp, mus musculus
agcattaaggcttggcacgagcctc

SEQ ID NO: 52891 - DNA, 25 bp, mus musculus
ctctccgggactagctgcaaaactt

SEQ ID NO: 52892 - DNA, 25 bp, mus musculus
tatgctctaaacatttctagttccc

SEQ ID NO: 52893 - DNA, 25 bp, mus musculus
ctccattgcttgttccagcatcttg

SEQ ID NO: 52894 - DNA, 25 bp, mus musculus
atcagctctggtgtccctgagagac

SEQ ID NO: 52895 - DNA, 25 bp, mus musculus
tcctcgctgagctgcaacctgatgc

SEQ ID NO: 52896 - DNA, 25 bp, mus musculus
ctgagctgcaacctgatgcatcgac

SEQ ID NO: 52897 - DNA, 25 bp, mus musculus
tcaggcctctgacttgagactactg

SEQ ID NO: 52898 - DNA, 25 bp, mus musculus
ctctgacttgagactactgctgtcg

SEQ ID NO: 52899 - DNA, 25 bp, mus musculus
cttgagactactgctgtcgcagatc

SEQ ID NO: 52900 - DNA, 25 bp, mus musculus
atctcagagttcaactctcatctca

SEQ ID NO: 52901 - DNA, 25 bp, mus musculus
gagttcaactctcatctcaagatca

SEQ ID NO: 52902 - DNA, 25 bp, mus musculus
aactctcatctcaagatcatggcct

SEQ ID NO: 52903 - DNA, 25 bp, mus musculus
catgatcactcgtacacggacaccg

SEQ ID NO: 52904 - DNA, 25 bp, mus musculus
tgatcactcgtacacggacaccggg

SEQ ID NO: 52905 - DNA, 25 bp, mus musculus
agactgccgggattatagtgatgag

SEQ ID NO: 52906 - DNA, 25 bp, mus musculus
atgagcgttactgccgatgcaatgc

SEQ ID NO: 52907 - DNA, 25 bp, mus musculus
gcgttactgccgatgcaatgccacc

SEQ ID NO: 52908 - DNA, 25 bp, mus musculus
gttactgccgatgcaatgccaccca

SEQ ID NO: 52909 - DNA, 25 bp, mus musculus
ccaccagttcacgtgcaaaaaccag

SEQ ID NO: 52910 - DNA, 25 bp, mus musculus
acgtgcaaaaaccagttctgcaagc

SEQ ID NO: 52911 - DNA, 25 bp, mus musculus
accagttctgcaagcccctcttctg

SEQ ID NO: 52912 - DNA, 25 bp, mus musculus
tcttctgggtctgtgacagtgtcaa

SEQ ID NO: 52913 - DNA, 25 bp, mus musculus
ttctgggtctgtgacagtgtcaacg

SEQ ID NO: 52914 - DNA, 25 bp, mus musculus
gtctgtgacagtgtcaacggactgt

SEQ ID NO: 52915 - DNA, 25 bp, mus musculus
gggttcctagctgagtacctctcct

SEQ ID NO: 52916 - DNA, 25 bp, mus musculus
agctgagtacctctcctacgactcc

SEQ ID NO: 52917 - DNA, 25 bp, mus musculus
tccaacgacccgtgcccagggatgt

SEQ ID NO: 52918 - DNA, 25 bp, mus musculus
cccgtgcccagggatgttcatgtgc

SEQ ID NO: 52919 - DNA, 25 bp, mus musculus
ttcatgtgcaagactggacggtgca

SEQ ID NO: 52920 - DNA, 25 bp, mus musculus
agactggacggtgcatccgaaagga

SEQ ID NO: 52921 - DNA, 25 bp, mus musculus
ctgggcagactgccgggattatagt

SEQ ID NO: 52922 - DNA, 25 bp, mus musculus
gcagactgccgggattatagtgatg

SEQ ID NO: 52923 - DNA, 25 bp, mus musculus
gccccatctgatttgcaaactttct

SEQ ID NO: 52924 - DNA, 25 bp, mus musculus
gatttgcaaactttctagaagatgc

SEQ ID NO: 52925 - DNA, 25 bp, mus musculus
cttgagccatactattggtgggcct

SEQ ID NO: 52926 - DNA, 25 bp, mus musculus
ttcagtgaccttggctctatccatg

SEQ ID NO: 52927 - DNA, 25 bp, mus musculus
gaccttggctctatccatgaccaga

SEQ ID NO: 52928 - DNA, 25 bp, mus musculus
ggctctatccatgaccagacaggac

SEQ ID NO: 52929 - DNA, 25 bp, mus musculus
tctatccatgaccagacaggaccca

SEQ ID NO: 52930 - DNA, 25 bp, mus musculus
gaccagacaggacccattttggctt

SEQ ID NO: 52931 - DNA, 25 bp, mus musculus
cagacaggacccattttggcttctt

SEQ ID NO: 52932 - DNA, 25 bp, mus musculus
cctgaactacacgtgtccatgtaga

SEQ ID NO: 52933 - DNA, 25 bp, mus musculus
gaactacacgtgtccatgtagattg

SEQ ID NO: 52934 - DNA, 25 bp, mus musculus
ctacacgtgtccatgtagattgtaa

SEQ ID NO: 52935 - DNA, 25 bp, mus musculus
atgccatgaggtggtgtgtgtagat

SEQ ID NO: 52936 - DNA, 25 bp, mus musculus
tctttgagcaagagctctggaaacc

SEQ ID NO: 52937 - DNA, 25 bp, mus musculus
agctctggaaaccacctcagcttca

SEQ ID NO: 52938 - DNA, 25 bp, mus musculus
tctggaaaccacctcagcttcaaca

SEQ ID NO: 52939 - DNA, 25 bp, mus musculus
ggaaaccacctcagcttcaacagag

SEQ ID NO: 52940 - DNA, 25 bp, mus musculus
ctcagcttcaacagaggctggtcca

SEQ ID NO: 52941 - DNA, 25 bp, mus musculus
agcttcaacagaggctggtccagtc

SEQ ID NO: 52942 - DNA, 25 bp, mus musculus
tgcccttcctactgctgagcaacca

SEQ ID NO: 52943 - DNA, 25 bp, mus musculus
tgtcatctttgccgatgtggcccag

SEQ ID NO: 52944 - DNA, 25 bp, mus musculus
ctttgccgatgtggcccagccagac

SEQ ID NO: 52945 - DNA, 25 bp, mus musculus
cactgcgtcagcagaggctgtgttt

SEQ ID NO: 52946 - DNA, 25 bp, mus musculus
tgtgtttgcatctgaagtgaagaag

SEQ ID NO: 52947 - DNA, 25 bp, mus musculus
gaacatgaagccgcaggagcagctg

SEQ ID NO: 52948 - DNA, 25 bp, mus musculus
catgaagccgcaggagcagctgacg

SEQ ID NO: 52949 - DNA, 25 bp, mus musculus
gcagctgacgctagagccttatgag

SEQ ID NO: 52950 - DNA, 25 bp, mus musculus
gctagagccttatgagcgagaccac

SEQ ID NO: 52951 - DNA, 25 bp, mus musculus
ttatgagcgagaccacgccgtggtt

SEQ ID NO: 52952 - DNA, 25 bp, mus musculus
ctgaaactcagagctgtctggattg

SEQ ID NO: 52953 - DNA, 25 bp, mus musculus
aaactcagagctgtctggattgaag

SEQ ID NO: 52954 - DNA, 25 bp, mus musculus
gcacgtgtggcttgtgattttttgg

SEQ ID NO: 52955 - DNA, 25 bp, mus musculus
tgccgatgtggcccagccagaccaa

SEQ ID NO: 52956 - DNA, 25 bp, mus musculus
gatttccattaaggccaactgcatt

SEQ ID NO: 52957 - DNA, 25 bp, mus musculus
ttccattaaggccaactgcattgac

SEQ ID NO: 52958 - DNA, 25 bp, mus musculus
cattaaggccaactgcattgactcc

SEQ ID NO: 52959 - DNA, 25 bp, mus musculus
ggccaactgcattgactccactgcg

SEQ ID NO: 52960 - DNA, 25 bp, mus musculus
caactgcattgactccactgcgtca

SEQ ID NO: 52961 - DNA, 25 bp, mus musculus
ctgcattgactccactgcgtcagca

SEQ ID NO: 52962 - DNA, 25 bp, mus musculus
tgactccactgcgtcagcagaggct

SEQ ID NO: 52963 - DNA, 25 bp, mus musculus
gctcactggggtgcaagaagccctg

SEQ ID NO: 52964 - DNA, 25 bp, mus musculus
tcctgccgacactagacctggcttc

SEQ ID NO: 52965 - DNA, 25 bp, mus musculus
cctgccttagacccctgactctgtg

SEQ ID NO: 52966 - DNA, 25 bp, mus musculus
ttagacccctgactctgtgtgcact

SEQ ID NO: 52967 - DNA, 25 bp, mus musculus
gcaagcttctctggaaaggacaggg

SEQ ID NO: 52968 - DNA, 25 bp, mus musculus
gcttagactgtgctacgggttccag

SEQ ID NO: 52969 - DNA, 25 bp, mus musculus
gttccagaactgcaatccacaaaag

SEQ ID NO: 52970 - DNA, 25 bp, mus musculus
gcacctgcatgtatcaccatcctgc

SEQ ID NO: 52971 - DNA, 25 bp, mus musculus
gcatgtatcaccatcctgcctctga

SEQ ID NO: 52972 - DNA, 25 bp, mus musculus
atcctgcctctgaagagccctcagc

SEQ ID NO: 52973 - DNA, 25 bp, mus musculus
cctctgaagagccctcagcatgaag

SEQ ID NO: 52974 - DNA, 25 bp, mus musculus
aagagccctcagcatgaagcaagca

SEQ ID NO: 52975 - DNA, 25 bp, mus musculus
tagacctggcttcctctgcattcac

SEQ ID NO: 52976 - DNA, 25 bp, mus musculus
tggcttcctctgcattcacactatg

SEQ ID NO: 52977 - DNA, 25 bp, mus musculus
atgcccagtggtgcctgtgatttgt

SEQ ID NO: 52978 - DNA, 25 bp, mus musculus
agtggtgcctgtgatttgtagtttg

SEQ ID NO: 52979 - DNA, 25 bp, mus musculus
gtctaagaacagccccatcttctcc

SEQ ID NO: 52980 - DNA, 25 bp, mus musculus
gtacaaccaacagcttcttctagac

SEQ ID NO: 52981 - DNA, 25 bp, mus musculus
tctagaccccactgggatagagcca

SEQ ID NO: 52982 - DNA, 25 bp, mus musculus
agagccaccagggtagcgagtggca

SEQ ID NO: 52983 - DNA, 25 bp, mus musculus
ttaagaacacctcgggatactgcgc

SEQ ID NO: 52984 - DNA, 25 bp, mus musculus
taagaacacctcgggatactgcgca

SEQ ID NO: 52985 - DNA, 25 bp, mus musculus
gcatatgcgcaaagccacctaagta

SEQ ID NO: 52986 - DNA, 25 bp, mus musculus
atatgcgcaaagccacctaagtatc

SEQ ID NO: 52987 - DNA, 25 bp, mus musculus
tatgcgcaaagccacctaagtatcg

SEQ ID NO: 52988 - DNA, 25 bp, mus musculus
atgcgcaaagccacctaagtatcgt

SEQ ID NO: 52989 - DNA, 25 bp, mus musculus
gcgcaaagccacctaagtatcgtga

SEQ ID NO: 52990 - DNA, 25 bp, mus musculus
cgcaaagccacctaagtatcgtgaa

SEQ ID NO: 52991 - DNA, 25 bp, mus musculus
gcaaagccacctaagtatcgtgaag

SEQ ID NO: 52992 - DNA, 25 bp, mus musculus
aagccacctaagtatcgtgaaggat

SEQ ID NO: 52993 - DNA, 25 bp, mus musculus
agccacctaagtatcgtgaaggatg

SEQ ID NO: 52994 - DNA, 25 bp, mus musculus
ccacctaagtatcgtgaaggatgtc

SEQ ID NO: 52995 - DNA, 25 bp, mus musculus
agaacacctcgggatactgcgcagg

SEQ ID NO: 52996 - DNA, 25 bp, mus musculus
gaacacctcgggatactgcgcaggc

SEQ ID NO: 52997 - DNA, 25 bp, mus musculus
aacacctcgggatactgcgcaggcc

SEQ ID NO: 52998 - DNA, 25 bp, mus musculus
cacctcgggatactgcgcaggccat

SEQ ID NO: 52999 - DNA, 25 bp, mus musculus
acctcgggatactgcgcaggccatc

SEQ ID NO: 53000 - DNA, 25 bp, mus musculus
cctcgggatactgcgcaggccatca

SEQ ID NO: 53001 - DNA, 25 bp, mus musculus
atgcatatgcgcaaagccacctaag

SEQ ID NO: 53002 - DNA, 25 bp, mus musculus
tgcatatgcgcaaagccacctaagt

SEQ ID NO: 53003 - DNA, 25 bp, mus musculus
gccttggcttctgacagtccttcca

SEQ ID NO: 53004 - DNA, 25 bp, mus musculus
ttggcttctgacagtccttccacct

SEQ ID NO: 53005 - DNA, 25 bp, mus musculus
actacagtatctgtccctgggttgg

SEQ ID NO: 53006 - DNA, 25 bp, mus musculus
gtatctgtccctgggttggcagaga

SEQ ID NO: 53007 - DNA, 25 bp, mus musculus
tctgtccctgggttggcagagactt

SEQ ID NO: 53008 - DNA, 25 bp, mus musculus
gtccctgggttggcagagacttgaa

SEQ ID NO: 53009 - DNA, 25 bp, mus musculus
tcatcctatggtttttctaatggat

SEQ ID NO: 53010 - DNA, 25 bp, mus musculus
taatcttgtaactattcaagctcca

SEQ ID NO: 53011 - DNA, 25 bp, mus musculus
ctctttgctgatcttggcttcctgg

SEQ ID NO: 53012 - DNA, 25 bp, mus musculus
tttgctgatcttggcttcctggctt

SEQ ID NO: 53013 - DNA, 25 bp, mus musculus
caccctctgctgtccttgtgtagtg

SEQ ID NO: 53014 - DNA, 25 bp, mus musculus
cctctgctgtccttgtgtagtgatt

SEQ ID NO: 53015 - DNA, 25 bp, mus musculus
ttctgaaactagctgccttttaaag

SEQ ID NO: 53016 - DNA, 25 bp, mus musculus
aaagtgctttatgctggcttttctc

SEQ ID NO: 53017 - DNA, 25 bp, mus musculus
tgaaactagctgccttttaaagcag

SEQ ID NO: 53018 - DNA, 25 bp, mus musculus
ccttttaaagcagatcccttcactg

SEQ ID NO: 53019 - DNA, 25 bp, mus musculus
aaagcagatcccttcactgctatgt

SEQ ID NO: 53020 - DNA, 25 bp, mus musculus
gatcccttcactgctatgttggaca

SEQ ID NO: 53021 - DNA, 25 bp, mus musculus
ttcactgctatgttggacactacag

SEQ ID NO: 53022 - DNA, 25 bp, mus musculus
ttggacactacagtatctgtccctg

SEQ ID NO: 53023 - DNA, 25 bp, mus musculus
gacactacagtatctgtccctgggt

SEQ ID NO: 53024 - DNA, 25 bp, mus musculus
ggcttgagctatgcccaacatcagc

SEQ ID NO: 53025 - DNA, 25 bp, mus musculus
agctatgcccaacatcagctgcggc

SEQ ID NO: 53026 - DNA, 25 bp, mus musculus
cttcagctctcgagcgtgaactcaa

SEQ ID NO: 53027 - DNA, 25 bp, mus musculus
ctctcgagcgtgaactcaagctcta

SEQ ID NO: 53028 - DNA, 25 bp, mus musculus
aactcaagctctacacacctgctca

SEQ ID NO: 53029 - DNA, 25 bp, mus musculus
agctctacacacctgctcatcatgt

SEQ ID NO: 53030 - DNA, 25 bp, mus musculus
ctgctcatcatgtgccttacactca

SEQ ID NO: 53031 - DNA, 25 bp, mus musculus
tgccttacactcagaggaagccttg

SEQ ID NO: 53032 - DNA, 25 bp, mus musculus
acactcagaggaagccttgggtcac

SEQ ID NO: 53033 - DNA, 25 bp, mus musculus
agccttgggtcacagagtctgattt

SEQ ID NO: 53034 - DNA, 25 bp, mus musculus
tgatttctggggcagctgagagcta

SEQ ID NO: 53035 - DNA, 25 bp, mus musculus
tagcaaagctcagggccagtgtgac

SEQ ID NO: 53036 - DNA, 25 bp, mus musculus
gcccaacatcagctgcggcctttgc

SEQ ID NO: 53037 - DNA, 25 bp, mus musculus
cctagctggctgccccatattgggc

SEQ ID NO: 53038 - DNA, 25 bp, mus musculus
tctcctatgccactcagccaactta

SEQ ID NO: 53039 - DNA, 25 bp, mus musculus
atgccactcagccaacttatttgtt

SEQ ID NO: 53040 - DNA, 25 bp, mus musculus
ctcagccaacttatttgttagccag

SEQ ID NO: 53041 - DNA, 25 bp, mus musculus
ctaggatgctacctggtggacccgc

SEQ ID NO: 53042 - DNA, 25 bp, mus musculus
ctggtggacccgcatctcacacggg

SEQ ID NO: 53043 - DNA, 25 bp, mus musculus
ctcgaacttcagctctcgagcgtga

SEQ ID NO: 53044 - DNA, 25 bp, mus musculus
tccgatactactatgacaaaaacat

SEQ ID NO: 53045 - DNA, 25 bp, mus musculus
agtttgacttccatggcattgccca

SEQ ID NO: 53046 - DNA, 25 bp, mus musculus
acgtgccttcacacttaggcagcta

SEQ ID NO: 53047 - DNA, 25 bp, mus musculus
cttcacacttaggcagctactacta

SEQ ID NO: 53048 - DNA, 25 bp, mus musculus
gcagctactactagaactaacacca

SEQ ID NO: 53049 - DNA, 25 bp, mus musculus
agaactaacaccagttggccttctg

SEQ ID NO: 53050 - DNA, 25 bp, mus musculus
aacaccagttggccttctggctgaa

SEQ ID NO: 53051 - DNA, 25 bp, mus musculus
ccttctggctgaagttccagctctc

SEQ ID NO: 53052 - DNA, 25 bp, mus musculus
agttccagctctcactttactggat

SEQ ID NO: 53053 - DNA, 25 bp, mus musculus
agctctcactttactggatactctg

SEQ ID NO: 53054 - DNA, 25 bp, mus musculus
actggatactctggactctaaaagg

SEQ ID NO: 53055 - DNA, 25 bp, mus musculus
tactctggactctaaaaggcacagt

SEQ ID NO: 53056 - DNA, 25 bp, mus musculus
atggcattgcccaggccctgcagcc

SEQ ID NO: 53057 - DNA, 25 bp, mus musculus
cacatccaacagagacatccatgta

SEQ ID NO: 53058 - DNA, 25 bp, mus musculus
agacatccatgtacaagtatccctc

SEQ ID NO: 53059 - DNA, 25 bp, mus musculus
acaagtatccctctgatatctccta

SEQ ID NO: 53060 - DNA, 25 bp, mus musculus
atccctctgatatctcctacatgcc

SEQ ID NO: 53061 - DNA, 25 bp, mus musculus
accatgcccatcaacagaaggtgaa

SEQ ID NO: 53062 - DNA, 25 bp, mus musculus
ccagcttctttggagcagcatcaca

SEQ ID NO: 53063 - DNA, 25 bp, mus musculus
tctttggagcagcatcacaatactg

SEQ ID NO: 53064 - DNA, 25 bp, mus musculus
tggattaatacccctcgaagacaag

SEQ ID NO: 53065 - DNA, 25 bp, mus musculus
cttctttctgacctgaaccatcaga

SEQ ID NO: 53066 - DNA, 25 bp, mus musculus
actcttagaggcctctttattatcg

SEQ ID NO: 53067 - DNA, 25 bp, mus musculus
cttagaggcctctttattatcgatg

SEQ ID NO: 53068 - DNA, 25 bp, mus musculus
ctctttattatcgatgacaaaggag

SEQ ID NO: 53069 - DNA, 25 bp, mus musculus
attactctgaatgaccttcctgtcg

SEQ ID NO: 53070 - DNA, 25 bp, mus musculus
aatgaccttcctgtcggaagatcag

SEQ ID NO: 53071 - DNA, 25 bp, mus musculus
gaccttcctgtcggaagatcagtgg

SEQ ID NO: 53072 - DNA, 25 bp, mus musculus
gacgagacactgcgtttggttcaag

SEQ ID NO: 53073 - DNA, 25 bp, mus musculus
gagacactgcgtttggttcaagcct

SEQ ID NO: 53074 - DNA, 25 bp, mus musculus
ttggttcaagccttccagtacactg

SEQ ID NO: 53075 - DNA, 25 bp, mus musculus
tacactgacaagcatggagaagtct

SEQ ID NO: 53076 - DNA, 25 bp, mus musculus
ctttctgacctgaaccatcagatct

SEQ ID NO: 53077 - DNA, 25 bp, mus musculus
gacctgaaccatcagatctcaaagg

SEQ ID NO: 53078 - DNA, 25 bp, mus musculus
aaccatcagatctcaaaggactatg

SEQ ID NO: 53079 - DNA, 25 bp, mus musculus
catcagatctcaaaggactatggtg

SEQ ID NO: 53080 - DNA, 25 bp, mus musculus
taccttgaagactcaggacatactc

SEQ ID NO: 53081 - DNA, 25 bp, mus musculus
gactcaggacatactcttagaggcc

SEQ ID NO: 53082 - DNA, 25 bp, mus musculus
ggacatactcttagaggcctcttta

SEQ ID NO: 53083 - DNA, 25 bp, mus musculus
catactcttagaggcctctttatta

SEQ ID NO: 53084 - DNA, 25 bp, mus musculus
ttcctgcagacttcattgctgaagg

SEQ ID NO: 53085 - DNA, 25 bp, mus musculus
cagacttcattgctgaaggcatcga

SEQ ID NO: 53086 - DNA, 25 bp, mus musculus
ttgtgaatggcctcatcttggcaag

SEQ ID NO: 53087 - DNA, 25 bp, mus musculus
atggcctcatcttggcaagtgatgg

SEQ ID NO: 53088 - DNA, 25 bp, mus musculus
tcatcttggcaagtgatggccaaaa

SEQ ID NO: 53089 - DNA, 25 bp, mus musculus
agaactacccagatccagtttccat

SEQ ID NO: 53090 - DNA, 25 bp, mus musculus
acccagatccagtttccatcatcga

SEQ ID NO: 53091 - DNA, 25 bp, mus musculus
atccagtttccatcatcgataagta

SEQ ID NO: 53092 - DNA, 25 bp, mus musculus
tttccatcatcgataagtatggtgc

SEQ ID NO: 53093 - DNA, 25 bp, mus musculus
cggacgcctcaggttatatctgatc

SEQ ID NO: 53094 - DNA, 25 bp, mus musculus
caattcccctgtggtaagagcagaa

SEQ ID NO: 53095 - DNA, 25 bp, mus musculus
agcagaaaacctgcgcttcaaggag

SEQ ID NO: 53096 - DNA, 25 bp, mus musculus
tcattgctgaaggcatcgatcaaac

SEQ ID NO: 53097 - DNA, 25 bp, mus musculus
gcatcgatcaaaccagaggatggtt

SEQ ID NO: 53098 - DNA, 25 bp, mus musculus
gatggttttacaccctgctggtgct

SEQ ID NO: 53099 - DNA, 25 bp, mus musculus
tttacaccctgctggtgctagccac

SEQ ID NO: 53100 - DNA, 25 bp, mus musculus
tagccacagcgctctttggacagcc

SEQ ID NO: 53101 - DNA, 25 bp, mus musculus
cagcgctctttggacagccaccttt

SEQ ID NO: 53102 - DNA, 25 bp, mus musculus
tctttggacagccacctttcaagaa

SEQ ID NO: 53103 - DNA, 25 bp, mus musculus
gacagccacctttcaagaatgtgat

SEQ ID NO: 53104 - DNA, 25 bp, mus musculus
ttgcgtgctcttcacagtcgggtta

SEQ ID NO: 53105 - DNA, 25 bp, mus musculus
gctcttcacagtcgggttacaggcg

SEQ ID NO: 53106 - DNA, 25 bp, mus musculus
ccaagtcctcagtattttagctttg

SEQ ID NO: 53107 - DNA, 25 bp, mus musculus
agctttgtggcttcctgatggcaga

SEQ ID NO: 53108 - DNA, 25 bp, mus musculus
gtggcttcctgatggcagaaaaatc

SEQ ID NO: 53109 - DNA, 25 bp, mus musculus
gtttgctctccagataatcactagc

SEQ ID NO: 53110 - DNA, 25 bp, mus musculus
tctccagataatcactagccagatt

SEQ ID NO: 53111 - DNA, 25 bp, mus musculus
gataatcactagccagatttcgaaa

SEQ ID NO: 53112 - DNA, 25 bp, mus musculus
cactagccagatttcgaaattactt

SEQ ID NO: 53113 - DNA, 25 bp, mus musculus
ttttagccgaggttatgataacatc

SEQ ID NO: 53114 - DNA, 25 bp, mus musculus
taacatctactgtatcctttagaat

SEQ ID NO: 53115 - DNA, 25 bp, mus musculus
aaactatgtctactggtttctgcct

SEQ ID NO: 53116 - DNA, 25 bp, mus musculus
gcgtttcctactcctaatgagagtt

SEQ ID NO: 53117 - DNA, 25 bp, mus musculus
gatgcagcttgctccttcctcatct

SEQ ID NO: 53118 - DNA, 25 bp, mus musculus
ctcatctctcaggctgtgccttaat

SEQ ID NO: 53119 - DNA, 25 bp, mus musculus
tctcaggctgtgccttaattcagaa

SEQ ID NO: 53120 - DNA, 25 bp, mus musculus
ttcagaacaccaaaagagaggaacg

SEQ ID NO: 53121 - DNA, 25 bp, mus musculus
tcctgacggggccgaagaattgtga

SEQ ID NO: 53122 - DNA, 25 bp, mus musculus
aaaggctcaggctggtgttcttcct

SEQ ID NO: 53123 - DNA, 25 bp, mus musculus
tggtgttcttcctctatctccactc

SEQ ID NO: 53124 - DNA, 25 bp, mus musculus
acaacgcaggtagcgcgttacgagc

SEQ ID NO: 53125 - DNA, 25 bp, mus musculus
acgcaggtagcgcgttacgagcagc

SEQ ID NO: 53126 - DNA, 25 bp, mus musculus
accgtcattgggtcaattgggtcag

SEQ ID NO: 53127 - DNA, 25 bp, mus musculus
ccaacagaagcccgactgcaggatt

SEQ ID NO: 53128 - DNA, 25 bp, mus musculus
caacagaagcccgactgcaggattt

SEQ ID NO: 53129 - DNA, 25 bp, mus musculus
aacagaagcccgactgcaggatttg

SEQ ID NO: 53130 - DNA, 25 bp, mus musculus
cagaagcccgactgcaggatttggt

SEQ ID NO: 53131 - DNA, 25 bp, mus musculus
agaagcccgactgcaggatttggtc

SEQ ID NO: 53132 - DNA, 25 bp, mus musculus
gaagcccgactgcaggatttggtca

SEQ ID NO: 53133 - DNA, 25 bp, mus musculus
aagcccgactgcaggatttggtcaa

SEQ ID NO: 53134 - DNA, 25 bp, mus musculus
gcccgactgcaggatttggtcaacg

SEQ ID NO: 53135 - DNA, 25 bp, mus musculus
cccgactgcaggatttggtcaacga

SEQ ID NO: 53136 - DNA, 25 bp, mus musculus
cgcaggtagcgcgttacgagcagca

SEQ ID NO: 53137 - DNA, 25 bp, mus musculus
tagcgcgttacgagcagcagaagcg

SEQ ID NO: 53138 - DNA, 25 bp, mus musculus
agcgcgttacgagcagcagaagcgg

SEQ ID NO: 53139 - DNA, 25 bp, mus musculus
cgcgttacgagcagcagaagcggag

SEQ ID NO: 53140 - DNA, 25 bp, mus musculus
gttacgagcagcagaagcggaggca

SEQ ID NO: 53141 - DNA, 25 bp, mus musculus
tggtgcagcaaccctcggctgcgtc

SEQ ID NO: 53142 - DNA, 25 bp, mus musculus
gtgcagcaaccctcggctgcgtcgg

SEQ ID NO: 53143 - DNA, 25 bp, mus musculus
tccaagaagctttctccctaattcg

SEQ ID NO: 53144 - DNA, 25 bp, mus musculus
tacatggtcctacggccatggtctg

SEQ ID NO: 53145 - DNA, 25 bp, mus musculus
atggtcctacggccatggtctggta

SEQ ID NO: 53146 - DNA, 25 bp, mus musculus
tgtgaattgcgatcctctgtgcagt

SEQ ID NO: 53147 - DNA, 25 bp, mus musculus
gaattgcgatcctctgtgcagttac

SEQ ID NO: 53148 - DNA, 25 bp, mus musculus
ttgcgatcctctgtgcagttactag

SEQ ID NO: 53149 - DNA, 25 bp, mus musculus
tcctctgtgcagttactagctgaag

SEQ ID NO: 53150 - DNA, 25 bp, mus musculus
tctgtgcagttactagctgaagatc

SEQ ID NO: 53151 - DNA, 25 bp, mus musculus
ttactagctgaagatctgtgacact

SEQ ID NO: 53152 - DNA, 25 bp, mus musculus
gatctgtgacactggacatgctgga

SEQ ID NO: 53153 - DNA, 25 bp, mus musculus
ctgtgacactggacatgctggacct

SEQ ID NO: 53154 - DNA, 25 bp, mus musculus
tgacactggacatgctggacctggg

SEQ ID NO: 53155 - DNA, 25 bp, mus musculus
cactggacatgctggacctgggggc

SEQ ID NO: 53156 - DNA, 25 bp, mus musculus
gtcctacggccatggtctggtagtg

SEQ ID NO: 53157 - DNA, 25 bp, mus musculus
caccacgactaagtactttgtgagc

SEQ ID NO: 53158 - DNA, 25 bp, mus musculus
taagtactttgtgagcagcggctct

SEQ ID NO: 53159 - DNA, 25 bp, mus musculus
gtactttgtgagcagcggctctgtc

SEQ ID NO: 53160 - DNA, 25 bp, mus musculus
ctttgtgagcagcggctctgtcact

SEQ ID NO: 53161 - DNA, 25 bp, mus musculus
tgtgagcagcggctctgtcactgtg

SEQ ID NO: 53162 - DNA, 25 bp, mus musculus
cggctctgtcactgtgaattgcgat

SEQ ID NO: 53163 - DNA, 25 bp, mus musculus
ctctgtcactgtgaattgcgatcct

SEQ ID NO: 53164 - DNA, 25 bp, mus musculus
atggcctctcggaaacgcgcacaat

SEQ ID NO: 53165 - DNA, 25 bp, mus musculus
tctcggaaacgcgcacaattcggaa

SEQ ID NO: 53166 - DNA, 25 bp, mus musculus
gacttctacggctacagcggttgtg

SEQ ID NO: 53167 - DNA, 25 bp, mus musculus
acttctacggctacagcggttgtgt

SEQ ID NO: 53168 - DNA, 25 bp, mus musculus
ttctacggctacagcggttgtgtga

SEQ ID NO: 53169 - DNA, 25 bp, mus musculus
tctacggctacagcggttgtgtgat

SEQ ID NO: 53170 - DNA, 25 bp, mus musculus
tacggctacagcggttgtgtgatgg

SEQ ID NO: 53171 - DNA, 25 bp, mus musculus
aaatcgaagctttcggactacagag

SEQ ID NO: 53172 - DNA, 25 bp, mus musculus
ggatttcaattcaaccaactggcgt

SEQ ID NO: 53173 - DNA, 25 bp, mus musculus
atttcaattcaaccaactggcgttg

SEQ ID NO: 53174 - DNA, 25 bp, mus musculus
tttcaattcaaccaactggcgttga

SEQ ID NO: 53175 - DNA, 25 bp, mus musculus
tcaattcaaccaactggcgttgagt

SEQ ID NO: 53176 - DNA, 25 bp, mus musculus
aaagtcggctctctgacttctacgg

SEQ ID NO: 53177 - DNA, 25 bp, mus musculus
agtcggctctctgacttctacggct

SEQ ID NO: 53178 - DNA, 25 bp, mus musculus
gtcggctctctgacttctacggcta

SEQ ID NO: 53179 - DNA, 25 bp, mus musculus
ggctctctgacttctacggctacag

SEQ ID NO: 53180 - DNA, 25 bp, mus musculus
ctctctgacttctacggctacagcg

SEQ ID NO: 53181 - DNA, 25 bp, mus musculus
tctctgacttctacggctacagcgg

SEQ ID NO: 53182 - DNA, 25 bp, mus musculus
tctgacttctacggctacagcggtt

SEQ ID NO: 53183 - DNA, 25 bp, mus musculus
ctgacttctacggctacagcggttg

SEQ ID NO: 53184 - DNA, 25 bp, mus musculus
aagccaagtgtttcaggctgcgctg

SEQ ID NO: 53185 - DNA, 25 bp, mus musculus
tcaggctgcgctgtgagtttgggcc

SEQ ID NO: 53186 - DNA, 25 bp, mus musculus
tgctcctaggtctgctcatctacgt

SEQ ID NO: 53187 - DNA, 25 bp, mus musculus
tctacgtcctctacaagctcggctt

SEQ ID NO: 53188 - DNA, 25 bp, mus musculus
tcctctacaagctcggcttcttcaa

SEQ ID NO: 53189 - DNA, 25 bp, mus musculus
cctacggcacagccatggaaaaagc

SEQ ID NO: 53190 - DNA, 25 bp, mus musculus
cagatgcctgagccctcctgatctc

SEQ ID NO: 53191 - DNA, 25 bp, mus musculus
ccctcctgatctcagactcatgatc

SEQ ID NO: 53192 - DNA, 25 bp, mus musculus
tgatctcagactcatgatcccgaag

SEQ ID NO: 53193 - DNA, 25 bp, mus musculus
catgatcccgaagagccagtccaat

SEQ ID NO: 53194 - DNA, 25 bp, mus musculus
gagccagtccaataccttccgacag

SEQ ID NO: 53195 - DNA, 25 bp, mus musculus
gcacttcctgaaggtgctgagggct

SEQ ID NO: 53196 - DNA, 25 bp, mus musculus
accgccaagagagccgtagtctgca

SEQ ID NO: 53197 - DNA, 25 bp, mus musculus
gtctgcagctccatttccgagtctg

SEQ ID NO: 53198 - DNA, 25 bp, mus musculus
aataccagccatttagccttcagtg

SEQ ID NO: 53199 - DNA, 25 bp, mus musculus
agccatttagccttcagtgtgaggc

SEQ ID NO: 53200 - DNA, 25 bp, mus musculus
ctctgaagatgccctaccagatcct

SEQ ID NO: 53201 - DNA, 25 bp, mus musculus
ccacagccgtgcagtggaccaaggc

SEQ ID NO: 53202 - DNA, 25 bp, mus musculus
tcccgttgtggatcatcatcctagc

SEQ ID NO: 53203 - DNA, 25 bp, mus musculus
gcctcctgctcctaggtctgctcat

SEQ ID NO: 53204 - DNA, 25 bp, mus musculus
gcaacctgatgtccgtggactacat

SEQ ID NO: 53205 - DNA, 25 bp, mus musculus
tgtccgtggactacatcaacgtggt

SEQ ID NO: 53206 - DNA, 25 bp, mus musculus
acacctctgactggaagttgcgtgc

SEQ ID NO: 53207 - DNA, 25 bp, mus musculus
tgcgtgctgatcacggactatcagg

SEQ ID NO: 53208 - DNA, 25 bp, mus musculus
ctgatcacggactatcaggagaaac

SEQ ID NO: 53209 - DNA, 25 bp, mus musculus
aaactgcagtcggagctaaggtcca

SEQ ID NO: 53210 - DNA, 25 bp, mus musculus
atctgcaccacgatcctgggacttg

SEQ ID NO: 53211 - DNA, 25 bp, mus musculus
tgcaccacgatcctgggacttgtgg

SEQ ID NO: 53212 - DNA, 25 bp, mus musculus
gtattgaatacccaaggcatttgat

SEQ ID NO: 53213 - DNA, 25 bp, mus musculus
ttgaatacccaaggcatttgatcca

SEQ ID NO: 53214 - DNA, 25 bp, mus musculus
aatacccaaggcatttgatccactc

SEQ ID NO: 53215 - DNA, 25 bp, mus musculus
caaggcatttgatccactcagtaac

SEQ ID NO: 53216 - DNA, 25 bp, mus musculus
ccgtggactacatcaacgtggtagt

SEQ ID NO: 53217 - DNA, 25 bp, mus musculus
tcaacgtggtagtgggccgcagtca

SEQ ID NO: 53218 - DNA, 25 bp, mus musculus
gccgcagtcagcctgagactgtcat

SEQ ID NO: 53219 - DNA, 25 bp, mus musculus
gtcagcctgagactgtcatcgctat

SEQ ID NO: 53220 - DNA, 25 bp, mus musculus
ctgagactgtcatcgctatcattga

SEQ ID NO: 53221 - DNA, 25 bp, mus musculus
agcagcggaccgacacctctgactg

SEQ ID NO: 53222 - DNA, 25 bp, mus musculus
ggaccgacacctctgactggaagtt

SEQ ID NO: 53223 - DNA, 25 bp, mus musculus
ccgacacctctgactggaagttgcg

SEQ ID NO: 53224 - DNA, 25 bp, mus musculus
ctgccaaatgctgctgaaggctgca

SEQ ID NO: 53225 - DNA, 25 bp, mus musculus
ccaaatgctgctgaaggctgcagct

SEQ ID NO: 53226 - DNA, 25 bp, mus musculus
actgagccaggccactccactgagt

SEQ ID NO: 53227 - DNA, 25 bp, mus musculus
gagccaggccactccactgagtatc

SEQ ID NO: 53228 - DNA, 25 bp, mus musculus
ctacttagccgctctactgctgtca

SEQ ID NO: 53229 - DNA, 25 bp, mus musculus
agccgctctactgctgtcactcctg

SEQ ID NO: 53230 - DNA, 25 bp, mus musculus
tctactgctgtcactcctgccatct

SEQ ID NO: 53231 - DNA, 25 bp, mus musculus
actgctgtcactcctgccatctcag

SEQ ID NO: 53232 - DNA, 25 bp, mus musculus
actcctgccatctcagctggactag

SEQ ID NO: 53233 - DNA, 25 bp, mus musculus
agccattgacttgaccagggcactg

SEQ ID NO: 53234 - DNA, 25 bp, mus musculus
cattgacttgaccagggcactggta

SEQ ID NO: 53235 - DNA, 25 bp, mus musculus
cttgaccagggcactggtagtctca

SEQ ID NO: 53236 - DNA, 25 bp, mus musculus
aatgctgctgaaggctgcagctacc

SEQ ID NO: 53237 - DNA, 25 bp, mus musculus
ctttcccaagaggtttcagctgact

SEQ ID NO: 53238 - DNA, 25 bp, mus musculus
tcccaagaggtttcagctgactgag

SEQ ID NO: 53239 - DNA, 25 bp, mus musculus
gtttcagctgactgaggaagaggct

SEQ ID NO: 53240 - DNA, 25 bp, mus musculus
tcagctgactgaggaagaggctctc

SEQ ID NO: 53241 - DNA, 25 bp, mus musculus
ccgcatcagtgaccattatcctgta

SEQ ID NO: 53242 - DNA, 25 bp, mus musculus
catcagtgaccattatcctgtagaa

SEQ ID NO: 53243 - DNA, 25 bp, mus musculus
tgaccattatcctgtagaagtggaa

SEQ ID NO: 53244 - DNA, 25 bp, mus musculus
caataatgcctactgtgtgacctgt

SEQ ID NO: 53245 - DNA, 25 bp, mus musculus
tgcctactgtgtgacctgtaatcgg

SEQ ID NO: 53246 - DNA, 25 bp, mus musculus
caatgccacatacgccagcgagtgt

SEQ ID NO: 53247 - DNA, 25 bp, mus musculus
cacatacgccagcgagtgtgccatg

SEQ ID NO: 53248 - DNA, 25 bp, mus musculus
ctgctcttctggcgtgcttcttgaa

SEQ ID NO: 53249 - DNA, 25 bp, mus musculus
gcattctggatcttgcaactccatc

SEQ ID NO: 53250 - DNA, 25 bp, mus musculus
ctttcctatctcttccattctagag

SEQ ID NO: 53251 - DNA, 25 bp, mus musculus
tatctcttccattctagagtggtaa

SEQ ID NO: 53252 - DNA, 25 bp, mus musculus
ttccattctagagtggtaaactctc

SEQ ID NO: 53253 - DNA, 25 bp, mus musculus
aactctccaccaatgttcagtgttg

SEQ ID NO: 53254 - DNA, 25 bp, mus musculus
ccaccaatgttcagtgttgacatag

SEQ ID NO: 53255 - DNA, 25 bp, mus musculus
agtgttgacatagcctttgggcaaa

SEQ ID NO: 53256 - DNA, 25 bp, mus musculus
ctgtgtgacctgtaatcggatttgc

SEQ ID NO: 53257 - DNA, 25 bp, mus musculus
ctcttctgaacagtacctttgtgga

SEQ ID NO: 53258 - DNA, 25 bp, mus musculus
ctgcttgctgggcagatccattgga

SEQ ID NO: 53259 - DNA, 25 bp, mus musculus
cattggattagcctatgagggaaag

SEQ ID NO: 53260 - DNA, 25 bp, mus musculus
gtgtatcacaaagtcctgtgaagat

SEQ ID NO: 53261 - DNA, 25 bp, mus musculus
atgcctatgggattccaaggttggc

SEQ ID NO: 53262 - DNA, 25 bp, mus musculus
ctgcgatgagctgtgtcctgacagt

SEQ ID NO: 53263 - DNA, 25 bp, mus musculus
tgagctgtgtcctgacagtaagtcg

SEQ ID NO: 53264 - DNA, 25 bp, mus musculus
ggtagaagaccacaccagagactgt

SEQ ID NO: 53265 - DNA, 25 bp, mus musculus
gtagaagaccacaccagagactgtc

SEQ ID NO: 53266 - DNA, 25 bp, mus musculus
cctaggtactccctggcatctcact

SEQ ID NO: 53267 - DNA, 25 bp, mus musculus
ctaggtactccctggcatctcactt

SEQ ID NO: 53268 - DNA, 25 bp, mus musculus
aggtactccctggcatctcactttt

SEQ ID NO: 53269 - DNA, 25 bp, mus musculus
ggtactccctggcatctcacttttt

SEQ ID NO: 53270 - DNA, 25 bp, mus musculus
gtactccctggcatctcactttttc

SEQ ID NO: 53271 - DNA, 25 bp, mus musculus
tactccctggcatctcactttttct

SEQ ID NO: 53272 - DNA, 25 bp, mus musculus
ctccctggcatctcactttttctgg

SEQ ID NO: 53273 - DNA, 25 bp, mus musculus
tccctggcatctcactttttctggg

SEQ ID NO: 53274 - DNA, 25 bp, mus musculus
ccctggcatctcactttttctgggg

SEQ ID NO: 53275 - DNA, 25 bp, mus musculus
cctggcatctcactttttctggggt

SEQ ID NO: 53276 - DNA, 25 bp, mus musculus
tagaagaccacaccagagactgtca

SEQ ID NO: 53277 - DNA, 25 bp, mus musculus
gaagaccacaccagagactgtcaga

SEQ ID NO: 53278 - DNA, 25 bp, mus musculus
aagaccacaccagagactgtcagag

SEQ ID NO: 53279 - DNA, 25 bp, mus musculus
agaccacaccagagactgtcagaga

SEQ ID NO: 53280 - DNA, 25 bp, mus musculus
gaccacaccagagactgtcagagag

SEQ ID NO: 53281 - DNA, 25 bp, mus musculus
gaaatgggctcttgagcgcacctcc

SEQ ID NO: 53282 - DNA, 25 bp, mus musculus
tcgttccctaggtactccctggcat

SEQ ID NO: 53283 - DNA, 25 bp, mus musculus
tccctaggtactccctggcatctca

SEQ ID NO: 53284 - DNA, 25 bp, mus musculus
agtctgggctgcagaaagagattgc

SEQ ID NO: 53285 - DNA, 25 bp, mus musculus
gccccgtgtgcaaaatcagccccga

SEQ ID NO: 53286 - DNA, 25 bp, mus musculus
tcatcaagcccatcagcatcgccgg

SEQ ID NO: 53287 - DNA, 25 bp, mus musculus
tcactcccggcacttcaaaccttgt

SEQ ID NO: 53288 - DNA, 25 bp, mus musculus
gcacttcaaaccttgtcttcaccta

SEQ ID NO: 53289 - DNA, 25 bp, mus musculus
accccaatgtcctggagcaggagtc

SEQ ID NO: 53290 - DNA, 25 bp, mus musculus
ccaatgtcctggagcaggagtcgcc

SEQ ID NO: 53291 - DNA, 25 bp, mus musculus
agtcgccttcgtcgccctcagagtc

SEQ ID NO: 53292 - DNA, 25 bp, mus musculus
cctcagagtcctgctccaaggctca

SEQ ID NO: 53293 - DNA, 25 bp, mus musculus
ccaaggctcaccgcagaagcagtag

SEQ ID NO: 53294 - DNA, 25 bp, mus musculus
ctcaccgcagaagcagtagcagtgg

SEQ ID NO: 53295 - DNA, 25 bp, mus musculus
accagtcatcagactccttgaactc

SEQ ID NO: 53296 - DNA, 25 bp, mus musculus
gcaaaatcagccccgaggaacgccg

SEQ ID NO: 53297 - DNA, 25 bp, mus musculus
cctccgggctgcagtccttgcgcgg

SEQ ID NO: 53298 - DNA, 25 bp, mus musculus
aagaggacagcccctcttcctcagc

SEQ ID NO: 53299 - DNA, 25 bp, mus musculus
cctcttcctcagcagggatggacaa

SEQ ID NO: 53300 - DNA, 25 bp, mus musculus
cttcctcagcagggatggacaagac

SEQ ID NO: 53301 - DNA, 25 bp, mus musculus
agacccagcgctctgtcatcaagcc

SEQ ID NO: 53302 - DNA, 25 bp, mus musculus
agcgctctgtcatcaagcccatcag

SEQ ID NO: 53303 - DNA, 25 bp, mus musculus
ctgtcatcaagcccatcagcatcgc

SEQ ID NO: 53304 - DNA, 25 bp, mus musculus
actgacgccagcgaatctcaccaca

SEQ ID NO: 53305 - DNA, 25 bp, mus musculus
gccagcgaatctcaccacagtacta

SEQ ID NO: 53306 - DNA, 25 bp, mus musculus
agcagcagtcctgaatggtgtttca

SEQ ID NO: 53307 - DNA, 25 bp, mus musculus
cttttacattacagttacaatagtg

SEQ ID NO: 53308 - DNA, 25 bp, mus musculus
gcttgtacaagcttgccaaagatag

SEQ ID NO: 53309 - DNA, 25 bp, mus musculus
gaatacggatcgccagtcttacatc

SEQ ID NO: 53310 - DNA, 25 bp, mus musculus
ggatcgccagtcttacatcgcactt

SEQ ID NO: 53311 - DNA, 25 bp, mus musculus
ccagtcttacatcgcactttcagtt

SEQ ID NO: 53312 - DNA, 25 bp, mus musculus
ttacatcgcactttcagttcctcca

SEQ ID NO: 53313 - DNA, 25 bp, mus musculus
cgcactttcagttcctccatttgga

SEQ ID NO: 53314 - DNA, 25 bp, mus musculus
tcctccatttggaattcagaaaggg

SEQ ID NO: 53315 - DNA, 25 bp, mus musculus
catactttgacacctactgtgttaa

SEQ ID NO: 53316 - DNA, 25 bp, mus musculus
gaatctgatacagcctcagttaatg

SEQ ID NO: 53317 - DNA, 25 bp, mus musculus
gatacagcctcagttaatgagaatg

SEQ ID NO: 53318 - DNA, 25 bp, mus musculus
agagcatggtccttcagaaaaggca

SEQ ID NO: 53319 - DNA, 25 bp, mus musculus
tggtccaactagcgcttctggcgat

SEQ ID NO: 53320 - DNA, 25 bp, mus musculus
tgaaattcctaagctaccgcgtact

SEQ ID NO: 53321 - DNA, 25 bp, mus musculus
gctaccgcgtactctgggagaagaa

SEQ ID NO: 53322 - DNA, 25 bp, mus musculus
agaagacagcactcaagaagcagca

SEQ ID NO: 53323 - DNA, 25 bp, mus musculus
cagcactcaagaagcagcagtcctg

SEQ ID NO: 53324 - DNA, 25 bp, mus musculus
tgaagactccaatacccatagacat

SEQ ID NO: 53325 - DNA, 25 bp, mus musculus
aagactccaatacccatagacatct

SEQ ID NO: 53326 - DNA, 25 bp, mus musculus
agagattgctgacactttggtgcaa

SEQ ID NO: 53327 - DNA, 25 bp, mus musculus
agattgctgacactttggtgcaaat

SEQ ID NO: 53328 - DNA, 25 bp, mus musculus
attgctgacactttggtgcaaatat

SEQ ID NO: 53329 - DNA, 25 bp, mus musculus
gtaaacagttcccatgtgagccgtt

SEQ ID NO: 53330 - DNA, 25 bp, mus musculus
acagttcccatgtgagccgttcaaa

SEQ ID NO: 53331 - DNA, 25 bp, mus musculus
agttcccatgtgagccgttcaaatt

SEQ ID NO: 53332 - DNA, 25 bp, mus musculus
ttcccatgtgagccgttcaaatttt

SEQ ID NO: 53333 - DNA, 25 bp, mus musculus
cccatgtgagccgttcaaatttttg

SEQ ID NO: 53334 - DNA, 25 bp, mus musculus
ggagccaactttaagactggagtat

SEQ ID NO: 53335 - DNA, 25 bp, mus musculus
agtattgcgaggctttggcaatgct

SEQ ID NO: 53336 - DNA, 25 bp, mus musculus
gactccaatacccatagacatctga

SEQ ID NO: 53337 - DNA, 25 bp, mus musculus
ccaatacccatagacatctgactga

SEQ ID NO: 53338 - DNA, 25 bp, mus musculus
aatacccatagacatctgactgaat

SEQ ID NO: 53339 - DNA, 25 bp, mus musculus
cccatagacatctgactgaatttgt

SEQ ID NO: 53340 - DNA, 25 bp, mus musculus
tagacatctgactgaatttgttggt

SEQ ID NO: 53341 - DNA, 25 bp, mus musculus
catctgactgaatttgttggtttgg

SEQ ID NO: 53342 - DNA, 25 bp, mus musculus
ttaattatcattaccatgaagttgt

SEQ ID NO: 53343 - DNA, 25 bp, mus musculus
aattatcattaccatgaagttgtag

SEQ ID NO: 53344 - DNA, 25 bp, mus musculus
cggcaacaagcccttcaggcatcag

SEQ ID NO: 53345 - DNA, 25 bp, mus musculus
caagcccttcaggcatcaggtgaca

SEQ ID NO: 53346 - DNA, 25 bp, mus musculus
cgttctcatgaaacagctagatact

SEQ ID NO: 53347 - DNA, 25 bp, mus musculus
agatacttggttgtcgcttgcgact

SEQ ID NO: 53348 - DNA, 25 bp, mus musculus
ttggttgtcgcttgcgactgagtct

SEQ ID NO: 53349 - DNA, 25 bp, mus musculus
gtcgcttgcgactgagtctcttgta

SEQ ID NO: 53350 - DNA, 25 bp, mus musculus
tgcgactgagtctcttgtaatcaag

SEQ ID NO: 53351 - DNA, 25 bp, mus musculus
tgagtctcttgtaatcaagagagtt

SEQ ID NO: 53352 - DNA, 25 bp, mus musculus
gagagttcctctgcgatgatcgcac

SEQ ID NO: 53353 - DNA, 25 bp, mus musculus
tcctctgcgatgatcgcaccaggcg

SEQ ID NO: 53354 - DNA, 25 bp, mus musculus
atcgcaccaggcgtctatgattacg

SEQ ID NO: 53355 - DNA, 25 bp, mus musculus
gtctatgattacgacttctgcaagc

SEQ ID NO: 53356 - DNA, 25 bp, mus musculus
cttcaggcatcaggtgacaaggcta

SEQ ID NO: 53357 - DNA, 25 bp, mus musculus
aaggctatgctccagtatcattctc

SEQ ID NO: 53358 - DNA, 25 bp, mus musculus
atgctccagtatcattctcggtact

SEQ ID NO: 53359 - DNA, 25 bp, mus musculus
cattctcggtactgtcctgatgatc

SEQ ID NO: 53360 - DNA, 25 bp, mus musculus
tgtcctgatgatcctcactatgctc

SEQ ID NO: 53361 - DNA, 25 bp, mus musculus
gatgatcctcactatgctccatacg

SEQ ID NO: 53362 - DNA, 25 bp, mus musculus
cctcactatgctccatacgagcaag

SEQ ID NO: 53363 - DNA, 25 bp, mus musculus
tatgctccatacgagcaagagagtc

SEQ ID NO: 53364 - DNA, 25 bp, mus musculus
tctccagcaggagcatcagagggag

SEQ ID NO: 53365 - DNA, 25 bp, mus musculus
gatcgaaggcctcctggagaacatc

SEQ ID NO: 53366 - DNA, 25 bp, mus musculus
gaaacaaactccagtccctgacaag

SEQ ID NO: 53367 - DNA, 25 bp, mus musculus
aactccagtccctgacaagaaggag

SEQ ID NO: 53368 - DNA, 25 bp, mus musculus
agtccctgacaagaaggagagagac

SEQ ID NO: 53369 - DNA, 25 bp, mus musculus
ttcccacgtgtacctcgcctataca

SEQ ID NO: 53370 - DNA, 25 bp, mus musculus
gagtctgcgtcagtctctgatgaag

SEQ ID NO: 53371 - DNA, 25 bp, mus musculus
gcgtcagtctctgatgaagttagaa

SEQ ID NO: 53372 - DNA, 25 bp, mus musculus
aaagcgttctgcaaagcctgagacc

SEQ ID NO: 53373 - DNA, 25 bp, mus musculus
ttctgcaaagcctgagaccgtaatt

SEQ ID NO: 53374 - DNA, 25 bp, mus musculus
aaagcctgagaccgtaattgattct

SEQ ID NO: 53375 - DNA, 25 bp, mus musculus
tgattctttacttcagtaaatgtac

SEQ ID NO: 53376 - DNA, 25 bp, mus musculus
aggcctcctggagaacatccggcag

SEQ ID NO: 53377 - DNA, 25 bp, mus musculus
gaacatccggcagctcagccgggag

SEQ ID NO: 53378 - DNA, 25 bp, mus musculus
tgataacttcatacctcaggattac

SEQ ID NO: 53379 - DNA, 25 bp, mus musculus
cttcatacctcaggattaccaggaa

SEQ ID NO: 53380 - DNA, 25 bp, mus musculus
acctcaggattaccaggaaatgatt

SEQ ID NO: 53381 - DNA, 25 bp, mus musculus
tgaaaactacgtccactggaatgaa

SEQ ID NO: 53382 - DNA, 25 bp, mus musculus
ctacgtccactggaatgaagacata

SEQ ID NO: 53383 - DNA, 25 bp, mus musculus
atgtgtggcctacacaggaaataac

SEQ ID NO: 53384 - DNA, 25 bp, mus musculus
atctggggtcagccatgatgctcag

SEQ ID NO: 53385 - DNA, 25 bp, mus musculus
tgctcagtgatcgactgacgtttct

SEQ ID NO: 53386 - DNA, 25 bp, mus musculus
tgattttttcagcagagcagacata

SEQ ID NO: 53387 - DNA, 25 bp, mus musculus
tgatgcggtgcctggaagacttggc

SEQ ID NO: 53388 - DNA, 25 bp, mus musculus
tggaagacttggcctcagggaggcc

SEQ ID NO: 53389 - DNA, 25 bp, mus musculus
aacctgatgcccagcgactgcagga

SEQ ID NO: 53390 - DNA, 25 bp, mus musculus
acatagagaccaccaaggtggagat

SEQ ID NO: 53391 - DNA, 25 bp, mus musculus
tgctgagactggctcttgcccggaa

SEQ ID NO: 53392 - DNA, 25 bp, mus musculus
gactggctcttgcccggaatcttgc

SEQ ID NO: 53393 - DNA, 25 bp, mus musculus
cccggaatcttgctcgggcaattat

SEQ ID NO: 53394 - DNA, 25 bp, mus musculus
atcttgctcgggcaattataaggga

SEQ ID NO: 53395 - DNA, 25 bp, mus musculus
aaggctcactggagggttcctgaga

SEQ ID NO: 53396 - DNA, 25 bp, mus musculus
gtgatcgactgacgtttctgggaaa

SEQ ID NO: 53397 - DNA, 25 bp, mus musculus
agaagcgctttggtgacgctgcttc

SEQ ID NO: 53398 - DNA, 25 bp, mus musculus
gctttggtgacgctgcttctcttct

SEQ ID NO: 53399 - DNA, 25 bp, mus musculus
tgctgtccctcatgacctctcagat

SEQ ID NO: 53400 - DNA, 25 bp, mus musculus
ctcagattgcacctcgttctttctg

SEQ ID NO: 53401 - DNA, 25 bp, mus musculus
ctcgttctttctggatgactctgct

SEQ ID NO: 53402 - DNA, 25 bp, mus musculus
ctttctggatgactctgctcacaga

SEQ ID NO: 53403 - DNA, 25 bp, mus musculus
ggatgactctgctcacagatgccct

SEQ ID NO: 53404 - DNA, 25 bp, mus musculus
tgagtttgccaacctttgtcttcat

SEQ ID NO: 53405 - DNA, 25 bp, mus musculus
gtttgccaacctttgtcttcatatt

SEQ ID NO: 53406 - DNA, 25 bp, mus musculus
ctgcaatactgttgctatttcccac

SEQ ID NO: 53407 - DNA, 25 bp, mus musculus
caatactgttgctatttcccactaa

SEQ ID NO: 53408 - DNA, 25 bp, mus musculus
tgttgctatttcccactaaattcac

SEQ ID NO: 53409 - DNA, 25 bp, mus musculus
agatgcttgctaacaccaggaggtt

SEQ ID NO: 53410 - DNA, 25 bp, mus musculus
tgcttgctaacaccaggaggttcta

SEQ ID NO: 53411 - DNA, 25 bp, mus musculus
tctagcaaggtcacttggtggacta

SEQ ID NO: 53412 - DNA, 25 bp, mus musculus
atctgattatggctaccatcatatc

SEQ ID NO: 53413 - DNA, 25 bp, mus musculus
tggctaccatcatatctacactttc

SEQ ID NO: 53414 - DNA, 25 bp, mus musculus
ctaccatcatatctacactttccta

SEQ ID NO: 53415 - DNA, 25 bp, mus musculus
ccatcatatctacactttcctaaat

SEQ ID NO: 53416 - DNA, 25 bp, mus musculus
atatcttaattgtcactgtgaataa

SEQ ID NO: 53417 - DNA, 25 bp, mus musculus
aattcagacatactgacccttctaa

SEQ ID NO: 53418 - DNA, 25 bp, mus musculus
atactgacccttctaaagcttgcct

SEQ ID NO: 53419 - DNA, 25 bp, mus musculus
catgctggtggcctttacaatttta

SEQ ID NO: 53420 - DNA, 25 bp, mus musculus
actttcagtggcattggactgctta

SEQ ID NO: 53421 - DNA, 25 bp, mus musculus
tgctgtgttcttttacctcaataaa

SEQ ID NO: 53422 - DNA, 25 bp, mus musculus
tgtgttcttttacctcaataaaatg

SEQ ID NO: 53423 - DNA, 25 bp, mus musculus
atgctgcaatactgttgctatttcc

SEQ ID NO: 53424 - DNA, 25 bp, mus musculus
attttcgtgcatttgtgagccaaag

SEQ ID NO: 53425 - DNA, 25 bp, mus musculus
atattagagtgcccttaacataatg

SEQ ID NO: 53426 - DNA, 25 bp, mus musculus
gtatatgaccaatctctgtgactcg

SEQ ID NO: 53427 - DNA, 25 bp, mus musculus
gaccaatctctgtgactcgcttagc

SEQ ID NO: 53428 - DNA, 25 bp, mus musculus
atgtttctgaagacctccgatacac

SEQ ID NO: 53429 - DNA, 25 bp, mus musculus
tttctgaagacctccgatacactga

SEQ ID NO: 53430 - DNA, 25 bp, mus musculus
aagacctccgatacactgaccagtc

SEQ ID NO: 53431 - DNA, 25 bp, mus musculus
acactgaccagtcccacaagtgttt

SEQ ID NO: 53432 - DNA, 25 bp, mus musculus
ctgaccagtcccacaagtgtttttg

SEQ ID NO: 53433 - DNA, 25 bp, mus musculus
gaagacatgaaacccacactgtgca

SEQ ID NO: 53434 - DNA, 25 bp, mus musculus
gacatgaaacccacactgtgcattt

SEQ ID NO: 53435 - DNA, 25 bp, mus musculus
cccacactgtgcatttagggtgtgc

SEQ ID NO: 53436 - DNA, 25 bp, mus musculus
ttagagtgcccttaacataatgatt

SEQ ID NO: 53437 - DNA, 25 bp, mus musculus
gagtgcccttaacataatgatttga

SEQ ID NO: 53438 - DNA, 25 bp, mus musculus
aacatatgtgtactgtctggaaacg

SEQ ID NO: 53439 - DNA, 25 bp, mus musculus
tgtgtactgtctggaaacgaattct

SEQ ID NO: 53440 - DNA, 25 bp, mus musculus
atcttgcttcagtagccttcgctct

SEQ ID NO: 53441 - DNA, 25 bp, mus musculus
cctcaggctgtatgtcagatgttct

SEQ ID NO: 53442 - DNA, 25 bp, mus musculus
aactagatctcctgtaattttgtag

SEQ ID NO: 53443 - DNA, 25 bp, mus musculus
tagatctcctgtaattttgtagtag

SEQ ID NO: 53444 - DNA, 25 bp, mus musculus
catcgactggcatcctctccatcat

SEQ ID NO: 53445 - DNA, 25 bp, mus musculus
ccattcatatctgtgatgaggtgga

SEQ ID NO: 53446 - DNA, 25 bp, mus musculus
gatgctgcgacccattaaggatgga

SEQ ID NO: 53447 - DNA, 25 bp, mus musculus
catctcccaggagccagtgtgttcc

SEQ ID NO: 53448 - DNA, 25 bp, mus musculus
gtgttccagacgcttccggggctga

SEQ ID NO: 53449 - DNA, 25 bp, mus musculus
tcccaggctttctggcagccccttg

SEQ ID NO: 53450 - DNA, 25 bp, mus musculus
gcaccctcatgttgttatcatctac

SEQ ID NO: 53451 - DNA, 25 bp, mus musculus
tgttatcatctacttagcaaagttg

SEQ ID NO: 53452 - DNA, 25 bp, mus musculus
catctacttagcaaagttgtccaac

SEQ ID NO: 53453 - DNA, 25 bp, mus musculus
ctctcccaggatacagagccagtct

SEQ ID NO: 53454 - DNA, 25 bp, mus musculus
tgtcccctagctggggaaaagcgag

SEQ ID NO: 53455 - DNA, 25 bp, mus musculus
attttgtcttctgagttggattgga

SEQ ID NO: 53456 - DNA, 25 bp, mus musculus
gggagaacaacccatcagcgggtgc

SEQ ID NO: 53457 - DNA, 25 bp, mus musculus
acaacccatcagcgggtgccttccg

SEQ ID NO: 53458 - DNA, 25 bp, mus musculus
acttcgagtacaacatcacaactac

SEQ ID NO: 53459 - DNA, 25 bp, mus musculus
agtacaacatcacaactaccctggc

SEQ ID NO: 53460 - DNA, 25 bp, mus musculus
ccctggcagccatcaataaaatccg

SEQ ID NO: 53461 - DNA, 25 bp, mus musculus
cagccatcaataaaatccgcatctt

SEQ ID NO: 53462 - DNA, 25 bp, mus musculus
tcaataaaatccgcatcttcaaggg

SEQ ID NO: 53463 - DNA, 25 bp, mus musculus
aaatccgcatcttcaaggggagatg

SEQ ID NO: 53464 - DNA, 25 bp, mus musculus
gcacagcagccagtggctgcatcag

SEQ ID NO: 53465 - DNA, 25 bp, mus musculus
agcagccagtggctgcatcaggctg

SEQ ID NO: 53466 - DNA, 25 bp, mus musculus
acacgcggctgtagcaacagcgtct

SEQ ID NO: 53467 - DNA, 25 bp, mus musculus
gtagcaacagcgtctgcacacgtga

SEQ ID NO: 53468 - DNA, 25 bp, mus musculus
agcaacagcgtctgcacacgtgatg

SEQ ID NO: 53469 - DNA, 25 bp, mus musculus
cgtctgcacacgtgatgtgaacacc

SEQ ID NO: 53470 - DNA, 25 bp, mus musculus
tctgcacacgtgatgtgaacaccat

SEQ ID NO: 53471 - DNA, 25 bp, mus musculus
atgtgaacaccatggactcgttggc

SEQ ID NO: 53472 - DNA, 25 bp, mus musculus
gtgaacaccatggactcgttggcag

SEQ ID NO: 53473 - DNA, 25 bp, mus musculus
acaccatggactcgttggcagcgtg

SEQ ID NO: 53474 - DNA, 25 bp, mus musculus
accatggactcgttggcagcgtgga

SEQ ID NO: 53475 - DNA, 25 bp, mus musculus
catggactcgttggcagcgtggatg

SEQ ID NO: 53476 - DNA, 25 bp, mus musculus
gccagtggctgcatcaggctgccca

SEQ ID NO: 53477 - DNA, 25 bp, mus musculus
cagtggctgcatcaggctgcccacc

SEQ ID NO: 53478 - DNA, 25 bp, mus musculus
ggctgcatcaggctgcccaccgtgc

SEQ ID NO: 53479 - DNA, 25 bp, mus musculus
tgctgcccagctggccatgcaagag

SEQ ID NO: 53480 - DNA, 25 bp, mus musculus
ctgcccagctggccatgcaagagtc

SEQ ID NO: 53481 - DNA, 25 bp, mus musculus
gcccagctggccatgcaagagtcgg

SEQ ID NO: 53482 - DNA, 25 bp, mus musculus
cgagagacacgcggctgtagcaaca

SEQ ID NO: 53483 - DNA, 25 bp, mus musculus
agagacacgcggctgtagcaacagc

SEQ ID NO: 53484 - DNA, 25 bp, mus musculus
gttggcagccgaacaactcaccatt

SEQ ID NO: 53485 - DNA, 25 bp, mus musculus
agccgaacaactcaccatttcatgt

SEQ ID NO: 53486 - DNA, 25 bp, mus musculus
ttcttcaagtacattcacgacaggt

SEQ ID NO: 53487 - DNA, 25 bp, mus musculus
ccttccacaggaatgctggtgctct

SEQ ID NO: 53488 - DNA, 25 bp, mus musculus
atgctggtgctcttctttgcactac

SEQ ID NO: 53489 - DNA, 25 bp, mus musculus
gtgctcttctttgcactacatgtgt

SEQ ID NO: 53490 - DNA, 25 bp, mus musculus
acaggcgtgcatgacgccgacttcg

SEQ ID NO: 53491 - DNA, 25 bp, mus musculus
gacgccgacttcgaagcccacatca

SEQ ID NO: 53492 - DNA, 25 bp, mus musculus
gaagcccacatcatcgacatgctgg

SEQ ID NO: 53493 - DNA, 25 bp, mus musculus
cacatcatcgacatgctggccaagg

SEQ ID NO: 53494 - DNA, 25 bp, mus musculus
gccaaggccagcaagatcgaggtct

SEQ ID NO: 53495 - DNA, 25 bp, mus musculus
gccctgagcgccttcagaaccagtc

SEQ ID NO: 53496 - DNA, 25 bp, mus musculus
caccatttcatgtacccagagagtg

SEQ ID NO: 53497 - DNA, 25 bp, mus musculus
gcgccttcagaaccagtcactcgag

SEQ ID NO: 53498 - DNA, 25 bp, mus musculus
ttcatgtacccagagagtgccaaga

SEQ ID NO: 53499 - DNA, 25 bp, mus musculus
tacccagagagtgccaagaacctgc

SEQ ID NO: 53500 - DNA, 25 bp, mus musculus
aacctgcctgccaatgtcagcttcg

SEQ ID NO: 53501 - DNA, 25 bp, mus musculus
cctgccaatgtcagcttcgtgctgg

SEQ ID NO: 53502 - DNA, 25 bp, mus musculus
aatgtcagcttcgtgctggtcccct

SEQ ID NO: 53503 - DNA, 25 bp, mus musculus
gccctggacctaatgtggattgcca

SEQ ID NO: 53504 - DNA, 25 bp, mus musculus
cgattcacctatgccccagtgaagt

SEQ ID NO: 53505 - DNA, 25 bp, mus musculus
gttttaaatctgcatcattgttgta

SEQ ID NO: 53506 - DNA, 25 bp, mus musculus
ttaaatctgcatcattgttgtatct

SEQ ID NO: 53507 - DNA, 25 bp, mus musculus
atagaatacattgctcaccaggaac

SEQ ID NO: 53508 - DNA, 25 bp, mus musculus
gctcccgcagcccattttgaaatgt

SEQ ID NO: 53509 - DNA, 25 bp, mus musculus
cattttgaaatgtgccctgtgtaga

SEQ ID NO: 53510 - DNA, 25 bp, mus musculus
tttgaaatgtgccctgtgtagaaga

SEQ ID NO: 53511 - DNA, 25 bp, mus musculus
gaaatgtgccctgtgtagaagaatg

SEQ ID NO: 53512 - DNA, 25 bp, mus musculus
atgtgccctgtgtagaagaatgtac

SEQ ID NO: 53513 - DNA, 25 bp, mus musculus
atgcatttccaaactgccttaaaca

SEQ ID NO: 53514 - DNA, 25 bp, mus musculus
catttccaaactgccttaaacattg

SEQ ID NO: 53515 - DNA, 25 bp, mus musculus
ttccaaactgccttaaacattgtat

SEQ ID NO: 53516 - DNA, 25 bp, mus musculus
atgcacacaccagtaaagagtttaa

SEQ ID NO: 53517 - DNA, 25 bp, mus musculus
aatctgcatcattgttgtatctccc

SEQ ID NO: 53518 - DNA, 25 bp, mus musculus
catcattgttgtatctcccctatcc

SEQ ID NO: 53519 - DNA, 25 bp, mus musculus
atctcccctatccaagaaatgtata

SEQ ID NO: 53520 - DNA, 25 bp, mus musculus
tcccctatccaagaaatgtatagaa

SEQ ID NO: 53521 - DNA, 25 bp, mus musculus
tcatgaggaatccactcctgcagcc

SEQ ID NO: 53522 - DNA, 25 bp, mus musculus
tgaggaatccactcctgcagcccat

SEQ ID NO: 53523 - DNA, 25 bp, mus musculus
tcctgcagcccatccaagaaatgta

SEQ ID NO: 53524 - DNA, 25 bp, mus musculus
tgcagcccatccaagaaatgtatag

SEQ ID NO: 53525 - DNA, 25 bp, mus musculus
gctgctgctgctgcacttcctctgc

SEQ ID NO: 53526 - DNA, 25 bp, mus musculus
gctgctgcacttcctctgccaggaa

SEQ ID NO: 53527 - DNA, 25 bp, mus musculus
ccaggaatactcggcgcagaacgca

SEQ ID NO: 53528 - DNA, 25 bp, mus musculus
caggaatactcggcgcagaacgcac

SEQ ID NO: 53529 - DNA, 25 bp, mus musculus
gcgcagaacgcacgcatcgtccgct

SEQ ID NO: 53530 - DNA, 25 bp, mus musculus
cagaacgcacgcatcgtccgcttgg

SEQ ID NO: 53531 - DNA, 25 bp, mus musculus
gaacgcacgcatcgtccgcttggtg

SEQ ID NO: 53532 - DNA, 25 bp, mus musculus
ggagactcgaatccacattctaccc

SEQ ID NO: 53533 - DNA, 25 bp, mus musculus
gagactcgaatccacattctaccct

SEQ ID NO: 53534 - DNA, 25 bp, mus musculus
tccctcaatcctgatggctatgaga

SEQ ID NO: 53535 - DNA, 25 bp, mus musculus
cctcaatcctgatggctatgagaag

SEQ ID NO: 53536 - DNA, 25 bp, mus musculus
ctcaatcctgatggctatgagaagg

SEQ ID NO: 53537 - DNA, 25 bp, mus musculus
ctgctgcacttcctctgccaggaat

SEQ ID NO: 53538 - DNA, 25 bp, mus musculus
gctgcacttcctctgccaggaatac

SEQ ID NO: 53539 - DNA, 25 bp, mus musculus
ctgcacttcctctgccaggaatact

SEQ ID NO: 53540 - DNA, 25 bp, mus musculus
gcacttcctctgccaggaatactcg

SEQ ID NO: 53541 - DNA, 25 bp, mus musculus
cacttcctctgccaggaatactcgg

SEQ ID NO: 53542 - DNA, 25 bp, mus musculus
ttcctctgccaggaatactcggcgc

SEQ ID NO: 53543 - DNA, 25 bp, mus musculus
cctctgccaggaatactcggcgcag

SEQ ID NO: 53544 - DNA, 25 bp, mus musculus
ctctgccaggaatactcggcgcaga

SEQ ID NO: 53545 - DNA, 25 bp, mus musculus
gaaaccctcgctgaagcggcacctg

SEQ ID NO: 53546 - DNA, 25 bp, mus musculus
aaccctcgctgaagcggcacctgct

SEQ ID NO: 53547 - DNA, 25 bp, mus musculus
cccctagctctacactaaagggcag

SEQ ID NO: 53548 - DNA, 25 bp, mus musculus
ccctagctctacactaaagggcagg

SEQ ID NO: 53549 - DNA, 25 bp, mus musculus
cctagctctacactaaagggcaggt

SEQ ID NO: 53550 - DNA, 25 bp, mus musculus
ctagctctacactaaagggcaggtg

SEQ ID NO: 53551 - DNA, 25 bp, mus musculus
tagctctacactaaagggcaggtgt

SEQ ID NO: 53552 - DNA, 25 bp, mus musculus
agctctacactaaagggcaggtgta

SEQ ID NO: 53553 - DNA, 25 bp, mus musculus
gctctacactaaagggcaggtgtat

SEQ ID NO: 53554 - DNA, 25 bp, mus musculus
ctctacactaaagggcaggtgtatc

SEQ ID NO: 53555 - DNA, 25 bp, mus musculus
tctacactaaagggcaggtgtatct

SEQ ID NO: 53556 - DNA, 25 bp, mus musculus
ctacactaaagggcaggtgtatctg

SEQ ID NO: 53557 - DNA, 25 bp, mus musculus
accctcgctgaagcggcacctgctg

SEQ ID NO: 53558 - DNA, 25 bp, mus musculus
ccctcgctgaagcggcacctgctgt

SEQ ID NO: 53559 - DNA, 25 bp, mus musculus
cctcgctgaagcggcacctgctgtt

SEQ ID NO: 53560 - DNA, 25 bp, mus musculus
tcgctgaagcggcacctgctgtttc

SEQ ID NO: 53561 - DNA, 25 bp, mus musculus
cgctgaagcggcacctgctgtttcc

SEQ ID NO: 53562 - DNA, 25 bp, mus musculus
gctgaagcggcacctgctgtttccc

SEQ ID NO: 53563 - DNA, 25 bp, mus musculus
ctgaagcggcacctgctgtttcccc

SEQ ID NO: 53564 - DNA, 25 bp, mus musculus
tggagaatcctccagttttttacag

SEQ ID NO: 53565 - DNA, 25 bp, mus musculus
cctttcggagctgtgcggcattctg

SEQ ID NO: 53566 - DNA, 25 bp, mus musculus
cagtgtggacctctgtgatgggaca

SEQ ID NO: 53567 - DNA, 25 bp, mus musculus
ttggctggcttgcttgggtacaaat

SEQ ID NO: 53568 - DNA, 25 bp, mus musculus
cgcatgggtcacctcaagtgaaggc

SEQ ID NO: 53569 - DNA, 25 bp, mus musculus
ggtcacctcaagtgaaggcactgca

SEQ ID NO: 53570 - DNA, 25 bp, mus musculus
cacctcaagtgaaggcactgcaaac

SEQ ID NO: 53571 - DNA, 25 bp, mus musculus
tgaaggcactgcaaacacaatgatt

SEQ ID NO: 53572 - DNA, 25 bp, mus musculus
aggcactgcaaacacaatgattggt

SEQ ID NO: 53573 - DNA, 25 bp, mus musculus
cactgcaaacacaatgattggtcat

SEQ ID NO: 53574 - DNA, 25 bp, mus musculus
tcattctgaatttccggtccttcat

SEQ ID NO: 53575 - DNA, 25 bp, mus musculus
aaggctcctgtgacaagtggacatg

SEQ ID NO: 53576 - DNA, 25 bp, mus musculus
gcagtgactgcacctttgtttctga

SEQ ID NO: 53577 - DNA, 25 bp, mus musculus
tgtggacctctgtgatgggacatct

SEQ ID NO: 53578 - DNA, 25 bp, mus musculus
tgatgggacatcttgtgggatctca

SEQ ID NO: 53579 - DNA, 25 bp, mus musculus
atcttgtgggatctcacagccagtt

SEQ ID NO: 53580 - DNA, 25 bp, mus musculus
gatctcacagccagttctgtggcaa

SEQ ID NO: 53581 - DNA, 25 bp, mus musculus
ctcacagccagttctgtggcaaagg

SEQ ID NO: 53582 - DNA, 25 bp, mus musculus
ttaactggttgcatgcttgttcatt

SEQ ID NO: 53583 - DNA, 25 bp, mus musculus
tgcatgcttgttcatttggctggct

SEQ ID NO: 53584 - DNA, 25 bp, mus musculus
catttggctggcttgcttgggtaca

SEQ ID NO: 53585 - DNA, 25 bp, mus musculus
gagtacaatggccgcacgggctaca

SEQ ID NO: 53586 - DNA, 25 bp, mus musculus
gtacaatggccgcacgggctacatg

SEQ ID NO: 53587 - DNA, 25 bp, mus musculus
cggccgatacgagtcttctgatcac

SEQ ID NO: 53588 - DNA, 25 bp, mus musculus
atacgagtcttctgatcacttcact

SEQ ID NO: 53589 - DNA, 25 bp, mus musculus
cgccttgcggagtcaaggtgactcc

SEQ ID NO: 53590 - DNA, 25 bp, mus musculus
ttcttgtctgagatgaaggtggaca

SEQ ID NO: 53591 - DNA, 25 bp, mus musculus
taatatcgtacccggacatcggagc

SEQ ID NO: 53592 - DNA, 25 bp, mus musculus
cccggacatcggagcgtacactcat

SEQ ID NO: 53593 - DNA, 25 bp, mus musculus
catcggagcgtacactcattcatcc

SEQ ID NO: 53594 - DNA, 25 bp, mus musculus
tcggagcgtacactcattcatccct

SEQ ID NO: 53595 - DNA, 25 bp, mus musculus
agcgtacactcattcatccctgtgt

SEQ ID NO: 53596 - DNA, 25 bp, mus musculus
ttcatccctgtgtgggactagtaat

SEQ ID NO: 53597 - DNA, 25 bp, mus musculus
aatggccgcacgggctacatgctca

SEQ ID NO: 53598 - DNA, 25 bp, mus musculus
cgcacgggctacatgctcaagcacg

SEQ ID NO: 53599 - DNA, 25 bp, mus musculus
ctacatgctcaagcacgagtttata

SEQ ID NO: 53600 - DNA, 25 bp, mus musculus
atgctcaagcacgagtttatactgc

SEQ ID NO: 53601 - DNA, 25 bp, mus musculus
gagtttatactgcggccgatacgag

SEQ ID NO: 53602 - DNA, 25 bp, mus musculus
gtttatactgcggccgatacgagtc

SEQ ID NO: 53603 - DNA, 25 bp, mus musculus
atactgcggccgatacgagtcttct

SEQ ID NO: 53604 - DNA, 25 bp, mus musculus
actgcggccgatacgagtcttctga

SEQ ID NO: 53605 - DNA, 25 bp, mus musculus
actggacacacttaagacacatctg

SEQ ID NO: 53606 - DNA, 25 bp, mus musculus
cacacttaagacacatctgcaaggc

SEQ ID NO: 53607 - DNA, 25 bp, mus musculus
ggcctcgtacaagcacagtgacatc

SEQ ID NO: 53608 - DNA, 25 bp, mus musculus
cccctagaccgagctgcaagagggc

SEQ ID NO: 53609 - DNA, 25 bp, mus musculus
gtttggacacacagcactggctcct

SEQ ID NO: 53610 - DNA, 25 bp, mus musculus
ggctcctctcgcatggtcctgcaac

SEQ ID NO: 53611 - DNA, 25 bp, mus musculus
atggtcctgcaacactggagcagcg

SEQ ID NO: 53612 - DNA, 25 bp, mus musculus
ctgcaacactggagcagcgtggacc

SEQ ID NO: 53613 - DNA, 25 bp, mus musculus
ttgccttgtaacatatctgtacata

SEQ ID NO: 53614 - DNA, 25 bp, mus musculus
caccggctgctcagagagagccacg

SEQ ID NO: 53615 - DNA, 25 bp, mus musculus
agtttgcagcagaacggatgtgaag

SEQ ID NO: 53616 - DNA, 25 bp, mus musculus
tctttctgactctaaaatatggaaa

SEQ ID NO: 53617 - DNA, 25 bp, mus musculus
taagacacatctgcaaggctctgtg

SEQ ID NO: 53618 - DNA, 25 bp, mus musculus
ctctgtgcacacctatgttggaggc

SEQ ID NO: 53619 - DNA, 25 bp, mus musculus
gcacacctatgttggaggcctgcca

SEQ ID NO: 53620 - DNA, 25 bp, mus musculus
tggaggcctgccagaagtatcggtg

SEQ ID NO: 53621 - DNA, 25 bp, mus musculus
atcggtgatttctgcacccgtcact

SEQ ID NO: 53622 - DNA, 25 bp, mus musculus
tgcgttctaccgcggatgcatgact

SEQ ID NO: 53623 - DNA, 25 bp, mus musculus
aatcctggacctggatacggcctcg

SEQ ID NO: 53624 - DNA, 25 bp, mus musculus
ggacctggatacggcctcgtacaag

SEQ ID NO: 53625 - DNA, 25 bp, mus musculus
ggagtctccaagtgtgcgaagagtt

SEQ ID NO: 53626 - DNA, 25 bp, mus musculus
ttttcgcaggagcagtatcatgaag

SEQ ID NO: 53627 - DNA, 25 bp, mus musculus
cggatcccatttgtgaataagccat

SEQ ID NO: 53628 - DNA, 25 bp, mus musculus
aagccattcagactcatattcccta

SEQ ID NO: 53629 - DNA, 25 bp, mus musculus
ttcagactcatattccctatttaac

SEQ ID NO: 53630 - DNA, 25 bp, mus musculus
atttaacagggtctctagtgctgtg

SEQ ID NO: 53631 - DNA, 25 bp, mus musculus
cagggtctctagtgctgtgaaaaaa

SEQ ID NO: 53632 - DNA, 25 bp, mus musculus
ctttattgtacctggatagctgtaa

SEQ ID NO: 53633 - DNA, 25 bp, mus musculus
tgtacctggatagctgtaagaaagg

SEQ ID NO: 53634 - DNA, 25 bp, mus musculus
gaaaccactaagtctgatgtccaaa

SEQ ID NO: 53635 - DNA, 25 bp, mus musculus
gtccaaatgggcacactgtcagttt

SEQ ID NO: 53636 - DNA, 25 bp, mus musculus
cccttcagttgtttgatgcatttaa

SEQ ID NO: 53637 - DNA, 25 bp, mus musculus
cagtatcatgaagcccgaaagcgac

SEQ ID NO: 53638 - DNA, 25 bp, mus musculus
catgaagcccgaaagcgacagatct

SEQ ID NO: 53639 - DNA, 25 bp, mus musculus
caaaggagctcgaggtggtgtctgc

SEQ ID NO: 53640 - DNA, 25 bp, mus musculus
agctcgaggtggtgtctgcattcca

SEQ ID NO: 53641 - DNA, 25 bp, mus musculus
tgtctgcattccaaccactgaatcc

SEQ ID NO: 53642 - DNA, 25 bp, mus musculus
cattccaaccactgaatccggatcc

SEQ ID NO: 53643 - DNA, 25 bp, mus musculus
aaccactgaatccggatcccatttg

SEQ ID NO: 53644 - DNA, 25 bp, mus musculus
tgaatccggatcccatttgtgaata

SEQ ID NO: 53645 - DNA, 25 bp, mus musculus
tcttagcaccacagtgtctgggcat

SEQ ID NO: 53646 - DNA, 25 bp, mus musculus
caccacagtgtctgggcatctggga

SEQ ID NO: 53647 - DNA, 25 bp, mus musculus
tcatcgctgacctgtatccccgcaa

SEQ ID NO: 53648 - DNA, 25 bp, mus musculus
ctgacctgtatccccgcaagagcaa

SEQ ID NO: 53649 - DNA, 25 bp, mus musculus
tgtatccccgcaagagcaatgactt

SEQ ID NO: 53650 - DNA, 25 bp, mus musculus
atgacttttgctaacagtatttctt

SEQ ID NO: 53651 - DNA, 25 bp, mus musculus
ctatcaaaatccacagtgaaaacct

SEQ ID NO: 53652 - DNA, 25 bp, mus musculus
taaactatttccatatctcagaggt

SEQ ID NO: 53653 - DNA, 25 bp, mus musculus
atttccatatctcagaggtttctga

SEQ ID NO: 53654 - DNA, 25 bp, mus musculus
atatctcagaggtttctgacatgca

SEQ ID NO: 53655 - DNA, 25 bp, mus musculus
tttctgacatgcaaacttgaaccct

SEQ ID NO: 53656 - DNA, 25 bp, mus musculus
acatgcaaacttgaacccttgaaag

SEQ ID NO: 53657 - DNA, 25 bp, mus musculus
agtgtctgggcatctgggaaactcc

SEQ ID NO: 53658 - DNA, 25 bp, mus musculus
atgtgatcacacacctgcagtttgg

SEQ ID NO: 53659 - DNA, 25 bp, mus musculus
tcacacacctgcagtttggggcatc

SEQ ID NO: 53660 - DNA, 25 bp, mus musculus
acctgcagtttggggcatcgaatcc

SEQ ID NO: 53661 - DNA, 25 bp, mus musculus
cgaatccagggccttgcatgtcttc

SEQ ID NO: 53662 - DNA, 25 bp, mus musculus
cagggccttgcatgtcttctgtaag

SEQ ID NO: 53663 - DNA, 25 bp, mus musculus
cttgcatgtcttctgtaagagctct

SEQ ID NO: 53664 - DNA, 25 bp, mus musculus
ctgtaagagctctcatcgctgacct

SEQ ID NO: 53665 - DNA, 25 bp, mus musculus
gcttctctcctcagttcctaaggaa

SEQ ID NO: 53666 - DNA, 25 bp, mus musculus
aaactccagtcagaattggcagcgg

SEQ ID NO: 53667 - DNA, 25 bp, mus musculus
gaaatgactgccttactaagaaagg

SEQ ID NO: 53668 - DNA, 25 bp, mus musculus
tttactgtacaaacttatcaacttg

SEQ ID NO: 53669 - DNA, 25 bp, mus musculus
gtacaaacttatcaacttgtcttgt

SEQ ID NO: 53670 - DNA, 25 bp, mus musculus
caacttgtcttgtagatgttttgtc

SEQ ID NO: 53671 - DNA, 25 bp, mus musculus
ttttctatacgcactacatgtggtc

SEQ ID NO: 53672 - DNA, 25 bp, mus musculus
actacatgtggtctctagagggcca

SEQ ID NO: 53673 - DNA, 25 bp, mus musculus
ctctagagggccaagacttggcaac

SEQ ID NO: 53674 - DNA, 25 bp, mus musculus
cagatgagccatcacttttcagtga

SEQ ID NO: 53675 - DNA, 25 bp, mus musculus
agccatcacttttcagtgacaggaa

SEQ ID NO: 53676 - DNA, 25 bp, mus musculus
cacttttcagtgacaggaaagcaga

SEQ ID NO: 53677 - DNA, 25 bp, mus musculus
ggactccatgcatgatgtggttgaa

SEQ ID NO: 53678 - DNA, 25 bp, mus musculus
aaatctccttagctactgcttccaa

SEQ ID NO: 53679 - DNA, 25 bp, mus musculus
ccttagctactgcttccaaacattt

SEQ ID NO: 53680 - DNA, 25 bp, mus musculus
ctactgcttccaaacatttttggat

SEQ ID NO: 53681 - DNA, 25 bp, mus musculus
tattgaattcccagagatgttagct

SEQ ID NO: 53682 - DNA, 25 bp, mus musculus
tgaaatcatcactaatcagatacca

SEQ ID NO: 53683 - DNA, 25 bp, mus musculus
aaagcttctgtttcatcagaaatga

SEQ ID NO: 53684 - DNA, 25 bp, mus musculus
tcatcagaaatgactgccttactaa

SEQ ID NO: 53685 - DNA, 25 bp, mus musculus
tgagacacctcggcttctcccttgc

SEQ ID NO: 53686 - DNA, 25 bp, mus musculus
gcttctcccttgcttgccaaagagg

SEQ ID NO: 53687 - DNA, 25 bp, mus musculus
acctgtcagcaaacatgggagaaac

SEQ ID NO: 53688 - DNA, 25 bp, mus musculus
aaactacatgcagcgaccaccaaga

SEQ ID NO: 53689 - DNA, 25 bp, mus musculus
ctacatgcagcgaccaccaagaaca

SEQ ID NO: 53690 - DNA, 25 bp, mus musculus
gcgaccaccaagaacaataatcttg

SEQ ID NO: 53691 - DNA, 25 bp, mus musculus
accaccaagaacaataatcttgccg

SEQ ID NO: 53692 - DNA, 25 bp, mus musculus
aatcttgccgtctcttccaagttca

SEQ ID NO: 53693 - DNA, 25 bp, mus musculus
cttgccgtctcttccaagttcaaca

SEQ ID NO: 53694 - DNA, 25 bp, mus musculus
gccgtctcttccaagttcaacattc

SEQ ID NO: 53695 - DNA, 25 bp, mus musculus
tccaagttcaacattcctgacctaa

SEQ ID NO: 53696 - DNA, 25 bp, mus musculus
ttcaacattcctgacctaaaggttg

SEQ ID NO: 53697 - DNA, 25 bp, mus musculus
tctcccttgcttgccaaagaggtaa

SEQ ID NO: 53698 - DNA, 25 bp, mus musculus
aaggttggcacgttggatgtcttgg

SEQ ID NO: 53699 - DNA, 25 bp, mus musculus
aacatgactgagttctggctcatat

SEQ ID NO: 53700 - DNA, 25 bp, mus musculus
atgactgagttctggctcatatctg

SEQ ID NO: 53701 - DNA, 25 bp, mus musculus
actgagttctggctcatatctgctc

SEQ ID NO: 53702 - DNA, 25 bp, mus musculus
gagttctggctcatatctgctcctg

SEQ ID NO: 53703 - DNA, 25 bp, mus musculus
tggctcatatctgctcctggggaga

SEQ ID NO: 53704 - DNA, 25 bp, mus musculus
atatctgctcctggggagaaaacct

SEQ ID NO: 53705 - DNA, 25 bp, mus musculus
tctgctcctggggagaaaacctgtc

SEQ ID NO: 53706 - DNA, 25 bp, mus musculus
gccaccatggaagctccctgggccg

SEQ ID NO: 53707 - DNA, 25 bp, mus musculus
ggcacctaagccgctgcctggcgtc

SEQ ID NO: 53708 - DNA, 25 bp, mus musculus
gcgacactgcgattccatcaactcg

SEQ ID NO: 53709 - DNA, 25 bp, mus musculus
acactgcgattccatcaactcggac

SEQ ID NO: 53710 - DNA, 25 bp, mus musculus
cactgcgattccatcaactcggact

SEQ ID NO: 53711 - DNA, 25 bp, mus musculus
ctgcgattccatcaactcggacttc

SEQ ID NO: 53712 - DNA, 25 bp, mus musculus
tgcgattccatcaactcggacttcg

SEQ ID NO: 53713 - DNA, 25 bp, mus musculus
cgattccatcaactcggacttcgga

SEQ ID NO: 53714 - DNA, 25 bp, mus musculus
ttccatcaactcggacttcggaagc

SEQ ID NO: 53715 - DNA, 25 bp, mus musculus
tccatcaactcggacttcggaagcg

SEQ ID NO: 53716 - DNA, 25 bp, mus musculus
catcaactcggacttcggaagcgag

SEQ ID NO: 53717 - DNA, 25 bp, mus musculus
atcaactcggacttcggaagcgagt

SEQ ID NO: 53718 - DNA, 25 bp, mus musculus
cacctaagccgctgcctggcgtctg

SEQ ID NO: 53719 - DNA, 25 bp, mus musculus
acctaagccgctgcctggcgtctga

SEQ ID NO: 53720 - DNA, 25 bp, mus musculus
cgtctgaggccattgaggcgctaag

SEQ ID NO: 53721 - DNA, 25 bp, mus musculus
tctgaggccattgaggcgctaagcg

SEQ ID NO: 53722 - DNA, 25 bp, mus musculus
ccattgaggcgctaagcggccggcc

SEQ ID NO: 53723 - DNA, 25 bp, mus musculus
tacgagcgacactgcgattccatca

SEQ ID NO: 53724 - DNA, 25 bp, mus musculus
cgagcgacactgcgattccatcaac

SEQ ID NO: 53725 - DNA, 25 bp, mus musculus
gagcgacactgcgattccatcaact

SEQ ID NO: 53726 - DNA, 25 bp, mus musculus
ggcatcataccagctataaaatgtc

SEQ ID NO: 53727 - DNA, 25 bp, mus musculus
caactatggcagcacctccacttct

SEQ ID NO: 53728 - DNA, 25 bp, mus musculus
aacagaagtttgcctcatggtgagg

SEQ ID NO: 53729 - DNA, 25 bp, mus musculus
agtttgcctcatggtgaggtacata

SEQ ID NO: 53730 - DNA, 25 bp, mus musculus
tgattgatgcactcttgtagtctgg

SEQ ID NO: 53731 - DNA, 25 bp, mus musculus
atgcactcttgtagtctggtacaca

SEQ ID NO: 53732 - DNA, 25 bp, mus musculus
gtacacagagttgcctggagccaac

SEQ ID NO: 53733 - DNA, 25 bp, mus musculus
agagttgcctggagccaactgacca

SEQ ID NO: 53734 - DNA, 25 bp, mus musculus
gcctggagccaactgaccagacagt

SEQ ID NO: 53735 - DNA, 25 bp, mus musculus
ttggttccaccagctctgcatcaag

SEQ ID NO: 53736 - DNA, 25 bp, mus musculus
ccaccagctctgcatcaagagactt

SEQ ID NO: 53737 - DNA, 25 bp, mus musculus
catcaagagacttccgtggcaagac

SEQ ID NO: 53738 - DNA, 25 bp, mus musculus
cacttctggtagccatgcccacgct

SEQ ID NO: 53739 - DNA, 25 bp, mus musculus
ccatgcccacgctgtgtcaaatgtc

SEQ ID NO: 53740 - DNA, 25 bp, mus musculus
ccacgctgtgtcaaatgtcactcag

SEQ ID NO: 53741 - DNA, 25 bp, mus musculus
tgtgtcaaatgtcactcagactggc

SEQ ID NO: 53742 - DNA, 25 bp, mus musculus
ctttaaagcataactctgatgggct

SEQ ID NO: 53743 - DNA, 25 bp, mus musculus
agcataactctgatgggctttgtca

SEQ ID NO: 53744 - DNA, 25 bp, mus musculus
tcctgatgcactttgggaagttgaa

SEQ ID NO: 53745 - DNA, 25 bp, mus musculus
atcaattgatcttcgaactgtgaag

SEQ ID NO: 53746 - DNA, 25 bp, mus musculus
ctaccaaagacacactcaggcttta

SEQ ID NO: 53747 - DNA, 25 bp, mus musculus
aagacacactcaggctttagtaaat

SEQ ID NO: 53748 - DNA, 25 bp, mus musculus
agactaacctcatagtggtcaagta

SEQ ID NO: 53749 - DNA, 25 bp, mus musculus
accattatggtgctactgagcattt

SEQ ID NO: 53750 - DNA, 25 bp, mus musculus
cgctgcatccattaatctgcttaga

SEQ ID NO: 53751 - DNA, 25 bp, mus musculus
atccattaatctgcttagagaacac

SEQ ID NO: 53752 - DNA, 25 bp, mus musculus
agaacactagtgccagctcttttag

SEQ ID NO: 53753 - DNA, 25 bp, mus musculus
ccagctcttttagctgatactgctc

SEQ ID NO: 53754 - DNA, 25 bp, mus musculus
cttttagctgatactgctcattatg

SEQ ID NO: 53755 - DNA, 25 bp, mus musculus
gctgatactgctcattatggtattt

SEQ ID NO: 53756 - DNA, 25 bp, mus musculus
actgctcattatggtatttgtacat

SEQ ID NO: 53757 - DNA, 25 bp, mus musculus
tgcattccaattttgttcagtaatg

SEQ ID NO: 53758 - DNA, 25 bp, mus musculus
ttaacatgtatatctttttgaacca

SEQ ID NO: 53759 - DNA, 25 bp, mus musculus
tcaaaacaatgcagagcttgtacca

SEQ ID NO: 53760 - DNA, 25 bp, mus musculus
gttcagctgacacgagcagaagttg

SEQ ID NO: 53761 - DNA, 25 bp, mus musculus
ggccaaaatactgcctgcactattg

SEQ ID NO: 53762 - DNA, 25 bp, mus musculus
aatactgcctgcactattgacttcc

SEQ ID NO: 53763 - DNA, 25 bp, mus musculus
actattgacttcccacacagctctc

SEQ ID NO: 53764 - DNA, 25 bp, mus musculus
agctctcccggcagactaacctcat

SEQ ID NO: 53765 - DNA, 25 bp, mus musculus
cccggcagactaacctcatagtggt

SEQ ID NO: 53766 - DNA, 25 bp, mus musculus
tttcctggacctctgctgggatcgc

SEQ ID NO: 53767 - DNA, 25 bp, mus musculus
ggacctctgctgggatcgcctacaa

SEQ ID NO: 53768 - DNA, 25 bp, mus musculus
acctcccgagtactgagattcaggc

SEQ ID NO: 53769 - DNA, 25 bp, mus musculus
gtattgctatgcctgacattttcct

SEQ ID NO: 53770 - DNA, 25 bp, mus musculus
ttgctatgcctgacattttccttcc

SEQ ID NO: 53771 - DNA, 25 bp, mus musculus
tcctcttagagccactggcctttac

SEQ ID NO: 53772 - DNA, 25 bp, mus musculus
tcttagagccactggcctttacagc

SEQ ID NO: 53773 - DNA, 25 bp, mus musculus
tagagccactggcctttacagccca

SEQ ID NO: 53774 - DNA, 25 bp, mus musculus
aaaccacctggagacatgcgctggt

SEQ ID NO: 53775 - DNA, 25 bp, mus musculus
cctggagacatgcgctggtatttgg

SEQ ID NO: 53776 - DNA, 25 bp, mus musculus
gacatgcgctggtatttggttaaat

SEQ ID NO: 53777 - DNA, 25 bp, mus musculus
taaatgtcagtgtcaagtggagcat

SEQ ID NO: 53778 - DNA, 25 bp, mus musculus
ccactcagttcttgaaggtacacag

SEQ ID NO: 53779 - DNA, 25 bp, mus musculus
acagaatagccttgaccttgtggca

SEQ ID NO: 53780 - DNA, 25 bp, mus musculus
tagccttgaccttgtggcagaggag

SEQ ID NO: 53781 - DNA, 25 bp, mus musculus
ccttgaccttgtggcagaggagacc

SEQ ID NO: 53782 - DNA, 25 bp, mus musculus
tgaccttgtggcagaggagaccccc

SEQ ID NO: 53783 - DNA, 25 bp, mus musculus
caggatcttctgtagctatgtagct

SEQ ID NO: 53784 - DNA, 25 bp, mus musculus
gatcttctgtagctatgtagctatg

SEQ ID NO: 53785 - DNA, 25 bp, mus musculus
tctacctcccgagtactgagattca

SEQ ID NO: 53786 - DNA, 25 bp, mus musculus
caaagacaccagctttggtatttga

SEQ ID NO: 53787 - DNA, 25 bp, mus musculus
caccagctttggtatttgaataact

SEQ ID NO: 53788 - DNA, 25 bp, mus musculus
actatctgattggggtctggcagag

SEQ ID NO: 53789 - DNA, 25 bp, mus musculus
gttctatcatcctgctcaggagtac

SEQ ID NO: 53790 - DNA, 25 bp, mus musculus
tcctgctcaggagtacaatgttcga

SEQ ID NO: 53791 - DNA, 25 bp, mus musculus
caatgttcgagtggcctcgaggtac

SEQ ID NO: 53792 - DNA, 25 bp, mus musculus
gtacttcaagggaccagagctcctt

SEQ ID NO: 53793 - DNA, 25 bp, mus musculus
caagggaccagagctccttgtggac

SEQ ID NO: 53794 - DNA, 25 bp, mus musculus
gctccttgtggactatcagatgtat

SEQ ID NO: 53795 - DNA, 25 bp, mus musculus
cttggacatgtggagcttgggctgc

SEQ ID NO: 53796 - DNA, 25 bp, mus musculus
gagcttgggctgcatgttagcgagc

SEQ ID NO: 53797 - DNA, 25 bp, mus musculus
cttgggctgcatgttagcgagcatg

SEQ ID NO: 53798 - DNA, 25 bp, mus musculus
attttaagcaactctaccagatcct

SEQ ID NO: 53799 - DNA, 25 bp, mus musculus
ttaagcaactctaccagatcctgac

SEQ ID NO: 53800 - DNA, 25 bp, mus musculus
tctaccagatcctgacagcatcttt

SEQ ID NO: 53801 - DNA, 25 bp, mus musculus
accagatcctgacagcatctttgat

SEQ ID NO: 53802 - DNA, 25 bp, mus musculus
cagcatctttgatatccggttttat

SEQ ID NO: 53803 - DNA, 25 bp, mus musculus
catctttgatatccggttttatatg

SEQ ID NO: 53804 - DNA, 25 bp, mus musculus
acttaaactccgactatctgattgg

SEQ ID NO: 53805 - DNA, 25 bp, mus musculus
ccgactatctgattggggtctggca

SEQ ID NO: 53806 - DNA, 25 bp, mus musculus
tacctcacagtctccattggacctc

SEQ ID NO: 53807 - DNA, 25 bp, mus musculus
ggacctcagccaggaccagcctctg

SEQ ID NO: 53808 - DNA, 25 bp, mus musculus
gcctagggctttcatcttgccttgc

SEQ ID NO: 53809 - DNA, 25 bp, mus musculus
gtcccatctgcagcctcaccaggtg

SEQ ID NO: 53810 - DNA, 25 bp, mus musculus
gggcttgtagcctctattatgcaaa

SEQ ID NO: 53811 - DNA, 25 bp, mus musculus
gtagcctctattatgcaaatattcg

SEQ ID NO: 53812 - DNA, 25 bp, mus musculus
atattcgtagctcagctttcagagc

SEQ ID NO: 53813 - DNA, 25 bp, mus musculus
gtagctcagctttcagagcgctaac

SEQ ID NO: 53814 - DNA, 25 bp, mus musculus
tcagagcgctaactctaaaggaatt

SEQ ID NO: 53815 - DNA, 25 bp, mus musculus
aggaattcacctgagccttgagaga

SEQ ID NO: 53816 - DNA, 25 bp, mus musculus
acatactccaaggtgacctcacatt

SEQ ID NO: 53817 - DNA, 25 bp, mus musculus
gtgacctcacatttgactatcaaat

SEQ ID NO: 53818 - DNA, 25 bp, mus musculus
tgacacttttgttctcagcttctgc

SEQ ID NO: 53819 - DNA, 25 bp, mus musculus
tctcagcttctgccatctgtgacta

SEQ ID NO: 53820 - DNA, 25 bp, mus musculus
ccatctgtgactactgatatcctgg

SEQ ID NO: 53821 - DNA, 25 bp, mus musculus
gtgactactgatatcctggatggac

SEQ ID NO: 53822 - DNA, 25 bp, mus musculus
actgatatcctggatggacaccttg

SEQ ID NO: 53823 - DNA, 25 bp, mus musculus
atcctggatggacaccttgctggac

SEQ ID NO: 53824 - DNA, 25 bp, mus musculus
caccttgctggacttgaagtccgct

SEQ ID NO: 53825 - DNA, 25 bp, mus musculus
gactttgcctagggctttcatcttg

SEQ ID NO: 53826 - DNA, 25 bp, mus musculus
cagtgctctgagcctgagcaatgtg

SEQ ID NO: 53827 - DNA, 25 bp, mus musculus
caatgtggcaggcgtgttctacatc

SEQ ID NO: 53828 - DNA, 25 bp, mus musculus
gattccacagcaatccatcaatgaa

SEQ ID NO: 53829 - DNA, 25 bp, mus musculus
cagccaggacttccccaagtccatg

SEQ ID NO: 53830 - DNA, 25 bp, mus musculus
ggacttccccaagtccatgcaatcc

SEQ ID NO: 53831 - DNA, 25 bp, mus musculus
gtccatgcaatccattccctgcatg

SEQ ID NO: 53832 - DNA, 25 bp, mus musculus
gcaatccattccctgcatgagccac

SEQ ID NO: 53833 - DNA, 25 bp, mus musculus
cattccctgcatgagccacagttca

SEQ ID NO: 53834 - DNA, 25 bp, mus musculus
ctgcatgagccacagttcagggatg

SEQ ID NO: 53835 - DNA, 25 bp, mus musculus
agggatgcccttgggagccacagga

SEQ ID NO: 53836 - DNA, 25 bp, mus musculus
gcccttgggagccacaggattgtaa

SEQ ID NO: 53837 - DNA, 25 bp, mus musculus
ccaccacaaccatatggagggcaat

SEQ ID NO: 53838 - DNA, 25 bp, mus musculus
cgtgttctacatcctgattggaggg

SEQ ID NO: 53839 - DNA, 25 bp, mus musculus
ggcaattcagccaatgtccctgaag

SEQ ID NO: 53840 - DNA, 25 bp, mus musculus
attggccatgctggttgccttaatc

SEQ ID NO: 53841 - DNA, 25 bp, mus musculus
catgctggttgccttaatcgagttc

SEQ ID NO: 53842 - DNA, 25 bp, mus musculus
cttaatcgagttctgctacaaatcc

SEQ ID NO: 53843 - DNA, 25 bp, mus musculus
ctgctacaaatcccgtagcgagtcg

SEQ ID NO: 53844 - DNA, 25 bp, mus musculus
caaatcccgtagcgagtcgaagcgg

SEQ ID NO: 53845 - DNA, 25 bp, mus musculus
ccgtagcgagtcgaagcggatgaag

SEQ ID NO: 53846 - DNA, 25 bp, mus musculus
ctgtttgattccacagcaatccatc

SEQ ID NO: 53847 - DNA, 25 bp, mus musculus
ttgtagcttattggccctgcatcat

SEQ ID NO: 53848 - DNA, 25 bp, mus musculus
cttattggccctgcatcattgtcca

SEQ ID NO: 53849 - DNA, 25 bp, mus musculus
cttcgagcacgagccagtggccagg

SEQ ID NO: 53850 - DNA, 25 bp, mus musculus
agtggccaggctcaacctgtgtgtc

SEQ ID NO: 53851 - DNA, 25 bp, mus musculus
cttccaaggctttgcattctgctca

SEQ ID NO: 53852 - DNA, 25 bp, mus musculus
aggctttgcattctgctcaccgctt

SEQ ID NO: 53853 - DNA, 25 bp, mus musculus
tgcattctgctcaccgcttcaccag

SEQ ID NO: 53854 - DNA, 25 bp, mus musculus
ggctagagactgcctgcctgggctt

SEQ ID NO: 53855 - DNA, 25 bp, mus musculus
tagagactgcctgcctgggcttgac

SEQ ID NO: 53856 - DNA, 25 bp, mus musculus
caggaatgtcccacagaagtaccag

SEQ ID NO: 53857 - DNA, 25 bp, mus musculus
gaatgtcccacagaagtaccagaca

SEQ ID NO: 53858 - DNA, 25 bp, mus musculus
taactactttgtaactgcatgatta

SEQ ID NO: 53859 - DNA, 25 bp, mus musculus
gtagcactatggggcgctctcctca

SEQ ID NO: 53860 - DNA, 25 bp, mus musculus
ctcctcagacctgcaagggacaagg

SEQ ID NO: 53861 - DNA, 25 bp, mus musculus
agacctgcaagggacaagggactct

SEQ ID NO: 53862 - DNA, 25 bp, mus musculus
ttgttcttcccatttgaaggtctat

SEQ ID NO: 53863 - DNA, 25 bp, mus musculus
gaaccataattcaaatcgagtgtcc

SEQ ID NO: 53864 - DNA, 25 bp, mus musculus
acttgggctccctgtttggagtctg

SEQ ID NO: 53865 - DNA, 25 bp, mus musculus
ccctgtttggagtctggcaggcttc

SEQ ID NO: 53866 - DNA, 25 bp, mus musculus
tgtttggagtctggcaggcttcgag

SEQ ID NO: 53867 - DNA, 25 bp, mus musculus
ttgccgcttcttagaactgcgagct

SEQ ID NO: 53868 - DNA, 25 bp, mus musculus
ccgcttcttagaactgcgagctgat

SEQ ID NO: 53869 - DNA, 25 bp, mus musculus
cagtgaccatgcacgtgttctcgct

SEQ ID NO: 53870 - DNA, 25 bp, mus musculus
tgaccatgcacgtgttctcgctggt

SEQ ID NO: 53871 - DNA, 25 bp, mus musculus
ccatgcacgtgttctcgctggtgat

SEQ ID NO: 53872 - DNA, 25 bp, mus musculus
tgcacgtgttctcgctggtgatgat

SEQ ID NO: 53873 - DNA, 25 bp, mus musculus
acgtgttctcgctggtgatgataat

SEQ ID NO: 53874 - DNA, 25 bp, mus musculus
tgttctcgctggtgatgataattgt

SEQ ID NO: 53875 - DNA, 25 bp, mus musculus
taattgtgtgagctgcgttggggta

SEQ ID NO: 53876 - DNA, 25 bp, mus musculus
ttgtgtgagctgcgttggggtacac

SEQ ID NO: 53877 - DNA, 25 bp, mus musculus
tgtgagctgcgttggggtacacaca

SEQ ID NO: 53878 - DNA, 25 bp, mus musculus
atacaggctactgggacttattcct

SEQ ID NO: 53879 - DNA, 25 bp, mus musculus
cttcttagaactgcgagctgatcag

SEQ ID NO: 53880 - DNA, 25 bp, mus musculus
tactgggacttattcctctacatct

SEQ ID NO: 53881 - DNA, 25 bp, mus musculus
agctgatcaggagctcgtgatgtat

SEQ ID NO: 53882 - DNA, 25 bp, mus musculus
tgatcaggagctcgtgatgtattcg

SEQ ID NO: 53883 - DNA, 25 bp, mus musculus
gtattcgcaggacaacatcgactgc

SEQ ID NO: 53884 - DNA, 25 bp, mus musculus
ttcgcaggacaacatcgactgcggc

SEQ ID NO: 53885 - DNA, 25 bp, mus musculus
ggacaacatcgactgcggcatcacc

SEQ ID NO: 53886 - DNA, 25 bp, mus musculus
cctgctgcacgctgggtacgacgat

SEQ ID NO: 53887 - DNA, 25 bp, mus musculus
tgccatgaacagtgaccatgcacgt

SEQ ID NO: 53888 - DNA, 25 bp, mus musculus
atatcgcctgtttttaaagcacgtg

SEQ ID NO: 53889 - DNA, 25 bp, mus musculus
gaaatctgcagctacaactgctatc

SEQ ID NO: 53890 - DNA, 25 bp, mus musculus
gacttcgggttttgcgtacagccat

SEQ ID NO: 53891 - DNA, 25 bp, mus musculus
ttatagctaccaaaagcttcctaca

SEQ ID NO: 53892 - DNA, 25 bp, mus musculus
ctaccaaaagcttcctacagtgaga

SEQ ID NO: 53893 - DNA, 25 bp, mus musculus
agttgttcttagctgtagagctcag

SEQ ID NO: 53894 - DNA, 25 bp, mus musculus
tcttagctgtagagctcagattatc

SEQ ID NO: 53895 - DNA, 25 bp, mus musculus
tagtttctcaccacttcagtctttg

SEQ ID NO: 53896 - DNA, 25 bp, mus musculus
ctcaccacttcagtctttgtgttgt

SEQ ID NO: 53897 - DNA, 25 bp, mus musculus
taattgcccatggcacacacttaaa

SEQ ID NO: 53898 - DNA, 25 bp, mus musculus
gcacacacttaaaccattaggagtc

SEQ ID NO: 53899 - DNA, 25 bp, mus musculus
ttttgcatattgcctaaaaatctaa

SEQ ID NO: 53900 - DNA, 25 bp, mus musculus
cggaatgttcttagccccagatcag

SEQ ID NO: 53901 - DNA, 25 bp, mus musculus
agccccagatcagaagctaaaggac

SEQ ID NO: 53902 - DNA, 25 bp, mus musculus
aaaggacatacggctggtgtcagct

SEQ ID NO: 53903 - DNA, 25 bp, mus musculus
gtcagctaaggctcacattcaaact

SEQ ID NO: 53904 - DNA, 25 bp, mus musculus
taaggctcacattcaaactgacttt

SEQ ID NO: 53905 - DNA, 25 bp, mus musculus
tcacattcaaactgactttctgtta

SEQ ID NO: 53906 - DNA, 25 bp, mus musculus
tctgttacctttcctcggcttctct

SEQ ID NO: 53907 - DNA, 25 bp, mus musculus
acctttcctcggcttctctcacttg

SEQ ID NO: 53908 - DNA, 25 bp, mus musculus
tacctggtgcgagagaacgtatccc

SEQ ID NO: 53909 - DNA, 25 bp, mus musculus
tctaaggcaacgctaactcagaaca

SEQ ID NO: 53910 - DNA, 25 bp, mus musculus
ccagcacttcaactctgtagtctgt

SEQ ID NO: 53911 - DNA, 25 bp, mus musculus
cttcaactctgtagtctgttgtaag

SEQ ID NO: 53912 - DNA, 25 bp, mus musculus
ctctgtagtctgttgtaaggctttg

SEQ ID NO: 53913 - DNA, 25 bp, mus musculus
cggcctttgatgtcttctggttgct

SEQ ID NO: 53914 - DNA, 25 bp, mus musculus
tcttctggttgcttctcaggggcag

SEQ ID NO: 53915 - DNA, 25 bp, mus musculus
ggttgcttctcaggggcagctgcag

SEQ ID NO: 53916 - DNA, 25 bp, mus musculus
ggagtcttgggtccatggattgtca

SEQ ID NO: 53917 - DNA, 25 bp, mus musculus
tctggggtcgcctagtatgtatgtt

SEQ ID NO: 53918 - DNA, 25 bp, mus musculus
ttgcctgtcattattatctgcagtt

SEQ ID NO: 53919 - DNA, 25 bp, mus musculus
attatctgcagttctcgaagtgtat

SEQ ID NO: 53920 - DNA, 25 bp, mus musculus
gcaacgctaactcagaacactaccg

SEQ ID NO: 53921 - DNA, 25 bp, mus musculus
gacagagactttctccgtgtctaat

SEQ ID NO: 53922 - DNA, 25 bp, mus musculus
tgtatatcctcctaggtgaaggagg

SEQ ID NO: 53923 - DNA, 25 bp, mus musculus
tatttattctaacttatgcaggggt

SEQ ID NO: 53924 - DNA, 25 bp, mus musculus
atatgcctccctgctgtaacacaga

SEQ ID NO: 53925 - DNA, 25 bp, mus musculus
ctccctgctgtaacacagatattta

SEQ ID NO: 53926 - DNA, 25 bp, mus musculus
taggactcccagcttggggattagt

SEQ ID NO: 53927 - DNA, 25 bp, mus musculus
tcccagcttggggattagtctgggg

SEQ ID NO: 53928 - DNA, 25 bp, mus musculus
cagggcagaccaacatccacctcgg

SEQ ID NO: 53929 - DNA, 25 bp, mus musculus
gcagaccaacatccacctcggcaaa

SEQ ID NO: 53930 - DNA, 25 bp, mus musculus
tttctgcatccgagtcttctcggag

SEQ ID NO: 53931 - DNA, 25 bp, mus musculus
tgcatccgagtcttctcggagaaga

SEQ ID NO: 53932 - DNA, 25 bp, mus musculus
catccgagtcttctcggagaagaag

SEQ ID NO: 53933 - DNA, 25 bp, mus musculus
agtcttctcggagaagaaggctgac

SEQ ID NO: 53934 - DNA, 25 bp, mus musculus
aaggctgactaccaagctgttgatg

SEQ ID NO: 53935 - DNA, 25 bp, mus musculus
ggctgactaccaagctgttgatgac

SEQ ID NO: 53936 - DNA, 25 bp, mus musculus
ctgactaccaagctgttgatgacga

SEQ ID NO: 53937 - DNA, 25 bp, mus musculus
gactaccaagctgttgatgacgaga

SEQ ID NO: 53938 - DNA, 25 bp, mus musculus
ctaccaagctgttgatgacgagatc

SEQ ID NO: 53939 - DNA, 25 bp, mus musculus
gattgacgccaatgaggaggacatt

SEQ ID NO: 53940 - DNA, 25 bp, mus musculus
tcctcacaacccgagccagggagcg

SEQ ID NO: 53941 - DNA, 25 bp, mus musculus
agataccttcattaacctccgcgag

SEQ ID NO: 53942 - DNA, 25 bp, mus musculus
gaggtcctcaaccgcttcaagctgc

SEQ ID NO: 53943 - DNA, 25 bp, mus musculus
tgcccccgggagagtatgtcctcgt

SEQ ID NO: 53944 - DNA, 25 bp, mus musculus
tcgaaccccacaaggatggcgattt

SEQ ID NO: 53945 - DNA, 25 bp, mus musculus
gaaccccacaaggatggcgatttct

SEQ ID NO: 53946 - DNA, 25 bp, mus musculus
accccacaaggatggcgatttctgc

SEQ ID NO: 53947 - DNA, 25 bp, mus musculus
tggcgatttctgcatccgagtcttc

SEQ ID NO: 53948 - DNA, 25 bp, mus musculus
gttcaaggccaaactgggcaacatg

SEQ ID NO: 53949 - DNA, 25 bp, mus musculus
caacatgagacactgtctcaaaagc

SEQ ID NO: 53950 - DNA, 25 bp, mus musculus
gctcagcccactgtgaaaccactgg

SEQ ID NO: 53951 - DNA, 25 bp, mus musculus
cccactgtgaaaccactgggttctg

SEQ ID NO: 53952 - DNA, 25 bp, mus musculus
gggtcccagtggctgaatcaggagt

SEQ ID NO: 53953 - DNA, 25 bp, mus musculus
accggcttcttgaagccccacatgt

SEQ ID NO: 53954 - DNA, 25 bp, mus musculus
aagccccacatgtacctcgaggcct

SEQ ID NO: 53955 - DNA, 25 bp, mus musculus
cacatgtacctcgaggcctttctgc

SEQ ID NO: 53956 - DNA, 25 bp, mus musculus
tacctcgaggcctttctgcctgcaa

SEQ ID NO: 53957 - DNA, 25 bp, mus musculus
gaggcctttctgcctgcaagcttcg

SEQ ID NO: 53958 - DNA, 25 bp, mus musculus
tggcccagtgcctttggtttgcatt

SEQ ID NO: 53959 - DNA, 25 bp, mus musculus
agtgcctttggtttgcatttgggag

SEQ ID NO: 53960 - DNA, 25 bp, mus musculus
atgctcacggtcctccatttcaacc

SEQ ID NO: 53961 - DNA, 25 bp, mus musculus
ttcaacccacgactgcgatgctggg

SEQ ID NO: 53962 - DNA, 25 bp, mus musculus
tgctgggacatgctgcaaggttggc

SEQ ID NO: 53963 - DNA, 25 bp, mus musculus
ctgcaaggttggcctccctgggtgt

SEQ ID NO: 53964 - DNA, 25 bp, mus musculus
ttggaccagacacctttctgccttt

SEQ ID NO: 53965 - DNA, 25 bp, mus musculus
tcccctctagggaatgcctccattg

SEQ ID NO: 53966 - DNA, 25 bp, mus musculus
aatgcctccattgagggcagaatgt

SEQ ID NO: 53967 - DNA, 25 bp, mus musculus
tctgtcaaccccacaagtgctcagc

SEQ ID NO: 53968 - DNA, 25 bp, mus musculus
tgcaccactcagccctgtttatttg

SEQ ID NO: 53969 - DNA, 25 bp, mus musculus
actcagccctgtttatttgtgtaat

SEQ ID NO: 53970 - DNA, 25 bp, mus musculus
cccattcaatgtgccaaatggcctc

SEQ ID NO: 53971 - DNA, 25 bp, mus musculus
caatgtgccaaatggcctcagtcca

SEQ ID NO: 53972 - DNA, 25 bp, mus musculus
gccaaatggcctcagtccatgtgcc

SEQ ID NO: 53973 - DNA, 25 bp, mus musculus
cagtccgtttgtccgtcctctgtgc

SEQ ID NO: 53974 - DNA, 25 bp, mus musculus
gcagtgacagccctggccaagccac

SEQ ID NO: 53975 - DNA, 25 bp, mus musculus
acagccctggccaagccacttctaa

SEQ ID NO: 53976 - DNA, 25 bp, mus musculus
aagccacttctaatcctctgtagca

SEQ ID NO: 53977 - DNA, 25 bp, mus musculus
cttctaatcctctgtagcaataacg

SEQ ID NO: 53978 - DNA, 25 bp, mus musculus
atcctctgtagcaataacggtgtgc

SEQ ID NO: 53979 - DNA, 25 bp, mus musculus
taatgaaatttctattcctgtctct

SEQ ID NO: 53980 - DNA, 25 bp, mus musculus
agccttgggtccagtgtgtcttcca

SEQ ID NO: 53981 - DNA, 25 bp, mus musculus
agtgtgtcttccaggcctgcctgca

SEQ ID NO: 53982 - DNA, 25 bp, mus musculus
tgctccagggtctctatcctttgtt

SEQ ID NO: 53983 - DNA, 25 bp, mus musculus
tccaaccctggttgtcaggcccagc

SEQ ID NO: 53984 - DNA, 25 bp, mus musculus
tgtcaggcccagccagcaaaggccc

SEQ ID NO: 53985 - DNA, 25 bp, mus musculus
cggaggcccagtcttcccagacgtg

SEQ ID NO: 53986 - DNA, 25 bp, mus musculus
agacgtgctaaccccattcaatgtg

SEQ ID NO: 53987 - DNA, 25 bp, mus musculus
gctaaccccattcaatgtgccaaat

SEQ ID NO: 53988 - DNA, 25 bp, mus musculus
aacatagcatgacttccgcagacta

SEQ ID NO: 53989 - DNA, 25 bp, mus musculus
atagcatgacttccgcagactagtt

SEQ ID NO: 53990 - DNA, 25 bp, mus musculus
cttctagcatccttgtatcatgcgt

SEQ ID NO: 53991 - DNA, 25 bp, mus musculus
ctagcatccttgtatcatgcgtcga

SEQ ID NO: 53992 - DNA, 25 bp, mus musculus
tccttgtatcatgcgtcgacaggat

SEQ ID NO: 53993 - DNA, 25 bp, mus musculus
ttgtatcatgcgtcgacaggatcag

SEQ ID NO: 53994 - DNA, 25 bp, mus musculus
tatcatgcgtcgacaggatcagctc

SEQ ID NO: 53995 - DNA, 25 bp, mus musculus
tcagctccttgaggacatcgtgacg

SEQ ID NO: 53996 - DNA, 25 bp, mus musculus
gctccttgaggacatcgtgacgcca

SEQ ID NO: 53997 - DNA, 25 bp, mus musculus
ggacatcgtgacgccagtgagcagc

SEQ ID NO: 53998 - DNA, 25 bp, mus musculus
catcgtgacgccagtgagcagcgtg

SEQ ID NO: 53999 - DNA, 25 bp, mus musculus
cgtgacgccagtgagcagcgtgtcc

SEQ ID NO: 54000 - DNA, 25 bp, mus musculus
gcatgacttccgcagactagttgat

SEQ ID NO: 54001 - DNA, 25 bp, mus musculus
cagcgtgtccagcctgaatgatgag

SEQ ID NO: 54002 - DNA, 25 bp, mus musculus
cttccgcagactagttgatattgag

SEQ ID NO: 54003 - DNA, 25 bp, mus musculus
tattgagcacggtgacctgctgaag

SEQ ID NO: 54004 - DNA, 25 bp, mus musculus
cggtgacctgctgaagcctgataga

SEQ ID NO: 54005 - DNA, 25 bp, mus musculus
tgacctgctgaagcctgatagagat

SEQ ID NO: 54006 - DNA, 25 bp, mus musculus
agattacaacgacttctagcatcct

SEQ ID NO: 54007 - DNA, 25 bp, mus musculus
ttacaacgacttctagcatccttgt

SEQ ID NO: 54008 - DNA, 25 bp, mus musculus
cgacttctagcatccttgtatcatg

SEQ ID NO: 54009 - DNA, 25 bp, mus musculus
gtcgctgacaacctggagcaacaca

SEQ ID NO: 54010 - DNA, 25 bp, mus musculus
gctgacaacctggagcaacacaagc

SEQ ID NO: 54011 - DNA, 25 bp, mus musculus
ttatggtcactctctatgcctactg

SEQ ID NO: 54012 - DNA, 25 bp, mus musculus
tggtcactctctatgcctactggac

SEQ ID NO: 54013 - DNA, 25 bp, mus musculus
acctcttggatgtgaatcgtgagct

SEQ ID NO: 54014 - DNA, 25 bp, mus musculus
tgaatcgtgagctcgccctgtacta

SEQ ID NO: 54015 - DNA, 25 bp, mus musculus
gtgagctcgccctgtactaatgaga

SEQ ID NO: 54016 - DNA, 25 bp, mus musculus
agctcgccctgtactaatgagactg

SEQ ID NO: 54017 - DNA, 25 bp, mus musculus
tcgccctgtactaatgagactgtga

SEQ ID NO: 54018 - DNA, 25 bp, mus musculus
atgctgttgttatcacagggacctc

SEQ ID NO: 54019 - DNA, 25 bp, mus musculus
ttgttatcacagggacctctcttct

SEQ ID NO: 54020 - DNA, 25 bp, mus musculus
ttatcacagggacctctcttctcgc

SEQ ID NO: 54021 - DNA, 25 bp, mus musculus
gacaacctggagcaacacaagctgc

SEQ ID NO: 54022 - DNA, 25 bp, mus musculus
tcgctgagcctgtggttgaggctga

SEQ ID NO: 54023 - DNA, 25 bp, mus musculus
gagcaacacaagctgctggcacaag

SEQ ID NO: 54024 - DNA, 25 bp, mus musculus
caacacaagctgctggcacaagaac

SEQ ID NO: 54025 - DNA, 25 bp, mus musculus
tctctacctgaatagggaagcagtt

SEQ ID NO: 54026 - DNA, 25 bp, mus musculus
ggcaacccggaggtgacgtgatcct

SEQ ID NO: 54027 - DNA, 25 bp, mus musculus
accacggtgacctgtgctaccttat

SEQ ID NO: 54028 - DNA, 25 bp, mus musculus
acctgtgctaccttatggtcactct

SEQ ID NO: 54029 - DNA, 25 bp, mus musculus
tgtgctaccttatggtcactctcta

SEQ ID NO: 54030 - DNA, 25 bp, mus musculus
tcggatcatggtcgtggagaagccc

SEQ ID NO: 54031 - DNA, 25 bp, mus musculus
ggacagagaatcccttcgagtacga

SEQ ID NO: 54032 - DNA, 25 bp, mus musculus
gcctcctcatcattctcagcaaaag

SEQ ID NO: 54033 - DNA, 25 bp, mus musculus
cctcctcatcattctcagcaaaagg

SEQ ID NO: 54034 - DNA, 25 bp, mus musculus
catcattctcagcaaaaggttccgc

SEQ ID NO: 54035 - DNA, 25 bp, mus musculus
atcattctcagcaaaaggttccgct

SEQ ID NO: 54036 - DNA, 25 bp, mus musculus
tcattctcagcaaaaggttccgctg

SEQ ID NO: 54037 - DNA, 25 bp, mus musculus
cattctcagcaaaaggttccgctgt

SEQ ID NO: 54038 - DNA, 25 bp, mus musculus
attctcagcaaaaggttccgctgtg

SEQ ID NO: 54039 - DNA, 25 bp, mus musculus
ttctcagcaaaaggttccgctgtgg

SEQ ID NO: 54040 - DNA, 25 bp, mus musculus
tctcagcaaaaggttccgctgtggg

SEQ ID NO: 54041 - DNA, 25 bp, mus musculus
ctcagcaaaaggttccgctgtgggg

SEQ ID NO: 54042 - DNA, 25 bp, mus musculus
gacagagaatcccttcgagtacgac

SEQ ID NO: 54043 - DNA, 25 bp, mus musculus
cagagaatcccttcgagtacgacta

SEQ ID NO: 54044 - DNA, 25 bp, mus musculus
agagaatcccttcgagtacgactat

SEQ ID NO: 54045 - DNA, 25 bp, mus musculus
agaatcccttcgagtacgactatga

SEQ ID NO: 54046 - DNA, 25 bp, mus musculus
tcccttcgagtacgactatgaaaca

SEQ ID NO: 54047 - DNA, 25 bp, mus musculus
cccttcgagtacgactatgaaacag

SEQ ID NO: 54048 - DNA, 25 bp, mus musculus
tcgtgggcctcctcatcattctcag

SEQ ID NO: 54049 - DNA, 25 bp, mus musculus
ggcctcctcatcattctcagcaaaa

SEQ ID NO: 54050 - DNA, 25 bp, mus musculus
ctggtcaacttgaacactgttactg

SEQ ID NO: 54051 - DNA, 25 bp, mus musculus
tttctaactttacagaattgcctgt

SEQ ID NO: 54052 - DNA, 25 bp, mus musculus
cagactgttacttggcttctgaaaa

SEQ ID NO: 54053 - DNA, 25 bp, mus musculus
cagcctgtgccccttacgttttctg

SEQ ID NO: 54054 - DNA, 25 bp, mus musculus
ggtttctctcttgccatgatgactt

SEQ ID NO: 54055 - DNA, 25 bp, mus musculus
tctcttgccatgatgacttctaatt

SEQ ID NO: 54056 - DNA, 25 bp, mus musculus
tctaattgccatcgtatagtatgtt

SEQ ID NO: 54057 - DNA, 25 bp, mus musculus
agataactcactgtaaacagactgt

SEQ ID NO: 54058 - DNA, 25 bp, mus musculus
ctcactgtaaacagactgtaactgc

SEQ ID NO: 54059 - DNA, 25 bp, mus musculus
agcgcttataaatcaacctaacatt

SEQ ID NO: 54060 - DNA, 25 bp, mus musculus
tataaatcaacctaacatttataag

SEQ ID NO: 54061 - DNA, 25 bp, mus musculus
catttataagatttcctctgacttg

SEQ ID NO: 54062 - DNA, 25 bp, mus musculus
ctaactttacagaattgcctgtttg

SEQ ID NO: 54063 - DNA, 25 bp, mus musculus
ttacagaattgcctgtttgtttcaa

SEQ ID NO: 54064 - DNA, 25 bp, mus musculus
cagaattgcctgtttgtttcaatgt

SEQ ID NO: 54065 - DNA, 25 bp, mus musculus
aattgcctgtttgtttcaatgtctc

SEQ ID NO: 54066 - DNA, 25 bp, mus musculus
cacttgtctcctatgagactcatag

SEQ ID NO: 54067 - DNA, 25 bp, mus musculus
atgagactcatagccagacagactg

SEQ ID NO: 54068 - DNA, 25 bp, mus musculus
ctcatagccagacagactgttactt

SEQ ID NO: 54069 - DNA, 25 bp, mus musculus
atagccagacagactgttacttggc

SEQ ID NO: 54070 - DNA, 25 bp, mus musculus
cagctacattcctcaaataccaggc

SEQ ID NO: 54071 - DNA, 25 bp, mus musculus
cattcctcaaataccaggcatttaa

SEQ ID NO: 54072 - DNA, 25 bp, mus musculus
atggccacactagcctcagtgctac

SEQ ID NO: 54073 - DNA, 25 bp, mus musculus
acactagcctcagtgctactagaca

SEQ ID NO: 54074 - DNA, 25 bp, mus musculus
gcctcagtgctactagacattcctc

SEQ ID NO: 54075 - DNA, 25 bp, mus musculus
attcctcctcaccagatggaagaga

SEQ ID NO: 54076 - DNA, 25 bp, mus musculus
acctcatgctgcctagcaatatttt

SEQ ID NO: 54077 - DNA, 25 bp, mus musculus
tgctgcctagcaatattttgggggc

SEQ ID NO: 54078 - DNA, 25 bp, mus musculus
atgtcccctgaccaattccatactc

SEQ ID NO: 54079 - DNA, 25 bp, mus musculus
cctgaccaattccatactccatggt

SEQ ID NO: 54080 - DNA, 25 bp, mus musculus
caattccatactccatggtcaacct

SEQ ID NO: 54081 - DNA, 25 bp, mus musculus
cacctatgggcagcctccttaccaa

SEQ ID NO: 54082 - DNA, 25 bp, mus musculus
cagggccaccactggccctatctga

SEQ ID NO: 54083 - DNA, 25 bp, mus musculus
tgccattaaatcctcaaaacagtta

SEQ ID NO: 54084 - DNA, 25 bp, mus musculus
tggccctatctgagccacccatctt

SEQ ID NO: 54085 - DNA, 25 bp, mus musculus
tatctgagccacccatctttccaca

SEQ ID NO: 54086 - DNA, 25 bp, mus musculus
agaatgcctatcagtctgcccctgg

SEQ ID NO: 54087 - DNA, 25 bp, mus musculus
aaaccagacttcccagaggctatgg

SEQ ID NO: 54088 - DNA, 25 bp, mus musculus
gctatgggcaagctcctcaaaactt

SEQ ID NO: 54089 - DNA, 25 bp, mus musculus
ggcaagctcctcaaaacttgaagga

SEQ ID NO: 54090 - DNA, 25 bp, mus musculus
tcaaggacacctatgtgagaggacc

SEQ ID NO: 54091 - DNA, 25 bp, mus musculus
gatccgattgtcatgatgagcccga

SEQ ID NO: 54092 - DNA, 25 bp, mus musculus
attgtcatgatgagcccgaggctcg

SEQ ID NO: 54093 - DNA, 25 bp, mus musculus
atctgccgaggtatctctgatgata

SEQ ID NO: 54094 - DNA, 25 bp, mus musculus
aagatccggatctttgcatttgaga

SEQ ID NO: 54095 - DNA, 25 bp, mus musculus
atccggatctttgcatttgagacgg

SEQ ID NO: 54096 - DNA, 25 bp, mus musculus
tgtgttcgtactttgagtgcatata

SEQ ID NO: 54097 - DNA, 25 bp, mus musculus
gttcgtactttgagtgcatataatg

SEQ ID NO: 54098 - DNA, 25 bp, mus musculus
tgagcaactcatttattgagcagta

SEQ ID NO: 54099 - DNA, 25 bp, mus musculus
agcagtagacgctacgcgtatttgt

SEQ ID NO: 54100 - DNA, 25 bp, mus musculus
agtagacgctacgcgtatttgtgca

SEQ ID NO: 54101 - DNA, 25 bp, mus musculus
agacgctacgcgtatttgtgcatgt

SEQ ID NO: 54102 - DNA, 25 bp, mus musculus
cgctacgcgtatttgtgcatgtaga

SEQ ID NO: 54103 - DNA, 25 bp, mus musculus
gcttggtgctaccggtattgttgga

SEQ ID NO: 54104 - DNA, 25 bp, mus musculus
tggtgctaccggtattgttggacta

SEQ ID NO: 54105 - DNA, 25 bp, mus musculus
tgctaccggtattgttggactatgc

SEQ ID NO: 54106 - DNA, 25 bp, mus musculus
atgccatatgcatagtcgcgtatct

SEQ ID NO: 54107 - DNA, 25 bp, mus musculus
ccatatgcatagtcgcgtatctgcc

SEQ ID NO: 54108 - DNA, 25 bp, mus musculus
tatgcatagtcgcgtatctgccgag

SEQ ID NO: 54109 - DNA, 25 bp, mus musculus
gcatagtcgcgtatctgccgaggta

SEQ ID NO: 54110 - DNA, 25 bp, mus musculus
cgtatctgccgaggtatctctgatg

SEQ ID NO: 54111 - DNA, 25 bp, mus musculus
gtatgctacactcaactactattca

SEQ ID NO: 54112 - DNA, 25 bp, mus musculus
caactactattcaagctgtcgaaag

SEQ ID NO: 54113 - DNA, 25 bp, mus musculus
ctgccagagcttcttctgctgctat

SEQ ID NO: 54114 - DNA, 25 bp, mus musculus
cttctgctgctatgaggagtgcaag

SEQ ID NO: 54115 - DNA, 25 bp, mus musculus
ctcctggaggagaggccgcatccac

SEQ ID NO: 54116 - DNA, 25 bp, mus musculus
aggccgcatccacattgatgtctct

SEQ ID NO: 54117 - DNA, 25 bp, mus musculus
tgtctctgagctggactcctactct

SEQ ID NO: 54118 - DNA, 25 bp, mus musculus
tgagctggactcctactctcgggtc

SEQ ID NO: 54119 - DNA, 25 bp, mus musculus
atacctgtatctttaagtgctgctc

SEQ ID NO: 54120 - DNA, 25 bp, mus musculus
ttaagtgctgctctgagggatgact

SEQ ID NO: 54121 - DNA, 25 bp, mus musculus
gctgctctgagggatgactgaagag

SEQ ID NO: 54122 - DNA, 25 bp, mus musculus
aggacacgactccagtttgttgtgc

SEQ ID NO: 54123 - DNA, 25 bp, mus musculus
ctattcaagctgtcgaaagccaacc

SEQ ID NO: 54124 - DNA, 25 bp, mus musculus
ttcgttattacatccagattccaca

SEQ ID NO: 54125 - DNA, 25 bp, mus musculus
tccagattccacaagatggattcct

SEQ ID NO: 54126 - DNA, 25 bp, mus musculus
ttccacaagatggattcctgatcga

SEQ ID NO: 54127 - DNA, 25 bp, mus musculus
agcaccctctaattactctctactg

SEQ ID NO: 54128 - DNA, 25 bp, mus musculus
ctctaattactctctactggacatg

SEQ ID NO: 54129 - DNA, 25 bp, mus musculus
ttccatgtactggcaggaatttgag

SEQ ID NO: 54130 - DNA, 25 bp, mus musculus
atttgaggacacctgtgtctatgag

SEQ ID NO: 54131 - DNA, 25 bp, mus musculus
agtcacctgtgagtcagccgcagag

SEQ ID NO: 54132 - DNA, 25 bp, mus musculus
ctgtgagtcagccgcagagtccagc

SEQ ID NO: 54133 - DNA, 25 bp, mus musculus
cttccccacagcattctgcattgag

SEQ ID NO: 54134 - DNA, 25 bp, mus musculus
cacagcattctgcattgagctactc

SEQ ID NO: 54135 - DNA, 25 bp, mus musculus
attctgcattgagctactcacttga

SEQ ID NO: 54136 - DNA, 25 bp, mus musculus
gctactcacttgacactgacccagg

SEQ ID NO: 54137 - DNA, 25 bp, mus musculus
accaggcagcatctgaggacctgct

SEQ ID NO: 54138 - DNA, 25 bp, mus musculus
acgacactagcacggacctcacgga

SEQ ID NO: 54139 - DNA, 25 bp, mus musculus
ctagcacggacctcacggacgtgat

SEQ ID NO: 54140 - DNA, 25 bp, mus musculus
cggacctcacggacgtgatggagca

SEQ ID NO: 54141 - DNA, 25 bp, mus musculus
agatcaacagcacgtttccctcttg

SEQ ID NO: 54142 - DNA, 25 bp, mus musculus
cctcttgcagctcaaatgtccccag

SEQ ID NO: 54143 - DNA, 25 bp, mus musculus
gtcagccgcagagtccagctcagat

SEQ ID NO: 54144 - DNA, 25 bp, mus musculus
ccccagcaggccacaggcaatgtga

SEQ ID NO: 54145 - DNA, 25 bp, mus musculus
aagctaaactcctgcggcagcacaa

SEQ ID NO: 54146 - DNA, 25 bp, mus musculus
aactcctgcggcagcacaaagggcg

SEQ ID NO: 54147 - DNA, 25 bp, mus musculus
agtctcagctgcaccgcctcagaca

SEQ ID NO: 54148 - DNA, 25 bp, mus musculus
accgcctcagacagctcctggagca

SEQ ID NO: 54149 - DNA, 25 bp, mus musculus
agctcctggagcagcctgactctga

SEQ ID NO: 54150 - DNA, 25 bp, mus musculus
tggagcagcctgactctgactcccg

SEQ ID NO: 54151 - DNA, 25 bp, mus musculus
actctgactcccgcatcaatggtgt

SEQ ID NO: 54152 - DNA, 25 bp, mus musculus
gacccgaacagcctgccctggtatc

SEQ ID NO: 54153 - DNA, 25 bp, mus musculus
agcctgccctggtatcctggtgctc

SEQ ID NO: 54154 - DNA, 25 bp, mus musculus
actccagctgttactgctgctactg

SEQ ID NO: 54155 - DNA, 25 bp, mus musculus
cctggtgcagcccctgaatcgtgca

SEQ ID NO: 54156 - DNA, 25 bp, mus musculus
gcagcccctgaatcgtgcacggaat

SEQ ID NO: 54157 - DNA, 25 bp, mus musculus
gcccctgaatcgtgcacggaatctg

SEQ ID NO: 54158 - DNA, 25 bp, mus musculus
tgcacggaatctgctgccattggag

SEQ ID NO: 54159 - DNA, 25 bp, mus musculus
tctgctgccattggagacacgctcc

SEQ ID NO: 54160 - DNA, 25 bp, mus musculus
acgctccacatacactacacgggca

SEQ ID NO: 54161 - DNA, 25 bp, mus musculus
cacatacactacacgggcagtttgg

SEQ ID NO: 54162 - DNA, 25 bp, mus musculus
attattgacacttctctgaccagag

SEQ ID NO: 54163 - DNA, 25 bp, mus musculus
attgacacttctctgaccagagatc

SEQ ID NO: 54164 - DNA, 25 bp, mus musculus
ctgccctggtatcctggtgctctga

SEQ ID NO: 54165 - DNA, 25 bp, mus musculus
tatcctggtgctctgacccggtcca

SEQ ID NO: 54166 - DNA, 25 bp, mus musculus
ggtgctctgacccggtccaatcatg

SEQ ID NO: 54167 - DNA, 25 bp, mus musculus
acccggtccaatcatgaccctgagc

SEQ ID NO: 54168 - DNA, 25 bp, mus musculus
cggtccaatcatgaccctgagccct

SEQ ID NO: 54169 - DNA, 25 bp, mus musculus
aatcatgaccctgagccctttgctc

SEQ ID NO: 54170 - DNA, 25 bp, mus musculus
cctaccactccagctgttactgctg

SEQ ID NO: 54171 - DNA, 25 bp, mus musculus
accactccagctgttactgctgcta

SEQ ID NO: 54172 - DNA, 25 bp, mus musculus
ttttatactacagccctgattcctc

SEQ ID NO: 54173 - DNA, 25 bp, mus musculus
actacagccctgattcctcggagca

SEQ ID NO: 54174 - DNA, 25 bp, mus musculus
cttgcgttatgtccctactcgccac

SEQ ID NO: 54175 - DNA, 25 bp, mus musculus
aactaagattctcacacacctcctg

SEQ ID NO: 54176 - DNA, 25 bp, mus musculus
gacgctgaaaccaacgtttctctag

SEQ ID NO: 54177 - DNA, 25 bp, mus musculus
gatctgcatgctttcttcagagagc

SEQ ID NO: 54178 - DNA, 25 bp, mus musculus
catgctttcttcagagagcttatat

SEQ ID NO: 54179 - DNA, 25 bp, mus musculus
tctgccaagccaccaagggccgtgt

SEQ ID NO: 54180 - DNA, 25 bp, mus musculus
ccgcagctgcacactcatagtcttc

SEQ ID NO: 54181 - DNA, 25 bp, mus musculus
actcatagtcttcagtggaatagtg

SEQ ID NO: 54182 - DNA, 25 bp, mus musculus
cctccaactgcctttacatcataga

SEQ ID NO: 54183 - DNA, 25 bp, mus musculus
actgcctttacatcatagaagacaa

SEQ ID NO: 54184 - DNA, 25 bp, mus musculus
gccctgattcctcggagcatcaagt

SEQ ID NO: 54185 - DNA, 25 bp, mus musculus
atcaagtgcataccgtagtatccag

SEQ ID NO: 54186 - DNA, 25 bp, mus musculus
tgcataccgtagtatccagatttcc

SEQ ID NO: 54187 - DNA, 25 bp, mus musculus
tatccagatttccacacatcccatg

SEQ ID NO: 54188 - DNA, 25 bp, mus musculus
tcccatggggactcagcaggatggc

SEQ ID NO: 54189 - DNA, 25 bp, mus musculus
caattgtgatccaaatcatgagttg

SEQ ID NO: 54190 - DNA, 25 bp, mus musculus
attctgagtccatttttgatcacat

SEQ ID NO: 54191 - DNA, 25 bp, mus musculus
tttttgatcacatatttgaaatgag

SEQ ID NO: 54192 - DNA, 25 bp, mus musculus
agcttattttcctgcaatgaaagca

SEQ ID NO: 54193 - DNA, 25 bp, mus musculus
tgtgaatttacccacagaaaatgaa

SEQ ID NO: 54194 - DNA, 25 bp, mus musculus
atcacaagtagctgaacttaagaaa

SEQ ID NO: 54195 - DNA, 25 bp, mus musculus
tgacaaaccagaccagatggctgca

SEQ ID NO: 54196 - DNA, 25 bp, mus musculus
caaaccagaccagatggctgcactc

SEQ ID NO: 54197 - DNA, 25 bp, mus musculus
ccagatggctgcactctttaaaaga

SEQ ID NO: 54198 - DNA, 25 bp, mus musculus
gatggctgcactctttaaaagatta

SEQ ID NO: 54199 - DNA, 25 bp, mus musculus
ggctgcactctttaaaagattatca

SEQ ID NO: 54200 - DNA, 25 bp, mus musculus
atcatctgttgacagtgtcttgaaa

SEQ ID NO: 54201 - DNA, 25 bp, mus musculus
atctgttgacagtgtcttgaaaagg

SEQ ID NO: 54202 - DNA, 25 bp, mus musculus
tccttcctcgtgagctccattgaag

SEQ ID NO: 54203 - DNA, 25 bp, mus musculus
ctgtcctcggctgctgggttaccat

SEQ ID NO: 54204 - DNA, 25 bp, mus musculus
attaacattcaatgcagaggaatat

SEQ ID NO: 54205 - DNA, 25 bp, mus musculus
atcattatcagagctcctaggccca

SEQ ID NO: 54206 - DNA, 25 bp, mus musculus
attatcagagctcctaggcccatat

SEQ ID NO: 54207 - DNA, 25 bp, mus musculus
agagctcctaggcccatatgggatg

SEQ ID NO: 54208 - DNA, 25 bp, mus musculus
cctaggcccatatgggatgaagttc

SEQ ID NO: 54209 - DNA, 25 bp, mus musculus
gagccttatgtggcacatttcatca

SEQ ID NO: 54210 - DNA, 25 bp, mus musculus
gcacatttcatcacaagtagctgaa

SEQ ID NO: 54211 - DNA, 25 bp, mus musculus
catttcatcacaagtagctgaactt

SEQ ID NO: 54212 - DNA, 25 bp, mus musculus
cccaggattgacccaccagacaggg

SEQ ID NO: 54213 - DNA, 25 bp, mus musculus
gacccaccagacaggggacatgggt

SEQ ID NO: 54214 - DNA, 25 bp, mus musculus
ccagatgtgaccccaacgcctgcag

SEQ ID NO: 54215 - DNA, 25 bp, mus musculus
cactcctctggtgtttgaaggcttc

SEQ ID NO: 54216 - DNA, 25 bp, mus musculus
tcctctggtgtttgaaggcttccct

SEQ ID NO: 54217 - DNA, 25 bp, mus musculus
tgcccctgtgcaggccctgattagg

SEQ ID NO: 54218 - DNA, 25 bp, mus musculus
ccctgtgcaggccctgattaggtgt

SEQ ID NO: 54219 - DNA, 25 bp, mus musculus
gcaggccctgattaggtgtgctaga

SEQ ID NO: 54220 - DNA, 25 bp, mus musculus
aggggccacacatgacccacacggg

SEQ ID NO: 54221 - DNA, 25 bp, mus musculus
gcccctgcactgccaggaaatgtga

SEQ ID NO: 54222 - DNA, 25 bp, mus musculus
cctgcactgccaggaaatgtgaaat

SEQ ID NO: 54223 - DNA, 25 bp, mus musculus
aatgtgaaattccctgtgtggacca

SEQ ID NO: 54224 - DNA, 25 bp, mus musculus
ccaccagacaggggacatgggtgtc

SEQ ID NO: 54225 - DNA, 25 bp, mus musculus
ttcatctctttcacatcagtttgtg

SEQ ID NO: 54226 - DNA, 25 bp, mus musculus
atctctttcacatcagtttgtggtt

SEQ ID NO: 54227 - DNA, 25 bp, mus musculus
aattacaggcagtttcaatgaaaga

SEQ ID NO: 54228 - DNA, 25 bp, mus musculus
atactgcaggcattctgagggacta

SEQ ID NO: 54229 - DNA, 25 bp, mus musculus
aagtttgctttcccacgactctcag

SEQ ID NO: 54230 - DNA, 25 bp, mus musculus
tttgctttcccacgactctcagact

SEQ ID NO: 54231 - DNA, 25 bp, mus musculus
aagccagatgtgaccccaacgcctg

SEQ ID NO: 54232 - DNA, 25 bp, mus musculus
agttgttcacgcaaggagctggacc

SEQ ID NO: 54233 - DNA, 25 bp, mus musculus
gttgttcacgcaaggagctggacca

SEQ ID NO: 54234 - DNA, 25 bp, mus musculus
caggtcaagatcctgctgcgagaag

SEQ ID NO: 54235 - DNA, 25 bp, mus musculus
aggtcaagatcctgctgcgagaagg

SEQ ID NO: 54236 - DNA, 25 bp, mus musculus
ggtcaagatcctgctgcgagaaggc

SEQ ID NO: 54237 - DNA, 25 bp, mus musculus
gtcaagatcctgctgcgagaaggct

SEQ ID NO: 54238 - DNA, 25 bp, mus musculus
caagatcctgctgcgagaaggctac

SEQ ID NO: 54239 - DNA, 25 bp, mus musculus
aagatcctgctgcgagaaggctaca

SEQ ID NO: 54240 - DNA, 25 bp, mus musculus
agatcctgctgcgagaaggctacag

SEQ ID NO: 54241 - DNA, 25 bp, mus musculus
gatcctgctgcgagaaggctacaga

SEQ ID NO: 54242 - DNA, 25 bp, mus musculus
atcctgctgcgagaaggctacagag

SEQ ID NO: 54243 - DNA, 25 bp, mus musculus
tcctgctgcgagaaggctacagaga

SEQ ID NO: 54244 - DNA, 25 bp, mus musculus
ttgttcacgcaaggagctggaccag

SEQ ID NO: 54245 - DNA, 25 bp, mus musculus
gttcacgcaaggagctggaccagtg

SEQ ID NO: 54246 - DNA, 25 bp, mus musculus
ttcacgcaaggagctggaccagtgg

SEQ ID NO: 54247 - DNA, 25 bp, mus musculus
ccgagtcccaggtcaagatcctgct

SEQ ID NO: 54248 - DNA, 25 bp, mus musculus
cgagtcccaggtcaagatcctgctg

SEQ ID NO: 54249 - DNA, 25 bp, mus musculus
agtcccaggtcaagatcctgctgcg

SEQ ID NO: 54250 - DNA, 25 bp, mus musculus
cccaggtcaagatcctgctgcgaga

SEQ ID NO: 54251 - DNA, 25 bp, mus musculus
ccaggtcaagatcctgctgcgagaa

SEQ ID NO: 54252 - DNA, 25 bp, mus musculus
gctgcaaaggctgctcctgctgctg

SEQ ID NO: 54253 - DNA, 25 bp, mus musculus
gggccttcaggagccctggttcatc

SEQ ID NO: 54254 - DNA, 25 bp, mus musculus
cacgttccagtggatgtctggctgt

SEQ ID NO: 54255 - DNA, 25 bp, mus musculus
ccagtggatgtctggctgtgacctc

SEQ ID NO: 54256 - DNA, 25 bp, mus musculus
aacacgtgaactgtggcggacatgg

SEQ ID NO: 54257 - DNA, 25 bp, mus musculus
atcacccgacacaactgccaggagg

SEQ ID NO: 54258 - DNA, 25 bp, mus musculus
acccgacacaactgccaggaggctg

SEQ ID NO: 54259 - DNA, 25 bp, mus musculus
cgacacaactgccaggaggctggtg

SEQ ID NO: 54260 - DNA, 25 bp, mus musculus
cacaactgccaggaggctggtgctg

SEQ ID NO: 54261 - DNA, 25 bp, mus musculus
caactgccaggaggctggtgctgca

SEQ ID NO: 54262 - DNA, 25 bp, mus musculus
aactgccaggaggctggtgctgcag

SEQ ID NO: 54263 - DNA, 25 bp, mus musculus
actgccaggaggctggtgctgcaga

SEQ ID NO: 54264 - DNA, 25 bp, mus musculus
ccttcaggagccctggttcatctct

SEQ ID NO: 54265 - DNA, 25 bp, mus musculus
tccgagatacgagcctcgtgtgtcg

SEQ ID NO: 54266 - DNA, 25 bp, mus musculus
gagatacgagcctcgtgtgtcgtgg

SEQ ID NO: 54267 - DNA, 25 bp, mus musculus
gatacagatcgccaagagcaatgag

SEQ ID NO: 54268 - DNA, 25 bp, mus musculus
acagatcgccaagagcaatgagcag

SEQ ID NO: 54269 - DNA, 25 bp, mus musculus
gaacgcgctgcgctactacaaccag

SEQ ID NO: 54270 - DNA, 25 bp, mus musculus
cgcgctgcgctactacaaccagagc

SEQ ID NO: 54271 - DNA, 25 bp, mus musculus
ctctcacacgttccagtggatgtct

SEQ ID NO: 54272 - DNA, 25 bp, mus musculus
aaaccttgcataagtcctcattcta

SEQ ID NO: 54273 - DNA, 25 bp, mus musculus
ataagtcctcattctaccacatgtt

SEQ ID NO: 54274 - DNA, 25 bp, mus musculus
tctattactaatctagttagtgcag

SEQ ID NO: 54275 - DNA, 25 bp, mus musculus
tgtgtttggtcttaggcctagattg

SEQ ID NO: 54276 - DNA, 25 bp, mus musculus
agaacacagcttcaacttcttggac

SEQ ID NO: 54277 - DNA, 25 bp, mus musculus
acacagcttcaacttcttggacctc

SEQ ID NO: 54278 - DNA, 25 bp, mus musculus
ggacctctgccaatgaagatgggtt

SEQ ID NO: 54279 - DNA, 25 bp, mus musculus
cctctgccaatgaagatgggttagg

SEQ ID NO: 54280 - DNA, 25 bp, mus musculus
taggttacacctggttactatactg

SEQ ID NO: 54281 - DNA, 25 bp, mus musculus
gttacacctggttactatactggca

SEQ ID NO: 54282 - DNA, 25 bp, mus musculus
tatactggcaaaatcccttttatag

SEQ ID NO: 54283 - DNA, 25 bp, mus musculus
ggcaaaatcccttttatagagatgg

SEQ ID NO: 54284 - DNA, 25 bp, mus musculus
agtcctcattctaccacatgttcac

SEQ ID NO: 54285 - DNA, 25 bp, mus musculus
cctcattctaccacatgttcactaa

SEQ ID NO: 54286 - DNA, 25 bp, mus musculus
tctaccacatgttcactaacccctg

SEQ ID NO: 54287 - DNA, 25 bp, mus musculus
gaccctctggctggtaacacaacac

SEQ ID NO: 54288 - DNA, 25 bp, mus musculus
aagctattcacaccagcatcatcta

SEQ ID NO: 54289 - DNA, 25 bp, mus musculus
ttcacaccagcatcatctattacta

SEQ ID NO: 54290 - DNA, 25 bp, mus musculus
acaccagcatcatctattactaatc

SEQ ID NO: 54291 - DNA, 25 bp, mus musculus
tcatctattactaatctagttagtg

SEQ ID NO: 54292 - DNA, 25 bp, mus musculus
tatgaatgggggcaccgtggaacag

SEQ ID NO: 54293 - DNA, 25 bp, mus musculus
caccgtggaacagctgctcagctcc

SEQ ID NO: 54294 - DNA, 25 bp, mus musculus
agacctcacatccaagaactgtctg

SEQ ID NO: 54295 - DNA, 25 bp, mus musculus
cctcacatccaagaactgtctggtc

SEQ ID NO: 54296 - DNA, 25 bp, mus musculus
cacatccaagaactgtctggtccga

SEQ ID NO: 54297 - DNA, 25 bp, mus musculus
caagaactgtctggtccgaaggaag

SEQ ID NO: 54298 - DNA, 25 bp, mus musculus
gaccgaggcttcacagctgttgtgg

SEQ ID NO: 54299 - DNA, 25 bp, mus musculus
cgaggcttcacagctgttgtgggtg

SEQ ID NO: 54300 - DNA, 25 bp, mus musculus
ggcttcacagctgttgtgggtgact

SEQ ID NO: 54301 - DNA, 25 bp, mus musculus
ttcacagctgttgtgggtgacttcg

SEQ ID NO: 54302 - DNA, 25 bp, mus musculus
ggtgacttcggactggctgagaaga

SEQ ID NO: 54303 - DNA, 25 bp, mus musculus
gacttcggactggctgagaagattc

SEQ ID NO: 54304 - DNA, 25 bp, mus musculus
ggaacagctgctcagctccccagaa

SEQ ID NO: 54305 - DNA, 25 bp, mus musculus
ccacctagccctggacattgcacaa

SEQ ID NO: 54306 - DNA, 25 bp, mus musculus
cctagccctggacattgcacaaggc

SEQ ID NO: 54307 - DNA, 25 bp, mus musculus
agccctggacattgcacaaggccta

SEQ ID NO: 54308 - DNA, 25 bp, mus musculus
ggacattgcacaaggcctacggtac

SEQ ID NO: 54309 - DNA, 25 bp, mus musculus
cattgcacaaggcctacggtaccta

SEQ ID NO: 54310 - DNA, 25 bp, mus musculus
tgcacaaggcctacggtacctacac

SEQ ID NO: 54311 - DNA, 25 bp, mus musculus
ccgagacctcacatccaagaactgt

SEQ ID NO: 54312 - DNA, 25 bp, mus musculus
gaaagcatcccatttgcggtgattg

SEQ ID NO: 54313 - DNA, 25 bp, mus musculus
atcccatttgcggtgattggcagca

SEQ ID NO: 54314 - DNA, 25 bp, mus musculus
agtggtactgacttccctatccctg

SEQ ID NO: 54315 - DNA, 25 bp, mus musculus
ccaccagggacagatccagaaactg

SEQ ID NO: 54316 - DNA, 25 bp, mus musculus
gagactcactaactggcttttggac

SEQ ID NO: 54317 - DNA, 25 bp, mus musculus
cactaactggcttttggacctgaat

SEQ ID NO: 54318 - DNA, 25 bp, mus musculus
ttcttcctgcctatgccagcctcta

SEQ ID NO: 54319 - DNA, 25 bp, mus musculus
gcctctattccctgcatcagctctg

SEQ ID NO: 54320 - DNA, 25 bp, mus musculus
attccctgcatcagctctgctcagg

SEQ ID NO: 54321 - DNA, 25 bp, mus musculus
ccagttcgccttatatccctgctga

SEQ ID NO: 54322 - DNA, 25 bp, mus musculus
cgccttatatccctgctgacttctc

SEQ ID NO: 54323 - DNA, 25 bp, mus musculus
acttctcaagagactcagaggaaat

SEQ ID NO: 54324 - DNA, 25 bp, mus musculus
ctctacccttggggcatcgtggaag

SEQ ID NO: 54325 - DNA, 25 bp, mus musculus
ggtcactgcgactttgtcaagttga

SEQ ID NO: 54326 - DNA, 25 bp, mus musculus
tgcgactttgtcaagttgaggacga

SEQ ID NO: 54327 - DNA, 25 bp, mus musculus
atgctggtgcgtacccacatgcagg

SEQ ID NO: 54328 - DNA, 25 bp, mus musculus
gtgacccgagagacacactacgaga

SEQ ID NO: 54329 - DNA, 25 bp, mus musculus
aactacagggcacagtgtatccaga

SEQ ID NO: 54330 - DNA, 25 bp, mus musculus
atccagagcatgacccggctagtag

SEQ ID NO: 54331 - DNA, 25 bp, mus musculus
agcatgacccggctagtagtgaagg

SEQ ID NO: 54332 - DNA, 25 bp, mus musculus
ggcgcgacaccattgcctacctggc

SEQ ID NO: 54333 - DNA, 25 bp, mus musculus
gcgagcctcgtactcgctcttcagg

SEQ ID NO: 54334 - DNA, 25 bp, mus musculus
agttgttacagggcactgatggaat

SEQ ID NO: 54335 - DNA, 25 bp, mus musculus
tgttacagggcactgatggaattgg

SEQ ID NO: 54336 - DNA, 25 bp, mus musculus
ttacagggcactgatggaattggaa

SEQ ID NO: 54337 - DNA, 25 bp, mus musculus
agattgtcctgatcagcaggtccca

SEQ ID NO: 54338 - DNA, 25 bp, mus musculus
attgtcctgatcagcaggtcccaag

SEQ ID NO: 54339 - DNA, 25 bp, mus musculus
ttgtcctgatcagcaggtcccaaga

SEQ ID NO: 54340 - DNA, 25 bp, mus musculus
gtcctgatcagcaggtcccaagata

SEQ ID NO: 54341 - DNA, 25 bp, mus musculus
tcagcaggtcccaagataaactgaa

SEQ ID NO: 54342 - DNA, 25 bp, mus musculus
gcaggtcccaagataaactgaatca

SEQ ID NO: 54343 - DNA, 25 bp, mus musculus
aatcaggtttccaacaacatcaaag

SEQ ID NO: 54344 - DNA, 25 bp, mus musculus
gagcctcgtactcgctcttcagggc

SEQ ID NO: 54345 - DNA, 25 bp, mus musculus
atcaggtttccaacaacatcaaaga

SEQ ID NO: 54346 - DNA, 25 bp, mus musculus
agcctcgtactcgctcttcagggcc

SEQ ID NO: 54347 - DNA, 25 bp, mus musculus
ctcgtactcgctcttcagggccttc

SEQ ID NO: 54348 - DNA, 25 bp, mus musculus
cgtactcgctcttcagggccttcca

SEQ ID NO: 54349 - DNA, 25 bp, mus musculus
cggtccgcgactcggagaatgggca

SEQ ID NO: 54350 - DNA, 25 bp, mus musculus
gtccgcgactcggagaatgggcagt

SEQ ID NO: 54351 - DNA, 25 bp, mus musculus
tccgcgactcggagaatgggcagtt

SEQ ID NO: 54352 - DNA, 25 bp, mus musculus
cagttgttacagggcactgatggaa

SEQ ID NO: 54353 - DNA, 25 bp, mus musculus
tgactttgaaaacctcgatgcacct

SEQ ID NO: 54354 - DNA, 25 bp, mus musculus
aacagctgggcttacgggcatgcta

SEQ ID NO: 54355 - DNA, 25 bp, mus musculus
attggacatgctgaaactggaggat

SEQ ID NO: 54356 - DNA, 25 bp, mus musculus
tgtagccctgtgtggttcctcttgt

SEQ ID NO: 54357 - DNA, 25 bp, mus musculus
cctgtgtggttcctcttgtcacctc

SEQ ID NO: 54358 - DNA, 25 bp, mus musculus
aaagcaactgctgggtatggtgctg

SEQ ID NO: 54359 - DNA, 25 bp, mus musculus
gcgtgcctggaacctcagtattcag

SEQ ID NO: 54360 - DNA, 25 bp, mus musculus
tgcctggaacctcagtattcaggag

SEQ ID NO: 54361 - DNA, 25 bp, mus musculus
cctcagtattcaggaggctgaggca

SEQ ID NO: 54362 - DNA, 25 bp, mus musculus
cagtattcaggaggctgaggcagag

SEQ ID NO: 54363 - DNA, 25 bp, mus musculus
acttcaaggccagcctgggcaactt

SEQ ID NO: 54364 - DNA, 25 bp, mus musculus
ccagcctgggcaacttcaggaaatg

SEQ ID NO: 54365 - DNA, 25 bp, mus musculus
agctgggcttacgggcatgctatat

SEQ ID NO: 54366 - DNA, 25 bp, mus musculus
tgggcttacgggcatgctatataca

SEQ ID NO: 54367 - DNA, 25 bp, mus musculus
ctaggcaagtgctgtgctgagttac

SEQ ID NO: 54368 - DNA, 25 bp, mus musculus
cccagaggacacactgtctgggtat

SEQ ID NO: 54369 - DNA, 25 bp, mus musculus
agaggacacactgtctgggtatggc

SEQ ID NO: 54370 - DNA, 25 bp, mus musculus
taattccagtgcttctggattggac

SEQ ID NO: 54371 - DNA, 25 bp, mus musculus
cagtgcttctggattggacatgctg

SEQ ID NO: 54372 - DNA, 25 bp, mus musculus
tgcttctggattggacatgctgaaa

SEQ ID NO: 54373 - DNA, 25 bp, mus musculus
tatactagctgcccactctggggca

SEQ ID NO: 54374 - DNA, 25 bp, mus musculus
ttggtcctcaagttattcagcaccc

SEQ ID NO: 54375 - DNA, 25 bp, mus musculus
tcagacatcattagttccgacactt

SEQ ID NO: 54376 - DNA, 25 bp, mus musculus
atcattagttccgacacttgtgaaa

SEQ ID NO: 54377 - DNA, 25 bp, mus musculus
gacacttgtgaaactccgagacgtg

SEQ ID NO: 54378 - DNA, 25 bp, mus musculus
actccgagacgtgccgtggtctcag

SEQ ID NO: 54379 - DNA, 25 bp, mus musculus
agacgtgccgtggtctcagcaatgc

SEQ ID NO: 54380 - DNA, 25 bp, mus musculus
gtctcagcaatgcacctgttttata

SEQ ID NO: 54381 - DNA, 25 bp, mus musculus
atctatatctatcagttgtgaccgt

SEQ ID NO: 54382 - DNA, 25 bp, mus musculus
atctatcagttgtgaccgtatggct

SEQ ID NO: 54383 - DNA, 25 bp, mus musculus
cagttgtgaccgtatggctgtcgat

SEQ ID NO: 54384 - DNA, 25 bp, mus musculus
tgaccgtatggctgtcgataaaacc

SEQ ID NO: 54385 - DNA, 25 bp, mus musculus
tgattcctggtgttagggcacctca

SEQ ID NO: 54386 - DNA, 25 bp, mus musculus
ttagggcacctcaaaccttgggctg

SEQ ID NO: 54387 - DNA, 25 bp, mus musculus
ttgatgctgcacgggaccctgcagg

SEQ ID NO: 54388 - DNA, 25 bp, mus musculus
ggctcggtcagtgatgtgttttgtc

SEQ ID NO: 54389 - DNA, 25 bp, mus musculus
cagcgacctggttccaggaggagct

SEQ ID NO: 54390 - DNA, 25 bp, mus musculus
cactgcgtctgccgccctaggcttt

SEQ ID NO: 54391 - DNA, 25 bp, mus musculus
gtctgccgccctaggctttcagaca

SEQ ID NO: 54392 - DNA, 25 bp, mus musculus
cgccctaggctttcagacatcatta

SEQ ID NO: 54393 - DNA, 25 bp, mus musculus
gagtaccattggggctgcctttcta

SEQ ID NO: 54394 - DNA, 25 bp, mus musculus
ggctgcctttctaacccaaactgtg

SEQ ID NO: 54395 - DNA, 25 bp, mus musculus
tagcaccaatgtactaccgaggagc

SEQ ID NO: 54396 - DNA, 25 bp, mus musculus
accaatgtactaccgaggagcacaa

SEQ ID NO: 54397 - DNA, 25 bp, mus musculus
gtactaccgaggagcacaagcagcc

SEQ ID NO: 54398 - DNA, 25 bp, mus musculus
actaccgaggagcacaagcagccat

SEQ ID NO: 54399 - DNA, 25 bp, mus musculus
agcacaagcagccatagttgtgtat

SEQ ID NO: 54400 - DNA, 25 bp, mus musculus
cacaagcagccatagttgtgtatga

SEQ ID NO: 54401 - DNA, 25 bp, mus musculus
agcagccatagttgtgtatgatatc

SEQ ID NO: 54402 - DNA, 25 bp, mus musculus
tgaggaatcctttgcgagagcaaaa

SEQ ID NO: 54403 - DNA, 25 bp, mus musculus
atcctttgcgagagcaaaaaactgg

SEQ ID NO: 54404 - DNA, 25 bp, mus musculus
gcaagcaagtcctaatattgtgata

SEQ ID NO: 54405 - DNA, 25 bp, mus musculus
ctgcctttctaacccaaactgtgtg

SEQ ID NO: 54406 - DNA, 25 bp, mus musculus
ttctaacccaaactgtgtgtcttga

SEQ ID NO: 54407 - DNA, 25 bp, mus musculus
aacccaaactgtgtgtcttgatgac

SEQ ID NO: 54408 - DNA, 25 bp, mus musculus
cccaaactgtgtgtcttgatgacac

SEQ ID NO: 54409 - DNA, 25 bp, mus musculus
atacagctggtcaagaacggtatca

SEQ ID NO: 54410 - DNA, 25 bp, mus musculus
tcatagcttagcaccaatgtactac

SEQ ID NO: 54411 - DNA, 25 bp, mus musculus
atagcttagcaccaatgtactaccg

SEQ ID NO: 54412 - DNA, 25 bp, mus musculus
cttagcaccaatgtactaccgagga

SEQ ID NO: 54413 - DNA, 25 bp, mus musculus
gcctccctggtatcgagcacagaaa

SEQ ID NO: 54414 - DNA, 25 bp, mus musculus
acagaaagatttcctctcaggcctg

SEQ ID NO: 54415 - DNA, 25 bp, mus musculus
gcactttctgtctcctgagacctct

SEQ ID NO: 54416 - DNA, 25 bp, mus musculus
ctctgctcagctctaccaccaggga

SEQ ID NO: 54417 - DNA, 25 bp, mus musculus
tcagctctaccaccagggagccagc

SEQ ID NO: 54418 - DNA, 25 bp, mus musculus
ccctgaccaccgtatgctttatgcc

SEQ ID NO: 54419 - DNA, 25 bp, mus musculus
tatgctttatgcccagatggaccgg

SEQ ID NO: 54420 - DNA, 25 bp, mus musculus
ttatgcccagatggaccgggctgtg

SEQ ID NO: 54421 - DNA, 25 bp, mus musculus
ccagatggaccgggctgtgttccaa

SEQ ID NO: 54422 - DNA, 25 bp, mus musculus
ggaccgggctgtgttccaagcagta

SEQ ID NO: 54423 - DNA, 25 bp, mus musculus
gttccaagcagtaaaggcggctgtg

SEQ ID NO: 54424 - DNA, 25 bp, mus musculus
tgtccagtctgcataatatcaacag

SEQ ID NO: 54425 - DNA, 25 bp, mus musculus
gtctccagggagccagaccagcact

SEQ ID NO: 54426 - DNA, 25 bp, mus musculus
tcgctttctccagatggtgtgccca

SEQ ID NO: 54427 - DNA, 25 bp, mus musculus
agcaggaaccttggagcctggtgcc

SEQ ID NO: 54428 - DNA, 25 bp, mus musculus
cccaggcagctgctacttggatgca

SEQ ID NO: 54429 - DNA, 25 bp, mus musculus
cagctgctacttggatgcagggttg

SEQ ID NO: 54430 - DNA, 25 bp, mus musculus
cctgctgcaggctcctggggaagcg

SEQ ID NO: 54431 - DNA, 25 bp, mus musculus
cagtgtcactcagcactttctgtct

SEQ ID NO: 54432 - DNA, 25 bp, mus musculus
cactcagcactttctgtctcctgag

SEQ ID NO: 54433 - DNA, 25 bp, mus musculus
atcctgctctttgacctcatctacc

SEQ ID NO: 54434 - DNA, 25 bp, mus musculus
ctgctctttgacctcatctaccgag

SEQ ID NO: 54435 - DNA, 25 bp, mus musculus
tcctcttcctcaaggacgacttcat

SEQ ID NO: 54436 - DNA, 25 bp, mus musculus
tcttcctcaaggacgacttcatcct

SEQ ID NO: 54437 - DNA, 25 bp, mus musculus
tgcccgggaaccactccagagccag

SEQ ID NO: 54438 - DNA, 25 bp, mus musculus
gccccctggggatgccacacggagc

SEQ ID NO: 54439 - DNA, 25 bp, mus musculus
ggatgccacacggagctgccacatt

SEQ ID NO: 54440 - DNA, 25 bp, mus musculus
tgccacacggagctgccacatttat

SEQ ID NO: 54441 - DNA, 25 bp, mus musculus
cacacggagctgccacatttatggg

SEQ ID NO: 54442 - DNA, 25 bp, mus musculus
gagctgccacatttatgggcacatg

SEQ ID NO: 54443 - DNA, 25 bp, mus musculus
ctgccacatttatgggcacatgtag

SEQ ID NO: 54444 - DNA, 25 bp, mus musculus
ccacatttatgggcacatgtagtgg

SEQ ID NO: 54445 - DNA, 25 bp, mus musculus
ctctttgacctcatctaccgagaga

SEQ ID NO: 54446 - DNA, 25 bp, mus musculus
gacctcatctaccgagagagacgct

SEQ ID NO: 54447 - DNA, 25 bp, mus musculus
tcatccttgtgtacctcttctccat

SEQ ID NO: 54448 - DNA, 25 bp, mus musculus
tccttgtgtacctcttctccatcgt

SEQ ID NO: 54449 - DNA, 25 bp, mus musculus
ttgtgtacctcttctccatcgtggg

SEQ ID NO: 54450 - DNA, 25 bp, mus musculus
tgtacctcttctccatcgtgggctt

SEQ ID NO: 54451 - DNA, 25 bp, mus musculus
tcttctccatcgtgggcttcctctt

SEQ ID NO: 54452 - DNA, 25 bp, mus musculus
gcttcctcttcctcaaggacgactt

SEQ ID NO: 54453 - DNA, 25 bp, mus musculus
caacaacaggttcgagctattgaga

SEQ ID NO: 54454 - DNA, 25 bp, mus musculus
attgagagcctcaagcagagcatgt

SEQ ID NO: 54455 - DNA, 25 bp, mus musculus
tatctctctcaatctcaggtttttg

SEQ ID NO: 54456 - DNA, 25 bp, mus musculus
tctcaatctcaggtttttgagacaa

SEQ ID NO: 54457 - DNA, 25 bp, mus musculus
agatctctcaccaaaactgagatca

SEQ ID NO: 54458 - DNA, 25 bp, mus musculus
ctcaccaaaactgagatcatcaatt

SEQ ID NO: 54459 - DNA, 25 bp, mus musculus
gactggtcttacagcagtggcctgc

SEQ ID NO: 54460 - DNA, 25 bp, mus musculus
ggcctgccatgcatagctttttata

SEQ ID NO: 54461 - DNA, 25 bp, mus musculus
aattggggtcctcatgtttacacag

SEQ ID NO: 54462 - DNA, 25 bp, mus musculus
ggtcctcatgtttacacagaaattt

SEQ ID NO: 54463 - DNA, 25 bp, mus musculus
gaaatttctttgctgtctcagcctg

SEQ ID NO: 54464 - DNA, 25 bp, mus musculus
tctttgctgtctcagcctgactcca

SEQ ID NO: 54465 - DNA, 25 bp, mus musculus
agcctcaagcagagcatgtactcat

SEQ ID NO: 54466 - DNA, 25 bp, mus musculus
tgtctcagcctgactccagctccag

SEQ ID NO: 54467 - DNA, 25 bp, mus musculus
agcatgtactcattccatcataata

SEQ ID NO: 54468 - DNA, 25 bp, mus musculus
ttccatcataataacaatccatgag

SEQ ID NO: 54469 - DNA, 25 bp, mus musculus
cataataacaatccatgaggtagac

SEQ ID NO: 54470 - DNA, 25 bp, mus musculus
atgttgtcactggatgcccatgaac

SEQ ID NO: 54471 - DNA, 25 bp, mus musculus
tcactggatgcccatgaactgtgag

SEQ ID NO: 54472 - DNA, 25 bp, mus musculus
ttgacatcaggtctcttctatctct

SEQ ID NO: 54473 - DNA, 25 bp, mus musculus
tcaggtctcttctatctctctcaat

SEQ ID NO: 54474 - DNA, 25 bp, mus musculus
cagtactgccagcacagctgtcgca

SEQ ID NO: 54475 - DNA, 25 bp, mus musculus
tgccagcacagctgtcgcagatgcc

SEQ ID NO: 54476 - DNA, 25 bp, mus musculus
gaccaccgtcatctctactgtgggc

SEQ ID NO: 54477 - DNA, 25 bp, mus musculus
cgtcatctctactgtgggcaccatc

SEQ ID NO: 54478 - DNA, 25 bp, mus musculus
agaggatgccccaggactggcagtg

SEQ ID NO: 54479 - DNA, 25 bp, mus musculus
tgccccaggactggcagtgaccaga

SEQ ID NO: 54480 - DNA, 25 bp, mus musculus
ccccaggcctggcaggactacagtc

SEQ ID NO: 54481 - DNA, 25 bp, mus musculus
caggactacagtccagtagcttcca

SEQ ID NO: 54482 - DNA, 25 bp, mus musculus
gccttccaagaggagcctctgtgat

SEQ ID NO: 54483 - DNA, 25 bp, mus musculus
gagcctctgtgatattccagccgga

SEQ ID NO: 54484 - DNA, 25 bp, mus musculus
ctgtgatattccagccggaaggaca

SEQ ID NO: 54485 - DNA, 25 bp, mus musculus
ttgtccagacacctcttgggtttca

SEQ ID NO: 54486 - DNA, 25 bp, mus musculus
cacagctgtcgcagatgcccagaag

SEQ ID NO: 54487 - DNA, 25 bp, mus musculus
tgtcgcagatgcccagaagaggaag

SEQ ID NO: 54488 - DNA, 25 bp, mus musculus
catccccgtgacgacaatagcacag

SEQ ID NO: 54489 - DNA, 25 bp, mus musculus
agtggtcactgtcaccactagtgcc

SEQ ID NO: 54490 - DNA, 25 bp, mus musculus
cactgtcaccactagtgccagtggc

SEQ ID NO: 54491 - DNA, 25 bp, mus musculus
caccactagtgccagtggctccaag

SEQ ID NO: 54492 - DNA, 25 bp, mus musculus
tagtgccagtggctccaagaccacc

SEQ ID NO: 54493 - DNA, 25 bp, mus musculus
cagtggctccaagaccaccgtcatc

SEQ ID NO: 54494 - DNA, 25 bp, mus musculus
tgtatctgctggcatacagaccagt

SEQ ID NO: 54495 - DNA, 25 bp, mus musculus
catacagaccagttttaggactggt

SEQ ID NO: 54496 - DNA, 25 bp, mus musculus
ctatcccatgccaacagggtattct

SEQ ID NO: 54497 - DNA, 25 bp, mus musculus
catgccaacagggtattctcaataa

SEQ ID NO: 54498 - DNA, 25 bp, mus musculus
tgactgcagtgcagcagtaattatg

SEQ ID NO: 54499 - DNA, 25 bp, mus musculus
atttctctacattcctgaaacaatt

SEQ ID NO: 54500 - DNA, 25 bp, mus musculus
tctctacattcctgaaacaattttt

SEQ ID NO: 54501 - DNA, 25 bp, mus musculus
tgttttcacaaaagcaactgtacag

SEQ ID NO: 54502 - DNA, 25 bp, mus musculus
tttcacaaaagcaactgtacagtga

SEQ ID NO: 54503 - DNA, 25 bp, mus musculus
ggcaatgcatggccttccaataaaa

SEQ ID NO: 54504 - DNA, 25 bp, mus musculus
aatgcatggccttccaataaaagat

SEQ ID NO: 54505 - DNA, 25 bp, mus musculus
gcatggccttccaataaaagatatt

SEQ ID NO: 54506 - DNA, 25 bp, mus musculus
gacttaccagaacggttatgatagc

SEQ ID NO: 54507 - DNA, 25 bp, mus musculus
tagcactcagcaatatggaagtaat

SEQ ID NO: 54508 - DNA, 25 bp, mus musculus
gaaccaacaggcatatgcatatcct

SEQ ID NO: 54509 - DNA, 25 bp, mus musculus
atatgcatatcctgtaccgcagcct

SEQ ID NO: 54510 - DNA, 25 bp, mus musculus
accgcagcctgcgcctatgattggc

SEQ ID NO: 54511 - DNA, 25 bp, mus musculus
gcctgcgcctatgattggctatccc

SEQ ID NO: 54512 - DNA, 25 bp, mus musculus
gattggctatcccatgccaacaggg

SEQ ID NO: 54513 - DNA, 25 bp, mus musculus
tggctatcccatgccaacagggtat

SEQ ID NO: 54514 - DNA, 25 bp, mus musculus
tggcttcggaggccctctgtacccg

SEQ ID NO: 54515 - DNA, 25 bp, mus musculus
ccagcgacctctgcacaaaaggaaa

SEQ ID NO: 54516 - DNA, 25 bp, mus musculus
cttgcccagtgaacagaataaaggt

SEQ ID NO: 54517 - DNA, 25 bp, mus musculus
taaaggtgcctctttggatcgttcg

SEQ ID NO: 54518 - DNA, 25 bp, mus musculus
tgcctctttggatcgttcgcagtgt

SEQ ID NO: 54519 - DNA, 25 bp, mus musculus
ctctttggatcgttcgcagtgttca

SEQ ID NO: 54520 - DNA, 25 bp, mus musculus
tttggatcgttcgcagtgttcaccc

SEQ ID NO: 54521 - DNA, 25 bp, mus musculus
ctctcaggaagaccccgactcggag

SEQ ID NO: 54522 - DNA, 25 bp, mus musculus
agaccccgactcggagatctcagag

SEQ ID NO: 54523 - DNA, 25 bp, mus musculus
ccccgactcggagatctcagaggat

SEQ ID NO: 54524 - DNA, 25 bp, mus musculus
ctcagaggattccgaccaggaggtg

SEQ ID NO: 54525 - DNA, 25 bp, mus musculus
atgacagtcatcggccatgttagag

SEQ ID NO: 54526 - DNA, 25 bp, mus musculus
ctccaacgaccagaccgtcgagctg

SEQ ID NO: 54527 - DNA, 25 bp, mus musculus
tcatcggccatgttagagaccgact

SEQ ID NO: 54528 - DNA, 25 bp, mus musculus
caacgaccagaccgtcgagctggag

SEQ ID NO: 54529 - DNA, 25 bp, mus musculus
gtttcagaatcgccgagctaaatgg

SEQ ID NO: 54530 - DNA, 25 bp, mus musculus
tcagaatcgccgagctaaatggaga

SEQ ID NO: 54531 - DNA, 25 bp, mus musculus
gaatcgccgagctaaatggagaaga

SEQ ID NO: 54532 - DNA, 25 bp, mus musculus
cagtttggacacttcctgtgagcag

SEQ ID NO: 54533 - DNA, 25 bp, mus musculus
tttggacacttcctgtgagcagggt

SEQ ID NO: 54534 - DNA, 25 bp, mus musculus
ttcctgtgagcagggtcaagacttg

SEQ ID NO: 54535 - DNA, 25 bp, mus musculus
tggtctatggtcctgaaggctcaga

SEQ ID NO: 54536 - DNA, 25 bp, mus musculus
atggtcctgaaggctcagacttggt

SEQ ID NO: 54537 - DNA, 25 bp, mus musculus
ctcatctgtatattatggggaatga

SEQ ID NO: 54538 - DNA, 25 bp, mus musculus
gcagtcagcaccatcaaggcaaggt

SEQ ID NO: 54539 - DNA, 25 bp, mus musculus
agcaccatcaaggcaaggtgacttt

SEQ ID NO: 54540 - DNA, 25 bp, mus musculus
attatggtggcccactcatttgtga

SEQ ID NO: 54541 - DNA, 25 bp, mus musculus
gtggcccactcatttgtgaacaaca

SEQ ID NO: 54542 - DNA, 25 bp, mus musculus
tcattgttcctggtcgtggatgtgc

SEQ ID NO: 54543 - DNA, 25 bp, mus musculus
ttcctggtcgtggatgtgccatccc

SEQ ID NO: 54544 - DNA, 25 bp, mus musculus
gatgtgccatcccaaatcgtcctgg

SEQ ID NO: 54545 - DNA, 25 bp, mus musculus
agcatccatggatacatgaggattt

SEQ ID NO: 54546 - DNA, 25 bp, mus musculus
aggatttccaagacttcaggatcaa

SEQ ID NO: 54547 - DNA, 25 bp, mus musculus
gctcagacttggttttactgaagct

SEQ ID NO: 54548 - DNA, 25 bp, mus musculus
ggatttccaagacttcaggatcaaa

SEQ ID NO: 54549 - DNA, 25 bp, mus musculus
ttttactgaagcttgctcgacctgc

SEQ ID NO: 54550 - DNA, 25 bp, mus musculus
tgaagcttgctcgacctgcaatcct

SEQ ID NO: 54551 - DNA, 25 bp, mus musculus
ttgctcgacctgcaatcctggataa

SEQ ID NO: 54552 - DNA, 25 bp, mus musculus
gacctgcaatcctggataactttgt

SEQ ID NO: 54553 - DNA, 25 bp, mus musculus
gtacaatccctgaaaagaccacttg

SEQ ID NO: 54554 - DNA, 25 bp, mus musculus
tccctgaaaagaccacttgcagtat

SEQ ID NO: 54555 - DNA, 25 bp, mus musculus
tgatcaacgcggatggtttattacg

SEQ ID NO: 54556 - DNA, 25 bp, mus musculus
ttttgctctgaaaatcgcccaaaga

SEQ ID NO: 54557 - DNA, 25 bp, mus musculus
ttgctctgaaaatcgcccaaagatc

SEQ ID NO: 54558 - DNA, 25 bp, mus musculus
gcataccgtgccaagggcaaaagtg

SEQ ID NO: 54559 - DNA, 25 bp, mus musculus
gtaggccaacaggctcaaagaagaa

SEQ ID NO: 54560 - DNA, 25 bp, mus musculus
agtggctgtcctaaagtgtggagta

SEQ ID NO: 54561 - DNA, 25 bp, mus musculus
tggctgtcctaaagtgtggagtata

SEQ ID NO: 54562 - DNA, 25 bp, mus musculus
aattcaagtgcagctcaacattagc

SEQ ID NO: 54563 - DNA, 25 bp, mus musculus
ttcaagtgcagctcaacattagctt

SEQ ID NO: 54564 - DNA, 25 bp, mus musculus
caagtgcagctcaacattagcttca

SEQ ID NO: 54565 - DNA, 25 bp, mus musculus
tgcagctcaacattagcttcagtat

SEQ ID NO: 54566 - DNA, 25 bp, mus musculus
cagctcaacattagcttcagtataa

SEQ ID NO: 54567 - DNA, 25 bp, mus musculus
gctcaacattagcttcagtataaaa

SEQ ID NO: 54568 - DNA, 25 bp, mus musculus
gctctgaaaatcgcccaaagatcaa

SEQ ID NO: 54569 - DNA, 25 bp, mus musculus
tgaaaatcgcccaaagatcaaaatt

SEQ ID NO: 54570 - DNA, 25 bp, mus musculus
tcgcccaaagatcaaaattgaacac

SEQ ID NO: 54571 - DNA, 25 bp, mus musculus
tgaacacccaggcctgtctattgga

SEQ ID NO: 54572 - DNA, 25 bp, mus musculus
ggatattgctgcataccgtgccaag

SEQ ID NO: 54573 - DNA, 25 bp, mus musculus
atattgctgcataccgtgccaaggg

SEQ ID NO: 54574 - DNA, 25 bp, mus musculus
attgctgcataccgtgccaagggca

SEQ ID NO: 54575 - DNA, 25 bp, mus musculus
tgctgcataccgtgccaagggcaaa

SEQ ID NO: 54576 - DNA, 25 bp, mus musculus
tccagatgacatcatcactgacatt

SEQ ID NO: 54577 - DNA, 25 bp, mus musculus
tgacatcatcactgacattgagatg

SEQ ID NO: 54578 - DNA, 25 bp, mus musculus
ttcccgaattcgaagctgctctgcc

SEQ ID NO: 54579 - DNA, 25 bp, mus musculus
actccatggtactgctgcaaggacc

SEQ ID NO: 54580 - DNA, 25 bp, mus musculus
tggtactgctgcaaggacctggctg

SEQ ID NO: 54581 - DNA, 25 bp, mus musculus
atgcctgaagttctggcagtctgtc

SEQ ID NO: 54582 - DNA, 25 bp, mus musculus
actcttccctgaggtagctcatgaa

SEQ ID NO: 54583 - DNA, 25 bp, mus musculus
tcatgaaatcatcttgcagacctgc

SEQ ID NO: 54584 - DNA, 25 bp, mus musculus
aatcatcttgcagacctgcctcctt

SEQ ID NO: 54585 - DNA, 25 bp, mus musculus
cagctctgccaaccttgctctagag

SEQ ID NO: 54586 - DNA, 25 bp, mus musculus
tgccaaccttgctctagagtgctgg

SEQ ID NO: 54587 - DNA, 25 bp, mus musculus
gctctcacagggctgcctgattcgc

SEQ ID NO: 54588 - DNA, 25 bp, mus musculus
catcactgacattgagatggtggat

SEQ ID NO: 54589 - DNA, 25 bp, mus musculus
ccaatgccgtggccactttggactt

SEQ ID NO: 54590 - DNA, 25 bp, mus musculus
tggacttttccctgcaaactatgtc

SEQ ID NO: 54591 - DNA, 25 bp, mus musculus
tttccctgcaaactatgtcaagctc

SEQ ID NO: 54592 - DNA, 25 bp, mus musculus
ctatgtcaagctcctctaatgacca

SEQ ID NO: 54593 - DNA, 25 bp, mus musculus
caagctcctctaatgaccagcccat

SEQ ID NO: 54594 - DNA, 25 bp, mus musculus
cctctaatgaccagcccattgtctt

SEQ ID NO: 54595 - DNA, 25 bp, mus musculus
atgaccagcccattgtcttccgact

SEQ ID NO: 54596 - DNA, 25 bp, mus musculus
tggccagcacgtgctaacaagccgg

SEQ ID NO: 54597 - DNA, 25 bp, mus musculus
ggccagcacgtgctaacaagccgga

SEQ ID NO: 54598 - DNA, 25 bp, mus musculus
gctaacaagccggatgggattacta

SEQ ID NO: 54599 - DNA, 25 bp, mus musculus
taacaagccggatgggattactaag

SEQ ID NO: 54600 - DNA, 25 bp, mus musculus
agttcccaagctgttccaacaactg

SEQ ID NO: 54601 - DNA, 25 bp, mus musculus
gttcccaagctgttccaacaactgt

SEQ ID NO: 54602 - DNA, 25 bp, mus musculus
ttcccaagctgttccaacaactgtc

SEQ ID NO: 54603 - DNA, 25 bp, mus musculus
tcccaagctgttccaacaactgtca

SEQ ID NO: 54604 - DNA, 25 bp, mus musculus
cccaagctgttccaacaactgtcag

SEQ ID NO: 54605 - DNA, 25 bp, mus musculus
caagctgttccaacaactgtcaggg

SEQ ID NO: 54606 - DNA, 25 bp, mus musculus
aagctgttccaacaactgtcaggga

SEQ ID NO: 54607 - DNA, 25 bp, mus musculus
agctgttccaacaactgtcagggaa

SEQ ID NO: 54608 - DNA, 25 bp, mus musculus
gccagcacgtgctaacaagccggat

SEQ ID NO: 54609 - DNA, 25 bp, mus musculus
gctgttccaacaactgtcagggaag

SEQ ID NO: 54610 - DNA, 25 bp, mus musculus
ccagcacgtgctaacaagccggatg

SEQ ID NO: 54611 - DNA, 25 bp, mus musculus
cagcacgtgctaacaagccggatgg

SEQ ID NO: 54612 - DNA, 25 bp, mus musculus
agcacgtgctaacaagccggatggg

SEQ ID NO: 54613 - DNA, 25 bp, mus musculus
acgtgctaacaagccggatgggatt

SEQ ID NO: 54614 - DNA, 25 bp, mus musculus
cgtgctaacaagccggatgggatta

SEQ ID NO: 54615 - DNA, 25 bp, mus musculus
gtgctaacaagccggatgggattac

SEQ ID NO: 54616 - DNA, 25 bp, mus musculus
tgctaacaagccggatgggattact

SEQ ID NO: 54617 - DNA, 25 bp, mus musculus
taaggttctccgcgataacatccag

SEQ ID NO: 54618 - DNA, 25 bp, mus musculus
cccacattccctgaaaaagcgctgt

SEQ ID NO: 54619 - DNA, 25 bp, mus musculus
cttgagtgcctttggagaattgtaa

SEQ ID NO: 54620 - DNA, 25 bp, mus musculus
tcaagtttgcaccattttcttggaa

SEQ ID NO: 54621 - DNA, 25 bp, mus musculus
gaaatactgccttattaagtgtgcg

SEQ ID NO: 54622 - DNA, 25 bp, mus musculus
atactgccttattaagtgtgcgcag

SEQ ID NO: 54623 - DNA, 25 bp, mus musculus
tattaagtgtgcgcagctaaactct

SEQ ID NO: 54624 - DNA, 25 bp, mus musculus
gtgtgcgcagctaaactctgttcct

SEQ ID NO: 54625 - DNA, 25 bp, mus musculus
tgcgcagctaaactctgttccttga

SEQ ID NO: 54626 - DNA, 25 bp, mus musculus
gcagctaaactctgttccttgagga

SEQ ID NO: 54627 - DNA, 25 bp, mus musculus
gctaaactctgttccttgaggaaag

SEQ ID NO: 54628 - DNA, 25 bp, mus musculus
tgttccttgaggaaagcctgagtga

SEQ ID NO: 54629 - DNA, 25 bp, mus musculus
acattccctgaaaaagcgctgtaat

SEQ ID NO: 54630 - DNA, 25 bp, mus musculus
taatactgaaccacttaacagcttg

SEQ ID NO: 54631 - DNA, 25 bp, mus musculus
tactgaaccacttaacagcttgggc

SEQ ID NO: 54632 - DNA, 25 bp, mus musculus
tgaaccacttaacagcttgggcatc

SEQ ID NO: 54633 - DNA, 25 bp, mus musculus
accacttaacagcttgggcatctca

SEQ ID NO: 54634 - DNA, 25 bp, mus musculus
taacagcttgggcatctcagagaat

SEQ ID NO: 54635 - DNA, 25 bp, mus musculus
cagcttgggcatctcagagaatata

SEQ ID NO: 54636 - DNA, 25 bp, mus musculus
aaccttgagtgcctttggagaattg

SEQ ID NO: 54637 - DNA, 25 bp, mus musculus
ttcctctgagggacttggcctgagg

SEQ ID NO: 54638 - DNA, 25 bp, mus musculus
tctccagtgggttctgtttatcctc

SEQ ID NO: 54639 - DNA, 25 bp, mus musculus
cagcaaagttgccaacctcgacggg

SEQ ID NO: 54640 - DNA, 25 bp, mus musculus
agttgccaacctcgacgggctagca

SEQ ID NO: 54641 - DNA, 25 bp, mus musculus
agtgtctaagcagcgatgggttcag

SEQ ID NO: 54642 - DNA, 25 bp, mus musculus
taagcagcgatgggttcagtgttgt

SEQ ID NO: 54643 - DNA, 25 bp, mus musculus
ttcagttctgtctcccagataatgt

SEQ ID NO: 54644 - DNA, 25 bp, mus musculus
tctgtctcccagataatgtgaaaac

SEQ ID NO: 54645 - DNA, 25 bp, mus musculus
atatgcagcgtgtgctttcttattc

SEQ ID NO: 54646 - DNA, 25 bp, mus musculus
aagccatttctactttgaagtcatt

SEQ ID NO: 54647 - DNA, 25 bp, mus musculus
tttctactttgaagtcattatcgat

SEQ ID NO: 54648 - DNA, 25 bp, mus musculus
tgatgtatcttcacctaccattttc

SEQ ID NO: 54649 - DNA, 25 bp, mus musculus
tctgtttatcctctcatgggtgatt

SEQ ID NO: 54650 - DNA, 25 bp, mus musculus
tatctcagtggtgtcaccaggggct

SEQ ID NO: 54651 - DNA, 25 bp, mus musculus
ccagaagtcagtcatccccaggccg

SEQ ID NO: 54652 - DNA, 25 bp, mus musculus
caggccgtgcacccttttcagctgg

SEQ ID NO: 54653 - DNA, 25 bp, mus musculus
ccttttcagctggatgagagccagg

SEQ ID NO: 54654 - DNA, 25 bp, mus musculus
tccaaacagctaccctggcccattt

SEQ ID NO: 54655 - DNA, 25 bp, mus musculus
taatctcattcttcaaaatgttcca

SEQ ID NO: 54656 - DNA, 25 bp, mus musculus
tgttccatagaatcctccaaattcc

SEQ ID NO: 54657 - DNA, 25 bp, mus musculus
ctaaggctaagacccgctcttcgcg

SEQ ID NO: 54658 - DNA, 25 bp, mus musculus
taaggctaagacccgctcttcgcgg

SEQ ID NO: 54659 - DNA, 25 bp, mus musculus
tgctccccaagaagactgagagtca

SEQ ID NO: 54660 - DNA, 25 bp, mus musculus
gctccccaagaagactgagagtcac

SEQ ID NO: 54661 - DNA, 25 bp, mus musculus
agactgagagtcaccacaaggccaa

SEQ ID NO: 54662 - DNA, 25 bp, mus musculus
ctgagagtcaccacaaggccaaggg

SEQ ID NO: 54663 - DNA, 25 bp, mus musculus
tgagagtcaccacaaggccaagggc

SEQ ID NO: 54664 - DNA, 25 bp, mus musculus
gagtcaccacaaggccaagggcaag

SEQ ID NO: 54665 - DNA, 25 bp, mus musculus
gtcaccacaaggccaagggcaagta

SEQ ID NO: 54666 - DNA, 25 bp, mus musculus
gtcttaacaaaggctcttttcagag

SEQ ID NO: 54667 - DNA, 25 bp, mus musculus
ggctcttttcagagccacccatgta

SEQ ID NO: 54668 - DNA, 25 bp, mus musculus
gctcttttcagagccacccatgtat

SEQ ID NO: 54669 - DNA, 25 bp, mus musculus
cttgctccgcaagggcaactactcc

SEQ ID NO: 54670 - DNA, 25 bp, mus musculus
tcttttcagagccacccatgtattc

SEQ ID NO: 54671 - DNA, 25 bp, mus musculus
gcaagggcaactactccgagcgagt

SEQ ID NO: 54672 - DNA, 25 bp, mus musculus
agggcaactactccgagcgagtcgg

SEQ ID NO: 54673 - DNA, 25 bp, mus musculus
gggcaactactccgagcgagtcggg

SEQ ID NO: 54674 - DNA, 25 bp, mus musculus
aggctgtactgctccccaagaagac

SEQ ID NO: 54675 - DNA, 25 bp, mus musculus
ggctgtactgctccccaagaagact

SEQ ID NO: 54676 - DNA, 25 bp, mus musculus
tgtactgctccccaagaagactgag

SEQ ID NO: 54677 - DNA, 25 bp, mus musculus
tactgctccccaagaagactgagag

SEQ ID NO: 54678 - DNA, 25 bp, mus musculus
gattcgcaaactgccattccagcgt

SEQ ID NO: 54679 - DNA, 25 bp, mus musculus
tcgcaaactgccattccagcgtcta

SEQ ID NO: 54680 - DNA, 25 bp, mus musculus
tgatctgcgttttcagagctcggcg

SEQ ID NO: 54681 - DNA, 25 bp, mus musculus
gcgttttcagagctcggcggtgatg

SEQ ID NO: 54682 - DNA, 25 bp, mus musculus
ttttcagagctcggcggtgatggcg

SEQ ID NO: 54683 - DNA, 25 bp, mus musculus
cctatgcgccattcacgccaagcga

SEQ ID NO: 54684 - DNA, 25 bp, mus musculus
atgcgccattcacgccaagcgagtg

SEQ ID NO: 54685 - DNA, 25 bp, mus musculus
cgccattcacgccaagcgagtgact

SEQ ID NO: 54686 - DNA, 25 bp, mus musculus
cattcacgccaagcgagtgactatc

SEQ ID NO: 54687 - DNA, 25 bp, mus musculus
tcacgccaagcgagtgactatcatg

SEQ ID NO: 54688 - DNA, 25 bp, mus musculus
aattgtcttgtgaatgtgtgctaac

SEQ ID NO: 54689 - DNA, 25 bp, mus musculus
tttcagagccaaccaccttttctat

SEQ ID NO: 54690 - DNA, 25 bp, mus musculus
caaactgccattccagcgtctagtc

SEQ ID NO: 54691 - DNA, 25 bp, mus musculus
actgccattccagcgtctagtccgt

SEQ ID NO: 54692 - DNA, 25 bp, mus musculus
gccattccagcgtctagtccgtgag

SEQ ID NO: 54693 - DNA, 25 bp, mus musculus
attccagcgtctagtccgtgagatc

SEQ ID NO: 54694 - DNA, 25 bp, mus musculus
gcgtctagtccgtgagatcgcgcag

SEQ ID NO: 54695 - DNA, 25 bp, mus musculus
tctagtccgtgagatcgcgcaggac

SEQ ID NO: 54696 - DNA, 25 bp, mus musculus
cttcaagactgatctgcgttttcag

SEQ ID NO: 54697 - DNA, 25 bp, mus musculus
gactgatctgcgttttcagagctcg

SEQ ID NO: 54698 - DNA, 25 bp, mus musculus
gtgccctcatcactgccagcagcag

SEQ ID NO: 54699 - DNA, 25 bp, mus musculus
tcagtttcagcagcaccagcagcct

SEQ ID NO: 54700 - DNA, 25 bp, mus musculus
cactggctggactttgtgcctactt

SEQ ID NO: 54701 - DNA, 25 bp, mus musculus
ttgcctagattggagccggacgcca

SEQ ID NO: 54702 - DNA, 25 bp, mus musculus
agattggagccggacgccacgggca

SEQ ID NO: 54703 - DNA, 25 bp, mus musculus
gacgccacgggcagcctcttcgggg

SEQ ID NO: 54704 - DNA, 25 bp, mus musculus
gttttccctacctaagcagctcaca

SEQ ID NO: 54705 - DNA, 25 bp, mus musculus
taagcagctcacactgtgaaatgtt

SEQ ID NO: 54706 - DNA, 25 bp, mus musculus
gaactgttcctctgagcaccagggg

SEQ ID NO: 54707 - DNA, 25 bp, mus musculus
ttcctctgagcaccaggggtcttgg

SEQ ID NO: 54708 - DNA, 25 bp, mus musculus
ggacttgctgcacttaggaggcctt

SEQ ID NO: 54709 - DNA, 25 bp, mus musculus
gctgcacttaggaggcctttaactt

SEQ ID NO: 54710 - DNA, 25 bp, mus musculus
tcagcagcaccagcagcctgggtag

SEQ ID NO: 54711 - DNA, 25 bp, mus musculus
actgctcggagctgccttcggctca

SEQ ID NO: 54712 - DNA, 25 bp, mus musculus
tcaccagcagtcctcaaagcccgga

SEQ ID NO: 54713 - DNA, 25 bp, mus musculus
gtttatagactggaccgagggcata

SEQ ID NO: 54714 - DNA, 25 bp, mus musculus
agactggaccgagggcatagcgtgc

SEQ ID NO: 54715 - DNA, 25 bp, mus musculus
agcgtgcagcttcctctacactggc

SEQ ID NO: 54716 - DNA, 25 bp, mus musculus
cagcttcctctacactggctggact

SEQ ID NO: 54717 - DNA, 25 bp, mus musculus
cctctacactggctggactttgtgc

SEQ ID NO: 54718 - DNA, 25 bp, mus musculus
aagcttcttgagcttcaggctggaa

SEQ ID NO: 54719 - DNA, 25 bp, mus musculus
tctctggaagaccaggtagaaacac

SEQ ID NO: 54720 - DNA, 25 bp, mus musculus
gccagtgccttccaggaacttgacg

SEQ ID NO: 54721 - DNA, 25 bp, mus musculus
gccttccaggaacttgacgacaaca

SEQ ID NO: 54722 - DNA, 25 bp, mus musculus
cttgacgacaacatggatgggatgg

SEQ ID NO: 54723 - DNA, 25 bp, mus musculus
atggtctcgctggctgagttacaga

SEQ ID NO: 54724 - DNA, 25 bp, mus musculus
gtctcgctggctgagttacagactc

SEQ ID NO: 54725 - DNA, 25 bp, mus musculus
gagttacagactcacccggagctgg

SEQ ID NO: 54726 - DNA, 25 bp, mus musculus
ttacagactcacccggagctggaca

SEQ ID NO: 54727 - DNA, 25 bp, mus musculus
cagactcacccggagctggacacag

SEQ ID NO: 54728 - DNA, 25 bp, mus musculus
actcacccggagctggacacagatg

SEQ ID NO: 54729 - DNA, 25 bp, mus musculus
cacccggagctggacacagatggag

SEQ ID NO: 54730 - DNA, 25 bp, mus musculus
gtagaaacactgcgggcagcgaaag

SEQ ID NO: 54731 - DNA, 25 bp, mus musculus
acactgcgggcagcgaaagaagaag

SEQ ID NO: 54732 - DNA, 25 bp, mus musculus
gccaaggaccagcaccggaagctgt

SEQ ID NO: 54733 - DNA, 25 bp, mus musculus
aaggaccagcaccggaagctgtggg

SEQ ID NO: 54734 - DNA, 25 bp, mus musculus
gaccagcaccggaagctgtgggaag

SEQ ID NO: 54735 - DNA, 25 bp, mus musculus
cagcaccggaagctgtgggaagagc

SEQ ID NO: 54736 - DNA, 25 bp, mus musculus
gagcagcaagctgctgccaaggccc

SEQ ID NO: 54737 - DNA, 25 bp, mus musculus
gcagccagtgccttccaggaacttg

SEQ ID NO: 54738 - DNA, 25 bp, mus musculus
catcggagcccgaagactcgaagaa

SEQ ID NO: 54739 - DNA, 25 bp, mus musculus
actcgaagaacgccatggcccccat

SEQ ID NO: 54740 - DNA, 25 bp, mus musculus
gacagacatcatgaccgagggcatc

SEQ ID NO: 54741 - DNA, 25 bp, mus musculus
cagacatcatgaccgagggcatcac

SEQ ID NO: 54742 - DNA, 25 bp, mus musculus
agacatcatgaccgagggcatcaca

SEQ ID NO: 54743 - DNA, 25 bp, mus musculus
catcatgaccgagggcatcacaatt

SEQ ID NO: 54744 - DNA, 25 bp, mus musculus
tcatgaccgagggcatcacaattgt

SEQ ID NO: 54745 - DNA, 25 bp, mus musculus
tgaccgagggcatcacaattgtgga

SEQ ID NO: 54746 - DNA, 25 bp, mus musculus
aggatatcaacaagcgccgagagcc

SEQ ID NO: 54747 - DNA, 25 bp, mus musculus
ggatatcaacaagcgccgagagcca

SEQ ID NO: 54748 - DNA, 25 bp, mus musculus
atatcaacaagcgccgagagccact

SEQ ID NO: 54749 - DNA, 25 bp, mus musculus
tatcaacaagcgccgagagccactc

SEQ ID NO: 54750 - DNA, 25 bp, mus musculus
gaagaacgccatggcccccattggc

SEQ ID NO: 54751 - DNA, 25 bp, mus musculus
catggcccccattggcctcaaggcg

SEQ ID NO: 54752 - DNA, 25 bp, mus musculus
tggcccccattggcctcaaggcggt

SEQ ID NO: 54753 - DNA, 25 bp, mus musculus
ggcccccattggcctcaaggcggtg

SEQ ID NO: 54754 - DNA, 25 bp, mus musculus
gatgctgtcctcctgctgcaagatg

SEQ ID NO: 54755 - DNA, 25 bp, mus musculus
tgctgtcctcctgctgcaagatgac

SEQ ID NO: 54756 - DNA, 25 bp, mus musculus
ctcctgctgcaagatgacagacatc

SEQ ID NO: 54757 - DNA, 25 bp, mus musculus
tgacagacatcatgaccgagggcat

SEQ ID NO: 54758 - DNA, 25 bp, mus musculus
gggtcaccataacattccgtagatg

SEQ ID NO: 54759 - DNA, 25 bp, mus musculus
gtcaccataacattccgtagatggg

SEQ ID NO: 54760 - DNA, 25 bp, mus musculus
caatacgtagctcttcatttgtgta

SEQ ID NO: 54761 - DNA, 25 bp, mus musculus
atacgtagctcttcatttgtgtaca

SEQ ID NO: 54762 - DNA, 25 bp, mus musculus
acgtagctcttcatttgtgtacatg

SEQ ID NO: 54763 - DNA, 25 bp, mus musculus
gtagctcttcatttgtgtacatgaa

SEQ ID NO: 54764 - DNA, 25 bp, mus musculus
agctcttcatttgtgtacatgaaca

SEQ ID NO: 54765 - DNA, 25 bp, mus musculus
ctcttcatttgtgtacatgaacaca

SEQ ID NO: 54766 - DNA, 25 bp, mus musculus
tgtgacttcagagtttgggtacgtg

SEQ ID NO: 54767 - DNA, 25 bp, mus musculus
tatatggctctttttgggtacatgt

SEQ ID NO: 54768 - DNA, 25 bp, mus musculus
tatggctctttttgggtacatgtaa

SEQ ID NO: 54769 - DNA, 25 bp, mus musculus
tggctctttttgggtacatgtaata

SEQ ID NO: 54770 - DNA, 25 bp, mus musculus
ccataacattccgtagatggggcta

SEQ ID NO: 54771 - DNA, 25 bp, mus musculus
aagtcctgagtctgttctgtgtgtg

SEQ ID NO: 54772 - DNA, 25 bp, mus musculus
tgagtctgttctgtgtgtggcgtaa

SEQ ID NO: 54773 - DNA, 25 bp, mus musculus
agtctgttctgtgtgtggcgtaaca

SEQ ID NO: 54774 - DNA, 25 bp, mus musculus
tgttctgtgtgtggcgtaacattgt

SEQ ID NO: 54775 - DNA, 25 bp, mus musculus
ggaacttgccgagtcactggaacaa

SEQ ID NO: 54776 - DNA, 25 bp, mus musculus
aacttgccgagtcactggaacaagt

SEQ ID NO: 54777 - DNA, 25 bp, mus musculus
tgccgagtcactggaacaagttcaa

SEQ ID NO: 54778 - DNA, 25 bp, mus musculus
ttggtgcagtttctcttggtcaaag

SEQ ID NO: 54779 - DNA, 25 bp, mus musculus
gaccaagccaaggtgcctgtccagc

SEQ ID NO: 54780 - DNA, 25 bp, mus musculus
acttacatcatcgtcaacaagatgg

SEQ ID NO: 54781 - DNA, 25 bp, mus musculus
tacatcatcgtcaacaagatggcgt

SEQ ID NO: 54782 - DNA, 25 bp, mus musculus
aagatggcgtaccctcagtgtaatt

SEQ ID NO: 54783 - DNA, 25 bp, mus musculus
taccctcagtgtaatttgctggcat

SEQ ID NO: 54784 - DNA, 25 bp, mus musculus
aatttgctggcatcctatttagaga

SEQ ID NO: 54785 - DNA, 25 bp, mus musculus
aggccaaagttcagcctcctgatgg

SEQ ID NO: 54786 - DNA, 25 bp, mus musculus
ttcagcctcctgatggtggtcttga

SEQ ID NO: 54787 - DNA, 25 bp, mus musculus
ctcctgatggtggtcttgagcctca

SEQ ID NO: 54788 - DNA, 25 bp, mus musculus
gtggtcttgagcctcatctttatga

SEQ ID NO: 54789 - DNA, 25 bp, mus musculus
gtcttgagcctcatctttatgaaag

SEQ ID NO: 54790 - DNA, 25 bp, mus musculus
cctgtccagctctcggagatggtaa

SEQ ID NO: 54791 - DNA, 25 bp, mus musculus
agcctcatctttatgaaaggctact

SEQ ID NO: 54792 - DNA, 25 bp, mus musculus
ttagacatcatcaaccgtgccaaca

SEQ ID NO: 54793 - DNA, 25 bp, mus musculus
gacatcatcaaccgtgccaacacta

SEQ ID NO: 54794 - DNA, 25 bp, mus musculus
atcaaccgtgccaacactaagctgg

SEQ ID NO: 54795 - DNA, 25 bp, mus musculus
cgtgccaacactaagctggagtgca

SEQ ID NO: 54796 - DNA, 25 bp, mus musculus
gagtgcacctttggttgtcaactga

SEQ ID NO: 54797 - DNA, 25 bp, mus musculus
tgcacctttggttgtcaactgaagg

SEQ ID NO: 54798 - DNA, 25 bp, mus musculus
acccacacttacatcatcgtcaaca

SEQ ID NO: 54799 - DNA, 25 bp, mus musculus
ctgttggctcccaggagagagatcc

SEQ ID NO: 54800 - DNA, 25 bp, mus musculus
gagatcctggtcttgacctaggtgg

SEQ ID NO: 54801 - DNA, 25 bp, mus musculus
acttcattgagtgttctcaaaagag

SEQ ID NO: 54802 - DNA, 25 bp, mus musculus
taattctgcctaaaagtcagggtcg

SEQ ID NO: 54803 - DNA, 25 bp, mus musculus
tgaaatgtcaaccctcactctaagc

SEQ ID NO: 54804 - DNA, 25 bp, mus musculus
tagtggctttctgattttggtagtc

SEQ ID NO: 54805 - DNA, 25 bp, mus musculus
ctttctgattttggtagtcatatca

SEQ ID NO: 54806 - DNA, 25 bp, mus musculus
atattgttgcattgtctgcccatgt

SEQ ID NO: 54807 - DNA, 25 bp, mus musculus
ttgcattgtctgcccatgtcctgcc

SEQ ID NO: 54808 - DNA, 25 bp, mus musculus
tgtctgcccatgtcctgcctgaata

SEQ ID NO: 54809 - DNA, 25 bp, mus musculus
cccatgtcctgcctgaataccatga

SEQ ID NO: 54810 - DNA, 25 bp, mus musculus
tcctgcctgaataccatgattgttt

SEQ ID NO: 54811 - DNA, 25 bp, mus musculus
ctggtcttgacctaggtggccacca

SEQ ID NO: 54812 - DNA, 25 bp, mus musculus
gccaccaaggcacaacaatgccttg

SEQ ID NO: 54813 - DNA, 25 bp, mus musculus
caacaatgccttgtggtctgggaaa

SEQ ID NO: 54814 - DNA, 25 bp, mus musculus
tgccttgtggtctgggaaaactata

SEQ ID NO: 54815 - DNA, 25 bp, mus musculus
ccctgtactatcaacatagacttaa

SEQ ID NO: 54816 - DNA, 25 bp, mus musculus
actatcaacatagacttaattccct

SEQ ID NO: 54817 - DNA, 25 bp, mus musculus
aattggtttcccagtccattgagtg

SEQ ID NO: 54818 - DNA, 25 bp, mus musculus
tttcccagtccattgagtgatgggg

SEQ ID NO: 54819 - DNA, 25 bp, mus musculus
tgagatccggagatccaaggactgt

SEQ ID NO: 54820 - DNA, 25 bp, mus musculus
atccggagatccaaggactgtgagg

SEQ ID NO: 54821 - DNA, 25 bp, mus musculus
cacttacaatctgtatgatgtccat

SEQ ID NO: 54822 - DNA, 25 bp, mus musculus
caatctgtatgatgtccatgaacat

SEQ ID NO: 54823 - DNA, 25 bp, mus musculus
tccatgaacatgttcaccggcaaca

SEQ ID NO: 54824 - DNA, 25 bp, mus musculus
catgaacatgttcaccggcaacaac

SEQ ID NO: 54825 - DNA, 25 bp, mus musculus
tgaacatgttcaccggcaacaacaa

SEQ ID NO: 54826 - DNA, 25 bp, mus musculus
aacatgttcaccggcaacaacaaga

SEQ ID NO: 54827 - DNA, 25 bp, mus musculus
tgttcaccggcaacaacaagatctg

SEQ ID NO: 54828 - DNA, 25 bp, mus musculus
caccggcaacaacaagatctgtggc

SEQ ID NO: 54829 - DNA, 25 bp, mus musculus
ccggcaacaacaagatctgtggctg

SEQ ID NO: 54830 - DNA, 25 bp, mus musculus
acaacaagatctgtggctggaatta

SEQ ID NO: 54831 - DNA, 25 bp, mus musculus
agatccaaggactgtgaggctacaa

SEQ ID NO: 54832 - DNA, 25 bp, mus musculus
ttatgagtgccctaaatttgaagag

SEQ ID NO: 54833 - DNA, 25 bp, mus musculus
atccaaggactgtgaggctacaatg

SEQ ID NO: 54834 - DNA, 25 bp, mus musculus
tcaagacttttccggatgcatggcc

SEQ ID NO: 54835 - DNA, 25 bp, mus musculus
aagacttttccggatgcatggcctc

SEQ ID NO: 54836 - DNA, 25 bp, mus musculus
cttttccggatgcatggcctcttcg

SEQ ID NO: 54837 - DNA, 25 bp, mus musculus
aacagtgacacttacaatctgtatg

SEQ ID NO: 54838 - DNA, 25 bp, mus musculus
cagtgacacttacaatctgtatgat

SEQ ID NO: 54839 - DNA, 25 bp, mus musculus
gtgacacttacaatctgtatgatgt

SEQ ID NO: 54840 - DNA, 25 bp, mus musculus
agctatgcagaccgacccgcgggta

SEQ ID NO: 54841 - DNA, 25 bp, mus musculus
agcgacacgttagcgtctggttggt

SEQ ID NO: 54842 - DNA, 25 bp, mus musculus
atggacccaagtgcgcggcgatttc

SEQ ID NO: 54843 - DNA, 25 bp, mus musculus
ggacccaagtgcgcggcgatttctt

SEQ ID NO: 54844 - DNA, 25 bp, mus musculus
ccaagtgcgcggcgatttctttgga

SEQ ID NO: 54845 - DNA, 25 bp, mus musculus
gtgcgcggcgatttctttggaacag

SEQ ID NO: 54846 - DNA, 25 bp, mus musculus
atttctttggaacagcttgctgtcc

SEQ ID NO: 54847 - DNA, 25 bp, mus musculus
ttggaacagcttgctgtccagtggt

SEQ ID NO: 54848 - DNA, 25 bp, mus musculus
ggaacagcttgctgtccagtggtgc

SEQ ID NO: 54849 - DNA, 25 bp, mus musculus
aacagcttgctgtccagtggtgcgc

SEQ ID NO: 54850 - DNA, 25 bp, mus musculus
ggccgctccgtagtgctcacgtcgc

SEQ ID NO: 54851 - DNA, 25 bp, mus musculus
cgtagtgctcacgtcgcacagcatg

SEQ ID NO: 54852 - DNA, 25 bp, mus musculus
cgacacgttagcgtctggttggtga

SEQ ID NO: 54853 - DNA, 25 bp, mus musculus
ttggtgacccagctgtggtctttct

SEQ ID NO: 54854 - DNA, 25 bp, mus musculus
tgacccagctgtggtctttctggac

SEQ ID NO: 54855 - DNA, 25 bp, mus musculus
agctgtggtctttctggacgagccc

SEQ ID NO: 54856 - DNA, 25 bp, mus musculus
ctgtggtctttctggacgagcccac

SEQ ID NO: 54857 - DNA, 25 bp, mus musculus
caccacaggcatggacccaagtgcg

SEQ ID NO: 54858 - DNA, 25 bp, mus musculus
ccacaggcatggacccaagtgcgcg

SEQ ID NO: 54859 - DNA, 25 bp, mus musculus
gcatggacccaagtgcgcggcgatt

SEQ ID NO: 54860 - DNA, 25 bp, mus musculus
tgcctgatggtcgtgatgttggatg

SEQ ID NO: 54861 - DNA, 25 bp, mus musculus
tcttgattgacctgtgttggacatc

SEQ ID NO: 54862 - DNA, 25 bp, mus musculus
cttttttgacattctggatgcatgg

SEQ ID NO: 54863 - DNA, 25 bp, mus musculus
tgacattctggatgcatggaaggtc

SEQ ID NO: 54864 - DNA, 25 bp, mus musculus
acatctcagcatgctgctatgcacc

SEQ ID NO: 54865 - DNA, 25 bp, mus musculus
gctgctatgcaccaagatagatggt

SEQ ID NO: 54866 - DNA, 25 bp, mus musculus
agatggttaccacaggcctgccatc

SEQ ID NO: 54867 - DNA, 25 bp, mus musculus
caggcctgccatctccttggtggag

SEQ ID NO: 54868 - DNA, 25 bp, mus musculus
cagacctatcgagtttttctctgaa

SEQ ID NO: 54869 - DNA, 25 bp, mus musculus
agttcctactgaggtcaagttcttg

SEQ ID NO: 54870 - DNA, 25 bp, mus musculus
ggtcaagttcttgtctggggcttgg

SEQ ID NO: 54871 - DNA, 25 bp, mus musculus
ctgcctgtgtttggccattaaaaag

SEQ ID NO: 54872 - DNA, 25 bp, mus musculus
ttgacctgtgttggacatcttgatt

SEQ ID NO: 54873 - DNA, 25 bp, mus musculus
acagaacacatcttctttggctcat

SEQ ID NO: 54874 - DNA, 25 bp, mus musculus
ttctttggctcattttatcctggga

SEQ ID NO: 54875 - DNA, 25 bp, mus musculus
ggctcattttatcctgggatcgcct

SEQ ID NO: 54876 - DNA, 25 bp, mus musculus
tggcagacttcttggttcagcagat

SEQ ID NO: 54877 - DNA, 25 bp, mus musculus
acttcttggttcagcagatgccaaa

SEQ ID NO: 54878 - DNA, 25 bp, mus musculus
tgccaaattggccaccatatcacat

SEQ ID NO: 54879 - DNA, 25 bp, mus musculus
attggccaccatatcacatggtgtc

SEQ ID NO: 54880 - DNA, 25 bp, mus musculus
ctgacggtctctacctcggctcaga

SEQ ID NO: 54881 - DNA, 25 bp, mus musculus
acctcggctcagagtgggacctggg

SEQ ID NO: 54882 - DNA, 25 bp, mus musculus
atgtgttgtgcactgcactttacag

SEQ ID NO: 54883 - DNA, 25 bp, mus musculus
tgtgcactgcactttacagtttgca

SEQ ID NO: 54884 - DNA, 25 bp, mus musculus
ctgcactttacagtttgcaaagttt

SEQ ID NO: 54885 - DNA, 25 bp, mus musculus
tttccagaagcctctgtgaggcctt

SEQ ID NO: 54886 - DNA, 25 bp, mus musculus
ggccttcatcgccttccttgtaggt

SEQ ID NO: 54887 - DNA, 25 bp, mus musculus
catcgccttccttgtaggtgctgcc

SEQ ID NO: 54888 - DNA, 25 bp, mus musculus
tcctcaaagttctccaggcaagtgc

SEQ ID NO: 54889 - DNA, 25 bp, mus musculus
aagttctccaggcaagtgccctcgg

SEQ ID NO: 54890 - DNA, 25 bp, mus musculus
ccctcggcacttgctactgtgtttt

SEQ ID NO: 54891 - DNA, 25 bp, mus musculus
gctcctgctaccaattaaaactgtt

SEQ ID NO: 54892 - DNA, 25 bp, mus musculus
gctcagagtgggacctgggaccagc

SEQ ID NO: 54893 - DNA, 25 bp, mus musculus
acctgggaccagctccagagcgtca

SEQ ID NO: 54894 - DNA, 25 bp, mus musculus
caggccctgacagggcatgaagtgt

SEQ ID NO: 54895 - DNA, 25 bp, mus musculus
aaggacctctgagcctccaacaggg

SEQ ID NO: 54896 - DNA, 25 bp, mus musculus
ctctgagcctccaacagggttttct

SEQ ID NO: 54897 - DNA, 25 bp, mus musculus
tcgaagccaacacccctagaatcca

SEQ ID NO: 54898 - DNA, 25 bp, mus musculus
cccctagaatccagatgggcctgtc

SEQ ID NO: 54899 - DNA, 25 bp, mus musculus
agatgggcctgtctgacagaaaggc

SEQ ID NO: 54900 - DNA, 25 bp, mus musculus
ataacataagccatgtgtcgaatac

SEQ ID NO: 54901 - DNA, 25 bp, mus musculus
taacataagccatgtgtcgaatacc

SEQ ID NO: 54902 - DNA, 25 bp, mus musculus
atagatatcattaccaaatgggtga

SEQ ID NO: 54903 - DNA, 25 bp, mus musculus
tagatatcattaccaaatgggtgac

SEQ ID NO: 54904 - DNA, 25 bp, mus musculus
agatatcattaccaaatgggtgacg

SEQ ID NO: 54905 - DNA, 25 bp, mus musculus
gatatcattaccaaatgggtgacgt

SEQ ID NO: 54906 - DNA, 25 bp, mus musculus
atatcattaccaaatgggtgacgtt

SEQ ID NO: 54907 - DNA, 25 bp, mus musculus
tatcattaccaaatgggtgacgtta

SEQ ID NO: 54908 - DNA, 25 bp, mus musculus
tcattaccaaatgggtgacgttagc

SEQ ID NO: 54909 - DNA, 25 bp, mus musculus
cattaccaaatgggtgacgttagca

SEQ ID NO: 54910 - DNA, 25 bp, mus musculus
attaccaaatgggtgacgttagcag

SEQ ID NO: 54911 - DNA, 25 bp, mus musculus
tgaagtatccagcagtttagatcta

SEQ ID NO: 54912 - DNA, 25 bp, mus musculus
gaagtatccagcagtttagatctag

SEQ ID NO: 54913 - DNA, 25 bp, mus musculus
aagtatccagcagtttagatctaga

SEQ ID NO: 54914 - DNA, 25 bp, mus musculus
agtatccagcagtttagatctagaa

SEQ ID NO: 54915 - DNA, 25 bp, mus musculus
gtatccagcagtttagatctagaac

SEQ ID NO: 54916 - DNA, 25 bp, mus musculus
tatccagcagtttagatctagaact

SEQ ID NO: 54917 - DNA, 25 bp, mus musculus
atccagcagtttagatctagaacta

SEQ ID NO: 54918 - DNA, 25 bp, mus musculus
tagatctagaactatctctgaatcg

SEQ ID NO: 54919 - DNA, 25 bp, mus musculus
gttgctcaagtcttatggccaggag

SEQ ID NO: 54920 - DNA, 25 bp, mus musculus
ggcggccattgaacagcctgtggcc

SEQ ID NO: 54921 - DNA, 25 bp, mus musculus
aggcagtagccttgtctgtctctgt

SEQ ID NO: 54922 - DNA, 25 bp, mus musculus
tgtctgtctctgtcctcagacaaac

SEQ ID NO: 54923 - DNA, 25 bp, mus musculus
tctctgtcctcagacaaactgggca

SEQ ID NO: 54924 - DNA, 25 bp, mus musculus
gccttttctccatcacagcttcctg

SEQ ID NO: 54925 - DNA, 25 bp, mus musculus
tcacagcttcctgagttccagaggc

SEQ ID NO: 54926 - DNA, 25 bp, mus musculus
tcactgctatggtggctgagattgt

SEQ ID NO: 54927 - DNA, 25 bp, mus musculus
agattgtgcctaaggcccctggagt

SEQ ID NO: 54928 - DNA, 25 bp, mus musculus
tgcctaaggcccctggagtggcctg

SEQ ID NO: 54929 - DNA, 25 bp, mus musculus
gagtccgccaaggaactcacttact

SEQ ID NO: 54930 - DNA, 25 bp, mus musculus
gccaaggaactcacttacttatgta

SEQ ID NO: 54931 - DNA, 25 bp, mus musculus
agattatctatcctggccagcatcc

SEQ ID NO: 54932 - DNA, 25 bp, mus musculus
aggttcaagtcctgcaactcctgga

SEQ ID NO: 54933 - DNA, 25 bp, mus musculus
tgcaactcctggagtcaacatggcc

SEQ ID NO: 54934 - DNA, 25 bp, mus musculus
tcgcctcaaggccaaagagttcagc

SEQ ID NO: 54935 - DNA, 25 bp, mus musculus
ccacagccaggtgcccacagtgaac

SEQ ID NO: 54936 - DNA, 25 bp, mus musculus
gcccacagtgaactgactgtgcatt

SEQ ID NO: 54937 - DNA, 25 bp, mus musculus
ctgactgtgcattgggtccagcttc

SEQ ID NO: 54938 - DNA, 25 bp, mus musculus
tggcccaatggcagactgcagcaaa

SEQ ID NO: 54939 - DNA, 25 bp, mus musculus
acaataacagccccgaaggcagctc

SEQ ID NO: 54940 - DNA, 25 bp, mus musculus
gccccgaaggcagctccactgtcat

SEQ ID NO: 54941 - DNA, 25 bp, mus musculus
ccagcaattggctcactgcaaagag

SEQ ID NO: 54942 - DNA, 25 bp, mus musculus
attggctcactgcaaagagtggcag

SEQ ID NO: 54943 - DNA, 25 bp, mus musculus
tcactgcaaagagtggcagagagaa

SEQ ID NO: 54944 - DNA, 25 bp, mus musculus
agaggtgcccttacaccaagcacca

SEQ ID NO: 54945 - DNA, 25 bp, mus musculus
agcgccgcctagagatcagtaagag

SEQ ID NO: 54946 - DNA, 25 bp, mus musculus
agagcgttaacctcaccgacaggca

SEQ ID NO: 54947 - DNA, 25 bp, mus musculus
gcgttaacctcaccgacaggcaggt

SEQ ID NO: 54948 - DNA, 25 bp, mus musculus
agaatcgaatccgagaactgaccgc

SEQ ID NO: 54949 - DNA, 25 bp, mus musculus
gaatccgagaactgaccgccaacct

SEQ ID NO: 54950 - DNA, 25 bp, mus musculus
gagaactgaccgccaacctcacctt

SEQ ID NO: 54951 - DNA, 25 bp, mus musculus
ccgaaggcagctccactgtcatgct

SEQ ID NO: 54952 - DNA, 25 bp, mus musculus
aaggcagctccactgtcatgctcca

SEQ ID NO: 54953 - DNA, 25 bp, mus musculus
cggctgcccagctgcagatggaaaa

SEQ ID NO: 54954 - DNA, 25 bp, mus musculus
cgagcgcccaggagcccactaaagt

SEQ ID NO: 54955 - DNA, 25 bp, mus musculus
ccactaaagtctcccaagtggagag

SEQ ID NO: 54956 - DNA, 25 bp, mus musculus
tttccgtgtccagtcccgaagtgca

SEQ ID NO: 54957 - DNA, 25 bp, mus musculus
aaatcaagtctgatactccaaccag

SEQ ID NO: 54958 - DNA, 25 bp, mus musculus
atactccaaccagcaattggctcac

SEQ ID NO: 54959 - DNA, 25 bp, mus musculus
gctcttcaagatgtagcccaaagaa

SEQ ID NO: 54960 - DNA, 25 bp, mus musculus
ttccgtggtgccggaagtgccgagt

SEQ ID NO: 54961 - DNA, 25 bp, mus musculus
gagatgaccatttgcttttggtcct

SEQ ID NO: 54962 - DNA, 25 bp, mus musculus
tgaccatttgcttttggtcctcacg

SEQ ID NO: 54963 - DNA, 25 bp, mus musculus
accatttgcttttggtcctcacgat

SEQ ID NO: 54964 - DNA, 25 bp, mus musculus
tttgcttttggtcctcacgatcccg

SEQ ID NO: 54965 - DNA, 25 bp, mus musculus
tgcttttggtcctcacgatcccgtt

SEQ ID NO: 54966 - DNA, 25 bp, mus musculus
tcacgatcccgttgtgcttagcgtc

SEQ ID NO: 54967 - DNA, 25 bp, mus musculus
acgatcccgttgtgcttagcgtcaa

SEQ ID NO: 54968 - DNA, 25 bp, mus musculus
ccgttgtgcttagcgtcaattgcaa

SEQ ID NO: 54969 - DNA, 25 bp, mus musculus
tgtgcttagcgtcaattgcaattcc

SEQ ID NO: 54970 - DNA, 25 bp, mus musculus
gtcaattgcaattccttctctcata

SEQ ID NO: 54971 - DNA, 25 bp, mus musculus
agaagtgccctgtgtgcccgacatg

SEQ ID NO: 54972 - DNA, 25 bp, mus musculus
caattgcaattccttctctcataaa

SEQ ID NO: 54973 - DNA, 25 bp, mus musculus
ccccagtgcccaaagcagccattgt

SEQ ID NO: 54974 - DNA, 25 bp, mus musculus
tgcccaaagcagccattgtgcgaag

SEQ ID NO: 54975 - DNA, 25 bp, mus musculus
cccaaagcagccattgtgcgaagaa

SEQ ID NO: 54976 - DNA, 25 bp, mus musculus
caaagcagccattgtgcgaagaaag

SEQ ID NO: 54977 - DNA, 25 bp, mus musculus
cacccaagctccaaatacacagcat

SEQ ID NO: 54978 - DNA, 25 bp, mus musculus
ccaaatacacagcataaaggctgtt

SEQ ID NO: 54979 - DNA, 25 bp, mus musculus
atacacagcataaaggctgttgagc

SEQ ID NO: 54980 - DNA, 25 bp, mus musculus
aaggactgagtgctccgcggcccgc

SEQ ID NO: 54981 - DNA, 25 bp, mus musculus
cggcccagaattcccgtgcaactcg

SEQ ID NO: 54982 - DNA, 25 bp, mus musculus
cagcaacttgacccaaacaaccctg

SEQ ID NO: 54983 - DNA, 25 bp, mus musculus
cttgacccaaacaaccctgcagcga

SEQ ID NO: 54984 - DNA, 25 bp, mus musculus
acaaccctgcagcgaactggatcca

SEQ ID NO: 54985 - DNA, 25 bp, mus musculus
aaccctgcagcgaactggatccacg

SEQ ID NO: 54986 - DNA, 25 bp, mus musculus
ccctgcagcgaactggatccacgct

SEQ ID NO: 54987 - DNA, 25 bp, mus musculus
ggaattcctcttcaacatgtacctc

SEQ ID NO: 54988 - DNA, 25 bp, mus musculus
aattcctcttcaacatgtacctcac

SEQ ID NO: 54989 - DNA, 25 bp, mus musculus
cggcgctacgaggtggctaggattc

SEQ ID NO: 54990 - DNA, 25 bp, mus musculus
gcgctacgaggtggctaggattctg

SEQ ID NO: 54991 - DNA, 25 bp, mus musculus
aggattctgaaccttacagagagac

SEQ ID NO: 54992 - DNA, 25 bp, mus musculus
cgtgcaactcgttcctgcgggacaa

SEQ ID NO: 54993 - DNA, 25 bp, mus musculus
tgcaactcgttcctgcgggacaagg

SEQ ID NO: 54994 - DNA, 25 bp, mus musculus
caactcgttcctgcgggacaaggca

SEQ ID NO: 54995 - DNA, 25 bp, mus musculus
actcgttcctgcgggacaaggcagc

SEQ ID NO: 54996 - DNA, 25 bp, mus musculus
ctcagcttgcagcgatcacccgagc

SEQ ID NO: 54997 - DNA, 25 bp, mus musculus
gcttgcagcgatcacccgagcccgg

SEQ ID NO: 54998 - DNA, 25 bp, mus musculus
ccgcagcagcaacttgacccaaaca

SEQ ID NO: 54999 - DNA, 25 bp, mus musculus
gcagcagcaacttgacccaaacaac

SEQ ID NO: 55000 - DNA, 25 bp, mus musculus
cggcacgatgccatactctggccct

SEQ ID NO: 55001 - DNA, 25 bp, mus musculus
ggcacgatgccatactctggccctc

SEQ ID NO: 55002 - DNA, 25 bp, mus musculus
tctggccctcacggagagacaggta

SEQ ID NO: 55003 - DNA, 25 bp, mus musculus
tggccctcacggagagacaggtaaa

SEQ ID NO: 55004 - DNA, 25 bp, mus musculus
gctgaaggctgccccacaaattaaa

SEQ ID NO: 55005 - DNA, 25 bp, mus musculus
ctctacctttacacttctaccacag

SEQ ID NO: 55006 - DNA, 25 bp, mus musculus
tacctttacacttctaccacagact

SEQ ID NO: 55007 - DNA, 25 bp, mus musculus
cctttacacttctaccacagactat

SEQ ID NO: 55008 - DNA, 25 bp, mus musculus
ctttacacttctaccacagactatt

SEQ ID NO: 55009 - DNA, 25 bp, mus musculus
ttctaccacagactattaagactga

SEQ ID NO: 55010 - DNA, 25 bp, mus musculus
tctaccacagactattaagactgat

SEQ ID NO: 55011 - DNA, 25 bp, mus musculus
accacagactattaagactgatgat

SEQ ID NO: 55012 - DNA, 25 bp, mus musculus
acgatgccatactctggccctcacg

SEQ ID NO: 55013 - DNA, 25 bp, mus musculus
gatgccatactctggccctcacgga

SEQ ID NO: 55014 - DNA, 25 bp, mus musculus
atgccatactctggccctcacggag

SEQ ID NO: 55015 - DNA, 25 bp, mus musculus
gccatactctggccctcacggagag

SEQ ID NO: 55016 - DNA, 25 bp, mus musculus
ccatactctggccctcacggagaga

SEQ ID NO: 55017 - DNA, 25 bp, mus musculus
atactctggccctcacggagagaca

SEQ ID NO: 55018 - DNA, 25 bp, mus musculus
tactctggccctcacggagagacag

SEQ ID NO: 55019 - DNA, 25 bp, mus musculus
ctctggccctcacggagagacaggt

SEQ ID NO: 55020 - DNA, 25 bp, mus musculus
agttcgggtgacggcatgtcatgtg

SEQ ID NO: 55021 - DNA, 25 bp, mus musculus
gggacctcggcgttcacgagagtca

SEQ ID NO: 55022 - DNA, 25 bp, mus musculus
gtccatgagccaggacctcacatct

SEQ ID NO: 55023 - DNA, 25 bp, mus musculus
tccatgagccaggacctcacatctt

SEQ ID NO: 55024 - DNA, 25 bp, mus musculus
catgagccaggacctcacatcttac

SEQ ID NO: 55025 - DNA, 25 bp, mus musculus
atgagccaggacctcacatcttact

SEQ ID NO: 55026 - DNA, 25 bp, mus musculus
gagccaggacctcacatcttactgt

SEQ ID NO: 55027 - DNA, 25 bp, mus musculus
agccaggacctcacatcttactgtt

SEQ ID NO: 55028 - DNA, 25 bp, mus musculus
ccaggacctcacatcttactgttcc

SEQ ID NO: 55029 - DNA, 25 bp, mus musculus
caggacctcacatcttactgttccg

SEQ ID NO: 55030 - DNA, 25 bp, mus musculus
tgttccgacgggcactggccagaga

SEQ ID NO: 55031 - DNA, 25 bp, mus musculus
ttccgacgggcactggccagagaag

SEQ ID NO: 55032 - DNA, 25 bp, mus musculus
gacctcggcgttcacgagagtcatg

SEQ ID NO: 55033 - DNA, 25 bp, mus musculus
acctcggcgttcacgagagtcatgg

SEQ ID NO: 55034 - DNA, 25 bp, mus musculus
ctcggcgttcacgagagtcatggat

SEQ ID NO: 55035 - DNA, 25 bp, mus musculus
gcgttcacgagagtcatggatgggt

SEQ ID NO: 55036 - DNA, 25 bp, mus musculus
ttcacgagagtcatggatgggtcca

SEQ ID NO: 55037 - DNA, 25 bp, mus musculus
gtccactatatggtccatgagccag

SEQ ID NO: 55038 - DNA, 25 bp, mus musculus
tccactatatggtccatgagccagg

SEQ ID NO: 55039 - DNA, 25 bp, mus musculus
actatatggtccatgagccaggacc

SEQ ID NO: 55040 - DNA, 25 bp, mus musculus
tgagaatcagaccaccagaaatctg

SEQ ID NO: 55041 - DNA, 25 bp, mus musculus
gaatcagaccaccagaaatctggac

SEQ ID NO: 55042 - DNA, 25 bp, mus musculus
gcttcaaggacctgtctttgtaggt

SEQ ID NO: 55043 - DNA, 25 bp, mus musculus
tcaaggacctgtctttgtaggtgtg

SEQ ID NO: 55044 - DNA, 25 bp, mus musculus
acctgtctttgtaggtgtgcccctg

SEQ ID NO: 55045 - DNA, 25 bp, mus musculus
tgtctttgtaggtgtgcccctgctg

SEQ ID NO: 55046 - DNA, 25 bp, mus musculus
gcccctgctgggccatcctgatttg

SEQ ID NO: 55047 - DNA, 25 bp, mus musculus
gctgggccatcctgatttgtatgct

SEQ ID NO: 55048 - DNA, 25 bp, mus musculus
tttgtatgctcattcatcagccatc

SEQ ID NO: 55049 - DNA, 25 bp, mus musculus
gtatgctcattcatcagccatccag

SEQ ID NO: 55050 - DNA, 25 bp, mus musculus
tcattcatcagccatccagtcggtg

SEQ ID NO: 55051 - DNA, 25 bp, mus musculus
atcagccatccagtcggtgtgagga

SEQ ID NO: 55052 - DNA, 25 bp, mus musculus
gaccaccagaaatctggacacctgt

SEQ ID NO: 55053 - DNA, 25 bp, mus musculus
catccagtcggtgtgaggatgagag

SEQ ID NO: 55054 - DNA, 25 bp, mus musculus
cagaaatctggacacctgtgccttc

SEQ ID NO: 55055 - DNA, 25 bp, mus musculus
tctggacacctgtgccttcagacct

SEQ ID NO: 55056 - DNA, 25 bp, mus musculus
ggacacctgtgccttcagacctgac

SEQ ID NO: 55057 - DNA, 25 bp, mus musculus
tgccttcagacctgacctgtgggaa

SEQ ID NO: 55058 - DNA, 25 bp, mus musculus
cttcagacctgacctgtgggaatgg

SEQ ID NO: 55059 - DNA, 25 bp, mus musculus
cagacctgacctgtgggaatggggc

SEQ ID NO: 55060 - DNA, 25 bp, mus musculus
gcagcttcaaggacctgtctttgta

SEQ ID NO: 55061 - DNA, 25 bp, mus musculus
actctctcggatgctcaacctcact

SEQ ID NO: 55062 - DNA, 25 bp, mus musculus
ctctcggatgctcaacctcactgac

SEQ ID NO: 55063 - DNA, 25 bp, mus musculus
acttcacgatttcttctcgccttca

SEQ ID NO: 55064 - DNA, 25 bp, mus musculus
cccagcgaccactacagcctgagga

SEQ ID NO: 55065 - DNA, 25 bp, mus musculus
agcgaccactacagcctgaggaaga

SEQ ID NO: 55066 - DNA, 25 bp, mus musculus
aagaggcccggaacttggctgtgcg

SEQ ID NO: 55067 - DNA, 25 bp, mus musculus
cccggaacttggctgtgcggatcct

SEQ ID NO: 55068 - DNA, 25 bp, mus musculus
ctgagtcctcaacgcggcgagatct

SEQ ID NO: 55069 - DNA, 25 bp, mus musculus
agtcctcaacgcggcgagatctgta

SEQ ID NO: 55070 - DNA, 25 bp, mus musculus
tttctttcccttcagtgaacacaga

SEQ ID NO: 55071 - DNA, 25 bp, mus musculus
ctttcccttcagtgaacacagatta

SEQ ID NO: 55072 - DNA, 25 bp, mus musculus
gtacctttgggcatgagtcactgtc

SEQ ID NO: 55073 - DNA, 25 bp, mus musculus
gttccagaatcgcaggatgaaagaa

SEQ ID NO: 55074 - DNA, 25 bp, mus musculus
cagggaccgtctgcaatatttcact

SEQ ID NO: 55075 - DNA, 25 bp, mus musculus
ccgtctgcaatatttcactggaaac

SEQ ID NO: 55076 - DNA, 25 bp, mus musculus
ctgctctcagcaggcccaatgtcct

SEQ ID NO: 55077 - DNA, 25 bp, mus musculus
atgtccttgggttcaatgacgcctc

SEQ ID NO: 55078 - DNA, 25 bp, mus musculus
tcaatgacgcctcttctctgtggaa

SEQ ID NO: 55079 - DNA, 25 bp, mus musculus
atgacgcctcttctctgtggaactt

SEQ ID NO: 55080 - DNA, 25 bp, mus musculus
ctctgtggaacttcacgatttcttc

SEQ ID NO: 55081 - DNA, 25 bp, mus musculus
taggaccccctgtctgacagtctgc

SEQ ID NO: 55082 - DNA, 25 bp, mus musculus
tctgacagtctgcgggagaactatg

SEQ ID NO: 55083 - DNA, 25 bp, mus musculus
tgacttgctgtcgcagctgatcagt

SEQ ID NO: 55084 - DNA, 25 bp, mus musculus
acttgctgtcgcagctgatcagtgt

SEQ ID NO: 55085 - DNA, 25 bp, mus musculus
cttgctgtcgcagctgatcagtgtc

SEQ ID NO: 55086 - DNA, 25 bp, mus musculus
tgctgtcgcagctgatcagtgtcaa

SEQ ID NO: 55087 - DNA, 25 bp, mus musculus
gctgtcgcagctgatcagtgtcaac

SEQ ID NO: 55088 - DNA, 25 bp, mus musculus
tgtcgcagctgatcagtgtcaacgc

SEQ ID NO: 55089 - DNA, 25 bp, mus musculus
tcttctgggtcagcgagtgctgtgg

SEQ ID NO: 55090 - DNA, 25 bp, mus musculus
tctgggtcagcgagtgctgtggact

SEQ ID NO: 55091 - DNA, 25 bp, mus musculus
ctgggtcagcgagtgctgtggacta

SEQ ID NO: 55092 - DNA, 25 bp, mus musculus
gggtcagcgagtgctgtggactatt

SEQ ID NO: 55093 - DNA, 25 bp, mus musculus
tgacagtctgcgggagaactatgtg

SEQ ID NO: 55094 - DNA, 25 bp, mus musculus
gagaactatgtgccggtggactggt

SEQ ID NO: 55095 - DNA, 25 bp, mus musculus
ctatgtgccggtggactggtgagac

SEQ ID NO: 55096 - DNA, 25 bp, mus musculus
tatgtgccggtggactggtgagaca

SEQ ID NO: 55097 - DNA, 25 bp, mus musculus
gccgccttagtgacttgctgtcgca

SEQ ID NO: 55098 - DNA, 25 bp, mus musculus
ccgccttagtgacttgctgtcgcag

SEQ ID NO: 55099 - DNA, 25 bp, mus musculus
gccttagtgacttgctgtcgcagct

SEQ ID NO: 55100 - DNA, 25 bp, mus musculus
tagtgacttgctgtcgcagctgatc

SEQ ID NO: 55101 - DNA, 25 bp, mus musculus
catctgaggaacgcagccggactag

SEQ ID NO: 55102 - DNA, 25 bp, mus musculus
ttcattcggctctcaaaggcaccaa

SEQ ID NO: 55103 - DNA, 25 bp, mus musculus
agaggaaaccctacacaaagcagca

SEQ ID NO: 55104 - DNA, 25 bp, mus musculus
aaccctacacaaagcagcagattgc

SEQ ID NO: 55105 - DNA, 25 bp, mus musculus
acacaaagcagcagattgcggagct

SEQ ID NO: 55106 - DNA, 25 bp, mus musculus
tcaatgaattcatcaaccggcagaa

SEQ ID NO: 55107 - DNA, 25 bp, mus musculus
tcaaccggcagaagcgtaaggaatt

SEQ ID NO: 55108 - DNA, 25 bp, mus musculus
tgtctaacaggctgaacctcagcga

SEQ ID NO: 55109 - DNA, 25 bp, mus musculus
acaggctgaacctcagcgaccagca

SEQ ID NO: 55110 - DNA, 25 bp, mus musculus
tgaacctcagcgaccagcaggtcaa

SEQ ID NO: 55111 - DNA, 25 bp, mus musculus
tcagcgaccagcaggtcaaaatctg

SEQ ID NO: 55112 - DNA, 25 bp, mus musculus
tgcagcgcgagcaagcactggccct

SEQ ID NO: 55113 - DNA, 25 bp, mus musculus
cggctctcaaaggcaccaagtatga

SEQ ID NO: 55114 - DNA, 25 bp, mus musculus
cgagcaagcactggccctctattag

SEQ ID NO: 55115 - DNA, 25 bp, mus musculus
gcaccaagtatgactacgcgggtgt

SEQ ID NO: 55116 - DNA, 25 bp, mus musculus
gctctgcgaccctgctccagggggc

SEQ ID NO: 55117 - DNA, 25 bp, mus musculus
ccaaaggcccgctcaacttgaacat

SEQ ID NO: 55118 - DNA, 25 bp, mus musculus
tcaacttgaacatggcagtgcaagt

SEQ ID NO: 55119 - DNA, 25 bp, mus musculus
gcctgcgatcttcactgcccgacgg

SEQ ID NO: 55120 - DNA, 25 bp, mus musculus
gtaaacagtgcccatgctccccgaa

SEQ ID NO: 55121 - DNA, 25 bp, mus musculus
agtgcccatgctccccgaagccagg

SEQ ID NO: 55122 - DNA, 25 bp, mus musculus
atttatccgtggtccccagcagaat

SEQ ID NO: 55123 - DNA, 25 bp, mus musculus
tggtccccagcagaattagaggctg

SEQ ID NO: 55124 - DNA, 25 bp, mus musculus
cttccactgtcaaactctaagcgct

SEQ ID NO: 55125 - DNA, 25 bp, mus musculus
ccactgtcaaactctaagcgctttg

SEQ ID NO: 55126 - DNA, 25 bp, mus musculus
aactctaagcgctttggcagcaaag

SEQ ID NO: 55127 - DNA, 25 bp, mus musculus
tctaagcgctttggcagcaaagcat

SEQ ID NO: 55128 - DNA, 25 bp, mus musculus
aagcgctttggcagcaaagcattgc

SEQ ID NO: 55129 - DNA, 25 bp, mus musculus
gctgctgcttcaccaaggtaggtta

SEQ ID NO: 55130 - DNA, 25 bp, mus musculus
ctattaacagtacattttcgtggct

SEQ ID NO: 55131 - DNA, 25 bp, mus musculus
acagtacattttcgtggctctcaag

SEQ ID NO: 55132 - DNA, 25 bp, mus musculus
ggctctcaagcatcccttttgaagg

SEQ ID NO: 55133 - DNA, 25 bp, mus musculus
gcatcccttttgaagggactggtgt

SEQ ID NO: 55134 - DNA, 25 bp, mus musculus
cagctgcttccggtcctgaaaccag

SEQ ID NO: 55135 - DNA, 25 bp, mus musculus
ctgcttccggtcctgaaaccaggca

SEQ ID NO: 55136 - DNA, 25 bp, mus musculus
gtcctgaaaccaggcaggacttgca

SEQ ID NO: 55137 - DNA, 25 bp, mus musculus
ctgaaaccaggcaggacttgcacag

SEQ ID NO: 55138 - DNA, 25 bp, mus musculus
aaaccaggcaggacttgcacagaga

SEQ ID NO: 55139 - DNA, 25 bp, mus musculus
aaattgctaagctaatcggtgctcc

SEQ ID NO: 55140 - DNA, 25 bp, mus musculus
agctaatcggtgctccaagagatga

SEQ ID NO: 55141 - DNA, 25 bp, mus musculus
ccagccctatagaaagcaagagccc

SEQ ID NO: 55142 - DNA, 25 bp, mus musculus
cgttccggcctgacagggtcacata

SEQ ID NO: 55143 - DNA, 25 bp, mus musculus
gttccggcctgacagggtcacataa

SEQ ID NO: 55144 - DNA, 25 bp, mus musculus
cccctcttggctcaagggctgcttt

SEQ ID NO: 55145 - DNA, 25 bp, mus musculus
ccctcttggctcaagggctgctttc

SEQ ID NO: 55146 - DNA, 25 bp, mus musculus
cctcttggctcaagggctgctttcc

SEQ ID NO: 55147 - DNA, 25 bp, mus musculus
ctcttggctcaagggctgctttcca

SEQ ID NO: 55148 - DNA, 25 bp, mus musculus
cttggctcaagggctgctttccaag

SEQ ID NO: 55149 - DNA, 25 bp, mus musculus
ttggctcaagggctgctttccaaga

SEQ ID NO: 55150 - DNA, 25 bp, mus musculus
tggctcaagggctgctttccaagac

SEQ ID NO: 55151 - DNA, 25 bp, mus musculus
ggctcaagggctgctttccaagacg

SEQ ID NO: 55152 - DNA, 25 bp, mus musculus
ctcaagggctgctttccaagacgtt

SEQ ID NO: 55153 - DNA, 25 bp, mus musculus
tcaagggctgctttccaagacgttt

SEQ ID NO: 55154 - DNA, 25 bp, mus musculus
tccggcctgacagggtcacataaca

SEQ ID NO: 55155 - DNA, 25 bp, mus musculus
ccggcctgacagggtcacataacag

SEQ ID NO: 55156 - DNA, 25 bp, mus musculus
cggcctgacagggtcacataacagt

SEQ ID NO: 55157 - DNA, 25 bp, mus musculus
aacagtttgcaatcgaccagcaagc

SEQ ID NO: 55158 - DNA, 25 bp, mus musculus
acagtttgcaatcgaccagcaagcg

SEQ ID NO: 55159 - DNA, 25 bp, mus musculus
cagtttgcaatcgaccagcaagcgc

SEQ ID NO: 55160 - DNA, 25 bp, mus musculus
aatcgaccagcaagcgcaatctctc

SEQ ID NO: 55161 - DNA, 25 bp, mus musculus
atcgaccagcaagcgcaatctctcc

SEQ ID NO: 55162 - DNA, 25 bp, mus musculus
cccaaacgttccaggacagatctgt

SEQ ID NO: 55163 - DNA, 25 bp, mus musculus
aaacgttccaggacagatctgtctc

SEQ ID NO: 55164 - DNA, 25 bp, mus musculus
tactctatgccattcggctccgttt

SEQ ID NO: 55165 - DNA, 25 bp, mus musculus
tctatgccattcggctccgttttct

SEQ ID NO: 55166 - DNA, 25 bp, mus musculus
atgccattcggctccgttttctcta

SEQ ID NO: 55167 - DNA, 25 bp, mus musculus
ccattcggctccgttttctctacag

SEQ ID NO: 55168 - DNA, 25 bp, mus musculus
ttcggctccgttttctctacagcca

SEQ ID NO: 55169 - DNA, 25 bp, mus musculus
ggctccgttttctctacagccagaa

SEQ ID NO: 55170 - DNA, 25 bp, mus musculus
tccgttttctctacagccagaagag

SEQ ID NO: 55171 - DNA, 25 bp, mus musculus
gttttctctacagccagaagagcag

SEQ ID NO: 55172 - DNA, 25 bp, mus musculus
ttctctacagccagaagagcagaaa

SEQ ID NO: 55173 - DNA, 25 bp, mus musculus
tctacagccagaagagcagaaagtt

SEQ ID NO: 55174 - DNA, 25 bp, mus musculus
cgttccaggacagatctgtctcagc

SEQ ID NO: 55175 - DNA, 25 bp, mus musculus
aggacagatctgtctcagcgcggat

SEQ ID NO: 55176 - DNA, 25 bp, mus musculus
ctgtctcagcgcggattaccttatg

SEQ ID NO: 55177 - DNA, 25 bp, mus musculus
tatgctgagctgatcaaggtcttga

SEQ ID NO: 55178 - DNA, 25 bp, mus musculus
ccttgcgtcttgcacactggctact

SEQ ID NO: 55179 - DNA, 25 bp, mus musculus
tgcgtcttgcacactggctactcta

SEQ ID NO: 55180 - DNA, 25 bp, mus musculus
actggctactctatgccattcggct

SEQ ID NO: 55181 - DNA, 25 bp, mus musculus
ggctactctatgccattcggctccg

SEQ ID NO: 55182 - DNA, 25 bp, mus musculus
ctgttcctgctggatcctgatgctg

SEQ ID NO: 55183 - DNA, 25 bp, mus musculus
ctgctggatcctgatgctgtggaca

SEQ ID NO: 55184 - DNA, 25 bp, mus musculus
cctatccctaggacatggctggtcc

SEQ ID NO: 55185 - DNA, 25 bp, mus musculus
accacaaccccagtggagcacagat

SEQ ID NO: 55186 - DNA, 25 bp, mus musculus
ttggtcctgggcagtaccttggatc

SEQ ID NO: 55187 - DNA, 25 bp, mus musculus
agtaccttggatcaggaggaagatc

SEQ ID NO: 55188 - DNA, 25 bp, mus musculus
ggctgcatacctgctgcctttaccc

SEQ ID NO: 55189 - DNA, 25 bp, mus musculus
ccaggtctactctctggtcacagct

SEQ ID NO: 55190 - DNA, 25 bp, mus musculus
ctactctctggtcacagcttcacag

SEQ ID NO: 55191 - DNA, 25 bp, mus musculus
tctggtcacagcttcacagccacac

SEQ ID NO: 55192 - DNA, 25 bp, mus musculus
gccacacttggactgaccctgcagg

SEQ ID NO: 55193 - DNA, 25 bp, mus musculus
cttggactgaccctgcaggttgttc

SEQ ID NO: 55194 - DNA, 25 bp, mus musculus
gatcctgatgctgtggacacaggga

SEQ ID NO: 55195 - DNA, 25 bp, mus musculus
agcagtgagctgcctgtgctctttg

SEQ ID NO: 55196 - DNA, 25 bp, mus musculus
gagctgcctgtgctctttgagctgg

SEQ ID NO: 55197 - DNA, 25 bp, mus musculus
gactacacggatgatcccaccatct

SEQ ID NO: 55198 - DNA, 25 bp, mus musculus
acggatgatcccaccatctctcttc

SEQ ID NO: 55199 - DNA, 25 bp, mus musculus
tctcttctgacaggcactgaacccc

SEQ ID NO: 55200 - DNA, 25 bp, mus musculus
ctgacaggcactgaaccccataaag

SEQ ID NO: 55201 - DNA, 25 bp, mus musculus
ttgtcaggctggcttgtgcctggcc

SEQ ID NO: 55202 - DNA, 25 bp, mus musculus
tcgctgcatgtccactaaataggtg

SEQ ID NO: 55203 - DNA, 25 bp, mus musculus
gctgcatgtccactaaataggtggt

SEQ ID NO: 55204 - DNA, 25 bp, mus musculus
acgagtctcctcttgcgagaagaac

SEQ ID NO: 55205 - DNA, 25 bp, mus musculus
gagtctcctcttgcgagaagaacat

SEQ ID NO: 55206 - DNA, 25 bp, mus musculus
gtctcctcttgcgagaagaacatag

SEQ ID NO: 55207 - DNA, 25 bp, mus musculus
agaacatagagccgtcgggccgtgc

SEQ ID NO: 55208 - DNA, 25 bp, mus musculus
gcggcacaatcgcgctcacccagaa

SEQ ID NO: 55209 - DNA, 25 bp, mus musculus
cgctcacccagaaacttatagctga

SEQ ID NO: 55210 - DNA, 25 bp, mus musculus
ctcacccagaaacttatagctgaga

SEQ ID NO: 55211 - DNA, 25 bp, mus musculus
cacccagaaacttatagctgagata

SEQ ID NO: 55212 - DNA, 25 bp, mus musculus
agataggacggcaccttgaggacgc

SEQ ID NO: 55213 - DNA, 25 bp, mus musculus
agggtgctccagagtggcgtaacgc

SEQ ID NO: 55214 - DNA, 25 bp, mus musculus
tgtccactaaataggtggtgaccgt

SEQ ID NO: 55215 - DNA, 25 bp, mus musculus
ggaagcgcacgacaacaccgaccat

SEQ ID NO: 55216 - DNA, 25 bp, mus musculus
gcacgacaacaccgaccatgtgagg

SEQ ID NO: 55217 - DNA, 25 bp, mus musculus
acgacaacaccgaccatgtgaggat

SEQ ID NO: 55218 - DNA, 25 bp, mus musculus
gacaacaccgaccatgtgaggatcc

SEQ ID NO: 55219 - DNA, 25 bp, mus musculus
caacaccgaccatgtgaggatccag

SEQ ID NO: 55220 - DNA, 25 bp, mus musculus
ggcaaaacgagtctcctcttgcgag

SEQ ID NO: 55221 - DNA, 25 bp, mus musculus
aaacgagtctcctcttgcgagaaga

SEQ ID NO: 55222 - DNA, 25 bp, mus musculus
tctaaatccaagccagacaaacaac

SEQ ID NO: 55223 - DNA, 25 bp, mus musculus
cttatccagtatactgcctttccac

SEQ ID NO: 55224 - DNA, 25 bp, mus musculus
gccacactcttctatttatgtgaac

SEQ ID NO: 55225 - DNA, 25 bp, mus musculus
cttgctcctgcacctctggatagtg

SEQ ID NO: 55226 - DNA, 25 bp, mus musculus
cctgcacctctggatagtgatatgc

SEQ ID NO: 55227 - DNA, 25 bp, mus musculus
actcccaagtggacactgtatatat

SEQ ID NO: 55228 - DNA, 25 bp, mus musculus
ctcactaaccatactctcacatagc

SEQ ID NO: 55229 - DNA, 25 bp, mus musculus
aaccatactctcacatagctttcag

SEQ ID NO: 55230 - DNA, 25 bp, mus musculus
acatagctttcagatgctactcgac

SEQ ID NO: 55231 - DNA, 25 bp, mus musculus
gatgctactcgactgcctaggcata

SEQ ID NO: 55232 - DNA, 25 bp, mus musculus
actcgactgcctaggcatatacgtt

SEQ ID NO: 55233 - DNA, 25 bp, mus musculus
tttaatgcacattactggcatatct

SEQ ID NO: 55234 - DNA, 25 bp, mus musculus
cagtatactgcctttccacttcttg

SEQ ID NO: 55235 - DNA, 25 bp, mus musculus
tcaattcaaatggccattttctcca

SEQ ID NO: 55236 - DNA, 25 bp, mus musculus
tttccacttcttgcattcctggatg

SEQ ID NO: 55237 - DNA, 25 bp, mus musculus
gaagttgtgccttctgtagataaac

SEQ ID NO: 55238 - DNA, 25 bp, mus musculus
gatgagctcctggatagcagcctgg

SEQ ID NO: 55239 - DNA, 25 bp, mus musculus
cttgtccgcctggaaccattgactg

SEQ ID NO: 55240 - DNA, 25 bp, mus musculus
cgcctggaaccattgactgaagcgg

SEQ ID NO: 55241 - DNA, 25 bp, mus musculus
gaaccattgactgaagcggaagcta

SEQ ID NO: 55242 - DNA, 25 bp, mus musculus
agtgaagccacactcttctatttat

SEQ ID NO: 55243 - DNA, 25 bp, mus musculus
tgagacagcagcgacgacgaaagga

SEQ ID NO: 55244 - DNA, 25 bp, mus musculus
agacagcagcgacgacgaaaggagt

SEQ ID NO: 55245 - DNA, 25 bp, mus musculus
gtacgcagcgaaggaccagaaagga

SEQ ID NO: 55246 - DNA, 25 bp, mus musculus
gtcccgtcagcgctgcgcctaggct

SEQ ID NO: 55247 - DNA, 25 bp, mus musculus
cccgtcagcgctgcgcctaggctta

SEQ ID NO: 55248 - DNA, 25 bp, mus musculus
agcgctgcgcctaggcttatgtggg

SEQ ID NO: 55249 - DNA, 25 bp, mus musculus
cgctgcgcctaggcttatgtgggga

SEQ ID NO: 55250 - DNA, 25 bp, mus musculus
cgtgactgtggccctatctgaagac

SEQ ID NO: 55251 - DNA, 25 bp, mus musculus
tgtggccctatctgaagacaggtgg

SEQ ID NO: 55252 - DNA, 25 bp, mus musculus
gccctatctgaagacaggtggcccg

SEQ ID NO: 55253 - DNA, 25 bp, mus musculus
aagacaggtggcccgtatgatgctt

SEQ ID NO: 55254 - DNA, 25 bp, mus musculus
caggtggcccgtatgatgcttggca

SEQ ID NO: 55255 - DNA, 25 bp, mus musculus
acagcagcgacgacgaaaggagtgg

SEQ ID NO: 55256 - DNA, 25 bp, mus musculus
ggtggcccgtatgatgcttggcaac

SEQ ID NO: 55257 - DNA, 25 bp, mus musculus
tcgtgagacagcgcccgaatgtgta

SEQ ID NO: 55258 - DNA, 25 bp, mus musculus
gtgagacagcgcccgaatgtgtaga

SEQ ID NO: 55259 - DNA, 25 bp, mus musculus
gagacagcgcccgaatgtgtagacg

SEQ ID NO: 55260 - DNA, 25 bp, mus musculus
gacagcgcccgaatgtgtagacgga

SEQ ID NO: 55261 - DNA, 25 bp, mus musculus
gcgcccgaatgtgtagacggaggac

SEQ ID NO: 55262 - DNA, 25 bp, mus musculus
cactggctcggcgtacgcagcgaag

SEQ ID NO: 55263 - DNA, 25 bp, mus musculus
ctcggcgtacgcagcgaaggaccag

SEQ ID NO: 55264 - DNA, 25 bp, mus musculus
tatcaatgaactgtgacaggaagct

SEQ ID NO: 55265 - DNA, 25 bp, mus musculus
tcaaggcaggttcctcaccaataac

SEQ ID NO: 55266 - DNA, 25 bp, mus musculus
aagagccatataccagtgtcctgct

SEQ ID NO: 55267 - DNA, 25 bp, mus musculus
catataccagtgtcctgctttcaac

SEQ ID NO: 55268 - DNA, 25 bp, mus musculus
tcctgctttcaacttaaatcactga

SEQ ID NO: 55269 - DNA, 25 bp, mus musculus
cttaaatcactgaggcatctctact

SEQ ID NO: 55270 - DNA, 25 bp, mus musculus
tcactgaggcatctctactcttctg

SEQ ID NO: 55271 - DNA, 25 bp, mus musculus
aggcatctctactcttctgtgagtc

SEQ ID NO: 55272 - DNA, 25 bp, mus musculus
ctctactcttctgtgagtcatcagg

SEQ ID NO: 55273 - DNA, 25 bp, mus musculus
catcaggactgtagcgctgtgtcaa

SEQ ID NO: 55274 - DNA, 25 bp, mus musculus
gactgtagcgctgtgtcaacaaaac

SEQ ID NO: 55275 - DNA, 25 bp, mus musculus
attatgtgacaacctttgtgtaata

SEQ ID NO: 55276 - DNA, 25 bp, mus musculus
cctcaccaataacttcagagaagtc

SEQ ID NO: 55277 - DNA, 25 bp, mus musculus
aaggctggctgaccactgtaatcat

SEQ ID NO: 55278 - DNA, 25 bp, mus musculus
ggctgaccactgtaatcatcagtta

SEQ ID NO: 55279 - DNA, 25 bp, mus musculus
atggtttactgctgtcattgtccat

SEQ ID NO: 55280 - DNA, 25 bp, mus musculus
tactgctgtcattgtccatgcctac

SEQ ID NO: 55281 - DNA, 25 bp, mus musculus
tgtcattgtccatgcctacagataa

SEQ ID NO: 55282 - DNA, 25 bp, mus musculus
ttgtacattcctgatgctggttgca

SEQ ID NO: 55283 - DNA, 25 bp, mus musculus
attcctgatgctggttgcaagagcc

SEQ ID NO: 55284 - DNA, 25 bp, mus musculus
ctaggatctggctcgctactccgcg

SEQ ID NO: 55285 - DNA, 25 bp, mus musculus
ggatctggctcgctactccgcgcct

SEQ ID NO: 55286 - DNA, 25 bp, mus musculus
cacacgttgtcttgttactgttcaa

SEQ ID NO: 55287 - DNA, 25 bp, mus musculus
tgttactgttcaaattcctgataca

SEQ ID NO: 55288 - DNA, 25 bp, mus musculus
cgtatgacgtgcatctatcgttgtg

SEQ ID NO: 55289 - DNA, 25 bp, mus musculus
tgcatctatcgttgtgttaccattg

SEQ ID NO: 55290 - DNA, 25 bp, mus musculus
atctatcgttgtgttaccattgcaa

SEQ ID NO: 55291 - DNA, 25 bp, mus musculus
gttaccattgcaacatggatgagct

SEQ ID NO: 55292 - DNA, 25 bp, mus musculus
tgtagcatgactgcactagatactg

SEQ ID NO: 55293 - DNA, 25 bp, mus musculus
agcatgactgcactagatactggta

SEQ ID NO: 55294 - DNA, 25 bp, mus musculus
atgtgtgttacatcttccataatgt

SEQ ID NO: 55295 - DNA, 25 bp, mus musculus
tgtgttacatcttccataatgtagg

SEQ ID NO: 55296 - DNA, 25 bp, mus musculus
ggctcgctactccgcgcctttacaa

SEQ ID NO: 55297 - DNA, 25 bp, mus musculus
acatcttccataatgtaggtgctat

SEQ ID NO: 55298 - DNA, 25 bp, mus musculus
ctactccgcgcctttacaagttcag

SEQ ID NO: 55299 - DNA, 25 bp, mus musculus
gcctttacaagttcagctaacatat

SEQ ID NO: 55300 - DNA, 25 bp, mus musculus
tttacaagttcagctaacatatgac

SEQ ID NO: 55301 - DNA, 25 bp, mus musculus
agttcagctaacatatgactcagat

SEQ ID NO: 55302 - DNA, 25 bp, mus musculus
aatcacccacataggacacacacgt

SEQ ID NO: 55303 - DNA, 25 bp, mus musculus
cataggacacacacgttgtcttgtt

SEQ ID NO: 55304 - DNA, 25 bp, mus musculus
aggacacacacgttgtcttgttact

SEQ ID NO: 55305 - DNA, 25 bp, mus musculus
gagtggcccctggagtgaaatttca

SEQ ID NO: 55306 - DNA, 25 bp, mus musculus
gcagcaactgactgtaacagatcgc

SEQ ID NO: 55307 - DNA, 25 bp, mus musculus
ctttcacaaactgaatgtctgccgc

SEQ ID NO: 55308 - DNA, 25 bp, mus musculus
caaactgaatgtctgccgcaatgtg

SEQ ID NO: 55309 - DNA, 25 bp, mus musculus
actgaatgtctgccgcaatgtgaat

SEQ ID NO: 55310 - DNA, 25 bp, mus musculus
gaatgtctgccgcaatgtgaataat

SEQ ID NO: 55311 - DNA, 25 bp, mus musculus
tgtctgccgcaatgtgaataatcct

SEQ ID NO: 55312 - DNA, 25 bp, mus musculus
gaataatcctgtttttggccgcaag

SEQ ID NO: 55313 - DNA, 25 bp, mus musculus
taatcctgtttttggccgcaagagc

SEQ ID NO: 55314 - DNA, 25 bp, mus musculus
tcctgtttttggccgcaagagctgg

SEQ ID NO: 55315 - DNA, 25 bp, mus musculus
tgtttttggccgcaagagctggaat

SEQ ID NO: 55316 - DNA, 25 bp, mus musculus
ttttggccgcaagagctggaatcag

SEQ ID NO: 55317 - DNA, 25 bp, mus musculus
aacagatcgcaagaacctaggactt

SEQ ID NO: 55318 - DNA, 25 bp, mus musculus
tcgcaagaacctaggacttgttatg

SEQ ID NO: 55319 - DNA, 25 bp, mus musculus
caagaacctaggacttgttatgtct

SEQ ID NO: 55320 - DNA, 25 bp, mus musculus
acttgttatgtctgatgatggagaa

SEQ ID NO: 55321 - DNA, 25 bp, mus musculus
tttttgccacaactttcacaaactg

SEQ ID NO: 55322 - DNA, 25 bp, mus musculus
ttgccacaactttcacaaactgaat

SEQ ID NO: 55323 - DNA, 25 bp, mus musculus
ccacaactttcacaaactgaatgtc

SEQ ID NO: 55324 - DNA, 25 bp, mus musculus
caactttcacaaactgaatgtctgc

SEQ ID NO: 55325 - DNA, 25 bp, mus musculus
attggaccaggatgtcctggagttc

SEQ ID NO: 55326 - DNA, 25 bp, mus musculus
ggaccaggatgtcctggagttcgat

SEQ ID NO: 55327 - DNA, 25 bp, mus musculus
gccggcctggatcttggctagtgca

SEQ ID NO: 55328 - DNA, 25 bp, mus musculus
ggcctggatcttggctagtgcatcc

SEQ ID NO: 55329 - DNA, 25 bp, mus musculus
gatcttggctagtgcatccagaaca

SEQ ID NO: 55330 - DNA, 25 bp, mus musculus
cagaacaagccccggtactctctga

SEQ ID NO: 55331 - DNA, 25 bp, mus musculus
aagccccggtactctctgattctga

SEQ ID NO: 55332 - DNA, 25 bp, mus musculus
ccccggtactctctgattctgacga

SEQ ID NO: 55333 - DNA, 25 bp, mus musculus
cggtactctctgattctgacgattc

SEQ ID NO: 55334 - DNA, 25 bp, mus musculus
tctctgattctgacgattccagttg

SEQ ID NO: 55335 - DNA, 25 bp, mus musculus
ctgattctgacgattccagttggca

SEQ ID NO: 55336 - DNA, 25 bp, mus musculus
attctgacgattccagttggcaagg

SEQ ID NO: 55337 - DNA, 25 bp, mus musculus
ccaggatgtcctggagttcgatgat

SEQ ID NO: 55338 - DNA, 25 bp, mus musculus
gcgcattgtgtgccacctctcagaa

SEQ ID NO: 55339 - DNA, 25 bp, mus musculus
cattgtgtgccacctctcagaaatg

SEQ ID NO: 55340 - DNA, 25 bp, mus musculus
ccacctctcagaaatgtgttcgaaa

SEQ ID NO: 55341 - DNA, 25 bp, mus musculus
tacttgatgtacagcccttattaca

SEQ ID NO: 55342 - DNA, 25 bp, mus musculus
atgtacagcccttattacaggctgg

SEQ ID NO: 55343 - DNA, 25 bp, mus musculus
ctggagaacgccggcctggatcttg

SEQ ID NO: 55344 - DNA, 25 bp, mus musculus
aacgccggcctggatcttggctagt

SEQ ID NO: 55345 - DNA, 25 bp, mus musculus
cgcgagcccagtctcccttcaaagt

SEQ ID NO: 55346 - DNA, 25 bp, mus musculus
attaccagttcaagatccagttcat

SEQ ID NO: 55347 - DNA, 25 bp, mus musculus
gcgagttgatcctgctcaagttcaa

SEQ ID NO: 55348 - DNA, 25 bp, mus musculus
tgatcctgctcaagttcaagtggga

SEQ ID NO: 55349 - DNA, 25 bp, mus musculus
acacagtgcagaccatcatgctatg

SEQ ID NO: 55350 - DNA, 25 bp, mus musculus
tgcagaccatcatgctatggggcat

SEQ ID NO: 55351 - DNA, 25 bp, mus musculus
actctggcctcattctgaagaccat

SEQ ID NO: 55352 - DNA, 25 bp, mus musculus
agaccatctgggtcaaagctggaga

SEQ ID NO: 55353 - DNA, 25 bp, mus musculus
cattttgccccgaaaatctggatga

SEQ ID NO: 55354 - DNA, 25 bp, mus musculus
tggatgacctccagcttcacccgag

SEQ ID NO: 55355 - DNA, 25 bp, mus musculus
agcttcacccgagccaggagaaagt

SEQ ID NO: 55356 - DNA, 25 bp, mus musculus
tctttgtgaactgtgaagtgaagtc

SEQ ID NO: 55357 - DNA, 25 bp, mus musculus
agttcaagatccagttcatcaatca

SEQ ID NO: 55358 - DNA, 25 bp, mus musculus
cttttaccatgtcgctgctgggaac

SEQ ID NO: 55359 - DNA, 25 bp, mus musculus
ccatgtcgctgctgggaacaaaaga

SEQ ID NO: 55360 - DNA, 25 bp, mus musculus
taaagagaattcccatcaccctggg

SEQ ID NO: 55361 - DNA, 25 bp, mus musculus
cctattccttccttatcacactgga

SEQ ID NO: 55362 - DNA, 25 bp, mus musculus
ccttccttatcacactggacaaaga

SEQ ID NO: 55363 - DNA, 25 bp, mus musculus
ttatcacactggacaaagacatcgg

SEQ ID NO: 55364 - DNA, 25 bp, mus musculus
acatcggcgagttgatcctgctcaa

SEQ ID NO: 55365 - DNA, 25 bp, mus musculus
ttgaacactggcagaatcttgctgg

SEQ ID NO: 55366 - DNA, 25 bp, mus musculus
acactggcagaatcttgctggggat

SEQ ID NO: 55367 - DNA, 25 bp, mus musculus
atcttgctggggatccttttggcaa

SEQ ID NO: 55368 - DNA, 25 bp, mus musculus
tcttgctggggatccttttggcaac

SEQ ID NO: 55369 - DNA, 25 bp, mus musculus
ttgctggggatccttttggcaacaa

SEQ ID NO: 55370 - DNA, 25 bp, mus musculus
tggcaacaagagccggcccaagcaa

SEQ ID NO: 55371 - DNA, 25 bp, mus musculus
gcaacaagagccggcccaagcaagt

SEQ ID NO: 55372 - DNA, 25 bp, mus musculus
caacaagagccggcccaagcaagtt

SEQ ID NO: 55373 - DNA, 25 bp, mus musculus
acaagagccggcccaagcaagttgt

SEQ ID NO: 55374 - DNA, 25 bp, mus musculus
caagagccggcccaagcaagttgta

SEQ ID NO: 55375 - DNA, 25 bp, mus musculus
gagccggcccaagcaagttgtaact

SEQ ID NO: 55376 - DNA, 25 bp, mus musculus
gccggcccaagcaagttgtaactca

SEQ ID NO: 55377 - DNA, 25 bp, mus musculus
cactggcagaatcttgctggggatc

SEQ ID NO: 55378 - DNA, 25 bp, mus musculus
actggcagaatcttgctggggatcc

SEQ ID NO: 55379 - DNA, 25 bp, mus musculus
ctggcagaatcttgctggggatcct

SEQ ID NO: 55380 - DNA, 25 bp, mus musculus
tggcagaatcttgctggggatcctt

SEQ ID NO: 55381 - DNA, 25 bp, mus musculus
cagaatcttgctggggatccttttg

SEQ ID NO: 55382 - DNA, 25 bp, mus musculus
agaatcttgctggggatccttttgg

SEQ ID NO: 55383 - DNA, 25 bp, mus musculus
gaatcttgctggggatccttttggc

SEQ ID NO: 55384 - DNA, 25 bp, mus musculus
aatcttgctggggatccttttggca

SEQ ID NO: 55385 - DNA, 25 bp, mus musculus
attaaacctgaacggagcaacagca

SEQ ID NO: 55386 - DNA, 25 bp, mus musculus
taaacctgaacggagcaacagcatc

SEQ ID NO: 55387 - DNA, 25 bp, mus musculus
gagcgggaccccaacttgtcacatt

SEQ ID NO: 55388 - DNA, 25 bp, mus musculus
ccccaacttgtcacatttctctcaa

SEQ ID NO: 55389 - DNA, 25 bp, mus musculus
cttgtcacatttctctcaaaccctc

SEQ ID NO: 55390 - DNA, 25 bp, mus musculus
tggtaacccgacacctcatttctct

SEQ ID NO: 55391 - DNA, 25 bp, mus musculus
gtaacccgacacctcatttctctca

SEQ ID NO: 55392 - DNA, 25 bp, mus musculus
cgacacctcatttctctcaaatcct

SEQ ID NO: 55393 - DNA, 25 bp, mus musculus
acacctcatttctctcaaatccttc

SEQ ID NO: 55394 - DNA, 25 bp, mus musculus
tttctctcaaatccttccctctaat

SEQ ID NO: 55395 - DNA, 25 bp, mus musculus
tcaaatccttccctctaattgttga

SEQ ID NO: 55396 - DNA, 25 bp, mus musculus
ttccctctaattgttgaaagcaatt

SEQ ID NO: 55397 - DNA, 25 bp, mus musculus
gagcaacagcatcagcttcacagct

SEQ ID NO: 55398 - DNA, 25 bp, mus musculus
gcaacagcatcagcttcacagcttg

SEQ ID NO: 55399 - DNA, 25 bp, mus musculus
atcagcttcacagcttgatggcaga

SEQ ID NO: 55400 - DNA, 25 bp, mus musculus
ttcacagcttgatggcagaggtgac

SEQ ID NO: 55401 - DNA, 25 bp, mus musculus
cacagcttgatggcagaggtgacat

SEQ ID NO: 55402 - DNA, 25 bp, mus musculus
cagcttgatggcagaggtgacatca

SEQ ID NO: 55403 - DNA, 25 bp, mus musculus
gtgacatcagcaacaaatacaagag

SEQ ID NO: 55404 - DNA, 25 bp, mus musculus
gacatcagcaacaaatacaagagcg

SEQ ID NO: 55405 - DNA, 25 bp, mus musculus
ttgaattcctgctctccaatcatct

SEQ ID NO: 55406 - DNA, 25 bp, mus musculus
gaattcctgctctccaatcatctag

SEQ ID NO: 55407 - DNA, 25 bp, mus musculus
tgcccacaatgccctagatgcccgt

SEQ ID NO: 55408 - DNA, 25 bp, mus musculus
cacaatgccctagatgcccgtcatg

SEQ ID NO: 55409 - DNA, 25 bp, mus musculus
caatgccctagatgcccgtcatgcc

SEQ ID NO: 55410 - DNA, 25 bp, mus musculus
atgccctagatgcccgtcatgccca

SEQ ID NO: 55411 - DNA, 25 bp, mus musculus
cctagatgcccgtcatgcccatctt

SEQ ID NO: 55412 - DNA, 25 bp, mus musculus
tagatgcccgtcatgcccatcttgc

SEQ ID NO: 55413 - DNA, 25 bp, mus musculus
atgcccatcttgcccgagatgcccg

SEQ ID NO: 55414 - DNA, 25 bp, mus musculus
gattgctcttgcttctccaataaac

SEQ ID NO: 55415 - DNA, 25 bp, mus musculus
ttgctcttgcttctccaataaactc

SEQ ID NO: 55416 - DNA, 25 bp, mus musculus
gctcttgcttctccaataaactcct

SEQ ID NO: 55417 - DNA, 25 bp, mus musculus
attcctgctctccaatcatctaggt

SEQ ID NO: 55418 - DNA, 25 bp, mus musculus
gcttctccaataaactccttgcaga

SEQ ID NO: 55419 - DNA, 25 bp, mus musculus
tcctgctctccaatcatctaggtga

SEQ ID NO: 55420 - DNA, 25 bp, mus musculus
ctgctctccaatcatctaggtgact

SEQ ID NO: 55421 - DNA, 25 bp, mus musculus
tctccaatcatctaggtgactcgca

SEQ ID NO: 55422 - DNA, 25 bp, mus musculus
tccaatcatctaggtgactcgcagc

SEQ ID NO: 55423 - DNA, 25 bp, mus musculus
caatcatctaggtgactcgcagcca

SEQ ID NO: 55424 - DNA, 25 bp, mus musculus
gctcttcaagatgcagccctaggat

SEQ ID NO: 55425 - DNA, 25 bp, mus musculus
ggtgcccacaatgccctagatgccc

SEQ ID NO: 55426 - DNA, 25 bp, mus musculus
ggtggtaatcgcgtgggtgatctca

SEQ ID NO: 55427 - DNA, 25 bp, mus musculus
aatgaagctctagcgcgtggcacta

SEQ ID NO: 55428 - DNA, 25 bp, mus musculus
tacgactctagcattcattcgtact

SEQ ID NO: 55429 - DNA, 25 bp, mus musculus
tctagcattcattcgtactttatca

SEQ ID NO: 55430 - DNA, 25 bp, mus musculus
attcattcgtactttatcactgacg

SEQ ID NO: 55431 - DNA, 25 bp, mus musculus
tttatcactgacgagaacagtggta

SEQ ID NO: 55432 - DNA, 25 bp, mus musculus
ggccccaatcagaattttggaggct

SEQ ID NO: 55433 - DNA, 25 bp, mus musculus
ccacagttccccattcttgcagagt

SEQ ID NO: 55434 - DNA, 25 bp, mus musculus
ttccccattcttgcagagttggctc

SEQ ID NO: 55435 - DNA, 25 bp, mus musculus
attcttgcagagttggctccaacag

SEQ ID NO: 55436 - DNA, 25 bp, mus musculus
ccaacagttggtgccttcttctttg

SEQ ID NO: 55437 - DNA, 25 bp, mus musculus
gccttcttctttggatctaaattag

SEQ ID NO: 55438 - DNA, 25 bp, mus musculus
ggcactatctttactcaaagcagat

SEQ ID NO: 55439 - DNA, 25 bp, mus musculus
atctttactcaaagcagattattat

SEQ ID NO: 55440 - DNA, 25 bp, mus musculus
ttattatcctctttcacacctcgat

SEQ ID NO: 55441 - DNA, 25 bp, mus musculus
tcctctttcacacctcgatcagaga

SEQ ID NO: 55442 - DNA, 25 bp, mus musculus
ttcacacctcgatcagagatggaga

SEQ ID NO: 55443 - DNA, 25 bp, mus musculus
catttgcttattggcttagcccgta

SEQ ID NO: 55444 - DNA, 25 bp, mus musculus
ggcttagcccgtaggcagcaaaaat

SEQ ID NO: 55445 - DNA, 25 bp, mus musculus
gtgacatacgactctagcattcatt

SEQ ID NO: 55446 - DNA, 25 bp, mus musculus
gagcaactgccaaattggcccgtgc

SEQ ID NO: 55447 - DNA, 25 bp, mus musculus
gcaactgccaaattggcccgtgcaa

SEQ ID NO: 55448 - DNA, 25 bp, mus musculus
gcacttgctcagggacaacccaggt

SEQ ID NO: 55449 - DNA, 25 bp, mus musculus
acttgctcagggacaacccaggtga

SEQ ID NO: 55450 - DNA, 25 bp, mus musculus
ttgctcagggacaacccaggtgagc

SEQ ID NO: 55451 - DNA, 25 bp, mus musculus
gctcagggacaacccaggtgagcct

SEQ ID NO: 55452 - DNA, 25 bp, mus musculus
tcaatgggtccaacgtgcgcaagaa

SEQ ID NO: 55453 - DNA, 25 bp, mus musculus
tccaacgtgcgcaagaaccccggcg

SEQ ID NO: 55454 - DNA, 25 bp, mus musculus
gtgcgcaagaaccccggcggctagc

SEQ ID NO: 55455 - DNA, 25 bp, mus musculus
acaggtgacccagttgctcagggga

SEQ ID NO: 55456 - DNA, 25 bp, mus musculus
gtgacccagttgctcaggggaaatg

SEQ ID NO: 55457 - DNA, 25 bp, mus musculus
gacccagttgctcaggggaaatggg

SEQ ID NO: 55458 - DNA, 25 bp, mus musculus
aactgccaaattggcccgtgcaaga

SEQ ID NO: 55459 - DNA, 25 bp, mus musculus
ctgccaaattggcccgtgcaagaac

SEQ ID NO: 55460 - DNA, 25 bp, mus musculus
gccaaattggcccgtgcaagaaccg

SEQ ID NO: 55461 - DNA, 25 bp, mus musculus
ttggcccgtgcaagaaccgggtgca

SEQ ID NO: 55462 - DNA, 25 bp, mus musculus
tgcaagaaccgggtgcacttgctca

SEQ ID NO: 55463 - DNA, 25 bp, mus musculus
caagaaccgggtgcacttgctcagg

SEQ ID NO: 55464 - DNA, 25 bp, mus musculus
agaaccgggtgcacttgctcaggga

SEQ ID NO: 55465 - DNA, 25 bp, mus musculus
gtgcacttgctcagggacaacccag

SEQ ID NO: 55466 - DNA, 25 bp, mus musculus
cccgggtctataacatccacagtcg

SEQ ID NO: 55467 - DNA, 25 bp, mus musculus
cgggtctataacatccacagtcgaa

SEQ ID NO: 55468 - DNA, 25 bp, mus musculus
gggtctataacatccacagtcgaac

SEQ ID NO: 55469 - DNA, 25 bp, mus musculus
ggtctataacatccacagtcgaacg

SEQ ID NO: 55470 - DNA, 25 bp, mus musculus
gtctataacatccacagtcgaacgg

SEQ ID NO: 55471 - DNA, 25 bp, mus musculus
tctataacatccacagtcgaacggt

SEQ ID NO: 55472 - DNA, 25 bp, mus musculus
ctataacatccacagtcgaacggtc

SEQ ID NO: 55473 - DNA, 25 bp, mus musculus
tataacatccacagtcgaacggtca

SEQ ID NO: 55474 - DNA, 25 bp, mus musculus
ataacatccacagtcgaacggtcac

SEQ ID NO: 55475 - DNA, 25 bp, mus musculus
taacatccacagtcgaacggtcacc

SEQ ID NO: 55476 - DNA, 25 bp, mus musculus
ctggaccacaagcccctggggcagg

SEQ ID NO: 55477 - DNA, 25 bp, mus musculus
tggaccacaagcccctggggcagga

SEQ ID NO: 55478 - DNA, 25 bp, mus musculus
gtctataacatccacagtcgaacgg

SEQ ID NO: 55479 - DNA, 25 bp, mus musculus
tctataacatccacagtcgaacggt

SEQ ID NO: 55480 - DNA, 25 bp, mus musculus
ctataacatccacagtcgaacggtc

SEQ ID NO: 55481 - DNA, 25 bp, mus musculus
tataacatccacagtcgaacggtca

SEQ ID NO: 55482 - DNA, 25 bp, mus musculus
ataacatccacagtcgaacggtcac

SEQ ID NO: 55483 - DNA, 25 bp, mus musculus
taacatccacagtcgaacggtcacc

SEQ ID NO: 55484 - DNA, 25 bp, mus musculus
gtcacccggtatcctgccaactcca

SEQ ID NO: 55485 - DNA, 25 bp, mus musculus
tcacccggtatcctgccaactccat

SEQ ID NO: 55486 - DNA, 25 bp, mus musculus
acccggtatcctgccaactccatcg

SEQ ID NO: 55487 - DNA, 25 bp, mus musculus
ggaccacaagcccctggggcaggag

SEQ ID NO: 55488 - DNA, 25 bp, mus musculus
actacgcgtgcggcccgcacggcta

SEQ ID NO: 55489 - DNA, 25 bp, mus musculus
tacctcgtcacagggatccccacca

SEQ ID NO: 55490 - DNA, 25 bp, mus musculus
cgtcacagggatccccaccagccac

SEQ ID NO: 55491 - DNA, 25 bp, mus musculus
cccgggtctataacatccacagtcg

SEQ ID NO: 55492 - DNA, 25 bp, mus musculus
cgggtctataacatccacagtcgaa

SEQ ID NO: 55493 - DNA, 25 bp, mus musculus
gggtctataacatccacagtcgaac

SEQ ID NO: 55494 - DNA, 25 bp, mus musculus
ggtctataacatccacagtcgaacg

SEQ ID NO: 55495 - DNA, 25 bp, mus musculus
tcctggagcgcatcggtatgagggt

SEQ ID NO: 55496 - DNA, 25 bp, mus musculus
gttgacatgttccagaccgtgaaga

SEQ ID NO: 55497 - DNA, 25 bp, mus musculus
ataccagctgtgctaccgtgcggcc

SEQ ID NO: 55498 - DNA, 25 bp, mus musculus
cagctgtgctaccgtgcggccctgg

SEQ ID NO: 55499 - DNA, 25 bp, mus musculus
tgctaccgtgcggccctggaatacc

SEQ ID NO: 55500 - DNA, 25 bp, mus musculus
ctttgatcactatgcaacgtaacta

SEQ ID NO: 55501 - DNA, 25 bp, mus musculus
tgatcactatgcaacgtaactactg

SEQ ID NO: 55502 - DNA, 25 bp, mus musculus
gatcactatgcaacgtaactactgc

SEQ ID NO: 55503 - DNA, 25 bp, mus musculus
tcactatgcaacgtaactactgctc

SEQ ID NO: 55504 - DNA, 25 bp, mus musculus
cactatgcaacgtaactactgctcc

SEQ ID NO: 55505 - DNA, 25 bp, mus musculus
ctatgcaacgtaactactgctcccc

SEQ ID NO: 55506 - DNA, 25 bp, mus musculus
tatgcaacgtaactactgctcccct

SEQ ID NO: 55507 - DNA, 25 bp, mus musculus
tgacatgttccagaccgtgaagacc

SEQ ID NO: 55508 - DNA, 25 bp, mus musculus
gacatgttccagaccgtgaagaccc

SEQ ID NO: 55509 - DNA, 25 bp, mus musculus
catgttccagaccgtgaagaccctc

SEQ ID NO: 55510 - DNA, 25 bp, mus musculus
agaggaccaataccagctgtgctac

SEQ ID NO: 55511 - DNA, 25 bp, mus musculus
gaggaccaataccagctgtgctacc

SEQ ID NO: 55512 - DNA, 25 bp, mus musculus
gaccaataccagctgtgctaccgtg

SEQ ID NO: 55513 - DNA, 25 bp, mus musculus
ccaataccagctgtgctaccgtgcg

SEQ ID NO: 55514 - DNA, 25 bp, mus musculus
caataccagctgtgctaccgtgcgg

SEQ ID NO: 55515 - DNA, 25 bp, mus musculus
ttcttgaactctggtcctcaaccca

SEQ ID NO: 55516 - DNA, 25 bp, mus musculus
ggtcctcaacccagttttatagatg

SEQ ID NO: 55517 - DNA, 25 bp, mus musculus
caaacactgacaacagctaggatct

SEQ ID NO: 55518 - DNA, 25 bp, mus musculus
tgctgacatcacttgaagctggcag

SEQ ID NO: 55519 - DNA, 25 bp, mus musculus
catcacttgaagctggcaggtcctg

SEQ ID NO: 55520 - DNA, 25 bp, mus musculus
ttgaagctggcaggtcctggggtcc

SEQ ID NO: 55521 - DNA, 25 bp, mus musculus
ctggcaggtcctggggtcctgtttg

SEQ ID NO: 55522 - DNA, 25 bp, mus musculus
gttttaacttacacacacacacaca

SEQ ID NO: 55523 - DNA, 25 bp, mus musculus
acacgctcacacaaaacctgtgaga

SEQ ID NO: 55524 - DNA, 25 bp, mus musculus
actgtttccacttttagctggagtg

SEQ ID NO: 55525 - DNA, 25 bp, mus musculus
ctttagctggcatctcctttattca

SEQ ID NO: 55526 - DNA, 25 bp, mus musculus
ctggcatctcctttattcacacatc

SEQ ID NO: 55527 - DNA, 25 bp, mus musculus
caacccagttttatagatgctttgc

SEQ ID NO: 55528 - DNA, 25 bp, mus musculus
cacatccatatatgctcctcacatt

SEQ ID NO: 55529 - DNA, 25 bp, mus musculus
gctttgcaaagaccctgtgcattgg

SEQ ID NO: 55530 - DNA, 25 bp, mus musculus
caaagaccctgtgcattggtatctg

SEQ ID NO: 55531 - DNA, 25 bp, mus musculus
ccctgtgcattggtatctggatgca

SEQ ID NO: 55532 - DNA, 25 bp, mus musculus
gtatctggatgcaacctttatacaa

SEQ ID NO: 55533 - DNA, 25 bp, mus musculus
ggatgcaacctttatacaagtgact

SEQ ID NO: 55534 - DNA, 25 bp, mus musculus
tttatagctactttgaaggtgttag

SEQ ID NO: 55535 - DNA, 25 bp, mus musculus
attctcacatgtgcatgacaaacac

SEQ ID NO: 55536 - DNA, 25 bp, mus musculus
tgtacgtgttcctcagtggaggctc

SEQ ID NO: 55537 - DNA, 25 bp, mus musculus
tgttcctcagtggaggctccagagg

SEQ ID NO: 55538 - DNA, 25 bp, mus musculus
ttgtcatcttcctgacagccatctg

SEQ ID NO: 55539 - DNA, 25 bp, mus musculus
tcttcctgacagccatctggaccct

SEQ ID NO: 55540 - DNA, 25 bp, mus musculus
tgacagccatctggaccctcagtaa

SEQ ID NO: 55541 - DNA, 25 bp, mus musculus
ccatctggaccctcagtaagtcacg

SEQ ID NO: 55542 - DNA, 25 bp, mus musculus
ggaccctcagtaagtcacgagaggg

SEQ ID NO: 55543 - DNA, 25 bp, mus musculus
gtgttatcccttcctctgagtccag

SEQ ID NO: 55544 - DNA, 25 bp, mus musculus
ctatctatcattgaccacaactggg

SEQ ID NO: 55545 - DNA, 25 bp, mus musculus
atcattgaccacaactggggatcct

SEQ ID NO: 55546 - DNA, 25 bp, mus musculus
acagaattcacaggccaggggacat

SEQ ID NO: 55547 - DNA, 25 bp, mus musculus
ttcacaggccaggggacatcatcag

SEQ ID NO: 55548 - DNA, 25 bp, mus musculus
tccatgaatcttctggatgctcagg

SEQ ID NO: 55549 - DNA, 25 bp, mus musculus
ctggatgctcaggatgctgactcct

SEQ ID NO: 55550 - DNA, 25 bp, mus musculus
gctcaggatgctgactccttcctct

SEQ ID NO: 55551 - DNA, 25 bp, mus musculus
gatgctgactccttcctctgagtcc

SEQ ID NO: 55552 - DNA, 25 bp, mus musculus
aactatctatcattgacacaactgg

SEQ ID NO: 55553 - DNA, 25 bp, mus musculus
ctatcattgacacaactggggatcc

SEQ ID NO: 55554 - DNA, 25 bp, mus musculus
gacagaattcacaggccagggacat

SEQ ID NO: 55555 - DNA, 25 bp, mus musculus
gggacatcatcagggcacagggctg

SEQ ID NO: 55556 - DNA, 25 bp, mus musculus
ctggctgagcggacgacgaagacag

SEQ ID NO: 55557 - DNA, 25 bp, mus musculus
aaggctctagtcagactggtgaaga

SEQ ID NO: 55558 - DNA, 25 bp, mus musculus
agtgacgtgtcagccagtagagtga

SEQ ID NO: 55559 - DNA, 25 bp, mus musculus
tgacgtgtcagccagtagagtgaca

SEQ ID NO: 55560 - DNA, 25 bp, mus musculus
gacgtgtcagccagtagagtgacac

SEQ ID NO: 55561 - DNA, 25 bp, mus musculus
acactgtgggagctcaggagtctgt

SEQ ID NO: 55562 - DNA, 25 bp, mus musculus
aggagtctgtgccagacgtgctaat

SEQ ID NO: 55563 - DNA, 25 bp, mus musculus
agtctgtgccagacgtgctaattga

SEQ ID NO: 55564 - DNA, 25 bp, mus musculus
gtctgtgccagacgtgctaattgaa

SEQ ID NO: 55565 - DNA, 25 bp, mus musculus
tctgtgccagacgtgctaattgaac

SEQ ID NO: 55566 - DNA, 25 bp, mus musculus
ctaattgaacatcgaccactgtgag

SEQ ID NO: 55567 - DNA, 25 bp, mus musculus
taattgaacatcgaccactgtgaga

SEQ ID NO: 55568 - DNA, 25 bp, mus musculus
aggctctagtcagactggtgaagaa

SEQ ID NO: 55569 - DNA, 25 bp, mus musculus
attgaacatcgaccactgtgagatg

SEQ ID NO: 55570 - DNA, 25 bp, mus musculus
ggctctagtcagactggtgaagaac

SEQ ID NO: 55571 - DNA, 25 bp, mus musculus
ctctagtcagactggtgaagaacga

SEQ ID NO: 55572 - DNA, 25 bp, mus musculus
tctagtcagactggtgaagaacgag

SEQ ID NO: 55573 - DNA, 25 bp, mus musculus
aacgagttcacgagtactagtgacg

SEQ ID NO: 55574 - DNA, 25 bp, mus musculus
cgagttcacgagtactagtgacgtg

SEQ ID NO: 55575 - DNA, 25 bp, mus musculus
ctagtgacgtgtcagccagtagagt

SEQ ID NO: 55576 - DNA, 25 bp, mus musculus
tagtgacgtgtcagccagtagagtg

SEQ ID NO: 55577 - DNA, 25 bp, mus musculus
gataaaaatctcaatctacttcttt

SEQ ID NO: 55578 - DNA, 25 bp, mus musculus
aatctcaatctacttctttattaag

SEQ ID NO: 55579 - DNA, 25 bp, mus musculus
aacattcactgcatcaaattatgca

SEQ ID NO: 55580 - DNA, 25 bp, mus musculus
attcactgcatcaaattatgcaaac

SEQ ID NO: 55581 - DNA, 25 bp, mus musculus
taggactctaaaacaccacattctg

SEQ ID NO: 55582 - DNA, 25 bp, mus musculus
gactctaaaacaccacattctgtca

SEQ ID NO: 55583 - DNA, 25 bp, mus musculus
ccacattctgtcatagaaatggaga

SEQ ID NO: 55584 - DNA, 25 bp, mus musculus
ctgcaaatcactgatcaagtttgtg

SEQ ID NO: 55585 - DNA, 25 bp, mus musculus
caaatcactgatcaagtttgtgtgc

SEQ ID NO: 55586 - DNA, 25 bp, mus musculus
catcaaaattcccatgcgataatgc

SEQ ID NO: 55587 - DNA, 25 bp, mus musculus
aattcccatgcgataatgcatgctt

SEQ ID NO: 55588 - DNA, 25 bp, mus musculus
ataatgcatgcttgatgttgttgaa

SEQ ID NO: 55589 - DNA, 25 bp, mus musculus
gaacacccaggaatagtttgcatct

SEQ ID NO: 55590 - DNA, 25 bp, mus musculus
atagtttgcatcttctaagcttcac

SEQ ID NO: 55591 - DNA, 25 bp, mus musculus
gtttgcatcttctaagcttcacctt

SEQ ID NO: 55592 - DNA, 25 bp, mus musculus
tgcatcttctaagcttcacctttaa

SEQ ID NO: 55593 - DNA, 25 bp, mus musculus
cgcactttagctgatacacactgat

SEQ ID NO: 55594 - DNA, 25 bp, mus musculus
gctgatacacactgatacaacatga

SEQ ID NO: 55595 - DNA, 25 bp, mus musculus
acacactgatacaacatgaactgca

SEQ ID NO: 55596 - DNA, 25 bp, mus musculus
tgatacaacatgaactgcagctcac

SEQ ID NO: 55597 - DNA, 25 bp, mus musculus
actggccttagcattcggagctccc

SEQ ID NO: 55598 - DNA, 25 bp, mus musculus
tggccttagcattcggagctcccaa

SEQ ID NO: 55599 - DNA, 25 bp, mus musculus
ctccatcgaacactcagactatcgc

SEQ ID NO: 55600 - DNA, 25 bp, mus musculus
ccatcgaacactcagactatcgcag

SEQ ID NO: 55601 - DNA, 25 bp, mus musculus
atcgaacactcagactatcgcagca

SEQ ID NO: 55602 - DNA, 25 bp, mus musculus
cactcagactatcgcagcaagcttg

SEQ ID NO: 55603 - DNA, 25 bp, mus musculus
atcgcagcaagcttgcccagatccg

SEQ ID NO: 55604 - DNA, 25 bp, mus musculus
gcaagcttgcccagatccgccacat

SEQ ID NO: 55605 - DNA, 25 bp, mus musculus
aagcttgcccagatccgccacatct

SEQ ID NO: 55606 - DNA, 25 bp, mus musculus
aatgagttcacaactcacgtcatga

SEQ ID NO: 55607 - DNA, 25 bp, mus musculus
tgagttcacaactcacgtcatgaac

SEQ ID NO: 55608 - DNA, 25 bp, mus musculus
agttcacaactcacgtcatgaacct

SEQ ID NO: 55609 - DNA, 25 bp, mus musculus
gccttagcattcggagctcccaaga

SEQ ID NO: 55610 - DNA, 25 bp, mus musculus
caactcacgtcatgaacctgctgag

SEQ ID NO: 55611 - DNA, 25 bp, mus musculus
tagcattcggagctcccaagaggag

SEQ ID NO: 55612 - DNA, 25 bp, mus musculus
cgtggacccacagctgatgcgcctg

SEQ ID NO: 55613 - DNA, 25 bp, mus musculus
tggacccacagctgatgcgcctgga

SEQ ID NO: 55614 - DNA, 25 bp, mus musculus
gacccacagctgatgcgcctggaca

SEQ ID NO: 55615 - DNA, 25 bp, mus musculus
tggcgtatccccggacaactccatc

SEQ ID NO: 55616 - DNA, 25 bp, mus musculus
gcgtatccccggacaactccatcga

SEQ ID NO: 55617 - DNA, 25 bp, mus musculus
acaactccatcgaacactcagacta

SEQ ID NO: 55618 - DNA, 25 bp, mus musculus
acagcttccggatgtcagcccggac

SEQ ID NO: 55619 - DNA, 25 bp, mus musculus
tccggatgtcagcccggacaaaggg

SEQ ID NO: 55620 - DNA, 25 bp, mus musculus
tctgagccctccagctaacacagca

SEQ ID NO: 55621 - DNA, 25 bp, mus musculus
agctaacacagcagcctttgcctgg

SEQ ID NO: 55622 - DNA, 25 bp, mus musculus
cacagcagcctttgcctggaacggc

SEQ ID NO: 55623 - DNA, 25 bp, mus musculus
agcctttgcctggaacggcctatga

SEQ ID NO: 55624 - DNA, 25 bp, mus musculus
tgcctggaacggcctatgaaggagg

SEQ ID NO: 55625 - DNA, 25 bp, mus musculus
cagattaactccaccttcctgagca

SEQ ID NO: 55626 - DNA, 25 bp, mus musculus
accttcctgagcatactggtccctg

SEQ ID NO: 55627 - DNA, 25 bp, mus musculus
ctgagcatactggtccctgtgtcaa

SEQ ID NO: 55628 - DNA, 25 bp, mus musculus
gtccctgtgtcaagacatcctgtga

SEQ ID NO: 55629 - DNA, 25 bp, mus musculus
gtgtcaagacatcctgtgatctcat

SEQ ID NO: 55630 - DNA, 25 bp, mus musculus
agaatcggcagctgacagtcacccg

SEQ ID NO: 55631 - DNA, 25 bp, mus musculus
tgacagtcacccgagggttgcaaaa

SEQ ID NO: 55632 - DNA, 25 bp, mus musculus
acagcaaggaccccagacatggagc

SEQ ID NO: 55633 - DNA, 25 bp, mus musculus
tgccttgctggtttgtccacgacaa

SEQ ID NO: 55634 - DNA, 25 bp, mus musculus
ttgtccacgacaatggagctggact

SEQ ID NO: 55635 - DNA, 25 bp, mus musculus
atggtgttcacactgactatgtcgt

SEQ ID NO: 55636 - DNA, 25 bp, mus musculus
ttcacactgactatgtcgtctctga

SEQ ID NO: 55637 - DNA, 25 bp, mus musculus
tctctgacatcttctgagccctcca

SEQ ID NO: 55638 - DNA, 25 bp, mus musculus
tctcaccctgaataaagagctgttc

SEQ ID NO: 55639 - DNA, 25 bp, mus musculus
taaagagctgttcttttccgttctg

SEQ ID NO: 55640 - DNA, 25 bp, mus musculus
ggagccagccatccacatcttcaat

SEQ ID NO: 55641 - DNA, 25 bp, mus musculus
agccatccacatcttcaatgagaga

SEQ ID NO: 55642 - DNA, 25 bp, mus musculus
tgtcaccagaggcctgcagaaggac

SEQ ID NO: 55643 - DNA, 25 bp, mus musculus
ttattttgtgcctcagctctacagc

SEQ ID NO: 55644 - DNA, 25 bp, mus musculus
tgtgcctcagctctacagctttctc

SEQ ID NO: 55645 - DNA, 25 bp, mus musculus
tcagctctacagctttctcaagcgg

SEQ ID NO: 55646 - DNA, 25 bp, mus musculus
ctacagctttctcaagcggccttaa

SEQ ID NO: 55647 - DNA, 25 bp, mus musculus
ctttctcaagcggccttaatggctt

SEQ ID NO: 55648 - DNA, 25 bp, mus musculus
caagcggccttaatggcttatagtt

SEQ ID NO: 55649 - DNA, 25 bp, mus musculus
atgtgtatccttttctcccttgata

SEQ ID NO: 55650 - DNA, 25 bp, mus musculus
gctgttcttttccgttctgctgcat

SEQ ID NO: 55651 - DNA, 25 bp, mus musculus
cttttccgttctgctgcatcgtgtg

SEQ ID NO: 55652 - DNA, 25 bp, mus musculus
cgttctgctgcatcgtgtgtggagg

SEQ ID NO: 55653 - DNA, 25 bp, mus musculus
ccccatagacaagttctcacctaga

SEQ ID NO: 55654 - DNA, 25 bp, mus musculus
agacaagttctcacctagagtgcat

SEQ ID NO: 55655 - DNA, 25 bp, mus musculus
gttctcacctagagtgcatggactg

SEQ ID NO: 55656 - DNA, 25 bp, mus musculus
gttaggccagttcatgcaggagcca

SEQ ID NO: 55657 - DNA, 25 bp, mus musculus
ccagttcatgcaggagccagccatc

SEQ ID NO: 55658 - DNA, 25 bp, mus musculus
ctagacacagtcacggtcacacaga

SEQ ID NO: 55659 - DNA, 25 bp, mus musculus
acagtcacggtcacacagaccgggc

SEQ ID NO: 55660 - DNA, 25 bp, mus musculus
gtcacaaggggctcccagaaagatt

SEQ ID NO: 55661 - DNA, 25 bp, mus musculus
accaaggtcatctgctggtttgtcc

SEQ ID NO: 55662 - DNA, 25 bp, mus musculus
gtcatctgctggtttgtccataaca

SEQ ID NO: 55663 - DNA, 25 bp, mus musculus
tttgtccataacaatggagaaggac

SEQ ID NO: 55664 - DNA, 25 bp, mus musculus
gatggtgtccataccgactatattg

SEQ ID NO: 55665 - DNA, 25 bp, mus musculus
accgactatattgtccccagcttgt

SEQ ID NO: 55666 - DNA, 25 bp, mus musculus
tatattgtccccagcttgttctgag

SEQ ID NO: 55667 - DNA, 25 bp, mus musculus
agcttgttctgagtagcatgtcagc

SEQ ID NO: 55668 - DNA, 25 bp, mus musculus
gtagcatgtcagctgctgatgaagt

SEQ ID NO: 55669 - DNA, 25 bp, mus musculus
tgtcagctgctgatgaagtagaagg

SEQ ID NO: 55670 - DNA, 25 bp, mus musculus
acggtcacacagaccgggctatctg

SEQ ID NO: 55671 - DNA, 25 bp, mus musculus
ctatctgtaacaatcaacaggaaaa

SEQ ID NO: 55672 - DNA, 25 bp, mus musculus
tttgtgatcatcctacaccaggttt

SEQ ID NO: 55673 - DNA, 25 bp, mus musculus
atcatcctacaccaggtttggaaga

SEQ ID NO: 55674 - DNA, 25 bp, mus musculus
gacagtcaccggatgtcagcacaga

SEQ ID NO: 55675 - DNA, 25 bp, mus musculus
atgtcagcacagacacatgggctgc

SEQ ID NO: 55676 - DNA, 25 bp, mus musculus
gcacagacacatgggctgctgggcc

SEQ ID NO: 55677 - DNA, 25 bp, mus musculus
acacatgggctgctgggccagttct

SEQ ID NO: 55678 - DNA, 25 bp, mus musculus
taaagtacacagcctcaactcctct

SEQ ID NO: 55679 - DNA, 25 bp, mus musculus
ctcttagaaaaccacagcctggaca

SEQ ID NO: 55680 - DNA, 25 bp, mus musculus
gcattgcaacatcccagagcaccat

SEQ ID NO: 55681 - DNA, 25 bp, mus musculus
ttgcaacatcccagagcaccataac

SEQ ID NO: 55682 - DNA, 25 bp, mus musculus
caacatcccagagcaccataaccta

SEQ ID NO: 55683 - DNA, 25 bp, mus musculus
cccagagcaccataacctagagaat

SEQ ID NO: 55684 - DNA, 25 bp, mus musculus
agagcaccataacctagagaatgaa

SEQ ID NO: 55685 - DNA, 25 bp, mus musculus
gcaccataacctagagaatgaagtg

SEQ ID NO: 55686 - DNA, 25 bp, mus musculus
gaaagcatccacgcagcattctgag

SEQ ID NO: 55687 - DNA, 25 bp, mus musculus
atccacgcagcattctgaggaagaa

SEQ ID NO: 55688 - DNA, 25 bp, mus musculus
cacgcagcattctgaggaagaagtg

SEQ ID NO: 55689 - DNA, 25 bp, mus musculus
tgggctgcaccgtgatattgatgac

SEQ ID NO: 55690 - DNA, 25 bp, mus musculus
ttagaaaaccacagcctggacagca

SEQ ID NO: 55691 - DNA, 25 bp, mus musculus
acagcagtggacctctgcctgcttc

SEQ ID NO: 55692 - DNA, 25 bp, mus musculus
gacctctgcctgcttcagggtactg

SEQ ID NO: 55693 - DNA, 25 bp, mus musculus
tgcctgcttcagggtactgggtcta

SEQ ID NO: 55694 - DNA, 25 bp, mus musculus
ccatcagaagcacgctgcataagtc

SEQ ID NO: 55695 - DNA, 25 bp, mus musculus
gaagcacgctgcataagtcattttc

SEQ ID NO: 55696 - DNA, 25 bp, mus musculus
atactgtacttcctgatggttctcc

SEQ ID NO: 55697 - DNA, 25 bp, mus musculus
ctgtacttcctgatggttctcctgt

SEQ ID NO: 55698 - DNA, 25 bp, mus musculus
atgtagtctttgttgctgaagccaa

SEQ ID NO: 55699 - DNA, 25 bp, mus musculus
tctttgttgctgaagccaaagtctg

SEQ ID NO: 55700 - DNA, 25 bp, mus musculus
tacttcttggccaagtcttcattaa

SEQ ID NO: 55701 - DNA, 25 bp, mus musculus
ttggccaagtcttcattaagaccct

SEQ ID NO: 55702 - DNA, 25 bp, mus musculus
atataatcaaacatatctcctccat

SEQ ID NO: 55703 - DNA, 25 bp, mus musculus
taatcaaacatatctcctccatctc

SEQ ID NO: 55704 - DNA, 25 bp, mus musculus
cctccatctccaagttctagaatga

SEQ ID NO: 55705 - DNA, 25 bp, mus musculus
agtttggtctgggtgtctatgactt

SEQ ID NO: 55706 - DNA, 25 bp, mus musculus
tctatgacttcatagagacgcacaa

SEQ ID NO: 55707 - DNA, 25 bp, mus musculus
tagagacgcacaatgttggggtgct

SEQ ID NO: 55708 - DNA, 25 bp, mus musculus
agacgcacaatgttggggtgctgca

SEQ ID NO: 55709 - DNA, 25 bp, mus musculus
cgcacaatgttggggtgctgcacta

SEQ ID NO: 55710 - DNA, 25 bp, mus musculus
ccaaagtctgtcaacttcacaagac

SEQ ID NO: 55711 - DNA, 25 bp, mus musculus
tctgtcaacttcacaagaccttgtt

SEQ ID NO: 55712 - DNA, 25 bp, mus musculus
aagactacattctctggtttcaagt

SEQ ID NO: 55713 - DNA, 25 bp, mus musculus
ttctctggtttcaagtctctgtgga

SEQ ID NO: 55714 - DNA, 25 bp, mus musculus
tctggtttcaagtctctgtggacca

SEQ ID NO: 55715 - DNA, 25 bp, mus musculus
ggtttcaagtctctgtggaccacat

SEQ ID NO: 55716 - DNA, 25 bp, mus musculus
tctctgtggaccacatggagtttat

SEQ ID NO: 55717 - DNA, 25 bp, mus musculus
ctgtggaccacatggagtttatggc

SEQ ID NO: 55718 - DNA, 25 bp, mus musculus
accattttcatcaagaacagcatcc

SEQ ID NO: 55719 - DNA, 25 bp, mus musculus
ttcatcaagaacagcatccgtttcc

SEQ ID NO: 55720 - DNA, 25 bp, mus musculus
gccccattttgccccatcttgaggg

SEQ ID NO: 55721 - DNA, 25 bp, mus musculus
ccattttgccccatcttgagggtag

SEQ ID NO: 55722 - DNA, 25 bp, mus musculus
gatctggacaaggcctgggaccagt

SEQ ID NO: 55723 - DNA, 25 bp, mus musculus
gacaaggcctgggaccagtgcattc

SEQ ID NO: 55724 - DNA, 25 bp, mus musculus
aaggcctgggaccagtgcattccca

SEQ ID NO: 55725 - DNA, 25 bp, mus musculus
tgggaccagtgcattcccaaatatt

SEQ ID NO: 55726 - DNA, 25 bp, mus musculus
gaccagtgcattcccaaatattcct

SEQ ID NO: 55727 - DNA, 25 bp, mus musculus
cagtgcattcccaaatattccttca

SEQ ID NO: 55728 - DNA, 25 bp, mus musculus
tgcattcccaaatattccttcactc

SEQ ID NO: 55729 - DNA, 25 bp, mus musculus
cccaaatattccttcactcggctag

SEQ ID NO: 55730 - DNA, 25 bp, mus musculus
atcaagaacagcatccgtttccctc

SEQ ID NO: 55731 - DNA, 25 bp, mus musculus
tattccttcactcggctagatggag

SEQ ID NO: 55732 - DNA, 25 bp, mus musculus
aacagcatccgtttccctctcttca

SEQ ID NO: 55733 - DNA, 25 bp, mus musculus
agcatccgtttccctctcttcaact

SEQ ID NO: 55734 - DNA, 25 bp, mus musculus
ttccctctcttcaactttgagaagg

SEQ ID NO: 55735 - DNA, 25 bp, mus musculus
ctcaccgacaaggacataaagaagt

SEQ ID NO: 55736 - DNA, 25 bp, mus musculus
aagtgccgcttccatcctgaaaagg

SEQ ID NO: 55737 - DNA, 25 bp, mus musculus
tgccgcttccatcctgaaaaggccc

SEQ ID NO: 55738 - DNA, 25 bp, mus musculus
cgcttccatcctgaaaaggccccat

SEQ ID NO: 55739 - DNA, 25 bp, mus musculus
aaccctccaggcagccgtcagctgt

SEQ ID NO: 55740 - DNA, 25 bp, mus musculus
agccgtcagctgtgcccctgaagcc

SEQ ID NO: 55741 - DNA, 25 bp, mus musculus
cttcttatcctgttctacagcccag

SEQ ID NO: 55742 - DNA, 25 bp, mus musculus
cctgttctacagcccagggtctggt

SEQ ID NO: 55743 - DNA, 25 bp, mus musculus
tgttctacagcccagggtctggtga

SEQ ID NO: 55744 - DNA, 25 bp, mus musculus
ctacagcccagggtctggtgagaag

SEQ ID NO: 55745 - DNA, 25 bp, mus musculus
cctttgaggtctacatatggtccga

SEQ ID NO: 55746 - DNA, 25 bp, mus musculus
gtctacatatggtccgagaagcaga

SEQ ID NO: 55747 - DNA, 25 bp, mus musculus
ctacatatggtccgagaagcagata

SEQ ID NO: 55748 - DNA, 25 bp, mus musculus
acatatggtccgagaagcagatagt

SEQ ID NO: 55749 - DNA, 25 bp, mus musculus
gaagccacagagtcttggaaaatca

SEQ ID NO: 55750 - DNA, 25 bp, mus musculus
aatcaactgcagcaccaactgcgca

SEQ ID NO: 55751 - DNA, 25 bp, mus musculus
gctgtgcccctgaagcccatagact

SEQ ID NO: 55752 - DNA, 25 bp, mus musculus
tgtgcccctgaagcccatagactcc

SEQ ID NO: 55753 - DNA, 25 bp, mus musculus
tgaagcccatagactccacagaccc

SEQ ID NO: 55754 - DNA, 25 bp, mus musculus
cacctgagatgtcttcttttgcttg

SEQ ID NO: 55755 - DNA, 25 bp, mus musculus
cttcttttgcttgctggagcctgtc

SEQ ID NO: 55756 - DNA, 25 bp, mus musculus
ttgcttgctggagcctgtctcttct

SEQ ID NO: 55757 - DNA, 25 bp, mus musculus
gcttgctggagcctgtctcttctta

SEQ ID NO: 55758 - DNA, 25 bp, mus musculus
ctcttcttatcctgttctacagccc

SEQ ID NO: 55759 - DNA, 25 bp, mus musculus
aggacgtcactgggtctgagcggtc

SEQ ID NO: 55760 - DNA, 25 bp, mus musculus
ggacgtcactgggtctgagcggtca

SEQ ID NO: 55761 - DNA, 25 bp, mus musculus
gtcacctgcattggtgcatgaagaa

SEQ ID NO: 55762 - DNA, 25 bp, mus musculus
tcacctgcattggtgcatgaagaat

SEQ ID NO: 55763 - DNA, 25 bp, mus musculus
gtaatgagctggactgctggcatgg

SEQ ID NO: 55764 - DNA, 25 bp, mus musculus
atgagctggactgctggcatggaga

SEQ ID NO: 55765 - DNA, 25 bp, mus musculus
aagattgactggctgtcaagtagga

SEQ ID NO: 55766 - DNA, 25 bp, mus musculus
agattgactggctgtcaagtaggac

SEQ ID NO: 55767 - DNA, 25 bp, mus musculus
gattgactggctgtcaagtaggact

SEQ ID NO: 55768 - DNA, 25 bp, mus musculus
attgactggctgtcaagtaggactg

SEQ ID NO: 55769 - DNA, 25 bp, mus musculus
ttgactggctgtcaagtaggactga

SEQ ID NO: 55770 - DNA, 25 bp, mus musculus
tgactggctgtcaagtaggactgac

SEQ ID NO: 55771 - DNA, 25 bp, mus musculus
gacgtcactgggtctgagcggtcac

SEQ ID NO: 55772 - DNA, 25 bp, mus musculus
tctgagcggtcacctgcattggtgc

SEQ ID NO: 55773 - DNA, 25 bp, mus musculus
ctgagcggtcacctgcattggtgca

SEQ ID NO: 55774 - DNA, 25 bp, mus musculus
tgagcggtcacctgcattggtgcat

SEQ ID NO: 55775 - DNA, 25 bp, mus musculus
agcggtcacctgcattggtgcatga

SEQ ID NO: 55776 - DNA, 25 bp, mus musculus
gcggtcacctgcattggtgcatgaa

SEQ ID NO: 55777 - DNA, 25 bp, mus musculus
cggtcacctgcattggtgcatgaag

SEQ ID NO: 55778 - DNA, 25 bp, mus musculus
ggtcacctgcattggtgcatgaaga

SEQ ID NO: 55779 - DNA, 25 bp, mus musculus
aaggactgacgcgaccatgtgcaat

SEQ ID NO: 55780 - DNA, 25 bp, mus musculus
tgacgcgaccatgtgcaatgtgggc

SEQ ID NO: 55781 - DNA, 25 bp, mus musculus
ttaatcttggtgacaggagagcccc

SEQ ID NO: 55782 - DNA, 25 bp, mus musculus
gctcttagcgggtaccctgggagcg

SEQ ID NO: 55783 - DNA, 25 bp, mus musculus
ctctcctagcacttgtccttttaga

SEQ ID NO: 55784 - DNA, 25 bp, mus musculus
tagcacttgtccttttagatgcttt

SEQ ID NO: 55785 - DNA, 25 bp, mus musculus
gccattgctgcaccatgtcgttttt

SEQ ID NO: 55786 - DNA, 25 bp, mus musculus
attgctgcaccatgtcgttttttac

SEQ ID NO: 55787 - DNA, 25 bp, mus musculus
gcaccatgtcgttttttacaacatt

SEQ ID NO: 55788 - DNA, 25 bp, mus musculus
ttacaacattcagcttcagcatttt

SEQ ID NO: 55789 - DNA, 25 bp, mus musculus
caacattcagcttcagcatttttac

SEQ ID NO: 55790 - DNA, 25 bp, mus musculus
tcagcttcagcatttttactattat

SEQ ID NO: 55791 - DNA, 25 bp, mus musculus
cgcgaccatgtgcaatgtgggctca

SEQ ID NO: 55792 - DNA, 25 bp, mus musculus
tccagggccaaagtccagcaagaag

SEQ ID NO: 55793 - DNA, 25 bp, mus musculus
agggccaaagtccagcaagaaggca

SEQ ID NO: 55794 - DNA, 25 bp, mus musculus
tccctgtggtatgctaactggccct

SEQ ID NO: 55795 - DNA, 25 bp, mus musculus
gtcacagctgcttcagccctagggc

SEQ ID NO: 55796 - DNA, 25 bp, mus musculus
agtttgttgctgtgtcccatgctgt

SEQ ID NO: 55797 - DNA, 25 bp, mus musculus
ctgtgtcccatgctgttcagagaca

SEQ ID NO: 55798 - DNA, 25 bp, mus musculus
cccatgctgttcagagacatttagg

SEQ ID NO: 55799 - DNA, 25 bp, mus musculus
ttttctctgcaagaatgttacatat

SEQ ID NO: 55800 - DNA, 25 bp, mus musculus
agtgacatttcataccctgtatata

SEQ ID NO: 55801 - DNA, 25 bp, mus musculus
agtatccagtttctgaggctcagag

SEQ ID NO: 55802 - DNA, 25 bp, mus musculus
cagtttctgaggctcagaggtaaca

SEQ ID NO: 55803 - DNA, 25 bp, mus musculus
tttctgaggctcagaggtaacagct

SEQ ID NO: 55804 - DNA, 25 bp, mus musculus
agaggtaacagctctctggtactgg

SEQ ID NO: 55805 - DNA, 25 bp, mus musculus
ggtaacagctctctggtactggtct

SEQ ID NO: 55806 - DNA, 25 bp, mus musculus
agctctctggtactggtcttgcatg

SEQ ID NO: 55807 - DNA, 25 bp, mus musculus
ctggtactggtcttgcatgattgca

SEQ ID NO: 55808 - DNA, 25 bp, mus musculus
gtcttgcatgattgcatgaggtgtt

SEQ ID NO: 55809 - DNA, 25 bp, mus musculus
tacgagtcctttcaaatgtgctttc

SEQ ID NO: 55810 - DNA, 25 bp, mus musculus
atgtgctttctttaacctagatgga

SEQ ID NO: 55811 - DNA, 25 bp, mus musculus
tcataccctgtatatatagagatgt

SEQ ID NO: 55812 - DNA, 25 bp, mus musculus
tcagctcccttgcagagcttttgct

SEQ ID NO: 55813 - DNA, 25 bp, mus musculus
tatctggatgttttctgtttggcca

SEQ ID NO: 55814 - DNA, 25 bp, mus musculus
gatgttttctgtttggccaggctgt

SEQ ID NO: 55815 - DNA, 25 bp, mus musculus
gttttctgtttggccaggctgttga

SEQ ID NO: 55816 - DNA, 25 bp, mus musculus
ttctgtttggccaggctgttgattt

SEQ ID NO: 55817 - DNA, 25 bp, mus musculus
ttgcccagtatccagtttctgaggc

SEQ ID NO: 55818 - DNA, 25 bp, mus musculus
cccagtatccagtttctgaggctca

SEQ ID NO: 55819 - DNA, 25 bp, mus musculus
ggactcttccagactagaacactgt

SEQ ID NO: 55820 - DNA, 25 bp, mus musculus
ctcttccagactagaacactgtacc

SEQ ID NO: 55821 - DNA, 25 bp, mus musculus
tctgtcatctcaaaactgtcattca

SEQ ID NO: 55822 - DNA, 25 bp, mus musculus
atctcaaaactgtcattcattttgg

SEQ ID NO: 55823 - DNA, 25 bp, mus musculus
tcaaaactgtcattcattttggcag

SEQ ID NO: 55824 - DNA, 25 bp, mus musculus
aaactgtcattcattttggcaggaa

SEQ ID NO: 55825 - DNA, 25 bp, mus musculus
tcattcattttggcaggaattcaaa

SEQ ID NO: 55826 - DNA, 25 bp, mus musculus
atttctgtaaaggcacttgttctct

SEQ ID NO: 55827 - DNA, 25 bp, mus musculus
aaggcacttgttctctttcaattca

SEQ ID NO: 55828 - DNA, 25 bp, mus musculus
gcacttgttctctttcaattcagtt

SEQ ID NO: 55829 - DNA, 25 bp, mus musculus
ctctttcaattcagttctatgtata

SEQ ID NO: 55830 - DNA, 25 bp, mus musculus
tttcaattcagttctatgtatacat

SEQ ID NO: 55831 - DNA, 25 bp, mus musculus
ttccagactagaacactgtacctct

SEQ ID NO: 55832 - DNA, 25 bp, mus musculus
agaacactgtacctctctgctcata

SEQ ID NO: 55833 - DNA, 25 bp, mus musculus
acactgtacctctctgctcatatct

SEQ ID NO: 55834 - DNA, 25 bp, mus musculus
tacctctctgctcatatctctgtca

SEQ ID NO: 55835 - DNA, 25 bp, mus musculus
ctctctgctcatatctctgtcatct

SEQ ID NO: 55836 - DNA, 25 bp, mus musculus
tctgctcatatctctgtcatctcaa

SEQ ID NO: 55837 - DNA, 25 bp, mus musculus
catatctctgtcatctcaaaactgt

SEQ ID NO: 55838 - DNA, 25 bp, mus musculus
atctctgtcatctcaaaactgtcat

SEQ ID NO: 55839 - DNA, 25 bp, mus musculus
ttggcctttggattggcgtcaaaga

SEQ ID NO: 55840 - DNA, 25 bp, mus musculus
atttaagccgcgatatgggcttgct

SEQ ID NO: 55841 - DNA, 25 bp, mus musculus
acaagctgaagccttccaacgctca

SEQ ID NO: 55842 - DNA, 25 bp, mus musculus
agctgaagccttccaacgctcaatc

SEQ ID NO: 55843 - DNA, 25 bp, mus musculus
tgaagccttccaacgctcaatctca

SEQ ID NO: 55844 - DNA, 25 bp, mus musculus
agccttccaacgctcaatctcaaga

SEQ ID NO: 55845 - DNA, 25 bp, mus musculus
ccaacgctcaatctcaagatatagt

SEQ ID NO: 55846 - DNA, 25 bp, mus musculus
acgctcaatctcaagatatagttcc

SEQ ID NO: 55847 - DNA, 25 bp, mus musculus
ctcaatctcaagatatagttccaac

SEQ ID NO: 55848 - DNA, 25 bp, mus musculus
aagatatagttccaaccataggatt

SEQ ID NO: 55849 - DNA, 25 bp, mus musculus
tagttccaaccataggatttagcat

SEQ ID NO: 55850 - DNA, 25 bp, mus musculus
ttccaaccataggatttagcataga

SEQ ID NO: 55851 - DNA, 25 bp, mus musculus
gccgcgatatgggcttgctggacag

SEQ ID NO: 55852 - DNA, 25 bp, mus musculus
atatgggcttgctggacagactttc

SEQ ID NO: 55853 - DNA, 25 bp, mus musculus
tgctggacagactttcaggtttgct

SEQ ID NO: 55854 - DNA, 25 bp, mus musculus
acagactttcaggtttgcttggcct

SEQ ID NO: 55855 - DNA, 25 bp, mus musculus
gactttcaggtttgcttggcctgaa

SEQ ID NO: 55856 - DNA, 25 bp, mus musculus
tttcaggtttgcttggcctgaagaa

SEQ ID NO: 55857 - DNA, 25 bp, mus musculus
caggtttgcttggcctgaagaagaa

SEQ ID NO: 55858 - DNA, 25 bp, mus musculus
ccacaatcattaacaagctgaagcc

SEQ ID NO: 55859 - DNA, 25 bp, mus musculus
cacagcacagacagacactcaggca

SEQ ID NO: 55860 - DNA, 25 bp, mus musculus
cagcacagacagacactcaggcacc

SEQ ID NO: 55861 - DNA, 25 bp, mus musculus
cacagcaatcagatggccatagtgc

SEQ ID NO: 55862 - DNA, 25 bp, mus musculus
gcaatcagatggccatagtgctgaa

SEQ ID NO: 55863 - DNA, 25 bp, mus musculus
aatcagatggccatagtgctgaacc

SEQ ID NO: 55864 - DNA, 25 bp, mus musculus
agtgctgaaccctgacctctacact

SEQ ID NO: 55865 - DNA, 25 bp, mus musculus
tgctgaaccctgacctctacactta

SEQ ID NO: 55866 - DNA, 25 bp, mus musculus
ctgaaccctgacctctacacttagc

SEQ ID NO: 55867 - DNA, 25 bp, mus musculus
gaaccctgacctctacacttagcct

SEQ ID NO: 55868 - DNA, 25 bp, mus musculus
tgacctctacacttagcctcgcggt

SEQ ID NO: 55869 - DNA, 25 bp, mus musculus
ctctacacttagcctcgcggtaagg

SEQ ID NO: 55870 - DNA, 25 bp, mus musculus
ttagcctcgcggtaaggagacacca

SEQ ID NO: 55871 - DNA, 25 bp, mus musculus
gcacagacagacactcaggcaccag

SEQ ID NO: 55872 - DNA, 25 bp, mus musculus
acagacagacactcaggcaccagcc

SEQ ID NO: 55873 - DNA, 25 bp, mus musculus
agacactcaggcaccagccagccag

SEQ ID NO: 55874 - DNA, 25 bp, mus musculus
acactcaggcaccagccagccaggg

SEQ ID NO: 55875 - DNA, 25 bp, mus musculus
ggtcgccaccataccgttcagaaca

SEQ ID NO: 55876 - DNA, 25 bp, mus musculus
caggctgccctacgagcctcaggag

SEQ ID NO: 55877 - DNA, 25 bp, mus musculus
ggctgccctacgagcctcaggagga

SEQ ID NO: 55878 - DNA, 25 bp, mus musculus
catacctcagcacacacagcaatca

SEQ ID NO: 55879 - DNA, 25 bp, mus musculus
atggccgagccggaccgattcagac

SEQ ID NO: 55880 - DNA, 25 bp, mus musculus
ccgagccggaccgattcagactcgg

SEQ ID NO: 55881 - DNA, 25 bp, mus musculus
gtcttctagacgagctgaccctcga

SEQ ID NO: 55882 - DNA, 25 bp, mus musculus
cttctagacgagctgaccctcgaag

SEQ ID NO: 55883 - DNA, 25 bp, mus musculus
tctagacgagctgaccctcgaagga

SEQ ID NO: 55884 - DNA, 25 bp, mus musculus
gacgagctgaccctcgaaggagtga

SEQ ID NO: 55885 - DNA, 25 bp, mus musculus
agctgaccctcgaaggagtgacacg

SEQ ID NO: 55886 - DNA, 25 bp, mus musculus
agtgacacgctacatgcagagcgag

SEQ ID NO: 55887 - DNA, 25 bp, mus musculus
tgacacgctacatgcagagcgagcg

SEQ ID NO: 55888 - DNA, 25 bp, mus musculus
acacgctacatgcagagcgagcgct

SEQ ID NO: 55889 - DNA, 25 bp, mus musculus
acgctacatgcagagcgagcgctgc

SEQ ID NO: 55890 - DNA, 25 bp, mus musculus
gagcgctgccgcaaggtcatctgtt

SEQ ID NO: 55891 - DNA, 25 bp, mus musculus
cggaccgattcagactcggacactg

SEQ ID NO: 55892 - DNA, 25 bp, mus musculus
gaccgattcagactcggacactgag

SEQ ID NO: 55893 - DNA, 25 bp, mus musculus
ccgattcagactcggacactgaggg

SEQ ID NO: 55894 - DNA, 25 bp, mus musculus
gattcagactcggacactgagggag

SEQ ID NO: 55895 - DNA, 25 bp, mus musculus
atggacttcctgaggaatttattca

SEQ ID NO: 55896 - DNA, 25 bp, mus musculus
ttattcacccagaccctgggcctgg

SEQ ID NO: 55897 - DNA, 25 bp, mus musculus
aggagcgtcttctagacgagctgac

SEQ ID NO: 55898 - DNA, 25 bp, mus musculus
gcgtcttctagacgagctgaccctc

SEQ ID NO: 55899 - DNA, 25 bp, mus musculus
tttgaacctcttcacatcaaaagac

SEQ ID NO: 55900 - DNA, 25 bp, mus musculus
acctcttcacatcaaaagacttgtc

SEQ ID NO: 55901 - DNA, 25 bp, mus musculus
ttgagcaattcttctcaatatgcaa

SEQ ID NO: 55902 - DNA, 25 bp, mus musculus
gagcaattcttctcaatatgcaaaa

SEQ ID NO: 55903 - DNA, 25 bp, mus musculus
agcaattcttctcaatatgcaaaac

SEQ ID NO: 55904 - DNA, 25 bp, mus musculus
caattcttctcaatatgcaaaaccg

SEQ ID NO: 55905 - DNA, 25 bp, mus musculus
aattcttctcaatatgcaaaaccgt

SEQ ID NO: 55906 - DNA, 25 bp, mus musculus
tcttctcaatatgcaaaaccgtgtt

SEQ ID NO: 55907 - DNA, 25 bp, mus musculus
ttctcaatatgcaaaaccgtgtttg

SEQ ID NO: 55908 - DNA, 25 bp, mus musculus
tctcaatatgcaaaaccgtgtttgt

SEQ ID NO: 55909 - DNA, 25 bp, mus musculus
atatgcaaaaccgtgtttgtatctg

SEQ ID NO: 55910 - DNA, 25 bp, mus musculus
tatgcaaaaccgtgtttgtatctga

SEQ ID NO: 55911 - DNA, 25 bp, mus musculus
tcacatcaaaagacttgtctgctac

SEQ ID NO: 55912 - DNA, 25 bp, mus musculus
cacatcaaaagacttgtctgctact

SEQ ID NO: 55913 - DNA, 25 bp, mus musculus
atcaaaagacttgtctgctacttgg

SEQ ID NO: 55914 - DNA, 25 bp, mus musculus
aagacttgtctgctacttggaatgc

SEQ ID NO: 55915 - DNA, 25 bp, mus musculus
agacttgtctgctacttggaatgca

SEQ ID NO: 55916 - DNA, 25 bp, mus musculus
tgtctgctacttggaatgcaactct

SEQ ID NO: 55917 - DNA, 25 bp, mus musculus
ttcagcaatcttgagcaattcttct

SEQ ID NO: 55918 - DNA, 25 bp, mus musculus
cttgagcaattcttctcaatatgca

SEQ ID NO: 55919 - DNA, 25 bp, mus musculus
catcttcacatcaaaggactcatct

SEQ ID NO: 55920 - DNA, 25 bp, mus musculus
cacatcaaaggactcatctgctgca

SEQ ID NO: 55921 - DNA, 25 bp, mus musculus
ctcagttaacttgctggcaagattg

SEQ ID NO: 55922 - DNA, 25 bp, mus musculus
taacttgctggcaagattgagcaag

SEQ ID NO: 55923 - DNA, 25 bp, mus musculus
gtgactcctgagacaaagtgtggag

SEQ ID NO: 55924 - DNA, 25 bp, mus musculus
ttttctgaaccagaacactgcatct

SEQ ID NO: 55925 - DNA, 25 bp, mus musculus
gaaccagaacactgcatctcacttt

SEQ ID NO: 55926 - DNA, 25 bp, mus musculus
gaacactgcatctcactttataaga

SEQ ID NO: 55927 - DNA, 25 bp, mus musculus
cataactttcacatatgagtacaaa

SEQ ID NO: 55928 - DNA, 25 bp, mus musculus
gatgtttcagcaatcttgagcgatc

SEQ ID NO: 55929 - DNA, 25 bp, mus musculus
tcagcaatcttgagcgatcattttc

SEQ ID NO: 55930 - DNA, 25 bp, mus musculus
atcttgagcgatcattttcaatatg

SEQ ID NO: 55931 - DNA, 25 bp, mus musculus
aaaggactcatctgctgcatggaat

SEQ ID NO: 55932 - DNA, 25 bp, mus musculus
cctcctagactcattctgcaatgaa

SEQ ID NO: 55933 - DNA, 25 bp, mus musculus
caatgaagtccatcagcagctcaat

SEQ ID NO: 55934 - DNA, 25 bp, mus musculus
agtccatcagcagctcaatgacctc

SEQ ID NO: 55935 - DNA, 25 bp, mus musculus
tgacctcaaagcctgtgtgatgcaa

SEQ ID NO: 55936 - DNA, 25 bp, mus musculus
gatgcaacaggtcggggtgcaggaa

SEQ ID NO: 55937 - DNA, 25 bp, mus musculus
agactccctgctggctgtgaggaaa

SEQ ID NO: 55938 - DNA, 25 bp, mus musculus
gatcactgtgtacctgagagagaag

SEQ ID NO: 55939 - DNA, 25 bp, mus musculus
cctcaaagcctgtgtgatgcaacag

SEQ ID NO: 55940 - DNA, 25 bp, mus musculus
ctcaaagcctgtgtgatgcaacagg

SEQ ID NO: 55941 - DNA, 25 bp, mus musculus
tggtatctgaatccacttgtccttt

SEQ ID NO: 55942 - DNA, 25 bp, mus musculus
ggtatctgaatccacttgtcctttc

SEQ ID NO: 55943 - DNA, 25 bp, mus musculus
tcaaagcctgtgtgatgcaacaggt

SEQ ID NO: 55944 - DNA, 25 bp, mus musculus
tttcagcaatcttgagcgatcattt

SEQ ID NO: 55945 - DNA, 25 bp, mus musculus
ttcagcaatcttgagcgatcatttt

SEQ ID NO: 55946 - DNA, 25 bp, mus musculus
tcagcaatcttgagcgatcattttc

SEQ ID NO: 55947 - DNA, 25 bp, mus musculus
agcaatcttgagcgatcattttcaa

SEQ ID NO: 55948 - DNA, 25 bp, mus musculus
caatcttgagcgatcattttcaata

SEQ ID NO: 55949 - DNA, 25 bp, mus musculus
atcttgagcgatcattttcaatatg

SEQ ID NO: 55950 - DNA, 25 bp, mus musculus
ttggtatctgaatccacttgtcctt

SEQ ID NO: 55951 - DNA, 25 bp, mus musculus
cctcaaagcctgtgtgatgcaacag

SEQ ID NO: 55952 - DNA, 25 bp, mus musculus
ctcaaagcctgtgtgatgcaacagg

SEQ ID NO: 55953 - DNA, 25 bp, mus musculus
tggtatctgaatccacttgtccttt

SEQ ID NO: 55954 - DNA, 25 bp, mus musculus
ggtatctgaatccacttgtcctttc

SEQ ID NO: 55955 - DNA, 25 bp, mus musculus
tatttattattctgcttttaataat

SEQ ID NO: 55956 - DNA, 25 bp, mus musculus
tcaaagcctgtgtgatgcaacaggt

SEQ ID NO: 55957 - DNA, 25 bp, mus musculus
tttcagcaatcttgagcgatcattt

SEQ ID NO: 55958 - DNA, 25 bp, mus musculus
ttcagcaatcttgagcgatcatttt

SEQ ID NO: 55959 - DNA, 25 bp, mus musculus
tcagcaatcttgagcgatcattttc

SEQ ID NO: 55960 - DNA, 25 bp, mus musculus
agcaatcttgagcgatcattttcaa

SEQ ID NO: 55961 - DNA, 25 bp, mus musculus
caatcttgagcgatcattttcaata

SEQ ID NO: 55962 - DNA, 25 bp, mus musculus
atcttgagcgatcattttcaatatg

SEQ ID NO: 55963 - DNA, 25 bp, mus musculus
ttggtatctgaatccacttgtcctt

SEQ ID NO: 55964 - DNA, 25 bp, mus musculus
gtcgttgccagagccagggttatga

SEQ ID NO: 55965 - DNA, 25 bp, mus musculus
tcgttgccagagccagggttatgag

SEQ ID NO: 55966 - DNA, 25 bp, mus musculus
ctgcaaccgcaagatcaaggaccgg

SEQ ID NO: 55967 - DNA, 25 bp, mus musculus
gcaaccgcaagatcaaggaccggta

SEQ ID NO: 55968 - DNA, 25 bp, mus musculus
gatcaaggaccggtacctgctgaag

SEQ ID NO: 55969 - DNA, 25 bp, mus musculus
tcaaggaccggtacctgctgaaggc

SEQ ID NO: 55970 - DNA, 25 bp, mus musculus
caaggaccggtacctgctgaaggca

SEQ ID NO: 55971 - DNA, 25 bp, mus musculus
aggaccggtacctgctgaaggcact

SEQ ID NO: 55972 - DNA, 25 bp, mus musculus
ggaccggtacctgctgaaggcactg

SEQ ID NO: 55973 - DNA, 25 bp, mus musculus
accggtacctgctgaaggcactgga

SEQ ID NO: 55974 - DNA, 25 bp, mus musculus
ggtacctgctgaaggcactggacaa

SEQ ID NO: 55975 - DNA, 25 bp, mus musculus
cctgctgaaggcactggacaagtac

SEQ ID NO: 55976 - DNA, 25 bp, mus musculus
gttgccagagccagggttatgagct

SEQ ID NO: 55977 - DNA, 25 bp, mus musculus
ttgccagagccagggttatgagcta

SEQ ID NO: 55978 - DNA, 25 bp, mus musculus
gccagagccagggttatgagctatc

SEQ ID NO: 55979 - DNA, 25 bp, mus musculus
gccgatgctctccgtccaacctaag

SEQ ID NO: 55980 - DNA, 25 bp, mus musculus
gcgcaggctgcaaccgcaagatcaa

SEQ ID NO: 55981 - DNA, 25 bp, mus musculus
cgcaggctgcaaccgcaagatcaag

SEQ ID NO: 55982 - DNA, 25 bp, mus musculus
aggctgcaaccgcaagatcaaggac

SEQ ID NO: 55983 - DNA, 25 bp, mus musculus
gctgcaaccgcaagatcaaggaccg

SEQ ID NO: 55984 - DNA, 25 bp, mus musculus
tttgagttctgcagtgacttcaaga

SEQ ID NO: 55985 - DNA, 25 bp, mus musculus
ttctgcagtgacttcaagaccattt

SEQ ID NO: 55986 - DNA, 25 bp, mus musculus
aaagtctcttgtcaatccacaagaa

SEQ ID NO: 55987 - DNA, 25 bp, mus musculus
caatccacaagaacaatgcaaagtt

SEQ ID NO: 55988 - DNA, 25 bp, mus musculus
ttaagtccacccaataataagatca

SEQ ID NO: 55989 - DNA, 25 bp, mus musculus
ccacccaataataagatcagaagat

SEQ ID NO: 55990 - DNA, 25 bp, mus musculus
gaaattctaagccttccagtatata

SEQ ID NO: 55991 - DNA, 25 bp, mus musculus
cttccagtatatacccttgtcatga

SEQ ID NO: 55992 - DNA, 25 bp, mus musculus
gtatatacccttgtcatgagaaaag

SEQ ID NO: 55993 - DNA, 25 bp, mus musculus
catggtgatccccaagagaactcaa

SEQ ID NO: 55994 - DNA, 25 bp, mus musculus
gatccccaagagaactcaagcctta

SEQ ID NO: 55995 - DNA, 25 bp, mus musculus
caagagaactcaagccttattcctc

SEQ ID NO: 55996 - DNA, 25 bp, mus musculus
ttcaagaccatttggaagcgggaga

SEQ ID NO: 55997 - DNA, 25 bp, mus musculus
actcaagccttattcctcacacact

SEQ ID NO: 55998 - DNA, 25 bp, mus musculus
atggctcaggcatccgtcagcaaac

SEQ ID NO: 55999 - DNA, 25 bp, mus musculus
caggcatccgtcagcaaactgacat

SEQ ID NO: 56000 - DNA, 25 bp, mus musculus
gtggccaccaactaagatgaaaaca

SEQ ID NO: 56001 - DNA, 25 bp, mus musculus
gctcctgcagacacaagggccaccg

SEQ ID NO: 56002 - DNA, 25 bp, mus musculus
gcagacacaagggccaccggggagt

SEQ ID NO: 56003 - DNA, 25 bp, mus musculus
cttctgaggccatctgcagaaagtc

SEQ ID NO: 56004 - DNA, 25 bp, mus musculus
tctgcagaaagtcccctgtgccttc

SEQ ID NO: 56005 - DNA, 25 bp, mus musculus
gccagccatgcgctcagctggcgac

SEQ ID NO: 56006 - DNA, 25 bp, mus musculus
ccagccatgcgctcagctggcgact

SEQ ID NO: 56007 - DNA, 25 bp, mus musculus
ctcagctggcgactgtcttaccctc

SEQ ID NO: 56008 - DNA, 25 bp, mus musculus
tcagctggcgactgtcttaccctcc

SEQ ID NO: 56009 - DNA, 25 bp, mus musculus
cgcgtcccatcacgtgagtctgaga

SEQ ID NO: 56010 - DNA, 25 bp, mus musculus
agatcgtaggaggcttcttgagaag

SEQ ID NO: 56011 - DNA, 25 bp, mus musculus
atcgtaggaggcttcttgagaagac

SEQ ID NO: 56012 - DNA, 25 bp, mus musculus
tgacttgtgcgtagcacccgagtag

SEQ ID NO: 56013 - DNA, 25 bp, mus musculus
gacttgtgcgtagcacccgagtagt

SEQ ID NO: 56014 - DNA, 25 bp, mus musculus
cttgtgcgtagcacccgagtagttt

SEQ ID NO: 56015 - DNA, 25 bp, mus musculus
ttgtgcgtagcacccgagtagttta

SEQ ID NO: 56016 - DNA, 25 bp, mus musculus
tgtgcgtagcacccgagtagtttac

SEQ ID NO: 56017 - DNA, 25 bp, mus musculus
cagccatgcgctcagctggcgactg

SEQ ID NO: 56018 - DNA, 25 bp, mus musculus
agccatgcgctcagctggcgactgt

SEQ ID NO: 56019 - DNA, 25 bp, mus musculus
ccatgcgctcagctggcgactgtct

SEQ ID NO: 56020 - DNA, 25 bp, mus musculus
catgcgctcagctggcgactgtctt

SEQ ID NO: 56021 - DNA, 25 bp, mus musculus
atgcgctcagctggcgactgtctta

SEQ ID NO: 56022 - DNA, 25 bp, mus musculus
tgcgctcagctggcgactgtcttac

SEQ ID NO: 56023 - DNA, 25 bp, mus musculus
cgctcagctggcgactgtcttaccc

SEQ ID NO: 56024 - DNA, 25 bp, mus musculus
gctcagctggcgactgtcttaccct

SEQ ID NO: 56025 - DNA, 25 bp, mus musculus
agtcacaactgggtaagagtgtcaa

SEQ ID NO: 56026 - DNA, 25 bp, mus musculus
aggacagcacttggtacctatgata

SEQ ID NO: 56027 - DNA, 25 bp, mus musculus
cagaactacataacacttcaccctt

SEQ ID NO: 56028 - DNA, 25 bp, mus musculus
ttcaccctttctacaacacttagat

SEQ ID NO: 56029 - DNA, 25 bp, mus musculus
ttctacaacacttagatttttcagc

SEQ ID NO: 56030 - DNA, 25 bp, mus musculus
ttcttgaaccctgaagaaagtgata

SEQ ID NO: 56031 - DNA, 25 bp, mus musculus
cttgaaccctgaagaaagtgatata

SEQ ID NO: 56032 - DNA, 25 bp, mus musculus
gccactgttccaagaaaacaatcac

SEQ ID NO: 56033 - DNA, 25 bp, mus musculus
cactgttccaagaaaacaatcacgt

SEQ ID NO: 56034 - DNA, 25 bp, mus musculus
tccaagaaaacaatcacgtattatt

SEQ ID NO: 56035 - DNA, 25 bp, mus musculus
tattattagtcagtctttagatcag

SEQ ID NO: 56036 - DNA, 25 bp, mus musculus
ttattagtcagtctttagatcaggt

SEQ ID NO: 56037 - DNA, 25 bp, mus musculus
gacagcacttggtacctatgataga

SEQ ID NO: 56038 - DNA, 25 bp, mus musculus
gcacttggtacctatgatagacaaa

SEQ ID NO: 56039 - DNA, 25 bp, mus musculus
aacactgtgcttatctgtttcagtt

SEQ ID NO: 56040 - DNA, 25 bp, mus musculus
cactgtgcttatctgtttcagttta

SEQ ID NO: 56041 - DNA, 25 bp, mus musculus
ctgtgcttatctgtttcagtttaaa

SEQ ID NO: 56042 - DNA, 25 bp, mus musculus
gtgcttatctgtttcagtttaaaag

SEQ ID NO: 56043 - DNA, 25 bp, mus musculus
ttatctgtttcagtttaaaagacag

SEQ ID NO: 56044 - DNA, 25 bp, mus musculus
gacagaactacataacacttcaccc

SEQ ID NO: 56045 - DNA, 25 bp, mus musculus
actacagcgacaaattctgataacc

SEQ ID NO: 56046 - DNA, 25 bp, mus musculus
gacaaattctgataacccagggcag

SEQ ID NO: 56047 - DNA, 25 bp, mus musculus
accccttgcttcagtggctgaactc

SEQ ID NO: 56048 - DNA, 25 bp, mus musculus
cttgcttcagtggctgaactcggtc

SEQ ID NO: 56049 - DNA, 25 bp, mus musculus
tttctaggctcaaaactgaaaagct

SEQ ID NO: 56050 - DNA, 25 bp, mus musculus
aagctgattacccatgtaatttatc

SEQ ID NO: 56051 - DNA, 25 bp, mus musculus
gctgattacccatgtaatttatctg

SEQ ID NO: 56052 - DNA, 25 bp, mus musculus
attacccatgtaatttatctggtct

SEQ ID NO: 56053 - DNA, 25 bp, mus musculus
tacccatgtaatttatctggtctta

SEQ ID NO: 56054 - DNA, 25 bp, mus musculus
taatttatctggtcttaaatgataa

SEQ ID NO: 56055 - DNA, 25 bp, mus musculus
cctcacttccccagaaatggctctt

SEQ ID NO: 56056 - DNA, 25 bp, mus musculus
tcacttccccagaaatggctctttt

SEQ ID NO: 56057 - DNA, 25 bp, mus musculus
caaattctgataacccagggcagta

SEQ ID NO: 56058 - DNA, 25 bp, mus musculus
aattctgataacccagggcagtaga

SEQ ID NO: 56059 - DNA, 25 bp, mus musculus
ctgataacccagggcagtagatctc

SEQ ID NO: 56060 - DNA, 25 bp, mus musculus
gataacccagggcagtagatctcct

SEQ ID NO: 56061 - DNA, 25 bp, mus musculus
ggcagtagatctccttccaggccca

SEQ ID NO: 56062 - DNA, 25 bp, mus musculus
ccttccaggcccagggcttgtgact

SEQ ID NO: 56063 - DNA, 25 bp, mus musculus
ttccaggcccagggcttgtgacttg

SEQ ID NO: 56064 - DNA, 25 bp, mus musculus
aggcccagggcttgtgacttgaaca

SEQ ID NO: 56065 - DNA, 25 bp, mus musculus
gtgatttctgttcccagcaagtgtc

SEQ ID NO: 56066 - DNA, 25 bp, mus musculus
tctgttcccagcaagtgtctcctcc

SEQ ID NO: 56067 - DNA, 25 bp, mus musculus
gtctaacaggttcacagcaaggcca

SEQ ID NO: 56068 - DNA, 25 bp, mus musculus
taacaggttcacagcaaggccactg

SEQ ID NO: 56069 - DNA, 25 bp, mus musculus
caggttcacagcaaggccactggta

SEQ ID NO: 56070 - DNA, 25 bp, mus musculus
gttcacagcaaggccactggtacag

SEQ ID NO: 56071 - DNA, 25 bp, mus musculus
cacagcaaggccactggtacagacg

SEQ ID NO: 56072 - DNA, 25 bp, mus musculus
agcaaggccactggtacagacgatt

SEQ ID NO: 56073 - DNA, 25 bp, mus musculus
agcaacatgctttgcctatggacag

SEQ ID NO: 56074 - DNA, 25 bp, mus musculus
aacatgctttgcctatggacagaca

SEQ ID NO: 56075 - DNA, 25 bp, mus musculus
ctttgcctatggacagacaggcagt

SEQ ID NO: 56076 - DNA, 25 bp, mus musculus
tcagaacgcatctaaagggatctac

SEQ ID NO: 56077 - DNA, 25 bp, mus musculus
gttcccagcaagtgtctcctcctgg

SEQ ID NO: 56078 - DNA, 25 bp, mus musculus
agcaagtgtctcctcctggtgcatg

SEQ ID NO: 56079 - DNA, 25 bp, mus musculus
aagtgtctcctcctggtgcatgaac

SEQ ID NO: 56080 - DNA, 25 bp, mus musculus
tgtctcctcctggtgcatgaaccca

SEQ ID NO: 56081 - DNA, 25 bp, mus musculus
ctcctggtgcatgaacccaagttaa

SEQ ID NO: 56082 - DNA, 25 bp, mus musculus
caagctttctgctttgactttgcat

SEQ ID NO: 56083 - DNA, 25 bp, mus musculus
tttgactttgcatttgatgagacag

SEQ ID NO: 56084 - DNA, 25 bp, mus musculus
acagcttccaatgaagttgtctaac

SEQ ID NO: 56085 - DNA, 25 bp, mus musculus
gatacacatcatgtcgtcttcacac

SEQ ID NO: 56086 - DNA, 25 bp, mus musculus
caccacagctggaccagagaccctt

SEQ ID NO: 56087 - DNA, 25 bp, mus musculus
actgaagcctacaaaagcagcccgc

SEQ ID NO: 56088 - DNA, 25 bp, mus musculus
gcctacaaaagcagcccgctctatc

SEQ ID NO: 56089 - DNA, 25 bp, mus musculus
ccacactgacatgcccaagactcag

SEQ ID NO: 56090 - DNA, 25 bp, mus musculus
tgacatgcccaagactcagaaggaa

SEQ ID NO: 56091 - DNA, 25 bp, mus musculus
gccacatcaccgcaggatcctttgc

SEQ ID NO: 56092 - DNA, 25 bp, mus musculus
tcaccgcaggatcctttgctgcttg

SEQ ID NO: 56093 - DNA, 25 bp, mus musculus
caggatcctttgctgcttgagcaac

SEQ ID NO: 56094 - DNA, 25 bp, mus musculus
ctgcttgagcaacctgcaaaacatc

SEQ ID NO: 56095 - DNA, 25 bp, mus musculus
gagcaacctgcaaaacatcgaaaca

SEQ ID NO: 56096 - DNA, 25 bp, mus musculus
tgggcatttcccccaatgaaatata

SEQ ID NO: 56097 - DNA, 25 bp, mus musculus
agctggaccagagaccctttgcggg

SEQ ID NO: 56098 - DNA, 25 bp, mus musculus
ttacttcaacaagcccacaggctat

SEQ ID NO: 56099 - DNA, 25 bp, mus musculus
caacaagcccacaggctatggctcc

SEQ ID NO: 56100 - DNA, 25 bp, mus musculus
gcccacaggctatggctccagcatt

SEQ ID NO: 56101 - DNA, 25 bp, mus musculus
aggctatggctccagcattcggagg

SEQ ID NO: 56102 - DNA, 25 bp, mus musculus
cagcattcggagggcacctcagaca

SEQ ID NO: 56103 - DNA, 25 bp, mus musculus
ggcacctcagacaggcattgtggat

SEQ ID NO: 56104 - DNA, 25 bp, mus musculus
tgagtgttgcttccggagctgtgat

SEQ ID NO: 56105 - DNA, 25 bp, mus musculus
ctcctgttccagatcatcccacggg

SEQ ID NO: 56106 - DNA, 25 bp, mus musculus
cctgttccagatcatcccacgggga

SEQ ID NO: 56107 - DNA, 25 bp, mus musculus
gatcatcccacggggagcaggtccc

SEQ ID NO: 56108 - DNA, 25 bp, mus musculus
atcatcccacggggagcaggtccca

SEQ ID NO: 56109 - DNA, 25 bp, mus musculus
tcatcccacggggagcaggtcccag

SEQ ID NO: 56110 - DNA, 25 bp, mus musculus
catcccacggggagcaggtcccagg

SEQ ID NO: 56111 - DNA, 25 bp, mus musculus
ccacggggagcaggtcccaggtgct

SEQ ID NO: 56112 - DNA, 25 bp, mus musculus
tcgccccataggcttccatctaagc

SEQ ID NO: 56113 - DNA, 25 bp, mus musculus
ccataggcttccatctaagccccag

SEQ ID NO: 56114 - DNA, 25 bp, mus musculus
gcttccatctaagccccagttttgg

SEQ ID NO: 56115 - DNA, 25 bp, mus musculus
catctaagccccagttttggtatgt

SEQ ID NO: 56116 - DNA, 25 bp, mus musculus
tctaagccccagttttggtatgtct

SEQ ID NO: 56117 - DNA, 25 bp, mus musculus
ctgttccagatcatcccacggggag

SEQ ID NO: 56118 - DNA, 25 bp, mus musculus
tgttccagatcatcccacggggagc

SEQ ID NO: 56119 - DNA, 25 bp, mus musculus
gttccagatcatcccacggggagca

SEQ ID NO: 56120 - DNA, 25 bp, mus musculus
ttccagatcatcccacggggagcag

SEQ ID NO: 56121 - DNA, 25 bp, mus musculus
tccagatcatcccacggggagcagg

SEQ ID NO: 56122 - DNA, 25 bp, mus musculus
ccagatcatcccacggggagcaggt

SEQ ID NO: 56123 - DNA, 25 bp, mus musculus
cagatcatcccacggggagcaggtc

SEQ ID NO: 56124 - DNA, 25 bp, mus musculus
agatcatcccacggggagcaggtcc

SEQ ID NO: 56125 - DNA, 25 bp, mus musculus
agctgcatccgcagtcacggagccc

SEQ ID NO: 56126 - DNA, 25 bp, mus musculus
atccgcagtcacggagcccctcaag

SEQ ID NO: 56127 - DNA, 25 bp, mus musculus
ggctctcacgggagagattaagatc

SEQ ID NO: 56128 - DNA, 25 bp, mus musculus
gagattaagatcacccacggggaat

SEQ ID NO: 56129 - DNA, 25 bp, mus musculus
gattaagatcacccacggggaatat

SEQ ID NO: 56130 - DNA, 25 bp, mus musculus
ttaagatcacccacggggaatattg

SEQ ID NO: 56131 - DNA, 25 bp, mus musculus
taagatcacccacggggaatattgg

SEQ ID NO: 56132 - DNA, 25 bp, mus musculus
atattgggacgtactgctgggccct

SEQ ID NO: 56133 - DNA, 25 bp, mus musculus
tattgggacgtactgctgggccctg

SEQ ID NO: 56134 - DNA, 25 bp, mus musculus
ggacgtactgctgggccctggacgc

SEQ ID NO: 56135 - DNA, 25 bp, mus musculus
gacgtactgctgggccctggacgca

SEQ ID NO: 56136 - DNA, 25 bp, mus musculus
cgtactgctgggccctggacgcaaa

SEQ ID NO: 56137 - DNA, 25 bp, mus musculus
tccgcagtcacggagcccctcaagg

SEQ ID NO: 56138 - DNA, 25 bp, mus musculus
ccgcagtcacggagcccctcaagga

SEQ ID NO: 56139 - DNA, 25 bp, mus musculus
gcagtcacggagcccctcaaggact

SEQ ID NO: 56140 - DNA, 25 bp, mus musculus
cagtcacggagcccctcaaggactc

SEQ ID NO: 56141 - DNA, 25 bp, mus musculus
agtcacggagcccctcaaggactct

SEQ ID NO: 56142 - DNA, 25 bp, mus musculus
gtcacggagcccctcaaggactctg

SEQ ID NO: 56143 - DNA, 25 bp, mus musculus
agcgggctctcacgggagagattaa

SEQ ID NO: 56144 - DNA, 25 bp, mus musculus
cgggctctcacgggagagattaaga

SEQ ID NO: 56145 - DNA, 25 bp, mus musculus
tccagaccgtgggccatgtggtcaa

SEQ ID NO: 56146 - DNA, 25 bp, mus musculus
ccgtgggccatgtggtcaaagccct

SEQ ID NO: 56147 - DNA, 25 bp, mus musculus
gttccatccaggataaaggctccat

SEQ ID NO: 56148 - DNA, 25 bp, mus musculus
gctccattcagaagtttgtgcccta

SEQ ID NO: 56149 - DNA, 25 bp, mus musculus
agtttgtgccctacctcatagcagg

SEQ ID NO: 56150 - DNA, 25 bp, mus musculus
tgccctacctcatagcagggatcca

SEQ ID NO: 56151 - DNA, 25 bp, mus musculus
acctcatagcagggatccagcatgg

SEQ ID NO: 56152 - DNA, 25 bp, mus musculus
ggatccagcatggctgccaggatat

SEQ ID NO: 56153 - DNA, 25 bp, mus musculus
ctgtcctgcgatccatgatgtactc

SEQ ID NO: 56154 - DNA, 25 bp, mus musculus
ggaccatgtcggcccagattgaggg

SEQ ID NO: 56155 - DNA, 25 bp, mus musculus
tgcacggcctacactcttacgaaaa

SEQ ID NO: 56156 - DNA, 25 bp, mus musculus
gcctacactcttacgaaaagcggct

SEQ ID NO: 56157 - DNA, 25 bp, mus musculus
tggtcaaagccctggcacttggagc

SEQ ID NO: 56158 - DNA, 25 bp, mus musculus
ctcttacgaaaagcggctgtactga

SEQ ID NO: 56159 - DNA, 25 bp, mus musculus
aagccctggcacttggagcctctac

SEQ ID NO: 56160 - DNA, 25 bp, mus musculus
tggcacttggagcctctacagtaat

SEQ ID NO: 56161 - DNA, 25 bp, mus musculus
ttggagcctctacagtaatgatggg

SEQ ID NO: 56162 - DNA, 25 bp, mus musculus
ccacggaggcgcctggtgaatactt

SEQ ID NO: 56163 - DNA, 25 bp, mus musculus
gcattggttctctggacgccatgga

SEQ ID NO: 56164 - DNA, 25 bp, mus musculus
tcgcacaaggtgtctccggttccat

SEQ ID NO: 56165 - DNA, 25 bp, mus musculus
tctccggttccatccaggataaagg

SEQ ID NO: 56166 - DNA, 25 bp, mus musculus
tggccctgtcagctgtaaagccagg

SEQ ID NO: 56167 - DNA, 25 bp, mus musculus
ctgtaaagccaggagaccgggtgct

SEQ ID NO: 56168 - DNA, 25 bp, mus musculus
ccacatttgccagccatgtgcaacc

SEQ ID NO: 56169 - DNA, 25 bp, mus musculus
gccatgtgcaaccaggccaatatgt

SEQ ID NO: 56170 - DNA, 25 bp, mus musculus
tgcaaccaggccaatatgtgctggt

SEQ ID NO: 56171 - DNA, 25 bp, mus musculus
aatatgtgctggtatcaggggtacc

SEQ ID NO: 56172 - DNA, 25 bp, mus musculus
tccagcctgctcgggtggcagctgt

SEQ ID NO: 56173 - DNA, 25 bp, mus musculus
cctatgctcctctcacaaggcatgg

SEQ ID NO: 56174 - DNA, 25 bp, mus musculus
atgtggtggcctcctgctttgcagc

SEQ ID NO: 56175 - DNA, 25 bp, mus musculus
tgcgactgtttcccagtttggcatg

SEQ ID NO: 56176 - DNA, 25 bp, mus musculus
gctggaccccaagtgagggtgttca

SEQ ID NO: 56177 - DNA, 25 bp, mus musculus
accctcagatgctctaccgcctggg

SEQ ID NO: 56178 - DNA, 25 bp, mus musculus
ccaccttcagtgatgtgcttatttt

SEQ ID NO: 56179 - DNA, 25 bp, mus musculus
atgtgcttattttcctggaccgcga

SEQ ID NO: 56180 - DNA, 25 bp, mus musculus
accgcgagccaaaccggctgagagc

SEQ ID NO: 56181 - DNA, 25 bp, mus musculus
agccaaaccggctgagagctttcca

SEQ ID NO: 56182 - DNA, 25 bp, mus musculus
accggctgagagctttccaggtcat

SEQ ID NO: 56183 - DNA, 25 bp, mus musculus
aggtcatcgagactcaggatcctcc

SEQ ID NO: 56184 - DNA, 25 bp, mus musculus
tgctcttcattgcggacaatcatac

SEQ ID NO: 56185 - DNA, 25 bp, mus musculus
atcatacagaaccagcagcccactt

SEQ ID NO: 56186 - DNA, 25 bp, mus musculus
aaatcgtatgcggctatctattcca

SEQ ID NO: 56187 - DNA, 25 bp, mus musculus
gcggctatctattccagttgtctct

SEQ ID NO: 56188 - DNA, 25 bp, mus musculus
tgctcagtgggacctgtacagggat

SEQ ID NO: 56189 - DNA, 25 bp, mus musculus
gaatttcagccaccttgtgttcctg

SEQ ID NO: 56190 - DNA, 25 bp, mus musculus
cctgggtcttgctgtctctaagcca

SEQ ID NO: 56191 - DNA, 25 bp, mus musculus
gggtcttgctgtctctaagccattc

SEQ ID NO: 56192 - DNA, 25 bp, mus musculus
ctctaagccattcctggtgacattt

SEQ ID NO: 56193 - DNA, 25 bp, mus musculus
gccattcctggtgacatttctggag

SEQ ID NO: 56194 - DNA, 25 bp, mus musculus
attcctggtgacatttctggagcaa

SEQ ID NO: 56195 - DNA, 25 bp, mus musculus
gcaaatacaagggccttgggacatg

SEQ ID NO: 56196 - DNA, 25 bp, mus musculus
aatacaagggccttgggacatgaag

SEQ ID NO: 56197 - DNA, 25 bp, mus musculus
acaagggccttgggacatgaagaga

SEQ ID NO: 56198 - DNA, 25 bp, mus musculus
gctatctattccagttgtctctgac

SEQ ID NO: 56199 - DNA, 25 bp, mus musculus
tattccagttgtctctgacaagaag

SEQ ID NO: 56200 - DNA, 25 bp, mus musculus
agttgtctctgacaagaaggaaatg

SEQ ID NO: 56201 - DNA, 25 bp, mus musculus
ggaaatgttgtccttctgggatgta

SEQ ID NO: 56202 - DNA, 25 bp, mus musculus
aatgttgtccttctgggatgtagcc

SEQ ID NO: 56203 - DNA, 25 bp, mus musculus
gttgtccttctgggatgtagccatt

SEQ ID NO: 56204 - DNA, 25 bp, mus musculus
cttctgggatgtagccattgatttc

SEQ ID NO: 56205 - DNA, 25 bp, mus musculus
tgatttctctccagaagagtgggaa

SEQ ID NO: 56206 - DNA, 25 bp, mus musculus
tatgacatttacctacaatggccag

SEQ ID NO: 56207 - DNA, 25 bp, mus musculus
caacatcactaggaatattgaactc

SEQ ID NO: 56208 - DNA, 25 bp, mus musculus
acaccaccagtactcagagaatgat

SEQ ID NO: 56209 - DNA, 25 bp, mus musculus
gatttttgatccagtcacaagggag

SEQ ID NO: 56210 - DNA, 25 bp, mus musculus
tgatccagtcacaagggaggatctg

SEQ ID NO: 56211 - DNA, 25 bp, mus musculus
tccacggagttctcagtcactccat

SEQ ID NO: 56212 - DNA, 25 bp, mus musculus
gagttctcagtcactccataccaca

SEQ ID NO: 56213 - DNA, 25 bp, mus musculus
tcagtcactccataccacagtcaaa

SEQ ID NO: 56214 - DNA, 25 bp, mus musculus
ctcctggagcattgcgctggcacct

SEQ ID NO: 56215 - DNA, 25 bp, mus musculus
tgcgctggcacctctgtctctgatc

SEQ ID NO: 56216 - DNA, 25 bp, mus musculus
ggcacctctgtctctgatcatcttg

SEQ ID NO: 56217 - DNA, 25 bp, mus musculus
atatggactgaccaagctacggact

SEQ ID NO: 56218 - DNA, 25 bp, mus musculus
ttctcccctggagacaataccagca

SEQ ID NO: 56219 - DNA, 25 bp, mus musculus
aagactgatagtcccgtgcaaagtg

SEQ ID NO: 56220 - DNA, 25 bp, mus musculus
gatagtcccgtgcaaagtgtttctg

SEQ ID NO: 56221 - DNA, 25 bp, mus musculus
tggtacatcttccaacaccattgtg

SEQ ID NO: 56222 - DNA, 25 bp, mus musculus
gttggctaacagcacgtttatctcg

SEQ ID NO: 56223 - DNA, 25 bp, mus musculus
cacgtttatctcggctgcttaccca

SEQ ID NO: 56224 - DNA, 25 bp, mus musculus
tatctcggctgcttacccaagaggc

SEQ ID NO: 56225 - DNA, 25 bp, mus musculus
ttacccaagaggccgtgtgaccgag

SEQ ID NO: 56226 - DNA, 25 bp, mus musculus
agatactgaggtgcggctggaactc

SEQ ID NO: 56227 - DNA, 25 bp, mus musculus
tactgaggtgcggctggaactcagc

SEQ ID NO: 56228 - DNA, 25 bp, mus musculus
gccctgcgacttccctggctgtgga

SEQ ID NO: 56229 - DNA, 25 bp, mus musculus
ctgcgacttccctggctgtggaagg

SEQ ID NO: 56230 - DNA, 25 bp, mus musculus
aaggatcttctccaaccggcagtat

SEQ ID NO: 56231 - DNA, 25 bp, mus musculus
gatcttctccaaccggcagtatctg

SEQ ID NO: 56232 - DNA, 25 bp, mus musculus
ctccaaccggcagtatctgaatcac

SEQ ID NO: 56233 - DNA, 25 bp, mus musculus
gtatctgaatcaccacaagaagtac

SEQ ID NO: 56234 - DNA, 25 bp, mus musculus
tctgaatcaccacaagaagtaccag

SEQ ID NO: 56235 - DNA, 25 bp, mus musculus
gaagtaccagcatatccaccagaag

SEQ ID NO: 56236 - DNA, 25 bp, mus musculus
ccagcatatccaccagaagtcgttc

SEQ ID NO: 56237 - DNA, 25 bp, mus musculus
gcatatccaccagaagtcgttctgc

SEQ ID NO: 56238 - DNA, 25 bp, mus musculus
tgcagagctgcacatgactgagtct

SEQ ID NO: 56239 - DNA, 25 bp, mus musculus
catgactgagtctctggagagccct

SEQ ID NO: 56240 - DNA, 25 bp, mus musculus
tctggagagccctgggagtcaggcc

SEQ ID NO: 56241 - DNA, 25 bp, mus musculus
gagtcaggcccagtctgctccgaat

SEQ ID NO: 56242 - DNA, 25 bp, mus musculus
ccagtctgctccgaatccgacttgg

SEQ ID NO: 56243 - DNA, 25 bp, mus musculus
tgaggatactgcccagattgggctc

SEQ ID NO: 56244 - DNA, 25 bp, mus musculus
ggatactgcccagattgggctcagg

SEQ ID NO: 56245 - DNA, 25 bp, mus musculus
tgcccagattgggctcaggagaatt

SEQ ID NO: 56246 - DNA, 25 bp, mus musculus
ttgtgcagtgcctgtagtaccttgc

SEQ ID NO: 56247 - DNA, 25 bp, mus musculus
agtgcctgtagtaccttgctccaaa

SEQ ID NO: 56248 - DNA, 25 bp, mus musculus
aggccaatttctatttcatatctaa

SEQ ID NO: 56249 - DNA, 25 bp, mus musculus
atttctatttcatatctaacatgta

SEQ ID NO: 56250 - DNA, 25 bp, mus musculus
atttcatatctaacatgtatatata

SEQ ID NO: 56251 - DNA, 25 bp, mus musculus
atatgatctctgtacacataaattt

SEQ ID NO: 56252 - DNA, 25 bp, mus musculus
tgtgtgtatatccacctgcctataa

SEQ ID NO: 56253 - DNA, 25 bp, mus musculus
gctatacataatcacacacatacat

SEQ ID NO: 56254 - DNA, 25 bp, mus musculus
cataatcacacacatacatctttca

SEQ ID NO: 56255 - DNA, 25 bp, mus musculus
cacacacatacatctttcagtagtc

SEQ ID NO: 56256 - DNA, 25 bp, mus musculus
catacatctttcagtagtcattggc

SEQ ID NO: 56257 - DNA, 25 bp, mus musculus
tctttcagtagtcattggcaaaata

SEQ ID NO: 56258 - DNA, 25 bp, mus musculus
tgtagtaccttgctccaaatggatc

SEQ ID NO: 56259 - DNA, 25 bp, mus musculus
ttccatttgtgaattccctttagag

SEQ ID NO: 56260 - DNA, 25 bp, mus musculus
accttgctccaaatggatcaccctg

SEQ ID NO: 56261 - DNA, 25 bp, mus musculus
ctccaaatggatcaccctgcaaatc

SEQ ID NO: 56262 - DNA, 25 bp, mus musculus
atggatcaccctgcaaatcattaat

SEQ ID NO: 56263 - DNA, 25 bp, mus musculus
aatttcactatttctcagacttcca

SEQ ID NO: 56264 - DNA, 25 bp, mus musculus
actatttctcagacttccaaaagtg

SEQ ID NO: 56265 - DNA, 25 bp, mus musculus
tctcagacttccaaaagtgaaaggc

SEQ ID NO: 56266 - DNA, 25 bp, mus musculus
taacattcacatttagagaggccaa

SEQ ID NO: 56267 - DNA, 25 bp, mus musculus
tccgggttcctgcagccatcagtcc

SEQ ID NO: 56268 - DNA, 25 bp, mus musculus
gggttcctgcagccatcagtccata

SEQ ID NO: 56269 - DNA, 25 bp, mus musculus
ctggaagctacagccttgagagctg

SEQ ID NO: 56270 - DNA, 25 bp, mus musculus
gaagctacagccttgagagctgcag

SEQ ID NO: 56271 - DNA, 25 bp, mus musculus
gccttgagagctgcaggcttgtaga

SEQ ID NO: 56272 - DNA, 25 bp, mus musculus
agctaagtaccgtgcagcttccctc

SEQ ID NO: 56273 - DNA, 25 bp, mus musculus
taagtaccgtgcagcttccctctac

SEQ ID NO: 56274 - DNA, 25 bp, mus musculus
gtaccgtgcagcttccctctacgtg

SEQ ID NO: 56275 - DNA, 25 bp, mus musculus
ccgtgcagcttccctctacgtgggt

SEQ ID NO: 56276 - DNA, 25 bp, mus musculus
tgcagcttccctctacgtgggtgac

SEQ ID NO: 56277 - DNA, 25 bp, mus musculus
tgacctccacgaagatgtcacggag

SEQ ID NO: 56278 - DNA, 25 bp, mus musculus
cctccacgaagatgtcacggaggac

SEQ ID NO: 56279 - DNA, 25 bp, mus musculus
ttcctgcagccatcagtccataacc

SEQ ID NO: 56280 - DNA, 25 bp, mus musculus
ctgcagccatcagtccataacctgg

SEQ ID NO: 56281 - DNA, 25 bp, mus musculus
cagccatcagtccataacctggaag

SEQ ID NO: 56282 - DNA, 25 bp, mus musculus
ccatcagtccataacctggaagcta

SEQ ID NO: 56283 - DNA, 25 bp, mus musculus
tcagtccataacctggaagctacag

SEQ ID NO: 56284 - DNA, 25 bp, mus musculus
gtccataacctggaagctacagcct

SEQ ID NO: 56285 - DNA, 25 bp, mus musculus
cataacctggaagctacagccttga

SEQ ID NO: 56286 - DNA, 25 bp, mus musculus
aacctggaagctacagccttgagag

SEQ ID NO: 56287 - DNA, 25 bp, mus musculus
ggacaacactgtggacctgcagcgc

SEQ ID NO: 56288 - DNA, 25 bp, mus musculus
tgtggacctgcagcgcgcagaggtc

SEQ ID NO: 56289 - DNA, 25 bp, mus musculus
ggtttaccctcggaagctcagcagc

SEQ ID NO: 56290 - DNA, 25 bp, mus musculus
gaagctcagcagctggagcgaagcc

SEQ ID NO: 56291 - DNA, 25 bp, mus musculus
gctcagcagctggagcgaagcctgg

SEQ ID NO: 56292 - DNA, 25 bp, mus musculus
gaagacagccttggtgacttcagtg

SEQ ID NO: 56293 - DNA, 25 bp, mus musculus
gacagccttggtgacttcagtggct

SEQ ID NO: 56294 - DNA, 25 bp, mus musculus
ggtgacttcagtggctacggtgctg

SEQ ID NO: 56295 - DNA, 25 bp, mus musculus
accagctcttgaagactgcgaggtg

SEQ ID NO: 56296 - DNA, 25 bp, mus musculus
agctcttgaagactgcgaggtgacg

SEQ ID NO: 56297 - DNA, 25 bp, mus musculus
agactgcgaggtgacgcctgtgaca

SEQ ID NO: 56298 - DNA, 25 bp, mus musculus
cgaggtgacgcctgtgacagacgcc

SEQ ID NO: 56299 - DNA, 25 bp, mus musculus
gcccacgttgacagtggagtgcaac

SEQ ID NO: 56300 - DNA, 25 bp, mus musculus
gcggaacagattccaccatggcctc

SEQ ID NO: 56301 - DNA, 25 bp, mus musculus
gtacaccctgcaggtcaaccagagc

SEQ ID NO: 56302 - DNA, 25 bp, mus musculus
ggtcaaccagagctcccgctcagag

SEQ ID NO: 56303 - DNA, 25 bp, mus musculus
ccgctcagagccacaggaatacaat

SEQ ID NO: 56304 - DNA, 25 bp, mus musculus
ctcagagccacaggaatacaatgtc

SEQ ID NO: 56305 - DNA, 25 bp, mus musculus
catctccttccgggtcaagtcgagg

SEQ ID NO: 56306 - DNA, 25 bp, mus musculus
cttccgggtcaagtcgaggtcagag

SEQ ID NO: 56307 - DNA, 25 bp, mus musculus
ttgcagtctctgtaagggcgtttgt

SEQ ID NO: 56308 - DNA, 25 bp, mus musculus
gcagtctctgtaagggcgtttgtag

SEQ ID NO: 56309 - DNA, 25 bp, mus musculus
tcctgcattatggagcgaagacaac

SEQ ID NO: 56310 - DNA, 25 bp, mus musculus
agacaacgattctatactggcttaa

SEQ ID NO: 56311 - DNA, 25 bp, mus musculus
aacgattctatactggcttaacctg

SEQ ID NO: 56312 - DNA, 25 bp, mus musculus
cgattctatactggcttaacctgtg

SEQ ID NO: 56313 - DNA, 25 bp, mus musculus
tctatactggcttaacctgtgcgag

SEQ ID NO: 56314 - DNA, 25 bp, mus musculus
tatactggcttaacctgtgcgagat

SEQ ID NO: 56315 - DNA, 25 bp, mus musculus
ctggcttaacctgtgcgagattgtg

SEQ ID NO: 56316 - DNA, 25 bp, mus musculus
ggcttaacctgtgcgagattgtgac

SEQ ID NO: 56317 - DNA, 25 bp, mus musculus
taacctgtgcgagattgtgaccacc

SEQ ID NO: 56318 - DNA, 25 bp, mus musculus
gattgtgaccaccatttccaacata

SEQ ID NO: 56319 - DNA, 25 bp, mus musculus
tctctgtaagggcgtttgtagcaag

SEQ ID NO: 56320 - DNA, 25 bp, mus musculus
gatgtgcatactcacggtattcctg

SEQ ID NO: 56321 - DNA, 25 bp, mus musculus
tgtgcatactcacggtattcctgca

SEQ ID NO: 56322 - DNA, 25 bp, mus musculus
catactcacggtattcctgcattat

SEQ ID NO: 56323 - DNA, 25 bp, mus musculus
tactcacggtattcctgcattatgg

SEQ ID NO: 56324 - DNA, 25 bp, mus musculus
cacggtattcctgcattatggagcg

SEQ ID NO: 56325 - DNA, 25 bp, mus musculus
cggtattcctgcattatggagcgaa

SEQ ID NO: 56326 - DNA, 25 bp, mus musculus
attcctgcattatggagcgaagaca

SEQ ID NO: 56327 - DNA, 25 bp, mus musculus
gtccggtctacttcagcctaagcta

SEQ ID NO: 56328 - DNA, 25 bp, mus musculus
agagcgcagtccttgtgatcatctg

SEQ ID NO: 56329 - DNA, 25 bp, mus musculus
cctgtgatcctacccaggcactaag

SEQ ID NO: 56330 - DNA, 25 bp, mus musculus
gtgatcctacccaggcactaaggat

SEQ ID NO: 56331 - DNA, 25 bp, mus musculus
atcctacccaggcactaaggatcgt

SEQ ID NO: 56332 - DNA, 25 bp, mus musculus
ctacccaggcactaaggatcgtgtc

SEQ ID NO: 56333 - DNA, 25 bp, mus musculus
cactaaggatcgtgtcctgaattca

SEQ ID NO: 56334 - DNA, 25 bp, mus musculus
ggatcgtgtcctgaattcatgtcca

SEQ ID NO: 56335 - DNA, 25 bp, mus musculus
tcgtgtcctgaattcatgtccacca

SEQ ID NO: 56336 - DNA, 25 bp, mus musculus
tgtcctgaattcatgtccaccaaat

SEQ ID NO: 56337 - DNA, 25 bp, mus musculus
gaattcatgtccaccaaattcgggt

SEQ ID NO: 56338 - DNA, 25 bp, mus musculus
ttcatgtccaccaaattcgggtgcc

SEQ ID NO: 56339 - DNA, 25 bp, mus musculus
gcgcagtccttgtgatcatctgccc

SEQ ID NO: 56340 - DNA, 25 bp, mus musculus
ggtattcgtggcatgttgggaatca

SEQ ID NO: 56341 - DNA, 25 bp, mus musculus
attcgtggcatgttgggaatcatgg

SEQ ID NO: 56342 - DNA, 25 bp, mus musculus
atcatggtcattcgacggacgactt

SEQ ID NO: 56343 - DNA, 25 bp, mus musculus
atggtcattcgacggacgacttctc

SEQ ID NO: 56344 - DNA, 25 bp, mus musculus
gtcattcgacggacgacttctccgt

SEQ ID NO: 56345 - DNA, 25 bp, mus musculus
ccgttgcctgtgatcctacccaggc

SEQ ID NO: 56346 - DNA, 25 bp, mus musculus
ttgcctgtgatcctacccaggcact

SEQ ID NO: 56347 - DNA, 25 bp, mus musculus
gcctattgctacaacccacatgcaa

SEQ ID NO: 56348 - DNA, 25 bp, mus musculus
tgctacaacccacatgcaaaggagt

SEQ ID NO: 56349 - DNA, 25 bp, mus musculus
gatgacaaccaggtctgctactggc

SEQ ID NO: 56350 - DNA, 25 bp, mus musculus
gacaaccaggtctgctactggcaca

SEQ ID NO: 56351 - DNA, 25 bp, mus musculus
aaccaggtctgctactggcacattc

SEQ ID NO: 56352 - DNA, 25 bp, mus musculus
caggtctgctactggcacattcggc

SEQ ID NO: 56353 - DNA, 25 bp, mus musculus
gtctgctactggcacattcggctca

SEQ ID NO: 56354 - DNA, 25 bp, mus musculus
tactggcacattcggctcaagtacg

SEQ ID NO: 56355 - DNA, 25 bp, mus musculus
tggcacattcggctcaagtacggtc

SEQ ID NO: 56356 - DNA, 25 bp, mus musculus
cacattcggctcaagtacggtcagc

SEQ ID NO: 56357 - DNA, 25 bp, mus musculus
cggctcaagtacggtcagcgaattc

SEQ ID NO: 56358 - DNA, 25 bp, mus musculus
cgaattcacctgagctttttggact

SEQ ID NO: 56359 - DNA, 25 bp, mus musculus
tacaacccacatgcaaaggagtgtg

SEQ ID NO: 56360 - DNA, 25 bp, mus musculus
aacccacatgcaaaggagtgtggtg

SEQ ID NO: 56361 - DNA, 25 bp, mus musculus
ggtgtcttcacagatccgaagcgaa

SEQ ID NO: 56362 - DNA, 25 bp, mus musculus
gtcttcacagatccgaagcgaattt

SEQ ID NO: 56363 - DNA, 25 bp, mus musculus
ttcacagatccgaagcgaattttta

SEQ ID NO: 56364 - DNA, 25 bp, mus musculus
ggcttcccaaatgagtacgatgaca

SEQ ID NO: 56365 - DNA, 25 bp, mus musculus
ttcccaaatgagtacgatgacaacc

SEQ ID NO: 56366 - DNA, 25 bp, mus musculus
tacgatgacaaccaggtctgctact

SEQ ID NO: 56367 - DNA, 25 bp, mus musculus
caaccttagcatcctttctcctagc

SEQ ID NO: 56368 - DNA, 25 bp, mus musculus
tagcatcctttctcctagccccttt

SEQ ID NO: 56369 - DNA, 25 bp, mus musculus
gcctctgtgcctggagcagctggat

SEQ ID NO: 56370 - DNA, 25 bp, mus musculus
tctgtgcctggagcagctggatttt

SEQ ID NO: 56371 - DNA, 25 bp, mus musculus
aatgagagccagccacatgctgggc

SEQ ID NO: 56372 - DNA, 25 bp, mus musculus
cagccacatgctgggccttacttct

SEQ ID NO: 56373 - DNA, 25 bp, mus musculus
ccacatgctgggccttacttctccg

SEQ ID NO: 56374 - DNA, 25 bp, mus musculus
catgctgggccttacttctccgtgt

SEQ ID NO: 56375 - DNA, 25 bp, mus musculus
catgccaacagaaagcataaaatgg

SEQ ID NO: 56376 - DNA, 25 bp, mus musculus
ttcaggtatcagggtcactggagaa

SEQ ID NO: 56377 - DNA, 25 bp, mus musculus
aggtatcagggtcactggagaagcc

SEQ ID NO: 56378 - DNA, 25 bp, mus musculus
cagtttactccaggaaaaacagatg

SEQ ID NO: 56379 - DNA, 25 bp, mus musculus
ttctcctagcccctttagatagatg

SEQ ID NO: 56380 - DNA, 25 bp, mus musculus
tcctagcccctttagatagatgata

SEQ ID NO: 56381 - DNA, 25 bp, mus musculus
acttaatgactctcttgctgaggga

SEQ ID NO: 56382 - DNA, 25 bp, mus musculus
gggatgccacaccggggcttcctgc

SEQ ID NO: 56383 - DNA, 25 bp, mus musculus
ggcttcctgctcctatctaacttca

SEQ ID NO: 56384 - DNA, 25 bp, mus musculus
atacccactagtcaatctctcctca

SEQ ID NO: 56385 - DNA, 25 bp, mus musculus
acttttcttatgtcctatgtatgaa

SEQ ID NO: 56386 - DNA, 25 bp, mus musculus
ctgtgccatgactgtgcctctgtgc

SEQ ID NO: 56387 - DNA, 25 bp, mus musculus
tcaccgcgccgaattgcacgcggaa

SEQ ID NO: 56388 - DNA, 25 bp, mus musculus
cgcgccgaattgcacgcggaaaacg

SEQ ID NO: 56389 - DNA, 25 bp, mus musculus
ccgaatcgatcttggctttgagcgt

SEQ ID NO: 56390 - DNA, 25 bp, mus musculus
gaatcgatcttggctttgagcgtcg

SEQ ID NO: 56391 - DNA, 25 bp, mus musculus
agcgtcgtcgcgttgaagggcttga

SEQ ID NO: 56392 - DNA, 25 bp, mus musculus
cgtcgtcgcgttgaagggcttgacg

SEQ ID NO: 56393 - DNA, 25 bp, mus musculus
tcgtcgcgttgaagggcttgacgat

SEQ ID NO: 56394 - DNA, 25 bp, mus musculus
cggtcttcgattccgcagtgaccat

SEQ ID NO: 56395 - DNA, 25 bp, mus musculus
gtcttcgattccgcagtgaccatga

SEQ ID NO: 56396 - DNA, 25 bp, mus musculus
cttcgattccgcagtgaccatgatg

SEQ ID NO: 56397 - DNA, 25 bp, mus musculus
tcgattccgcagtgaccatgatgaa

SEQ ID NO: 56398 - DNA, 25 bp, mus musculus
ttccgcagtgaccatgatgaaagga

SEQ ID NO: 56399 - DNA, 25 bp, mus musculus
cgttgaatgccgctgccttccatca

SEQ ID NO: 56400 - DNA, 25 bp, mus musculus
ttgaatgccgctgccttccatcagt

SEQ ID NO: 56401 - DNA, 25 bp, mus musculus
atgccgctgccttccatcagttctt

SEQ ID NO: 56402 - DNA, 25 bp, mus musculus
gccgctgccttccatcagttcttcg

SEQ ID NO: 56403 - DNA, 25 bp, mus musculus
catcagttcttcgacaccctcggct

SEQ ID NO: 56404 - DNA, 25 bp, mus musculus
tcagttcttcgacaccctcggcttt

SEQ ID NO: 56405 - DNA, 25 bp, mus musculus
ttcttcgacaccctcggctttgcgc

SEQ ID NO: 56406 - DNA, 25 bp, mus musculus
tgatttaagcgacggcggccgtggt

SEQ ID NO: 56407 - DNA, 25 bp, mus musculus
cctcacagagccgtacccacgaaga

SEQ ID NO: 56408 - DNA, 25 bp, mus musculus
cacagagccgtacccacgaagacct

SEQ ID NO: 56409 - DNA, 25 bp, mus musculus
acagcttccaagagtgagactgcca

SEQ ID NO: 56410 - DNA, 25 bp, mus musculus
tactaggcccctatgctctgggggt

SEQ ID NO: 56411 - DNA, 25 bp, mus musculus
tagagttgacctggcttggagtctg

SEQ ID NO: 56412 - DNA, 25 bp, mus musculus
tctgagtcctggctgtctgcctctg

SEQ ID NO: 56413 - DNA, 25 bp, mus musculus
tgtgcacacgcgtgcacatgctcgt

SEQ ID NO: 56414 - DNA, 25 bp, mus musculus
tataggatgtgccctacaggataag

SEQ ID NO: 56415 - DNA, 25 bp, mus musculus
aggatgtgccctacaggataagcct

SEQ ID NO: 56416 - DNA, 25 bp, mus musculus
tgccctacaggataagcctgagcct

SEQ ID NO: 56417 - DNA, 25 bp, mus musculus
taagcctgagccttctcgtgcccat

SEQ ID NO: 56418 - DNA, 25 bp, mus musculus
tgagccttctcgtgcccatgatggg

SEQ ID NO: 56419 - DNA, 25 bp, mus musculus
gccgtacccacgaagacctcttcat

SEQ ID NO: 56420 - DNA, 25 bp, mus musculus
gtacccacgaagacctcttcatcat

SEQ ID NO: 56421 - DNA, 25 bp, mus musculus
caaactgtgaccgcaacggcaactt

SEQ ID NO: 56422 - DNA, 25 bp, mus musculus
actgtgaccgcaacggcaacttcca

SEQ ID NO: 56423 - DNA, 25 bp, mus musculus
ccctggacggacagcgtggcaagtg

SEQ ID NO: 56424 - DNA, 25 bp, mus musculus
agctggactgccaccagctggctga

SEQ ID NO: 56425 - DNA, 25 bp, mus musculus
tggactgccaccagctggctgacag

SEQ ID NO: 56426 - DNA, 25 bp, mus musculus
tggctgacagcttccaagagtgaga

SEQ ID NO: 56427 - DNA, 25 bp, mus musculus
catcatggtcgtctttacacctctg

SEQ ID NO: 56428 - DNA, 25 bp, mus musculus
atcatggtcgtctttacacctctgc

SEQ ID NO: 56429 - DNA, 25 bp, mus musculus
gtagctctaccacggctgtaccaga

SEQ ID NO: 56430 - DNA, 25 bp, mus musculus
tagctctaccacggctgtaccagag

SEQ ID NO: 56431 - DNA, 25 bp, mus musculus
taccacggctgtaccagagaccctg

SEQ ID NO: 56432 - DNA, 25 bp, mus musculus
cacggctgtaccagagaccctgatc

SEQ ID NO: 56433 - DNA, 25 bp, mus musculus
cggctgtaccagagaccctgatcgg

SEQ ID NO: 56434 - DNA, 25 bp, mus musculus
ggctgtaccagagaccctgatcggg

SEQ ID NO: 56435 - DNA, 25 bp, mus musculus
ctgtaccagagaccctgatcggggc

SEQ ID NO: 56436 - DNA, 25 bp, mus musculus
tgtaccagagaccctgatcggggct

SEQ ID NO: 56437 - DNA, 25 bp, mus musculus
taccagagaccctgatcggggctga

SEQ ID NO: 56438 - DNA, 25 bp, mus musculus
tggatgctctgagatcgtgtgtgga

SEQ ID NO: 56439 - DNA, 25 bp, mus musculus
catggtcgtctttacacctctgcga

SEQ ID NO: 56440 - DNA, 25 bp, mus musculus
ggatgctctgagatcgtgtgtggac

SEQ ID NO: 56441 - DNA, 25 bp, mus musculus
atggtcgtctttacacctctgcgac

SEQ ID NO: 56442 - DNA, 25 bp, mus musculus
ggtcgtctttacacctctgcgacgt

SEQ ID NO: 56443 - DNA, 25 bp, mus musculus
cgtctttacacctctgcgacgtggc

SEQ ID NO: 56444 - DNA, 25 bp, mus musculus
tttacacctctgcgacgtggcgctc

SEQ ID NO: 56445 - DNA, 25 bp, mus musculus
gctcaccttcagtagctctaccacg

SEQ ID NO: 56446 - DNA, 25 bp, mus musculus
tcaccttcagtagctctaccacggc

SEQ ID NO: 56447 - DNA, 25 bp, mus musculus
tcagtagctctaccacggctgtacc

SEQ ID NO: 56448 - DNA, 25 bp, mus musculus
aaggctgtgcagacctctagactac

SEQ ID NO: 56449 - DNA, 25 bp, mus musculus
ctgtgcagacctctagactactgac

SEQ ID NO: 56450 - DNA, 25 bp, mus musculus
ctgactagggacctgacaggactgg

SEQ ID NO: 56451 - DNA, 25 bp, mus musculus
ctagggacctgacaggactggtcac

SEQ ID NO: 56452 - DNA, 25 bp, mus musculus
ggacctgacaggactggtcacgcag

SEQ ID NO: 56453 - DNA, 25 bp, mus musculus
ctgacaggactggtcacgcagtctg

SEQ ID NO: 56454 - DNA, 25 bp, mus musculus
cccctgtaagcccagagtccatcag

SEQ ID NO: 56455 - DNA, 25 bp, mus musculus
cctgtaagcccagagtccatcagtt

SEQ ID NO: 56456 - DNA, 25 bp, mus musculus
cactacacctccagagtacaaagca

SEQ ID NO: 56457 - DNA, 25 bp, mus musculus
acacctccagagtacaaagcactat

SEQ ID NO: 56458 - DNA, 25 bp, mus musculus
acctccagagtacaaagcactattt

SEQ ID NO: 56459 - DNA, 25 bp, mus musculus
agaacagaatacccttctctctcct

SEQ ID NO: 56460 - DNA, 25 bp, mus musculus
gtgcagacctctagactactgacta

SEQ ID NO: 56461 - DNA, 25 bp, mus musculus
aacagaatacccttctctctcctct

SEQ ID NO: 56462 - DNA, 25 bp, mus musculus
gcagacctctagactactgactagg

SEQ ID NO: 56463 - DNA, 25 bp, mus musculus
agacctctagactactgactaggga

SEQ ID NO: 56464 - DNA, 25 bp, mus musculus
ctctagactactgactagggacctg

SEQ ID NO: 56465 - DNA, 25 bp, mus musculus
ctagactactgactagggacctgac

SEQ ID NO: 56466 - DNA, 25 bp, mus musculus
agactactgactagggacctgacag

SEQ ID NO: 56467 - DNA, 25 bp, mus musculus
actactgactagggacctgacagga

SEQ ID NO: 56468 - DNA, 25 bp, mus musculus
tactgactagggacctgacaggact

SEQ ID NO: 56469 - DNA, 25 bp, mus musculus
aaatccctgggtctctggagactag

SEQ ID NO: 56470 - DNA, 25 bp, mus musculus
tatttatactctggagcacaccatt

SEQ ID NO: 56471 - DNA, 25 bp, mus musculus
caaagttctgctttgaaagggcagc

SEQ ID NO: 56472 - DNA, 25 bp, mus musculus
ggcccactcggaattcctcatcgtc

SEQ ID NO: 56473 - DNA, 25 bp, mus musculus
ctcggaattcctcatcgtctcacac

SEQ ID NO: 56474 - DNA, 25 bp, mus musculus
attcctcatcgtctcacacagatct

SEQ ID NO: 56475 - DNA, 25 bp, mus musculus
catcgtctcacacagatctgtgtct

SEQ ID NO: 56476 - DNA, 25 bp, mus musculus
tgatgcacatttgctgggaaagttc

SEQ ID NO: 56477 - DNA, 25 bp, mus musculus
aaagttccgatgctgattgtgtaac

SEQ ID NO: 56478 - DNA, 25 bp, mus musculus
agctgcgtcccatacattgttaaat

SEQ ID NO: 56479 - DNA, 25 bp, mus musculus
gtcccatacattgttaaatacacat

SEQ ID NO: 56480 - DNA, 25 bp, mus musculus
gttaaatacacatctggaataaata

SEQ ID NO: 56481 - DNA, 25 bp, mus musculus
tatatatccaggaactagtttttat

SEQ ID NO: 56482 - DNA, 25 bp, mus musculus
tttttatactccacatacttcttga

SEQ ID NO: 56483 - DNA, 25 bp, mus musculus
tactccacatacttcttgatgtaca

SEQ ID NO: 56484 - DNA, 25 bp, mus musculus
acatacttcttgatgtacaagtggg

SEQ ID NO: 56485 - DNA, 25 bp, mus musculus
ctcatctctctcgtacatgtaaata

SEQ ID NO: 56486 - DNA, 25 bp, mus musculus
gtaaatactatatctcagctcttgc

SEQ ID NO: 56487 - DNA, 25 bp, mus musculus
actatatctcagctcttgcaaagtt

SEQ ID NO: 56488 - DNA, 25 bp, mus musculus
tctcagctcttgcaaagttctgctt

SEQ ID NO: 56489 - DNA, 25 bp, mus musculus
atgatgagatcctgtctcctcgtcc

SEQ ID NO: 56490 - DNA, 25 bp, mus musculus
tgatgagatcctgtctcctcgtccg

SEQ ID NO: 56491 - DNA, 25 bp, mus musculus
cgtacccagctttatgatcagtggc

SEQ ID NO: 56492 - DNA, 25 bp, mus musculus
gtacccagctttatgatcagtggcg

SEQ ID NO: 56493 - DNA, 25 bp, mus musculus
acccagctttatgatcagtggcgca

SEQ ID NO: 56494 - DNA, 25 bp, mus musculus
cccagctttatgatcagtggcgcac

SEQ ID NO: 56495 - DNA, 25 bp, mus musculus
tcaaatcactctgcaggatgtccga

SEQ ID NO: 56496 - DNA, 25 bp, mus musculus
caaatcactctgcaggatgtccgag

SEQ ID NO: 56497 - DNA, 25 bp, mus musculus
aaatcactctgcaggatgtccgaga

SEQ ID NO: 56498 - DNA, 25 bp, mus musculus
atcactctgcaggatgtccgagaat

SEQ ID NO: 56499 - DNA, 25 bp, mus musculus
cactctgcaggatgtccgagaatct

SEQ ID NO: 56500 - DNA, 25 bp, mus musculus
tgtccgagaatctgtcatcttcttc

SEQ ID NO: 56501 - DNA, 25 bp, mus musculus
atgagatcctgtctcctcgtccgta

SEQ ID NO: 56502 - DNA, 25 bp, mus musculus
tccgagaatctgtcatcttcttcag

SEQ ID NO: 56503 - DNA, 25 bp, mus musculus
tgagatcctgtctcctcgtccgtac

SEQ ID NO: 56504 - DNA, 25 bp, mus musculus
gagatcctgtctcctcgtccgtacc

SEQ ID NO: 56505 - DNA, 25 bp, mus musculus
ctcctcgtccgtacccagctttatg

SEQ ID NO: 56506 - DNA, 25 bp, mus musculus
cctcgtccgtacccagctttatgat

SEQ ID NO: 56507 - DNA, 25 bp, mus musculus
tcgtccgtacccagctttatgatca

SEQ ID NO: 56508 - DNA, 25 bp, mus musculus
cgtccgtacccagctttatgatcag

SEQ ID NO: 56509 - DNA, 25 bp, mus musculus
gtccgtacccagctttatgatcagt

SEQ ID NO: 56510 - DNA, 25 bp, mus musculus
atcagtgagtccgaggaggagcaca

SEQ ID NO: 56511 - DNA, 25 bp, mus musculus
gagcacaatgctgggagtgtggaaa

SEQ ID NO: 56512 - DNA, 25 bp, mus musculus
gaatacggtccctgccgcagagaaa

SEQ ID NO: 56513 - DNA, 25 bp, mus musculus
gacacactgaatcatctgaagttcc

SEQ ID NO: 56514 - DNA, 25 bp, mus musculus
catctgaagttcctcaatgtgctga

SEQ ID NO: 56515 - DNA, 25 bp, mus musculus
ctcaatgtgctgagtcccagaggcg

SEQ ID NO: 56516 - DNA, 25 bp, mus musculus
gtgctgagtcccagaggcgtccaca

SEQ ID NO: 56517 - DNA, 25 bp, mus musculus
agaggcgtccacatcccaaactgtg

SEQ ID NO: 56518 - DNA, 25 bp, mus musculus
ccttccaaaggcagaaagcagagct

SEQ ID NO: 56519 - DNA, 25 bp, mus musculus
cgcttgccaggctacgacaccaagg

SEQ ID NO: 56520 - DNA, 25 bp, mus musculus
gacgacgtacattgcctcagcgtgc

SEQ ID NO: 56521 - DNA, 25 bp, mus musculus
gtacattgcctcagcgtgcagagcc

SEQ ID NO: 56522 - DNA, 25 bp, mus musculus
acacaccgagtgaccgattccaagt

SEQ ID NO: 56523 - DNA, 25 bp, mus musculus
gcctcagcgtgcagagccagtagat

SEQ ID NO: 56524 - DNA, 25 bp, mus musculus
cgagtgaccgattccaagttccatc

SEQ ID NO: 56525 - DNA, 25 bp, mus musculus
ccactccatgccaagatggatgtca

SEQ ID NO: 56526 - DNA, 25 bp, mus musculus
agggacagccagcgctacaaagttg

SEQ ID NO: 56527 - DNA, 25 bp, mus musculus
agccagcgctacaaagttgactatg

SEQ ID NO: 56528 - DNA, 25 bp, mus musculus
gagtctcaaagcacagacacccaga

SEQ ID NO: 56529 - DNA, 25 bp, mus musculus
caaagcacagacacccagaacttct

SEQ ID NO: 56530 - DNA, 25 bp, mus musculus
tcctccgagtctaagcgggagacag

SEQ ID NO: 56531 - DNA, 25 bp, mus musculus
ggaaacttgcctcagagagcagttc

SEQ ID NO: 56532 - DNA, 25 bp, mus musculus
tcaaatctggtggcatcacacagca

SEQ ID NO: 56533 - DNA, 25 bp, mus musculus
gctgctccaactgtgtcttgtctag

SEQ ID NO: 56534 - DNA, 25 bp, mus musculus
ccaactgtgtcttgtctagatcaga

SEQ ID NO: 56535 - DNA, 25 bp, mus musculus
actgtgtcttgtctagatcagaggt

SEQ ID NO: 56536 - DNA, 25 bp, mus musculus
gtgtcttgtctagatcagaggtgcc

SEQ ID NO: 56537 - DNA, 25 bp, mus musculus
caacaattttcttgctctgaactaa

SEQ ID NO: 56538 - DNA, 25 bp, mus musculus
caattttcttgctctgaactaagtt

SEQ ID NO: 56539 - DNA, 25 bp, mus musculus
ttttcttgctctgaactaagttctc

SEQ ID NO: 56540 - DNA, 25 bp, mus musculus
tgctctgaactaagttctctaattc

SEQ ID NO: 56541 - DNA, 25 bp, mus musculus
tctctaattcctcccagtaaggctg

SEQ ID NO: 56542 - DNA, 25 bp, mus musculus
cctcccagtaaggctgtaaatgctc

SEQ ID NO: 56543 - DNA, 25 bp, mus musculus
gcatcacacagcaggaggccaggtt

SEQ ID NO: 56544 - DNA, 25 bp, mus musculus
tcacacagcaggaggccaggttaac

SEQ ID NO: 56545 - DNA, 25 bp, mus musculus
cacagcaggaggccaggttaacttg

SEQ ID NO: 56546 - DNA, 25 bp, mus musculus
tgggttttacctgtgcccactgata

SEQ ID NO: 56547 - DNA, 25 bp, mus musculus
gttttacctgtgcccactgatacag

SEQ ID NO: 56548 - DNA, 25 bp, mus musculus
gtgcccactgatacagctgctccaa

SEQ ID NO: 56549 - DNA, 25 bp, mus musculus
gatacagctgctccaactgtgtctt

SEQ ID NO: 56550 - DNA, 25 bp, mus musculus
acagctgctccaactgtgtcttgtc

SEQ ID NO: 56551 - DNA, 25 bp, mus musculus
acgtcaaccgcagcgtgtcagacca

SEQ ID NO: 56552 - DNA, 25 bp, mus musculus
gtcaaccgcagcgtgtcagaccagt

SEQ ID NO: 56553 - DNA, 25 bp, mus musculus
accagttctatcgctacaagatgcc

SEQ ID NO: 56554 - DNA, 25 bp, mus musculus
cagttctatcgctacaagatgcccc

SEQ ID NO: 56555 - DNA, 25 bp, mus musculus
agttctatcgctacaagatgccccg

SEQ ID NO: 56556 - DNA, 25 bp, mus musculus
ttctatcgctacaagatgccccgtt

SEQ ID NO: 56557 - DNA, 25 bp, mus musculus
tctatcgctacaagatgccccgttt

SEQ ID NO: 56558 - DNA, 25 bp, mus musculus
tatcgctacaagatgccccgtttga

SEQ ID NO: 56559 - DNA, 25 bp, mus musculus
atcgctacaagatgccccgtttgat

SEQ ID NO: 56560 - DNA, 25 bp, mus musculus
cgctacaagatgccccgtttgattc

SEQ ID NO: 56561 - DNA, 25 bp, mus musculus
gctacaagatgccccgtttgattct

SEQ ID NO: 56562 - DNA, 25 bp, mus musculus
tacaagatgccccgtttgattctaa

SEQ ID NO: 56563 - DNA, 25 bp, mus musculus
aaccgcagcgtgtcagaccagttct

SEQ ID NO: 56564 - DNA, 25 bp, mus musculus
caagatgccccgtttgattctaaag

SEQ ID NO: 56565 - DNA, 25 bp, mus musculus
cgcagcgtgtcagaccagttctatc

SEQ ID NO: 56566 - DNA, 25 bp, mus musculus
gcgtgtcagaccagttctatcgcta

SEQ ID NO: 56567 - DNA, 25 bp, mus musculus
gtgtcagaccagttctatcgctaca

SEQ ID NO: 56568 - DNA, 25 bp, mus musculus
tgtcagaccagttctatcgctacaa

SEQ ID NO: 56569 - DNA, 25 bp, mus musculus
tcagaccagttctatcgctacaaga

SEQ ID NO: 56570 - DNA, 25 bp, mus musculus
cagaccagttctatcgctacaagat

SEQ ID NO: 56571 - DNA, 25 bp, mus musculus
gaccagttctatcgctacaagatgc

SEQ ID NO: 56572 - DNA, 25 bp, mus musculus
cgctctcgtgacacaaaccacagag

SEQ ID NO: 56573 - DNA, 25 bp, mus musculus
cgtgacacaaaccacagagaccggc

SEQ ID NO: 56574 - DNA, 25 bp, mus musculus
gacctcagaggcttctaccgcaagc

SEQ ID NO: 56575 - DNA, 25 bp, mus musculus
ttctaccgcaagcagcagtgtcgtt

SEQ ID NO: 56576 - DNA, 25 bp, mus musculus
ggccagcctttgccagtgtctccag

SEQ ID NO: 56577 - DNA, 25 bp, mus musculus
cctttgccagtgtctccagatggtc

SEQ ID NO: 56578 - DNA, 25 bp, mus musculus
agcactcagtgctctgccaggagca

SEQ ID NO: 56579 - DNA, 25 bp, mus musculus
cagtgctctgccaggagcagtgggt

SEQ ID NO: 56580 - DNA, 25 bp, mus musculus
tctgccaggagcagtgggtgaagcc

SEQ ID NO: 56581 - DNA, 25 bp, mus musculus
gaataactctgtgcccaagacccaa

SEQ ID NO: 56582 - DNA, 25 bp, mus musculus
ttacacagctagttagaaagattgc

SEQ ID NO: 56583 - DNA, 25 bp, mus musculus
agattgctgttggcttgtgtactaa

SEQ ID NO: 56584 - DNA, 25 bp, mus musculus
atacggcccaatcctgttcaagata

SEQ ID NO: 56585 - DNA, 25 bp, mus musculus
cccaatcctgttcaagatagtgaga

SEQ ID NO: 56586 - DNA, 25 bp, mus musculus
gattcagtactgcagcagctccaga

SEQ ID NO: 56587 - DNA, 25 bp, mus musculus
gtactgcagcagctccagactgagg

SEQ ID NO: 56588 - DNA, 25 bp, mus musculus
actgaggtcttccgaggcggagcac

SEQ ID NO: 56589 - DNA, 25 bp, mus musculus
ctctatgtgccaaactgtgacctca

SEQ ID NO: 56590 - DNA, 25 bp, mus musculus
gtgccaaactgtgacctcagaggct

SEQ ID NO: 56591 - DNA, 25 bp, mus musculus
aactgtgacctcagaggcttctacc

SEQ ID NO: 56592 - DNA, 25 bp, mus musculus
actattttgtagctctcagaagcca

SEQ ID NO: 56593 - DNA, 25 bp, mus musculus
gaagccaggactctgcaacactgtt

SEQ ID NO: 56594 - DNA, 25 bp, mus musculus
tctaccactgttagatacttctgcc

SEQ ID NO: 56595 - DNA, 25 bp, mus musculus
actgttagatacttctgccacccat

SEQ ID NO: 56596 - DNA, 25 bp, mus musculus
agatacttctgccacccatcctaag

SEQ ID NO: 56597 - DNA, 25 bp, mus musculus
cacccatcctaagagtatagttgtt

SEQ ID NO: 56598 - DNA, 25 bp, mus musculus
aaaggagtctcagctgctgtcagca

SEQ ID NO: 56599 - DNA, 25 bp, mus musculus
gtctcagctgctgtcagcaggagtc

SEQ ID NO: 56600 - DNA, 25 bp, mus musculus
gtcagcaggagtccctcattcgact

SEQ ID NO: 56601 - DNA, 25 bp, mus musculus
tcctgtggttgccctttccatcatg

SEQ ID NO: 56602 - DNA, 25 bp, mus musculus
ggttgccctttccatcatgccaaag

SEQ ID NO: 56603 - DNA, 25 bp, mus musculus
cctttccatcatgccaaagaataaa

SEQ ID NO: 56604 - DNA, 25 bp, mus musculus
aggactctgcaacactgtttgctgc

SEQ ID NO: 56605 - DNA, 25 bp, mus musculus
ctgcaacactgtttgctgcctgtgg

SEQ ID NO: 56606 - DNA, 25 bp, mus musculus
cactgtttgctgcctgtggatcttc

SEQ ID NO: 56607 - DNA, 25 bp, mus musculus
ttgctgcctgtggatcttctatatt

SEQ ID NO: 56608 - DNA, 25 bp, mus musculus
ctatattcacagtgtcccagttgct

SEQ ID NO: 56609 - DNA, 25 bp, mus musculus
tcacagtgtcccagttgcttctgat

SEQ ID NO: 56610 - DNA, 25 bp, mus musculus
agttgcttctgatctaccactgtta

SEQ ID NO: 56611 - DNA, 25 bp, mus musculus
ttctgatctaccactgttagatact

SEQ ID NO: 56612 - DNA, 25 bp, mus musculus
gcatgcctggcatctctgcctcctt

SEQ ID NO: 56613 - DNA, 25 bp, mus musculus
cctcctttcacactgcagtgctgaa

SEQ ID NO: 56614 - DNA, 25 bp, mus musculus
ctaagcatgcagacatccctctgtg

SEQ ID NO: 56615 - DNA, 25 bp, mus musculus
atgcagacatccctctgtggacttc

SEQ ID NO: 56616 - DNA, 25 bp, mus musculus
atccacctctaaagagagtcactag

SEQ ID NO: 56617 - DNA, 25 bp, mus musculus
tcactagtgaccaacagcctttctc

SEQ ID NO: 56618 - DNA, 25 bp, mus musculus
gtgaccaacagcctttctctctcct

SEQ ID NO: 56619 - DNA, 25 bp, mus musculus
ctaatcgactcctacatatatatgt

SEQ ID NO: 56620 - DNA, 25 bp, mus musculus
tatatgtcattttgtcctagcaaac

SEQ ID NO: 56621 - DNA, 25 bp, mus musculus
tgtcctagcaaacaccccttagctc

SEQ ID NO: 56622 - DNA, 25 bp, mus musculus
ttcctattccacgatgatatgcctt

SEQ ID NO: 56623 - DNA, 25 bp, mus musculus
ttccacgatgatatgccttagtgtc

SEQ ID NO: 56624 - DNA, 25 bp, mus musculus
ttcacactgcagtgctgaatctgct

SEQ ID NO: 56625 - DNA, 25 bp, mus musculus
tgccttagtgtctccccttgaattc

SEQ ID NO: 56626 - DNA, 25 bp, mus musculus
tgctgaatctgctcaaagccaacgc

SEQ ID NO: 56627 - DNA, 25 bp, mus musculus
tcaaagccaacgcagctgctggcac

SEQ ID NO: 56628 - DNA, 25 bp, mus musculus
ccaacgcagctgctggcaccactgg

SEQ ID NO: 56629 - DNA, 25 bp, mus musculus
ggcgccctctgtctttgctctacta

SEQ ID NO: 56630 - DNA, 25 bp, mus musculus
ctctgtctttgctctactatgacag

SEQ ID NO: 56631 - DNA, 25 bp, mus musculus
ctttgctctactatgacagggacag

SEQ ID NO: 56632 - DNA, 25 bp, mus musculus
gtgatacaggctgcctgaggtagaa

SEQ ID NO: 56633 - DNA, 25 bp, mus musculus
tctgagacagcacatgcatctccca

SEQ ID NO: 56634 - DNA, 25 bp, mus musculus
tctgccgcgggtaccatgaagatct

SEQ ID NO: 56635 - DNA, 25 bp, mus musculus
tttgtcactcgaaggaaccgccaag

SEQ ID NO: 56636 - DNA, 25 bp, mus musculus
actcgaaggaaccgccaagtgtgtg

SEQ ID NO: 56637 - DNA, 25 bp, mus musculus
tacatcaactatttggagatgagct

SEQ ID NO: 56638 - DNA, 25 bp, mus musculus
tttcttgattctgaccctgtatagc

SEQ ID NO: 56639 - DNA, 25 bp, mus musculus
cttccctgtcattgcttgctctagt

SEQ ID NO: 56640 - DNA, 25 bp, mus musculus
tgtcattgcttgctctagtcctagc

SEQ ID NO: 56641 - DNA, 25 bp, mus musculus
tgcttgctctagtcctagccagctt

SEQ ID NO: 56642 - DNA, 25 bp, mus musculus
ctctagtcctagccagcttggggat

SEQ ID NO: 56643 - DNA, 25 bp, mus musculus
cgaggctctgcacagcaaacccaag

SEQ ID NO: 56644 - DNA, 25 bp, mus musculus
cagcaaacccaagaaatcagcattt

SEQ ID NO: 56645 - DNA, 25 bp, mus musculus
accatgaagatctctgcagctgccc

SEQ ID NO: 56646 - DNA, 25 bp, mus musculus
tcaccatatggctcggacaccactc

SEQ ID NO: 56647 - DNA, 25 bp, mus musculus
cgtgcccacgtcaaggagtatttct

SEQ ID NO: 56648 - DNA, 25 bp, mus musculus
tatttctacaccagcagcaagtgct

SEQ ID NO: 56649 - DNA, 25 bp, mus musculus
agcagcaagtgctccaatcttgcag

SEQ ID NO: 56650 - DNA, 25 bp, mus musculus
aagtgctccaatcttgcagtcgtgt

SEQ ID NO: 56651 - DNA, 25 bp, mus musculus
tccaatcttgcagtcgtgtttgtca

SEQ ID NO: 56652 - DNA, 25 bp, mus musculus
cttgcagtcgtgtttgtcactcgaa

SEQ ID NO: 56653 - DNA, 25 bp, mus musculus
atggccctgttggtgcacttcctac

SEQ ID NO: 56654 - DNA, 25 bp, mus musculus
tggccctgttggtgcacttcctacc

SEQ ID NO: 56655 - DNA, 25 bp, mus musculus
tctctggcatttattgtcatgttag

SEQ ID NO: 56656 - DNA, 25 bp, mus musculus
ctctggcatttattgtcatgttagc

SEQ ID NO: 56657 - DNA, 25 bp, mus musculus
ttagcatactattaaaccattgtta

SEQ ID NO: 56658 - DNA, 25 bp, mus musculus
agcatactattaaaccattgttagg

SEQ ID NO: 56659 - DNA, 25 bp, mus musculus
gcatactattaaaccattgttaggt

SEQ ID NO: 56660 - DNA, 25 bp, mus musculus
tattaaaccattgttaggttggatg

SEQ ID NO: 56661 - DNA, 25 bp, mus musculus
ttaaaccattgttaggttggatgat

SEQ ID NO: 56662 - DNA, 25 bp, mus musculus
aaccattgttaggttggatgattat

SEQ ID NO: 56663 - DNA, 25 bp, mus musculus
gagaactactgcaactaaggcccac

SEQ ID NO: 56664 - DNA, 25 bp, mus musculus
gaactactgcaactaaggcccacct

SEQ ID NO: 56665 - DNA, 25 bp, mus musculus
tatatagacatctttttctctggca

SEQ ID NO: 56666 - DNA, 25 bp, mus musculus
atatagacatctttttctctggcat

SEQ ID NO: 56667 - DNA, 25 bp, mus musculus
tatagacatctttttctctggcatt

SEQ ID NO: 56668 - DNA, 25 bp, mus musculus
atagacatctttttctctggcattt

SEQ ID NO: 56669 - DNA, 25 bp, mus musculus
tagacatctttttctctggcattta

SEQ ID NO: 56670 - DNA, 25 bp, mus musculus
agacatctttttctctggcatttat

SEQ ID NO: 56671 - DNA, 25 bp, mus musculus
gcagatcatgtctgagctggaaatc

SEQ ID NO: 56672 - DNA, 25 bp, mus musculus
agatcatgtctgagctggaaatcct

SEQ ID NO: 56673 - DNA, 25 bp, mus musculus
gatgtgaagccctccaacatgcttg

SEQ ID NO: 56674 - DNA, 25 bp, mus musculus
tgtgaagccctccaacatgcttgta

SEQ ID NO: 56675 - DNA, 25 bp, mus musculus
tgaagccctccaacatgcttgtaaa

SEQ ID NO: 56676 - DNA, 25 bp, mus musculus
aagccctccaacatgcttgtaaaca

SEQ ID NO: 56677 - DNA, 25 bp, mus musculus
gccctccaacatgcttgtaaacaca

SEQ ID NO: 56678 - DNA, 25 bp, mus musculus
cctccaacatgcttgtaaacacagg

SEQ ID NO: 56679 - DNA, 25 bp, mus musculus
caacatgcttgtaaacacaggcgga

SEQ ID NO: 56680 - DNA, 25 bp, mus musculus
atgcttgtaaacacaggcggacagg

SEQ ID NO: 56681 - DNA, 25 bp, mus musculus
ttgtaaacacaggcggacaggtcaa

SEQ ID NO: 56682 - DNA, 25 bp, mus musculus
gtaaacacaggcggacaggtcaagc

SEQ ID NO: 56683 - DNA, 25 bp, mus musculus
atcatgtctgagctggaaatccttt

SEQ ID NO: 56684 - DNA, 25 bp, mus musculus
tgtgactcatcgtatatcataggat

SEQ ID NO: 56685 - DNA, 25 bp, mus musculus
tgactcatcgtatatcataggattt

SEQ ID NO: 56686 - DNA, 25 bp, mus musculus
actcatcgtatatcataggatttta

SEQ ID NO: 56687 - DNA, 25 bp, mus musculus
aaattccagagcacgtccttggaag

SEQ ID NO: 56688 - DNA, 25 bp, mus musculus
gagcacgtccttggaagaattgcag

SEQ ID NO: 56689 - DNA, 25 bp, mus musculus
tgttaaaggccttacctatctgtgg

SEQ ID NO: 56690 - DNA, 25 bp, mus musculus
ttaaaggccttacctatctgtggag

SEQ ID NO: 56691 - DNA, 25 bp, mus musculus
caccagccctaagtgatccgctaca

SEQ ID NO: 56692 - DNA, 25 bp, mus musculus
ccagccctaagtgatccgctacaat

SEQ ID NO: 56693 - DNA, 25 bp, mus musculus
ctacaatcaaaaaccatcagcaagc

SEQ ID NO: 56694 - DNA, 25 bp, mus musculus
aatcaaaaaccatcagcaagcaggt

SEQ ID NO: 56695 - DNA, 25 bp, mus musculus
tcaaaaaccatcagcaagcaggtta

SEQ ID NO: 56696 - DNA, 25 bp, mus musculus
tcaacatggccctgtggatgcgctt

SEQ ID NO: 56697 - DNA, 25 bp, mus musculus
caacatggccctgtggatgcgcttc

SEQ ID NO: 56698 - DNA, 25 bp, mus musculus
acatggccctgtggatgcgcttcct

SEQ ID NO: 56699 - DNA, 25 bp, mus musculus
catggccctgtggatgcgcttcctg

SEQ ID NO: 56700 - DNA, 25 bp, mus musculus
caggtgaccttcagaccttggcact

SEQ ID NO: 56701 - DNA, 25 bp, mus musculus
aggtgaccttcagaccttggcactg

SEQ ID NO: 56702 - DNA, 25 bp, mus musculus
agaactactgcaactagacccacca

SEQ ID NO: 56703 - DNA, 25 bp, mus musculus
gccctaagtgatccgctacaatcaa

SEQ ID NO: 56704 - DNA, 25 bp, mus musculus
ccctaagtgatccgctacaatcaaa

SEQ ID NO: 56705 - DNA, 25 bp, mus musculus
taagtgatccgctacaatcaaaaac

SEQ ID NO: 56706 - DNA, 25 bp, mus musculus
agtgatccgctacaatcaaaaacca

SEQ ID NO: 56707 - DNA, 25 bp, mus musculus
gtgatccgctacaatcaaaaaccat

SEQ ID NO: 56708 - DNA, 25 bp, mus musculus
gatccgctacaatcaaaaaccatca

SEQ ID NO: 56709 - DNA, 25 bp, mus musculus
atccgctacaatcaaaaaccatcag

SEQ ID NO: 56710 - DNA, 25 bp, mus musculus
ccgctacaatcaaaaaccatcagca

SEQ ID NO: 56711 - DNA, 25 bp, mus musculus
gtctcgacttgtttaactgtgagat

SEQ ID NO: 56712 - DNA, 25 bp, mus musculus
tctcgacttgtttaactgtgagatc

SEQ ID NO: 56713 - DNA, 25 bp, mus musculus
tcacctacctggacggattcgacca

SEQ ID NO: 56714 - DNA, 25 bp, mus musculus
cacctacctggacggattcgaccag

SEQ ID NO: 56715 - DNA, 25 bp, mus musculus
tggacggattcgaccaggaggacaa

SEQ ID NO: 56716 - DNA, 25 bp, mus musculus
attcgaccaggaggacaacgaagct

SEQ ID NO: 56717 - DNA, 25 bp, mus musculus
ggacaacgaagctcccgactcggag

SEQ ID NO: 56718 - DNA, 25 bp, mus musculus
caacgaagctcccgactcggaggag

SEQ ID NO: 56719 - DNA, 25 bp, mus musculus
aagatgaagctggcccaccggaagg

SEQ ID NO: 56720 - DNA, 25 bp, mus musculus
agatgaagctggcccaccggaaggc

SEQ ID NO: 56721 - DNA, 25 bp, mus musculus
ctggcccaccggaaggctatgaaga

SEQ ID NO: 56722 - DNA, 25 bp, mus musculus
tggcccaccggaaggctatgaagag

SEQ ID NO: 56723 - DNA, 25 bp, mus musculus
tgagatcacaaacctggaagattat

SEQ ID NO: 56724 - DNA, 25 bp, mus musculus
agatcacaaacctggaagattatag

SEQ ID NO: 56725 - DNA, 25 bp, mus musculus
tttttgaactgctgcagcagatcac

SEQ ID NO: 56726 - DNA, 25 bp, mus musculus
ttttgaactgctgcagcagatcacc

SEQ ID NO: 56727 - DNA, 25 bp, mus musculus
tgaactgctgcagcagatcacctac

SEQ ID NO: 56728 - DNA, 25 bp, mus musculus
aactgctgcagcagatcacctacct

SEQ ID NO: 56729 - DNA, 25 bp, mus musculus
gcagatcacctacctggacggattc

SEQ ID NO: 56730 - DNA, 25 bp, mus musculus
gatcacctacctggacggattcgac

SEQ ID NO: 56731 - DNA, 25 bp, mus musculus
catgtcctgctcagttcctatctac

SEQ ID NO: 56732 - DNA, 25 bp, mus musculus
ctgctcagttcctatctaccatttg

SEQ ID NO: 56733 - DNA, 25 bp, mus musculus
caccagtgagattccatgtggacct

SEQ ID NO: 56734 - DNA, 25 bp, mus musculus
tccacagctaagtggctggaggctg

SEQ ID NO: 56735 - DNA, 25 bp, mus musculus
gaggctgccctaaaagctcaggagg

SEQ ID NO: 56736 - DNA, 25 bp, mus musculus
aaagctcaggaggcaccgcaagcaa

SEQ ID NO: 56737 - DNA, 25 bp, mus musculus
caggaggcaccgcaagcaagccttg

SEQ ID NO: 56738 - DNA, 25 bp, mus musculus
ccaccagcttgaccttagacttctg

SEQ ID NO: 56739 - DNA, 25 bp, mus musculus
gcttgaccttagacttctggccttc

SEQ ID NO: 56740 - DNA, 25 bp, mus musculus
acttctggccttcaggctgtgacaa

SEQ ID NO: 56741 - DNA, 25 bp, mus musculus
ggccttcaggctgtgacaatacatt

SEQ ID NO: 56742 - DNA, 25 bp, mus musculus
gtgacaatacattcctgctgtttaa

SEQ ID NO: 56743 - DNA, 25 bp, mus musculus
agttcctatctaccatttgaccctg

SEQ ID NO: 56744 - DNA, 25 bp, mus musculus
tacattcctgctgtttaaagaacca

SEQ ID NO: 56745 - DNA, 25 bp, mus musculus
tatctaccatttgaccctggttgac

SEQ ID NO: 56746 - DNA, 25 bp, mus musculus
gaccctggttgacacaacacaacct

SEQ ID NO: 56747 - DNA, 25 bp, mus musculus
ggttgacacaacacaaccttttctg

SEQ ID NO: 56748 - DNA, 25 bp, mus musculus
atttggctgtaggctgggacacaca

SEQ ID NO: 56749 - DNA, 25 bp, mus musculus
gctgggacacacacacgcacacaag

SEQ ID NO: 56750 - DNA, 25 bp, mus musculus
ttcagagcattccaccagtgagatt

SEQ ID NO: 56751 - DNA, 25 bp, mus musculus
gcattccaccagtgagattccatgt

SEQ ID NO: 56752 - DNA, 25 bp, mus musculus
ttggcaatggcaactccaccaaagg

SEQ ID NO: 56753 - DNA, 25 bp, mus musculus
ggcaatggcaactccaccaaaggtg

SEQ ID NO: 56754 - DNA, 25 bp, mus musculus
actggcggctacttccaggaggagc

SEQ ID NO: 56755 - DNA, 25 bp, mus musculus
gcggctacttccaggaggagcagct

SEQ ID NO: 56756 - DNA, 25 bp, mus musculus
ggctacttccaggaggagcagctgc

SEQ ID NO: 56757 - DNA, 25 bp, mus musculus
gctacttccaggaggagcagctgcg

SEQ ID NO: 56758 - DNA, 25 bp, mus musculus
gagcagctgcgcaagccaggcatca

SEQ ID NO: 56759 - DNA, 25 bp, mus musculus
gcaagccaggcatcaagaaggcgaa

SEQ ID NO: 56760 - DNA, 25 bp, mus musculus
aagcttaccaggaagctgttgaatt

SEQ ID NO: 56761 - DNA, 25 bp, mus musculus
agcttaccaggaagctgttgaattt

SEQ ID NO: 56762 - DNA, 25 bp, mus musculus
cttaccaggaagctgttgaatttca

SEQ ID NO: 56763 - DNA, 25 bp, mus musculus
gtcctcagctccaggggtatctggg

SEQ ID NO: 56764 - DNA, 25 bp, mus musculus
gcaatggcaactccaccaaaggtgg

SEQ ID NO: 56765 - DNA, 25 bp, mus musculus
gcaactccaccaaaggtggtaacag

SEQ ID NO: 56766 - DNA, 25 bp, mus musculus
tccaccaaaggtggtaacagcgatg

SEQ ID NO: 56767 - DNA, 25 bp, mus musculus
atccccaaacaactgactggcggct

SEQ ID NO: 56768 - DNA, 25 bp, mus musculus
tccccaaacaactgactggcggcta

SEQ ID NO: 56769 - DNA, 25 bp, mus musculus
cccaaacaactgactggcggctact

SEQ ID NO: 56770 - DNA, 25 bp, mus musculus
ccaaacaactgactggcggctactt

SEQ ID NO: 56771 - DNA, 25 bp, mus musculus
aactgactggcggctacttccagga

SEQ ID NO: 56772 - DNA, 25 bp, mus musculus
actgtagctcagtattcaggagtag

SEQ ID NO: 56773 - DNA, 25 bp, mus musculus
tattcaggagtagcttggtggatca

SEQ ID NO: 56774 - DNA, 25 bp, mus musculus
aggcttacttccgatgcatagtatt

SEQ ID NO: 56775 - DNA, 25 bp, mus musculus
acttccgatgcatagtattgatcta

SEQ ID NO: 56776 - DNA, 25 bp, mus musculus
acttccataattgtgtggattcttt

SEQ ID NO: 56777 - DNA, 25 bp, mus musculus
taagcgctctaggtacgatgacagc

SEQ ID NO: 56778 - DNA, 25 bp, mus musculus
tgacagcattccccgataccatgcg

SEQ ID NO: 56779 - DNA, 25 bp, mus musculus
ccatgcggtgcggatccggaaagaa

SEQ ID NO: 56780 - DNA, 25 bp, mus musculus
aggtgcttcaaagcctgctcagctc

SEQ ID NO: 56781 - DNA, 25 bp, mus musculus
cccccatatatgatttcagactgac

SEQ ID NO: 56782 - DNA, 25 bp, mus musculus
cgacacccagtatggacctacagtt

SEQ ID NO: 56783 - DNA, 25 bp, mus musculus
tacagtttcaactgtggatattgtt

SEQ ID NO: 56784 - DNA, 25 bp, mus musculus
tggatcatcctcctggctgttcttg

SEQ ID NO: 56785 - DNA, 25 bp, mus musculus
ctggctgttcttgccgggattctga

SEQ ID NO: 56786 - DNA, 25 bp, mus musculus
attctgatgctggctctattagtgt

SEQ ID NO: 56787 - DNA, 25 bp, mus musculus
atgctggctctattagtgtttttac

SEQ ID NO: 56788 - DNA, 25 bp, mus musculus
gatcattacgatgccacctatcaca

SEQ ID NO: 56789 - DNA, 25 bp, mus musculus
tacgatgccacctatcacaaggctg

SEQ ID NO: 56790 - DNA, 25 bp, mus musculus
gccacctatcacaaggctgagatcc

SEQ ID NO: 56791 - DNA, 25 bp, mus musculus
gagatccatactcagccgtctgata

SEQ ID NO: 56792 - DNA, 25 bp, mus musculus
atcgcgccactgcgaccgcaggaac

SEQ ID NO: 56793 - DNA, 25 bp, mus musculus
caggaaccccggtgaggacagcagt

SEQ ID NO: 56794 - DNA, 25 bp, mus musculus
gctgcttctgatgccaagctaatgg

SEQ ID NO: 56795 - DNA, 25 bp, mus musculus
aagctaatggccagatctgcctctg

SEQ ID NO: 56796 - DNA, 25 bp, mus musculus
atggccagatctgcctctgaggact

SEQ ID NO: 56797 - DNA, 25 bp, mus musculus
agatctgcctctgaggactctttcc

SEQ ID NO: 56798 - DNA, 25 bp, mus musculus
tctgcctctgaggactctttcctgg

SEQ ID NO: 56799 - DNA, 25 bp, mus musculus
tctgaggactctttcctgggaccaa

SEQ ID NO: 56800 - DNA, 25 bp, mus musculus
tagacaacctgggctccaaactgag

SEQ ID NO: 56801 - DNA, 25 bp, mus musculus
acctgggctccaaactgaggacaat

SEQ ID NO: 56802 - DNA, 25 bp, mus musculus
tgggctccaaactgaggacaataaa

SEQ ID NO: 56803 - DNA, 25 bp, mus musculus
tacaaacttgagcgttccaatacgg

SEQ ID NO: 56804 - DNA, 25 bp, mus musculus
taacctaggcgtcgcacaagaagaa

SEQ ID NO: 56805 - DNA, 25 bp, mus musculus
aaattcttgagggcacgagagccag

SEQ ID NO: 56806 - DNA, 25 bp, mus musculus
ttcttgagggcacgagagccagttg

SEQ ID NO: 56807 - DNA, 25 bp, mus musculus
tgctgcgagcttctggaaaaacagc

SEQ ID NO: 56808 - DNA, 25 bp, mus musculus
cagccctgagcttctgaaaactttg

SEQ ID NO: 56809 - DNA, 25 bp, mus musculus
ccctgagcttctgaaaactttgagg

SEQ ID NO: 56810 - DNA, 25 bp, mus musculus
aactttgaggctgcttctgatgcca

SEQ ID NO: 56811 - DNA, 25 bp, mus musculus
gaggctgcttctgatgccaagctaa

SEQ ID NO: 56812 - DNA, 25 bp, mus musculus
cctcctatgggaaccagaagagcgt

SEQ ID NO: 56813 - DNA, 25 bp, mus musculus
gcagcactcaatgactgcatctatg

SEQ ID NO: 56814 - DNA, 25 bp, mus musculus
cggtcttctagccatgatttcttgg

SEQ ID NO: 56815 - DNA, 25 bp, mus musculus
tctagccatgatttcttggccccag

SEQ ID NO: 56816 - DNA, 25 bp, mus musculus
agccatgatttcttggccccaggta

SEQ ID NO: 56817 - DNA, 25 bp, mus musculus
tgaagtttacaaccctcattcagat

SEQ ID NO: 56818 - DNA, 25 bp, mus musculus
ttacaaccctcattcagatacatgg

SEQ ID NO: 56819 - DNA, 25 bp, mus musculus
ccctcattcagatacatggacggaa

SEQ ID NO: 56820 - DNA, 25 bp, mus musculus
taatatgatcactagtcgttgtgaa

SEQ ID NO: 56821 - DNA, 25 bp, mus musculus
tgttgctgtactgtgacagagaagg

SEQ ID NO: 56822 - DNA, 25 bp, mus musculus
taggttctgaccatttgcaaatcaa

SEQ ID NO: 56823 - DNA, 25 bp, mus musculus
ctgaccatttgcaaatcaaacatat

SEQ ID NO: 56824 - DNA, 25 bp, mus musculus
aatgactgcatctatgctattggag

SEQ ID NO: 56825 - DNA, 25 bp, mus musculus
caagatgcccttcatactgtagaaa

SEQ ID NO: 56826 - DNA, 25 bp, mus musculus
atgaaagttcctagagcaggcatgt

SEQ ID NO: 56827 - DNA, 25 bp, mus musculus
gttcctagagcaggcatgtgtgctg

SEQ ID NO: 56828 - DNA, 25 bp, mus musculus
agagcaggcatgtgtgctgtgacag

SEQ ID NO: 56829 - DNA, 25 bp, mus musculus
tgtgctgtgacagtcaatggtcttc

SEQ ID NO: 56830 - DNA, 25 bp, mus musculus
aatggtcttctgtatgtctctggag

SEQ ID NO: 56831 - DNA, 25 bp, mus musculus
tatgtctctggaggccggtcttcta

SEQ ID NO: 56832 - DNA, 25 bp, mus musculus
ggcctgcaactgtttgctgctcaag

SEQ ID NO: 56833 - DNA, 25 bp, mus musculus
ctgcaactgtttgctgctcaaggtc

SEQ ID NO: 56834 - DNA, 25 bp, mus musculus
agcgtgcaagctggcccaggagaac

SEQ ID NO: 56835 - DNA, 25 bp, mus musculus
ggtgagtcatcgctctggagaaacc

SEQ ID NO: 56836 - DNA, 25 bp, mus musculus
gagtcatcgctctggagaaaccgag

SEQ ID NO: 56837 - DNA, 25 bp, mus musculus
tcatcgctctggagaaaccgaggac

SEQ ID NO: 56838 - DNA, 25 bp, mus musculus
tcgctctggagaaaccgaggacacg

SEQ ID NO: 56839 - DNA, 25 bp, mus musculus
aaccgaggacacgttcattgcagac

SEQ ID NO: 56840 - DNA, 25 bp, mus musculus
cgaggacacgttcattgcagacctc

SEQ ID NO: 56841 - DNA, 25 bp, mus musculus
cacgttcattgcagacctcgtagtg

SEQ ID NO: 56842 - DNA, 25 bp, mus musculus
gttcattgcagacctcgtagtggga

SEQ ID NO: 56843 - DNA, 25 bp, mus musculus
agacctcgtagtgggactgtgtaca

SEQ ID NO: 56844 - DNA, 25 bp, mus musculus
caactgtttgctgctcaaggtcaac

SEQ ID NO: 56845 - DNA, 25 bp, mus musculus
tttgctgctcaaggtcaaccagatc

SEQ ID NO: 56846 - DNA, 25 bp, mus musculus
caaccagatcggctcagtcacagaa

SEQ ID NO: 56847 - DNA, 25 bp, mus musculus
ccagatcggctcagtcacagaagcc

SEQ ID NO: 56848 - DNA, 25 bp, mus musculus
cggctcagtcacagaagccatccaa

SEQ ID NO: 56849 - DNA, 25 bp, mus musculus
agtcacagaagccatccaagcgtgc

SEQ ID NO: 56850 - DNA, 25 bp, mus musculus
cacagaagccatccaagcgtgcaag

SEQ ID NO: 56851 - DNA, 25 bp, mus musculus
agaagccatccaagcgtgcaagctg

SEQ ID NO: 56852 - DNA, 25 bp, mus musculus
ccacatctacttctgatgagggtgc

SEQ ID NO: 56853 - DNA, 25 bp, mus musculus
gggcactgccattcctggaggcaca

SEQ ID NO: 56854 - DNA, 25 bp, mus musculus
agaccttcttcacacttcagattca

SEQ ID NO: 56855 - DNA, 25 bp, mus musculus
tcttcacacttcagattcatagcag

SEQ ID NO: 56856 - DNA, 25 bp, mus musculus
cacttcagattcatagcagcgatgg

SEQ ID NO: 56857 - DNA, 25 bp, mus musculus
agattcatagcagcgatgggatccc

SEQ ID NO: 56858 - DNA, 25 bp, mus musculus
tgtagataggtcacccgtcaaaagt

SEQ ID NO: 56859 - DNA, 25 bp, mus musculus
tgtttgattatctacctttcaatca

SEQ ID NO: 56860 - DNA, 25 bp, mus musculus
attatctacctttcaatcaacatga

SEQ ID NO: 56861 - DNA, 25 bp, mus musculus
tacctttcaatcaacatgagattgc

SEQ ID NO: 56862 - DNA, 25 bp, mus musculus
accattttcaacgattgttgacagg

SEQ ID NO: 56863 - DNA, 25 bp, mus musculus
ttcaacgattgttgacaggggtcct

SEQ ID NO: 56864 - DNA, 25 bp, mus musculus
gaactcgcttctctttaaagtcacg

SEQ ID NO: 56865 - DNA, 25 bp, mus musculus
ctaatcttgagctcagcactagcca

SEQ ID NO: 56866 - DNA, 25 bp, mus musculus
ttgagctcagcactagccagtattc

SEQ ID NO: 56867 - DNA, 25 bp, mus musculus
ctcagaagtggctcctaccctttct

SEQ ID NO: 56868 - DNA, 25 bp, mus musculus
tttgtctctgctcggtgacaccctt

SEQ ID NO: 56869 - DNA, 25 bp, mus musculus
tccctggagagcccagtcctccgtg

SEQ ID NO: 56870 - DNA, 25 bp, mus musculus
gagagcccagtcctccgtgtattac

SEQ ID NO: 56871 - DNA, 25 bp, mus musculus
ccagtcctccgtgtattacaccagt

SEQ ID NO: 56872 - DNA, 25 bp, mus musculus
tccgtgactaactccatgacggtgt

SEQ ID NO: 56873 - DNA, 25 bp, mus musculus
actaactccatgacggtgtcagaac

SEQ ID NO: 56874 - DNA, 25 bp, mus musculus
aggggccacagcaacatctatgagg

SEQ ID NO: 56875 - DNA, 25 bp, mus musculus
cacagcaacatctatgaggtctttc

SEQ ID NO: 56876 - DNA, 25 bp, mus musculus
aacatctatgaggtctttctgacgc

SEQ ID NO: 56877 - DNA, 25 bp, mus musculus
tatgaggtctttctgacgcagactg

SEQ ID NO: 56878 - DNA, 25 bp, mus musculus
gtctttctgacgcagactgtagaca

SEQ ID NO: 56879 - DNA, 25 bp, mus musculus
agtcacgaagaccagttctggctga

SEQ ID NO: 56880 - DNA, 25 bp, mus musculus
cagttctggctgagcttcgagggaa

SEQ ID NO: 56881 - DNA, 25 bp, mus musculus
ggcctaaagccccagtgcacagtga

SEQ ID NO: 56882 - DNA, 25 bp, mus musculus
aagccccagtgcacagtgatcaagc

SEQ ID NO: 56883 - DNA, 25 bp, mus musculus
catccagagccagtgttggttataa

SEQ ID NO: 56884 - DNA, 25 bp, mus musculus
attgcccagaagattggtgtgccgg

SEQ ID NO: 56885 - DNA, 25 bp, mus musculus
gcccaccaaactgcagtgctccagg

SEQ ID NO: 56886 - DNA, 25 bp, mus musculus
caaactgcagtgctccaggacggtc

SEQ ID NO: 56887 - DNA, 25 bp, mus musculus
gcagtgctccaggacggtcttaccc

SEQ ID NO: 56888 - DNA, 25 bp, mus musculus
cagaactgcagcgagcctctgagca

SEQ ID NO: 56889 - DNA, 25 bp, mus musculus
tgcagcgagcctctgagcatcctgg

SEQ ID NO: 56890 - DNA, 25 bp, mus musculus
gagcctctgagcatcctggtgagga

SEQ ID NO: 56891 - DNA, 25 bp, mus musculus
ctgagcatcctggtgaggaacgaaa

SEQ ID NO: 56892 - DNA, 25 bp, mus musculus
tcggatccatgcactgaacggcttt

SEQ ID NO: 56893 - DNA, 25 bp, mus musculus
cggatccatgcactgaacggctttc

SEQ ID NO: 56894 - DNA, 25 bp, mus musculus
cctgcacctttagtcagcaccttta

SEQ ID NO: 56895 - DNA, 25 bp, mus musculus
tgcacctttagtcagcacctttagc

SEQ ID NO: 56896 - DNA, 25 bp, mus musculus
gcacctttagtcagcacctttagcc

SEQ ID NO: 56897 - DNA, 25 bp, mus musculus
cctttagtcagcacctttagccagc

SEQ ID NO: 56898 - DNA, 25 bp, mus musculus
tttagtcagcacctttagccagcac

SEQ ID NO: 56899 - DNA, 25 bp, mus musculus
ttagtcagcacctttagccagcacc

SEQ ID NO: 56900 - DNA, 25 bp, mus musculus
agtcagcacctttagccagcacctg

SEQ ID NO: 56901 - DNA, 25 bp, mus musculus
acctttagccagcacctgcgccaga

SEQ ID NO: 56902 - DNA, 25 bp, mus musculus
gaccccagcaatggcgaaccatgcg

SEQ ID NO: 56903 - DNA, 25 bp, mus musculus
accccagcaatggcgaaccatgcgc

SEQ ID NO: 56904 - DNA, 25 bp, mus musculus
gatccatgcactgaacggctttcag

SEQ ID NO: 56905 - DNA, 25 bp, mus musculus
atccatgcactgaacggctttcagc

SEQ ID NO: 56906 - DNA, 25 bp, mus musculus
catgcactgaacggctttcagcctc

SEQ ID NO: 56907 - DNA, 25 bp, mus musculus
tgcactgaacggctttcagcctccc

SEQ ID NO: 56908 - DNA, 25 bp, mus musculus
tgggctccacctgcctgcaccttta

SEQ ID NO: 56909 - DNA, 25 bp, mus musculus
cacctgcctgcacctttagtcagca

SEQ ID NO: 56910 - DNA, 25 bp, mus musculus
ctgcctgcacctttagtcagcacct

SEQ ID NO: 56911 - DNA, 25 bp, mus musculus
gcctgcacctttagtcagcaccttt

SEQ ID NO: 56912 - DNA, 25 bp, mus musculus
ccctaccgggagaacatcacagcca

SEQ ID NO: 56913 - DNA, 25 bp, mus musculus
gagaacatcacagccacatttgtcc

SEQ ID NO: 56914 - DNA, 25 bp, mus musculus
agctccgcatctcgtctacttacaa

SEQ ID NO: 56915 - DNA, 25 bp, mus musculus
tccgcatctcgtctacttacaacat

SEQ ID NO: 56916 - DNA, 25 bp, mus musculus
gcatctcgtctacttacaacatgaa

SEQ ID NO: 56917 - DNA, 25 bp, mus musculus
tctcgtctacttacaacatgaagaa

SEQ ID NO: 56918 - DNA, 25 bp, mus musculus
ctacttacaacatgaagaaggttct

SEQ ID NO: 56919 - DNA, 25 bp, mus musculus
gcatcagcaaaatctttgaggagaa

SEQ ID NO: 56920 - DNA, 25 bp, mus musculus
tcacccggatctcatctcatcgaag

SEQ ID NO: 56921 - DNA, 25 bp, mus musculus
ggatctcatctcatcgaagcctgaa

SEQ ID NO: 56922 - DNA, 25 bp, mus musculus
tctcatctcatcgaagcctgaaggt

SEQ ID NO: 56923 - DNA, 25 bp, mus musculus
catctcatcgaagcctgaaggtggg

SEQ ID NO: 56924 - DNA, 25 bp, mus musculus
aacatcacagccacatttgtccttc

SEQ ID NO: 56925 - DNA, 25 bp, mus musculus
atcacagccacatttgtccttcctg

SEQ ID NO: 56926 - DNA, 25 bp, mus musculus
gccacatttgtccttcctgacaatg

SEQ ID NO: 56927 - DNA, 25 bp, mus musculus
acatttgtccttcctgacaatggca

SEQ ID NO: 56928 - DNA, 25 bp, mus musculus
caggcagacatctttgccaagtgga

SEQ ID NO: 56929 - DNA, 25 bp, mus musculus
tggaaaagccttctctcaaaaagag

SEQ ID NO: 56930 - DNA, 25 bp, mus musculus
agccttctctcaaaaagagtggtgg

SEQ ID NO: 56931 - DNA, 25 bp, mus musculus
cttctctcaaaaagagtggtggatg

SEQ ID NO: 56932 - DNA, 25 bp, mus musculus
caggcccttaaggcgagaatcggag

SEQ ID NO: 56933 - DNA, 25 bp, mus musculus
actggctgattccgtctttggaata

SEQ ID NO: 56934 - DNA, 25 bp, mus musculus
atgacttacctggaatgcttctctt

SEQ ID NO: 56935 - DNA, 25 bp, mus musculus
tacctggaatgcttctctttagggg

SEQ ID NO: 56936 - DNA, 25 bp, mus musculus
gaatgcttctctttaggggaacaag

SEQ ID NO: 56937 - DNA, 25 bp, mus musculus
ttctctttaggggaacaagagtgat

SEQ ID NO: 56938 - DNA, 25 bp, mus musculus
aacacaggcaagactctgccttaat

SEQ ID NO: 56939 - DNA, 25 bp, mus musculus
ctgctaactacatgaacacgaactg

SEQ ID NO: 56940 - DNA, 25 bp, mus musculus
actacatgaacacgaactgtatttt

SEQ ID NO: 56941 - DNA, 25 bp, mus musculus
tgttgaaagcgcacagtgtgcttta

SEQ ID NO: 56942 - DNA, 25 bp, mus musculus
aagcgcacagtgtgctttaaagcat

SEQ ID NO: 56943 - DNA, 25 bp, mus musculus
atttggctattaactgccaaaaatg

SEQ ID NO: 56944 - DNA, 25 bp, mus musculus
tgattccgtctttggaatacttact

SEQ ID NO: 56945 - DNA, 25 bp, mus musculus
acttactttgctacacagcctgacg

SEQ ID NO: 56946 - DNA, 25 bp, mus musculus
tttgctacacagcctgacgttggtc

SEQ ID NO: 56947 - DNA, 25 bp, mus musculus
acagttatacagaccatggtactgg

SEQ ID NO: 56948 - DNA, 25 bp, mus musculus
atacagaccatggtactggtcgaga

SEQ ID NO: 56949 - DNA, 25 bp, mus musculus
gagctttgcaggcctccaagagaca

SEQ ID NO: 56950 - DNA, 25 bp, mus musculus
tgcaggcctccaagagacatgatgg

SEQ ID NO: 56951 - DNA, 25 bp, mus musculus
gcaggcaagcctcagtttgggtaca

SEQ ID NO: 56952 - DNA, 25 bp, mus musculus
ttttgatagctcaggcctctagtag

SEQ ID NO: 56953 - DNA, 25 bp, mus musculus
tgatagctcaggcctctagtagtgt

SEQ ID NO: 56954 - DNA, 25 bp, mus musculus
agaaggagcctctgtgctgggtgca

SEQ ID NO: 56955 - DNA, 25 bp, mus musculus
aggagcctctgtgctgggtgcagaa

SEQ ID NO: 56956 - DNA, 25 bp, mus musculus
ctctgtgctgggtgcagaacatggg

SEQ ID NO: 56957 - DNA, 25 bp, mus musculus
acatggggcactcatgggaatcacc

SEQ ID NO: 56958 - DNA, 25 bp, mus musculus
actcccttctgggcagcactggtgc

SEQ ID NO: 56959 - DNA, 25 bp, mus musculus
cccttctgggcagcactggtgcctc

SEQ ID NO: 56960 - DNA, 25 bp, mus musculus
ttctgggcagcactggtgcctctgc

SEQ ID NO: 56961 - DNA, 25 bp, mus musculus
cgactgtaaaccgtctcaagtgcaa

SEQ ID NO: 56962 - DNA, 25 bp, mus musculus
ctgtaaaccgtctcaagtgcaatgc

SEQ ID NO: 56963 - DNA, 25 bp, mus musculus
taaaccgtctcaagtgcaatgcccc

SEQ ID NO: 56964 - DNA, 25 bp, mus musculus
tagctcaggcctctagtagtgttac

SEQ ID NO: 56965 - DNA, 25 bp, mus musculus
ctcaggcctctagtagtgttaccct

SEQ ID NO: 56966 - DNA, 25 bp, mus musculus
tgttggcaatcacacacggtaacct

SEQ ID NO: 56967 - DNA, 25 bp, mus musculus
tggcaatcacacacggtaacctcat

SEQ ID NO: 56968 - DNA, 25 bp, mus musculus
caatcacacacggtaacctcatacc

SEQ ID NO: 56969 - DNA, 25 bp, mus musculus
tcacacacggtaacctcatacctgc

SEQ ID NO: 56970 - DNA, 25 bp, mus musculus
acggtaacctcatacctgccctatg

SEQ ID NO: 56971 - DNA, 25 bp, mus musculus
tggtccagaaggagcctctgtgctg

SEQ ID NO: 56972 - DNA, 25 bp, mus musculus
atgccaactcttccaggaccaggtg

SEQ ID NO: 56973 - DNA, 25 bp, mus musculus
ccaggaccaggtgtgcaagagcgga

SEQ ID NO: 56974 - DNA, 25 bp, mus musculus
ttctactatcacgcacacaggctgg

SEQ ID NO: 56975 - DNA, 25 bp, mus musculus
tatcacgcacacaggctggagtgcg

SEQ ID NO: 56976 - DNA, 25 bp, mus musculus
cgctgcgtcaacacggtgggctctt

SEQ ID NO: 56977 - DNA, 25 bp, mus musculus
tgcgtcaacacggtgggctcttacc

SEQ ID NO: 56978 - DNA, 25 bp, mus musculus
gtcaacacggtgggctcttaccact

SEQ ID NO: 56979 - DNA, 25 bp, mus musculus
gtgggctcttaccactgtacctgcg

SEQ ID NO: 56980 - DNA, 25 bp, mus musculus
cactgtacctgcgagccccactggt

SEQ ID NO: 56981 - DNA, 25 bp, mus musculus
gctgcgtctccaacgagagccagag

SEQ ID NO: 56982 - DNA, 25 bp, mus musculus
gcgtctccaacgagagccagagcct

SEQ ID NO: 56983 - DNA, 25 bp, mus musculus
tctccaacgagagccagagcctgga

SEQ ID NO: 56984 - DNA, 25 bp, mus musculus
cacggccccagctactcttgctatt

SEQ ID NO: 56985 - DNA, 25 bp, mus musculus
atctaggagtgtgctggcaggaagt

SEQ ID NO: 56986 - DNA, 25 bp, mus musculus
cccagctactcttgctattgcagca

SEQ ID NO: 56987 - DNA, 25 bp, mus musculus
agctactcttgctattgcagcaacg

SEQ ID NO: 56988 - DNA, 25 bp, mus musculus
tactcttgctattgcagcaacgggt

SEQ ID NO: 56989 - DNA, 25 bp, mus musculus
tattgcagcaacgggttctactatc

SEQ ID NO: 56990 - DNA, 25 bp, mus musculus
tgcagcaacgggttctactatcacg

SEQ ID NO: 56991 - DNA, 25 bp, mus musculus
aacgggttctactatcacgcacaca

SEQ ID NO: 56992 - DNA, 25 bp, mus musculus
gggttctactatcacgcacacaggc

SEQ ID NO: 56993 - DNA, 25 bp, mus musculus
atcccagaccattctcggcagctga

SEQ ID NO: 56994 - DNA, 25 bp, mus musculus
gaccattctcggcagctgacaaaga

SEQ ID NO: 56995 - DNA, 25 bp, mus musculus
accagtttcatctccaaagactcca

SEQ ID NO: 56996 - DNA, 25 bp, mus musculus
ttcatctccaaagactccatccaga

SEQ ID NO: 56997 - DNA, 25 bp, mus musculus
tccaaagactccatccagaagtccc

SEQ ID NO: 56998 - DNA, 25 bp, mus musculus
gactccatccagaagtccctacaca

SEQ ID NO: 56999 - DNA, 25 bp, mus musculus
atccagaagtccctacacatgtact

SEQ ID NO: 57000 - DNA, 25 bp, mus musculus
gctaacctacggctgccacatatgt

SEQ ID NO: 57001 - DNA, 25 bp, mus musculus
tcttcaacttcaaaactctcttagc

SEQ ID NO: 57002 - DNA, 25 bp, mus musculus
acttcaaaactctcttagctcttgt

SEQ ID NO: 57003 - DNA, 25 bp, mus musculus
aaactctcttagctcttgtgttcct

SEQ ID NO: 57004 - DNA, 25 bp, mus musculus
tcttagctcttgtgttcctaacctt

SEQ ID NO: 57005 - DNA, 25 bp, mus musculus
tctcggcagctgacaaagaacatga

SEQ ID NO: 57006 - DNA, 25 bp, mus musculus
atgcgaaaggccaccgcagacaacc

SEQ ID NO: 57007 - DNA, 25 bp, mus musculus
aaggccaccgcagacaacctgatca

SEQ ID NO: 57008 - DNA, 25 bp, mus musculus
accgcagacaacctgatcaagcagc

SEQ ID NO: 57009 - DNA, 25 bp, mus musculus
gacaacctgatcaagcagcgagagg

SEQ ID NO: 57010 - DNA, 25 bp, mus musculus
gctgacatccagaatttcaccagtt

SEQ ID NO: 57011 - DNA, 25 bp, mus musculus
atccagaatttcaccagtttcatct

SEQ ID NO: 57012 - DNA, 25 bp, mus musculus
aatttcaccagtttcatctccaaag

SEQ ID NO: 57013 - DNA, 25 bp, mus musculus
gtcctgctgccttggctttaccctc

SEQ ID NO: 57014 - DNA, 25 bp, mus musculus
cctcatcccaggaccctgtgacaat

SEQ ID NO: 57015 - DNA, 25 bp, mus musculus
ccttttcccagcttctgagcctggt

SEQ ID NO: 57016 - DNA, 25 bp, mus musculus
ttctgagcctggtgggctctgtctc

SEQ ID NO: 57017 - DNA, 25 bp, mus musculus
tgggctctgtctcaatgatggaggg

SEQ ID NO: 57018 - DNA, 25 bp, mus musculus
gctctgtctcaatgatggagggcaa

SEQ ID NO: 57019 - DNA, 25 bp, mus musculus
gaaggctcccagagatggggagaac

SEQ ID NO: 57020 - DNA, 25 bp, mus musculus
ggctcccagagatggggagaacctg

SEQ ID NO: 57021 - DNA, 25 bp, mus musculus
ggtggctacagcaaacactaaggaa

SEQ ID NO: 57022 - DNA, 25 bp, mus musculus
ctccaaatcaatacactagttgttt

SEQ ID NO: 57023 - DNA, 25 bp, mus musculus
caaatcaatacactagttgtttcca

SEQ ID NO: 57024 - DNA, 25 bp, mus musculus
atcaatacactagttgtttccatcc

SEQ ID NO: 57025 - DNA, 25 bp, mus musculus
catcccaggaccctgtgacaatggt

SEQ ID NO: 57026 - DNA, 25 bp, mus musculus
tcaatacactagttgtttccatccc

SEQ ID NO: 57027 - DNA, 25 bp, mus musculus
cactgccacgccagctgcagagaaa

SEQ ID NO: 57028 - DNA, 25 bp, mus musculus
tgccacgccagctgcagagaaatgg

SEQ ID NO: 57029 - DNA, 25 bp, mus musculus
cactacacgaggccgaggctcctct

SEQ ID NO: 57030 - DNA, 25 bp, mus musculus
tacacgaggccgaggctcctctgcc

SEQ ID NO: 57031 - DNA, 25 bp, mus musculus
ggattcccagaggcaaatctgccgt

SEQ ID NO: 57032 - DNA, 25 bp, mus musculus
gaggcaaatctgccgtgcttgcttt

SEQ ID NO: 57033 - DNA, 25 bp, mus musculus
ttgagcctaccttttcccagcttct

SEQ ID NO: 57034 - DNA, 25 bp, mus musculus
gcactaactgcactttgtcccagct

SEQ ID NO: 57035 - DNA, 25 bp, mus musculus
acatggtcctggaaattccttattg

SEQ ID NO: 57036 - DNA, 25 bp, mus musculus
gaaccatccctgagcatcaccgaag

SEQ ID NO: 57037 - DNA, 25 bp, mus musculus
agcatcaccgaagtgcctgattcct

SEQ ID NO: 57038 - DNA, 25 bp, mus musculus
accgaagtgcctgattcctcaggcg

SEQ ID NO: 57039 - DNA, 25 bp, mus musculus
gtgcctgattcctcaggcgacagga

SEQ ID NO: 57040 - DNA, 25 bp, mus musculus
aggcaggacattccatgcagagccc

SEQ ID NO: 57041 - DNA, 25 bp, mus musculus
ttagcactgacatcagatgagctct

SEQ ID NO: 57042 - DNA, 25 bp, mus musculus
ttaaagcaaacctagcacttgtttg

SEQ ID NO: 57043 - DNA, 25 bp, mus musculus
ttgtttgcttcccttacattcacct

SEQ ID NO: 57044 - DNA, 25 bp, mus musculus
gcttcccttacattcacctgtgtaa

SEQ ID NO: 57045 - DNA, 25 bp, mus musculus
cttacattcacctgtgtaatacacc

SEQ ID NO: 57046 - DNA, 25 bp, mus musculus
cttattgagggtccagacagagcat

SEQ ID NO: 57047 - DNA, 25 bp, mus musculus
ccagacagagcatccacgaacaaga

SEQ ID NO: 57048 - DNA, 25 bp, mus musculus
agagcatccacgaacaagaccataa

SEQ ID NO: 57049 - DNA, 25 bp, mus musculus
gctaactcccaagatacgaatacca

SEQ ID NO: 57050 - DNA, 25 bp, mus musculus
ccaaatcttctgaagaacctgtctc

SEQ ID NO: 57051 - DNA, 25 bp, mus musculus
cttctgaagaacctgtctcctgagg

SEQ ID NO: 57052 - DNA, 25 bp, mus musculus
gggctgacccatccgcttcttgagg

SEQ ID NO: 57053 - DNA, 25 bp, mus musculus
agccagaactggccatgggagtctg

SEQ ID NO: 57054 - DNA, 25 bp, mus musculus
agttgcctgtattggagcctggcac

SEQ ID NO: 57055 - DNA, 25 bp, mus musculus
tgccttcactgtggctcgagctggg

SEQ ID NO: 57056 - DNA, 25 bp, mus musculus
tgacttcatcatgctcaaaggctgt

SEQ ID NO: 57057 - DNA, 25 bp, mus musculus
catcatgctcaaaggctgtgtggtg

SEQ ID NO: 57058 - DNA, 25 bp, mus musculus
tcttcgtaagtccttgctggttcag

SEQ ID NO: 57059 - DNA, 25 bp, mus musculus
taagtccttgctggttcagaccaaa

SEQ ID NO: 57060 - DNA, 25 bp, mus musculus
cttgctggttcagaccaaacgtcgg

SEQ ID NO: 57061 - DNA, 25 bp, mus musculus
caaatttggccatggtcgcttccag

SEQ ID NO: 57062 - DNA, 25 bp, mus musculus
tggtcgcttccagaccatggaggag

SEQ ID NO: 57063 - DNA, 25 bp, mus musculus
agcatttatgggaccactcaagaaa

SEQ ID NO: 57064 - DNA, 25 bp, mus musculus
accactcaagaaagatcgcattgcc

SEQ ID NO: 57065 - DNA, 25 bp, mus musculus
agcttgattccaggaccactttgtg

SEQ ID NO: 57066 - DNA, 25 bp, mus musculus
aggctaccatcaccgaacagagatt

SEQ ID NO: 57067 - DNA, 25 bp, mus musculus
ctacctcatcaaggatggcaaactg

SEQ ID NO: 57068 - DNA, 25 bp, mus musculus
gaacaatgcatctactgactatgac

SEQ ID NO: 57069 - DNA, 25 bp, mus musculus
tgcatctactgactatgacttgtct

SEQ ID NO: 57070 - DNA, 25 bp, mus musculus
tgacaagagcatcaacccactgggt

SEQ ID NO: 57071 - DNA, 25 bp, mus musculus
gagcatcaacccactgggtggcttt

SEQ ID NO: 57072 - DNA, 25 bp, mus musculus
tggctttgtgcattatggtgaggtg

SEQ ID NO: 57073 - DNA, 25 bp, mus musculus
gaccaatgacttcatcatgctcaaa

SEQ ID NO: 57074 - DNA, 25 bp, mus musculus
aaccaagactcttcagtcacgctta

SEQ ID NO: 57075 - DNA, 25 bp, mus musculus
gactcttcagtcacgcttaggccag

SEQ ID NO: 57076 - DNA, 25 bp, mus musculus
atatctgggcttggtatttgggcag

SEQ ID NO: 57077 - DNA, 25 bp, mus musculus
tctgggcttggtatttgggcagtat

SEQ ID NO: 57078 - DNA, 25 bp, mus musculus
gggatgctgaccacctctgagatct

SEQ ID NO: 57079 - DNA, 25 bp, mus musculus
ctgaccacctctgagatctgctctg

SEQ ID NO: 57080 - DNA, 25 bp, mus musculus
gagatctgctctgctgcactcatac

SEQ ID NO: 57081 - DNA, 25 bp, mus musculus
atctgctctgctgcactcatacctg

SEQ ID NO: 57082 - DNA, 25 bp, mus musculus
gctgcactcatacctgcttctgcat

SEQ ID NO: 57083 - DNA, 25 bp, mus musculus
gcactcatacctgcttctgcatgtt

SEQ ID NO: 57084 - DNA, 25 bp, mus musculus
ctcatacctgcttctgcatgttggt

SEQ ID NO: 57085 - DNA, 25 bp, mus musculus
gcttctgcatgttggttgacaatgt

SEQ ID NO: 57086 - DNA, 25 bp, mus musculus
tgtctggtcgggacttgttgtaatg

SEQ ID NO: 57087 - DNA, 25 bp, mus musculus
aatgtccatgcagagtgccaaggat

SEQ ID NO: 57088 - DNA, 25 bp, mus musculus
tgccaaggattctctcctgatgtta

SEQ ID NO: 57089 - DNA, 25 bp, mus musculus
tctcctgatgttaggccttgattgc

SEQ ID NO: 57090 - DNA, 25 bp, mus musculus
aggccttgattgccaatgtgtctgt

SEQ ID NO: 57091 - DNA, 25 bp, mus musculus
ttgccaatgtgtctgttgatcatgt

SEQ ID NO: 57092 - DNA, 25 bp, mus musculus
gtgtgttactggggtgctgttttat

SEQ ID NO: 57093 - DNA, 25 bp, mus musculus
tactggggtgctgttttatgatgta

SEQ ID NO: 57094 - DNA, 25 bp, mus musculus
tgctccttaccagctgttctagccg

SEQ ID NO: 57095 - DNA, 25 bp, mus musculus
tccttaccagctgttctagccgatt

SEQ ID NO: 57096 - DNA, 25 bp, mus musculus
gatctatctctgcagtaactgttct

SEQ ID NO: 57097 - DNA, 25 bp, mus musculus
ctgcagtaactgttctccctcagtt

SEQ ID NO: 57098 - DNA, 25 bp, mus musculus
tccctcagttgcgatggaagcaggc

SEQ ID NO: 57099 - DNA, 25 bp, mus musculus
cgatctgttcagagcctgagcagtt

SEQ ID NO: 57100 - DNA, 25 bp, mus musculus
tctgttcagagcctgagcagtttgc

SEQ ID NO: 57101 - DNA, 25 bp, mus musculus
gttcagagcctgagcagtttgcagt

SEQ ID NO: 57102 - DNA, 25 bp, mus musculus
agcagtttgcagttccgttgtgctt

SEQ ID NO: 57103 - DNA, 25 bp, mus musculus
ttccgttgtgctttctgaggtccta

SEQ ID NO: 57104 - DNA, 25 bp, mus musculus
gctttctgaggtcctagattcagga

SEQ ID NO: 57105 - DNA, 25 bp, mus musculus
ctcttccttacccagctttgtagct

SEQ ID NO: 57106 - DNA, 25 bp, mus musculus
gctgttctagccgattctcttcaga

SEQ ID NO: 57107 - DNA, 25 bp, mus musculus
gttctagccgattctcttcagatca

SEQ ID NO: 57108 - DNA, 25 bp, mus musculus
gccgattctcttcagatcagctaca

SEQ ID NO: 57109 - DNA, 25 bp, mus musculus
gctcactgtggccttactgatctat

SEQ ID NO: 57110 - DNA, 25 bp, mus musculus
cactgtggccttactgatctatctc

SEQ ID NO: 57111 - DNA, 25 bp, mus musculus
tgtggccttactgatctatctctgc

SEQ ID NO: 57112 - DNA, 25 bp, mus musculus
cttactgatctatctctgcagtaac

SEQ ID NO: 57113 - DNA, 25 bp, mus musculus
actgatctatctctgcagtaactgt

SEQ ID NO: 57114 - DNA, 25 bp, mus musculus
gatccacagtccaaaatgcaaaaga

SEQ ID NO: 57115 - DNA, 25 bp, mus musculus
tccacagtccaaaatgcaaaagatc

SEQ ID NO: 57116 - DNA, 25 bp, mus musculus
tatcccatgcagtaaacccaatgcg

SEQ ID NO: 57117 - DNA, 25 bp, mus musculus
tcccatgcagtaaacccaatgcgcc

SEQ ID NO: 57118 - DNA, 25 bp, mus musculus
ccatgcagtaaacccaatgcgccgg

SEQ ID NO: 57119 - DNA, 25 bp, mus musculus
atgcagtaaacccaatgcgccgggc

SEQ ID NO: 57120 - DNA, 25 bp, mus musculus
gcagtaaacccaatgcgccgggcat

SEQ ID NO: 57121 - DNA, 25 bp, mus musculus
agtaaacccaatgcgccgggcatct

SEQ ID NO: 57122 - DNA, 25 bp, mus musculus
taaacccaatgcgccgggcatctac

SEQ ID NO: 57123 - DNA, 25 bp, mus musculus
aacccaatgcgccgggcatctacac

SEQ ID NO: 57124 - DNA, 25 bp, mus musculus
caatgcgccgggcatctacaccaaa

SEQ ID NO: 57125 - DNA, 25 bp, mus musculus
cctctgttctcaataaaatccacta

SEQ ID NO: 57126 - DNA, 25 bp, mus musculus
cacagtccaaaatgcaaaagatctc

SEQ ID NO: 57127 - DNA, 25 bp, mus musculus
aatgcaaaagatctccagtgtgtga

SEQ ID NO: 57128 - DNA, 25 bp, mus musculus
tgcaaaagatctccagtgtgtgaac

SEQ ID NO: 57129 - DNA, 25 bp, mus musculus
acatcatggggctctatcccatgca

SEQ ID NO: 57130 - DNA, 25 bp, mus musculus
tggggctctatcccatgcagtaaac

SEQ ID NO: 57131 - DNA, 25 bp, mus musculus
gggctctatcccatgcagtaaaccc

SEQ ID NO: 57132 - DNA, 25 bp, mus musculus
gctctatcccatgcagtaaacccaa

SEQ ID NO: 57133 - DNA, 25 bp, mus musculus
tctatcccatgcagtaaacccaatg

SEQ ID NO: 57134 - DNA, 25 bp, mus musculus
agcctcctgacactcaaagagatac

SEQ ID NO: 57135 - DNA, 25 bp, mus musculus
cctcctgacactcaaagagatacct

SEQ ID NO: 57136 - DNA, 25 bp, mus musculus
aggtatcacatcaacaggccctata

SEQ ID NO: 57137 - DNA, 25 bp, mus musculus
gtatcacatcaacaggccctatacc

SEQ ID NO: 57138 - DNA, 25 bp, mus musculus
atcacatcaacaggccctataccat

SEQ ID NO: 57139 - DNA, 25 bp, mus musculus
cacatcaacaggccctataccatgc

SEQ ID NO: 57140 - DNA, 25 bp, mus musculus
catcaacaggccctataccatgcgg

SEQ ID NO: 57141 - DNA, 25 bp, mus musculus
tcaacaggccctataccatgcggta

SEQ ID NO: 57142 - DNA, 25 bp, mus musculus
ggccctataccatgcggtaaacctg

SEQ ID NO: 57143 - DNA, 25 bp, mus musculus
ctataccatgcggtaaacctggtgt

SEQ ID NO: 57144 - DNA, 25 bp, mus musculus
aattcctgagtgtcacattatccca

SEQ ID NO: 57145 - DNA, 25 bp, mus musculus
ttcctgagtgtcacattatcccatg

SEQ ID NO: 57146 - DNA, 25 bp, mus musculus
tcctgacactcaaagagatacctcc

SEQ ID NO: 57147 - DNA, 25 bp, mus musculus
caaagagatacctcctggggctgac

SEQ ID NO: 57148 - DNA, 25 bp, mus musculus
cctgcccacgaaggagtcaaaactg

SEQ ID NO: 57149 - DNA, 25 bp, mus musculus
gttcctcaagctcctgcctattaag

SEQ ID NO: 57150 - DNA, 25 bp, mus musculus
agctcctgcctattaagaactgtat

SEQ ID NO: 57151 - DNA, 25 bp, mus musculus
ctcctgcctattaagaactgtatag

SEQ ID NO: 57152 - DNA, 25 bp, mus musculus
cctgcctattaagaactgtatagaa

SEQ ID NO: 57153 - DNA, 25 bp, mus musculus
caaggtatcacatcaacaggcccta

SEQ ID NO: 57154 - DNA, 25 bp, mus musculus
ggctcgtaagtctcagctccgagat

SEQ ID NO: 57155 - DNA, 25 bp, mus musculus
taagtctcagctccgagatgacagc

SEQ ID NO: 57156 - DNA, 25 bp, mus musculus
cgagtcagatgcctggcaggagaaa

SEQ ID NO: 57157 - DNA, 25 bp, mus musculus
ggccgtcttccaggcccgtgtcctg

SEQ ID NO: 57158 - DNA, 25 bp, mus musculus
agcttgctatgtcattgaaaaccag

SEQ ID NO: 57159 - DNA, 25 bp, mus musculus
cattgaaaaccaggcggccgtagag

SEQ ID NO: 57160 - DNA, 25 bp, mus musculus
cgtagagcagcctgccacacacctt

SEQ ID NO: 57161 - DNA, 25 bp, mus musculus
acaccttcctgaactgaagccattg

SEQ ID NO: 57162 - DNA, 25 bp, mus musculus
actgaagccattgtcgtgaacccca

SEQ ID NO: 57163 - DNA, 25 bp, mus musculus
acactctacaggtgacaagcggatc

SEQ ID NO: 57164 - DNA, 25 bp, mus musculus
agtcgcatgcctgccatagtcttta

SEQ ID NO: 57165 - DNA, 25 bp, mus musculus
atgcctgccatagtctttattgtag

SEQ ID NO: 57166 - DNA, 25 bp, mus musculus
tcagctccgagatgacagcaagcta

SEQ ID NO: 57167 - DNA, 25 bp, mus musculus
aatgacaccagttttctgaaattgc

SEQ ID NO: 57168 - DNA, 25 bp, mus musculus
caagctagaggcgctctacatcctc

SEQ ID NO: 57169 - DNA, 25 bp, mus musculus
gctctacatcctcatggtgctgggc

SEQ ID NO: 57170 - DNA, 25 bp, mus musculus
catggtgctgggcttcttcggcttc

SEQ ID NO: 57171 - DNA, 25 bp, mus musculus
cggcttcttcaccctgggcatcatg

SEQ ID NO: 57172 - DNA, 25 bp, mus musculus
cctgggcatcatgctgagttacatc

SEQ ID NO: 57173 - DNA, 25 bp, mus musculus
ttacatccgatccaagaagctggag

SEQ ID NO: 57174 - DNA, 25 bp, mus musculus
caacgtgtacatcgagtcagatgcc

SEQ ID NO: 57175 - DNA, 25 bp, mus musculus
accacgagctctatggagcccaatg

SEQ ID NO: 57176 - DNA, 25 bp, mus musculus
tctatggagcccaatgagatgatgc

SEQ ID NO: 57177 - DNA, 25 bp, mus musculus
aaactgccccggctgtctctcaacg

SEQ ID NO: 57178 - DNA, 25 bp, mus musculus
cggctgtctctcaacggtgttcggt

SEQ ID NO: 57179 - DNA, 25 bp, mus musculus
atatcgggcacttccatggccttca

SEQ ID NO: 57180 - DNA, 25 bp, mus musculus
agcagaggcccaccagtggacttgg

SEQ ID NO: 57181 - DNA, 25 bp, mus musculus
agaggcccaccagtggacttggctg

SEQ ID NO: 57182 - DNA, 25 bp, mus musculus
cctgcatcccctgggagaaactgca

SEQ ID NO: 57183 - DNA, 25 bp, mus musculus
gcatcccctgggagaaactgcagga

SEQ ID NO: 57184 - DNA, 25 bp, mus musculus
cctgctggcacttgtcccttccagg

SEQ ID NO: 57185 - DNA, 25 bp, mus musculus
cccctcggtactgcggttgcacaga

SEQ ID NO: 57186 - DNA, 25 bp, mus musculus
ctcggtactgcggttgcacagagta

SEQ ID NO: 57187 - DNA, 25 bp, mus musculus
gagatccgcaaggtgctggacgcca

SEQ ID NO: 57188 - DNA, 25 bp, mus musculus
ctggacgccaacagctgccaaagcg

SEQ ID NO: 57189 - DNA, 25 bp, mus musculus
gccaacagctgccaaagcgagctgc

SEQ ID NO: 57190 - DNA, 25 bp, mus musculus
aacagctgccaaagcgagctgcacg

SEQ ID NO: 57191 - DNA, 25 bp, mus musculus
ctactgtgcgtgcatggcacaccag

SEQ ID NO: 57192 - DNA, 25 bp, mus musculus
gtgcatggcacaccaggccacgaga

SEQ ID NO: 57193 - DNA, 25 bp, mus musculus
catggcacaccaggccacgagaact

SEQ ID NO: 57194 - DNA, 25 bp, mus musculus
ccaggccacgagaactttgtgcagt

SEQ ID NO: 57195 - DNA, 25 bp, mus musculus
gagaatctcagcgatcctcagttac

SEQ ID NO: 57196 - DNA, 25 bp, mus musculus
agaatctcagcgatcctcagttact

SEQ ID NO: 57197 - DNA, 25 bp, mus musculus
gtgatcctgcattgcgaaaacgctt

SEQ ID NO: 57198 - DNA, 25 bp, mus musculus
tgatcctgcattgcgaaaacgcttg

SEQ ID NO: 57199 - DNA, 25 bp, mus musculus
gatcctgcattgcgaaaacgcttgc

SEQ ID NO: 57200 - DNA, 25 bp, mus musculus
atcctgcattgcgaaaacgcttgca

SEQ ID NO: 57201 - DNA, 25 bp, mus musculus
ctgcattgcgaaaacgcttgcaaac

SEQ ID NO: 57202 - DNA, 25 bp, mus musculus
attgcgaaaacgcttgcaaacctgg

SEQ ID NO: 57203 - DNA, 25 bp, mus musculus
cttgcaaacctggagaatcgcttca

SEQ ID NO: 57204 - DNA, 25 bp, mus musculus
aacctggagaatcgcttcagcggtg

SEQ ID NO: 57205 - DNA, 25 bp, mus musculus
gacctgagcccagcgcgcacgagga

SEQ ID NO: 57206 - DNA, 25 bp, mus musculus
acctgagcccagcgcgcacgaggag

SEQ ID NO: 57207 - DNA, 25 bp, mus musculus
gaatctcagcgatcctcagttactc

SEQ ID NO: 57208 - DNA, 25 bp, mus musculus
aatctcagcgatcctcagttactcc

SEQ ID NO: 57209 - DNA, 25 bp, mus musculus
tctcagcgatcctcagttactcccg

SEQ ID NO: 57210 - DNA, 25 bp, mus musculus
tcagcgatcctcagttactcccgca

SEQ ID NO: 57211 - DNA, 25 bp, mus musculus
cagcgatcctcagttactcccgcat

SEQ ID NO: 57212 - DNA, 25 bp, mus musculus
cgatcctcagttactcccgcatctt

SEQ ID NO: 57213 - DNA, 25 bp, mus musculus
gatcctcagttactcccgcatcttc

SEQ ID NO: 57214 - DNA, 25 bp, mus musculus
atcctcagttactcccgcatcttct

SEQ ID NO: 57215 - DNA, 25 bp, mus musculus
atggagcttctcactcgacggcgtg

SEQ ID NO: 57216 - DNA, 25 bp, mus musculus
gagcttctcactcgacggcgtgcga

SEQ ID NO: 57217 - DNA, 25 bp, mus musculus
ctttcctgaagaacaggagtacata

SEQ ID NO: 57218 - DNA, 25 bp, mus musculus
gagtacatatcggccaccaaacact

SEQ ID NO: 57219 - DNA, 25 bp, mus musculus
gtacatatcggccaccaaacactcg

SEQ ID NO: 57220 - DNA, 25 bp, mus musculus
cggtcttcccctagagcgagcttgc

SEQ ID NO: 57221 - DNA, 25 bp, mus musculus
cccctagagcgagcttgccttgatg

SEQ ID NO: 57222 - DNA, 25 bp, mus musculus
cctagagcgagcttgccttgatgtt

SEQ ID NO: 57223 - DNA, 25 bp, mus musculus
ctagagcgagcttgccttgatgttt

SEQ ID NO: 57224 - DNA, 25 bp, mus musculus
agagcgagcttgccttgatgtttta

SEQ ID NO: 57225 - DNA, 25 bp, mus musculus
gagcgagcttgccttgatgttttac

SEQ ID NO: 57226 - DNA, 25 bp, mus musculus
cgagcttgccttgatgttttacttt

SEQ ID NO: 57227 - DNA, 25 bp, mus musculus
agcttctcactcgacggcgtgcgag

SEQ ID NO: 57228 - DNA, 25 bp, mus musculus
ttctcactcgacggcgtgcgagtat

SEQ ID NO: 57229 - DNA, 25 bp, mus musculus
ctcgacggcgtgcgagtattacctc

SEQ ID NO: 57230 - DNA, 25 bp, mus musculus
ccgccatgcaatttcctctatcaat

SEQ ID NO: 57231 - DNA, 25 bp, mus musculus
gccatgcaatttcctctatcaataa

SEQ ID NO: 57232 - DNA, 25 bp, mus musculus
ccatgcaatttcctctatcaataat

SEQ ID NO: 57233 - DNA, 25 bp, mus musculus
atgcaatttcctctatcaataattt

SEQ ID NO: 57234 - DNA, 25 bp, mus musculus
ttctttcctgaagaacaggagtaca

SEQ ID NO: 57235 - DNA, 25 bp, mus musculus
gatatctcctgtgcgatcttcactt

SEQ ID NO: 57236 - DNA, 25 bp, mus musculus
tcctgtgcgatcttcacttcacctc

SEQ ID NO: 57237 - DNA, 25 bp, mus musculus
gcagaaactccttctgcagatgtac

SEQ ID NO: 57238 - DNA, 25 bp, mus musculus
gatgtacactgtcactctcagctcc

SEQ ID NO: 57239 - DNA, 25 bp, mus musculus
cggcttccacctgatcctggagatc

SEQ ID NO: 57240 - DNA, 25 bp, mus musculus
ccacctgatcctggagatctatgtt

SEQ ID NO: 57241 - DNA, 25 bp, mus musculus
tctacaatgatgctcattctccatc

SEQ ID NO: 57242 - DNA, 25 bp, mus musculus
atgatgctcattctccatcacctgg

SEQ ID NO: 57243 - DNA, 25 bp, mus musculus
cacctggcagcaacgggctctgcca

SEQ ID NO: 57244 - DNA, 25 bp, mus musculus
gcagcaacgggctctgccaggtcaa

SEQ ID NO: 57245 - DNA, 25 bp, mus musculus
aggtcaacaaggactgcttggtgtc

SEQ ID NO: 57246 - DNA, 25 bp, mus musculus
tggtgtcccgtgcaaccctgctcct

SEQ ID NO: 57247 - DNA, 25 bp, mus musculus
gcgatcttcacttcacctccagtct

SEQ ID NO: 57248 - DNA, 25 bp, mus musculus
ccagtcttcctggtgctcatcttgt

SEQ ID NO: 57249 - DNA, 25 bp, mus musculus
ttcctggtgctcatcttgttactct

SEQ ID NO: 57250 - DNA, 25 bp, mus musculus
ggacgatcttcttggccatggtgtg

SEQ ID NO: 57251 - DNA, 25 bp, mus musculus
tggccatggtgtgacctctgttcta

SEQ ID NO: 57252 - DNA, 25 bp, mus musculus
tggtgtgacctctgttctattggaa

SEQ ID NO: 57253 - DNA, 25 bp, mus musculus
tgttctattggaacctggtagcttc

SEQ ID NO: 57254 - DNA, 25 bp, mus musculus
tagcttcttctcaacttgggtcaag

SEQ ID NO: 57255 - DNA, 25 bp, mus musculus
tacccctgcttagcaccgatctctg

SEQ ID NO: 57256 - DNA, 25 bp, mus musculus
cctgcttagcaccgatctctgcaac

SEQ ID NO: 57257 - DNA, 25 bp, mus musculus
cagctcatgcatgtacagtggggca

SEQ ID NO: 57258 - DNA, 25 bp, mus musculus
tcatgcatgtacagtggggcactca

SEQ ID NO: 57259 - DNA, 25 bp, mus musculus
tggggcactcacacaccgcatgctg

SEQ ID NO: 57260 - DNA, 25 bp, mus musculus
gggcactcacacaccgcatgctgtg

SEQ ID NO: 57261 - DNA, 25 bp, mus musculus
actcacacaccgcatgctgtgtgcc

SEQ ID NO: 57262 - DNA, 25 bp, mus musculus
cggctacctggatggaagggcagat

SEQ ID NO: 57263 - DNA, 25 bp, mus musculus
tgtcccagtggtgacacgtggcacc

SEQ ID NO: 57264 - DNA, 25 bp, mus musculus
tcccagtggtgacacgtggcacctt

SEQ ID NO: 57265 - DNA, 25 bp, mus musculus
tggtgacacgtggcaccttgtaggg

SEQ ID NO: 57266 - DNA, 25 bp, mus musculus
gtgacacgtggcaccttgtaggggt

SEQ ID NO: 57267 - DNA, 25 bp, mus musculus
cttagcaccgatctctgcaacagct

SEQ ID NO: 57268 - DNA, 25 bp, mus musculus
tagcaccgatctctgcaacagctca

SEQ ID NO: 57269 - DNA, 25 bp, mus musculus
accgatctctgcaacagctcatgca

SEQ ID NO: 57270 - DNA, 25 bp, mus musculus
cgatctctgcaacagctcatgcatg

SEQ ID NO: 57271 - DNA, 25 bp, mus musculus
atctctgcaacagctcatgcatgta

SEQ ID NO: 57272 - DNA, 25 bp, mus musculus
ctctgcaacagctcatgcatgtaca

SEQ ID NO: 57273 - DNA, 25 bp, mus musculus
ctgcaacagctcatgcatgtacagt

SEQ ID NO: 57274 - DNA, 25 bp, mus musculus
gcaacagctcatgcatgtacagtgg

SEQ ID NO: 57275 - DNA, 25 bp, mus musculus
gacacggatcctgccaactctgctc

SEQ ID NO: 57276 - DNA, 25 bp, mus musculus
cctgccaactctgctctacagatca

SEQ ID NO: 57277 - DNA, 25 bp, mus musculus
atctctagcttgcaatgacatgagt

SEQ ID NO: 57278 - DNA, 25 bp, mus musculus
gcaaacggctacgagtgtgaactgt

SEQ ID NO: 57279 - DNA, 25 bp, mus musculus
ccccgagcgacacaccagaagttat

SEQ ID NO: 57280 - DNA, 25 bp, mus musculus
cgagcgacacaccagaagttatgac

SEQ ID NO: 57281 - DNA, 25 bp, mus musculus
gcgacacaccagaagttatgactac

SEQ ID NO: 57282 - DNA, 25 bp, mus musculus
actgttctgtcgcacccagtggtac

SEQ ID NO: 57283 - DNA, 25 bp, mus musculus
gttctgtcgcacccagtggtacctg

SEQ ID NO: 57284 - DNA, 25 bp, mus musculus
ctgtcgcacccagtggtacctgagg

SEQ ID NO: 57285 - DNA, 25 bp, mus musculus
tcgcacccagtggtacctgaggatt

SEQ ID NO: 57286 - DNA, 25 bp, mus musculus
ccagtggtacctgaggattgacaaa

SEQ ID NO: 57287 - DNA, 25 bp, mus musculus
aactctgctctacagatcatgcttc

SEQ ID NO: 57288 - DNA, 25 bp, mus musculus
gaacagctacaacatcatggaaatc

SEQ ID NO: 57289 - DNA, 25 bp, mus musculus
gctctacagatcatgcttccacctc

SEQ ID NO: 57290 - DNA, 25 bp, mus musculus
ctacagatcatgcttccacctcgtc

SEQ ID NO: 57291 - DNA, 25 bp, mus musculus
ccacctcgtctgtctagtgggcact

SEQ ID NO: 57292 - DNA, 25 bp, mus musculus
cgtctgtctagtgggcactatatct

SEQ ID NO: 57293 - DNA, 25 bp, mus musculus
agtgggcactatatctctagcttgc

SEQ ID NO: 57294 - DNA, 25 bp, mus musculus
gggcactatatctctagcttgcaat

SEQ ID NO: 57295 - DNA, 25 bp, mus musculus
cactatatctctagcttgcaatgac

SEQ ID NO: 57296 - DNA, 25 bp, mus musculus
tgagctcagctgggacctgatgtcc

SEQ ID NO: 57297 - DNA, 25 bp, mus musculus
gctcagctgggacctgatgtccagc

SEQ ID NO: 57298 - DNA, 25 bp, mus musculus
gttactctctgcaaagacatgcagt

SEQ ID NO: 57299 - DNA, 25 bp, mus musculus
actctctgcaaagacatgcagtcct

SEQ ID NO: 57300 - DNA, 25 bp, mus musculus
gacatgcagtcctttagtacaccag

SEQ ID NO: 57301 - DNA, 25 bp, mus musculus
atgcagtcctttagtacaccaggta

SEQ ID NO: 57302 - DNA, 25 bp, mus musculus
cagtcctttagtacaccaggtagca

SEQ ID NO: 57303 - DNA, 25 bp, mus musculus
tcctttagtacaccaggtagcaagt

SEQ ID NO: 57304 - DNA, 25 bp, mus musculus
tttagtacaccaggtagcaagtggg

SEQ ID NO: 57305 - DNA, 25 bp, mus musculus
agtacaccaggtagcaagtgggcag

SEQ ID NO: 57306 - DNA, 25 bp, mus musculus
tgtagccattattgctatctaggtc

SEQ ID NO: 57307 - DNA, 25 bp, mus musculus
tagccattattgctatctaggtcgg

SEQ ID NO: 57308 - DNA, 25 bp, mus musculus
cagctgggacctgatgtccagcaag

SEQ ID NO: 57309 - DNA, 25 bp, mus musculus
agccattattgctatctaggtcgga

SEQ ID NO: 57310 - DNA, 25 bp, mus musculus
cctgatgtccagcaagcaatcgata

SEQ ID NO: 57311 - DNA, 25 bp, mus musculus
gatgtccagcaagcaatcgatagat

SEQ ID NO: 57312 - DNA, 25 bp, mus musculus
gtccagcaagcaatcgatagatgct

SEQ ID NO: 57313 - DNA, 25 bp, mus musculus
agatgcttggcttttatcgttactc

SEQ ID NO: 57314 - DNA, 25 bp, mus musculus
gcttttatcgttactctctgcaaag

SEQ ID NO: 57315 - DNA, 25 bp, mus musculus
tttatcgttactctctgcaaagaca

SEQ ID NO: 57316 - DNA, 25 bp, mus musculus
atcgttactctctgcaaagacatgc

SEQ ID NO: 57317 - DNA, 25 bp, mus musculus
attcacctgacacacgtcgtcctgc

SEQ ID NO: 57318 - DNA, 25 bp, mus musculus
tcacctgacacacgtcgtcctgcgt

SEQ ID NO: 57319 - DNA, 25 bp, mus musculus
tcgcccgcagtctactaggtgataa

SEQ ID NO: 57320 - DNA, 25 bp, mus musculus
gcccgcagtctactaggtgataaat

SEQ ID NO: 57321 - DNA, 25 bp, mus musculus
ccgcagtctactaggtgataaataa

SEQ ID NO: 57322 - DNA, 25 bp, mus musculus
taaataactactgtcaactcgatgc

SEQ ID NO: 57323 - DNA, 25 bp, mus musculus
taactactgtcaactcgatgctgcc

SEQ ID NO: 57324 - DNA, 25 bp, mus musculus
tactgtcaactcgatgctgccacac

SEQ ID NO: 57325 - DNA, 25 bp, mus musculus
ctgtcaactcgatgctgccacacgg

SEQ ID NO: 57326 - DNA, 25 bp, mus musculus
gtcaactcgatgctgccacacggtc

SEQ ID NO: 57327 - DNA, 25 bp, mus musculus
taagctctagctcatcaagatgcat

SEQ ID NO: 57328 - DNA, 25 bp, mus musculus
agctctagctcatcaagatgcatga

SEQ ID NO: 57329 - DNA, 25 bp, mus musculus
gacacacgtcgtcctgcgtgtggaa

SEQ ID NO: 57330 - DNA, 25 bp, mus musculus
cacacgtcgtcctgcgtgtggaata

SEQ ID NO: 57331 - DNA, 25 bp, mus musculus
cacgtcgtcctgcgtgtggaatatg

SEQ ID NO: 57332 - DNA, 25 bp, mus musculus
ctataatatggacgctccgtgtgga

SEQ ID NO: 57333 - DNA, 25 bp, mus musculus
ataatatggacgctccgtgtggatg

SEQ ID NO: 57334 - DNA, 25 bp, mus musculus
aatatggacgctccgtgtggatgct

SEQ ID NO: 57335 - DNA, 25 bp, mus musculus
ctccgtgtggatgctcgcccgcagt

SEQ ID NO: 57336 - DNA, 25 bp, mus musculus
atgctcgcccgcagtctactaggtg

SEQ ID NO: 57337 - DNA, 25 bp, mus musculus
aaagcgttcatcatcagaaagttca

SEQ ID NO: 57338 - DNA, 25 bp, mus musculus
ttcatcatcagaaagttcaaaggca

SEQ ID NO: 57339 - DNA, 25 bp, mus musculus
ctgcgtggctagcagtgtaggtaca

SEQ ID NO: 57340 - DNA, 25 bp, mus musculus
ttttccaattatggtctcaccttgt

SEQ ID NO: 57341 - DNA, 25 bp, mus musculus
aattatggtctcaccttgtttctca

SEQ ID NO: 57342 - DNA, 25 bp, mus musculus
tcctttcttggcatgtaacatgtac

SEQ ID NO: 57343 - DNA, 25 bp, mus musculus
tttcttggcatgtaacatgtacgta

SEQ ID NO: 57344 - DNA, 25 bp, mus musculus
taacatgtacgtatttctgaaatat

SEQ ID NO: 57345 - DNA, 25 bp, mus musculus
atccctgttattttagctgccttat

SEQ ID NO: 57346 - DNA, 25 bp, mus musculus
gttattttagctgccttattgggag

SEQ ID NO: 57347 - DNA, 25 bp, mus musculus
attttagctgccttattgggagaga

SEQ ID NO: 57348 - DNA, 25 bp, mus musculus
ttagctgccttattgggagagaagt

SEQ ID NO: 57349 - DNA, 25 bp, mus musculus
ttcaaaggcaccaagttctcacttt

SEQ ID NO: 57350 - DNA, 25 bp, mus musculus
ttaaccatcctagtgactttgcttt

SEQ ID NO: 57351 - DNA, 25 bp, mus musculus
cagtttttactgtgtggccactggt

SEQ ID NO: 57352 - DNA, 25 bp, mus musculus
tgtggccactggtttaagcaatgtt

SEQ ID NO: 57353 - DNA, 25 bp, mus musculus
tgttttgctcattcagtttgagggg

SEQ ID NO: 57354 - DNA, 25 bp, mus musculus
gctcattcagtttgaggggacagcg

SEQ ID NO: 57355 - DNA, 25 bp, mus musculus
gagactcgtgttctgcgtggctagc

SEQ ID NO: 57356 - DNA, 25 bp, mus musculus
gttctgcgtggctagcagtgtaggt

SEQ ID NO: 57357 - DNA, 25 bp, mus musculus
ttccgatgccattaggctcttttcc

SEQ ID NO: 57358 - DNA, 25 bp, mus musculus
tccgatgccattaggctcttttcca

SEQ ID NO: 57359 - DNA, 25 bp, mus musculus
ttttccagtcatcgttcttgggtga

SEQ ID NO: 57360 - DNA, 25 bp, mus musculus
ttccagtcatcgttcttgggtgatg

SEQ ID NO: 57361 - DNA, 25 bp, mus musculus
agtcatcgttcttgggtgatggaat

SEQ ID NO: 57362 - DNA, 25 bp, mus musculus
catcgttcttgggtgatggaatcct

SEQ ID NO: 57363 - DNA, 25 bp, mus musculus
tagccagtcattgctgataggatgt

SEQ ID NO: 57364 - DNA, 25 bp, mus musculus
gccagtcattgctgataggatgtag

SEQ ID NO: 57365 - DNA, 25 bp, mus musculus
agatattactgctctgactcctagc

SEQ ID NO: 57366 - DNA, 25 bp, mus musculus
gatatgtggctccatcctgtcctca

SEQ ID NO: 57367 - DNA, 25 bp, mus musculus
atatgtggctccatcctgtcctcac

SEQ ID NO: 57368 - DNA, 25 bp, mus musculus
atgtggctccatcctgtcctcactg

SEQ ID NO: 57369 - DNA, 25 bp, mus musculus
cgatgccattaggctcttttccagt

SEQ ID NO: 57370 - DNA, 25 bp, mus musculus
gatgccattaggctcttttccagtc

SEQ ID NO: 57371 - DNA, 25 bp, mus musculus
gccattaggctcttttccagtcatc

SEQ ID NO: 57372 - DNA, 25 bp, mus musculus
cattaggctcttttccagtcatcgt

SEQ ID NO: 57373 - DNA, 25 bp, mus musculus
attaggctcttttccagtcatcgtt

SEQ ID NO: 57374 - DNA, 25 bp, mus musculus
taggctcttttccagtcatcgttct

SEQ ID NO: 57375 - DNA, 25 bp, mus musculus
gctcttttccagtcatcgttcttgg

SEQ ID NO: 57376 - DNA, 25 bp, mus musculus
ctcttttccagtcatcgttcttggg

SEQ ID NO: 57377 - DNA, 25 bp, mus musculus
catccaggtgaccctgtcaaggaag

SEQ ID NO: 57378 - DNA, 25 bp, mus musculus
ctactctcagcccagcgtgtcagca

SEQ ID NO: 57379 - DNA, 25 bp, mus musculus
gatgctcaactagatcagtatctcc

SEQ ID NO: 57380 - DNA, 25 bp, mus musculus
ctcaactagatcagtatctcctcgc

SEQ ID NO: 57381 - DNA, 25 bp, mus musculus
caactagatcagtatctcctcgctt

SEQ ID NO: 57382 - DNA, 25 bp, mus musculus
gatcagtatctcctcgcttttcgta

SEQ ID NO: 57383 - DNA, 25 bp, mus musculus
acctgtcgccaatctgacaaacttc

SEQ ID NO: 57384 - DNA, 25 bp, mus musculus
ctgtcgccaatctgacaaacttcgg

SEQ ID NO: 57385 - DNA, 25 bp, mus musculus
cgccaatctgacaaacttcggaacg

SEQ ID NO: 57386 - DNA, 25 bp, mus musculus
ccaatctgacaaacttcggaacgtg

SEQ ID NO: 57387 - DNA, 25 bp, mus musculus
tctgacaaacttcggaacgtgaggc

SEQ ID NO: 57388 - DNA, 25 bp, mus musculus
tgacaaacttcggaacgtgaggctt

SEQ ID NO: 57389 - DNA, 25 bp, mus musculus
actctcagcccagcgtgtcagcagg

SEQ ID NO: 57390 - DNA, 25 bp, mus musculus
agcccagcgtgtcagcaggcccatg

SEQ ID NO: 57391 - DNA, 25 bp, mus musculus
cagcgtgtcagcaggcccatgatgc

SEQ ID NO: 57392 - DNA, 25 bp, mus musculus
gtcagcaggcccatgatgctcaact

SEQ ID NO: 57393 - DNA, 25 bp, mus musculus
cagcaggcccatgatgctcaactag

SEQ ID NO: 57394 - DNA, 25 bp, mus musculus
aggcccatgatgctcaactagatca

SEQ ID NO: 57395 - DNA, 25 bp, mus musculus
gcccatgatgctcaactagatcagt

SEQ ID NO: 57396 - DNA, 25 bp, mus musculus
atgatgctcaactagatcagtatct

SEQ ID NO: 57397 - DNA, 25 bp, mus musculus
aaccagctgcagaaatcttgataaa

SEQ ID NO: 57398 - DNA, 25 bp, mus musculus
aaatcttgataaagcctcaggaaga

SEQ ID NO: 57399 - DNA, 25 bp, mus musculus
tttgagctttcctggtcatactctc

SEQ ID NO: 57400 - DNA, 25 bp, mus musculus
tcctggtcatactctcttcagacgc

SEQ ID NO: 57401 - DNA, 25 bp, mus musculus
tggtcatactctcttcagacgccaa

SEQ ID NO: 57402 - DNA, 25 bp, mus musculus
atcaccagggatctcagcgcaatta

SEQ ID NO: 57403 - DNA, 25 bp, mus musculus
accagggatctcagcgcaattacag

SEQ ID NO: 57404 - DNA, 25 bp, mus musculus
ctcagcgcaattacagtttaggggt

SEQ ID NO: 57405 - DNA, 25 bp, mus musculus
tgtcctatccaataaagctctgaaa

SEQ ID NO: 57406 - DNA, 25 bp, mus musculus
cctatccaataaagctctgaaattc

SEQ ID NO: 57407 - DNA, 25 bp, mus musculus
atccaataaagctctgaaattcgct

SEQ ID NO: 57408 - DNA, 25 bp, mus musculus
taaagctctgaaattcgctgccaaa

SEQ ID NO: 57409 - DNA, 25 bp, mus musculus
aaactagagtcgctttggacagtga

SEQ ID NO: 57410 - DNA, 25 bp, mus musculus
aaagctctgaaattcgctgccaaaa

SEQ ID NO: 57411 - DNA, 25 bp, mus musculus
ctagagtcgctttggacagtgaacc

SEQ ID NO: 57412 - DNA, 25 bp, mus musculus
acattgtatgcaccaagaagttaag

SEQ ID NO: 57413 - DNA, 25 bp, mus musculus
tgtggttttcacctccagtgtaaag

SEQ ID NO: 57414 - DNA, 25 bp, mus musculus
tttcacctccagtgtaaagatgaac

SEQ ID NO: 57415 - DNA, 25 bp, mus musculus
cacctccagtgtaaagatgaactgt

SEQ ID NO: 57416 - DNA, 25 bp, mus musculus
taaatactactgctactgcctgagt

SEQ ID NO: 57417 - DNA, 25 bp, mus musculus
ctgctactgcctgagtttaaggaag

SEQ ID NO: 57418 - DNA, 25 bp, mus musculus
tagacgcattttctcacctagcgcc

SEQ ID NO: 57419 - DNA, 25 bp, mus musculus
cgcattttctcacctagcgccattt

SEQ ID NO: 57420 - DNA, 25 bp, mus musculus
ggctatgcacggacccttctctgga

SEQ ID NO: 57421 - DNA, 25 bp, mus musculus
ctatgcacggacccttctctggagc

SEQ ID NO: 57422 - DNA, 25 bp, mus musculus
gcacggacccttctctggagcgaca

SEQ ID NO: 57423 - DNA, 25 bp, mus musculus
acggacccttctctggagcgacact

SEQ ID NO: 57424 - DNA, 25 bp, mus musculus
acccttctctggagcgacactctgc

SEQ ID NO: 57425 - DNA, 25 bp, mus musculus
ctctggagcgacactctgctcctcg

SEQ ID NO: 57426 - DNA, 25 bp, mus musculus
agcgacactctgctcctcgcgattc

SEQ ID NO: 57427 - DNA, 25 bp, mus musculus
ctcctcgcgattctgggctttgatc

SEQ ID NO: 57428 - DNA, 25 bp, mus musculus
tcaagagccatgtggcctgtgtgct

SEQ ID NO: 57429 - DNA, 25 bp, mus musculus
aagagccatgtggcctgtgtgctct

SEQ ID NO: 57430 - DNA, 25 bp, mus musculus
cattttctcacctagcgccatttca

SEQ ID NO: 57431 - DNA, 25 bp, mus musculus
ttctcacctagcgccatttcaaggg

SEQ ID NO: 57432 - DNA, 25 bp, mus musculus
ctcacctagcgccatttcaagggat

SEQ ID NO: 57433 - DNA, 25 bp, mus musculus
gatatcgacatagcttctaagtaca

SEQ ID NO: 57434 - DNA, 25 bp, mus musculus
tatcgacatagcttctaagtacatt

SEQ ID NO: 57435 - DNA, 25 bp, mus musculus
catagcttctaagtacattggagct

SEQ ID NO: 57436 - DNA, 25 bp, mus musculus
atcattggctatgcacggacccttc

SEQ ID NO: 57437 - DNA, 25 bp, mus musculus
cattggctatgcacggacccttctc

SEQ ID NO: 57438 - DNA, 25 bp, mus musculus
atcgtggtaactccttgcatggaaa

SEQ ID NO: 57439 - DNA, 25 bp, mus musculus
gtggtaactccttgcatggaaataa

SEQ ID NO: 57440 - DNA, 25 bp, mus musculus
atctgttctcgcctggccagagatg

SEQ ID NO: 57441 - DNA, 25 bp, mus musculus
tctgttctcgcctggccagagatga

SEQ ID NO: 57442 - DNA, 25 bp, mus musculus
tctcgcctggccagagatgagcgtt

SEQ ID NO: 57443 - DNA, 25 bp, mus musculus
cgcctggccagagatgagcgttggt

SEQ ID NO: 57444 - DNA, 25 bp, mus musculus
ggaatcaattactctgcagcgacaa

SEQ ID NO: 57445 - DNA, 25 bp, mus musculus
atcaattactctgcagcgacaaaga

SEQ ID NO: 57446 - DNA, 25 bp, mus musculus
tcaattactctgcagcgacaaagag

SEQ ID NO: 57447 - DNA, 25 bp, mus musculus
attactctgcagcgacaaagagcta

SEQ ID NO: 57448 - DNA, 25 bp, mus musculus
tactctgcagcgacaaagagctaag

SEQ ID NO: 57449 - DNA, 25 bp, mus musculus
actctgcagcgacaaagagctaagt

SEQ ID NO: 57450 - DNA, 25 bp, mus musculus
ggtaactccttgcatggaaataagt

SEQ ID NO: 57451 - DNA, 25 bp, mus musculus
gtaactccttgcatggaaataagta

SEQ ID NO: 57452 - DNA, 25 bp, mus musculus
aactccttgcatggaaataagtact

SEQ ID NO: 57453 - DNA, 25 bp, mus musculus
actccttgcatggaaataagtactt

SEQ ID NO: 57454 - DNA, 25 bp, mus musculus
ataagtacttagccctgtgcatctg

SEQ ID NO: 57455 - DNA, 25 bp, mus musculus
aagtacttagccctgtgcatctgtt

SEQ ID NO: 57456 - DNA, 25 bp, mus musculus
tacttagccctgtgcatctgttctc

SEQ ID NO: 57457 - DNA, 25 bp, mus musculus
acttagccctgtgcatctgttctcg

SEQ ID NO: 57458 - DNA, 25 bp, mus musculus
acacactgcatcaatggctcaagga

SEQ ID NO: 57459 - DNA, 25 bp, mus musculus
tgcatcaatggctcaaggacaagaa

SEQ ID NO: 57460 - DNA, 25 bp, mus musculus
aagagtacaccaagaccagagagtt

SEQ ID NO: 57461 - DNA, 25 bp, mus musculus
acaaggcttacctagcaattcggca

SEQ ID NO: 57462 - DNA, 25 bp, mus musculus
cttacctagcaattcggcagcatgc

SEQ ID NO: 57463 - DNA, 25 bp, mus musculus
ttcggcagcatgccaatctcttcat

SEQ ID NO: 57464 - DNA, 25 bp, mus musculus
agcatgccaatctcttcatcaacct

SEQ ID NO: 57465 - DNA, 25 bp, mus musculus
tcttcatcaaccttttttcaatgat

SEQ ID NO: 57466 - DNA, 25 bp, mus musculus
ttttttcaatgatgcttggctctgg

SEQ ID NO: 57467 - DNA, 25 bp, mus musculus
gaatgccagaactacaatcttttga

SEQ ID NO: 57468 - DNA, 25 bp, mus musculus
cagaactacaatcttttgatgacat

SEQ ID NO: 57469 - DNA, 25 bp, mus musculus
atatccgaaagactctagccttgga

SEQ ID NO: 57470 - DNA, 25 bp, mus musculus
atgcagccattgacctgttcactcg

SEQ ID NO: 57471 - DNA, 25 bp, mus musculus
ccattgacctgttcactcggtcctg

SEQ ID NO: 57472 - DNA, 25 bp, mus musculus
acctgttcactcggtcctgcgctgg

SEQ ID NO: 57473 - DNA, 25 bp, mus musculus
ggtactgcgtggcaacctttatctt

SEQ ID NO: 57474 - DNA, 25 bp, mus musculus
accggcacaacagcaacatcatggt

SEQ ID NO: 57475 - DNA, 25 bp, mus musculus
atgacggacagctgtttcatataga

SEQ ID NO: 57476 - DNA, 25 bp, mus musculus
ggcactttttggatcacaagaagaa

SEQ ID NO: 57477 - DNA, 25 bp, mus musculus
tgttgacacaggatttcttgattgt

SEQ ID NO: 57478 - DNA, 25 bp, mus musculus
ctccggcaagcggggccattctgcc

SEQ ID NO: 57479 - DNA, 25 bp, mus musculus
ttctgcccagatcgctaagcctgtg

SEQ ID NO: 57480 - DNA, 25 bp, mus musculus
aaccctggccacatatctgcacttt

SEQ ID NO: 57481 - DNA, 25 bp, mus musculus
atatctgcactttcagtttctaaga

SEQ ID NO: 57482 - DNA, 25 bp, mus musculus
gcactttcagtttctaagagggact

SEQ ID NO: 57483 - DNA, 25 bp, mus musculus
tgaggcctcttctctcagcatgctg

SEQ ID NO: 57484 - DNA, 25 bp, mus musculus
tctcagcatgctgcaaaacctgtgg

SEQ ID NO: 57485 - DNA, 25 bp, mus musculus
catgctgcaaaacctgtggtctctg

SEQ ID NO: 57486 - DNA, 25 bp, mus musculus
cctgtggtctctgacactaactccc

SEQ ID NO: 57487 - DNA, 25 bp, mus musculus
agcccgtgatcttggactgtttgat

SEQ ID NO: 57488 - DNA, 25 bp, mus musculus
tgatcttggactgtttgatgtctcc

SEQ ID NO: 57489 - DNA, 25 bp, mus musculus
gtttgatgtctcctcctattccgta

SEQ ID NO: 57490 - DNA, 25 bp, mus musculus
cttccagaactaccagaacctgcac

SEQ ID NO: 57491 - DNA, 25 bp, mus musculus
ggctgcgcctagctccacttcagat

SEQ ID NO: 57492 - DNA, 25 bp, mus musculus
ctccacttcagatatgtactttgcc

SEQ ID NO: 57493 - DNA, 25 bp, mus musculus
tatgtactttgccagcagcggacgc

SEQ ID NO: 57494 - DNA, 25 bp, mus musculus
ctttgccagcagcggacgcacatct

SEQ ID NO: 57495 - DNA, 25 bp, mus musculus
ctaccagaaggccaacatggacaat

SEQ ID NO: 57496 - DNA, 25 bp, mus musculus
tgccacagatatcaacgacaacagg

SEQ ID NO: 57497 - DNA, 25 bp, mus musculus
agatatcaacgacaacaggagtgac

SEQ ID NO: 57498 - DNA, 25 bp, mus musculus
cattggcctcattgatatcttctag

SEQ ID NO: 57499 - DNA, 25 bp, mus musculus
cctcattgatatcttctagcctgaa

SEQ ID NO: 57500 - DNA, 25 bp, mus musculus
tatggtctccgacgcattccacaaa

SEQ ID NO: 57501 - DNA, 25 bp, mus musculus
tggtctccgacgcattccacaaatg

SEQ ID NO: 57502 - DNA, 25 bp, mus musculus
gtctccgacgcattccacaaatgca

SEQ ID NO: 57503 - DNA, 25 bp, mus musculus
ctccgacgcattccacaaatgcatt

SEQ ID NO: 57504 - DNA, 25 bp, mus musculus
ccgacgcattccacaaatgcatttc

SEQ ID NO: 57505 - DNA, 25 bp, mus musculus
cgcattccacaaatgcatttcttcg

SEQ ID NO: 57506 - DNA, 25 bp, mus musculus
cattccacaaatgcatttcttcgaa

SEQ ID NO: 57507 - DNA, 25 bp, mus musculus
ttccacaaatgcatttcttcgaagg

SEQ ID NO: 57508 - DNA, 25 bp, mus musculus
ccacaaatgcatttcttcgaaggaa

SEQ ID NO: 57509 - DNA, 25 bp, mus musculus
gcatttcttcgaaggaaatgaagaa

SEQ ID NO: 57510 - DNA, 25 bp, mus musculus
tcattgatatcttctagcctgaaaa

SEQ ID NO: 57511 - DNA, 25 bp, mus musculus
attgatatcttctagcctgaaaagt

SEQ ID NO: 57512 - DNA, 25 bp, mus musculus
tgatatcttctagcctgaaaagtct

SEQ ID NO: 57513 - DNA, 25 bp, mus musculus
atatcttctagcctgaaaagtctga

SEQ ID NO: 57514 - DNA, 25 bp, mus musculus
cttctagcctgaaaagtctgaactc

SEQ ID NO: 57515 - DNA, 25 bp, mus musculus
acgacctctatggtctccgacgcat

SEQ ID NO: 57516 - DNA, 25 bp, mus musculus
gacctctatggtctccgacgcattc

SEQ ID NO: 57517 - DNA, 25 bp, mus musculus
tctatggtctccgacgcattccaca

SEQ ID NO: 57518 - DNA, 25 bp, mus musculus
gctttccagctgttatgaccgaaca

SEQ ID NO: 57519 - DNA, 25 bp, mus musculus
ctttccagctgttatgaccgaacag

SEQ ID NO: 57520 - DNA, 25 bp, mus musculus
ctgctggccctaggcaagagtcact

SEQ ID NO: 57521 - DNA, 25 bp, mus musculus
tgctggccctaggcaagagtcacta

SEQ ID NO: 57522 - DNA, 25 bp, mus musculus
ctggccctaggcaagagtcactacc

SEQ ID NO: 57523 - DNA, 25 bp, mus musculus
gcaagagtcactaccatacgccgag

SEQ ID NO: 57524 - DNA, 25 bp, mus musculus
aagagtcactaccatacgccgagtt

SEQ ID NO: 57525 - DNA, 25 bp, mus musculus
agagtcactaccatacgccgagttg

SEQ ID NO: 57526 - DNA, 25 bp, mus musculus
gtcactaccatacgccgagttgctc

SEQ ID NO: 57527 - DNA, 25 bp, mus musculus
cactaccatacgccgagttgctcaa

SEQ ID NO: 57528 - DNA, 25 bp, mus musculus
taccatacgccgagttgctcaaggt

SEQ ID NO: 57529 - DNA, 25 bp, mus musculus
accatacgccgagttgctcaaggtc

SEQ ID NO: 57530 - DNA, 25 bp, mus musculus
ctgttatgaccgaacaggttgatgg

SEQ ID NO: 57531 - DNA, 25 bp, mus musculus
tgttatgaccgaacaggttgatggc

SEQ ID NO: 57532 - DNA, 25 bp, mus musculus
atggcagatgctcgctacagcgcag

SEQ ID NO: 57533 - DNA, 25 bp, mus musculus
gatgctcgctacagcgcagtgtggg

SEQ ID NO: 57534 - DNA, 25 bp, mus musculus
atgctcgctacagcgcagtgtggga

SEQ ID NO: 57535 - DNA, 25 bp, mus musculus
ctcgctacagcgcagtgtgggagat

SEQ ID NO: 57536 - DNA, 25 bp, mus musculus
agatgtgtctgctggccctaggcaa

SEQ ID NO: 57537 - DNA, 25 bp, mus musculus
tgtctgctggccctaggcaagagtc

SEQ ID NO: 57538 - DNA, 25 bp, mus musculus
tgaattactaactctaaaatgtaag

SEQ ID NO: 57539 - DNA, 25 bp, mus musculus
gctagttgctactgggtggcagata

SEQ ID NO: 57540 - DNA, 25 bp, mus musculus
tgctttgagttctcagctaatagtc

SEQ ID NO: 57541 - DNA, 25 bp, mus musculus
tttgagttctcagctaatagtcatt

SEQ ID NO: 57542 - DNA, 25 bp, mus musculus
gagttctcagctaatagtcattaaa

SEQ ID NO: 57543 - DNA, 25 bp, mus musculus
ttctcagctaatagtcattaaactg

SEQ ID NO: 57544 - DNA, 25 bp, mus musculus
taaatttactctatttagatgacaa

SEQ ID NO: 57545 - DNA, 25 bp, mus musculus
tataatctctaattatctaggaatc

SEQ ID NO: 57546 - DNA, 25 bp, mus musculus
aatctctaattatctaggaatcaaa

SEQ ID NO: 57547 - DNA, 25 bp, mus musculus
atacatatctttgtgtcttattgga

SEQ ID NO: 57548 - DNA, 25 bp, mus musculus
catatctttgtgtcttattggagag

SEQ ID NO: 57549 - DNA, 25 bp, mus musculus
atctttgtgtcttattggagagtca

SEQ ID NO: 57550 - DNA, 25 bp, mus musculus
agttgctactgggtggcagataaat

SEQ ID NO: 57551 - DNA, 25 bp, mus musculus
tgctactgggtggcagataaattgt

SEQ ID NO: 57552 - DNA, 25 bp, mus musculus
ttttaatgccatgcatgctgctttg

SEQ ID NO: 57553 - DNA, 25 bp, mus musculus
taatgccatgcatgctgctttgagt

SEQ ID NO: 57554 - DNA, 25 bp, mus musculus
tgccatgcatgctgctttgagttct

SEQ ID NO: 57555 - DNA, 25 bp, mus musculus
catgcatgctgctttgagttctcag

SEQ ID NO: 57556 - DNA, 25 bp, mus musculus
gcatgctgctttgagttctcagcta

SEQ ID NO: 57557 - DNA, 25 bp, mus musculus
tgctgctttgagttctcagctaata

SEQ ID NO: 57558 - DNA, 25 bp, mus musculus
tggttacgagccgtgacctctgaga

SEQ ID NO: 57559 - DNA, 25 bp, mus musculus
ttacgagccgtgacctctgagattc

SEQ ID NO: 57560 - DNA, 25 bp, mus musculus
gaagagatccggctcctgaggctac

SEQ ID NO: 57561 - DNA, 25 bp, mus musculus
atccggctcctgaggctacttgagt

SEQ ID NO: 57562 - DNA, 25 bp, mus musculus
ctgaggctacttgagtcgtacatgc

SEQ ID NO: 57563 - DNA, 25 bp, mus musculus
ctacttgagtcgtacatgccagtct

SEQ ID NO: 57564 - DNA, 25 bp, mus musculus
gagtcgtacatgccagtcttccact

SEQ ID NO: 57565 - DNA, 25 bp, mus musculus
tcgtacatgccagtcttccactcca

SEQ ID NO: 57566 - DNA, 25 bp, mus musculus
tacatgccagtcttccactccagct

SEQ ID NO: 57567 - DNA, 25 bp, mus musculus
tgcctccatgctactgcttggcact

SEQ ID NO: 57568 - DNA, 25 bp, mus musculus
ctccatgctactgcttggcactctc

SEQ ID NO: 57569 - DNA, 25 bp, mus musculus
catgctactgcttggcactctccta

SEQ ID NO: 57570 - DNA, 25 bp, mus musculus
cgagccgtgacctctgagattcagt

SEQ ID NO: 57571 - DNA, 25 bp, mus musculus
atgctactgcttggcactctcctac

SEQ ID NO: 57572 - DNA, 25 bp, mus musculus
gtgacctctgagattcagtgccatg

SEQ ID NO: 57573 - DNA, 25 bp, mus musculus
catgccaaggcatactttgactcca

SEQ ID NO: 57574 - DNA, 25 bp, mus musculus
tttgactccacacacgaccagctga

SEQ ID NO: 57575 - DNA, 25 bp, mus musculus
cttctcatgtccgcagtaactagtc

SEQ ID NO: 57576 - DNA, 25 bp, mus musculus
ctcatgtccgcagtaactagtctgg

SEQ ID NO: 57577 - DNA, 25 bp, mus musculus
tccgcagtaactagtctggtgaact

SEQ ID NO: 57578 - DNA, 25 bp, mus musculus
ttcttcggcggtttaatcatgcttg

SEQ ID NO: 57579 - DNA, 25 bp, mus musculus
aaatgcttccgctgaaggtccggag

SEQ ID NO: 57580 - DNA, 25 bp, mus musculus
aatgcttccgctgaaggtccggagg

SEQ ID NO: 57581 - DNA, 25 bp, mus musculus
tgctgcttaccatccatacaacacc

SEQ ID NO: 57582 - DNA, 25 bp, mus musculus
gctgcttaccatccatacaacacca

SEQ ID NO: 57583 - DNA, 25 bp, mus musculus
ctgcttaccatccatacaacaccag

SEQ ID NO: 57584 - DNA, 25 bp, mus musculus
tgcttaccatccatacaacaccagg

SEQ ID NO: 57585 - DNA, 25 bp, mus musculus
gcttaccatccatacaacaccagga

SEQ ID NO: 57586 - DNA, 25 bp, mus musculus
cttaccatccatacaacaccaggac

SEQ ID NO: 57587 - DNA, 25 bp, mus musculus
ttaccatccatacaacaccaggact

SEQ ID NO: 57588 - DNA, 25 bp, mus musculus
taccatccatacaacaccaggactt

SEQ ID NO: 57589 - DNA, 25 bp, mus musculus
actgatgtcatcttgagcttttatt

SEQ ID NO: 57590 - DNA, 25 bp, mus musculus
atgcttccgctgaaggtccggaggg

SEQ ID NO: 57591 - DNA, 25 bp, mus musculus
tgcttccgctgaaggtccggagggc

SEQ ID NO: 57592 - DNA, 25 bp, mus musculus
attggctgctgcttaccatccatac

SEQ ID NO: 57593 - DNA, 25 bp, mus musculus
ttggctgctgcttaccatccataca

SEQ ID NO: 57594 - DNA, 25 bp, mus musculus
tggctgctgcttaccatccatacaa

SEQ ID NO: 57595 - DNA, 25 bp, mus musculus
ggctgctgcttaccatccatacaac

SEQ ID NO: 57596 - DNA, 25 bp, mus musculus
gctgctgcttaccatccatacaaca

SEQ ID NO: 57597 - DNA, 25 bp, mus musculus
ctgctgcttaccatccatacaacac

SEQ ID NO: 57598 - DNA, 25 bp, mus musculus
aggtgaagctgctcctacttctgct

SEQ ID NO: 57599 - DNA, 25 bp, mus musculus
tgctcctacttctgctgtggctggt

SEQ ID NO: 57600 - DNA, 25 bp, mus musculus
acatggcggccacaggcttaaatgc

SEQ ID NO: 57601 - DNA, 25 bp, mus musculus
tggcggccacaggcttaaatgccac

SEQ ID NO: 57602 - DNA, 25 bp, mus musculus
caggcttaaatgccacctctggaca

SEQ ID NO: 57603 - DNA, 25 bp, mus musculus
gcttaaatgccacctctggacagga

SEQ ID NO: 57604 - DNA, 25 bp, mus musculus
taaatgccacctctggacaggatac

SEQ ID NO: 57605 - DNA, 25 bp, mus musculus
atgccacctctggacaggatactca

SEQ ID NO: 57606 - DNA, 25 bp, mus musculus
gcagtcatctgggcaccatggtgga

SEQ ID NO: 57607 - DNA, 25 bp, mus musculus
gtcatctgggcaccatggtggaatt

SEQ ID NO: 57608 - DNA, 25 bp, mus musculus
atctgggcaccatggtggaatttgc

SEQ ID NO: 57609 - DNA, 25 bp, mus musculus
tggaatttgcagtggccctggggtc

SEQ ID NO: 57610 - DNA, 25 bp, mus musculus
ttctgctgtggctggtggcatcttg

SEQ ID NO: 57611 - DNA, 25 bp, mus musculus
atttgcagtggccctggggtctaag

SEQ ID NO: 57612 - DNA, 25 bp, mus musculus
tggtggcatcttgttccctatttct

SEQ ID NO: 57613 - DNA, 25 bp, mus musculus
catcttgttccctatttctgcattc

SEQ ID NO: 57614 - DNA, 25 bp, mus musculus
cttgttccctatttctgcattccca

SEQ ID NO: 57615 - DNA, 25 bp, mus musculus
acgcctggctgtctgagctgctctc

SEQ ID NO: 57616 - DNA, 25 bp, mus musculus
cctggctgtctgagctgctctccaa

SEQ ID NO: 57617 - DNA, 25 bp, mus musculus
ctgagctgctctccaagccaaagtt

SEQ ID NO: 57618 - DNA, 25 bp, mus musculus
cctacatggcggccacaggcttaaa

SEQ ID NO: 57619 - DNA, 25 bp, mus musculus
gcatcagccatggctctgcgctacc

SEQ ID NO: 57620 - DNA, 25 bp, mus musculus
tcagccatggctctgcgctacccca

SEQ ID NO: 57621 - DNA, 25 bp, mus musculus
tcaccaaacacaccaagttcgtgcg

SEQ ID NO: 57622 - DNA, 25 bp, mus musculus
tcgcaccctacgagcggcgagccat

SEQ ID NO: 57623 - DNA, 25 bp, mus musculus
caccctacgagcggcgagccatgga

SEQ ID NO: 57624 - DNA, 25 bp, mus musculus
acgagcggcgagccatggagttgct

SEQ ID NO: 57625 - DNA, 25 bp, mus musculus
agcggcgagccatggagttgctcaa

SEQ ID NO: 57626 - DNA, 25 bp, mus musculus
tgtccaaggacaagcgcgcactcaa

SEQ ID NO: 57627 - DNA, 25 bp, mus musculus
aggacaagcgcgcactcaagttcat

SEQ ID NO: 57628 - DNA, 25 bp, mus musculus
acaagcgcgcactcaagttcatcaa

SEQ ID NO: 57629 - DNA, 25 bp, mus musculus
gcgcactcaagttcatcaagaagag

SEQ ID NO: 57630 - DNA, 25 bp, mus musculus
cactcaagttcatcaagaagagggt

SEQ ID NO: 57631 - DNA, 25 bp, mus musculus
atggctctgcgctaccccatggccg

SEQ ID NO: 57632 - DNA, 25 bp, mus musculus
cgctaccccatggccgtgggctcaa

SEQ ID NO: 57633 - DNA, 25 bp, mus musculus
taccccatggccgtgggctcaacaa

SEQ ID NO: 57634 - DNA, 25 bp, mus musculus
cccatggccgtgggctcaacaaggg

SEQ ID NO: 57635 - DNA, 25 bp, mus musculus
ggctcaacaagggccacaaggtgac

SEQ ID NO: 57636 - DNA, 25 bp, mus musculus
aaaacgtcagtaagccgagacacag

SEQ ID NO: 57637 - DNA, 25 bp, mus musculus
agccgagacacagccggcgacgcgg

SEQ ID NO: 57638 - DNA, 25 bp, mus musculus
gcgggcgcctcaccaaacacaccaa

SEQ ID NO: 57639 - DNA, 25 bp, mus musculus
cggccgccatcggagagcatcagcc

SEQ ID NO: 57640 - DNA, 25 bp, mus musculus
ggccgccatcggagagcatcagcca

SEQ ID NO: 57641 - DNA, 25 bp, mus musculus
gccgccatcggagagcatcagccat

SEQ ID NO: 57642 - DNA, 25 bp, mus musculus
ccgccatcggagagcatcagccatg

SEQ ID NO: 57643 - DNA, 25 bp, mus musculus
cggccgccatcggagagcatcagcc

SEQ ID NO: 57644 - DNA, 25 bp, mus musculus
ggccgccatcggagagcatcagcca

SEQ ID NO: 57645 - DNA, 25 bp, mus musculus
gccgccatcggagagcatcagccat

SEQ ID NO: 57646 - DNA, 25 bp, mus musculus
ccgccatcggagagcatcagccatg

SEQ ID NO: 57647 - DNA, 25 bp, mus musculus
tacccttaacgagtacgacacatgg

SEQ ID NO: 57648 - DNA, 25 bp, mus musculus
ccttaacgagtacgacacatggtca

SEQ ID NO: 57649 - DNA, 25 bp, mus musculus
agtctgagtgccatgcctggagacg

SEQ ID NO: 57650 - DNA, 25 bp, mus musculus
ctgagtgccatgcctggagacgctt

SEQ ID NO: 57651 - DNA, 25 bp, mus musculus
agtgccatgcctggagacgcttaat

SEQ ID NO: 57652 - DNA, 25 bp, mus musculus
gccatgcctggagacgcttaatgac

SEQ ID NO: 57653 - DNA, 25 bp, mus musculus
gacgcttaatgacccctgtcgcaga

SEQ ID NO: 57654 - DNA, 25 bp, mus musculus
gcttaatgacccctgtcgcagagtt

SEQ ID NO: 57655 - DNA, 25 bp, mus musculus
taatgacccctgtcgcagagttgtg

SEQ ID NO: 57656 - DNA, 25 bp, mus musculus
tgacccctgtcgcagagttgtgatc

SEQ ID NO: 57657 - DNA, 25 bp, mus musculus
cccctgtcgcagagttgtgatccga

SEQ ID NO: 57658 - DNA, 25 bp, mus musculus
tgtgatccgacaaacggcacccgag

SEQ ID NO: 57659 - DNA, 25 bp, mus musculus
cacatggtcaaaatccacctgaaga

SEQ ID NO: 57660 - DNA, 25 bp, mus musculus
atccacctgaagacacttcactagc

SEQ ID NO: 57661 - DNA, 25 bp, mus musculus
cacctgaagacacttcactagcaag

SEQ ID NO: 57662 - DNA, 25 bp, mus musculus
ctgaagacacttcactagcaagcca

SEQ ID NO: 57663 - DNA, 25 bp, mus musculus
aagacacttcactagcaagccagac

SEQ ID NO: 57664 - DNA, 25 bp, mus musculus
acacttcactagcaagccagacctg

SEQ ID NO: 57665 - DNA, 25 bp, mus musculus
cttcactagcaagccagacctgcgc

SEQ ID NO: 57666 - DNA, 25 bp, mus musculus
gacctgcgacatagtctgagtgcca

SEQ ID NO: 57667 - DNA, 25 bp, mus musculus
atcgtgactcccggcaaggccattc

SEQ ID NO: 57668 - DNA, 25 bp, mus musculus
gactcccggcaaggccattctggct

SEQ ID NO: 57669 - DNA, 25 bp, mus musculus
cgcagtccgtattcagtgctgatga

SEQ ID NO: 57670 - DNA, 25 bp, mus musculus
cagtccgtattcagtgctgatgacc

SEQ ID NO: 57671 - DNA, 25 bp, mus musculus
agtccgtattcagtgctgatgaccg

SEQ ID NO: 57672 - DNA, 25 bp, mus musculus
gtccgtattcagtgctgatgaccgt

SEQ ID NO: 57673 - DNA, 25 bp, mus musculus
tgggtcatcttcttccatgagagac

SEQ ID NO: 57674 - DNA, 25 bp, mus musculus
gggtcatcttcttccatgagagact

SEQ ID NO: 57675 - DNA, 25 bp, mus musculus
ggtcatcttcttccatgagagactc

SEQ ID NO: 57676 - DNA, 25 bp, mus musculus
gtcatcttcttccatgagagactct

SEQ ID NO: 57677 - DNA, 25 bp, mus musculus
tcatcttcttccatgagagactcta

SEQ ID NO: 57678 - DNA, 25 bp, mus musculus
catcttcttccatgagagactctac

SEQ ID NO: 57679 - DNA, 25 bp, mus musculus
actcccggcaaggccattctggctg

SEQ ID NO: 57680 - DNA, 25 bp, mus musculus
atcttcttccatgagagactctacc

SEQ ID NO: 57681 - DNA, 25 bp, mus musculus
gctggtaccgcagtccgtattcagt

SEQ ID NO: 57682 - DNA, 25 bp, mus musculus
ctggtaccgcagtccgtattcagtg

SEQ ID NO: 57683 - DNA, 25 bp, mus musculus
tggtaccgcagtccgtattcagtgc

SEQ ID NO: 57684 - DNA, 25 bp, mus musculus
ggtaccgcagtccgtattcagtgct

SEQ ID NO: 57685 - DNA, 25 bp, mus musculus
taccgcagtccgtattcagtgctga

SEQ ID NO: 57686 - DNA, 25 bp, mus musculus
accgcagtccgtattcagtgctgat

SEQ ID NO: 57687 - DNA, 25 bp, mus musculus
ccgcagtccgtattcagtgctgatg

SEQ ID NO: 57688 - DNA, 25 bp, mus musculus
gatacatacaatagctacacagctg

SEQ ID NO: 57689 - DNA, 25 bp, mus musculus
tacaatagctacacagctgggcagc

SEQ ID NO: 57690 - DNA, 25 bp, mus musculus
agcctgaatggctgccctgaccact

SEQ ID NO: 57691 - DNA, 25 bp, mus musculus
attcaaaaccatcaagctgtcatag

SEQ ID NO: 57692 - DNA, 25 bp, mus musculus
gtcatagacacagtgctgtacagat

SEQ ID NO: 57693 - DNA, 25 bp, mus musculus
tctctgtctttcagtgacacacatg

SEQ ID NO: 57694 - DNA, 25 bp, mus musculus
tctttcagtgacacacatgcatttt

SEQ ID NO: 57695 - DNA, 25 bp, mus musculus
acattcacacaacactttagttaat

SEQ ID NO: 57696 - DNA, 25 bp, mus musculus
tttttccactaagaattatatgcct

SEQ ID NO: 57697 - DNA, 25 bp, mus musculus
gaattatatgccttctagagagctt

SEQ ID NO: 57698 - DNA, 25 bp, mus musculus
tatgccttctagagagctttttccc

SEQ ID NO: 57699 - DNA, 25 bp, mus musculus
attgctacagttcattgggattaaa

SEQ ID NO: 57700 - DNA, 25 bp, mus musculus
acagctgggcagctttccttcccac

SEQ ID NO: 57701 - DNA, 25 bp, mus musculus
agcacccgagggtcactacacattg

SEQ ID NO: 57702 - DNA, 25 bp, mus musculus
tcactacacattggaggcgtcccag

SEQ ID NO: 57703 - DNA, 25 bp, mus musculus
cacattggaggcgtcccagacaaat

SEQ ID NO: 57704 - DNA, 25 bp, mus musculus
tcattttttggctgtctgaagaata

SEQ ID NO: 57705 - DNA, 25 bp, mus musculus
acagaagccaccgatgtccaaggtt

SEQ ID NO: 57706 - DNA, 25 bp, mus musculus
gatgtccaaggttctgtcagcctga

SEQ ID NO: 57707 - DNA, 25 bp, mus musculus
tctgtcagcctgaatggctgccctg

SEQ ID NO: 57708 - DNA, 25 bp, mus musculus
gaatctcggatgacacgtatcacag

SEQ ID NO: 57709 - DNA, 25 bp, mus musculus
tgacacgtatcacagagctagagtg

SEQ ID NO: 57710 - DNA, 25 bp, mus musculus
aggagcatcacatatcagagtgagg

SEQ ID NO: 57711 - DNA, 25 bp, mus musculus
gcatcacatatcagagtgaggacga

SEQ ID NO: 57712 - DNA, 25 bp, mus musculus
cgacacgaagcatgtcttcagactg

SEQ ID NO: 57713 - DNA, 25 bp, mus musculus
acacgaagcatgtcttcagactgca

SEQ ID NO: 57714 - DNA, 25 bp, mus musculus
agcatgtcttcagactgcaggatct

SEQ ID NO: 57715 - DNA, 25 bp, mus musculus
catgtcttcagactgcaggatctag

SEQ ID NO: 57716 - DNA, 25 bp, mus musculus
tgtcttcagactgcaggatctagtg

SEQ ID NO: 57717 - DNA, 25 bp, mus musculus
tcttcagactgcaggatctagtgga

SEQ ID NO: 57718 - DNA, 25 bp, mus musculus
cagactgcaggatctagtggataga

SEQ ID NO: 57719 - DNA, 25 bp, mus musculus
agactccaagtgagagtccagtccc

SEQ ID NO: 57720 - DNA, 25 bp, mus musculus
acacgtatcacagagctagagtgtg

SEQ ID NO: 57721 - DNA, 25 bp, mus musculus
gtgagccgcaaggcgagcatgaaca

SEQ ID NO: 57722 - DNA, 25 bp, mus musculus
gaacaggacacagactctgtggacg

SEQ ID NO: 57723 - DNA, 25 bp, mus musculus
acaggacacagactctgtggacggc

SEQ ID NO: 57724 - DNA, 25 bp, mus musculus
gacacagactctgtggacggcctaa

SEQ ID NO: 57725 - DNA, 25 bp, mus musculus
cacagactctgtggacggcctaagg

SEQ ID NO: 57726 - DNA, 25 bp, mus musculus
cagactctgtggacggcctaaggaa

SEQ ID NO: 57727 - DNA, 25 bp, mus musculus
gactctgtggacggcctaaggaagt

SEQ ID NO: 57728 - DNA, 25 bp, mus musculus
ctttactgagctagggcgagttctt

SEQ ID NO: 57729 - DNA, 25 bp, mus musculus
agttctttctctctcctggcacagc

SEQ ID NO: 57730 - DNA, 25 bp, mus musculus
gctgccttccgacagggcaggtgta

SEQ ID NO: 57731 - DNA, 25 bp, mus musculus
actctgcactggagctagcttcctt

SEQ ID NO: 57732 - DNA, 25 bp, mus musculus
cactggagctagcttccttgtattt

SEQ ID NO: 57733 - DNA, 25 bp, mus musculus
agctagcttccttgtatttgaggag

SEQ ID NO: 57734 - DNA, 25 bp, mus musculus
cttccttgtatttgaggagcaggtc

SEQ ID NO: 57735 - DNA, 25 bp, mus musculus
taatctgcaggtcctcaggggtctg

SEQ ID NO: 57736 - DNA, 25 bp, mus musculus
gtttctggccctggctaggtgagat

SEQ ID NO: 57737 - DNA, 25 bp, mus musculus
ctctcagctctacagattgtttctt

SEQ ID NO: 57738 - DNA, 25 bp, mus musculus
agatgcatgccaaacgtgtgttcca

SEQ ID NO: 57739 - DNA, 25 bp, mus musculus
tcttttacgcctatgatttgtaata

SEQ ID NO: 57740 - DNA, 25 bp, mus musculus
ctcctggcacagctgatggtaggaa

SEQ ID NO: 57741 - DNA, 25 bp, mus musculus
tcccccaaggcaagagctcttggcc

SEQ ID NO: 57742 - DNA, 25 bp, mus musculus
agagctcttggccacaggatgccac

SEQ ID NO: 57743 - DNA, 25 bp, mus musculus
cttggccacaggatgccaccactgc

SEQ ID NO: 57744 - DNA, 25 bp, mus musculus
tcctgcttctagagtacctccgttt

SEQ ID NO: 57745 - DNA, 25 bp, mus musculus
gtgaccggcgttggatcctggatag

SEQ ID NO: 57746 - DNA, 25 bp, mus musculus
gttatggctggctgcagtcactgag

SEQ ID NO: 57747 - DNA, 25 bp, mus musculus
tgcagtcactgagcctctgctgcct

SEQ ID NO: 57748 - DNA, 25 bp, mus musculus
cttcagccatcacgtaaacacgact

SEQ ID NO: 57749 - DNA, 25 bp, mus musculus
cagccatcacgtaaacacgactacg

SEQ ID NO: 57750 - DNA, 25 bp, mus musculus
ttactgcatgtgactcgccctcatg

SEQ ID NO: 57751 - DNA, 25 bp, mus musculus
ctgcatgtgactcgccctcatgtca

SEQ ID NO: 57752 - DNA, 25 bp, mus musculus
catgtgactcgccctcatgtcatca

SEQ ID NO: 57753 - DNA, 25 bp, mus musculus
cgccctcatgtcatcataagatttc

SEQ ID NO: 57754 - DNA, 25 bp, mus musculus
caccacactccagaagttagtcata

SEQ ID NO: 57755 - DNA, 25 bp, mus musculus
cacactccagaagttagtcatagtc

SEQ ID NO: 57756 - DNA, 25 bp, mus musculus
agtcatagtcaactctacaaaagtt

SEQ ID NO: 57757 - DNA, 25 bp, mus musculus
aatcactaagacatgacttacgcat

SEQ ID NO: 57758 - DNA, 25 bp, mus musculus
taagacatgacttacgcatacttcc

SEQ ID NO: 57759 - DNA, 25 bp, mus musculus
atgacttacgcatacttcccagaag

SEQ ID NO: 57760 - DNA, 25 bp, mus musculus
ccatcacgtaaacacgactacgcgt

SEQ ID NO: 57761 - DNA, 25 bp, mus musculus
tccaacatcaatcctggaactctag

SEQ ID NO: 57762 - DNA, 25 bp, mus musculus
atcaatcctggaactctagtcctca

SEQ ID NO: 57763 - DNA, 25 bp, mus musculus
aatcctggaactctagtcctcatac

SEQ ID NO: 57764 - DNA, 25 bp, mus musculus
ctagtcctcatacacaatggacgac

SEQ ID NO: 57765 - DNA, 25 bp, mus musculus
atacacaatggacgacacagaggca

SEQ ID NO: 57766 - DNA, 25 bp, mus musculus
aagattctgattctcctaaagcaac

SEQ ID NO: 57767 - DNA, 25 bp, mus musculus
ctgattctcctaaagcaactgaaca

SEQ ID NO: 57768 - DNA, 25 bp, mus musculus
tcccgcttaaaggcccaccagagat

SEQ ID NO: 57769 - DNA, 25 bp, mus musculus
cccgcttaaaggcccaccagagatg

SEQ ID NO: 57770 - DNA, 25 bp, mus musculus
catacaagtgctcatgggaagtatg

SEQ ID NO: 57771 - DNA, 25 bp, mus musculus
atacaagtgctcatgggaagtatgc

SEQ ID NO: 57772 - DNA, 25 bp, mus musculus
tacaagtgctcatgggaagtatgcg

SEQ ID NO: 57773 - DNA, 25 bp, mus musculus
tggcgttttgcacggagcgatgagc

SEQ ID NO: 57774 - DNA, 25 bp, mus musculus
ggcgttttgcacggagcgatgagct

SEQ ID NO: 57775 - DNA, 25 bp, mus musculus
gcgttttgcacggagcgatgagctg

SEQ ID NO: 57776 - DNA, 25 bp, mus musculus
cgttttgcacggagcgatgagctgc

SEQ ID NO: 57777 - DNA, 25 bp, mus musculus
gttttgcacggagcgatgagctgca

SEQ ID NO: 57778 - DNA, 25 bp, mus musculus
tttgcacggagcgatgagctgcaga

SEQ ID NO: 57779 - DNA, 25 bp, mus musculus
ttgcacggagcgatgagctgcagag

SEQ ID NO: 57780 - DNA, 25 bp, mus musculus
ccgcttaaaggcccaccagagatgt

SEQ ID NO: 57781 - DNA, 25 bp, mus musculus
cgcttaaaggcccaccagagatgtc

SEQ ID NO: 57782 - DNA, 25 bp, mus musculus
gcttaaaggcccaccagagatgtca

SEQ ID NO: 57783 - DNA, 25 bp, mus musculus
cttaaaggcccaccagagatgtcac

SEQ ID NO: 57784 - DNA, 25 bp, mus musculus
ttaaaggcccaccagagatgtcaca

SEQ ID NO: 57785 - DNA, 25 bp, mus musculus
agaagccatacaagtgctcatggga

SEQ ID NO: 57786 - DNA, 25 bp, mus musculus
aagccatacaagtgctcatgggaag

SEQ ID NO: 57787 - DNA, 25 bp, mus musculus
ccatacaagtgctcatgggaagtat

SEQ ID NO: 57788 - DNA, 25 bp, mus musculus
gagttctgctggctcagatattgaa

SEQ ID NO: 57789 - DNA, 25 bp, mus musculus
tgaccctaatggcaactacctctca

SEQ ID NO: 57790 - DNA, 25 bp, mus musculus
tccttcgcctcacagagcctgtcat

SEQ ID NO: 57791 - DNA, 25 bp, mus musculus
cagagcctgtcatacccaaggactg

SEQ ID NO: 57792 - DNA, 25 bp, mus musculus
ctgtcatacccaaggactggcagaa

SEQ ID NO: 57793 - DNA, 25 bp, mus musculus
cattggctgtctgtggctccatcct

SEQ ID NO: 57794 - DNA, 25 bp, mus musculus
gtggctccatcctcttccttctcat

SEQ ID NO: 57795 - DNA, 25 bp, mus musculus
tcttccttctcatagtgttgctcct

SEQ ID NO: 57796 - DNA, 25 bp, mus musculus
ttctcatagtgttgctcctcaccat

SEQ ID NO: 57797 - DNA, 25 bp, mus musculus
ctcctggctaccaccatgttgcaga

SEQ ID NO: 57798 - DNA, 25 bp, mus musculus
gctaccaccatgttgcagacaggga

SEQ ID NO: 57799 - DNA, 25 bp, mus musculus
accatgttgcagacagggaagacca

SEQ ID NO: 57800 - DNA, 25 bp, mus musculus
ccgcgcatgacactaccctggttgc

SEQ ID NO: 57801 - DNA, 25 bp, mus musculus
ctaccctggttgctctgcaaatggc

SEQ ID NO: 57802 - DNA, 25 bp, mus musculus
tggttgctctgcaaatggcattgaa

SEQ ID NO: 57803 - DNA, 25 bp, mus musculus
aagctccctatgcttcctgccacat

SEQ ID NO: 57804 - DNA, 25 bp, mus musculus
cttcctgccacatatttgaactgta

SEQ ID NO: 57805 - DNA, 25 bp, mus musculus
ggcctctgatcctgcctggctgtcc

SEQ ID NO: 57806 - DNA, 25 bp, mus musculus
tgatcctgcctggctgtcctcaccg

SEQ ID NO: 57807 - DNA, 25 bp, mus musculus
cactgcaggatttccttcgcctcac

SEQ ID NO: 57808 - DNA, 25 bp, mus musculus
tcaccaaagtgctcagctgggttta

SEQ ID NO: 57809 - DNA, 25 bp, mus musculus
ccaaagtgctcagctgggtttacag

SEQ ID NO: 57810 - DNA, 25 bp, mus musculus
tctactatatgcaacttcaataaca

SEQ ID NO: 57811 - DNA, 25 bp, mus musculus
tgcaacttcaataacatggcgcttg

SEQ ID NO: 57812 - DNA, 25 bp, mus musculus
aacttcaataacatggcgcttgcca

SEQ ID NO: 57813 - DNA, 25 bp, mus musculus
atggcgcttgccagcgagacctccc

SEQ ID NO: 57814 - DNA, 25 bp, mus musculus
agacaaaatgcgcatcacatgggcg

SEQ ID NO: 57815 - DNA, 25 bp, mus musculus
aatgcgcatcacatgggcgagatca

SEQ ID NO: 57816 - DNA, 25 bp, mus musculus
catcacatgggcgagatcagtcatt

SEQ ID NO: 57817 - DNA, 25 bp, mus musculus
gagatcagtcattgcgtccgtcgcc

SEQ ID NO: 57818 - DNA, 25 bp, mus musculus
atcagtcattgcgtccgtcgccaga

SEQ ID NO: 57819 - DNA, 25 bp, mus musculus
cgtcgccagacgtctgcatgatttc

SEQ ID NO: 57820 - DNA, 25 bp, mus musculus
aagtgctcagctgggtttacagata

SEQ ID NO: 57821 - DNA, 25 bp, mus musculus
cagacgtctgcatgatttcttcaac

SEQ ID NO: 57822 - DNA, 25 bp, mus musculus
gatagacgtgctcaagtctgccatc

SEQ ID NO: 57823 - DNA, 25 bp, mus musculus
agacgtgctcaagtctgccatccca

SEQ ID NO: 57824 - DNA, 25 bp, mus musculus
gctcaagtctgccatcccatcattg

SEQ ID NO: 57825 - DNA, 25 bp, mus musculus
gtctgccatcccatcattgtctttg

SEQ ID NO: 57826 - DNA, 25 bp, mus musculus
cccatcattgtctttgtgtggatta

SEQ ID NO: 57827 - DNA, 25 bp, mus musculus
attaagtctactatatgcaacttca

SEQ ID NO: 57828 - DNA, 25 bp, mus musculus
aagtctactatatgcaacttcaata

SEQ ID NO: 57829 - DNA, 25 bp, mus musculus
atatgcacttccttctcgtgtggct

SEQ ID NO: 57830 - DNA, 25 bp, mus musculus
acttccttctcgtgtggctgactgg

SEQ ID NO: 57831 - DNA, 25 bp, mus musculus
tttcttgctatcttaagttcggtga

SEQ ID NO: 57832 - DNA, 25 bp, mus musculus
aatgaagtcactgatccatattcct

SEQ ID NO: 57833 - DNA, 25 bp, mus musculus
gaagtcactgatccatattcctttt

SEQ ID NO: 57834 - DNA, 25 bp, mus musculus
gtcactgatccatattccttttggg

SEQ ID NO: 57835 - DNA, 25 bp, mus musculus
ccatattccttttgggctcagtgta

SEQ ID NO: 57836 - DNA, 25 bp, mus musculus
tattccttttgggctcagtgtagca

SEQ ID NO: 57837 - DNA, 25 bp, mus musculus
atatgctcatttacttgagggaaac

SEQ ID NO: 57838 - DNA, 25 bp, mus musculus
aaactcctttcctctgtttctgctg

SEQ ID NO: 57839 - DNA, 25 bp, mus musculus
ctcctttcctctgtttctgctgtca

SEQ ID NO: 57840 - DNA, 25 bp, mus musculus
tcctctgtttctgctgtcactgaga

SEQ ID NO: 57841 - DNA, 25 bp, mus musculus
ttctcgtgtggctgactggctagga

SEQ ID NO: 57842 - DNA, 25 bp, mus musculus
tcgtgtggctgactggctaggacac

SEQ ID NO: 57843 - DNA, 25 bp, mus musculus
gctaggacacaatcttcggcggctt

SEQ ID NO: 57844 - DNA, 25 bp, mus musculus
tcttcggcggctttgggttgaatgt

SEQ ID NO: 57845 - DNA, 25 bp, mus musculus
tgaatgtactccgcaagttaattta

SEQ ID NO: 57846 - DNA, 25 bp, mus musculus
atgtactccgcaagttaatttagcg

SEQ ID NO: 57847 - DNA, 25 bp, mus musculus
gggaacacttgatcttctcccactt

SEQ ID NO: 57848 - DNA, 25 bp, mus musculus
acttgatcttctcccactttaatat

SEQ ID NO: 57849 - DNA, 25 bp, mus musculus
cctccaggaactgaatccagaaatg

SEQ ID NO: 57850 - DNA, 25 bp, mus musculus
ctacaccaactgggccatcggcctg

SEQ ID NO: 57851 - DNA, 25 bp, mus musculus
cctccaatgtgaccatgaaccttta

SEQ ID NO: 57852 - DNA, 25 bp, mus musculus
atgtgaccatgaacctttagtcttc

SEQ ID NO: 57853 - DNA, 25 bp, mus musculus
ccatgaacctttagtcttcagccat

SEQ ID NO: 57854 - DNA, 25 bp, mus musculus
agtcttcagccatgtatgtaggtca

SEQ ID NO: 57855 - DNA, 25 bp, mus musculus
taggtcacagtttgcttcttccctg

SEQ ID NO: 57856 - DNA, 25 bp, mus musculus
acagtttgcttcttccctgacatgt

SEQ ID NO: 57857 - DNA, 25 bp, mus musculus
tgcttcttccctgacatgtgatatg

SEQ ID NO: 57858 - DNA, 25 bp, mus musculus
ttccctgacatgtgatatgagctca

SEQ ID NO: 57859 - DNA, 25 bp, mus musculus
tgcactaggagctcctgatcaaata

SEQ ID NO: 57860 - DNA, 25 bp, mus musculus
aggagctcctgatcaaataaagtta

SEQ ID NO: 57861 - DNA, 25 bp, mus musculus
caactgggccatcggcctgagcgtg

SEQ ID NO: 57862 - DNA, 25 bp, mus musculus
ggccatcggcctgagcgtggctgac

SEQ ID NO: 57863 - DNA, 25 bp, mus musculus
agacctcaaagacctgtgactgcca

SEQ ID NO: 57864 - DNA, 25 bp, mus musculus
caaagacctgtgactgccagtctct

SEQ ID NO: 57865 - DNA, 25 bp, mus musculus
cctgtgactgccagtctctaggctg

SEQ ID NO: 57866 - DNA, 25 bp, mus musculus
actgccagtctctaggctgtagaac

SEQ ID NO: 57867 - DNA, 25 bp, mus musculus
agtctctaggctgtagaacacaaac

SEQ ID NO: 57868 - DNA, 25 bp, mus musculus
cacaaacctccaatgtgaccatgaa

SEQ ID NO: 57869 - DNA, 25 bp, mus musculus
ctccggagcagtcatcattgtagac

SEQ ID NO: 57870 - DNA, 25 bp, mus musculus
cagtcatcattgtagaccaaggaag

SEQ ID NO: 57871 - DNA, 25 bp, mus musculus
ggtcacacttactgtggaggctctg

SEQ ID NO: 57872 - DNA, 25 bp, mus musculus
ctgttgctcaaagcagtctactgca

SEQ ID NO: 57873 - DNA, 25 bp, mus musculus
gttgctcaaagcagtctactgcagt

SEQ ID NO: 57874 - DNA, 25 bp, mus musculus
ctcaaagcagtctactgcagtcagc

SEQ ID NO: 57875 - DNA, 25 bp, mus musculus
caaagcagtctactgcagtcagcgg

SEQ ID NO: 57876 - DNA, 25 bp, mus musculus
aagcagtctactgcagtcagcggtg

SEQ ID NO: 57877 - DNA, 25 bp, mus musculus
tctactgcagtcagcggtgatcatt

SEQ ID NO: 57878 - DNA, 25 bp, mus musculus
tactgcagtcagcggtgatcattat

SEQ ID NO: 57879 - DNA, 25 bp, mus musculus
ctgcagtcagcggtgatcattattc

SEQ ID NO: 57880 - DNA, 25 bp, mus musculus
cggtgatcattattccgttgacttt

SEQ ID NO: 57881 - DNA, 25 bp, mus musculus
gtcatcattgtagaccaaggaaggc

SEQ ID NO: 57882 - DNA, 25 bp, mus musculus
ttatggctacatctctctttgcttc

SEQ ID NO: 57883 - DNA, 25 bp, mus musculus
ctctttgcttcaccctgaaatatac

SEQ ID NO: 57884 - DNA, 25 bp, mus musculus
ctgaaatatacgctccctttatgtg

SEQ ID NO: 57885 - DNA, 25 bp, mus musculus
gaaatatacgctccctttatgtgtg

SEQ ID NO: 57886 - DNA, 25 bp, mus musculus
aatatacgctccctttatgtgtgga

SEQ ID NO: 57887 - DNA, 25 bp, mus musculus
tatacgctccctttatgtgtggatc

SEQ ID NO: 57888 - DNA, 25 bp, mus musculus
tatcccctgaggtcacacttactgt

SEQ ID NO: 57889 - DNA, 25 bp, mus musculus
gtcaggacatcgcatagcaactaat

SEQ ID NO: 57890 - DNA, 25 bp, mus musculus
tcaggacatcgcatagcaactaatg

SEQ ID NO: 57891 - DNA, 25 bp, mus musculus
gcactagatctcatcagtatatgga

SEQ ID NO: 57892 - DNA, 25 bp, mus musculus
cactagatctcatcagtatatggaa

SEQ ID NO: 57893 - DNA, 25 bp, mus musculus
gacacatgcagacccactatgtcta

SEQ ID NO: 57894 - DNA, 25 bp, mus musculus
acatgcagacccactatgtctagaa

SEQ ID NO: 57895 - DNA, 25 bp, mus musculus
atgcagacccactatgtctagaacc

SEQ ID NO: 57896 - DNA, 25 bp, mus musculus
tagaaccgcactggactgctgcgcc

SEQ ID NO: 57897 - DNA, 25 bp, mus musculus
agaaccgcactggactgctgcgcct

SEQ ID NO: 57898 - DNA, 25 bp, mus musculus
ctggactgctgcgccttgacccctg

SEQ ID NO: 57899 - DNA, 25 bp, mus musculus
tgctgcgccttgacccctgcagtgt

SEQ ID NO: 57900 - DNA, 25 bp, mus musculus
cgccttgacccctgcagtgtggact

SEQ ID NO: 57901 - DNA, 25 bp, mus musculus
atagcaactaatgcacaatatccat

SEQ ID NO: 57902 - DNA, 25 bp, mus musculus
agcaactaatgcacaatatccatga

SEQ ID NO: 57903 - DNA, 25 bp, mus musculus
gcaactaatgcacaatatccatgat

SEQ ID NO: 57904 - DNA, 25 bp, mus musculus
gaaatacatgtacccgatagaaaga

SEQ ID NO: 57905 - DNA, 25 bp, mus musculus
acatgtacccgatagaaagaactga

SEQ ID NO: 57906 - DNA, 25 bp, mus musculus
aggccaccggtacaaggctatatgc

SEQ ID NO: 57907 - DNA, 25 bp, mus musculus
gccaccggtacaaggctatatgcac

SEQ ID NO: 57908 - DNA, 25 bp, mus musculus
ccaccggtacaaggctatatgcact

SEQ ID NO: 57909 - DNA, 25 bp, mus musculus
atcctatgctcaagaggaagaggtg

SEQ ID NO: 57910 - DNA, 25 bp, mus musculus
ttgtcacatgggtaacctaagaaga

SEQ ID NO: 57911 - DNA, 25 bp, mus musculus
tttttgcaaaccctgattgctgcac

SEQ ID NO: 57912 - DNA, 25 bp, mus musculus
caaaccctgattgctgcacctctct

SEQ ID NO: 57913 - DNA, 25 bp, mus musculus
ctgattgctgcacctctctgcaatt

SEQ ID NO: 57914 - DNA, 25 bp, mus musculus
cctctctgcaatttctccaggttag

SEQ ID NO: 57915 - DNA, 25 bp, mus musculus
tgcaatttctccaggttaggctggg

SEQ ID NO: 57916 - DNA, 25 bp, mus musculus
actctgggatgctctgtatacaaag

SEQ ID NO: 57917 - DNA, 25 bp, mus musculus
ttgaatgggctgatctcaggcctgt

SEQ ID NO: 57918 - DNA, 25 bp, mus musculus
gggctgatctcaggcctgtcctgtg

SEQ ID NO: 57919 - DNA, 25 bp, mus musculus
atctcaggcctgtcctgtgcgttgc

SEQ ID NO: 57920 - DNA, 25 bp, mus musculus
tgctttgaaacccttgttcagatgt

SEQ ID NO: 57921 - DNA, 25 bp, mus musculus
acctgtccactactcaagacacaag

SEQ ID NO: 57922 - DNA, 25 bp, mus musculus
ccactactcaagacacaagggcaca

SEQ ID NO: 57923 - DNA, 25 bp, mus musculus
cagcccactgggacacttgtaaaga

SEQ ID NO: 57924 - DNA, 25 bp, mus musculus
agctctgtaatgtgccgatggcacc

SEQ ID NO: 57925 - DNA, 25 bp, mus musculus
gtaatgtgccgatggcacctggctc

SEQ ID NO: 57926 - DNA, 25 bp, mus musculus
ctggctcggttttcattctgtatat

SEQ ID NO: 57927 - DNA, 25 bp, mus musculus
tcattctgtatattcaaggatatca

SEQ ID NO: 57928 - DNA, 25 bp, mus musculus
gatatcacacatatgtattaaatct

SEQ ID NO: 57929 - DNA, 25 bp, mus musculus
ggaattactatacccagctaagcaa

SEQ ID NO: 57930 - DNA, 25 bp, mus musculus
gctaagcaacaataccaaggaagat

SEQ ID NO: 57931 - DNA, 25 bp, mus musculus
acacaacagctcagtaaccacttcc

SEQ ID NO: 57932 - DNA, 25 bp, mus musculus
cacaacagctcagtaaccacttcca

SEQ ID NO: 57933 - DNA, 25 bp, mus musculus
acaacagctcagtaaccacttccag

SEQ ID NO: 57934 - DNA, 25 bp, mus musculus
ggagcacaacatgctggtgaaatat

SEQ ID NO: 57935 - DNA, 25 bp, mus musculus
gagcacaacatgctggtgaaatatg

SEQ ID NO: 57936 - DNA, 25 bp, mus musculus
agcacaacatgctggtgaaatatgt

SEQ ID NO: 57937 - DNA, 25 bp, mus musculus
aggatgacacacaacagctcagtaa

SEQ ID NO: 57938 - DNA, 25 bp, mus musculus
ggatgacacacaacagctcagtaac

SEQ ID NO: 57939 - DNA, 25 bp, mus musculus
gatgacacacaacagctcagtaacc

SEQ ID NO: 57940 - DNA, 25 bp, mus musculus
atgacacacaacagctcagtaacca

SEQ ID NO: 57941 - DNA, 25 bp, mus musculus
tgacacacaacagctcagtaaccac

SEQ ID NO: 57942 - DNA, 25 bp, mus musculus
gacacacaacagctcagtaaccact

SEQ ID NO: 57943 - DNA, 25 bp, mus musculus
acacacaacagctcagtaaccactt

SEQ ID NO: 57944 - DNA, 25 bp, mus musculus
cacacaacagctcagtaaccacttc

SEQ ID NO: 57945 - DNA, 25 bp, mus musculus
caagggctctgaggtactggagaca

SEQ ID NO: 57946 - DNA, 25 bp, mus musculus
cacgctcactacgttcttcagcaga

SEQ ID NO: 57947 - DNA, 25 bp, mus musculus
atctctatgagcaacaggtattcat

SEQ ID NO: 57948 - DNA, 25 bp, mus musculus
aacaggtattcatccaatctgctcc

SEQ ID NO: 57949 - DNA, 25 bp, mus musculus
cttagccccggatcctgctgttagc

SEQ ID NO: 57950 - DNA, 25 bp, mus musculus
ggatcctgctgttagctgccgcaca

SEQ ID NO: 57951 - DNA, 25 bp, mus musculus
ctgccgcacactctgcatttgtgaa

SEQ ID NO: 57952 - DNA, 25 bp, mus musculus
cacactctgcatttgtgaatatttg

SEQ ID NO: 57953 - DNA, 25 bp, mus musculus
tctgtgctttctttggaaccaattg

SEQ ID NO: 57954 - DNA, 25 bp, mus musculus
ctttctttggaaccaattgctgaat

SEQ ID NO: 57955 - DNA, 25 bp, mus musculus
gctgaatcaccatgaggatgatctt

SEQ ID NO: 57956 - DNA, 25 bp, mus musculus
tgatcttagtggacccacattttcc

SEQ ID NO: 57957 - DNA, 25 bp, mus musculus
gctcactacgttcttcagcagacgg

SEQ ID NO: 57958 - DNA, 25 bp, mus musculus
tacgttcttcagcagacggaagtct

SEQ ID NO: 57959 - DNA, 25 bp, mus musculus
tcgccagggctctttagtactagaa

SEQ ID NO: 57960 - DNA, 25 bp, mus musculus
ccagggctctttagtactagaagag

SEQ ID NO: 57961 - DNA, 25 bp, mus musculus
tccacaagccaaagatgaggccgca

SEQ ID NO: 57962 - DNA, 25 bp, mus musculus
agatgaggccgcacctcaatctcta

SEQ ID NO: 57963 - DNA, 25 bp, mus musculus
ggccgcacctcaatctctatgagca

SEQ ID NO: 57964 - DNA, 25 bp, mus musculus
tcaatctctatgagcaacaggtatt

SEQ ID NO: 57965 - DNA, 25 bp, mus musculus
tgtccacacttgatacatgaataca

SEQ ID NO: 57966 - DNA, 25 bp, mus musculus
taatggctcaccagatggatccctc

SEQ ID NO: 57967 - DNA, 25 bp, mus musculus
gaaccgctatacctgagatggtgtc

SEQ ID NO: 57968 - DNA, 25 bp, mus musculus
ctatacctgagatggtgtcgacatc

SEQ ID NO: 57969 - DNA, 25 bp, mus musculus
tgatttgagcgtcagacccaaccga

SEQ ID NO: 57970 - DNA, 25 bp, mus musculus
tttgagcgtcagacccaaccgatac

SEQ ID NO: 57971 - DNA, 25 bp, mus musculus
gagcgtcagacccaaccgatactgg

SEQ ID NO: 57972 - DNA, 25 bp, mus musculus
atactggctctgcgctgctactgct

SEQ ID NO: 57973 - DNA, 25 bp, mus musculus
gctctgcgctgctactgcttccagc

SEQ ID NO: 57974 - DNA, 25 bp, mus musculus
cgctgctactgcttccagcatcaag

SEQ ID NO: 57975 - DNA, 25 bp, mus musculus
tgctactgcttccagcatcaagatc

SEQ ID NO: 57976 - DNA, 25 bp, mus musculus
tactgcttccagcatcaagatctag

SEQ ID NO: 57977 - DNA, 25 bp, mus musculus
accagatggatccctctatgcggca

SEQ ID NO: 57978 - DNA, 25 bp, mus musculus
tggatccctctatgcggcacgaggc

SEQ ID NO: 57979 - DNA, 25 bp, mus musculus
cctctatgcggcacgaggcaaggat

SEQ ID NO: 57980 - DNA, 25 bp, mus musculus
tggcgacgctatgtcgtggcatctc

SEQ ID NO: 57981 - DNA, 25 bp, mus musculus
cgacgctatgtcgtggcatctcgat

SEQ ID NO: 57982 - DNA, 25 bp, mus musculus
cgctatgtcgtggcatctcgatgac

SEQ ID NO: 57983 - DNA, 25 bp, mus musculus
gtggcatctcgatgacgtcaagaac

SEQ ID NO: 57984 - DNA, 25 bp, mus musculus
gcatctcgatgacgtcaagaaccgc

SEQ ID NO: 57985 - DNA, 25 bp, mus musculus
ccagtaaacagtgtccactgcaagc

SEQ ID NO: 57986 - DNA, 25 bp, mus musculus
tgcaagcctggtgatactcacataa

SEQ ID NO: 57987 - DNA, 25 bp, mus musculus
agacaggcacctgggagcccaggag

SEQ ID NO: 57988 - DNA, 25 bp, mus musculus
cagataagccgttcccgagagctgc

SEQ ID NO: 57989 - DNA, 25 bp, mus musculus
cagcttcccttctttgcagtattgt

SEQ ID NO: 57990 - DNA, 25 bp, mus musculus
tcatgatggctctcccaagatgcca

SEQ ID NO: 57991 - DNA, 25 bp, mus musculus
tggctctcccaagatgccaagtgct

SEQ ID NO: 57992 - DNA, 25 bp, mus musculus
gatgccaagtgctcttgtgtccccc

SEQ ID NO: 57993 - DNA, 25 bp, mus musculus
aagtgctcttgtgtcccccagaggc

SEQ ID NO: 57994 - DNA, 25 bp, mus musculus
cgggcctgctgcggaatggtgcaac

SEQ ID NO: 57995 - DNA, 25 bp, mus musculus
ccatcatcgaacaaactgatgcaaa

SEQ ID NO: 57996 - DNA, 25 bp, mus musculus
gaactgagccagacactgtaaatac

SEQ ID NO: 57997 - DNA, 25 bp, mus musculus
gatactcacataaccactcactctg

SEQ ID NO: 57998 - DNA, 25 bp, mus musculus
accactcactctgtgcacagcaaca

SEQ ID NO: 57999 - DNA, 25 bp, mus musculus
cactctgtgcacagcaacaaggacc

SEQ ID NO: 58000 - DNA, 25 bp, mus musculus
ttccacaccatcagtctctggggaa

SEQ ID NO: 58001 - DNA, 25 bp, mus musculus
accatcagtctctggggaagtccag

SEQ ID NO: 58002 - DNA, 25 bp, mus musculus
agtctctggggaagtccagcaacca

SEQ ID NO: 58003 - DNA, 25 bp, mus musculus
agtccagcaaccagacaggcacctg

SEQ ID NO: 58004 - DNA, 25 bp, mus musculus
gcaaccagacaggcacctgggagcc

SEQ ID NO: 58005 - DNA, 25 bp, mus musculus
tgagtgagacgcaccgctagcgtgc

SEQ ID NO: 58006 - DNA, 25 bp, mus musculus
agtgagacgcaccgctagcgtgcgg

SEQ ID NO: 58007 - DNA, 25 bp, mus musculus
ccctgcgtcagtacttcttcgagac

SEQ ID NO: 58008 - DNA, 25 bp, mus musculus
cctgcgtcagtacttcttcgagacg

SEQ ID NO: 58009 - DNA, 25 bp, mus musculus
gtcagtacttcttcgagacgcgctg

SEQ ID NO: 58010 - DNA, 25 bp, mus musculus
tcagtacttcttcgagacgcgctgc

SEQ ID NO: 58011 - DNA, 25 bp, mus musculus
agtacttcttcgagacgcgctgcaa

SEQ ID NO: 58012 - DNA, 25 bp, mus musculus
gtacttcttcgagacgcgctgcaag

SEQ ID NO: 58013 - DNA, 25 bp, mus musculus
acttcttcgagacgcgctgcaaggc

SEQ ID NO: 58014 - DNA, 25 bp, mus musculus
agacgcgctgcaaggccgaaagcgc

SEQ ID NO: 58015 - DNA, 25 bp, mus musculus
gacgcgctgcaaggccgaaagcgct

SEQ ID NO: 58016 - DNA, 25 bp, mus musculus
cactggctctcagaatgccaggcta

SEQ ID NO: 58017 - DNA, 25 bp, mus musculus
acgcaccgctagcgtgcgggtgagc

SEQ ID NO: 58018 - DNA, 25 bp, mus musculus
tggctctcagaatgccaggctaagc

SEQ ID NO: 58019 - DNA, 25 bp, mus musculus
ctggcagtatgcgacgcatgagtgg

SEQ ID NO: 58020 - DNA, 25 bp, mus musculus
acgcatgagtggctgggtgaccgac

SEQ ID NO: 58021 - DNA, 25 bp, mus musculus
tgaccgaccggcggacagctgtgga

SEQ ID NO: 58022 - DNA, 25 bp, mus musculus
gaccgaccggcggacagctgtggac

SEQ ID NO: 58023 - DNA, 25 bp, mus musculus
tgcctgcggcaggtggcagtcccct

SEQ ID NO: 58024 - DNA, 25 bp, mus musculus
cagtcccctgcgtcagtacttcttc

SEQ ID NO: 58025 - DNA, 25 bp, mus musculus
gtcccctgcgtcagtacttcttcga

SEQ ID NO: 58026 - DNA, 25 bp, mus musculus
gacctctgcgagtcatctcacgcag

SEQ ID NO: 58027 - DNA, 25 bp, mus musculus
tgcgagtcatctcacgcagacgggg

SEQ ID NO: 58028 - DNA, 25 bp, mus musculus
tcctcacctgtgctacgatctcaca

SEQ ID NO: 58029 - DNA, 25 bp, mus musculus
tcacctgtgctacgatctcacatgc

SEQ ID NO: 58030 - DNA, 25 bp, mus musculus
cctgtgctacgatctcacatgctca

SEQ ID NO: 58031 - DNA, 25 bp, mus musculus
ctacgatctcacatgctcatacaat

SEQ ID NO: 58032 - DNA, 25 bp, mus musculus
cgatctcacatgctcatacaatgtg

SEQ ID NO: 58033 - DNA, 25 bp, mus musculus
tctcacatgctcatacaatgtgctg

SEQ ID NO: 58034 - DNA, 25 bp, mus musculus
cacatgctcatacaatgtgctgcac

SEQ ID NO: 58035 - DNA, 25 bp, mus musculus
ctcatacaatgtgctgcacggacta

SEQ ID NO: 58036 - DNA, 25 bp, mus musculus
gctgcacggactacgtgcaggtgtg

SEQ ID NO: 58037 - DNA, 25 bp, mus musculus
gcacggactacgtgcaggtgtgcac

SEQ ID NO: 58038 - DNA, 25 bp, mus musculus
gttcacccgattctgcactcggcac

SEQ ID NO: 58039 - DNA, 25 bp, mus musculus
ccgattctgcactcggcacactcag

SEQ ID NO: 58040 - DNA, 25 bp, mus musculus
ctgcactcggcacactcagatcgac

SEQ ID NO: 58041 - DNA, 25 bp, mus musculus
cactcggcacactcagatcgacact

SEQ ID NO: 58042 - DNA, 25 bp, mus musculus
tcggcacactcagatcgacactctc

SEQ ID NO: 58043 - DNA, 25 bp, mus musculus
gcacactcagatcgacactctcttg

SEQ ID NO: 58044 - DNA, 25 bp, mus musculus
cactctcttgaagtccacgaactat

SEQ ID NO: 58045 - DNA, 25 bp, mus musculus
taatcctcacctgtgctacgatctc

SEQ ID NO: 58046 - DNA, 25 bp, mus musculus
cacaagctgtcatcctttctgttca

SEQ ID NO: 58047 - DNA, 25 bp, mus musculus
ctgtcatcctttctgttcagttact

SEQ ID NO: 58048 - DNA, 25 bp, mus musculus
ctgatcaagttctacagcgtcccca

SEQ ID NO: 58049 - DNA, 25 bp, mus musculus
agcaagcccattattttgatcataa

SEQ ID NO: 58050 - DNA, 25 bp, mus musculus
attttgatcataacctcacagggtc

SEQ ID NO: 58051 - DNA, 25 bp, mus musculus
atcataacctcacagggtcttcgtg

SEQ ID NO: 58052 - DNA, 25 bp, mus musculus
acctcacagggtcttcgtgatccac

SEQ ID NO: 58053 - DNA, 25 bp, mus musculus
cagggtcttcgtgatccacaacaga

SEQ ID NO: 58054 - DNA, 25 bp, mus musculus
cttcgtgatccacaacagattgtaa

SEQ ID NO: 58055 - DNA, 25 bp, mus musculus
gatccacaacagattgtaactggga

SEQ ID NO: 58056 - DNA, 25 bp, mus musculus
gcatgctccagaggttgcaggcgct

SEQ ID NO: 58057 - DNA, 25 bp, mus musculus
tgctccagaggttgcaggcgcttgt

SEQ ID NO: 58058 - DNA, 25 bp, mus musculus
tcctttctgttcagttacttgtcgg

SEQ ID NO: 58059 - DNA, 25 bp, mus musculus
ctgttcagttacttgtcggtccaga

SEQ ID NO: 58060 - DNA, 25 bp, mus musculus
acaacgcggtccctcagctgcaaca

SEQ ID NO: 58061 - DNA, 25 bp, mus musculus
cggtccctcagctgcaacagtgtgc

SEQ ID NO: 58062 - DNA, 25 bp, mus musculus
ctcagctgcaacagtgtgcctatga

SEQ ID NO: 58063 - DNA, 25 bp, mus musculus
tgcaacagtgtgcctatgagtgccc

SEQ ID NO: 58064 - DNA, 25 bp, mus musculus
agtgtgcctatgagtgcccagaagt

SEQ ID NO: 58065 - DNA, 25 bp, mus musculus
cctatgagtgcccagaagtcactcc

SEQ ID NO: 58066 - DNA, 25 bp, mus musculus
gattgctgctgcttctgagcttgct

SEQ ID NO: 58067 - DNA, 25 bp, mus musculus
attgctgctgcttctgagcttgctc

SEQ ID NO: 58068 - DNA, 25 bp, mus musculus
tgagcttgctcatagcgctttcggc

SEQ ID NO: 58069 - DNA, 25 bp, mus musculus
gagcttgctcatagcgctttcggca

SEQ ID NO: 58070 - DNA, 25 bp, mus musculus
agcttgctcatagcgctttcggcat

SEQ ID NO: 58071 - DNA, 25 bp, mus musculus
gcttgctcatagcgctttcggcatc

SEQ ID NO: 58072 - DNA, 25 bp, mus musculus
cttgctcatagcgctttcggcatcc

SEQ ID NO: 58073 - DNA, 25 bp, mus musculus
ttgctcatagcgctttcggcatccg

SEQ ID NO: 58074 - DNA, 25 bp, mus musculus
gctcatagcgctttcggcatccgta

SEQ ID NO: 58075 - DNA, 25 bp, mus musculus
tagcgctttcggcatccgtatcatc

SEQ ID NO: 58076 - DNA, 25 bp, mus musculus
agcgctttcggcatccgtatcatct

SEQ ID NO: 58077 - DNA, 25 bp, mus musculus
gcgctttcggcatccgtatcatctc

SEQ ID NO: 58078 - DNA, 25 bp, mus musculus
ttgctgctgcttctgagcttgctca

SEQ ID NO: 58079 - DNA, 25 bp, mus musculus
tgctgctgcttctgagcttgctcat

SEQ ID NO: 58080 - DNA, 25 bp, mus musculus
gctgctgcttctgagcttgctcata

SEQ ID NO: 58081 - DNA, 25 bp, mus musculus
ctgctgcttctgagcttgctcatag

SEQ ID NO: 58082 - DNA, 25 bp, mus musculus
tgcttctgagcttgctcatagcgct

SEQ ID NO: 58083 - DNA, 25 bp, mus musculus
gcttctgagcttgctcatagcgctt

SEQ ID NO: 58084 - DNA, 25 bp, mus musculus
cttctgagcttgctcatagcgcttt

SEQ ID NO: 58085 - DNA, 25 bp, mus musculus
ctgagcttgctcatagcgctttcgg

SEQ ID NO: 58086 - DNA, 25 bp, mus musculus
tccttttacggagattaccagagtg

SEQ ID NO: 58087 - DNA, 25 bp, mus musculus
caggctcagacgccagtggacctac

SEQ ID NO: 58088 - DNA, 25 bp, mus musculus
tcgcctagtcctgagcccagcttgc

SEQ ID NO: 58089 - DNA, 25 bp, mus musculus
ctccactccatgtcagcggaggtct

SEQ ID NO: 58090 - DNA, 25 bp, mus musculus
ttcgggcccagtccacctttctcat

SEQ ID NO: 58091 - DNA, 25 bp, mus musculus
cctttctcatctctgtcggtcaatg

SEQ ID NO: 58092 - DNA, 25 bp, mus musculus
tcatctctgtcggtcaatggtggag

SEQ ID NO: 58093 - DNA, 25 bp, mus musculus
gccagctacgggaaccatttgtctc

SEQ ID NO: 58094 - DNA, 25 bp, mus musculus
atgaacgaggcagccgtgtggtagc

SEQ ID NO: 58095 - DNA, 25 bp, mus musculus
ctcgcatgggccacgggagctcgtg

SEQ ID NO: 58096 - DNA, 25 bp, mus musculus
gccacgggagctcgtggttgtacag

SEQ ID NO: 58097 - DNA, 25 bp, mus musculus
tccttcagcctcggggaccagtctg

SEQ ID NO: 58098 - DNA, 25 bp, mus musculus
gctcagacgccagtggacctaccct

SEQ ID NO: 58099 - DNA, 25 bp, mus musculus
agtctgtttggggagactggatagc

SEQ ID NO: 58100 - DNA, 25 bp, mus musculus
ccagtggacctaccctttgtgccat

SEQ ID NO: 58101 - DNA, 25 bp, mus musculus
gacctaccctttgtgccatcatctg

SEQ ID NO: 58102 - DNA, 25 bp, mus musculus
ccctttgtgccatcatctggccctt

SEQ ID NO: 58103 - DNA, 25 bp, mus musculus
tttgtgccatcatctggcccttcgg

SEQ ID NO: 58104 - DNA, 25 bp, mus musculus
gtgccatcatctggcccttcgggga

SEQ ID NO: 58105 - DNA, 25 bp, mus musculus
tccagtgaggcgcagcgatttactg

SEQ ID NO: 58106 - DNA, 25 bp, mus musculus
cgatttactgacatcctggcacatc

SEQ ID NO: 58107 - DNA, 25 bp, mus musculus
attaaactagggccgtgagagagtg

SEQ ID NO: 58108 - DNA, 25 bp, mus musculus
atcactacgataggattctgccaat

SEQ ID NO: 58109 - DNA, 25 bp, mus musculus
ctcggatctgcatgaccctagtaaa

SEQ ID NO: 58110 - DNA, 25 bp, mus musculus
cggatctgcatgaccctagtaaaca

SEQ ID NO: 58111 - DNA, 25 bp, mus musculus
tctgcatgaccctagtaaacacagc

SEQ ID NO: 58112 - DNA, 25 bp, mus musculus
tgcatgaccctagtaaacacagcca

SEQ ID NO: 58113 - DNA, 25 bp, mus musculus
catgaccctagtaaacacagccacc

SEQ ID NO: 58114 - DNA, 25 bp, mus musculus
tgaccctagtaaacacagccaccag

SEQ ID NO: 58115 - DNA, 25 bp, mus musculus
accctagtaaacacagccaccagag

SEQ ID NO: 58116 - DNA, 25 bp, mus musculus
cctagtaaacacagccaccagagag

SEQ ID NO: 58117 - DNA, 25 bp, mus musculus
tagtaaacacagccaccagagagaa

SEQ ID NO: 58118 - DNA, 25 bp, mus musculus
acagccaccagagagaatgtcagat

SEQ ID NO: 58119 - DNA, 25 bp, mus musculus
ggattctgccaatatcatattctga

SEQ ID NO: 58120 - DNA, 25 bp, mus musculus
attctgccaatatcatattctgaaa

SEQ ID NO: 58121 - DNA, 25 bp, mus musculus
tctgccaatatcatattctgaaaaa

SEQ ID NO: 58122 - DNA, 25 bp, mus musculus
tgccaatatcatattctgaaaaaga

SEQ ID NO: 58123 - DNA, 25 bp, mus musculus
agatgtctctcggatctgcatgacc

SEQ ID NO: 58124 - DNA, 25 bp, mus musculus
atgtctctcggatctgcatgaccct

SEQ ID NO: 58125 - DNA, 25 bp, mus musculus
gtctctcggatctgcatgaccctag

SEQ ID NO: 58126 - DNA, 25 bp, mus musculus
ctctcggatctgcatgaccctagta

SEQ ID NO: 58127 - DNA, 25 bp, mus musculus
acatacttcagtgcttatgagatcg

SEQ ID NO: 58128 - DNA, 25 bp, mus musculus
atacttcagtgcttatgagatcgga

SEQ ID NO: 58129 - DNA, 25 bp, mus musculus
aatgtctttacgtgctgcagagcct

SEQ ID NO: 58130 - DNA, 25 bp, mus musculus
tgtctttacgtgctgcagagccttg

SEQ ID NO: 58131 - DNA, 25 bp, mus musculus
tgctgcagagccttgactaataggc

SEQ ID NO: 58132 - DNA, 25 bp, mus musculus
ctgcagagccttgactaataggcca

SEQ ID NO: 58133 - DNA, 25 bp, mus musculus
ccttgactaataggccaccaacgct

SEQ ID NO: 58134 - DNA, 25 bp, mus musculus
ttgactaataggccaccaacgctga

SEQ ID NO: 58135 - DNA, 25 bp, mus musculus
gactaataggccaccaacgctgaag

SEQ ID NO: 58136 - DNA, 25 bp, mus musculus
ctaataggccaccaacgctgaagtg

SEQ ID NO: 58137 - DNA, 25 bp, mus musculus
aataggccaccaacgctgaagtgct

SEQ ID NO: 58138 - DNA, 25 bp, mus musculus
taggccaccaacgctgaagtgctac

SEQ ID NO: 58139 - DNA, 25 bp, mus musculus
atttcagtgaggcgttttcattgta

SEQ ID NO: 58140 - DNA, 25 bp, mus musculus
ggccaccaacgctgaagtgctacgc

SEQ ID NO: 58141 - DNA, 25 bp, mus musculus
ataatcggactggaacggcagatct

SEQ ID NO: 58142 - DNA, 25 bp, mus musculus
tcgattactgtcaatgtctttacgt

SEQ ID NO: 58143 - DNA, 25 bp, mus musculus
gattactgtcaatgtctttacgtgc

SEQ ID NO: 58144 - DNA, 25 bp, mus musculus
ttactgtcaatgtctttacgtgctg

SEQ ID NO: 58145 - DNA, 25 bp, mus musculus
actgtcaatgtctttacgtgctgca

SEQ ID NO: 58146 - DNA, 25 bp, mus musculus
tgtcaatgtctttacgtgctgcaga

SEQ ID NO: 58147 - DNA, 25 bp, mus musculus
tcaatgtctttacgtgctgcagagc

SEQ ID NO: 58148 - DNA, 25 bp, mus musculus
accaacgcactgctcatattctcca

SEQ ID NO: 58149 - DNA, 25 bp, mus musculus
gcactgctcatattctccagctctg

SEQ ID NO: 58150 - DNA, 25 bp, mus musculus
gtctgcctccatcctgatcagacag

SEQ ID NO: 58151 - DNA, 25 bp, mus musculus
atcctgatcagacagagcccatcta

SEQ ID NO: 58152 - DNA, 25 bp, mus musculus
cctgatcagacagagcccatctagc

SEQ ID NO: 58153 - DNA, 25 bp, mus musculus
ctgatcagacagagcccatctagca

SEQ ID NO: 58154 - DNA, 25 bp, mus musculus
gatcagacagagcccatctagcacc

SEQ ID NO: 58155 - DNA, 25 bp, mus musculus
atcagacagagcccatctagcacct

SEQ ID NO: 58156 - DNA, 25 bp, mus musculus
cagacagagcccatctagcaccttc

SEQ ID NO: 58157 - DNA, 25 bp, mus musculus
agacagagcccatctagcaccttct

SEQ ID NO: 58158 - DNA, 25 bp, mus musculus
acagagcccatctagcaccttctga

SEQ ID NO: 58159 - DNA, 25 bp, mus musculus
cagagcccatctagcaccttctgag

SEQ ID NO: 58160 - DNA, 25 bp, mus musculus
actgctcatattctccagctctgac

SEQ ID NO: 58161 - DNA, 25 bp, mus musculus
gagcccatctagcaccttctgagca

SEQ ID NO: 58162 - DNA, 25 bp, mus musculus
gctcatattctccagctctgactcg

SEQ ID NO: 58163 - DNA, 25 bp, mus musculus
ctcatattctccagctctgactcgc

SEQ ID NO: 58164 - DNA, 25 bp, mus musculus
atattctccagctctgactcgctcc

SEQ ID NO: 58165 - DNA, 25 bp, mus musculus
gtaccaggggtctaatcaggctgtg

SEQ ID NO: 58166 - DNA, 25 bp, mus musculus
gtctaatcaggctgtgtctgcctcc

SEQ ID NO: 58167 - DNA, 25 bp, mus musculus
tctaatcaggctgtgtctgcctcca

SEQ ID NO: 58168 - DNA, 25 bp, mus musculus
taatcaggctgtgtctgcctccatc

SEQ ID NO: 58169 - DNA, 25 bp, mus musculus
taatgtagaccagggagctgcagtt

SEQ ID NO: 58170 - DNA, 25 bp, mus musculus
tgtagaccagggagctgcagttcta

SEQ ID NO: 58171 - DNA, 25 bp, mus musculus
gcatctcttcggagcgatcctatac

SEQ ID NO: 58172 - DNA, 25 bp, mus musculus
tctcttcggagcgatcctatactga

SEQ ID NO: 58173 - DNA, 25 bp, mus musculus
cttcggagcgatcctatactgactt

SEQ ID NO: 58174 - DNA, 25 bp, mus musculus
agcgatcctatactgacttcctctt

SEQ ID NO: 58175 - DNA, 25 bp, mus musculus
gatcctatactgacttcctctttgc

SEQ ID NO: 58176 - DNA, 25 bp, mus musculus
cctatactgacttcctctttgcaag

SEQ ID NO: 58177 - DNA, 25 bp, mus musculus
atactgacttcctctttgcaagtac

SEQ ID NO: 58178 - DNA, 25 bp, mus musculus
ctgacttcctctttgcaagtacgat

SEQ ID NO: 58179 - DNA, 25 bp, mus musculus
acttcctctttgcaagtacgatact

SEQ ID NO: 58180 - DNA, 25 bp, mus musculus
tcctctttgcaagtacgatactata

SEQ ID NO: 58181 - DNA, 25 bp, mus musculus
agttctattactgtgtcctcgtgca

SEQ ID NO: 58182 - DNA, 25 bp, mus musculus
tctattactgtgtcctcgtgcatac

SEQ ID NO: 58183 - DNA, 25 bp, mus musculus
attactgtgtcctcgtgcatacctt

SEQ ID NO: 58184 - DNA, 25 bp, mus musculus
gcgtctactcacgtgtaggcagctt

SEQ ID NO: 58185 - DNA, 25 bp, mus musculus
actcacgtgtaggcagcttcatact

SEQ ID NO: 58186 - DNA, 25 bp, mus musculus
cctagaactaggcgcacttccaatg

SEQ ID NO: 58187 - DNA, 25 bp, mus musculus
tccaatgcatctcttcggagcgatc

SEQ ID NO: 58188 - DNA, 25 bp, mus musculus
aatgcatctcttcggagcgatccta

SEQ ID NO: 58189 - DNA, 25 bp, mus musculus
tcaaggctgccctgctaaaacatgg

SEQ ID NO: 58190 - DNA, 25 bp, mus musculus
atagtgccaaatttgcctcctgttt

SEQ ID NO: 58191 - DNA, 25 bp, mus musculus
tgtctggagagtttgccatgttgtg

SEQ ID NO: 58192 - DNA, 25 bp, mus musculus
gggcctttgatctcaggactgctgt

SEQ ID NO: 58193 - DNA, 25 bp, mus musculus
ttgatctcaggactgctgtactgga

SEQ ID NO: 58194 - DNA, 25 bp, mus musculus
ctgctgtactggagaccatgacggc

SEQ ID NO: 58195 - DNA, 25 bp, mus musculus
agaccatgacggccttccgcagagc

SEQ ID NO: 58196 - DNA, 25 bp, mus musculus
ccttccgcagagccggtgccgacat

SEQ ID NO: 58197 - DNA, 25 bp, mus musculus
ccgacatcatcatcacctactttgc

SEQ ID NO: 58198 - DNA, 25 bp, mus musculus
tcatcatcacctactttgcaccgca

SEQ ID NO: 58199 - DNA, 25 bp, mus musculus
tcacctactttgcaccgcagctgtt

SEQ ID NO: 58200 - DNA, 25 bp, mus musculus
actttgcaccgcagctgttgaagtg

SEQ ID NO: 58201 - DNA, 25 bp, mus musculus
tctacggtcctttccgggatgcagc

SEQ ID NO: 58202 - DNA, 25 bp, mus musculus
caagcccagcttttggagaccgacg

SEQ ID NO: 58203 - DNA, 25 bp, mus musculus
tggcccgagacattcaagaaggagc

SEQ ID NO: 58204 - DNA, 25 bp, mus musculus
ctgacatgctcatggtgaagccggg

SEQ ID NO: 58205 - DNA, 25 bp, mus musculus
tgctcatggtgaagccgggattgcc

SEQ ID NO: 58206 - DNA, 25 bp, mus musculus
cctacctggacatggtgcgagaggt

SEQ ID NO: 58207 - DNA, 25 bp, mus musculus
tgaaggacaagcaccccgagctccc

SEQ ID NO: 58208 - DNA, 25 bp, mus musculus
cagtataccaggtgtctggagagtt

SEQ ID NO: 58209 - DNA, 25 bp, mus musculus
atgtctcgccagactgagatggagg

SEQ ID NO: 58210 - DNA, 25 bp, mus musculus
tgtctcgccagactgagatggagga

SEQ ID NO: 58211 - DNA, 25 bp, mus musculus
aattcctgagaacagggatgcgatt

SEQ ID NO: 58212 - DNA, 25 bp, mus musculus
ttcctgagaacagggatgcgattat

SEQ ID NO: 58213 - DNA, 25 bp, mus musculus
atgggacgctctaatgtcgagaatg

SEQ ID NO: 58214 - DNA, 25 bp, mus musculus
tgggacgctctaatgtcgagaatga

SEQ ID NO: 58215 - DNA, 25 bp, mus musculus
ggacgctctaatgtcgagaatgagg

SEQ ID NO: 58216 - DNA, 25 bp, mus musculus
acgctctaatgtcgagaatgaggaa

SEQ ID NO: 58217 - DNA, 25 bp, mus musculus
cattaactctactgtcctatcgaac

SEQ ID NO: 58218 - DNA, 25 bp, mus musculus
attaactctactgtcctatcgaaca

SEQ ID NO: 58219 - DNA, 25 bp, mus musculus
ttaactctactgtcctatcgaacat

SEQ ID NO: 58220 - DNA, 25 bp, mus musculus
taactctactgtcctatcgaacatg

SEQ ID NO: 58221 - DNA, 25 bp, mus musculus
gtctcgccagactgagatggaggag

SEQ ID NO: 58222 - DNA, 25 bp, mus musculus
tctcgccagactgagatggaggagt

SEQ ID NO: 58223 - DNA, 25 bp, mus musculus
ctcgccagactgagatggaggagtt

SEQ ID NO: 58224 - DNA, 25 bp, mus musculus
tcgccagactgagatggaggagttc

SEQ ID NO: 58225 - DNA, 25 bp, mus musculus
ctgtaattcctgagaacagggatgc

SEQ ID NO: 58226 - DNA, 25 bp, mus musculus
tgtaattcctgagaacagggatgcg

SEQ ID NO: 58227 - DNA, 25 bp, mus musculus
gtaattcctgagaacagggatgcga

SEQ ID NO: 58228 - DNA, 25 bp, mus musculus
taattcctgagaacagggatgcgat

SEQ ID NO: 58229 - DNA, 25 bp, mus musculus
tcttccggccggtgcatgccagctt

SEQ ID NO: 58230 - DNA, 25 bp, mus musculus
ttccggccggtgcatgccagcttca

SEQ ID NO: 58231 - DNA, 25 bp, mus musculus
gtcctgccattctatcgaccacaga

SEQ ID NO: 58232 - DNA, 25 bp, mus musculus
cctgccattctatcgaccacagaga

SEQ ID NO: 58233 - DNA, 25 bp, mus musculus
tgccattctatcgaccacagagatc

SEQ ID NO: 58234 - DNA, 25 bp, mus musculus
ccattctatcgaccacagagatcct

SEQ ID NO: 58235 - DNA, 25 bp, mus musculus
tctatcgaccacagagatcctctaa

SEQ ID NO: 58236 - DNA, 25 bp, mus musculus
tatcgaccacagagatcctctaagt

SEQ ID NO: 58237 - DNA, 25 bp, mus musculus
tcgaccacagagatcctctaagtcg

SEQ ID NO: 58238 - DNA, 25 bp, mus musculus
acagagatcctctaagtcggtggtg

SEQ ID NO: 58239 - DNA, 25 bp, mus musculus
gtggctcgattcgatgctcgatgta

SEQ ID NO: 58240 - DNA, 25 bp, mus musculus
ggctcgattcgatgctcgatgtatt

SEQ ID NO: 58241 - DNA, 25 bp, mus musculus
ccggtgcatgccagcttcactcgta

SEQ ID NO: 58242 - DNA, 25 bp, mus musculus
gctcgattcgatgctcgatgtattg

SEQ ID NO: 58243 - DNA, 25 bp, mus musculus
ggtgcatgccagcttcactcgtatc

SEQ ID NO: 58244 - DNA, 25 bp, mus musculus
tgcatgccagcttcactcgtatcta

SEQ ID NO: 58245 - DNA, 25 bp, mus musculus
catgccagcttcactcgtatctaca

SEQ ID NO: 58246 - DNA, 25 bp, mus musculus
ccagcttcactcgtatctacaccag

SEQ ID NO: 58247 - DNA, 25 bp, mus musculus
agcttcactcgtatctacaccagca

SEQ ID NO: 58248 - DNA, 25 bp, mus musculus
cttcactcgtatctacaccagcatt

SEQ ID NO: 58249 - DNA, 25 bp, mus musculus
gcgggtcctgccattctatcgacca

SEQ ID NO: 58250 - DNA, 25 bp, mus musculus
ctaccctgatgcagtctgcatttct

SEQ ID NO: 58251 - DNA, 25 bp, mus musculus
ccctgatgcagtctgcatttctcag

SEQ ID NO: 58252 - DNA, 25 bp, mus musculus
ggtgcttctgttaaatctgggctcg

SEQ ID NO: 58253 - DNA, 25 bp, mus musculus
aaatctgggctcggtcttcctgcag

SEQ ID NO: 58254 - DNA, 25 bp, mus musculus
ggtcttcctgcagaccttgctgtaa

SEQ ID NO: 58255 - DNA, 25 bp, mus musculus
cttgttgtttatcctcatttgcaac

SEQ ID NO: 58256 - DNA, 25 bp, mus musculus
gttgtttatcctcatttgcaactat

SEQ ID NO: 58257 - DNA, 25 bp, mus musculus
cttcctagaatgccattttgtgtgg

SEQ ID NO: 58258 - DNA, 25 bp, mus musculus
atgccattttgtgtggcttgctaat

SEQ ID NO: 58259 - DNA, 25 bp, mus musculus
ccattttgtgtggcttgctaatctt

SEQ ID NO: 58260 - DNA, 25 bp, mus musculus
ttttgtgtggcttgctaatcttggc

SEQ ID NO: 58261 - DNA, 25 bp, mus musculus
tgctaatcttggccctggaggctcg

SEQ ID NO: 58262 - DNA, 25 bp, mus musculus
ctgcatttctcagcaggtagaactt

SEQ ID NO: 58263 - DNA, 25 bp, mus musculus
ttctcagcaggtagaacttattgtg

SEQ ID NO: 58264 - DNA, 25 bp, mus musculus
caaactctgctttcctttctgccct

SEQ ID NO: 58265 - DNA, 25 bp, mus musculus
tttctgccctgctaatcttgaaaat

SEQ ID NO: 58266 - DNA, 25 bp, mus musculus
ccctgctaatcttgaaaatatggag

SEQ ID NO: 58267 - DNA, 25 bp, mus musculus
cctgggtactactgtcaacgtgaat

SEQ ID NO: 58268 - DNA, 25 bp, mus musculus
gggtactactgtcaacgtgaatact

SEQ ID NO: 58269 - DNA, 25 bp, mus musculus
accattttccactggaggcagcacc

SEQ ID NO: 58270 - DNA, 25 bp, mus musculus
gacaaccagactaacctgctgccag

SEQ ID NO: 58271 - DNA, 25 bp, mus musculus
caaccagactaacctgctgccagat

SEQ ID NO: 58272 - DNA, 25 bp, mus musculus
catctctgttgatctcgtcctcacg

SEQ ID NO: 58273 - DNA, 25 bp, mus musculus
tctctgttgatctcgtcctcacgaa

SEQ ID NO: 58274 - DNA, 25 bp, mus musculus
tctgttgatctcgtcctcacgaagc

SEQ ID NO: 58275 - DNA, 25 bp, mus musculus
tgttgatctcgtcctcacgaagcat

SEQ ID NO: 58276 - DNA, 25 bp, mus musculus
ttgatctcgtcctcacgaagcatga

SEQ ID NO: 58277 - DNA, 25 bp, mus musculus
gatctcgtcctcacgaagcatgacc

SEQ ID NO: 58278 - DNA, 25 bp, mus musculus
gtcctcacgaagcatgacctgcttg

SEQ ID NO: 58279 - DNA, 25 bp, mus musculus
ctcgcttgcaaatcggagatggatg

SEQ ID NO: 58280 - DNA, 25 bp, mus musculus
tcgcttgcaaatcggagatggatga

SEQ ID NO: 58281 - DNA, 25 bp, mus musculus
cgcttgcaaatcggagatggatgac

SEQ ID NO: 58282 - DNA, 25 bp, mus musculus
accagactaacctgctgccagatgc

SEQ ID NO: 58283 - DNA, 25 bp, mus musculus
cagactaacctgctgccagatgctc

SEQ ID NO: 58284 - DNA, 25 bp, mus musculus
aacctgctgccagatgctctgaacc

SEQ ID NO: 58285 - DNA, 25 bp, mus musculus
gccagatgctctgaacctcttcagg

SEQ ID NO: 58286 - DNA, 25 bp, mus musculus
cttcaggagcatctggacaacagat

SEQ ID NO: 58287 - DNA, 25 bp, mus musculus
atctggacaacagatggctgggacc

SEQ ID NO: 58288 - DNA, 25 bp, mus musculus
tggctgggaccatctctgttgatct

SEQ ID NO: 58289 - DNA, 25 bp, mus musculus
accatctctgttgatctcgtcctca

SEQ ID NO: 58290 - DNA, 25 bp, mus musculus
agcagcgcctcaatctacagtggca

SEQ ID NO: 58291 - DNA, 25 bp, mus musculus
cagcgcctcaatctacagtggcaag

SEQ ID NO: 58292 - DNA, 25 bp, mus musculus
ccctgcgctgcaatcactaatgtgg

SEQ ID NO: 58293 - DNA, 25 bp, mus musculus
cctgcgctgcaatcactaatgtggc

SEQ ID NO: 58294 - DNA, 25 bp, mus musculus
tgcgctgcaatcactaatgtggcat

SEQ ID NO: 58295 - DNA, 25 bp, mus musculus
gcgctgcaatcactaatgtggcatc

SEQ ID NO: 58296 - DNA, 25 bp, mus musculus
gctgcaatcactaatgtggcatcac

SEQ ID NO: 58297 - DNA, 25 bp, mus musculus
ctgcaatcactaatgtggcatcaca

SEQ ID NO: 58298 - DNA, 25 bp, mus musculus
caatcactaatgtggcatcacatat

SEQ ID NO: 58299 - DNA, 25 bp, mus musculus
atcactaatgtggcatcacatatcc

SEQ ID NO: 58300 - DNA, 25 bp, mus musculus
atgtggcatcacatatcctctcact

SEQ ID NO: 58301 - DNA, 25 bp, mus musculus
tggcatcacatatcctctcactctc

SEQ ID NO: 58302 - DNA, 25 bp, mus musculus
agcgcctcaatctacagtggcaagc

SEQ ID NO: 58303 - DNA, 25 bp, mus musculus
cgcctcaatctacagtggcaagcca

SEQ ID NO: 58304 - DNA, 25 bp, mus musculus
gcctcaatctacagtggcaagccaa

SEQ ID NO: 58305 - DNA, 25 bp, mus musculus
ctcaatctacagtggcaagccaaat

SEQ ID NO: 58306 - DNA, 25 bp, mus musculus
tcaatctacagtggcaagccaaatg

SEQ ID NO: 58307 - DNA, 25 bp, mus musculus
agaagttgtccttggcagtgaagaa

SEQ ID NO: 58308 - DNA, 25 bp, mus musculus
ctcccctgcgctgcaatcactaatg

SEQ ID NO: 58309 - DNA, 25 bp, mus musculus
tcccctgcgctgcaatcactaatgt

SEQ ID NO: 58310 - DNA, 25 bp, mus musculus
gggattccagaccagttgtcatttc

SEQ ID NO: 58311 - DNA, 25 bp, mus musculus
attccagaccagttgtcatttcccg

SEQ ID NO: 58312 - DNA, 25 bp, mus musculus
caggaaaccatcttcgcaagcagca

SEQ ID NO: 58313 - DNA, 25 bp, mus musculus
ttcgcaagcagcagctccttcgtcc

SEQ ID NO: 58314 - DNA, 25 bp, mus musculus
cgcaagcagcagctccttcgtccaa

SEQ ID NO: 58315 - DNA, 25 bp, mus musculus
gcaagcagcagctccttcgtccaag

SEQ ID NO: 58316 - DNA, 25 bp, mus musculus
cagcagctccttcgtccaaggccat

SEQ ID NO: 58317 - DNA, 25 bp, mus musculus
ttcgtccaaggccattctggggtgt

SEQ ID NO: 58318 - DNA, 25 bp, mus musculus
ggccattctggggtgtttgccctgg

SEQ ID NO: 58319 - DNA, 25 bp, mus musculus
ggtgtttgccctggtctgaaggcga

SEQ ID NO: 58320 - DNA, 25 bp, mus musculus
gtgtttgccctggtctgaaggcgat

SEQ ID NO: 58321 - DNA, 25 bp, mus musculus
gccctggtctgaaggcgatgggact

SEQ ID NO: 58322 - DNA, 25 bp, mus musculus
ttccagaccagttgtcatttcccgg

SEQ ID NO: 58323 - DNA, 25 bp, mus musculus
ccctggtctgaaggcgatgggactc

SEQ ID NO: 58324 - DNA, 25 bp, mus musculus
gaccagttgtcatttcccgggacat

SEQ ID NO: 58325 - DNA, 25 bp, mus musculus
atcatgagctggcattggcacagtg

SEQ ID NO: 58326 - DNA, 25 bp, mus musculus
atgagctggcattggcacagtgttt

SEQ ID NO: 58327 - DNA, 25 bp, mus musculus
agctggcattggcacagtgtttggt

SEQ ID NO: 58328 - DNA, 25 bp, mus musculus
cattggcacagtgtttggtagcttg

SEQ ID NO: 58329 - DNA, 25 bp, mus musculus
aatgcaggaaaccatcttcgcaagc

SEQ ID NO: 58330 - DNA, 25 bp, mus musculus
gcaggaaaccatcttcgcaagcagc

SEQ ID NO: 58331 - DNA, 25 bp, mus musculus
tgagacttcctgcaacacaactacc

SEQ ID NO: 58332 - DNA, 25 bp, mus musculus
attttgcgttgctctggagatagaa

SEQ ID NO: 58333 - DNA, 25 bp, mus musculus
tctctgatgatccattcaatgacct

SEQ ID NO: 58334 - DNA, 25 bp, mus musculus
atccattcaatgaccttcatccttg

SEQ ID NO: 58335 - DNA, 25 bp, mus musculus
cattcaatgaccttcatccttgtcc

SEQ ID NO: 58336 - DNA, 25 bp, mus musculus
tcctcacttgcaaccaatgcttact

SEQ ID NO: 58337 - DNA, 25 bp, mus musculus
tcacttgcaaccaatgcttactgga

SEQ ID NO: 58338 - DNA, 25 bp, mus musculus
cttgcaaccaatgcttactggagtc

SEQ ID NO: 58339 - DNA, 25 bp, mus musculus
accaatgcttactggagtcctctag

SEQ ID NO: 58340 - DNA, 25 bp, mus musculus
aatgcttactggagtcctctagcga

SEQ ID NO: 58341 - DNA, 25 bp, mus musculus
gcttactggagtcctctagcgatga

SEQ ID NO: 58342 - DNA, 25 bp, mus musculus
cactttataacccctgctgtatagg

SEQ ID NO: 58343 - DNA, 25 bp, mus musculus
ttgcgttgctctggagatagaagtt

SEQ ID NO: 58344 - DNA, 25 bp, mus musculus
gctgctcttgaccctggaggcatgt

SEQ ID NO: 58345 - DNA, 25 bp, mus musculus
ctctcacagaagcaaagtcaagagc

SEQ ID NO: 58346 - DNA, 25 bp, mus musculus
caagagcaatctctgccttcccatc

SEQ ID NO: 58347 - DNA, 25 bp, mus musculus
ctgccccactactctggacaatact

SEQ ID NO: 58348 - DNA, 25 bp, mus musculus
cactactctggacaatactgagatc

SEQ ID NO: 58349 - DNA, 25 bp, mus musculus
caatactgagatcactggtaatgct

SEQ ID NO: 58350 - DNA, 25 bp, mus musculus
gacctttctctgatgatccattcaa

SEQ ID NO: 58351 - DNA, 25 bp, mus musculus
ctttctctgatgatccattcaatga

SEQ ID NO: 58352 - DNA, 25 bp, mus musculus
atgcagggaacccttctctgaagca

SEQ ID NO: 58353 - DNA, 25 bp, mus musculus
tgcagggaacccttctctgaagcaa

SEQ ID NO: 58354 - DNA, 25 bp, mus musculus
ctcctaggcgattctgggctttgct

SEQ ID NO: 58355 - DNA, 25 bp, mus musculus
aggcgattctgggctttgctgcttc

SEQ ID NO: 58356 - DNA, 25 bp, mus musculus
ggcgattctgggctttgctgcttca

SEQ ID NO: 58357 - DNA, 25 bp, mus musculus
cgattctgggctttgctgcttcata

SEQ ID NO: 58358 - DNA, 25 bp, mus musculus
gctttgctgcttcataggccatggg

SEQ ID NO: 58359 - DNA, 25 bp, mus musculus
ctttgctgcttcataggccatgggg

SEQ ID NO: 58360 - DNA, 25 bp, mus musculus
ttgctgcttcataggccatggggcg

SEQ ID NO: 58361 - DNA, 25 bp, mus musculus
tgctgcttcataggccatggggcgc

SEQ ID NO: 58362 - DNA, 25 bp, mus musculus
ctgcttcataggccatggggcgctt

SEQ ID NO: 58363 - DNA, 25 bp, mus musculus
tgcttcataggccatggggcgcttt

SEQ ID NO: 58364 - DNA, 25 bp, mus musculus
acccttctctgaagcaagaactctt

SEQ ID NO: 58365 - DNA, 25 bp, mus musculus
cccttctctgaagcaagaactcttc

SEQ ID NO: 58366 - DNA, 25 bp, mus musculus
gaagcaagaactcttctcctaggcg

SEQ ID NO: 58367 - DNA, 25 bp, mus musculus
agcaagaactcttctcctaggcgat

SEQ ID NO: 58368 - DNA, 25 bp, mus musculus
gcaagaactcttctcctaggcgatt

SEQ ID NO: 58369 - DNA, 25 bp, mus musculus
agaactcttctcctaggcgattctg

SEQ ID NO: 58370 - DNA, 25 bp, mus musculus
aactcttctcctaggcgattctggg

SEQ ID NO: 58371 - DNA, 25 bp, mus musculus
tcttctcctaggcgattctgggctt

SEQ ID NO: 58372 - DNA, 25 bp, mus musculus
ttcctggggactgcgatggcgaccc

SEQ ID NO: 58373 - DNA, 25 bp, mus musculus
gcgaccccaatgggtcagtgagacc

SEQ ID NO: 58374 - DNA, 25 bp, mus musculus
tctcccacaggctacttgcagtggc

SEQ ID NO: 58375 - DNA, 25 bp, mus musculus
acaggctacttgcagtggctttgcc

SEQ ID NO: 58376 - DNA, 25 bp, mus musculus
gaatcgacaaggccaagtagccatg

SEQ ID NO: 58377 - DNA, 25 bp, mus musculus
acaaggccaagtagccatgggatcc

SEQ ID NO: 58378 - DNA, 25 bp, mus musculus
agccatgggatcccagaggtcctga

SEQ ID NO: 58379 - DNA, 25 bp, mus musculus
ccatgaagcccaactggttgcgctt

SEQ ID NO: 58380 - DNA, 25 bp, mus musculus
agcccaactggttgcgcttgatcca

SEQ ID NO: 58381 - DNA, 25 bp, mus musculus
actggttgcgcttgatccatgatcc

SEQ ID NO: 58382 - DNA, 25 bp, mus musculus
tgcgcttgatccatgatcctgttaa

SEQ ID NO: 58383 - DNA, 25 bp, mus musculus
tgatccatgatcctgttaaccgcga

SEQ ID NO: 58384 - DNA, 25 bp, mus musculus
tgagacccatcaagttggagcagac

SEQ ID NO: 58385 - DNA, 25 bp, mus musculus
agttggagcagacatccctgagtcc

SEQ ID NO: 58386 - DNA, 25 bp, mus musculus
tgagtcctgaggtgcggtgacccaa

SEQ ID NO: 58387 - DNA, 25 bp, mus musculus
tgctgctcagtgaactccctgtaaa

SEQ ID NO: 58388 - DNA, 25 bp, mus musculus
aaggatctcaggtcgcccagatgag

SEQ ID NO: 58389 - DNA, 25 bp, mus musculus
ctcaggtcgcccagatgaggaaacg

SEQ ID NO: 58390 - DNA, 25 bp, mus musculus
ggaaacgccctgtagctctggaagg

SEQ ID NO: 58391 - DNA, 25 bp, mus musculus
tagctctggaagggtgaccggcgac

SEQ ID NO: 58392 - DNA, 25 bp, mus musculus
gtggccactcaaatttactaagccg

SEQ ID NO: 58393 - DNA, 25 bp, mus musculus
tggccactcaaatttactaagccgt

SEQ ID NO: 58394 - DNA, 25 bp, mus musculus
gccgtagtgctaccaaggggatctc

SEQ ID NO: 58395 - DNA, 25 bp, mus musculus
cgtagtgctaccaaggggatctctg

SEQ ID NO: 58396 - DNA, 25 bp, mus musculus
tgctaccaaggggatctctgaggtt

SEQ ID NO: 58397 - DNA, 25 bp, mus musculus
gctaccaaggggatctctgaggttg

SEQ ID NO: 58398 - DNA, 25 bp, mus musculus
taccaaggggatctctgaggttggg

SEQ ID NO: 58399 - DNA, 25 bp, mus musculus
ggatctctgaggttgggatgtttag

SEQ ID NO: 58400 - DNA, 25 bp, mus musculus
gatctctgaggttgggatgtttagg

SEQ ID NO: 58401 - DNA, 25 bp, mus musculus
atctctgaggttgggatgtttaggg

SEQ ID NO: 58402 - DNA, 25 bp, mus musculus
ccaaatagcatgagtccttgaagac

SEQ ID NO: 58403 - DNA, 25 bp, mus musculus
atagcatgagtccttgaagacatgg

SEQ ID NO: 58404 - DNA, 25 bp, mus musculus
gccactcaaatttactaagccgtag

SEQ ID NO: 58405 - DNA, 25 bp, mus musculus
cactcaaatttactaagccgtagtg

SEQ ID NO: 58406 - DNA, 25 bp, mus musculus
tcaaatttactaagccgtagtgcta

SEQ ID NO: 58407 - DNA, 25 bp, mus musculus
tttactaagccgtagtgctaccaag

SEQ ID NO: 58408 - DNA, 25 bp, mus musculus
ttactaagccgtagtgctaccaagg

SEQ ID NO: 58409 - DNA, 25 bp, mus musculus
tactaagccgtagtgctaccaaggg

SEQ ID NO: 58410 - DNA, 25 bp, mus musculus
taagccgtagtgctaccaaggggat

SEQ ID NO: 58411 - DNA, 25 bp, mus musculus
agccgtagtgctaccaaggggatct

SEQ ID NO: 58412 - DNA, 25 bp, mus musculus
tagatttcactcacacactcacgtt

SEQ ID NO: 58413 - DNA, 25 bp, mus musculus
tcactcacacactcacgttcttgat

SEQ ID NO: 58414 - DNA, 25 bp, mus musculus
tgatcactcgaagcacatttagccc

SEQ ID NO: 58415 - DNA, 25 bp, mus musculus
gcacatttagcccagatatctggtc

SEQ ID NO: 58416 - DNA, 25 bp, mus musculus
ttagcccagatatctggtcagcatc

SEQ ID NO: 58417 - DNA, 25 bp, mus musculus
tctggtcagcatccttagtggcctg

SEQ ID NO: 58418 - DNA, 25 bp, mus musculus
ccttagtggcctgacgctgtgaatc

SEQ ID NO: 58419 - DNA, 25 bp, mus musculus
tggcctgacgctgtgaatcattgca

SEQ ID NO: 58420 - DNA, 25 bp, mus musculus
aattcgcagggactatgttcacagc

SEQ ID NO: 58421 - DNA, 25 bp, mus musculus
ctatgttcacagcattttttgctgc

SEQ ID NO: 58422 - DNA, 25 bp, mus musculus
tcacagcattttttgctgcttggcg

SEQ ID NO: 58423 - DNA, 25 bp, mus musculus
aattttcctcaggtctctttcatct

SEQ ID NO: 58424 - DNA, 25 bp, mus musculus
cacctaagtcatacacagcagtgac

SEQ ID NO: 58425 - DNA, 25 bp, mus musculus
agtcatacacagcagtgactttatc

SEQ ID NO: 58426 - DNA, 25 bp, mus musculus
cttcagatttgtccagaccgtaagc

SEQ ID NO: 58427 - DNA, 25 bp, mus musculus
atttgtccagaccgtaagctatagc

SEQ ID NO: 58428 - DNA, 25 bp, mus musculus
ccagaccgtaagctatagcagcagc

SEQ ID NO: 58429 - DNA, 25 bp, mus musculus
cagcagctgtatgctcattgatcac

SEQ ID NO: 58430 - DNA, 25 bp, mus musculus
ctgtatgctcattgatcactcgaag

SEQ ID NO: 58431 - DNA, 25 bp, mus musculus
gctcattgatcactcgaagcacatt

SEQ ID NO: 58432 - DNA, 25 bp, mus musculus
cacctgcgctgtctgagctgagcac

SEQ ID NO: 58433 - DNA, 25 bp, mus musculus
atagtagctctgactcggaccctga

SEQ ID NO: 58434 - DNA, 25 bp, mus musculus
ttgtcacggatgtcacagccaacct

SEQ ID NO: 58435 - DNA, 25 bp, mus musculus
cggatgtcacagccaacctcatcac

SEQ ID NO: 58436 - DNA, 25 bp, mus musculus
tgggcttcttcaacttgaggcatta

SEQ ID NO: 58437 - DNA, 25 bp, mus musculus
attgagaccattgcccgagccgagc

SEQ ID NO: 58438 - DNA, 25 bp, mus musculus
gttttgctttgatgcctgacctggg

SEQ ID NO: 58439 - DNA, 25 bp, mus musculus
ctttgatgcctgacctgggggccaa

SEQ ID NO: 58440 - DNA, 25 bp, mus musculus
actctgccctgtcctgagactcagg

SEQ ID NO: 58441 - DNA, 25 bp, mus musculus
gaaatggcttcctgctgattctacc

SEQ ID NO: 58442 - DNA, 25 bp, mus musculus
ctctctgggcctccacttcagtctg

SEQ ID NO: 58443 - DNA, 25 bp, mus musculus
ccacttcagtctgtcctgtcatctc

SEQ ID NO: 58444 - DNA, 25 bp, mus musculus
gctctgactcggaccctgactcgac

SEQ ID NO: 58445 - DNA, 25 bp, mus musculus
agtctgtcctgtcatctcaggaaag

SEQ ID NO: 58446 - DNA, 25 bp, mus musculus
cctcgcttcccagtgctgcgcagaa

SEQ ID NO: 58447 - DNA, 25 bp, mus musculus
ttcccagtgctgcgcagaacctatc

SEQ ID NO: 58448 - DNA, 25 bp, mus musculus
gtgctgcgcagaacctatctgtagc

SEQ ID NO: 58449 - DNA, 25 bp, mus musculus
acctatctgtagctatccagaccag

SEQ ID NO: 58450 - DNA, 25 bp, mus musculus
ctatccagaccagccaggactggaa

SEQ ID NO: 58451 - DNA, 25 bp, mus musculus
actggaaacctacccgcagtctcat

SEQ ID NO: 58452 - DNA, 25 bp, mus musculus
cccgcagtctcatcgaacacgtctt

SEQ ID NO: 58453 - DNA, 25 bp, mus musculus
gtccaagatccaaattgtgacaaag

SEQ ID NO: 58454 - DNA, 25 bp, mus musculus
tgccatcgagatcgtacctgccacg

SEQ ID NO: 58455 - DNA, 25 bp, mus musculus
tgtcatggtcctggtgaacaccttt

SEQ ID NO: 58456 - DNA, 25 bp, mus musculus
ggtcctggtgaacaccttttgccag

SEQ ID NO: 58457 - DNA, 25 bp, mus musculus
ggtgaacaccttttgccagagctgt

SEQ ID NO: 58458 - DNA, 25 bp, mus musculus
ttgccagagctgtatccccgaaagg

SEQ ID NO: 58459 - DNA, 25 bp, mus musculus
ccctgcctgctatgcactctgcaat

SEQ ID NO: 58460 - DNA, 25 bp, mus musculus
ctgctatgcactctgcaatgccact

SEQ ID NO: 58461 - DNA, 25 bp, mus musculus
ctgcaatgccactttcaaaaagacc

SEQ ID NO: 58462 - DNA, 25 bp, mus musculus
ccaccttttgctgtgccagtatcgg

SEQ ID NO: 58463 - DNA, 25 bp, mus musculus
tttgctgtgccagtatcggaacatc

SEQ ID NO: 58464 - DNA, 25 bp, mus musculus
gtatcggaacatcggcacagccagg

SEQ ID NO: 58465 - DNA, 25 bp, mus musculus
agcagccaatgtggcccgaaagttt

SEQ ID NO: 58466 - DNA, 25 bp, mus musculus
caatgtggcccgaaagtttgccagc

SEQ ID NO: 58467 - DNA, 25 bp, mus musculus
aaagtttgccagcatcgctcgtaac

SEQ ID NO: 58468 - DNA, 25 bp, mus musculus
tgccagcatcgctcgtaaccaggtg

SEQ ID NO: 58469 - DNA, 25 bp, mus musculus
agtgactcggacaatctttgccatt

SEQ ID NO: 58470 - DNA, 25 bp, mus musculus
tcggacaatctttgccattctgctg

SEQ ID NO: 58471 - DNA, 25 bp, mus musculus
cacctggacaccctacaatgtcatg

SEQ ID NO: 58472 - DNA, 25 bp, mus musculus
ctacaatgtcatggtcctggtgaac

SEQ ID NO: 58473 - DNA, 25 bp, mus musculus
ggccctttccacatcgcaggaacgg

SEQ ID NO: 58474 - DNA, 25 bp, mus musculus
cacatcgcaggaacgggcaggaatg

SEQ ID NO: 58475 - DNA, 25 bp, mus musculus
ggcctccagatctcccaagagtagc

SEQ ID NO: 58476 - DNA, 25 bp, mus musculus
atctcccaagagtagcaagaccaag

SEQ ID NO: 58477 - DNA, 25 bp, mus musculus
caagaccaaggctgtcaagaagcca

SEQ ID NO: 58478 - DNA, 25 bp, mus musculus
gccaaaggctacgcccacaaaagct

SEQ ID NO: 58479 - DNA, 25 bp, mus musculus
tacgcccacaaaagcttctgggagc

SEQ ID NO: 58480 - DNA, 25 bp, mus musculus
agccagggcagcaaaccccaattct

SEQ ID NO: 58481 - DNA, 25 bp, mus musculus
ggcagcaaaccccaattctgggaag

SEQ ID NO: 58482 - DNA, 25 bp, mus musculus
tcttttaagagccacttacatactt

SEQ ID NO: 58483 - DNA, 25 bp, mus musculus
tttaagagccacttacatacttctt

SEQ ID NO: 58484 - DNA, 25 bp, mus musculus
agccacttacatacttcttaaaatg

SEQ ID NO: 58485 - DNA, 25 bp, mus musculus
aggaatgtcccttgctgccctgaag

SEQ ID NO: 58486 - DNA, 25 bp, mus musculus
ccttgctgccctgaagaaagccctg

SEQ ID NO: 58487 - DNA, 25 bp, mus musculus
tgctgccctgaagaaagccctggct

SEQ ID NO: 58488 - DNA, 25 bp, mus musculus
cctggctgcggctggttacgacgtg

SEQ ID NO: 58489 - DNA, 25 bp, mus musculus
catcaagctggccctcaagagactt

SEQ ID NO: 58490 - DNA, 25 bp, mus musculus
gctggccctcaagagacttgtgaat

SEQ ID NO: 58491 - DNA, 25 bp, mus musculus
ctcaggctccttcaagctcagtaag

SEQ ID NO: 58492 - DNA, 25 bp, mus musculus
gaaatctgcttctgccaaggctaag

SEQ ID NO: 58493 - DNA, 25 bp, mus musculus
caacctatcatttgactggtacatc

SEQ ID NO: 58494 - DNA, 25 bp, mus musculus
gtacatcaagacttctcatggtcac

SEQ ID NO: 58495 - DNA, 25 bp, mus musculus
cagctccattgggggcctggtgctc

SEQ ID NO: 58496 - DNA, 25 bp, mus musculus
cattgggggcctggtgctcttggct

SEQ ID NO: 58497 - DNA, 25 bp, mus musculus
cttggctctcatcactgctggccta

SEQ ID NO: 58498 - DNA, 25 bp, mus musculus
tctcatcactgctggcctatacaag

SEQ ID NO: 58499 - DNA, 25 bp, mus musculus
tggcctatacaagcttggctttttc

SEQ ID NO: 58500 - DNA, 25 bp, mus musculus
gcttggctttttcaagcggcagtac

SEQ ID NO: 58501 - DNA, 25 bp, mus musculus
acggccttttctccaatgcattgac

SEQ ID NO: 58502 - DNA, 25 bp, mus musculus
gatggtcagaccaacaccgaagcta

SEQ ID NO: 58503 - DNA, 25 bp, mus musculus
cagaccaacaccgaagctagtgaca

SEQ ID NO: 58504 - DNA, 25 bp, mus musculus
acatatgttgttgctgtgatgtctt

SEQ ID NO: 58505 - DNA, 25 bp, mus musculus
ttctcatggtcacctcctgcttgtg

SEQ ID NO: 58506 - DNA, 25 bp, mus musculus
cctcctgcttgtgagcagcactgag

SEQ ID NO: 58507 - DNA, 25 bp, mus musculus
cactgagatcctgtttaatgactct

SEQ ID NO: 58508 - DNA, 25 bp, mus musculus
gatcctgtttaatgactctgcgttt

SEQ ID NO: 58509 - DNA, 25 bp, mus musculus
gtttaatgactctgcgtttgccctg

SEQ ID NO: 58510 - DNA, 25 bp, mus musculus
atatgaagttcacaatcctgtacca

SEQ ID NO: 58511 - DNA, 25 bp, mus musculus
agttcacaatcctgtaccactcatt

SEQ ID NO: 58512 - DNA, 25 bp, mus musculus
tgtaccactcattgtgggcagctcc

SEQ ID NO: 58513 - DNA, 25 bp, mus musculus
aagcccaagactatcatcacgtcca

SEQ ID NO: 58514 - DNA, 25 bp, mus musculus
actatcatcacgtccaagatgcctg

SEQ ID NO: 58515 - DNA, 25 bp, mus musculus
gtaccccagcacatgcagactagat

SEQ ID NO: 58516 - DNA, 25 bp, mus musculus
atgcagactagattcccgagtgact

SEQ ID NO: 58517 - DNA, 25 bp, mus musculus
ttcccgagtgactctgattgtgcac

SEQ ID NO: 58518 - DNA, 25 bp, mus musculus
gactctgattgtgcacgcaagaagc

SEQ ID NO: 58519 - DNA, 25 bp, mus musculus
gcacgcaagaagctgcttggttcta

SEQ ID NO: 58520 - DNA, 25 bp, mus musculus
agaccagagacatcagcagctgggt

SEQ ID NO: 58521 - DNA, 25 bp, mus musculus
acatcagcagctgggtacctctgat

SEQ ID NO: 58522 - DNA, 25 bp, mus musculus
gggtacctctgatgccgcggagtgt

SEQ ID NO: 58523 - DNA, 25 bp, mus musculus
tacctctgatgccgcggagtgtgac

SEQ ID NO: 58524 - DNA, 25 bp, mus musculus
tgatgccgcggagtgtgacatcaag

SEQ ID NO: 58525 - DNA, 25 bp, mus musculus
atcacgtccaagatgcctgtcaagt

SEQ ID NO: 58526 - DNA, 25 bp, mus musculus
tccaagatgcctgtcaagtgagtca

SEQ ID NO: 58527 - DNA, 25 bp, mus musculus
aagatgcctgtcaagtgagtcagtc

SEQ ID NO: 58528 - DNA, 25 bp, mus musculus
tgagtcagtccacgactcctctgca

SEQ ID NO: 58529 - DNA, 25 bp, mus musculus
agtccacgactcctctgcacaaaag

SEQ ID NO: 58530 - DNA, 25 bp, mus musculus
cgactcctctgcacaaaagctgtgg

SEQ ID NO: 58531 - DNA, 25 bp, mus musculus
ctctgcacaaaagctgtgggatccg

SEQ ID NO: 58532 - DNA, 25 bp, mus musculus
gaacgcgtaccccagcacatgcaga

SEQ ID NO: 58533 - DNA, 25 bp, mus musculus
tgtgattctcgtcctcgagaagcag

SEQ ID NO: 58534 - DNA, 25 bp, mus musculus
gtgattctcgtcctcgagaagcagg

SEQ ID NO: 58535 - DNA, 25 bp, mus musculus
actactttccaggaggtcgctgcgc

SEQ ID NO: 58536 - DNA, 25 bp, mus musculus
ctactttccaggaggtcgctgcgct

SEQ ID NO: 58537 - DNA, 25 bp, mus musculus
tactttccaggaggtcgctgcgctg

SEQ ID NO: 58538 - DNA, 25 bp, mus musculus
ctttccaggaggtcgctgcgctgac

SEQ ID NO: 58539 - DNA, 25 bp, mus musculus
tttccaggaggtcgctgcgctgaca

SEQ ID NO: 58540 - DNA, 25 bp, mus musculus
ttccaggaggtcgctgcgctgacac

SEQ ID NO: 58541 - DNA, 25 bp, mus musculus
tccaggaggtcgctgcgctgacacc

SEQ ID NO: 58542 - DNA, 25 bp, mus musculus
gtcgctgcgctgacaccgagtgcgt

SEQ ID NO: 58543 - DNA, 25 bp, mus musculus
tcgctgcgctgacaccgagtgcgtg

SEQ ID NO: 58544 - DNA, 25 bp, mus musculus
cgctgcgctgacaccgagtgcgtga

SEQ ID NO: 58545 - DNA, 25 bp, mus musculus
tgattctcgtcctcgagaagcagga

SEQ ID NO: 58546 - DNA, 25 bp, mus musculus
gattctcgtcctcgagaagcaggac

SEQ ID NO: 58547 - DNA, 25 bp, mus musculus
ttctcgtcctcgagaagcaggacct

SEQ ID NO: 58548 - DNA, 25 bp, mus musculus
tcgtcctcgagaagcaggacctgcg

SEQ ID NO: 58549 - DNA, 25 bp, mus musculus
tcctcgagaagcaggacctgcgtgg

SEQ ID NO: 58550 - DNA, 25 bp, mus musculus
caggacctgcgtggtgagagagtcc

SEQ ID NO: 58551 - DNA, 25 bp, mus musculus
aggactactttccaggaggtcgctg

SEQ ID NO: 58552 - DNA, 25 bp, mus musculus
gactactttccaggaggtcgctgcg

SEQ ID NO: 58553 - DNA, 25 bp, mus musculus
tcaaacaggacctacatcagagccc

SEQ ID NO: 58554 - DNA, 25 bp, mus musculus
tacatcagagcccgagtacagtcta

SEQ ID NO: 58555 - DNA, 25 bp, mus musculus
tctctctaaggctacaggctgctca

SEQ ID NO: 58556 - DNA, 25 bp, mus musculus
taaggctacaggctgctcagctgcc

SEQ ID NO: 58557 - DNA, 25 bp, mus musculus
tacaggctgctcagctgcctgacaa

SEQ ID NO: 58558 - DNA, 25 bp, mus musculus
ctgctcagctgcctgacaagggaca

SEQ ID NO: 58559 - DNA, 25 bp, mus musculus
ggccatgtttctcttgcaaccgtga

SEQ ID NO: 58560 - DNA, 25 bp, mus musculus
tcacccgcagacgacaatcaaccta

SEQ ID NO: 58561 - DNA, 25 bp, mus musculus
gcagacgacaatcaacctaccagcc

SEQ ID NO: 58562 - DNA, 25 bp, mus musculus
ctgccccagtccactgtgtaagcca

SEQ ID NO: 58563 - DNA, 25 bp, mus musculus
accaaggagcgcctcatctcttcac

SEQ ID NO: 58564 - DNA, 25 bp, mus musculus
tctctgtctttaggaacacaatgaa

SEQ ID NO: 58565 - DNA, 25 bp, mus musculus
acaatgtgtccttcccacaggcagc

SEQ ID NO: 58566 - DNA, 25 bp, mus musculus
tgtccttcccacaggcagcacagtg

SEQ ID NO: 58567 - DNA, 25 bp, mus musculus
tcccacaggcagcacagtggacatt

SEQ ID NO: 58568 - DNA, 25 bp, mus musculus
cgcagaattcatctcttcgagagct

SEQ ID NO: 58569 - DNA, 25 bp, mus musculus
gagagctccaagctcccttgggcca

SEQ ID NO: 58570 - DNA, 25 bp, mus musculus
aaagcttctgctgtggaaatgcaag

SEQ ID NO: 58571 - DNA, 25 bp, mus musculus
ttctttctccagctgttcaccttga

SEQ ID NO: 58572 - DNA, 25 bp, mus musculus
ctgttcaccttgacctgctctctct

SEQ ID NO: 58573 - DNA, 25 bp, mus musculus
agcagctagctcaggcgaccgcgag

SEQ ID NO: 58574 - DNA, 25 bp, mus musculus
gcagctagctcaggcgaccgcgagt

SEQ ID NO: 58575 - DNA, 25 bp, mus musculus
gcgagtccctgacagtacatcgcag

SEQ ID NO: 58576 - DNA, 25 bp, mus musculus
cgagtccctgacagtacatcgcagt

SEQ ID NO: 58577 - DNA, 25 bp, mus musculus
gagtccctgacagtacatcgcagtg

SEQ ID NO: 58578 - DNA, 25 bp, mus musculus
agtccctgacagtacatcgcagtgc

SEQ ID NO: 58579 - DNA, 25 bp, mus musculus
gtccctgacagtacatcgcagtgca

SEQ ID NO: 58580 - DNA, 25 bp, mus musculus
aaggatcgctgcgccgtctacagcc

SEQ ID NO: 58581 - DNA, 25 bp, mus musculus
aggatcgctgcgccgtctacagcct

SEQ ID NO: 58582 - DNA, 25 bp, mus musculus
gatcgctgcgccgtctacagcctgc

SEQ ID NO: 58583 - DNA, 25 bp, mus musculus
ccaggaccgcaactagagtaagcgt

SEQ ID NO: 58584 - DNA, 25 bp, mus musculus
caggaccgcaactagagtaagcgtc

SEQ ID NO: 58585 - DNA, 25 bp, mus musculus
tagctcaggcgaccgcgagtccctg

SEQ ID NO: 58586 - DNA, 25 bp, mus musculus
caggcgaccgcgagtccctgacagt

SEQ ID NO: 58587 - DNA, 25 bp, mus musculus
gcgaccgcgagtccctgacagtaca

SEQ ID NO: 58588 - DNA, 25 bp, mus musculus
cgaccgcgagtccctgacagtacat

SEQ ID NO: 58589 - DNA, 25 bp, mus musculus
gaccgcgagtccctgacagtacatc

SEQ ID NO: 58590 - DNA, 25 bp, mus musculus
accgcgagtccctgacagtacatcg

SEQ ID NO: 58591 - DNA, 25 bp, mus musculus
ccgcgagtccctgacagtacatcgc

SEQ ID NO: 58592 - DNA, 25 bp, mus musculus
cgcgagtccctgacagtacatcgca

SEQ ID NO: 58593 - DNA, 25 bp, mus musculus
gcaatgcctgggaccatgtaaaact

SEQ ID NO: 58594 - DNA, 25 bp, mus musculus
aatgcctgggaccatgtaaaactgt

SEQ ID NO: 58595 - DNA, 25 bp, mus musculus
gttctagccagggttggaggacagc

SEQ ID NO: 58596 - DNA, 25 bp, mus musculus
tctagccagggttggaggacagcct

SEQ ID NO: 58597 - DNA, 25 bp, mus musculus
ggacagccttgtcttaggtttctgc

SEQ ID NO: 58598 - DNA, 25 bp, mus musculus
acagccttgtcttaggtttctgcac

SEQ ID NO: 58599 - DNA, 25 bp, mus musculus
agccttgtcttaggtttctgcactg

SEQ ID NO: 58600 - DNA, 25 bp, mus musculus
ccttgtcttaggtttctgcactgca

SEQ ID NO: 58601 - DNA, 25 bp, mus musculus
gtcttaggtttctgcactgcaggac

SEQ ID NO: 58602 - DNA, 25 bp, mus musculus
cttaggtttctgcactgcaggactc

SEQ ID NO: 58603 - DNA, 25 bp, mus musculus
taggtttctgcactgcaggactcag

SEQ ID NO: 58604 - DNA, 25 bp, mus musculus
ggtttctgcactgcaggactcagag

SEQ ID NO: 58605 - DNA, 25 bp, mus musculus
tgtcctggttctttccaaggtatag

SEQ ID NO: 58606 - DNA, 25 bp, mus musculus
ggttctttccaaggtatagagcata

SEQ ID NO: 58607 - DNA, 25 bp, mus musculus
ttctttccaaggtatagagcatagc

SEQ ID NO: 58608 - DNA, 25 bp, mus musculus
gagcatagctcatgggctgatagtt

SEQ ID NO: 58609 - DNA, 25 bp, mus musculus
gcatagctcatgggctgatagttct

SEQ ID NO: 58610 - DNA, 25 bp, mus musculus
atagctcatgggctgatagttctag

SEQ ID NO: 58611 - DNA, 25 bp, mus musculus
ctgatagttctagccagggttggag

SEQ ID NO: 58612 - DNA, 25 bp, mus musculus
tagttctagccagggttggaggaca

SEQ ID NO: 58613 - DNA, 25 bp, mus musculus
agacccttaccactgtccagtggat

SEQ ID NO: 58614 - DNA, 25 bp, mus musculus
cccttaccactgtccagtggatcgc

SEQ ID NO: 58615 - DNA, 25 bp, mus musculus
accagccgcaagacatatgcagatt

SEQ ID NO: 58616 - DNA, 25 bp, mus musculus
acatatgcagattcctgagagagat

SEQ ID NO: 58617 - DNA, 25 bp, mus musculus
tttggctgcctaaggacgatccagc

SEQ ID NO: 58618 - DNA, 25 bp, mus musculus
atccagctgaaggtcatgggtgtta

SEQ ID NO: 58619 - DNA, 25 bp, mus musculus
agatgcttgtagctctgttaaacgt

SEQ ID NO: 58620 - DNA, 25 bp, mus musculus
ttgtagctctgttaaacgttagtgg

SEQ ID NO: 58621 - DNA, 25 bp, mus musculus
gacggatcctctctcaatgagtccg

SEQ ID NO: 58622 - DNA, 25 bp, mus musculus
tcctctctcaatgagtccgaatctc

SEQ ID NO: 58623 - DNA, 25 bp, mus musculus
tctctcaatgagtccgaatctcctt

SEQ ID NO: 58624 - DNA, 25 bp, mus musculus
ctcaatgagtccgaatctccttctg

SEQ ID NO: 58625 - DNA, 25 bp, mus musculus
ttaccactgtccagtggatcgctca

SEQ ID NO: 58626 - DNA, 25 bp, mus musculus
ctgtccagtggatcgctcatgatta

SEQ ID NO: 58627 - DNA, 25 bp, mus musculus
tccagtggatcgctcatgattacga

SEQ ID NO: 58628 - DNA, 25 bp, mus musculus
taattcagctacagggttaccagcc

SEQ ID NO: 58629 - DNA, 25 bp, mus musculus
ttcagctacagggttaccagccgca

SEQ ID NO: 58630 - DNA, 25 bp, mus musculus
agctacagggttaccagccgcaaga

SEQ ID NO: 58631 - DNA, 25 bp, mus musculus
agggttaccagccgcaagacatatg

SEQ ID NO: 58632 - DNA, 25 bp, mus musculus
gttaccagccgcaagacatatgcag

SEQ ID NO: 58633 - DNA, 25 bp, mus musculus
gtccttctgtcagagcaaagagcct

SEQ ID NO: 58634 - DNA, 25 bp, mus musculus
gagcaaagagcctccagggacagtg

SEQ ID NO: 58635 - DNA, 25 bp, mus musculus
tcctgattctgcaacggagttgtgg

SEQ ID NO: 58636 - DNA, 25 bp, mus musculus
tgattctgcaacggagttgtggaag

SEQ ID NO: 58637 - DNA, 25 bp, mus musculus
gaagacagaacctcaagatgcagga

SEQ ID NO: 58638 - DNA, 25 bp, mus musculus
gacagaacctcaagatgcaggagac

SEQ ID NO: 58639 - DNA, 25 bp, mus musculus
agaacctcaagatgcaggagaccag

SEQ ID NO: 58640 - DNA, 25 bp, mus musculus
aggcaacacttgcatcctcagggag

SEQ ID NO: 58641 - DNA, 25 bp, mus musculus
caacacttgcatcctcagggaggaa

SEQ ID NO: 58642 - DNA, 25 bp, mus musculus
ttgcatcctcagggaggaagccagg

SEQ ID NO: 58643 - DNA, 25 bp, mus musculus
catcctcagggaggaagccaggatg

SEQ ID NO: 58644 - DNA, 25 bp, mus musculus
gtcagcagagcctacagccctgctc

SEQ ID NO: 58645 - DNA, 25 bp, mus musculus
caaagagcctccagggacagtgtct

SEQ ID NO: 58646 - DNA, 25 bp, mus musculus
tccagggacagtgtcttggtaatgt

SEQ ID NO: 58647 - DNA, 25 bp, mus musculus
atgtccagggctccaggaagagatg

SEQ ID NO: 58648 - DNA, 25 bp, mus musculus
agagatgtccttgtggctggaggcc

SEQ ID NO: 58649 - DNA, 25 bp, mus musculus
gtccttgtggctggaggcctcaatg

SEQ ID NO: 58650 - DNA, 25 bp, mus musculus
cttgtggctggaggcctcaatgcct

SEQ ID NO: 58651 - DNA, 25 bp, mus musculus
ggaggcctcaatgcctgatgtttct

SEQ ID NO: 58652 - DNA, 25 bp, mus musculus
ggcctcaatgcctgatgtttctcct

SEQ ID NO: 58653 - DNA, 25 bp, mus musculus
attcggaacgaggcgtctctgctgc

SEQ ID NO: 58654 - DNA, 25 bp, mus musculus
ttcggaacgaggcgtctctgctgct

SEQ ID NO: 58655 - DNA, 25 bp, mus musculus
gatggcaacaacatcacggtcaaaa

SEQ ID NO: 58656 - DNA, 25 bp, mus musculus
tggcaacaacatcacggtcaaaacc

SEQ ID NO: 58657 - DNA, 25 bp, mus musculus
ggcaacaacatcacggtcaaaaccg

SEQ ID NO: 58658 - DNA, 25 bp, mus musculus
caacaacatcacggtcaaaaccgag

SEQ ID NO: 58659 - DNA, 25 bp, mus musculus
caacatcacggtcaaaaccgagagc

SEQ ID NO: 58660 - DNA, 25 bp, mus musculus
aacatcacggtcaaaaccgagagca

SEQ ID NO: 58661 - DNA, 25 bp, mus musculus
catcacggtcaaaaccgagagcaca

SEQ ID NO: 58662 - DNA, 25 bp, mus musculus
atcacggtcaaaaccgagagcacag

SEQ ID NO: 58663 - DNA, 25 bp, mus musculus
tgaaacgacagctgatggcagaaaa

SEQ ID NO: 58664 - DNA, 25 bp, mus musculus
gaaacgacagctgatggcagaaaaa

SEQ ID NO: 58665 - DNA, 25 bp, mus musculus
gaggcgtctctgctgcttttgtgct

SEQ ID NO: 58666 - DNA, 25 bp, mus musculus
aggcgtctctgctgcttttgtgctc

SEQ ID NO: 58667 - DNA, 25 bp, mus musculus
gcgtctctgctgcttttgtgctctc

SEQ ID NO: 58668 - DNA, 25 bp, mus musculus
tctctgctgcttttgtgctctccct

SEQ ID NO: 58669 - DNA, 25 bp, mus musculus
ctgtatcattacgtgtgatggcaac

SEQ ID NO: 58670 - DNA, 25 bp, mus musculus
tgtatcattacgtgtgatggcaaca

SEQ ID NO: 58671 - DNA, 25 bp, mus musculus
atcattacgtgtgatggcaacaaca

SEQ ID NO: 58672 - DNA, 25 bp, mus musculus
tgatggcaacaacatcacggtcaaa

SEQ ID NO: 58673 - DNA, 25 bp, mus musculus
tgtccagattcaccaggaggcctac

SEQ ID NO: 58674 - DNA, 25 bp, mus musculus
gtccagattcaccaggaggcctacc

SEQ ID NO: 58675 - DNA, 25 bp, mus musculus
atctataatggctgatcgcaagatc

SEQ ID NO: 58676 - DNA, 25 bp, mus musculus
ctataatggctgatcgcaagatcaa

SEQ ID NO: 58677 - DNA, 25 bp, mus musculus
tggctgatcgcaagatcaaggtttc

SEQ ID NO: 58678 - DNA, 25 bp, mus musculus
atgatagcccagcagatggttccaa

SEQ ID NO: 58679 - DNA, 25 bp, mus musculus
tccaaaagtccgtggagtccttgct

SEQ ID NO: 58680 - DNA, 25 bp, mus musculus
gtccgtggagtccttgcttggttca

SEQ ID NO: 58681 - DNA, 25 bp, mus musculus
tccgtggagtccttgcttggttcaa

SEQ ID NO: 58682 - DNA, 25 bp, mus musculus
cgtggagtccttgcttggttcaaat

SEQ ID NO: 58683 - DNA, 25 bp, mus musculus
agtccttgcttggttcaaatgccac

SEQ ID NO: 58684 - DNA, 25 bp, mus musculus
cttggttcaaatgccactaggaatt

SEQ ID NO: 58685 - DNA, 25 bp, mus musculus
ccagattcaccaggaggcctacctg

SEQ ID NO: 58686 - DNA, 25 bp, mus musculus
agattcaccaggaggcctacctgac

SEQ ID NO: 58687 - DNA, 25 bp, mus musculus
accaggaggcctacctgactgatga

SEQ ID NO: 58688 - DNA, 25 bp, mus musculus
ccaggaggcctacctgactgatgaa

SEQ ID NO: 58689 - DNA, 25 bp, mus musculus
ggaggcctacctgactgatgaaata

SEQ ID NO: 58690 - DNA, 25 bp, mus musculus
gaggcctacctgactgatgaaatag

SEQ ID NO: 58691 - DNA, 25 bp, mus musculus
cctacctgactgatgaaatagctgg

SEQ ID NO: 58692 - DNA, 25 bp, mus musculus
tgaaatagctggtcgcgtcgagatc

SEQ ID NO: 58693 - DNA, 25 bp, mus musculus
actgagatgctcaggcattgttcca

SEQ ID NO: 58694 - DNA, 25 bp, mus musculus
gataattcgtcagcatcattttgga

SEQ ID NO: 58695 - DNA, 25 bp, mus musculus
tcattttggacacacaattgatctc

SEQ ID NO: 58696 - DNA, 25 bp, mus musculus
cattttggacacacaattgatctca

SEQ ID NO: 58697 - DNA, 25 bp, mus musculus
attttggacacacaattgatctcat

SEQ ID NO: 58698 - DNA, 25 bp, mus musculus
tggacacacaattgatctcatttaa

SEQ ID NO: 58699 - DNA, 25 bp, mus musculus
gacacacaattgatctcatttaaga

SEQ ID NO: 58700 - DNA, 25 bp, mus musculus
acacacaattgatctcatttaagaa

SEQ ID NO: 58701 - DNA, 25 bp, mus musculus
cacacaattgatctcatttaagaag

SEQ ID NO: 58702 - DNA, 25 bp, mus musculus
acacaattgatctcatttaagaagg

SEQ ID NO: 58703 - DNA, 25 bp, mus musculus
cacaattgatctcatttaagaagga

SEQ ID NO: 58704 - DNA, 25 bp, mus musculus
acaattgatctcatttaagaaggat

SEQ ID NO: 58705 - DNA, 25 bp, mus musculus
ataattcgtcagcatcattttggac

SEQ ID NO: 58706 - DNA, 25 bp, mus musculus
taattcgtcagcatcattttggaca

SEQ ID NO: 58707 - DNA, 25 bp, mus musculus
aattcgtcagcatcattttggacac

SEQ ID NO: 58708 - DNA, 25 bp, mus musculus
attcgtcagcatcattttggacaca

SEQ ID NO: 58709 - DNA, 25 bp, mus musculus
ttcgtcagcatcattttggacacac

SEQ ID NO: 58710 - DNA, 25 bp, mus musculus
cgtcagcatcattttggacacacaa

SEQ ID NO: 58711 - DNA, 25 bp, mus musculus
tcagcatcattttggacacacaatt

SEQ ID NO: 58712 - DNA, 25 bp, mus musculus
agcatcattttggacacacaattga

SEQ ID NO: 58713 - DNA, 25 bp, mus musculus
gcatgctcccagcatttgtctaccc

SEQ ID NO: 58714 - DNA, 25 bp, mus musculus
catttgtctacccaagtccacacca

SEQ ID NO: 58715 - DNA, 25 bp, mus musculus
ctcatctgattggcccaacggttta

SEQ ID NO: 58716 - DNA, 25 bp, mus musculus
tgattggcccaacggtttagtgcag

SEQ ID NO: 58717 - DNA, 25 bp, mus musculus
ttgcacctttcgtagcttctttaat

SEQ ID NO: 58718 - DNA, 25 bp, mus musculus
gcttctttgatcagaaccagaaaaa

SEQ ID NO: 58719 - DNA, 25 bp, mus musculus
gaagagctctcagcaagtgtacagc

SEQ ID NO: 58720 - DNA, 25 bp, mus musculus
gtacagcatctgccttcctttgtct

SEQ ID NO: 58721 - DNA, 25 bp, mus musculus
ccttcctttgtcttgcattggctat

SEQ ID NO: 58722 - DNA, 25 bp, mus musculus
ttttccattaatttcaacacatggg

SEQ ID NO: 58723 - DNA, 25 bp, mus musculus
attaatttcaacacatgggaacaca

SEQ ID NO: 58724 - DNA, 25 bp, mus musculus
ttcaacacatgggaacacatgtaca

SEQ ID NO: 58725 - DNA, 25 bp, mus musculus
caagtccacaccaagtcaagctgca

SEQ ID NO: 58726 - DNA, 25 bp, mus musculus
aagtcaagctgcatgcagcaacacc

SEQ ID NO: 58727 - DNA, 25 bp, mus musculus
agctgcatgcagcaacacccaagtc

SEQ ID NO: 58728 - DNA, 25 bp, mus musculus
cattttgccttaggaagtgactgaa

SEQ ID NO: 58729 - DNA, 25 bp, mus musculus
atgtacaaagacacctgatgcactt

SEQ ID NO: 58730 - DNA, 25 bp, mus musculus
tttttaaaccatccatgtaggattg

SEQ ID NO: 58731 - DNA, 25 bp, mus musculus
gtagatactccagggaaaggagcgt

SEQ ID NO: 58732 - DNA, 25 bp, mus musculus
aggtaccagaagctcatctgattgg

SEQ ID NO: 58733 - DNA, 25 bp, mus musculus
accatactatgtggctccggaagtc

SEQ ID NO: 58734 - DNA, 25 bp, mus musculus
cctgggcccggagaagtatgacaag

SEQ ID NO: 58735 - DNA, 25 bp, mus musculus
ctggatcatgcaatctacgaaggtc

SEQ ID NO: 58736 - DNA, 25 bp, mus musculus
catgcaatctacgaaggtccctcag

SEQ ID NO: 58737 - DNA, 25 bp, mus musculus
gcaatctacgaaggtccctcagact

SEQ ID NO: 58738 - DNA, 25 bp, mus musculus
actgcacaccagccgtgtcctgaag

SEQ ID NO: 58739 - DNA, 25 bp, mus musculus
gatgaccagtgccttggccacgatg

SEQ ID NO: 58740 - DNA, 25 bp, mus musculus
tgccttggccacgatgcgtgttgac

SEQ ID NO: 58741 - DNA, 25 bp, mus musculus
cttggccacgatgcgtgttgactat

SEQ ID NO: 58742 - DNA, 25 bp, mus musculus
agaagacgcatccaaccctctgctt

SEQ ID NO: 58743 - DNA, 25 bp, mus musculus
caaccctctgcttctcaagaggcgg

SEQ ID NO: 58744 - DNA, 25 bp, mus musculus
tctgcttctcaagaggcggaagaaa

SEQ ID NO: 58745 - DNA, 25 bp, mus musculus
caagtcctgtgacatgtggtccttg

SEQ ID NO: 58746 - DNA, 25 bp, mus musculus
gtggtccttgggtgtcatcatgtat

SEQ ID NO: 58747 - DNA, 25 bp, mus musculus
catctctccgggcatgaagactcgt

SEQ ID NO: 58748 - DNA, 25 bp, mus musculus
ctctccgggcatgaagactcgtatt

SEQ ID NO: 58749 - DNA, 25 bp, mus musculus
tattcgaatgggccagtatgaattt

SEQ ID NO: 58750 - DNA, 25 bp, mus musculus
gatgcttatccggaatctgctaaaa

SEQ ID NO: 58751 - DNA, 25 bp, mus musculus
aatgaccatcacagaattcatgaac

SEQ ID NO: 58752 - DNA, 25 bp, mus musculus
gaccatcacagaattcatgaaccac

SEQ ID NO: 58753 - DNA, 25 bp, mus musculus
gtcattctcggagtgactgccgggc

SEQ ID NO: 58754 - DNA, 25 bp, mus musculus
cggtcatcatcttcatagccatcct

SEQ ID NO: 58755 - DNA, 25 bp, mus musculus
ttatcatattcctcatctttgccat

SEQ ID NO: 58756 - DNA, 25 bp, mus musculus
tattcctcatctttgccatgcccat

SEQ ID NO: 58757 - DNA, 25 bp, mus musculus
tcctctacttgctgtactacgagta

SEQ ID NO: 58758 - DNA, 25 bp, mus musculus
acttgctgtactacgagtactggtc

SEQ ID NO: 58759 - DNA, 25 bp, mus musculus
cagcctttgggaacctgcataacat

SEQ ID NO: 58760 - DNA, 25 bp, mus musculus
ataacatctccttgcttttctccac

SEQ ID NO: 58761 - DNA, 25 bp, mus musculus
tctccttgcttttctccaccatcaa

SEQ ID NO: 58762 - DNA, 25 bp, mus musculus
tcctgaccagggctttcaaagatga

SEQ ID NO: 58763 - DNA, 25 bp, mus musculus
gcaacggcaacactgtatccattga

SEQ ID NO: 58764 - DNA, 25 bp, mus musculus
ttttagcttgtgcttggaatgcaat

SEQ ID NO: 58765 - DNA, 25 bp, mus musculus
tcatcttcatagccatcctcagctt

SEQ ID NO: 58766 - DNA, 25 bp, mus musculus
tcagcttcttggtcttcactccgct

SEQ ID NO: 58767 - DNA, 25 bp, mus musculus
tcttggtcttcactccgctcatgtt

SEQ ID NO: 58768 - DNA, 25 bp, mus musculus
tcttcactccgctcatgttagtgtc

SEQ ID NO: 58769 - DNA, 25 bp, mus musculus
tagtgtccagctccatcttggtggt

SEQ ID NO: 58770 - DNA, 25 bp, mus musculus
attcttcgaagctgtacattgtcat

SEQ ID NO: 58771 - DNA, 25 bp, mus musculus
tgtacattgtcatcatggtcaccat

SEQ ID NO: 58772 - DNA, 25 bp, mus musculus
tcaccattatcatattcctcatctt

SEQ ID NO: 58773 - DNA, 25 bp, mus musculus
ccctggaccttctgaggaagctgaa

SEQ ID NO: 58774 - DNA, 25 bp, mus musculus
cctggaccttctgaggaagctgaac

SEQ ID NO: 58775 - DNA, 25 bp, mus musculus
gagtccgcaagcactgttcagacaa

SEQ ID NO: 58776 - DNA, 25 bp, mus musculus
cgcaagcactgttcagacaaggaag

SEQ ID NO: 58777 - DNA, 25 bp, mus musculus
gcaagcactgttcagacaaggaagt

SEQ ID NO: 58778 - DNA, 25 bp, mus musculus
caagcactgttcagacaaggaagtg

SEQ ID NO: 58779 - DNA, 25 bp, mus musculus
aagcactgttcagacaaggaagtgg

SEQ ID NO: 58780 - DNA, 25 bp, mus musculus
agcactgttcagacaaggaagtggt

SEQ ID NO: 58781 - DNA, 25 bp, mus musculus
tggtgtccttggccaaagtcctcat

SEQ ID NO: 58782 - DNA, 25 bp, mus musculus
gtgtccttggccaaagtcctcatta

SEQ ID NO: 58783 - DNA, 25 bp, mus musculus
tgtccttggccaaagtcctcattaa

SEQ ID NO: 58784 - DNA, 25 bp, mus musculus
tggccaaagtcctcattaaaaactg

SEQ ID NO: 58785 - DNA, 25 bp, mus musculus
ctggaccttctgaggaagctgaaca

SEQ ID NO: 58786 - DNA, 25 bp, mus musculus
tggaccttctgaggaagctgaacag

SEQ ID NO: 58787 - DNA, 25 bp, mus musculus
ggaccttctgaggaagctgaacagt

SEQ ID NO: 58788 - DNA, 25 bp, mus musculus
ggcagtcaacggagtccgcaagcac

SEQ ID NO: 58789 - DNA, 25 bp, mus musculus
gcagtcaacggagtccgcaagcact

SEQ ID NO: 58790 - DNA, 25 bp, mus musculus
cagtcaacggagtccgcaagcactg

SEQ ID NO: 58791 - DNA, 25 bp, mus musculus
agtcaacggagtccgcaagcactgt

SEQ ID NO: 58792 - DNA, 25 bp, mus musculus
aacggagtccgcaagcactgttcag

SEQ ID NO: 58793 - DNA, 25 bp, mus musculus
tcggtgctctacacggtaccggcca

SEQ ID NO: 58794 - DNA, 25 bp, mus musculus
acggtaccggccaccatcgtcatcg

SEQ ID NO: 58795 - DNA, 25 bp, mus musculus
cgcccgacttcacagtctacatgat

SEQ ID NO: 58796 - DNA, 25 bp, mus musculus
acatgatcaaatacctcatgacgct

SEQ ID NO: 58797 - DNA, 25 bp, mus musculus
atgatcaaatacctcatgacgctca

SEQ ID NO: 58798 - DNA, 25 bp, mus musculus
gatcaaatacctcatgacgctcatc

SEQ ID NO: 58799 - DNA, 25 bp, mus musculus
tcaaatacctcatgacgctcatcgt

SEQ ID NO: 58800 - DNA, 25 bp, mus musculus
atacctcatgacgctcatcgtgggc

SEQ ID NO: 58801 - DNA, 25 bp, mus musculus
acctcatgacgctcatcgtgggcat

SEQ ID NO: 58802 - DNA, 25 bp, mus musculus
ctcatgacgctcatcgtgggcatca

SEQ ID NO: 58803 - DNA, 25 bp, mus musculus
catgacgctcatcgtgggcatcacg

SEQ ID NO: 58804 - DNA, 25 bp, mus musculus
acgctcatcgtgggcatcacgtcgg

SEQ ID NO: 58805 - DNA, 25 bp, mus musculus
gtcatcgcctgctacttctatgagc

SEQ ID NO: 58806 - DNA, 25 bp, mus musculus
catcgcctgctacttctatgagcag

SEQ ID NO: 58807 - DNA, 25 bp, mus musculus
actgggagcgctcctgggtaagcca

SEQ ID NO: 58808 - DNA, 25 bp, mus musculus
agcgctcctgggtaagccagcactg

SEQ ID NO: 58809 - DNA, 25 bp, mus musculus
cgctcctgggtaagccagcactgca

SEQ ID NO: 58810 - DNA, 25 bp, mus musculus
agccagcactgcaagagcctagcca

SEQ ID NO: 58811 - DNA, 25 bp, mus musculus
ccagcactgcaagagcctagccatc

SEQ ID NO: 58812 - DNA, 25 bp, mus musculus
gcatgtcgcccgacttcacagtcta

SEQ ID NO: 58813 - DNA, 25 bp, mus musculus
tattgtggtcttccagtattcagat

SEQ ID NO: 58814 - DNA, 25 bp, mus musculus
ggtcttccagtattcagatggaaaa

SEQ ID NO: 58815 - DNA, 25 bp, mus musculus
cacggtgcggctctatgagtggacc

SEQ ID NO: 58816 - DNA, 25 bp, mus musculus
ggagcttcgcactgagtgtaatcac

SEQ ID NO: 58817 - DNA, 25 bp, mus musculus
gcttcgcactgagtgtaatcactac

SEQ ID NO: 58818 - DNA, 25 bp, mus musculus
gtgtaatcactacaacaacatcatg

SEQ ID NO: 58819 - DNA, 25 bp, mus musculus
taatcactacaacaacatcatggcc

SEQ ID NO: 58820 - DNA, 25 bp, mus musculus
ctacaacaacatcatggccctgtac

SEQ ID NO: 58821 - DNA, 25 bp, mus musculus
caacaacatcatggccctgtacctg

SEQ ID NO: 58822 - DNA, 25 bp, mus musculus
caacatcatggccctgtacctgaag

SEQ ID NO: 58823 - DNA, 25 bp, mus musculus
catggccctgtacctgaagaccaag

SEQ ID NO: 58824 - DNA, 25 bp, mus musculus
gggcgacctcatgcgctcagtgctg

SEQ ID NO: 58825 - DNA, 25 bp, mus musculus
actacagactgtggctgaaaaggaa

SEQ ID NO: 58826 - DNA, 25 bp, mus musculus
cctcatgcgctcagtgctgctgctt

SEQ ID NO: 58827 - DNA, 25 bp, mus musculus
tgtgtactctatggtggagtttaat

SEQ ID NO: 58828 - DNA, 25 bp, mus musculus
gtactctatggtggagtttaatggg

SEQ ID NO: 58829 - DNA, 25 bp, mus musculus
gaagctgcttgccagcatcaatagc

SEQ ID NO: 58830 - DNA, 25 bp, mus musculus
gctgcttgccagcatcaatagcacg

SEQ ID NO: 58831 - DNA, 25 bp, mus musculus
tgccagcatcaatagcacggtgcgg

SEQ ID NO: 58832 - DNA, 25 bp, mus musculus
cagcatcaatagcacggtgcggctc

SEQ ID NO: 58833 - DNA, 25 bp, mus musculus
catcaatagcacggtgcggctctat

SEQ ID NO: 58834 - DNA, 25 bp, mus musculus
caagtccatactctgctttctcccg

SEQ ID NO: 58835 - DNA, 25 bp, mus musculus
catactctgctttctcccggaacca

SEQ ID NO: 58836 - DNA, 25 bp, mus musculus
gcctactttggatgccaatgaccct

SEQ ID NO: 58837 - DNA, 25 bp, mus musculus
tgatcctttctactatgattggtac

SEQ ID NO: 58838 - DNA, 25 bp, mus musculus
ccgagtcggcgggctcatttgtgca

SEQ ID NO: 58839 - DNA, 25 bp, mus musculus
ttgtgcagggattctctgtgccctg

SEQ ID NO: 58840 - DNA, 25 bp, mus musculus
tctctgtgccctgggcattatagtc

SEQ ID NO: 58841 - DNA, 25 bp, mus musculus
accaggctcagctcacaactgctga

SEQ ID NO: 58842 - DNA, 25 bp, mus musculus
tggctctgaaggtgggcttgaactc

SEQ ID NO: 58843 - DNA, 25 bp, mus musculus
tgggcttgaactccgagctggctgt

SEQ ID NO: 58844 - DNA, 25 bp, mus musculus
tgaactccgagctggctgttctcct

SEQ ID NO: 58845 - DNA, 25 bp, mus musculus
acccctcgtggtagcaggctctttg

SEQ ID NO: 58846 - DNA, 25 bp, mus musculus
acctctcagcctgttgagctactca

SEQ ID NO: 58847 - DNA, 25 bp, mus musculus
cagcctgttgagctactcaggtcaa

SEQ ID NO: 58848 - DNA, 25 bp, mus musculus
gttgagctactcaggtcaaggcttt

SEQ ID NO: 58849 - DNA, 25 bp, mus musculus
ctactcaggtcaaggctttgacatg

SEQ ID NO: 58850 - DNA, 25 bp, mus musculus
ggttgttctgagcctgttggtcctt

SEQ ID NO: 58851 - DNA, 25 bp, mus musculus
cctgttggtccttctagcaggcctg

SEQ ID NO: 58852 - DNA, 25 bp, mus musculus
ggtccttctagcaggcctgcctact

SEQ ID NO: 58853 - DNA, 25 bp, mus musculus
aggcctgcctactttggatgccaat

SEQ ID NO: 58854 - DNA, 25 bp, mus musculus
atgtgcaacatgcaacaacttgctt

SEQ ID NO: 58855 - DNA, 25 bp, mus musculus
gtgcaacatgcaacaacttgcttgc

SEQ ID NO: 58856 - DNA, 25 bp, mus musculus
aatggcttggtccaattcttaagct

SEQ ID NO: 58857 - DNA, 25 bp, mus musculus
tggcttggtccaattcttaagcttg

SEQ ID NO: 58858 - DNA, 25 bp, mus musculus
ttggtccaattcttaagcttgacag

SEQ ID NO: 58859 - DNA, 25 bp, mus musculus
ggtccaattcttaagcttgacagtt

SEQ ID NO: 58860 - DNA, 25 bp, mus musculus
tccaattcttaagcttgacagttca

SEQ ID NO: 58861 - DNA, 25 bp, mus musculus
gcttgacagttcaagcccagttaga

SEQ ID NO: 58862 - DNA, 25 bp, mus musculus
gacagttcaagcccagttagactct

SEQ ID NO: 58863 - DNA, 25 bp, mus musculus
cagttcaagcccagttagactcttg

SEQ ID NO: 58864 - DNA, 25 bp, mus musculus
tcaagcccagttagactcttgacaa

SEQ ID NO: 58865 - DNA, 25 bp, mus musculus
actcttgacaagggtttcatgttgt

SEQ ID NO: 58866 - DNA, 25 bp, mus musculus
gcaacatgcaacaacttgcttgctt

SEQ ID NO: 58867 - DNA, 25 bp, mus musculus
tgcaacaacttgcttgcttgacttg

SEQ ID NO: 58868 - DNA, 25 bp, mus musculus
caacaacttgcttgcttgacttggt

SEQ ID NO: 58869 - DNA, 25 bp, mus musculus
acaacttgcttgcttgacttggtcc

SEQ ID NO: 58870 - DNA, 25 bp, mus musculus
cttgcttgcttgacttggtccctgg

SEQ ID NO: 58871 - DNA, 25 bp, mus musculus
gttttgccaatggcttggtccaatt

SEQ ID NO: 58872 - DNA, 25 bp, mus musculus
tgccaatggcttggtccaattctta

SEQ ID NO: 58873 - DNA, 25 bp, mus musculus
ccaatggcttggtccaattcttaag

SEQ ID NO: 58874 - DNA, 25 bp, mus musculus
ataccttccgtgtggagttcctgat

SEQ ID NO: 58875 - DNA, 25 bp, mus musculus
cttccgtgtggagttcctgatggtt

SEQ ID NO: 58876 - DNA, 25 bp, mus musculus
ctacctgagagtccgtggccatcct

SEQ ID NO: 58877 - DNA, 25 bp, mus musculus
acctgagagtccgtggccatccttc

SEQ ID NO: 58878 - DNA, 25 bp, mus musculus
gaccatcatcatgcactacctctgc

SEQ ID NO: 58879 - DNA, 25 bp, mus musculus
ccatcatcatgcactacctctgctt

SEQ ID NO: 58880 - DNA, 25 bp, mus musculus
atcatcatgcactacctctgcttcc

SEQ ID NO: 58881 - DNA, 25 bp, mus musculus
catcatgcactacctctgcttcctg

SEQ ID NO: 58882 - DNA, 25 bp, mus musculus
tcatgcactacctctgcttcctggg

SEQ ID NO: 58883 - DNA, 25 bp, mus musculus
tctcattgctgtagtggctggtgtc

SEQ ID NO: 58884 - DNA, 25 bp, mus musculus
tcattgctgtagtggctggtgtcgt

SEQ ID NO: 58885 - DNA, 25 bp, mus musculus
attgctgtagtggctggtgtcgtct

SEQ ID NO: 58886 - DNA, 25 bp, mus musculus
tccgtgtggagttcctgatggttcc

SEQ ID NO: 58887 - DNA, 25 bp, mus musculus
gtagtggctggtgtcgtctagatga

SEQ ID NO: 58888 - DNA, 25 bp, mus musculus
gagttcctgatggttcctgtatgag

SEQ ID NO: 58889 - DNA, 25 bp, mus musculus
gttcctgatggttcctgtatgaggc

SEQ ID NO: 58890 - DNA, 25 bp, mus musculus
tggaccttctccatctacctgagag

SEQ ID NO: 58891 - DNA, 25 bp, mus musculus
ttctccatctacctgagagtccgtg

SEQ ID NO: 58892 - DNA, 25 bp, mus musculus
ctccatctacctgagagtccgtggc

SEQ ID NO: 58893 - DNA, 25 bp, mus musculus
ccatctacctgagagtccgtggcca

SEQ ID NO: 58894 - DNA, 25 bp, mus musculus
atctacctgagagtccgtggccatc

SEQ ID NO: 58895 - DNA, 25 bp, mus musculus
gcccgttttacgctgtcctgaagct

SEQ ID NO: 58896 - DNA, 25 bp, mus musculus
tttacgctgtcctgaagctggagat

SEQ ID NO: 58897 - DNA, 25 bp, mus musculus
tggtttgtatggccacgtgcattag

SEQ ID NO: 58898 - DNA, 25 bp, mus musculus
gtatggccacgtgcattaggctgag

SEQ ID NO: 58899 - DNA, 25 bp, mus musculus
tcacttaagtccagctggtgtactg

SEQ ID NO: 58900 - DNA, 25 bp, mus musculus
tttaaacatggctcagccaggtggt

SEQ ID NO: 58901 - DNA, 25 bp, mus musculus
tcccttttctacctgtgagctaggc

SEQ ID NO: 58902 - DNA, 25 bp, mus musculus
ttctacctgtgagctaggcattgct

SEQ ID NO: 58903 - DNA, 25 bp, mus musculus
ccagttctcactgagtctgcatgag

SEQ ID NO: 58904 - DNA, 25 bp, mus musculus
ctcactgagtctgcatgaggattgg

SEQ ID NO: 58905 - DNA, 25 bp, mus musculus
aagttgatggctgctgtagagtggc

SEQ ID NO: 58906 - DNA, 25 bp, mus musculus
atggctgctgtagagtggcgcataa

SEQ ID NO: 58907 - DNA, 25 bp, mus musculus
accggaacgtcgtcaatgtacacat

SEQ ID NO: 58908 - DNA, 25 bp, mus musculus
acgtcgtcaatgtacacatcttcgt

SEQ ID NO: 58909 - DNA, 25 bp, mus musculus
tacacatcttcgtctccgagtactg

SEQ ID NO: 58910 - DNA, 25 bp, mus musculus
tcttcgtctccgagtactggttctg

SEQ ID NO: 58911 - DNA, 25 bp, mus musculus
tctccgagtactggttctgagggcc

SEQ ID NO: 58912 - DNA, 25 bp, mus musculus
gcccttgctgccagtgacagccagg

SEQ ID NO: 58913 - DNA, 25 bp, mus musculus
gctgccagtgacagccaggtgcctg

SEQ ID NO: 58914 - DNA, 25 bp, mus musculus
cgggcctcccttgatgtttcatatt

SEQ ID NO: 58915 - DNA, 25 bp, mus musculus
ccgtctctctatcgtcgctctaggc

SEQ ID NO: 58916 - DNA, 25 bp, mus musculus
acgggcaacccaaggcctcaatatg

SEQ ID NO: 58917 - DNA, 25 bp, mus musculus
gcgcagaacctactgcagtgaacgg

SEQ ID NO: 58918 - DNA, 25 bp, mus musculus
gcagaacctactgcagtgaacggct

SEQ ID NO: 58919 - DNA, 25 bp, mus musculus
aacctactgcagtgaacggctgtgt

SEQ ID NO: 58920 - DNA, 25 bp, mus musculus
gctgtgtgaccggacactttacttc

SEQ ID NO: 58921 - DNA, 25 bp, mus musculus
tgtgtgaccggacactttacttcag

SEQ ID NO: 58922 - DNA, 25 bp, mus musculus
tgaccggacactttacttcagcgga

SEQ ID NO: 58923 - DNA, 25 bp, mus musculus
gacactttacttcagcggaagatct

SEQ ID NO: 58924 - DNA, 25 bp, mus musculus
cactttacttcagcggaagatctga

SEQ ID NO: 58925 - DNA, 25 bp, mus musculus
aagatctgaacctgttgattgctaa

SEQ ID NO: 58926 - DNA, 25 bp, mus musculus
gatctgaacctgttgattgctaaaa

SEQ ID NO: 58927 - DNA, 25 bp, mus musculus
gcaacccaaggcctcaatatgtcgt

SEQ ID NO: 58928 - DNA, 25 bp, mus musculus
caaggcctcaatatgtcgtacaact

SEQ ID NO: 58929 - DNA, 25 bp, mus musculus
aggcctcaatatgtcgtacaactac

SEQ ID NO: 58930 - DNA, 25 bp, mus musculus
ctcaatatgtcgtacaactacgtcg

SEQ ID NO: 58931 - DNA, 25 bp, mus musculus
caatatgtcgtacaactacgtcgta

SEQ ID NO: 58932 - DNA, 25 bp, mus musculus
tacaactacgtcgtaacggcgcaga

SEQ ID NO: 58933 - DNA, 25 bp, mus musculus
cgtcgtaacggcgcagaacctactg

SEQ ID NO: 58934 - DNA, 25 bp, mus musculus
gtaacggcgcagaacctactgcagt

SEQ ID NO: 58935 - DNA, 25 bp, mus musculus
tctagcggctcatgatggccaacca

SEQ ID NO: 58936 - DNA, 25 bp, mus musculus
tgatggccaaccacaaccagtatct

SEQ ID NO: 58937 - DNA, 25 bp, mus musculus
aagcattcctgcaagagcgacatcc

SEQ ID NO: 58938 - DNA, 25 bp, mus musculus
cattcctgcaagagcgacatcctta

SEQ ID NO: 58939 - DNA, 25 bp, mus musculus
tgcaagagcgacatccttacaggac

SEQ ID NO: 58940 - DNA, 25 bp, mus musculus
aagagcgacatccttacaggacaat

SEQ ID NO: 58941 - DNA, 25 bp, mus musculus
agcgacatccttacaggacaatttt

SEQ ID NO: 58942 - DNA, 25 bp, mus musculus
gatggacacctccagggagattttg

SEQ ID NO: 58943 - DNA, 25 bp, mus musculus
ggacacctccagggagattttgaag

SEQ ID NO: 58944 - DNA, 25 bp, mus musculus
cacctccagggagattttgaagcac

SEQ ID NO: 58945 - DNA, 25 bp, mus musculus
attatatctcgtggggccccaggat

SEQ ID NO: 58946 - DNA, 25 bp, mus musculus
atatctcgtggggccccaggatcaa

SEQ ID NO: 58947 - DNA, 25 bp, mus musculus
tggccaaccacaaccagtatctcct

SEQ ID NO: 58948 - DNA, 25 bp, mus musculus
acaaccagtatctcctgcgtcttcg

SEQ ID NO: 58949 - DNA, 25 bp, mus musculus
accagtatctcctgcgtcttcgaac

SEQ ID NO: 58950 - DNA, 25 bp, mus musculus
agtatctcctgcgtcttcgaacgga

SEQ ID NO: 58951 - DNA, 25 bp, mus musculus
tcctgcgtcttcgaacggacctgtc

SEQ ID NO: 58952 - DNA, 25 bp, mus musculus
acctgtcgccagtttgacaagctgc

SEQ ID NO: 58953 - DNA, 25 bp, mus musculus
gccttcatgaagcattcctgcaaga

SEQ ID NO: 58954 - DNA, 25 bp, mus musculus
atgaagcattcctgcaagagcgaca

SEQ ID NO: 58955 - DNA, 25 bp, mus musculus
tctgggccccaagcctgctctgaag

SEQ ID NO: 58956 - DNA, 25 bp, mus musculus
ccccaagcctgctctgaaggagggt

SEQ ID NO: 58957 - DNA, 25 bp, mus musculus
cttcatctctcgaatgaggtattcc

SEQ ID NO: 58958 - DNA, 25 bp, mus musculus
gtattccccaaacactcaggtggag

SEQ ID NO: 58959 - DNA, 25 bp, mus musculus
cccaaacactcaggtggagatactg

SEQ ID NO: 58960 - DNA, 25 bp, mus musculus
gatactgcgccagggccgagagagt

SEQ ID NO: 58961 - DNA, 25 bp, mus musculus
agagagtcccatcttcaagcaattc

SEQ ID NO: 58962 - DNA, 25 bp, mus musculus
tcccatcttcaagcaattcttcaag

SEQ ID NO: 58963 - DNA, 25 bp, mus musculus
gcaattcttcaagaactggaagtga

SEQ ID NO: 58964 - DNA, 25 bp, mus musculus
cctgctgggtcagtactgaggtgcc

SEQ ID NO: 58965 - DNA, 25 bp, mus musculus
gtactgaggtgccctctggatgcac

SEQ ID NO: 58966 - DNA, 25 bp, mus musculus
aggtgccctctggatgcacaataaa

SEQ ID NO: 58967 - DNA, 25 bp, mus musculus
taaccccgaggaagacattacagct

SEQ ID NO: 58968 - DNA, 25 bp, mus musculus
tgactccagcccttttgcctctgaa

SEQ ID NO: 58969 - DNA, 25 bp, mus musculus
actgctaattccagatgactgcttt

SEQ ID NO: 58970 - DNA, 25 bp, mus musculus
aattccagatgactgctttgttctg

SEQ ID NO: 58971 - DNA, 25 bp, mus musculus
ctgctttgttctggacaacgggctg

SEQ ID NO: 58972 - DNA, 25 bp, mus musculus
tgttctggacaacgggctgtgtggc

SEQ ID NO: 58973 - DNA, 25 bp, mus musculus
ggcagccctccaagtggctgatggc

SEQ ID NO: 58974 - DNA, 25 bp, mus musculus
tgatggcttcatctctcgaatgagg

SEQ ID NO: 58975 - DNA, 25 bp, mus musculus
agccgctggacgcgcgtgaatgagc

SEQ ID NO: 58976 - DNA, 25 bp, mus musculus
ccctagcgcaggatgttcgtgctgg

SEQ ID NO: 58977 - DNA, 25 bp, mus musculus
ctctgcatctgtctgtttgatatca

SEQ ID NO: 58978 - DNA, 25 bp, mus musculus
ctgtttgatatcaccaagctggagg

SEQ ID NO: 58979 - DNA, 25 bp, mus musculus
tttgatatcaccaagctggaggatg

SEQ ID NO: 58980 - DNA, 25 bp, mus musculus
atcaccaagctggaggatgcctacg

SEQ ID NO: 58981 - DNA, 25 bp, mus musculus
gatgcctacgtattcccaggggatg

SEQ ID NO: 58982 - DNA, 25 bp, mus musculus
ggagcatcacataccaaagtgcatt

SEQ ID NO: 58983 - DNA, 25 bp, mus musculus
gcatcacataccaaagtgcatttcc

SEQ ID NO: 58984 - DNA, 25 bp, mus musculus
cataccaaagtgcatttccgatacg

SEQ ID NO: 58985 - DNA, 25 bp, mus musculus
accaaagtgcatttccgatacgtgg

SEQ ID NO: 58986 - DNA, 25 bp, mus musculus
aaagtgcatttccgatacgtggtgt

SEQ ID NO: 58987 - DNA, 25 bp, mus musculus
atggtggacaccgtgcgcatacccc

SEQ ID NO: 58988 - DNA, 25 bp, mus musculus
cggaaactcaacgactccattgctg

SEQ ID NO: 58989 - DNA, 25 bp, mus musculus
aaactcaacgactccattgctgagg

SEQ ID NO: 58990 - DNA, 25 bp, mus musculus
aacgactccattgctgaggagctga

SEQ ID NO: 58991 - DNA, 25 bp, mus musculus
gactccattgctgaggagctgaaca

SEQ ID NO: 58992 - DNA, 25 bp, mus musculus
tccattgctgaggagctgaacaaga

SEQ ID NO: 58993 - DNA, 25 bp, mus musculus
aatgtgggactctgcatctgtctgt

SEQ ID NO: 58994 - DNA, 25 bp, mus musculus
ggactctgcatctgtctgtttgata

SEQ ID NO: 58995 - DNA, 25 bp, mus musculus
caccaatttatgactacagagactg

SEQ ID NO: 58996 - DNA, 25 bp, mus musculus
accaatttatgactacagagactgg

SEQ ID NO: 58997 - DNA, 25 bp, mus musculus
aatgtacagcagactaaccgtacag

SEQ ID NO: 58998 - DNA, 25 bp, mus musculus
tgtacagcagactaaccgtacagaa

SEQ ID NO: 58999 - DNA, 25 bp, mus musculus
gtacagcagactaaccgtacagaaa

SEQ ID NO: 59000 - DNA, 25 bp, mus musculus
acagcagactaaccgtacagaaaca

SEQ ID NO: 59001 - DNA, 25 bp, mus musculus
gcagactaaccgtacagaaacagtt

SEQ ID NO: 59002 - DNA, 25 bp, mus musculus
taaagtacctgctgatctcttaaag

SEQ ID NO: 59003 - DNA, 25 bp, mus musculus
aaagtacctgctgatctcttaaagc

SEQ ID NO: 59004 - DNA, 25 bp, mus musculus
gtacctgctgatctcttaaagcggg

SEQ ID NO: 59005 - DNA, 25 bp, mus musculus
acctgctgatctcttaaagcgggcc

SEQ ID NO: 59006 - DNA, 25 bp, mus musculus
tcgttcccactttgccagttctcac

SEQ ID NO: 59007 - DNA, 25 bp, mus musculus
tgactacagagactggctgataaaa

SEQ ID NO: 59008 - DNA, 25 bp, mus musculus
actacagagactggctgataaaagt

SEQ ID NO: 59009 - DNA, 25 bp, mus musculus
aaggctacacactaatgtacagcag

SEQ ID NO: 59010 - DNA, 25 bp, mus musculus
aggctacacactaatgtacagcaga

SEQ ID NO: 59011 - DNA, 25 bp, mus musculus
gctacacactaatgtacagcagact

SEQ ID NO: 59012 - DNA, 25 bp, mus musculus
ctacacactaatgtacagcagacta

SEQ ID NO: 59013 - DNA, 25 bp, mus musculus
acacactaatgtacagcagactaac

SEQ ID NO: 59014 - DNA, 25 bp, mus musculus
cactaatgtacagcagactaaccgt

SEQ ID NO: 59015 - DNA, 25 bp, mus musculus
aattgttgacattcaagccggaaag

SEQ ID NO: 59016 - DNA, 25 bp, mus musculus
attgttgacattcaagccggaaagt

SEQ ID NO: 59017 - DNA, 25 bp, mus musculus
gggaacttccacggagacagcgaat

SEQ ID NO: 59018 - DNA, 25 bp, mus musculus
ggaacttccacggagacagcgaatt

SEQ ID NO: 59019 - DNA, 25 bp, mus musculus
gaacttccacggagacagcgaattg

SEQ ID NO: 59020 - DNA, 25 bp, mus musculus
aacttccacggagacagcgaattgt

SEQ ID NO: 59021 - DNA, 25 bp, mus musculus
acttccacggagacagcgaattgta

SEQ ID NO: 59022 - DNA, 25 bp, mus musculus
cttccacggagacagcgaattgtag

SEQ ID NO: 59023 - DNA, 25 bp, mus musculus
ttccacggagacagcgaattgtagc

SEQ ID NO: 59024 - DNA, 25 bp, mus musculus
tccacggagacagcgaattgtagct

SEQ ID NO: 59025 - DNA, 25 bp, mus musculus
cgaattgtagcttgaccggatctct

SEQ ID NO: 59026 - DNA, 25 bp, mus musculus
aattgtagcttgaccggatctctgt

SEQ ID NO: 59027 - DNA, 25 bp, mus musculus
ttgttgacattcaagccggaaagtt

SEQ ID NO: 59028 - DNA, 25 bp, mus musculus
tgttgacattcaagccggaaagttt

SEQ ID NO: 59029 - DNA, 25 bp, mus musculus
ttgacattcaagccggaaagttttg

SEQ ID NO: 59030 - DNA, 25 bp, mus musculus
tgacattcaagccggaaagttttgc

SEQ ID NO: 59031 - DNA, 25 bp, mus musculus
gacattcaagccggaaagttttgca

SEQ ID NO: 59032 - DNA, 25 bp, mus musculus
gttttgcaaccagattggggctaag

SEQ ID NO: 59033 - DNA, 25 bp, mus musculus
ttttgcaaccagattggggctaagt

SEQ ID NO: 59034 - DNA, 25 bp, mus musculus
tttgcaaccagattggggctaagtt

SEQ ID NO: 59035 - DNA, 25 bp, mus musculus
ccacagcagctacgtcctgcagcag

SEQ ID NO: 59036 - DNA, 25 bp, mus musculus
cagcagctacgtcctgcagcagcta

SEQ ID NO: 59037 - DNA, 25 bp, mus musculus
cgccattgacgacacttacttccaa

SEQ ID NO: 59038 - DNA, 25 bp, mus musculus
cattgacgacacttacttccaagca

SEQ ID NO: 59039 - DNA, 25 bp, mus musculus
tgacgacacttacttccaagcacac

SEQ ID NO: 59040 - DNA, 25 bp, mus musculus
cacttacttccaagcacacaaggcc

SEQ ID NO: 59041 - DNA, 25 bp, mus musculus
ttacttccaagcacacaaggccgtg

SEQ ID NO: 59042 - DNA, 25 bp, mus musculus
cttccaagcacacaaggccgtgcta

SEQ ID NO: 59043 - DNA, 25 bp, mus musculus
agcacacaaggccgtgctagctgcc

SEQ ID NO: 59044 - DNA, 25 bp, mus musculus
cgtgctagctgcctgtagctcctac

SEQ ID NO: 59045 - DNA, 25 bp, mus musculus
gctagctgcctgtagctcctacttc

SEQ ID NO: 59046 - DNA, 25 bp, mus musculus
agctgcctgtagctcctacttcagg

SEQ ID NO: 59047 - DNA, 25 bp, mus musculus
ctacgtcctgcagcagctaaacaac

SEQ ID NO: 59048 - DNA, 25 bp, mus musculus
ctgtagctcctacttcaggatgttc

SEQ ID NO: 59049 - DNA, 25 bp, mus musculus
cgtcctgcagcagctaaacaaccag

SEQ ID NO: 59050 - DNA, 25 bp, mus musculus
cctgcagcagctaaacaaccagaga

SEQ ID NO: 59051 - DNA, 25 bp, mus musculus
gggctttctgtgcgactgctgcatc

SEQ ID NO: 59052 - DNA, 25 bp, mus musculus
tctgtgcgactgctgcatcgccatt

SEQ ID NO: 59053 - DNA, 25 bp, mus musculus
cgactgctgcatcgccattgacgac

SEQ ID NO: 59054 - DNA, 25 bp, mus musculus
ctgctgcatcgccattgacgacact

SEQ ID NO: 59055 - DNA, 25 bp, mus musculus
ctgcatcgccattgacgacacttac

SEQ ID NO: 59056 - DNA, 25 bp, mus musculus
tcggctactgccagcgcttccaaag

SEQ ID NO: 59057 - DNA, 25 bp, mus musculus
cggctactgccagcgcttccaaagc

SEQ ID NO: 59058 - DNA, 25 bp, mus musculus
ctgcaaccaatctaggccatggtgg

SEQ ID NO: 59059 - DNA, 25 bp, mus musculus
gcaaccaatctaggccatggtggcg

SEQ ID NO: 59060 - DNA, 25 bp, mus musculus
accaatctaggccatggtggcgttc

SEQ ID NO: 59061 - DNA, 25 bp, mus musculus
ccaatctaggccatggtggcgttcg

SEQ ID NO: 59062 - DNA, 25 bp, mus musculus
aatctaggccatggtggcgttcggt

SEQ ID NO: 59063 - DNA, 25 bp, mus musculus
atctaggccatggtggcgttcggtt

SEQ ID NO: 59064 - DNA, 25 bp, mus musculus
tctaggccatggtggcgttcggttc

SEQ ID NO: 59065 - DNA, 25 bp, mus musculus
aagcacagaaacctgaactggtcgc

SEQ ID NO: 59066 - DNA, 25 bp, mus musculus
agcacagaaacctgaactggtcgcc

SEQ ID NO: 59067 - DNA, 25 bp, mus musculus
cacagaaacctgaactggtcgccaa

SEQ ID NO: 59068 - DNA, 25 bp, mus musculus
tgccagcgcttccaaagccgccatg

SEQ ID NO: 59069 - DNA, 25 bp, mus musculus
gccagcgcttccaaagccgccatgt

SEQ ID NO: 59070 - DNA, 25 bp, mus musculus
cattcccattctgatggagattgcg

SEQ ID NO: 59071 - DNA, 25 bp, mus musculus
aaggcagctgcaaccaatctaggcc

SEQ ID NO: 59072 - DNA, 25 bp, mus musculus
aggcagctgcaaccaatctaggcca

SEQ ID NO: 59073 - DNA, 25 bp, mus musculus
gcagctgcaaccaatctaggccatg

SEQ ID NO: 59074 - DNA, 25 bp, mus musculus
cagctgcaaccaatctaggccatgg

SEQ ID NO: 59075 - DNA, 25 bp, mus musculus
agctgcaaccaatctaggccatggt

SEQ ID NO: 59076 - DNA, 25 bp, mus musculus
caactctttctgctatgagaacgag

SEQ ID NO: 59077 - DNA, 25 bp, mus musculus
gctggccttcctgatcagagatgag

SEQ ID NO: 59078 - DNA, 25 bp, mus musculus
agcctcgggtcacagactcagtagc

SEQ ID NO: 59079 - DNA, 25 bp, mus musculus
tcacagactcagtagcatcttagtc

SEQ ID NO: 59080 - DNA, 25 bp, mus musculus
cagactcagtagcatcttagtcttt

SEQ ID NO: 59081 - DNA, 25 bp, mus musculus
actcagtagcatcttagtctttttc

SEQ ID NO: 59082 - DNA, 25 bp, mus musculus
ttttcgcagtagcttgggaaagttg

SEQ ID NO: 59083 - DNA, 25 bp, mus musculus
ccaaatgactggctcacggcctcgg

SEQ ID NO: 59084 - DNA, 25 bp, mus musculus
ctcacggcctcggaggctgatgtat

SEQ ID NO: 59085 - DNA, 25 bp, mus musculus
gatgtatacccatgggcaaggaggt

SEQ ID NO: 59086 - DNA, 25 bp, mus musculus
gtatacccatgggcaaggaggtgac

SEQ ID NO: 59087 - DNA, 25 bp, mus musculus
ctctgctggaggccttaggtgcagg

SEQ ID NO: 59088 - DNA, 25 bp, mus musculus
ggccttcctgatcagagatgaggag

SEQ ID NO: 59089 - DNA, 25 bp, mus musculus
tcagcccgagcatgactttgacaga

SEQ ID NO: 59090 - DNA, 25 bp, mus musculus
tgactttgacagactgcaggccagc

SEQ ID NO: 59091 - DNA, 25 bp, mus musculus
ctttgacagactgcaggccagcagc

SEQ ID NO: 59092 - DNA, 25 bp, mus musculus
actgcaggccagcagcgctgccctt

SEQ ID NO: 59093 - DNA, 25 bp, mus musculus
ccctgaccacaataggtcccatgtc

SEQ ID NO: 59094 - DNA, 25 bp, mus musculus
caggccgaaagcctcgggtcacaga

SEQ ID NO: 59095 - DNA, 25 bp, mus musculus
gaaagcctcgggtcacagactcagt

SEQ ID NO: 59096 - DNA, 25 bp, mus musculus
cagtgagaccctgtcttgaaaagga

SEQ ID NO: 59097 - DNA, 25 bp, mus musculus
tgagaccctgtcttgaaaaggaaag

SEQ ID NO: 59098 - DNA, 25 bp, mus musculus
tgagcctgctaagcggctgacctta

SEQ ID NO: 59099 - DNA, 25 bp, mus musculus
gcctgctaagcggctgaccttaggt

SEQ ID NO: 59100 - DNA, 25 bp, mus musculus
gcggctgaccttaggtgaagccctt

SEQ ID NO: 59101 - DNA, 25 bp, mus musculus
aggtgaagcccttcagcatcctttc

SEQ ID NO: 59102 - DNA, 25 bp, mus musculus
tgaagcccttcagcatcctttcttc

SEQ ID NO: 59103 - DNA, 25 bp, mus musculus
tcggactgagccacccaacaccaag

SEQ ID NO: 59104 - DNA, 25 bp, mus musculus
tgagccacccaacaccaagttgtgg

SEQ ID NO: 59105 - DNA, 25 bp, mus musculus
caacaccaagttgtgggactccagt

SEQ ID NO: 59106 - DNA, 25 bp, mus musculus
gtgggactccagtcgggatatcagt

SEQ ID NO: 59107 - DNA, 25 bp, mus musculus
ggactccagtcgggatatcagtcgg

SEQ ID NO: 59108 - DNA, 25 bp, mus musculus
taaggcattgccttaccttcttcct

SEQ ID NO: 59109 - DNA, 25 bp, mus musculus
ccaccagcggtatctgacctcagag

SEQ ID NO: 59110 - DNA, 25 bp, mus musculus
ccagcggtatctgacctcagaggca

SEQ ID NO: 59111 - DNA, 25 bp, mus musculus
gcggtatctgacctcagaggcagag

SEQ ID NO: 59112 - DNA, 25 bp, mus musculus
tctgacctcagaggcagaggaccac

SEQ ID NO: 59113 - DNA, 25 bp, mus musculus
ccaccagctcttcgatctgattgaa

SEQ ID NO: 59114 - DNA, 25 bp, mus musculus
ccagctcttcgatctgattgaaaat

SEQ ID NO: 59115 - DNA, 25 bp, mus musculus
gctcttcgatctgattgaaaatatg

SEQ ID NO: 59116 - DNA, 25 bp, mus musculus
cccacagcccagctggtacagagag

SEQ ID NO: 59117 - DNA, 25 bp, mus musculus
tacacgcagtcaggtggtgttcgtc

SEQ ID NO: 59118 - DNA, 25 bp, mus musculus
atctgcaatgaggctggctttagga

SEQ ID NO: 59119 - DNA, 25 bp, mus musculus
aatgaggctggctttaggaggctca

SEQ ID NO: 59120 - DNA, 25 bp, mus musculus
aggctcactccaactgaagtgaggg

SEQ ID NO: 59121 - DNA, 25 bp, mus musculus
gattacctggctgccatagcgtgat

SEQ ID NO: 59122 - DNA, 25 bp, mus musculus
tacctggctgccatagcgtgatgaa

SEQ ID NO: 59123 - DNA, 25 bp, mus musculus
agatgtgctcacacactcgactttt

SEQ ID NO: 59124 - DNA, 25 bp, mus musculus
tgtgctcacacactcgactttttca

SEQ ID NO: 59125 - DNA, 25 bp, mus musculus
cacacactcgactttttcatgttta

SEQ ID NO: 59126 - DNA, 25 bp, mus musculus
gcagacttatttctacatggtttag

SEQ ID NO: 59127 - DNA, 25 bp, mus musculus
tttctacatggtttagtggattcac

SEQ ID NO: 59128 - DNA, 25 bp, mus musculus
acgcagtcaggtggtgttcgtccat

SEQ ID NO: 59129 - DNA, 25 bp, mus musculus
ttatttcagtcagatccatctggag

SEQ ID NO: 59130 - DNA, 25 bp, mus musculus
tcagatccatctggagcttactttg

SEQ ID NO: 59131 - DNA, 25 bp, mus musculus
gatccatctggagcttactttgcct

SEQ ID NO: 59132 - DNA, 25 bp, mus musculus
tctggagcttactttgcctggaagg

SEQ ID NO: 59133 - DNA, 25 bp, mus musculus
gcttactttgcctggaaggccacag

SEQ ID NO: 59134 - DNA, 25 bp, mus musculus
tttgcctggaaggccacagcaatgg

SEQ ID NO: 59135 - DNA, 25 bp, mus musculus
catacagccatcttaacccttaagg

SEQ ID NO: 59136 - DNA, 25 bp, mus musculus
gtcagacttgtggctacaagtttca

SEQ ID NO: 59137 - DNA, 25 bp, mus musculus
agtttcatgagcactgtagcaccaa

SEQ ID NO: 59138 - DNA, 25 bp, mus musculus
caaattccactgttggtgacagtgg

SEQ ID NO: 59139 - DNA, 25 bp, mus musculus
ccactgttggtgacagtggagtccc

SEQ ID NO: 59140 - DNA, 25 bp, mus musculus
caccttctttcccaatgcgtcggat

SEQ ID NO: 59141 - DNA, 25 bp, mus musculus
ctttcccaatgcgtcggatgcgaga

SEQ ID NO: 59142 - DNA, 25 bp, mus musculus
caatgcgtcggatgcgagaatctgt

SEQ ID NO: 59143 - DNA, 25 bp, mus musculus
tgcgagaatctgtttcccggatgcc

SEQ ID NO: 59144 - DNA, 25 bp, mus musculus
ggatgcctgctagttcccagcacag

SEQ ID NO: 59145 - DNA, 25 bp, mus musculus
ctgctagttcccagcacagatactc

SEQ ID NO: 59146 - DNA, 25 bp, mus musculus
gttcccagcacagatactctacacc

SEQ ID NO: 59147 - DNA, 25 bp, mus musculus
agcacagatactctacaccccatgc

SEQ ID NO: 59148 - DNA, 25 bp, mus musculus
atgagcactgtagcaccaaagtacc

SEQ ID NO: 59149 - DNA, 25 bp, mus musculus
cagaaggttccctgtcccagaggca

SEQ ID NO: 59150 - DNA, 25 bp, mus musculus
actgtagcaccaaagtacctactat

SEQ ID NO: 59151 - DNA, 25 bp, mus musculus
aagtacctactatgtgtgtggactg

SEQ ID NO: 59152 - DNA, 25 bp, mus musculus
ctactatgtgtgtggactggagtaa

SEQ ID NO: 59153 - DNA, 25 bp, mus musculus
atatcagacagctcttgctgtttcc

SEQ ID NO: 59154 - DNA, 25 bp, mus musculus
gacagctcttgctgtttccaaattc

SEQ ID NO: 59155 - DNA, 25 bp, mus musculus
tcttgctgtttccaaattccactgt

SEQ ID NO: 59156 - DNA, 25 bp, mus musculus
tgtttccaaattccactgttggtga

SEQ ID NO: 59157 - DNA, 25 bp, mus musculus
tctcttccaggtggccttctattta

SEQ ID NO: 59158 - DNA, 25 bp, mus musculus
ttctatttacccggagagaagccag

SEQ ID NO: 59159 - DNA, 25 bp, mus musculus
gggctgcacctaagctgccccttcg

SEQ ID NO: 59160 - DNA, 25 bp, mus musculus
tgcacctaagctgccccttcgactg

SEQ ID NO: 59161 - DNA, 25 bp, mus musculus
gccttagaaacccatctcttccaca

SEQ ID NO: 59162 - DNA, 25 bp, mus musculus
cttagaaacccatctcttccacagt

SEQ ID NO: 59163 - DNA, 25 bp, mus musculus
tccgagcctcgctcttcctctgagg

SEQ ID NO: 59164 - DNA, 25 bp, mus musculus
cactcccttgacccaagatgtgacc

SEQ ID NO: 59165 - DNA, 25 bp, mus musculus
ctcccttgacccaagatgtgaccac

SEQ ID NO: 59166 - DNA, 25 bp, mus musculus
cccttgacccaagatgtgaccacac

SEQ ID NO: 59167 - DNA, 25 bp, mus musculus
ccttcgcccagcctgtacttgggag

SEQ ID NO: 59168 - DNA, 25 bp, mus musculus
taagcctgagtagtttcctattatt

SEQ ID NO: 59169 - DNA, 25 bp, mus musculus
ttacccggagagaagccagaatcac

SEQ ID NO: 59170 - DNA, 25 bp, mus musculus
agaagccagaatcaccttgggctgc

SEQ ID NO: 59171 - DNA, 25 bp, mus musculus
gccagaatcaccttgggctgcacct

SEQ ID NO: 59172 - DNA, 25 bp, mus musculus
cagaatcaccttgggctgcacctaa

SEQ ID NO: 59173 - DNA, 25 bp, mus musculus
gaatcaccttgggctgcacctaagc

SEQ ID NO: 59174 - DNA, 25 bp, mus musculus
atcaccttgggctgcacctaagctg

SEQ ID NO: 59175 - DNA, 25 bp, mus musculus
caccttgggctgcacctaagctgcc

SEQ ID NO: 59176 - DNA, 25 bp, mus musculus
ttgggctgcacctaagctgcccctt

SEQ ID NO: 59177 - DNA, 25 bp, mus musculus
ctaataaggcctctgtagccatggc

SEQ ID NO: 59178 - DNA, 25 bp, mus musculus
aggcctctgtagccatggctacttc

SEQ ID NO: 59179 - DNA, 25 bp, mus musculus
tcttcggcttggcaatgctccttta

SEQ ID NO: 59180 - DNA, 25 bp, mus musculus
tcggcttggcaatgctcctttaaga

SEQ ID NO: 59181 - DNA, 25 bp, mus musculus
tggcaatgctcctttaagaattggt

SEQ ID NO: 59182 - DNA, 25 bp, mus musculus
caatgctcctttaagaattggttgt

SEQ ID NO: 59183 - DNA, 25 bp, mus musculus
ttgtttacattcttccatcgtgtaa

SEQ ID NO: 59184 - DNA, 25 bp, mus musculus
tttacattcttccatcgtgtaaatg

SEQ ID NO: 59185 - DNA, 25 bp, mus musculus
acattcttccatcgtgtaaatgtca

SEQ ID NO: 59186 - DNA, 25 bp, mus musculus
aattcacaattctgtctttaattca

SEQ ID NO: 59187 - DNA, 25 bp, mus musculus
caattctgtctttaattcatggtgt

SEQ ID NO: 59188 - DNA, 25 bp, mus musculus
atggtgtcttacacaacataaacac

SEQ ID NO: 59189 - DNA, 25 bp, mus musculus
cctctgtagccatggctacttctga

SEQ ID NO: 59190 - DNA, 25 bp, mus musculus
ctgtagccatggctacttctgacgt

SEQ ID NO: 59191 - DNA, 25 bp, mus musculus
ccatggctacttctgacgtgaaacc

SEQ ID NO: 59192 - DNA, 25 bp, mus musculus
tggctacttctgacgtgaaaccaaa

SEQ ID NO: 59193 - DNA, 25 bp, mus musculus
ccatggtcgaccgatggccagagac

SEQ ID NO: 59194 - DNA, 25 bp, mus musculus
ctttcttctactacaacaaagagag

SEQ ID NO: 59195 - DNA, 25 bp, mus musculus
tcttctactacaacaaagagaggga

SEQ ID NO: 59196 - DNA, 25 bp, mus musculus
ctttcttcggcttggcaatgctcct

SEQ ID NO: 59197 - DNA, 25 bp, mus musculus
tatcctgctgggtgttttcatcttc

SEQ ID NO: 59198 - DNA, 25 bp, mus musculus
ctgcatctgctacacggcccatttc

SEQ ID NO: 59199 - DNA, 25 bp, mus musculus
gaactgtgcttggcttcgtctgtaa

SEQ ID NO: 59200 - DNA, 25 bp, mus musculus
tgcttggcttcgtctgtaagctcgt

SEQ ID NO: 59201 - DNA, 25 bp, mus musculus
tctgtaagctcgtggccctttgcag

SEQ ID NO: 59202 - DNA, 25 bp, mus musculus
tggccctttgcagacgggacacggc

SEQ ID NO: 59203 - DNA, 25 bp, mus musculus
acacggcgtaggatgggctgtctgt

SEQ ID NO: 59204 - DNA, 25 bp, mus musculus
atctagcacatagcctggaagaatc

SEQ ID NO: 59205 - DNA, 25 bp, mus musculus
caggcaaagcagccctgagtgtcat

SEQ ID NO: 59206 - DNA, 25 bp, mus musculus
aagcagccctgagtgtcatctgtgt

SEQ ID NO: 59207 - DNA, 25 bp, mus musculus
ccctgagtgtcatctgtgttcattg

SEQ ID NO: 59208 - DNA, 25 bp, mus musculus
gtgtcatctgtgttcattgctaggc

SEQ ID NO: 59209 - DNA, 25 bp, mus musculus
caacacctacctggttctcatcatg

SEQ ID NO: 59210 - DNA, 25 bp, mus musculus
tgtcatctgtgttcattgctaggca

SEQ ID NO: 59211 - DNA, 25 bp, mus musculus
ctacctggttctcatcatgtgcaac

SEQ ID NO: 59212 - DNA, 25 bp, mus musculus
gctgcgcaacacgttcaaggagatt

SEQ ID NO: 59213 - DNA, 25 bp, mus musculus
ggagattctctgcggctgcaacagc

SEQ ID NO: 59214 - DNA, 25 bp, mus musculus
tctctgcggctgcaacagcatgaac

SEQ ID NO: 59215 - DNA, 25 bp, mus musculus
catgaacttgggctaggatgcccgt

SEQ ID NO: 59216 - DNA, 25 bp, mus musculus
tgcccgtggaggtgttccacatcca

SEQ ID NO: 59217 - DNA, 25 bp, mus musculus
tgttccacatccagccaagagacaa

SEQ ID NO: 59218 - DNA, 25 bp, mus musculus
tcactgtcaaggttgctgatttcgg

SEQ ID NO: 59219 - DNA, 25 bp, mus musculus
atttcggtcttgccagagacatgta

SEQ ID NO: 59220 - DNA, 25 bp, mus musculus
tgctaaaatgctggcaccccaaagc

SEQ ID NO: 59221 - DNA, 25 bp, mus musculus
aactggtctccaggatatcctcaat

SEQ ID NO: 59222 - DNA, 25 bp, mus musculus
ggatatcctcaatcttctccacgtt

SEQ ID NO: 59223 - DNA, 25 bp, mus musculus
cctcaatcttctccacgttcattgg

SEQ ID NO: 59224 - DNA, 25 bp, mus musculus
tccacgtgaacgctacttatgtgaa

SEQ ID NO: 59225 - DNA, 25 bp, mus musculus
aatgtgttgctccatatccttctct

SEQ ID NO: 59226 - DNA, 25 bp, mus musculus
ttgctccatatccttctctgttgcc

SEQ ID NO: 59227 - DNA, 25 bp, mus musculus
cttctctgttgccatcccaagacaa

SEQ ID NO: 59228 - DNA, 25 bp, mus musculus
tgttgccatcccaagacaacattga

SEQ ID NO: 59229 - DNA, 25 bp, mus musculus
catcccaagacaacattgatggcga

SEQ ID NO: 59230 - DNA, 25 bp, mus musculus
gtgccaagctaccagtaaagtggat

SEQ ID NO: 59231 - DNA, 25 bp, mus musculus
gtgtgctcctctgggagctcatgac

SEQ ID NO: 59232 - DNA, 25 bp, mus musculus
tcctctgggagctcatgacgagagg

SEQ ID NO: 59233 - DNA, 25 bp, mus musculus
ttgatatcactatctacctgttgca

SEQ ID NO: 59234 - DNA, 25 bp, mus musculus
tcactatctacctgttgcaaggcag

SEQ ID NO: 59235 - DNA, 25 bp, mus musculus
gaagactcttgcaaccagaatactg

SEQ ID NO: 59236 - DNA, 25 bp, mus musculus
tcttgcaaccagaatactgtccaga

SEQ ID NO: 59237 - DNA, 25 bp, mus musculus
gtccagacgccttgtacgaagtgat

SEQ ID NO: 59238 - DNA, 25 bp, mus musculus
caccgaggctccacctaaagagcca

SEQ ID NO: 59239 - DNA, 25 bp, mus musculus
ggctccacctaaagagccactggac

SEQ ID NO: 59240 - DNA, 25 bp, mus musculus
gtctgtttcatcgtcccaggacacg

SEQ ID NO: 59241 - DNA, 25 bp, mus musculus
gtcccaggacacggcaaatgaagtc

SEQ ID NO: 59242 - DNA, 25 bp, mus musculus
ggccttgctggcaccgcatctaaag

SEQ ID NO: 59243 - DNA, 25 bp, mus musculus
ttctgacccattagtagtcttgaat

SEQ ID NO: 59244 - DNA, 25 bp, mus musculus
cttgaatgtggggctctgagataaa

SEQ ID NO: 59245 - DNA, 25 bp, mus musculus
aggcccgcagacagggacaagggat

SEQ ID NO: 59246 - DNA, 25 bp, mus musculus
acacatttgctgccttctcctcaag

SEQ ID NO: 59247 - DNA, 25 bp, mus musculus
ttgctgccttctcctcaaggaagaa

SEQ ID NO: 59248 - DNA, 25 bp, mus musculus
cagccaagcttgtcagcagcctgta

SEQ ID NO: 59249 - DNA, 25 bp, mus musculus
agcttgtcagcagcctgtaggatca

SEQ ID NO: 59250 - DNA, 25 bp, mus musculus
catggaagacctatcttctggcctg

SEQ ID NO: 59251 - DNA, 25 bp, mus musculus
tcaagtcaccctgtgaagacagagg

SEQ ID NO: 59252 - DNA, 25 bp, mus musculus
acagaggccagctctgcacagcagc

SEQ ID NO: 59253 - DNA, 25 bp, mus musculus
tgtgcctcagcccttcttatgttcc

SEQ ID NO: 59254 - DNA, 25 bp, mus musculus
tcagcccttcttatgttccctgatg

SEQ ID NO: 59255 - DNA, 25 bp, mus musculus
cttcttatgttccctgatgtcacac

SEQ ID NO: 59256 - DNA, 25 bp, mus musculus
cttgagactggtgtctgtttcatcg

SEQ ID NO: 59257 - DNA, 25 bp, mus musculus
actggtgtctgtttcatcgtcccag

SEQ ID NO: 59258 - DNA, 25 bp, mus musculus
tacaaccacatgcttcgcagaagaa

SEQ ID NO: 59259 - DNA, 25 bp, mus musculus
acaaccacatgcttcgcagaagaag

SEQ ID NO: 59260 - DNA, 25 bp, mus musculus
cagcggcgaggactggcggtcaata

SEQ ID NO: 59261 - DNA, 25 bp, mus musculus
ggttccttagagctcttacgatctg

SEQ ID NO: 59262 - DNA, 25 bp, mus musculus
gttccttagagctcttacgatctgc

SEQ ID NO: 59263 - DNA, 25 bp, mus musculus
tccttagagctcttacgatctgcgc

SEQ ID NO: 59264 - DNA, 25 bp, mus musculus
ccttagagctcttacgatctgcgct

SEQ ID NO: 59265 - DNA, 25 bp, mus musculus
ttagagctcttacgatctgcgcttt

SEQ ID NO: 59266 - DNA, 25 bp, mus musculus
tagagctcttacgatctgcgctttt

SEQ ID NO: 59267 - DNA, 25 bp, mus musculus
agctcttacgatctgcgctttttgt

SEQ ID NO: 59268 - DNA, 25 bp, mus musculus
ctcttacgatctgcgctttttgtgg

SEQ ID NO: 59269 - DNA, 25 bp, mus musculus
tcttacgatctgcgctttttgtggt

SEQ ID NO: 59270 - DNA, 25 bp, mus musculus
aaccacatgcttcgcagaagaagaa

SEQ ID NO: 59271 - DNA, 25 bp, mus musculus
accacatgcttcgcagaagaagaac

SEQ ID NO: 59272 - DNA, 25 bp, mus musculus
cacatgcttcgcagaagaagaacct

SEQ ID NO: 59273 - DNA, 25 bp, mus musculus
acatgcttcgcagaagaagaacctc

SEQ ID NO: 59274 - DNA, 25 bp, mus musculus
agtataacagcggcgaggactggcg

SEQ ID NO: 59275 - DNA, 25 bp, mus musculus
ataacagcggcgaggactggcggtc

SEQ ID NO: 59276 - DNA, 25 bp, mus musculus
taacagcggcgaggactggcggtca

SEQ ID NO: 59277 - DNA, 25 bp, mus musculus
acagcggcgaggactggcggtcaat

SEQ ID NO: 59278 - DNA, 25 bp, mus musculus
agcacaggagccagtttcatatttg

SEQ ID NO: 59279 - DNA, 25 bp, mus musculus
taggtcttaccgacagggatggctc

SEQ ID NO: 59280 - DNA, 25 bp, mus musculus
tgaaccgctgggtatgcgaaaagag

SEQ ID NO: 59281 - DNA, 25 bp, mus musculus
gacggaacatcacccactaggagtc

SEQ ID NO: 59282 - DNA, 25 bp, mus musculus
ggaacatcacccactaggagtcggc

SEQ ID NO: 59283 - DNA, 25 bp, mus musculus
ccaacatcctcactggggatactgg

SEQ ID NO: 59284 - DNA, 25 bp, mus musculus
acatcctcactggggatactggagc

SEQ ID NO: 59285 - DNA, 25 bp, mus musculus
catggctctatggtctcatacctta

SEQ ID NO: 59286 - DNA, 25 bp, mus musculus
atggtctcataccttaggaagactg

SEQ ID NO: 59287 - DNA, 25 bp, mus musculus
tcataccttaggaagactgagaatc

SEQ ID NO: 59288 - DNA, 25 bp, mus musculus
ttctgcacaatttattgcaattgtt

SEQ ID NO: 59289 - DNA, 25 bp, mus musculus
tttcggccttctgaatggagtagga

SEQ ID NO: 59290 - DNA, 25 bp, mus musculus
gtcttaccgacagggatggctcctg

SEQ ID NO: 59291 - DNA, 25 bp, mus musculus
ccgacagggatggctcctggaaatg

SEQ ID NO: 59292 - DNA, 25 bp, mus musculus
gggccttcactcagccagataactg

SEQ ID NO: 59293 - DNA, 25 bp, mus musculus
ccttcactcagccagataactggca

SEQ ID NO: 59294 - DNA, 25 bp, mus musculus
ctgaaatcctgtcagatggccattg

SEQ ID NO: 59295 - DNA, 25 bp, mus musculus
aaatcctgtcagatggccattggaa

SEQ ID NO: 59296 - DNA, 25 bp, mus musculus
atgacaacttctgccagcaggtgaa

SEQ ID NO: 59297 - DNA, 25 bp, mus musculus
acttctgccagcaggtgaaccgctg

SEQ ID NO: 59298 - DNA, 25 bp, mus musculus
gtgttcagctcagacttccaggagt

SEQ ID NO: 59299 - DNA, 25 bp, mus musculus
ttcagctcagacttccaggagtttg

SEQ ID NO: 59300 - DNA, 25 bp, mus musculus
cacacccacgcggactgcagtgtga

SEQ ID NO: 59301 - DNA, 25 bp, mus musculus
acccacgcggactgcagtgtgacag

SEQ ID NO: 59302 - DNA, 25 bp, mus musculus
cacgcggactgcagtgtgacagcag

SEQ ID NO: 59303 - DNA, 25 bp, mus musculus
agtgtgacagcagcgccacagtctg

SEQ ID NO: 59304 - DNA, 25 bp, mus musculus
gtgacagcagcgccacagtctgtgt

SEQ ID NO: 59305 - DNA, 25 bp, mus musculus
gcagcgccacagtctgtgtccttgt

SEQ ID NO: 59306 - DNA, 25 bp, mus musculus
ccacagtctgtgtccttgtccctgt

SEQ ID NO: 59307 - DNA, 25 bp, mus musculus
cagtctgtgtccttgtccctgtcgg

SEQ ID NO: 59308 - DNA, 25 bp, mus musculus
tccctgtcggcacagtggccgctgc

SEQ ID NO: 59309 - DNA, 25 bp, mus musculus
ctgcctctggggacagtgatgctgt

SEQ ID NO: 59310 - DNA, 25 bp, mus musculus
tcagacttccaggagtttgtgaata

SEQ ID NO: 59311 - DNA, 25 bp, mus musculus
tgtctcattaagaacccagcagaca

SEQ ID NO: 59312 - DNA, 25 bp, mus musculus
ctcattaagaacccagcagacacgc

SEQ ID NO: 59313 - DNA, 25 bp, mus musculus
aacccagcagacacgcagatctgaa

SEQ ID NO: 59314 - DNA, 25 bp, mus musculus
ccagcagacacgcagatctgaagct

SEQ ID NO: 59315 - DNA, 25 bp, mus musculus
gcagacacgcagatctgaagctgct

SEQ ID NO: 59316 - DNA, 25 bp, mus musculus
tggacttcgccggctgctgtgcaga

SEQ ID NO: 59317 - DNA, 25 bp, mus musculus
tcgccggctgctgtgcagaaccctg

SEQ ID NO: 59318 - DNA, 25 bp, mus musculus
ggcctcactgacagctgtggtgatc

SEQ ID NO: 59319 - DNA, 25 bp, mus musculus
actgacagctgtggtgatccactgg

SEQ ID NO: 59320 - DNA, 25 bp, mus musculus
cccaggtgctgcaggacacttgaga

SEQ ID NO: 59321 - DNA, 25 bp, mus musculus
caggtgctgcaggacacttgagaga

SEQ ID NO: 59322 - DNA, 25 bp, mus musculus
ccagggcactctgtactccttcaag

SEQ ID NO: 59323 - DNA, 25 bp, mus musculus
ggcactctgtactccttcaaggctt

SEQ ID NO: 59324 - DNA, 25 bp, mus musculus
ctctgtactccttcaaggcttgccg

SEQ ID NO: 59325 - DNA, 25 bp, mus musculus
ctgtactccttcaaggcttgccggg

SEQ ID NO: 59326 - DNA, 25 bp, mus musculus
gtactccttcaaggcttgccgggct

SEQ ID NO: 59327 - DNA, 25 bp, mus musculus
actccttcaaggcttgccgggctct

SEQ ID NO: 59328 - DNA, 25 bp, mus musculus
tccttcaaggcttgccgggctctgc

SEQ ID NO: 59329 - DNA, 25 bp, mus musculus
cttcaaggcttgccgggctctgctg

SEQ ID NO: 59330 - DNA, 25 bp, mus musculus
aagaggcagctgagcgcttgtaccc

SEQ ID NO: 59331 - DNA, 25 bp, mus musculus
ttcaaggcttgccgggctctgctgg

SEQ ID NO: 59332 - DNA, 25 bp, mus musculus
cagctgagcgcttgtacccactggt

SEQ ID NO: 59333 - DNA, 25 bp, mus musculus
cgcttgtacccactggtagagcata

SEQ ID NO: 59334 - DNA, 25 bp, mus musculus
cttgtacccactggtagagcatatc

SEQ ID NO: 59335 - DNA, 25 bp, mus musculus
tacccactggtagagcatatccccc

SEQ ID NO: 59336 - DNA, 25 bp, mus musculus
gcatatcccccaggtgctgcaggac

SEQ ID NO: 59337 - DNA, 25 bp, mus musculus
atatcccccaggtgctgcaggacac

SEQ ID NO: 59338 - DNA, 25 bp, mus musculus
cccccaggtgctgcaggacacttga

SEQ ID NO: 59339 - DNA, 25 bp, mus musculus
gggagctctccgttttatcttcatc

SEQ ID NO: 59340 - DNA, 25 bp, mus musculus
ggagctctccgttttatcttcatcc

SEQ ID NO: 59341 - DNA, 25 bp, mus musculus
agcgctgcgccgtgtcctttacgac

SEQ ID NO: 59342 - DNA, 25 bp, mus musculus
tcttcccacggatgtgatcttcgtg

SEQ ID NO: 59343 - DNA, 25 bp, mus musculus
tttctaaactaccccaatggatgca

SEQ ID NO: 59344 - DNA, 25 bp, mus musculus
ttctaaactaccccaatggatgcag

SEQ ID NO: 59345 - DNA, 25 bp, mus musculus
ctaaactaccccaatggatgcagac

SEQ ID NO: 59346 - DNA, 25 bp, mus musculus
taaactaccccaatggatgcagaca

SEQ ID NO: 59347 - DNA, 25 bp, mus musculus
aactaccccaatggatgcagacagt

SEQ ID NO: 59348 - DNA, 25 bp, mus musculus
actaccccaatggatgcagacagtg

SEQ ID NO: 59349 - DNA, 25 bp, mus musculus
taccccaatggatgcagacagtgat

SEQ ID NO: 59350 - DNA, 25 bp, mus musculus
accccaatggatgcagacagtgatg

SEQ ID NO: 59351 - DNA, 25 bp, mus musculus
agctctccgttttatcttcatcctt

SEQ ID NO: 59352 - DNA, 25 bp, mus musculus
ttttatcttcatccttgtcctccag

SEQ ID NO: 59353 - DNA, 25 bp, mus musculus
tttatcttcatccttgtcctccagc

SEQ ID NO: 59354 - DNA, 25 bp, mus musculus
tatcttcatccttgtcctccagctt

SEQ ID NO: 59355 - DNA, 25 bp, mus musculus
atcttcatccttgtcctccagcttc

SEQ ID NO: 59356 - DNA, 25 bp, mus musculus
cttcatccttgtcctccagcttctt

SEQ ID NO: 59357 - DNA, 25 bp, mus musculus
ttcatccttgtcctccagcttcttc

SEQ ID NO: 59358 - DNA, 25 bp, mus musculus
agcagcagcgctgcgccgtgtcctt

SEQ ID NO: 59359 - DNA, 25 bp, mus musculus
ttacaggttacatcatctattacag

SEQ ID NO: 59360 - DNA, 25 bp, mus musculus
gttacatcatctattacagcacgga

SEQ ID NO: 59361 - DNA, 25 bp, mus musculus
ttgatacgccatactacttcaaaat

SEQ ID NO: 59362 - DNA, 25 bp, mus musculus
atacgccatactacttcaaaatcca

SEQ ID NO: 59363 - DNA, 25 bp, mus musculus
catactacttcaaaatccaggcccg

SEQ ID NO: 59364 - DNA, 25 bp, mus musculus
tccaggcccggaactcaaagggcat

SEQ ID NO: 59365 - DNA, 25 bp, mus musculus
ggaactcaaagggcatggggcccat

SEQ ID NO: 59366 - DNA, 25 bp, mus musculus
gcatggggcccatgtctgaagctgt

SEQ ID NO: 59367 - DNA, 25 bp, mus musculus
ggcccatgtctgaagctgtacagtt

SEQ ID NO: 59368 - DNA, 25 bp, mus musculus
tacagttcagaacacctaaagcctt

SEQ ID NO: 59369 - DNA, 25 bp, mus musculus
cacctaaagccttagggtcagcagg

SEQ ID NO: 59370 - DNA, 25 bp, mus musculus
gaagccgactaccagacctgggatc

SEQ ID NO: 59371 - DNA, 25 bp, mus musculus
tcatctattacagcacggatgtgaa

SEQ ID NO: 59372 - DNA, 25 bp, mus musculus
gactaccagacctgggatctgacta

SEQ ID NO: 59373 - DNA, 25 bp, mus musculus
tctattacagcacggatgtgaatgc

SEQ ID NO: 59374 - DNA, 25 bp, mus musculus
attacagcacggatgtgaatgcaga

SEQ ID NO: 59375 - DNA, 25 bp, mus musculus
acagactgactcaccagattcaaga

SEQ ID NO: 59376 - DNA, 25 bp, mus musculus
tgactcaccagattcaagagttaac

SEQ ID NO: 59377 - DNA, 25 bp, mus musculus
ctcaccagattcaagagttaacact

SEQ ID NO: 59378 - DNA, 25 bp, mus musculus
agttaacacttgatacgccatacta

SEQ ID NO: 59379 - DNA, 25 bp, mus musculus
cacttgatacgccatactacttcaa

SEQ ID NO: 59380 - DNA, 25 bp, mus musculus
gattcgttgtgacctggagcggcag

SEQ ID NO: 59381 - DNA, 25 bp, mus musculus
ttgtgacctggagcggcagaaccat

SEQ ID NO: 59382 - DNA, 25 bp, mus musculus
gagcagccaccagagggcctaggcc

SEQ ID NO: 59383 - DNA, 25 bp, mus musculus
ccaccagagggcctaggccacagga

SEQ ID NO: 59384 - DNA, 25 bp, mus musculus
gacaccttgtggttcttggcagcta

SEQ ID NO: 59385 - DNA, 25 bp, mus musculus
aaatgatcttgcacttctctagggc

SEQ ID NO: 59386 - DNA, 25 bp, mus musculus
ctagggccctccttgcttatcaggt

SEQ ID NO: 59387 - DNA, 25 bp, mus musculus
ttgcttatcaggtttttctactcaa

SEQ ID NO: 59388 - DNA, 25 bp, mus musculus
atcaggtttttctactcaaattcat

SEQ ID NO: 59389 - DNA, 25 bp, mus musculus
aactgtgctttttacgccatgcaaa

SEQ ID NO: 59390 - DNA, 25 bp, mus musculus
gctttttacgccatgcaaaaccagg

SEQ ID NO: 59391 - DNA, 25 bp, mus musculus
atattcccaataaagtgttctcttg

SEQ ID NO: 59392 - DNA, 25 bp, mus musculus
tgagtatcaggtgttactggatgtc

SEQ ID NO: 59393 - DNA, 25 bp, mus musculus
ccacccttgttccacggaatgcaag

SEQ ID NO: 59394 - DNA, 25 bp, mus musculus
ttgttccacggaatgcaagcctgct

SEQ ID NO: 59395 - DNA, 25 bp, mus musculus
aagtcagcacccagatccggaccat

SEQ ID NO: 59396 - DNA, 25 bp, mus musculus
agatccggaccatcaccgaggagat

SEQ ID NO: 59397 - DNA, 25 bp, mus musculus
ggaccatcaccgaggagatcaggga

SEQ ID NO: 59398 - DNA, 25 bp, mus musculus
tctcctccagggagcacgtggtgcc

SEQ ID NO: 59399 - DNA, 25 bp, mus musculus
caatgtgagcagccaccagagggcc

SEQ ID NO: 59400 - DNA, 25 bp, mus musculus
gcagttcgatcactggaacgtggtt

SEQ ID NO: 59401 - DNA, 25 bp, mus musculus
tctggacaagcccggcaaggtcacc

SEQ ID NO: 59402 - DNA, 25 bp, mus musculus
tgccaacctaaaggcctctgtggtg

SEQ ID NO: 59403 - DNA, 25 bp, mus musculus
ggcctctgtggtgtttaaccagctc

SEQ ID NO: 59404 - DNA, 25 bp, mus musculus
ctgatgacagccctggctgccctac

SEQ ID NO: 59405 - DNA, 25 bp, mus musculus
cctcatgtgtatttgggggacattc

SEQ ID NO: 59406 - DNA, 25 bp, mus musculus
gtgctcatcttggccagagttcccc

SEQ ID NO: 59407 - DNA, 25 bp, mus musculus
cagtgatgtcccatggctccgtagt

SEQ ID NO: 59408 - DNA, 25 bp, mus musculus
tgtcccatggctccgtagtctagat

SEQ ID NO: 59409 - DNA, 25 bp, mus musculus
atggctccgtagtctagatctagaa

SEQ ID NO: 59410 - DNA, 25 bp, mus musculus
tctagaagccggatgctgctactat

SEQ ID NO: 59411 - DNA, 25 bp, mus musculus
agccggatgctgctactatagactg

SEQ ID NO: 59412 - DNA, 25 bp, mus musculus
cggcaaggtcaccatcacgggcacc

SEQ ID NO: 59413 - DNA, 25 bp, mus musculus
cctcatgacacgccagctgctggac

SEQ ID NO: 59414 - DNA, 25 bp, mus musculus
cgccatcttctggcgcaaggaagac

SEQ ID NO: 59415 - DNA, 25 bp, mus musculus
ctccgacgccatggattggaatgag

SEQ ID NO: 59416 - DNA, 25 bp, mus musculus
gcgcctttctgatctggccaagatc

SEQ ID NO: 59417 - DNA, 25 bp, mus musculus
tctggccaagatccgcaaggtcatg

SEQ ID NO: 59418 - DNA, 25 bp, mus musculus
caagatccgcaaggtcatgtatttc

SEQ ID NO: 59419 - DNA, 25 bp, mus musculus
ggtcatgtatttcctcatcaccttt

SEQ ID NO: 59420 - DNA, 25 bp, mus musculus
gcccatgtcctcctgaagattctcc

SEQ ID NO: 59421 - DNA, 25 bp, mus musculus
gtcctcctgaagattctcctaattc

SEQ ID NO: 59422 - DNA, 25 bp, mus musculus
cacacagtccttggtggccccaggg

SEQ ID NO: 59423 - DNA, 25 bp, mus musculus
gttcgtccgggccatttctcttatg

SEQ ID NO: 59424 - DNA, 25 bp, mus musculus
atctgcggtatgtgggtctgccaag

SEQ ID NO: 59425 - DNA, 25 bp, mus musculus
tgggtctgccaagtaggtggagttc

SEQ ID NO: 59426 - DNA, 25 bp, mus musculus
ctttagctccatgtgccttgttctt

SEQ ID NO: 59427 - DNA, 25 bp, mus musculus
ctccatgtgccttgttcttgtggtg

SEQ ID NO: 59428 - DNA, 25 bp, mus musculus
gtgccttgttcttgtggtgatgata

SEQ ID NO: 59429 - DNA, 25 bp, mus musculus
atgaggcccaactctgtgccctgtg

SEQ ID NO: 59430 - DNA, 25 bp, mus musculus
cccaactctgtgccctgtggttgca

SEQ ID NO: 59431 - DNA, 25 bp, mus musculus
tctgcaaactctgggagtctggggg

SEQ ID NO: 59432 - DNA, 25 bp, mus musculus
ctgaagattctcctaattcctttct

SEQ ID NO: 59433 - DNA, 25 bp, mus musculus
tcaataaacttgccaagctaacttc

SEQ ID NO: 59434 - DNA, 25 bp, mus musculus
tcagctccagccacagtaaatgtat

SEQ ID NO: 59435 - DNA, 25 bp, mus musculus
atgagcacagacccctaagatctgc

SEQ ID NO: 59436 - DNA, 25 bp, mus musculus
acagacccctaagatctgcaggcat

SEQ ID NO: 59437 - DNA, 25 bp, mus musculus
gatctgcaggcatccttagcccatc

SEQ ID NO: 59438 - DNA, 25 bp, mus musculus
caggcatccttagcccatcttgtcc

SEQ ID NO: 59439 - DNA, 25 bp, mus musculus
cttccctggcagaagatgcttcatc

SEQ ID NO: 59440 - DNA, 25 bp, mus musculus
gaccccaaagggcacacagtccttg

SEQ ID NO: 59441 - DNA, 25 bp, mus musculus
caactataggctgctaaggaccatc

SEQ ID NO: 59442 - DNA, 25 bp, mus musculus
caacttcgccaaagtcaagctggct

SEQ ID NO: 59443 - DNA, 25 bp, mus musculus
ctgaaccccagtagcttgcagaagc

SEQ ID NO: 59444 - DNA, 25 bp, mus musculus
agcttgcagaagctgttcagagaag

SEQ ID NO: 59445 - DNA, 25 bp, mus musculus
caccccaacatcgtgaagctttttg

SEQ ID NO: 59446 - DNA, 25 bp, mus musculus
aacatcgtgaagctttttgaggtga

SEQ ID NO: 59447 - DNA, 25 bp, mus musculus
aagacgctatacctggtgatggaat

SEQ ID NO: 59448 - DNA, 25 bp, mus musculus
acgctatacctggtgatggaatacg

SEQ ID NO: 59449 - DNA, 25 bp, mus musculus
ctatacctggtgatggaatacgcta

SEQ ID NO: 59450 - DNA, 25 bp, mus musculus
atggaatacgctagcgcaggagaag

SEQ ID NO: 59451 - DNA, 25 bp, mus musculus
tacgctagcgcaggagaagtgtttg

SEQ ID NO: 59452 - DNA, 25 bp, mus musculus
gtgtttgactacctcgtgtcgcacg

SEQ ID NO: 59453 - DNA, 25 bp, mus musculus
cttcgccaaagtcaagctggctcgg

SEQ ID NO: 59454 - DNA, 25 bp, mus musculus
agtcaagctggctcggcatatcctc

SEQ ID NO: 59455 - DNA, 25 bp, mus musculus
caagctggctcggcatatcctcacg

SEQ ID NO: 59456 - DNA, 25 bp, mus musculus
gctggctcggcatatcctcacgggc

SEQ ID NO: 59457 - DNA, 25 bp, mus musculus
attgataagacccagctgaacccca

SEQ ID NO: 59458 - DNA, 25 bp, mus musculus
gataagacccagctgaaccccagta

SEQ ID NO: 59459 - DNA, 25 bp, mus musculus
acccagctgaaccccagtagcttgc

SEQ ID NO: 59460 - DNA, 25 bp, mus musculus
cagctgaaccccagtagcttgcaga

SEQ ID NO: 59461 - DNA, 25 bp, mus musculus
ttggtcattctcagtccatgatggt

SEQ ID NO: 59462 - DNA, 25 bp, mus musculus
tgtggtccccagtgctccttggcat

SEQ ID NO: 59463 - DNA, 25 bp, mus musculus
tggtgtatgtcttctccaagttgaa

SEQ ID NO: 59464 - DNA, 25 bp, mus musculus
gctatttccccagtagcattgtccg

SEQ ID NO: 59465 - DNA, 25 bp, mus musculus
gtagcattgtccgggaggacctgaa

SEQ ID NO: 59466 - DNA, 25 bp, mus musculus
actcgaaacctggcaaaattgatat

SEQ ID NO: 59467 - DNA, 25 bp, mus musculus
aatgggatttctactgccagtgagc

SEQ ID NO: 59468 - DNA, 25 bp, mus musculus
actgccagtgagctcagcctaccgc

SEQ ID NO: 59469 - DNA, 25 bp, mus musculus
ctaccgctatccctgcagttacctt

SEQ ID NO: 59470 - DNA, 25 bp, mus musculus
ctgcagttaccttccggctctatgc

SEQ ID NO: 59471 - DNA, 25 bp, mus musculus
ttaccttccggctctatgcaaatac

SEQ ID NO: 59472 - DNA, 25 bp, mus musculus
tccggctctatgcaaatacagcagc

SEQ ID NO: 59473 - DNA, 25 bp, mus musculus
gagctatgcccaagctggctgactg

SEQ ID NO: 59474 - DNA, 25 bp, mus musculus
ctatgcaaatacagcagccaatggc

SEQ ID NO: 59475 - DNA, 25 bp, mus musculus
agctggctgactggaagctgtgtgc

SEQ ID NO: 59476 - DNA, 25 bp, mus musculus
ctgactggaagctgtgtgcggacga

SEQ ID NO: 59477 - DNA, 25 bp, mus musculus
aggaatgcagccatcctatctccat

SEQ ID NO: 59478 - DNA, 25 bp, mus musculus
tctccatggctgtggccctccagga

SEQ ID NO: 59479 - DNA, 25 bp, mus musculus
tccaggactacgtggcccctgattg

SEQ ID NO: 59480 - DNA, 25 bp, mus musculus
actacgtggcccctgattgccgctt

SEQ ID NO: 59481 - DNA, 25 bp, mus musculus
gccgcttcttgactatatatagggg

SEQ ID NO: 59482 - DNA, 25 bp, mus musculus
attttcgtgctttatcagtagccct

SEQ ID NO: 59483 - DNA, 25 bp, mus musculus
gtgctttatcagtagccctgcatat

SEQ ID NO: 59484 - DNA, 25 bp, mus musculus
actgatttctccaagtgtgagcttt

SEQ ID NO: 59485 - DNA, 25 bp, mus musculus
tccaagtgtgagctttctgagcaag

SEQ ID NO: 59486 - DNA, 25 bp, mus musculus
tgtgagctttctgagcaaggggatt

SEQ ID NO: 59487 - DNA, 25 bp, mus musculus
ttttttgcttcagagaagtaagtgt

SEQ ID NO: 59488 - DNA, 25 bp, mus musculus
taagtgtctgtccgttttcattcag

SEQ ID NO: 59489 - DNA, 25 bp, mus musculus
gtgtctgtccgttttcattcagggg

SEQ ID NO: 59490 - DNA, 25 bp, mus musculus
tctgtctgtgacctcctttgaaatt

SEQ ID NO: 59491 - DNA, 25 bp, mus musculus
tgtgacctcctttgaaattaacatg

SEQ ID NO: 59492 - DNA, 25 bp, mus musculus
aagacatccaagactttctcgcttt

SEQ ID NO: 59493 - DNA, 25 bp, mus musculus
acatccaagactttctcgctttcta

SEQ ID NO: 59494 - DNA, 25 bp, mus musculus
ctttatcagtagccctgcatatatt

SEQ ID NO: 59495 - DNA, 25 bp, mus musculus
agactttctcgctttctaatacgcg

SEQ ID NO: 59496 - DNA, 25 bp, mus musculus
attttgtgagccagacttgtatatt

SEQ ID NO: 59497 - DNA, 25 bp, mus musculus
cctcctaagtattgtaccttcagcg

SEQ ID NO: 59498 - DNA, 25 bp, mus musculus
cctaagtattgtaccttcagcgtgc

SEQ ID NO: 59499 - DNA, 25 bp, mus musculus
aagtattgtaccttcagcgtgcagt

SEQ ID NO: 59500 - DNA, 25 bp, mus musculus
accttcagcgtgcagtatctgtgaa

SEQ ID NO: 59501 - DNA, 25 bp, mus musculus
ttcagcgtgcagtatctgtgaactg

SEQ ID NO: 59502 - DNA, 25 bp, mus musculus
tgaactgatttctccaagtgtgagc

SEQ ID NO: 59503 - DNA, 25 bp, mus musculus
gcgcgcgcgcacaagagcaagaagg

SEQ ID NO: 59504 - DNA, 25 bp, mus musculus
tgctgccagcgcgaagaaagtgaag

SEQ ID NO: 59505 - DNA, 25 bp, mus musculus
cgcaagtgacgcccctacggtctgg

SEQ ID NO: 59506 - DNA, 25 bp, mus musculus
cccctacggtctggcgacatcgtcg

SEQ ID NO: 59507 - DNA, 25 bp, mus musculus
ccctacggtctggcgacatcgtcga

SEQ ID NO: 59508 - DNA, 25 bp, mus musculus
ctacggtctggcgacatcgtcgagt

SEQ ID NO: 59509 - DNA, 25 bp, mus musculus
tacggtctggcgacatcgtcgagtt

SEQ ID NO: 59510 - DNA, 25 bp, mus musculus
cggtctggcgacatcgtcgagtttt

SEQ ID NO: 59511 - DNA, 25 bp, mus musculus
ggtctggcgacatcgtcgagttttc

SEQ ID NO: 59512 - DNA, 25 bp, mus musculus
tctggcgacatcgtcgagttttcca

SEQ ID NO: 59513 - DNA, 25 bp, mus musculus
ctggcgacatcgtcgagttttccat

SEQ ID NO: 59514 - DNA, 25 bp, mus musculus
gcgacatcgtcgagttttccatctg

SEQ ID NO: 59515 - DNA, 25 bp, mus musculus
gctgccagcgcgaagaaagtgaaga

SEQ ID NO: 59516 - DNA, 25 bp, mus musculus
gacatcgtcgagttttccatctgtc

SEQ ID NO: 59517 - DNA, 25 bp, mus musculus
acccagcgtgcccaaggtgcccaag

SEQ ID NO: 59518 - DNA, 25 bp, mus musculus
cccagcgtgcccaaggtgcccaagg

SEQ ID NO: 59519 - DNA, 25 bp, mus musculus
cagcgtgcccaaggtgcccaagggc

SEQ ID NO: 59520 - DNA, 25 bp, mus musculus
gtgcccaaggtgcccaagggccgca

SEQ ID NO: 59521 - DNA, 25 bp, mus musculus
caaggtgcccaagggccgcaagtga

SEQ ID NO: 59522 - DNA, 25 bp, mus musculus
gtgcccaagggccgcaagtgacgcc

SEQ ID NO: 59523 - DNA, 25 bp, mus musculus
ccgcaagtgacgcccctacggtctg

SEQ ID NO: 59524 - DNA, 25 bp, mus musculus
tattaattccattgcccagatgttg

SEQ ID NO: 59525 - DNA, 25 bp, mus musculus
ttccattgcccagatgttgttatgt

SEQ ID NO: 59526 - DNA, 25 bp, mus musculus
tgtgagtaacccttggacattttat

SEQ ID NO: 59527 - DNA, 25 bp, mus musculus
gacattttatgtcttcctcgtaagg

SEQ ID NO: 59528 - DNA, 25 bp, mus musculus
ttatgtcttcctcgtaaggcacagt

SEQ ID NO: 59529 - DNA, 25 bp, mus musculus
cttcctcgtaaggcacagtgccttg

SEQ ID NO: 59530 - DNA, 25 bp, mus musculus
cctcgtaaggcacagtgccttgctt

SEQ ID NO: 59531 - DNA, 25 bp, mus musculus
aaggcacagtgccttgcttagcaat

SEQ ID NO: 59532 - DNA, 25 bp, mus musculus
gcacagtgccttgcttagcaattgt

SEQ ID NO: 59533 - DNA, 25 bp, mus musculus
cagtgccttgcttagcaattgtttt

SEQ ID NO: 59534 - DNA, 25 bp, mus musculus
gccttttcgtgtcttgaagtggaca

SEQ ID NO: 59535 - DNA, 25 bp, mus musculus
ttttcgtgtcttgaagtggacacat

SEQ ID NO: 59536 - DNA, 25 bp, mus musculus
cattgcccagatgttgttatgttta

SEQ ID NO: 59537 - DNA, 25 bp, mus musculus
gatatcgattcgctaattcactgta

SEQ ID NO: 59538 - DNA, 25 bp, mus musculus
atcgattcgctaattcactgtaata

SEQ ID NO: 59539 - DNA, 25 bp, mus musculus
gattcgctaattcactgtaatatct

SEQ ID NO: 59540 - DNA, 25 bp, mus musculus
tcgctaattcactgtaatatcttaa

SEQ ID NO: 59541 - DNA, 25 bp, mus musculus
agatgcagtcggatggctttcatgg

SEQ ID NO: 59542 - DNA, 25 bp, mus musculus
ttttgtaagcaccgaggagagtaga

SEQ ID NO: 59543 - DNA, 25 bp, mus musculus
tgtaagcaccgaggagagtagaaca

SEQ ID NO: 59544 - DNA, 25 bp, mus musculus
tggactcacaattccaagtactacc

SEQ ID NO: 59545 - DNA, 25 bp, mus musculus
ggactcacaattccaagtactacca

SEQ ID NO: 59546 - DNA, 25 bp, mus musculus
gacagcatggagcccggtgacctct

SEQ ID NO: 59547 - DNA, 25 bp, mus musculus
acagcatggagcccggtgacctctg

SEQ ID NO: 59548 - DNA, 25 bp, mus musculus
agcatggagcccggtgacctctggg

SEQ ID NO: 59549 - DNA, 25 bp, mus musculus
catggagcccggtgacctctgggac

SEQ ID NO: 59550 - DNA, 25 bp, mus musculus
accagaggcgctggcacattctctt

SEQ ID NO: 59551 - DNA, 25 bp, mus musculus
aggcgctggcacattctcttgtcgg

SEQ ID NO: 59552 - DNA, 25 bp, mus musculus
ggcgctggcacattctcttgtcggg

SEQ ID NO: 59553 - DNA, 25 bp, mus musculus
gactcacaattccaagtactaccag

SEQ ID NO: 59554 - DNA, 25 bp, mus musculus
actcacaattccaagtactaccaga

SEQ ID NO: 59555 - DNA, 25 bp, mus musculus
ctcacaattccaagtactaccagaa

SEQ ID NO: 59556 - DNA, 25 bp, mus musculus
tcacaattccaagtactaccagaaa

SEQ ID NO: 59557 - DNA, 25 bp, mus musculus
cacaattccaagtactaccagaaag

SEQ ID NO: 59558 - DNA, 25 bp, mus musculus
caggacagcatggagcccggtgacc

SEQ ID NO: 59559 - DNA, 25 bp, mus musculus
aggacagcatggagcccggtgacct

SEQ ID NO: 59560 - DNA, 25 bp, mus musculus
ggacagcatggagcccggtgacctc

SEQ ID NO: 59561 - DNA, 25 bp, mus musculus
cgattcttccttcaatttagtgttg

SEQ ID NO: 59562 - DNA, 25 bp, mus musculus
taatgacatttatcttacagaaata

SEQ ID NO: 59563 - DNA, 25 bp, mus musculus
attgtgtcagctcctcacatgggaa

SEQ ID NO: 59564 - DNA, 25 bp, mus musculus
gtgtcagctcctcacatgggaatga

SEQ ID NO: 59565 - DNA, 25 bp, mus musculus
tcagctcctcacatgggaatgatat

SEQ ID NO: 59566 - DNA, 25 bp, mus musculus
gctcctcacatgggaatgatattgt

SEQ ID NO: 59567 - DNA, 25 bp, mus musculus
tgtgtgtgacgctctcttaaatgaa

SEQ ID NO: 59568 - DNA, 25 bp, mus musculus
cgctctcttaaatgaatgttgatgg

SEQ ID NO: 59569 - DNA, 25 bp, mus musculus
ctagaaacacgctgatctgtataca

SEQ ID NO: 59570 - DNA, 25 bp, mus musculus
gaaacacgctgatctgtatacactt

SEQ ID NO: 59571 - DNA, 25 bp, mus musculus
cgctgatctgtatacactttcttat

SEQ ID NO: 59572 - DNA, 25 bp, mus musculus
tgatctgtatacactttcttattaa

SEQ ID NO: 59573 - DNA, 25 bp, mus musculus
tggatggatcctcagccagacctac

SEQ ID NO: 59574 - DNA, 25 bp, mus musculus
atggatcctcagccagacctactat

SEQ ID NO: 59575 - DNA, 25 bp, mus musculus
cctcagccagacctactattgcttc

SEQ ID NO: 59576 - DNA, 25 bp, mus musculus
ccagacctactattgcttcaataaa

SEQ ID NO: 59577 - DNA, 25 bp, mus musculus
gacctactattgcttcaataaaagt

SEQ ID NO: 59578 - DNA, 25 bp, mus musculus
agataggcttccaggattgtgtcag

SEQ ID NO: 59579 - DNA, 25 bp, mus musculus
taggcttccaggattgtgtcagctc

SEQ ID NO: 59580 - DNA, 25 bp, mus musculus
gcttccaggattgtgtcagctcctc

SEQ ID NO: 59581 - DNA, 25 bp, mus musculus
gtccctctgactttatcgaccctgg

SEQ ID NO: 59582 - DNA, 25 bp, mus musculus
tgaccagcctgagacagattctcca

SEQ ID NO: 59583 - DNA, 25 bp, mus musculus
ccagcctatgtgcagcctgccttta

SEQ ID NO: 59584 - DNA, 25 bp, mus musculus
gcctatgtgcagcctgcctttagct

SEQ ID NO: 59585 - DNA, 25 bp, mus musculus
tatgtgcagcctgcctttagcttgc

SEQ ID NO: 59586 - DNA, 25 bp, mus musculus
gtgcagcctgcctttagcttgcccc

SEQ ID NO: 59587 - DNA, 25 bp, mus musculus
ttctgtccccagctgtccctttgag

SEQ ID NO: 59588 - DNA, 25 bp, mus musculus
ccccagctgtccctttgaggatctc

SEQ ID NO: 59589 - DNA, 25 bp, mus musculus
cagctgtccctttgaggatctcaaa

SEQ ID NO: 59590 - DNA, 25 bp, mus musculus
ctgtccctttgaggatctcaaagat

SEQ ID NO: 59591 - DNA, 25 bp, mus musculus
tccctttgaggatctcaaagataca

SEQ ID NO: 59592 - DNA, 25 bp, mus musculus
caataaagacctaacctccagcagc

SEQ ID NO: 59593 - DNA, 25 bp, mus musculus
ccagcctgagacagattctccaagc

SEQ ID NO: 59594 - DNA, 25 bp, mus musculus
gacagattctccaagccagagctct

SEQ ID NO: 59595 - DNA, 25 bp, mus musculus
agattctccaagccagagctctctg

SEQ ID NO: 59596 - DNA, 25 bp, mus musculus
ctctctggtactctttgtgttcaac

SEQ ID NO: 59597 - DNA, 25 bp, mus musculus
ggtactctttgtgttcaacaaagct

SEQ ID NO: 59598 - DNA, 25 bp, mus musculus
caacaaagcttgtccccagactatc

SEQ ID NO: 59599 - DNA, 25 bp, mus musculus
agcttgtccccagactatccccagt

SEQ ID NO: 59600 - DNA, 25 bp, mus musculus
ttgtccccagactatccccagtctg

SEQ ID NO: 59601 - DNA, 25 bp, mus musculus
tgtcacagtcaaaaccatcaagaaa

SEQ ID NO: 59602 - DNA, 25 bp, mus musculus
gggcaccgtacgaaccatcaccaag

SEQ ID NO: 59603 - DNA, 25 bp, mus musculus
gttcaccttagcctctgactttgaa

SEQ ID NO: 59604 - DNA, 25 bp, mus musculus
caccttagcctctgactttgaaatt

SEQ ID NO: 59605 - DNA, 25 bp, mus musculus
cttagcctctgactttgaaattggg

SEQ ID NO: 59606 - DNA, 25 bp, mus musculus
agcctctgactttgaaattgggcac

SEQ ID NO: 59607 - DNA, 25 bp, mus musculus
gcacttttttcgtgagcgcatcgtg

SEQ ID NO: 59608 - DNA, 25 bp, mus musculus
ttttcgtgagcgcatcgtgccacgg

SEQ ID NO: 59609 - DNA, 25 bp, mus musculus
tcgtgagcgcatcgtgccacgggct

SEQ ID NO: 59610 - DNA, 25 bp, mus musculus
gccacgggctgtcctctacttcact

SEQ ID NO: 59611 - DNA, 25 bp, mus musculus
acgggctgtcctctacttcactggg

SEQ ID NO: 59612 - DNA, 25 bp, mus musculus
ggctgtcctctacttcactggggag

SEQ ID NO: 59613 - DNA, 25 bp, mus musculus
caccgtacgaaccatcaccaagcaa

SEQ ID NO: 59614 - DNA, 25 bp, mus musculus
aaccatcaccaagcaagtgcccaat

SEQ ID NO: 59615 - DNA, 25 bp, mus musculus
catcaccaagcaagtgcccaatgag

SEQ ID NO: 59616 - DNA, 25 bp, mus musculus
caccaagcaagtgcccaatgagtcc

SEQ ID NO: 59617 - DNA, 25 bp, mus musculus
agtgcccaatgagtccttcttcaac

SEQ ID NO: 59618 - DNA, 25 bp, mus musculus
gcccaatgagtccttcttcaacttc

SEQ ID NO: 59619 - DNA, 25 bp, mus musculus
caatgagtccttcttcaacttcttc

SEQ ID NO: 59620 - DNA, 25 bp, mus musculus
agattccgagttcaccttagcctct

SEQ ID NO: 59621 - DNA, 25 bp, mus musculus
tctgctgtccggaattctctggttt

SEQ ID NO: 59622 - DNA, 25 bp, mus musculus
gctgtccggaattctctggttttct

SEQ ID NO: 59623 - DNA, 25 bp, mus musculus
ctggatttccgctgacaaaattgaa

SEQ ID NO: 59624 - DNA, 25 bp, mus musculus
aattgaagatgctcctgctccttct

SEQ ID NO: 59625 - DNA, 25 bp, mus musculus
tgaagatgctcctgctccttctacc

SEQ ID NO: 59626 - DNA, 25 bp, mus musculus
agatgctcctgctccttctacctcg

SEQ ID NO: 59627 - DNA, 25 bp, mus musculus
tacctcggcagataaaatggagagt

SEQ ID NO: 59628 - DNA, 25 bp, mus musculus
acatctggtgatgggtgacattcca

SEQ ID NO: 59629 - DNA, 25 bp, mus musculus
gggtgacattccagcagctgttaat

SEQ ID NO: 59630 - DNA, 25 bp, mus musculus
tgacattccagcagctgttaatgca

SEQ ID NO: 59631 - DNA, 25 bp, mus musculus
agctgttaatgcattccaggaagca

SEQ ID NO: 59632 - DNA, 25 bp, mus musculus
tgttaatgcattccaggaagcagct

SEQ ID NO: 59633 - DNA, 25 bp, mus musculus
aattctctggttttcttcgcaggca

SEQ ID NO: 59634 - DNA, 25 bp, mus musculus
tgcattccaggaagcagctagtctt

SEQ ID NO: 59635 - DNA, 25 bp, mus musculus
tctctggttttcttcgcaggcagtg

SEQ ID NO: 59636 - DNA, 25 bp, mus musculus
ctggttttcttcgcaggcagtgttc

SEQ ID NO: 59637 - DNA, 25 bp, mus musculus
ttcttcgcaggcagtgttctgccca

SEQ ID NO: 59638 - DNA, 25 bp, mus musculus
ttcgcaggcagtgttctgcccactg

SEQ ID NO: 59639 - DNA, 25 bp, mus musculus
gatggccacagagtctacagccgct

SEQ ID NO: 59640 - DNA, 25 bp, mus musculus
ggccacagagtctacagccgctgct

SEQ ID NO: 59641 - DNA, 25 bp, mus musculus
cacagagtctacagccgctgctgcc

SEQ ID NO: 59642 - DNA, 25 bp, mus musculus
agttgtcaagggcaaggtggaatat

SEQ ID NO: 59643 - DNA, 25 bp, mus musculus
ggacaacacttgggagccagaagag

SEQ ID NO: 59644 - DNA, 25 bp, mus musculus
ctctgatgaggctgacctggtccct

SEQ ID NO: 59645 - DNA, 25 bp, mus musculus
tgaggctgacctggtccctgccaag

SEQ ID NO: 59646 - DNA, 25 bp, mus musculus
tgacctggtccctgccaaggaagcc

SEQ ID NO: 59647 - DNA, 25 bp, mus musculus
ggtccctgccaaggaagccaatgtc

SEQ ID NO: 59648 - DNA, 25 bp, mus musculus
caatgtcaagtgcccacaggttgtc

SEQ ID NO: 59649 - DNA, 25 bp, mus musculus
caagtgcccacaggttgtcatatcc

SEQ ID NO: 59650 - DNA, 25 bp, mus musculus
cccacaggttgtcatatccttctat

SEQ ID NO: 59651 - DNA, 25 bp, mus musculus
ggttgtcatatccttctatgaggaa

SEQ ID NO: 59652 - DNA, 25 bp, mus musculus
catatccttctatgaggaaaggcta

SEQ ID NO: 59653 - DNA, 25 bp, mus musculus
ctacccctcagaggatgatgacaaa

SEQ ID NO: 59654 - DNA, 25 bp, mus musculus
ggattgccctgaccttattgctgag

SEQ ID NO: 59655 - DNA, 25 bp, mus musculus
ccctgaccttattgctgagtttcta

SEQ ID NO: 59656 - DNA, 25 bp, mus musculus
ccttattgctgagtttctacagtca

SEQ ID NO: 59657 - DNA, 25 bp, mus musculus
gtttctacagtcacagaaaacagct

SEQ ID NO: 59658 - DNA, 25 bp, mus musculus
agctgattctgattctgaagataaa

SEQ ID NO: 59659 - DNA, 25 bp, mus musculus
tattggagctactgactccagtgga

SEQ ID NO: 59660 - DNA, 25 bp, mus musculus
tgactccagtggagagctcatgttc

SEQ ID NO: 59661 - DNA, 25 bp, mus musculus
agagctcatgttcctgatgaaatgg

SEQ ID NO: 59662 - DNA, 25 bp, mus musculus
gtcgttacacgtcagcctgccttga

SEQ ID NO: 59663 - DNA, 25 bp, mus musculus
acacgtcagcctgccttgagccaag

SEQ ID NO: 59664 - DNA, 25 bp, mus musculus
aagttcttcctggagctgtgtgtgg

SEQ ID NO: 59665 - DNA, 25 bp, mus musculus
gacgtgcttcggtcttcgaatctgc

SEQ ID NO: 59666 - DNA, 25 bp, mus musculus
gtgcttcggtcttcgaatctgcttc

SEQ ID NO: 59667 - DNA, 25 bp, mus musculus
tcgaatctgcttcacaatgggcttc

SEQ ID NO: 59668 - DNA, 25 bp, mus musculus
aatctgcttcacaatgggcttcagg

SEQ ID NO: 59669 - DNA, 25 bp, mus musculus
ctgcttcacaatgggcttcaggaga

SEQ ID NO: 59670 - DNA, 25 bp, mus musculus
cttcacaatgggcttcaggagatcc

SEQ ID NO: 59671 - DNA, 25 bp, mus musculus
caggagatccagccacaccacgatc

SEQ ID NO: 59672 - DNA, 25 bp, mus musculus
ccacaccacgatcttcctgtggtca

SEQ ID NO: 59673 - DNA, 25 bp, mus musculus
caccacgatcttcctgtggtcaggg

SEQ ID NO: 59674 - DNA, 25 bp, mus musculus
cgtcagcctgccttgagccaagtcc

SEQ ID NO: 59675 - DNA, 25 bp, mus musculus
gtggttgcacacggcgtcaaacaga

SEQ ID NO: 59676 - DNA, 25 bp, mus musculus
cagcctgccttgagccaagtcctgc

SEQ ID NO: 59677 - DNA, 25 bp, mus musculus
cctgccttgagccaagtcctgcttc

SEQ ID NO: 59678 - DNA, 25 bp, mus musculus
agccaagtcctgcttcacctgcaga

SEQ ID NO: 59679 - DNA, 25 bp, mus musculus
gtcctgcttcacctgcagagcgaac

SEQ ID NO: 59680 - DNA, 25 bp, mus musculus
cttcacctgcagagcgaacaggtac

SEQ ID NO: 59681 - DNA, 25 bp, mus musculus
cacctgcagagcgaacaggtacctg

SEQ ID NO: 59682 - DNA, 25 bp, mus musculus
cctggtaagttcttcctggagctgt

SEQ ID NO: 59683 - DNA, 25 bp, mus musculus
atccagcagattgccatggagatgc

SEQ ID NO: 59684 - DNA, 25 bp, mus musculus
accttggagcagctccaagagaagg

SEQ ID NO: 59685 - DNA, 25 bp, mus musculus
cacatcaaaaagcccatggactttt

SEQ ID NO: 59686 - DNA, 25 bp, mus musculus
cccatggactttttcaccatgaagc

SEQ ID NO: 59687 - DNA, 25 bp, mus musculus
gcttaccgctacttgaactttgatg

SEQ ID NO: 59688 - DNA, 25 bp, mus musculus
taccgctacttgaactttgatgatt

SEQ ID NO: 59689 - DNA, 25 bp, mus musculus
gacttcaacctcattgtcagcaact

SEQ ID NO: 59690 - DNA, 25 bp, mus musculus
ttcaacctcattgtcagcaactgcc

SEQ ID NO: 59691 - DNA, 25 bp, mus musculus
aacctcattgtcagcaactgcctaa

SEQ ID NO: 59692 - DNA, 25 bp, mus musculus
attgtcagcaactgcctaaagtata

SEQ ID NO: 59693 - DNA, 25 bp, mus musculus
gtcagcaactgcctaaagtataatg

SEQ ID NO: 59694 - DNA, 25 bp, mus musculus
agcaactgcctaaagtataatgcca

SEQ ID NO: 59695 - DNA, 25 bp, mus musculus
gacacaggcaacatcttcagcgagc

SEQ ID NO: 59696 - DNA, 25 bp, mus musculus
acaggcaacatcttcagcgagccgg

SEQ ID NO: 59697 - DNA, 25 bp, mus musculus
atcttcagcgagccggtccctctgt

SEQ ID NO: 59698 - DNA, 25 bp, mus musculus
ttcagcgagccggtccctctgtctg

SEQ ID NO: 59699 - DNA, 25 bp, mus musculus
gtacccgactacctagaccacatca

SEQ ID NO: 59700 - DNA, 25 bp, mus musculus
gactacctagaccacatcaaaaagc

SEQ ID NO: 59701 - DNA, 25 bp, mus musculus
tacctagaccacatcaaaaagccca

SEQ ID NO: 59702 - DNA, 25 bp, mus musculus
ctagaccacatcaaaaagcccatgg

SEQ ID NO: 59703 - DNA, 25 bp, mus musculus
tactggaccgtcgtgtagtgaatgg

SEQ ID NO: 59704 - DNA, 25 bp, mus musculus
tggaccgtcgtgtagtgaatgggaa

SEQ ID NO: 59705 - DNA, 25 bp, mus musculus
tctcgaccctgaacgaataatcggc

SEQ ID NO: 59706 - DNA, 25 bp, mus musculus
tcgaccctgaacgaataatcggcgc

SEQ ID NO: 59707 - DNA, 25 bp, mus musculus
cgccacagacagcagcggagagtta

SEQ ID NO: 59708 - DNA, 25 bp, mus musculus
aatgtttctcatgaagtggaaggac

SEQ ID NO: 59709 - DNA, 25 bp, mus musculus
gtttctcatgaagtggaaggactcg

SEQ ID NO: 59710 - DNA, 25 bp, mus musculus
cgaggccgacttggtgctggcaaag

SEQ ID NO: 59711 - DNA, 25 bp, mus musculus
ttgtcattgccttctacgaggagcg

SEQ ID NO: 59712 - DNA, 25 bp, mus musculus
cattgccttctacgaggagcggctg

SEQ ID NO: 59713 - DNA, 25 bp, mus musculus
ttgccttctacgaggagcggctgac

SEQ ID NO: 59714 - DNA, 25 bp, mus musculus
tgccttctacgaggagcggctgact

SEQ ID NO: 59715 - DNA, 25 bp, mus musculus
gaaatctttatctgacagtgaatct

SEQ ID NO: 59716 - DNA, 25 bp, mus musculus
aatctttatctgacagtgaatctga

SEQ ID NO: 59717 - DNA, 25 bp, mus musculus
atctttatctgacagtgaatctgat

SEQ ID NO: 59718 - DNA, 25 bp, mus musculus
tttatctgacagtgaatctgatgat

SEQ ID NO: 59719 - DNA, 25 bp, mus musculus
agatgctgctgacaaaccaaggggc

SEQ ID NO: 59720 - DNA, 25 bp, mus musculus
atgctgctgacaaaccaaggggctt

SEQ ID NO: 59721 - DNA, 25 bp, mus musculus
tgctgctgacaaaccaaggggcttt

SEQ ID NO: 59722 - DNA, 25 bp, mus musculus
gtctcgaccctgaacgaataatcgg

SEQ ID NO: 59723 - DNA, 25 bp, mus musculus
ttggagcccctgagcacatttctca

SEQ ID NO: 59724 - DNA, 25 bp, mus musculus
ctgagcacatttctcacctacatga

SEQ ID NO: 59725 - DNA, 25 bp, mus musculus
gccaagtgtcacccactgggccgtt

SEQ ID NO: 59726 - DNA, 25 bp, mus musculus
tgtcacccactgggccgtttcacag

SEQ ID NO: 59727 - DNA, 25 bp, mus musculus
cacccactgggccgtttcacagaga

SEQ ID NO: 59728 - DNA, 25 bp, mus musculus
gaagctgtcaacattgcagagaccc

SEQ ID NO: 59729 - DNA, 25 bp, mus musculus
gaaacaccattagctccattctttc

SEQ ID NO: 59730 - DNA, 25 bp, mus musculus
acaccattagctccattctttcaag

SEQ ID NO: 59731 - DNA, 25 bp, mus musculus
ccattagctccattctttcaagatt

SEQ ID NO: 59732 - DNA, 25 bp, mus musculus
ccattctttcaagattgtatgtctg

SEQ ID NO: 59733 - DNA, 25 bp, mus musculus
tctgaaaacactcttgatgaactga

SEQ ID NO: 59734 - DNA, 25 bp, mus musculus
aacactcttgatgaactgaatattg

SEQ ID NO: 59735 - DNA, 25 bp, mus musculus
agcacatttctcacctacatgacat

SEQ ID NO: 59736 - DNA, 25 bp, mus musculus
acatttctcacctacatgacatgca

SEQ ID NO: 59737 - DNA, 25 bp, mus musculus
ctcacctacatgacatgcagctata

SEQ ID NO: 59738 - DNA, 25 bp, mus musculus
acctacatgacatgcagctatatga

SEQ ID NO: 59739 - DNA, 25 bp, mus musculus
tacatgacatgcagctatatgatag

SEQ ID NO: 59740 - DNA, 25 bp, mus musculus
ataattctacttatgaatggggcct

SEQ ID NO: 59741 - DNA, 25 bp, mus musculus
attctacttatgaatggggccttgc

SEQ ID NO: 59742 - DNA, 25 bp, mus musculus
gttctagccaagtgtcacccactgg

SEQ ID NO: 59743 - DNA, 25 bp, mus musculus
agcagctccattttgataaagaaac

SEQ ID NO: 59744 - DNA, 25 bp, mus musculus
tctcagcgctgggatgaaatgaaca

SEQ ID NO: 59745 - DNA, 25 bp, mus musculus
gacccatctgcagaatcttctctca

SEQ ID NO: 59746 - DNA, 25 bp, mus musculus
tctgcagaatcttctctcaaggtga

SEQ ID NO: 59747 - DNA, 25 bp, mus musculus
gcagaatcttctctcaaggtgactc

SEQ ID NO: 59748 - DNA, 25 bp, mus musculus
tcttctctcaaggtgactcctcagt

SEQ ID NO: 59749 - DNA, 25 bp, mus musculus
tctctcaaggtgactcctcagtcag

SEQ ID NO: 59750 - DNA, 25 bp, mus musculus
ctcaaggtgactcctcagtcagtgg

SEQ ID NO: 59751 - DNA, 25 bp, mus musculus
aaggtgactcctcagtcagtggcag

SEQ ID NO: 59752 - DNA, 25 bp, mus musculus
actcctcagtcagtggcagagaggt

SEQ ID NO: 59753 - DNA, 25 bp, mus musculus
cctcagtcagtggcagagaggtttg

SEQ ID NO: 59754 - DNA, 25 bp, mus musculus
tttgccacaatggacaatttcctcc

SEQ ID NO: 59755 - DNA, 25 bp, mus musculus
atgaacatcttggctacctaccacc

SEQ ID NO: 59756 - DNA, 25 bp, mus musculus
taccaccctgctgacaaagactatg

SEQ ID NO: 59757 - DNA, 25 bp, mus musculus
caccctgctgacaaagactatggct

SEQ ID NO: 59758 - DNA, 25 bp, mus musculus
taccacaggctgcaggacaccgatg

SEQ ID NO: 59759 - DNA, 25 bp, mus musculus
cacaggctgcaggacaccgatgagg

SEQ ID NO: 59760 - DNA, 25 bp, mus musculus
aggctgcaggacaccgatgaggacc

SEQ ID NO: 59761 - DNA, 25 bp, mus musculus
gacaccgatgaggacccatctgcag

SEQ ID NO: 59762 - DNA, 25 bp, mus musculus
gatgaggacccatctgcagaatctt

SEQ ID NO: 59763 - DNA, 25 bp, mus musculus
tcacaccagccaagccttattgctg

SEQ ID NO: 59764 - DNA, 25 bp, mus musculus
cagccaagccttattgctgcctatc

SEQ ID NO: 59765 - DNA, 25 bp, mus musculus
cctttgcagtgctggggatcgaacc

SEQ ID NO: 59766 - DNA, 25 bp, mus musculus
ttgcagtgctggggatcgaacccag

SEQ ID NO: 59767 - DNA, 25 bp, mus musculus
ggatcgaacccagagcctcaaatat

SEQ ID NO: 59768 - DNA, 25 bp, mus musculus
tcgaacccagagcctcaaatatgct

SEQ ID NO: 59769 - DNA, 25 bp, mus musculus
aacccagagcctcaaatatgctagg

SEQ ID NO: 59770 - DNA, 25 bp, mus musculus
ccagagcctcaaatatgctaggcaa

SEQ ID NO: 59771 - DNA, 25 bp, mus musculus
atatgctaggcaagcactctgcccc

SEQ ID NO: 59772 - DNA, 25 bp, mus musculus
tgctaggcaagcactctgcccctga

SEQ ID NO: 59773 - DNA, 25 bp, mus musculus
actctgcccctgagctgctttaaga

SEQ ID NO: 59774 - DNA, 25 bp, mus musculus
ctgcccctgagctgctttaagaaaa

SEQ ID NO: 59775 - DNA, 25 bp, mus musculus
ccaagccttattgctgcctatccct

SEQ ID NO: 59776 - DNA, 25 bp, mus musculus
cttattgctgcctatccctgaccca

SEQ ID NO: 59777 - DNA, 25 bp, mus musculus
attgctgcctatccctgacccagaa

SEQ ID NO: 59778 - DNA, 25 bp, mus musculus
tcctgtccctgcaagagatgggaag

SEQ ID NO: 59779 - DNA, 25 bp, mus musculus
tgtccctgcaagagatgggaaggcc

SEQ ID NO: 59780 - DNA, 25 bp, mus musculus
gaagtttacagcccagaccattccg

SEQ ID NO: 59781 - DNA, 25 bp, mus musculus
tcctctgctagggaagacaacccaa

SEQ ID NO: 59782 - DNA, 25 bp, mus musculus
gacaacccaagctgctaaaactcgg

SEQ ID NO: 59783 - DNA, 25 bp, mus musculus
tcctccatgggatgcatttggacct

SEQ ID NO: 59784 - DNA, 25 bp, mus musculus
tatcctgcgtgttccggaaaaagct

SEQ ID NO: 59785 - DNA, 25 bp, mus musculus
ctcaggcaacagtctccttggaaga

SEQ ID NO: 59786 - DNA, 25 bp, mus musculus
agacccctgtgtgcctcagtattag

SEQ ID NO: 59787 - DNA, 25 bp, mus musculus
ccagatcctgctgatgttgcagaag

SEQ ID NO: 59788 - DNA, 25 bp, mus musculus
cctgctgatgttgcagaaggagggt

SEQ ID NO: 59789 - DNA, 25 bp, mus musculus
tgaatttcttgcatggagatctgat

SEQ ID NO: 59790 - DNA, 25 bp, mus musculus
caccccatcaagacagaagctgtcc

SEQ ID NO: 59791 - DNA, 25 bp, mus musculus
tctaccgaagttagagcatgtatca

SEQ ID NO: 59792 - DNA, 25 bp, mus musculus
tgtatcagttttcccctacagcata

SEQ ID NO: 59793 - DNA, 25 bp, mus musculus
cccctacagcatatttcatatgttt

SEQ ID NO: 59794 - DNA, 25 bp, mus musculus
gattacatcaagctaattgtgcaag

SEQ ID NO: 59795 - DNA, 25 bp, mus musculus
ggaagacctcccaggttcacacaca

SEQ ID NO: 59796 - DNA, 25 bp, mus musculus
aggttcacacacatgcgcagctcag

SEQ ID NO: 59797 - DNA, 25 bp, mus musculus
atgcgcagctcagatctcagaccca

SEQ ID NO: 59798 - DNA, 25 bp, mus musculus
agctcagatctcagacccaacttct

SEQ ID NO: 59799 - DNA, 25 bp, mus musculus
agacccaacttctgaggatgctcct

SEQ ID NO: 59800 - DNA, 25 bp, mus musculus
tgaggatgctcctgtgaggactggt

SEQ ID NO: 59801 - DNA, 25 bp, mus musculus
tgctcctgtgaggactggtgggaaa

SEQ ID NO: 59802 - DNA, 25 bp, mus musculus
aacagcctcaggcaacagtctcctt

SEQ ID NO: 59803 - DNA, 25 bp, mus musculus
ttggtaagcccgctgatcgacactt

SEQ ID NO: 59804 - DNA, 25 bp, mus musculus
tgagtctctcttttctggctgaaga

SEQ ID NO: 59805 - DNA, 25 bp, mus musculus
cagactctgactctcagtgaagttt

SEQ ID NO: 59806 - DNA, 25 bp, mus musculus
ctctcatggatcattgctatcgatg

SEQ ID NO: 59807 - DNA, 25 bp, mus musculus
tggatcattgctatcgatgtcttgt

SEQ ID NO: 59808 - DNA, 25 bp, mus musculus
attgctatcgatgtcttgtatttgc

SEQ ID NO: 59809 - DNA, 25 bp, mus musculus
tttagggcatgctgttcagtgtaat

SEQ ID NO: 59810 - DNA, 25 bp, mus musculus
gcatgctgttcagtgtaatgtgtgg

SEQ ID NO: 59811 - DNA, 25 bp, mus musculus
atacttgtgttgctcatctcagaaa

SEQ ID NO: 59812 - DNA, 25 bp, mus musculus
gtgttgctcatctcagaaacaactg

SEQ ID NO: 59813 - DNA, 25 bp, mus musculus
cctgtcagctcctgttcataaaata

SEQ ID NO: 59814 - DNA, 25 bp, mus musculus
agctcctgttcataaaatagaaggc

SEQ ID NO: 59815 - DNA, 25 bp, mus musculus
ttttactgtgctgtctaatgctgat

SEQ ID NO: 59816 - DNA, 25 bp, mus musculus
gtctaatgctgatcgcctacctctg

SEQ ID NO: 59817 - DNA, 25 bp, mus musculus
tgctgatcgcctacctctggtctga

SEQ ID NO: 59818 - DNA, 25 bp, mus musculus
tcgcctacctctggtctgaagtaca

SEQ ID NO: 59819 - DNA, 25 bp, mus musculus
ctccaccgagttcatcagagtcttc

SEQ ID NO: 59820 - DNA, 25 bp, mus musculus
catcagagtcttcgtcttcatcatc

SEQ ID NO: 59821 - DNA, 25 bp, mus musculus
agtcttcgtcttcatcatcctggtc

SEQ ID NO: 59822 - DNA, 25 bp, mus musculus
cgtcttcatcatcctggtcagactc

SEQ ID NO: 59823 - DNA, 25 bp, mus musculus
ttccagctgcagtttggcagtaact

SEQ ID NO: 59824 - DNA, 25 bp, mus musculus
aactggactgatgtctatggaaccc

SEQ ID NO: 59825 - DNA, 25 bp, mus musculus
gcatgctcagagctcagtcctgcat

SEQ ID NO: 59826 - DNA, 25 bp, mus musculus
tgctcagagctcagtcctgcatctc

SEQ ID NO: 59827 - DNA, 25 bp, mus musculus
tcagagctcagtcctgcatctccac

SEQ ID NO: 59828 - DNA, 25 bp, mus musculus
agtcctgcatctccacatggcagcg

SEQ ID NO: 59829 - DNA, 25 bp, mus musculus
aatataccaggagactccaggctgg

SEQ ID NO: 59830 - DNA, 25 bp, mus musculus
aagcccaaatgccttttatctctct

SEQ ID NO: 59831 - DNA, 25 bp, mus musculus
cccaaatgccttttatctctctctg

SEQ ID NO: 59832 - DNA, 25 bp, mus musculus
cttttatctctctctgtctaataaa

SEQ ID NO: 59833 - DNA, 25 bp, mus musculus
ttatctctctctgtctaataaacta

SEQ ID NO: 59834 - DNA, 25 bp, mus musculus
tctctctctgtctaataaactatgt

SEQ ID NO: 59835 - DNA, 25 bp, mus musculus
tttatagacttccttctggaggacg

SEQ ID NO: 59836 - DNA, 25 bp, mus musculus
gcagtgatctgcctgacttccctga

SEQ ID NO: 59837 - DNA, 25 bp, mus musculus
atctgcctgacttccctgaccttca

SEQ ID NO: 59838 - DNA, 25 bp, mus musculus
tgcctgacttccctgaccttcacta

SEQ ID NO: 59839 - DNA, 25 bp, mus musculus
tccctgaccttcactacaaacaagg

SEQ ID NO: 59840 - DNA, 25 bp, mus musculus
tacttcagtgacactggaggttcag

SEQ ID NO: 59841 - DNA, 25 bp, mus musculus
ggaatgcatgcaccgggcctctgcg

SEQ ID NO: 59842 - DNA, 25 bp, mus musculus
atgcatgcaccgggcctctgcgtca

SEQ ID NO: 59843 - DNA, 25 bp, mus musculus
agcagagacctcctcagcctggagg

SEQ ID NO: 59844 - DNA, 25 bp, mus musculus
gacctcctcagcctggaggaaacca

SEQ ID NO: 59845 - DNA, 25 bp, mus musculus
gacctcctcagccaggaaaccatca

SEQ ID NO: 59846 - DNA, 25 bp, mus musculus
ctcagccaggaaaccatcaaggccc

SEQ ID NO: 59847 - DNA, 25 bp, mus musculus
caggaaaccatcaaggcccacctca

SEQ ID NO: 59848 - DNA, 25 bp, mus musculus
aaggcccacctcagcatggaaacaa

SEQ ID NO: 59849 - DNA, 25 bp, mus musculus
cacctcagcatggaaacaatgaaca

SEQ ID NO: 59850 - DNA, 25 bp, mus musculus
atgaacagccaagttacctgtggtc

SEQ ID NO: 59851 - DNA, 25 bp, mus musculus
tgtggtcactttttgcttaaccatc

SEQ ID NO: 59852 - DNA, 25 bp, mus musculus
aaccatctcattccttaccagagag

SEQ ID NO: 59853 - DNA, 25 bp, mus musculus
agatgacttcaataccattcttata

SEQ ID NO: 59854 - DNA, 25 bp, mus musculus
taccattcttatagcagaatgatgt

SEQ ID NO: 59855 - DNA, 25 bp, mus musculus
ctcctccaaggcctggaaaccagca

SEQ ID NO: 59856 - DNA, 25 bp, mus musculus
gaggcccccagcagagacccactca

SEQ ID NO: 59857 - DNA, 25 bp, mus musculus
cccagcagagacccactcagcctgg

SEQ ID NO: 59858 - DNA, 25 bp, mus musculus
ccactcagcctggaaaccaacaagg

SEQ ID NO: 59859 - DNA, 25 bp, mus musculus
ctcctaggcctggaaaccagcaagg

SEQ ID NO: 59860 - DNA, 25 bp, mus musculus
gacctcctaggactggaaaccagca

SEQ ID NO: 59861 - DNA, 25 bp, mus musculus
cacccccacagggaggccctcagag

SEQ ID NO: 59862 - DNA, 25 bp, mus musculus
ctcagagacctcctcagccaggaaa

SEQ ID NO: 59863 - DNA, 25 bp, mus musculus
ataccattcttatagcagaatgatg

SEQ ID NO: 59864 - DNA, 25 bp, mus musculus
ataccattcttatagcagaatgatg

SEQ ID NO: 59865 - DNA, 25 bp, mus musculus
taccattcttatagcagaatgatgt

SEQ ID NO: 59866 - DNA, 25 bp, mus musculus
tcatgtgtgtctggtctgtgagcat

SEQ ID NO: 59867 - DNA, 25 bp, mus musculus
gtgtctggtctgtgagcatgggcaa

SEQ ID NO: 59868 - DNA, 25 bp, mus musculus
aaatcagccacggcttgttagaggg

SEQ ID NO: 59869 - DNA, 25 bp, mus musculus
gctcccatgtgctaggcactgtgct

SEQ ID NO: 59870 - DNA, 25 bp, mus musculus
gaatgccaaatcctcgatcaccttc

SEQ ID NO: 59871 - DNA, 25 bp, mus musculus
ctcgatcaccttctggttggcagaa

SEQ ID NO: 59872 - DNA, 25 bp, mus musculus
caccttctggttggcagaaacaagg

SEQ ID NO: 59873 - DNA, 25 bp, mus musculus
ttctgggccagctctgcttaactgg

SEQ ID NO: 59874 - DNA, 25 bp, mus musculus
tctgcttaactggccatttctcctt

SEQ ID NO: 59875 - DNA, 25 bp, mus musculus
tggccttcctgtgctatttgtacct

SEQ ID NO: 59876 - DNA, 25 bp, mus musculus
tcctgtgctatttgtacctgaggtt

SEQ ID NO: 59877 - DNA, 25 bp, mus musculus
gctatttgtacctgaggttcacact

SEQ ID NO: 59878 - DNA, 25 bp, mus musculus
gtgcctgccaatcacatgagtctgg

SEQ ID NO: 59879 - DNA, 25 bp, mus musculus
cacatgagtctgggctcactgctta

SEQ ID NO: 59880 - DNA, 25 bp, mus musculus
agtctgggctcactgcttaggacaa

SEQ ID NO: 59881 - DNA, 25 bp, mus musculus
cagtgagcagacagcccgagttcaa

SEQ ID NO: 59882 - DNA, 25 bp, mus musculus
agttcaagtcatcaccctgtagcac

SEQ ID NO: 59883 - DNA, 25 bp, mus musculus
gtagcacagtactgtgtgtgacttt

SEQ ID NO: 59884 - DNA, 25 bp, mus musculus
cagtactgtgtgtgactttggccaa

SEQ ID NO: 59885 - DNA, 25 bp, mus musculus
gataaattctcttccttataaatga

SEQ ID NO: 59886 - DNA, 25 bp, mus musculus
agctgctaaaccaggctgacccctg

SEQ ID NO: 59887 - DNA, 25 bp, mus musculus
taaaccaggctgacccctgtgtcca

SEQ ID NO: 59888 - DNA, 25 bp, mus musculus
agatccacatcagtgtatctgaacc

SEQ ID NO: 59889 - DNA, 25 bp, mus musculus
cagtgtatctgaacccattattcca

SEQ ID NO: 59890 - DNA, 25 bp, mus musculus
gtatctgaacccattattccattca

SEQ ID NO: 59891 - DNA, 25 bp, mus musculus
atctgaacccattattccattcaga

SEQ ID NO: 59892 - DNA, 25 bp, mus musculus
ctgaacccattattccattcagaga

SEQ ID NO: 59893 - DNA, 25 bp, mus musculus
gaacccattattccattcagagaaa

SEQ ID NO: 59894 - DNA, 25 bp, mus musculus
ccattattccattcagagaaacgat

SEQ ID NO: 59895 - DNA, 25 bp, mus musculus
attattccattcagagaaacgatca

SEQ ID NO: 59896 - DNA, 25 bp, mus musculus
tattccattcagagaaacgatcaca

SEQ ID NO: 59897 - DNA, 25 bp, mus musculus
cctcccaaagttgacatggtcaatg

SEQ ID NO: 59898 - DNA, 25 bp, mus musculus
agagcatgtcctggtcacggccggg

SEQ ID NO: 59899 - DNA, 25 bp, mus musculus
agcaaagcaaaatcccagaggggat

SEQ ID NO: 59900 - DNA, 25 bp, mus musculus
ggaggtccaccttcagcgatgtttg

SEQ ID NO: 59901 - DNA, 25 bp, mus musculus
gtccaccttcagcgatgtttggatg

SEQ ID NO: 59902 - DNA, 25 bp, mus musculus
ccaccttcagcgatgtttggatgac

SEQ ID NO: 59903 - DNA, 25 bp, mus musculus
accttcagcgatgtttggatgactt

SEQ ID NO: 59904 - DNA, 25 bp, mus musculus
cttcagcgatgtttggatgacttac

SEQ ID NO: 59905 - DNA, 25 bp, mus musculus
ttgcaaagatccacatcagtgtatc

SEQ ID NO: 59906 - DNA, 25 bp, mus musculus
gcaaagatccacatcagtgtatctg

SEQ ID NO: 59907 - DNA, 25 bp, mus musculus
aggacacttcacattatactggaac

SEQ ID NO: 59908 - DNA, 25 bp, mus musculus
acacttcacattatactggaacact

SEQ ID NO: 59909 - DNA, 25 bp, mus musculus
tgcctccttatactaacaggcaagt

SEQ ID NO: 59910 - DNA, 25 bp, mus musculus
ctccttatactaacaggcaagtagg

SEQ ID NO: 59911 - DNA, 25 bp, mus musculus
aattctgcatggtctaagtctttgt

SEQ ID NO: 59912 - DNA, 25 bp, mus musculus
ttcatgcagccagcattgcaggtta

SEQ ID NO: 59913 - DNA, 25 bp, mus musculus
tctaattgttcatcctaatggttct

SEQ ID NO: 59914 - DNA, 25 bp, mus musculus
ttcttgttttcatctagtcatggag

SEQ ID NO: 59915 - DNA, 25 bp, mus musculus
gattcagtaagtgccttggaagaat

SEQ ID NO: 59916 - DNA, 25 bp, mus musculus
tcagtaagtgccttggaagaatatt

SEQ ID NO: 59917 - DNA, 25 bp, mus musculus
ctcttagctcgtgtgtgttacttta

SEQ ID NO: 59918 - DNA, 25 bp, mus musculus
tgaattcaactggggttagaagact

SEQ ID NO: 59919 - DNA, 25 bp, mus musculus
attatactggaacactcgaagtcca

SEQ ID NO: 59920 - DNA, 25 bp, mus musculus
atactggaacactcgaagtccactg

SEQ ID NO: 59921 - DNA, 25 bp, mus musculus
cactcgaagtccactgaaagccagg

SEQ ID NO: 59922 - DNA, 25 bp, mus musculus
tcgaagtccactgaaagccaggctt

SEQ ID NO: 59923 - DNA, 25 bp, mus musculus
tccactgaaagccaggcttatagta

SEQ ID NO: 59924 - DNA, 25 bp, mus musculus
gcttatagtattccatctttaatgt

SEQ ID NO: 59925 - DNA, 25 bp, mus musculus
attccatctttaatgtgggagctag

SEQ ID NO: 59926 - DNA, 25 bp, mus musculus
acctgcctccttatactaacaggca

SEQ ID NO: 59927 - DNA, 25 bp, mus musculus
cttgattttctcatccctgctgctt

SEQ ID NO: 59928 - DNA, 25 bp, mus musculus
gattttctcatccctgctgctttag

SEQ ID NO: 59929 - DNA, 25 bp, mus musculus
gatcctctataatgctggtgagaac

SEQ ID NO: 59930 - DNA, 25 bp, mus musculus
cctctataatgctggtgagaacaaa

SEQ ID NO: 59931 - DNA, 25 bp, mus musculus
agacaaattcaccgaggtcttgtgt

SEQ ID NO: 59932 - DNA, 25 bp, mus musculus
attcaccgaggtcttgtgtctacgg

SEQ ID NO: 59933 - DNA, 25 bp, mus musculus
cgaggtcttgtgtctacggagcttc

SEQ ID NO: 59934 - DNA, 25 bp, mus musculus
ggtcttgtgtctacggagcttcccg

SEQ ID NO: 59935 - DNA, 25 bp, mus musculus
tctacggagcttcccgcagctgaaa

SEQ ID NO: 59936 - DNA, 25 bp, mus musculus
gagcttcccgcagctgaaactaaca

SEQ ID NO: 59937 - DNA, 25 bp, mus musculus
cttcccgcagctgaaactaacattt

SEQ ID NO: 59938 - DNA, 25 bp, mus musculus
cccgcagctgaaactaacatttgat

SEQ ID NO: 59939 - DNA, 25 bp, mus musculus
ctcatccctgctgctttagggtaga

SEQ ID NO: 59940 - DNA, 25 bp, mus musculus
atccctgctgctttagggtagaaga

SEQ ID NO: 59941 - DNA, 25 bp, mus musculus
cctgctgctttagggtagaagagat

SEQ ID NO: 59942 - DNA, 25 bp, mus musculus
tgaacatctggccaaaaaggatgct

SEQ ID NO: 59943 - DNA, 25 bp, mus musculus
acatctggccaaaaaggatgctcag

SEQ ID NO: 59944 - DNA, 25 bp, mus musculus
ggatgctcagatcctctataatgct

SEQ ID NO: 59945 - DNA, 25 bp, mus musculus
tgctcagatcctctataatgctggt

SEQ ID NO: 59946 - DNA, 25 bp, mus musculus
tcagatcctctataatgctggtgag

SEQ ID NO: 59947 - DNA, 25 bp, mus musculus
tttattaggtcttctcaccttagag

SEQ ID NO: 59948 - DNA, 25 bp, mus musculus
ttaggtcttctcaccttagagaaca

SEQ ID NO: 59949 - DNA, 25 bp, mus musculus
gctcctaccttagagcccatcagaa

SEQ ID NO: 59950 - DNA, 25 bp, mus musculus
tcctaccttagagcccatcagaaaa

SEQ ID NO: 59951 - DNA, 25 bp, mus musculus
tatgacaaacccaatacccaggact

SEQ ID NO: 59952 - DNA, 25 bp, mus musculus
atttatccagtattctatctgctta

SEQ ID NO: 59953 - DNA, 25 bp, mus musculus
ttatccagtattctatctgcttata

SEQ ID NO: 59954 - DNA, 25 bp, mus musculus
ccagtattctatctgcttataagtc

SEQ ID NO: 59955 - DNA, 25 bp, mus musculus
agtattctatctgcttataagtcat

SEQ ID NO: 59956 - DNA, 25 bp, mus musculus
tattctatctgcttataagtcataa

SEQ ID NO: 59957 - DNA, 25 bp, mus musculus
ttctatctgcttataagtcataaga

SEQ ID NO: 59958 - DNA, 25 bp, mus musculus
ctatctgcttataagtcataagaat

SEQ ID NO: 59959 - DNA, 25 bp, mus musculus
aggtcttctcaccttagagaacatc

SEQ ID NO: 59960 - DNA, 25 bp, mus musculus
cttctcaccttagagaacatcagaa

SEQ ID NO: 59961 - DNA, 25 bp, mus musculus
tctcaccttagagaacatcagaaaa

SEQ ID NO: 59962 - DNA, 25 bp, mus musculus
acatatcatttagccagatttcaaa

SEQ ID NO: 59963 - DNA, 25 bp, mus musculus
atatcatttagccagatttcaaatc

SEQ ID NO: 59964 - DNA, 25 bp, mus musculus
ctcataactcaaattttagaacaca

SEQ ID NO: 59965 - DNA, 25 bp, mus musculus
aaccttatagatgtgccgaatgtga

SEQ ID NO: 59966 - DNA, 25 bp, mus musculus
tttactaggtgctcctaccttagag

SEQ ID NO: 59967 - DNA, 25 bp, mus musculus
gactcaggtcccatgtagtgacctg

SEQ ID NO: 59968 - DNA, 25 bp, mus musculus
tcaggtcccatgtagtgacctgctg

SEQ ID NO: 59969 - DNA, 25 bp, mus musculus
gaatcaactggactatatcatccgc

SEQ ID NO: 59970 - DNA, 25 bp, mus musculus
actggactatatcatccgcagccat

SEQ ID NO: 59971 - DNA, 25 bp, mus musculus
ggactatatcatccgcagccatgaa

SEQ ID NO: 59972 - DNA, 25 bp, mus musculus
ctatatcatccgcagccatgaagtc

SEQ ID NO: 59973 - DNA, 25 bp, mus musculus
tatcatccgcagccatgaagtcaaa

SEQ ID NO: 59974 - DNA, 25 bp, mus musculus
catccgcagccatgaagtcaaagcc

SEQ ID NO: 59975 - DNA, 25 bp, mus musculus
tgaagtcaaagccgagggcgacgag

SEQ ID NO: 59976 - DNA, 25 bp, mus musculus
tggtggccgctgtgtcactgtcttt

SEQ ID NO: 59977 - DNA, 25 bp, mus musculus
caactattgtgaccagatgggaaac

SEQ ID NO: 59978 - DNA, 25 bp, mus musculus
ctattgtgaccagatgggaaacaaa

SEQ ID NO: 59979 - DNA, 25 bp, mus musculus
cccatgtagtgacctgctgtagtca

SEQ ID NO: 59980 - DNA, 25 bp, mus musculus
atgtagtgacctgctgtagtcagat

SEQ ID NO: 59981 - DNA, 25 bp, mus musculus
gagttgccagtttgggcctgatgtc

SEQ ID NO: 59982 - DNA, 25 bp, mus musculus
ttgccagtttgggcctgatgtcacc

SEQ ID NO: 59983 - DNA, 25 bp, mus musculus
tgggcctgatgtcaccaaggccttc

SEQ ID NO: 59984 - DNA, 25 bp, mus musculus
gcctgatgtcaccaaggccttcctg

SEQ ID NO: 59985 - DNA, 25 bp, mus musculus
tgatgtcaccaaggccttcctggag

SEQ ID NO: 59986 - DNA, 25 bp, mus musculus
caaggccttcctggaggagaatcaa

SEQ ID NO: 59987 - DNA, 25 bp, mus musculus
ggtgatctcatcctacagatggtct

SEQ ID NO: 59988 - DNA, 25 bp, mus musculus
ctcatcctacagatggtctcggagt

SEQ ID NO: 59989 - DNA, 25 bp, mus musculus
tacatcaacagaagccccggggctg

SEQ ID NO: 59990 - DNA, 25 bp, mus musculus
gggccctccgtagtgcactgcagcg

SEQ ID NO: 59991 - DNA, 25 bp, mus musculus
gaccggatcctccagcagttggact

SEQ ID NO: 59992 - DNA, 25 bp, mus musculus
atcctccagcagttggactctaagg

SEQ ID NO: 59993 - DNA, 25 bp, mus musculus
ttggactctaaggactccgtggaca

SEQ ID NO: 59994 - DNA, 25 bp, mus musculus
tctaaggactccgtggacatttatg

SEQ ID NO: 59995 - DNA, 25 bp, mus musculus
gactccgtggacatttatggggcag

SEQ ID NO: 59996 - DNA, 25 bp, mus musculus
gtgcatgacctaagactccacaggg

SEQ ID NO: 59997 - DNA, 25 bp, mus musculus
gacctaagactccacagggttcaca

SEQ ID NO: 59998 - DNA, 25 bp, mus musculus
agactccacagggttcacatggtcc

SEQ ID NO: 59999 - DNA, 25 bp, mus musculus
ttggatgcacacagactcatccgtc

SEQ ID NO: 60000 - DNA, 25 bp, mus musculus
aatctactcgagacattaagaattc

SEQ ID NO: 60001 - DNA, 25 bp, mus musculus
gcacacagactcatccgtcactttc

SEQ ID NO: 60002 - DNA, 25 bp, mus musculus
agactcatccgtcactttcactaca

SEQ ID NO: 60003 - DNA, 25 bp, mus musculus
atccgtcactttcactacacggtgt

SEQ ID NO: 60004 - DNA, 25 bp, mus musculus
cactacacggtgtggccagaccatg

SEQ ID NO: 60005 - DNA, 25 bp, mus musculus
tggccagaccatggggtcccagaga

SEQ ID NO: 60006 - DNA, 25 bp, mus musculus
cagtccctgatccaatttgtgagga

SEQ ID NO: 60007 - DNA, 25 bp, mus musculus
agggactacatcaacagaagccccg

SEQ ID NO: 60008 - DNA, 25 bp, mus musculus
tcctgcccagctgtgtccacagtac

SEQ ID NO: 60009 - DNA, 25 bp, mus musculus
catcatcagcagaattttcaggatt

SEQ ID NO: 60010 - DNA, 25 bp, mus musculus
acaccagagaactgtggatgtcttc

SEQ ID NO: 60011 - DNA, 25 bp, mus musculus
tgtggatgtcttccatgctgtcaag

SEQ ID NO: 60012 - DNA, 25 bp, mus musculus
tgtcttccatgctgtcaagacattg

SEQ ID NO: 60013 - DNA, 25 bp, mus musculus
ccatgctgtcaagacattgaggaac

SEQ ID NO: 60014 - DNA, 25 bp, mus musculus
accaaacatggtggacctcctggat

SEQ ID NO: 60015 - DNA, 25 bp, mus musculus
tcagtacaagttctgctatgaggtg

SEQ ID NO: 60016 - DNA, 25 bp, mus musculus
cctgaattcgggctgacagcatcag

SEQ ID NO: 60017 - DNA, 25 bp, mus musculus
ctgacagcatcagcagccccgcaga

SEQ ID NO: 60018 - DNA, 25 bp, mus musculus
ggagttctacagtgtccgtgacgat

SEQ ID NO: 60019 - DNA, 25 bp, mus musculus
tgtccgtgacgatcagaactgtcag

SEQ ID NO: 60020 - DNA, 25 bp, mus musculus
ggttcagcagttccagttcctgggc

SEQ ID NO: 60021 - DNA, 25 bp, mus musculus
ctccttcttgaagctcatacgccag

SEQ ID NO: 60022 - DNA, 25 bp, mus musculus
gctcatacgccaggtggacaagtgg

SEQ ID NO: 60023 - DNA, 25 bp, mus musculus
tggtacattctgtgccatcagcatt

SEQ ID NO: 60024 - DNA, 25 bp, mus musculus
tgccatcagcattgtctgtgagatg

SEQ ID NO: 60025 - DNA, 25 bp, mus musculus
tgtctgtgagatgctccgacaccag

SEQ ID NO: 60026 - DNA, 25 bp, mus musculus
tgagatgctccgacaccagagaact

SEQ ID NO: 60027 - DNA, 25 bp, mus musculus
gctccgacaccagagaactgtggat

SEQ ID NO: 60028 - DNA, 25 bp, mus musculus
agtgtctccaagaggctgaaaaaag

SEQ ID NO: 60029 - DNA, 25 bp, mus musculus
gatgaagccactcaatttggtctta

SEQ ID NO: 60030 - DNA, 25 bp, mus musculus
acctcctaccacagtacaagcaact

SEQ ID NO: 60031 - DNA, 25 bp, mus musculus
taccacagtacaagcaactacaatg

SEQ ID NO: 60032 - DNA, 25 bp, mus musculus
agcaactacaatgccagctgccagt

SEQ ID NO: 60033 - DNA, 25 bp, mus musculus
tacaatgccagctgccagtatctcc

SEQ ID NO: 60034 - DNA, 25 bp, mus musculus
gccagctgccagtatctccataact

SEQ ID NO: 60035 - DNA, 25 bp, mus musculus
tgccagtatctccataactactcct

SEQ ID NO: 60036 - DNA, 25 bp, mus musculus
cataactactcctactgctagagat

SEQ ID NO: 60037 - DNA, 25 bp, mus musculus
tactcctactgctagagattccact

SEQ ID NO: 60038 - DNA, 25 bp, mus musculus
tactgctagagattccactgatatt

SEQ ID NO: 60039 - DNA, 25 bp, mus musculus
tctttacctaagcattattcaaaat

SEQ ID NO: 60040 - DNA, 25 bp, mus musculus
caatttggtcttaggcctctgcatt

SEQ ID NO: 60041 - DNA, 25 bp, mus musculus
ggtcttaggcctctgcattcttgta

SEQ ID NO: 60042 - DNA, 25 bp, mus musculus
tcttgtaggatgcttcctgtcctgt

SEQ ID NO: 60043 - DNA, 25 bp, mus musculus
tgagtgtcacagaggccctagaaga

SEQ ID NO: 60044 - DNA, 25 bp, mus musculus
tcacagaggccctagaagacatgat

SEQ ID NO: 60045 - DNA, 25 bp, mus musculus
acatcctagacctccaagcaatccg

SEQ ID NO: 60046 - DNA, 25 bp, mus musculus
tagacctccaagcaatccgtctcct

SEQ ID NO: 60047 - DNA, 25 bp, mus musculus
tactccaagcattcctcctaccgga

SEQ ID NO: 60048 - DNA, 25 bp, mus musculus
atcagctacccacggacagaaacca

SEQ ID NO: 60049 - DNA, 25 bp, mus musculus
cactatcccgagaactttgacctga

SEQ ID NO: 60050 - DNA, 25 bp, mus musculus
atcacccatactgggcagactcggt

SEQ ID NO: 60051 - DNA, 25 bp, mus musculus
acgcatggagactctacgagtatat

SEQ ID NO: 60052 - DNA, 25 bp, mus musculus
tctacgagtatatcaccagacactt

SEQ ID NO: 60053 - DNA, 25 bp, mus musculus
agtatatcaccagacacttcattgc

SEQ ID NO: 60054 - DNA, 25 bp, mus musculus
atatcaccagacacttcattgccac

SEQ ID NO: 60055 - DNA, 25 bp, mus musculus
gacacttcattgccacagtgagcca

SEQ ID NO: 60056 - DNA, 25 bp, mus musculus
acttcattgccacagtgagccatga

SEQ ID NO: 60057 - DNA, 25 bp, mus musculus
tcattgccacagtgagccatgactg

SEQ ID NO: 60058 - DNA, 25 bp, mus musculus
ccacagtgagccatgactgcaagta

SEQ ID NO: 60059 - DNA, 25 bp, mus musculus
cagtgagccatgactgcaagtatct

SEQ ID NO: 60060 - DNA, 25 bp, mus musculus
tatcccgagaactttgacctgaagg

SEQ ID NO: 60061 - DNA, 25 bp, mus musculus
atgactgcaagtatctccagagcac

SEQ ID NO: 60062 - DNA, 25 bp, mus musculus
gagaactttgacctgaagggctctt

SEQ ID NO: 60063 - DNA, 25 bp, mus musculus
tttgacctgaagggctctttgcgac

SEQ ID NO: 60064 - DNA, 25 bp, mus musculus
aagggctctttgcgacacaggccaa

SEQ ID NO: 60065 - DNA, 25 bp, mus musculus
ttgcgacacaggccaatcacccata

SEQ ID NO: 60066 - DNA, 25 bp, mus musculus
cgacacaggccaatcacccatactg

SEQ ID NO: 60067 - DNA, 25 bp, mus musculus
cacaggccaatcacccatactgggc

SEQ ID NO: 60068 - DNA, 25 bp, mus musculus
ccaatcacccatactgggcagactc

SEQ ID NO: 60069 - DNA, 25 bp, mus musculus
tttgtcctctgggttcttataggat

SEQ ID NO: 60070 - DNA, 25 bp, mus musculus
ataggatgtttcctgtctggtgagt

SEQ ID NO: 60071 - DNA, 25 bp, mus musculus
cattctttatccctttatgctcctc

SEQ ID NO: 60072 - DNA, 25 bp, mus musculus
gtaatacaaccttcaagtattatag

SEQ ID NO: 60073 - DNA, 25 bp, mus musculus
actctaagttcagatcctagccctc

SEQ ID NO: 60074 - DNA, 25 bp, mus musculus
gatcctagccctcaaagaaattgtc

SEQ ID NO: 60075 - DNA, 25 bp, mus musculus
ataccagggccaataactgcacaac

SEQ ID NO: 60076 - DNA, 25 bp, mus musculus
gggccaataactgcacaactactgc

SEQ ID NO: 60077 - DNA, 25 bp, mus musculus
gcacaactactgccaaagctcaaaa

SEQ ID NO: 60078 - DNA, 25 bp, mus musculus
ctactgccaaagctcaaaattccac

SEQ ID NO: 60079 - DNA, 25 bp, mus musculus
tgaattccttttggcagtcaagaca

SEQ ID NO: 60080 - DNA, 25 bp, mus musculus
ccttttggcagtcaagacagcataa

SEQ ID NO: 60081 - DNA, 25 bp, mus musculus
tgtcacagagcacccagaggacaac

SEQ ID NO: 60082 - DNA, 25 bp, mus musculus
ggacaacatggtcctagaagaacat

SEQ ID NO: 60083 - DNA, 25 bp, mus musculus
agaacattagctccttcaactcacc

SEQ ID NO: 60084 - DNA, 25 bp, mus musculus
ttagctccttcaactcaccatcgtc

SEQ ID NO: 60085 - DNA, 25 bp, mus musculus
catcgtcattatcatctttatcctc

SEQ ID NO: 60086 - DNA, 25 bp, mus musculus
cattatcatctttatcctctgccag

SEQ ID NO: 60087 - DNA, 25 bp, mus musculus
catctttatcctctgccagatccca

SEQ ID NO: 60088 - DNA, 25 bp, mus musculus
tatcctctgccagatcccaatcatg

SEQ ID NO: 60089 - DNA, 25 bp, mus musculus
ttattctaagattgctgggcaatta

SEQ ID NO: 60090 - DNA, 25 bp, mus musculus
aaatttcctcaaaggagaagtgcag

SEQ ID NO: 60091 - DNA, 25 bp, mus musculus
gaacttcctgtttatcacctatgag

SEQ ID NO: 60092 - DNA, 25 bp, mus musculus
cctgtttatcacctatgaggagctg

SEQ ID NO: 60093 - DNA, 25 bp, mus musculus
gtttatcacctatgaggagctgcag

SEQ ID NO: 60094 - DNA, 25 bp, mus musculus
tatcacctatgaggagctgcagcag

SEQ ID NO: 60095 - DNA, 25 bp, mus musculus
ctatgaggagctgcagcaggacctg

SEQ ID NO: 60096 - DNA, 25 bp, mus musculus
aggctccgtgcaacgcatctgtgag

SEQ ID NO: 60097 - DNA, 25 bp, mus musculus
gcaacgcatctgtgagttcctgggc

SEQ ID NO: 60098 - DNA, 25 bp, mus musculus
acgcatctgtgagttcctgggccgg

SEQ ID NO: 60099 - DNA, 25 bp, mus musculus
catctgtgagttcctgggccggcca

SEQ ID NO: 60100 - DNA, 25 bp, mus musculus
ccggccactgggtgaagaggccctg

SEQ ID NO: 60101 - DNA, 25 bp, mus musculus
agtgcagtttggctcctggtttgac

SEQ ID NO: 60102 - DNA, 25 bp, mus musculus
tgaagaggccctgagctctgtggtg

SEQ ID NO: 60103 - DNA, 25 bp, mus musculus
gtttggctcctggtttgaccacatc

SEQ ID NO: 60104 - DNA, 25 bp, mus musculus
tggctcctggtttgaccacatcaag

SEQ ID NO: 60105 - DNA, 25 bp, mus musculus
ctcctggtttgaccacatcaagggc

SEQ ID NO: 60106 - DNA, 25 bp, mus musculus
gtttgaccacatcaagggctggatc

SEQ ID NO: 60107 - DNA, 25 bp, mus musculus
tgaccacatcaagggctggatccgg

SEQ ID NO: 60108 - DNA, 25 bp, mus musculus
ccacatcaagggctggatccggatg

SEQ ID NO: 60109 - DNA, 25 bp, mus musculus
agagaacttcctgtttatcacctat

SEQ ID NO: 60110 - DNA, 25 bp, mus musculus
catcatttaaacttcctgcagaggc

SEQ ID NO: 60111 - DNA, 25 bp, mus musculus
tcatttaaacttcctgcagaggcac

SEQ ID NO: 60112 - DNA, 25 bp, mus musculus
aaatggtcacagctgctggagcgca

SEQ ID NO: 60113 - DNA, 25 bp, mus musculus
ggtcacagctgctggagcgcagttc

SEQ ID NO: 60114 - DNA, 25 bp, mus musculus
tcacagctgctggagcgcagttcta

SEQ ID NO: 60115 - DNA, 25 bp, mus musculus
acagctgctggagcgcagttctaat

SEQ ID NO: 60116 - DNA, 25 bp, mus musculus
agctgctggagcgcagttctaatgg

SEQ ID NO: 60117 - DNA, 25 bp, mus musculus
atacctgaagtgcaagcagaatgga

SEQ ID NO: 60118 - DNA, 25 bp, mus musculus
gggcaaacgatgcgctcctgcggat

SEQ ID NO: 60119 - DNA, 25 bp, mus musculus
gcaaacgatgcgctcctgcggatgg

SEQ ID NO: 60120 - DNA, 25 bp, mus musculus
aaacgatgcgctcctgcggatggtg

SEQ ID NO: 60121 - DNA, 25 bp, mus musculus
acgatgcgctcctgcggatggtgtg

SEQ ID NO: 60122 - DNA, 25 bp, mus musculus
atttaaacttcctgcagaggcacaa

SEQ ID NO: 60123 - DNA, 25 bp, mus musculus
acttcctgcagaggcacaaacgcca

SEQ ID NO: 60124 - DNA, 25 bp, mus musculus
ttcctgcagaggcacaaacgccaga

SEQ ID NO: 60125 - DNA, 25 bp, mus musculus
cagaggcacaaacgccagacgtgaa

SEQ ID NO: 60126 - DNA, 25 bp, mus musculus
gaggcacaaacgccagacgtgaaaa

SEQ ID NO: 60127 - DNA, 25 bp, mus musculus
ggcacaaacgccagacgtgaaaaat

SEQ ID NO: 60128 - DNA, 25 bp, mus musculus
cacaaacgccagacgtgaaaaatga

SEQ ID NO: 60129 - DNA, 25 bp, mus musculus
tgaaatggtcacagctgctggagcg

SEQ ID NO: 60130 - DNA, 25 bp, mus musculus
aggcttctgcctcaagggtgctgcc

SEQ ID NO: 60131 - DNA, 25 bp, mus musculus
ctgcctcaagggtgctgccaccctt

SEQ ID NO: 60132 - DNA, 25 bp, mus musculus
tggcctgcatctgtgagaccacagg

SEQ ID NO: 60133 - DNA, 25 bp, mus musculus
gcatctgtgagaccacaggtactca

SEQ ID NO: 60134 - DNA, 25 bp, mus musculus
gtgagaccacaggtactcatccctt

SEQ ID NO: 60135 - DNA, 25 bp, mus musculus
ccacaggtactcatcccttcctgat

SEQ ID NO: 60136 - DNA, 25 bp, mus musculus
atcccttcctgatctccatttgtct

SEQ ID NO: 60137 - DNA, 25 bp, mus musculus
tcctgatctccatttgtctaagggt

SEQ ID NO: 60138 - DNA, 25 bp, mus musculus
tctccatttgtctaagggtcgacag

SEQ ID NO: 60139 - DNA, 25 bp, mus musculus
tttgtctaagggtcgacaggatgag

SEQ ID NO: 60140 - DNA, 25 bp, mus musculus
ctagccctgagcaagggtcagacca

SEQ ID NO: 60141 - DNA, 25 bp, mus musculus
aagggtcagaccacaggctcctgaa

SEQ ID NO: 60142 - DNA, 25 bp, mus musculus
caagggtgctgccacccttactatc

SEQ ID NO: 60143 - DNA, 25 bp, mus musculus
cagctgcatcttcaagaacttcaac

SEQ ID NO: 60144 - DNA, 25 bp, mus musculus
catcttcaagaacttcaacctcttc

SEQ ID NO: 60145 - DNA, 25 bp, mus musculus
ctatgctttccgcagccaggagctc

SEQ ID NO: 60146 - DNA, 25 bp, mus musculus
cagccaggagctccgcatgacactc

SEQ ID NO: 60147 - DNA, 25 bp, mus musculus
ggagctccgcatgacactcaaggag

SEQ ID NO: 60148 - DNA, 25 bp, mus musculus
ccgcatgacactcaaggaggtgctg

SEQ ID NO: 60149 - DNA, 25 bp, mus musculus
gacactcaaggaggtgctgctgtgc

SEQ ID NO: 60150 - DNA, 25 bp, mus musculus
cccgaagcgcctgagagactgatga

SEQ ID NO: 60151 - DNA, 25 bp, mus musculus
atgacagacaccattaatgaaccaa

SEQ ID NO: 60152 - DNA, 25 bp, mus musculus
atgcagcgctgtcctgaggatcctc

SEQ ID NO: 60153 - DNA, 25 bp, mus musculus
cgctgtcctgaggatcctcgactta

SEQ ID NO: 60154 - DNA, 25 bp, mus musculus
cctgaggatcctcgacttactgaat

SEQ ID NO: 60155 - DNA, 25 bp, mus musculus
gatcctcgacttactgaatctgtgg

SEQ ID NO: 60156 - DNA, 25 bp, mus musculus
cctcgacttactgaatctgtggacg

SEQ ID NO: 60157 - DNA, 25 bp, mus musculus
cgacttactgaatctgtggacgtgt

SEQ ID NO: 60158 - DNA, 25 bp, mus musculus
gtgttgatgcccaacgttggtgaga

SEQ ID NO: 60159 - DNA, 25 bp, mus musculus
ttgatgcccaacgttggtgagattg

SEQ ID NO: 60160 - DNA, 25 bp, mus musculus
attgtaggtggctcgatgcgctcct

SEQ ID NO: 60161 - DNA, 25 bp, mus musculus
ggcaccctcatggagggtactggct

SEQ ID NO: 60162 - DNA, 25 bp, mus musculus
acagacaccattaatgaaccaatcc

SEQ ID NO: 60163 - DNA, 25 bp, mus musculus
gacaccattaatgaaccaatcctgc

SEQ ID NO: 60164 - DNA, 25 bp, mus musculus
aatgaaccaatcctgctgtgtcgct

SEQ ID NO: 60165 - DNA, 25 bp, mus musculus
ctgctgtgtcgctttcctgtggaga

SEQ ID NO: 60166 - DNA, 25 bp, mus musculus
ctgtgtcgctttcctgtggagatca

SEQ ID NO: 60167 - DNA, 25 bp, mus musculus
atcaagtctttctatatgcagcgct

SEQ ID NO: 60168 - DNA, 25 bp, mus musculus
ttctatatgcagcgctgtcctgagg

SEQ ID NO: 60169 - DNA, 25 bp, mus musculus
tatatgcagcgctgtcctgaggatc

SEQ ID NO: 60170 - DNA, 25 bp, mus musculus
tgtactaacaaatgctgtgatgcaa

SEQ ID NO: 60171 - DNA, 25 bp, mus musculus
ttccagtgtgccctgggggaatgct

SEQ ID NO: 60172 - DNA, 25 bp, mus musculus
ccagtgtgccctgggggaatgctgt

SEQ ID NO: 60173 - DNA, 25 bp, mus musculus
aaacctggggttgtgtgcagagcag

SEQ ID NO: 60174 - DNA, 25 bp, mus musculus
aacctggggttgtgtgcagagcagc

SEQ ID NO: 60175 - DNA, 25 bp, mus musculus
acctggggttgtgtgcagagcagca

SEQ ID NO: 60176 - DNA, 25 bp, mus musculus
tgtactaacaaatgctgtgatgcaa

SEQ ID NO: 60177 - DNA, 25 bp, mus musculus
ttccagtgtgccctgggggaatgct

SEQ ID NO: 60178 - DNA, 25 bp, mus musculus
ccagtgtgccctgggggaatgctgt

SEQ ID NO: 60179 - DNA, 25 bp, mus musculus
aaaacctggggttgtgtgcagagca

SEQ ID NO: 60180 - DNA, 25 bp, mus musculus
aaacctggggttgtgtgcagagcag

SEQ ID NO: 60181 - DNA, 25 bp, mus musculus
aacctggggttgtgtgcagagcagc

SEQ ID NO: 60182 - DNA, 25 bp, mus musculus
acctggggttgtgtgcagagcagca

SEQ ID NO: 60183 - DNA, 25 bp, mus musculus
accctcttcctgtgagcacagcaga

SEQ ID NO: 60184 - DNA, 25 bp, mus musculus
aacgttaagtgccatggatgtgtca

SEQ ID NO: 60185 - DNA, 25 bp, mus musculus
ctgtgatgctgccgtcatggggtca

SEQ ID NO: 60186 - DNA, 25 bp, mus musculus
tgctgccgtcatggggtcagaaatt

SEQ ID NO: 60187 - DNA, 25 bp, mus musculus
tgccgtcatggggtcagaaattgga

SEQ ID NO: 60188 - DNA, 25 bp, mus musculus
tgccatctgaaagctcacctttcag

SEQ ID NO: 60189 - DNA, 25 bp, mus musculus
ctgaaagctcacctttcagacgtat

SEQ ID NO: 60190 - DNA, 25 bp, mus musculus
gctcacctttcagacgtattttctt

SEQ ID NO: 60191 - DNA, 25 bp, mus musculus
tctttactcgtatcccaggaacatc

SEQ ID NO: 60192 - DNA, 25 bp, mus musculus
ttactcgtatcccaggaacatccat

SEQ ID NO: 60193 - DNA, 25 bp, mus musculus
gtatcccaggaacatccattttaag

SEQ ID NO: 60194 - DNA, 25 bp, mus musculus
caggaacatccattttaaggaactg

SEQ ID NO: 60195 - DNA, 25 bp, mus musculus
aagtgccatggatgtgtcagagttc

SEQ ID NO: 60196 - DNA, 25 bp, mus musculus
gtccagtccggttcacagtgaagca

SEQ ID NO: 60197 - DNA, 25 bp, mus musculus
cagtccggttcacagtgaagcacta

SEQ ID NO: 60198 - DNA, 25 bp, mus musculus
cagtgaagcactactgcaggggtag

SEQ ID NO: 60199 - DNA, 25 bp, mus musculus
agcactactgcaggggtagaggaaa

SEQ ID NO: 60200 - DNA, 25 bp, mus musculus
agacctggccggcagcttctccagg

SEQ ID NO: 60201 - DNA, 25 bp, mus musculus
cctggccggcagcttctccagggga

SEQ ID NO: 60202 - DNA, 25 bp, mus musculus
taccggctgtgatgctgccgtcatg

SEQ ID NO: 60203 - DNA, 25 bp, mus musculus
cgttcgctgctggacaaggtctgac

SEQ ID NO: 60204 - DNA, 25 bp, mus musculus
ctaccacaaggactttgcctctgaa

SEQ ID NO: 60205 - DNA, 25 bp, mus musculus
caaggctctgcacttgaaggcaaga

SEQ ID NO: 60206 - DNA, 25 bp, mus musculus
tgaccttataggcaacggccaaatg

SEQ ID NO: 60207 - DNA, 25 bp, mus musculus
tataggcaacggccaaatggggtca

SEQ ID NO: 60208 - DNA, 25 bp, mus musculus
actacataccttaaatctctgaact

SEQ ID NO: 60209 - DNA, 25 bp, mus musculus
ctgaactctgacctcaggaggctct

SEQ ID NO: 60210 - DNA, 25 bp, mus musculus
ctcaggaggctctgggcatatgagc

SEQ ID NO: 60211 - DNA, 25 bp, mus musculus
tatgagccctatatgtaccaagtgt

SEQ ID NO: 60212 - DNA, 25 bp, mus musculus
atgtaccaagtgtacctggttggct

SEQ ID NO: 60213 - DNA, 25 bp, mus musculus
caagtgtacctggttggctgcctcc

SEQ ID NO: 60214 - DNA, 25 bp, mus musculus
ccgccactctgactaaaaggaatct

SEQ ID NO: 60215 - DNA, 25 bp, mus musculus
ctttgcctctgaaggccagtggcta

SEQ ID NO: 60216 - DNA, 25 bp, mus musculus
ctctgaaggccagtggctacaggtg

SEQ ID NO: 60217 - DNA, 25 bp, mus musculus
gcttcatccataagtgggtcccttg

SEQ ID NO: 60218 - DNA, 25 bp, mus musculus
cctctggccctcaagggaatctcac

SEQ ID NO: 60219 - DNA, 25 bp, mus musculus
aagggaatctcacagctcggtgtgt

SEQ ID NO: 60220 - DNA, 25 bp, mus musculus
cagctcggtgtgtgttcagccctag

SEQ ID NO: 60221 - DNA, 25 bp, mus musculus
tgttcagccctagttgaatgttgtc

SEQ ID NO: 60222 - DNA, 25 bp, mus musculus
tgttgtcaaggctctgcacttgaag

SEQ ID NO: 60223 - DNA, 25 bp, mus musculus
tcggccatggctcccaaaggcggct

SEQ ID NO: 60224 - DNA, 25 bp, mus musculus
gccatggctcccaaaggcggctcca

SEQ ID NO: 60225 - DNA, 25 bp, mus musculus
aacgcgttcatcgtgtctgccatcc

SEQ ID NO: 60226 - DNA, 25 bp, mus musculus
atccccatctggttgtattggagaa

SEQ ID NO: 60227 - DNA, 25 bp, mus musculus
cccatctggttgtattggagaatat

SEQ ID NO: 60228 - DNA, 25 bp, mus musculus
gatctcatccagtctgctgtgctct

SEQ ID NO: 60229 - DNA, 25 bp, mus musculus
ctcatccagtctgctgtgctctaca

SEQ ID NO: 60230 - DNA, 25 bp, mus musculus
atccagtctgctgtgctctacagtg

SEQ ID NO: 60231 - DNA, 25 bp, mus musculus
gctgtgctctacagtgtgatgacct

SEQ ID NO: 60232 - DNA, 25 bp, mus musculus
gtgctctacagtgtgatgaccttag

SEQ ID NO: 60233 - DNA, 25 bp, mus musculus
ttagtagccttcgcgtacaagaatg

SEQ ID NO: 60234 - DNA, 25 bp, mus musculus
gccttcgcgtacaagaatgtaaaat

SEQ ID NO: 60235 - DNA, 25 bp, mus musculus
gctcccaaaggcggctccaagcagc

SEQ ID NO: 60236 - DNA, 25 bp, mus musculus
tccaagcagcagtccgaggaggacc

SEQ ID NO: 60237 - DNA, 25 bp, mus musculus
ctgctccttcaggatttcagccgca

SEQ ID NO: 60238 - DNA, 25 bp, mus musculus
caggatttcagccgcaacctgtcgg

SEQ ID NO: 60239 - DNA, 25 bp, mus musculus
gatttcagccgcaacctgtcggcca

SEQ ID NO: 60240 - DNA, 25 bp, mus musculus
ttcagccgcaacctgtcggccaaat

SEQ ID NO: 60241 - DNA, 25 bp, mus musculus
cgcaacctgtcggccaaatcgtcgg

SEQ ID NO: 60242 - DNA, 25 bp, mus musculus
ttcttcgggaacgcgttcatcgtgt

SEQ ID NO: 60243 - DNA, 25 bp, mus musculus
ggtgaactcagtgcattgggccaac

SEQ ID NO: 60244 - DNA, 25 bp, mus musculus
ctcagtgcattgggccaacggttca

SEQ ID NO: 60245 - DNA, 25 bp, mus musculus
ccctttgatgcaccttgtcgcacaa

SEQ ID NO: 60246 - DNA, 25 bp, mus musculus
gatgcaccttgtcgcacaaagaata

SEQ ID NO: 60247 - DNA, 25 bp, mus musculus
ccttgtcgcacaaagaatatcgccc

SEQ ID NO: 60248 - DNA, 25 bp, mus musculus
ccctggtacaagtctactgtcatcc

SEQ ID NO: 60249 - DNA, 25 bp, mus musculus
tctactgtcatccacatgactgttg

SEQ ID NO: 60250 - DNA, 25 bp, mus musculus
gtcatccacatgactgttggtggct

SEQ ID NO: 60251 - DNA, 25 bp, mus musculus
ggtggcttcctgcctttcagcgcca

SEQ ID NO: 60252 - DNA, 25 bp, mus musculus
agcgccatctccgtggagctgtact

SEQ ID NO: 60253 - DNA, 25 bp, mus musculus
atctccgtggagctgtactacatct

SEQ ID NO: 60254 - DNA, 25 bp, mus musculus
ctgtactacatctttgccacagtct

SEQ ID NO: 60255 - DNA, 25 bp, mus musculus
gcattgggccaacggttcaacacag

SEQ ID NO: 60256 - DNA, 25 bp, mus musculus
tacatctttgccacagtctggggtc

SEQ ID NO: 60257 - DNA, 25 bp, mus musculus
cggttcaacacaggcgctgcgacca

SEQ ID NO: 60258 - DNA, 25 bp, mus musculus
acaaccatcctgctgctgctgacag

SEQ ID NO: 60259 - DNA, 25 bp, mus musculus
ctgacagtctggctgctggtaggct

SEQ ID NO: 60260 - DNA, 25 bp, mus musculus
gtaggctttcctctcactgtcattg

SEQ ID NO: 60261 - DNA, 25 bp, mus musculus
tttcctctcactgtcattggcggca

SEQ ID NO: 60262 - DNA, 25 bp, mus musculus
ctcactgtcattggcggcatctttg

SEQ ID NO: 60263 - DNA, 25 bp, mus musculus
gctagtccctttgatgcaccttgtc

SEQ ID NO: 60264 - DNA, 25 bp, mus musculus
aggacatgctgcagacgtttcttga

SEQ ID NO: 60265 - DNA, 25 bp, mus musculus
acatgctgcagacgtttcttgaaaa

SEQ ID NO: 60266 - DNA, 25 bp, mus musculus
tcacttttcaaggctttgcaggacc

SEQ ID NO: 60267 - DNA, 25 bp, mus musculus
cttttcaaggctttgcaggacctgt

SEQ ID NO: 60268 - DNA, 25 bp, mus musculus
gctttgcaggacctgtgactctgga

SEQ ID NO: 60269 - DNA, 25 bp, mus musculus
ttgcaggacctgtgactctggatga

SEQ ID NO: 60270 - DNA, 25 bp, mus musculus
ttgacaacattatgtcccttctgta

SEQ ID NO: 60271 - DNA, 25 bp, mus musculus
acattatgtcccttctgtatgtgtc

SEQ ID NO: 60272 - DNA, 25 bp, mus musculus
tgtcccttctgtatgtgtctctgga

SEQ ID NO: 60273 - DNA, 25 bp, mus musculus
tggctgagaaccccaacttcatctg

SEQ ID NO: 60274 - DNA, 25 bp, mus musculus
ggaagaaccacaagctccccaatga

SEQ ID NO: 60275 - DNA, 25 bp, mus musculus
agctccccaatgacgttcctgggct

SEQ ID NO: 60276 - DNA, 25 bp, mus musculus
tgctgcagacgtttcttgaaaatgg

SEQ ID NO: 60277 - DNA, 25 bp, mus musculus
atgtcacgggtcccaagtttgctcg

SEQ ID NO: 60278 - DNA, 25 bp, mus musculus
cgggtcccaagtttgctcgtgcatt

SEQ ID NO: 60279 - DNA, 25 bp, mus musculus
ccaagtttgctcgtgcattcaggaa

SEQ ID NO: 60280 - DNA, 25 bp, mus musculus
agtttgctcgtgcattcaggaatct

SEQ ID NO: 60281 - DNA, 25 bp, mus musculus
cattcaggaatctcacttttcaagg

SEQ ID NO: 60282 - DNA, 25 bp, mus musculus
tcaggaatctcacttttcaaggctt

SEQ ID NO: 60283 - DNA, 25 bp, mus musculus
atctcacttttcaaggctttgcagg

SEQ ID NO: 60284 - DNA, 25 bp, mus musculus
cgacttctgagactggaggtcaatg

SEQ ID NO: 60285 - DNA, 25 bp, mus musculus
cttctgagactggaggtcaatgctg

SEQ ID NO: 60286 - DNA, 25 bp, mus musculus
tatgtgctgcagtttctcaaagagg

SEQ ID NO: 60287 - DNA, 25 bp, mus musculus
ctgcagtttctcaaagaggatctgc

SEQ ID NO: 60288 - DNA, 25 bp, mus musculus
gaggatctgcccaaggtggttgtac

SEQ ID NO: 60289 - DNA, 25 bp, mus musculus
gatctgcccaaggtggttgtacaag

SEQ ID NO: 60290 - DNA, 25 bp, mus musculus
caaggcatcccagaggtgtcgcgag

SEQ ID NO: 60291 - DNA, 25 bp, mus musculus
ggcatcccagaggtgtcgcgagctg

SEQ ID NO: 60292 - DNA, 25 bp, mus musculus
ccagaggtgtcgcgagctgtcatcc

SEQ ID NO: 60293 - DNA, 25 bp, mus musculus
cgagctgtcatccatattgacgagc

SEQ ID NO: 60294 - DNA, 25 bp, mus musculus
gctgtcatccatattgacgagcaga

SEQ ID NO: 60295 - DNA, 25 bp, mus musculus
catattgacgagcagagtgggaagg

SEQ ID NO: 60296 - DNA, 25 bp, mus musculus
aatgctgagacagtgcggtactcca

SEQ ID NO: 60297 - DNA, 25 bp, mus musculus
gtgcggtactccatctgcacatcca

SEQ ID NO: 60298 - DNA, 25 bp, mus musculus
cggtactccatctgcacatccaagc

SEQ ID NO: 60299 - DNA, 25 bp, mus musculus
atctgcacatccaagctccgagtga

SEQ ID NO: 60300 - DNA, 25 bp, mus musculus
tgcacatccaagctccgagtgaagc

SEQ ID NO: 60301 - DNA, 25 bp, mus musculus
aagctccgagtgaagcctggtgatg

SEQ ID NO: 60302 - DNA, 25 bp, mus musculus
ctccgagtgaagcctggtgatgtgg

SEQ ID NO: 60303 - DNA, 25 bp, mus musculus
aagagctccatgtattatgtgctgc

SEQ ID NO: 60304 - DNA, 25 bp, mus musculus
aatatactcataacggtcgcattgg

SEQ ID NO: 60305 - DNA, 25 bp, mus musculus
atatactcataacggtcgcattggc

SEQ ID NO: 60306 - DNA, 25 bp, mus musculus
taacggtcgcattggcttcgatccc

SEQ ID NO: 60307 - DNA, 25 bp, mus musculus
cggtcgcattggcttcgatcccttt

SEQ ID NO: 60308 - DNA, 25 bp, mus musculus
ggtcgcattggcttcgatccctttt

SEQ ID NO: 60309 - DNA, 25 bp, mus musculus
tcgcattggcttcgatcccttttaa

SEQ ID NO: 60310 - DNA, 25 bp, mus musculus
agacaatcaggtctacttgcggttc

SEQ ID NO: 60311 - DNA, 25 bp, mus musculus
gacaatcaggtctacttgcggttcc

SEQ ID NO: 60312 - DNA, 25 bp, mus musculus
caatcaggtctacttgcggttccca

SEQ ID NO: 60313 - DNA, 25 bp, mus musculus
atcaggtctacttgcggttcccaag

SEQ ID NO: 60314 - DNA, 25 bp, mus musculus
tcaggtctacttgcggttcccaagg

SEQ ID NO: 60315 - DNA, 25 bp, mus musculus
tatactcataacggtcgcattggct

SEQ ID NO: 60316 - DNA, 25 bp, mus musculus
atactcataacggtcgcattggctt

SEQ ID NO: 60317 - DNA, 25 bp, mus musculus
tactcataacggtcgcattggcttc

SEQ ID NO: 60318 - DNA, 25 bp, mus musculus
actcataacggtcgcattggcttcg

SEQ ID NO: 60319 - DNA, 25 bp, mus musculus
ctcataacggtcgcattggcttcga

SEQ ID NO: 60320 - DNA, 25 bp, mus musculus
tcataacggtcgcattggcttcgat

SEQ ID NO: 60321 - DNA, 25 bp, mus musculus
cataacggtcgcattggcttcgatc

SEQ ID NO: 60322 - DNA, 25 bp, mus musculus
ataacggtcgcattggcttcgatcc

SEQ ID NO: 60323 - DNA, 25 bp, mus musculus
cccaggacctgtctttgtatgtgga

SEQ ID NO: 60324 - DNA, 25 bp, mus musculus
ccaggacctgtctttgtatgtggaa

SEQ ID NO: 60325 - DNA, 25 bp, mus musculus
tggaccaaaacgtgccatactaatg

SEQ ID NO: 60326 - DNA, 25 bp, mus musculus
gaccaaaacgtgccatactaatgat

SEQ ID NO: 60327 - DNA, 25 bp, mus musculus
accaaaacgtgccatactaatgatg

SEQ ID NO: 60328 - DNA, 25 bp, mus musculus
aacgtgccatactaatgatgagcgg

SEQ ID NO: 60329 - DNA, 25 bp, mus musculus
gtgaactctagcacactgttgtaga

SEQ ID NO: 60330 - DNA, 25 bp, mus musculus
gaactctagcacactgttgtagatg

SEQ ID NO: 60331 - DNA, 25 bp, mus musculus
aactctagcacactgttgtagatga

SEQ ID NO: 60332 - DNA, 25 bp, mus musculus
ctctagcacactgttgtagatgagt

SEQ ID NO: 60333 - DNA, 25 bp, mus musculus
tctagcacactgttgtagatgagtc

SEQ ID NO: 60334 - DNA, 25 bp, mus musculus
tagcacactgttgtagatgagtcag

SEQ ID NO: 60335 - DNA, 25 bp, mus musculus
aggacctgtctttgtatgtggaagt

SEQ ID NO: 60336 - DNA, 25 bp, mus musculus
acctgtctttgtatgtggaagtata

SEQ ID NO: 60337 - DNA, 25 bp, mus musculus
cctgtctttgtatgtggaagtatac

SEQ ID NO: 60338 - DNA, 25 bp, mus musculus
ttaaaacacatcatggaccaaaacg

SEQ ID NO: 60339 - DNA, 25 bp, mus musculus
cacatcatggaccaaaacgtgccat

SEQ ID NO: 60340 - DNA, 25 bp, mus musculus
acatcatggaccaaaacgtgccata

SEQ ID NO: 60341 - DNA, 25 bp, mus musculus
tcatggaccaaaacgtgccatacta

SEQ ID NO: 60342 - DNA, 25 bp, mus musculus
atggaccaaaacgtgccatactaat

SEQ ID NO: 60343 - DNA, 25 bp, mus musculus
cagttccctgagtagaaggagagat

SEQ ID NO: 60344 - DNA, 25 bp, mus musculus
agataactcaaagcttcagagaaga

SEQ ID NO: 60345 - DNA, 25 bp, mus musculus
tgtttgactattttgcctggtacaa

SEQ ID NO: 60346 - DNA, 25 bp, mus musculus
cactcctgatatccgtacgctcaaa

SEQ ID NO: 60347 - DNA, 25 bp, mus musculus
tcctgatatccgtacgctcaaatgt

SEQ ID NO: 60348 - DNA, 25 bp, mus musculus
ccgtacgctcaaatgtggataagag

SEQ ID NO: 60349 - DNA, 25 bp, mus musculus
gattcacagttttcttgaacaaaag

SEQ ID NO: 60350 - DNA, 25 bp, mus musculus
gcggcaaacacttctcactgcacat

SEQ ID NO: 60351 - DNA, 25 bp, mus musculus
gcaaacacttctcactgcacatcac

SEQ ID NO: 60352 - DNA, 25 bp, mus musculus
aacacttctcactgcacatcacagc

SEQ ID NO: 60353 - DNA, 25 bp, mus musculus
agcctgaagacacagcagtgtacct

SEQ ID NO: 60354 - DNA, 25 bp, mus musculus
tctgcgcagcaggtgaggctatgga

SEQ ID NO: 60355 - DNA, 25 bp, mus musculus
aagacatgactggcttcctgaaggc

SEQ ID NO: 60356 - DNA, 25 bp, mus musculus
tcctgaaggccttgctgttggttct

SEQ ID NO: 60357 - DNA, 25 bp, mus musculus
tgaaggccttgctgttggttctgtg

SEQ ID NO: 60358 - DNA, 25 bp, mus musculus
ccttgctgttggttctgtgcctgcg

SEQ ID NO: 60359 - DNA, 25 bp, mus musculus
tgttggttctgtgcctgcggccaga

SEQ ID NO: 60360 - DNA, 25 bp, mus musculus
ttctgtgcctgcggccagaatggat

SEQ ID NO: 60361 - DNA, 25 bp, mus musculus
agactggtggccagcaagttaaaca

SEQ ID NO: 60362 - DNA, 25 bp, mus musculus
aagttaaacaaagctctccatcgct

SEQ ID NO: 60363 - DNA, 25 bp, mus musculus
gatatgacttccttttacaacacgc

SEQ ID NO: 60364 - DNA, 25 bp, mus musculus
tgcaagctacttgacgaaggttgtg

SEQ ID NO: 60365 - DNA, 25 bp, mus musculus
ctggtcctgtagggagcataggtga

SEQ ID NO: 60366 - DNA, 25 bp, mus musculus
atggttttccagctgtgccttttgt

SEQ ID NO: 60367 - DNA, 25 bp, mus musculus
ttccagctgtgccttttgtgttgac

SEQ ID NO: 60368 - DNA, 25 bp, mus musculus
ctgtgccttttgtgttgacattaac

SEQ ID NO: 60369 - DNA, 25 bp, mus musculus
tgttgacattaaccagacagccatt

SEQ ID NO: 60370 - DNA, 25 bp, mus musculus
cattaaccagacagccattagtgag

SEQ ID NO: 60371 - DNA, 25 bp, mus musculus
ccagacagccattagtgagtgaaca

SEQ ID NO: 60372 - DNA, 25 bp, mus musculus
gtattctgtttgtcatgattggacc

SEQ ID NO: 60373 - DNA, 25 bp, mus musculus
tgattggacctttgcatgcaggtgg

SEQ ID NO: 60374 - DNA, 25 bp, mus musculus
ttggacctttgcatgcaggtggcat

SEQ ID NO: 60375 - DNA, 25 bp, mus musculus
aagctacttgacgaaggttgtgatg

SEQ ID NO: 60376 - DNA, 25 bp, mus musculus
ctttgcatgcaggtggcattcgaat

SEQ ID NO: 60377 - DNA, 25 bp, mus musculus
tgtgatgaactcactgctcgaggga

SEQ ID NO: 60378 - DNA, 25 bp, mus musculus
gatgaactcactgctcgagggagaa

SEQ ID NO: 60379 - DNA, 25 bp, mus musculus
agaagtcaagcccagcaatgaggac

SEQ ID NO: 60380 - DNA, 25 bp, mus musculus
caagcccagcaatgaggactcctgc

SEQ ID NO: 60381 - DNA, 25 bp, mus musculus
caatgaggactcctgcctggttagc

SEQ ID NO: 60382 - DNA, 25 bp, mus musculus
tgaggactcctgcctggttagctag

SEQ ID NO: 60383 - DNA, 25 bp, mus musculus
ctgcctggttagctagtgcggctgg

SEQ ID NO: 60384 - DNA, 25 bp, mus musculus
gaactctacccaggaaagcagatct

SEQ ID NO: 60385 - DNA, 25 bp, mus musculus
ctctacccaggaaagcagatctgtt

SEQ ID NO: 60386 - DNA, 25 bp, mus musculus
cttcctggcctcaagtcctagagga

SEQ ID NO: 60387 - DNA, 25 bp, mus musculus
gacttctaggcaccaagggactcct

SEQ ID NO: 60388 - DNA, 25 bp, mus musculus
gactcctggaactatcttgggagga

SEQ ID NO: 60389 - DNA, 25 bp, mus musculus
caggctaaagtctcatctgaatggc

SEQ ID NO: 60390 - DNA, 25 bp, mus musculus
aaagtctcatctgaatggcttgtgt

SEQ ID NO: 60391 - DNA, 25 bp, mus musculus
gtctcatctgaatggcttgtgtttt

SEQ ID NO: 60392 - DNA, 25 bp, mus musculus
ttttataagctgctgcggggttgta

SEQ ID NO: 60393 - DNA, 25 bp, mus musculus
tataagctgctgcggggttgtatgc

SEQ ID NO: 60394 - DNA, 25 bp, mus musculus
aaactgttgccttctgggacatctt

SEQ ID NO: 60395 - DNA, 25 bp, mus musculus
ttgccttctgggacatcttctaata

SEQ ID NO: 60396 - DNA, 25 bp, mus musculus
tcctgctggccctgggcttggaagt

SEQ ID NO: 60397 - DNA, 25 bp, mus musculus
gtaacaacatgtggctctcaaaaac

SEQ ID NO: 60398 - DNA, 25 bp, mus musculus
ccagctaccacttccaaattggctc

SEQ ID NO: 60399 - DNA, 25 bp, mus musculus
tccaaattggctcccaactgtgatg

SEQ ID NO: 60400 - DNA, 25 bp, mus musculus
aaattggctcccaactgtgatggcc

SEQ ID NO: 60401 - DNA, 25 bp, mus musculus
ttggctcccaactgtgatggcctcc

SEQ ID NO: 60402 - DNA, 25 bp, mus musculus
ggcctccaattacttcctggcctca

SEQ ID NO: 60403 - DNA, 25 bp, mus musculus
caattacttcctggcctcaagtcct

SEQ ID NO: 60404 - DNA, 25 bp, mus musculus
tccaagtctgccgtagcccgggtgt

SEQ ID NO: 60405 - DNA, 25 bp, mus musculus
tctgccgtagcccgggtgtgttgat

SEQ ID NO: 60406 - DNA, 25 bp, mus musculus
ggtctccagtgtgggtctcctgctc

SEQ ID NO: 60407 - DNA, 25 bp, mus musculus
ctccagtgtgggtctcctgctccca

SEQ ID NO: 60408 - DNA, 25 bp, mus musculus
cagctgcccagtgaaatgtttgtgc

SEQ ID NO: 60409 - DNA, 25 bp, mus musculus
gaaatgtttgtgccacccatcatca

SEQ ID NO: 60410 - DNA, 25 bp, mus musculus
atgtttgtgccacccatcatcaaac

SEQ ID NO: 60411 - DNA, 25 bp, mus musculus
tttgtgccacccatcatcaaactcc

SEQ ID NO: 60412 - DNA, 25 bp, mus musculus
cccatcatcaaactccgtggactgc

SEQ ID NO: 60413 - DNA, 25 bp, mus musculus
atcatcaaactccgtggactgcagt

SEQ ID NO: 60414 - DNA, 25 bp, mus musculus
atcaaactccgtggactgcagtggt

SEQ ID NO: 60415 - DNA, 25 bp, mus musculus
ctgcagtggtcaggggctgtcaaag

SEQ ID NO: 60416 - DNA, 25 bp, mus musculus
gccgtagcccgggtgtgttgatctg

SEQ ID NO: 60417 - DNA, 25 bp, mus musculus
tgatttacccccatggacagttaca

SEQ ID NO: 60418 - DNA, 25 bp, mus musculus
tgatctgtgagtcctcaggccggga

SEQ ID NO: 60419 - DNA, 25 bp, mus musculus
tctgtgagtcctcaggccgggatat

SEQ ID NO: 60420 - DNA, 25 bp, mus musculus
agtcctcaggccgggatatatgttg

SEQ ID NO: 60421 - DNA, 25 bp, mus musculus
cctcaggccgggatatatgttgaat

SEQ ID NO: 60422 - DNA, 25 bp, mus musculus
ctgcggacgctgggccatgaaaggt

SEQ ID NO: 60423 - DNA, 25 bp, mus musculus
acgctgggccatgaaaggtactctg

SEQ ID NO: 60424 - DNA, 25 bp, mus musculus
aggtactctgctgctggtctccagt

SEQ ID NO: 60425 - DNA, 25 bp, mus musculus
tccaaacatctaaagcaactgtcga

SEQ ID NO: 60426 - DNA, 25 bp, mus musculus
catctaaagcaactgtcgagttgct

SEQ ID NO: 60427 - DNA, 25 bp, mus musculus
gagccaaggcctggcagtcctgcag

SEQ ID NO: 60428 - DNA, 25 bp, mus musculus
ccaaggcctggcagtcctgcagcca

SEQ ID NO: 60429 - DNA, 25 bp, mus musculus
tcgcagccgcagacggtctggacac

SEQ ID NO: 60430 - DNA, 25 bp, mus musculus
cgggacttcgcagctacagcacatc

SEQ ID NO: 60431 - DNA, 25 bp, mus musculus
gacttcgcagctacagcacatctat

SEQ ID NO: 60432 - DNA, 25 bp, mus musculus
ttcgcagctacagcacatctatttt

SEQ ID NO: 60433 - DNA, 25 bp, mus musculus
atttctactacagagacattccaat

SEQ ID NO: 60434 - DNA, 25 bp, mus musculus
tctactacagagacattccaataaa

SEQ ID NO: 60435 - DNA, 25 bp, mus musculus
actacagagacattccaataaactc

SEQ ID NO: 60436 - DNA, 25 bp, mus musculus
gagacattccaataaactcgttaag

SEQ ID NO: 60437 - DNA, 25 bp, mus musculus
aagcaactgtcgagttgctgtcccc

SEQ ID NO: 60438 - DNA, 25 bp, mus musculus
caactgtcgagttgctgtcccctaa

SEQ ID NO: 60439 - DNA, 25 bp, mus musculus
cggagtcaccgagactgagatgagg

SEQ ID NO: 60440 - DNA, 25 bp, mus musculus
agtcaccgagactgagatgaggaga

SEQ ID NO: 60441 - DNA, 25 bp, mus musculus
agccaggagcagcaccacaggtggt

SEQ ID NO: 60442 - DNA, 25 bp, mus musculus
caggagcagcaccacaggtggtcgc

SEQ ID NO: 60443 - DNA, 25 bp, mus musculus
gggcacctcaggcaagaggagactg

SEQ ID NO: 60444 - DNA, 25 bp, mus musculus
ttagagccaaggcctggcagtcctg

SEQ ID NO: 60445 - DNA, 25 bp, mus musculus
atagtttcagcatttgggaggtaga

SEQ ID NO: 60446 - DNA, 25 bp, mus musculus
cttatccttggcaacacacctagtt

SEQ ID NO: 60447 - DNA, 25 bp, mus musculus
cagctgttttctccccagcagcgag

SEQ ID NO: 60448 - DNA, 25 bp, mus musculus
tctccccagcagcgaggtttgcatc

SEQ ID NO: 60449 - DNA, 25 bp, mus musculus
ccccagcagcgaggtttgcatcttc

SEQ ID NO: 60450 - DNA, 25 bp, mus musculus
attcctttcacgttctctaccatag

SEQ ID NO: 60451 - DNA, 25 bp, mus musculus
ttcacgttctctaccatagaggcaa

SEQ ID NO: 60452 - DNA, 25 bp, mus musculus
acgttctctaccatagaggcaatgt

SEQ ID NO: 60453 - DNA, 25 bp, mus musculus
atgtcatggtccctctcagggtaca

SEQ ID NO: 60454 - DNA, 25 bp, mus musculus
gtctcatggggcatttcactgcttg

SEQ ID NO: 60455 - DNA, 25 bp, mus musculus
ggcatttcactgcttgatgttgagc

SEQ ID NO: 60456 - DNA, 25 bp, mus musculus
atttcactgcttgatgttgagcatt

SEQ ID NO: 60457 - DNA, 25 bp, mus musculus
tcagcctgggctacatgagagccta

SEQ ID NO: 60458 - DNA, 25 bp, mus musculus
tttctctacctgttgaaagcaaagt

SEQ ID NO: 60459 - DNA, 25 bp, mus musculus
ctctacctgttgaaagcaaagtcta

SEQ ID NO: 60460 - DNA, 25 bp, mus musculus
aggaaggccccaaacatgatagcat

SEQ ID NO: 60461 - DNA, 25 bp, mus musculus
aaggccccaaacatgatagcatttg

SEQ ID NO: 60462 - DNA, 25 bp, mus musculus
atgatagcatttgggcccttagtaa

SEQ ID NO: 60463 - DNA, 25 bp, mus musculus
gcatttgggcccttagtaagctgaa

SEQ ID NO: 60464 - DNA, 25 bp, mus musculus
cagctgcaggctcagctgttttctc

SEQ ID NO: 60465 - DNA, 25 bp, mus musculus
gagcaacaattgactcctatgatgt

SEQ ID NO: 60466 - DNA, 25 bp, mus musculus
caacaattgactcctatgatgtaat

SEQ ID NO: 60467 - DNA, 25 bp, mus musculus
actccagtcactatgaccccaatac

SEQ ID NO: 60468 - DNA, 25 bp, mus musculus
ccagtcactatgaccccaatactac

SEQ ID NO: 60469 - DNA, 25 bp, mus musculus
actatgaccccaatactacagcggt

SEQ ID NO: 60470 - DNA, 25 bp, mus musculus
ccaatactacagcggttctcgtcgt

SEQ ID NO: 60471 - DNA, 25 bp, mus musculus
atactacagcggttctcgtcgtctt

SEQ ID NO: 60472 - DNA, 25 bp, mus musculus
ttctcgtcgtctttaagccacagga

SEQ ID NO: 60473 - DNA, 25 bp, mus musculus
tcgtcgtctttaagccacaggattt

SEQ ID NO: 60474 - DNA, 25 bp, mus musculus
tcgtctttaagccacaggatttaag

SEQ ID NO: 60475 - DNA, 25 bp, mus musculus
tctttaagccacaggatttaaggtg

SEQ ID NO: 60476 - DNA, 25 bp, mus musculus
ttaagccacaggatttaaggtggct

SEQ ID NO: 60477 - DNA, 25 bp, mus musculus
caattgactcctatgatgtaataat

SEQ ID NO: 60478 - DNA, 25 bp, mus musculus
acaacggtcctgtcttaggccatga

SEQ ID NO: 60479 - DNA, 25 bp, mus musculus
ctgtcttaggccatgaagaggaagt

SEQ ID NO: 60480 - DNA, 25 bp, mus musculus
atccagagtctgtcttttcagactc

SEQ ID NO: 60481 - DNA, 25 bp, mus musculus
agtctgtcttttcagactccagtca

SEQ ID NO: 60482 - DNA, 25 bp, mus musculus
ctgtcttttcagactccagtcacta

SEQ ID NO: 60483 - DNA, 25 bp, mus musculus
tcttttcagactccagtcactatga

SEQ ID NO: 60484 - DNA, 25 bp, mus musculus
tttcagactccagtcactatgaccc

SEQ ID NO: 60485 - DNA, 25 bp, mus musculus
cttttaatcatataatcttacatct

SEQ ID NO: 60486 - DNA, 25 bp, mus musculus
taatcttacatcttttcttataaga

SEQ ID NO: 60487 - DNA, 25 bp, mus musculus
atatcacatttccattgtaagcaca

SEQ ID NO: 60488 - DNA, 25 bp, mus musculus
tcacatttccattgtaagcacattt

SEQ ID NO: 60489 - DNA, 25 bp, mus musculus
catttccattgtaagcacatttcaa

SEQ ID NO: 60490 - DNA, 25 bp, mus musculus
cacatttcaagaatgcctggtaaat

SEQ ID NO: 60491 - DNA, 25 bp, mus musculus
atttcaagaatgcctggtaaatgaa

SEQ ID NO: 60492 - DNA, 25 bp, mus musculus
gttatttcatacaatgtccagttgt

SEQ ID NO: 60493 - DNA, 25 bp, mus musculus
ttactatatacagtactttgccaat

SEQ ID NO: 60494 - DNA, 25 bp, mus musculus
ctatatacagtactttgccaatcat

SEQ ID NO: 60495 - DNA, 25 bp, mus musculus
tatacagtactttgccaatcatgag

SEQ ID NO: 60496 - DNA, 25 bp, mus musculus
acagtactttgccaatcatgagcca

SEQ ID NO: 60497 - DNA, 25 bp, mus musculus
tcttacatcttttcttataagaaat

SEQ ID NO: 60498 - DNA, 25 bp, mus musculus
atccccaatgaaattagcaaaccat

SEQ ID NO: 60499 - DNA, 25 bp, mus musculus
attagcaaaccatgaacacgaacat

SEQ ID NO: 60500 - DNA, 25 bp, mus musculus
agcaaaccatgaacacgaacattta

SEQ ID NO: 60501 - DNA, 25 bp, mus musculus
ccatgaacacgaacatttaagaatg

SEQ ID NO: 60502 - DNA, 25 bp, mus musculus
atgatcacacagttagccttgtaga

SEQ ID NO: 60503 - DNA, 25 bp, mus musculus
atcacacagttagccttgtagatat

SEQ ID NO: 60504 - DNA, 25 bp, mus musculus
acacagttagccttgtagatatgta

SEQ ID NO: 60505 - DNA, 25 bp, mus musculus
cctgacctggaagccatgcatccct

SEQ ID NO: 60506 - DNA, 25 bp, mus musculus
ctgacctggaagccatgcatcccta

SEQ ID NO: 60507 - DNA, 25 bp, mus musculus
tggacctgctggctgtttactgccg

SEQ ID NO: 60508 - DNA, 25 bp, mus musculus
ggacctgctggctgtttactgccgc

SEQ ID NO: 60509 - DNA, 25 bp, mus musculus
gacctgctggctgtttactgccgca

SEQ ID NO: 60510 - DNA, 25 bp, mus musculus
acctgctggctgtttactgccgcag

SEQ ID NO: 60511 - DNA, 25 bp, mus musculus
cctgctggctgtttactgccgcagt

SEQ ID NO: 60512 - DNA, 25 bp, mus musculus
ctggctgtttactgccgcagtgagg

SEQ ID NO: 60513 - DNA, 25 bp, mus musculus
ggccgcgggattcaggcttgtcaac

SEQ ID NO: 60514 - DNA, 25 bp, mus musculus
tgacctggaagccatgcatccctac

SEQ ID NO: 60515 - DNA, 25 bp, mus musculus
acctggaagccatgcatccctactc

SEQ ID NO: 60516 - DNA, 25 bp, mus musculus
cctggaagccatgcatccctactca

SEQ ID NO: 60517 - DNA, 25 bp, mus musculus
ctggaagccatgcatccctactcaa

SEQ ID NO: 60518 - DNA, 25 bp, mus musculus
ccatgcatccctactcaagaaggag

SEQ ID NO: 60519 - DNA, 25 bp, mus musculus
ccttggacctgctggctgtttactg

SEQ ID NO: 60520 - DNA, 25 bp, mus musculus
cttggacctgctggctgtttactgc

SEQ ID NO: 60521 - DNA, 25 bp, mus musculus
ttggacctgctggctgtttactgcc

SEQ ID NO: 60522 - DNA, 25 bp, mus musculus
tgaacatgcgtcctgacacctgctc

SEQ ID NO: 60523 - DNA, 25 bp, mus musculus
aacatgcgtcctgacacctgctcag

SEQ ID NO: 60524 - DNA, 25 bp, mus musculus
gatgctgaactgcacctatcagagt

SEQ ID NO: 60525 - DNA, 25 bp, mus musculus
tgctgaactgcacctatcagagtac

SEQ ID NO: 60526 - DNA, 25 bp, mus musculus
ctgaactgcacctatcagagtactt

SEQ ID NO: 60527 - DNA, 25 bp, mus musculus
actgcacctatcagagtacttactc

SEQ ID NO: 60528 - DNA, 25 bp, mus musculus
tgcacctatcagagtacttactcac

SEQ ID NO: 60529 - DNA, 25 bp, mus musculus
cacctatcagagtacttactcacct

SEQ ID NO: 60530 - DNA, 25 bp, mus musculus
cctatcagagtacttactcaccttt

SEQ ID NO: 60531 - DNA, 25 bp, mus musculus
tcagagtacttactcacctttcctt

SEQ ID NO: 60532 - DNA, 25 bp, mus musculus
tactcacctttccttttctggtatg

SEQ ID NO: 60533 - DNA, 25 bp, mus musculus
gcccctaagctacttttgaagagct

SEQ ID NO: 60534 - DNA, 25 bp, mus musculus
actctgtgacccagacagaaggcct

SEQ ID NO: 60535 - DNA, 25 bp, mus musculus
tgtgacccagacagaaggcctggtc

SEQ ID NO: 60536 - DNA, 25 bp, mus musculus
tgacccagacagaaggcctggtcac

SEQ ID NO: 60537 - DNA, 25 bp, mus musculus
acagaaggcctggtcactctcaccg

SEQ ID NO: 60538 - DNA, 25 bp, mus musculus
agaaggcctggtcactctcaccgag

SEQ ID NO: 60539 - DNA, 25 bp, mus musculus
cctggtcactctcaccgaggggttg

SEQ ID NO: 60540 - DNA, 25 bp, mus musculus
ctcaccgaggggttgcctgtgatgc

SEQ ID NO: 60541 - DNA, 25 bp, mus musculus
ttgcctgtgatgctgaactgcacct

SEQ ID NO: 60542 - DNA, 25 bp, mus musculus
atgagcaccgaaccagctgtctgct

SEQ ID NO: 60543 - DNA, 25 bp, mus musculus
accgaaccagctgtctgctcttcat

SEQ ID NO: 60544 - DNA, 25 bp, mus musculus
gataatctctgtggtttatgataat

SEQ ID NO: 60545 - DNA, 25 bp, mus musculus
gttgtgccagctattccctagaggt

SEQ ID NO: 60546 - DNA, 25 bp, mus musculus
tagaggtcctagacacacagactgc

SEQ ID NO: 60547 - DNA, 25 bp, mus musculus
tcctagacacacagactgccttagc

SEQ ID NO: 60548 - DNA, 25 bp, mus musculus
cagcctttattcgtcaacggcctct

SEQ ID NO: 60549 - DNA, 25 bp, mus musculus
aagtagcaccgttcctgcccagtgg

SEQ ID NO: 60550 - DNA, 25 bp, mus musculus
ggaaagcaatcccaacatgtctgag

SEQ ID NO: 60551 - DNA, 25 bp, mus musculus
caatcccaacatgtctgagatgttc

SEQ ID NO: 60552 - DNA, 25 bp, mus musculus
aggactacatagtctatcctagaga

SEQ ID NO: 60553 - DNA, 25 bp, mus musculus
acatagtctatcctagagataaata

SEQ ID NO: 60554 - DNA, 25 bp, mus musculus
ccagctgtctgctcttcatgggaaa

SEQ ID NO: 60555 - DNA, 25 bp, mus musculus
taaataaacaaccatatttaccatg

SEQ ID NO: 60556 - DNA, 25 bp, mus musculus
gtctgctcttcatgggaaaagtgac

SEQ ID NO: 60557 - DNA, 25 bp, mus musculus
ccaaccctgccaagtcttaatggca

SEQ ID NO: 60558 - DNA, 25 bp, mus musculus
ctgccaagtcttaatggcagtggtc

SEQ ID NO: 60559 - DNA, 25 bp, mus musculus
agtggtctgggcacctgatgtagtt

SEQ ID NO: 60560 - DNA, 25 bp, mus musculus
ctgggcacctgatgtagtttgggga

SEQ ID NO: 60561 - DNA, 25 bp, mus musculus
acactctgtattcctgttttcattc

SEQ ID NO: 60562 - DNA, 25 bp, mus musculus
tgtattcctgttttcattctaacaa

SEQ ID NO: 60563 - DNA, 25 bp, mus musculus
tccgtgacccagacagaaggcctgg

SEQ ID NO: 60564 - DNA, 25 bp, mus musculus
cgtgacccagacagaaggcctggtc

SEQ ID NO: 60565 - DNA, 25 bp, mus musculus
gatgctgaactgcacctatcagact

SEQ ID NO: 60566 - DNA, 25 bp, mus musculus
tgctgaactgcacctatcagactat

SEQ ID NO: 60567 - DNA, 25 bp, mus musculus
ctgaactgcacctatcagactattt

SEQ ID NO: 60568 - DNA, 25 bp, mus musculus
actgcacctatcagactatttactc

SEQ ID NO: 60569 - DNA, 25 bp, mus musculus
tgcacctatcagactatttactcaa

SEQ ID NO: 60570 - DNA, 25 bp, mus musculus
cacctatcagactatttactcaaat

SEQ ID NO: 60571 - DNA, 25 bp, mus musculus
tcagactatttactcaaatcctttc

SEQ ID NO: 60572 - DNA, 25 bp, mus musculus
caacatctcaatgaatcccctcggc

SEQ ID NO: 60573 - DNA, 25 bp, mus musculus
acatctcaatgaatcccctcggcta

SEQ ID NO: 60574 - DNA, 25 bp, mus musculus
atctcaatgaatcccctcggctact

SEQ ID NO: 60575 - DNA, 25 bp, mus musculus
tgacccagacagaaggcctggtcac

SEQ ID NO: 60576 - DNA, 25 bp, mus musculus
acagaaggcctggtcactctcacag

SEQ ID NO: 60577 - DNA, 25 bp, mus musculus
agaaggcctggtcactctcacagaa

SEQ ID NO: 60578 - DNA, 25 bp, mus musculus
ggcctggtcactctcacagaagggt

SEQ ID NO: 60579 - DNA, 25 bp, mus musculus
cctggtcactctcacagaagggttg

SEQ ID NO: 60580 - DNA, 25 bp, mus musculus
tggtcactctcacagaagggttgcc

SEQ ID NO: 60581 - DNA, 25 bp, mus musculus
gtcactctcacagaagggttgcctg

SEQ ID NO: 60582 - DNA, 25 bp, mus musculus
ttgcctgtgatgctgaactgcacct

SEQ ID NO: 60583 - DNA, 25 bp, mus musculus
aacatgcgtcctgacacctgctcag

SEQ ID NO: 60584 - DNA, 25 bp, mus musculus
agactcagtgacccagacagaaggc

SEQ ID NO: 60585 - DNA, 25 bp, mus musculus
ctcaccaaggggttgcctgtgatgc

SEQ ID NO: 60586 - DNA, 25 bp, mus musculus
ttgcctgtgatgctgaactgcacct

SEQ ID NO: 60587 - DNA, 25 bp, mus musculus
gatgctgaactgcacctatcagact

SEQ ID NO: 60588 - DNA, 25 bp, mus musculus
tgctgaactgcacctatcagactac

SEQ ID NO: 60589 - DNA, 25 bp, mus musculus
ctgaactgcacctatcagactactt

SEQ ID NO: 60590 - DNA, 25 bp, mus musculus
gaactgcacctatcagactacttac

SEQ ID NO: 60591 - DNA, 25 bp, mus musculus
actgcacctatcagactacttactc

SEQ ID NO: 60592 - DNA, 25 bp, mus musculus
tgcacctatcagactacttactcac

SEQ ID NO: 60593 - DNA, 25 bp, mus musculus
tatcagactacttactcacctttcc

SEQ ID NO: 60594 - DNA, 25 bp, mus musculus
tactcacctttccttttctggtatg

SEQ ID NO: 60595 - DNA, 25 bp, mus musculus
actcagtgacccagacagaaggcct

SEQ ID NO: 60596 - DNA, 25 bp, mus musculus
agtgacccagacagaaggcctggtc

SEQ ID NO: 60597 - DNA, 25 bp, mus musculus
tgacccagacagaaggcctggtcac

SEQ ID NO: 60598 - DNA, 25 bp, mus musculus
acccagacagaaggcctggtcactc

SEQ ID NO: 60599 - DNA, 25 bp, mus musculus
acagaaggcctggtcactctcacca

SEQ ID NO: 60600 - DNA, 25 bp, mus musculus
agaaggcctggtcactctcaccaag

SEQ ID NO: 60601 - DNA, 25 bp, mus musculus
aaggcctggtcactctcaccaaggg

SEQ ID NO: 60602 - DNA, 25 bp, mus musculus
gtcactctcaccaaggggttgcctg

SEQ ID NO: 60603 - DNA, 25 bp, mus musculus
catgcgtcctgtcacctgctcagtt

SEQ ID NO: 60604 - DNA, 25 bp, mus musculus
tggagactccgtgacccagacagaa

SEQ ID NO: 60605 - DNA, 25 bp, mus musculus
gttgcctgtgatgctgaactgcacc

SEQ ID NO: 60606 - DNA, 25 bp, mus musculus
gatgctgaactgcacctatcagact

SEQ ID NO: 60607 - DNA, 25 bp, mus musculus
gctgaactgcacctatcagactgct

SEQ ID NO: 60608 - DNA, 25 bp, mus musculus
gaactgcacctatcagactgcttac

SEQ ID NO: 60609 - DNA, 25 bp, mus musculus
ctgcacctatcagactgcttactca

SEQ ID NO: 60610 - DNA, 25 bp, mus musculus
tcagactgcttactcagatgttgcc

SEQ ID NO: 60611 - DNA, 25 bp, mus musculus
gactgcttactcagatgttgccttt

SEQ ID NO: 60612 - DNA, 25 bp, mus musculus
ttactcagatgttgcctttttctgg

SEQ ID NO: 60613 - DNA, 25 bp, mus musculus
ctcagatgttgcctttttctggtat

SEQ ID NO: 60614 - DNA, 25 bp, mus musculus
tgcctttttctggtatgtgcaatat

SEQ ID NO: 60615 - DNA, 25 bp, mus musculus
agactccgtgacccagacagaaggc

SEQ ID NO: 60616 - DNA, 25 bp, mus musculus
ctccgtgacccagacagaaggcctg

SEQ ID NO: 60617 - DNA, 25 bp, mus musculus
cgtgacccagacagaaggcctggtc

SEQ ID NO: 60618 - DNA, 25 bp, mus musculus
gacccagacagaaggcctggtcact

SEQ ID NO: 60619 - DNA, 25 bp, mus musculus
gacagaaggcctggtcactgtcaca

SEQ ID NO: 60620 - DNA, 25 bp, mus musculus
agaaggcctggtcactgtcacagaa

SEQ ID NO: 60621 - DNA, 25 bp, mus musculus
cctggtcactgtcacagaagggttg

SEQ ID NO: 60622 - DNA, 25 bp, mus musculus
ggtcactgtcacagaagggttgcct

SEQ ID NO: 60623 - DNA, 25 bp, mus musculus
tgaacatgcgtcctgtcacctcctc

SEQ ID NO: 60624 - DNA, 25 bp, mus musculus
aacatgcgtcctgtcacctcctcag

SEQ ID NO: 60625 - DNA, 25 bp, mus musculus
ctgaactgcacctatcagactactt

SEQ ID NO: 60626 - DNA, 25 bp, mus musculus
actgcacctatcagactacttattt

SEQ ID NO: 60627 - DNA, 25 bp, mus musculus
tgcacctatcagactacttatttaa

SEQ ID NO: 60628 - DNA, 25 bp, mus musculus
cacctatcagactacttatttaact

SEQ ID NO: 60629 - DNA, 25 bp, mus musculus
cctatcagactacttatttaactat

SEQ ID NO: 60630 - DNA, 25 bp, mus musculus
tcagactacttatttaactattgcc

SEQ ID NO: 60631 - DNA, 25 bp, mus musculus
actattgcctttttctggtatgtgc

SEQ ID NO: 60632 - DNA, 25 bp, mus musculus
tattgcctttttctggtatgtgcaa

SEQ ID NO: 60633 - DNA, 25 bp, mus musculus
ttgcctttttctggtatgtgcaata

SEQ ID NO: 60634 - DNA, 25 bp, mus musculus
gcctttttctggtatgtgcaatatc

SEQ ID NO: 60635 - DNA, 25 bp, mus musculus
actccgtgacccagacagaaggcct

SEQ ID NO: 60636 - DNA, 25 bp, mus musculus
tccgtgacccagacagaaggcctgg

SEQ ID NO: 60637 - DNA, 25 bp, mus musculus
cgtgacccagacagaaggcctggtc

SEQ ID NO: 60638 - DNA, 25 bp, mus musculus
tgacccagacagaaggcctggtcac

SEQ ID NO: 60639 - DNA, 25 bp, mus musculus
acagaaggcctggtcactgtcaccg

SEQ ID NO: 60640 - DNA, 25 bp, mus musculus
ttgcctgtgaagctgaactgcacct

SEQ ID NO: 60641 - DNA, 25 bp, mus musculus
gaagctgaactgcacctatcagact

SEQ ID NO: 60642 - DNA, 25 bp, mus musculus
agctgaactgcacctatcagactac

SEQ ID NO: 60643 - DNA, 25 bp, mus musculus
taccacctggtttttgacacctatg

SEQ ID NO: 60644 - DNA, 25 bp, mus musculus
tttttgacacctatgccatcaccat

SEQ ID NO: 60645 - DNA, 25 bp, mus musculus
catcaccattaatgaatgggtggaa

SEQ ID NO: 60646 - DNA, 25 bp, mus musculus
tggaaagccataaactccttggact

SEQ ID NO: 60647 - DNA, 25 bp, mus musculus
ttttgaaactgccaggcaagaagaa

SEQ ID NO: 60648 - DNA, 25 bp, mus musculus
tttgaaactgccaggcaagaagaat

SEQ ID NO: 60649 - DNA, 25 bp, mus musculus
tgaaactgccaggcaagaagaatta

SEQ ID NO: 60650 - DNA, 25 bp, mus musculus
gaaactgccaggcaagaagaattat

SEQ ID NO: 60651 - DNA, 25 bp, mus musculus
aaactgccaggcaagaagaattatg

SEQ ID NO: 60652 - DNA, 25 bp, mus musculus
aattatgccagattacgaccgttag

SEQ ID NO: 60653 - DNA, 25 bp, mus musculus
attatgccagattacgaccgttagg

SEQ ID NO: 60654 - DNA, 25 bp, mus musculus
ttatgccagattacgaccgttaggt

SEQ ID NO: 60655 - DNA, 25 bp, mus musculus
ttttgacacctatgccatcaccatt

SEQ ID NO: 60656 - DNA, 25 bp, mus musculus
tttgacacctatgccatcaccatta

SEQ ID NO: 60657 - DNA, 25 bp, mus musculus
tgacacctatgccatcaccattaat

SEQ ID NO: 60658 - DNA, 25 bp, mus musculus
gacacctatgccatcaccattaatg

SEQ ID NO: 60659 - DNA, 25 bp, mus musculus
acacctatgccatcaccattaatga

SEQ ID NO: 60660 - DNA, 25 bp, mus musculus
cctatgccatcaccattaatgaatg

SEQ ID NO: 60661 - DNA, 25 bp, mus musculus
ctatgccatcaccattaatgaatgg

SEQ ID NO: 60662 - DNA, 25 bp, mus musculus
atgccatcaccattaatgaatgggt

SEQ ID NO: 60663 - DNA, 25 bp, mus musculus
ttgtcctgttggcttctttggccac

SEQ ID NO: 60664 - DNA, 25 bp, mus musculus
ctgttggcttctttggccacgcgtg

SEQ ID NO: 60665 - DNA, 25 bp, mus musculus
gtcctctgattatatcagcagctcg

SEQ ID NO: 60666 - DNA, 25 bp, mus musculus
ctgattatatcagcagctcgagcag

SEQ ID NO: 60667 - DNA, 25 bp, mus musculus
tgattatatcagcagctcgagcaga

SEQ ID NO: 60668 - DNA, 25 bp, mus musculus
gattatatcagcagctcgagcagac

SEQ ID NO: 60669 - DNA, 25 bp, mus musculus
attatatcagcagctcgagcagact

SEQ ID NO: 60670 - DNA, 25 bp, mus musculus
ttatatcagcagctcgagcagacta

SEQ ID NO: 60671 - DNA, 25 bp, mus musculus
tatatcagcagctcgagcagactaa

SEQ ID NO: 60672 - DNA, 25 bp, mus musculus
atatcagcagctcgagcagactaag

SEQ ID NO: 60673 - DNA, 25 bp, mus musculus
tatcagcagctcgagcagactaagc

SEQ ID NO: 60674 - DNA, 25 bp, mus musculus
atcagcagctcgagcagactaagcc

SEQ ID NO: 60675 - DNA, 25 bp, mus musculus
ccacgcgtggactttcccatgatcc

SEQ ID NO: 60676 - DNA, 25 bp, mus musculus
tcagcagctcgagcagactaagccc

SEQ ID NO: 60677 - DNA, 25 bp, mus musculus
atgatccccagagccctgtcctctg

SEQ ID NO: 60678 - DNA, 25 bp, mus musculus
gatccccagagccctgtcctctgat

SEQ ID NO: 60679 - DNA, 25 bp, mus musculus
cccagagccctgtcctctgattata

SEQ ID NO: 60680 - DNA, 25 bp, mus musculus
ccctgtcctctgattatatcagcag

SEQ ID NO: 60681 - DNA, 25 bp, mus musculus
cctgtcctctgattatatcagcagc

SEQ ID NO: 60682 - DNA, 25 bp, mus musculus
ctgtcctctgattatatcagcagct

SEQ ID NO: 60683 - DNA, 25 bp, mus musculus
tgtcctctgattatatcagcagctc

SEQ ID NO: 60684 - DNA, 25 bp, mus musculus
cggtgtatgcatctccatgaaaaaa

SEQ ID NO: 60685 - DNA, 25 bp, mus musculus
tgtatgcatctccatgaaaaaaggg

SEQ ID NO: 60686 - DNA, 25 bp, mus musculus
atccagagactgagacctgtctaca

SEQ ID NO: 60687 - DNA, 25 bp, mus musculus
agactgagacctgtctacacacgtt

SEQ ID NO: 60688 - DNA, 25 bp, mus musculus
ctgagacctgtctacacacgttaca

SEQ ID NO: 60689 - DNA, 25 bp, mus musculus
agacctgtctacacacgttacaggg

SEQ ID NO: 60690 - DNA, 25 bp, mus musculus
tacacacgttacagggacacactaa

SEQ ID NO: 60691 - DNA, 25 bp, mus musculus
acacgttacagggacacactaatag

SEQ ID NO: 60692 - DNA, 25 bp, mus musculus
attcattacagtttgatggcatcca

SEQ ID NO: 60693 - DNA, 25 bp, mus musculus
ttgatggcatccatgtggtgagtgg

SEQ ID NO: 60694 - DNA, 25 bp, mus musculus
atggcatccatgtggtgagtggatc

SEQ ID NO: 60695 - DNA, 25 bp, mus musculus
gcatccatgtggtgagtggatctct

SEQ ID NO: 60696 - DNA, 25 bp, mus musculus
atgcatctccatgaaaaaagggttg

SEQ ID NO: 60697 - DNA, 25 bp, mus musculus
gttgtaagcggttctcgagatgcca

SEQ ID NO: 60698 - DNA, 25 bp, mus musculus
ggttctcgagatgccactctcaggg

SEQ ID NO: 60699 - DNA, 25 bp, mus musculus
gccactctcagggtttgggatattg

SEQ ID NO: 60700 - DNA, 25 bp, mus musculus
actctcagggtttgggatattgaga

SEQ ID NO: 60701 - DNA, 25 bp, mus musculus
gatattgagaccggccagtgtttac

SEQ ID NO: 60702 - DNA, 25 bp, mus musculus
ttacacgtcctgatgggtcacgtag

SEQ ID NO: 60703 - DNA, 25 bp, mus musculus
cacgtcctgatgggtcacgtagcag

SEQ ID NO: 60704 - DNA, 25 bp, mus musculus
ggcagcctaacagccttggttgcta

SEQ ID NO: 60705 - DNA, 25 bp, mus musculus
gccttggttgctaggcacagaacac

SEQ ID NO: 60706 - DNA, 25 bp, mus musculus
tcttaagggggtcctgccgcctctg

SEQ ID NO: 60707 - DNA, 25 bp, mus musculus
gcctctgacagccatatctcttgtt

SEQ ID NO: 60708 - DNA, 25 bp, mus musculus
gacagccatatctcttgttattgct

SEQ ID NO: 60709 - DNA, 25 bp, mus musculus
tcttgttattgctggctggacctcc

SEQ ID NO: 60710 - DNA, 25 bp, mus musculus
tgatctcttcagctgcctaccctac

SEQ ID NO: 60711 - DNA, 25 bp, mus musculus
cttcagctgcctaccctacaaatgc

SEQ ID NO: 60712 - DNA, 25 bp, mus musculus
tgccaatacttcttggaccaagaat

SEQ ID NO: 60713 - DNA, 25 bp, mus musculus
tcacacaaaataactctgtggtcaa

SEQ ID NO: 60714 - DNA, 25 bp, mus musculus
agcttttgcagccaaaacttcttca

SEQ ID NO: 60715 - DNA, 25 bp, mus musculus
tgcagccaaaacttcttcagctggt

SEQ ID NO: 60716 - DNA, 25 bp, mus musculus
aggcacagaacacctggcttgctcc

SEQ ID NO: 60717 - DNA, 25 bp, mus musculus
tcttcagctggtccatcaacagcaa

SEQ ID NO: 60718 - DNA, 25 bp, mus musculus
aacatgaccagctcccatggaacca

SEQ ID NO: 60719 - DNA, 25 bp, mus musculus
accagctcccatggaaccagctagg

SEQ ID NO: 60720 - DNA, 25 bp, mus musculus
tcccatggaaccagctaggggtcct

SEQ ID NO: 60721 - DNA, 25 bp, mus musculus
ttcaaaggctgcacaactccctgaa

SEQ ID NO: 60722 - DNA, 25 bp, mus musculus
ggctgcacaactccctgaacctggg

SEQ ID NO: 60723 - DNA, 25 bp, mus musculus
ccctgaacctggggccatcaattca

SEQ ID NO: 60724 - DNA, 25 bp, mus musculus
gtagctgtatcatcttaagggggtc

SEQ ID NO: 60725 - DNA, 25 bp, mus musculus
ggcgctatgccacacacgagaggaa

SEQ ID NO: 60726 - DNA, 25 bp, mus musculus
gctatgccacacacgagaggaagat

SEQ ID NO: 60727 - DNA, 25 bp, mus musculus
tttgacctcagaggatgctggcagc

SEQ ID NO: 60728 - DNA, 25 bp, mus musculus
gacctcagaggatgctggcagcaag

SEQ ID NO: 60729 - DNA, 25 bp, mus musculus
acaggtcttgggccatctggcctac

SEQ ID NO: 60730 - DNA, 25 bp, mus musculus
ccatctggcctactgttgcatagaa

SEQ ID NO: 60731 - DNA, 25 bp, mus musculus
tctggcctactgttgcatagaattc

SEQ ID NO: 60732 - DNA, 25 bp, mus musculus
tgttgtcattgcagcatcatctaga

SEQ ID NO: 60733 - DNA, 25 bp, mus musculus
tgtcattgcagcatcatctagagaa

SEQ ID NO: 60734 - DNA, 25 bp, mus musculus
atgcccacctgactcctgtgtgtct

SEQ ID NO: 60735 - DNA, 25 bp, mus musculus
gtctgaatctctgtgtattgccaat

SEQ ID NO: 60736 - DNA, 25 bp, mus musculus
tgaatctctgtgtattgccaataaa

SEQ ID NO: 60737 - DNA, 25 bp, mus musculus
ctgtcacgatttcacctttggatgg

SEQ ID NO: 60738 - DNA, 25 bp, mus musculus
tcacgatttcacctttggatgggaa

SEQ ID NO: 60739 - DNA, 25 bp, mus musculus
tacagaaagccttgagggtgtttct

SEQ ID NO: 60740 - DNA, 25 bp, mus musculus
aagagatctttgcccatctgggact

SEQ ID NO: 60741 - DNA, 25 bp, mus musculus
cccatctgggactggactacattga

SEQ ID NO: 60742 - DNA, 25 bp, mus musculus
ttcttttcggtttagacaagctgtg

SEQ ID NO: 60743 - DNA, 25 bp, mus musculus
tagacaagctgtgctctgtgttagt

SEQ ID NO: 60744 - DNA, 25 bp, mus musculus
ggattctttgacctcagaggatgct

SEQ ID NO: 60745 - DNA, 25 bp, mus musculus
cttgctctcaattttgcgcaagttg

SEQ ID NO: 60746 - DNA, 25 bp, mus musculus
ttgctctcaattttgcgcaagttga

SEQ ID NO: 60747 - DNA, 25 bp, mus musculus
acttctcctgggcttggataatgct

SEQ ID NO: 60748 - DNA, 25 bp, mus musculus
tctcctgggcttggataatgctggc

SEQ ID NO: 60749 - DNA, 25 bp, mus musculus
aagaccactcttctgaagcagcttg

SEQ ID NO: 60750 - DNA, 25 bp, mus musculus
gaccactcttctgaagcagcttgca

SEQ ID NO: 60751 - DNA, 25 bp, mus musculus
accactcttctgaagcagcttgcat

SEQ ID NO: 60752 - DNA, 25 bp, mus musculus
actcttctgaagcagcttgcatctg

SEQ ID NO: 60753 - DNA, 25 bp, mus musculus
ctcttctgaagcagcttgcatctga

SEQ ID NO: 60754 - DNA, 25 bp, mus musculus
tcttctgaagcagcttgcatctgaa

SEQ ID NO: 60755 - DNA, 25 bp, mus musculus
gtttcaacatcaaaagtgtacaatc

SEQ ID NO: 60756 - DNA, 25 bp, mus musculus
tgtacaatcacaaggttttaaactg

SEQ ID NO: 60757 - DNA, 25 bp, mus musculus
tgctctcaattttgcgcaagttgaa

SEQ ID NO: 60758 - DNA, 25 bp, mus musculus
ctctcaattttgcgcaagttgaaaa

SEQ ID NO: 60759 - DNA, 25 bp, mus musculus
tctcaattttgcgcaagttgaaaag

SEQ ID NO: 60760 - DNA, 25 bp, mus musculus
ctcaattttgcgcaagttgaaaagt

SEQ ID NO: 60761 - DNA, 25 bp, mus musculus
caattttgcgcaagttgaaaagtgc

SEQ ID NO: 60762 - DNA, 25 bp, mus musculus
gagaatacttctcctgggcttggat

SEQ ID NO: 60763 - DNA, 25 bp, mus musculus
atacttctcctgggcttggataatg

SEQ ID NO: 60764 - DNA, 25 bp, mus musculus
tacttctcctgggcttggataatgc

SEQ ID NO: 60765 - DNA, 25 bp, mus musculus
tctgggcatccacaatgaagtgtcc

SEQ ID NO: 60766 - DNA, 25 bp, mus musculus
catccacaatgaagtgtccaagatc

SEQ ID NO: 60767 - DNA, 25 bp, mus musculus
catcacgcctcaggagatcaatggc

SEQ ID NO: 60768 - DNA, 25 bp, mus musculus
cacgcctcaggagatcaatggcaaa

SEQ ID NO: 60769 - DNA, 25 bp, mus musculus
ggaccatgtacggcagctagtgccc

SEQ ID NO: 60770 - DNA, 25 bp, mus musculus
tgtacggcagctagtgccccggagg

SEQ ID NO: 60771 - DNA, 25 bp, mus musculus
gaccaggctctcacagaggaacatg

SEQ ID NO: 60772 - DNA, 25 bp, mus musculus
caggctctcacagaggaacatgcaa

SEQ ID NO: 60773 - DNA, 25 bp, mus musculus
ctacgcaaacagtttggcgcacaag

SEQ ID NO: 60774 - DNA, 25 bp, mus musculus
tttggcgcacaagccaatgtcattg

SEQ ID NO: 60775 - DNA, 25 bp, mus musculus
ggcgcacaagccaatgtcattgggc

SEQ ID NO: 60776 - DNA, 25 bp, mus musculus
gcacaagccaatgtcattgggccct

SEQ ID NO: 60777 - DNA, 25 bp, mus musculus
agtgtccaagatcgtccagacctat

SEQ ID NO: 60778 - DNA, 25 bp, mus musculus
gccaatgtcattgggccctggatcc

SEQ ID NO: 60779 - DNA, 25 bp, mus musculus
gtccaagatcgtccagacctatcat

SEQ ID NO: 60780 - DNA, 25 bp, mus musculus
caagatcgtccagacctatcatgtc

SEQ ID NO: 60781 - DNA, 25 bp, mus musculus
cgtccagacctatcatgtcaacatg

SEQ ID NO: 60782 - DNA, 25 bp, mus musculus
ccagacctatcatgtcaacatggca

SEQ ID NO: 60783 - DNA, 25 bp, mus musculus
tcatgtcaacatggcaggcaccaac

SEQ ID NO: 60784 - DNA, 25 bp, mus musculus
ctatacaaccatcacgcctcaggag

SEQ ID NO: 60785 - DNA, 25 bp, mus musculus
tacaaccatcacgcctcaggagatc

SEQ ID NO: 60786 - DNA, 25 bp, mus musculus
accccaagacactcagacggaatgt

SEQ ID NO: 60787 - DNA, 25 bp, mus musculus
agacactcagacggaatgttcacca

SEQ ID NO: 60788 - DNA, 25 bp, mus musculus
cctcctggaccaaggtctgctgttg

SEQ ID NO: 60789 - DNA, 25 bp, mus musculus
cctggaccaaggtctgctgttgatc

SEQ ID NO: 60790 - DNA, 25 bp, mus musculus
ccaaggtctgctgttgatcgttcag

SEQ ID NO: 60791 - DNA, 25 bp, mus musculus
tctgctgttgatcgttcagagtgga

SEQ ID NO: 60792 - DNA, 25 bp, mus musculus
gctgttgatcgttcagagtggactg

SEQ ID NO: 60793 - DNA, 25 bp, mus musculus
actgaaacaaccaggccacccagat

SEQ ID NO: 60794 - DNA, 25 bp, mus musculus
aagagtctctaggaccctggctgga

SEQ ID NO: 60795 - DNA, 25 bp, mus musculus
agtctctaggaccctggctggagta

SEQ ID NO: 60796 - DNA, 25 bp, mus musculus
ctctaggaccctggctggagtaggg

SEQ ID NO: 60797 - DNA, 25 bp, mus musculus
taggaccctggctggagtagggatt

SEQ ID NO: 60798 - DNA, 25 bp, mus musculus
atcccagagaacagcctggcccggt

SEQ ID NO: 60799 - DNA, 25 bp, mus musculus
gaggaccagctctgcttgctgtggt

SEQ ID NO: 60800 - DNA, 25 bp, mus musculus
tcgaacactcagaccctacaggact

SEQ ID NO: 60801 - DNA, 25 bp, mus musculus
actcagaccctacaggactggcttc

SEQ ID NO: 60802 - DNA, 25 bp, mus musculus
cagaccctacaggactggcttctgc

SEQ ID NO: 60803 - DNA, 25 bp, mus musculus
ctacaggactggcttctgcccaggc

SEQ ID NO: 60804 - DNA, 25 bp, mus musculus
aggctgtccctggatgggtccctgt

SEQ ID NO: 60805 - DNA, 25 bp, mus musculus
tctctctggctgcctcctggaccaa

SEQ ID NO: 60806 - DNA, 25 bp, mus musculus
agccccagcgcatctgctgctgatc

SEQ ID NO: 60807 - DNA, 25 bp, mus musculus
tgagctcagtggctgctttgccggc

SEQ ID NO: 60808 - DNA, 25 bp, mus musculus
cagccatgtataccaggctctgtgc

SEQ ID NO: 60809 - DNA, 25 bp, mus musculus
tgtataccaggctctgtgcccaggc

SEQ ID NO: 60810 - DNA, 25 bp, mus musculus
tgctagctgatgctagcagaaagcc

SEQ ID NO: 60811 - DNA, 25 bp, mus musculus
gtctcttccatgccctttggctttt

SEQ ID NO: 60812 - DNA, 25 bp, mus musculus
tccatgccctttggcttttacataa

SEQ ID NO: 60813 - DNA, 25 bp, mus musculus
tacataaacctgggcctggagtgtt

SEQ ID NO: 60814 - DNA, 25 bp, mus musculus
gagtgttgtctaccactgagttcta

SEQ ID NO: 60815 - DNA, 25 bp, mus musculus
agcaggaacccacctggatacgtag

SEQ ID NO: 60816 - DNA, 25 bp, mus musculus
gtaatcctctgttttggaaacatct

SEQ ID NO: 60817 - DNA, 25 bp, mus musculus
caaacttgttcttagtagtatgctt

SEQ ID NO: 60818 - DNA, 25 bp, mus musculus
cagtggctgctttgccggctgcaca

SEQ ID NO: 60819 - DNA, 25 bp, mus musculus
ctgctttgccggctgcacagatggt

SEQ ID NO: 60820 - DNA, 25 bp, mus musculus
ctgcacagatggtctctcagagctg

SEQ ID NO: 60821 - DNA, 25 bp, mus musculus
agatggtctctcagagctggtgact

SEQ ID NO: 60822 - DNA, 25 bp, mus musculus
ttgaagcactcattttgctcatttc

SEQ ID NO: 60823 - DNA, 25 bp, mus musculus
cactcattttgctcatttcttcaag

SEQ ID NO: 60824 - DNA, 25 bp, mus musculus
tcatttcttcaagggtttgagtgcc

SEQ ID NO: 60825 - DNA, 25 bp, mus musculus
gagtgccagccatgtataccaggct

SEQ ID NO: 60826 - DNA, 25 bp, mus musculus
tatgacttcttccgtgtagactcag

SEQ ID NO: 60827 - DNA, 25 bp, mus musculus
actgcaggcgactctatgagctacc

SEQ ID NO: 60828 - DNA, 25 bp, mus musculus
tacgccaacctcaatgggctctatg

SEQ ID NO: 60829 - DNA, 25 bp, mus musculus
aacctcaatgggctctatgggagca

SEQ ID NO: 60830 - DNA, 25 bp, mus musculus
acagtggatcaccagggagtgagct

SEQ ID NO: 60831 - DNA, 25 bp, mus musculus
gatcaccagggagtgagctggtacc

SEQ ID NO: 60832 - DNA, 25 bp, mus musculus
ttctctgtgcccttcacggaaatga

SEQ ID NO: 60833 - DNA, 25 bp, mus musculus
gtgcccttcacggaaatgaagctgc

SEQ ID NO: 60834 - DNA, 25 bp, mus musculus
gaaatgaagctgcgacccagaaact

SEQ ID NO: 60835 - DNA, 25 bp, mus musculus
actgccgagcactgaggggttgtgc

SEQ ID NO: 60836 - DNA, 25 bp, mus musculus
gaagagccagcatgccacaccaagg

SEQ ID NO: 60837 - DNA, 25 bp, mus musculus
ccagcatgccacaccaaggaggcct

SEQ ID NO: 60838 - DNA, 25 bp, mus musculus
ggcgactctatgagctaccacagtg

SEQ ID NO: 60839 - DNA, 25 bp, mus musculus
tctatgagctaccacagtggcagtg

SEQ ID NO: 60840 - DNA, 25 bp, mus musculus
gtcttttctgcccgtgatcgagacc

SEQ ID NO: 60841 - DNA, 25 bp, mus musculus
tctgcccgtgatcgagaccccaaca

SEQ ID NO: 60842 - DNA, 25 bp, mus musculus
cgagaccccaacaacttgctcatct

SEQ ID NO: 60843 - DNA, 25 bp, mus musculus
cccaacaacttgctcatctcttgcg

SEQ ID NO: 60844 - DNA, 25 bp, mus musculus
gctgtctcttatcgtggggcttggt

SEQ ID NO: 60845 - DNA, 25 bp, mus musculus
tgtcactacgccaacctcaatgggc

SEQ ID NO: 60846 - DNA, 25 bp, mus musculus
agccttgctgagtcactttatacag

SEQ ID NO: 60847 - DNA, 25 bp, mus musculus
tcactttatacagccagtttatatc

SEQ ID NO: 60848 - DNA, 25 bp, mus musculus
tcctctgcagataaacttggaccat

SEQ ID NO: 60849 - DNA, 25 bp, mus musculus
taaatcactcagtttgaattgggca

SEQ ID NO: 60850 - DNA, 25 bp, mus musculus
atcaatggcaagtcggctttgtaag

SEQ ID NO: 60851 - DNA, 25 bp, mus musculus
tttacttgaagctcggacataccac

SEQ ID NO: 60852 - DNA, 25 bp, mus musculus
tatgtctggaccctatcaagaagca

SEQ ID NO: 60853 - DNA, 25 bp, mus musculus
tggaccctatcaagaagcaaaggcg

SEQ ID NO: 60854 - DNA, 25 bp, mus musculus
gttactgaaggcctacttgcagcag

SEQ ID NO: 60855 - DNA, 25 bp, mus musculus
ctacttgcagcagcatggctatggc

SEQ ID NO: 60856 - DNA, 25 bp, mus musculus
gcatggctatggctcctggattgtg

SEQ ID NO: 60857 - DNA, 25 bp, mus musculus
gattgtgaaatctccctgtatagag

SEQ ID NO: 60858 - DNA, 25 bp, mus musculus
tatacagccagtttatatcagcagt

SEQ ID NO: 60859 - DNA, 25 bp, mus musculus
ttatatcagcagtatacttgttggt

SEQ ID NO: 60860 - DNA, 25 bp, mus musculus
tatacttgttggtgatgggaattgc

SEQ ID NO: 60861 - DNA, 25 bp, mus musculus
cgcaataaaccagcgtgttgatgac

SEQ ID NO: 60862 - DNA, 25 bp, mus musculus
aaaccagcgtgttgatgacgcactc

SEQ ID NO: 60863 - DNA, 25 bp, mus musculus
cacatcaaaactgcccatgttttac

SEQ ID NO: 60864 - DNA, 25 bp, mus musculus
gttttacttggtcaacagacctcat

SEQ ID NO: 60865 - DNA, 25 bp, mus musculus
acctcatattagcttagtgcccacc

SEQ ID NO: 60866 - DNA, 25 bp, mus musculus
ggtcgttgcttcatcaggaagagct

SEQ ID NO: 60867 - DNA, 25 bp, mus musculus
cgttgcttcatcaggaagagctgaa

SEQ ID NO: 60868 - DNA, 25 bp, mus musculus
ttctcaagcagctgtgctctccgag

SEQ ID NO: 60869 - DNA, 25 bp, mus musculus
tcaagcagctgtgctctccgagaac

SEQ ID NO: 60870 - DNA, 25 bp, mus musculus
ctccgagaactgtgtgcgagatctg

SEQ ID NO: 60871 - DNA, 25 bp, mus musculus
gagtgactctgtccccgacacgaaa

SEQ ID NO: 60872 - DNA, 25 bp, mus musculus
gcccggcagcaaacctgaattcggc

SEQ ID NO: 60873 - DNA, 25 bp, mus musculus
cggcagcaaacctgaattcggcatt

SEQ ID NO: 60874 - DNA, 25 bp, mus musculus
caaacctgaattcggcatttcttct

SEQ ID NO: 60875 - DNA, 25 bp, mus musculus
tgaattcggcatttcttctttaaat

SEQ ID NO: 60876 - DNA, 25 bp, mus musculus
cggcatttcttctttaaatggactg

SEQ ID NO: 60877 - DNA, 25 bp, mus musculus
catttcttctttaaatggactgatg

SEQ ID NO: 60878 - DNA, 25 bp, mus musculus
tgcttcatcaggaagagctgaagtt

SEQ ID NO: 60879 - DNA, 25 bp, mus musculus
ttcttctttaaatggactgatgtat

SEQ ID NO: 60880 - DNA, 25 bp, mus musculus
aataccctgctgggcatagttcagc

SEQ ID NO: 60881 - DNA, 25 bp, mus musculus
accctgctgggcatagttcagccag

SEQ ID NO: 60882 - DNA, 25 bp, mus musculus
accacaggagttgggccagagagag

SEQ ID NO: 60883 - DNA, 25 bp, mus musculus
aaagcttcaatgttctcaagcagct

SEQ ID NO: 60884 - DNA, 25 bp, mus musculus
gcttcaatgttctcaagcagctgtg

SEQ ID NO: 60885 - DNA, 25 bp, mus musculus
tcaatgttctcaagcagctgtgctc

SEQ ID NO: 60886 - DNA, 25 bp, mus musculus
atgttctcaagcagctgtgctctcc

SEQ ID NO: 60887 - DNA, 25 bp, mus musculus
gacttgcactacaaattcaattttt

SEQ ID NO: 60888 - DNA, 25 bp, mus musculus
tatatactatcttccctgcctgtat

SEQ ID NO: 60889 - DNA, 25 bp, mus musculus
tttaagaatctcaactcagagtctt

SEQ ID NO: 60890 - DNA, 25 bp, mus musculus
tatttatggactctctttgccgttc

SEQ ID NO: 60891 - DNA, 25 bp, mus musculus
ttatggactctctttgccgttcaaa

SEQ ID NO: 60892 - DNA, 25 bp, mus musculus
ctctttgccgttcaaaagcagacag

SEQ ID NO: 60893 - DNA, 25 bp, mus musculus
aaagtccaggccagcactcgtcatt

SEQ ID NO: 60894 - DNA, 25 bp, mus musculus
agcactcgtcattttattcataatt

SEQ ID NO: 60895 - DNA, 25 bp, mus musculus
actcgtcattttattcataatttca

SEQ ID NO: 60896 - DNA, 25 bp, mus musculus
cataatttcatccattatttccctg

SEQ ID NO: 60897 - DNA, 25 bp, mus musculus
ttcatccattatttccctgatttca

SEQ ID NO: 60898 - DNA, 25 bp, mus musculus
cattatttccctgatttcattgaaa

SEQ ID NO: 60899 - DNA, 25 bp, mus musculus
atactatcttccctgcctgtatttt

SEQ ID NO: 60900 - DNA, 25 bp, mus musculus
tgacatgagctacctgggtccattc

SEQ ID NO: 60901 - DNA, 25 bp, mus musculus
catgagctacctgggtccattcctc

SEQ ID NO: 60902 - DNA, 25 bp, mus musculus
aggtttgagctccacagtgtttcag

SEQ ID NO: 60903 - DNA, 25 bp, mus musculus
gagctccacagtgtttcagcctttt

SEQ ID NO: 60904 - DNA, 25 bp, mus musculus
gccttttctgcgtcagtgtgagtca

SEQ ID NO: 60905 - DNA, 25 bp, mus musculus
ttttctgcgtcagtgtgagtcatgt

SEQ ID NO: 60906 - DNA, 25 bp, mus musculus
tctgcgtcagtgtgagtcatgtggc

SEQ ID NO: 60907 - DNA, 25 bp, mus musculus
gaaatgacagctgcttgctacccca

SEQ ID NO: 60908 - DNA, 25 bp, mus musculus
atgacagctgcttgctaccccagga

SEQ ID NO: 60909 - DNA, 25 bp, mus musculus
gtgaatcctcagtgggccttggaca

SEQ ID NO: 60910 - DNA, 25 bp, mus musculus
tgggccttggacagcaccagaccaa

SEQ ID NO: 60911 - DNA, 25 bp, mus musculus
ttggacagcaccagaccaagctcta

SEQ ID NO: 60912 - DNA, 25 bp, mus musculus
tcctcaacactaccaagctcagtga

SEQ ID NO: 60913 - DNA, 25 bp, mus musculus
tcaacactaccaagctcagtgaaga

SEQ ID NO: 60914 - DNA, 25 bp, mus musculus
ctaccaagctcagtgaagagctgtt

SEQ ID NO: 60915 - DNA, 25 bp, mus musculus
aagagctgttctaccagatactcat

SEQ ID NO: 60916 - DNA, 25 bp, mus musculus
agctgttctaccagatactcattta

SEQ ID NO: 60917 - DNA, 25 bp, mus musculus
tctaccagatactcatttatgattt

SEQ ID NO: 60918 - DNA, 25 bp, mus musculus
ttgccaactttggtgttctgaggtt

SEQ ID NO: 60919 - DNA, 25 bp, mus musculus
atcattaacctcaccagcgtcttga

SEQ ID NO: 60920 - DNA, 25 bp, mus musculus
tatcggaaccagcgccactcttcga

SEQ ID NO: 60921 - DNA, 25 bp, mus musculus
accagcgtcttgagtctccaggaag

SEQ ID NO: 60922 - DNA, 25 bp, mus musculus
agcgtcttgagtctccaggaagaga

SEQ ID NO: 60923 - DNA, 25 bp, mus musculus
attagtgagcggtgccatgagactc

SEQ ID NO: 60924 - DNA, 25 bp, mus musculus
tgccatgagactctccgggagatgc

SEQ ID NO: 60925 - DNA, 25 bp, mus musculus
catgagactctccgggagatgctcc

SEQ ID NO: 60926 - DNA, 25 bp, mus musculus
atgctccgtaaccattcctttgtgg

SEQ ID NO: 60927 - DNA, 25 bp, mus musculus
tgtgtgaatcctcagtgggccttgg

SEQ ID NO: 60928 - DNA, 25 bp, mus musculus
acaatatctcgtaattcagagggat

SEQ ID NO: 60929 - DNA, 25 bp, mus musculus
agccctggccactggcctgtacaca

SEQ ID NO: 60930 - DNA, 25 bp, mus musculus
agctttgctttctggatacaataaa

SEQ ID NO: 60931 - DNA, 25 bp, mus musculus
aaggtacacacctctagatagtgcc

SEQ ID NO: 60932 - DNA, 25 bp, mus musculus
cacacctctagatagtgccacacag

SEQ ID NO: 60933 - DNA, 25 bp, mus musculus
tctagatagtgccacacagagtcca

SEQ ID NO: 60934 - DNA, 25 bp, mus musculus
cacacagagtccagaagggttttgt

SEQ ID NO: 60935 - DNA, 25 bp, mus musculus
gtaagctcagcatatttgtacatat

SEQ ID NO: 60936 - DNA, 25 bp, mus musculus
agtttcgctagaacacaagcaaagc

SEQ ID NO: 60937 - DNA, 25 bp, mus musculus
gcaaagcctttgcttatgacgtcac

SEQ ID NO: 60938 - DNA, 25 bp, mus musculus
cctttgcttatgacgtcacatgtac

SEQ ID NO: 60939 - DNA, 25 bp, mus musculus
cttatgacgtcacatgtacaaaata

SEQ ID NO: 60940 - DNA, 25 bp, mus musculus
ggccactggcctgtacacaagaatt

SEQ ID NO: 60941 - DNA, 25 bp, mus musculus
tgggacctcgcttgggatctggcta

SEQ ID NO: 60942 - DNA, 25 bp, mus musculus
ctcgcttgggatctggctagaattg

SEQ ID NO: 60943 - DNA, 25 bp, mus musculus
cccagtgtgccagttcataagaatc

SEQ ID NO: 60944 - DNA, 25 bp, mus musculus
tttgacaacatccacagggacattg

SEQ ID NO: 60945 - DNA, 25 bp, mus musculus
aacatccacagggacattgtccagt

SEQ ID NO: 60946 - DNA, 25 bp, mus musculus
gacattgtccagtcatttcaggaca

SEQ ID NO: 60947 - DNA, 25 bp, mus musculus
ctgcatagctttgctttctggatac

SEQ ID NO: 60948 - DNA, 25 bp, mus musculus
ccaaaactacaacatgaattggcaa

SEQ ID NO: 60949 - DNA, 25 bp, mus musculus
gggtgaccaaaccagccttcagagc

SEQ ID NO: 60950 - DNA, 25 bp, mus musculus
tcctacttcagactttacttgtggt

SEQ ID NO: 60951 - DNA, 25 bp, mus musculus
tacttcagactttacttgtggtgtg

SEQ ID NO: 60952 - DNA, 25 bp, mus musculus
ttcagactttacttgtggtgtgacc

SEQ ID NO: 60953 - DNA, 25 bp, mus musculus
aatcttattccgagcattccagtaa

SEQ ID NO: 60954 - DNA, 25 bp, mus musculus
cttattccgagcattccagtaactt

SEQ ID NO: 60955 - DNA, 25 bp, mus musculus
attccgagcattccagtaacttttg

SEQ ID NO: 60956 - DNA, 25 bp, mus musculus
ccgagcattccagtaacttttgtgt

SEQ ID NO: 60957 - DNA, 25 bp, mus musculus
agcattccagtaacttttgtgtatg

SEQ ID NO: 60958 - DNA, 25 bp, mus musculus
gtacctagctgtactataagtagtt

SEQ ID NO: 60959 - DNA, 25 bp, mus musculus
tgaaacaatgtccaacaataaaccg

SEQ ID NO: 60960 - DNA, 25 bp, mus musculus
tgaccaaaccagccttcagagcgtt

SEQ ID NO: 60961 - DNA, 25 bp, mus musculus
aaccagccttcagagcgttttctgt

SEQ ID NO: 60962 - DNA, 25 bp, mus musculus
cagccttcagagcgttttctgtcct

SEQ ID NO: 60963 - DNA, 25 bp, mus musculus
ccttcagagcgttttctgtcctact

SEQ ID NO: 60964 - DNA, 25 bp, mus musculus
tcagagcgttttctgtcctacttca

SEQ ID NO: 60965 - DNA, 25 bp, mus musculus
gagcgttttctgtcctacttcagac

SEQ ID NO: 60966 - DNA, 25 bp, mus musculus
tttctgtcctacttcagactttact

SEQ ID NO: 60967 - DNA, 25 bp, mus musculus
ctgtcctacttcagactttacttgt

SEQ ID NO: 60968 - DNA, 25 bp, mus musculus
tgtcccccagaggacaaaatagagg

SEQ ID NO: 60969 - DNA, 25 bp, mus musculus
tcccccagaggacaaaatagaggag

SEQ ID NO: 60970 - DNA, 25 bp, mus musculus
ctcaaacctaattaggcaccagaga

SEQ ID NO: 60971 - DNA, 25 bp, mus musculus
caaacctaattaggcaccagagaat

SEQ ID NO: 60972 - DNA, 25 bp, mus musculus
cctaattaggcaccagagaatacat

SEQ ID NO: 60973 - DNA, 25 bp, mus musculus
taattaggcaccagagaatacatgc

SEQ ID NO: 60974 - DNA, 25 bp, mus musculus
ctttggtggacacccacattttctg

SEQ ID NO: 60975 - DNA, 25 bp, mus musculus
ggtggacacccacattttctgtcac

SEQ ID NO: 60976 - DNA, 25 bp, mus musculus
tggacacccacattttctgtcactg

SEQ ID NO: 60977 - DNA, 25 bp, mus musculus
gacacccacattttctgtcactgca

SEQ ID NO: 60978 - DNA, 25 bp, mus musculus
cacccacattttctgtcactgcaca

SEQ ID NO: 60979 - DNA, 25 bp, mus musculus
cccacattttctgtcactgcacaga

SEQ ID NO: 60980 - DNA, 25 bp, mus musculus
gaacagcccaagaaactccatttgt

SEQ ID NO: 60981 - DNA, 25 bp, mus musculus
acagcccaagaaactccatttgtgt

SEQ ID NO: 60982 - DNA, 25 bp, mus musculus
cccaagaaactccatttgtgtgcct

SEQ ID NO: 60983 - DNA, 25 bp, mus musculus
caagaaactccatttgtgtgccttg

SEQ ID NO: 60984 - DNA, 25 bp, mus musculus
aaactccatttgtgtgccttgtgtg

SEQ ID NO: 60985 - DNA, 25 bp, mus musculus
tttgtgtgccttgtgtggcaagaac

SEQ ID NO: 60986 - DNA, 25 bp, mus musculus
tgtgtgccttgtgtggcaagaactt

SEQ ID NO: 60987 - DNA, 25 bp, mus musculus
tgtgccttgtgtggcaagaactttt

SEQ ID NO: 60988 - DNA, 25 bp, mus musculus
tgtgctgagctctacgagaagctgc

SEQ ID NO: 60989 - DNA, 25 bp, mus musculus
tacgagaagctgcctcaaggctatc

SEQ ID NO: 60990 - DNA, 25 bp, mus musculus
tacgtgaacatgtcgctgtttgaga

SEQ ID NO: 60991 - DNA, 25 bp, mus musculus
aacatgtcgctgtttgagaacttca

SEQ ID NO: 60992 - DNA, 25 bp, mus musculus
tttgagaacttcacctatgcgggca

SEQ ID NO: 60993 - DNA, 25 bp, mus musculus
aacttcacctatgcgggcatcgatg

SEQ ID NO: 60994 - DNA, 25 bp, mus musculus
acctatgcgggcatcgatgccacag

SEQ ID NO: 60995 - DNA, 25 bp, mus musculus
gctctgctggccggagcaaattgct

SEQ ID NO: 60996 - DNA, 25 bp, mus musculus
aattgcttccacctgtgactttgga

SEQ ID NO: 60997 - DNA, 25 bp, mus musculus
tctgacccaagctgtctcaagaaag

SEQ ID NO: 60998 - DNA, 25 bp, mus musculus
ccaagctgtctcaagaaagtcttta

SEQ ID NO: 60999 - DNA, 25 bp, mus musculus
ttcttgccagctgttcccatagcta

SEQ ID NO: 61000 - DNA, 25 bp, mus musculus
aagctgcctcaaggctatcgcatgg

SEQ ID NO: 61001 - DNA, 25 bp, mus musculus
cctcaaggctatcgcatggagcagc

SEQ ID NO: 61002 - DNA, 25 bp, mus musculus
gagcagcctcgaaactgcgatgacg

SEQ ID NO: 61003 - DNA, 25 bp, mus musculus
cctcgaaactgcgatgacgaagtgt

SEQ ID NO: 61004 - DNA, 25 bp, mus musculus
tacgagctgatgcggcagtgctggc

SEQ ID NO: 61005 - DNA, 25 bp, mus musculus
ctacagttgggccgcatgctggaag

SEQ ID NO: 61006 - DNA, 25 bp, mus musculus
ttgggccgcatgctggaagccagga

SEQ ID NO: 61007 - DNA, 25 bp, mus musculus
aaggcctacgtgaacatgtcgctgt

SEQ ID NO: 61008 - DNA, 25 bp, mus musculus
tcatcttgggacagctgccacatag

SEQ ID NO: 61009 - DNA, 25 bp, mus musculus
tgggacagctgccacataggactga

SEQ ID NO: 61010 - DNA, 25 bp, mus musculus
ttgcacagccaaccttcctggtcct

SEQ ID NO: 61011 - DNA, 25 bp, mus musculus
ccttcctggtcctcaggcattgggg

SEQ ID NO: 61012 - DNA, 25 bp, mus musculus
tggtcctcaggcattgggggacatc

SEQ ID NO: 61013 - DNA, 25 bp, mus musculus
cttcatcctgtcagctccacgctgt

SEQ ID NO: 61014 - DNA, 25 bp, mus musculus
cctgtcagctccacgctgtcctgga

SEQ ID NO: 61015 - DNA, 25 bp, mus musculus
tcctggacctgtgtctcctcacacg

SEQ ID NO: 61016 - DNA, 25 bp, mus musculus
acctgtgtctcctcacacgcacagt

SEQ ID NO: 61017 - DNA, 25 bp, mus musculus
tcacacgcacagtgtatctcctcat

SEQ ID NO: 61018 - DNA, 25 bp, mus musculus
gcacagtgtatctcctcatttccac

SEQ ID NO: 61019 - DNA, 25 bp, mus musculus
tgtatctcctcatttccacactgaa

SEQ ID NO: 61020 - DNA, 25 bp, mus musculus
agctgccacataggactgagtcact

SEQ ID NO: 61021 - DNA, 25 bp, mus musculus
agtcactagttctgacttctgaaca

SEQ ID NO: 61022 - DNA, 25 bp, mus musculus
tagttctgacttctgaacagtgaaa

SEQ ID NO: 61023 - DNA, 25 bp, mus musculus
atcactttgggcagcagtgtctgcg

SEQ ID NO: 61024 - DNA, 25 bp, mus musculus
acaccaagactcagaccctacatta

SEQ ID NO: 61025 - DNA, 25 bp, mus musculus
agactcagaccctacattagccatc

SEQ ID NO: 61026 - DNA, 25 bp, mus musculus
agaccctacattagccatcatccct

SEQ ID NO: 61027 - DNA, 25 bp, mus musculus
tacattagccatcatcccttgcaca

SEQ ID NO: 61028 - DNA, 25 bp, mus musculus
tcagtcatctagaggacctgcggct

SEQ ID NO: 61029 - DNA, 25 bp, mus musculus
cctcacctgagcagagagcggtaac

SEQ ID NO: 61030 - DNA, 25 bp, mus musculus
gtccctggtccctacagtcatctta

SEQ ID NO: 61031 - DNA, 25 bp, mus musculus
cctggtccctacagtcatcttagga

SEQ ID NO: 61032 - DNA, 25 bp, mus musculus
ggtccctacagtcatcttaggatct

SEQ ID NO: 61033 - DNA, 25 bp, mus musculus
tacagtcatcttaggatctgcaggc

SEQ ID NO: 61034 - DNA, 25 bp, mus musculus
agtcatcttaggatctgcaggcccc

SEQ ID NO: 61035 - DNA, 25 bp, mus musculus
catcttaggatctgcaggcccctcg

SEQ ID NO: 61036 - DNA, 25 bp, mus musculus
ttaggtcacccttgtttcagcaaga

SEQ ID NO: 61037 - DNA, 25 bp, mus musculus
ggtcacccttgtttcagcaagacac

SEQ ID NO: 61038 - DNA, 25 bp, mus musculus
cacccttgtttcagcaagacacact

SEQ ID NO: 61039 - DNA, 25 bp, mus musculus
tgtttcagcaagacacactgacctt

SEQ ID NO: 61040 - DNA, 25 bp, mus musculus
cacctgagcagagagcggtaacagg

SEQ ID NO: 61041 - DNA, 25 bp, mus musculus
gacctgtatcctcaagactcctgtg

SEQ ID NO: 61042 - DNA, 25 bp, mus musculus
ctgtatcctcaagactcctgtgctt

SEQ ID NO: 61043 - DNA, 25 bp, mus musculus
tatcctcaagactcctgtgctttga

SEQ ID NO: 61044 - DNA, 25 bp, mus musculus
caagactcctgtgctttgaagactc

SEQ ID NO: 61045 - DNA, 25 bp, mus musculus
gactcctgtgctttgaagactcagt

SEQ ID NO: 61046 - DNA, 25 bp, mus musculus
cagtttactgagccagcttccaggg

SEQ ID NO: 61047 - DNA, 25 bp, mus musculus
tttactgagccagcttccagggtcc

SEQ ID NO: 61048 - DNA, 25 bp, mus musculus
aagctccatgtcgaccagccgcaag

SEQ ID NO: 61049 - DNA, 25 bp, mus musculus
catgtcgaccagccgcaagctaaag

SEQ ID NO: 61050 - DNA, 25 bp, mus musculus
aagtcgcaattaccgatcccacttg

SEQ ID NO: 61051 - DNA, 25 bp, mus musculus
tcgcaattaccgatcccacttgtga

SEQ ID NO: 61052 - DNA, 25 bp, mus musculus
caattaccgatcccacttgtgatgc

SEQ ID NO: 61053 - DNA, 25 bp, mus musculus
ccgatcccacttgtgatgcggcaat

SEQ ID NO: 61054 - DNA, 25 bp, mus musculus
ccacttgtgatgcggcaatgagctc

SEQ ID NO: 61055 - DNA, 25 bp, mus musculus
caatgagctctgccctggtggtctt

SEQ ID NO: 61056 - DNA, 25 bp, mus musculus
tgagctctgccctggtggtcttcaa

SEQ ID NO: 61057 - DNA, 25 bp, mus musculus
gctctgccctggtggtcttcaaaca

SEQ ID NO: 61058 - DNA, 25 bp, mus musculus
ctgccctggtggtcttcaaacaaca

SEQ ID NO: 61059 - DNA, 25 bp, mus musculus
gtggtcttcaaacaacacggggcag

SEQ ID NO: 61060 - DNA, 25 bp, mus musculus
gtcgaccagccgcaagctaaagact

SEQ ID NO: 61061 - DNA, 25 bp, mus musculus
gaccagccgcaagctaaagactcat

SEQ ID NO: 61062 - DNA, 25 bp, mus musculus
aggcaagaaccgagctcctcacaag

SEQ ID NO: 61063 - DNA, 25 bp, mus musculus
caagaaccgagctcctcacaagggc

SEQ ID NO: 61064 - DNA, 25 bp, mus musculus
ccgagctcctcacaagggcgtcaag

SEQ ID NO: 61065 - DNA, 25 bp, mus musculus
agctcctcacaagggcgtcaagaga

SEQ ID NO: 61066 - DNA, 25 bp, mus musculus
tcctcacaagggcgtcaagagaggt

SEQ ID NO: 61067 - DNA, 25 bp, mus musculus
tcacaagggcgtcaagagaggtgga

SEQ ID NO: 61068 - DNA, 25 bp, mus musculus
gcaccaggcccgactgtttcttgga

SEQ ID NO: 61069 - DNA, 25 bp, mus musculus
cgactgtttcttggaagtagccgat

SEQ ID NO: 61070 - DNA, 25 bp, mus musculus
tgctgtagctgtggcttctgaccgc

SEQ ID NO: 61071 - DNA, 25 bp, mus musculus
gtagctgtggcttctgaccgctgct

SEQ ID NO: 61072 - DNA, 25 bp, mus musculus
catccacctgcagctgcaggtgcta

SEQ ID NO: 61073 - DNA, 25 bp, mus musculus
ctgcagctgcaggtgctagtggacc

SEQ ID NO: 61074 - DNA, 25 bp, mus musculus
gcagctgcaggtgctagtggaccca

SEQ ID NO: 61075 - DNA, 25 bp, mus musculus
cagctgcaggtgctagtggacccag

SEQ ID NO: 61076 - DNA, 25 bp, mus musculus
ccagcccgggagttgggcaagctgc

SEQ ID NO: 61077 - DNA, 25 bp, mus musculus
caagctgcaggccaagcgaagtgag

SEQ ID NO: 61078 - DNA, 25 bp, mus musculus
gctgcaggccaagcgaagtgaggca

SEQ ID NO: 61079 - DNA, 25 bp, mus musculus
ctgcaggccaagcgaagtgaggcac

SEQ ID NO: 61080 - DNA, 25 bp, mus musculus
ctgtttcttggaagtagccgatgac

SEQ ID NO: 61081 - DNA, 25 bp, mus musculus
tttcttggaagtagccgatgacgca

SEQ ID NO: 61082 - DNA, 25 bp, mus musculus
tagccgatgacgcacaggtgccttg

SEQ ID NO: 61083 - DNA, 25 bp, mus musculus
agccgatgacgcacaggtgccttgg

SEQ ID NO: 61084 - DNA, 25 bp, mus musculus
cacgcagcttgctgctgtagctgtg

SEQ ID NO: 61085 - DNA, 25 bp, mus musculus
cttgctgctgtagctgtggcttctg

SEQ ID NO: 61086 - DNA, 25 bp, mus musculus
tgctgctgtagctgtggcttctgac

SEQ ID NO: 61087 - DNA, 25 bp, mus musculus
gctgctgtagctgtggcttctgacc

SEQ ID NO: 61088 - DNA, 25 bp, mus musculus
atactacaccttaatggacattgcg

SEQ ID NO: 61089 - DNA, 25 bp, mus musculus
cattgcgtacatctacccctggcga

SEQ ID NO: 61090 - DNA, 25 bp, mus musculus
cgctgggaccaccacagctaccaat

SEQ ID NO: 61091 - DNA, 25 bp, mus musculus
tgggaccaccacagctaccaatggg

SEQ ID NO: 61092 - DNA, 25 bp, mus musculus
gaccaccacagctaccaatgggggc

SEQ ID NO: 61093 - DNA, 25 bp, mus musculus
caccacagctaccaatgggggcact

SEQ ID NO: 61094 - DNA, 25 bp, mus musculus
cacagctaccaatgggggcacttcg

SEQ ID NO: 61095 - DNA, 25 bp, mus musculus
taccaatgggggcacttcgaactgc

SEQ ID NO: 61096 - DNA, 25 bp, mus musculus
gggcacttcgaactgcctgcaaacg

SEQ ID NO: 61097 - DNA, 25 bp, mus musculus
cacttcgaactgcctgcaaacgcca

SEQ ID NO: 61098 - DNA, 25 bp, mus musculus
ttcgaactgcctgcaaacgccatcc

SEQ ID NO: 61099 - DNA, 25 bp, mus musculus
tggttcctcccattttcagagtggg

SEQ ID NO: 61100 - DNA, 25 bp, mus musculus
catctacccctggcgaaggaatggg

SEQ ID NO: 61101 - DNA, 25 bp, mus musculus
caagtaccgtgtccagccagcctgc

SEQ ID NO: 61102 - DNA, 25 bp, mus musculus
ctcagaaggcaccaacaccagcggg

SEQ ID NO: 61103 - DNA, 25 bp, mus musculus
caccaacaccagcggggcatcagag

SEQ ID NO: 61104 - DNA, 25 bp, mus musculus
caacaccagcggggcatcagagtgt

SEQ ID NO: 61105 - DNA, 25 bp, mus musculus
caccagcggggcatcagagtgtgag

SEQ ID NO: 61106 - DNA, 25 bp, mus musculus
ttcaactgccgctgggaccaccaca

SEQ ID NO: 61107 - DNA, 25 bp, mus musculus
aactgccgctgggaccaccacagct

SEQ ID NO: 61108 - DNA, 25 bp, mus musculus
gttaagtctaggcttgaggtgtcgg

SEQ ID NO: 61109 - DNA, 25 bp, mus musculus
tgcttttcaaatgcccccaaggtct

SEQ ID NO: 61110 - DNA, 25 bp, mus musculus
aatccacacaaagacaatgatgggt

SEQ ID NO: 61111 - DNA, 25 bp, mus musculus
ttttaccaaccttcaattgcataca

SEQ ID NO: 61112 - DNA, 25 bp, mus musculus
ccttcaattgcatacagtgacaatg

SEQ ID NO: 61113 - DNA, 25 bp, mus musculus
gacaatgttttcctattatgaatgg

SEQ ID NO: 61114 - DNA, 25 bp, mus musculus
ttgagcacgtctatttgtaaaccca

SEQ ID NO: 61115 - DNA, 25 bp, mus musculus
acgtctatttgtaaacccagctgag

SEQ ID NO: 61116 - DNA, 25 bp, mus musculus
atttgtaaacccagctgagaactct

SEQ ID NO: 61117 - DNA, 25 bp, mus musculus
tgtaaacccagctgagaactctggt

SEQ ID NO: 61118 - DNA, 25 bp, mus musculus
aaacccagctgagaactctggtgac

SEQ ID NO: 61119 - DNA, 25 bp, mus musculus
taccaagagcccggaagtacataga

SEQ ID NO: 61120 - DNA, 25 bp, mus musculus
aagcacttggaatcacgggttgaag

SEQ ID NO: 61121 - DNA, 25 bp, mus musculus
ggaatgcctgatcttgcccatgtga

SEQ ID NO: 61122 - DNA, 25 bp, mus musculus
atgcctgatcttgcccatgtgatgc

SEQ ID NO: 61123 - DNA, 25 bp, mus musculus
gatcttgcccatgtgatgcgcattt

SEQ ID NO: 61124 - DNA, 25 bp, mus musculus
atgcgcattttgtctgcagaaaata

SEQ ID NO: 61125 - DNA, 25 bp, mus musculus
ctcgctggcaagcgccatgttattg

SEQ ID NO: 61126 - DNA, 25 bp, mus musculus
ggcaagcgccatgttattgaagctg

SEQ ID NO: 61127 - DNA, 25 bp, mus musculus
agtagacttaatccacacaaagaca

SEQ ID NO: 61128 - DNA, 25 bp, mus musculus
gcaagaacttcccttgtctgtaggt

SEQ ID NO: 61129 - DNA, 25 bp, mus musculus
aggtggccttgtctgtaggtctgtc

SEQ ID NO: 61130 - DNA, 25 bp, mus musculus
ctcttcaacacaccattaggtgggt

SEQ ID NO: 61131 - DNA, 25 bp, mus musculus
tttgttgcccgagaaatggaaggag

SEQ ID NO: 61132 - DNA, 25 bp, mus musculus
aactgctgtgggctgaggttgttcg

SEQ ID NO: 61133 - DNA, 25 bp, mus musculus
gttctccattaattacatgaacttc

SEQ ID NO: 61134 - DNA, 25 bp, mus musculus
ttacatgaacttcctgtagggctac

SEQ ID NO: 61135 - DNA, 25 bp, mus musculus
catgaacttcctgtagggctacaaa

SEQ ID NO: 61136 - DNA, 25 bp, mus musculus
caaagtatctgcggcagttatttaa

SEQ ID NO: 61137 - DNA, 25 bp, mus musculus
aagagcagcaccacctagtggctaa

SEQ ID NO: 61138 - DNA, 25 bp, mus musculus
agcagcaccacctagtggctaaata

SEQ ID NO: 61139 - DNA, 25 bp, mus musculus
agcaccacctagtggctaaataatg

SEQ ID NO: 61140 - DNA, 25 bp, mus musculus
ccttgtctgtaggtctgtcctacag

SEQ ID NO: 61141 - DNA, 25 bp, mus musculus
ctgtaggtctgtcctacagaatgtg

SEQ ID NO: 61142 - DNA, 25 bp, mus musculus
taggtctgtcctacagaatgtgttt

SEQ ID NO: 61143 - DNA, 25 bp, mus musculus
ggcattttccaaaggtcctgaactg

SEQ ID NO: 61144 - DNA, 25 bp, mus musculus
caaaggtcctgaactggcctcttca

SEQ ID NO: 61145 - DNA, 25 bp, mus musculus
aggtcctgaactggcctcttcaaca

SEQ ID NO: 61146 - DNA, 25 bp, mus musculus
tcctgaactggcctcttcaacacac

SEQ ID NO: 61147 - DNA, 25 bp, mus musculus
actggcctcttcaacacaccattag

SEQ ID NO: 61148 - DNA, 25 bp, mus musculus
gatttcaccacacaaggccgcagct

SEQ ID NO: 61149 - DNA, 25 bp, mus musculus
caaggccgcagctcaagacactgga

SEQ ID NO: 61150 - DNA, 25 bp, mus musculus
cagtagcttccatctcatgtgtttc

SEQ ID NO: 61151 - DNA, 25 bp, mus musculus
tctcatgtgtttccacaggagcagt

SEQ ID NO: 61152 - DNA, 25 bp, mus musculus
gtgtttccacaggagcagtgcaggc

SEQ ID NO: 61153 - DNA, 25 bp, mus musculus
cgtgctaatgcctctcctacgcact

SEQ ID NO: 61154 - DNA, 25 bp, mus musculus
ctggcatagactccagatccttcta

SEQ ID NO: 61155 - DNA, 25 bp, mus musculus
gttcattcagaatcagcaaggctct

SEQ ID NO: 61156 - DNA, 25 bp, mus musculus
tccagtcaccacaaagcacaggcga

SEQ ID NO: 61157 - DNA, 25 bp, mus musculus
tgctatagcattttgctggtctggc

SEQ ID NO: 61158 - DNA, 25 bp, mus musculus
agcattttgctggtctggctcagat

SEQ ID NO: 61159 - DNA, 25 bp, mus musculus
ttgctggtctggctcagatatcctc

SEQ ID NO: 61160 - DNA, 25 bp, mus musculus
cgcagctcaagacactggacaggaa

SEQ ID NO: 61161 - DNA, 25 bp, mus musculus
ggcaagtctcaagctgcctgggcaa

SEQ ID NO: 61162 - DNA, 25 bp, mus musculus
tctcaagctgcctgggcaaagacat

SEQ ID NO: 61163 - DNA, 25 bp, mus musculus
tgaggacaccagatgctgagtctta

SEQ ID NO: 61164 - DNA, 25 bp, mus musculus
atgctgagtcttatcatcagcccaa

SEQ ID NO: 61165 - DNA, 25 bp, mus musculus
atcatcagcccaaggctgcagtagc

SEQ ID NO: 61166 - DNA, 25 bp, mus musculus
agcccaaggctgcagtagcttccat

SEQ ID NO: 61167 - DNA, 25 bp, mus musculus
aggctgcagtagcttccatctcatg

SEQ ID NO: 61168 - DNA, 25 bp, mus musculus
acagggaagcttccggcgggatctg

SEQ ID NO: 61169 - DNA, 25 bp, mus musculus
aagcttccggcgggatctgcctgtt

SEQ ID NO: 61170 - DNA, 25 bp, mus musculus
ttggctagctacttcttaaatcgtg

SEQ ID NO: 61171 - DNA, 25 bp, mus musculus
gctagctacttcttaaatcgtgccc

SEQ ID NO: 61172 - DNA, 25 bp, mus musculus
agctacttcttaaatcgtgcccaga

SEQ ID NO: 61173 - DNA, 25 bp, mus musculus
ttcttaaatcgtgcccagagtctgt

SEQ ID NO: 61174 - DNA, 25 bp, mus musculus
aatcgtgcccagagtctgtgtggcc

SEQ ID NO: 61175 - DNA, 25 bp, mus musculus
cagagtctgtgtggcccagagcatg

SEQ ID NO: 61176 - DNA, 25 bp, mus musculus
tccctgtggtggctatgcatccctt

SEQ ID NO: 61177 - DNA, 25 bp, mus musculus
tggtggctatgcatcccttgggcca

SEQ ID NO: 61178 - DNA, 25 bp, mus musculus
tggctatgcatcccttgggccagaa

SEQ ID NO: 61179 - DNA, 25 bp, mus musculus
ctatgcatcccttgggccagaagtt

SEQ ID NO: 61180 - DNA, 25 bp, mus musculus
ggatctgcctgttcagatgtgcaca

SEQ ID NO: 61181 - DNA, 25 bp, mus musculus
atgcatcccttgggccagaagtttt

SEQ ID NO: 61182 - DNA, 25 bp, mus musculus
cacatggctctgtgtgctgtgaacc

SEQ ID NO: 61183 - DNA, 25 bp, mus musculus
ctaccaagcacactgattgagatcc

SEQ ID NO: 61184 - DNA, 25 bp, mus musculus
gagatccacctgacagcggccattg

SEQ ID NO: 61185 - DNA, 25 bp, mus musculus
atccacctgacagcggccattgggc

SEQ ID NO: 61186 - DNA, 25 bp, mus musculus
ctcaagacccgctgtggaggcaagc

SEQ ID NO: 61187 - DNA, 25 bp, mus musculus
aagctgggcttcttggctagctact

SEQ ID NO: 61188 - DNA, 25 bp, mus musculus
ctgggcttcttggctagctacttct

SEQ ID NO: 61189 - DNA, 25 bp, mus musculus
catcatgctgctttcctactgcctc

SEQ ID NO: 61190 - DNA, 25 bp, mus musculus
catgctgctttcctactgcctccga

SEQ ID NO: 61191 - DNA, 25 bp, mus musculus
gcaccctcaattacatagcatcaga

SEQ ID NO: 61192 - DNA, 25 bp, mus musculus
tcaattacatagcatcagaatgagt

SEQ ID NO: 61193 - DNA, 25 bp, mus musculus
aaatttcttgtgttggtgacagaca

SEQ ID NO: 61194 - DNA, 25 bp, mus musculus
tttcttgtgttggtgacagacagct

SEQ ID NO: 61195 - DNA, 25 bp, mus musculus
tgaatctatctggttttgtaaagaa

SEQ ID NO: 61196 - DNA, 25 bp, mus musculus
aaccacaggcacagtacaccatatg

SEQ ID NO: 61197 - DNA, 25 bp, mus musculus
cacaggcacagtacaccatatgcac

SEQ ID NO: 61198 - DNA, 25 bp, mus musculus
cacagtacaccatatgcactctgat

SEQ ID NO: 61199 - DNA, 25 bp, mus musculus
agtacaccatatgcactctgatacc

SEQ ID NO: 61200 - DNA, 25 bp, mus musculus
acaccatatgcactctgatacctta

SEQ ID NO: 61201 - DNA, 25 bp, mus musculus
cctccgacactcggcaagtagagag

SEQ ID NO: 61202 - DNA, 25 bp, mus musculus
ccgacactcggcaagtagagagcac

SEQ ID NO: 61203 - DNA, 25 bp, mus musculus
tagagagcactccctgcctgccagc

SEQ ID NO: 61204 - DNA, 25 bp, mus musculus
cagctgcacactgcatgagaggttt

SEQ ID NO: 61205 - DNA, 25 bp, mus musculus
ctgcacactgcatgagaggttttca

SEQ ID NO: 61206 - DNA, 25 bp, mus musculus
aatctccataaggagtcataacaaa

SEQ ID NO: 61207 - DNA, 25 bp, mus musculus
tttagagcaccctcaattacatagc

SEQ ID NO: 61208 - DNA, 25 bp, mus musculus
agagcaccctcaattacatagcatc

SEQ ID NO: 61209 - DNA, 25 bp, mus musculus
gacaaggacatctctcctttctcct

SEQ ID NO: 61210 - DNA, 25 bp, mus musculus
cctttctcctacacggcaccgagat

SEQ ID NO: 61211 - DNA, 25 bp, mus musculus
tccttcgtgttccggcatctgctgc

SEQ ID NO: 61212 - DNA, 25 bp, mus musculus
ttccggcatctgctgcctctcacag

SEQ ID NO: 61213 - DNA, 25 bp, mus musculus
cggcatctgctgcctctcacagaca

SEQ ID NO: 61214 - DNA, 25 bp, mus musculus
ctgctgcctctcacagacagagtcg

SEQ ID NO: 61215 - DNA, 25 bp, mus musculus
ctgcctctcacagacagagtcgaca

SEQ ID NO: 61216 - DNA, 25 bp, mus musculus
cctctcacagacagagtcgacagct

SEQ ID NO: 61217 - DNA, 25 bp, mus musculus
ctcacagacagagtcgacagcttca

SEQ ID NO: 61218 - DNA, 25 bp, mus musculus
agagtcgacagcttcaacgaggaag

SEQ ID NO: 61219 - DNA, 25 bp, mus musculus
gtcgacagcttcaacgaggaagtga

SEQ ID NO: 61220 - DNA, 25 bp, mus musculus
tgtgttgatgcggtcctccaggctg

SEQ ID NO: 61221 - DNA, 25 bp, mus musculus
tcctacacggcaccgagataccaga

SEQ ID NO: 61222 - DNA, 25 bp, mus musculus
aggctgctgtctgcaaggagaagat

SEQ ID NO: 61223 - DNA, 25 bp, mus musculus
tacacggcaccgagataccagacca

SEQ ID NO: 61224 - DNA, 25 bp, mus musculus
acggcaccgagataccagaccaatc

SEQ ID NO: 61225 - DNA, 25 bp, mus musculus
gcaccgagataccagaccaatccgt

SEQ ID NO: 61226 - DNA, 25 bp, mus musculus
agataccagaccaatccgtgtattg

SEQ ID NO: 61227 - DNA, 25 bp, mus musculus
taccagaccaatccgtgtattggtt

SEQ ID NO: 61228 - DNA, 25 bp, mus musculus
cagaccaatccgtgtattggttaca

SEQ ID NO: 61229 - DNA, 25 bp, mus musculus
gcctccttcgtgttccggcatctgc

SEQ ID NO: 61230 - DNA, 25 bp, mus musculus
tcgatgctgccatttctaataaaga

SEQ ID NO: 61231 - DNA, 25 bp, mus musculus
ctgccatttctaataaagagaaaag

SEQ ID NO: 61232 - DNA, 25 bp, mus musculus
ggcatcctgtgttttaactgatgct

SEQ ID NO: 61233 - DNA, 25 bp, mus musculus
gctttgttcagcatgtgctatggca

SEQ ID NO: 61234 - DNA, 25 bp, mus musculus
ttcagcatgtgctatggcagaacca

SEQ ID NO: 61235 - DNA, 25 bp, mus musculus
tggatgacaccagtcaacgtcaagt

SEQ ID NO: 61236 - DNA, 25 bp, mus musculus
acaccagtcaacgtcaagttgtcaa

SEQ ID NO: 61237 - DNA, 25 bp, mus musculus
gcttacactgtgtcccaaggagagg

SEQ ID NO: 61238 - DNA, 25 bp, mus musculus
aggcactcctgggccacaaacaagt

SEQ ID NO: 61239 - DNA, 25 bp, mus musculus
tcctgggccacaaacaagtgtctga

SEQ ID NO: 61240 - DNA, 25 bp, mus musculus
gccacaaacaagtgtctgaactgtg

SEQ ID NO: 61241 - DNA, 25 bp, mus musculus
tgtctgaactgtgtagatggtttgt

SEQ ID NO: 61242 - DNA, 25 bp, mus musculus
aggactttccaggtgttgactcaag

SEQ ID NO: 61243 - DNA, 25 bp, mus musculus
ttccaggtgttgactcaagggtgga

SEQ ID NO: 61244 - DNA, 25 bp, mus musculus
ttgggtttctctacttcttcagtgg

SEQ ID NO: 61245 - DNA, 25 bp, mus musculus
ttctctacttcttcagtggatcttc

SEQ ID NO: 61246 - DNA, 25 bp, mus musculus
acttcttcagtggatcttcgcagtt

SEQ ID NO: 61247 - DNA, 25 bp, mus musculus
tcagtggatcttcgcagttggaatt

SEQ ID NO: 61248 - DNA, 25 bp, mus musculus
gatcttcgcagttggaatttgaccc

SEQ ID NO: 61249 - DNA, 25 bp, mus musculus
aagtgacccacatattgaagagcaa

SEQ ID NO: 61250 - DNA, 25 bp, mus musculus
gggctcaaatccacacaaagagcaa

SEQ ID NO: 61251 - DNA, 25 bp, mus musculus
ctcaaatccacacaaagagcaaggt

SEQ ID NO: 61252 - DNA, 25 bp, mus musculus
cagcagtcagcaaccatgaggctaa

SEQ ID NO: 61253 - DNA, 25 bp, mus musculus
gcaaccatgaggctaacctccactt

SEQ ID NO: 61254 - DNA, 25 bp, mus musculus
acctccacttcctgctgtgtttcct

SEQ ID NO: 61255 - DNA, 25 bp, mus musculus
acttcctgctgtgtttccttctcac

SEQ ID NO: 61256 - DNA, 25 bp, mus musculus
gtttccttctcacctgtaagccttg

SEQ ID NO: 61257 - DNA, 25 bp, mus musculus
ttctcacctgtaagccttgccccta

SEQ ID NO: 61258 - DNA, 25 bp, mus musculus
cctgtaagccttgcccctagaaatg

SEQ ID NO: 61259 - DNA, 25 bp, mus musculus
gtaagccttgcccctagaaatgagg

SEQ ID NO: 61260 - DNA, 25 bp, mus musculus
agccttgcccctagaaatgagggct

SEQ ID NO: 61261 - DNA, 25 bp, mus musculus
gtgatctgagctccctggctctacc

SEQ ID NO: 61262 - DNA, 25 bp, mus musculus
tccacacaaagagcaaggtgacatt

SEQ ID NO: 61263 - DNA, 25 bp, mus musculus
tgagatcctggcgctggacgcagtc

SEQ ID NO: 61264 - DNA, 25 bp, mus musculus
cctggcgctggacgcagtctagtat

SEQ ID NO: 61265 - DNA, 25 bp, mus musculus
ctagtatggtccatcccacctgctt

SEQ ID NO: 61266 - DNA, 25 bp, mus musculus
actgtgagcccagaagctccatcct

SEQ ID NO: 61267 - DNA, 25 bp, mus musculus
ccagaagctccatcctttcagcagt

SEQ ID NO: 61268 - DNA, 25 bp, mus musculus
gaagctccatcctttcagcagtcag

SEQ ID NO: 61269 - DNA, 25 bp, mus musculus
gctccatcctttcagcagtcagcaa

SEQ ID NO: 61270 - DNA, 25 bp, mus musculus
attacctatgtgtaaaagtggacag

SEQ ID NO: 61271 - DNA, 25 bp, mus musculus
gacaggactccgaaaggcacacagg

SEQ ID NO: 61272 - DNA, 25 bp, mus musculus
caggtacctgttgatgttgttgaga

SEQ ID NO: 61273 - DNA, 25 bp, mus musculus
ggtacctgttgatgttgttgagatg

SEQ ID NO: 61274 - DNA, 25 bp, mus musculus
gtacctgttgatgttgttgagatga

SEQ ID NO: 61275 - DNA, 25 bp, mus musculus
tacctgttgatgttgttgagatgag

SEQ ID NO: 61276 - DNA, 25 bp, mus musculus
agagaaaccatcatagcctttgcct

SEQ ID NO: 61277 - DNA, 25 bp, mus musculus
gagaaaccatcatagcctttgcctg

SEQ ID NO: 61278 - DNA, 25 bp, mus musculus
gaaaccatcatagcctttgcctggg

SEQ ID NO: 61279 - DNA, 25 bp, mus musculus
aaaccatcatagcctttgcctggga

SEQ ID NO: 61280 - DNA, 25 bp, mus musculus
aaccatcatagcctttgcctgggaa

SEQ ID NO: 61281 - DNA, 25 bp, mus musculus
acaggactccgaaaggcacacaggg

SEQ ID NO: 61282 - DNA, 25 bp, mus musculus
aggactccgaaaggcacacagggag

SEQ ID NO: 61283 - DNA, 25 bp, mus musculus
ggactccgaaaggcacacagggagt

SEQ ID NO: 61284 - DNA, 25 bp, mus musculus
gactccgaaaggcacacagggagtt

SEQ ID NO: 61285 - DNA, 25 bp, mus musculus
actccgaaaggcacacagggagttg

SEQ ID NO: 61286 - DNA, 25 bp, mus musculus
ctccgaaaggcacacagggagttgt

SEQ ID NO: 61287 - DNA, 25 bp, mus musculus
aagcaggtacctgttgatgttgttg

SEQ ID NO: 61288 - DNA, 25 bp, mus musculus
gcaggtacctgttgatgttgttgag

SEQ ID NO: 61289 - DNA, 25 bp, mus musculus
gagcattggcggttcgtgcttcagc

SEQ ID NO: 61290 - DNA, 25 bp, mus musculus
gtcttcctggcagcatttgtggtat

SEQ ID NO: 61291 - DNA, 25 bp, mus musculus
tctggttttcgtcttctcaatctga

SEQ ID NO: 61292 - DNA, 25 bp, mus musculus
cttctcaatctgaaaaatgactccc

SEQ ID NO: 61293 - DNA, 25 bp, mus musculus
aagcgctacgacggcttgaagtacg

SEQ ID NO: 61294 - DNA, 25 bp, mus musculus
gtctatgacctttccatccgaggct

SEQ ID NO: 61295 - DNA, 25 bp, mus musculus
gacctttccatccgaggcttcaata

SEQ ID NO: 61296 - DNA, 25 bp, mus musculus
tccatccgaggcttcaataaggaga

SEQ ID NO: 61297 - DNA, 25 bp, mus musculus
tcttcctgtagttagcacaccagtt

SEQ ID NO: 61298 - DNA, 25 bp, mus musculus
tgtagttagcacaccagttgctaaa

SEQ ID NO: 61299 - DNA, 25 bp, mus musculus
tagcacaccagttgctaaacaactg

SEQ ID NO: 61300 - DNA, 25 bp, mus musculus
tattttcgtaaccagctgtgtgctg

SEQ ID NO: 61301 - DNA, 25 bp, mus musculus
gaaacagagaccctggtgacccgag

SEQ ID NO: 61302 - DNA, 25 bp, mus musculus
acccgagaggctgttacagagattc

SEQ ID NO: 61303 - DNA, 25 bp, mus musculus
tttcatctggatgtggaagattatc

SEQ ID NO: 61304 - DNA, 25 bp, mus musculus
ttaattcttgccagtgaactgtcga

SEQ ID NO: 61305 - DNA, 25 bp, mus musculus
tctgtcaacagtgtcactgctggag

SEQ ID NO: 61306 - DNA, 25 bp, mus musculus
gtcactgctggagactactctcggc

SEQ ID NO: 61307 - DNA, 25 bp, mus musculus
cacatttctactttcatcaatgagc

SEQ ID NO: 61308 - DNA, 25 bp, mus musculus
tctactttcatcaatgagctggatt

SEQ ID NO: 61309 - DNA, 25 bp, mus musculus
ggcataacctgtccccgataccatt

SEQ ID NO: 61310 - DNA, 25 bp, mus musculus
gcataacctgtccccgataccatta

SEQ ID NO: 61311 - DNA, 25 bp, mus musculus
taccattaatgactccaaccacaag

SEQ ID NO: 61312 - DNA, 25 bp, mus musculus
accattaatgactccaaccacaagg

SEQ ID NO: 61313 - DNA, 25 bp, mus musculus
ccattaatgactccaaccacaaggc

SEQ ID NO: 61314 - DNA, 25 bp, mus musculus
cattaatgactccaaccacaaggcc

SEQ ID NO: 61315 - DNA, 25 bp, mus musculus
attaatgactccaaccacaaggcca

SEQ ID NO: 61316 - DNA, 25 bp, mus musculus
ttaatgactccaaccacaaggccat

SEQ ID NO: 61317 - DNA, 25 bp, mus musculus
taatgactccaaccacaaggccatt

SEQ ID NO: 61318 - DNA, 25 bp, mus musculus
aatgactccaaccacaaggccattg

SEQ ID NO: 61319 - DNA, 25 bp, mus musculus
atgactccaaccacaaggccattgc

SEQ ID NO: 61320 - DNA, 25 bp, mus musculus
tgactccaaccacaaggccattgcc

SEQ ID NO: 61321 - DNA, 25 bp, mus musculus
cctgtccccgataccattaatgact

SEQ ID NO: 61322 - DNA, 25 bp, mus musculus
gactccaaccacaaggccattgcct

SEQ ID NO: 61323 - DNA, 25 bp, mus musculus
ctgtccccgataccattaatgactc

SEQ ID NO: 61324 - DNA, 25 bp, mus musculus
tgtccccgataccattaatgactcc

SEQ ID NO: 61325 - DNA, 25 bp, mus musculus
gtccccgataccattaatgactcca

SEQ ID NO: 61326 - DNA, 25 bp, mus musculus
tccccgataccattaatgactccaa

SEQ ID NO: 61327 - DNA, 25 bp, mus musculus
cgataccattaatgactccaaccac

SEQ ID NO: 61328 - DNA, 25 bp, mus musculus
gataccattaatgactccaaccaca

SEQ ID NO: 61329 - DNA, 25 bp, mus musculus
ataccattaatgactccaaccacaa

SEQ ID NO: 61330 - DNA, 25 bp, mus musculus
ttataaaagcagccatgttgattag

SEQ ID NO: 61331 - DNA, 25 bp, mus musculus
gttacaacaaatcacatgacattat

SEQ ID NO: 61332 - DNA, 25 bp, mus musculus
tctgctcttgcatatttgccaatgt

SEQ ID NO: 61333 - DNA, 25 bp, mus musculus
tatttgccaatgtgttccctagctc

SEQ ID NO: 61334 - DNA, 25 bp, mus musculus
tgttccctagctcagttctctggac

SEQ ID NO: 61335 - DNA, 25 bp, mus musculus
ctagctcagttctctggacatgaaa

SEQ ID NO: 61336 - DNA, 25 bp, mus musculus
catgaaactgcctgggccacagttc

SEQ ID NO: 61337 - DNA, 25 bp, mus musculus
taattctcgtatcttagaggcctgc

SEQ ID NO: 61338 - DNA, 25 bp, mus musculus
tcgtatcttagaggcctgcgaggaa

SEQ ID NO: 61339 - DNA, 25 bp, mus musculus
ttctgtgcatcttatcaaatgttgt

SEQ ID NO: 61340 - DNA, 25 bp, mus musculus
acagcattgttacaccacttatcag

SEQ ID NO: 61341 - DNA, 25 bp, mus musculus
caccacttatcagccttctgtgtat

SEQ ID NO: 61342 - DNA, 25 bp, mus musculus
attatctttctgaaactgctctcat

SEQ ID NO: 61343 - DNA, 25 bp, mus musculus
tttctgaaactgctctcattttgct

SEQ ID NO: 61344 - DNA, 25 bp, mus musculus
ctctcattttgctttcagcgtatta

SEQ ID NO: 61345 - DNA, 25 bp, mus musculus
gtgcaaggccaccacaaagtcacag

SEQ ID NO: 61346 - DNA, 25 bp, mus musculus
cacaaagtcacagtccttgccacac

SEQ ID NO: 61347 - DNA, 25 bp, mus musculus
ttcacttgctggaacacatctgctc

SEQ ID NO: 61348 - DNA, 25 bp, mus musculus
tgctggaacacatctgctcttgcat

SEQ ID NO: 61349 - DNA, 25 bp, mus musculus
aacacatctgctcttgcatatttgc

SEQ ID NO: 61350 - DNA, 25 bp, mus musculus
cagtacagcgcgaggcagccgtgcg

SEQ ID NO: 61351 - DNA, 25 bp, mus musculus
agtacagcgcgaggcagccgtgcga

SEQ ID NO: 61352 - DNA, 25 bp, mus musculus
tccgtatcttaattcaatgttccgt

SEQ ID NO: 61353 - DNA, 25 bp, mus musculus
tatcttaattcaatgttccgttcag

SEQ ID NO: 61354 - DNA, 25 bp, mus musculus
atcttaattcaatgttccgttcaga

SEQ ID NO: 61355 - DNA, 25 bp, mus musculus
cttaattcaatgttccgttcagaag

SEQ ID NO: 61356 - DNA, 25 bp, mus musculus
ttaattcaatgttccgttcagaagg

SEQ ID NO: 61357 - DNA, 25 bp, mus musculus
taattcaatgttccgttcagaagga

SEQ ID NO: 61358 - DNA, 25 bp, mus musculus
ttcaatgttccgttcagaaggagat

SEQ ID NO: 61359 - DNA, 25 bp, mus musculus
tcaatgttccgttcagaaggagatt

SEQ ID NO: 61360 - DNA, 25 bp, mus musculus
atgttccgttcagaaggagattttg

SEQ ID NO: 61361 - DNA, 25 bp, mus musculus
tgttccgttcagaaggagattttgg

SEQ ID NO: 61362 - DNA, 25 bp, mus musculus
tgttcgagccattgctcaagaccgg

SEQ ID NO: 61363 - DNA, 25 bp, mus musculus
gttcgagccattgctcaagaccggg

SEQ ID NO: 61364 - DNA, 25 bp, mus musculus
ttcgagccattgctcaagaccgggg

SEQ ID NO: 61365 - DNA, 25 bp, mus musculus
ttgtggccctccgtatcttaattca

SEQ ID NO: 61366 - DNA, 25 bp, mus musculus
gtggccctccgtatcttaattcaat

SEQ ID NO: 61367 - DNA, 25 bp, mus musculus
ggccctccgtatcttaattcaatgt

SEQ ID NO: 61368 - DNA, 25 bp, mus musculus
gccctccgtatcttaattcaatgtt

SEQ ID NO: 61369 - DNA, 25 bp, mus musculus
ctccgtatcttaattcaatgttccg

SEQ ID NO: 61370 - DNA, 25 bp, mus musculus
tgaacctggactatgagatgtataa

SEQ ID NO: 61371 - DNA, 25 bp, mus musculus
aactactgtcatttatgaaggatct

SEQ ID NO: 61372 - DNA, 25 bp, mus musculus
tggagtatcacttcctgtcgcccta

SEQ ID NO: 61373 - DNA, 25 bp, mus musculus
cgccctatgtatctccaagagagtc

SEQ ID NO: 61374 - DNA, 25 bp, mus musculus
atgtatctccaagagagtctccttt

SEQ ID NO: 61375 - DNA, 25 bp, mus musculus
tccgacatatcttctggggctctgg

SEQ ID NO: 61376 - DNA, 25 bp, mus musculus
acactctctcagctttagtggagaa

SEQ ID NO: 61377 - DNA, 25 bp, mus musculus
tcagaaaccagttggccctggctac

SEQ ID NO: 61378 - DNA, 25 bp, mus musculus
tggccctggctacttggactattca

SEQ ID NO: 61379 - DNA, 25 bp, mus musculus
tcgcaaatgccctctctggtgacat

SEQ ID NO: 61380 - DNA, 25 bp, mus musculus
atgccctctctggtgacatttggaa

SEQ ID NO: 61381 - DNA, 25 bp, mus musculus
tctctggtgacatttggaatattga

SEQ ID NO: 61382 - DNA, 25 bp, mus musculus
tgaaccagttcaaaacagatatcag

SEQ ID NO: 61383 - DNA, 25 bp, mus musculus
taagtctacagtggctgtattccgc

SEQ ID NO: 61384 - DNA, 25 bp, mus musculus
tacagtggctgtattccgctcgtgg

SEQ ID NO: 61385 - DNA, 25 bp, mus musculus
ggctgtattccgctcgtggagacta

SEQ ID NO: 61386 - DNA, 25 bp, mus musculus
ctcgtggagactacttccgtgctac

SEQ ID NO: 61387 - DNA, 25 bp, mus musculus
gagactacttccgtgctacttctag

SEQ ID NO: 61388 - DNA, 25 bp, mus musculus
gtgctacttctagactaacaactga

SEQ ID NO: 61389 - DNA, 25 bp, mus musculus
gactaacaactgattttcataatgc

SEQ ID NO: 61390 - DNA, 25 bp, mus musculus
gggtctcatccagaagcaccggcga

SEQ ID NO: 61391 - DNA, 25 bp, mus musculus
gtctcatccagaagcaccggcgacg

SEQ ID NO: 61392 - DNA, 25 bp, mus musculus
gcttcggcatctatgaggtaccggc

SEQ ID NO: 61393 - DNA, 25 bp, mus musculus
cggcatctatgaggtaccggcagag

SEQ ID NO: 61394 - DNA, 25 bp, mus musculus
atctatgaggtaccggcagaggatg

SEQ ID NO: 61395 - DNA, 25 bp, mus musculus
agccactcagaccccagaggcaaga

SEQ ID NO: 61396 - DNA, 25 bp, mus musculus
ccactcagaccccagaggcaagact

SEQ ID NO: 61397 - DNA, 25 bp, mus musculus
actcagaccccagaggcaagacttg

SEQ ID NO: 61398 - DNA, 25 bp, mus musculus
tcagaccccagaggcaagacttgga

SEQ ID NO: 61399 - DNA, 25 bp, mus musculus
agaccccagaggcaagacttggaat

SEQ ID NO: 61400 - DNA, 25 bp, mus musculus
agacgccagctcagccagacttagc

SEQ ID NO: 61401 - DNA, 25 bp, mus musculus
acgccagctcagccagacttagcag

SEQ ID NO: 61402 - DNA, 25 bp, mus musculus
cagaagcaccggcgacggcagagga

SEQ ID NO: 61403 - DNA, 25 bp, mus musculus
gccagctcagccagacttagcagta

SEQ ID NO: 61404 - DNA, 25 bp, mus musculus
cgaggacatgcacaccattggcttc

SEQ ID NO: 61405 - DNA, 25 bp, mus musculus
aggacatgcacaccattggcttcgg

SEQ ID NO: 61406 - DNA, 25 bp, mus musculus
gacatgcacaccattggcttcggca

SEQ ID NO: 61407 - DNA, 25 bp, mus musculus
catgcacaccattggcttcggcatc

SEQ ID NO: 61408 - DNA, 25 bp, mus musculus
tgcacaccattggcttcggcatcta

SEQ ID NO: 61409 - DNA, 25 bp, mus musculus
cacaccattggcttcggcatctatg

SEQ ID NO: 61410 - DNA, 25 bp, mus musculus
tggcttcggcatctatgaggtaccg

SEQ ID NO: 61411 - DNA, 25 bp, mus musculus
tccccgcaacagccaaaatggtgaa

SEQ ID NO: 61412 - DNA, 25 bp, mus musculus
ccccgcaacagccaaaatggtgaag

SEQ ID NO: 61413 - DNA, 25 bp, mus musculus
ctgccaggatgttgctgcagactgt

SEQ ID NO: 61414 - DNA, 25 bp, mus musculus
tgccaggatgttgctgcagactgtg

SEQ ID NO: 61415 - DNA, 25 bp, mus musculus
ggatgttgctgcagactgtgaagtc

SEQ ID NO: 61416 - DNA, 25 bp, mus musculus
gatgttgctgcagactgtgaagtca

SEQ ID NO: 61417 - DNA, 25 bp, mus musculus
gttgctgcagactgtgaagtcatat

SEQ ID NO: 61418 - DNA, 25 bp, mus musculus
agtcatatgcatgccgaccttccag

SEQ ID NO: 61419 - DNA, 25 bp, mus musculus
gtcatatgcatgccgaccttccagt

SEQ ID NO: 61420 - DNA, 25 bp, mus musculus
atatgcatgccgaccttccagtttt

SEQ ID NO: 61421 - DNA, 25 bp, mus musculus
atgcatgccgaccttccagttttat

SEQ ID NO: 61422 - DNA, 25 bp, mus musculus
tgcatgccgaccttccagttttata

SEQ ID NO: 61423 - DNA, 25 bp, mus musculus
ctctgctacgtggtgtggaccttgc

SEQ ID NO: 61424 - DNA, 25 bp, mus musculus
tctgctacgtggtgtggaccttgca

SEQ ID NO: 61425 - DNA, 25 bp, mus musculus
tgctacgtggtgtggaccttgcaaa

SEQ ID NO: 61426 - DNA, 25 bp, mus musculus
gctacgtggtgtggaccttgcaaaa

SEQ ID NO: 61427 - DNA, 25 bp, mus musculus
atgatcaagcccttcttccattccc

SEQ ID NO: 61428 - DNA, 25 bp, mus musculus
cttcttccattccctctgtgacaag

SEQ ID NO: 61429 - DNA, 25 bp, mus musculus
ttcttccattccctctgtgacaagt

SEQ ID NO: 61430 - DNA, 25 bp, mus musculus
ttccattccctctgtgacaagtatt

SEQ ID NO: 61431 - DNA, 25 bp, mus musculus
cgaacggagttcagcctgcgacgtg

SEQ ID NO: 61432 - DNA, 25 bp, mus musculus
aacggagttcagcctgcgacgtgtg

SEQ ID NO: 61433 - DNA, 25 bp, mus musculus
gggccccactgctttgagctactga

SEQ ID NO: 61434 - DNA, 25 bp, mus musculus
ggccccactgctttgagctactgag

SEQ ID NO: 61435 - DNA, 25 bp, mus musculus
gccccactgctttgagctactgaga

SEQ ID NO: 61436 - DNA, 25 bp, mus musculus
ccactgctttgagctactgagatga

SEQ ID NO: 61437 - DNA, 25 bp, mus musculus
cactgctttgagctactgagatgac

SEQ ID NO: 61438 - DNA, 25 bp, mus musculus
ctgctttgagctactgagatgactg

SEQ ID NO: 61439 - DNA, 25 bp, mus musculus
agattgtatgcagtgccaaggacac

SEQ ID NO: 61440 - DNA, 25 bp, mus musculus
attgtatgcagtgccaaggacacag

SEQ ID NO: 61441 - DNA, 25 bp, mus musculus
tgtatgcagtgccaaggacacagcc

SEQ ID NO: 61442 - DNA, 25 bp, mus musculus
tatgcagtgccaaggacacagccca

SEQ ID NO: 61443 - DNA, 25 bp, mus musculus
cggagttcagcctgcgacgtgtgtc

SEQ ID NO: 61444 - DNA, 25 bp, mus musculus
ggagttcagcctgcgacgtgtgtcc

SEQ ID NO: 61445 - DNA, 25 bp, mus musculus
ttcagcctgcgacgtgtgtccagag

SEQ ID NO: 61446 - DNA, 25 bp, mus musculus
acctgggtcctgagcgcatcgggcc

SEQ ID NO: 61447 - DNA, 25 bp, mus musculus
ctgggtcctgagcgcatcgggcccc

SEQ ID NO: 61448 - DNA, 25 bp, mus musculus
catcgggccccactgctttgagcta

SEQ ID NO: 61449 - DNA, 25 bp, mus musculus
atcgggccccactgctttgagctac

SEQ ID NO: 61450 - DNA, 25 bp, mus musculus
tcgggccccactgctttgagctact

SEQ ID NO: 61451 - DNA, 25 bp, mus musculus
atgacatcatgctgatcaaactggc

SEQ ID NO: 61452 - DNA, 25 bp, mus musculus
tgatcaaactggcttcccctgtgac

SEQ ID NO: 61453 - DNA, 25 bp, mus musculus
gtgttgatgccccagtgctgcctca

SEQ ID NO: 61454 - DNA, 25 bp, mus musculus
cagtgctgcctcaggctgactgtga

SEQ ID NO: 61455 - DNA, 25 bp, mus musculus
tgcctcaggctgactgtgaggcctc

SEQ ID NO: 61456 - DNA, 25 bp, mus musculus
atggctgtgcccagccagatgctcc

SEQ ID NO: 61457 - DNA, 25 bp, mus musculus
agccagatgctcctggtgtatacac

SEQ ID NO: 61458 - DNA, 25 bp, mus musculus
caattgctgacaactagagaaccct

SEQ ID NO: 61459 - DNA, 25 bp, mus musculus
ctgacaactagagaaccctagtctc

SEQ ID NO: 61460 - DNA, 25 bp, mus musculus
gaaccctagtctctcttcaatcagt

SEQ ID NO: 61461 - DNA, 25 bp, mus musculus
tagtctctcttcaatcagtattatc

SEQ ID NO: 61462 - DNA, 25 bp, mus musculus
ctcttcaatcagtattatcaataaa

SEQ ID NO: 61463 - DNA, 25 bp, mus musculus
atgccagagtggcctctgtacctct

SEQ ID NO: 61464 - DNA, 25 bp, mus musculus
gagtggcctctgtacctctgcccag

SEQ ID NO: 61465 - DNA, 25 bp, mus musculus
gctcctgtgcacctgcaggcactca

SEQ ID NO: 61466 - DNA, 25 bp, mus musculus
ggggcaacaccctcagcaatggtgt

SEQ ID NO: 61467 - DNA, 25 bp, mus musculus
acaccctcagcaatggtgtgaacaa

SEQ ID NO: 61468 - DNA, 25 bp, mus musculus
tgaacaacccagacctgctccagtg

SEQ ID NO: 61469 - DNA, 25 bp, mus musculus
acccagacctgctccagtgtgttga

SEQ ID NO: 61470 - DNA, 25 bp, mus musculus
acctgctccagtgtgttgatgcccc

SEQ ID NO: 61471 - DNA, 25 bp, mus musculus
ctccagctgccggctgatgtgaatc

SEQ ID NO: 61472 - DNA, 25 bp, mus musculus
gatgtgaatccttctgtggccagtg

SEQ ID NO: 61473 - DNA, 25 bp, mus musculus
gaatgttcccgtatggtagatttca

SEQ ID NO: 61474 - DNA, 25 bp, mus musculus
caccacgtccgactcattgttgtca

SEQ ID NO: 61475 - DNA, 25 bp, mus musculus
gtccgactcattgttgtcatctctc

SEQ ID NO: 61476 - DNA, 25 bp, mus musculus
gtcatctctctttaggaagacgcca

SEQ ID NO: 61477 - DNA, 25 bp, mus musculus
gaagacgccaacatagggctgtgca

SEQ ID NO: 61478 - DNA, 25 bp, mus musculus
tgcaagtcggactttccttctcagg

SEQ ID NO: 61479 - DNA, 25 bp, mus musculus
tttccttctcaggagctcaaccaac

SEQ ID NO: 61480 - DNA, 25 bp, mus musculus
ccttctcaggagctcaaccaacttc

SEQ ID NO: 61481 - DNA, 25 bp, mus musculus
tttaagctccacgatcttgataaag

SEQ ID NO: 61482 - DNA, 25 bp, mus musculus
aagctccacgatcttgataaagcgc

SEQ ID NO: 61483 - DNA, 25 bp, mus musculus
gtgaatccttctgtggccagtgaca

SEQ ID NO: 61484 - DNA, 25 bp, mus musculus
agtgacaatcattcgcaacttgtct

SEQ ID NO: 61485 - DNA, 25 bp, mus musculus
tcgcaacttgtctccgaggtcctgc

SEQ ID NO: 61486 - DNA, 25 bp, mus musculus
caacttgtctccgaggtcctgcatc

SEQ ID NO: 61487 - DNA, 25 bp, mus musculus
tccgaggtcctgcatctcatgaatc

SEQ ID NO: 61488 - DNA, 25 bp, mus musculus
gaggtcctgcatctcatgaatctga

SEQ ID NO: 61489 - DNA, 25 bp, mus musculus
catctcatgaatctgagcgaatgtt

SEQ ID NO: 61490 - DNA, 25 bp, mus musculus
ctcatgaatctgagcgaatgttccc

SEQ ID NO: 61491 - DNA, 25 bp, mus musculus
ttttatccaagtggctggaggaagc

SEQ ID NO: 61492 - DNA, 25 bp, mus musculus
ctgagcaggtcggagctttgtacaa

SEQ ID NO: 61493 - DNA, 25 bp, mus musculus
gcctgttctctatttccaaggaaca

SEQ ID NO: 61494 - DNA, 25 bp, mus musculus
tttccaaggaacatctagagtgcag

SEQ ID NO: 61495 - DNA, 25 bp, mus musculus
ttagtcacttgctcctactaggtat

SEQ ID NO: 61496 - DNA, 25 bp, mus musculus
acttgctcctactaggtatgtataa

SEQ ID NO: 61497 - DNA, 25 bp, mus musculus
tgtataaaccatgctaaaggaacgg

SEQ ID NO: 61498 - DNA, 25 bp, mus musculus
agtgaacaaccgctacaaccatgaa

SEQ ID NO: 61499 - DNA, 25 bp, mus musculus
caaccgctacaaccatgaagggcat

SEQ ID NO: 61500 - DNA, 25 bp, mus musculus
ctacaaccatgaagggcatagtttt

SEQ ID NO: 61501 - DNA, 25 bp, mus musculus
cctgaggttccttaacaatgtgtca

SEQ ID NO: 61502 - DNA, 25 bp, mus musculus
gttccttaacaatgtgtcaatgttg

SEQ ID NO: 61503 - DNA, 25 bp, mus musculus
caaccatcagtgtagctgctaagga

SEQ ID NO: 61504 - DNA, 25 bp, mus musculus
tagctgctaaggatgctctggagag

SEQ ID NO: 61505 - DNA, 25 bp, mus musculus
gacacttcggggagcacagcaagcc

SEQ ID NO: 61506 - DNA, 25 bp, mus musculus
agcacagcaagccttcctcgcagga

SEQ ID NO: 61507 - DNA, 25 bp, mus musculus
gcaagccttcctcgcaggagatcat

SEQ ID NO: 61508 - DNA, 25 bp, mus musculus
cttcctcgcaggagatcatgcggat

SEQ ID NO: 61509 - DNA, 25 bp, mus musculus
ggttctgcaaccgaaggcagagaga

SEQ ID NO: 61510 - DNA, 25 bp, mus musculus
gtctcaatcagagcctgttctctat

SEQ ID NO: 61511 - DNA, 25 bp, mus musculus
cgacaactgtcaccaaagcttataa

SEQ ID NO: 61512 - DNA, 25 bp, mus musculus
ctgtcaccaaagcttataaaacacg

SEQ ID NO: 61513 - DNA, 25 bp, mus musculus
cccagttagtcactctgtgtaatcc

SEQ ID NO: 61514 - DNA, 25 bp, mus musculus
tagtcactctgtgtaatcccggaat

SEQ ID NO: 61515 - DNA, 25 bp, mus musculus
ctctgtgtaatcccggaatctagct

SEQ ID NO: 61516 - DNA, 25 bp, mus musculus
ccggaatctagctgctgaagtcttg

SEQ ID NO: 61517 - DNA, 25 bp, mus musculus
tctagctgctgaagtcttgcgaagt

SEQ ID NO: 61518 - DNA, 25 bp, mus musculus
taaactccccgtgaccgatgtcagt

SEQ ID NO: 61519 - DNA, 25 bp, mus musculus
gtttctgcacctcacctgtatagtc

SEQ ID NO: 61520 - DNA, 25 bp, mus musculus
ctgttctacttgtcacctttcaata

SEQ ID NO: 61521 - DNA, 25 bp, mus musculus
tacttgtcacctttcaataaagcat

SEQ ID NO: 61522 - DNA, 25 bp, mus musculus
tcacctttcaataaagcatatcaaa

SEQ ID NO: 61523 - DNA, 25 bp, mus musculus
gatagtactgtccctcttttctgaa

SEQ ID NO: 61524 - DNA, 25 bp, mus musculus
actgtccctcttttctgaaccatca

SEQ ID NO: 61525 - DNA, 25 bp, mus musculus
cctcttttctgaaccatcagaagac

SEQ ID NO: 61526 - DNA, 25 bp, mus musculus
ttctgaaccatcagaagacacaaaa

SEQ ID NO: 61527 - DNA, 25 bp, mus musculus
agtgacacaacggtgacaggtagct

SEQ ID NO: 61528 - DNA, 25 bp, mus musculus
tactgtttagcttctacacattgaa

SEQ ID NO: 61529 - DNA, 25 bp, mus musculus
ttagcttctacacattgaaatgtag

SEQ ID NO: 61530 - DNA, 25 bp, mus musculus
gcttgtccttcctagagagatctac

SEQ ID NO: 61531 - DNA, 25 bp, mus musculus
acttacaccgtgagaacactgtcta

SEQ ID NO: 61532 - DNA, 25 bp, mus musculus
acatcttgctggatgattatggcca

SEQ ID NO: 61533 - DNA, 25 bp, mus musculus
ggccccagaagttctgaacaaccag

SEQ ID NO: 61534 - DNA, 25 bp, mus musculus
agttctgaacaaccagcgatatgga

SEQ ID NO: 61535 - DNA, 25 bp, mus musculus
tctgaacaaccagcgatatggactg

SEQ ID NO: 61536 - DNA, 25 bp, mus musculus
gaacaaccagcgatatggactgagc

SEQ ID NO: 61537 - DNA, 25 bp, mus musculus
atatggactgagccctgactactgg

SEQ ID NO: 61538 - DNA, 25 bp, mus musculus
gggctgcctcatctatgagatgatt

SEQ ID NO: 61539 - DNA, 25 bp, mus musculus
ctgcctcatctatgagatgattgaa

SEQ ID NO: 61540 - DNA, 25 bp, mus musculus
tgaaggccagtcaccatttcgaggt

SEQ ID NO: 61541 - DNA, 25 bp, mus musculus
aggccagtcaccatttcgaggtcgc

SEQ ID NO: 61542 - DNA, 25 bp, mus musculus
ccagtcaccatttcgaggtcgcaag

SEQ ID NO: 61543 - DNA, 25 bp, mus musculus
atgattatggccacataaggatctc

SEQ ID NO: 61544 - DNA, 25 bp, mus musculus
accatttcgaggtcgcaaggagaag

SEQ ID NO: 61545 - DNA, 25 bp, mus musculus
attatggccacataaggatctcaga

SEQ ID NO: 61546 - DNA, 25 bp, mus musculus
taaggatctcagacctcggactggc

SEQ ID NO: 61547 - DNA, 25 bp, mus musculus
tggccgtgaagatccccgagggaga

SEQ ID NO: 61548 - DNA, 25 bp, mus musculus
ttatccgtggccgggtagcactgtt

SEQ ID NO: 61549 - DNA, 25 bp, mus musculus
cactgttggctacatggccccagaa

SEQ ID NO: 61550 - DNA, 25 bp, mus musculus
tggctacatggccccagaagttctg

SEQ ID NO: 61551 - DNA, 25 bp, mus musculus
catggccccagaagttctgaacaac

SEQ ID NO: 61552 - DNA, 25 bp, mus musculus
gtctgttttaatccctataacacag

SEQ ID NO: 61553 - DNA, 25 bp, mus musculus
tttaatccctataacacagtagcca

SEQ ID NO: 61554 - DNA, 25 bp, mus musculus
gataactgaccaacaccctgtctca

SEQ ID NO: 61555 - DNA, 25 bp, mus musculus
acaccctgtctcacaataagaagct

SEQ ID NO: 61556 - DNA, 25 bp, mus musculus
tgtctcacaataagaagctgggctg

SEQ ID NO: 61557 - DNA, 25 bp, mus musculus
agaagctgggctgcagctgaatcgt

SEQ ID NO: 61558 - DNA, 25 bp, mus musculus
tgggctgcagctgaatcgtagatta

SEQ ID NO: 61559 - DNA, 25 bp, mus musculus
acttcgtagatctcgcaaggcccga

SEQ ID NO: 61560 - DNA, 25 bp, mus musculus
aggtgcagtccctaatgttgcagaa

SEQ ID NO: 61561 - DNA, 25 bp, mus musculus
acaatattgcactcctgtaaaatag

SEQ ID NO: 61562 - DNA, 25 bp, mus musculus
ttgcactcctgtaaaatagtaccct

SEQ ID NO: 61563 - DNA, 25 bp, mus musculus
atactgtattggtttcatgaggaga

SEQ ID NO: 61564 - DNA, 25 bp, mus musculus
ccctataacacagtagccatcaaat

SEQ ID NO: 61565 - DNA, 25 bp, mus musculus
aacacagtagccatcaaatgaatgg

SEQ ID NO: 61566 - DNA, 25 bp, mus musculus
gtgcttcagccgatgatcacagcta

SEQ ID NO: 61567 - DNA, 25 bp, mus musculus
cagccgatgatcacagctagttaag

SEQ ID NO: 61568 - DNA, 25 bp, mus musculus
caaggcttgcctaggctacagactg

SEQ ID NO: 61569 - DNA, 25 bp, mus musculus
ttgcctaggctacagactgggctca

SEQ ID NO: 61570 - DNA, 25 bp, mus musculus
aggctacagactgggctcaacataa

SEQ ID NO: 61571 - DNA, 25 bp, mus musculus
cagactgggctcaacataagcttag

SEQ ID NO: 61572 - DNA, 25 bp, mus musculus
tctccaggccagatcacttgaatgg

SEQ ID NO: 61573 - DNA, 25 bp, mus musculus
ccaggccagatcacttgaatggaca

SEQ ID NO: 61574 - DNA, 25 bp, mus musculus
gaaagtacttgcgggccgcatacat

SEQ ID NO: 61575 - DNA, 25 bp, mus musculus
ccgcatacatggcagaccacctgaa

SEQ ID NO: 61576 - DNA, 25 bp, mus musculus
catacatggcagaccacctgaagaa

SEQ ID NO: 61577 - DNA, 25 bp, mus musculus
cagaccacctgaagaagcacagtga

SEQ ID NO: 61578 - DNA, 25 bp, mus musculus
accacctgaagaagcacagtgaggg

SEQ ID NO: 61579 - DNA, 25 bp, mus musculus
ggcccagcaacttctgtagcatctg

SEQ ID NO: 61580 - DNA, 25 bp, mus musculus
gcaacttctgtagcatctgtaaccg

SEQ ID NO: 61581 - DNA, 25 bp, mus musculus
acttctgtagcatctgtaaccgaga

SEQ ID NO: 61582 - DNA, 25 bp, mus musculus
tctgtaaccgagaaggccagaaatg

SEQ ID NO: 61583 - DNA, 25 bp, mus musculus
gccagaaatgctcacatcaggatct

SEQ ID NO: 61584 - DNA, 25 bp, mus musculus
aggtgcacacttctgagcgacctca

SEQ ID NO: 61585 - DNA, 25 bp, mus musculus
aatgctcacatcaggatctgattga

SEQ ID NO: 61586 - DNA, 25 bp, mus musculus
tgcacacttctgagcgacctcacaa

SEQ ID NO: 61587 - DNA, 25 bp, mus musculus
ctgagcgacctcacaagtgtcagac

SEQ ID NO: 61588 - DNA, 25 bp, mus musculus
agcgacctcacaagtgtcagacctg

SEQ ID NO: 61589 - DNA, 25 bp, mus musculus
acaagtgtcagacctgcaatgcctc

SEQ ID NO: 61590 - DNA, 25 bp, mus musculus
agtgtcagacctgcaatgcctcctt

SEQ ID NO: 61591 - DNA, 25 bp, mus musculus
gtcagacctgcaatgcctcctttgc

SEQ ID NO: 61592 - DNA, 25 bp, mus musculus
cctttgcgactcgagaccgcctgcg

SEQ ID NO: 61593 - DNA, 25 bp, mus musculus
acttcaccaaggccaagctgatcac

SEQ ID NO: 61594 - DNA, 25 bp, mus musculus
ccaaggccaagctgatcaccccaat

SEQ ID NO: 61595 - DNA, 25 bp, mus musculus
acatcaagccccagaatttgcttgt

SEQ ID NO: 61596 - DNA, 25 bp, mus musculus
tgcttgtggaccctgacactgctgt

SEQ ID NO: 61597 - DNA, 25 bp, mus musculus
tggaccctgacactgctgtcctcaa

SEQ ID NO: 61598 - DNA, 25 bp, mus musculus
ctgacactgctgtcctcaagctctg

SEQ ID NO: 61599 - DNA, 25 bp, mus musculus
ctgctgtcctcaagctctgcgattt

SEQ ID NO: 61600 - DNA, 25 bp, mus musculus
tcctcaagctctgcgattttggcag

SEQ ID NO: 61601 - DNA, 25 bp, mus musculus
agctctgcgattttggcagtgcaaa

SEQ ID NO: 61602 - DNA, 25 bp, mus musculus
actaccgtgctccggaactcatctt

SEQ ID NO: 61603 - DNA, 25 bp, mus musculus
gtgctccggaactcatctttggagc

SEQ ID NO: 61604 - DNA, 25 bp, mus musculus
cggaactcatctttggagccacaga

SEQ ID NO: 61605 - DNA, 25 bp, mus musculus
ccaagctgatcaccccaatcatcta

SEQ ID NO: 61606 - DNA, 25 bp, mus musculus
tcatctttggagccacagattacag

SEQ ID NO: 61607 - DNA, 25 bp, mus musculus
ccccaatcatctacatcaaggtgta

SEQ ID NO: 61608 - DNA, 25 bp, mus musculus
acatgtaccagctcttccggagctt

SEQ ID NO: 61609 - DNA, 25 bp, mus musculus
accagctcttccggagcttggccta

SEQ ID NO: 61610 - DNA, 25 bp, mus musculus
tcttccggagcttggcctacatcca

SEQ ID NO: 61611 - DNA, 25 bp, mus musculus
actcccaaggtgtgtgtcaccgtga

SEQ ID NO: 61612 - DNA, 25 bp, mus musculus
tgtgtcaccgtgacatcaagcccca

SEQ ID NO: 61613 - DNA, 25 bp, mus musculus
accgtgacatcaagccccagaattt

SEQ ID NO: 61614 - DNA, 25 bp, mus musculus
gcctcagctgtcatagtccctgaag

SEQ ID NO: 61615 - DNA, 25 bp, mus musculus
gctgtcatagtccctgaagcgcagt

SEQ ID NO: 61616 - DNA, 25 bp, mus musculus
aatcagccacagtaacatggacagc

SEQ ID NO: 61617 - DNA, 25 bp, mus musculus
cgagcgaaacagccactgtgccatt

SEQ ID NO: 61618 - DNA, 25 bp, mus musculus
ccactgtgccattgtctaagaaatc

SEQ ID NO: 61619 - DNA, 25 bp, mus musculus
ctctgccccaacatatgaactgcct

SEQ ID NO: 61620 - DNA, 25 bp, mus musculus
cccaacatatgaactgcctgatggt

SEQ ID NO: 61621 - DNA, 25 bp, mus musculus
gcagggacttccccaattcagtatc

SEQ ID NO: 61622 - DNA, 25 bp, mus musculus
ccaattcagtatcccctgacaagtg

SEQ ID NO: 61623 - DNA, 25 bp, mus musculus
cccctgacaagtgggatcctgcact

SEQ ID NO: 61624 - DNA, 25 bp, mus musculus
gggatcctgcactcaagtcccttaa

SEQ ID NO: 61625 - DNA, 25 bp, mus musculus
atcctgcactcaagtcccttaaata

SEQ ID NO: 61626 - DNA, 25 bp, mus musculus
ggctccaacatagaaatgagtgcct

SEQ ID NO: 61627 - DNA, 25 bp, mus musculus
agtgcctccggtcagctaactgatg

SEQ ID NO: 61628 - DNA, 25 bp, mus musculus
tccggtcagctaactgatgaagaac

SEQ ID NO: 61629 - DNA, 25 bp, mus musculus
atgactactgttttacacccaatgt

SEQ ID NO: 61630 - DNA, 25 bp, mus musculus
ttacacccaatgtttgaagaggagg

SEQ ID NO: 61631 - DNA, 25 bp, mus musculus
aaaccacagccagttgttgatgacc

SEQ ID NO: 61632 - DNA, 25 bp, mus musculus
gatgaccctgaatttgaggattaca

SEQ ID NO: 61633 - DNA, 25 bp, mus musculus
gtaccaaatcagccacagtaacatg

SEQ ID NO: 61634 - DNA, 25 bp, mus musculus
tcatacacaaagcaatgtgtgatcg

SEQ ID NO: 61635 - DNA, 25 bp, mus musculus
catacacaaagcaatgtgtgatcga

SEQ ID NO: 61636 - DNA, 25 bp, mus musculus
gtcttctcagtcacggatagaggca

SEQ ID NO: 61637 - DNA, 25 bp, mus musculus
tcttctcagtcacggatagaggcag

SEQ ID NO: 61638 - DNA, 25 bp, mus musculus
tctcagtcacggatagaggcagttt

SEQ ID NO: 61639 - DNA, 25 bp, mus musculus
caataaagctgacctggaccatcag

SEQ ID NO: 61640 - DNA, 25 bp, mus musculus
taaagctgacctggaccatcagaga

SEQ ID NO: 61641 - DNA, 25 bp, mus musculus
aaagctgacctggaccatcagagac

SEQ ID NO: 61642 - DNA, 25 bp, mus musculus
agctgacctggaccatcagagacag

SEQ ID NO: 61643 - DNA, 25 bp, mus musculus
gctgacctggaccatcagagacagg

SEQ ID NO: 61644 - DNA, 25 bp, mus musculus
tgacctggaccatcagagacaggta

SEQ ID NO: 61645 - DNA, 25 bp, mus musculus
gacctggaccatcagagacaggtaa

SEQ ID NO: 61646 - DNA, 25 bp, mus musculus
gctgcccggctggacattttggata

SEQ ID NO: 61647 - DNA, 25 bp, mus musculus
gcccggctggacattttggatacag

SEQ ID NO: 61648 - DNA, 25 bp, mus musculus
acattttggatacagccggacaaga

SEQ ID NO: 61649 - DNA, 25 bp, mus musculus
attttggatacagccggacaagagg

SEQ ID NO: 61650 - DNA, 25 bp, mus musculus
atacagccggacaagaggagtttgg

SEQ ID NO: 61651 - DNA, 25 bp, mus musculus
agtttggagccatgagagagcaata

SEQ ID NO: 61652 - DNA, 25 bp, mus musculus
tgttggtcttctcagtcacggatag

SEQ ID NO: 61653 - DNA, 25 bp, mus musculus
ttggtcttctcagtcacggatagag

SEQ ID NO: 61654 - DNA, 25 bp, mus musculus
catctttccagctccagtcggacag

SEQ ID NO: 61655 - DNA, 25 bp, mus musculus
atctttccagctccagtcggacagg

SEQ ID NO: 61656 - DNA, 25 bp, mus musculus
gcgtgcagcgtcaccggatcgtcca

SEQ ID NO: 61657 - DNA, 25 bp, mus musculus
cagcgtcaccggatcgtccaccata

SEQ ID NO: 61658 - DNA, 25 bp, mus musculus
gatcgtccaccatagcggcagagga

SEQ ID NO: 61659 - DNA, 25 bp, mus musculus
atcgtccaccatagcggcagaggaa

SEQ ID NO: 61660 - DNA, 25 bp, mus musculus
tcgtccaccatagcggcagaggaac

SEQ ID NO: 61661 - DNA, 25 bp, mus musculus
cgtccaccatagcggcagaggaacc

SEQ ID NO: 61662 - DNA, 25 bp, mus musculus
ccaccatagcggcagaggaaccgtc

SEQ ID NO: 61663 - DNA, 25 bp, mus musculus
caccatagcggcagaggaaccgtcg

SEQ ID NO: 61664 - DNA, 25 bp, mus musculus
tctttccagctccagtcggacaggc

SEQ ID NO: 61665 - DNA, 25 bp, mus musculus
ctttccagctccagtcggacaggcg

SEQ ID NO: 61666 - DNA, 25 bp, mus musculus
tttccagctccagtcggacaggcgc

SEQ ID NO: 61667 - DNA, 25 bp, mus musculus
ttccagctccagtcggacaggcgcg

SEQ ID NO: 61668 - DNA, 25 bp, mus musculus
tccagctccagtcggacaggcgcgg

SEQ ID NO: 61669 - DNA, 25 bp, mus musculus
ctccagtcggacaggcgcggagact

SEQ ID NO: 61670 - DNA, 25 bp, mus musculus
caccctgggcgtgcagcgtcaccgg

SEQ ID NO: 61671 - DNA, 25 bp, mus musculus
accctgggcgtgcagcgtcaccgga

SEQ ID NO: 61672 - DNA, 25 bp, mus musculus
gccaggagaccctggcaaagcaaac

SEQ ID NO: 61673 - DNA, 25 bp, mus musculus
ccccacaactggaagcctgggtcag

SEQ ID NO: 61674 - DNA, 25 bp, mus musculus
ttccacactggccaagacggttctt

SEQ ID NO: 61675 - DNA, 25 bp, mus musculus
ttaaaatccaacttctgtcatctgc

SEQ ID NO: 61676 - DNA, 25 bp, mus musculus
tccaacttctgtcatctgccccata

SEQ ID NO: 61677 - DNA, 25 bp, mus musculus
ttctgtcatctgccccatatggcaa

SEQ ID NO: 61678 - DNA, 25 bp, mus musculus
atggcaagactgacctggtataact

SEQ ID NO: 61679 - DNA, 25 bp, mus musculus
agactgacctggtataacttcagcg

SEQ ID NO: 61680 - DNA, 25 bp, mus musculus
tataacttcagcgcatcctccaagg

SEQ ID NO: 61681 - DNA, 25 bp, mus musculus
atatataaccctgctcttgttaatc

SEQ ID NO: 61682 - DNA, 25 bp, mus musculus
aaccctgctcttgttaatctcaatg

SEQ ID NO: 61683 - DNA, 25 bp, mus musculus
cttgttaatctcaatgacaataaaa

SEQ ID NO: 61684 - DNA, 25 bp, mus musculus
aggctttaggtctaggctgatgtaa

SEQ ID NO: 61685 - DNA, 25 bp, mus musculus
gatgtaagccctgtgtatcctatcc

SEQ ID NO: 61686 - DNA, 25 bp, mus musculus
agccctgtgtatcctatcccagttc

SEQ ID NO: 61687 - DNA, 25 bp, mus musculus
tttcttcttagatgctaaccctggg

SEQ ID NO: 61688 - DNA, 25 bp, mus musculus
cttagatgctaaccctgggccctct

SEQ ID NO: 61689 - DNA, 25 bp, mus musculus
tgctaaccctgggccctctgtacat

SEQ ID NO: 61690 - DNA, 25 bp, mus musculus
ccctgggccctctgtacatagcatc

SEQ ID NO: 61691 - DNA, 25 bp, mus musculus
tacccacttcaggaacttcaaagag

SEQ ID NO: 61692 - DNA, 25 bp, mus musculus
caagcctccatgactccaaaagggg

SEQ ID NO: 61693 - DNA, 25 bp, mus musculus
gcctccatgactccaaaagggggca

SEQ ID NO: 61694 - DNA, 25 bp, mus musculus
tggcatctgccactgcaggtgctgt

SEQ ID NO: 61695 - DNA, 25 bp, mus musculus
tgctgcttcagctgtaacgaatgag

SEQ ID NO: 61696 - DNA, 25 bp, mus musculus
tgcttcagctgtaacgaatgagcca

SEQ ID NO: 61697 - DNA, 25 bp, mus musculus
atgatgcagtcggcagacggacccg

SEQ ID NO: 61698 - DNA, 25 bp, mus musculus
atgcagtcggcagacggacccgaag

SEQ ID NO: 61699 - DNA, 25 bp, mus musculus
aagctgttctgacacatggactatt

SEQ ID NO: 61700 - DNA, 25 bp, mus musculus
ttctgacacatggactatttttgta

SEQ ID NO: 61701 - DNA, 25 bp, mus musculus
acttggacattggtcacttgtagga

SEQ ID NO: 61702 - DNA, 25 bp, mus musculus
tggacattggtcacttgtaggaaat

SEQ ID NO: 61703 - DNA, 25 bp, mus musculus
gaaattaacttgtctatcttcattt

SEQ ID NO: 61704 - DNA, 25 bp, mus musculus
agcttgtccctccatgtaggcccag

SEQ ID NO: 61705 - DNA, 25 bp, mus musculus
ctccatgtaggcccagctgtggact

SEQ ID NO: 61706 - DNA, 25 bp, mus musculus
tgccttgctgccagcagggatctct

SEQ ID NO: 61707 - DNA, 25 bp, mus musculus
gctgccagcagggatctcttgagcc

SEQ ID NO: 61708 - DNA, 25 bp, mus musculus
agcctgtctccagcttgaccccaag

SEQ ID NO: 61709 - DNA, 25 bp, mus musculus
gcttgaccccaaggtagacactggc

SEQ ID NO: 61710 - DNA, 25 bp, mus musculus
tgaccccaaggtagacactggcatc

SEQ ID NO: 61711 - DNA, 25 bp, mus musculus
ggtagacactggcatctgccactgc

SEQ ID NO: 61712 - DNA, 25 bp, mus musculus
ggctcgcccatggcgtaacgtggcc

SEQ ID NO: 61713 - DNA, 25 bp, mus musculus
catggcgtaacgtggccgacacgaa

SEQ ID NO: 61714 - DNA, 25 bp, mus musculus
gctgtacgacatcctgggcgtccct

SEQ ID NO: 61715 - DNA, 25 bp, mus musculus
gcgctacgcagaacgagctgaagaa

SEQ ID NO: 61716 - DNA, 25 bp, mus musculus
cgctacgcagaacgagctgaagaag

SEQ ID NO: 61717 - DNA, 25 bp, mus musculus
tagccaaagaataccaccctgataa

SEQ ID NO: 61718 - DNA, 25 bp, mus musculus
agccaaagaataccaccctgataag

SEQ ID NO: 61719 - DNA, 25 bp, mus musculus
caaagaataccaccctgataagaat

SEQ ID NO: 61720 - DNA, 25 bp, mus musculus
agaataccaccctgataagaatcca

SEQ ID NO: 61721 - DNA, 25 bp, mus musculus
gtcaaatccagagaagcgagactgt

SEQ ID NO: 61722 - DNA, 25 bp, mus musculus
ggatgatatcttctcacatattttt

SEQ ID NO: 61723 - DNA, 25 bp, mus musculus
gatgatatcttctcacatatttttg

SEQ ID NO: 61724 - DNA, 25 bp, mus musculus
taacgtggccgacacgaagctgtac

SEQ ID NO: 61725 - DNA, 25 bp, mus musculus
gatatcttctcacatatttttggtg

SEQ ID NO: 61726 - DNA, 25 bp, mus musculus
acgtggccgacacgaagctgtacga

SEQ ID NO: 61727 - DNA, 25 bp, mus musculus
cgtggccgacacgaagctgtacgac

SEQ ID NO: 61728 - DNA, 25 bp, mus musculus
tggccgacacgaagctgtacgacat

SEQ ID NO: 61729 - DNA, 25 bp, mus musculus
ggccgacacgaagctgtacgacatc

SEQ ID NO: 61730 - DNA, 25 bp, mus musculus
ccgacacgaagctgtacgacatcct

SEQ ID NO: 61731 - DNA, 25 bp, mus musculus
gaagctgtacgacatcctgggcgtc

SEQ ID NO: 61732 - DNA, 25 bp, mus musculus
agctgtacgacatcctgggcgtccc

SEQ ID NO: 61733 - DNA, 25 bp, mus musculus
caactggatcttctaggctcaaagt

SEQ ID NO: 61734 - DNA, 25 bp, mus musculus
gatcttctaggctcaaagtggcagg

SEQ ID NO: 61735 - DNA, 25 bp, mus musculus
tgtttctctacaacatatatgtgac

SEQ ID NO: 61736 - DNA, 25 bp, mus musculus
tacacctctaatgtcctcccttgtt

SEQ ID NO: 61737 - DNA, 25 bp, mus musculus
tctaatgtcctcccttgttgcctta

SEQ ID NO: 61738 - DNA, 25 bp, mus musculus
gtcctcccttgttgccttagagtag

SEQ ID NO: 61739 - DNA, 25 bp, mus musculus
actgaaccgtcaactgttctgccct

SEQ ID NO: 61740 - DNA, 25 bp, mus musculus
actgttctgcccttggaacatgcct

SEQ ID NO: 61741 - DNA, 25 bp, mus musculus
catgcctactttaagcacacgtagc

SEQ ID NO: 61742 - DNA, 25 bp, mus musculus
tactttaagcacacgtagctttttg

SEQ ID NO: 61743 - DNA, 25 bp, mus musculus
aagcacacgtagctttttgtgttgg

SEQ ID NO: 61744 - DNA, 25 bp, mus musculus
tacttttctgttgacaaagtagcca

SEQ ID NO: 61745 - DNA, 25 bp, mus musculus
tggcaggctcttgggacaagggaaa

SEQ ID NO: 61746 - DNA, 25 bp, mus musculus
tagatactaacaactccattttcaa

SEQ ID NO: 61747 - DNA, 25 bp, mus musculus
agcaataatacatgtcctataatca

SEQ ID NO: 61748 - DNA, 25 bp, mus musculus
ataatcatgttctacagcctcttgt

SEQ ID NO: 61749 - DNA, 25 bp, mus musculus
tacagcctcttgtttgatacctaca

SEQ ID NO: 61750 - DNA, 25 bp, mus musculus
gatatgtgtcctacattatgaagcc

SEQ ID NO: 61751 - DNA, 25 bp, mus musculus
tgtcctacattatgaagccaaggac

SEQ ID NO: 61752 - DNA, 25 bp, mus musculus
cagttaatcagagtcctttgctagg

SEQ ID NO: 61753 - DNA, 25 bp, mus musculus
ccttggcatgtcagcctttaagtaa

SEQ ID NO: 61754 - DNA, 25 bp, mus musculus
tggcatgtcagcctttaagtaacgg

SEQ ID NO: 61755 - DNA, 25 bp, mus musculus
agctatgccacacagagaccatagt

SEQ ID NO: 61756 - DNA, 25 bp, mus musculus
gccacacagagaccatagtcacttg

SEQ ID NO: 61757 - DNA, 25 bp, mus musculus
cagagaccatagtcacttgtcattt

SEQ ID NO: 61758 - DNA, 25 bp, mus musculus
tagtcacttgtcattttcaagcctc

SEQ ID NO: 61759 - DNA, 25 bp, mus musculus
tcacttgtcattttcaagcctctat

SEQ ID NO: 61760 - DNA, 25 bp, mus musculus
ttcaagcctctattttcccagctcc

SEQ ID NO: 61761 - DNA, 25 bp, mus musculus
cctctattttcccagctccatggtg

SEQ ID NO: 61762 - DNA, 25 bp, mus musculus
ctattttcccagctccatggtgagg

SEQ ID NO: 61763 - DNA, 25 bp, mus musculus
cagctccatggtgaggacaccagct

SEQ ID NO: 61764 - DNA, 25 bp, mus musculus
ctccatggtgaggacaccagctttc

SEQ ID NO: 61765 - DNA, 25 bp, mus musculus
gttctcaaaacctagaagtcatggc

SEQ ID NO: 61766 - DNA, 25 bp, mus musculus
ctcaaaacctagaagtcatggcatg

SEQ ID NO: 61767 - DNA, 25 bp, mus musculus
cagccctaaggatgtctcagaggca

SEQ ID NO: 61768 - DNA, 25 bp, mus musculus
gcattcagaggggcttctgcaaacc

SEQ ID NO: 61769 - DNA, 25 bp, mus musculus
ggggcttctgcaaacctagagtcca

SEQ ID NO: 61770 - DNA, 25 bp, mus musculus
gcttctgcaaacctagagtccagga

SEQ ID NO: 61771 - DNA, 25 bp, mus musculus
aacctagagtccaggaggcaatggg

SEQ ID NO: 61772 - DNA, 25 bp, mus musculus
ggtagctatgccacacagagaccat

SEQ ID NO: 61773 - DNA, 25 bp, mus musculus
caggccctgtaggatgctgtgggtc

SEQ ID NO: 61774 - DNA, 25 bp, mus musculus
gtgggtcctcagcatctaagtcaca

SEQ ID NO: 61775 - DNA, 25 bp, mus musculus
taaaggtccacagtctagagtatta

SEQ ID NO: 61776 - DNA, 25 bp, mus musculus
tccacagtctagagtattaggtacg

SEQ ID NO: 61777 - DNA, 25 bp, mus musculus
tttccctccttaagcacctatgctc

SEQ ID NO: 61778 - DNA, 25 bp, mus musculus
cctgtgcgatgcactgggaatgcct

SEQ ID NO: 61779 - DNA, 25 bp, mus musculus
cgatgcactgggaatgcctgctttc

SEQ ID NO: 61780 - DNA, 25 bp, mus musculus
ctcatttggggccatgttgcccctt

SEQ ID NO: 61781 - DNA, 25 bp, mus musculus
agtcccctatgcctgttctgaagtg

SEQ ID NO: 61782 - DNA, 25 bp, mus musculus
ctatgcctgttctgaagtgtggact

SEQ ID NO: 61783 - DNA, 25 bp, mus musculus
gcctccagagaggctcagatcacat

SEQ ID NO: 61784 - DNA, 25 bp, mus musculus
gctcagatcacataaaacttttgtc

SEQ ID NO: 61785 - DNA, 25 bp, mus musculus
cctcagcatctaagtcacaagaggc

SEQ ID NO: 61786 - DNA, 25 bp, mus musculus
tcacataaaacttttgtcagtcact

SEQ ID NO: 61787 - DNA, 25 bp, mus musculus
taaccacttctaatgctggacacct

SEQ ID NO: 61788 - DNA, 25 bp, mus musculus
cttctaatgctggacacctctaggt

SEQ ID NO: 61789 - DNA, 25 bp, mus musculus
atgctggacacctctaggttctatg

SEQ ID NO: 61790 - DNA, 25 bp, mus musculus
tctaggttctatgctgctttttgcc

SEQ ID NO: 61791 - DNA, 25 bp, mus musculus
aatgcccaagaatacatatgtctaa

SEQ ID NO: 61792 - DNA, 25 bp, mus musculus
ttaaatctctaagcactatggagcc

SEQ ID NO: 61793 - DNA, 25 bp, mus musculus
ctctaagcactatggagccaatgtt

SEQ ID NO: 61794 - DNA, 25 bp, mus musculus
ccttcaccttttgccaggagcagcc

SEQ ID NO: 61795 - DNA, 25 bp, mus musculus
agcagccctattcccagctgtcgga

SEQ ID NO: 61796 - DNA, 25 bp, mus musculus
ttcagcaaggagccgagtgatgatg

SEQ ID NO: 61797 - DNA, 25 bp, mus musculus
gatgatgcatcagcacctggcagtg

SEQ ID NO: 61798 - DNA, 25 bp, mus musculus
gcacctggcagtgttcctgtggccc

SEQ ID NO: 61799 - DNA, 25 bp, mus musculus
gttcctgtggcccagatccttccca

SEQ ID NO: 61800 - DNA, 25 bp, mus musculus
gtggcccagatccttcccacaagac

SEQ ID NO: 61801 - DNA, 25 bp, mus musculus
cactccagctggacattcaatggac

SEQ ID NO: 61802 - DNA, 25 bp, mus musculus
acattcaatggacccgagagacaga

SEQ ID NO: 61803 - DNA, 25 bp, mus musculus
agaattagtcactctgccctctctg

SEQ ID NO: 61804 - DNA, 25 bp, mus musculus
tccctgctccctactattgactcat

SEQ ID NO: 61805 - DNA, 25 bp, mus musculus
ctccctactattgactcatatatac

SEQ ID NO: 61806 - DNA, 25 bp, mus musculus
cccagctgtcggatgagcaggttat

SEQ ID NO: 61807 - DNA, 25 bp, mus musculus
acactggagagttcttccgagacca

SEQ ID NO: 61808 - DNA, 25 bp, mus musculus
gagagttcttccgagaccaagggag

SEQ ID NO: 61809 - DNA, 25 bp, mus musculus
ggcagatctatctccctcaaccagc

SEQ ID NO: 61810 - DNA, 25 bp, mus musculus
gccccgactctgtgtataagctgat

SEQ ID NO: 61811 - DNA, 25 bp, mus musculus
gagaaaccaagcaccggccatcctt

SEQ ID NO: 61812 - DNA, 25 bp, mus musculus
catccttccaggaaatacacctcct

SEQ ID NO: 61813 - DNA, 25 bp, mus musculus
acctcctgcttcttcagcaaggagc

SEQ ID NO: 61814 - DNA, 25 bp, mus musculus
aggaacactcccgtagctccttcat

SEQ ID NO: 61815 - DNA, 25 bp, mus musculus
actcccgtagctccttcatccattg

SEQ ID NO: 61816 - DNA, 25 bp, mus musculus
gtgcagatttccccacatttatttg

SEQ ID NO: 61817 - DNA, 25 bp, mus musculus
cagatttccccacatttatttgtat

SEQ ID NO: 61818 - DNA, 25 bp, mus musculus
aaagctgcgacgtagcagtgacctc

SEQ ID NO: 61819 - DNA, 25 bp, mus musculus
acgtagcagtgacctcagcagtccc

SEQ ID NO: 61820 - DNA, 25 bp, mus musculus
tagcagtgacctcagcagtccctat

SEQ ID NO: 61821 - DNA, 25 bp, mus musculus
cagtgacctcagcagtccctatgtt

SEQ ID NO: 61822 - DNA, 25 bp, mus musculus
tgacctcagcagtccctatgttttc

SEQ ID NO: 61823 - DNA, 25 bp, mus musculus
ctaaagtctttgttcttgaaatgca

SEQ ID NO: 61824 - DNA, 25 bp, mus musculus
aagtctttgttcttgaaatgcaagg

SEQ ID NO: 61825 - DNA, 25 bp, mus musculus
tgaaagcaacatactcttaatgttg

SEQ ID NO: 61826 - DNA, 25 bp, mus musculus
gtagctccttcatccattgccagtg

SEQ ID NO: 61827 - DNA, 25 bp, mus musculus
gctccttcatccattgccagtggag

SEQ ID NO: 61828 - DNA, 25 bp, mus musculus
aggtgcctttgcggatgacctcatt

SEQ ID NO: 61829 - DNA, 25 bp, mus musculus
tgcctttgcggatgacctcattttg

SEQ ID NO: 61830 - DNA, 25 bp, mus musculus
ctttgcggatgacctcattttgatg

SEQ ID NO: 61831 - DNA, 25 bp, mus musculus
tgcggatgacctcattttgatgtta

SEQ ID NO: 61832 - DNA, 25 bp, mus musculus
ggatgacctcattttgatgttaaaa

SEQ ID NO: 61833 - DNA, 25 bp, mus musculus
gctcgaacttcgatgcagagtttgt

SEQ ID NO: 61834 - DNA, 25 bp, mus musculus
acagacgccatctttgatgagtggc

SEQ ID NO: 61835 - DNA, 25 bp, mus musculus
tggcctcaggaactggcacccattg

SEQ ID NO: 61836 - DNA, 25 bp, mus musculus
cgcaaaggctatgcgcccttaatgg

SEQ ID NO: 61837 - DNA, 25 bp, mus musculus
ggctatgcgcccttaatggagacag

SEQ ID NO: 61838 - DNA, 25 bp, mus musculus
catgctcctacctggcctgacctgg

SEQ ID NO: 61839 - DNA, 25 bp, mus musculus
aggtggaactcttcagcgtgtgctc

SEQ ID NO: 61840 - DNA, 25 bp, mus musculus
aactcttcagcgtgtgctctttagt

SEQ ID NO: 61841 - DNA, 25 bp, mus musculus
tcagcgtgtgctctttagtagtgat

SEQ ID NO: 61842 - DNA, 25 bp, mus musculus
tgatgccttagcaatgacaattatc

SEQ ID NO: 61843 - DNA, 25 bp, mus musculus
aatgacaattatctctagttgctgc

SEQ ID NO: 61844 - DNA, 25 bp, mus musculus
ttgctgctttgcttattgtacacag

SEQ ID NO: 61845 - DNA, 25 bp, mus musculus
tacacagacaaaatgcttgggtcat

SEQ ID NO: 61846 - DNA, 25 bp, mus musculus
ccaccggtgactaatgaggagctct

SEQ ID NO: 61847 - DNA, 25 bp, mus musculus
cttggctacaattacgccgttgatc

SEQ ID NO: 61848 - DNA, 25 bp, mus musculus
tacaattacgccgttgatctgtcag

SEQ ID NO: 61849 - DNA, 25 bp, mus musculus
gaagctccagtttggtccacaactc

SEQ ID NO: 61850 - DNA, 25 bp, mus musculus
tggtccacaactctctcagtggtca

SEQ ID NO: 61851 - DNA, 25 bp, mus musculus
ttgctcttggggttgctggcttttc

SEQ ID NO: 61852 - DNA, 25 bp, mus musculus
ttgctggcttttcttcaatacagaa

SEQ ID NO: 61853 - DNA, 25 bp, mus musculus
cttcaatacagaaggcttcgcaaag

SEQ ID NO: 61854 - DNA, 25 bp, mus musculus
tggagctcctgatgatggccctcct

SEQ ID NO: 61855 - DNA, 25 bp, mus musculus
tcctgatgatggccctcctggagag

SEQ ID NO: 61856 - DNA, 25 bp, mus musculus
accttggcttgcctctgagggagat

SEQ ID NO: 61857 - DNA, 25 bp, mus musculus
aattttctgttgatagtgggcatgt

SEQ ID NO: 61858 - DNA, 25 bp, mus musculus
cttactgcacttgctgtctttccaa

SEQ ID NO: 61859 - DNA, 25 bp, mus musculus
actgcacttgctgtctttccaaaag

SEQ ID NO: 61860 - DNA, 25 bp, mus musculus
gcacttgctgtctttccaaaaggcc

SEQ ID NO: 61861 - DNA, 25 bp, mus musculus
aaaggccacttcctactgctcaact

SEQ ID NO: 61862 - DNA, 25 bp, mus musculus
ctgctcaactccctttggtatactg

SEQ ID NO: 61863 - DNA, 25 bp, mus musculus
tccctttggtatactgcacgtgtta

SEQ ID NO: 61864 - DNA, 25 bp, mus musculus
ctttggtatactgcacgtgttataa

SEQ ID NO: 61865 - DNA, 25 bp, mus musculus
tggtatactgcacgtgttataaccc

SEQ ID NO: 61866 - DNA, 25 bp, mus musculus
ccctgaaggccctgatggtccagag

SEQ ID NO: 61867 - DNA, 25 bp, mus musculus
aggccctgatggtccagaggagaag

SEQ ID NO: 61868 - DNA, 25 bp, mus musculus
gcgacgtagtcaccgaagtgagagg

SEQ ID NO: 61869 - DNA, 25 bp, mus musculus
agaccgtgatcgggatcgagagcac

SEQ ID NO: 61870 - DNA, 25 bp, mus musculus
gtacatggccccagagaatggatat

SEQ ID NO: 61871 - DNA, 25 bp, mus musculus
gtggacatgctcctaatcttgctgt

SEQ ID NO: 61872 - DNA, 25 bp, mus musculus
ctgtctgccttcctagccttttcca

SEQ ID NO: 61873 - DNA, 25 bp, mus musculus
ttttccaccttggcttgcctctgag

SEQ ID NO: 61874 - DNA, 25 bp, mus musculus
gtcctcgcctactcgagcggttcat

SEQ ID NO: 61875 - DNA, 25 bp, mus musculus
tcctcgcctactcgagcggttcata

SEQ ID NO: 61876 - DNA, 25 bp, mus musculus
ctcgagcggttcatatgcaggccat

SEQ ID NO: 61877 - DNA, 25 bp, mus musculus
cggttcatatgcaggccatcaagtg

SEQ ID NO: 61878 - DNA, 25 bp, mus musculus
ggttcatatgcaggccatcaagtgt

SEQ ID NO: 61879 - DNA, 25 bp, mus musculus
ttcatatgcaggccatcaagtgtgt

SEQ ID NO: 61880 - DNA, 25 bp, mus musculus
gaaaccagttgaatccggtcctatg

SEQ ID NO: 61881 - DNA, 25 bp, mus musculus
ttgaatccggtcctatgggacacat

SEQ ID NO: 61882 - DNA, 25 bp, mus musculus
atccggtcctatgggacacatctgt

SEQ ID NO: 61883 - DNA, 25 bp, mus musculus
tccggtcctatgggacacatctgta

SEQ ID NO: 61884 - DNA, 25 bp, mus musculus
ccggtcctatgggacacatctgtac

SEQ ID NO: 61885 - DNA, 25 bp, mus musculus
cggtcctatgggacacatctgtaca

SEQ ID NO: 61886 - DNA, 25 bp, mus musculus
cctcgcctactcgagcggttcatat

SEQ ID NO: 61887 - DNA, 25 bp, mus musculus
ctcgcctactcgagcggttcatatg

SEQ ID NO: 61888 - DNA, 25 bp, mus musculus
tcgcctactcgagcggttcatatgc

SEQ ID NO: 61889 - DNA, 25 bp, mus musculus
gcctactcgagcggttcatatgcag

SEQ ID NO: 61890 - DNA, 25 bp, mus musculus
cctactcgagcggttcatatgcagg

SEQ ID NO: 61891 - DNA, 25 bp, mus musculus
ctactcgagcggttcatatgcaggc

SEQ ID NO: 61892 - DNA, 25 bp, mus musculus
tactcgagcggttcatatgcaggcc

SEQ ID NO: 61893 - DNA, 25 bp, mus musculus
actcgagcggttcatatgcaggcca

SEQ ID NO: 61894 - DNA, 25 bp, mus musculus
agccgaatgacagccggcagcaact

SEQ ID NO: 61895 - DNA, 25 bp, mus musculus
ccgaatgacagccggcagcaactgg

SEQ ID NO: 61896 - DNA, 25 bp, mus musculus
tgcaggaccacagctcccgtccttt

SEQ ID NO: 61897 - DNA, 25 bp, mus musculus
caggaccacagctcccgtcctttgg

SEQ ID NO: 61898 - DNA, 25 bp, mus musculus
tggcttctggtccttcctgttctcc

SEQ ID NO: 61899 - DNA, 25 bp, mus musculus
cttctccttagtcttcctgactcaa

SEQ ID NO: 61900 - DNA, 25 bp, mus musculus
tctccttagtcttcctgactcaacc

SEQ ID NO: 61901 - DNA, 25 bp, mus musculus
cttagtcttcctgactcaacccgtg

SEQ ID NO: 61902 - DNA, 25 bp, mus musculus
tagtcttcctgactcaacccgtggt

SEQ ID NO: 61903 - DNA, 25 bp, mus musculus
gtcttcctgactcaacccgtggtct

SEQ ID NO: 61904 - DNA, 25 bp, mus musculus
tctctggcagtttcatatttgctaa

SEQ ID NO: 61905 - DNA, 25 bp, mus musculus
tttcatatttgctaatacgaatttg

SEQ ID NO: 61906 - DNA, 25 bp, mus musculus
gaatgacagccggcagcaactggaa

SEQ ID NO: 61907 - DNA, 25 bp, mus musculus
gacagccggcagcaactggaatggc

SEQ ID NO: 61908 - DNA, 25 bp, mus musculus
cagccggcagcaactggaatggcag

SEQ ID NO: 61909 - DNA, 25 bp, mus musculus
ggcaagtgcacacaggcccacacag

SEQ ID NO: 61910 - DNA, 25 bp, mus musculus
caagtgcacacaggcccacacagac

SEQ ID NO: 61911 - DNA, 25 bp, mus musculus
aattttgttgtctggccctcagtgc

SEQ ID NO: 61912 - DNA, 25 bp, mus musculus
ttttgttgtctggccctcagtgccc

SEQ ID NO: 61913 - DNA, 25 bp, mus musculus
ttgttgtctggccctcagtgccctg

SEQ ID NO: 61914 - DNA, 25 bp, mus musculus
tgagcccaagctaggactctgcagc

SEQ ID NO: 61915 - DNA, 25 bp, mus musculus
gctaggactctgcagccttggagcc

SEQ ID NO: 61916 - DNA, 25 bp, mus musculus
tggtgagacctccacacctgcagcc

SEQ ID NO: 61917 - DNA, 25 bp, mus musculus
acctgcagcctgcagcaaggtggat

SEQ ID NO: 61918 - DNA, 25 bp, mus musculus
agcctgcagcaaggtggatgttcgg

SEQ ID NO: 61919 - DNA, 25 bp, mus musculus
ctttccttcccagatgggcttgcta

SEQ ID NO: 61920 - DNA, 25 bp, mus musculus
ttcccagatgggcttgctacctgac

SEQ ID NO: 61921 - DNA, 25 bp, mus musculus
acctgaccccacattgaactggagg

SEQ ID NO: 61922 - DNA, 25 bp, mus musculus
tgcccctgcaggaaggagctacctg

SEQ ID NO: 61923 - DNA, 25 bp, mus musculus
ttttaagctctgagctgtcaacgag

SEQ ID NO: 61924 - DNA, 25 bp, mus musculus
taagctctgagctgtcaacgagacg

SEQ ID NO: 61925 - DNA, 25 bp, mus musculus
gctctgagctgtcaacgagacgttt

SEQ ID NO: 61926 - DNA, 25 bp, mus musculus
ctgcagccttggagcctcagctcca

SEQ ID NO: 61927 - DNA, 25 bp, mus musculus
ccttggagcctcagctccagggttc

SEQ ID NO: 61928 - DNA, 25 bp, mus musculus
tagcaaccatcagactgagccagcg

SEQ ID NO: 61929 - DNA, 25 bp, mus musculus
caaccatcagactgagccagcgctg

SEQ ID NO: 61930 - DNA, 25 bp, mus musculus
gactgagccagcgctggacgggccc

SEQ ID NO: 61931 - DNA, 25 bp, mus musculus
cttctgcatttgcagttccggcatg

SEQ ID NO: 61932 - DNA, 25 bp, mus musculus
ctgcatttgcagttccggcatggac

SEQ ID NO: 61933 - DNA, 25 bp, mus musculus
ttgcagttccggcatggacaatgga

SEQ ID NO: 61934 - DNA, 25 bp, mus musculus
taattattcggtctgcattcccagt

SEQ ID NO: 61935 - DNA, 25 bp, mus musculus
aattattcggtctgcattcccagtg

SEQ ID NO: 61936 - DNA, 25 bp, mus musculus
tggcattactctgcactctagccac

SEQ ID NO: 61937 - DNA, 25 bp, mus musculus
ggcattactctgcactctagccact

SEQ ID NO: 61938 - DNA, 25 bp, mus musculus
gcattactctgcactctagccactt

SEQ ID NO: 61939 - DNA, 25 bp, mus musculus
attactctgcactctagccacttgc

SEQ ID NO: 61940 - DNA, 25 bp, mus musculus
ttactctgcactctagccacttgcc

SEQ ID NO: 61941 - DNA, 25 bp, mus musculus
tgcactctagccacttgccccaatt

SEQ ID NO: 61942 - DNA, 25 bp, mus musculus
gcactctagccacttgccccaattt

SEQ ID NO: 61943 - DNA, 25 bp, mus musculus
ctctagccacttgccccaatttaag

SEQ ID NO: 61944 - DNA, 25 bp, mus musculus
tctagccacttgccccaatttaagt

SEQ ID NO: 61945 - DNA, 25 bp, mus musculus
caataatagctgaacctctgttaaa

SEQ ID NO: 61946 - DNA, 25 bp, mus musculus
ttattcggtctgcattcccagtggg

SEQ ID NO: 61947 - DNA, 25 bp, mus musculus
tattcggtctgcattcccagtgggc

SEQ ID NO: 61948 - DNA, 25 bp, mus musculus
attcggtctgcattcccagtgggca

SEQ ID NO: 61949 - DNA, 25 bp, mus musculus
ttcggtctgcattcccagtgggcag

SEQ ID NO: 61950 - DNA, 25 bp, mus musculus
cggtctgcattcccagtgggcagtg

SEQ ID NO: 61951 - DNA, 25 bp, mus musculus
ggtctgcattcccagtgggcagtga

SEQ ID NO: 61952 - DNA, 25 bp, mus musculus
tgatggcattactctgcactctagc

SEQ ID NO: 61953 - DNA, 25 bp, mus musculus
atggcattactctgcactctagcca

SEQ ID NO: 61954 - DNA, 25 bp, mus musculus
tcaccatgaccagcctatgaaaccc

SEQ ID NO: 61955 - DNA, 25 bp, mus musculus
tgaccagcctatgaaacccctggac

SEQ ID NO: 61956 - DNA, 25 bp, mus musculus
gagctcactgacaatgaactacatg

SEQ ID NO: 61957 - DNA, 25 bp, mus musculus
gaacaaactttcagcctcattctta

SEQ ID NO: 61958 - DNA, 25 bp, mus musculus
actttcagcctcattcttatttatg

SEQ ID NO: 61959 - DNA, 25 bp, mus musculus
agcctcattcttatttatgaaccac

SEQ ID NO: 61960 - DNA, 25 bp, mus musculus
ccttctaaacacttgacttgattct

SEQ ID NO: 61961 - DNA, 25 bp, mus musculus
ttgacttgattcttttctaataaag

SEQ ID NO: 61962 - DNA, 25 bp, mus musculus
atttttaccatataagaagacatat

SEQ ID NO: 61963 - DNA, 25 bp, mus musculus
tactgatacattctcaaaaatctcc

SEQ ID NO: 61964 - DNA, 25 bp, mus musculus
tacattctcaaaaatctccatttct

SEQ ID NO: 61965 - DNA, 25 bp, mus musculus
ctcaaaaatctccatttctgtaatt

SEQ ID NO: 61966 - DNA, 25 bp, mus musculus
cagggctgtcttctggattgagttt

SEQ ID NO: 61967 - DNA, 25 bp, mus musculus
gcgccacaaaagagccaagcacctg

SEQ ID NO: 61968 - DNA, 25 bp, mus musculus
agccaagcacctgagaccacttgga

SEQ ID NO: 61969 - DNA, 25 bp, mus musculus
gcacctgagaccacttggacataac

SEQ ID NO: 61970 - DNA, 25 bp, mus musculus
tggattcctactctcttgtgtggca

SEQ ID NO: 61971 - DNA, 25 bp, mus musculus
ctcttgtgtggcaaccactatagtc

SEQ ID NO: 61972 - DNA, 25 bp, mus musculus
tgtggcaaccactatagtccttagt

SEQ ID NO: 61973 - DNA, 25 bp, mus musculus
tgtaaagtgcctcttgttcatttac

SEQ ID NO: 61974 - DNA, 25 bp, mus musculus
cacttcatgtcactgaaggctcagg

SEQ ID NO: 61975 - DNA, 25 bp, mus musculus
atgtcactgaaggctcaggacgcta

SEQ ID NO: 61976 - DNA, 25 bp, mus musculus
tgcaccagtctggattcagcttgtc

SEQ ID NO: 61977 - DNA, 25 bp, mus musculus
agtctggattcagcttgtctggtgc

SEQ ID NO: 61978 - DNA, 25 bp, mus musculus
gattcagcttgtctggtgctcagat

SEQ ID NO: 61979 - DNA, 25 bp, mus musculus
gcttgtctggtgctcagattgacga

SEQ ID NO: 61980 - DNA, 25 bp, mus musculus
gcctgctaaagcccctagcctgcag

SEQ ID NO: 61981 - DNA, 25 bp, mus musculus
taaagcccctagcctgcaggccact

SEQ ID NO: 61982 - DNA, 25 bp, mus musculus
ccctagcctgcaggccacttgggga

SEQ ID NO: 61983 - DNA, 25 bp, mus musculus
acacctgaggacattctgagacttc

SEQ ID NO: 61984 - DNA, 25 bp, mus musculus
attctgagacttcctttcttccatt

SEQ ID NO: 61985 - DNA, 25 bp, mus musculus
tgcactcggtctcccctggagtttc

SEQ ID NO: 61986 - DNA, 25 bp, mus musculus
gctcaggacgctacattccccggaa

SEQ ID NO: 61987 - DNA, 25 bp, mus musculus
tccctgactttgtgtacaaacgcat

SEQ ID NO: 61988 - DNA, 25 bp, mus musculus
tgtacaaacgcatcaaagcaaggag

SEQ ID NO: 61989 - DNA, 25 bp, mus musculus
tgacgcccaagacggtgactccagc

SEQ ID NO: 61990 - DNA, 25 bp, mus musculus
ctccagcctcatcagctaagacatc

SEQ ID NO: 61991 - DNA, 25 bp, mus musculus
agcaggcaccacctgttcggaacct

SEQ ID NO: 61992 - DNA, 25 bp, mus musculus
ctgttcggaacctgcaccagtctgg

SEQ ID NO: 61993 - DNA, 25 bp, mus musculus
ggaacctgcaccagtctggattcag

SEQ ID NO: 61994 - DNA, 25 bp, mus musculus
gcctgctccattcctcagtctgaac

SEQ ID NO: 61995 - DNA, 25 bp, mus musculus
tgctccattcctcagtctgaacagt

SEQ ID NO: 61996 - DNA, 25 bp, mus musculus
atcaccacagtaaagcatctatact

SEQ ID NO: 61997 - DNA, 25 bp, mus musculus
accacagtaaagcatctatactcaa

SEQ ID NO: 61998 - DNA, 25 bp, mus musculus
gtaaagcatctatactcaatgctgt

SEQ ID NO: 61999 - DNA, 25 bp, mus musculus
aagcatctatactcaatgctgtcca

SEQ ID NO: 62000 - DNA, 25 bp, mus musculus
catctatactcaatgctgtccaagt

SEQ ID NO: 62001 - DNA, 25 bp, mus musculus
tcaatgctgtccaagtcctctctta

SEQ ID NO: 62002 - DNA, 25 bp, mus musculus
atgctgtccaagtcctctcttaccc

SEQ ID NO: 62003 - DNA, 25 bp, mus musculus
ctgtccaagtcctctcttaccctag

SEQ ID NO: 62004 - DNA, 25 bp, mus musculus
ggcctcagtttgctgggtgtttata

SEQ ID NO: 62005 - DNA, 25 bp, mus musculus
catgcttttgagttacgttggaaga

SEQ ID NO: 62006 - DNA, 25 bp, mus musculus
cctcagtctgaacagttcagcccag

SEQ ID NO: 62007 - DNA, 25 bp, mus musculus
gaacagttcagcccagtcagactct

SEQ ID NO: 62008 - DNA, 25 bp, mus musculus
ttcagcccagtcagactctggacag

SEQ ID NO: 62009 - DNA, 25 bp, mus musculus
ccagtcagactctggacaggggttt

SEQ ID NO: 62010 - DNA, 25 bp, mus musculus
gaattaccagcaaggaattgggtct

SEQ ID NO: 62011 - DNA, 25 bp, mus musculus
tgcaggtaacctgtgtggtgtgaac

SEQ ID NO: 62012 - DNA, 25 bp, mus musculus
taacctgtgtggtgtgaaccaagca

SEQ ID NO: 62013 - DNA, 25 bp, mus musculus
accatcaccacagtaaagcatctat

SEQ ID NO: 62014 - DNA, 25 bp, mus musculus
ctccgatcatcgcgatctactgcct

SEQ ID NO: 62015 - DNA, 25 bp, mus musculus
tcatcgcgatctactgcctattggt

SEQ ID NO: 62016 - DNA, 25 bp, mus musculus
ttgtcatctgtcctatatgcttagt

SEQ ID NO: 62017 - DNA, 25 bp, mus musculus
tctgtcctatatgcttagtcttcga

SEQ ID NO: 62018 - DNA, 25 bp, mus musculus
ctatatgcttagtcttcgaggcact

SEQ ID NO: 62019 - DNA, 25 bp, mus musculus
gcttagtcttcgaggcactgtcatg

SEQ ID NO: 62020 - DNA, 25 bp, mus musculus
tcttcgaggcactgtcatgcagact

SEQ ID NO: 62021 - DNA, 25 bp, mus musculus
aggcactgtcatgcagactcgactg

SEQ ID NO: 62022 - DNA, 25 bp, mus musculus
tgtcatgcagactcgactgttcatg

SEQ ID NO: 62023 - DNA, 25 bp, mus musculus
catctctgctgaggtgctacgcatc

SEQ ID NO: 62024 - DNA, 25 bp, mus musculus
ggtgctacgcatctactgtctcatc

SEQ ID NO: 62025 - DNA, 25 bp, mus musculus
acgcatctactgtctcatcgtggcc

SEQ ID NO: 62026 - DNA, 25 bp, mus musculus
cgatctactgcctattggttgcagt

SEQ ID NO: 62027 - DNA, 25 bp, mus musculus
actgcctattggttgcagtacttat

SEQ ID NO: 62028 - DNA, 25 bp, mus musculus
tcgctagctctctcgactgatgtca

SEQ ID NO: 62029 - DNA, 25 bp, mus musculus
gctctctcgactgatgtcatcaccc

SEQ ID NO: 62030 - DNA, 25 bp, mus musculus
aatgacctgactactagctttgcat

SEQ ID NO: 62031 - DNA, 25 bp, mus musculus
ctgactactagctttgcattgtcat

SEQ ID NO: 62032 - DNA, 25 bp, mus musculus
actagctttgcattgtcatctgtcc

SEQ ID NO: 62033 - DNA, 25 bp, mus musculus
tttgcattgtcatctgtcctatatg

SEQ ID NO: 62034 - DNA, 25 bp, mus musculus
agttaaactgcaggagtctggggct

SEQ ID NO: 62035 - DNA, 25 bp, mus musculus
cttctggatacacattcactagcta

SEQ ID NO: 62036 - DNA, 25 bp, mus musculus
tctattactgtgcaagggactatag

SEQ ID NO: 62037 - DNA, 25 bp, mus musculus
ctattactgtgcaagggactatagg

SEQ ID NO: 62038 - DNA, 25 bp, mus musculus
tattactgtgcaagggactataggt

SEQ ID NO: 62039 - DNA, 25 bp, mus musculus
cacggtcaccgtctcctcagcgtgg

SEQ ID NO: 62040 - DNA, 25 bp, mus musculus
caccgtctcctcagcgtggaggcat

SEQ ID NO: 62041 - DNA, 25 bp, mus musculus
accgtctcctcagcgtggaggcatc

SEQ ID NO: 62042 - DNA, 25 bp, mus musculus
gtctcctcagcgtggaggcatccac

SEQ ID NO: 62043 - DNA, 25 bp, mus musculus
tctcctcagcgtggaggcatccaca

SEQ ID NO: 62044 - DNA, 25 bp, mus musculus
ctcctcagcgtggaggcatccacag

SEQ ID NO: 62045 - DNA, 25 bp, mus musculus
cctcagcgtggaggcatccacagtt

SEQ ID NO: 62046 - DNA, 25 bp, mus musculus
ttctggatacacattcactagctat

SEQ ID NO: 62047 - DNA, 25 bp, mus musculus
gaggcatccacagttcggaggctaa

SEQ ID NO: 62048 - DNA, 25 bp, mus musculus
ctggatacacattcactagctatgt

SEQ ID NO: 62049 - DNA, 25 bp, mus musculus
tggatacacattcactagctatgtt

SEQ ID NO: 62050 - DNA, 25 bp, mus musculus
ggatacacattcactagctatgtta

SEQ ID NO: 62051 - DNA, 25 bp, mus musculus
tacacattcactagctatgttatgc

SEQ ID NO: 62052 - DNA, 25 bp, mus musculus
ctgcggtctattactgtgcaaggga

SEQ ID NO: 62053 - DNA, 25 bp, mus musculus
cggtctattactgtgcaagggacta

SEQ ID NO: 62054 - DNA, 25 bp, mus musculus
ggtctattactgtgcaagggactat

SEQ ID NO: 62055 - DNA, 25 bp, mus musculus
acaatgcgacctgcactcggggcta

SEQ ID NO: 62056 - DNA, 25 bp, mus musculus
cgacctgcactcggggctattagaa

SEQ ID NO: 62057 - DNA, 25 bp, mus musculus
ctctttattacaaacacttttcatg

SEQ ID NO: 62058 - DNA, 25 bp, mus musculus
ttattacaaacacttttcatggagc

SEQ ID NO: 62059 - DNA, 25 bp, mus musculus
attacaaacacttttcatggagctt

SEQ ID NO: 62060 - DNA, 25 bp, mus musculus
tacaaacacttttcatggagcttca

SEQ ID NO: 62061 - DNA, 25 bp, mus musculus
caaacacttttcatggagcttcatg

SEQ ID NO: 62062 - DNA, 25 bp, mus musculus
cacttttcatggagcttcatgtcag

SEQ ID NO: 62063 - DNA, 25 bp, mus musculus
cttttcatggagcttcatgtcagac

SEQ ID NO: 62064 - DNA, 25 bp, mus musculus
tcatggagcttcatgtcagacttgg

SEQ ID NO: 62065 - DNA, 25 bp, mus musculus
ggagcttcatgtcagacttggttta

SEQ ID NO: 62066 - DNA, 25 bp, mus musculus
gtcagacttggtttaccaggaatgt

SEQ ID NO: 62067 - DNA, 25 bp, mus musculus
ctgcactcggggctattagaagggg

SEQ ID NO: 62068 - DNA, 25 bp, mus musculus
gctcgattcagtgagcggtcaaatg

SEQ ID NO: 62069 - DNA, 25 bp, mus musculus
tcaaatgctacaaacagcttcactt

SEQ ID NO: 62070 - DNA, 25 bp, mus musculus
aaatgctacaaacagcttcacttct

SEQ ID NO: 62071 - DNA, 25 bp, mus musculus
atgctacaaacagcttcacttcttt

SEQ ID NO: 62072 - DNA, 25 bp, mus musculus
gctacaaacagcttcacttctttgg

SEQ ID NO: 62073 - DNA, 25 bp, mus musculus
tatttttcatgactgttgaggtctc

SEQ ID NO: 62074 - DNA, 25 bp, mus musculus
atgactgttgaggtctctttattac

SEQ ID NO: 62075 - DNA, 25 bp, mus musculus
agaagatcactatcacctgcagtgt

SEQ ID NO: 62076 - DNA, 25 bp, mus musculus
aagatcactatcacctgcagtgtca

SEQ ID NO: 62077 - DNA, 25 bp, mus musculus
tctcccctaaactcttgatttatag

SEQ ID NO: 62078 - DNA, 25 bp, mus musculus
ctaaactcttgatttataggacatc

SEQ ID NO: 62079 - DNA, 25 bp, mus musculus
tataggacatccaatctggcttctg

SEQ ID NO: 62080 - DNA, 25 bp, mus musculus
taggacatccaatctggcttctgga

SEQ ID NO: 62081 - DNA, 25 bp, mus musculus
tggcaccatggaggctgaagatgtt

SEQ ID NO: 62082 - DNA, 25 bp, mus musculus
actactgccagcagggtagtagtat

SEQ ID NO: 62083 - DNA, 25 bp, mus musculus
tactgccagcagggtagtagtatac

SEQ ID NO: 62084 - DNA, 25 bp, mus musculus
gtagtataccattcacgttcggagg

SEQ ID NO: 62085 - DNA, 25 bp, mus musculus
agtataccattcacgttcggaggag

SEQ ID NO: 62086 - DNA, 25 bp, mus musculus
ccaagctcgagatcaaacgggaaca

SEQ ID NO: 62087 - DNA, 25 bp, mus musculus
gatcactatcacctgcagtgtcagc

SEQ ID NO: 62088 - DNA, 25 bp, mus musculus
agttccaaattcttgcattggtatc

SEQ ID NO: 62089 - DNA, 25 bp, mus musculus
ttccaaattcttgcattggtatcag

SEQ ID NO: 62090 - DNA, 25 bp, mus musculus
ccaaattcttgcattggtatcagca

SEQ ID NO: 62091 - DNA, 25 bp, mus musculus
aaattcttgcattggtatcagcaga

SEQ ID NO: 62092 - DNA, 25 bp, mus musculus
tcttgcattggtatcagcagaagcc

SEQ ID NO: 62093 - DNA, 25 bp, mus musculus
gccaggattctcccctaaactcttg

SEQ ID NO: 62094 - DNA, 25 bp, mus musculus
caggattctcccctaaactcttgat

SEQ ID NO: 62095 - DNA, 25 bp, mus musculus
gggagtacatccatcagctgtgtga

SEQ ID NO: 62096 - DNA, 25 bp, mus musculus
agtacatccatcagctgtgtgagga

SEQ ID NO: 62097 - DNA, 25 bp, mus musculus
agcactacctcatgcgggccaatgt

SEQ ID NO: 62098 - DNA, 25 bp, mus musculus
acctcatgcgggccaatgtcacagc

SEQ ID NO: 62099 - DNA, 25 bp, mus musculus
ccaatgtcacagccattcgtagagt

SEQ ID NO: 62100 - DNA, 25 bp, mus musculus
atgtcacagccattcgtagagtccg

SEQ ID NO: 62101 - DNA, 25 bp, mus musculus
ataatcgcattgctagagcctgtgg

SEQ ID NO: 62102 - DNA, 25 bp, mus musculus
atcgcattgctagagcctgtggggc

SEQ ID NO: 62103 - DNA, 25 bp, mus musculus
ttgctagagcctgtggggcacggat

SEQ ID NO: 62104 - DNA, 25 bp, mus musculus
tagtcagccgacctgaggaactgag

SEQ ID NO: 62105 - DNA, 25 bp, mus musculus
ccagtaccattcgtctgcttacctc

SEQ ID NO: 62106 - DNA, 25 bp, mus musculus
ccattcgtctgcttacctccttcgg

SEQ ID NO: 62107 - DNA, 25 bp, mus musculus
aggacatcatccagctgaagcctga

SEQ ID NO: 62108 - DNA, 25 bp, mus musculus
cattcgtctgcttacctccttcggg

SEQ ID NO: 62109 - DNA, 25 bp, mus musculus
acatcatccagctgaagcctgacgt

SEQ ID NO: 62110 - DNA, 25 bp, mus musculus
tccagctgaagcctgacgtggtcat

SEQ ID NO: 62111 - DNA, 25 bp, mus musculus
tgaagcctgacgtggtcatcacaga

SEQ ID NO: 62112 - DNA, 25 bp, mus musculus
ctgacgtggtcatcacagagaaggg

SEQ ID NO: 62113 - DNA, 25 bp, mus musculus
tctcagatttagctcagcactacct

SEQ ID NO: 62114 - DNA, 25 bp, mus musculus
cagatttagctcagcactacctcat

SEQ ID NO: 62115 - DNA, 25 bp, mus musculus
ctcagcactacctcatgcgggccaa

SEQ ID NO: 62116 - DNA, 25 bp, mus musculus
ttccctgtaacagagtgcatcccta

SEQ ID NO: 62117 - DNA, 25 bp, mus musculus
gtaacagagtgcatccctatgtcca

SEQ ID NO: 62118 - DNA, 25 bp, mus musculus
cctatctggtgcggcagagggtgaa

SEQ ID NO: 62119 - DNA, 25 bp, mus musculus
agttcgccatcagcattaagtataa

SEQ ID NO: 62120 - DNA, 25 bp, mus musculus
tcatgacgtcagaggggttgtaccg

SEQ ID NO: 62121 - DNA, 25 bp, mus musculus
attgcttcaagtcgttggacaccac

SEQ ID NO: 62122 - DNA, 25 bp, mus musculus
gcaagccaccagctggaagcaccaa

SEQ ID NO: 62123 - DNA, 25 bp, mus musculus
caccagctggaagcaccaagtattt

SEQ ID NO: 62124 - DNA, 25 bp, mus musculus
agtattttggcactgccaaagcccg

SEQ ID NO: 62125 - DNA, 25 bp, mus musculus
ttggcactgccaaagcccgctacga

SEQ ID NO: 62126 - DNA, 25 bp, mus musculus
ctgccaaagcccgctacgacttctg

SEQ ID NO: 62127 - DNA, 25 bp, mus musculus
agatctacggccggatcggctggtt

SEQ ID NO: 62128 - DNA, 25 bp, mus musculus
gagtgcatccctatgtccacggccc

SEQ ID NO: 62129 - DNA, 25 bp, mus musculus
ctcctcaggacctgtctgtgcatct

SEQ ID NO: 62130 - DNA, 25 bp, mus musculus
aggacctgtctgtgcatctctggta

SEQ ID NO: 62131 - DNA, 25 bp, mus musculus
tgtctgtgcatctctggtatgcggg

SEQ ID NO: 62132 - DNA, 25 bp, mus musculus
tctggtatgcgggccctatggaacg

SEQ ID NO: 62133 - DNA, 25 bp, mus musculus
atgcgggccctatggaacgagcagg

SEQ ID NO: 62134 - DNA, 25 bp, mus musculus
tcctcaccaaccgttctgatgggac

SEQ ID NO: 62135 - DNA, 25 bp, mus musculus
ccaaccgttctgatgggacctatct

SEQ ID NO: 62136 - DNA, 25 bp, mus musculus
tatgcctatctcctgggccaaggct

SEQ ID NO: 62137 - DNA, 25 bp, mus musculus
gacccgtctgatgggttcagcacaa

SEQ ID NO: 62138 - DNA, 25 bp, mus musculus
tgctggttgctagctactgtacctg

SEQ ID NO: 62139 - DNA, 25 bp, mus musculus
atcttacggaatgtcctgtttgctg

SEQ ID NO: 62140 - DNA, 25 bp, mus musculus
cggaatgtcctgtttgctggactga

SEQ ID NO: 62141 - DNA, 25 bp, mus musculus
tttgctggactgaaatccaggagca

SEQ ID NO: 62142 - DNA, 25 bp, mus musculus
aaatccaggagcaatcccacagcag

SEQ ID NO: 62143 - DNA, 25 bp, mus musculus
ctgaacagtcatcctaatgactgac

SEQ ID NO: 62144 - DNA, 25 bp, mus musculus
agtcatcctaatgactgacatcatg

SEQ ID NO: 62145 - DNA, 25 bp, mus musculus
cctaatgactgacatcatggctggc

SEQ ID NO: 62146 - DNA, 25 bp, mus musculus
cctgctgtacttcgctcatctgtat

SEQ ID NO: 62147 - DNA, 25 bp, mus musculus
cgctcatctgtatataacttatttg

SEQ ID NO: 62148 - DNA, 25 bp, mus musculus
gggttcagcacaagctctggctgct

SEQ ID NO: 62149 - DNA, 25 bp, mus musculus
agcacaagctctggctgctcttaca

SEQ ID NO: 62150 - DNA, 25 bp, mus musculus
agctctggctgctcttacagcagct

SEQ ID NO: 62151 - DNA, 25 bp, mus musculus
agcagctctgtgccttaacactgcc

SEQ ID NO: 62152 - DNA, 25 bp, mus musculus
tctgtgccttaacactgccagagcc

SEQ ID NO: 62153 - DNA, 25 bp, mus musculus
cagcccctggacagcagtgcagcct

SEQ ID NO: 62154 - DNA, 25 bp, mus musculus
agcagtgcagcctgccagtgctggt

SEQ ID NO: 62155 - DNA, 25 bp, mus musculus
tgccagtgctggttgctagctactg

SEQ ID NO: 62156 - DNA, 25 bp, mus musculus
gcagaaccacttcctgcagtaacat

SEQ ID NO: 62157 - DNA, 25 bp, mus musculus
cctgcagtaacatcacctgctggct

SEQ ID NO: 62158 - DNA, 25 bp, mus musculus
tgataatgaaacccacggagaaagc

SEQ ID NO: 62159 - DNA, 25 bp, mus musculus
tgaaacccacggagaaagcagaagt

SEQ ID NO: 62160 - DNA, 25 bp, mus musculus
gaatccttttgctgttggctatgac

SEQ ID NO: 62161 - DNA, 25 bp, mus musculus
ttttgctgttggctatgactgcagg

SEQ ID NO: 62162 - DNA, 25 bp, mus musculus
tgttggctatgactgcaggtttgtg

SEQ ID NO: 62163 - DNA, 25 bp, mus musculus
tcggcttcttcaaaagacaatataa

SEQ ID NO: 62164 - DNA, 25 bp, mus musculus
atgagaccacagaactcaacagcta

SEQ ID NO: 62165 - DNA, 25 bp, mus musculus
ccacagaactcaacagctaaaccat

SEQ ID NO: 62166 - DNA, 25 bp, mus musculus
acagctaaaccatcggcggacagca

SEQ ID NO: 62167 - DNA, 25 bp, mus musculus
gcatccctgccagggctcgctggtg

SEQ ID NO: 62168 - DNA, 25 bp, mus musculus
tgaaagaccttcacatgaaagcaga

SEQ ID NO: 62169 - DNA, 25 bp, mus musculus
accttcacatgaaagcagagtactt

SEQ ID NO: 62170 - DNA, 25 bp, mus musculus
tcatcaatgtgacaaccagagtttg

SEQ ID NO: 62171 - DNA, 25 bp, mus musculus
atgtgacaaccagagtttggaacag

SEQ ID NO: 62172 - DNA, 25 bp, mus musculus
cttcgactttccagactgtgcagct

SEQ ID NO: 62173 - DNA, 25 bp, mus musculus
tcgatacacataaccctcagctctt

SEQ ID NO: 62174 - DNA, 25 bp, mus musculus
ctgtcacgattcccctcatgataat

SEQ ID NO: 62175 - DNA, 25 bp, mus musculus
cgattcccctcatgataatgaaacc

SEQ ID NO: 62176 - DNA, 25 bp, mus musculus
gcaggaaccaggggtgcagtgaccc

SEQ ID NO: 62177 - DNA, 25 bp, mus musculus
caggaaccaggggtgcagtgaccct

SEQ ID NO: 62178 - DNA, 25 bp, mus musculus
gtctggagccatggcctggacgtct

SEQ ID NO: 62179 - DNA, 25 bp, mus musculus
tctggagccatggcctggacgtctg

SEQ ID NO: 62180 - DNA, 25 bp, mus musculus
ctggagccatggcctggacgtctgt

SEQ ID NO: 62181 - DNA, 25 bp, mus musculus
tggagccatggcctggacgtctgtc

SEQ ID NO: 62182 - DNA, 25 bp, mus musculus
ggagccatggcctggacgtctgtcc

SEQ ID NO: 62183 - DNA, 25 bp, mus musculus
gagccatggcctggacgtctgtcct

SEQ ID NO: 62184 - DNA, 25 bp, mus musculus
agccatggcctggacgtctgtcctg

SEQ ID NO: 62185 - DNA, 25 bp, mus musculus
gccatggcctggacgtctgtcctgc

SEQ ID NO: 62186 - DNA, 25 bp, mus musculus
ccatggcctggacgtctgtcctgct

SEQ ID NO: 62187 - DNA, 25 bp, mus musculus
catggcctggacgtctgtcctgctc

SEQ ID NO: 62188 - DNA, 25 bp, mus musculus
ggaaccaggggtgcagtgaccctct

SEQ ID NO: 62189 - DNA, 25 bp, mus musculus
gaaccaggggtgcagtgaccctctc

SEQ ID NO: 62190 - DNA, 25 bp, mus musculus
tcagggcccaggagcagtggctgta

SEQ ID NO: 62191 - DNA, 25 bp, mus musculus
tgcaggtctggagccatggcctgga

SEQ ID NO: 62192 - DNA, 25 bp, mus musculus
gcaggtctggagccatggcctggac

SEQ ID NO: 62193 - DNA, 25 bp, mus musculus
caggtctggagccatggcctggacg

SEQ ID NO: 62194 - DNA, 25 bp, mus musculus
aggtctggagccatggcctggacgt

SEQ ID NO: 62195 - DNA, 25 bp, mus musculus
ggtctggagccatggcctggacgtc

SEQ ID NO: 62196 - DNA, 25 bp, mus musculus
catgacaatgactactgcctgggct

SEQ ID NO: 62197 - DNA, 25 bp, mus musculus
gacaatgactactgcctgggctctg

SEQ ID NO: 62198 - DNA, 25 bp, mus musculus
cttggctcctccttagacctagaat

SEQ ID NO: 62199 - DNA, 25 bp, mus musculus
ggctcctccttagacctagaattgc

SEQ ID NO: 62200 - DNA, 25 bp, mus musculus
tcctccttagacctagaattgcatc

SEQ ID NO: 62201 - DNA, 25 bp, mus musculus
tccttagacctagaattgcatcctt

SEQ ID NO: 62202 - DNA, 25 bp, mus musculus
gacctagaattgcatccttggaaga

SEQ ID NO: 62203 - DNA, 25 bp, mus musculus
ctagaattgcatccttggaagagga

SEQ ID NO: 62204 - DNA, 25 bp, mus musculus
gaattgcatccttggaagaggaaga

SEQ ID NO: 62205 - DNA, 25 bp, mus musculus
ttgcatccttggaagaggaagatct

SEQ ID NO: 62206 - DNA, 25 bp, mus musculus
atctatactgtggtgacagcttcct

SEQ ID NO: 62207 - DNA, 25 bp, mus musculus
actgtggtgacagcttcctaacgtg

SEQ ID NO: 62208 - DNA, 25 bp, mus musculus
gactactgcctgggctctgtctaac

SEQ ID NO: 62209 - DNA, 25 bp, mus musculus
cccacgcagttttggaacttgtgat

SEQ ID NO: 62210 - DNA, 25 bp, mus musculus
tcctgtcttttaaccatgtggaaga

SEQ ID NO: 62211 - DNA, 25 bp, mus musculus
tgtcttttaaccatgtggaagatgg

SEQ ID NO: 62212 - DNA, 25 bp, mus musculus
tgatggctagccccagaagattttt

SEQ ID NO: 62213 - DNA, 25 bp, mus musculus
tttgaacctacagaccccatgcttg

SEQ ID NO: 62214 - DNA, 25 bp, mus musculus
gaacctacagaccccatgcttggct

SEQ ID NO: 62215 - DNA, 25 bp, mus musculus
atgcttggctcctccttagacctag

SEQ ID NO: 62216 - DNA, 25 bp, mus musculus
gatgtccatgccccaaatgcctcag

SEQ ID NO: 62217 - DNA, 25 bp, mus musculus
catgccccaaatgcctcagagatgt

SEQ ID NO: 62218 - DNA, 25 bp, mus musculus
caatggtcaccagatccgttggcca

SEQ ID NO: 62219 - DNA, 25 bp, mus musculus
tctctagtgtctgtctggcctggaa

SEQ ID NO: 62220 - DNA, 25 bp, mus musculus
gtctggcctggaagtgaggtgctac

SEQ ID NO: 62221 - DNA, 25 bp, mus musculus
gtgctacatacagcccatctgccac

SEQ ID NO: 62222 - DNA, 25 bp, mus musculus
ctgccacaagagcttcctgattggt

SEQ ID NO: 62223 - DNA, 25 bp, mus musculus
cttcctgattggtaccactgtgaac

SEQ ID NO: 62224 - DNA, 25 bp, mus musculus
ccatacaggagtgtgcccggagagc

SEQ ID NO: 62225 - DNA, 25 bp, mus musculus
ggctgcacacgcgtggtgactgact

SEQ ID NO: 62226 - DNA, 25 bp, mus musculus
acacgcgtggtgactgactgtcttc

SEQ ID NO: 62227 - DNA, 25 bp, mus musculus
tgtcttctgcctggaactttgcgtt

SEQ ID NO: 62228 - DNA, 25 bp, mus musculus
ccaaatgcctcagagatgttgcctc

SEQ ID NO: 62229 - DNA, 25 bp, mus musculus
ttgcctcactttgagttgtatgaac

SEQ ID NO: 62230 - DNA, 25 bp, mus musculus
tatgaacttcggagacatggggaca

SEQ ID NO: 62231 - DNA, 25 bp, mus musculus
acagtcaagccgcagagccagggtt

SEQ ID NO: 62232 - DNA, 25 bp, mus musculus
aagccgcagagccagggttgtttca

SEQ ID NO: 62233 - DNA, 25 bp, mus musculus
tgtttcaggacccatctgattcccc

SEQ ID NO: 62234 - DNA, 25 bp, mus musculus
aggacccatctgattccccagagcc

SEQ ID NO: 62235 - DNA, 25 bp, mus musculus
catctgattccccagagcctgctgt

SEQ ID NO: 62236 - DNA, 25 bp, mus musculus
cttcatgtatctgaccttcttcctt

SEQ ID NO: 62237 - DNA, 25 bp, mus musculus
gtatctgaccttcttccttgaagat

SEQ ID NO: 62238 - DNA, 25 bp, mus musculus
cttccagtgcttctgctttgacact

SEQ ID NO: 62239 - DNA, 25 bp, mus musculus
gtgcttctgctttgacacttgactg

SEQ ID NO: 62240 - DNA, 25 bp, mus musculus
ggccatgcctcaggccgttgaccat

SEQ ID NO: 62241 - DNA, 25 bp, mus musculus
gcctcaggccgttgaccatagctag

SEQ ID NO: 62242 - DNA, 25 bp, mus musculus
aatgagcctccactcagagtcttgg

SEQ ID NO: 62243 - DNA, 25 bp, mus musculus
cctccactcagagtcttggaaaagc

SEQ ID NO: 62244 - DNA, 25 bp, mus musculus
ttgaagtgtctgtcctctctgaagg

SEQ ID NO: 62245 - DNA, 25 bp, mus musculus
tgtctgtcctctctgaaggcacaag

SEQ ID NO: 62246 - DNA, 25 bp, mus musculus
gcacaagggccactctgagtgttct

SEQ ID NO: 62247 - DNA, 25 bp, mus musculus
gggccactctgagtgttctgtcctt

SEQ ID NO: 62248 - DNA, 25 bp, mus musculus
tgacgacaggctggagcagatcaga

SEQ ID NO: 62249 - DNA, 25 bp, mus musculus
aaaggattacaccagcggagccatg

SEQ ID NO: 62250 - DNA, 25 bp, mus musculus
gctcaccggggagctcaagaagacg

SEQ ID NO: 62251 - DNA, 25 bp, mus musculus
agacgtccttcagcccctgatcgca

SEQ ID NO: 62252 - DNA, 25 bp, mus musculus
gatcgcagagcaccaggcccgacgc

SEQ ID NO: 62253 - DNA, 25 bp, mus musculus
ccgacgcaaggcggtcactgaggag

SEQ ID NO: 62254 - DNA, 25 bp, mus musculus
gctgtccttccacttccagtgcttc

SEQ ID NO: 62255 - DNA, 25 bp, mus musculus
cttccacttccagtgcttctgcttt

SEQ ID NO: 62256 - DNA, 25 bp, mus musculus
ctgtggcactttgggtggaatgata

SEQ ID NO: 62257 - DNA, 25 bp, mus musculus
tggcactttgggtggaatgataaag

SEQ ID NO: 62258 - DNA, 25 bp, mus musculus
tgccagtgtcctttcagtttaaggg

SEQ ID NO: 62259 - DNA, 25 bp, mus musculus
tgtagagctcaacttttcagttact

SEQ ID NO: 62260 - DNA, 25 bp, mus musculus
gctcaacttttcagttactgtgcaa

SEQ ID NO: 62261 - DNA, 25 bp, mus musculus
cttttcagttactgtgcaagattgt

SEQ ID NO: 62262 - DNA, 25 bp, mus musculus
ttcagttactgtgcaagattgtttt

SEQ ID NO: 62263 - DNA, 25 bp, mus musculus
ctgttttccttgcacactcaaaatc

SEQ ID NO: 62264 - DNA, 25 bp, mus musculus
tccttgcacactcaaaatctgtgag

SEQ ID NO: 62265 - DNA, 25 bp, mus musculus
cacactcaaaatctgtgagcttggt

SEQ ID NO: 62266 - DNA, 25 bp, mus musculus
actcaaaatctgtgagcttggtatc

SEQ ID NO: 62267 - DNA, 25 bp, mus musculus
cattcctattggaagccatacttat

SEQ ID NO: 62268 - DNA, 25 bp, mus musculus
tgtgaacacaagccaacagataagg

SEQ ID NO: 62269 - DNA, 25 bp, mus musculus
gaacacaagccaacagataagggta

SEQ ID NO: 62270 - DNA, 25 bp, mus musculus
cacaagccaacagataagggtagga

SEQ ID NO: 62271 - DNA, 25 bp, mus musculus
aaccacactgaagatttgcaaaggg

SEQ ID NO: 62272 - DNA, 25 bp, mus musculus
ttcctggtttctctatggggatgca

SEQ ID NO: 62273 - DNA, 25 bp, mus musculus
gtttctctatggggatgcagagcta

SEQ ID NO: 62274 - DNA, 25 bp, mus musculus
ctcagatgccagtgtcctttcagtt

SEQ ID NO: 62275 - DNA, 25 bp, mus musculus
agatgccagtgtcctttcagtttaa

SEQ ID NO: 62276 - DNA, 25 bp, mus musculus
gctgccacaggacggcgtctattac

SEQ ID NO: 62277 - DNA, 25 bp, mus musculus
cggcgtctattacctctactgccac

SEQ ID NO: 62278 - DNA, 25 bp, mus musculus
ccccgacatggtggactacaggaga

SEQ ID NO: 62279 - DNA, 25 bp, mus musculus
gtgacagccatctgtattcattcct

SEQ ID NO: 62280 - DNA, 25 bp, mus musculus
gccatctgtattcattcctggagga

SEQ ID NO: 62281 - DNA, 25 bp, mus musculus
tgtattcattcctggaggatcgact

SEQ ID NO: 62282 - DNA, 25 bp, mus musculus
aggatcgactgacggtgcgaatgtg

SEQ ID NO: 62283 - DNA, 25 bp, mus musculus
gtgaatcgtgatgtccgggaccccg

SEQ ID NO: 62284 - DNA, 25 bp, mus musculus
aactatgccggcccttgccagtgtc

SEQ ID NO: 62285 - DNA, 25 bp, mus musculus
cagtgtcttcacggaaatgcagacg

SEQ ID NO: 62286 - DNA, 25 bp, mus musculus
tttgattctgggacacgtgcaggtg

SEQ ID NO: 62287 - DNA, 25 bp, mus musculus
gtggctgacccagctttgaactgtg

SEQ ID NO: 62288 - DNA, 25 bp, mus musculus
ctattacctctactgccacgtcggg

SEQ ID NO: 62289 - DNA, 25 bp, mus musculus
tggctgacccagctttgaactgtgg

SEQ ID NO: 62290 - DNA, 25 bp, mus musculus
cctctactgccacgtcgggtacagg

SEQ ID NO: 62291 - DNA, 25 bp, mus musculus
ggagacagtcacacctgttgtggac

SEQ ID NO: 62292 - DNA, 25 bp, mus musculus
gacagtcacacctgttgtggacccc

SEQ ID NO: 62293 - DNA, 25 bp, mus musculus
cacacctgttgtggaccccatcggg

SEQ ID NO: 62294 - DNA, 25 bp, mus musculus
cgttaacatcagtcaccccgacatg

SEQ ID NO: 62295 - DNA, 25 bp, mus musculus
taacatcagtcaccccgacatggtg

SEQ ID NO: 62296 - DNA, 25 bp, mus musculus
catcagtcaccccgacatggtggac

SEQ ID NO: 62297 - DNA, 25 bp, mus musculus
ataactacatttcagaagtttgata

SEQ ID NO: 62298 - DNA, 25 bp, mus musculus
cagagccagaccctggaagcaatta

SEQ ID NO: 62299 - DNA, 25 bp, mus musculus
gtttcccatcttcagactaaggaag

SEQ ID NO: 62300 - DNA, 25 bp, mus musculus
ttcccatcttcagactaaggaagca

SEQ ID NO: 62301 - DNA, 25 bp, mus musculus
gcatgcatattttgcacttgctggt

SEQ ID NO: 62302 - DNA, 25 bp, mus musculus
atgcatattttgcacttgctggtac

SEQ ID NO: 62303 - DNA, 25 bp, mus musculus
atattttgcacttgctggtacattt

SEQ ID NO: 62304 - DNA, 25 bp, mus musculus
attttgcacttgctggtacatttgt

SEQ ID NO: 62305 - DNA, 25 bp, mus musculus
tgcacttgctggtacatttgtaacc

SEQ ID NO: 62306 - DNA, 25 bp, mus musculus
cacttgctggtacatttgtaaccaa

SEQ ID NO: 62307 - DNA, 25 bp, mus musculus
gtctcctatgaaacagagtttgaaa

SEQ ID NO: 62308 - DNA, 25 bp, mus musculus
atccttgttattctgatgattctaa

SEQ ID NO: 62309 - DNA, 25 bp, mus musculus
gccagaccctggaagcaattaaaga

SEQ ID NO: 62310 - DNA, 25 bp, mus musculus
actacatggagggtctgatgaactt

SEQ ID NO: 62311 - DNA, 25 bp, mus musculus
agcatactctgaagtactcttctag

SEQ ID NO: 62312 - DNA, 25 bp, mus musculus
catactctgaagtactcttctagtt

SEQ ID NO: 62313 - DNA, 25 bp, mus musculus
ctgaagtactcttctagtttcccat

SEQ ID NO: 62314 - DNA, 25 bp, mus musculus
tactcttctagtttcccatcttcag

SEQ ID NO: 62315 - DNA, 25 bp, mus musculus
cttctagtttcccatcttcagacta

SEQ ID NO: 62316 - DNA, 25 bp, mus musculus
tctagtttcccatcttcagactaag

SEQ ID NO: 62317 - DNA, 25 bp, mus musculus
tgagaatatgccgcctcacgtagaa

SEQ ID NO: 62318 - DNA, 25 bp, mus musculus
gagaatatgccgcctcacgtagaag

SEQ ID NO: 62319 - DNA, 25 bp, mus musculus
atggcagcgttttgcacgttctgta

SEQ ID NO: 62320 - DNA, 25 bp, mus musculus
gcagcgttttgcacgttctgtagag

SEQ ID NO: 62321 - DNA, 25 bp, mus musculus
cagcgttttgcacgttctgtagaga

SEQ ID NO: 62322 - DNA, 25 bp, mus musculus
gcgttttgcacgttctgtagagaca

SEQ ID NO: 62323 - DNA, 25 bp, mus musculus
cgttttgcacgttctgtagagacac

SEQ ID NO: 62324 - DNA, 25 bp, mus musculus
ttttgcacgttctgtagagacacca

SEQ ID NO: 62325 - DNA, 25 bp, mus musculus
tttgcacgttctgtagagacaccaa

SEQ ID NO: 62326 - DNA, 25 bp, mus musculus
cagagtccgaccatggaagcaattg

SEQ ID NO: 62327 - DNA, 25 bp, mus musculus
gagtccgaccatggaagcaattgaa

SEQ ID NO: 62328 - DNA, 25 bp, mus musculus
agtccgaccatggaagcaattgaag

SEQ ID NO: 62329 - DNA, 25 bp, mus musculus
gaatatgccgcctcacgtagaagca

SEQ ID NO: 62330 - DNA, 25 bp, mus musculus
aatatgccgcctcacgtagaagcag

SEQ ID NO: 62331 - DNA, 25 bp, mus musculus
tatgccgcctcacgtagaagcagat

SEQ ID NO: 62332 - DNA, 25 bp, mus musculus
atgccgcctcacgtagaagcagatg

SEQ ID NO: 62333 - DNA, 25 bp, mus musculus
ccgcctcacgtagaagcagatgaag

SEQ ID NO: 62334 - DNA, 25 bp, mus musculus
gcctcacgtagaagcagatgaagat

SEQ ID NO: 62335 - DNA, 25 bp, mus musculus
tttctcagaggaatggcagcgtttt

SEQ ID NO: 62336 - DNA, 25 bp, mus musculus
gaatggcagcgttttgcacgttctg

SEQ ID NO: 62337 - DNA, 25 bp, mus musculus
gtttgattacaccatctgtgaagaa

SEQ ID NO: 62338 - DNA, 25 bp, mus musculus
ttacaccatctgtgaagaatgcggg

SEQ ID NO: 62339 - DNA, 25 bp, mus musculus
cgatatgaagctctacctaaagcta

SEQ ID NO: 62340 - DNA, 25 bp, mus musculus
tatgaagctctacctaaagctacag

SEQ ID NO: 62341 - DNA, 25 bp, mus musculus
aagagagacaaccactcaccaacat

SEQ ID NO: 62342 - DNA, 25 bp, mus musculus
agagacaaccactcaccaacatgaa

SEQ ID NO: 62343 - DNA, 25 bp, mus musculus
aaccactcaccaacatgaatatgga

SEQ ID NO: 62344 - DNA, 25 bp, mus musculus
gtaccgcaagacttgtaccttgtgt

SEQ ID NO: 62345 - DNA, 25 bp, mus musculus
gacttgtaccttgtgtggccacgaa

SEQ ID NO: 62346 - DNA, 25 bp, mus musculus
taccttgtgtggccacgaactgaca

SEQ ID NO: 62347 - DNA, 25 bp, mus musculus
gtgtggccacgaactgacatatgaa

SEQ ID NO: 62348 - DNA, 25 bp, mus musculus
tggccacgaactgacatatgaaaaa

SEQ ID NO: 62349 - DNA, 25 bp, mus musculus
catggactcgtaccttatgaaccac

SEQ ID NO: 62350 - DNA, 25 bp, mus musculus
ccttatgaaccactttgatctgcca

SEQ ID NO: 62351 - DNA, 25 bp, mus musculus
tatgaaccactttgatctgccaacg

SEQ ID NO: 62352 - DNA, 25 bp, mus musculus
ccactttgatctgccaacgtgtgac

SEQ ID NO: 62353 - DNA, 25 bp, mus musculus
tgatctgccaacgtgtgacagctgc

SEQ ID NO: 62354 - DNA, 25 bp, mus musculus
aacgtgtgacagctgcagagatgct

SEQ ID NO: 62355 - DNA, 25 bp, mus musculus
caagcttataaccaagacagaagcg

SEQ ID NO: 62356 - DNA, 25 bp, mus musculus
gtaccttctgaaggactgtgatcta

SEQ ID NO: 62357 - DNA, 25 bp, mus musculus
tctgtgggcagactagctgtagtgt

SEQ ID NO: 62358 - DNA, 25 bp, mus musculus
tttctcttcagtaaagacttatctc

SEQ ID NO: 62359 - DNA, 25 bp, mus musculus
caaaccctccatgctgactgtggga

SEQ ID NO: 62360 - DNA, 25 bp, mus musculus
agatttaagcaccctgactctcact

SEQ ID NO: 62361 - DNA, 25 bp, mus musculus
aagcaccctgactctcactaaattt

SEQ ID NO: 62362 - DNA, 25 bp, mus musculus
cctgactctcactaaatttgaatca

SEQ ID NO: 62363 - DNA, 25 bp, mus musculus
tgaatcacggcctgaacgtagtctt

SEQ ID NO: 62364 - DNA, 25 bp, mus musculus
tgaacgtagtctttcttgttgtgtc

SEQ ID NO: 62365 - DNA, 25 bp, mus musculus
tagtctttcttgttgtgtccagcag

SEQ ID NO: 62366 - DNA, 25 bp, mus musculus
ttgtgtccagcagtgtttaatgctt

SEQ ID NO: 62367 - DNA, 25 bp, mus musculus
gtgtttaatgcttcctggctgtagt

SEQ ID NO: 62368 - DNA, 25 bp, mus musculus
aatgcttcctggctgtagtaggtag

SEQ ID NO: 62369 - DNA, 25 bp, mus musculus
agaagttcctaagtttgcagctgct

SEQ ID NO: 62370 - DNA, 25 bp, mus musculus
tggtgcgccttgttatacctcaatg

SEQ ID NO: 62371 - DNA, 25 bp, mus musculus
gccttgttatacctcaatgtccagc

SEQ ID NO: 62372 - DNA, 25 bp, mus musculus
ttatacctcaatgtccagcagcccc

SEQ ID NO: 62373 - DNA, 25 bp, mus musculus
ctcaatgtccagcagcccctggtgc

SEQ ID NO: 62374 - DNA, 25 bp, mus musculus
cctgacagtgctctctgaccttatc

SEQ ID NO: 62375 - DNA, 25 bp, mus musculus
agtgctctctgaccttatcaaaccc

SEQ ID NO: 62376 - DNA, 25 bp, mus musculus
ccttatcaaaccctccatgctgact

SEQ ID NO: 62377 - DNA, 25 bp, mus musculus
ttgcctcccatagtagtatttcctc

SEQ ID NO: 62378 - DNA, 25 bp, mus musculus
cctcccatagtagtatttcctcagg

SEQ ID NO: 62379 - DNA, 25 bp, mus musculus
gacactcctccggctgaggagagat

SEQ ID NO: 62380 - DNA, 25 bp, mus musculus
taccaagttctagccaatccttccg

SEQ ID NO: 62381 - DNA, 25 bp, mus musculus
caagttctagccaatccttccgtgt

SEQ ID NO: 62382 - DNA, 25 bp, mus musculus
gtctatactatggtgccaaagattc

SEQ ID NO: 62383 - DNA, 25 bp, mus musculus
ttttcctgtgttggctacataaggg

SEQ ID NO: 62384 - DNA, 25 bp, mus musculus
gtctttgataatcccagtatctttg

SEQ ID NO: 62385 - DNA, 25 bp, mus musculus
tttgataatcccagtatctttgcca

SEQ ID NO: 62386 - DNA, 25 bp, mus musculus
gataatcccagtatctttgccaata

SEQ ID NO: 62387 - DNA, 25 bp, mus musculus
cccagtatctttgccaataaaatgt

SEQ ID NO: 62388 - DNA, 25 bp, mus musculus
ccagtatctttgccaataaaatgtg

SEQ ID NO: 62389 - DNA, 25 bp, mus musculus
gcccaggtgccaatcatgaaggatt

SEQ ID NO: 62390 - DNA, 25 bp, mus musculus
attacctacaagaaggatccagctc

SEQ ID NO: 62391 - DNA, 25 bp, mus musculus
aaggatccagctctctatgcttatc

SEQ ID NO: 62392 - DNA, 25 bp, mus musculus
gatccagctctctatgcttatcagc

SEQ ID NO: 62393 - DNA, 25 bp, mus musculus
ccagctctctatgcttatcagctcc

SEQ ID NO: 62394 - DNA, 25 bp, mus musculus
gctctctatgcttatcagctcctgg

SEQ ID NO: 62395 - DNA, 25 bp, mus musculus
cacatgattccagacactcctccgg

SEQ ID NO: 62396 - DNA, 25 bp, mus musculus
atgattccagacactcctccggctg

SEQ ID NO: 62397 - DNA, 25 bp, mus musculus
gtagctgcactacaacagattctta

SEQ ID NO: 62398 - DNA, 25 bp, mus musculus
gcactacaacagattcttaccgttt

SEQ ID NO: 62399 - DNA, 25 bp, mus musculus
agcacaaccagtgtctgtcagtttc

SEQ ID NO: 62400 - DNA, 25 bp, mus musculus
accagtgtctgtcagtttccacgca

SEQ ID NO: 62401 - DNA, 25 bp, mus musculus
gtctgtcagtttccacgcataaagt

SEQ ID NO: 62402 - DNA, 25 bp, mus musculus
cagtttccacgcataaagtttagtg

SEQ ID NO: 62403 - DNA, 25 bp, mus musculus
ttgctagttcttcctggtagagtta

SEQ ID NO: 62404 - DNA, 25 bp, mus musculus
gttcttcctggtagagttataaatg

SEQ ID NO: 62405 - DNA, 25 bp, mus musculus
attacactatctgattaatagtttc

SEQ ID NO: 62406 - DNA, 25 bp, mus musculus
tagtttcttcatactctgcatataa

SEQ ID NO: 62407 - DNA, 25 bp, mus musculus
tttgttgcacactatgtaacaaaac

SEQ ID NO: 62408 - DNA, 25 bp, mus musculus
gttgcacactatgtaacaaaactga

SEQ ID NO: 62409 - DNA, 25 bp, mus musculus
accgtttccacaaggtcagagattg

SEQ ID NO: 62410 - DNA, 25 bp, mus musculus
gctaacttcattttcagaactgttt

SEQ ID NO: 62411 - DNA, 25 bp, mus musculus
gtaatccttgttgctttcctgatac

SEQ ID NO: 62412 - DNA, 25 bp, mus musculus
gctttcctgataccagatcgtttcc

SEQ ID NO: 62413 - DNA, 25 bp, mus musculus
ctgataccagatcgtttcccgtggt

SEQ ID NO: 62414 - DNA, 25 bp, mus musculus
aagttcagccattttgtatcacaca

SEQ ID NO: 62415 - DNA, 25 bp, mus musculus
agccattttgtatcacacagcacaa

SEQ ID NO: 62416 - DNA, 25 bp, mus musculus
tttgtatcacacagcacaaccagtg

SEQ ID NO: 62417 - DNA, 25 bp, mus musculus
ggcttcagccagcgctcgcagctcg

SEQ ID NO: 62418 - DNA, 25 bp, mus musculus
cgctcgcagctcgtggtgcaccagc

SEQ ID NO: 62419 - DNA, 25 bp, mus musculus
cagcgagcgcacttgggagacaagc

SEQ ID NO: 62420 - DNA, 25 bp, mus musculus
ggagacaagccttacaggtgcccgg

SEQ ID NO: 62421 - DNA, 25 bp, mus musculus
agctggaactccgttctcatcatcc

SEQ ID NO: 62422 - DNA, 25 bp, mus musculus
aaaggcttcagcaacagctccaact

SEQ ID NO: 62423 - DNA, 25 bp, mus musculus
ggcttcagcaacagctccaacttca

SEQ ID NO: 62424 - DNA, 25 bp, mus musculus
atcacacaccagaggacgcacctga

SEQ ID NO: 62425 - DNA, 25 bp, mus musculus
caccagaggacgcacctgaaagaga

SEQ ID NO: 62426 - DNA, 25 bp, mus musculus
aagctttactgaagtggcagaaaag

SEQ ID NO: 62427 - DNA, 25 bp, mus musculus
ctgagctgactctgcagggagaact

SEQ ID NO: 62428 - DNA, 25 bp, mus musculus
agctgactctgcagggagaactccc

SEQ ID NO: 62429 - DNA, 25 bp, mus musculus
ccctacaagtgcctcatgtgtggca

SEQ ID NO: 62430 - DNA, 25 bp, mus musculus
tacaagtgcctcatgtgtggcaaga

SEQ ID NO: 62431 - DNA, 25 bp, mus musculus
aagagcttcagccggggctccattc

SEQ ID NO: 62432 - DNA, 25 bp, mus musculus
agcttcagccggggctccattctgg

SEQ ID NO: 62433 - DNA, 25 bp, mus musculus
agccggggctccattctggtgatgc

SEQ ID NO: 62434 - DNA, 25 bp, mus musculus
ggctccattctggtgatgcaccagc

SEQ ID NO: 62435 - DNA, 25 bp, mus musculus
attctggtgatgcaccagcgagcgc

SEQ ID NO: 62436 - DNA, 25 bp, mus musculus
caccagcgagcgcacttgggagaca

SEQ ID NO: 62437 - DNA, 25 bp, mus musculus
tagtatgttctcattgtggacagag

SEQ ID NO: 62438 - DNA, 25 bp, mus musculus
tatgttctcattgtggacagagtgt

SEQ ID NO: 62439 - DNA, 25 bp, mus musculus
attaatggtggcttccactgaacac

SEQ ID NO: 62440 - DNA, 25 bp, mus musculus
ggtggcttccactgaacacaagagt

SEQ ID NO: 62441 - DNA, 25 bp, mus musculus
ttccactgaacacaagagtgcagca

SEQ ID NO: 62442 - DNA, 25 bp, mus musculus
tgagtctatttcacagtgttatttg

SEQ ID NO: 62443 - DNA, 25 bp, mus musculus
gtctatttcacagtgttatttgaaa

SEQ ID NO: 62444 - DNA, 25 bp, mus musculus
tatttcacagtgttatttgaaaaag

SEQ ID NO: 62445 - DNA, 25 bp, mus musculus
taagatttctatgctcctttatgaa

SEQ ID NO: 62446 - DNA, 25 bp, mus musculus
ttctatgctcctttatgaacaatga

SEQ ID NO: 62447 - DNA, 25 bp, mus musculus
ttcacaaagaatttcctatagagca

SEQ ID NO: 62448 - DNA, 25 bp, mus musculus
aatttcctatagagcacagattttt

SEQ ID NO: 62449 - DNA, 25 bp, mus musculus
gttctcattgtggacagagtgtgta

SEQ ID NO: 62450 - DNA, 25 bp, mus musculus
ctcattgtggacagagtgtgtatgt

SEQ ID NO: 62451 - DNA, 25 bp, mus musculus
atgtgtgtccctgtactctgtgtac

SEQ ID NO: 62452 - DNA, 25 bp, mus musculus
gtccctgtactctgtgtacatatat

SEQ ID NO: 62453 - DNA, 25 bp, mus musculus
cctgtactctgtgtacatatatatg

SEQ ID NO: 62454 - DNA, 25 bp, mus musculus
gtgtttatccccatatatttgtata

SEQ ID NO: 62455 - DNA, 25 bp, mus musculus
tttatccccatatatttgtatatga

SEQ ID NO: 62456 - DNA, 25 bp, mus musculus
atccccatatatttgtatatgaata

SEQ ID NO: 62457 - DNA, 25 bp, mus musculus
ctacttcaagtgcccgcaacagtca

SEQ ID NO: 62458 - DNA, 25 bp, mus musculus
agcattttgcgtgtaacctttgtgg

SEQ ID NO: 62459 - DNA, 25 bp, mus musculus
tctcacagtacagaacttgtataac

SEQ ID NO: 62460 - DNA, 25 bp, mus musculus
taaactgtgtggtcaacttgccttt

SEQ ID NO: 62461 - DNA, 25 bp, mus musculus
tggtcaacttgcctttattgtgagg

SEQ ID NO: 62462 - DNA, 25 bp, mus musculus
tcaacttgcctttattgtgaggtat

SEQ ID NO: 62463 - DNA, 25 bp, mus musculus
acttgcctttattgtgaggtatgga

SEQ ID NO: 62464 - DNA, 25 bp, mus musculus
tgggccacgcgagatagcttagcta

SEQ ID NO: 62465 - DNA, 25 bp, mus musculus
gatagcttagctagtcatggttctt

SEQ ID NO: 62466 - DNA, 25 bp, mus musculus
gctagtcatggttctttaggatagc

SEQ ID NO: 62467 - DNA, 25 bp, mus musculus
actcacatggagttcccaaaagttg

SEQ ID NO: 62468 - DNA, 25 bp, mus musculus
gagttcccaaaagttgtcttctgag

SEQ ID NO: 62469 - DNA, 25 bp, mus musculus
ccttcaacagtcagagttcctatta

SEQ ID NO: 62470 - DNA, 25 bp, mus musculus
gtcagagttcctattacactcataa

SEQ ID NO: 62471 - DNA, 25 bp, mus musculus
gtaatttccttaagcatgaaagaag

SEQ ID NO: 62472 - DNA, 25 bp, mus musculus
atttccttaagcatgaaagaagtca

SEQ ID NO: 62473 - DNA, 25 bp, mus musculus
gtcacaccatggaaacattatccat

SEQ ID NO: 62474 - DNA, 25 bp, mus musculus
cattatccatatgaacaataggtaa

SEQ ID NO: 62475 - DNA, 25 bp, mus musculus
gcatttctgggtcctacatcccatt

SEQ ID NO: 62476 - DNA, 25 bp, mus musculus
cctacatcccattagaaacctatat

SEQ ID NO: 62477 - DNA, 25 bp, mus musculus
tgtattccattttgccaacagctcc

SEQ ID NO: 62478 - DNA, 25 bp, mus musculus
cagctccagaaatacgctctacatc

SEQ ID NO: 62479 - DNA, 25 bp, mus musculus
ttcacagttccagatccatggaccc

SEQ ID NO: 62480 - DNA, 25 bp, mus musculus
tgatgtcactgtagggcccctgata

SEQ ID NO: 62481 - DNA, 25 bp, mus musculus
cgaccagactgtggaaggctggact

SEQ ID NO: 62482 - DNA, 25 bp, mus musculus
ctggactgcttctgctcaaacctct

SEQ ID NO: 62483 - DNA, 25 bp, mus musculus
tgctcaaacctctgtggctcttggg

SEQ ID NO: 62484 - DNA, 25 bp, mus musculus
cctggccacagtggcattcctgacc

SEQ ID NO: 62485 - DNA, 25 bp, mus musculus
ggcattcctgaccctggcagctata

SEQ ID NO: 62486 - DNA, 25 bp, mus musculus
cctgaccctggcagctatagtcctt

SEQ ID NO: 62487 - DNA, 25 bp, mus musculus
agctatagtccttgctgtcaccagg

SEQ ID NO: 62488 - DNA, 25 bp, mus musculus
tgctgtcaccaggaagtgtcactcc

SEQ ID NO: 62489 - DNA, 25 bp, mus musculus
cagaaatacgctctacatcacctgc

SEQ ID NO: 62490 - DNA, 25 bp, mus musculus
caaagtcgcgccagctaaccagatc

SEQ ID NO: 62491 - DNA, 25 bp, mus musculus
agctaaccagatccccgataagctc

SEQ ID NO: 62492 - DNA, 25 bp, mus musculus
taagctcaacaaagcctgttcgttc

SEQ ID NO: 62493 - DNA, 25 bp, mus musculus
tgatgctgacatctgtgattgctgc

SEQ ID NO: 62494 - DNA, 25 bp, mus musculus
tgacatctgtgattgctgcagccat

SEQ ID NO: 62495 - DNA, 25 bp, mus musculus
ctgtgattgctgcagccatggcaac

SEQ ID NO: 62496 - DNA, 25 bp, mus musculus
taattcaagctcttcacagttccag

SEQ ID NO: 62497 - DNA, 25 bp, mus musculus
tgtacagatcctctagatgcagccg

SEQ ID NO: 62498 - DNA, 25 bp, mus musculus
tacagatcctctagatgcagccgtg

SEQ ID NO: 62499 - DNA, 25 bp, mus musculus
tttgagaacactttcggcagacaat

SEQ ID NO: 62500 - DNA, 25 bp, mus musculus
tgagaacactttcggcagacaatgc

SEQ ID NO: 62501 - DNA, 25 bp, mus musculus
aacactttcggcagacaatgcccgg

SEQ ID NO: 62502 - DNA, 25 bp, mus musculus
cactttcggcagacaatgcccgggc

SEQ ID NO: 62503 - DNA, 25 bp, mus musculus
ctttcggcagacaatgcccgggcag

SEQ ID NO: 62504 - DNA, 25 bp, mus musculus
cagccattgaacatgtctgtcagga

SEQ ID NO: 62505 - DNA, 25 bp, mus musculus
cattgaacatgtctgtcaggatgga

SEQ ID NO: 62506 - DNA, 25 bp, mus musculus
ttgaacatgtctgtcaggatggaat

SEQ ID NO: 62507 - DNA, 25 bp, mus musculus
gaacatgtctgtcaggatggaattt

SEQ ID NO: 62508 - DNA, 25 bp, mus musculus
acatgtctgtcaggatggaattttg

SEQ ID NO: 62509 - DNA, 25 bp, mus musculus
cagatcctctagatgcagccgtgct

SEQ ID NO: 62510 - DNA, 25 bp, mus musculus
tcctctagatgcagccgtgctcctc

SEQ ID NO: 62511 - DNA, 25 bp, mus musculus
agatgcagccgtgctcctctaacca

SEQ ID NO: 62512 - DNA, 25 bp, mus musculus
agccgtgctcctctaaccatgaatg

SEQ ID NO: 62513 - DNA, 25 bp, mus musculus
ccgtgctcctctaaccatgaatgag

SEQ ID NO: 62514 - DNA, 25 bp, mus musculus
gtgctcctctaaccatgaatgaggc

SEQ ID NO: 62515 - DNA, 25 bp, mus musculus
tttgtccggaacattggtagagcat

SEQ ID NO: 62516 - DNA, 25 bp, mus musculus
tgtccggaacattggtagagcatac

SEQ ID NO: 62517 - DNA, 25 bp, mus musculus
agcctttgcactgtagattctaaag

SEQ ID NO: 62518 - DNA, 25 bp, mus musculus
cctccatcctgaccgttgtttcaag

SEQ ID NO: 62519 - DNA, 25 bp, mus musculus
gcctacctagaagttcctgcacaga

SEQ ID NO: 62520 - DNA, 25 bp, mus musculus
gttcctgcacagagcagggtttttg

SEQ ID NO: 62521 - DNA, 25 bp, mus musculus
agccgtcagatgacaactaggtccc

SEQ ID NO: 62522 - DNA, 25 bp, mus musculus
caaaggtgtctcacctcagacagga

SEQ ID NO: 62523 - DNA, 25 bp, mus musculus
acctcagacaggacccatctaagag

SEQ ID NO: 62524 - DNA, 25 bp, mus musculus
aaagcacgaagctctaaaagccagc

SEQ ID NO: 62525 - DNA, 25 bp, mus musculus
cgaagctctaaaagccagccactgc

SEQ ID NO: 62526 - DNA, 25 bp, mus musculus
agccagccactgcttggctagacat

SEQ ID NO: 62527 - DNA, 25 bp, mus musculus
ccactgcttggctagacatccacag

SEQ ID NO: 62528 - DNA, 25 bp, mus musculus
cttggctagacatccacagggaccc

SEQ ID NO: 62529 - DNA, 25 bp, mus musculus
tttcaagggtcacatccccacagtc

SEQ ID NO: 62530 - DNA, 25 bp, mus musculus
gctctcacgggagtctgagacactt

SEQ ID NO: 62531 - DNA, 25 bp, mus musculus
gtctgagacacttcaggggactaca

SEQ ID NO: 62532 - DNA, 25 bp, mus musculus
gacacttcaggggactacatcttcc

SEQ ID NO: 62533 - DNA, 25 bp, mus musculus
cccagggccactccagatgctcagg

SEQ ID NO: 62534 - DNA, 25 bp, mus musculus
gccactccagatgctcaggggacga

SEQ ID NO: 62535 - DNA, 25 bp, mus musculus
gggacgactcaagcctacctagaag

SEQ ID NO: 62536 - DNA, 25 bp, mus musculus
actcaagcctacctagaagttcctg

SEQ ID NO: 62537 - DNA, 25 bp, mus musculus
ggaacgcttcttccgtcagagctgt

SEQ ID NO: 62538 - DNA, 25 bp, mus musculus
gactcactagcaaacgaggacagcc

SEQ ID NO: 62539 - DNA, 25 bp, mus musculus
cgaacatcgtttacatggcagatgt

SEQ ID NO: 62540 - DNA, 25 bp, mus musculus
tctgtggcagtgtggcttagtataa

SEQ ID NO: 62541 - DNA, 25 bp, mus musculus
attaaatgcaggcatctcgagtctg

SEQ ID NO: 62542 - DNA, 25 bp, mus musculus
tgcaggcatctcgagtctgtgtctc

SEQ ID NO: 62543 - DNA, 25 bp, mus musculus
gagtctgtgtctcatgatggataga

SEQ ID NO: 62544 - DNA, 25 bp, mus musculus
tacactaagtgccttttattgaaga

SEQ ID NO: 62545 - DNA, 25 bp, mus musculus
ttgaagatgcttccacagtgaaatt

SEQ ID NO: 62546 - DNA, 25 bp, mus musculus
tccaaatacacttgttcctatatat

SEQ ID NO: 62547 - DNA, 25 bp, mus musculus
atgtttgctttggcttgcactgaaa

SEQ ID NO: 62548 - DNA, 25 bp, mus musculus
atttgctaccaagagcaaacttgat

SEQ ID NO: 62549 - DNA, 25 bp, mus musculus
gacagccgcgatagtgaccacagct

SEQ ID NO: 62550 - DNA, 25 bp, mus musculus
cacagctctgagcacgcacacttat

SEQ ID NO: 62551 - DNA, 25 bp, mus musculus
cacgcacacttatgatacctacaaa

SEQ ID NO: 62552 - DNA, 25 bp, mus musculus
cacttatgatacctacaaagaccag

SEQ ID NO: 62553 - DNA, 25 bp, mus musculus
tgatacctacaaagaccagctccat

SEQ ID NO: 62554 - DNA, 25 bp, mus musculus
ctacaaagaccagctccattctcag

SEQ ID NO: 62555 - DNA, 25 bp, mus musculus
ttctcaggaaagcaccattgtgatg

SEQ ID NO: 62556 - DNA, 25 bp, mus musculus
ggaaagcaccattgtgatggcaaac

SEQ ID NO: 62557 - DNA, 25 bp, mus musculus
ccgtgctgaatgctgtctcgccatc

SEQ ID NO: 62558 - DNA, 25 bp, mus musculus
tgctgaatgctgtctcgccatctct

SEQ ID NO: 62559 - DNA, 25 bp, mus musculus
ttctctggaggcatcatgcgctggt

SEQ ID NO: 62560 - DNA, 25 bp, mus musculus
atgcgctggtgctgcgtccttatga

SEQ ID NO: 62561 - DNA, 25 bp, mus musculus
aatgttttgaccattttcatggtgg

SEQ ID NO: 62562 - DNA, 25 bp, mus musculus
agcaatgcagtaccccatagactgg

SEQ ID NO: 62563 - DNA, 25 bp, mus musculus
gtaccccatagactggtgttaagtg

SEQ ID NO: 62564 - DNA, 25 bp, mus musculus
ccccatagactggtgttaagtgttg

SEQ ID NO: 62565 - DNA, 25 bp, mus musculus
agtgcaaatccatgttctagcatat

SEQ ID NO: 62566 - DNA, 25 bp, mus musculus
gcaaatccatgttctagcatatgta

SEQ ID NO: 62567 - DNA, 25 bp, mus musculus
aatccatgttctagcatatgtaata

SEQ ID NO: 62568 - DNA, 25 bp, mus musculus
tacagtgctcttgttgatcttgtgt

SEQ ID NO: 62569 - DNA, 25 bp, mus musculus
tccccgtgtcctccagtgtgttctg

SEQ ID NO: 62570 - DNA, 25 bp, mus musculus
ccgtgtcctccagtgtgttctgcag

SEQ ID NO: 62571 - DNA, 25 bp, mus musculus
tctgcagctgtgtctgagactggga

SEQ ID NO: 62572 - DNA, 25 bp, mus musculus
atctgcctgtcactgtggctagtga

SEQ ID NO: 62573 - DNA, 25 bp, mus musculus
ctgtcactgtggctagtgatgggct

SEQ ID NO: 62574 - DNA, 25 bp, mus musculus
tccttctttcctttctctggaggca

SEQ ID NO: 62575 - DNA, 25 bp, mus musculus
ttctttcctttctctggaggcatca

SEQ ID NO: 62576 - DNA, 25 bp, mus musculus
tttcctttctctggaggcatcatgc

SEQ ID NO: 62577 - DNA, 25 bp, mus musculus
tgattctaattttcttgagaagaac

SEQ ID NO: 62578 - DNA, 25 bp, mus musculus
tgaaccacgaacgattgaagatttc

SEQ ID NO: 62579 - DNA, 25 bp, mus musculus
caccattcttgcctataagaagttc

SEQ ID NO: 62580 - DNA, 25 bp, mus musculus
gacaaagcttgtgcccaaatgtggc

SEQ ID NO: 62581 - DNA, 25 bp, mus musculus
atatgcacttattctttcatgaaaa

SEQ ID NO: 62582 - DNA, 25 bp, mus musculus
ggtatatcaacatctgtcccctaca

SEQ ID NO: 62583 - DNA, 25 bp, mus musculus
tcaacatctgtcccctacattatgg

SEQ ID NO: 62584 - DNA, 25 bp, mus musculus
aaatcatagacatcaaatagctctt

SEQ ID NO: 62585 - DNA, 25 bp, mus musculus
tagacatcaaatagctctttctgca

SEQ ID NO: 62586 - DNA, 25 bp, mus musculus
tcaaatagctctttctgcaaaatta

SEQ ID NO: 62587 - DNA, 25 bp, mus musculus
agctctttctgcaaaattaaccatt

SEQ ID NO: 62588 - DNA, 25 bp, mus musculus
ttctgcaaaattaaccatttatgta

SEQ ID NO: 62589 - DNA, 25 bp, mus musculus
tataagtacatactaccaggtatct

SEQ ID NO: 62590 - DNA, 25 bp, mus musculus
tacatactaccaggtatctcgaaca

SEQ ID NO: 62591 - DNA, 25 bp, mus musculus
ggtatctcgaacatctgtgatgaca

SEQ ID NO: 62592 - DNA, 25 bp, mus musculus
gatgacaaacacatcactttgttcc

SEQ ID NO: 62593 - DNA, 25 bp, mus musculus
cctacataccaaagacggagtccat

SEQ ID NO: 62594 - DNA, 25 bp, mus musculus
taccaaagacggagtccatggctta

SEQ ID NO: 62595 - DNA, 25 bp, mus musculus
agtccatggcttaatgggcaccatt

SEQ ID NO: 62596 - DNA, 25 bp, mus musculus
aatgggcaccattcttgcctataag

SEQ ID NO: 62597 - DNA, 25 bp, mus musculus
tgtgtcttatgtctatgtggcatac

SEQ ID NO: 62598 - DNA, 25 bp, mus musculus
atcacataaagaccagcatggccaa

SEQ ID NO: 62599 - DNA, 25 bp, mus musculus
tccgtctggatggtggtgatcacac

SEQ ID NO: 62600 - DNA, 25 bp, mus musculus
gtggtgatcacacctccattaacat

SEQ ID NO: 62601 - DNA, 25 bp, mus musculus
ttaacatccttacccagcattctgt

SEQ ID NO: 62602 - DNA, 25 bp, mus musculus
tccttacccagcattctgtacttcg

SEQ ID NO: 62603 - DNA, 25 bp, mus musculus
agtgaaacatcaacaccacctttgt

SEQ ID NO: 62604 - DNA, 25 bp, mus musculus
acatcaacaccacctttgtttccat

SEQ ID NO: 62605 - DNA, 25 bp, mus musculus
cctttgtttccattctcactgctgt

SEQ ID NO: 62606 - DNA, 25 bp, mus musculus
tttccattctcactgctgtaaatac

SEQ ID NO: 62607 - DNA, 25 bp, mus musculus
ttctcactgctgtaaatactgagta

SEQ ID NO: 62608 - DNA, 25 bp, mus musculus
ctttgcattctgtcagaatacttgt

SEQ ID NO: 62609 - DNA, 25 bp, mus musculus
taaagaccagcatggccaagttccg

SEQ ID NO: 62610 - DNA, 25 bp, mus musculus
ccagcatggccaagttccgtgggaa

SEQ ID NO: 62611 - DNA, 25 bp, mus musculus
ggtctcccagtcctgaagggccaag

SEQ ID NO: 62612 - DNA, 25 bp, mus musculus
ccagtcctgaagggccaaggtgtat

SEQ ID NO: 62613 - DNA, 25 bp, mus musculus
aggattctatgtcctcattttctat

SEQ ID NO: 62614 - DNA, 25 bp, mus musculus
ctatgtcctcattttctatgggacc

SEQ ID NO: 62615 - DNA, 25 bp, mus musculus
cctcattttctatgggacctcccat

SEQ ID NO: 62616 - DNA, 25 bp, mus musculus
tttctatgggacctcccatgcccag

SEQ ID NO: 62617 - DNA, 25 bp, mus musculus
cacctgtattgtgggcacagggacc

SEQ ID NO: 62618 - DNA, 25 bp, mus musculus
ctgtattgtgggcacagggaccagc

SEQ ID NO: 62619 - DNA, 25 bp, mus musculus
aacattgttcccacagagcactgct

SEQ ID NO: 62620 - DNA, 25 bp, mus musculus
attgttcccacagagcactgcttcc

SEQ ID NO: 62621 - DNA, 25 bp, mus musculus
cccacagagcactgcttcctgggaa

SEQ ID NO: 62622 - DNA, 25 bp, mus musculus
cactgcttcctgggaaatggtacag

SEQ ID NO: 62623 - DNA, 25 bp, mus musculus
acagagtaccgaggcgtggccagca

SEQ ID NO: 62624 - DNA, 25 bp, mus musculus
ctgagctgcctggcctggaattctg

SEQ ID NO: 62625 - DNA, 25 bp, mus musculus
tgcctggcctggaattctgacctgc

SEQ ID NO: 62626 - DNA, 25 bp, mus musculus
gcctggaattctgacctgctctacc

SEQ ID NO: 62627 - DNA, 25 bp, mus musculus
tggaattctgacctgctctaccagg

SEQ ID NO: 62628 - DNA, 25 bp, mus musculus
tctgacctgctctaccaggagctgc

SEQ ID NO: 62629 - DNA, 25 bp, mus musculus
cacagggaccagcgtctgcacctgc

SEQ ID NO: 62630 - DNA, 25 bp, mus musculus
taccaggagctgcacgtggactcag

SEQ ID NO: 62631 - DNA, 25 bp, mus musculus
cagcgtctgcacctgcccgttgcgt

SEQ ID NO: 62632 - DNA, 25 bp, mus musculus
ctgcccgttgcgtatgctgggcggt

SEQ ID NO: 62633 - DNA, 25 bp, mus musculus
cccgttgcgtatgctgggcggttct

SEQ ID NO: 62634 - DNA, 25 bp, mus musculus
gcgtatgctgggcggttctgtaaca

SEQ ID NO: 62635 - DNA, 25 bp, mus musculus
tatgctgggcggttctgtaacattg

SEQ ID NO: 62636 - DNA, 25 bp, mus musculus
ttctgtaacattgttcccacagagc

SEQ ID NO: 62637 - DNA, 25 bp, mus musculus
tgtaacattgttcccacagagcact

SEQ ID NO: 62638 - DNA, 25 bp, mus musculus
gctacaatcagagctcctacacaca

SEQ ID NO: 62639 - DNA, 25 bp, mus musculus
gctcctacacacaatggaacctaca

SEQ ID NO: 62640 - DNA, 25 bp, mus musculus
tcatcctctgcttcatcaaacgcag

SEQ ID NO: 62641 - DNA, 25 bp, mus musculus
tcatcaaacgcagcaagggtggcaa

SEQ ID NO: 62642 - DNA, 25 bp, mus musculus
gcgagtacaggtccctggagagtga

SEQ ID NO: 62643 - DNA, 25 bp, mus musculus
acaggtccctggagagtgacaatga

SEQ ID NO: 62644 - DNA, 25 bp, mus musculus
aggcctttggcagcagccagccatc

SEQ ID NO: 62645 - DNA, 25 bp, mus musculus
agccatctctcaacggagacatcaa

SEQ ID NO: 62646 - DNA, 25 bp, mus musculus
acatcaaacccctaggcagtgatga

SEQ ID NO: 62647 - DNA, 25 bp, mus musculus
gtgatgacagcctggctgattatgg

SEQ ID NO: 62648 - DNA, 25 bp, mus musculus
atggctctttcatcggccagtacag

SEQ ID NO: 62649 - DNA, 25 bp, mus musculus
ctcctatcaatcctgcagtagccct

SEQ ID NO: 62650 - DNA, 25 bp, mus musculus
acacacaatggaacctacagcctga

SEQ ID NO: 62651 - DNA, 25 bp, mus musculus
acctacagcctgacaccaaatatga

SEQ ID NO: 62652 - DNA, 25 bp, mus musculus
agaaggtcctcctgcaccatctgga

SEQ ID NO: 62653 - DNA, 25 bp, mus musculus
tgcaccatctggatgtgaagactaa

SEQ ID NO: 62654 - DNA, 25 bp, mus musculus
ggttcatcgcctttgtcagcgctat

SEQ ID NO: 62655 - DNA, 25 bp, mus musculus
tcgcctttgtcagcgctatcattct

SEQ ID NO: 62656 - DNA, 25 bp, mus musculus
gcgctatcattctcttgctcctcat

SEQ ID NO: 62657 - DNA, 25 bp, mus musculus
tcctgctcatcctctgcttcatcaa

SEQ ID NO: 62658 - DNA, 25 bp, mus musculus
acaacggagtttgctagcgggcagt

SEQ ID NO: 62659 - DNA, 25 bp, mus musculus
tgggctggcattgttctggacgatc

SEQ ID NO: 62660 - DNA, 25 bp, mus musculus
tctggacgatccataagggaagaat

SEQ ID NO: 62661 - DNA, 25 bp, mus musculus
taacggcattgttgttagagtccat

SEQ ID NO: 62662 - DNA, 25 bp, mus musculus
tgttagagtccattacttcatgtgt

SEQ ID NO: 62663 - DNA, 25 bp, mus musculus
gttagagtccattacttcatgtgtt

SEQ ID NO: 62664 - DNA, 25 bp, mus musculus
tagagtccattacttcatgtgtttc

SEQ ID NO: 62665 - DNA, 25 bp, mus musculus
agagtccattacttcatgtgtttcc

SEQ ID NO: 62666 - DNA, 25 bp, mus musculus
gagtccattacttcatgtgtttccc

SEQ ID NO: 62667 - DNA, 25 bp, mus musculus
gtccattacttcatgtgtttcccct

SEQ ID NO: 62668 - DNA, 25 bp, mus musculus
tccattacttcatgtgtttcccctt

SEQ ID NO: 62669 - DNA, 25 bp, mus musculus
gctggcattgttctggacgatccat

SEQ ID NO: 62670 - DNA, 25 bp, mus musculus
gcattgttctggacgatccataagg

SEQ ID NO: 62671 - DNA, 25 bp, mus musculus
cattgttctggacgatccataaggg

SEQ ID NO: 62672 - DNA, 25 bp, mus musculus
attgttctggacgatccataaggga

SEQ ID NO: 62673 - DNA, 25 bp, mus musculus
ttgttctggacgatccataagggaa

SEQ ID NO: 62674 - DNA, 25 bp, mus musculus
tgttctggacgatccataagggaag

SEQ ID NO: 62675 - DNA, 25 bp, mus musculus
gttctggacgatccataagggaaga

SEQ ID NO: 62676 - DNA, 25 bp, mus musculus
ttctggacgatccataagggaagaa

SEQ ID NO: 62677 - DNA, 25 bp, mus musculus
tgtcagccaacaggctgccaggcct

SEQ ID NO: 62678 - DNA, 25 bp, mus musculus
ccaacaggctgccaggcctgccgga

SEQ ID NO: 62679 - DNA, 25 bp, mus musculus
cccctctgagccatctcaagagtct

SEQ ID NO: 62680 - DNA, 25 bp, mus musculus
ctctgagccatctcaagagtctgga

SEQ ID NO: 62681 - DNA, 25 bp, mus musculus
tgagccatctcaagagtctggacct

SEQ ID NO: 62682 - DNA, 25 bp, mus musculus
atctcaagagtctggacctcagcca

SEQ ID NO: 62683 - DNA, 25 bp, mus musculus
tcaagagtctggacctcagccacaa

SEQ ID NO: 62684 - DNA, 25 bp, mus musculus
agtttgcctggagcgacctgcacaa

SEQ ID NO: 62685 - DNA, 25 bp, mus musculus
acaacctcagcgctctgcagctgct

SEQ ID NO: 62686 - DNA, 25 bp, mus musculus
acctcagcgctctgcagctgctcaa

SEQ ID NO: 62687 - DNA, 25 bp, mus musculus
tgcagctgctcaagatggacagcaa

SEQ ID NO: 62688 - DNA, 25 bp, mus musculus
tcatccctcgggacgcctttagcag

SEQ ID NO: 62689 - DNA, 25 bp, mus musculus
ccttcagggaagtgcccctattgca

SEQ ID NO: 62690 - DNA, 25 bp, mus musculus
aagtgcccctattgcagtcgctgtg

SEQ ID NO: 62691 - DNA, 25 bp, mus musculus
tgcagtcgctgtggctggcacacaa

SEQ ID NO: 62692 - DNA, 25 bp, mus musculus
tgtggctggcacacaatgagatccg

SEQ ID NO: 62693 - DNA, 25 bp, mus musculus
atgagatccgctcggtggctattgg

SEQ ID NO: 62694 - DNA, 25 bp, mus musculus
agatccgctcggtggctattggtgc

SEQ ID NO: 62695 - DNA, 25 bp, mus musculus
tggctattggtgctctggcccctct

SEQ ID NO: 62696 - DNA, 25 bp, mus musculus
ttggtgctctggcccctctgagcca

SEQ ID NO: 62697 - DNA, 25 bp, mus musculus
gcttactcacagccagctaactgct

SEQ ID NO: 62698 - DNA, 25 bp, mus musculus
tcacagccagctaactgctactaaa

SEQ ID NO: 62699 - DNA, 25 bp, mus musculus
attatacttggtgtggagaacacac

SEQ ID NO: 62700 - DNA, 25 bp, mus musculus
ccatactcataattgagcattagtc

SEQ ID NO: 62701 - DNA, 25 bp, mus musculus
caatagcttcagccatatcttagct

SEQ ID NO: 62702 - DNA, 25 bp, mus musculus
cttcagccatatcttagctatatcc

SEQ ID NO: 62703 - DNA, 25 bp, mus musculus
ccatatcttagctatatccacctgt

SEQ ID NO: 62704 - DNA, 25 bp, mus musculus
cacctgtctatgtgaagcttgttgc

SEQ ID NO: 62705 - DNA, 25 bp, mus musculus
tgaagcttgttgccgtagtggtggc

SEQ ID NO: 62706 - DNA, 25 bp, mus musculus
ttgttgccgtagtggtggcccgact

SEQ ID NO: 62707 - DNA, 25 bp, mus musculus
tggtggcccgacttattgtctgaaa

SEQ ID NO: 62708 - DNA, 25 bp, mus musculus
tgaagtctccccatgttttcaaata

SEQ ID NO: 62709 - DNA, 25 bp, mus musculus
ccagctaactgctactaaaataact

SEQ ID NO: 62710 - DNA, 25 bp, mus musculus
taacacatgggttcttttatgtgac

SEQ ID NO: 62711 - DNA, 25 bp, mus musculus
atgtgacagcgggactcctgaccac

SEQ ID NO: 62712 - DNA, 25 bp, mus musculus
ataatctgaagccttttgtgaggaa

SEQ ID NO: 62713 - DNA, 25 bp, mus musculus
agcaggctttcacacatacacactc

SEQ ID NO: 62714 - DNA, 25 bp, mus musculus
ctttcacacatacacactcaggtgg

SEQ ID NO: 62715 - DNA, 25 bp, mus musculus
cacactcaggtggatcctgcactga

SEQ ID NO: 62716 - DNA, 25 bp, mus musculus
gatcctgcactgactctggagaagg

SEQ ID NO: 62717 - DNA, 25 bp, mus musculus
gtcgccgatcgcgtcggaagcagca

SEQ ID NO: 62718 - DNA, 25 bp, mus musculus
tcgccgatcgcgtcggaagcagcaa

SEQ ID NO: 62719 - DNA, 25 bp, mus musculus
actgctggccaggagcgatatagtg

SEQ ID NO: 62720 - DNA, 25 bp, mus musculus
ctgctggccaggagcgatatagtgc

SEQ ID NO: 62721 - DNA, 25 bp, mus musculus
tgctggccaggagcgatatagtgct

SEQ ID NO: 62722 - DNA, 25 bp, mus musculus
atatagtgctattacgtctgcgtag

SEQ ID NO: 62723 - DNA, 25 bp, mus musculus
tagtgctattacgtctgcgtagtaa

SEQ ID NO: 62724 - DNA, 25 bp, mus musculus
agtgctattacgtctgcgtagtaat

SEQ ID NO: 62725 - DNA, 25 bp, mus musculus
gtgctattacgtctgcgtagtaata

SEQ ID NO: 62726 - DNA, 25 bp, mus musculus
tattacgtctgcgtagtaatatgat

SEQ ID NO: 62727 - DNA, 25 bp, mus musculus
ttacgtctgcgtagtaatatgatgc

SEQ ID NO: 62728 - DNA, 25 bp, mus musculus
tacgtctgcgtagtaatatgatgca

SEQ ID NO: 62729 - DNA, 25 bp, mus musculus
ccgatcgcgtcggaagcagcaagac

SEQ ID NO: 62730 - DNA, 25 bp, mus musculus
cgatcgcgtcggaagcagcaagaca

SEQ ID NO: 62731 - DNA, 25 bp, mus musculus
gatcgcgtcggaagcagcaagacaa

SEQ ID NO: 62732 - DNA, 25 bp, mus musculus
gccacacgcagcattcaggtagacg

SEQ ID NO: 62733 - DNA, 25 bp, mus musculus
cacacgcagcattcaggtagacggc

SEQ ID NO: 62734 - DNA, 25 bp, mus musculus
acacgcagcattcaggtagacggca

SEQ ID NO: 62735 - DNA, 25 bp, mus musculus
aacactgctggccaggagcgatata

SEQ ID NO: 62736 - DNA, 25 bp, mus musculus
acactgctggccaggagcgatatag

SEQ ID NO: 62737 - DNA, 25 bp, mus musculus
tcaccatcagcaagtcggtaaaggt

SEQ ID NO: 62738 - DNA, 25 bp, mus musculus
gtgaccgtagcccgcaggagtccaa

SEQ ID NO: 62739 - DNA, 25 bp, mus musculus
ctaccaaatacatcaccaaatctgt

SEQ ID NO: 62740 - DNA, 25 bp, mus musculus
ccaaatacatcaccaaatctgtaac

SEQ ID NO: 62741 - DNA, 25 bp, mus musculus
aatacatcaccaaatctgtaaccgt

SEQ ID NO: 62742 - DNA, 25 bp, mus musculus
acatcaccaaatctgtaaccgtcac

SEQ ID NO: 62743 - DNA, 25 bp, mus musculus
tcaccaaatctgtaaccgtcactca

SEQ ID NO: 62744 - DNA, 25 bp, mus musculus
ccgtcactcaaaaggttgaagagca

SEQ ID NO: 62745 - DNA, 25 bp, mus musculus
aggtcacttcacacgccatagtcaa

SEQ ID NO: 62746 - DNA, 25 bp, mus musculus
tcacttcacacgccatagtcaagga

SEQ ID NO: 62747 - DNA, 25 bp, mus musculus
cttcacacgccatagtcaaggaagt

SEQ ID NO: 62748 - DNA, 25 bp, mus musculus
cacacgccatagtcaaggaagtcac

SEQ ID NO: 62749 - DNA, 25 bp, mus musculus
gtagcccgcaggagtccaagaagga

SEQ ID NO: 62750 - DNA, 25 bp, mus musculus
gcccgcaggagtccaagaaggaaga

SEQ ID NO: 62751 - DNA, 25 bp, mus musculus
tcactaatggcttagatgtgagccc

SEQ ID NO: 62752 - DNA, 25 bp, mus musculus
tagatgtgagccctgcagaggagaa

SEQ ID NO: 62753 - DNA, 25 bp, mus musculus
atgtgagccctgcagaggagaagaa

SEQ ID NO: 62754 - DNA, 25 bp, mus musculus
tgagccctgcagaggagaagaaagg

SEQ ID NO: 62755 - DNA, 25 bp, mus musculus
atggtgctaccaaatacatcaccaa

SEQ ID NO: 62756 - DNA, 25 bp, mus musculus
gtgctaccaaatacatcaccaaatc

SEQ ID NO: 62757 - DNA, 25 bp, mus musculus
gtctccgccacagatggactaagcg

SEQ ID NO: 62758 - DNA, 25 bp, mus musculus
tccgccacagatggactaagcgaag

SEQ ID NO: 62759 - DNA, 25 bp, mus musculus
cctccttgtaccataagtagctgta

SEQ ID NO: 62760 - DNA, 25 bp, mus musculus
aatgtagcttcctgatgcttgacta

SEQ ID NO: 62761 - DNA, 25 bp, mus musculus
gtagcttcctgatgcttgactaatt

SEQ ID NO: 62762 - DNA, 25 bp, mus musculus
gcttcctgatgcttgactaattgag

SEQ ID NO: 62763 - DNA, 25 bp, mus musculus
gagtttgttgctctgtatgacgcct

SEQ ID NO: 62764 - DNA, 25 bp, mus musculus
gttgctctgtatgacgcctgtatgc

SEQ ID NO: 62765 - DNA, 25 bp, mus musculus
gctctgtatgacgcctgtatgcatt

SEQ ID NO: 62766 - DNA, 25 bp, mus musculus
ctgtatgacgcctgtatgcattgta

SEQ ID NO: 62767 - DNA, 25 bp, mus musculus
gacgcctgtatgcattgtatattgc

SEQ ID NO: 62768 - DNA, 25 bp, mus musculus
tttattactgtcagagatttgtaga

SEQ ID NO: 62769 - DNA, 25 bp, mus musculus
gaggcattcactaaccagttaccag

SEQ ID NO: 62770 - DNA, 25 bp, mus musculus
tacacaacgtcttaccaacagattt

SEQ ID NO: 62771 - DNA, 25 bp, mus musculus
acaacgtcttaccaacagatttctg

SEQ ID NO: 62772 - DNA, 25 bp, mus musculus
taccaacagatttctggtgtccagc

SEQ ID NO: 62773 - DNA, 25 bp, mus musculus
caacagatttctggtgtccagcaaa

SEQ ID NO: 62774 - DNA, 25 bp, mus musculus
ttttcatgatcggaaggacggacgg

SEQ ID NO: 62775 - DNA, 25 bp, mus musculus
gtgaagctgcctccttgtaccataa

SEQ ID NO: 62776 - DNA, 25 bp, mus musculus
aagctgcctccttgtaccataagta

SEQ ID NO: 62777 - DNA, 25 bp, mus musculus
aagccttcagtcgactctcgtcact

SEQ ID NO: 62778 - DNA, 25 bp, mus musculus
tcagtcgactctcgtcactcacgca

SEQ ID NO: 62779 - DNA, 25 bp, mus musculus
tgattcagcacgaaaggacgcatac

SEQ ID NO: 62780 - DNA, 25 bp, mus musculus
ccaatttgcacgaccatcagagaac

SEQ ID NO: 62781 - DNA, 25 bp, mus musculus
atttgcacgaccatcagagaactca

SEQ ID NO: 62782 - DNA, 25 bp, mus musculus
tgcacgaccatcagagaactcacac

SEQ ID NO: 62783 - DNA, 25 bp, mus musculus
ttcacgcccggaataaactgcagga

SEQ ID NO: 62784 - DNA, 25 bp, mus musculus
gcacggccgaacgatctgcttccaa

SEQ ID NO: 62785 - DNA, 25 bp, mus musculus
gatctgcttccaacccagtgtcaga

SEQ ID NO: 62786 - DNA, 25 bp, mus musculus
ctgcttccaacccagtgtcagagga

SEQ ID NO: 62787 - DNA, 25 bp, mus musculus
ccaacccagtgtcagaggattctga

SEQ ID NO: 62788 - DNA, 25 bp, mus musculus
tttggacactgtgtatagagaaaac

SEQ ID NO: 62789 - DNA, 25 bp, mus musculus
gtcgactctcgtcactcacgcaaca

SEQ ID NO: 62790 - DNA, 25 bp, mus musculus
gactctcgtcactcacgcaacacga

SEQ ID NO: 62791 - DNA, 25 bp, mus musculus
cactcacgcaacacgagaggaccca

SEQ ID NO: 62792 - DNA, 25 bp, mus musculus
aacacgagaggacccacactggcga

SEQ ID NO: 62793 - DNA, 25 bp, mus musculus
tcagtcaaagctcatccctgattca

SEQ ID NO: 62794 - DNA, 25 bp, mus musculus
gtcaaagctcatccctgattcagca

SEQ ID NO: 62795 - DNA, 25 bp, mus musculus
aaagctcatccctgattcagcacga

SEQ ID NO: 62796 - DNA, 25 bp, mus musculus
ccctgattcagcacgaaaggacgca

SEQ ID NO: 62797 - DNA, 25 bp, mus musculus
atcagcgatgcgaacatcagcattg

SEQ ID NO: 62798 - DNA, 25 bp, mus musculus
tgcgaacatcagcattgctgctggg

SEQ ID NO: 62799 - DNA, 25 bp, mus musculus
cactggccccaaggaccaaggccag

SEQ ID NO: 62800 - DNA, 25 bp, mus musculus
atattcagtcgagtttgctggaaaa

SEQ ID NO: 62801 - DNA, 25 bp, mus musculus
tattcagtcgagtttgctggaaaag

SEQ ID NO: 62802 - DNA, 25 bp, mus musculus
ttcagtcgagtttgctggaaaagct

SEQ ID NO: 62803 - DNA, 25 bp, mus musculus
tcagtcgagtttgctggaaaagctc

SEQ ID NO: 62804 - DNA, 25 bp, mus musculus
agctctatcgaaaccgatccaactt

SEQ ID NO: 62805 - DNA, 25 bp, mus musculus
gctctatcgaaaccgatccaacttg

SEQ ID NO: 62806 - DNA, 25 bp, mus musculus
tctatcgaaaccgatccaacttgga

SEQ ID NO: 62807 - DNA, 25 bp, mus musculus
ctatcgaaaccgatccaacttggag

SEQ ID NO: 62808 - DNA, 25 bp, mus musculus
gaaaccgatccaacttggagaccat

SEQ ID NO: 62809 - DNA, 25 bp, mus musculus
gcgaacatcagcattgctgctgggc

SEQ ID NO: 62810 - DNA, 25 bp, mus musculus
gaacatcagcattgctgctgggccc

SEQ ID NO: 62811 - DNA, 25 bp, mus musculus
aacatcagcattgctgctgggcccc

SEQ ID NO: 62812 - DNA, 25 bp, mus musculus
catcagcattgctgctgggccccct

SEQ ID NO: 62813 - DNA, 25 bp, mus musculus
atcagcattgctgctgggcccccta

SEQ ID NO: 62814 - DNA, 25 bp, mus musculus
aattcattatgcattagggcaaaaa

SEQ ID NO: 62815 - DNA, 25 bp, mus musculus
gtgagttcactggccccaaggacca

SEQ ID NO: 62816 - DNA, 25 bp, mus musculus
tcactggccccaaggaccaaggcca

SEQ ID NO: 62817 - DNA, 25 bp, mus musculus
gacagtgacctggactgtgggcctc

SEQ ID NO: 62818 - DNA, 25 bp, mus musculus
gggcctctcatgcaccaccatcaag

SEQ ID NO: 62819 - DNA, 25 bp, mus musculus
ttcagacctttccagactcttccct

SEQ ID NO: 62820 - DNA, 25 bp, mus musculus
cagactcttccctgaggtgcaatgc

SEQ ID NO: 62821 - DNA, 25 bp, mus musculus
cttccctgaggtgcaatgcacagcc

SEQ ID NO: 62822 - DNA, 25 bp, mus musculus
gcaatgcacagccttcctcacagag

SEQ ID NO: 62823 - DNA, 25 bp, mus musculus
ctctaccttgttgcctcctcttttg

SEQ ID NO: 62824 - DNA, 25 bp, mus musculus
ttggtgaccaggctgtcgctacatc

SEQ ID NO: 62825 - DNA, 25 bp, mus musculus
accaggctgtcgctacatcactgaa

SEQ ID NO: 62826 - DNA, 25 bp, mus musculus
gactgtaattgccctacagtcaatt

SEQ ID NO: 62827 - DNA, 25 bp, mus musculus
aattgccctacagtcaattgagaga

SEQ ID NO: 62828 - DNA, 25 bp, mus musculus
tgccctacagtcaattgagagaaat

SEQ ID NO: 62829 - DNA, 25 bp, mus musculus
caccaccatcaaggactcaaatggg

SEQ ID NO: 62830 - DNA, 25 bp, mus musculus
gctttccgaattcactggagcctcg

SEQ ID NO: 62831 - DNA, 25 bp, mus musculus
cactggagcctcgaatgtccattcc

SEQ ID NO: 62832 - DNA, 25 bp, mus musculus
gaatgtccattcctgagttctgcaa

SEQ ID NO: 62833 - DNA, 25 bp, mus musculus
tcaggttgcctctgtctcagaatga

SEQ ID NO: 62834 - DNA, 25 bp, mus musculus
tgcctctgtctcagaatgaggctgg

SEQ ID NO: 62835 - DNA, 25 bp, mus musculus
gataagatctcaggccttcctacct

SEQ ID NO: 62836 - DNA, 25 bp, mus musculus
atctcaggccttcctaccttcagac

SEQ ID NO: 62837 - DNA, 25 bp, mus musculus
cagaatcgccgcaacaagtggaagc

SEQ ID NO: 62838 - DNA, 25 bp, mus musculus
gaatcgccgcaacaagtggaagcga

SEQ ID NO: 62839 - DNA, 25 bp, mus musculus
cgaccttgggctcactgccttgcct

SEQ ID NO: 62840 - DNA, 25 bp, mus musculus
ttcgaatcgattttcgtgcaattaa

SEQ ID NO: 62841 - DNA, 25 bp, mus musculus
cgaatcgattttcgtgcaattaatt

SEQ ID NO: 62842 - DNA, 25 bp, mus musculus
attaattcctatgaatttgaggcgc

SEQ ID NO: 62843 - DNA, 25 bp, mus musculus
taattcctatgaatttgaggcgctt

SEQ ID NO: 62844 - DNA, 25 bp, mus musculus
attcctatgaatttgaggcgcttct

SEQ ID NO: 62845 - DNA, 25 bp, mus musculus
gaatttgaggcgcttctcctcttat

SEQ ID NO: 62846 - DNA, 25 bp, mus musculus
atttgaggcgcttctcctcttattt

SEQ ID NO: 62847 - DNA, 25 bp, mus musculus
tggttttgcttaccattgagagaaa

SEQ ID NO: 62848 - DNA, 25 bp, mus musculus
tttgcttaccattgagagaaaacgg

SEQ ID NO: 62849 - DNA, 25 bp, mus musculus
agcgcatcgtacgcgtgcccatcct

SEQ ID NO: 62850 - DNA, 25 bp, mus musculus
atcctctaccacgagaactctgcgg

SEQ ID NO: 62851 - DNA, 25 bp, mus musculus
tctaccacgagaactctgcggccga

SEQ ID NO: 62852 - DNA, 25 bp, mus musculus
taccacgagaactctgcggccgagg

SEQ ID NO: 62853 - DNA, 25 bp, mus musculus
ccctactaaggccggtgtgagatgg

SEQ ID NO: 62854 - DNA, 25 bp, mus musculus
actaaggccggtgtgagatgggaca

SEQ ID NO: 62855 - DNA, 25 bp, mus musculus
ctgtggccagcgaccttgggctcac

SEQ ID NO: 62856 - DNA, 25 bp, mus musculus
agcgaccttgggctcactgccttgc

SEQ ID NO: 62857 - DNA, 25 bp, mus musculus
cttcaggtaccaatggggatcccag

SEQ ID NO: 62858 - DNA, 25 bp, mus musculus
ttcaacccgtgcaaacggtcgcagc

SEQ ID NO: 62859 - DNA, 25 bp, mus musculus
cggttcatcgtgggatgagtgctgc

SEQ ID NO: 62860 - DNA, 25 bp, mus musculus
ggttcatcgtgggatgagtgctgct

SEQ ID NO: 62861 - DNA, 25 bp, mus musculus
tcatcgtgggatgagtgctgcttcc

SEQ ID NO: 62862 - DNA, 25 bp, mus musculus
tgagtgctgcttccgaactgccacc

SEQ ID NO: 62863 - DNA, 25 bp, mus musculus
tgctgcttccgaactgccaccctgg

SEQ ID NO: 62864 - DNA, 25 bp, mus musculus
tgccaccctggccttcctgtagaca

SEQ ID NO: 62865 - DNA, 25 bp, mus musculus
caccctggccttcctgtagacatac

SEQ ID NO: 62866 - DNA, 25 bp, mus musculus
accctggccttcctgtagacatact

SEQ ID NO: 62867 - DNA, 25 bp, mus musculus
cttcctgtagacatactgtgtcaac

SEQ ID NO: 62868 - DNA, 25 bp, mus musculus
ttcctgtagacatactgtgtcaacc

SEQ ID NO: 62869 - DNA, 25 bp, mus musculus
tcaacccgtgcaaacggtcgcagcg

SEQ ID NO: 62870 - DNA, 25 bp, mus musculus
ccgtgcaaacggtcgcagcggttca

SEQ ID NO: 62871 - DNA, 25 bp, mus musculus
tgcaaacggtcgcagcggttcatcg

SEQ ID NO: 62872 - DNA, 25 bp, mus musculus
gcaaacggtcgcagcggttcatcgt

SEQ ID NO: 62873 - DNA, 25 bp, mus musculus
aacggtcgcagcggttcatcgtggg

SEQ ID NO: 62874 - DNA, 25 bp, mus musculus
cggtcgcagcggttcatcgtgggat

SEQ ID NO: 62875 - DNA, 25 bp, mus musculus
tcgcagcggttcatcgtgggatgag

SEQ ID NO: 62876 - DNA, 25 bp, mus musculus
cgcagcggttcatcgtgggatgagt

SEQ ID NO: 62877 - DNA, 25 bp, mus musculus
atctggaccaagtcggaacagcacc

SEQ ID NO: 62878 - DNA, 25 bp, mus musculus
agccgcacaagatcctaccatgaag

SEQ ID NO: 62879 - DNA, 25 bp, mus musculus
tattcctgccttgctccctcatttc

SEQ ID NO: 62880 - DNA, 25 bp, mus musculus
atgtgtcacttgatttggatatatt

SEQ ID NO: 62881 - DNA, 25 bp, mus musculus
atatattcaaccagtaattgaatcc

SEQ ID NO: 62882 - DNA, 25 bp, mus musculus
cttcactgatcttgcttatccctgg

SEQ ID NO: 62883 - DNA, 25 bp, mus musculus
tgatcttgcttatccctggtctcac

SEQ ID NO: 62884 - DNA, 25 bp, mus musculus
tccctggtctcacgcagcagttgtg

SEQ ID NO: 62885 - DNA, 25 bp, mus musculus
gtagtgtctccccagctagattgta

SEQ ID NO: 62886 - DNA, 25 bp, mus musculus
atggacctctcctgtcttgtagtgt

SEQ ID NO: 62887 - DNA, 25 bp, mus musculus
ctctcctgtcttgtagtgtcctagg

SEQ ID NO: 62888 - DNA, 25 bp, mus musculus
tgtcttgtagtgtcctaggaccctg

SEQ ID NO: 62889 - DNA, 25 bp, mus musculus
acaagatcctaccatgaagatcgaa

SEQ ID NO: 62890 - DNA, 25 bp, mus musculus
acagcccatcaaccagcagaatgga

SEQ ID NO: 62891 - DNA, 25 bp, mus musculus
catcaaccagcagaatggacattct

SEQ ID NO: 62892 - DNA, 25 bp, mus musculus
acattctgacatcaccagctgaagc

SEQ ID NO: 62893 - DNA, 25 bp, mus musculus
tgacatcaccagctgaagccctaca

SEQ ID NO: 62894 - DNA, 25 bp, mus musculus
ccctacatctcggtgcagaagagaa

SEQ ID NO: 62895 - DNA, 25 bp, mus musculus
gctgccccttgcctatggcacacat

SEQ ID NO: 62896 - DNA, 25 bp, mus musculus
ctatggcacacatattcctgccttg

SEQ ID NO: 62897 - DNA, 25 bp, mus musculus
tccatcggcaggtcccctgacagca

SEQ ID NO: 62898 - DNA, 25 bp, mus musculus
cctgacagcatccttgtcacggcca

SEQ ID NO: 62899 - DNA, 25 bp, mus musculus
tatgcacctcctgtggattccttcc

SEQ ID NO: 62900 - DNA, 25 bp, mus musculus
cctgtggattccttcctctgagtgc

SEQ ID NO: 62901 - DNA, 25 bp, mus musculus
gtggattccttcctctgagtgctcc

SEQ ID NO: 62902 - DNA, 25 bp, mus musculus
ttctgaaggacttcctcagcgtttc

SEQ ID NO: 62903 - DNA, 25 bp, mus musculus
tgaaggacttcctcagcgtttccta

SEQ ID NO: 62904 - DNA, 25 bp, mus musculus
tcgttagcctttggtggagttgcca

SEQ ID NO: 62905 - DNA, 25 bp, mus musculus
ttagcctttggtggagttgccagct

SEQ ID NO: 62906 - DNA, 25 bp, mus musculus
gaatttgcacacctggaagcttggc

SEQ ID NO: 62907 - DNA, 25 bp, mus musculus
tttgcacacctggaagcttggcagt

SEQ ID NO: 62908 - DNA, 25 bp, mus musculus
gcacacctggaagcttggcagtctc

SEQ ID NO: 62909 - DNA, 25 bp, mus musculus
gacagcatccttgtcacggccagtg

SEQ ID NO: 62910 - DNA, 25 bp, mus musculus
atccttgtcacggccagtgtgaagg

SEQ ID NO: 62911 - DNA, 25 bp, mus musculus
cttgtcacggccagtgtgaaggaag

SEQ ID NO: 62912 - DNA, 25 bp, mus musculus
gtcacggccagtgtgaaggaagcag

SEQ ID NO: 62913 - DNA, 25 bp, mus musculus
gcagcagaagccttcctcggcttct

SEQ ID NO: 62914 - DNA, 25 bp, mus musculus
gcagaagccttcctcggcttctcct

SEQ ID NO: 62915 - DNA, 25 bp, mus musculus
ttctcctatgcacctcctgtggatt

SEQ ID NO: 62916 - DNA, 25 bp, mus musculus
tcctatgcacctcctgtggattcct

SEQ ID NO: 62917 - DNA, 25 bp, mus musculus
ggttgacaacatctccgggaatgga

SEQ ID NO: 62918 - DNA, 25 bp, mus musculus
tgacaacatctccgggaatggaaag

SEQ ID NO: 62919 - DNA, 25 bp, mus musculus
agaccaagcagcttgcagaaatgct

SEQ ID NO: 62920 - DNA, 25 bp, mus musculus
ccaagcagcttgcagaaatgcttcc

SEQ ID NO: 62921 - DNA, 25 bp, mus musculus
ttgcagaaatgcttcccaggatcct

SEQ ID NO: 62922 - DNA, 25 bp, mus musculus
aaatgcttcccaggatccttcacca

SEQ ID NO: 62923 - DNA, 25 bp, mus musculus
tgcttcccaggatccttcaccagct

SEQ ID NO: 62924 - DNA, 25 bp, mus musculus
ttcccaggatccttcaccagcttgg

SEQ ID NO: 62925 - DNA, 25 bp, mus musculus
ccaggatccttcaccagcttggtgc

SEQ ID NO: 62926 - DNA, 25 bp, mus musculus
ggatccttcaccagcttggtgcaga

SEQ ID NO: 62927 - DNA, 25 bp, mus musculus
ttcaccagcttggtgcagaaaacct

SEQ ID NO: 62928 - DNA, 25 bp, mus musculus
caacccttggtaactgagagggatg

SEQ ID NO: 62929 - DNA, 25 bp, mus musculus
catggttacaaacccagggacagtg

SEQ ID NO: 62930 - DNA, 25 bp, mus musculus
cttctaacaattcaaggcacgccga

SEQ ID NO: 62931 - DNA, 25 bp, mus musculus
ctaacaattcaaggcacgccgagac

SEQ ID NO: 62932 - DNA, 25 bp, mus musculus
acaattcaaggcacgccgagaccaa

SEQ ID NO: 62933 - DNA, 25 bp, mus musculus
attcaaggcacgccgagaccaagca

SEQ ID NO: 62934 - DNA, 25 bp, mus musculus
caaggcacgccgagaccaagcagct

SEQ ID NO: 62935 - DNA, 25 bp, mus musculus
ggcacgccgagaccaagcagcttgc

SEQ ID NO: 62936 - DNA, 25 bp, mus musculus
ccgagaccaagcagcttgcagaaat

SEQ ID NO: 62937 - DNA, 25 bp, mus musculus
aactaggctttgcgttggcaccctg

SEQ ID NO: 62938 - DNA, 25 bp, mus musculus
gctttgcgttggcaccctgacaaga

SEQ ID NO: 62939 - DNA, 25 bp, mus musculus
tacgaccgggcaggctgtgacagat

SEQ ID NO: 62940 - DNA, 25 bp, mus musculus
ggtgcaatgtcccccatagcagtcc

SEQ ID NO: 62941 - DNA, 25 bp, mus musculus
gcaatgtcccccatagcagtccctt

SEQ ID NO: 62942 - DNA, 25 bp, mus musculus
atgtcccccatagcagtcccttcgg

SEQ ID NO: 62943 - DNA, 25 bp, mus musculus
tcggtgctggctatcccttccgaaa

SEQ ID NO: 62944 - DNA, 25 bp, mus musculus
gtgctggctatcccttccgaaatcc

SEQ ID NO: 62945 - DNA, 25 bp, mus musculus
ctggctatcccttccgaaatcctga

SEQ ID NO: 62946 - DNA, 25 bp, mus musculus
gctatcccttccgaaatcctgagga

SEQ ID NO: 62947 - DNA, 25 bp, mus musculus
atcccttccgaaatcctgaggatat

SEQ ID NO: 62948 - DNA, 25 bp, mus musculus
tctgggacactccgttcagcggccg

SEQ ID NO: 62949 - DNA, 25 bp, mus musculus
ttgcgttggcaccctgacaagaacc

SEQ ID NO: 62950 - DNA, 25 bp, mus musculus
tggcaccctgacaagaaccccgaca

SEQ ID NO: 62951 - DNA, 25 bp, mus musculus
tccgaagcctacgaagtcttgtcag

SEQ ID NO: 62952 - DNA, 25 bp, mus musculus
gcctacgaagtcttgtcagactcta

SEQ ID NO: 62953 - DNA, 25 bp, mus musculus
gaagtcttgtcagactctaagaagc

SEQ ID NO: 62954 - DNA, 25 bp, mus musculus
gtcttgtcagactctaagaagcgtt

SEQ ID NO: 62955 - DNA, 25 bp, mus musculus
cgttctgtgtacgaccgggcaggct

SEQ ID NO: 62956 - DNA, 25 bp, mus musculus
tctgtgtacgaccgggcaggctgtg

SEQ ID NO: 62957 - DNA, 25 bp, mus musculus
aggtgtccagtcgagcagaaaagtg

SEQ ID NO: 62958 - DNA, 25 bp, mus musculus
ctgtacctgtcgccagcaccaatgt

SEQ ID NO: 62959 - DNA, 25 bp, mus musculus
ggatcatctaccccaagcagtacaa

SEQ ID NO: 62960 - DNA, 25 bp, mus musculus
tctaccccaagcagtacaatgccta

SEQ ID NO: 62961 - DNA, 25 bp, mus musculus
ccaagcagtacaatgcctatcgctg

SEQ ID NO: 62962 - DNA, 25 bp, mus musculus
cctacatccagagcctgctgaaacg

SEQ ID NO: 62963 - DNA, 25 bp, mus musculus
tccagagcctgctgaaacgatacca

SEQ ID NO: 62964 - DNA, 25 bp, mus musculus
tgaagaccaagccactgagcatgct

SEQ ID NO: 62965 - DNA, 25 bp, mus musculus
ccaagccactgagcatgctttatgt

SEQ ID NO: 62966 - DNA, 25 bp, mus musculus
tttatgtggacaatggcagggtcct

SEQ ID NO: 62967 - DNA, 25 bp, mus musculus
tcctggaacaccacaaggacatgat

SEQ ID NO: 62968 - DNA, 25 bp, mus musculus
aacaccacaaggacatgattgtgga

SEQ ID NO: 62969 - DNA, 25 bp, mus musculus
ccagcaccaatgtgctcatgctcta

SEQ ID NO: 62970 - DNA, 25 bp, mus musculus
accggcctcaggagcagaggcagct

SEQ ID NO: 62971 - DNA, 25 bp, mus musculus
gcgccactttgctttgggaagctga

SEQ ID NO: 62972 - DNA, 25 bp, mus musculus
ctttgctttgggaagctgagagctc

SEQ ID NO: 62973 - DNA, 25 bp, mus musculus
gccgacatcatttgccagacagaag

SEQ ID NO: 62974 - DNA, 25 bp, mus musculus
atcatttgccagacagaagccaact

SEQ ID NO: 62975 - DNA, 25 bp, mus musculus
tccaggtggacttcaacctgattgg

SEQ ID NO: 62976 - DNA, 25 bp, mus musculus
gctcctggatcatctaccccaagca

SEQ ID NO: 62977 - DNA, 25 bp, mus musculus
atactatctccacagaatgggcatt

SEQ ID NO: 62978 - DNA, 25 bp, mus musculus
tctccacagaatgggcattgtccac

SEQ ID NO: 62979 - DNA, 25 bp, mus musculus
aggctatgttgctccggaagttctc

SEQ ID NO: 62980 - DNA, 25 bp, mus musculus
ctatgttgctccggaagttctcgcc

SEQ ID NO: 62981 - DNA, 25 bp, mus musculus
tgctccggaagttctcgcccagaaa

SEQ ID NO: 62982 - DNA, 25 bp, mus musculus
tctcgcccagaaaccgtacagcaaa

SEQ ID NO: 62983 - DNA, 25 bp, mus musculus
cgcccagaaaccgtacagcaaagct

SEQ ID NO: 62984 - DNA, 25 bp, mus musculus
ccagaaaccgtacagcaaagctgtg

SEQ ID NO: 62985 - DNA, 25 bp, mus musculus
ggactgctggtccatcggggtgatc

SEQ ID NO: 62986 - DNA, 25 bp, mus musculus
gtccatcggggtgatcgcctatatc

SEQ ID NO: 62987 - DNA, 25 bp, mus musculus
ggtgatcgcctatatcttgctctgt

SEQ ID NO: 62988 - DNA, 25 bp, mus musculus
gatcgcctatatcttgctctgtggt

SEQ ID NO: 62989 - DNA, 25 bp, mus musculus
aatgggcattgtccacagggacctc

SEQ ID NO: 62990 - DNA, 25 bp, mus musculus
cctcaagccggagaatctcttatac

SEQ ID NO: 62991 - DNA, 25 bp, mus musculus
gaatctcttatactacagtcaagac

SEQ ID NO: 62992 - DNA, 25 bp, mus musculus
cttatactacagtcaagacgaggag

SEQ ID NO: 62993 - DNA, 25 bp, mus musculus
tgactttggcttgtcgaaaatggag

SEQ ID NO: 62994 - DNA, 25 bp, mus musculus
tgtgatgtccacggcctgcgggacc

SEQ ID NO: 62995 - DNA, 25 bp, mus musculus
ctgcgggaccccaggctatgttgct

SEQ ID NO: 62996 - DNA, 25 bp, mus musculus
cccaggctatgttgctccggaagtt

SEQ ID NO: 62997 - DNA, 25 bp, mus musculus
agcggctgaacagccacttttcaaa

SEQ ID NO: 62998 - DNA, 25 bp, mus musculus
tgaacagccacttttcaaatctcgt

SEQ ID NO: 62999 - DNA, 25 bp, mus musculus
gctctcttaacacggaagatgatga

SEQ ID NO: 63000 - DNA, 25 bp, mus musculus
ccaattcactcttaaacaagctaat

SEQ ID NO: 63001 - DNA, 25 bp, mus musculus
attcactcttaaacaagctaatccg

SEQ ID NO: 63002 - DNA, 25 bp, mus musculus
cactcttaaacaagctaatccgtca

SEQ ID NO: 63003 - DNA, 25 bp, mus musculus
acaagctaatccgtcagtccttaat

SEQ ID NO: 63004 - DNA, 25 bp, mus musculus
agctaatccgtcagtccttaataga

SEQ ID NO: 63005 - DNA, 25 bp, mus musculus
taatagaatccagccaccgagtgga

SEQ ID NO: 63006 - DNA, 25 bp, mus musculus
aatccagccaccgagtggaagtctt

SEQ ID NO: 63007 - DNA, 25 bp, mus musculus
tcttacagaaggatcccagctctcc

SEQ ID NO: 63008 - DNA, 25 bp, mus musculus
tacagaaggatcccagctctccact

SEQ ID NO: 63009 - DNA, 25 bp, mus musculus
gccacttttcaaatctcgtccatcc

SEQ ID NO: 63010 - DNA, 25 bp, mus musculus
acttttcaaatctcgtccatcccag

SEQ ID NO: 63011 - DNA, 25 bp, mus musculus
atctcgtccatcccaggaagaacct

SEQ ID NO: 63012 - DNA, 25 bp, mus musculus
tcgtccatcccaggaagaaccttcg

SEQ ID NO: 63013 - DNA, 25 bp, mus musculus
ggagtaccacagtcccaaacataga

SEQ ID NO: 63014 - DNA, 25 bp, mus musculus
ccacagtcccaaacatagacggctc

SEQ ID NO: 63015 - DNA, 25 bp, mus musculus
caaacatagacggctctcttaacac

SEQ ID NO: 63016 - DNA, 25 bp, mus musculus
acggctctcttaacacggaagatga

SEQ ID NO: 63017 - DNA, 25 bp, mus musculus
caatccggactctgtgtactgagta

SEQ ID NO: 63018 - DNA, 25 bp, mus musculus
atatgactagggctccacgtactga

SEQ ID NO: 63019 - DNA, 25 bp, mus musculus
tctgctcaaagcctcaactccaggc

SEQ ID NO: 63020 - DNA, 25 bp, mus musculus
tcccagagcctggctcaccttttag

SEQ ID NO: 63021 - DNA, 25 bp, mus musculus
agcctggctcaccttttagggcctg

SEQ ID NO: 63022 - DNA, 25 bp, mus musculus
atgcattccacttctaattgtaaat

SEQ ID NO: 63023 - DNA, 25 bp, mus musculus
tcttcctgttgttctcttggctcag

SEQ ID NO: 63024 - DNA, 25 bp, mus musculus
tgttgttctcttggctcagcctgcc

SEQ ID NO: 63025 - DNA, 25 bp, mus musculus
ggctcagcctgcctaatagaaatgt

SEQ ID NO: 63026 - DNA, 25 bp, mus musculus
ttttgtaatatggcacctggtcaca

SEQ ID NO: 63027 - DNA, 25 bp, mus musculus
aatatggcacctggtcacagtcctt

SEQ ID NO: 63028 - DNA, 25 bp, mus musculus
gcacctggtcacagtcctttgtagc

SEQ ID NO: 63029 - DNA, 25 bp, mus musculus
ctagggctccacgtactgagtatgt

SEQ ID NO: 63030 - DNA, 25 bp, mus musculus
gtcacagtcctttgtagctgaattc

SEQ ID NO: 63031 - DNA, 25 bp, mus musculus
ctccacgtactgagtatgtggccct

SEQ ID NO: 63032 - DNA, 25 bp, mus musculus
agtatgtggccctcgtatgtaccaa

SEQ ID NO: 63033 - DNA, 25 bp, mus musculus
tggccctcgtatgtaccaagtagcc

SEQ ID NO: 63034 - DNA, 25 bp, mus musculus
agtagccagccttgggcacaccctc

SEQ ID NO: 63035 - DNA, 25 bp, mus musculus
tcacttcactgcattccagataaga

SEQ ID NO: 63036 - DNA, 25 bp, mus musculus
cactgcattccagataagacgtgta

SEQ ID NO: 63037 - DNA, 25 bp, mus musculus
gtcttgtctgctcaaagcctcaact

SEQ ID NO: 63038 - DNA, 25 bp, mus musculus
agccaccagctgcaggtgccagagc

SEQ ID NO: 63039 - DNA, 25 bp, mus musculus
tccccgcattccaacatctctgatt

SEQ ID NO: 63040 - DNA, 25 bp, mus musculus
ttcaggatgctggggcgaccaaagg

SEQ ID NO: 63041 - DNA, 25 bp, mus musculus
atgctggggcgaccaaaggagcttt

SEQ ID NO: 63042 - DNA, 25 bp, mus musculus
ttctatggcactaggggaaaaacat

SEQ ID NO: 63043 - DNA, 25 bp, mus musculus
ctagttctcagagccttgattttcc

SEQ ID NO: 63044 - DNA, 25 bp, mus musculus
gttctcagagccttgattttcctgg

SEQ ID NO: 63045 - DNA, 25 bp, mus musculus
ctcagagccttgattttcctggtca

SEQ ID NO: 63046 - DNA, 25 bp, mus musculus
gccttgattttcctggtcagggtga

SEQ ID NO: 63047 - DNA, 25 bp, mus musculus
ttgattttcctggtcagggtgaagt

SEQ ID NO: 63048 - DNA, 25 bp, mus musculus
ttccctgtgtgtctgtaaaatatga

SEQ ID NO: 63049 - DNA, 25 bp, mus musculus
ttattgattgcttctttccaaaatc

SEQ ID NO: 63050 - DNA, 25 bp, mus musculus
aacatctctgattggtccgagggca

SEQ ID NO: 63051 - DNA, 25 bp, mus musculus
tattgattgcttctttccaaaatcg

SEQ ID NO: 63052 - DNA, 25 bp, mus musculus
atctctgattggtccgagggcatct

SEQ ID NO: 63053 - DNA, 25 bp, mus musculus
atcacccacattccagaggcattta

SEQ ID NO: 63054 - DNA, 25 bp, mus musculus
acccacattccagaggcatttaaat

SEQ ID NO: 63055 - DNA, 25 bp, mus musculus
gatgcaggaccccagcttccgttcc

SEQ ID NO: 63056 - DNA, 25 bp, mus musculus
ggaagtcctttccagtgcttcagga

SEQ ID NO: 63057 - DNA, 25 bp, mus musculus
ttccagtgcttcaggatgctggggc

SEQ ID NO: 63058 - DNA, 25 bp, mus musculus
cagtgcttcaggatgctggggcgac

SEQ ID NO: 63059 - DNA, 25 bp, mus musculus
tttcttcaactcttgctgggttgat

SEQ ID NO: 63060 - DNA, 25 bp, mus musculus
caactcttgctgggttgattcttaa

SEQ ID NO: 63061 - DNA, 25 bp, mus musculus
catgggactgcagtcctgggagagt

SEQ ID NO: 63062 - DNA, 25 bp, mus musculus
actgcagtcctgggagagtcgtgaa

SEQ ID NO: 63063 - DNA, 25 bp, mus musculus
tcgtgaacacctggagacaggtagc

SEQ ID NO: 63064 - DNA, 25 bp, mus musculus
gaacgctcagtcgcacccacttctg

SEQ ID NO: 63065 - DNA, 25 bp, mus musculus
tcagtcgcacccacttctgtctgag

SEQ ID NO: 63066 - DNA, 25 bp, mus musculus
gcacccacttctgtctgagtgattc

SEQ ID NO: 63067 - DNA, 25 bp, mus musculus
cttttgcactgtgtattgtatgtaa

SEQ ID NO: 63068 - DNA, 25 bp, mus musculus
tatacttctgactttaaaggaggat

SEQ ID NO: 63069 - DNA, 25 bp, mus musculus
tatgtcttcctctatgatctaataa

SEQ ID NO: 63070 - DNA, 25 bp, mus musculus
ttcctctatgatctaataaacaaac

SEQ ID NO: 63071 - DNA, 25 bp, mus musculus
ttcttaatcaggatccggaatatgc

SEQ ID NO: 63072 - DNA, 25 bp, mus musculus
tttccttcttgatggcaggcattaa

SEQ ID NO: 63073 - DNA, 25 bp, mus musculus
ccacacgactgtgaagggaagacat

SEQ ID NO: 63074 - DNA, 25 bp, mus musculus
atcttctagcctagactaatgtctc

SEQ ID NO: 63075 - DNA, 25 bp, mus musculus
agactaatgtctctgaagtgttgga

SEQ ID NO: 63076 - DNA, 25 bp, mus musculus
tgttggactcttcagtgacatctct

SEQ ID NO: 63077 - DNA, 25 bp, mus musculus
gaggtcagcatccttatagaaagaa

SEQ ID NO: 63078 - DNA, 25 bp, mus musculus
atccttcatgggactgcagtcctgg

SEQ ID NO: 63079 - DNA, 25 bp, mus musculus
ggaaagtgctcgcgctccaggcccg

SEQ ID NO: 63080 - DNA, 25 bp, mus musculus
gctcgcgctccaggcccgaaagaaa

SEQ ID NO: 63081 - DNA, 25 bp, mus musculus
gattctagggtctgacgatgacgag

SEQ ID NO: 63082 - DNA, 25 bp, mus musculus
tctagggtctgacgatgacgagcag

SEQ ID NO: 63083 - DNA, 25 bp, mus musculus
gtctgacgatgacgagcaggaagac

SEQ ID NO: 63084 - DNA, 25 bp, mus musculus
ttatcatcttgtgaaaattggagat

SEQ ID NO: 63085 - DNA, 25 bp, mus musculus
gacacttttccacagtgtggttatc

SEQ ID NO: 63086 - DNA, 25 bp, mus musculus
acacttttccacagtgtggttatca

SEQ ID NO: 63087 - DNA, 25 bp, mus musculus
acttttccacagtgtggttatcatg

SEQ ID NO: 63088 - DNA, 25 bp, mus musculus
cttttccacagtgtggttatcatgg

SEQ ID NO: 63089 - DNA, 25 bp, mus musculus
tttccacagtgtggttatcatggga

SEQ ID NO: 63090 - DNA, 25 bp, mus musculus
ttccacagtgtggttatcatgggat

SEQ ID NO: 63091 - DNA, 25 bp, mus musculus
agcctgaaactcagcaccgaggctc

SEQ ID NO: 63092 - DNA, 25 bp, mus musculus
gcctgaaactcagcaccgaggctct

SEQ ID NO: 63093 - DNA, 25 bp, mus musculus
tgaaactcagcaccgaggctctgca

SEQ ID NO: 63094 - DNA, 25 bp, mus musculus
aaactcagcaccgaggctctgcacc

SEQ ID NO: 63095 - DNA, 25 bp, mus musculus
actccgagagcgacatcccagagca

SEQ ID NO: 63096 - DNA, 25 bp, mus musculus
ctccgagagcgacatcccagagcag

SEQ ID NO: 63097 - DNA, 25 bp, mus musculus
ccgagagcgacatcccagagcagga

SEQ ID NO: 63098 - DNA, 25 bp, mus musculus
agattctagggtctgacgatgacga

SEQ ID NO: 63099 - DNA, 25 bp, mus musculus
gaagacagctctgctcgtcctcctt

SEQ ID NO: 63100 - DNA, 25 bp, mus musculus
ccttgtcttggctgtggcactagcc

SEQ ID NO: 63101 - DNA, 25 bp, mus musculus
gtcgccccgtcaatttgcaatttcg

SEQ ID NO: 63102 - DNA, 25 bp, mus musculus
gtgtcaaatctcaggcacttcggtt

SEQ ID NO: 63103 - DNA, 25 bp, mus musculus
cagtggtcccaggttcacacaatcc

SEQ ID NO: 63104 - DNA, 25 bp, mus musculus
acaatccgtcgagatgtccctatgc

SEQ ID NO: 63105 - DNA, 25 bp, mus musculus
atccgtcgagatgtccctatgcaac

SEQ ID NO: 63106 - DNA, 25 bp, mus musculus
cgtcgagatgtccctatgcaacaag

SEQ ID NO: 63107 - DNA, 25 bp, mus musculus
cgagatgtccctatgcaacaagagt

SEQ ID NO: 63108 - DNA, 25 bp, mus musculus
gatgtccctatgcaacaagagtctg

SEQ ID NO: 63109 - DNA, 25 bp, mus musculus
gtccctatgcaacaagagtctggtc

SEQ ID NO: 63110 - DNA, 25 bp, mus musculus
cctatgcaacaagagtctggtcagc

SEQ ID NO: 63111 - DNA, 25 bp, mus musculus
tgtcttggctgtggcactagcccag

SEQ ID NO: 63112 - DNA, 25 bp, mus musculus
ggcactagcccagcctgggcacttc

SEQ ID NO: 63113 - DNA, 25 bp, mus musculus
actagcccagcctgggcacttcgat

SEQ ID NO: 63114 - DNA, 25 bp, mus musculus
gtgtgcaccatcagtgccaactgta

SEQ ID NO: 63115 - DNA, 25 bp, mus musculus
tgcaccatcagtgccaactgtagaa

SEQ ID NO: 63116 - DNA, 25 bp, mus musculus
accatcagtgccaactgtagaatcc

SEQ ID NO: 63117 - DNA, 25 bp, mus musculus
gccaactgtagaatcccacaggtcg

SEQ ID NO: 63118 - DNA, 25 bp, mus musculus
ccacaggtcgccccgtcaatttgca

SEQ ID NO: 63119 - DNA, 25 bp, mus musculus
cttgtgacatatctcacatggtgac

SEQ ID NO: 63120 - DNA, 25 bp, mus musculus
atgtttgtctagttgctggctttag

SEQ ID NO: 63121 - DNA, 25 bp, mus musculus
ttctaaggtttgcagcatggcgctc

SEQ ID NO: 63122 - DNA, 25 bp, mus musculus
ggtttgcagcatggcgctcatgacg

SEQ ID NO: 63123 - DNA, 25 bp, mus musculus
cagcatggcgctcatgacgtcatag

SEQ ID NO: 63124 - DNA, 25 bp, mus musculus
ggcgctcatgacgtcataggtaatg

SEQ ID NO: 63125 - DNA, 25 bp, mus musculus
ttctacatgccctgacttgactgct

SEQ ID NO: 63126 - DNA, 25 bp, mus musculus
atgccctgacttgactgctttactt

SEQ ID NO: 63127 - DNA, 25 bp, mus musculus
gactgctttacttagctgcacaggc

SEQ ID NO: 63128 - DNA, 25 bp, mus musculus
tttacttagctgcacaggccttgcg

SEQ ID NO: 63129 - DNA, 25 bp, mus musculus
tagctgcacaggccttgcgcttccc

SEQ ID NO: 63130 - DNA, 25 bp, mus musculus
tttctaggtcactttttacatgtgc

SEQ ID NO: 63131 - DNA, 25 bp, mus musculus
tcgtagcttcttagtggaggacttc

SEQ ID NO: 63132 - DNA, 25 bp, mus musculus
ttttacatgtgctgctctgtcagtg

SEQ ID NO: 63133 - DNA, 25 bp, mus musculus
ttggtcctggtgcctctggcatccc

SEQ ID NO: 63134 - DNA, 25 bp, mus musculus
cactactttaatcttgcatttgatc

SEQ ID NO: 63135 - DNA, 25 bp, mus musculus
tttaatcttgcatttgatccataca

SEQ ID NO: 63136 - DNA, 25 bp, mus musculus
tttgatccatacagctcttttggat

SEQ ID NO: 63137 - DNA, 25 bp, mus musculus
atcctatcaaacctggatccacgag

SEQ ID NO: 63138 - DNA, 25 bp, mus musculus
tcttcttttcttgcctcctgcaata

SEQ ID NO: 63139 - DNA, 25 bp, mus musculus
tgcaatagcttctctgtcttgtaca

SEQ ID NO: 63140 - DNA, 25 bp, mus musculus
tcccctaggctttcagcttcaggca

SEQ ID NO: 63141 - DNA, 25 bp, mus musculus
cctaggctttcagcttcaggcagct

SEQ ID NO: 63142 - DNA, 25 bp, mus musculus
ctgaccccaatcttggtcagctctg

SEQ ID NO: 63143 - DNA, 25 bp, mus musculus
accccaatcttggtcagctctggag

SEQ ID NO: 63144 - DNA, 25 bp, mus musculus
atcttggtcagctctggagtactgc

SEQ ID NO: 63145 - DNA, 25 bp, mus musculus
ttggtcagctctggagtactgcctg

SEQ ID NO: 63146 - DNA, 25 bp, mus musculus
gtcagctctggagtactgcctgccc

SEQ ID NO: 63147 - DNA, 25 bp, mus musculus
ttcctaaccgagcagtagggataga

SEQ ID NO: 63148 - DNA, 25 bp, mus musculus
ctaaccgagcagtagggatagaaag

SEQ ID NO: 63149 - DNA, 25 bp, mus musculus
aaagcgtgagcctgggagtgctttt

SEQ ID NO: 63150 - DNA, 25 bp, mus musculus
aatttatctctgtgacctgccaggg

SEQ ID NO: 63151 - DNA, 25 bp, mus musculus
ttatctctgtgacctgccagggaga

SEQ ID NO: 63152 - DNA, 25 bp, mus musculus
aggctttcagcttcaggcagcttct

SEQ ID NO: 63153 - DNA, 25 bp, mus musculus
ggcagcttcttcacagcctgttcag

SEQ ID NO: 63154 - DNA, 25 bp, mus musculus
ttcttcacagcctgttcagcctggg

SEQ ID NO: 63155 - DNA, 25 bp, mus musculus
ttcacagcctgttcagcctgggctc

SEQ ID NO: 63156 - DNA, 25 bp, mus musculus
acagcctgttcagcctgggctcctg

SEQ ID NO: 63157 - DNA, 25 bp, mus musculus
tcagcctgggctcctggaggacagc

SEQ ID NO: 63158 - DNA, 25 bp, mus musculus
caagatagccaggtggttggttcca

SEQ ID NO: 63159 - DNA, 25 bp, mus musculus
gttggttccaggaccacagtgtctt

SEQ ID NO: 63160 - DNA, 25 bp, mus musculus
cgtgcactactgtcatcagaagaac

SEQ ID NO: 63161 - DNA, 25 bp, mus musculus
gcactactgtcatcagaagaacatt

SEQ ID NO: 63162 - DNA, 25 bp, mus musculus
gctgttccagggcaagaagtatgat

SEQ ID NO: 63163 - DNA, 25 bp, mus musculus
gtatgatgggccagaggtggacatc

SEQ ID NO: 63164 - DNA, 25 bp, mus musculus
tgtcatcctgtacacgctggtcagc

SEQ ID NO: 63165 - DNA, 25 bp, mus musculus
catcctgtacacgctggtcagcggc

SEQ ID NO: 63166 - DNA, 25 bp, mus musculus
cctgtacacgctggtcagcggctcc

SEQ ID NO: 63167 - DNA, 25 bp, mus musculus
gtacacgctggtcagcggctccctg

SEQ ID NO: 63168 - DNA, 25 bp, mus musculus
gcccttcgatgggcacaacctcaag

SEQ ID NO: 63169 - DNA, 25 bp, mus musculus
ccttcgatgggcacaacctcaagga

SEQ ID NO: 63170 - DNA, 25 bp, mus musculus
cttcgatgggcacaacctcaaggag

SEQ ID NO: 63171 - DNA, 25 bp, mus musculus
acaacctcaaggagctgcgggacgt

SEQ ID NO: 63172 - DNA, 25 bp, mus musculus
ggctgaaaacctgttgctggatgcc

SEQ ID NO: 63173 - DNA, 25 bp, mus musculus
caacctcaaggagctgcgggacgta

SEQ ID NO: 63174 - DNA, 25 bp, mus musculus
tgaaaacctgttgctggatgccgag

SEQ ID NO: 63175 - DNA, 25 bp, mus musculus
tgccgaggccaacatcaaaatcgcc

SEQ ID NO: 63176 - DNA, 25 bp, mus musculus
ggccaacatcaaaatcgccgacttc

SEQ ID NO: 63177 - DNA, 25 bp, mus musculus
cagcaatgagttcacgctgggctcc

SEQ ID NO: 63178 - DNA, 25 bp, mus musculus
caatgagttcacgctgggctccaag

SEQ ID NO: 63179 - DNA, 25 bp, mus musculus
caagctggacaccttctgtgggagc

SEQ ID NO: 63180 - DNA, 25 bp, mus musculus
agagctgttccagggcaagaagtat

SEQ ID NO: 63181 - DNA, 25 bp, mus musculus
tatcgagaatgtctccttcggttct

SEQ ID NO: 63182 - DNA, 25 bp, mus musculus
atcgagaatgtctccttcggttctg

SEQ ID NO: 63183 - DNA, 25 bp, mus musculus
ttctggtggcgctttgctacagaag

SEQ ID NO: 63184 - DNA, 25 bp, mus musculus
tctggtggcgctttgctacagaagt

SEQ ID NO: 63185 - DNA, 25 bp, mus musculus
tggcgctttgctacagaagttaacc

SEQ ID NO: 63186 - DNA, 25 bp, mus musculus
ttaacccgagacctcttgaattgct

SEQ ID NO: 63187 - DNA, 25 bp, mus musculus
taacccgagacctcttgaattgctc

SEQ ID NO: 63188 - DNA, 25 bp, mus musculus
acccgagacctcttgaattgctcct

SEQ ID NO: 63189 - DNA, 25 bp, mus musculus
cccgagacctcttgaattgctcctt

SEQ ID NO: 63190 - DNA, 25 bp, mus musculus
ccgagacctcttgaattgctccttc

SEQ ID NO: 63191 - DNA, 25 bp, mus musculus
tcgagaatgtctccttcggttctgg

SEQ ID NO: 63192 - DNA, 25 bp, mus musculus
cgagaatgtctccttcggttctggt

SEQ ID NO: 63193 - DNA, 25 bp, mus musculus
gagaatgtctccttcggttctggtg

SEQ ID NO: 63194 - DNA, 25 bp, mus musculus
ttcggttctggtggcgctttgctac

SEQ ID NO: 63195 - DNA, 25 bp, mus musculus
tcggttctggtggcgctttgctaca

SEQ ID NO: 63196 - DNA, 25 bp, mus musculus
cggttctggtggcgctttgctacag

SEQ ID NO: 63197 - DNA, 25 bp, mus musculus
ggttctggtggcgctttgctacaga

SEQ ID NO: 63198 - DNA, 25 bp, mus musculus
gttctggtggcgctttgctacagaa

SEQ ID NO: 63199 - DNA, 25 bp, mus musculus
gaccgacaagtcctcagccattgac

SEQ ID NO: 63200 - DNA, 25 bp, mus musculus
caagtcctcagccattgacattcgg

SEQ ID NO: 63201 - DNA, 25 bp, mus musculus
aacctatgtccgagcactgacttca

SEQ ID NO: 63202 - DNA, 25 bp, mus musculus
tgtccgagcactgacttcagaaaac

SEQ ID NO: 63203 - DNA, 25 bp, mus musculus
caacaaactcgtaggctggcgctgg

SEQ ID NO: 63204 - DNA, 25 bp, mus musculus
actcgtaggctggcgctggatacga

SEQ ID NO: 63205 - DNA, 25 bp, mus musculus
aggctggcgctggatacgaatagac

SEQ ID NO: 63206 - DNA, 25 bp, mus musculus
aatagacacttcctgtgtgtgtgcc

SEQ ID NO: 63207 - DNA, 25 bp, mus musculus
aacttcagcaacccttacagtatat

SEQ ID NO: 63208 - DNA, 25 bp, mus musculus
agcaacccttacagtatataagctt

SEQ ID NO: 63209 - DNA, 25 bp, mus musculus
ccatctgttaaccttgttttgtgat

SEQ ID NO: 63210 - DNA, 25 bp, mus musculus
ttgtgattgggctctcgggaaccct

SEQ ID NO: 63211 - DNA, 25 bp, mus musculus
ctcagccattgacattcggggacac

SEQ ID NO: 63212 - DNA, 25 bp, mus musculus
cattgacattcggggacaccaggtc

SEQ ID NO: 63213 - DNA, 25 bp, mus musculus
cggtaactctcctgtgaaacaatat

SEQ ID NO: 63214 - DNA, 25 bp, mus musculus
tgacaaacactggaactctcagtgc

SEQ ID NO: 63215 - DNA, 25 bp, mus musculus
acactggaactctcagtgcaaaact

SEQ ID NO: 63216 - DNA, 25 bp, mus musculus
gaactctcagtgcaaaacttcgcaa

SEQ ID NO: 63217 - DNA, 25 bp, mus musculus
tcagtgcaaaacttcgcaaacctat

SEQ ID NO: 63218 - DNA, 25 bp, mus musculus
ttcgcaaacctatgtccgagcactg

SEQ ID NO: 63219 - DNA, 25 bp, mus musculus
tagcctgaggcctgcactgaacagc

SEQ ID NO: 63220 - DNA, 25 bp, mus musculus
cctgaggcctgcactgaacagccca

SEQ ID NO: 63221 - DNA, 25 bp, mus musculus
cttggacttcagtgaggtagaacta

SEQ ID NO: 63222 - DNA, 25 bp, mus musculus
actagagcctattgaggtggaagac

SEQ ID NO: 63223 - DNA, 25 bp, mus musculus
ggcccgtagaagccgcttctccaag

SEQ ID NO: 63224 - DNA, 25 bp, mus musculus
ccgtagaagccgcttctccaagtct

SEQ ID NO: 63225 - DNA, 25 bp, mus musculus
aagccgcttctccaagtctgctgat

SEQ ID NO: 63226 - DNA, 25 bp, mus musculus
ccgcttctccaagtctgctgatgag

SEQ ID NO: 63227 - DNA, 25 bp, mus musculus
cttctccaagtctgctgatgagaga

SEQ ID NO: 63228 - DNA, 25 bp, mus musculus
ctccaagtctgctgatgagagacag

SEQ ID NO: 63229 - DNA, 25 bp, mus musculus
catgttagttcagcgcaaggatgac

SEQ ID NO: 63230 - DNA, 25 bp, mus musculus
cctcctgcagcaggctcgaaagcgg

SEQ ID NO: 63231 - DNA, 25 bp, mus musculus
gcctgcactgaacagcccagtggag

SEQ ID NO: 63232 - DNA, 25 bp, mus musculus
agaagcttctgtccagacggagcgt

SEQ ID NO: 63233 - DNA, 25 bp, mus musculus
tgtccagacggagcgtgtaccactg

SEQ ID NO: 63234 - DNA, 25 bp, mus musculus
gcgtgtaccactggacctcagtcct

SEQ ID NO: 63235 - DNA, 25 bp, mus musculus
tgtaccactggacctcagtcctcgc

SEQ ID NO: 63236 - DNA, 25 bp, mus musculus
actggacctcagtcctcgcctagag

SEQ ID NO: 63237 - DNA, 25 bp, mus musculus
tcgcctagaggagaccttggacttc

SEQ ID NO: 63238 - DNA, 25 bp, mus musculus
ggagaccttggacttcagtgaggta

SEQ ID NO: 63239 - DNA, 25 bp, mus musculus
tcagcaagagctccagcctggctaa

SEQ ID NO: 63240 - DNA, 25 bp, mus musculus
agcaagagctccagcctggctaacc

SEQ ID NO: 63241 - DNA, 25 bp, mus musculus
acaagtgtgcgactgcgggaagtgc

SEQ ID NO: 63242 - DNA, 25 bp, mus musculus
caagtgtgcgactgcgggaagtgct

SEQ ID NO: 63243 - DNA, 25 bp, mus musculus
agtgtgcgactgcgggaagtgcttc

SEQ ID NO: 63244 - DNA, 25 bp, mus musculus
gtgtgcgactgcgggaagtgcttca

SEQ ID NO: 63245 - DNA, 25 bp, mus musculus
gaagtgcttcagcgagcgttccaag

SEQ ID NO: 63246 - DNA, 25 bp, mus musculus
aagtgcttcagcgagcgttccaagc

SEQ ID NO: 63247 - DNA, 25 bp, mus musculus
gtgcttcagcgagcgttccaagctc

SEQ ID NO: 63248 - DNA, 25 bp, mus musculus
gtgtggcaagttcttccgagaccgc

SEQ ID NO: 63249 - DNA, 25 bp, mus musculus
ggcaagttcttccgagaccgctcca

SEQ ID NO: 63250 - DNA, 25 bp, mus musculus
aagccgtacaagtgcagagagtgcg

SEQ ID NO: 63251 - DNA, 25 bp, mus musculus
aagagctccagcctggctaaccacc

SEQ ID NO: 63252 - DNA, 25 bp, mus musculus
agagctccagcctggctaaccaccg

SEQ ID NO: 63253 - DNA, 25 bp, mus musculus
tccagcctggctaaccaccgacgga

SEQ ID NO: 63254 - DNA, 25 bp, mus musculus
actcacaccggcgagaagcgcacaa

SEQ ID NO: 63255 - DNA, 25 bp, mus musculus
acaccggcgagaagcgcacaagtgt

SEQ ID NO: 63256 - DNA, 25 bp, mus musculus
aagcgcacaagtgtgcgactgcggg

SEQ ID NO: 63257 - DNA, 25 bp, mus musculus
agcgcacaagtgtgcgactgcggga

SEQ ID NO: 63258 - DNA, 25 bp, mus musculus
gcacaagtgtgcgactgcgggaagt

SEQ ID NO: 63259 - DNA, 25 bp, mus musculus
ttatcaaagtgccccagaacccaca

SEQ ID NO: 63260 - DNA, 25 bp, mus musculus
tcaaagtgccccagaacccacatgg

SEQ ID NO: 63261 - DNA, 25 bp, mus musculus
ttgtcaaaggtctgtctgaggatac

SEQ ID NO: 63262 - DNA, 25 bp, mus musculus
tcaaaggtctgtctgaggataccac

SEQ ID NO: 63263 - DNA, 25 bp, mus musculus
agggctctgttcgtgcaagaatagt

SEQ ID NO: 63264 - DNA, 25 bp, mus musculus
gctctgttcgtgcaagaatagtcac

SEQ ID NO: 63265 - DNA, 25 bp, mus musculus
gaatagtcactgatcgggaaactgg

SEQ ID NO: 63266 - DNA, 25 bp, mus musculus
atgccaaagctgccaaggaggccat

SEQ ID NO: 63267 - DNA, 25 bp, mus musculus
ccaaagctgccaaggaggccatgga

SEQ ID NO: 63268 - DNA, 25 bp, mus musculus
aagctgccaaggaggccatggaaga

SEQ ID NO: 63269 - DNA, 25 bp, mus musculus
gagacttcaagccacaaggaaagaa

SEQ ID NO: 63270 - DNA, 25 bp, mus musculus
cttcaagccacaaggaaagaagacg

SEQ ID NO: 63271 - DNA, 25 bp, mus musculus
aagtgccccagaacccacatggcaa

SEQ ID NO: 63272 - DNA, 25 bp, mus musculus
cacatggcaaacctaaagggtatgc

SEQ ID NO: 63273 - DNA, 25 bp, mus musculus
aatttgcttcatttgaagatgctaa

SEQ ID NO: 63274 - DNA, 25 bp, mus musculus
gaacaatcaggctggagttgcaagg

SEQ ID NO: 63275 - DNA, 25 bp, mus musculus
caatcaggctggagttgcaaggatc

SEQ ID NO: 63276 - DNA, 25 bp, mus musculus
cgagaagtcaaccatccaaaactct

SEQ ID NO: 63277 - DNA, 25 bp, mus musculus
gaagtcaaccatccaaaactctgtt

SEQ ID NO: 63278 - DNA, 25 bp, mus musculus
gtcaaccatccaaaactctgtttgt

SEQ ID NO: 63279 - DNA, 25 bp, mus musculus
ttgctctcatgatgtgtgatgacag

SEQ ID NO: 63280 - DNA, 25 bp, mus musculus
ggatctccatgcaagagagacgcaa

SEQ ID NO: 63281 - DNA, 25 bp, mus musculus
tcatgatcatcatgcgagaccacac

SEQ ID NO: 63282 - DNA, 25 bp, mus musculus
accacacttatgccaagtgccagaa

SEQ ID NO: 63283 - DNA, 25 bp, mus musculus
cttatgccaagtgccagaacgctct

SEQ ID NO: 63284 - DNA, 25 bp, mus musculus
ccaagtgccagaacgctcttcagca

SEQ ID NO: 63285 - DNA, 25 bp, mus musculus
gcattctcagtgtgattcccctgca

SEQ ID NO: 63286 - DNA, 25 bp, mus musculus
tggctttccacctggctgtgctgag

SEQ ID NO: 63287 - DNA, 25 bp, mus musculus
tccacctggctgtgctgagaggcta

SEQ ID NO: 63288 - DNA, 25 bp, mus musculus
ttgattttccacggaatcttgccaa

SEQ ID NO: 63289 - DNA, 25 bp, mus musculus
ttccacggaatcttgccaaatctgt

SEQ ID NO: 63290 - DNA, 25 bp, mus musculus
ggaatcttgccaaatctgtgactgt

SEQ ID NO: 63291 - DNA, 25 bp, mus musculus
tcatgctcggactgaagcgactgcc

SEQ ID NO: 63292 - DNA, 25 bp, mus musculus
tgccaaatctgtgactgtagagtga

SEQ ID NO: 63293 - DNA, 25 bp, mus musculus
aaatccagaagctagcaacggagct

SEQ ID NO: 63294 - DNA, 25 bp, mus musculus
gctaccattatgctacatgccttga

SEQ ID NO: 63295 - DNA, 25 bp, mus musculus
attatgctacatgccttgaaggggc

SEQ ID NO: 63296 - DNA, 25 bp, mus musculus
ttacttatatgcattcggaaggcat

SEQ ID NO: 63297 - DNA, 25 bp, mus musculus
attcggaaggcatccttgctggtga

SEQ ID NO: 63298 - DNA, 25 bp, mus musculus
aaggcatccttgctggtgagctcaa

SEQ ID NO: 63299 - DNA, 25 bp, mus musculus
tgatgcctgtcatcatgatcatcat

SEQ ID NO: 63300 - DNA, 25 bp, mus musculus
aggaacctgcaggtggctgcgtgac

SEQ ID NO: 63301 - DNA, 25 bp, mus musculus
ggcgtctctttgttgaggtttgact

SEQ ID NO: 63302 - DNA, 25 bp, mus musculus
attcattactaaattacactttgct

SEQ ID NO: 63303 - DNA, 25 bp, mus musculus
tactaaattacactttgcttgattg

SEQ ID NO: 63304 - DNA, 25 bp, mus musculus
attacactttgcttgattgcaattt

SEQ ID NO: 63305 - DNA, 25 bp, mus musculus
ctttgcttgattgcaatttgtaaaa

SEQ ID NO: 63306 - DNA, 25 bp, mus musculus
tatttccattttggtaataatcagt

SEQ ID NO: 63307 - DNA, 25 bp, mus musculus
tgtattatttcatcctgatgactgg

SEQ ID NO: 63308 - DNA, 25 bp, mus musculus
atttcatcctgatgactggcatttc

SEQ ID NO: 63309 - DNA, 25 bp, mus musculus
tcctgatgactggcatttcatcacc

SEQ ID NO: 63310 - DNA, 25 bp, mus musculus
gcatttcatcacctattgagatcac

SEQ ID NO: 63311 - DNA, 25 bp, mus musculus
ctattgagatcactgggtgtgtttc

SEQ ID NO: 63312 - DNA, 25 bp, mus musculus
agcctgcagatggaggcctgcagtc

SEQ ID NO: 63313 - DNA, 25 bp, mus musculus
aaagctatgaccagtttctgtctgt

SEQ ID NO: 63314 - DNA, 25 bp, mus musculus
gaggcctgcagtcatttacgtgcgt

SEQ ID NO: 63315 - DNA, 25 bp, mus musculus
tgcagtcatttacgtgcgtctttac

SEQ ID NO: 63316 - DNA, 25 bp, mus musculus
tctttacagtttccttgctgatgtg

SEQ ID NO: 63317 - DNA, 25 bp, mus musculus
cagtttccttgctgatgtgaatggt

SEQ ID NO: 63318 - DNA, 25 bp, mus musculus
taaacttttcattggccaacaccag

SEQ ID NO: 63319 - DNA, 25 bp, mus musculus
tttcattggccaacaccagaatgta

SEQ ID NO: 63320 - DNA, 25 bp, mus musculus
tggccaacaccagaatgtattatat

SEQ ID NO: 63321 - DNA, 25 bp, mus musculus
ggagtcctgtctgcctcgatacgtg

SEQ ID NO: 63322 - DNA, 25 bp, mus musculus
agtcctgtctgcctcgatacgtgag

SEQ ID NO: 63323 - DNA, 25 bp, mus musculus
gctgactaccaaccctgtctccagg

SEQ ID NO: 63324 - DNA, 25 bp, mus musculus
acccgtgctcgttcaggcacaagtc

SEQ ID NO: 63325 - DNA, 25 bp, mus musculus
ccgtgctcgttcaggcacaagtctc

SEQ ID NO: 63326 - DNA, 25 bp, mus musculus
gctcgttcaggcacaagtctccttt

SEQ ID NO: 63327 - DNA, 25 bp, mus musculus
tcgttcaggcacaagtctcctttgt

SEQ ID NO: 63328 - DNA, 25 bp, mus musculus
gttcaggcacaagtctcctttgttg

SEQ ID NO: 63329 - DNA, 25 bp, mus musculus
tcaggcacaagtctcctttgttgga

SEQ ID NO: 63330 - DNA, 25 bp, mus musculus
gcacaagtctcctttgttggagata

SEQ ID NO: 63331 - DNA, 25 bp, mus musculus
acaagtctcctttgttggagatagc

SEQ ID NO: 63332 - DNA, 25 bp, mus musculus
aagtctcctttgttggagatagctg

SEQ ID NO: 63333 - DNA, 25 bp, mus musculus
ctgtctgcctcgatacgtgagccag

SEQ ID NO: 63334 - DNA, 25 bp, mus musculus
gtctgcctcgatacgtgagccagct

SEQ ID NO: 63335 - DNA, 25 bp, mus musculus
ctgcctcgatacgtgagccagcttg

SEQ ID NO: 63336 - DNA, 25 bp, mus musculus
gcctcgatacgtgagccagcttgcc

SEQ ID NO: 63337 - DNA, 25 bp, mus musculus
cgatacgtgagccagcttgccaaca

SEQ ID NO: 63338 - DNA, 25 bp, mus musculus
atacgtgagccagcttgccaacagt

SEQ ID NO: 63339 - DNA, 25 bp, mus musculus
acgtgagccagcttgccaacagtgg

SEQ ID NO: 63340 - DNA, 25 bp, mus musculus
gtgagccagcttgccaacagtggac

SEQ ID NO: 63341 - DNA, 25 bp, mus musculus
ggctctcttccaataacgtctctgg

SEQ ID NO: 63342 - DNA, 25 bp, mus musculus
cttccaataacgtctctggatgcaa

SEQ ID NO: 63343 - DNA, 25 bp, mus musculus
tccatccagagctctctgttcacag

SEQ ID NO: 63344 - DNA, 25 bp, mus musculus
tctctgttcacagtcgcctctgcca

SEQ ID NO: 63345 - DNA, 25 bp, mus musculus
ttcacagtcgcctctgccagtgggc

SEQ ID NO: 63346 - DNA, 25 bp, mus musculus
gctgcctccaaggcacagtgagctg

SEQ ID NO: 63347 - DNA, 25 bp, mus musculus
ccacaggctttcctcactacagggt

SEQ ID NO: 63348 - DNA, 25 bp, mus musculus
gctttcctcactacagggtgatagg

SEQ ID NO: 63349 - DNA, 25 bp, mus musculus
ctcactacagggtgataggctggct

SEQ ID NO: 63350 - DNA, 25 bp, mus musculus
ccaccatgttgtgaggaggaagaag

SEQ ID NO: 63351 - DNA, 25 bp, mus musculus
caatgtcttttcaggattgcttcat

SEQ ID NO: 63352 - DNA, 25 bp, mus musculus
cttttcaggattgcttcatggattg

SEQ ID NO: 63353 - DNA, 25 bp, mus musculus
tctctggatgcaactgggaacctgg

SEQ ID NO: 63354 - DNA, 25 bp, mus musculus
gatgcaactgggaacctggtatttg

SEQ ID NO: 63355 - DNA, 25 bp, mus musculus
aacctggtatttgccaatgcaggag

SEQ ID NO: 63356 - DNA, 25 bp, mus musculus
ccgaacatcgtgactgcacctctgt

SEQ ID NO: 63357 - DNA, 25 bp, mus musculus
gctgcagcctccacagggaactctg

SEQ ID NO: 63358 - DNA, 25 bp, mus musculus
gcctccacagggaactctgcaccta

SEQ ID NO: 63359 - DNA, 25 bp, mus musculus
acctcaactgagtccatccagagct

SEQ ID NO: 63360 - DNA, 25 bp, mus musculus
actgagtccatccagagctctctgt

SEQ ID NO: 63361 - DNA, 25 bp, mus musculus
tgggctgagtccagccctcatgagc

SEQ ID NO: 63362 - DNA, 25 bp, mus musculus
gctgagtccagccctcatgagcaac

SEQ ID NO: 63363 - DNA, 25 bp, mus musculus
gcctctcttcttgaaccacaccggt

SEQ ID NO: 63364 - DNA, 25 bp, mus musculus
tctcttcttgaaccacaccggtctg

SEQ ID NO: 63365 - DNA, 25 bp, mus musculus
ggctgcagccgtagcagcatccatc

SEQ ID NO: 63366 - DNA, 25 bp, mus musculus
tgcagccgtagcagcatccatctcc

SEQ ID NO: 63367 - DNA, 25 bp, mus musculus
cgtagcagcatccatctccagcaag

SEQ ID NO: 63368 - DNA, 25 bp, mus musculus
agcagcatccatctccagcaagtct

SEQ ID NO: 63369 - DNA, 25 bp, mus musculus
agcatccatctccagcaagtctcct

SEQ ID NO: 63370 - DNA, 25 bp, mus musculus
atcctccacgtgcagtgatgtggca

SEQ ID NO: 63371 - DNA, 25 bp, mus musculus
ctccacgtgcagtgatgtggcagca

SEQ ID NO: 63372 - DNA, 25 bp, mus musculus
tgtggcagcacagacccctggaggc

SEQ ID NO: 63373 - DNA, 25 bp, mus musculus
cctcatgagcaacaaccctttggcc

SEQ ID NO: 63374 - DNA, 25 bp, mus musculus
gagcaacaaccctttggccactatc

SEQ ID NO: 63375 - DNA, 25 bp, mus musculus
cactatccaagccctggcctctggt

SEQ ID NO: 63376 - DNA, 25 bp, mus musculus
gccccttaccagccttgatggcagc

SEQ ID NO: 63377 - DNA, 25 bp, mus musculus
cagccttgatggcagcgggaacctg

SEQ ID NO: 63378 - DNA, 25 bp, mus musculus
gagtcccagcttagtaacctcgcct

SEQ ID NO: 63379 - DNA, 25 bp, mus musculus
cagcttagtaacctcgcctctcttc

SEQ ID NO: 63380 - DNA, 25 bp, mus musculus
cttagtaacctcgcctctcttcttg

SEQ ID NO: 63381 - DNA, 25 bp, mus musculus
ctgtcgccgtacggttcgtgctcgc

SEQ ID NO: 63382 - DNA, 25 bp, mus musculus
tgtcgccgtacggttcgtgctcgcc

SEQ ID NO: 63383 - DNA, 25 bp, mus musculus
acctgtactcggcgctactggccga

SEQ ID NO: 63384 - DNA, 25 bp, mus musculus
ctgtactcggcgctactggccgacg

SEQ ID NO: 63385 - DNA, 25 bp, mus musculus
cgtcgtctccgagttcccggctctg

SEQ ID NO: 63386 - DNA, 25 bp, mus musculus
gtcgtctccgagttcccggctctgc

SEQ ID NO: 63387 - DNA, 25 bp, mus musculus
gtctccgagttcccggctctgcgtc

SEQ ID NO: 63388 - DNA, 25 bp, mus musculus
ttttccaccggcacggatgagcacg

SEQ ID NO: 63389 - DNA, 25 bp, mus musculus
tttccaccggcacggatgagcacgg

SEQ ID NO: 63390 - DNA, 25 bp, mus musculus
tccaccggcacggatgagcacggcc

SEQ ID NO: 63391 - DNA, 25 bp, mus musculus
ccaccggcacggatgagcacggcct

SEQ ID NO: 63392 - DNA, 25 bp, mus musculus
accggcacggatgagcacggcctga

SEQ ID NO: 63393 - DNA, 25 bp, mus musculus
cgccgtacggttcgtgctcgccgag

SEQ ID NO: 63394 - DNA, 25 bp, mus musculus
tgctcgccgagcgctagtggcgacg

SEQ ID NO: 63395 - DNA, 25 bp, mus musculus
ttcaccacacctatcttctacgtga

SEQ ID NO: 63396 - DNA, 25 bp, mus musculus
tcaccacacctatcttctacgtgaa

SEQ ID NO: 63397 - DNA, 25 bp, mus musculus
accacacctatcttctacgtgaacg

SEQ ID NO: 63398 - DNA, 25 bp, mus musculus
ccacacctatcttctacgtgaacgc

SEQ ID NO: 63399 - DNA, 25 bp, mus musculus
acacctatcttctacgtgaacgccg

SEQ ID NO: 63400 - DNA, 25 bp, mus musculus
ggcacctgtactcggcgctactggc

SEQ ID NO: 63401 - DNA, 25 bp, mus musculus
gtgctgcctgtgtgactacaagctg

SEQ ID NO: 63402 - DNA, 25 bp, mus musculus
tgactacaagctgtactgccttcgc

SEQ ID NO: 63403 - DNA, 25 bp, mus musculus
gccgccatgtgtggatgagaaggac

SEQ ID NO: 63404 - DNA, 25 bp, mus musculus
gtactcctacgggctcggcagctgt

SEQ ID NO: 63405 - DNA, 25 bp, mus musculus
ctacgggctcggcagctgtgtcaag

SEQ ID NO: 63406 - DNA, 25 bp, mus musculus
gctcggcagctgtgtcaagatcgag

SEQ ID NO: 63407 - DNA, 25 bp, mus musculus
gtctccatgttacccttgcacgtct

SEQ ID NO: 63408 - DNA, 25 bp, mus musculus
atgttacccttgcacgtctccctgt

SEQ ID NO: 63409 - DNA, 25 bp, mus musculus
tccctgtaatccttgcaacccatgt

SEQ ID NO: 63410 - DNA, 25 bp, mus musculus
taatccttgcaacccatgtagcccc

SEQ ID NO: 63411 - DNA, 25 bp, mus musculus
ctatccctgtggaagccgattctcc

SEQ ID NO: 63412 - DNA, 25 bp, mus musculus
aagccgattctcctgtaggaagatg

SEQ ID NO: 63413 - DNA, 25 bp, mus musculus
caagctgtactgccttcgcccatcg

SEQ ID NO: 63414 - DNA, 25 bp, mus musculus
ctcctcttgctgcagcagtaacata

SEQ ID NO: 63415 - DNA, 25 bp, mus musculus
taacatactgggatcggtgaatgtg

SEQ ID NO: 63416 - DNA, 25 bp, mus musculus
tcaagtcaaagtgcgcgtgaaagat

SEQ ID NO: 63417 - DNA, 25 bp, mus musculus
gtacgactgcctcggatccaaaaag

SEQ ID NO: 63418 - DNA, 25 bp, mus musculus
ctgcctcggatccaaaaagtacagt

SEQ ID NO: 63419 - DNA, 25 bp, mus musculus
ttacatgaacatctgcaaagagttc

SEQ ID NO: 63420 - DNA, 25 bp, mus musculus
agagttcagtctgccgccatgtgtg

SEQ ID NO: 63421 - DNA, 25 bp, mus musculus
caattatacatattcacgtctacaa

SEQ ID NO: 63422 - DNA, 25 bp, mus musculus
tacatattcacgtctacaaaaactc

SEQ ID NO: 63423 - DNA, 25 bp, mus musculus
ccagcttcttttcacaatccaccag

SEQ ID NO: 63424 - DNA, 25 bp, mus musculus
tcttttcacaatccaccaggtagtt

SEQ ID NO: 63425 - DNA, 25 bp, mus musculus
cacaatccaccaggtagttgactcc

SEQ ID NO: 63426 - DNA, 25 bp, mus musculus
ccaccaggtagttgactccgtcaat

SEQ ID NO: 63427 - DNA, 25 bp, mus musculus
ggtagttgactccgtcaataacaat

SEQ ID NO: 63428 - DNA, 25 bp, mus musculus
tgactccgtcaataacaatctgaac

SEQ ID NO: 63429 - DNA, 25 bp, mus musculus
taacaatctgaacaagctcaacctc

SEQ ID NO: 63430 - DNA, 25 bp, mus musculus
caagctcaacctctgatctgccgat

SEQ ID NO: 63431 - DNA, 25 bp, mus musculus
caacctctgatctgccgatccgatc

SEQ ID NO: 63432 - DNA, 25 bp, mus musculus
ctgatctgccgatccgatctatgtt

SEQ ID NO: 63433 - DNA, 25 bp, mus musculus
ttcacgtctacaaaaactctatcga

SEQ ID NO: 63434 - DNA, 25 bp, mus musculus
tgccgatccgatctatgttggaaat

SEQ ID NO: 63435 - DNA, 25 bp, mus musculus
tctacaaaaactctatcgagcagag

SEQ ID NO: 63436 - DNA, 25 bp, mus musculus
agcagagacttcctgtgtctgtcat

SEQ ID NO: 63437 - DNA, 25 bp, mus musculus
gacttcctgtgtctgtcataccagc

SEQ ID NO: 63438 - DNA, 25 bp, mus musculus
ctgtcataccagcagacagtttacc

SEQ ID NO: 63439 - DNA, 25 bp, mus musculus
taccagcagacagtttacccataaa

SEQ ID NO: 63440 - DNA, 25 bp, mus musculus
tgatgtcttggcctctctccagctt

SEQ ID NO: 63441 - DNA, 25 bp, mus musculus
ctctctccagcttcttttcacaatc

SEQ ID NO: 63442 - DNA, 25 bp, mus musculus
ccaggccaagcctgcagtatggcac

SEQ ID NO: 63443 - DNA, 25 bp, mus musculus
gccaagcctgcagtatggcactaca

SEQ ID NO: 63444 - DNA, 25 bp, mus musculus
ttttccttccttctctaatcaacag

SEQ ID NO: 63445 - DNA, 25 bp, mus musculus
ttccttccttctctaatcaacagag

SEQ ID NO: 63446 - DNA, 25 bp, mus musculus
ttccttctctaatcaacagaggatt

SEQ ID NO: 63447 - DNA, 25 bp, mus musculus
ccttctctaatcaacagaggattct

SEQ ID NO: 63448 - DNA, 25 bp, mus musculus
ttctctaatcaacagaggattcttt

SEQ ID NO: 63449 - DNA, 25 bp, mus musculus
ctctaatcaacagaggattctttga

SEQ ID NO: 63450 - DNA, 25 bp, mus musculus
ggattctttgattcaatgtcacccc

SEQ ID NO: 63451 - DNA, 25 bp, mus musculus
ccctccaatgcactcttgttctgtc

SEQ ID NO: 63452 - DNA, 25 bp, mus musculus
cagtgagtggtctttcctttagtat

SEQ ID NO: 63453 - DNA, 25 bp, mus musculus
agtatctcttctacacttttatctc

SEQ ID NO: 63454 - DNA, 25 bp, mus musculus
agcctgcagtatggcactacagagc

SEQ ID NO: 63455 - DNA, 25 bp, mus musculus
cctgcagtatggcactacagagctt

SEQ ID NO: 63456 - DNA, 25 bp, mus musculus
tgcagtatggcactacagagcttct

SEQ ID NO: 63457 - DNA, 25 bp, mus musculus
cagtatggcactacagagcttcttc

SEQ ID NO: 63458 - DNA, 25 bp, mus musculus
atggcactacagagcttcttccttg

SEQ ID NO: 63459 - DNA, 25 bp, mus musculus
cactacagagcttcttccttgtgtc

SEQ ID NO: 63460 - DNA, 25 bp, mus musculus
ctacagagcttcttccttgtgtctc

SEQ ID NO: 63461 - DNA, 25 bp, mus musculus
ttgtgtctctctggctacttccctg

SEQ ID NO: 63462 - DNA, 25 bp, mus musculus
tcaacgccatctctgtcctctactt

SEQ ID NO: 63463 - DNA, 25 bp, mus musculus
tctacttcgacgacagctctaatgt

SEQ ID NO: 63464 - DNA, 25 bp, mus musculus
tttccttctggcacgtgacggacaa

SEQ ID NO: 63465 - DNA, 25 bp, mus musculus
agatcctaccagctaccacagcaaa

SEQ ID NO: 63466 - DNA, 25 bp, mus musculus
taccagctaccacagcaaacgccta

SEQ ID NO: 63467 - DNA, 25 bp, mus musculus
ctaccacagcaaacgcctaagagca

SEQ ID NO: 63468 - DNA, 25 bp, mus musculus
aatgtctgccaggaaagtgtccatt

SEQ ID NO: 63469 - DNA, 25 bp, mus musculus
ccctggcgctctgagtctttgagga

SEQ ID NO: 63470 - DNA, 25 bp, mus musculus
agtaatcgcaagcctcgttcagctg

SEQ ID NO: 63471 - DNA, 25 bp, mus musculus
cgcaagcctcgttcagctgcagcag

SEQ ID NO: 63472 - DNA, 25 bp, mus musculus
tcagctgcagcagaaggaagggctt

SEQ ID NO: 63473 - DNA, 25 bp, mus musculus
aaccaagcagaagccactgtaatga

SEQ ID NO: 63474 - DNA, 25 bp, mus musculus
tcgacgacagctctaatgtcatcct

SEQ ID NO: 63475 - DNA, 25 bp, mus musculus
tatgtcacaataaaacccatgaatg

SEQ ID NO: 63476 - DNA, 25 bp, mus musculus
cctgtggctgccactagctcttcct

SEQ ID NO: 63477 - DNA, 25 bp, mus musculus
actagctcttcctgagaccctgacc

SEQ ID NO: 63478 - DNA, 25 bp, mus musculus
ttccaaatcttcgatgtctcaccat

SEQ ID NO: 63479 - DNA, 25 bp, mus musculus
actgcccaccttggcgaggagccaa

SEQ ID NO: 63480 - DNA, 25 bp, mus musculus
caccttggcgaggagccaacagacc

SEQ ID NO: 63481 - DNA, 25 bp, mus musculus
cagaaacctgagcgtgcaggcagct

SEQ ID NO: 63482 - DNA, 25 bp, mus musculus
gcgccctttccttctggcacgtgac

SEQ ID NO: 63483 - DNA, 25 bp, mus musculus
ccaggtgcctttctttgcctctgca

SEQ ID NO: 63484 - DNA, 25 bp, mus musculus
gcctttctttgcctctgcagtctca

SEQ ID NO: 63485 - DNA, 25 bp, mus musculus
cttaacagtgtgcagttgggattgg

SEQ ID NO: 63486 - DNA, 25 bp, mus musculus
gtgaaaatccatcccgataagtctc

SEQ ID NO: 63487 - DNA, 25 bp, mus musculus
tgctgtgactctgactccttagtcg

SEQ ID NO: 63488 - DNA, 25 bp, mus musculus
agtcccatcacctctgaaaggctac

SEQ ID NO: 63489 - DNA, 25 bp, mus musculus
atcaggccatgctccattacaccct

SEQ ID NO: 63490 - DNA, 25 bp, mus musculus
ttttctgttgtagtgagtgttacag

SEQ ID NO: 63491 - DNA, 25 bp, mus musculus
gttacagcttggctagagaagcagc

SEQ ID NO: 63492 - DNA, 25 bp, mus musculus
aagcagctactatgtgggtgcaatt

SEQ ID NO: 63493 - DNA, 25 bp, mus musculus
ccttaatctaaaagctctattcaat

SEQ ID NO: 63494 - DNA, 25 bp, mus musculus
tctaaaagctctattcaatgcaact

SEQ ID NO: 63495 - DNA, 25 bp, mus musculus
ctttgcctctgcagtctcatttctc

SEQ ID NO: 63496 - DNA, 25 bp, mus musculus
gctctattcaatgcaactggaattc

SEQ ID NO: 63497 - DNA, 25 bp, mus musculus
atttctcatgatttgcaaggttggc

SEQ ID NO: 63498 - DNA, 25 bp, mus musculus
ttgcaaggttggccctgtatttctt

SEQ ID NO: 63499 - DNA, 25 bp, mus musculus
ctgttgacccccagtaagctgaact

SEQ ID NO: 63500 - DNA, 25 bp, mus musculus
tgttaaagcctctgacatagccaca

SEQ ID NO: 63501 - DNA, 25 bp, mus musculus
tgacatagccacaacaggcttctgc

SEQ ID NO: 63502 - DNA, 25 bp, mus musculus
agccacaacaggcttctgcttaaca

SEQ ID NO: 63503 - DNA, 25 bp, mus musculus
cttctgcttaacagtgtgcagttgg

SEQ ID NO: 63504 - DNA, 25 bp, mus musculus
atctacggagcgacatttgagtatt

SEQ ID NO: 63505 - DNA, 25 bp, mus musculus
aatgctaggaccaaacacaatcggt

SEQ ID NO: 63506 - DNA, 25 bp, mus musculus
gtttacttatctgcactgtcaagac

SEQ ID NO: 63507 - DNA, 25 bp, mus musculus
tttacttatctgcactgtcaagact

SEQ ID NO: 63508 - DNA, 25 bp, mus musculus
ttacttatctgcactgtcaagactg

SEQ ID NO: 63509 - DNA, 25 bp, mus musculus
tacttatctgcactgtcaagactga

SEQ ID NO: 63510 - DNA, 25 bp, mus musculus
cttatctgcactgtcaagactgaat

SEQ ID NO: 63511 - DNA, 25 bp, mus musculus
ttatctgcactgtcaagactgaatg

SEQ ID NO: 63512 - DNA, 25 bp, mus musculus
tatctgcactgtcaagactgaatgg

SEQ ID NO: 63513 - DNA, 25 bp, mus musculus
ctgcactgtcaagactgaatggctg

SEQ ID NO: 63514 - DNA, 25 bp, mus musculus
tgcactgtcaagactgaatggctgt

SEQ ID NO: 63515 - DNA, 25 bp, mus musculus
agcatgtggtctttaccaaggtgaa

SEQ ID NO: 63516 - DNA, 25 bp, mus musculus
atgctaggaccaaacacaatcggtt

SEQ ID NO: 63517 - DNA, 25 bp, mus musculus
tgctaggaccaaacacaatcggttc

SEQ ID NO: 63518 - DNA, 25 bp, mus musculus
tcggttcccagtttacttatctgca

SEQ ID NO: 63519 - DNA, 25 bp, mus musculus
gttcccagtttacttatctgcactg

SEQ ID NO: 63520 - DNA, 25 bp, mus musculus
tcccagtttacttatctgcactgtc

SEQ ID NO: 63521 - DNA, 25 bp, mus musculus
cccagtttacttatctgcactgtca

SEQ ID NO: 63522 - DNA, 25 bp, mus musculus
ccagtttacttatctgcactgtcaa

SEQ ID NO: 63523 - DNA, 25 bp, mus musculus
cagtttacttatctgcactgtcaag

SEQ ID NO: 63524 - DNA, 25 bp, mus musculus
tttgtttctttgcctcagcagcaca

SEQ ID NO: 63525 - DNA, 25 bp, mus musculus
tctttgcctcagcagcacatcttgc

SEQ ID NO: 63526 - DNA, 25 bp, mus musculus
ctgtgcccagctatgccagcagtcc

SEQ ID NO: 63527 - DNA, 25 bp, mus musculus
ccagctatgccagcagtccaggggc

SEQ ID NO: 63528 - DNA, 25 bp, mus musculus
ccctgcctgtccttctgtagaggct

SEQ ID NO: 63529 - DNA, 25 bp, mus musculus
ctgtccttctgtagaggctgttgag

SEQ ID NO: 63530 - DNA, 25 bp, mus musculus
gactgagatcctgtgggacagtcgg

SEQ ID NO: 63531 - DNA, 25 bp, mus musculus
ttaccactgatgttttagctgatgg

SEQ ID NO: 63532 - DNA, 25 bp, mus musculus
ttttagctgatggtgactggcatag

SEQ ID NO: 63533 - DNA, 25 bp, mus musculus
ggcatagtcccaattccctatctct

SEQ ID NO: 63534 - DNA, 25 bp, mus musculus
gtcccaattccctatctctccaagt

SEQ ID NO: 63535 - DNA, 25 bp, mus musculus
tatctctccaagtaggtggtgttag

SEQ ID NO: 63536 - DNA, 25 bp, mus musculus
atcttgctactggctttagatctgt

SEQ ID NO: 63537 - DNA, 25 bp, mus musculus
ctactggctttagatctgtggtttt

SEQ ID NO: 63538 - DNA, 25 bp, mus musculus
gatctgtggttttccctctacccag

SEQ ID NO: 63539 - DNA, 25 bp, mus musculus
gccatctccccagaatgggaatttc

SEQ ID NO: 63540 - DNA, 25 bp, mus musculus
tttttgtgcgcgatacttaaggttg

SEQ ID NO: 63541 - DNA, 25 bp, mus musculus
tacaaccgacagctgatgtcaggcg

SEQ ID NO: 63542 - DNA, 25 bp, mus musculus
ctgatgtcaggcggcgcgtttttct

SEQ ID NO: 63543 - DNA, 25 bp, mus musculus
tagctatttcctctgtgcccagcta

SEQ ID NO: 63544 - DNA, 25 bp, mus musculus
tatgattttatacctgtggggctga

SEQ ID NO: 63545 - DNA, 25 bp, mus musculus
gattttatacctgtggggctgaggc

SEQ ID NO: 63546 - DNA, 25 bp, mus musculus
gtagcgagctgggcctggattcaat

SEQ ID NO: 63547 - DNA, 25 bp, mus musculus
attcaataaacacctgtgtcttaca

SEQ ID NO: 63548 - DNA, 25 bp, mus musculus
tcttacactcctgcctgtcattggg

SEQ ID NO: 63549 - DNA, 25 bp, mus musculus
tacactcctgcctgtcattgggcgg

SEQ ID NO: 63550 - DNA, 25 bp, mus musculus
gtggtaccacggagcacaaaggatg

SEQ ID NO: 63551 - DNA, 25 bp, mus musculus
gtaccacggagcacaaaggatgaca

SEQ ID NO: 63552 - DNA, 25 bp, mus musculus
aagtctttgtgcctgagtgagcaga

SEQ ID NO: 63553 - DNA, 25 bp, mus musculus
tctttgtgcctgagtgagcagaggt

SEQ ID NO: 63554 - DNA, 25 bp, mus musculus
ttgtgcctgagtgagcagaggtcct

SEQ ID NO: 63555 - DNA, 25 bp, mus musculus
accatctatcagtacagctatggtg

SEQ ID NO: 63556 - DNA, 25 bp, mus musculus
aacgactacaggctcagtattgtcc

SEQ ID NO: 63557 - DNA, 25 bp, mus musculus
gactacaggctcagtattgtcctgg

SEQ ID NO: 63558 - DNA, 25 bp, mus musculus
tacaggctcagtattgtcctggggc

SEQ ID NO: 63559 - DNA, 25 bp, mus musculus
aggctcagtattgtcctggggccag

SEQ ID NO: 63560 - DNA, 25 bp, mus musculus
ccatcccagatgtggtattggggaa

SEQ ID NO: 63561 - DNA, 25 bp, mus musculus
tcttccctgagcccttcattctgag

SEQ ID NO: 63562 - DNA, 25 bp, mus musculus
agcccttcattctgagctgtagcga

SEQ ID NO: 63563 - DNA, 25 bp, mus musculus
ccttcattctgagctgtagcgagct

SEQ ID NO: 63564 - DNA, 25 bp, mus musculus
cttgctcccaatgaaatggataaac

SEQ ID NO: 63565 - DNA, 25 bp, mus musculus
tctcctcacagaatgttgttgtgtt

SEQ ID NO: 63566 - DNA, 25 bp, mus musculus
gttaaacaccaatgatgcatgcact

SEQ ID NO: 63567 - DNA, 25 bp, mus musculus
caccaatgatgcatgcactgtccct

SEQ ID NO: 63568 - DNA, 25 bp, mus musculus
cacctctgttagggtaggtatatca

SEQ ID NO: 63569 - DNA, 25 bp, mus musculus
tattgtgcatttgtggcattatgta

SEQ ID NO: 63570 - DNA, 25 bp, mus musculus
agaattgcagtgtgcgctgccgaaa

SEQ ID NO: 63571 - DNA, 25 bp, mus musculus
attgcagtgtgcgctgccgaaaatg

SEQ ID NO: 63572 - DNA, 25 bp, mus musculus
tgcgctgccgaaaatgcaggctttt

SEQ ID NO: 63573 - DNA, 25 bp, mus musculus
gtcctctcataagtacccaatgtat

SEQ ID NO: 63574 - DNA, 25 bp, mus musculus
ctctcataagtacccaatgtatttt

SEQ ID NO: 63575 - DNA, 25 bp, mus musculus
tcataagtacccaatgtattttagc

SEQ ID NO: 63576 - DNA, 25 bp, mus musculus
tagccagactgaaagcccaccttaa

SEQ ID NO: 63577 - DNA, 25 bp, mus musculus
cagggcaggccttgttctgaactgt

SEQ ID NO: 63578 - DNA, 25 bp, mus musculus
tgttctgaactgtttgcgcttctga

SEQ ID NO: 63579 - DNA, 25 bp, mus musculus
tctgaactgtttgcgcttctgactg

SEQ ID NO: 63580 - DNA, 25 bp, mus musculus
ctgtttgcgcttctgactgttaaac

SEQ ID NO: 63581 - DNA, 25 bp, mus musculus
tttgcgcttctgactgttaaacacc

SEQ ID NO: 63582 - DNA, 25 bp, mus musculus
gcgcttctgactgttaaacaccaat

SEQ ID NO: 63583 - DNA, 25 bp, mus musculus
actgttaaacaccaatgatgcatgc

SEQ ID NO: 63584 - DNA, 25 bp, mus musculus
ctataagatggacgctccggatggc

SEQ ID NO: 63585 - DNA, 25 bp, mus musculus
gaactgctcgcacctggatgctgcc

SEQ ID NO: 63586 - DNA, 25 bp, mus musculus
ttacagatctggtgccctgctgctt

SEQ ID NO: 63587 - DNA, 25 bp, mus musculus
tggtgccctgctgcttgctgggcct

SEQ ID NO: 63588 - DNA, 25 bp, mus musculus
tgccctgctgcttgctgggcctgaa

SEQ ID NO: 63589 - DNA, 25 bp, mus musculus
cctgctgcttgctgggcctgaactt

SEQ ID NO: 63590 - DNA, 25 bp, mus musculus
gcttgctgggcctgaacttgaactg

SEQ ID NO: 63591 - DNA, 25 bp, mus musculus
taggcctggcatcttctctcatgga

SEQ ID NO: 63592 - DNA, 25 bp, mus musculus
gcctggcatcttctctcatggaccc

SEQ ID NO: 63593 - DNA, 25 bp, mus musculus
cttctctcatggacccacctatagg

SEQ ID NO: 63594 - DNA, 25 bp, mus musculus
tcatggacccacctatagggcttgg

SEQ ID NO: 63595 - DNA, 25 bp, mus musculus
ctatagggcttggggtgcccactga

SEQ ID NO: 63596 - DNA, 25 bp, mus musculus
ctcgcacctggatgctgccacacgg

SEQ ID NO: 63597 - DNA, 25 bp, mus musculus
cacgtttttgcagcttcgggaacag

SEQ ID NO: 63598 - DNA, 25 bp, mus musculus
gcagcttcgggaacagctcgagcac

SEQ ID NO: 63599 - DNA, 25 bp, mus musculus
gctcgagcacatcaagacccatgag

SEQ ID NO: 63600 - DNA, 25 bp, mus musculus
catcaagacccatgagctgcacctg

SEQ ID NO: 63601 - DNA, 25 bp, mus musculus
gacccatgagctgcacctgtgacct

SEQ ID NO: 63602 - DNA, 25 bp, mus musculus
tgagctgcacctgtgacctctgcct

SEQ ID NO: 63603 - DNA, 25 bp, mus musculus
acagggcctcggagattacagatct

SEQ ID NO: 63604 - DNA, 25 bp, mus musculus
gacaagtctctacaccaagccattg

SEQ ID NO: 63605 - DNA, 25 bp, mus musculus
tctctacaccaagccattgagggtg

SEQ ID NO: 63606 - DNA, 25 bp, mus musculus
actgtccatccagctggggcactct

SEQ ID NO: 63607 - DNA, 25 bp, mus musculus
catccagctggggcactctctagcc

SEQ ID NO: 63608 - DNA, 25 bp, mus musculus
tctagccattgaggtcccaggcggt

SEQ ID NO: 63609 - DNA, 25 bp, mus musculus
ctggtgaaccacggccatataatgc

SEQ ID NO: 63610 - DNA, 25 bp, mus musculus
aaccacggccatataatgcattcaa

SEQ ID NO: 63611 - DNA, 25 bp, mus musculus
ataatgcattcaactctgatcccct

SEQ ID NO: 63612 - DNA, 25 bp, mus musculus
ctccacataaccctgcctgacttga

SEQ ID NO: 63613 - DNA, 25 bp, mus musculus
ctgcctgacttgagctttgtcacat

SEQ ID NO: 63614 - DNA, 25 bp, mus musculus
agctttgtcacatctcaagacatac

SEQ ID NO: 63615 - DNA, 25 bp, mus musculus
gtcacatctcaagacataccaactc

SEQ ID NO: 63616 - DNA, 25 bp, mus musculus
caccaagccattgagggtgacacct

SEQ ID NO: 63617 - DNA, 25 bp, mus musculus
ctcaagacataccaactctgtctat

SEQ ID NO: 63618 - DNA, 25 bp, mus musculus
gacacctctggagacttcatgaagg

SEQ ID NO: 63619 - DNA, 25 bp, mus musculus
gctttgcttgctctgtgtggcggag

SEQ ID NO: 63620 - DNA, 25 bp, mus musculus
taaggctcctgacctcagagggccc

SEQ ID NO: 63621 - DNA, 25 bp, mus musculus
gccgtgacctgaccaagccattgct

SEQ ID NO: 63622 - DNA, 25 bp, mus musculus
acctgaccaagccattgctccagct

SEQ ID NO: 63623 - DNA, 25 bp, mus musculus
ccaagccattgctccagcttcaggg

SEQ ID NO: 63624 - DNA, 25 bp, mus musculus
cattgctccagcttcagggtctaag

SEQ ID NO: 63625 - DNA, 25 bp, mus musculus
ctgtatccccgaggtctacagatcg

SEQ ID NO: 63626 - DNA, 25 bp, mus musculus
cgaggtctacagatcgcccagtaat

SEQ ID NO: 63627 - DNA, 25 bp, mus musculus
gcccagtaatgtcatccaagtctat

SEQ ID NO: 63628 - DNA, 25 bp, mus musculus
ataagccaatggctgtacggtgaaa

SEQ ID NO: 63629 - DNA, 25 bp, mus musculus
taagccaatggctgtacggtgaaat

SEQ ID NO: 63630 - DNA, 25 bp, mus musculus
gatcagccagactaaccgccatcct

SEQ ID NO: 63631 - DNA, 25 bp, mus musculus
atcagccagactaaccgccatcctg

SEQ ID NO: 63632 - DNA, 25 bp, mus musculus
cagccagactaaccgccatcctgag

SEQ ID NO: 63633 - DNA, 25 bp, mus musculus
agccagactaaccgccatcctgaga

SEQ ID NO: 63634 - DNA, 25 bp, mus musculus
ccagactaaccgccatcctgagata

SEQ ID NO: 63635 - DNA, 25 bp, mus musculus
cagactaaccgccatcctgagatac

SEQ ID NO: 63636 - DNA, 25 bp, mus musculus
actaaccgccatcctgagatacatc

SEQ ID NO: 63637 - DNA, 25 bp, mus musculus
aggtctacagatcgcccagtaatgt

SEQ ID NO: 63638 - DNA, 25 bp, mus musculus
tctacagatcgcccagtaatgtcat

SEQ ID NO: 63639 - DNA, 25 bp, mus musculus
ctacagatcgcccagtaatgtcatc

SEQ ID NO: 63640 - DNA, 25 bp, mus musculus
acagatcgcccagtaatgtcatcca

SEQ ID NO: 63641 - DNA, 25 bp, mus musculus
cagatcgcccagtaatgtcatccaa

SEQ ID NO: 63642 - DNA, 25 bp, mus musculus
gatcgcccagtaatgtcatccaagt

SEQ ID NO: 63643 - DNA, 25 bp, mus musculus
atcgcccagtaatgtcatccaagtc

SEQ ID NO: 63644 - DNA, 25 bp, mus musculus
cgcccagtaatgtcatccaagtcta

SEQ ID NO: 63645 - DNA, 25 bp, mus musculus
agaacagcgcttcaacagcttcctg

SEQ ID NO: 63646 - DNA, 25 bp, mus musculus
acagcgcttcaacagcttcctggaa

SEQ ID NO: 63647 - DNA, 25 bp, mus musculus
actccaggtctctacagagtgacca

SEQ ID NO: 63648 - DNA, 25 bp, mus musculus
ccaggtctctacagagtgaccataa

SEQ ID NO: 63649 - DNA, 25 bp, mus musculus
ctctacagagtgaccataaggacat

SEQ ID NO: 63650 - DNA, 25 bp, mus musculus
accgaattcggccgattcagcttgg

SEQ ID NO: 63651 - DNA, 25 bp, mus musculus
gaattcggccgattcagcttggact

SEQ ID NO: 63652 - DNA, 25 bp, mus musculus
ttcggccgattcagcttggacttaa

SEQ ID NO: 63653 - DNA, 25 bp, mus musculus
ggccgattcagcttggacttaacca

SEQ ID NO: 63654 - DNA, 25 bp, mus musculus
cgattcagcttggacttaaccaggc

SEQ ID NO: 63655 - DNA, 25 bp, mus musculus
agcttggacttaaccaggctgaact

SEQ ID NO: 63656 - DNA, 25 bp, mus musculus
ttggacttaaccaggctgaacttgc

SEQ ID NO: 63657 - DNA, 25 bp, mus musculus
cttcaacagcttcctggaagccctt

SEQ ID NO: 63658 - DNA, 25 bp, mus musculus
tggacttaaccaggctgaacttgct

SEQ ID NO: 63659 - DNA, 25 bp, mus musculus
caacagcttcctggaagcccttcga

SEQ ID NO: 63660 - DNA, 25 bp, mus musculus
cagcttcctggaagcccttcgagag

SEQ ID NO: 63661 - DNA, 25 bp, mus musculus
aatccaagagtgccagctctgtgct

SEQ ID NO: 63662 - DNA, 25 bp, mus musculus
tggcagcatccctgaggccgtgcag

SEQ ID NO: 63663 - DNA, 25 bp, mus musculus
acgtcatcctagcagacaacttggg

SEQ ID NO: 63664 - DNA, 25 bp, mus musculus
gaatgagtcactccaggtctctaca

SEQ ID NO: 63665 - DNA, 25 bp, mus musculus
tgagtcactccaggtctctacagag

SEQ ID NO: 63666 - DNA, 25 bp, mus musculus
cagggtgcacctgcatctaagtcct

SEQ ID NO: 63667 - DNA, 25 bp, mus musculus
gcacctgcatctaagtcctgttgca

SEQ ID NO: 63668 - DNA, 25 bp, mus musculus
tctctatgtagactgggctggcctc

SEQ ID NO: 63669 - DNA, 25 bp, mus musculus
tctgtgtcctgagttctgagttaat

SEQ ID NO: 63670 - DNA, 25 bp, mus musculus
taagcaagcaccatcacacagggac

SEQ ID NO: 63671 - DNA, 25 bp, mus musculus
agcaccatcacacagggacttagag

SEQ ID NO: 63672 - DNA, 25 bp, mus musculus
aaagtctatcgagtctagcctaata

SEQ ID NO: 63673 - DNA, 25 bp, mus musculus
tatcgagtctagcctaatattctag

SEQ ID NO: 63674 - DNA, 25 bp, mus musculus
gtctagcctaatattctagacttca

SEQ ID NO: 63675 - DNA, 25 bp, mus musculus
cctaatattctagacttcatatact

SEQ ID NO: 63676 - DNA, 25 bp, mus musculus
attctagacttcatatactgacttg

SEQ ID NO: 63677 - DNA, 25 bp, mus musculus
gacttcatatactgacttgataatt

SEQ ID NO: 63678 - DNA, 25 bp, mus musculus
gcatctaagtcctgttgcatccagt

SEQ ID NO: 63679 - DNA, 25 bp, mus musculus
aagtcctgttgcatccagtagctga

SEQ ID NO: 63680 - DNA, 25 bp, mus musculus
atccagtagctgactgcactgcagc

SEQ ID NO: 63681 - DNA, 25 bp, mus musculus
gaggtcaccctggcactggacagtt

SEQ ID NO: 63682 - DNA, 25 bp, mus musculus
gtggcaaacacagcaggcatctata

SEQ ID NO: 63683 - DNA, 25 bp, mus musculus
aacacagcaggcatctatatcatca

SEQ ID NO: 63684 - DNA, 25 bp, mus musculus
atctatatcatcaaatggtcttaga

SEQ ID NO: 63685 - DNA, 25 bp, mus musculus
tggaactctctatgtagactgggct

SEQ ID NO: 63686 - DNA, 25 bp, mus musculus
agagtccgtccagctgcgttctctt

SEQ ID NO: 63687 - DNA, 25 bp, mus musculus
tcttctaggtcgccagctccaaatg

SEQ ID NO: 63688 - DNA, 25 bp, mus musculus
catgtgtactcgaactgagcgctgg

SEQ ID NO: 63689 - DNA, 25 bp, mus musculus
tactcgaactgagcgctggtttttc

SEQ ID NO: 63690 - DNA, 25 bp, mus musculus
gaaaccggaaagctcctcagactct

SEQ ID NO: 63691 - DNA, 25 bp, mus musculus
ggaaagctcctcagactctgttttg

SEQ ID NO: 63692 - DNA, 25 bp, mus musculus
aagctcctcagactctgttttgtgg

SEQ ID NO: 63693 - DNA, 25 bp, mus musculus
ctcctcagactctgttttgtggctg

SEQ ID NO: 63694 - DNA, 25 bp, mus musculus
gagtcagcagcgagccctggaaggt

SEQ ID NO: 63695 - DNA, 25 bp, mus musculus
agccctggaaggtcccatggtctgt

SEQ ID NO: 63696 - DNA, 25 bp, mus musculus
ggaaggtcccatggtctgttaacat

SEQ ID NO: 63697 - DNA, 25 bp, mus musculus
aggtcccatggtctgttaacattca

SEQ ID NO: 63698 - DNA, 25 bp, mus musculus
tctaggtcgccagctccaaatgtcc

SEQ ID NO: 63699 - DNA, 25 bp, mus musculus
aggtcgccagctccaaatgtccagg

SEQ ID NO: 63700 - DNA, 25 bp, mus musculus
gctccaaatgtccaggccagaatga

SEQ ID NO: 63701 - DNA, 25 bp, mus musculus
ccaaatgtccaggccagaatgacgt

SEQ ID NO: 63702 - DNA, 25 bp, mus musculus
gtccaggccagaatgacgtgaaaag

SEQ ID NO: 63703 - DNA, 25 bp, mus musculus
gctacctgtgtaatccatgtgtact

SEQ ID NO: 63704 - DNA, 25 bp, mus musculus
acctgtgtaatccatgtgtactcga

SEQ ID NO: 63705 - DNA, 25 bp, mus musculus
atccatgtgtactcgaactgagcgc

SEQ ID NO: 63706 - DNA, 25 bp, mus musculus
aagctcttcacacgttcaagtcacg

SEQ ID NO: 63707 - DNA, 25 bp, mus musculus
ttcacacgttcaagtcacgacagca

SEQ ID NO: 63708 - DNA, 25 bp, mus musculus
gcaacatcttaatgcccagctggcg

SEQ ID NO: 63709 - DNA, 25 bp, mus musculus
gctggcgcaacagcccgctgtttgc

SEQ ID NO: 63710 - DNA, 25 bp, mus musculus
ttggactgcttccatgttagtaacc

SEQ ID NO: 63711 - DNA, 25 bp, mus musculus
catgttagtaaccgctcctcaagag

SEQ ID NO: 63712 - DNA, 25 bp, mus musculus
tgaaaggctattccctctcatccaa

SEQ ID NO: 63713 - DNA, 25 bp, mus musculus
taagatcacgggcatgttgctggac

SEQ ID NO: 63714 - DNA, 25 bp, mus musculus
ggaaccacttcgtatgcttgaatct

SEQ ID NO: 63715 - DNA, 25 bp, mus musculus
acttcgtatgcttgaatctccagtg

SEQ ID NO: 63716 - DNA, 25 bp, mus musculus
ggctgcccagaaagctgttggcagt

SEQ ID NO: 63717 - DNA, 25 bp, mus musculus
agctgttggcagtacctctggtgtc

SEQ ID NO: 63718 - DNA, 25 bp, mus musculus
agtcacgacagcacatcgcattact

SEQ ID NO: 63719 - DNA, 25 bp, mus musculus
gacagcacatcgcattactaacaca

SEQ ID NO: 63720 - DNA, 25 bp, mus musculus
acatcgcattactaacacatcagca

SEQ ID NO: 63721 - DNA, 25 bp, mus musculus
cattactaacacatcagcacagata

SEQ ID NO: 63722 - DNA, 25 bp, mus musculus
agctacagcgactcctgttcactcg

SEQ ID NO: 63723 - DNA, 25 bp, mus musculus
tcactcgattccacagtacaagtat

SEQ ID NO: 63724 - DNA, 25 bp, mus musculus
gattccacagtacaagtatgctgca

SEQ ID NO: 63725 - DNA, 25 bp, mus musculus
ccagaactcccagcaacatcttaat

SEQ ID NO: 63726 - DNA, 25 bp, mus musculus
gcatcttcaagtgccaaaagtttaa

SEQ ID NO: 63727 - DNA, 25 bp, mus musculus
atacttctgctatacactaaatata

SEQ ID NO: 63728 - DNA, 25 bp, mus musculus
ctttcccatgatattcacccagaaa

SEQ ID NO: 63729 - DNA, 25 bp, mus musculus
tcatatgtacgtatctgcaactcat

SEQ ID NO: 63730 - DNA, 25 bp, mus musculus
gtacgtatctgcaactcatctataa

SEQ ID NO: 63731 - DNA, 25 bp, mus musculus
atctgcaactcatctataattagga

SEQ ID NO: 63732 - DNA, 25 bp, mus musculus
tgcaactcatctataattaggacta

SEQ ID NO: 63733 - DNA, 25 bp, mus musculus
aactcatctataattaggactacat

SEQ ID NO: 63734 - DNA, 25 bp, mus musculus
acttacacactgctatctgttgtat

SEQ ID NO: 63735 - DNA, 25 bp, mus musculus
tacacactgctatctgttgtataaa

SEQ ID NO: 63736 - DNA, 25 bp, mus musculus
ttatctttctatcactgtaacaaaa

SEQ ID NO: 63737 - DNA, 25 bp, mus musculus
cactgtaacaaaatacctgagataa

SEQ ID NO: 63738 - DNA, 25 bp, mus musculus
attgtatagcagtcttcagtgctta

SEQ ID NO: 63739 - DNA, 25 bp, mus musculus
gtatagcagtcttcagtgcttacag

SEQ ID NO: 63740 - DNA, 25 bp, mus musculus
tagcagtcttcagtgcttacagtat

SEQ ID NO: 63741 - DNA, 25 bp, mus musculus
tgtttcctaaagtcagatgatgtct

SEQ ID NO: 63742 - DNA, 25 bp, mus musculus
caaattgttgtcctctgtttaatga

SEQ ID NO: 63743 - DNA, 25 bp, mus musculus
tatgagtcttccatactttcccatg

SEQ ID NO: 63744 - DNA, 25 bp, mus musculus
tcttccatactttcccatgatattc

SEQ ID NO: 63745 - DNA, 25 bp, mus musculus
atactttcccatgatattcacccag

SEQ ID NO: 63746 - DNA, 25 bp, mus musculus
attgttaactacatcatgtgaactt

SEQ ID NO: 63747 - DNA, 25 bp, mus musculus
gttaactacatcatgtgaacttaag

SEQ ID NO: 63748 - DNA, 25 bp, mus musculus
cactaatttgtccaataatggaatt

SEQ ID NO: 63749 - DNA, 25 bp, mus musculus
aattaacgtcttctcatctgtttga

SEQ ID NO: 63750 - DNA, 25 bp, mus musculus
cttctcatctgtttgaggaagatct

SEQ ID NO: 63751 - DNA, 25 bp, mus musculus
gagtacatggctccaggcttacttt

SEQ ID NO: 63752 - DNA, 25 bp, mus musculus
tacatggctccaggcttactttata

SEQ ID NO: 63753 - DNA, 25 bp, mus musculus
atggctccaggcttactttatatac

SEQ ID NO: 63754 - DNA, 25 bp, mus musculus
gctccaggcttactttatatactgc

SEQ ID NO: 63755 - DNA, 25 bp, mus musculus
ctttatatactgcctgtatttgtgg

SEQ ID NO: 63756 - DNA, 25 bp, mus musculus
tatatactgcctgtatttgtggctt

SEQ ID NO: 63757 - DNA, 25 bp, mus musculus
atactgcctgtatttgtggctttaa

SEQ ID NO: 63758 - DNA, 25 bp, mus musculus
agtgtcagttttccctcatcctcga

SEQ ID NO: 63759 - DNA, 25 bp, mus musculus
tcatcctcgatcatagtccttcccg

SEQ ID NO: 63760 - DNA, 25 bp, mus musculus
atcatagtccttcccgtgaagcagg

SEQ ID NO: 63761 - DNA, 25 bp, mus musculus
ccaccagatagtcccctgtctgctt

SEQ ID NO: 63762 - DNA, 25 bp, mus musculus
gatagtcccctgtctgctttaacct

SEQ ID NO: 63763 - DNA, 25 bp, mus musculus
ctgtctgctttaacctaccagttag

SEQ ID NO: 63764 - DNA, 25 bp, mus musculus
tttgttcactaatttgtccaataat

SEQ ID NO: 63765 - DNA, 25 bp, mus musculus
gttcactaatttgtccaataatgga

SEQ ID NO: 63766 - DNA, 25 bp, mus musculus
tgactgcctgcctcacttacggcaa

SEQ ID NO: 63767 - DNA, 25 bp, mus musculus
cctgcctcacttacggcaacagctg

SEQ ID NO: 63768 - DNA, 25 bp, mus musculus
actaccgtgagtacctgcgtggccg

SEQ ID NO: 63769 - DNA, 25 bp, mus musculus
agtacctgcgtggccgccagcggtc

SEQ ID NO: 63770 - DNA, 25 bp, mus musculus
gccgccagcggtcactgggtagcag

SEQ ID NO: 63771 - DNA, 25 bp, mus musculus
gcccatggagtgctggcagcttcct

SEQ ID NO: 63772 - DNA, 25 bp, mus musculus
aggactcgggccgctcactgtcctc

SEQ ID NO: 63773 - DNA, 25 bp, mus musculus
ccaacagccaacaggccacagagac

SEQ ID NO: 63774 - DNA, 25 bp, mus musculus
acagccaacaggccacagagaccct

SEQ ID NO: 63775 - DNA, 25 bp, mus musculus
gccaacaggccacagagaccctcgt

SEQ ID NO: 63776 - DNA, 25 bp, mus musculus
tcgtgctgtctccagttccccctaa

SEQ ID NO: 63777 - DNA, 25 bp, mus musculus
tgctgtctccagttccccctaatgg

SEQ ID NO: 63778 - DNA, 25 bp, mus musculus
tcacttacggcaacagctgcatcaa

SEQ ID NO: 63779 - DNA, 25 bp, mus musculus
cttacggcaacagctgcatcaatcc

SEQ ID NO: 63780 - DNA, 25 bp, mus musculus
acggcaacagctgcatcaatccctt

SEQ ID NO: 63781 - DNA, 25 bp, mus musculus
tcctctacactctgctcaccaagaa

SEQ ID NO: 63782 - DNA, 25 bp, mus musculus
acactctgctcaccaagaactaccg

SEQ ID NO: 63783 - DNA, 25 bp, mus musculus
ctctgctcaccaagaactaccgtga

SEQ ID NO: 63784 - DNA, 25 bp, mus musculus
ccaagaactaccgtgagtacctgcg

SEQ ID NO: 63785 - DNA, 25 bp, mus musculus
agaactaccgtgagtacctgcgtgg

SEQ ID NO: 63786 - DNA, 25 bp, mus musculus
aatgaaataacctctagcattagaa

SEQ ID NO: 63787 - DNA, 25 bp, mus musculus
ataacctctagcattagaaacacat

SEQ ID NO: 63788 - DNA, 25 bp, mus musculus
gcctgtagctgatcttgcccctaac

SEQ ID NO: 63789 - DNA, 25 bp, mus musculus
tcttgcccctaactgtgaattgtcc

SEQ ID NO: 63790 - DNA, 25 bp, mus musculus
attgtcccagcatgacctaaaaagc

SEQ ID NO: 63791 - DNA, 25 bp, mus musculus
ctgcgtgtgtttccttacaggtgcc

SEQ ID NO: 63792 - DNA, 25 bp, mus musculus
gtgtttccttacaggtgcctttcat

SEQ ID NO: 63793 - DNA, 25 bp, mus musculus
aggtgcctttcattatctcaagcca

SEQ ID NO: 63794 - DNA, 25 bp, mus musculus
ctttcattatctcaagccagatatt

SEQ ID NO: 63795 - DNA, 25 bp, mus musculus
ttatctcaagccagatattgcataa

SEQ ID NO: 63796 - DNA, 25 bp, mus musculus
ctgtccacttggagccctgtttccg

SEQ ID NO: 63797 - DNA, 25 bp, mus musculus
ggcctccacagactagacatgaaga

SEQ ID NO: 63798 - DNA, 25 bp, mus musculus
aacacatgttcttaatgaggtcagc

SEQ ID NO: 63799 - DNA, 25 bp, mus musculus
tgttcttaatgaggtcagcgccagg

SEQ ID NO: 63800 - DNA, 25 bp, mus musculus
taatgaggtcagcgccaggatcata

SEQ ID NO: 63801 - DNA, 25 bp, mus musculus
ggtcagcgccaggatcatatgggga

SEQ ID NO: 63802 - DNA, 25 bp, mus musculus
tattagtctcgatcctttgataccg

SEQ ID NO: 63803 - DNA, 25 bp, mus musculus
tctcgatcctttgataccgtggtat

SEQ ID NO: 63804 - DNA, 25 bp, mus musculus
atgacattgtcagcctgtagctgat

SEQ ID NO: 63805 - DNA, 25 bp, mus musculus
ttgtcagcctgtagctgatcttgcc

SEQ ID NO: 63806 - DNA, 25 bp, mus musculus
cactgcctgggacacagccattgcg

SEQ ID NO: 63807 - DNA, 25 bp, mus musculus
cacagccattgcgcctctggatggt

SEQ ID NO: 63808 - DNA, 25 bp, mus musculus
ccactgagcatgcaccattttgtaa

SEQ ID NO: 63809 - DNA, 25 bp, mus musculus
actgagcatgcaccattttgtaagg

SEQ ID NO: 63810 - DNA, 25 bp, mus musculus
tgagcatgcaccattttgtaaggaa

SEQ ID NO: 63811 - DNA, 25 bp, mus musculus
agcatgcaccattttgtaaggaaga

SEQ ID NO: 63812 - DNA, 25 bp, mus musculus
catgcaccattttgtaaggaagaaa

SEQ ID NO: 63813 - DNA, 25 bp, mus musculus
tgcaccattttgtaaggaagaaatt

SEQ ID NO: 63814 - DNA, 25 bp, mus musculus
gaagaaattcctcaagctggccctc

SEQ ID NO: 63815 - DNA, 25 bp, mus musculus
tcctcaagctggccctccgggaact

SEQ ID NO: 63816 - DNA, 25 bp, mus musculus
gaattccgttgcaagacttgtggtt

SEQ ID NO: 63817 - DNA, 25 bp, mus musculus
tccgttgcaagacttgtggttacag

SEQ ID NO: 63818 - DNA, 25 bp, mus musculus
cagccattgcgcctctggatggtga

SEQ ID NO: 63819 - DNA, 25 bp, mus musculus
gccattgcgcctctggatggtgagg

SEQ ID NO: 63820 - DNA, 25 bp, mus musculus
cattgcgcctctggatggtgaggag

SEQ ID NO: 63821 - DNA, 25 bp, mus musculus
ttgcgcctctggatggtgaggagct

SEQ ID NO: 63822 - DNA, 25 bp, mus musculus
gcgcctctggatggtgaggagctca

SEQ ID NO: 63823 - DNA, 25 bp, mus musculus
aagatgtgccactgagcatgcacca

SEQ ID NO: 63824 - DNA, 25 bp, mus musculus
tgtgccactgagcatgcaccatttt

SEQ ID NO: 63825 - DNA, 25 bp, mus musculus
tgccactgagcatgcaccattttgt

SEQ ID NO: 63826 - DNA, 25 bp, mus musculus
taccaccttgagcctctactacctg

SEQ ID NO: 63827 - DNA, 25 bp, mus musculus
gcatctttctggggattcagctgac

SEQ ID NO: 63828 - DNA, 25 bp, mus musculus
agccttgccaattcaagtgtgcttt

SEQ ID NO: 63829 - DNA, 25 bp, mus musculus
tcaagtgtgctttctgcagttccag

SEQ ID NO: 63830 - DNA, 25 bp, mus musculus
actgaagagacccccaaggccagca

SEQ ID NO: 63831 - DNA, 25 bp, mus musculus
cccaaggccagcaacaagattccct

SEQ ID NO: 63832 - DNA, 25 bp, mus musculus
cacatacaacctcactgtaaatacc

SEQ ID NO: 63833 - DNA, 25 bp, mus musculus
tgaaactctgtttcggtcaagcttt

SEQ ID NO: 63834 - DNA, 25 bp, mus musculus
tctgtttcggtcaagctttcctctt

SEQ ID NO: 63835 - DNA, 25 bp, mus musculus
gtctttggtctctgaaatatctccc

SEQ ID NO: 63836 - DNA, 25 bp, mus musculus
tgaaatatctccctactatgttggg

SEQ ID NO: 63837 - DNA, 25 bp, mus musculus
cctccattaccacatgactcaataa

SEQ ID NO: 63838 - DNA, 25 bp, mus musculus
agctgaccttctatttccagttgct

SEQ ID NO: 63839 - DNA, 25 bp, mus musculus
atgactcaataaaccattactcttg

SEQ ID NO: 63840 - DNA, 25 bp, mus musculus
ccttctatttccagttgctgtgcat

SEQ ID NO: 63841 - DNA, 25 bp, mus musculus
atttccagttgctgtgcatttacaa

SEQ ID NO: 63842 - DNA, 25 bp, mus musculus
agttgctgtgcatttacaagcaccc

SEQ ID NO: 63843 - DNA, 25 bp, mus musculus
ccttagcctctcaaccagtggctac

SEQ ID NO: 63844 - DNA, 25 bp, mus musculus
tggctacccctttggcagcagcgaa

SEQ ID NO: 63845 - DNA, 25 bp, mus musculus
cccctttggcagcagcgaacctgtc

SEQ ID NO: 63846 - DNA, 25 bp, mus musculus
aggctctacgtagaacataggaagc

SEQ ID NO: 63847 - DNA, 25 bp, mus musculus
cgattaattgtcccaatggttcagc

SEQ ID NO: 63848 - DNA, 25 bp, mus musculus
ttaattgtcccaatggttcagcgcc

SEQ ID NO: 63849 - DNA, 25 bp, mus musculus
gttgtaccctttgccgcacacatag

SEQ ID NO: 63850 - DNA, 25 bp, mus musculus
tgtaccctttgccgcacacatagtt

SEQ ID NO: 63851 - DNA, 25 bp, mus musculus
gtaccctttgccgcacacatagttt

SEQ ID NO: 63852 - DNA, 25 bp, mus musculus
accctttgccgcacacatagtttag

SEQ ID NO: 63853 - DNA, 25 bp, mus musculus
ccctttgccgcacacatagtttaga

SEQ ID NO: 63854 - DNA, 25 bp, mus musculus
ctttgccgcacacatagtttagacg

SEQ ID NO: 63855 - DNA, 25 bp, mus musculus
tttgccgcacacatagtttagacga

SEQ ID NO: 63856 - DNA, 25 bp, mus musculus
tgccgcacacatagtttagacgaag

SEQ ID NO: 63857 - DNA, 25 bp, mus musculus
gccgcacacatagtttagacgaaga

SEQ ID NO: 63858 - DNA, 25 bp, mus musculus
cgcacacatagtttagacgaagagc

SEQ ID NO: 63859 - DNA, 25 bp, mus musculus
taattgtcccaatggttcagcgccg

SEQ ID NO: 63860 - DNA, 25 bp, mus musculus
attgtcccaatggttcagcgccgct

SEQ ID NO: 63861 - DNA, 25 bp, mus musculus
agcgccgctgtgtgtctcggataca

SEQ ID NO: 63862 - DNA, 25 bp, mus musculus
cgccgctgtgtgtctcggatacatg

SEQ ID NO: 63863 - DNA, 25 bp, mus musculus
gccgctgtgtgtctcggatacatgc

SEQ ID NO: 63864 - DNA, 25 bp, mus musculus
tctcggatacatgcgcccgctgtgc

SEQ ID NO: 63865 - DNA, 25 bp, mus musculus
ggatacatgcgcccgctgtgcgcgt

SEQ ID NO: 63866 - DNA, 25 bp, mus musculus
cgttgtaccctttgccgcacacata

SEQ ID NO: 63867 - DNA, 25 bp, mus musculus
tgagcctgttcacctaacgtttgct

SEQ ID NO: 63868 - DNA, 25 bp, mus musculus
tgttcacctaacgtttgctctgagg

SEQ ID NO: 63869 - DNA, 25 bp, mus musculus
tttggctcccaagattgaagatgag

SEQ ID NO: 63870 - DNA, 25 bp, mus musculus
atcttaggcattgctagaaattgag

SEQ ID NO: 63871 - DNA, 25 bp, mus musculus
tcctgagatgccagcgtgtcctgag

SEQ ID NO: 63872 - DNA, 25 bp, mus musculus
agcgtgtcctgaggtcttttctgtc

SEQ ID NO: 63873 - DNA, 25 bp, mus musculus
tcctgaggtcttttctgtcaccaag

SEQ ID NO: 63874 - DNA, 25 bp, mus musculus
caccaagtttgtacctgagtattct

SEQ ID NO: 63875 - DNA, 25 bp, mus musculus
cattctccataatttgcttaaagaa

SEQ ID NO: 63876 - DNA, 25 bp, mus musculus
aatgtttctgctttacaaatactgg

SEQ ID NO: 63877 - DNA, 25 bp, mus musculus
tctgctttacaaatactggtgattt

SEQ ID NO: 63878 - DNA, 25 bp, mus musculus
ttccatcaatgatcttgacgctaaa

SEQ ID NO: 63879 - DNA, 25 bp, mus musculus
gtttgctctgaggtacctgaacttt

SEQ ID NO: 63880 - DNA, 25 bp, mus musculus
cactccactgtctcctacagtaaca

SEQ ID NO: 63881 - DNA, 25 bp, mus musculus
actgtctcctacagtaacactcagt

SEQ ID NO: 63882 - DNA, 25 bp, mus musculus
actcagtatgtctgcagatgtgccc

SEQ ID NO: 63883 - DNA, 25 bp, mus musculus
tatgtctgcagatgtgccccttgtt

SEQ ID NO: 63884 - DNA, 25 bp, mus musculus
tgcagatgtgccccttgttgtagag

SEQ ID NO: 63885 - DNA, 25 bp, mus musculus
tgtgccccttgttgtagagtataaa

SEQ ID NO: 63886 - DNA, 25 bp, mus musculus
gtattatttggctcccaagattgaa

SEQ ID NO: 63887 - DNA, 25 bp, mus musculus
gccgccagaatctcaagccggaaat

SEQ ID NO: 63888 - DNA, 25 bp, mus musculus
cgccagaatctcaagccggaaattc

SEQ ID NO: 63889 - DNA, 25 bp, mus musculus
agtcccctgagcactgcatggagca

SEQ ID NO: 63890 - DNA, 25 bp, mus musculus
ccctgagcactgcatggagcagatc

SEQ ID NO: 63891 - DNA, 25 bp, mus musculus
ctgagcactgcatggagcagatcca

SEQ ID NO: 63892 - DNA, 25 bp, mus musculus
gagcagatccaggctgggcacactg

SEQ ID NO: 63893 - DNA, 25 bp, mus musculus
agatccaggctgggcacactgacgc

SEQ ID NO: 63894 - DNA, 25 bp, mus musculus
gctgggcacactgacgctgtgactc

SEQ ID NO: 63895 - DNA, 25 bp, mus musculus
tgtatgctgaggaggacaggagcaa

SEQ ID NO: 63896 - DNA, 25 bp, mus musculus
agcaattcctactttgtggtggctg

SEQ ID NO: 63897 - DNA, 25 bp, mus musculus
caattcctactttgtggtggctgtg

SEQ ID NO: 63898 - DNA, 25 bp, mus musculus
attcctactttgtggtggctgtggc

SEQ ID NO: 63899 - DNA, 25 bp, mus musculus
ccagaatctcaagccggaaattcag

SEQ ID NO: 63900 - DNA, 25 bp, mus musculus
agaatctcaagccggaaattcagtg

SEQ ID NO: 63901 - DNA, 25 bp, mus musculus
aatctcaagccggaaattcagtgtg

SEQ ID NO: 63902 - DNA, 25 bp, mus musculus
tctcaagccggaaattcagtgtgtg

SEQ ID NO: 63903 - DNA, 25 bp, mus musculus
gaaattcagtgtgtgtcggccgagt

SEQ ID NO: 63904 - DNA, 25 bp, mus musculus
aattcagtgtgtgtcggccgagtcc

SEQ ID NO: 63905 - DNA, 25 bp, mus musculus
ttcagtgtgtgtcggccgagtcccc

SEQ ID NO: 63906 - DNA, 25 bp, mus musculus
gccgagtcccctgagcactgcatgg

SEQ ID NO: 63907 - DNA, 25 bp, mus musculus
aaggctatgcacactggtagaagat

SEQ ID NO: 63908 - DNA, 25 bp, mus musculus
aagcaatgccatagctttttcatga

SEQ ID NO: 63909 - DNA, 25 bp, mus musculus
gtctcttttctagtaacttgtgtga

SEQ ID NO: 63910 - DNA, 25 bp, mus musculus
tttctagtaacttgtgtgacagggg

SEQ ID NO: 63911 - DNA, 25 bp, mus musculus
gccagctggtcagtcgcccttttga

SEQ ID NO: 63912 - DNA, 25 bp, mus musculus
tggtcagtcgcccttttgagaccac

SEQ ID NO: 63913 - DNA, 25 bp, mus musculus
cttttgagaccactcctttgtgctc

SEQ ID NO: 63914 - DNA, 25 bp, mus musculus
tgtgctccaccatgtttgttaatcc

SEQ ID NO: 63915 - DNA, 25 bp, mus musculus
ccaccatgtttgttaatccctctct

SEQ ID NO: 63916 - DNA, 25 bp, mus musculus
cctctctgctttccttagcgagtaa

SEQ ID NO: 63917 - DNA, 25 bp, mus musculus
tgctttccttagcgagtaacacttg

SEQ ID NO: 63918 - DNA, 25 bp, mus musculus
ccttagcgagtaacacttggtgctt

SEQ ID NO: 63919 - DNA, 25 bp, mus musculus
tgccatagctttttcatgaattatt

SEQ ID NO: 63920 - DNA, 25 bp, mus musculus
gtttatctacccacttgttctaatg

SEQ ID NO: 63921 - DNA, 25 bp, mus musculus
ctacccacttgttctaatgacctat

SEQ ID NO: 63922 - DNA, 25 bp, mus musculus
acttgttctaatgacctatagactc

SEQ ID NO: 63923 - DNA, 25 bp, mus musculus
tctaatgacctatagactctttgat

SEQ ID NO: 63924 - DNA, 25 bp, mus musculus
gacctatagactctttgatacatag

SEQ ID NO: 63925 - DNA, 25 bp, mus musculus
ctttgatacatagtctcttttctag

SEQ ID NO: 63926 - DNA, 25 bp, mus musculus
tacatagtctcttttctagtaactt

SEQ ID NO: 63927 - DNA, 25 bp, mus musculus
agtggatacatctctcggtgctaca

SEQ ID NO: 63928 - DNA, 25 bp, mus musculus
gctccctacaggtgtagaccccaca

SEQ ID NO: 63929 - DNA, 25 bp, mus musculus
gaatcacattacgagatcttacgag

SEQ ID NO: 63930 - DNA, 25 bp, mus musculus
aatcacattacgagatcttacgagg

SEQ ID NO: 63931 - DNA, 25 bp, mus musculus
tcacattacgagatcttacgaggac

SEQ ID NO: 63932 - DNA, 25 bp, mus musculus
cacattacgagatcttacgaggaca

SEQ ID NO: 63933 - DNA, 25 bp, mus musculus
cattacgagatcttacgaggacaga

SEQ ID NO: 63934 - DNA, 25 bp, mus musculus
attacgagatcttacgaggacagag

SEQ ID NO: 63935 - DNA, 25 bp, mus musculus
tcttacgaggacagagcccgaaatt

SEQ ID NO: 63936 - DNA, 25 bp, mus musculus
gaaatcagaacggtctggagcacag

SEQ ID NO: 63937 - DNA, 25 bp, mus musculus
aatcagaacggtctggagcacagta

SEQ ID NO: 63938 - DNA, 25 bp, mus musculus
agaacggtctggagcacagtaggaa

SEQ ID NO: 63939 - DNA, 25 bp, mus musculus
cacactagtgtcatattcactatcc

SEQ ID NO: 63940 - DNA, 25 bp, mus musculus
gtgtcatattcactatccactgagg

SEQ ID NO: 63941 - DNA, 25 bp, mus musculus
gtcatattcactatccactgagggc

SEQ ID NO: 63942 - DNA, 25 bp, mus musculus
tcactatccactgagggcacactat

SEQ ID NO: 63943 - DNA, 25 bp, mus musculus
atccactgagggcacactataagtg

SEQ ID NO: 63944 - DNA, 25 bp, mus musculus
agcagtcacacaatcagcgaagaat

SEQ ID NO: 63945 - DNA, 25 bp, mus musculus
gcagtcacacaatcagcgaagaatc

SEQ ID NO: 63946 - DNA, 25 bp, mus musculus
cacacaatcagcgaagaatcacatt

SEQ ID NO: 63947 - DNA, 25 bp, mus musculus
gtacaaagtggagcccctggcattt

SEQ ID NO: 63948 - DNA, 25 bp, mus musculus
gcccctggcatttcatggtacgcct

SEQ ID NO: 63949 - DNA, 25 bp, mus musculus
tgtaggctactgtgagcaggagttt

SEQ ID NO: 63950 - DNA, 25 bp, mus musculus
ctactgtgagcaggagtttgagcag

SEQ ID NO: 63951 - DNA, 25 bp, mus musculus
tgagcagacttgagccaccagcgct

SEQ ID NO: 63952 - DNA, 25 bp, mus musculus
gacttgagccaccagcgctgaacac

SEQ ID NO: 63953 - DNA, 25 bp, mus musculus
agccaccagcgctgaacacccagga

SEQ ID NO: 63954 - DNA, 25 bp, mus musculus
aggttgctgtcctttgagtcagctg

SEQ ID NO: 63955 - DNA, 25 bp, mus musculus
ctgtcctttgagtcagctgcgctga

SEQ ID NO: 63956 - DNA, 25 bp, mus musculus
tttgagtcagctgcgctgagcaccc

SEQ ID NO: 63957 - DNA, 25 bp, mus musculus
tgcccctgtgactacagagaaggag

SEQ ID NO: 63958 - DNA, 25 bp, mus musculus
tgctggcactggtgttcaataaaga

SEQ ID NO: 63959 - DNA, 25 bp, mus musculus
ggcatttcatggtacgcctgaacag

SEQ ID NO: 63960 - DNA, 25 bp, mus musculus
tacgcctgaacagaaggctctggtc

SEQ ID NO: 63961 - DNA, 25 bp, mus musculus
ggacagcaccaacctggtccccaga

SEQ ID NO: 63962 - DNA, 25 bp, mus musculus
acgtttgtcgcatttccgttgtgag

SEQ ID NO: 63963 - DNA, 25 bp, mus musculus
gtcgcatttccgttgtgagctggtg

SEQ ID NO: 63964 - DNA, 25 bp, mus musculus
tttccgttgtgagctggtgaggaga

SEQ ID NO: 63965 - DNA, 25 bp, mus musculus
ccagcccatcagtgtaggctactgt

SEQ ID NO: 63966 - DNA, 25 bp, mus musculus
catcagtgtaggctactgtgagcag

SEQ ID NO: 63967 - DNA, 25 bp, mus musculus
agtcaggccaacatgagtgagagac

SEQ ID NO: 63968 - DNA, 25 bp, mus musculus
catagtatttatgccccctataggc

SEQ ID NO: 63969 - DNA, 25 bp, mus musculus
gtttatctccattacaattcctctg

SEQ ID NO: 63970 - DNA, 25 bp, mus musculus
ttatctccattacaattcctctgca

SEQ ID NO: 63971 - DNA, 25 bp, mus musculus
atctccattacaattcctctgcaac

SEQ ID NO: 63972 - DNA, 25 bp, mus musculus
attacaattcctctgcaactatttt

SEQ ID NO: 63973 - DNA, 25 bp, mus musculus
tacaattcctctgcaactattttcc

SEQ ID NO: 63974 - DNA, 25 bp, mus musculus
caattcctctgcaactattttcctt

SEQ ID NO: 63975 - DNA, 25 bp, mus musculus
attcctctgcaactattttccttga

SEQ ID NO: 63976 - DNA, 25 bp, mus musculus
ctctgcaactattttccttgatgtt

SEQ ID NO: 63977 - DNA, 25 bp, mus musculus
ctgcaactattttccttgatgttgt

SEQ ID NO: 63978 - DNA, 25 bp, mus musculus
gcaactattttccttgatgttgtaa

SEQ ID NO: 63979 - DNA, 25 bp, mus musculus
tagtatttatgccccctataggcag

SEQ ID NO: 63980 - DNA, 25 bp, mus musculus
gtatttatgccccctataggcaggt

SEQ ID NO: 63981 - DNA, 25 bp, mus musculus
atttatgccccctataggcaggtat

SEQ ID NO: 63982 - DNA, 25 bp, mus musculus
gccccctataggcaggtatccacag

SEQ ID NO: 63983 - DNA, 25 bp, mus musculus
cccctataggcaggtatccacagta

SEQ ID NO: 63984 - DNA, 25 bp, mus musculus
agcttaatctgtttatctccattac

SEQ ID NO: 63985 - DNA, 25 bp, mus musculus
taatctgtttatctccattacaatt

SEQ ID NO: 63986 - DNA, 25 bp, mus musculus
atctgtttatctccattacaattcc

SEQ ID NO: 63987 - DNA, 25 bp, mus musculus
acccagaccctattcagatcctgac

SEQ ID NO: 63988 - DNA, 25 bp, mus musculus
cagaccctattcagatcctgaccat

SEQ ID NO: 63989 - DNA, 25 bp, mus musculus
agccagggcctctttccttctcagg

SEQ ID NO: 63990 - DNA, 25 bp, mus musculus
gtcctactcggtgctgttgagtagg

SEQ ID NO: 63991 - DNA, 25 bp, mus musculus
gaattgaccagcttagtgaggagcc

SEQ ID NO: 63992 - DNA, 25 bp, mus musculus
tgcgagcttgtgcccaattgtaaca

SEQ ID NO: 63993 - DNA, 25 bp, mus musculus
gagcttgtgcccaattgtaacactc

SEQ ID NO: 63994 - DNA, 25 bp, mus musculus
gccaaggacagtctcctggatgtat

SEQ ID NO: 63995 - DNA, 25 bp, mus musculus
gacagtctcctggatgtatggtttg

SEQ ID NO: 63996 - DNA, 25 bp, mus musculus
ggttcctgaatgcaccataattgct

SEQ ID NO: 63997 - DNA, 25 bp, mus musculus
tgaatgcaccataattgctgtatga

SEQ ID NO: 63998 - DNA, 25 bp, mus musculus
atgcaccataattgctgtatgaaat

SEQ ID NO: 63999 - DNA, 25 bp, mus musculus
ctattcagatcctgaccatcactat

SEQ ID NO: 64000 - DNA, 25 bp, mus musculus
ttcagatcctgaccatcactatacc

SEQ ID NO: 64001 - DNA, 25 bp, mus musculus
agatcctgaccatcactataccctg

SEQ ID NO: 64002 - DNA, 25 bp, mus musculus
tgaccatcactataccctgggattg

SEQ ID NO: 64003 - DNA, 25 bp, mus musculus
ccatcactataccctgggattggct

SEQ ID NO: 64004 - DNA, 25 bp, mus musculus
tcactataccctgggattggctatg

SEQ ID NO: 64005 - DNA, 25 bp, mus musculus
taccctgggattggctatgggaaag

SEQ ID NO: 64006 - DNA, 25 bp, mus musculus
agaactaccagagactgggagatgg

SEQ ID NO: 64007 - DNA, 25 bp, mus musculus
gacttcgggttcgcgcgactgcgcc

SEQ ID NO: 64008 - DNA, 25 bp, mus musculus
cccagagcccggcagagccatgcag

SEQ ID NO: 64009 - DNA, 25 bp, mus musculus
tcctgcgatctatggagcctgggtg

SEQ ID NO: 64010 - DNA, 25 bp, mus musculus
gatctatggagcctgggtgtcattc

SEQ ID NO: 64011 - DNA, 25 bp, mus musculus
ctgtacatgatgctgtctggccagg

SEQ ID NO: 64012 - DNA, 25 bp, mus musculus
tacatgatgctgtctggccaggttc

SEQ ID NO: 64013 - DNA, 25 bp, mus musculus
atgatgctgtctggccaggttccct

SEQ ID NO: 64014 - DNA, 25 bp, mus musculus
ctgtctggccaggttcccttccaag

SEQ ID NO: 64015 - DNA, 25 bp, mus musculus
ttccaaggggcctccgcatgggtgg

SEQ ID NO: 64016 - DNA, 25 bp, mus musculus
gcctccgcatgggtggacagagtca

SEQ ID NO: 64017 - DNA, 25 bp, mus musculus
tgtgcaagatccgtgaagggcgctt

SEQ ID NO: 64018 - DNA, 25 bp, mus musculus
agatccgtgaagggcgcttctccct

SEQ ID NO: 64019 - DNA, 25 bp, mus musculus
agagcccggcagagccatgcagact

SEQ ID NO: 64020 - DNA, 25 bp, mus musculus
tccttgcttcacactgcagtacgct

SEQ ID NO: 64021 - DNA, 25 bp, mus musculus
actgcagtacgctgcacccgagctg

SEQ ID NO: 64022 - DNA, 25 bp, mus musculus
tgcacccgagctgctggcacagagg

SEQ ID NO: 64023 - DNA, 25 bp, mus musculus
gctgctggcacagagggctacgatg

SEQ ID NO: 64024 - DNA, 25 bp, mus musculus
ggctacgatgagtcctgcgatctat

SEQ ID NO: 64025 - DNA, 25 bp, mus musculus
gatgagtcctgcgatctatggagcc

SEQ ID NO: 64026 - DNA, 25 bp, mus musculus
gagtcctgcgatctatggagcctgg

SEQ ID NO: 64027 - DNA, 25 bp, mus musculus
cttggaactctgacctagcacctat

SEQ ID NO: 64028 - DNA, 25 bp, mus musculus
tcttccctaagccactcctatgagt

SEQ ID NO: 64029 - DNA, 25 bp, mus musculus
gtccgcactgcagcctaagctggag

SEQ ID NO: 64030 - DNA, 25 bp, mus musculus
actgcagcctaagctggagagaggt

SEQ ID NO: 64031 - DNA, 25 bp, mus musculus
aggtttgatcctgagagcctcatcc

SEQ ID NO: 64032 - DNA, 25 bp, mus musculus
ctcatcctacatccctagagaaggc

SEQ ID NO: 64033 - DNA, 25 bp, mus musculus
ctacatccctagagaaggcaccctt

SEQ ID NO: 64034 - DNA, 25 bp, mus musculus
tcctctgtactcctctcatggtgta

SEQ ID NO: 64035 - DNA, 25 bp, mus musculus
agggtctctccaacatttggctgaa

SEQ ID NO: 64036 - DNA, 25 bp, mus musculus
tctccaacatttggctgaacttgaa

SEQ ID NO: 64037 - DNA, 25 bp, mus musculus
acatttggctgaacttgaagggcaa

SEQ ID NO: 64038 - DNA, 25 bp, mus musculus
aggtcaagccccaatgcctgtccta

SEQ ID NO: 64039 - DNA, 25 bp, mus musculus
cactcctatgagtgttatcattcct

SEQ ID NO: 64040 - DNA, 25 bp, mus musculus
tgttatcattcctgagggctgataa

SEQ ID NO: 64041 - DNA, 25 bp, mus musculus
ctgataagacaaccctgtctcaggg

SEQ ID NO: 64042 - DNA, 25 bp, mus musculus
agacaaccctgtctcagggtcctga

SEQ ID NO: 64043 - DNA, 25 bp, mus musculus
ctcagggtcctgaggctggcaccca

SEQ ID NO: 64044 - DNA, 25 bp, mus musculus
gcaaggtcaccttgacactggtacc

SEQ ID NO: 64045 - DNA, 25 bp, mus musculus
tgacactggtaccatggtaaccttg

SEQ ID NO: 64046 - DNA, 25 bp, mus musculus
cctggcactggcctccacagaaagg

SEQ ID NO: 64047 - DNA, 25 bp, mus musculus
aatcgccttggtttagctccatatg

SEQ ID NO: 64048 - DNA, 25 bp, mus musculus
atcgccttggtttagctccatatga

SEQ ID NO: 64049 - DNA, 25 bp, mus musculus
tttagctccatatgaaagctttgaa

SEQ ID NO: 64050 - DNA, 25 bp, mus musculus
acttctcatggctgatgagaacgcg

SEQ ID NO: 64051 - DNA, 25 bp, mus musculus
cttctcatggctgatgagaacgcgc

SEQ ID NO: 64052 - DNA, 25 bp, mus musculus
ttctcatggctgatgagaacgcgca

SEQ ID NO: 64053 - DNA, 25 bp, mus musculus
tctcatggctgatgagaacgcgcaa

SEQ ID NO: 64054 - DNA, 25 bp, mus musculus
tgagaacgcgcaaggcttcgaaggt

SEQ ID NO: 64055 - DNA, 25 bp, mus musculus
agaacgcgcaaggcttcgaaggtgt

SEQ ID NO: 64056 - DNA, 25 bp, mus musculus
gaacgcgcaaggcttcgaaggtgtt

SEQ ID NO: 64057 - DNA, 25 bp, mus musculus
aacgcgcaaggcttcgaaggtgttg

SEQ ID NO: 64058 - DNA, 25 bp, mus musculus
acgcgcaaggcttcgaaggtgttga

SEQ ID NO: 64059 - DNA, 25 bp, mus musculus
tcgccttggtttagctccatatgaa

SEQ ID NO: 64060 - DNA, 25 bp, mus musculus
cgcgcaaggcttcgaaggtgttgat

SEQ ID NO: 64061 - DNA, 25 bp, mus musculus
cgccttggtttagctccatatgaaa

SEQ ID NO: 64062 - DNA, 25 bp, mus musculus
gccttggtttagctccatatgaaag

SEQ ID NO: 64063 - DNA, 25 bp, mus musculus
ccttggtttagctccatatgaaagc

SEQ ID NO: 64064 - DNA, 25 bp, mus musculus
ttggtttagctccatatgaaagctt

SEQ ID NO: 64065 - DNA, 25 bp, mus musculus
tggtttagctccatatgaaagcttt

SEQ ID NO: 64066 - DNA, 25 bp, mus musculus
ggtttagctccatatgaaagctttg

SEQ ID NO: 64067 - DNA, 25 bp, mus musculus
gtttagctccatatgaaagctttga

SEQ ID NO: 64068 - DNA, 25 bp, mus musculus
tggtccagcaccagcaatttggact

SEQ ID NO: 64069 - DNA, 25 bp, mus musculus
ggtccagcaccagcaatttggactg

SEQ ID NO: 64070 - DNA, 25 bp, mus musculus
aatatgcgcagttcagtgagccgtc

SEQ ID NO: 64071 - DNA, 25 bp, mus musculus
atatgcgcagttcagtgagccgtca

SEQ ID NO: 64072 - DNA, 25 bp, mus musculus
atgcgcagttcagtgagccgtcaaa

SEQ ID NO: 64073 - DNA, 25 bp, mus musculus
tgcgcagttcagtgagccgtcaaat

SEQ ID NO: 64074 - DNA, 25 bp, mus musculus
cgcagttcagtgagccgtcaaatgt

SEQ ID NO: 64075 - DNA, 25 bp, mus musculus
agttcagtgagccgtcaaatgtagc

SEQ ID NO: 64076 - DNA, 25 bp, mus musculus
tagcaaacagcttgacttctttggt

SEQ ID NO: 64077 - DNA, 25 bp, mus musculus
agcaaacagcttgacttctttggtg

SEQ ID NO: 64078 - DNA, 25 bp, mus musculus
gacttctttggtgttatattgcatg

SEQ ID NO: 64079 - DNA, 25 bp, mus musculus
atattgcatgactgttgagtgctct

SEQ ID NO: 64080 - DNA, 25 bp, mus musculus
ccagcaccagcaatttggactggaa

SEQ ID NO: 64081 - DNA, 25 bp, mus musculus
agcaccagcaatttggactggaagg

SEQ ID NO: 64082 - DNA, 25 bp, mus musculus
gcaccagcaatttggactggaagga

SEQ ID NO: 64083 - DNA, 25 bp, mus musculus
gtcactccggtctattaagaggtgc

SEQ ID NO: 64084 - DNA, 25 bp, mus musculus
tcactccggtctattaagaggtgca

SEQ ID NO: 64085 - DNA, 25 bp, mus musculus
actccggtctattaagaggtgcaat

SEQ ID NO: 64086 - DNA, 25 bp, mus musculus
ttagcttccacagtgaatatgcgca

SEQ ID NO: 64087 - DNA, 25 bp, mus musculus
tgaatatgcgcagttcagtgagccg

SEQ ID NO: 64088 - DNA, 25 bp, mus musculus
atactatgggcccagcacctaaagc

SEQ ID NO: 64089 - DNA, 25 bp, mus musculus
cagcacctaaagccacccttgggag

SEQ ID NO: 64090 - DNA, 25 bp, mus musculus
tctgcatgcccaggtacctcagttt

SEQ ID NO: 64091 - DNA, 25 bp, mus musculus
agaatctcctcattcactctgtcct

SEQ ID NO: 64092 - DNA, 25 bp, mus musculus
tcctcattcactctgtcctggagtt

SEQ ID NO: 64093 - DNA, 25 bp, mus musculus
ctgtcctggagttgggttctggctc

SEQ ID NO: 64094 - DNA, 25 bp, mus musculus
ctccttcacacctaggactctgaaa

SEQ ID NO: 64095 - DNA, 25 bp, mus musculus
cacacctaggactctgaaatgagca

SEQ ID NO: 64096 - DNA, 25 bp, mus musculus
atgagcaagcacttcagacagtcag

SEQ ID NO: 64097 - DNA, 25 bp, mus musculus
caagagtctagctgtctggtgggca

SEQ ID NO: 64098 - DNA, 25 bp, mus musculus
tctagctgtctggtgggcacccaaa

SEQ ID NO: 64099 - DNA, 25 bp, mus musculus
gtgggcacccaaaatgaccagggct

SEQ ID NO: 64100 - DNA, 25 bp, mus musculus
ctgaaccaatcccaagatctggaaa

SEQ ID NO: 64101 - DNA, 25 bp, mus musculus
gcatgagcacttaccaggcaaaagc

SEQ ID NO: 64102 - DNA, 25 bp, mus musculus
gcacttaccaggcaaaagctccgtg

SEQ ID NO: 64103 - DNA, 25 bp, mus musculus
accaggcaaaagctccgtgagcgta

SEQ ID NO: 64104 - DNA, 25 bp, mus musculus
ctccgtgagcgtatctgctgtcctt

SEQ ID NO: 64105 - DNA, 25 bp, mus musculus
gagcgtatctgctgtccttctgcat

SEQ ID NO: 64106 - DNA, 25 bp, mus musculus
atctgctgtccttctgcatgcccag

SEQ ID NO: 64107 - DNA, 25 bp, mus musculus
tgtccttctgcatgcccaggtacct

SEQ ID NO: 64108 - DNA, 25 bp, mus musculus
agaacacaggcagtgtctccgtgac

SEQ ID NO: 64109 - DNA, 25 bp, mus musculus
aacacaggcagtgtctccgtgacac

SEQ ID NO: 64110 - DNA, 25 bp, mus musculus
ccagtgcctctggaagtcattgtga

SEQ ID NO: 64111 - DNA, 25 bp, mus musculus
tgcctctggaagtcattgtgattga

SEQ ID NO: 64112 - DNA, 25 bp, mus musculus
attgaccagaacgacaacagaccca

SEQ ID NO: 64113 - DNA, 25 bp, mus musculus
cagaacgacaacagacccatcttcc

SEQ ID NO: 64114 - DNA, 25 bp, mus musculus
gaacgacaacagacccatcttccgg

SEQ ID NO: 64115 - DNA, 25 bp, mus musculus
gacaacagacccatcttccgggaag

SEQ ID NO: 64116 - DNA, 25 bp, mus musculus
cccttacatcggccatgtcatggaa

SEQ ID NO: 64117 - DNA, 25 bp, mus musculus
cttacatcggccatgtcatggaagg

SEQ ID NO: 64118 - DNA, 25 bp, mus musculus
tacatcggccatgtcatggaagggt

SEQ ID NO: 64119 - DNA, 25 bp, mus musculus
tcggccatgtcatggaagggtcacc

SEQ ID NO: 64120 - DNA, 25 bp, mus musculus
ggcagtgtctccgtgacacggaccc

SEQ ID NO: 64121 - DNA, 25 bp, mus musculus
ggtcacccacagggaccacggtgat

SEQ ID NO: 64122 - DNA, 25 bp, mus musculus
gtgtctccgtgacacggaccctgga

SEQ ID NO: 64123 - DNA, 25 bp, mus musculus
ctccgtgacacggaccctggacaga

SEQ ID NO: 64124 - DNA, 25 bp, mus musculus
aaacgatcgctacttatcaactgta

SEQ ID NO: 64125 - DNA, 25 bp, mus musculus
gatcgctacttatcaactgtatgtg

SEQ ID NO: 64126 - DNA, 25 bp, mus musculus
gctacttatcaactgtatgtggaaa

SEQ ID NO: 64127 - DNA, 25 bp, mus musculus
aaactctggaagggccagtgcctct

SEQ ID NO: 64128 - DNA, 25 bp, mus musculus
agggccagtgcctctggaagtcatt

SEQ ID NO: 64129 - DNA, 25 bp, mus musculus
ccccttacagctgtcctgaggacac

SEQ ID NO: 64130 - DNA, 25 bp, mus musculus
cttacagctgtcctgaggacacaga

SEQ ID NO: 64131 - DNA, 25 bp, mus musculus
agacgtcccatgcaggacaagagac

SEQ ID NO: 64132 - DNA, 25 bp, mus musculus
acgggattaccacctcaactgccag

SEQ ID NO: 64133 - DNA, 25 bp, mus musculus
gttctaaccctgaaccaatgaacat

SEQ ID NO: 64134 - DNA, 25 bp, mus musculus
accctgaaccaatgaacattgcaag

SEQ ID NO: 64135 - DNA, 25 bp, mus musculus
ctagctggttggctagctggcatct

SEQ ID NO: 64136 - DNA, 25 bp, mus musculus
gagtactgctcacaatggtaccaaa

SEQ ID NO: 64137 - DNA, 25 bp, mus musculus
ggactcgagataacccacatttaga

SEQ ID NO: 64138 - DNA, 25 bp, mus musculus
ctcgagataacccacatttagacac

SEQ ID NO: 64139 - DNA, 25 bp, mus musculus
gagataacccacatttagacaccgg

SEQ ID NO: 64140 - DNA, 25 bp, mus musculus
cacatttagacaccggaagtgctat

SEQ ID NO: 64141 - DNA, 25 bp, mus musculus
acagctgtcctgaggacacagaaga

SEQ ID NO: 64142 - DNA, 25 bp, mus musculus
cgagacccttttttcatatcatgaa

SEQ ID NO: 64143 - DNA, 25 bp, mus musculus
gacccttttttcatatcatgaagcc

SEQ ID NO: 64144 - DNA, 25 bp, mus musculus
ttcatatcatgaagccagcaagagt

SEQ ID NO: 64145 - DNA, 25 bp, mus musculus
atatcatgaagccagcaagagtggc

SEQ ID NO: 64146 - DNA, 25 bp, mus musculus
tcatgaagccagcaagagtggcaga

SEQ ID NO: 64147 - DNA, 25 bp, mus musculus
gtcaccagcagcgtgtggacagaca

SEQ ID NO: 64148 - DNA, 25 bp, mus musculus
accagcagcgtgtggacagacatga

SEQ ID NO: 64149 - DNA, 25 bp, mus musculus
aggccctctttctgatgcctgtaga

SEQ ID NO: 64150 - DNA, 25 bp, mus musculus
tcagagctccactatcccatctgat

SEQ ID NO: 64151 - DNA, 25 bp, mus musculus
accacagagatccagtgttctattc

SEQ ID NO: 64152 - DNA, 25 bp, mus musculus
tctattctggggacatacagggact

SEQ ID NO: 64153 - DNA, 25 bp, mus musculus
ttcccttgtttattatggcaacagg

SEQ ID NO: 64154 - DNA, 25 bp, mus musculus
ttatggcaacagggccaaggggatt

SEQ ID NO: 64155 - DNA, 25 bp, mus musculus
aagttctgcctggcttctgccctga

SEQ ID NO: 64156 - DNA, 25 bp, mus musculus
tgcctggcttctgccctgaacaggg

SEQ ID NO: 64157 - DNA, 25 bp, mus musculus
ctaattccacctttgcctcttatgc

SEQ ID NO: 64158 - DNA, 25 bp, mus musculus
ttgcctcttatgccagaccttaata

SEQ ID NO: 64159 - DNA, 25 bp, mus musculus
cttatgccagaccttaataaagcct

SEQ ID NO: 64160 - DNA, 25 bp, mus musculus
ccagaccttaataaagcctctgctt

SEQ ID NO: 64161 - DNA, 25 bp, mus musculus
tatcccatctgatactcctggccag

SEQ ID NO: 64162 - DNA, 25 bp, mus musculus
gactcagctgctaaccagagtctgc

SEQ ID NO: 64163 - DNA, 25 bp, mus musculus
gctgctaaccagagtctgcgggaaa

SEQ ID NO: 64164 - DNA, 25 bp, mus musculus
aaccagagtctgcgggaaagacagt

SEQ ID NO: 64165 - DNA, 25 bp, mus musculus
agtagctgaagttcgctgtggctca

SEQ ID NO: 64166 - DNA, 25 bp, mus musculus
tgaagttcgctgtggctcacctgta

SEQ ID NO: 64167 - DNA, 25 bp, mus musculus
acctgtaccttcagttcagcttggc

SEQ ID NO: 64168 - DNA, 25 bp, mus musculus
accttcagttcagcttggcctctgc

SEQ ID NO: 64169 - DNA, 25 bp, mus musculus
cctgtgcctctgggcatttggacac

SEQ ID NO: 64170 - DNA, 25 bp, mus musculus
tggacacttcttgctgtttgagaat

SEQ ID NO: 64171 - DNA, 25 bp, mus musculus
cctgatggagctctgtgtgtaccta

SEQ ID NO: 64172 - DNA, 25 bp, mus musculus
ggatctccattttctctctactctg

SEQ ID NO: 64173 - DNA, 25 bp, mus musculus
tactctgtctgccatctagatattg

SEQ ID NO: 64174 - DNA, 25 bp, mus musculus
gcactttctctccagcatgctctgt

SEQ ID NO: 64175 - DNA, 25 bp, mus musculus
cagcatgctctgtgacacatagcag

SEQ ID NO: 64176 - DNA, 25 bp, mus musculus
tgacacatagcagctcccaaagcat

SEQ ID NO: 64177 - DNA, 25 bp, mus musculus
gctcccaaagcattctacgatacgc

SEQ ID NO: 64178 - DNA, 25 bp, mus musculus
aaagcattctacgatacgccagtga

SEQ ID NO: 64179 - DNA, 25 bp, mus musculus
atgagcatccgtgactctgaccctc

SEQ ID NO: 64180 - DNA, 25 bp, mus musculus
gaccctcattttgagatctgtacag

SEQ ID NO: 64181 - DNA, 25 bp, mus musculus
cttcttgctgtttgagaattggctc

SEQ ID NO: 64182 - DNA, 25 bp, mus musculus
tgtacagagctgtccgttcctttca

SEQ ID NO: 64183 - DNA, 25 bp, mus musculus
agagccaccacatggagcaagatac

SEQ ID NO: 64184 - DNA, 25 bp, mus musculus
cacatactgtgtccaatactgattt

SEQ ID NO: 64185 - DNA, 25 bp, mus musculus
ctgtgtccaatactgatttgaaaga

SEQ ID NO: 64186 - DNA, 25 bp, mus musculus
agtagccttgcgtattctgctgagc

SEQ ID NO: 64187 - DNA, 25 bp, mus musculus
tattctgctgagcttcatccacaca

SEQ ID NO: 64188 - DNA, 25 bp, mus musculus
gctgagcttcatccacacagttaaa

SEQ ID NO: 64189 - DNA, 25 bp, mus musculus
ttaacacctgatggagctctgtgtg

SEQ ID NO: 64190 - DNA, 25 bp, mus musculus
acacgcatcacctttgagaaggaag

SEQ ID NO: 64191 - DNA, 25 bp, mus musculus
cccaacatcatccctgctgacatta

SEQ ID NO: 64192 - DNA, 25 bp, mus musculus
cttgatgaccggctgctcaacatcc

SEQ ID NO: 64193 - DNA, 25 bp, mus musculus
gatgaccggctgctcaacatcccta

SEQ ID NO: 64194 - DNA, 25 bp, mus musculus
gaccggctgctcaacatccctatca

SEQ ID NO: 64195 - DNA, 25 bp, mus musculus
ctgctcaacatccctatcaacgaca

SEQ ID NO: 64196 - DNA, 25 bp, mus musculus
ctcaacatccctatcaacgacattg

SEQ ID NO: 64197 - DNA, 25 bp, mus musculus
aacatccctatcaacgacattgtcc

SEQ ID NO: 64198 - DNA, 25 bp, mus musculus
atcaacgacattgtccaccctaagt

SEQ ID NO: 64199 - DNA, 25 bp, mus musculus
caccctaagtacttcaagattgtgc

SEQ ID NO: 64200 - DNA, 25 bp, mus musculus
gggatgccactgcctgagaacccca

SEQ ID NO: 64201 - DNA, 25 bp, mus musculus
atgccactgcctgagaaccccagca

SEQ ID NO: 64202 - DNA, 25 bp, mus musculus
atcatccctgctgacattatcttca

SEQ ID NO: 64203 - DNA, 25 bp, mus musculus
ctgcctgagaaccccagcaagaagg

SEQ ID NO: 64204 - DNA, 25 bp, mus musculus
cctgctgacattatcttcattgtga

SEQ ID NO: 64205 - DNA, 25 bp, mus musculus
gctgacattatcttcattgtgaagg

SEQ ID NO: 64206 - DNA, 25 bp, mus musculus
cctcgcttccgcagggagcatgaca

SEQ ID NO: 64207 - DNA, 25 bp, mus musculus
cgcttccgcagggagcatgacaacc

SEQ ID NO: 64208 - DNA, 25 bp, mus musculus
gagcatgacaacctcttcttcgtgt

SEQ ID NO: 64209 - DNA, 25 bp, mus musculus
cctttgggcaaggcctgtacctgct

SEQ ID NO: 64210 - DNA, 25 bp, mus musculus
gcctgtacctgctgcactgtggagg

SEQ ID NO: 64211 - DNA, 25 bp, mus musculus
cgacacggacagtgaggatgagctg

SEQ ID NO: 64212 - DNA, 25 bp, mus musculus
gagagaaccaccaaggacggctggg

SEQ ID NO: 64213 - DNA, 25 bp, mus musculus
ctacgccaatcacactgaggagaag

SEQ ID NO: 64214 - DNA, 25 bp, mus musculus
tacgccaatcacactgaggagaaga

SEQ ID NO: 64215 - DNA, 25 bp, mus musculus
acgccaatcacactgaggagaagac

SEQ ID NO: 64216 - DNA, 25 bp, mus musculus
cgccaatcacactgaggagaagacc

SEQ ID NO: 64217 - DNA, 25 bp, mus musculus
gccaatcacactgaggagaagaccc

SEQ ID NO: 64218 - DNA, 25 bp, mus musculus
ccaatcacactgaggagaagaccca

SEQ ID NO: 64219 - DNA, 25 bp, mus musculus
gagaaccaccaaggacggctgggtg

SEQ ID NO: 64220 - DNA, 25 bp, mus musculus
gggtgtactacgccaatcacactga

SEQ ID NO: 64221 - DNA, 25 bp, mus musculus
ggtgtactacgccaatcacactgag

SEQ ID NO: 64222 - DNA, 25 bp, mus musculus
gtgtactacgccaatcacactgagg

SEQ ID NO: 64223 - DNA, 25 bp, mus musculus
tgtactacgccaatcacactgagga

SEQ ID NO: 64224 - DNA, 25 bp, mus musculus
gtactacgccaatcacactgaggag

SEQ ID NO: 64225 - DNA, 25 bp, mus musculus
tactacgccaatcacactgaggaga

SEQ ID NO: 64226 - DNA, 25 bp, mus musculus
actacgccaatcacactgaggagaa

SEQ ID NO: 64227 - DNA, 25 bp, mus musculus
gtccagggaaccaactccactcgct

SEQ ID NO: 64228 - DNA, 25 bp, mus musculus
ctccactcgctttctagttttcaat

SEQ ID NO: 64229 - DNA, 25 bp, mus musculus
ctgacacaagaatacccagaagaag

SEQ ID NO: 64230 - DNA, 25 bp, mus musculus
gaaatccttaaatctgtctatgagt

SEQ ID NO: 64231 - DNA, 25 bp, mus musculus
aatccttaaatctgtctatgagtgc

SEQ ID NO: 64232 - DNA, 25 bp, mus musculus
tccttaaatctgtctatgagtgcat

SEQ ID NO: 64233 - DNA, 25 bp, mus musculus
taaatctgtctatgagtgcatagcg

SEQ ID NO: 64234 - DNA, 25 bp, mus musculus
aatctgtctatgagtgcatagcgaa

SEQ ID NO: 64235 - DNA, 25 bp, mus musculus
tccaacattagagctatcggcgtga

SEQ ID NO: 64236 - DNA, 25 bp, mus musculus
caacattagagctatcggcgtgagt

SEQ ID NO: 64237 - DNA, 25 bp, mus musculus
acattagagctatcggcgtgagtaa

SEQ ID NO: 64238 - DNA, 25 bp, mus musculus
attagagctatcggcgtgagtaacc

SEQ ID NO: 64239 - DNA, 25 bp, mus musculus
ccactcgctttctagttttcaatag

SEQ ID NO: 64240 - DNA, 25 bp, mus musculus
actcgctttctagttttcaatagca

SEQ ID NO: 64241 - DNA, 25 bp, mus musculus
tcgctttctagttttcaatagcaaa

SEQ ID NO: 64242 - DNA, 25 bp, mus musculus
agaactagtttgctctcatcaggtg

SEQ ID NO: 64243 - DNA, 25 bp, mus musculus
ctagtttgctctcatcaggtggaac

SEQ ID NO: 64244 - DNA, 25 bp, mus musculus
agtttgctctcatcaggtggaactg

SEQ ID NO: 64245 - DNA, 25 bp, mus musculus
tttgctctcatcaggtggaactgac

SEQ ID NO: 64246 - DNA, 25 bp, mus musculus
tgctctcatcaggtggaactgacac

SEQ ID NO: 64247 - DNA, 25 bp, mus musculus
gcctacttctctcactgaagtgcat

SEQ ID NO: 64248 - DNA, 25 bp, mus musculus
ttctctcactgaagtgcatctagat

SEQ ID NO: 64249 - DNA, 25 bp, mus musculus
caaactcctcagggtgcctgctggg

SEQ ID NO: 64250 - DNA, 25 bp, mus musculus
tgctgggctggcacagcataagtat

SEQ ID NO: 64251 - DNA, 25 bp, mus musculus
tatccaggtcgtctaccttcacaac

SEQ ID NO: 64252 - DNA, 25 bp, mus musculus
tcacaacaacaacatctccgcagtt

SEQ ID NO: 64253 - DNA, 25 bp, mus musculus
caacaacatctccgcagttgggcaa

SEQ ID NO: 64254 - DNA, 25 bp, mus musculus
catctccgcagttgggcaaaatgac

SEQ ID NO: 64255 - DNA, 25 bp, mus musculus
tcgaaaggcttcctactcggctgtg

SEQ ID NO: 64256 - DNA, 25 bp, mus musculus
ctttccaaacaccttcagatgtgtc

SEQ ID NO: 64257 - DNA, 25 bp, mus musculus
atgtgtctatgtgcgttctgccatt

SEQ ID NO: 64258 - DNA, 25 bp, mus musculus
ctcagacggcctaattcttataatc

SEQ ID NO: 64259 - DNA, 25 bp, mus musculus
caagatcaccaaggttgatgcaccc

SEQ ID NO: 64260 - DNA, 25 bp, mus musculus
ggttgatgcacccagcctgaaagga

SEQ ID NO: 64261 - DNA, 25 bp, mus musculus
attgagcttcaacagcatcaccgtt

SEQ ID NO: 64262 - DNA, 25 bp, mus musculus
cagcatcaccgttatggagaatggc

SEQ ID NO: 64263 - DNA, 25 bp, mus musculus
gaatggcagtctggccaatgttcct

SEQ ID NO: 64264 - DNA, 25 bp, mus musculus
cagtctggccaatgttcctcatctg

SEQ ID NO: 64265 - DNA, 25 bp, mus musculus
ggccaatgttcctcatctgagggaa

SEQ ID NO: 64266 - DNA, 25 bp, mus musculus
tcatctgagggaactccacttggac

SEQ ID NO: 64267 - DNA, 25 bp, mus musculus
gcacgaaattcaccatcttcgataa

SEQ ID NO: 64268 - DNA, 25 bp, mus musculus
tgaaccctgagcggagttactgggt

SEQ ID NO: 64269 - DNA, 25 bp, mus musculus
gacacggcctgcttctactgcagaa

SEQ ID NO: 64270 - DNA, 25 bp, mus musculus
ttctactgcagaacaaggccccatc

SEQ ID NO: 64271 - DNA, 25 bp, mus musculus
ccccatcgtggagcgacgaaagcgg

SEQ ID NO: 64272 - DNA, 25 bp, mus musculus
tcaattttcacggtcgcgtctcgcg

SEQ ID NO: 64273 - DNA, 25 bp, mus musculus
cagtcaagaacttccagatagtgca

SEQ ID NO: 64274 - DNA, 25 bp, mus musculus
ccgaccacctggtgctccagtttgg

SEQ ID NO: 64275 - DNA, 25 bp, mus musculus
gccgtgtggccccaaacatattcac

SEQ ID NO: 64276 - DNA, 25 bp, mus musculus
caaacatattcacgatggatttccg

SEQ ID NO: 64277 - DNA, 25 bp, mus musculus
tccaagccttcgccatctgcttatc

SEQ ID NO: 64278 - DNA, 25 bp, mus musculus
ccttcgccatctgcttatccagttt

SEQ ID NO: 64279 - DNA, 25 bp, mus musculus
acagtgcccggatcagagaggagct

SEQ ID NO: 64280 - DNA, 25 bp, mus musculus
tgactgtgatccttccaggaatgga

SEQ ID NO: 64281 - DNA, 25 bp, mus musculus
ttccaggaatggacagccggaagca

SEQ ID NO: 64282 - DNA, 25 bp, mus musculus
gaatggacagccggaagcagaggat

SEQ ID NO: 64283 - DNA, 25 bp, mus musculus
acagccggaagcagaggatgaaagt

SEQ ID NO: 64284 - DNA, 25 bp, mus musculus
tgaaagtccaaccacaaaatgatca

SEQ ID NO: 64285 - DNA, 25 bp, mus musculus
tccaaccacaaaatgatcaggattc

SEQ ID NO: 64286 - DNA, 25 bp, mus musculus
ccatattgagtcgcgtacagaaggg

SEQ ID NO: 64287 - DNA, 25 bp, mus musculus
tcaatttctctgaatgaaagtatat

SEQ ID NO: 64288 - DNA, 25 bp, mus musculus
ttaaaacccatcagtggtagatcct

SEQ ID NO: 64289 - DNA, 25 bp, mus musculus
tttttacctctcaggtaagctctga

SEQ ID NO: 64290 - DNA, 25 bp, mus musculus
cctctcaggtaagctctgatggaat

SEQ ID NO: 64291 - DNA, 25 bp, mus musculus
aaattattccattcagtacagattg

SEQ ID NO: 64292 - DNA, 25 bp, mus musculus
tttctacattcattcattatggctc

SEQ ID NO: 64293 - DNA, 25 bp, mus musculus
cattcattcattatggctctgagaa

SEQ ID NO: 64294 - DNA, 25 bp, mus musculus
ttcattatggctctgagaactactt

SEQ ID NO: 64295 - DNA, 25 bp, mus musculus
actactttgttagcctgcttacata

SEQ ID NO: 64296 - DNA, 25 bp, mus musculus
ttgttagcctgcttacataaatgtc

SEQ ID NO: 64297 - DNA, 25 bp, mus musculus
ttacataaatgtcctctgatctaag

SEQ ID NO: 64298 - DNA, 25 bp, mus musculus
cctctgatctaagactctattaaga

SEQ ID NO: 64299 - DNA, 25 bp, mus musculus
cccatcagtggtagatccttcagag

SEQ ID NO: 64300 - DNA, 25 bp, mus musculus
aatttctcagttctcatcaacattc

SEQ ID NO: 64301 - DNA, 25 bp, mus musculus
tcagttctcatcaacattcatcaaa

SEQ ID NO: 64302 - DNA, 25 bp, mus musculus
ctcatcaacattcatcaaatttggg

SEQ ID NO: 64303 - DNA, 25 bp, mus musculus
aacattcatcaaatttgggactcat

SEQ ID NO: 64304 - DNA, 25 bp, mus musculus
gactcatatcatttgggctctgtct

SEQ ID NO: 64305 - DNA, 25 bp, mus musculus
tatcatttgggctctgtctgttcat

SEQ ID NO: 64306 - DNA, 25 bp, mus musculus
tgttcatttttacctctcaggtaag

SEQ ID NO: 64307 - DNA, 25 bp, mus musculus
cgcagtaaccctgggaagaatgcat

SEQ ID NO: 64308 - DNA, 25 bp, mus musculus
cagtaaccctgggaagaatgcatcg

SEQ ID NO: 64309 - DNA, 25 bp, mus musculus
tttgaactggtggccttggccaaga

SEQ ID NO: 64310 - DNA, 25 bp, mus musculus
ttgaactggtggccttggccaagat

SEQ ID NO: 64311 - DNA, 25 bp, mus musculus
aactggtggccttggccaagattct

SEQ ID NO: 64312 - DNA, 25 bp, mus musculus
tggtggccttggccaagattctggt

SEQ ID NO: 64313 - DNA, 25 bp, mus musculus
ccttggccaagattctggttggtca

SEQ ID NO: 64314 - DNA, 25 bp, mus musculus
ttggccaagattctggttggtcaac

SEQ ID NO: 64315 - DNA, 25 bp, mus musculus
ttcgcctattacaggttcttggcgg

SEQ ID NO: 64316 - DNA, 25 bp, mus musculus
tcgcctattacaggttcttggcggg

SEQ ID NO: 64317 - DNA, 25 bp, mus musculus
agttccgattaaagctctttacatg

SEQ ID NO: 64318 - DNA, 25 bp, mus musculus
gattaaagctctttacatggtcggg

SEQ ID NO: 64319 - DNA, 25 bp, mus musculus
gaatgcatcgagctcttcaaccaca

SEQ ID NO: 64320 - DNA, 25 bp, mus musculus
aatgcatcgagctcttcaaccacat

SEQ ID NO: 64321 - DNA, 25 bp, mus musculus
ctcttcaaccacatggagaaccttg

SEQ ID NO: 64322 - DNA, 25 bp, mus musculus
tcttcaaccacatggagaaccttgg

SEQ ID NO: 64323 - DNA, 25 bp, mus musculus
ttcaaccacatggagaaccttgggg

SEQ ID NO: 64324 - DNA, 25 bp, mus musculus
tcaaccacatggagaaccttgggga

SEQ ID NO: 64325 - DNA, 25 bp, mus musculus
gagcctgaccccttgtaatgttcca

SEQ ID NO: 64326 - DNA, 25 bp, mus musculus
tgtaatgttccaactttaagaagca

SEQ ID NO: 64327 - DNA, 25 bp, mus musculus
ccagctaccaaactgagctgtgcaa

SEQ ID NO: 64328 - DNA, 25 bp, mus musculus
gctaccaaactgagctgtgcaacca

SEQ ID NO: 64329 - DNA, 25 bp, mus musculus
tggacaaatcgggctccctgagcat

SEQ ID NO: 64330 - DNA, 25 bp, mus musculus
tgatcgacatcttcgacacagacgg

SEQ ID NO: 64331 - DNA, 25 bp, mus musculus
tcgacatcttcgacacagacggcaa

SEQ ID NO: 64332 - DNA, 25 bp, mus musculus
acatcttcgacacagacggcaacgg

SEQ ID NO: 64333 - DNA, 25 bp, mus musculus
tcttcgacacagacggcaacgggga

SEQ ID NO: 64334 - DNA, 25 bp, mus musculus
tcgacacagacggcaacggggaagt

SEQ ID NO: 64335 - DNA, 25 bp, mus musculus
aagtggacttccacgagttcatcgt

SEQ ID NO: 64336 - DNA, 25 bp, mus musculus
acttccacgagttcatcgtgggcac

SEQ ID NO: 64337 - DNA, 25 bp, mus musculus
cccagttcagcgtcaagggtgatga

SEQ ID NO: 64338 - DNA, 25 bp, mus musculus
agttcagcgtcaagggtgatgaaga

SEQ ID NO: 64339 - DNA, 25 bp, mus musculus
accaaactgagctgtgcaaccactt

SEQ ID NO: 64340 - DNA, 25 bp, mus musculus
aaactgagctgtgcaaccacttcga

SEQ ID NO: 64341 - DNA, 25 bp, mus musculus
ctgagctgtgcaaccacttcgacca

SEQ ID NO: 64342 - DNA, 25 bp, mus musculus
agctgtgcaaccacttcgaccagga

SEQ ID NO: 64343 - DNA, 25 bp, mus musculus
tgtgcaaccacttcgaccaggaaga

SEQ ID NO: 64344 - DNA, 25 bp, mus musculus
gcaaccacttcgaccaggaagagat

SEQ ID NO: 64345 - DNA, 25 bp, mus musculus
accacttcgaccaggaagagataag

SEQ ID NO: 64346 - DNA, 25 bp, mus musculus
acttcgaccaggaagagataagaag

SEQ ID NO: 64347 - DNA, 7 bp, mus musculus
catargt

SEQ ID NO: 64348 - DNA, 25 bp, mus musculus
aatttagctgactccttaaagcaga

SEQ ID NO: 64349 - DNA, 25 bp, mus musculus
gctgactccttaaagcagagagcat

SEQ ID NO: 64350 - DNA, 25 bp, mus musculus
ggagctatccggttccaaagcctct

SEQ ID NO: 64351 - DNA, 25 bp, mus musculus
agcatttgcagtggatcttgggaac

SEQ ID NO: 64352 - DNA, 25 bp, mus musculus
tcttgggaaccttccagtgctttgt

SEQ ID NO: 64353 - DNA, 25 bp, mus musculus
gaaccttccagtgctttgtgtattg

SEQ ID NO: 64354 - DNA, 25 bp, mus musculus
agctgccgcctgaccaaggtctcct

SEQ ID NO: 64355 - DNA, 25 bp, mus musculus
tgccgcctgaccaaggtctcctgtg

SEQ ID NO: 64356 - DNA, 25 bp, mus musculus
ctgaccaaggtctcctgtgctgatg

SEQ ID NO: 64357 - DNA, 25 bp, mus musculus
aaggtctcctgtgctgatgataccg

SEQ ID NO: 64358 - DNA, 25 bp, mus musculus
tcctgtgctgatgataccgggaaca

SEQ ID NO: 64359 - DNA, 25 bp, mus musculus
tgacttcttttgttaactaagcatt

SEQ ID NO: 64360 - DNA, 25 bp, mus musculus
cagagagcatcctcttctgaggaga

SEQ ID NO: 64361 - DNA, 25 bp, mus musculus
agagcatcctcttctgaggagagaa

SEQ ID NO: 64362 - DNA, 25 bp, mus musculus
tcctcttctgaggagagaaagatgg

SEQ ID NO: 64363 - DNA, 25 bp, mus musculus
tccagagagcccccttgttaatgtc

SEQ ID NO: 64364 - DNA, 25 bp, mus musculus
ccctcagtggggcaaactcaggagc

SEQ ID NO: 64365 - DNA, 25 bp, mus musculus
ttatcataatatgcctcgaattcca

SEQ ID NO: 64366 - DNA, 25 bp, mus musculus
tcataatatgcctcgaattccaccc

SEQ ID NO: 64367 - DNA, 25 bp, mus musculus
gttctagtctcttcctgaagccagt

SEQ ID NO: 64368 - DNA, 25 bp, mus musculus
tcagccgggcacagtagtcgaagtg

SEQ ID NO: 64369 - DNA, 25 bp, mus musculus
ttctgctccttggtacttagacctg

SEQ ID NO: 64370 - DNA, 25 bp, mus musculus
aactgtcactgacctagaaaatgcc

SEQ ID NO: 64371 - DNA, 25 bp, mus musculus
cactgacctagaaaatgcctacaaa

SEQ ID NO: 64372 - DNA, 25 bp, mus musculus
ctacaaacgactggccgtgcaccgc

SEQ ID NO: 64373 - DNA, 25 bp, mus musculus
acgactggccgtgcaccgctgcaga

SEQ ID NO: 64374 - DNA, 25 bp, mus musculus
gcaccgctgcagaatggtcagccgt

SEQ ID NO: 64375 - DNA, 25 bp, mus musculus
tggaatagctgcacaacctctctat

SEQ ID NO: 64376 - DNA, 25 bp, mus musculus
agctgcacaacctctctatactgga

SEQ ID NO: 64377 - DNA, 25 bp, mus musculus
tctctatactggatactgtaactat

SEQ ID NO: 64378 - DNA, 25 bp, mus musculus
gtgacagacgtctacagcattccag

SEQ ID NO: 64379 - DNA, 25 bp, mus musculus
gacgtctacagcattccagctatga

SEQ ID NO: 64380 - DNA, 25 bp, mus musculus
tccttggtacttagacctgatcagc

SEQ ID NO: 64381 - DNA, 25 bp, mus musculus
gtacttagacctgatcagctatggg

SEQ ID NO: 64382 - DNA, 25 bp, mus musculus
agacctgatcagctatgggcaagac

SEQ ID NO: 64383 - DNA, 25 bp, mus musculus
gccccttaattttgaaggctctgag

SEQ ID NO: 64384 - DNA, 25 bp, mus musculus
taattttgaaggctctgagaagcag

SEQ ID NO: 64385 - DNA, 25 bp, mus musculus
tccaagattatggcctcgagcaagc

SEQ ID NO: 64386 - DNA, 25 bp, mus musculus
attatggcctcgagcaagcgctgtt

SEQ ID NO: 64387 - DNA, 25 bp, mus musculus
agcaagcgctgttggtgagagactc

SEQ ID NO: 64388 - DNA, 25 bp, mus musculus
agcagatcgtgcaccaggctggtgc

SEQ ID NO: 64389 - DNA, 25 bp, mus musculus
ctgggcaccagatcatcgtgcagaa

SEQ ID NO: 64390 - DNA, 25 bp, mus musculus
cactggcttcagcgatcagtgaggg

SEQ ID NO: 64391 - DNA, 25 bp, mus musculus
gtactgtgctcacagcccgggcagg

SEQ ID NO: 64392 - DNA, 25 bp, mus musculus
acagtactgaacaggccactgtgac

SEQ ID NO: 64393 - DNA, 25 bp, mus musculus
aggccactgtgacaatggtgtcatc

SEQ ID NO: 64394 - DNA, 25 bp, mus musculus
agatccttgagcacggaggagagct

SEQ ID NO: 64395 - DNA, 25 bp, mus musculus
tggtcattgcttcaccagagggcca

SEQ ID NO: 64396 - DNA, 25 bp, mus musculus
ttgcttcaccagagggccagcttga

SEQ ID NO: 64397 - DNA, 25 bp, mus musculus
ttgagggcctctgctgtggaagatc

SEQ ID NO: 64398 - DNA, 25 bp, mus musculus
gcccgcacttgcctggtcagaagac

SEQ ID NO: 64399 - DNA, 25 bp, mus musculus
cttcaggcagccaaaggagagagag

SEQ ID NO: 64400 - DNA, 25 bp, mus musculus
accagatcatcgtgcagaatgtcac

SEQ ID NO: 64401 - DNA, 25 bp, mus musculus
agacagcactgggttcggaggcagc

SEQ ID NO: 64402 - DNA, 25 bp, mus musculus
cactgggttcggaggcagctgctgc

SEQ ID NO: 64403 - DNA, 25 bp, mus musculus
aggcagctgctgcagacacgatcac

SEQ ID NO: 64404 - DNA, 25 bp, mus musculus
ctgctgcagacacgatcaccattgc

SEQ ID NO: 64405 - DNA, 25 bp, mus musculus
cgatcaccattgccactcctgagag

SEQ ID NO: 64406 - DNA, 25 bp, mus musculus
gtcttactgagcaggtggccatgac

SEQ ID NO: 64407 - DNA, 25 bp, mus musculus
ccatgacactggcttcagcgatcag

SEQ ID NO: 64408 - DNA, 25 bp, mus musculus
gaaatggcagcgggctctaaattat

SEQ ID NO: 64409 - DNA, 25 bp, mus musculus
tgtccacctggaagagacaattgag

SEQ ID NO: 64410 - DNA, 25 bp, mus musculus
cttgacttccaaaggagagaacagt

SEQ ID NO: 64411 - DNA, 25 bp, mus musculus
gtactttgacgccatggaagactct

SEQ ID NO: 64412 - DNA, 25 bp, mus musculus
ctttgacgccatggaagactctaca

SEQ ID NO: 64413 - DNA, 25 bp, mus musculus
ggaagactctacatctttcatcacc

SEQ ID NO: 64414 - DNA, 25 bp, mus musculus
ctctacatctttcatcaccgtagtc

SEQ ID NO: 64415 - DNA, 25 bp, mus musculus
tacatctttcatcaccgtagtcact

SEQ ID NO: 64416 - DNA, 25 bp, mus musculus
atctttcatcaccgtagtcactgag

SEQ ID NO: 64417 - DNA, 25 bp, mus musculus
catcaccgtagtcactgaggccaag

SEQ ID NO: 64418 - DNA, 25 bp, mus musculus
caccgtagtcactgaggccaaggaa

SEQ ID NO: 64419 - DNA, 25 bp, mus musculus
cgtagtcactgaggccaaggaagac

SEQ ID NO: 64420 - DNA, 25 bp, mus musculus
caagcagcacaacagtcttgaacgg

SEQ ID NO: 64421 - DNA, 25 bp, mus musculus
gcagcacaacagtcttgaacgggcc

SEQ ID NO: 64422 - DNA, 25 bp, mus musculus
cagtcttgaacgggccttctgcaac

SEQ ID NO: 64423 - DNA, 25 bp, mus musculus
tcttgaacgggccttctgcaacacc

SEQ ID NO: 64424 - DNA, 25 bp, mus musculus
cgggccagccagctccagcaagagc

SEQ ID NO: 64425 - DNA, 25 bp, mus musculus
gccagccagctccagcaagagcttc

SEQ ID NO: 64426 - DNA, 25 bp, mus musculus
agccagctccagcaagagcttcagc

SEQ ID NO: 64427 - DNA, 25 bp, mus musculus
aagcttcttgacttccaaaggagag

SEQ ID NO: 64428 - DNA, 25 bp, mus musculus
aattctctgtccatgtggagtctgt

SEQ ID NO: 64429 - DNA, 25 bp, mus musculus
tcctgaatcgtgtccctcagccaga

SEQ ID NO: 64430 - DNA, 25 bp, mus musculus
cacccagtggcagatttggcaccat

SEQ ID NO: 64431 - DNA, 25 bp, mus musculus
ccaaggcagctgccacctacgtgca

SEQ ID NO: 64432 - DNA, 25 bp, mus musculus
cagctgccacctacgtgcaggagtt

SEQ ID NO: 64433 - DNA, 25 bp, mus musculus
aggagtttctgccacacagcctctg

SEQ ID NO: 64434 - DNA, 25 bp, mus musculus
ttctgccacacagcctctgtgccat

SEQ ID NO: 64435 - DNA, 25 bp, mus musculus
cacacagcctctgtgccatgcagtg

SEQ ID NO: 64436 - DNA, 25 bp, mus musculus
tgtgggttctgcctgttagaacact

SEQ ID NO: 64437 - DNA, 25 bp, mus musculus
gaacacttcagtagctagcccgtct

SEQ ID NO: 64438 - DNA, 25 bp, mus musculus
ttcagtagctagcccgtctggttga

SEQ ID NO: 64439 - DNA, 25 bp, mus musculus
gctgacgatctcactacttttgaag

SEQ ID NO: 64440 - DNA, 25 bp, mus musculus
gccaacttctggttgaagccatcct

SEQ ID NO: 64441 - DNA, 25 bp, mus musculus
ttgttctcaccatgctggcagatat

SEQ ID NO: 64442 - DNA, 25 bp, mus musculus
tcaccatgctggcagatattgaaat

SEQ ID NO: 64443 - DNA, 25 bp, mus musculus
ggagcatcattgctgtggagaaaat

SEQ ID NO: 64444 - DNA, 25 bp, mus musculus
atgataccatgttggcaaaggatcc

SEQ ID NO: 64445 - DNA, 25 bp, mus musculus
ctgcatctggcatctgtactctcct

SEQ ID NO: 64446 - DNA, 25 bp, mus musculus
tctgtactctcctgtatgacagtgc

SEQ ID NO: 64447 - DNA, 25 bp, mus musculus
acagtgcacccagtggcagatttgg

SEQ ID NO: 64448 - DNA, 25 bp, mus musculus
actacccagtgtctgatccctagac

SEQ ID NO: 64449 - DNA, 25 bp, mus musculus
gcgccactctggtctggagtactaa

SEQ ID NO: 64450 - DNA, 25 bp, mus musculus
tcctagacttttcagctagctgggc

SEQ ID NO: 64451 - DNA, 25 bp, mus musculus
acttttcagctagctgggccactca

SEQ ID NO: 64452 - DNA, 25 bp, mus musculus
cagctagctgggccactcattcctt

SEQ ID NO: 64453 - DNA, 25 bp, mus musculus
ctagctgggccactcattccttgaa

SEQ ID NO: 64454 - DNA, 25 bp, mus musculus
ccactcattccttgaaatcaagcaa

SEQ ID NO: 64455 - DNA, 25 bp, mus musculus
ctcattccttgaaatcaagcaacct

SEQ ID NO: 64456 - DNA, 25 bp, mus musculus
tgaaatcaagcaacctgaagagtcc

SEQ ID NO: 64457 - DNA, 25 bp, mus musculus
aatcaagcaacctgaagagtcccac

SEQ ID NO: 64458 - DNA, 25 bp, mus musculus
tccctagccagtatggcgcagaggt

SEQ ID NO: 64459 - DNA, 25 bp, mus musculus
ctagccagtatggcgcagaggttag

SEQ ID NO: 64460 - DNA, 25 bp, mus musculus
ccactctggtctggagtactaatca

SEQ ID NO: 64461 - DNA, 25 bp, mus musculus
cttgctaggctttcttaggaacagg

SEQ ID NO: 64462 - DNA, 25 bp, mus musculus
tcaaattacacctgtccctcactca

SEQ ID NO: 64463 - DNA, 25 bp, mus musculus
tcactcagtgcccaatcataaaggg

SEQ ID NO: 64464 - DNA, 25 bp, mus musculus
ctcagtgcccaatcataaagggtcc

SEQ ID NO: 64465 - DNA, 25 bp, mus musculus
agaagccgagccaacagctcctaga

SEQ ID NO: 64466 - DNA, 25 bp, mus musculus
gccaacagctcctagacttttcagc

SEQ ID NO: 64467 - DNA, 25 bp, mus musculus
aacagctcctagacttttcagctag

SEQ ID NO: 64468 - DNA, 25 bp, mus musculus
ccatgaagacttccaggtcacagag

SEQ ID NO: 64469 - DNA, 25 bp, mus musculus
tgaagacttccaggtcacagaggaa

SEQ ID NO: 64470 - DNA, 25 bp, mus musculus
agagtccgtgctgcagatgatgcag

SEQ ID NO: 64471 - DNA, 25 bp, mus musculus
catctacttgagcgacatgggtgcg

SEQ ID NO: 64472 - DNA, 25 bp, mus musculus
ggagtcccatgagctgcaagatgtt

SEQ ID NO: 64473 - DNA, 25 bp, mus musculus
tgagctgcaagatgttctggaagag

SEQ ID NO: 64474 - DNA, 25 bp, mus musculus
ggaagagaccaacatccttaagcgg

SEQ ID NO: 64475 - DNA, 25 bp, mus musculus
agagaccaacatccttaagcggctc

SEQ ID NO: 64476 - DNA, 25 bp, mus musculus
gaccaacatccttaagcggctctat

SEQ ID NO: 64477 - DNA, 25 bp, mus musculus
caacatccttaagcggctctataag

SEQ ID NO: 64478 - DNA, 25 bp, mus musculus
catccttaagcggctctataaggcc

SEQ ID NO: 64479 - DNA, 25 bp, mus musculus
ccttaagcggctctataaggccctg

SEQ ID NO: 64480 - DNA, 25 bp, mus musculus
agacttccaggtcacagaggaagtg

SEQ ID NO: 64481 - DNA, 25 bp, mus musculus
agtgaaggccctgactgcagagatt

SEQ ID NO: 64482 - DNA, 25 bp, mus musculus
gaaggccctgactgcagagattgtg

SEQ ID NO: 64483 - DNA, 25 bp, mus musculus
tcgggatatcatcgccttgaaccct

SEQ ID NO: 64484 - DNA, 25 bp, mus musculus
ggatatcatcgccttgaaccctctg

SEQ ID NO: 64485 - DNA, 25 bp, mus musculus
catcgccttgaaccctctgtacaga

SEQ ID NO: 64486 - DNA, 25 bp, mus musculus
cgccttgaaccctctgtacagagag

SEQ ID NO: 64487 - DNA, 25 bp, mus musculus
cttgaaccctctgtacagagagtcc

SEQ ID NO: 64488 - DNA, 25 bp, mus musculus
ttatagtatctcctatggatcaatt

SEQ ID NO: 64489 - DNA, 25 bp, mus musculus
tatctcctatggatcaattacagag

SEQ ID NO: 64490 - DNA, 25 bp, mus musculus
agcaggtgcctttggggaatgctcc

SEQ ID NO: 64491 - DNA, 25 bp, mus musculus
atgctccaacctgtttcatccccaa

SEQ ID NO: 64492 - DNA, 25 bp, mus musculus
tttccgaggacactgtcatgcacga

SEQ ID NO: 64493 - DNA, 25 bp, mus musculus
aggacactgtcatgcacgacctcac

SEQ ID NO: 64494 - DNA, 25 bp, mus musculus
ctgtcatgcacgacctcacatttct

SEQ ID NO: 64495 - DNA, 25 bp, mus musculus
tgcacgacctcacatttctaaaaga

SEQ ID NO: 64496 - DNA, 25 bp, mus musculus
acctccttcctcaagagacaaatga

SEQ ID NO: 64497 - DNA, 25 bp, mus musculus
tcacactcagcaaacaggagatgtt

SEQ ID NO: 64498 - DNA, 25 bp, mus musculus
agatgttctgctcagatatgaattt

SEQ ID NO: 64499 - DNA, 25 bp, mus musculus
tttcgtactcccaataaatgactct

SEQ ID NO: 64500 - DNA, 25 bp, mus musculus
gcacaatgactgtcgttggatatat

SEQ ID NO: 64501 - DNA, 25 bp, mus musculus
tacaagtggctcctgttccacaata

SEQ ID NO: 64502 - DNA, 25 bp, mus musculus
ctgttccacaatactaactactata

SEQ ID NO: 64503 - DNA, 25 bp, mus musculus
cacaatactaactactatatttcta

SEQ ID NO: 64504 - DNA, 25 bp, mus musculus
tactatatttctacattgtgacttg

SEQ ID NO: 64505 - DNA, 25 bp, mus musculus
atatggtgtctacctggtatctctc

SEQ ID NO: 64506 - DNA, 25 bp, mus musculus
cctggtatctctctcccaataagaa

SEQ ID NO: 64507 - DNA, 25 bp, mus musculus
atctctctcccaataagaagcaggt

SEQ ID NO: 64508 - DNA, 25 bp, mus musculus
agaagcaccctgtatagttcttctg

SEQ ID NO: 64509 - DNA, 25 bp, mus musculus
ctgtatagttcttctggcttttgca

SEQ ID NO: 64510 - DNA, 25 bp, mus musculus
tctcagtgctttggccctgctgagt

SEQ ID NO: 64511 - DNA, 25 bp, mus musculus
cagtgctttggccctgctgagttta

SEQ ID NO: 64512 - DNA, 25 bp, mus musculus
tttggccctgctgagtttagcaggt

SEQ ID NO: 64513 - DNA, 25 bp, mus musculus
taacactttttcagctaaggtgact

SEQ ID NO: 64514 - DNA, 25 bp, mus musculus
ggctagttgccatgatgcagtggcg

SEQ ID NO: 64515 - DNA, 25 bp, mus musculus
tacttatgccaatgaatgtgttctg

SEQ ID NO: 64516 - DNA, 25 bp, mus musculus
tgaatgtgttctgtgctttgaaaac

SEQ ID NO: 64517 - DNA, 25 bp, mus musculus
atgtgttctgtgctttgaaaacagg

SEQ ID NO: 64518 - DNA, 25 bp, mus musculus
acgcatagagcctgtcctcattcga

SEQ ID NO: 64519 - DNA, 25 bp, mus musculus
tgtcctcattcgaaaaggtgggcct

SEQ ID NO: 64520 - DNA, 25 bp, mus musculus
tatagttcttctggcttttgcaccc

SEQ ID NO: 64521 - DNA, 25 bp, mus musculus
agttcttctggcttttgcacccaga

SEQ ID NO: 64522 - DNA, 25 bp, mus musculus
ggcttttgcacccagatcttcgaca

SEQ ID NO: 64523 - DNA, 25 bp, mus musculus
ttttgcacccagatcttcgacaatg

SEQ ID NO: 64524 - DNA, 25 bp, mus musculus
tgcacccagatcttcgacaatgaag

SEQ ID NO: 64525 - DNA, 25 bp, mus musculus
cagatcttcgacaatgaaggtggct

SEQ ID NO: 64526 - DNA, 25 bp, mus musculus
atcttcgacaatgaaggtggctgtc

SEQ ID NO: 64527 - DNA, 25 bp, mus musculus
tcttctcagtgctttggccctgctg

SEQ ID NO: 64528 - DNA, 25 bp, mus musculus
acttagctctatatcctggaagtga

SEQ ID NO: 64529 - DNA, 25 bp, mus musculus
tagctctatatcctggaagtgattc

SEQ ID NO: 64530 - DNA, 25 bp, mus musculus
tctatcgctcaccgattccatctca

SEQ ID NO: 64531 - DNA, 25 bp, mus musculus
atcgctcaccgattccatctcatga

SEQ ID NO: 64532 - DNA, 25 bp, mus musculus
ttccatctcatgagagagaaatatc

SEQ ID NO: 64533 - DNA, 25 bp, mus musculus
tactttgagtttgccacatctgagt

SEQ ID NO: 64534 - DNA, 25 bp, mus musculus
gagtttgccacatctgagtccatct

SEQ ID NO: 64535 - DNA, 25 bp, mus musculus
gagtccatcttctcaacatgcaaaa

SEQ ID NO: 64536 - DNA, 25 bp, mus musculus
tccatcttctcaacatgcaaaaagc

SEQ ID NO: 64537 - DNA, 25 bp, mus musculus
gagtctgtaaccgttgagatatgcg

SEQ ID NO: 64538 - DNA, 25 bp, mus musculus
tctgtaaccgttgagatatgcggga

SEQ ID NO: 64539 - DNA, 25 bp, mus musculus
atatgcgggaagctgctggatctga

SEQ ID NO: 64540 - DNA, 25 bp, mus musculus
gttccctctcaaatcatcaataact

SEQ ID NO: 64541 - DNA, 25 bp, mus musculus
ccctctcaaatcatcaataactact

SEQ ID NO: 64542 - DNA, 25 bp, mus musculus
tctcaaatcatcaataactacttct

SEQ ID NO: 64543 - DNA, 25 bp, mus musculus
atcatcaataactacttctccattg

SEQ ID NO: 64544 - DNA, 25 bp, mus musculus
atcaataactacttctccattggcg

SEQ ID NO: 64545 - DNA, 25 bp, mus musculus
ttctccattggcgtggatgcttcta

SEQ ID NO: 64546 - DNA, 25 bp, mus musculus
tccattggcgtggatgcttctatcg

SEQ ID NO: 64547 - DNA, 25 bp, mus musculus
gatgcttctatcgctcaccgattcc

SEQ ID NO: 64548 - DNA, 25 bp, mus musculus
catttgaacttttgtgcagtgccta

SEQ ID NO: 64549 - DNA, 25 bp, mus musculus
ttgaacttttgtgcagtgcctagag

SEQ ID NO: 64550 - DNA, 25 bp, mus musculus
gtccaacacttcagagcacaagagc

SEQ ID NO: 64551 - DNA, 25 bp, mus musculus
cacttcagagcacaagagcttggct

SEQ ID NO: 64552 - DNA, 25 bp, mus musculus
agagcacaagagcttggctgctatt

SEQ ID NO: 64553 - DNA, 25 bp, mus musculus
gagcttggctgctattcaagtagtt

SEQ ID NO: 64554 - DNA, 25 bp, mus musculus
cttggctgctattcaagtagttaca

SEQ ID NO: 64555 - DNA, 25 bp, mus musculus
ttgtttcattcagtacaacagaaaa

SEQ ID NO: 64556 - DNA, 25 bp, mus musculus
tttcattcagtacaacagaaaagca

SEQ ID NO: 64557 - DNA, 25 bp, mus musculus
tatattagcagccattaaaagttac

SEQ ID NO: 64558 - DNA, 25 bp, mus musculus
aatctgatccagtttactctgctca

SEQ ID NO: 64559 - DNA, 25 bp, mus musculus
tttactctgctcaagtaaaggaacg

SEQ ID NO: 64560 - DNA, 25 bp, mus musculus
ttttgtgcagtgcctagagatggta

SEQ ID NO: 64561 - DNA, 25 bp, mus musculus
tgtgcagtgcctagagatggtatcc

SEQ ID NO: 64562 - DNA, 25 bp, mus musculus
tatatctggacttctttaagttcaa

SEQ ID NO: 64563 - DNA, 25 bp, mus musculus
tggacttctttaagttcaagaagat

SEQ ID NO: 64564 - DNA, 25 bp, mus musculus
taaacgtgtgcttctgtccaacact

SEQ ID NO: 64565 - DNA, 25 bp, mus musculus
tgtgcttctgtccaacacttcagag

SEQ ID NO: 64566 - DNA, 25 bp, mus musculus
gcttctgtccaacacttcagagcac

SEQ ID NO: 64567 - DNA, 25 bp, mus musculus
tctgtccaacacttcagagcacaag

SEQ ID NO: 64568 - DNA, 25 bp, mus musculus
gagcacactcaagagccacaagcgc

SEQ ID NO: 64569 - DNA, 25 bp, mus musculus
actcaagagccacaagcgcatccac

SEQ ID NO: 64570 - DNA, 25 bp, mus musculus
aacacacaacggtgcctcgccatac

SEQ ID NO: 64571 - DNA, 25 bp, mus musculus
gccataccagtgtaccatctgcacg

SEQ ID NO: 64572 - DNA, 25 bp, mus musculus
ccagtgtaccatctgcacggaatac

SEQ ID NO: 64573 - DNA, 25 bp, mus musculus
taccatctgcacggaatactgcccc

SEQ ID NO: 64574 - DNA, 25 bp, mus musculus
ctcctccatgcagaaacacatgaag

SEQ ID NO: 64575 - DNA, 25 bp, mus musculus
catgaagggccacaagccggaggag

SEQ ID NO: 64576 - DNA, 25 bp, mus musculus
gggccacaagccggaggagatccca

SEQ ID NO: 64577 - DNA, 25 bp, mus musculus
gaagacgtacctctacctgtgttat

SEQ ID NO: 64578 - DNA, 25 bp, mus musculus
tgatagttacttggccttggattat

SEQ ID NO: 64579 - DNA, 25 bp, mus musculus
gatctggctatcaaaccactgcccc

SEQ ID NO: 64580 - DNA, 25 bp, mus musculus
gagccacaagcgcatccacacaggg

SEQ ID NO: 64581 - DNA, 25 bp, mus musculus
ctccctggcgacagcaacggaattc

SEQ ID NO: 64582 - DNA, 25 bp, mus musculus
gttcagcctcaagcaccagttggag

SEQ ID NO: 64583 - DNA, 25 bp, mus musculus
cctcaagcaccagttggagacgcac

SEQ ID NO: 64584 - DNA, 25 bp, mus musculus
gacgcactacagggttcacacaggt

SEQ ID NO: 64585 - DNA, 25 bp, mus musculus
tgagaagccctttgagtgcaaactc

SEQ ID NO: 64586 - DNA, 25 bp, mus musculus
tgagtgcaaactctgccaccagcgc

SEQ ID NO: 64587 - DNA, 25 bp, mus musculus
agactactcggccatgatcaagcac

SEQ ID NO: 64588 - DNA, 25 bp, mus musculus
ctcggccatgatcaagcacctgaga

SEQ ID NO: 64589 - DNA, 25 bp, mus musculus
aaggacctggtgtcagcttgtggca

SEQ ID NO: 64590 - DNA, 25 bp, mus musculus
ggacctggtgtcagcttgtggcagt

SEQ ID NO: 64591 - DNA, 25 bp, mus musculus
ggtagtgactctgagcccgacagtc

SEQ ID NO: 64592 - DNA, 25 bp, mus musculus
tagtgactctgagcccgacagtcca

SEQ ID NO: 64593 - DNA, 25 bp, mus musculus
gactctgagcccgacagtccagcct

SEQ ID NO: 64594 - DNA, 25 bp, mus musculus
ctctgagcccgacagtccagccttt

SEQ ID NO: 64595 - DNA, 25 bp, mus musculus
ctgagcccgacagtccagcctttga

SEQ ID NO: 64596 - DNA, 25 bp, mus musculus
gagcccgacagtccagcctttgagg

SEQ ID NO: 64597 - DNA, 25 bp, mus musculus
ccgacagtccagcctttgaggatag

SEQ ID NO: 64598 - DNA, 25 bp, mus musculus
cagtccagcctttgaggatagccag

SEQ ID NO: 64599 - DNA, 25 bp, mus musculus
gtccagcctttgaggatagccaggt

SEQ ID NO: 64600 - DNA, 25 bp, mus musculus
agcctttgaggatagccaggtcaaa

SEQ ID NO: 64601 - DNA, 25 bp, mus musculus
agagtagccccttgtcttttggcag

SEQ ID NO: 64602 - DNA, 25 bp, mus musculus
agtagccccttgtcttttggcagca

SEQ ID NO: 64603 - DNA, 25 bp, mus musculus
tagccccttgtcttttggcagcaga

SEQ ID NO: 64604 - DNA, 25 bp, mus musculus
cttgtcttttggcagcagagctagc

SEQ ID NO: 64605 - DNA, 25 bp, mus musculus
tgtcttttggcagcagagctagcag

SEQ ID NO: 64606 - DNA, 25 bp, mus musculus
tcttttggcagcagagctagcagca

SEQ ID NO: 64607 - DNA, 25 bp, mus musculus
ttttggcagcagagctagcagcagt

SEQ ID NO: 64608 - DNA, 25 bp, mus musculus
ctagcagcagtggtggtagtgactc

SEQ ID NO: 64609 - DNA, 25 bp, mus musculus
gccactgggcctacggacaagggcg

SEQ ID NO: 64610 - DNA, 25 bp, mus musculus
cataaaagcctgctggctcggggcg

SEQ ID NO: 64611 - DNA, 25 bp, mus musculus
agagctgggctttggacagaaaaga

SEQ ID NO: 64612 - DNA, 25 bp, mus musculus
agacagagcacaggacctgtccctg

SEQ ID NO: 64613 - DNA, 25 bp, mus musculus
cagagcacaggacctgtccctgtga

SEQ ID NO: 64614 - DNA, 25 bp, mus musculus
acaggacctgtccctgtgagcgcct

SEQ ID NO: 64615 - DNA, 25 bp, mus musculus
agtgtaccagggcagcccctgagtc

SEQ ID NO: 64616 - DNA, 25 bp, mus musculus
ctgagtccacatgcacacctcagca

SEQ ID NO: 64617 - DNA, 25 bp, mus musculus
catgcacacctcagcagcctatatt

SEQ ID NO: 64618 - DNA, 25 bp, mus musculus
ggtttagcctcaagggctggaagct

SEQ ID NO: 64619 - DNA, 25 bp, mus musculus
ttagcctcaagggctggaagctggg

SEQ ID NO: 64620 - DNA, 25 bp, mus musculus
gcctcaagggctggaagctgggcct

SEQ ID NO: 64621 - DNA, 25 bp, mus musculus
cctgctcctctgtcctcaaacagtg

SEQ ID NO: 64622 - DNA, 25 bp, mus musculus
gctcctctgtcctcaaacagtgaac

SEQ ID NO: 64623 - DNA, 25 bp, mus musculus
cctctgtcctcaaacagtgaaccca

SEQ ID NO: 64624 - DNA, 25 bp, mus musculus
agtgaacccaggctgcagcctgaga

SEQ ID NO: 64625 - DNA, 25 bp, mus musculus
aggctgcagcctgagacctggactc

SEQ ID NO: 64626 - DNA, 25 bp, mus musculus
ctgcagcctgagacctggactctag

SEQ ID NO: 64627 - DNA, 25 bp, mus musculus
cagcctgagacctggactctagccc

SEQ ID NO: 64628 - DNA, 25 bp, mus musculus
ctcccagctagagggagagctgggc

SEQ ID NO: 64629 - DNA, 25 bp, mus musculus
gacactgagtgccatttctgcaagt

SEQ ID NO: 64630 - DNA, 25 bp, mus musculus
gagtgccatttctgcaagtctgtga

SEQ ID NO: 64631 - DNA, 25 bp, mus musculus
gctatgcacaggcaatgcaccaggc

SEQ ID NO: 64632 - DNA, 25 bp, mus musculus
cacaggcaatgcaccaggcctgcct

SEQ ID NO: 64633 - DNA, 25 bp, mus musculus
aggcaatgcaccaggcctgccttcg

SEQ ID NO: 64634 - DNA, 25 bp, mus musculus
cctgccttcgcttctggctagacag

SEQ ID NO: 64635 - DNA, 25 bp, mus musculus
gccttcgcttctggctagacaggca

SEQ ID NO: 64636 - DNA, 25 bp, mus musculus
ttcgcttctggctagacaggcaaaa

SEQ ID NO: 64637 - DNA, 25 bp, mus musculus
tggaacagcacatgccccagctgct

SEQ ID NO: 64638 - DNA, 25 bp, mus musculus
aacagcacatgccccagctgctggc

SEQ ID NO: 64639 - DNA, 25 bp, mus musculus
cccagctgctggccctggtgcctag

SEQ ID NO: 64640 - DNA, 25 bp, mus musculus
tgcctaggagccaggattgcccaat

SEQ ID NO: 64641 - DNA, 25 bp, mus musculus
tgccatttctgcaagtctgtgatca

SEQ ID NO: 64642 - DNA, 25 bp, mus musculus
ttctgcaagtctgtgatcaaccagg

SEQ ID NO: 64643 - DNA, 25 bp, mus musculus
tctgtgatcaaccaggcctggaaca

SEQ ID NO: 64644 - DNA, 25 bp, mus musculus
gtgatcaaccaggcctggaacacca

SEQ ID NO: 64645 - DNA, 25 bp, mus musculus
caggcctggaacaccagtgaacagg

SEQ ID NO: 64646 - DNA, 25 bp, mus musculus
gcctggaacaccagtgaacaggcta

SEQ ID NO: 64647 - DNA, 25 bp, mus musculus
aacaccagtgaacaggctatgcaca

SEQ ID NO: 64648 - DNA, 25 bp, mus musculus
caggctatgcacaggcaatgcacca

SEQ ID NO: 64649 - DNA, 25 bp, mus musculus
gcttcctcacaggttccacgagtca

SEQ ID NO: 64650 - DNA, 25 bp, mus musculus
tcctcacaggttccacgagtcatgt

SEQ ID NO: 64651 - DNA, 25 bp, mus musculus
gataactcagaattacttcacatgc

SEQ ID NO: 64652 - DNA, 25 bp, mus musculus
aactcagaattacttcacatgctcg

SEQ ID NO: 64653 - DNA, 25 bp, mus musculus
gctgtactacaagcccaccaagcga

SEQ ID NO: 64654 - DNA, 25 bp, mus musculus
gtactacaagcccaccaagcgaaag

SEQ ID NO: 64655 - DNA, 25 bp, mus musculus
aacagtgccactggtgttccaactg

SEQ ID NO: 64656 - DNA, 25 bp, mus musculus
agtgccactggtgttccaactgtct

SEQ ID NO: 64657 - DNA, 25 bp, mus musculus
gccactggtgttccaactgtctaaa

SEQ ID NO: 64658 - DNA, 25 bp, mus musculus
ggtgttccaactgtctaaattgatc

SEQ ID NO: 64659 - DNA, 25 bp, mus musculus
gttccaactgtctaaattgatcagg

SEQ ID NO: 64660 - DNA, 25 bp, mus musculus
acagaaactcgtgcttcaccgaaga

SEQ ID NO: 64661 - DNA, 25 bp, mus musculus
caggttccacgagtcatgtcaacac

SEQ ID NO: 64662 - DNA, 25 bp, mus musculus
gttccacgagtcatgtcaacacagc

SEQ ID NO: 64663 - DNA, 25 bp, mus musculus
ccacgagtcatgtcaacacagcgtg

SEQ ID NO: 64664 - DNA, 25 bp, mus musculus
tcaacacagcgtgttgctaacacat

SEQ ID NO: 64665 - DNA, 25 bp, mus musculus
gttgctaacacatcaacacagacaa

SEQ ID NO: 64666 - DNA, 25 bp, mus musculus
aacacatcaacacagacaatgggtc

SEQ ID NO: 64667 - DNA, 25 bp, mus musculus
acatcaacacagacaatgggtccac

SEQ ID NO: 64668 - DNA, 25 bp, mus musculus
acaatgggtccacgtcctgcagctg

SEQ ID NO: 64669 - DNA, 25 bp, mus musculus
cgactctgccaacaacgtggtgtat

SEQ ID NO: 64670 - DNA, 25 bp, mus musculus
gtacgaggacatggtcgtggaatct

SEQ ID NO: 64671 - DNA, 25 bp, mus musculus
cggagaccttcatttctctccagac

SEQ ID NO: 64672 - DNA, 25 bp, mus musculus
tttctctccagactctccagagaag

SEQ ID NO: 64673 - DNA, 25 bp, mus musculus
gctatatcctaagctctttaaggga

SEQ ID NO: 64674 - DNA, 25 bp, mus musculus
tcctaagctctttaagggagagctg

SEQ ID NO: 64675 - DNA, 25 bp, mus musculus
agagctgtctcctccttgaatcacc

SEQ ID NO: 64676 - DNA, 25 bp, mus musculus
tccttgaatcacctttgtgcctggt

SEQ ID NO: 64677 - DNA, 25 bp, mus musculus
aatcacctttgtgcctggtgacttt

SEQ ID NO: 64678 - DNA, 25 bp, mus musculus
ctttgtgcctggtgactttctgcca

SEQ ID NO: 64679 - DNA, 25 bp, mus musculus
tgactttctgccacgagatgttcat

SEQ ID NO: 64680 - DNA, 25 bp, mus musculus
tctgccacgagatgttcattacagg

SEQ ID NO: 64681 - DNA, 25 bp, mus musculus
tccagggtggcacatccagagacta

SEQ ID NO: 64682 - DNA, 25 bp, mus musculus
tctacaggttcctggagtaacagag

SEQ ID NO: 64683 - DNA, 25 bp, mus musculus
gtgaagctgctgcccgaagtttcct

SEQ ID NO: 64684 - DNA, 25 bp, mus musculus
cagcaggcttactctctggatgtga

SEQ ID NO: 64685 - DNA, 25 bp, mus musculus
actaaagagatcaccttctgaagat

SEQ ID NO: 64686 - DNA, 25 bp, mus musculus
accttctgaagattcctgcccaagg

SEQ ID NO: 64687 - DNA, 25 bp, mus musculus
tgaagattcctgcccaaggaacaga

SEQ ID NO: 64688 - DNA, 25 bp, mus musculus
gattcagttcaccatctctcctgcc

SEQ ID NO: 64689 - DNA, 25 bp, mus musculus
agcctggctcacccaactactgcaa

SEQ ID NO: 64690 - DNA, 25 bp, mus musculus
accacggcagcggtggcataagccc

SEQ ID NO: 64691 - DNA, 25 bp, mus musculus
ttccacgtacaagagcttgtgaaca

SEQ ID NO: 64692 - DNA, 25 bp, mus musculus
aacacggatttcagccaggctgctc

SEQ ID NO: 64693 - DNA, 25 bp, mus musculus
acggatttcagccaggctgctctca

SEQ ID NO: 64694 - DNA, 25 bp, mus musculus
gatttcagccaggctgctctcaaag

SEQ ID NO: 64695 - DNA, 25 bp, mus musculus
ttcagccaggctgctctcaaaggcc

SEQ ID NO: 64696 - DNA, 25 bp, mus musculus
caggctgctctcaaaggcccctggt

SEQ ID NO: 64697 - DNA, 25 bp, mus musculus
gctgctctcaaaggcccctggtcag

SEQ ID NO: 64698 - DNA, 25 bp, mus musculus
gctctcaaaggcccctggtcaggag

SEQ ID NO: 64699 - DNA, 25 bp, mus musculus
ctcaaaggcccctggtcaggagcag

SEQ ID NO: 64700 - DNA, 25 bp, mus musculus
ccctggtcaggagcagcagagtgag

SEQ ID NO: 64701 - DNA, 25 bp, mus musculus
gcccattggctcaagaagaggtgat

SEQ ID NO: 64702 - DNA, 25 bp, mus musculus
ttgaaaccaacagggcaggtgaggc

SEQ ID NO: 64703 - DNA, 25 bp, mus musculus
tcttaggttcaggcagagtagggtg

SEQ ID NO: 64704 - DNA, 25 bp, mus musculus
gctggaccccaggcacaaagagcca

SEQ ID NO: 64705 - DNA, 25 bp, mus musculus
ggaccccaggcacaaagagccacag

SEQ ID NO: 64706 - DNA, 25 bp, mus musculus
caaagagccacagaaacaggattcc

SEQ ID NO: 64707 - DNA, 25 bp, mus musculus
acaggattccacgtacaagagcttg

SEQ ID NO: 64708 - DNA, 25 bp, mus musculus
ggattccacgtacaagagcttgtga

SEQ ID NO: 64709 - DNA, 25 bp, mus musculus
actacagcaaatacctcgactcccg

SEQ ID NO: 64710 - DNA, 25 bp, mus musculus
attttgtgcagtggttgatgaacac

SEQ ID NO: 64711 - DNA, 25 bp, mus musculus
tggacaatcttgccaccagggactt

SEQ ID NO: 64712 - DNA, 25 bp, mus musculus
ccaccagggacttcatcaactggct

SEQ ID NO: 64713 - DNA, 25 bp, mus musculus
tcatcaactggctgattcaaaccaa

SEQ ID NO: 64714 - DNA, 25 bp, mus musculus
actggctgattcaaaccaagatcac

SEQ ID NO: 64715 - DNA, 25 bp, mus musculus
tgattcaaaccaagatcactgacaa

SEQ ID NO: 64716 - DNA, 25 bp, mus musculus
aggtactttcaccattcacaaccat

SEQ ID NO: 64717 - DNA, 25 bp, mus musculus
tttcaccattcacaaccatcttcac

SEQ ID NO: 64718 - DNA, 25 bp, mus musculus
caaccatcttcacaacatctctgcg

SEQ ID NO: 64719 - DNA, 25 bp, mus musculus
tcttcacaacatctctgcggaatga

SEQ ID NO: 64720 - DNA, 25 bp, mus musculus
caacatctctgcggaatgaattcca

SEQ ID NO: 64721 - DNA, 25 bp, mus musculus
acattgccaaacgtcatgatgaatt

SEQ ID NO: 64722 - DNA, 25 bp, mus musculus
ggacctttaccagtgatgtgagttc

SEQ ID NO: 64723 - DNA, 25 bp, mus musculus
acttcccagaagaagtcgccattgc

SEQ ID NO: 64724 - DNA, 25 bp, mus musculus
ctgaggaactcggccgcaggcacgc

SEQ ID NO: 64725 - DNA, 25 bp, mus musculus
aactcggccgcaggcacgctgatgg

SEQ ID NO: 64726 - DNA, 25 bp, mus musculus
ctgatggctccttctctgatgagat

SEQ ID NO: 64727 - DNA, 25 bp, mus musculus
gctccttctctgatgagatgagcac

SEQ ID NO: 64728 - DNA, 25 bp, mus musculus
ccattctggacaatcttgccaccag

SEQ ID NO: 64729 - DNA, 25 bp, mus musculus
accccagactccgtcagtttctgca

SEQ ID NO: 64730 - DNA, 25 bp, mus musculus
tccgtcagtttctgcagaagtctct

SEQ ID NO: 64731 - DNA, 25 bp, mus musculus
caccccgggaacgcaaagctggctg

SEQ ID NO: 64732 - DNA, 25 bp, mus musculus
gctgcaagaacttcttctggaagac

SEQ ID NO: 64733 - DNA, 25 bp, mus musculus
gcaagaacttcttctggaagacatt

SEQ ID NO: 64734 - DNA, 25 bp, mus musculus
aatattgttgtcctagccagacctc

SEQ ID NO: 64735 - DNA, 25 bp, mus musculus
attgttgtcctagccagacctctga

SEQ ID NO: 64736 - DNA, 25 bp, mus musculus
gttgtcctagccagacctctgatcc

SEQ ID NO: 64737 - DNA, 25 bp, mus musculus
ccatatctcttccttaactcctggc

SEQ ID NO: 64738 - DNA, 25 bp, mus musculus
ctcaacttgaccctgcattagaaat

SEQ ID NO: 64739 - DNA, 25 bp, mus musculus
aacttgaccctgcattagaaattga

SEQ ID NO: 64740 - DNA, 25 bp, mus musculus
ttgaccctgcattagaaattgaaga

SEQ ID NO: 64741 - DNA, 25 bp, mus musculus
agtttctgcagaagtctctggcggc

SEQ ID NO: 64742 - DNA, 25 bp, mus musculus
tgcagaagtctctggcggctgccac

SEQ ID NO: 64743 - DNA, 25 bp, mus musculus
atgatgccctggagcccgaggattt

SEQ ID NO: 64744 - DNA, 25 bp, mus musculus
aggatttgccccaggcagctgagca

SEQ ID NO: 64745 - DNA, 25 bp, mus musculus
atttgccccaggcagctgagcagga

SEQ ID NO: 64746 - DNA, 25 bp, mus musculus
tgccccaggcagctgagcaggacga

SEQ ID NO: 64747 - DNA, 25 bp, mus musculus
agaggtctgccaactcgaacccagc

SEQ ID NO: 64748 - DNA, 25 bp, mus musculus
ggtctgccaactcgaacccagcaat

SEQ ID NO: 64749 - DNA, 25 bp, mus musculus
agtgactacctcctaatggtttctg

SEQ ID NO: 64750 - DNA, 25 bp, mus musculus
tgactacctcctaatggtttctgta

SEQ ID NO: 64751 - DNA, 25 bp, mus musculus
cactggaagaggctccccagctgtg

SEQ ID NO: 64752 - DNA, 25 bp, mus musculus
aagaggctccccagctgtgactcta

SEQ ID NO: 64753 - DNA, 25 bp, mus musculus
ggctccccagctgtgactctagtac

SEQ ID NO: 64754 - DNA, 25 bp, mus musculus
ctccccagctgtgactctagtacag

SEQ ID NO: 64755 - DNA, 25 bp, mus musculus
ccccagctgtgactctagtacagtt

SEQ ID NO: 64756 - DNA, 25 bp, mus musculus
ccagctgtgactctagtacagttac

SEQ ID NO: 64757 - DNA, 25 bp, mus musculus
ctgtgactctagtacagttaccttc

SEQ ID NO: 64758 - DNA, 25 bp, mus musculus
gactctagtacagttaccttcaggc

SEQ ID NO: 64759 - DNA, 25 bp, mus musculus
ctctagtacagttaccttcaggcca

SEQ ID NO: 64760 - DNA, 25 bp, mus musculus
taccttcaggccaaactgtacaagt

SEQ ID NO: 64761 - DNA, 25 bp, mus musculus
tacctcctaatggtttctgtagctg

SEQ ID NO: 64762 - DNA, 25 bp, mus musculus
accttcaggccaaactgtacaagtg

SEQ ID NO: 64763 - DNA, 25 bp, mus musculus
cctcctaatggtttctgtagctgga

SEQ ID NO: 64764 - DNA, 25 bp, mus musculus
tggtttctgtagctggatcaggcac

SEQ ID NO: 64765 - DNA, 25 bp, mus musculus
gtttctgtagctggatcaggcactg

SEQ ID NO: 64766 - DNA, 25 bp, mus musculus
ttctgtagctggatcaggcactgga

SEQ ID NO: 64767 - DNA, 25 bp, mus musculus
gtagctggatcaggcactggaagag

SEQ ID NO: 64768 - DNA, 25 bp, mus musculus
agctggatcaggcactggaagaggc

SEQ ID NO: 64769 - DNA, 25 bp, mus musculus
ggatcaggcactggaagaggctccc

SEQ ID NO: 64770 - DNA, 25 bp, mus musculus
cccccagaggcgcttcggcagttca

SEQ ID NO: 64771 - DNA, 25 bp, mus musculus
cccagaggcgcttcggcagttcagt

SEQ ID NO: 64772 - DNA, 25 bp, mus musculus
tcttttcctttccaagcgttcagca

SEQ ID NO: 64773 - DNA, 25 bp, mus musculus
tttcctttccaagcgttcagcaatt

SEQ ID NO: 64774 - DNA, 25 bp, mus musculus
ttcctttccaagcgttcagcaattc

SEQ ID NO: 64775 - DNA, 25 bp, mus musculus
cctttccaagcgttcagcaattcta

SEQ ID NO: 64776 - DNA, 25 bp, mus musculus
ctttccaagcgttcagcaattctaa

SEQ ID NO: 64777 - DNA, 25 bp, mus musculus
ttccaagcgttcagcaattctaact

SEQ ID NO: 64778 - DNA, 25 bp, mus musculus
tccaagcgttcagcaattctaactt

SEQ ID NO: 64779 - DNA, 25 bp, mus musculus
tcagcaattctaacttgaccaggag

SEQ ID NO: 64780 - DNA, 25 bp, mus musculus
agcaattctaacttgaccaggagtg

SEQ ID NO: 64781 - DNA, 25 bp, mus musculus
gcaattctaacttgaccaggagtga

SEQ ID NO: 64782 - DNA, 25 bp, mus musculus
ccagaggcgcttcggcagttcagtc

SEQ ID NO: 64783 - DNA, 25 bp, mus musculus
ttctaacttgaccaggagtgaaacg

SEQ ID NO: 64784 - DNA, 25 bp, mus musculus
cttcggcagttcagtcagttgttgc

SEQ ID NO: 64785 - DNA, 25 bp, mus musculus
cagttcagtcagttgttgcagagat

SEQ ID NO: 64786 - DNA, 25 bp, mus musculus
gttcagtcagttgttgcagagattg

SEQ ID NO: 64787 - DNA, 25 bp, mus musculus
ttcagtcagttgttgcagagattga

SEQ ID NO: 64788 - DNA, 25 bp, mus musculus
cttgaagccagtggtagttgaaatt

SEQ ID NO: 64789 - DNA, 25 bp, mus musculus
aattctgaactttaagccagattag

SEQ ID NO: 64790 - DNA, 25 bp, mus musculus
ttctgaactttaagccagattaggg

SEQ ID NO: 64791 - DNA, 25 bp, mus musculus
ttttttcgtcaatgggctgacactt

SEQ ID NO: 64792 - DNA, 25 bp, mus musculus
cgtcaatgggctgacacttgggggc

SEQ ID NO: 64793 - DNA, 25 bp, mus musculus
gactgccaagacgctagtcctgctg

SEQ ID NO: 64794 - DNA, 25 bp, mus musculus
tgccaagacgctagtcctgctgatg

SEQ ID NO: 64795 - DNA, 25 bp, mus musculus
gacgctagtcctgctgatgggcaaa

SEQ ID NO: 64796 - DNA, 25 bp, mus musculus
agtcctgctgatgggcaaagaaggt

SEQ ID NO: 64797 - DNA, 25 bp, mus musculus
ttatgaaatggcctctcacctgcgg

SEQ ID NO: 64798 - DNA, 25 bp, mus musculus
ttcccagtactgacctcgtctgtcc

SEQ ID NO: 64799 - DNA, 25 bp, mus musculus
ccagtactgacctcgtctgtccctt

SEQ ID NO: 64800 - DNA, 25 bp, mus musculus
cttctttccatacacacacatacca

SEQ ID NO: 64801 - DNA, 25 bp, mus musculus
ctttccatacacacacataccatta

SEQ ID NO: 64802 - DNA, 25 bp, mus musculus
ttgctgccaaaaccacatgggctgg

SEQ ID NO: 64803 - DNA, 25 bp, mus musculus
caatgggctgacacttgggggccag

SEQ ID NO: 64804 - DNA, 25 bp, mus musculus
aatggatcttcgtaccaagagcacc

SEQ ID NO: 64805 - DNA, 25 bp, mus musculus
ggatcttcgtaccaagagcaccgga

SEQ ID NO: 64806 - DNA, 25 bp, mus musculus
caccttcaatgtcactgtcaccatg

SEQ ID NO: 64807 - DNA, 25 bp, mus musculus
cttcaatgtcactgtcaccatgact

SEQ ID NO: 64808 - DNA, 25 bp, mus musculus
tgtcactgtcaccatgactgccaag

SEQ ID NO: 64809 - DNA, 25 bp, mus musculus
cactgtcaccatgactgccaagacg

SEQ ID NO: 64810 - DNA, 25 bp, mus musculus
tgtcaccatgactgccaagacgcta

SEQ ID NO: 64811 - DNA, 25 bp, mus musculus
agaacaagccagggagcagtcctgg

SEQ ID NO: 64812 - DNA, 25 bp, mus musculus
agcctgatgtgcttcattgacatgg

SEQ ID NO: 64813 - DNA, 25 bp, mus musculus
tgacgggactgcggaacctgggcaa

SEQ ID NO: 64814 - DNA, 25 bp, mus musculus
ggaacctgggcaacacctgctacat

SEQ ID NO: 64815 - DNA, 25 bp, mus musculus
tgggcaacacctgctacatgaacgc

SEQ ID NO: 64816 - DNA, 25 bp, mus musculus
acacctgctacatgaacgccatctt

SEQ ID NO: 64817 - DNA, 25 bp, mus musculus
gctacatgaacgccatcttgcaatg

SEQ ID NO: 64818 - DNA, 25 bp, mus musculus
acatgaacgccatcttgcaatgcct

SEQ ID NO: 64819 - DNA, 25 bp, mus musculus
tcttgcaatgcctctgcagcgtatc

SEQ ID NO: 64820 - DNA, 25 bp, mus musculus
tgcaatgcctctgcagcgtatctcc

SEQ ID NO: 64821 - DNA, 25 bp, mus musculus
gcctctgcagcgtatctccactggt

SEQ ID NO: 64822 - DNA, 25 bp, mus musculus
gcagcgtatctccactggtggagta

SEQ ID NO: 64823 - DNA, 25 bp, mus musculus
atgtgcttcattgacatggcgtctc

SEQ ID NO: 64824 - DNA, 25 bp, mus musculus
tatctccactggtggagtacttcct

SEQ ID NO: 64825 - DNA, 25 bp, mus musculus
ttcattgacatggcgtctcatcggc

SEQ ID NO: 64826 - DNA, 25 bp, mus musculus
attgacatggcgtctcatcggccgg

SEQ ID NO: 64827 - DNA, 25 bp, mus musculus
ccggtccctgcagacgacttcggtg

SEQ ID NO: 64828 - DNA, 25 bp, mus musculus
cctgcagacgacttcggtgcctact

SEQ ID NO: 64829 - DNA, 25 bp, mus musculus
gcctactacaacctggcgtgacggg

SEQ ID NO: 64830 - DNA, 25 bp, mus musculus
tactacaacctggcgtgacgggact

SEQ ID NO: 64831 - DNA, 25 bp, mus musculus
tacaacctggcgtgacgggactgcg

SEQ ID NO: 64832 - DNA, 25 bp, mus musculus
tgtaacaaagccgtaccttgccctg

SEQ ID NO: 64833 - DNA, 25 bp, mus musculus
gactgcagccggctgagaatgtcca

SEQ ID NO: 64834 - DNA, 25 bp, mus musculus
cactgctataacatccataactgta

SEQ ID NO: 64835 - DNA, 25 bp, mus musculus
tataacatccataactgtatcatga

SEQ ID NO: 64836 - DNA, 25 bp, mus musculus
atccataactgtatcatgaaaggtt

SEQ ID NO: 64837 - DNA, 25 bp, mus musculus
tcacagtggagtacctggagtctgt

SEQ ID NO: 64838 - DNA, 25 bp, mus musculus
tgcacaccaccatgtagtcccaacg

SEQ ID NO: 64839 - DNA, 25 bp, mus musculus
ccgcctacagtttcaatggttgaag

SEQ ID NO: 64840 - DNA, 25 bp, mus musculus
gggactccacggccactgtgtgaag

SEQ ID NO: 64841 - DNA, 25 bp, mus musculus
ccacggccactgtgtgaagcgctac

SEQ ID NO: 64842 - DNA, 25 bp, mus musculus
catgtgcctgtctgcaaagacccag

SEQ ID NO: 64843 - DNA, 25 bp, mus musculus
cctgtctgcaaagacccagaagaga

SEQ ID NO: 64844 - DNA, 25 bp, mus musculus
ctgagaatgtccatcaactgtgaag

SEQ ID NO: 64845 - DNA, 25 bp, mus musculus
atgtccatcaactgtgaaggaaccc

SEQ ID NO: 64846 - DNA, 25 bp, mus musculus
ggaaccccaggccagcagtcacgtt

SEQ ID NO: 64847 - DNA, 25 bp, mus musculus
ccaggccagcagtcacgttcaagga

SEQ ID NO: 64848 - DNA, 25 bp, mus musculus
cagcagtcacgttcaaggagctgtg

SEQ ID NO: 64849 - DNA, 25 bp, mus musculus
tcacgttcaaggagctgtggcgacc

SEQ ID NO: 64850 - DNA, 25 bp, mus musculus
tcaaggagctgtggcgaccgcaaat

SEQ ID NO: 64851 - DNA, 25 bp, mus musculus
aaactccaggatattcgacactgct

SEQ ID NO: 64852 - DNA, 25 bp, mus musculus
ccgtgagtgcccgctacaagtgtct

SEQ ID NO: 64853 - DNA, 25 bp, mus musculus
gattgtggctgacgctgagtcgcta

SEQ ID NO: 64854 - DNA, 25 bp, mus musculus
tatgatcccactgcatacagggatc

SEQ ID NO: 64855 - DNA, 25 bp, mus musculus
gatcccactgcatacagggatctgg

SEQ ID NO: 64856 - DNA, 25 bp, mus musculus
actgcatacagggatctggtaagac

SEQ ID NO: 64857 - DNA, 25 bp, mus musculus
tatgaagtcttccgacagtctctat

SEQ ID NO: 64858 - DNA, 25 bp, mus musculus
gaagtcttccgacagtctctatatg

SEQ ID NO: 64859 - DNA, 25 bp, mus musculus
gtcttccgacagtctctatatgact

SEQ ID NO: 64860 - DNA, 25 bp, mus musculus
ttccgacagtctctatatgacttgg

SEQ ID NO: 64861 - DNA, 25 bp, mus musculus
cagtctctatatgacttggcttcga

SEQ ID NO: 64862 - DNA, 25 bp, mus musculus
tctctatatgacttggcttcgagat

SEQ ID NO: 64863 - DNA, 25 bp, mus musculus
gcttcgagatagcctcttgtgctat

SEQ ID NO: 64864 - DNA, 25 bp, mus musculus
tgacgctgagtcgctaggacctggt

SEQ ID NO: 64865 - DNA, 25 bp, mus musculus
cgctgagtcgctaggacctggtgac

SEQ ID NO: 64866 - DNA, 25 bp, mus musculus
tgagtcgctaggacctggtgacagc

SEQ ID NO: 64867 - DNA, 25 bp, mus musculus
gctaggacctggtgacagcgctatg

SEQ ID NO: 64868 - DNA, 25 bp, mus musculus
aggacctggtgacagcgctatgatc

SEQ ID NO: 64869 - DNA, 25 bp, mus musculus
acctggtgacagcgctatgatccca

SEQ ID NO: 64870 - DNA, 25 bp, mus musculus
cagcgctatgatcccactgcataca

SEQ ID NO: 64871 - DNA, 25 bp, mus musculus
cgctatgatcccactgcatacaggg

SEQ ID NO: 64872 - DNA, 25 bp, mus musculus
cttatcaataacttgctacaagtga

SEQ ID NO: 64873 - DNA, 25 bp, mus musculus
agtcacccttggctacaggactatc

SEQ ID NO: 64874 - DNA, 25 bp, mus musculus
cacagcgacagtcctgaggctgaag

SEQ ID NO: 64875 - DNA, 25 bp, mus musculus
gacagtcctgaggctgaagagagag

SEQ ID NO: 64876 - DNA, 25 bp, mus musculus
gagcgtgtcagcatcctctgattcc

SEQ ID NO: 64877 - DNA, 25 bp, mus musculus
catcccctctaatctgtcaaaacac

SEQ ID NO: 64878 - DNA, 25 bp, mus musculus
tttaacatttgccttgcagaactgc

SEQ ID NO: 64879 - DNA, 25 bp, mus musculus
atttgccttgcagaactgccattat

SEQ ID NO: 64880 - DNA, 25 bp, mus musculus
cttgcagaactgccattattttctg

SEQ ID NO: 64881 - DNA, 25 bp, mus musculus
ccattattttctgtcagatgagaac

SEQ ID NO: 64882 - DNA, 25 bp, mus musculus
actgttagcactgttgatgtatctg

SEQ ID NO: 64883 - DNA, 25 bp, mus musculus
ttgtgtgaccaactgtgttgtatta

SEQ ID NO: 64884 - DNA, 25 bp, mus musculus
ccttggctacaggactatcagacct

SEQ ID NO: 64885 - DNA, 25 bp, mus musculus
taatacattaaacctgtctccactg

SEQ ID NO: 64886 - DNA, 25 bp, mus musculus
gactatcagacctggttagatttac

SEQ ID NO: 64887 - DNA, 25 bp, mus musculus
gaacgctatattacccacgaaagcg

SEQ ID NO: 64888 - DNA, 25 bp, mus musculus
gatgactccaggtgggaacagtacg

SEQ ID NO: 64889 - DNA, 25 bp, mus musculus
ccggcgcacctgatcagtctgagtg

SEQ ID NO: 64890 - DNA, 25 bp, mus musculus
cacctgatcagtctgagtgctagcc

SEQ ID NO: 64891 - DNA, 25 bp, mus musculus
atcagtctgagtgctagccacagcg

SEQ ID NO: 64892 - DNA, 25 bp, mus musculus
ctgagtgctagccacagcgacagtc

SEQ ID NO: 64893 - DNA, 25 bp, mus musculus
cattttcattccatgctccaaaatt

SEQ ID NO: 64894 - DNA, 25 bp, mus musculus
tttcattccatgctccaaaattcag

SEQ ID NO: 64895 - DNA, 25 bp, mus musculus
actctcagtcaactgtgaagctcta

SEQ ID NO: 64896 - DNA, 25 bp, mus musculus
ctcagtcaactgtgaagctctaaca

SEQ ID NO: 64897 - DNA, 25 bp, mus musculus
caactgtgaagctctaacagagtta

SEQ ID NO: 64898 - DNA, 25 bp, mus musculus
tacgcattgtgtctttctacttcca

SEQ ID NO: 64899 - DNA, 25 bp, mus musculus
gcattgtgtctttctacttccaaac

SEQ ID NO: 64900 - DNA, 25 bp, mus musculus
gtttatttcaggtgaccagtagaca

SEQ ID NO: 64901 - DNA, 25 bp, mus musculus
tatttcaggtgaccagtagacagat

SEQ ID NO: 64902 - DNA, 25 bp, mus musculus
tgacttcaatatcatcctataacac

SEQ ID NO: 64903 - DNA, 25 bp, mus musculus
caatatcatcctataacacactgat

SEQ ID NO: 64904 - DNA, 25 bp, mus musculus
catcctataacacactgatgtcaat

SEQ ID NO: 64905 - DNA, 25 bp, mus musculus
tccatgctccaaaattcagtgatga

SEQ ID NO: 64906 - DNA, 25 bp, mus musculus
atgctccaaaattcagtgatgacca

SEQ ID NO: 64907 - DNA, 25 bp, mus musculus
aattcagtgatgaccaccttgttcc

SEQ ID NO: 64908 - DNA, 25 bp, mus musculus
tcagtgatgaccaccttgttcctag

SEQ ID NO: 64909 - DNA, 25 bp, mus musculus
gtgatgaccaccttgttcctagaga

SEQ ID NO: 64910 - DNA, 25 bp, mus musculus
accttgttcctagagatatagatca

SEQ ID NO: 64911 - DNA, 25 bp, mus musculus
gatacatccaaaacatgaataatct

SEQ ID NO: 64912 - DNA, 25 bp, mus musculus
tttaaattcactctcagtcaactgt

SEQ ID NO: 64913 - DNA, 25 bp, mus musculus
accagtgcactccaatatccccatg

SEQ ID NO: 64914 - DNA, 25 bp, mus musculus
gcactccaatatccccatgatggac

SEQ ID NO: 64915 - DNA, 25 bp, mus musculus
ctccatcacagttaacgacattgta

SEQ ID NO: 64916 - DNA, 25 bp, mus musculus
catcacagttaacgacattgtacat

SEQ ID NO: 64917 - DNA, 25 bp, mus musculus
cgacattgtacatgtcgtggacagc

SEQ ID NO: 64918 - DNA, 25 bp, mus musculus
cattgtacatgtcgtggacagcggt

SEQ ID NO: 64919 - DNA, 25 bp, mus musculus
acatgtcgtggacagcggtctgcac

SEQ ID NO: 64920 - DNA, 25 bp, mus musculus
tgtcgtggacagcggtctgcacaag

SEQ ID NO: 64921 - DNA, 25 bp, mus musculus
ctatgacctgaagaccaaggtgtcc

SEQ ID NO: 64922 - DNA, 25 bp, mus musculus
tgacctgaagaccaaggtgtcctgc

SEQ ID NO: 64923 - DNA, 25 bp, mus musculus
gaccaaggtgtcctgcctggagact

SEQ ID NO: 64924 - DNA, 25 bp, mus musculus
ccgctgccagtcaggttttgcctac

SEQ ID NO: 64925 - DNA, 25 bp, mus musculus
ctccaatatccccatgatggaccag

SEQ ID NO: 64926 - DNA, 25 bp, mus musculus
caatatccccatgatggaccagaag

SEQ ID NO: 64927 - DNA, 25 bp, mus musculus
ggccatattccaacagcctccactt

SEQ ID NO: 64928 - DNA, 25 bp, mus musculus
gattgtattggccaccaacattgct

SEQ ID NO: 64929 - DNA, 25 bp, mus musculus
ggccaccaacattgctgaaacctcc

SEQ ID NO: 64930 - DNA, 25 bp, mus musculus
caccaacattgctgaaacctccatc

SEQ ID NO: 64931 - DNA, 25 bp, mus musculus
cattgctgaaacctccatcacagtt

SEQ ID NO: 64932 - DNA, 25 bp, mus musculus
tgaaacctccatcacagttaacgac

SEQ ID NO: 64933 - DNA, 25 bp, mus musculus
tcctcagcacactgaatccaagtgt

SEQ ID NO: 64934 - DNA, 25 bp, mus musculus
tcctctctaatctactggcaggaca

SEQ ID NO: 64935 - DNA, 25 bp, mus musculus
actctccagtggtttcatcttactt

SEQ ID NO: 64936 - DNA, 25 bp, mus musculus
tggtttcatcttacttctgatggca

SEQ ID NO: 64937 - DNA, 25 bp, mus musculus
catcttacttctgatggcatttccc

SEQ ID NO: 64938 - DNA, 25 bp, mus musculus
acttctgatggcatttccctctaga

SEQ ID NO: 64939 - DNA, 25 bp, mus musculus
tctgatggcatttccctctagaaag

SEQ ID NO: 64940 - DNA, 25 bp, mus musculus
gatggcatttccctctagaaagtgc

SEQ ID NO: 64941 - DNA, 25 bp, mus musculus
aaagtgctactatcatccacacatt

SEQ ID NO: 64942 - DNA, 25 bp, mus musculus
ctactatcatccacacatttctacc

SEQ ID NO: 64943 - DNA, 25 bp, mus musculus
tcatccacacatttctacctgagac

SEQ ID NO: 64944 - DNA, 25 bp, mus musculus
tccacacatttctacctgagaccac

SEQ ID NO: 64945 - DNA, 25 bp, mus musculus
tctctaatctactggcaggacaggt

SEQ ID NO: 64946 - DNA, 25 bp, mus musculus
atctactggcaggacaggtacaact

SEQ ID NO: 64947 - DNA, 25 bp, mus musculus
gacaggtacaacttgccctctgaag

SEQ ID NO: 64948 - DNA, 25 bp, mus musculus
gatgccacaaatctcctgctggcta

SEQ ID NO: 64949 - DNA, 25 bp, mus musculus
gccacaaatctcctgctggctactc

SEQ ID NO: 64950 - DNA, 25 bp, mus musculus
aatctcctgctggctactctccagt

SEQ ID NO: 64951 - DNA, 25 bp, mus musculus
ctgctggctactctccagtggtttc

SEQ ID NO: 64952 - DNA, 25 bp, mus musculus
gctactctccagtggtttcatctta

SEQ ID NO: 64953 - DNA, 25 bp, mus musculus
tgttgttactaagccttatactgtg

SEQ ID NO: 64954 - DNA, 25 bp, mus musculus
tactaagccttatactgtggtgctt

SEQ ID NO: 64955 - DNA, 25 bp, mus musculus
accctcagataactaaacatgactg

SEQ ID NO: 64956 - DNA, 25 bp, mus musculus
ctaaacatgactggactctgaacag

SEQ ID NO: 64957 - DNA, 25 bp, mus musculus
atgactggactctgaacagagggac

SEQ ID NO: 64958 - DNA, 25 bp, mus musculus
actggactctgaacagagggacgat

SEQ ID NO: 64959 - DNA, 25 bp, mus musculus
ttattttggccagagacatttttat

SEQ ID NO: 64960 - DNA, 25 bp, mus musculus
agctctgttgcccattgttcattct

SEQ ID NO: 64961 - DNA, 25 bp, mus musculus
gttgcccattgttcattctttctgg

SEQ ID NO: 64962 - DNA, 25 bp, mus musculus
tataccacaaagtgacttattaacg

SEQ ID NO: 64963 - DNA, 25 bp, mus musculus
ataatccaatccatttgggagaagg

SEQ ID NO: 64964 - DNA, 25 bp, mus musculus
atccaatccatttgggagaaggtag

SEQ ID NO: 64965 - DNA, 25 bp, mus musculus
taagccttatactgtggtgctttca

SEQ ID NO: 64966 - DNA, 25 bp, mus musculus
gccttatactgtggtgctttcagat

SEQ ID NO: 64967 - DNA, 25 bp, mus musculus
tactgtggtgctttcagattaatgt

SEQ ID NO: 64968 - DNA, 25 bp, mus musculus
agattaatgtctgcctctgtcagat

SEQ ID NO: 64969 - DNA, 25 bp, mus musculus
tctgcctctgtcagataaaccctca

SEQ ID NO: 64970 - DNA, 25 bp, mus musculus
gcctctgtcagataaaccctcagat

SEQ ID NO: 64971 - DNA, 25 bp, mus musculus
tctgtcagataaaccctcagataac

SEQ ID NO: 64972 - DNA, 25 bp, mus musculus
taaaccctcagataactaaacatga

SEQ ID NO: 64973 - DNA, 25 bp, mus musculus
ttctgtataggctccggcctctgct

SEQ ID NO: 64974 - DNA, 25 bp, mus musculus
tgtataggctccggcctctgctcat

SEQ ID NO: 64975 - DNA, 25 bp, mus musculus
ctatggccctcggatgacgccattc

SEQ ID NO: 64976 - DNA, 25 bp, mus musculus
tggccctcggatgacgccattcttc

SEQ ID NO: 64977 - DNA, 25 bp, mus musculus
tcggatgacgccattcttctggaaa

SEQ ID NO: 64978 - DNA, 25 bp, mus musculus
gatgacgccattcttctggaaatgc

SEQ ID NO: 64979 - DNA, 25 bp, mus musculus
gacgccattcttctggaaatgctgg

SEQ ID NO: 64980 - DNA, 25 bp, mus musculus
attcttctggaaatgctggagaaac

SEQ ID NO: 64981 - DNA, 25 bp, mus musculus
taaaggctgtaccaatcggacacca

SEQ ID NO: 64982 - DNA, 25 bp, mus musculus
aggctgtaccaatcggacaccacct

SEQ ID NO: 64983 - DNA, 25 bp, mus musculus
taccaatcggacaccacctgtaggg

SEQ ID NO: 64984 - DNA, 25 bp, mus musculus
caatcggacaccacctgtagggagg

SEQ ID NO: 64985 - DNA, 25 bp, mus musculus
tccggcctctgctcatccaagttgc

SEQ ID NO: 64986 - DNA, 25 bp, mus musculus
ggcctctgctcatccaagttgcagg

SEQ ID NO: 64987 - DNA, 25 bp, mus musculus
tgctcatccaagttgcaggatgtcg

SEQ ID NO: 64988 - DNA, 25 bp, mus musculus
tcatccaagttgcaggatgtcgatg

SEQ ID NO: 64989 - DNA, 25 bp, mus musculus
aggagcctttgctgctgcagactcc

SEQ ID NO: 64990 - DNA, 25 bp, mus musculus
ctttgctgctgcagactccttcgac

SEQ ID NO: 64991 - DNA, 25 bp, mus musculus
ctcgcggccctcctgagtttctgtt

SEQ ID NO: 64992 - DNA, 25 bp, mus musculus
gcggccctcctgagtttctgttcag

SEQ ID NO: 64993 - DNA, 25 bp, mus musculus
tgaacctcatcgaggtgttcagaag

SEQ ID NO: 64994 - DNA, 25 bp, mus musculus
acctcatcgaggtgttcagaagaaa

SEQ ID NO: 64995 - DNA, 25 bp, mus musculus
ttcaagcccttaacttctgtcacaa

SEQ ID NO: 64996 - DNA, 25 bp, mus musculus
aagcccttaacttctgtcacaagca

SEQ ID NO: 64997 - DNA, 25 bp, mus musculus
ttaacttctgtcacaagcacaattg

SEQ ID NO: 64998 - DNA, 25 bp, mus musculus
acttctgtcacaagcacaattgtat

SEQ ID NO: 64999 - DNA, 25 bp, mus musculus
tctgtcacaagcacaattgtattca

SEQ ID NO: 65000 - DNA, 25 bp, mus musculus
gtcacaagcacaattgtattcatcg

SEQ ID NO: 65001 - DNA, 25 bp, mus musculus
agcacaattgtattcatcgggatgt

SEQ ID NO: 65002 - DNA, 25 bp, mus musculus
ctgaaaacatcctaataaccaagca

SEQ ID NO: 65003 - DNA, 25 bp, mus musculus
acatcctaataaccaagcaagggat

SEQ ID NO: 65004 - DNA, 25 bp, mus musculus
tcctaataaccaagcaagggatgat

SEQ ID NO: 65005 - DNA, 25 bp, mus musculus
agatgcatctagtttttgagtactg

SEQ ID NO: 65006 - DNA, 25 bp, mus musculus
agtactgtgatcacacactgttaaa

SEQ ID NO: 65007 - DNA, 25 bp, mus musculus
actgtgatcacacactgttaaacga

SEQ ID NO: 65008 - DNA, 25 bp, mus musculus
atcacacactgttaaacgagctgga

SEQ ID NO: 65009 - DNA, 25 bp, mus musculus
acacactgttaaacgagctggagag

SEQ ID NO: 65010 - DNA, 25 bp, mus musculus
cactgttaaacgagctggagagaaa

SEQ ID NO: 65011 - DNA, 25 bp, mus musculus
gtgtgctatggcaaacccttcaagc

SEQ ID NO: 65012 - DNA, 25 bp, mus musculus
tgctatggcaaacccttcaagccct

SEQ ID NO: 65013 - DNA, 25 bp, mus musculus
ggattctccagccacgagtgccctc

SEQ ID NO: 65014 - DNA, 25 bp, mus musculus
cacgagtgccctctgaaattctatc

SEQ ID NO: 65015 - DNA, 25 bp, mus musculus
ttctatgtcaatttccagacaggca

SEQ ID NO: 65016 - DNA, 25 bp, mus musculus
gtcaatttccagacaggcattctct

SEQ ID NO: 65017 - DNA, 25 bp, mus musculus
ttccagacaggcattctctgcccat

SEQ ID NO: 65018 - DNA, 25 bp, mus musculus
acaggcattctctgcccatcctcta

SEQ ID NO: 65019 - DNA, 25 bp, mus musculus
tctttgctgttacctgtatgcccta

SEQ ID NO: 65020 - DNA, 25 bp, mus musculus
gttagcatttctttccaggatgcaa

SEQ ID NO: 65021 - DNA, 25 bp, mus musculus
ttccaggatgcaagcctagtgatga

SEQ ID NO: 65022 - DNA, 25 bp, mus musculus
tcattgttccattgtcagaatagct

SEQ ID NO: 65023 - DNA, 25 bp, mus musculus
aatagctacagaatccagcctgttc

SEQ ID NO: 65024 - DNA, 25 bp, mus musculus
tacagaatccagcctgttctgccct

SEQ ID NO: 65025 - DNA, 25 bp, mus musculus
tgccctctgaaattctatcttatta

SEQ ID NO: 65026 - DNA, 25 bp, mus musculus
tcattttcctgcttgttcacaccac

SEQ ID NO: 65027 - DNA, 25 bp, mus musculus
ttcctggtacactctggcctcagtc

SEQ ID NO: 65028 - DNA, 25 bp, mus musculus
gtacactctggcctcagtctttcca

SEQ ID NO: 65029 - DNA, 25 bp, mus musculus
ctagaacattcttgcctgcataact

SEQ ID NO: 65030 - DNA, 25 bp, mus musculus
tgcctgcataactatctgcttctgt

SEQ ID NO: 65031 - DNA, 25 bp, mus musculus
cataactatctgcttctgtcctcac

SEQ ID NO: 65032 - DNA, 25 bp, mus musculus
tcctcactgtattctgatctgtatt

SEQ ID NO: 65033 - DNA, 25 bp, mus musculus
tatgagcgtctctccgcctggtcac

SEQ ID NO: 65034 - DNA, 25 bp, mus musculus
tctctccgcctggtcacatgttgca

SEQ ID NO: 65035 - DNA, 25 bp, mus musculus
gctggacaccctgatgcctcgcagg

SEQ ID NO: 65036 - DNA, 25 bp, mus musculus
gacaccctgatgcctcgcaggacac

SEQ ID NO: 65037 - DNA, 25 bp, mus musculus
ctgatgcctcgcaggacaccccagg

SEQ ID NO: 65038 - DNA, 25 bp, mus musculus
caagctttcgtcaggtccaggccac

SEQ ID NO: 65039 - DNA, 25 bp, mus musculus
agctttcgtcaggtccaggccacct

SEQ ID NO: 65040 - DNA, 25 bp, mus musculus
tctgctccggagctctggacccaga

SEQ ID NO: 65041 - DNA, 25 bp, mus musculus
ctccggagctctggacccagaagca

SEQ ID NO: 65042 - DNA, 25 bp, mus musculus
ccggagctctggacccagaagcagc

SEQ ID NO: 65043 - DNA, 25 bp, mus musculus
agctctggacccagaagcagctgga

SEQ ID NO: 65044 - DNA, 25 bp, mus musculus
gcagttcttgctgattaaggaccag

SEQ ID NO: 65045 - DNA, 25 bp, mus musculus
tctccgcctggtcacatgttgcaaa

SEQ ID NO: 65046 - DNA, 25 bp, mus musculus
cgcctggtcacatgttgcaaaaaac

SEQ ID NO: 65047 - DNA, 25 bp, mus musculus
cctggtcacatgttgcaaaaaacga

SEQ ID NO: 65048 - DNA, 25 bp, mus musculus
gccaccctggtgcccagctatggag

SEQ ID NO: 65049 - DNA, 25 bp, mus musculus
tgcccagctatggagccccagcgac

SEQ ID NO: 65050 - DNA, 25 bp, mus musculus
cagcgactgctgcccgggtgtctct

SEQ ID NO: 65051 - DNA, 25 bp, mus musculus
tgtctctagagagatcgcgagagtg

SEQ ID NO: 65052 - DNA, 25 bp, mus musculus
gagtgctggacaccctgatgcctcg

SEQ ID NO: 65053 - DNA, 25 bp, mus musculus
tagatagaccacaagctccatttcc

SEQ ID NO: 65054 - DNA, 25 bp, mus musculus
cccatccaatgtctcttcttatggg

SEQ ID NO: 65055 - DNA, 25 bp, mus musculus
cacgcacgtgtgagcacacacacac

SEQ ID NO: 65056 - DNA, 25 bp, mus musculus
aggttgtggtcctgtcttatgacag

SEQ ID NO: 65057 - DNA, 25 bp, mus musculus
gttacttagatactctcacactgcc

SEQ ID NO: 65058 - DNA, 25 bp, mus musculus
cactgccctcatgctcactggcaag

SEQ ID NO: 65059 - DNA, 25 bp, mus musculus
cctcatgctcactggcaagttcatc

SEQ ID NO: 65060 - DNA, 25 bp, mus musculus
gctcactggcaagttcatccgtcct

SEQ ID NO: 65061 - DNA, 25 bp, mus musculus
ccgtcctggagctgaggcatccttc

SEQ ID NO: 65062 - DNA, 25 bp, mus musculus
tgaggcatccttcactgatattaaa

SEQ ID NO: 65063 - DNA, 25 bp, mus musculus
cctcttcaggattccaacatacatt

SEQ ID NO: 65064 - DNA, 25 bp, mus musculus
gttcagtagaccagcttgatccctt

SEQ ID NO: 65065 - DNA, 25 bp, mus musculus
ttcagatctctgccaatgcatgagg

SEQ ID NO: 65066 - DNA, 25 bp, mus musculus
tgtgttcttcctaacttctatcaat

SEQ ID NO: 65067 - DNA, 25 bp, mus musculus
tatcaatacctcttctccaatatag

SEQ ID NO: 65068 - DNA, 25 bp, mus musculus
tacctcttctccaatatagtctcat

SEQ ID NO: 65069 - DNA, 25 bp, mus musculus
ttctccaatatagtctcatggaaat

SEQ ID NO: 65070 - DNA, 25 bp, mus musculus
aggatgcgcaagcacacgcacgcac

SEQ ID NO: 65071 - DNA, 25 bp, mus musculus
cgcaagcacacgcacgcacgtgtga

SEQ ID NO: 65072 - DNA, 25 bp, mus musculus
cacacgcacgcacgtgtgagcacac

SEQ ID NO: 65073 - DNA, 25 bp, mus musculus
tcaccatgctcacctacaatttcat

SEQ ID NO: 65074 - DNA, 25 bp, mus musculus
ctcaggagccattcattgtggggtt

SEQ ID NO: 65075 - DNA, 25 bp, mus musculus
tcacagtgctcctcttgcctttgtc

SEQ ID NO: 65076 - DNA, 25 bp, mus musculus
ctttgtcttctgagtgctaggagta

SEQ ID NO: 65077 - DNA, 25 bp, mus musculus
catcccgttcacctgattttatgag

SEQ ID NO: 65078 - DNA, 25 bp, mus musculus
gttcacctgattttatgagacaagg

SEQ ID NO: 65079 - DNA, 25 bp, mus musculus
gttcctcactggcctggatttttgc

SEQ ID NO: 65080 - DNA, 25 bp, mus musculus
cactggcctggatttttgctcagta

SEQ ID NO: 65081 - DNA, 25 bp, mus musculus
cctggatttttgctcagtaggctgg

SEQ ID NO: 65082 - DNA, 25 bp, mus musculus
ctcagtaggctgggctggctagaca

SEQ ID NO: 65083 - DNA, 25 bp, mus musculus
ctagacaatgagcccctctgtgccc

SEQ ID NO: 65084 - DNA, 25 bp, mus musculus
ccctatgctaggattagaggcaggc

SEQ ID NO: 65085 - DNA, 25 bp, mus musculus
ttttgagcctggtctcactatgtag

SEQ ID NO: 65086 - DNA, 25 bp, mus musculus
tctcactatgtagccctagtcagcc

SEQ ID NO: 65087 - DNA, 25 bp, mus musculus
tatgtagccctagtcagcctacaac

SEQ ID NO: 65088 - DNA, 25 bp, mus musculus
gccctagtcagcctacaacttgcta

SEQ ID NO: 65089 - DNA, 25 bp, mus musculus
gtcagcctacaacttgctatacaga

SEQ ID NO: 65090 - DNA, 25 bp, mus musculus
cttgctatacagaccaggttggcct

SEQ ID NO: 65091 - DNA, 25 bp, mus musculus
atacagaccaggttggccttcaact

SEQ ID NO: 65092 - DNA, 25 bp, mus musculus
accaggttggccttcaactcacagt

SEQ ID NO: 65093 - DNA, 25 bp, mus musculus
gcacccctggtgtgcctgggacatc

SEQ ID NO: 65094 - DNA, 25 bp, mus musculus
cccctggtgtgcctgggacatctgt

SEQ ID NO: 65095 - DNA, 25 bp, mus musculus
aggcacctgggagtctcacccagag

SEQ ID NO: 65096 - DNA, 25 bp, mus musculus
cacctgggagtctcacccagagact

SEQ ID NO: 65097 - DNA, 25 bp, mus musculus
ggagtctcacccagagactgcagag

SEQ ID NO: 65098 - DNA, 25 bp, mus musculus
tcacccagagactgcagagctggtg

SEQ ID NO: 65099 - DNA, 25 bp, mus musculus
ttcagatcctgggtcctgcctaaca

SEQ ID NO: 65100 - DNA, 25 bp, mus musculus
tcctgggtcctgcctaacagcccga

SEQ ID NO: 65101 - DNA, 25 bp, mus musculus
ctcgcagctttgcttctgggctgag

SEQ ID NO: 65102 - DNA, 25 bp, mus musculus
ttccctttgccaccctgattgtgaa

SEQ ID NO: 65103 - DNA, 25 bp, mus musculus
ttgccaccctgattgtgaataaaga

SEQ ID NO: 65104 - DNA, 25 bp, mus musculus
ccaccctgattgtgaataaagattg

SEQ ID NO: 65105 - DNA, 25 bp, mus musculus
ctggtgtgcctgggacatctgtgaa

SEQ ID NO: 65106 - DNA, 25 bp, mus musculus
ggacatctgtgaagcttgggcagag

SEQ ID NO: 65107 - DNA, 25 bp, mus musculus
ttataaaacgcgcaaggcagctcga

SEQ ID NO: 65108 - DNA, 25 bp, mus musculus
agcagccaatagcctacttcgcctg

SEQ ID NO: 65109 - DNA, 25 bp, mus musculus
caatagcctacttcgcctggcagtg

SEQ ID NO: 65110 - DNA, 25 bp, mus musculus
tcgcctggcagtggatggccgcctc

SEQ ID NO: 65111 - DNA, 25 bp, mus musculus
tggccgcctcagcctatgtttctac

SEQ ID NO: 65112 - DNA, 25 bp, mus musculus
tcctggctacagcgaacagagaggc

SEQ ID NO: 65113 - DNA, 25 bp, mus musculus
ccaagggactcatccaccaggagca

SEQ ID NO: 65114 - DNA, 25 bp, mus musculus
ggactcatccaccaggagcaggcac

SEQ ID NO: 65115 - DNA, 25 bp, mus musculus
atgtttggtcctgtgggcattgagg

SEQ ID NO: 65116 - DNA, 25 bp, mus musculus
tgtttggtcctgtgggcattgaggc

SEQ ID NO: 65117 - DNA, 25 bp, mus musculus
cctgtgggcattgaggctgtgctag

SEQ ID NO: 65118 - DNA, 25 bp, mus musculus
gctgtgctagaccagctgaggatca

SEQ ID NO: 65119 - DNA, 25 bp, mus musculus
ctgtgctagaccagctgaggatcaa

SEQ ID NO: 65120 - DNA, 25 bp, mus musculus
tgctagaccagctgaggatcaaggc

SEQ ID NO: 65121 - DNA, 25 bp, mus musculus
ctagaccagctgaggatcaaggcta

SEQ ID NO: 65122 - DNA, 25 bp, mus musculus
tagaccagctgaggatcaaggctat

SEQ ID NO: 65123 - DNA, 25 bp, mus musculus
ggctaggcaagtccaccatggtgaa

SEQ ID NO: 65124 - DNA, 25 bp, mus musculus
tccaccatggtgaacacactgttca

SEQ ID NO: 65125 - DNA, 25 bp, mus musculus
gactcatccaccaggagcaggcacc

SEQ ID NO: 65126 - DNA, 25 bp, mus musculus
tcatccaccaggagcaggcaccact

SEQ ID NO: 65127 - DNA, 25 bp, mus musculus
atccaccaggagcaggcaccactgc

SEQ ID NO: 65128 - DNA, 25 bp, mus musculus
tccaccaggagcaggcaccactgca

SEQ ID NO: 65129 - DNA, 25 bp, mus musculus
cacccttggccccatggatgagagg

SEQ ID NO: 65130 - DNA, 25 bp, mus musculus
acccttggccccatggatgagaggc

SEQ ID NO: 65131 - DNA, 25 bp, mus musculus
cttggccccatggatgagaggcggt

SEQ ID NO: 65132 - DNA, 25 bp, mus musculus
ccacccaatgagatgtttggtcctg

SEQ ID NO: 65133 - DNA, 25 bp, mus musculus
accaggatgccacggctgatgagca

SEQ ID NO: 65134 - DNA, 25 bp, mus musculus
ccaggatgccacggctgatgagcag

SEQ ID NO: 65135 - DNA, 25 bp, mus musculus
ttgtgctgggtctctggtgctcttc

SEQ ID NO: 65136 - DNA, 25 bp, mus musculus
tgctgggtctctggtgctcttcact

SEQ ID NO: 65137 - DNA, 25 bp, mus musculus
gctgggtctctggtgctcttcactg

SEQ ID NO: 65138 - DNA, 25 bp, mus musculus
tgggtctctggtgctcttcactgtt

SEQ ID NO: 65139 - DNA, 25 bp, mus musculus
gggtctctggtgctcttcactgttg

SEQ ID NO: 65140 - DNA, 25 bp, mus musculus
ggtctctggtgctcttcactgttgc

SEQ ID NO: 65141 - DNA, 25 bp, mus musculus
tctctggtgctcttcactgttgcct

SEQ ID NO: 65142 - DNA, 25 bp, mus musculus
tggtgctcttcactgttgcctgtca

SEQ ID NO: 65143 - DNA, 25 bp, mus musculus
ggtgctcttcactgttgcctgtcac

SEQ ID NO: 65144 - DNA, 25 bp, mus musculus
ctcttcactgttgcctgtcactttt

SEQ ID NO: 65145 - DNA, 25 bp, mus musculus
gcttgagttccccaggccaagcagg

SEQ ID NO: 65146 - DNA, 25 bp, mus musculus
cttgagttccccaggccaagcaggt

SEQ ID NO: 65147 - DNA, 25 bp, mus musculus
ttgagttccccaggccaagcaggtt

SEQ ID NO: 65148 - DNA, 25 bp, mus musculus
gagttccccaggccaagcaggttag

SEQ ID NO: 65149 - DNA, 25 bp, mus musculus
caggccaagcaggttagggaaagct

SEQ ID NO: 65150 - DNA, 25 bp, mus musculus
ataccttggcagttgaaggaaggag

SEQ ID NO: 65151 - DNA, 25 bp, mus musculus
taccttggcagttgaaggaaggaga

SEQ ID NO: 65152 - DNA, 25 bp, mus musculus
atggtcttaggtttgtgctgggtct

SEQ ID NO: 65153 - DNA, 25 bp, mus musculus
cactgttgatgctaccctggaccag

SEQ ID NO: 65154 - DNA, 25 bp, mus musculus
taccctggaccagtggctacaagct

SEQ ID NO: 65155 - DNA, 25 bp, mus musculus
caggttccgacacctgaagatgccc

SEQ ID NO: 65156 - DNA, 25 bp, mus musculus
ggtcatgtgaccacctctgccgagg

SEQ ID NO: 65157 - DNA, 25 bp, mus musculus
ccaccctagaaatgactgcggcaca

SEQ ID NO: 65158 - DNA, 25 bp, mus musculus
tgactgcggcacagaatcctgatgg

SEQ ID NO: 65159 - DNA, 25 bp, mus musculus
agaatcctgatggcagcaaagtgaa

SEQ ID NO: 65160 - DNA, 25 bp, mus musculus
gtaaccaatggaactcagttgcata

SEQ ID NO: 65161 - DNA, 25 bp, mus musculus
ttgcatacgcctcactgtgcttaaa

SEQ ID NO: 65162 - DNA, 25 bp, mus musculus
acgcctcactgtgcttaaaattcat

SEQ ID NO: 65163 - DNA, 25 bp, mus musculus
taacgctggtgctgtccacgtgtca

SEQ ID NO: 65164 - DNA, 25 bp, mus musculus
tgtccacgtgtcatatgatgtataa

SEQ ID NO: 65165 - DNA, 25 bp, mus musculus
ggaccagtggctacaagctggcggt

SEQ ID NO: 65166 - DNA, 25 bp, mus musculus
ctacctcagtgggcagcctgttgag

SEQ ID NO: 65167 - DNA, 25 bp, mus musculus
cagtgggcagcctgttgagaagtct

SEQ ID NO: 65168 - DNA, 25 bp, mus musculus
gctggcctgcttccttgtctaccac

SEQ ID NO: 65169 - DNA, 25 bp, mus musculus
ctgcttccttgtctaccactctgtg

SEQ ID NO: 65170 - DNA, 25 bp, mus musculus
ctctgtgccagcaccacgacacttg

SEQ ID NO: 65171 - DNA, 25 bp, mus musculus
ctttgctgaactcctctacaggttc

SEQ ID NO: 65172 - DNA, 25 bp, mus musculus
tgaactcctctacaggttccgacac

SEQ ID NO: 65173 - DNA, 25 bp, mus musculus
gcaagaccagcctggccctccggta

SEQ ID NO: 65174 - DNA, 25 bp, mus musculus
tggccctccggtacatgaagcagga

SEQ ID NO: 65175 - DNA, 25 bp, mus musculus
ccaatgctgcgctcctggtttatga

SEQ ID NO: 65176 - DNA, 25 bp, mus musculus
acatcactcggaaggattcctttca

SEQ ID NO: 65177 - DNA, 25 bp, mus musculus
aggattcctttcacaaggcccagca

SEQ ID NO: 65178 - DNA, 25 bp, mus musculus
cctttcacaaggcccagcagtggct

SEQ ID NO: 65179 - DNA, 25 bp, mus musculus
ccaagctgaactaccaggtgtctga

SEQ ID NO: 65180 - DNA, 25 bp, mus musculus
agatcttcaacactgttgctcagga

SEQ ID NO: 65181 - DNA, 25 bp, mus musculus
tcaacactgttgctcaggagcttct

SEQ ID NO: 65182 - DNA, 25 bp, mus musculus
agcttctgcagagagcaggagacac

SEQ ID NO: 65183 - DNA, 25 bp, mus musculus
ctctgaaccaggaacctcccatcag

SEQ ID NO: 65184 - DNA, 25 bp, mus musculus
aacctcccatcaggcagcgccagtg

SEQ ID NO: 65185 - DNA, 25 bp, mus musculus
acttcagcaacgtcttgccgactgt

SEQ ID NO: 65186 - DNA, 25 bp, mus musculus
gtgccttcttcacaaaggtgctgga

SEQ ID NO: 65187 - DNA, 25 bp, mus musculus
tgctggacttgggctcctcatctct

SEQ ID NO: 65188 - DNA, 25 bp, mus musculus
acttgggctcctcatctctgaagct

SEQ ID NO: 65189 - DNA, 25 bp, mus musculus
gctcctcatctctgaagcttgagat

SEQ ID NO: 65190 - DNA, 25 bp, mus musculus
catctctgaagcttgagatctggga

SEQ ID NO: 65191 - DNA, 25 bp, mus musculus
agtaccaaagcgtctgccacctcta

SEQ ID NO: 65192 - DNA, 25 bp, mus musculus
acctctacttcaggggtgccaatgc

SEQ ID NO: 65193 - DNA, 25 bp, mus musculus
ggtctccacatgccttcacaaacat

SEQ ID NO: 65194 - DNA, 25 bp, mus musculus
tctccacatgccttcacaaacatga

SEQ ID NO: 65195 - DNA, 25 bp, mus musculus
catgaacgagctcatgctgaaaaga

SEQ ID NO: 65196 - DNA, 25 bp, mus musculus
tagaactgaagcccatatagatctt

SEQ ID NO: 65197 - DNA, 25 bp, mus musculus
gaactgaagcccatatagatctttg

SEQ ID NO: 65198 - DNA, 25 bp, mus musculus
actgaagcccatatagatctttgat

SEQ ID NO: 65199 - DNA, 25 bp, mus musculus
tgaagcccatatagatctttgatca

SEQ ID NO: 65200 - DNA, 25 bp, mus musculus
aagcccatatagatctttgatcaac

SEQ ID NO: 65201 - DNA, 25 bp, mus musculus
agatctttgatcaactgtcaggaaa

SEQ ID NO: 65202 - DNA, 25 bp, mus musculus
atctttgatcaactgtcaggaaaag

SEQ ID NO: 65203 - DNA, 25 bp, mus musculus
ctttgatcaactgtcaggaaaagtg

SEQ ID NO: 65204 - DNA, 25 bp, mus musculus
gataaaagcacttgccctaagcttg

SEQ ID NO: 65205 - DNA, 25 bp, mus musculus
tccacatgccttcacaaacatgaac

SEQ ID NO: 65206 - DNA, 25 bp, mus musculus
cacatgccttcacaaacatgaacga

SEQ ID NO: 65207 - DNA, 25 bp, mus musculus
catgccttcacaaacatgaacgagc

SEQ ID NO: 65208 - DNA, 25 bp, mus musculus
tgccttcacaaacatgaacgagctc

SEQ ID NO: 65209 - DNA, 25 bp, mus musculus
ttcacaaacatgaacgagctcatgc

SEQ ID NO: 65210 - DNA, 25 bp, mus musculus
cacaaacatgaacgagctcatgctg

SEQ ID NO: 65211 - DNA, 25 bp, mus musculus
caaacatgaacgagctcatgctgaa

SEQ ID NO: 65212 - DNA, 25 bp, mus musculus
aacatgaacgagctcatgctgaaaa

SEQ ID NO: 65213 - DNA, 25 bp, mus musculus
tagaagatgcccgtcagcattccaa

SEQ ID NO: 65214 - DNA, 25 bp, mus musculus
atgcccgtcagcattccaattccaa

SEQ ID NO: 65215 - DNA, 25 bp, mus musculus
acgctgctaccaacgcatctcatgg

SEQ ID NO: 65216 - DNA, 25 bp, mus musculus
ctaccaacgcatctcatggaagcaa

SEQ ID NO: 65217 - DNA, 25 bp, mus musculus
acgcatctcatggaagcaaccaagg

SEQ ID NO: 65218 - DNA, 25 bp, mus musculus
accggctagctgcccagtggagcca

SEQ ID NO: 65219 - DNA, 25 bp, mus musculus
cccagtggagccacgcactctgtca

SEQ ID NO: 65220 - DNA, 25 bp, mus musculus
tttcctcatgctcagctgagacatg

SEQ ID NO: 65221 - DNA, 25 bp, mus musculus
catgctcagctgagacatgaaacta

SEQ ID NO: 65222 - DNA, 25 bp, mus musculus
atggctttatgtcacaggagacttt

SEQ ID NO: 65223 - DNA, 25 bp, mus musculus
ttatgtcacaggagactttaatcct

SEQ ID NO: 65224 - DNA, 25 bp, mus musculus
taatccttcagattcttgtataact

SEQ ID NO: 65225 - DNA, 25 bp, mus musculus
gtcagcattccaattccaacatggt

SEQ ID NO: 65226 - DNA, 25 bp, mus musculus
attccaattccaacatggtcatcat

SEQ ID NO: 65227 - DNA, 25 bp, mus musculus
aagcttttgcacgagagcatggact

SEQ ID NO: 65228 - DNA, 25 bp, mus musculus
atggacttatcttcatggaaacttc

SEQ ID NO: 65229 - DNA, 25 bp, mus musculus
ttatcttcatggaaacttctgccaa

SEQ ID NO: 65230 - DNA, 25 bp, mus musculus
tcatggaaacttctgccaagactgc

SEQ ID NO: 65231 - DNA, 25 bp, mus musculus
agactgcgtctaatgtagaggaggc

SEQ ID NO: 65232 - DNA, 25 bp, mus musculus
ttaaaattggccctcagcacgctgc

SEQ ID NO: 65233 - DNA, 25 bp, mus musculus
cgcagcatctccaagacagcggtca

SEQ ID NO: 65234 - DNA, 25 bp, mus musculus
agcatctccaagacagcggtcacac

SEQ ID NO: 65235 - DNA, 25 bp, mus musculus
gacagcggtcacaccatcgagaggg

SEQ ID NO: 65236 - DNA, 25 bp, mus musculus
acagcggtcacaccatcgagagggt

SEQ ID NO: 65237 - DNA, 25 bp, mus musculus
cagcggtcacaccatcgagagggtc

SEQ ID NO: 65238 - DNA, 25 bp, mus musculus
agcggtcacaccatcgagagggtca

SEQ ID NO: 65239 - DNA, 25 bp, mus musculus
gcggtcacaccatcgagagggtcaa

SEQ ID NO: 65240 - DNA, 25 bp, mus musculus
cggtcacaccatcgagagggtcaag

SEQ ID NO: 65241 - DNA, 25 bp, mus musculus
ggtcacaccatcgagagggtcaagc

SEQ ID NO: 65242 - DNA, 25 bp, mus musculus
gtcacaccatcgagagggtcaagct

SEQ ID NO: 65243 - DNA, 25 bp, mus musculus
tcacaccatcgagagggtcaagctg

SEQ ID NO: 65244 - DNA, 25 bp, mus musculus
cacaccatcgagagggtcaagctgc

SEQ ID NO: 65245 - DNA, 25 bp, mus musculus
atctccaagacagcggtcacaccat

SEQ ID NO: 65246 - DNA, 25 bp, mus musculus
tctccaagacagcggtcacaccatc

SEQ ID NO: 65247 - DNA, 25 bp, mus musculus
ctccaagacagcggtcacaccatcg

SEQ ID NO: 65248 - DNA, 25 bp, mus musculus
tccaagacagcggtcacaccatcga

SEQ ID NO: 65249 - DNA, 25 bp, mus musculus
ccaagacagcggtcacaccatcgag

SEQ ID NO: 65250 - DNA, 25 bp, mus musculus
caagacagcggtcacaccatcgaga

SEQ ID NO: 65251 - DNA, 25 bp, mus musculus
aagacagcggtcacaccatcgagag

SEQ ID NO: 65252 - DNA, 25 bp, mus musculus
agacagcggtcacaccatcgagagg

SEQ ID NO: 65253 - DNA, 25 bp, mus musculus
tttctaccacagacagggaatcttt

SEQ ID NO: 65254 - DNA, 25 bp, mus musculus
ctaccacagacagggaatcttttga

SEQ ID NO: 65255 - DNA, 25 bp, mus musculus
tctttaatgcatcggtcggaagtca

SEQ ID NO: 65256 - DNA, 25 bp, mus musculus
ttaatgcatcggtcggaagtcactt

SEQ ID NO: 65257 - DNA, 25 bp, mus musculus
tcggaagtcacttgggccagaattc

SEQ ID NO: 65258 - DNA, 25 bp, mus musculus
gtcacttgggccagaattcaagttc

SEQ ID NO: 65259 - DNA, 25 bp, mus musculus
tcatcaaccttagacctaacaaaca

SEQ ID NO: 65260 - DNA, 25 bp, mus musculus
agagaaccagaaaccctttcagcag

SEQ ID NO: 65261 - DNA, 25 bp, mus musculus
gaaccagaaaccctttcagcagctg

SEQ ID NO: 65262 - DNA, 25 bp, mus musculus
gaaaccctttcagcagctgtagtgt

SEQ ID NO: 65263 - DNA, 25 bp, mus musculus
accctttcagcagctgtagtgtacc

SEQ ID NO: 65264 - DNA, 25 bp, mus musculus
ctttcagcagctgtagtgtacccta

SEQ ID NO: 65265 - DNA, 25 bp, mus musculus
cttttgaagcgatttccagctggag

SEQ ID NO: 65266 - DNA, 25 bp, mus musculus
aagcgatttccagctggagagaaaa

SEQ ID NO: 65267 - DNA, 25 bp, mus musculus
atataccaaccgcactggtgcaaaa

SEQ ID NO: 65268 - DNA, 25 bp, mus musculus
taccaaccgcactggtgcaaaacaa

SEQ ID NO: 65269 - DNA, 25 bp, mus musculus
acaagatcgatctgctggatgattc

SEQ ID NO: 65270 - DNA, 25 bp, mus musculus
atccagaacagacacactcaagtag

SEQ ID NO: 65271 - DNA, 25 bp, mus musculus
cagaacagacacactcaagtagtaa

SEQ ID NO: 65272 - DNA, 25 bp, mus musculus
cacactcaagtagtaacaagattgg

SEQ ID NO: 65273 - DNA, 25 bp, mus musculus
ccacttagtgacagcagtgaggctc

SEQ ID NO: 65274 - DNA, 25 bp, mus musculus
cgcgagctccttcattgtcaaggag

SEQ ID NO: 65275 - DNA, 25 bp, mus musculus
tcaagtatctttgatctccaaagac

SEQ ID NO: 65276 - DNA, 25 bp, mus musculus
atctttgatctccaaagacacagag

SEQ ID NO: 65277 - DNA, 25 bp, mus musculus
tttgatctccaaagacacagagcca

SEQ ID NO: 65278 - DNA, 25 bp, mus musculus
agacacagagccaagtaggattaaa

SEQ ID NO: 65279 - DNA, 25 bp, mus musculus
gttgtaccatctgtggtcataaatt

SEQ ID NO: 65280 - DNA, 25 bp, mus musculus
gtaccatctgtggtcataaatttct

SEQ ID NO: 65281 - DNA, 25 bp, mus musculus
ttcttcgaaagagccagttactgga

SEQ ID NO: 65282 - DNA, 25 bp, mus musculus
gccagttactggaacacatgtatac

SEQ ID NO: 65283 - DNA, 25 bp, mus musculus
aacacatgtatacacacaatgggta

SEQ ID NO: 65284 - DNA, 25 bp, mus musculus
acatgtatacacacaatgggtaaat

SEQ ID NO: 65285 - DNA, 25 bp, mus musculus
tgagcagcagcagccatcacctgag

SEQ ID NO: 65286 - DNA, 25 bp, mus musculus
gcagcagcagccatcacctgagcac

SEQ ID NO: 65287 - DNA, 25 bp, mus musculus
gcagccatcacctgagcactcgagc

SEQ ID NO: 65288 - DNA, 25 bp, mus musculus
gccatcacctgagcactcgagccga

SEQ ID NO: 65289 - DNA, 25 bp, mus musculus
atcacctgagcactcgagccgaggc

SEQ ID NO: 65290 - DNA, 25 bp, mus musculus
ctcgagccgaggcacctcagagcct

SEQ ID NO: 65291 - DNA, 25 bp, mus musculus
ccgaggcacctcagagcctttgcag

SEQ ID NO: 65292 - DNA, 25 bp, mus musculus
cacctcagagcctttgcagattagt

SEQ ID NO: 65293 - DNA, 25 bp, mus musculus
gcgactacagtacgctgcttgtgtg

SEQ ID NO: 65294 - DNA, 25 bp, mus musculus
actacagtacgctgcttgtgtggcc

SEQ ID NO: 65295 - DNA, 25 bp, mus musculus
tgaccaggtgctacatcaactatta

SEQ ID NO: 65296 - DNA, 25 bp, mus musculus
acatcaactattacgacatgagacg

SEQ ID NO: 65297 - DNA, 25 bp, mus musculus
tcaactattacgacatgagacgctg

SEQ ID NO: 65298 - DNA, 25 bp, mus musculus
attacgacatgagacgctgccaatg

SEQ ID NO: 65299 - DNA, 25 bp, mus musculus
acgacatgagacgctgccaatgttg

SEQ ID NO: 65300 - DNA, 25 bp, mus musculus
acatgagacgctgccaatgttgggg

SEQ ID NO: 65301 - DNA, 25 bp, mus musculus
tgagacgctgccaatgttggggctt

SEQ ID NO: 65302 - DNA, 25 bp, mus musculus
gacgctgccaatgttggggcttgaa

SEQ ID NO: 65303 - DNA, 25 bp, mus musculus
gctgccaatgttggggcttgaacgg

SEQ ID NO: 65304 - DNA, 25 bp, mus musculus
cttgagtccttgccccattacctgc

SEQ ID NO: 65305 - DNA, 25 bp, mus musculus
acagtacgctgcttgtgtggcctgc

SEQ ID NO: 65306 - DNA, 25 bp, mus musculus
gtacgctgcttgtgtggcctgctgt

SEQ ID NO: 65307 - DNA, 25 bp, mus musculus
tgcttgtgtggcctgctgtccgatc

SEQ ID NO: 65308 - DNA, 25 bp, mus musculus
ctgcacatcagcccgtgaccaggtg

SEQ ID NO: 65309 - DNA, 25 bp, mus musculus
cacatcagcccgtgaccaggtgcta

SEQ ID NO: 65310 - DNA, 25 bp, mus musculus
atcagcccgtgaccaggtgctacat

SEQ ID NO: 65311 - DNA, 25 bp, mus musculus
agcccgtgaccaggtgctacatcaa

SEQ ID NO: 65312 - DNA, 25 bp, mus musculus
ccgtgaccaggtgctacatcaacta

SEQ ID NO: 65313 - DNA, 25 bp, mus musculus
gctacgaagccatgagcagaatcta

SEQ ID NO: 65314 - DNA, 25 bp, mus musculus
tggatgaactcttccagaaagtggc

SEQ ID NO: 65315 - DNA, 25 bp, mus musculus
acccttacttctacagctgttgtca

SEQ ID NO: 65316 - DNA, 25 bp, mus musculus
acttctacagctgttgtcatcactg

SEQ ID NO: 65317 - DNA, 25 bp, mus musculus
tctacagctgttgtcatcactgagt

SEQ ID NO: 65318 - DNA, 25 bp, mus musculus
acagctgttgtcatcactgagtcac

SEQ ID NO: 65319 - DNA, 25 bp, mus musculus
gttgtcatcactgagtcaccactca

SEQ ID NO: 65320 - DNA, 25 bp, mus musculus
gtcatcactgagtcaccactcatct

SEQ ID NO: 65321 - DNA, 25 bp, mus musculus
atcactgagtcaccactcatctggc

SEQ ID NO: 65322 - DNA, 25 bp, mus musculus
gagtcaccactcatctggcccagtg

SEQ ID NO: 65323 - DNA, 25 bp, mus musculus
tcaccactcatctggcccagtggaa

SEQ ID NO: 65324 - DNA, 25 bp, mus musculus
ccactcatctggcccagtggaatta

SEQ ID NO: 65325 - DNA, 25 bp, mus musculus
atgaactcttccagaaagtggctga

SEQ ID NO: 65326 - DNA, 25 bp, mus musculus
tcttccagaaagtggctgaggatta

SEQ ID NO: 65327 - DNA, 25 bp, mus musculus
acgtcagtgtggctgctttccaggt

SEQ ID NO: 65328 - DNA, 25 bp, mus musculus
tcagtgtggctgctttccaggtgat

SEQ ID NO: 65329 - DNA, 25 bp, mus musculus
ctgctttccaggtgatgacagagga

SEQ ID NO: 65330 - DNA, 25 bp, mus musculus
ctttccaggtgatgacagaggacaa

SEQ ID NO: 65331 - DNA, 25 bp, mus musculus
aggcaaacccttacttctacagctg

SEQ ID NO: 65332 - DNA, 25 bp, mus musculus
caaacccttacttctacagctgttg

SEQ ID NO: 65333 - DNA, 25 bp, mus musculus
ttcggatccatggatgtggtgagcc

SEQ ID NO: 65334 - DNA, 25 bp, mus musculus
gtggtgagcccatctgagttcaaga

SEQ ID NO: 65335 - DNA, 25 bp, mus musculus
gtttccttctggatggtctccacaa

SEQ ID NO: 65336 - DNA, 25 bp, mus musculus
ttctggatggtctccacaatgaggt

SEQ ID NO: 65337 - DNA, 25 bp, mus musculus
atggtctccacaatgaggtgaaccg

SEQ ID NO: 65338 - DNA, 25 bp, mus musculus
gtctccacaatgaggtgaaccgggt

SEQ ID NO: 65339 - DNA, 25 bp, mus musculus
tgaaccgggtggcagcaaggcctaa

SEQ ID NO: 65340 - DNA, 25 bp, mus musculus
ctaaggcagccctgagacccttgat

SEQ ID NO: 65341 - DNA, 25 bp, mus musculus
aggcagccctgagacccttgatcat

SEQ ID NO: 65342 - DNA, 25 bp, mus musculus
gacccttgatcatctccctgatgaa

SEQ ID NO: 65343 - DNA, 25 bp, mus musculus
tgatcatctccctgatgaagaaaag

SEQ ID NO: 65344 - DNA, 25 bp, mus musculus
tcatctccctgatgaagaaaagggg

SEQ ID NO: 65345 - DNA, 25 bp, mus musculus
agcccatctgagttcaagacccaga

SEQ ID NO: 65346 - DNA, 25 bp, mus musculus
ccatctgagttcaagacccagatcc

SEQ ID NO: 65347 - DNA, 25 bp, mus musculus
aagacccagatccagagatatgcgc

SEQ ID NO: 65348 - DNA, 25 bp, mus musculus
acccagatccagagatatgcgccac

SEQ ID NO: 65349 - DNA, 25 bp, mus musculus
atccagagatatgcgccacgcttca

SEQ ID NO: 65350 - DNA, 25 bp, mus musculus
agatatgcgccacgcttcatgggct

SEQ ID NO: 65351 - DNA, 25 bp, mus musculus
gcgccacgcttcatgggctataatc

SEQ ID NO: 65352 - DNA, 25 bp, mus musculus
ccacgcttcatgggctataatcagc

SEQ ID NO: 65353 - DNA, 25 bp, mus musculus
ccctatgtactacaggggtgcccag

SEQ ID NO: 65354 - DNA, 25 bp, mus musculus
tgcccaggctgcaatcgtggtctat

SEQ ID NO: 65355 - DNA, 25 bp, mus musculus
tgttattgccttggcagggaacaaa

SEQ ID NO: 65356 - DNA, 25 bp, mus musculus
tgccttggcagggaacaaagctgac

SEQ ID NO: 65357 - DNA, 25 bp, mus musculus
gaacaaagctgaccttgccaacaag

SEQ ID NO: 65358 - DNA, 25 bp, mus musculus
agctgaccttgccaacaagcgcatg

SEQ ID NO: 65359 - DNA, 25 bp, mus musculus
agaggctcaggcatatgcagatgac

SEQ ID NO: 65360 - DNA, 25 bp, mus musculus
ggagacttcagctaagactgctatg

SEQ ID NO: 65361 - DNA, 25 bp, mus musculus
ttcagctaagactgctatgaacgtg

SEQ ID NO: 65362 - DNA, 25 bp, mus musculus
gaatgatctcttcctggcaatagca

SEQ ID NO: 65363 - DNA, 25 bp, mus musculus
tcttcatgagcagtcccagcagaac

SEQ ID NO: 65364 - DNA, 25 bp, mus musculus
tgagcagtcccagcagaacaagagc

SEQ ID NO: 65365 - DNA, 25 bp, mus musculus
ggctgcaatcgtggtctatgatatt

SEQ ID NO: 65366 - DNA, 25 bp, mus musculus
tcaggaaacgtttgctcgggcaaag

SEQ ID NO: 65367 - DNA, 25 bp, mus musculus
aacgtttgctcgggcaaagacatgg

SEQ ID NO: 65368 - DNA, 25 bp, mus musculus
ggaactacagcggcaagccagccct

SEQ ID NO: 65369 - DNA, 25 bp, mus musculus
acagcggcaagccagccctagcatt

SEQ ID NO: 65370 - DNA, 25 bp, mus musculus
gcaagccagccctagcattgttatt

SEQ ID NO: 65371 - DNA, 25 bp, mus musculus
cagccctagcattgttattgccttg

SEQ ID NO: 65372 - DNA, 25 bp, mus musculus
tagcattgttattgccttggcaggg

SEQ ID NO: 65373 - DNA, 25 bp, mus musculus
actttggcttagccaaggcagagcg

SEQ ID NO: 65374 - DNA, 25 bp, mus musculus
ggctggactcaagccggctgccagt

SEQ ID NO: 65375 - DNA, 25 bp, mus musculus
ccttccgcaaaatagtggagaagct

SEQ ID NO: 65376 - DNA, 25 bp, mus musculus
agaagctgggccgtgagctccgcag

SEQ ID NO: 65377 - DNA, 25 bp, mus musculus
gtgagctccgcagtgtgggtgtctc

SEQ ID NO: 65378 - DNA, 25 bp, mus musculus
acccctgatccctgaagcagaaagc

SEQ ID NO: 65379 - DNA, 25 bp, mus musculus
gatccctgaagcagaaagcaagagg

SEQ ID NO: 65380 - DNA, 25 bp, mus musculus
tgagacccccatgcctgggacactc

SEQ ID NO: 65381 - DNA, 25 bp, mus musculus
actccataaagagcatttggaagga

SEQ ID NO: 65382 - DNA, 25 bp, mus musculus
attttgtacaactgtctgatgcctg

SEQ ID NO: 65383 - DNA, 25 bp, mus musculus
ttgtacaactgtctgatgcctgtgt

SEQ ID NO: 65384 - DNA, 25 bp, mus musculus
tgtctgatgcctgtgtgtcctccac

SEQ ID NO: 65385 - DNA, 25 bp, mus musculus
actcaagccggctgccagtcaagtg

SEQ ID NO: 65386 - DNA, 25 bp, mus musculus
caagccggctgccagtcaagtggac

SEQ ID NO: 65387 - DNA, 25 bp, mus musculus
ggacggcacctgaggctctcaaaaa

SEQ ID NO: 65388 - DNA, 25 bp, mus musculus
cggcacctgaggctctcaaaaacgg

SEQ ID NO: 65389 - DNA, 25 bp, mus musculus
cacctgaggctctcaaaaacgggcg

SEQ ID NO: 65390 - DNA, 25 bp, mus musculus
atggaagagccccataccccaagat

SEQ ID NO: 65391 - DNA, 25 bp, mus musculus
atggctgcccaggctctgtgcacac

SEQ ID NO: 65392 - DNA, 25 bp, mus musculus
ccctcatgggtagctgctgggaggc

SEQ ID NO: 65393 - DNA, 25 bp, mus musculus
ttttcccttgtgagtcctgcatcat

SEQ ID NO: 65394 - DNA, 25 bp, mus musculus
tcccttgtgagtcctgcatcatttg

SEQ ID NO: 65395 - DNA, 25 bp, mus musculus
tcagctctcacacagcgaggactca

SEQ ID NO: 65396 - DNA, 25 bp, mus musculus
gctctcacacagcgaggactcaaga

SEQ ID NO: 65397 - DNA, 25 bp, mus musculus
tttgacgaagctatccgagcggttc

SEQ ID NO: 65398 - DNA, 25 bp, mus musculus
gacgaagctatccgagcggttctct

SEQ ID NO: 65399 - DNA, 25 bp, mus musculus
cctgcctggaacctttgtagctttg

SEQ ID NO: 65400 - DNA, 25 bp, mus musculus
gcctggaacctttgtagctttgctc

SEQ ID NO: 65401 - DNA, 25 bp, mus musculus
tttgctcaaaaatcagcgagccttc

SEQ ID NO: 65402 - DNA, 25 bp, mus musculus
tcagcgagccttcgcatttgatgcc

SEQ ID NO: 65403 - DNA, 25 bp, mus musculus
attttgaaccaatgaaccagtcaat

SEQ ID NO: 65404 - DNA, 25 bp, mus musculus
ttgaaccaatgaaccagtcaataat

SEQ ID NO: 65405 - DNA, 25 bp, mus musculus
gtgagtcctgcatcatttgaaaatg

SEQ ID NO: 65406 - DNA, 25 bp, mus musculus
tatcctgaagtgcgacaccactgtc

SEQ ID NO: 65407 - DNA, 25 bp, mus musculus
cctgaagtgcgacaccactgtccca

SEQ ID NO: 65408 - DNA, 25 bp, mus musculus
tgtcccaatactcctatcatcctcg

SEQ ID NO: 65409 - DNA, 25 bp, mus musculus
cctatcatcctcgtggggacgaagc

SEQ ID NO: 65410 - DNA, 25 bp, mus musculus
atcatcctcgtggggacgaagcttg

SEQ ID NO: 65411 - DNA, 25 bp, mus musculus
tacctggagtgctcagctctcacac

SEQ ID NO: 65412 - DNA, 25 bp, mus musculus
tgctcagctctcacacagcgaggac

SEQ ID NO: 65413 - DNA, 25 bp, mus musculus
acgaggactgcctctactactttga

SEQ ID NO: 65414 - DNA, 25 bp, mus musculus
ttatccccctagagaacctggagag

SEQ ID NO: 65415 - DNA, 25 bp, mus musculus
acagacaccctgctacgtgttgtcc

SEQ ID NO: 65416 - DNA, 25 bp, mus musculus
gacaccctgctacgtgttgtccttt

SEQ ID NO: 65417 - DNA, 25 bp, mus musculus
gatcatgctgaacaccagcctttca

SEQ ID NO: 65418 - DNA, 25 bp, mus musculus
catgctgaacaccagcctttcaaat

SEQ ID NO: 65419 - DNA, 25 bp, mus musculus
tgctgaacaccagcctttcaaatcc

SEQ ID NO: 65420 - DNA, 25 bp, mus musculus
gctgaacaccagcctttcaaatccc

SEQ ID NO: 65421 - DNA, 25 bp, mus musculus
tgaacaccagcctttcaaatcccaa

SEQ ID NO: 65422 - DNA, 25 bp, mus musculus
acaccagcctttcaaatcccaatgt

SEQ ID NO: 65423 - DNA, 25 bp, mus musculus
cagcctttcaaatcccaatgtcagg

SEQ ID NO: 65424 - DNA, 25 bp, mus musculus
gcctttcaaatcccaatgtcagggg

SEQ ID NO: 65425 - DNA, 25 bp, mus musculus
tatccccctagagaacctggagagg

SEQ ID NO: 65426 - DNA, 25 bp, mus musculus
gtcttccagtctacagacaccctgc

SEQ ID NO: 65427 - DNA, 25 bp, mus musculus
cttccagtctacagacaccctgcta

SEQ ID NO: 65428 - DNA, 25 bp, mus musculus
ttccagtctacagacaccctgctac

SEQ ID NO: 65429 - DNA, 25 bp, mus musculus
ccagtctacagacaccctgctacgt

SEQ ID NO: 65430 - DNA, 25 bp, mus musculus
cagtctacagacaccctgctacgtg

SEQ ID NO: 65431 - DNA, 25 bp, mus musculus
gtctacagacaccctgctacgtgtt

SEQ ID NO: 65432 - DNA, 25 bp, mus musculus
tacagacaccctgctacgtgttgtc

SEQ ID NO: 65433 - DNA, 25 bp, mus musculus
gcacgtgcttcagactcatttgcga

SEQ ID NO: 65434 - DNA, 25 bp, mus musculus
gcttcagactcatttgcgagggaat

SEQ ID NO: 65435 - DNA, 25 bp, mus musculus
tcacttttccaacacatcacagcga

SEQ ID NO: 65436 - DNA, 25 bp, mus musculus
cttttccaacacatcacagcgatag

SEQ ID NO: 65437 - DNA, 25 bp, mus musculus
ttccaacacatcacagcgatagtcc

SEQ ID NO: 65438 - DNA, 25 bp, mus musculus
atcacagcgatagtccttattgcta

SEQ ID NO: 65439 - DNA, 25 bp, mus musculus
tacattatcattgctacatcagttg

SEQ ID NO: 65440 - DNA, 25 bp, mus musculus
attatcattgctacatcagttgtta

SEQ ID NO: 65441 - DNA, 25 bp, mus musculus
gctacatcagttgttacagtgttga

SEQ ID NO: 65442 - DNA, 25 bp, mus musculus
ataacatttatcattagcagttgag

SEQ ID NO: 65443 - DNA, 25 bp, mus musculus
acatttatcattagcagttgagagc

SEQ ID NO: 65444 - DNA, 25 bp, mus musculus
catctctaatcttggataatactgg

SEQ ID NO: 65445 - DNA, 25 bp, mus musculus
tcagactcatttgcgagggaatgct

SEQ ID NO: 65446 - DNA, 25 bp, mus musculus
tgctttctgtatgagagggagacgg

SEQ ID NO: 65447 - DNA, 25 bp, mus musculus
gtaggccttaccactcagacctgga

SEQ ID NO: 65448 - DNA, 25 bp, mus musculus
cttaccactcagacctggacgtata

SEQ ID NO: 65449 - DNA, 25 bp, mus musculus
actcagacctggacgtataagtgct

SEQ ID NO: 65450 - DNA, 25 bp, mus musculus
cagacctggacgtataagtgctcac

SEQ ID NO: 65451 - DNA, 25 bp, mus musculus
tataagtgctcacttttccaacaca

SEQ ID NO: 65452 - DNA, 25 bp, mus musculus
aagtgctcacttttccaacacatca

SEQ ID NO: 65453 - DNA, 25 bp, mus musculus
cggtccgatcggcgcacgtgcccaa

SEQ ID NO: 65454 - DNA, 25 bp, mus musculus
gatcggcgcacgtgcccaagagccc

SEQ ID NO: 65455 - DNA, 25 bp, mus musculus
tcctctgaggactctggaaaacagg

SEQ ID NO: 65456 - DNA, 25 bp, mus musculus
atggctgcaaacaagcccaagggtc

SEQ ID NO: 65457 - DNA, 25 bp, mus musculus
ggctgcaaacaagcccaagggtcag

SEQ ID NO: 65458 - DNA, 25 bp, mus musculus
gctgcaaacaagcccaagggtcaga

SEQ ID NO: 65459 - DNA, 25 bp, mus musculus
ctgcaaacaagcccaagggtcagaa

SEQ ID NO: 65460 - DNA, 25 bp, mus musculus
tgcaaacaagcccaagggtcagaat

SEQ ID NO: 65461 - DNA, 25 bp, mus musculus
gcaaacaagcccaagggtcagaatt

SEQ ID NO: 65462 - DNA, 25 bp, mus musculus
agttcatgtacgacgagtttgtaga

SEQ ID NO: 65463 - DNA, 25 bp, mus musculus
gttcatgtacgacgagtttgtagag

SEQ ID NO: 65464 - DNA, 25 bp, mus musculus
ttcatgtacgacgagtttgtagagg

SEQ ID NO: 65465 - DNA, 25 bp, mus musculus
cgcacgtgcccaagagcccgcgggt

SEQ ID NO: 65466 - DNA, 25 bp, mus musculus
catgtacgacgagtttgtagaggac

SEQ ID NO: 65467 - DNA, 25 bp, mus musculus
tttcttaatcctctgaggactctgg

SEQ ID NO: 65468 - DNA, 25 bp, mus musculus
ttcttaatcctctgaggactctgga

SEQ ID NO: 65469 - DNA, 25 bp, mus musculus
tcttaatcctctgaggactctggaa

SEQ ID NO: 65470 - DNA, 25 bp, mus musculus
cttaatcctctgaggactctggaaa

SEQ ID NO: 65471 - DNA, 25 bp, mus musculus
taatcctctgaggactctggaaaac

SEQ ID NO: 65472 - DNA, 25 bp, mus musculus
aatcctctgaggactctggaaaaca

SEQ ID NO: 65473 - DNA, 25 bp, mus musculus
atcctctgaggactctggaaaacag

SEQ ID NO: 65474 - DNA, 25 bp, mus musculus
ctgctggcctccaagctgggatgga

SEQ ID NO: 65475 - DNA, 25 bp, mus musculus
gcctccaagctgggatggaaattct

SEQ ID NO: 65476 - DNA, 25 bp, mus musculus
accactgagcgaccagagatgtggc

SEQ ID NO: 65477 - DNA, 25 bp, mus musculus
cactgagcgaccagagatgtggctt

SEQ ID NO: 65478 - DNA, 25 bp, mus musculus
ggctttgggacagcctgttgttcta

SEQ ID NO: 65479 - DNA, 25 bp, mus musculus
ctttgggacagcctgttgttctagc

SEQ ID NO: 65480 - DNA, 25 bp, mus musculus
tgttctagcctgttcagctctgaag

SEQ ID NO: 65481 - DNA, 25 bp, mus musculus
ctagcctgttcagctctgaagaaaa

SEQ ID NO: 65482 - DNA, 25 bp, mus musculus
agcctgttcagctctgaagaaaacg

SEQ ID NO: 65483 - DNA, 25 bp, mus musculus
cctgttcagctctgaagaaaacgta

SEQ ID NO: 65484 - DNA, 25 bp, mus musculus
aaacgtacagagacatcttgatccg

SEQ ID NO: 65485 - DNA, 25 bp, mus musculus
acagagacatcttgatccgaggagg

SEQ ID NO: 65486 - DNA, 25 bp, mus musculus
aaattctatgatgccgatgattacc

SEQ ID NO: 65487 - DNA, 25 bp, mus musculus
attctatgatgccgatgattaccac

SEQ ID NO: 65488 - DNA, 25 bp, mus musculus
gccgatgattaccactccgaggaga

SEQ ID NO: 65489 - DNA, 25 bp, mus musculus
cgatgattaccactccgaggagaat

SEQ ID NO: 65490 - DNA, 25 bp, mus musculus
atgattaccactccgaggagaatcg

SEQ ID NO: 65491 - DNA, 25 bp, mus musculus
gattaccactccgaggagaatcgga

SEQ ID NO: 65492 - DNA, 25 bp, mus musculus
gggtaccactgagcgaccagagatg

SEQ ID NO: 65493 - DNA, 25 bp, mus musculus
gtaccactgagcgaccagagatgtg

SEQ ID NO: 65494 - DNA, 25 bp, mus musculus
atctgatccaaacttgtcaactgct

SEQ ID NO: 65495 - DNA, 25 bp, mus musculus
tccaaacttgtcaactgcttcaacg

SEQ ID NO: 65496 - DNA, 25 bp, mus musculus
gagctacaccacttacaaccagacg

SEQ ID NO: 65497 - DNA, 25 bp, mus musculus
ttacaaccagacgggatacatgcct

SEQ ID NO: 65498 - DNA, 25 bp, mus musculus
gggatacatgccttcctttctcaag

SEQ ID NO: 65499 - DNA, 25 bp, mus musculus
atcagctggccagaggatccaattg

SEQ ID NO: 65500 - DNA, 25 bp, mus musculus
ccaattggcacctttaggtgcgtcg

SEQ ID NO: 65501 - DNA, 25 bp, mus musculus
ggcttcggactatacctggagcaca

SEQ ID NO: 65502 - DNA, 25 bp, mus musculus
ggactatacctggagcacaaaaact

SEQ ID NO: 65503 - DNA, 25 bp, mus musculus
cacagccaaaaatctcaatattgtg

SEQ ID NO: 65504 - DNA, 25 bp, mus musculus
actcattgctccgtagaggacgatc

SEQ ID NO: 65505 - DNA, 25 bp, mus musculus
ccttgatcccgggagccctctacag

SEQ ID NO: 65506 - DNA, 25 bp, mus musculus
aactgcttcaacggctaagcagtac

SEQ ID NO: 65507 - DNA, 25 bp, mus musculus
ttcaacggctaagcagtactatttg

SEQ ID NO: 65508 - DNA, 25 bp, mus musculus
gaaacaatcaagataccttccaggt

SEQ ID NO: 65509 - DNA, 25 bp, mus musculus
ccccaagaatgtgtctttggtagct

SEQ ID NO: 65510 - DNA, 25 bp, mus musculus
gaatgtgtctttggtagctggaggc

SEQ ID NO: 65511 - DNA, 25 bp, mus musculus
tataaattcacactcttggaataat

SEQ ID NO: 65512 - DNA, 25 bp, mus musculus
ttcacactcttggaataatcagcta

SEQ ID NO: 65513 - DNA, 25 bp, mus musculus
atttcctaagtcgctgggatccatg

SEQ ID NO: 65514 - DNA, 25 bp, mus musculus
atatcaccaatacttacttctatcc

SEQ ID NO: 65515 - DNA, 25 bp, mus musculus
tactcaaatacataccctactacat

SEQ ID NO: 65516 - DNA, 25 bp, mus musculus
ctactatttcaaccatcaacacaaa

SEQ ID NO: 65517 - DNA, 25 bp, mus musculus
tttcaaccatcaacacaaatctcac

SEQ ID NO: 65518 - DNA, 25 bp, mus musculus
caaccatcaacacaaatctcaccat

SEQ ID NO: 65519 - DNA, 25 bp, mus musculus
caaatctcaccatccaatttataca

SEQ ID NO: 65520 - DNA, 25 bp, mus musculus
atctcaccatccaatttatacatta

SEQ ID NO: 65521 - DNA, 25 bp, mus musculus
ccatccaatttatacattaatatcc

SEQ ID NO: 65522 - DNA, 25 bp, mus musculus
ctcttccatacctatccaaatttca

SEQ ID NO: 65523 - DNA, 25 bp, mus musculus
ttccatacctatccaaatttcatct

SEQ ID NO: 65524 - DNA, 25 bp, mus musculus
tatccaaatttcatctcaccatata

SEQ ID NO: 65525 - DNA, 25 bp, mus musculus
aatttcatctcaccatatacatact

SEQ ID NO: 65526 - DNA, 25 bp, mus musculus
tcaaatacataccctactacatatt

SEQ ID NO: 65527 - DNA, 25 bp, mus musculus
atctcaccatatacatacttaccaa

SEQ ID NO: 65528 - DNA, 25 bp, mus musculus
acatattttaccttcattatatcct

SEQ ID NO: 65529 - DNA, 25 bp, mus musculus
attatatccttcccaaacatctcaa

SEQ ID NO: 65530 - DNA, 25 bp, mus musculus
ttcccaaacatctcaactctactat

SEQ ID NO: 65531 - DNA, 25 bp, mus musculus
ccaaacatctcaactctactatttc

SEQ ID NO: 65532 - DNA, 25 bp, mus musculus
aacatctcaactctactatttcaac

SEQ ID NO: 65533 - DNA, 25 bp, mus musculus
tcaactctactatttcaaccatcaa

SEQ ID NO: 65534 - DNA, 25 bp, mus musculus
actctactatttcaaccatcaacac

SEQ ID NO: 65535 - DNA, 25 bp, mus musculus
cagcgccgggaccactgcttgtgcg

SEQ ID NO: 65536 - DNA, 25 bp, mus musculus
ggaccactgcttgtgcgcgcactgc

SEQ ID NO: 65537 - DNA, 25 bp, mus musculus
ctgacgggcgccaaacagaacaccg

SEQ ID NO: 65538 - DNA, 25 bp, mus musculus
acagaacaccggcgtgtggctggtc

SEQ ID NO: 65539 - DNA, 25 bp, mus musculus
agaacaccggcgtgtggctggtcaa

SEQ ID NO: 65540 - DNA, 25 bp, mus musculus
aacaccggcgtgtggctggtcaagg

SEQ ID NO: 65541 - DNA, 25 bp, mus musculus
tggctggtcaaggttcctaaatatt

SEQ ID NO: 65542 - DNA, 25 bp, mus musculus
atttgtcccagcaatgggcaaaagc

SEQ ID NO: 65543 - DNA, 25 bp, mus musculus
ttgtcccagcaatgggcaaaagcct

SEQ ID NO: 65544 - DNA, 25 bp, mus musculus
gtcccagcaatgggcaaaagcctct

SEQ ID NO: 65545 - DNA, 25 bp, mus musculus
tgggcaaaagcctctggaagaggtg

SEQ ID NO: 65546 - DNA, 25 bp, mus musculus
aaagcctctggaagaggtgaagttg

SEQ ID NO: 65547 - DNA, 25 bp, mus musculus
accactgcttgtgcgcgcactgcac

SEQ ID NO: 65548 - DNA, 25 bp, mus musculus
cactgcttgtgcgcgcactgcacgc

SEQ ID NO: 65549 - DNA, 25 bp, mus musculus
ctgcttgtgcgcgcactgcacgcct

SEQ ID NO: 65550 - DNA, 25 bp, mus musculus
tcctcacgcgacaagctcatggcgg

SEQ ID NO: 65551 - DNA, 25 bp, mus musculus
aactcgatctgacgggcgccaaaca

SEQ ID NO: 65552 - DNA, 25 bp, mus musculus
ctcgatctgacgggcgccaaacaga

SEQ ID NO: 65553 - DNA, 25 bp, mus musculus
cgatctgacgggcgccaaacagaac

SEQ ID NO: 65554 - DNA, 25 bp, mus musculus
atctgacgggcgccaaacagaacac

SEQ ID NO: 65555 - DNA, 25 bp, mus musculus
tcatcccttcagttcttgataggct

SEQ ID NO: 65556 - DNA, 25 bp, mus musculus
cttcagttcttgataggctggtagc

SEQ ID NO: 65557 - DNA, 25 bp, mus musculus
tgtgccacacctgtgcaaaggacca

SEQ ID NO: 65558 - DNA, 25 bp, mus musculus
acactgctgttctgttgggccgacc

SEQ ID NO: 65559 - DNA, 25 bp, mus musculus
catgccctgctgagtacgcttcaac

SEQ ID NO: 65560 - DNA, 25 bp, mus musculus
ctgctgagtacgcttcaacttagag

SEQ ID NO: 65561 - DNA, 25 bp, mus musculus
ttactttctagaatttgtgagccag

SEQ ID NO: 65562 - DNA, 25 bp, mus musculus
atttgtgagccagttctacagggtc

SEQ ID NO: 65563 - DNA, 25 bp, mus musculus
accccgttgtcacctgccattcatg

SEQ ID NO: 65564 - DNA, 25 bp, mus musculus
ttgtcacctgccattcatggtgatg

SEQ ID NO: 65565 - DNA, 25 bp, mus musculus
attcatggtgatgttgcaggttaac

SEQ ID NO: 65566 - DNA, 25 bp, mus musculus
ggttaaccttggcagtgtgtacatt
